United States Patent 7,341,835 (METHODS OF ANALYSIS OF ALTERNATIVE SPLICING IN MOUSE) - sequence listing, part 9

SEQ ID NO: 319214 - DNA, 25 bp, Mus musculus
ggaaacacaagagcaggcaaggccc

SEQ ID NO: 319215 - DNA, 25 bp, Mus musculus
ggaaacacaatcagatgtcgtttgg

SEQ ID NO: 319216 - DNA, 25 bp, Mus musculus
ggaaacacaatcagccgcataactc

SEQ ID NO: 319217 - DNA, 25 bp, Mus musculus
ggaaacacaatcagccgtcattcag

SEQ ID NO: 319218 - DNA, 25 bp, Mus musculus
ggaaacacaatcagtcgaagggggc

SEQ ID NO: 319219 - DNA, 25 bp, Mus musculus
ggaaacacacagcagatgcattaca

SEQ ID NO: 319220 - DNA, 25 bp, Mus musculus
ggaaacacagaaatatgccgagcgc

SEQ ID NO: 319221 - DNA, 25 bp, Mus musculus
ggaaacacagatacctctgaaatta

SEQ ID NO: 319222 - DNA, 25 bp, Mus musculus
ggaaacacagccggatgttctttgg

SEQ ID NO: 319223 - DNA, 25 bp, Mus musculus
ggaaacaccatccagcacgtgcagg

SEQ ID NO: 319224 - DNA, 25 bp, Mus musculus
ggaaacacccagagcctctcggccc

SEQ ID NO: 319225 - DNA, 25 bp, Mus musculus
ggaaacacggcatagatttcaccga

SEQ ID NO: 319226 - DNA, 25 bp, Mus musculus
ggaaacacggcataggaccactgca

SEQ ID NO: 319227 - DNA, 25 bp, Mus musculus
ggaaacacggcataggagctggtgg

SEQ ID NO: 319228 - DNA, 25 bp, Mus musculus
ggaaacagaagagtctgaggttatg

SEQ ID NO: 319229 - DNA, 25 bp, Mus musculus
ggaaacagacacaggtaccagagag

SEQ ID NO: 319230 - DNA, 25 bp, Mus musculus
ggaaacagacacaggtggggtgaac

SEQ ID NO: 319231 - DNA, 25 bp, Mus musculus
ggaaacagcagattcctcagacaaa

SEQ ID NO: 319232 - DNA, 25 bp, Mus musculus
ggaaacagcagggaaggatctgtcc

SEQ ID NO: 319233 - DNA, 25 bp, Mus musculus
ggaaacagccaaggaggcaccgaga

SEQ ID NO: 319234 - DNA, 25 bp, Mus musculus
ggaaacaggacaaaaacagtacaac

SEQ ID NO: 319235 - DNA, 25 bp, Mus musculus
ggaaacaggcggaggaaacctatga

SEQ ID NO: 319236 - DNA, 25 bp, Mus musculus
ggaaacaggcggaggctagacaaat

SEQ ID NO: 319237 - DNA, 25 bp, Mus musculus
ggaaacaggggaacacctctactgg

SEQ ID NO: 319238 - DNA, 25 bp, Mus musculus
ggaaacagttacctgcagaatgtgt

SEQ ID NO: 319239 - DNA, 25 bp, Mus musculus
ggaaacatacagtggatgaatatat

SEQ ID NO: 319240 - DNA, 25 bp, Mus musculus
ggaaacatagagaggaactacaaga

SEQ ID NO: 319241 - DNA, 25 bp, Mus musculus
ggaaacatgaagagggtaaatagct

SEQ ID NO: 319242 - DNA, 25 bp, Mus musculus
ggaaacatgaagaggtattgactga

SEQ ID NO: 319243 - DNA, 25 bp, Mus musculus
ggaaaccaaacaccagtatttctct

SEQ ID NO: 319244 - DNA, 25 bp, Mus musculus
ggaaaccaaggacacactgaagcca

SEQ ID NO: 319245 - DNA, 25 bp, Mus musculus
ggaaaccagagccatgagggatctt

SEQ ID NO: 319246 - DNA, 25 bp, Mus musculus
ggaaaccagagccatgcggtgctct

SEQ ID NO: 319247 - DNA, 25 bp, Mus musculus
ggaaaccagagccatgtggaaccag

SEQ ID NO: 319248 - DNA, 25 bp, Mus musculus
ggaaaccagccaaggactaactacg

SEQ ID NO: 319249 - DNA, 25 bp, Mus musculus
ggaaaccagtaagggcaaagatgac

SEQ ID NO: 319250 - DNA, 25 bp, Mus musculus
ggaaaccataacgtcaaactccgtg

SEQ ID NO: 319251 - DNA, 25 bp, Mus musculus
ggaaaccatggcagaacaaaaatca

SEQ ID NO: 319252 - DNA, 25 bp, Mus musculus
ggaaaccatggcagaattttctcag

SEQ ID NO: 319253 - DNA, 25 bp, Mus musculus
ggaaaccatggcaggtacagagcta

SEQ ID NO: 319254 - DNA, 25 bp, Mus musculus
ggaaacccaagcttatggcaaaccc

SEQ ID NO: 319255 - DNA, 25 bp, Mus musculus
ggaaacccagcgctaactgtccttc

SEQ ID NO: 319256 - DNA, 25 bp, Mus musculus
ggaaaccccacagccaaggcctggc

SEQ ID NO: 319257 - DNA, 25 bp, Mus musculus
ggaaaccgaggactcagagaggctg

SEQ ID NO: 319258 - DNA, 25 bp, Mus musculus
ggaaaccttggtcttgccacctcat

SEQ ID NO: 319259 - DNA, 25 bp, Mus musculus
ggaaacctttccatattgtatttta

SEQ ID NO: 319260 - DNA, 25 bp, Mus musculus
ggaaacgactacatcgaccagctga

SEQ ID NO: 319261 - DNA, 25 bp, Mus musculus
ggaaacgacttgtaccaggggctgg

SEQ ID NO: 319262 - DNA, 25 bp, Mus musculus
ggaaacgattcagaggatcgacgag

SEQ ID NO: 319263 - DNA, 25 bp, Mus musculus
ggaaacgcgaagatgtgacagcatg

SEQ ID NO: 319264 - DNA, 25 bp, Mus musculus
ggaaacggattttggcaagtcaagc

SEQ ID NO: 319265 - DNA, 25 bp, Mus musculus
ggaaactaaggcattactcatcagt

SEQ ID NO: 319266 - DNA, 25 bp, Mus musculus
ggaaactaaggctggccttgtggta

SEQ ID NO: 319267 - DNA, 25 bp, Mus musculus
ggaaactatgatctcttcactggtc

SEQ ID NO: 319268 - DNA, 25 bp, Mus musculus
ggaaactcaagatgtcggttggacc

SEQ ID NO: 319269 - DNA, 25 bp, Mus musculus
ggaaactcagactaaggctggacca

SEQ ID NO: 319270 - DNA, 25 bp, Mus musculus
ggaaactcagatgaatgaagaaagg

SEQ ID NO: 319271 - DNA, 25 bp, Mus musculus
ggaaactcatcctgactctcactca

SEQ ID NO: 319272 - DNA, 25 bp, Mus musculus
ggaaactctacaccctagaggagag

SEQ ID NO: 319273 - DNA, 25 bp, Mus musculus
ggaaactctccccccatcttcatca

SEQ ID NO: 319274 - DNA, 25 bp, Mus musculus
ggaaactctcccgccatcttcatca

SEQ ID NO: 319275 - DNA, 25 bp, Mus musculus
ggaaactgagcacattaatccagta

SEQ ID NO: 319276 - DNA, 25 bp, Mus musculus
ggaaactgagcaccaaacaacatgt

SEQ ID NO: 319277 - DNA, 25 bp, Mus musculus
ggaaactgagcaccaagcttacaat

SEQ ID NO: 319278 - DNA, 25 bp, Mus musculus
ggaaactgagcagcagaataaagat

SEQ ID NO: 319279 - DNA, 25 bp, Mus musculus
ggaaactgagcattttgctctgtaa

SEQ ID NO: 319280 - DNA, 25 bp, Mus musculus
ggaaactgccgccacagtacatgtg

SEQ ID NO: 319281 - DNA, 25 bp, Mus musculus
ggaaactggcggtgttttcagctgt

SEQ ID NO: 319282 - DNA, 25 bp, Mus musculus
ggaaactggcgttgttgacaagatt

SEQ ID NO: 319283 - DNA, 25 bp, Mus musculus
ggaaactggtacagtacaatatctc

SEQ ID NO: 319284 - DNA, 25 bp, Mus musculus
ggaaacttagggaatgacaaggtct

SEQ ID NO: 319285 - DNA, 25 bp, Mus musculus
ggaaacttagtgagtgtgtcccttc

SEQ ID NO: 319286 - DNA, 25 bp, Mus musculus
ggaaacttcaggacccctgtgcagc

SEQ ID NO: 319287 - DNA, 25 bp, Mus musculus
ggaaacttcaggagtcatggctggc

SEQ ID NO: 319288 - DNA, 25 bp, Mus musculus
ggaaacttcattgatgccaaagacc

SEQ ID NO: 319289 - DNA, 25 bp, Mus musculus
ggaaacttctacaggtttccgtgga

SEQ ID NO: 319290 - DNA, 25 bp, Mus musculus
ggaaacttggagcaggcaccgctcc

SEQ ID NO: 319291 - DNA, 25 bp, Mus musculus
ggaaactttgatctgctgttgtgtg

SEQ ID NO: 319292 - DNA, 25 bp, Mus musculus
ggaaactttgatgaaacttttttgg

SEQ ID NO: 319293 - DNA, 25 bp, Mus musculus
ggaaagaaaacagccccttcgagga

SEQ ID NO: 319294 - DNA, 25 bp, Mus musculus
ggaaagaaaacagctttgtttacta

SEQ ID NO: 319295 - DNA, 25 bp, Mus musculus
ggaaagaaaacagtgacaacataag

SEQ ID NO: 319296 - DNA, 25 bp, Mus musculus
ggaaagaaaacgagctgtttgacaa

SEQ ID NO: 319297 - DNA, 25 bp, Mus musculus
ggaaagaaaagggctgaagaagaga

SEQ ID NO: 319298 - DNA, 25 bp, Mus musculus
ggaaagaaacacgaagaaaggcttt

SEQ ID NO: 319299 - DNA, 25 bp, Mus musculus
ggaaagaaagaatggaatctataga

SEQ ID NO: 319300 - DNA, 25 bp, Mus musculus
ggaaagaaagatgcaccaacaagga

SEQ ID NO: 319301 - DNA, 25 bp, Mus musculus
ggaaagaaagccgctctgcacagct

SEQ ID NO: 319302 - DNA, 25 bp, Mus musculus
ggaaagaaagtcacagacaagttca

SEQ ID NO: 319303 - DNA, 25 bp, Mus musculus
ggaaagaaatgatggttcaacttct

SEQ ID NO: 319304 - DNA, 25 bp, Mus musculus
ggaaagaacaagagacatgtttggc

SEQ ID NO: 319305 - DNA, 25 bp, Mus musculus
ggaaagaagaaatatctgccacctc

SEQ ID NO: 319306 - DNA, 25 bp, Mus musculus
ggaaagaagaagaggcacactggag

SEQ ID NO: 319307 - DNA, 25 bp, Mus musculus
ggaaagaagaagaggtgagtaatct

SEQ ID NO: 319308 - DNA, 25 bp, Mus musculus
ggaaagaagagagagtacctcagcc

SEQ ID NO: 319309 - DNA, 25 bp, Mus musculus
ggaaagacagggggcagtgcccaaa

SEQ ID NO: 319310 - DNA, 25 bp, Mus musculus
ggaaagacagtgtttgtaagcggtg

SEQ ID NO: 319311 - DNA, 25 bp, Mus musculus
ggaaagaccagacatcatcccacac

SEQ ID NO: 319312 - DNA, 25 bp, Mus musculus
ggaaagaccaggacctcaccatccc

SEQ ID NO: 319313 - DNA, 25 bp, Mus musculus
ggaaagagaaaggtattaagtcatg

SEQ ID NO: 319314 - DNA, 25 bp, Mus musculus
ggaaagagagaaggggaacagccag

SEQ ID NO: 319315 - DNA, 25 bp, Mus musculus
ggaaagagagcaaacctgtcattct

SEQ ID NO: 319316 - DNA, 25 bp, Mus musculus
ggaaagagagcaaagctgtcattct

SEQ ID NO: 319317 - DNA, 25 bp, Mus musculus
ggaaagagataacagcagacaggaa

SEQ ID NO: 319318 - DNA, 25 bp, Mus musculus
ggaaagagccaaacgagccacaatc

SEQ ID NO: 319319 - DNA, 25 bp, Mus musculus
ggaaagagcggaggccaacaccctg

SEQ ID NO: 319320 - DNA, 25 bp, Mus musculus
ggaaagaggaagaagtcgtcacatt

SEQ ID NO: 319321 - DNA, 25 bp, Mus musculus
ggaaagaggagaaagggaagaaggc

SEQ ID NO: 319322 - DNA, 25 bp, Mus musculus
ggaaagaggtcttggtccacagatg

SEQ ID NO: 319323 - DNA, 25 bp, Mus musculus
ggaaagatgagatcctgggcaactt

SEQ ID NO: 319324 - DNA, 25 bp, Mus musculus
ggaaagatgtcctcggtgactcaga

SEQ ID NO: 319325 - DNA, 25 bp, Mus musculus
ggaaagattgagttcaggagggggc

SEQ ID NO: 319326 - DNA, 25 bp, Mus musculus
ggaaagatttctgaaaattaatgag

SEQ ID NO: 319327 - DNA, 25 bp, Mus musculus
ggaaagatttctggggtgatgacta

SEQ ID NO: 319328 - DNA, 25 bp, Mus musculus
ggaaagcaacgaaagatgtgataca

SEQ ID NO: 319329 - DNA, 25 bp, Mus musculus
ggaaagcaacgaaagctcctgcaaa

SEQ ID NO: 319330 - DNA, 25 bp, Mus musculus
ggaaagcaactttttctgctaatgc

SEQ ID NO: 319331 - DNA, 25 bp, Mus musculus
ggaaagcaagatatattttgcacag

SEQ ID NO: 319332 - DNA, 25 bp, Mus musculus
ggaaagcaaggaatcttcaaagtcc

SEQ ID NO: 319333 - DNA, 25 bp, Mus musculus
ggaaagcaaggcatgccgcttttcc

SEQ ID NO: 319334 - DNA, 25 bp, Mus musculus
ggaaagcaagggaacctagtaacaa

SEQ ID NO: 319335 - DNA, 25 bp, Mus musculus
ggaaagcaatcactctgtggagggg

SEQ ID NO: 319336 - DNA, 25 bp, Mus musculus
ggaaagcacagaactctttgttgct

SEQ ID NO: 319337 - DNA, 25 bp, Mus musculus
ggaaagcacagagaccagctatgga

SEQ ID NO: 319338 - DNA, 25 bp, Mus musculus
ggaaagcacagggaagctgggaaaa

SEQ ID NO: 319339 - DNA, 25 bp, Mus musculus
ggaaagcaccaaagcttcgcataag

SEQ ID NO: 319340 - DNA, 25 bp, Mus musculus
ggaaagcaccaaagtaccatttagg

SEQ ID NO: 319341 - DNA, 25 bp, Mus musculus
ggaaagcaccagcccacctaaacca

SEQ ID NO: 319342 - DNA, 25 bp, Mus musculus
ggaaagcaccgcaggtatcagccta

SEQ ID NO: 319343 - DNA, 25 bp, Mus musculus
ggaaagcagctgcagaggcattgca

SEQ ID NO: 319344 - DNA, 25 bp, Mus musculus
ggaaagcagctggtcaaccctccct

SEQ ID NO: 319345 - DNA, 25 bp, Mus musculus
ggaaagcaggggagaagtcaataaa

SEQ ID NO: 319346 - DNA, 25 bp, Mus musculus
ggaaagcatgaagacgtggccattc

SEQ ID NO: 319347 - DNA, 25 bp, Mus musculus
ggaaagccaagatgccagaccagtt

SEQ ID NO: 319348 - DNA, 25 bp, Mus musculus
ggaaagccagcggaaatggtccttc

SEQ ID NO: 319349 - DNA, 25 bp, Mus musculus
ggaaagccaggaataagatgtcaca

SEQ ID NO: 319350 - DNA, 25 bp, Mus musculus
ggaaagccaggacgttaaaggatca

SEQ ID NO: 319351 - DNA, 25 bp, Mus musculus
ggaaagccagtaatggtcagcaaga

SEQ ID NO: 319352 - DNA, 25 bp, Mus musculus
ggaaagccgaaggtcctggttatgg

SEQ ID NO: 319353 - DNA, 25 bp, Mus musculus
ggaaagcctcagaaaccttgatttc

SEQ ID NO: 319354 - DNA, 25 bp, Mus musculus
ggaaagcctcagagccttttcagct

SEQ ID NO: 319355 - DNA, 25 bp, Mus musculus
ggaaagcctgccaagttctggaaat

SEQ ID NO: 319356 - DNA, 25 bp, Mus musculus
ggaaagcgaactgacaagttggatg

SEQ ID NO: 319357 - DNA, 25 bp, Mus musculus
ggaaagcgaactgggttacattccg

SEQ ID NO: 319358 - DNA, 25 bp, Mus musculus
ggaaagcgaggatgagaagcagctc

SEQ ID NO: 319359 - DNA, 25 bp, Mus musculus
ggaaagcgcggatgacaacctcaag

SEQ ID NO: 319360 - DNA, 25 bp, Mus musculus
ggaaagcgcggatgggtaactcgtc

SEQ ID NO: 319361 - DNA, 25 bp, Mus musculus
ggaaagcgtcaaaccggtgcccaaa

SEQ ID NO: 319362 - DNA, 25 bp, Mus musculus
ggaaagcgtcaaactccctgaattc

SEQ ID NO: 319363 - DNA, 25 bp, Mus musculus
ggaaagctgacggacgaatgctaca

SEQ ID NO: 319364 - DNA, 25 bp, Mus musculus
ggaaagctgactcaggaatttgaag

SEQ ID NO: 319365 - DNA, 25 bp, Mus musculus
ggaaagctgatgaatgcacccttgt

SEQ ID NO: 319366 - DNA, 25 bp, Mus musculus
ggaaagctgccttcaccttccactc

SEQ ID NO: 319367 - DNA, 25 bp, Mus musculus
ggaaagctgcggcctcagcctggga

SEQ ID NO: 319368 - DNA, 25 bp, Mus musculus
ggaaagctgcgtctcgcggcaggtg

SEQ ID NO: 319369 - DNA, 25 bp, Mus musculus
ggaaagctggagaagaatatggaga

SEQ ID NO: 319370 - DNA, 25 bp, Mus musculus
ggaaagctggagaaggcattcgggg

SEQ ID NO: 319371 - DNA, 25 bp, Mus musculus
ggaaagctggccgaggagttgtctt

SEQ ID NO: 319372 - DNA, 25 bp, Mus musculus
ggaaagctttcatagtgcctgcagt

SEQ ID NO: 319373 - DNA, 25 bp, Mus musculus
ggaaaggaaaaaagcacctgacgtt

SEQ ID NO: 319374 - DNA, 25 bp, Mus musculus
ggaaaggaaaaaagtctgatgccaa

SEQ ID NO: 319375 - DNA, 25 bp, Mus musculus
ggaaaggaacaggtatgtcactggc

SEQ ID NO: 319376 - DNA, 25 bp, Mus musculus
ggaaaggaagaggagccgctgctgc

SEQ ID NO: 319377 - DNA, 25 bp, Mus musculus
ggaaaggaagcaagatttcctttcc

SEQ ID NO: 319378 - DNA, 25 bp, Mus musculus
ggaaaggaagtcggtgtgttatctc

SEQ ID NO: 319379 - DNA, 25 bp, Mus musculus
ggaaaggacacgagttgcctagcag

SEQ ID NO: 319380 - DNA, 25 bp, Mus musculus
ggaaaggagcttagtgctttgggct

SEQ ID NO: 319381 - DNA, 25 bp, Mus musculus
ggaaaggagtatgtttgtcctgggt

SEQ ID NO: 319382 - DNA, 25 bp, Mus musculus
ggaaaggagtattgcaagaagaaca

SEQ ID NO: 319383 - DNA, 25 bp, Mus musculus
ggaaaggcaggtgtccacagccatg

SEQ ID NO: 319384 - DNA, 25 bp, Mus musculus
ggaaaggcatgtataatgcctgcgt

SEQ ID NO: 319385 - DNA, 25 bp, Mus musculus
ggaaaggccataaggagctggtggg

SEQ ID NO: 319386 - DNA, 25 bp, Mus musculus
ggaaaggccggatggaccaagagtt

SEQ ID NO: 319387 - DNA, 25 bp, Mus musculus
ggaaaggccgttttggactacatct

SEQ ID NO: 319388 - DNA, 25 bp, Mus musculus
ggaaaggcgagaagatccttatcct

SEQ ID NO: 319389 - DNA, 25 bp, Mus musculus
ggaaaggcgagaagatgggctgcat

SEQ ID NO: 319390 - DNA, 25 bp, Mus musculus
ggaaagggggcctggtccatcccgt

SEQ ID NO: 319391 - DNA, 25 bp, Mus musculus
ggaaaggggtcaaaattgacaagac

SEQ ID NO: 319392 - DNA, 25 bp, Mus musculus
ggaaaggtcgaggaccaaactctta

SEQ ID NO: 319393 - DNA, 25 bp, Mus musculus
ggaaaggtgaacgctgctggttgtc

SEQ ID NO: 319394 - DNA, 25 bp, Mus musculus
ggaaagtcacagctttctcagggcc

SEQ ID NO: 319395 - DNA, 25 bp, Mus musculus
ggaaagtcttacagcctttgtttct

SEQ ID NO: 319396 - DNA, 25 bp, Mus musculus
ggaaagtcttacaggagttaggatc

SEQ ID NO: 319397 - DNA, 25 bp, Mus musculus
ggaaagtcttacagtattaccagga

SEQ ID NO: 319398 - DNA, 25 bp, Mus musculus
ggaaagtcttagcacctccgcacct

SEQ ID NO: 319399 - DNA, 25 bp, Mus musculus
ggaaagtcttagtgtcgagcacagc

SEQ ID NO: 319400 - DNA, 25 bp, Mus musculus
ggaaagtgaccagccgagaacgagg

SEQ ID NO: 319401 - DNA, 25 bp, Mus musculus
ggaaagtgaccagcgtgtccaccct

SEQ ID NO: 319402 - DNA, 25 bp, Mus musculus
ggaaagtgagcaagcaggaggaggc

SEQ ID NO: 319403 - DNA, 25 bp, Mus musculus
ggaaagtgagttacatgaacatgca

SEQ ID NO: 319404 - DNA, 25 bp, Mus musculus
ggaaagtgcgagacggtcgcagagg

SEQ ID NO: 319405 - DNA, 25 bp, Mus musculus
ggaaagtgcgaggagatgctcacgt

SEQ ID NO: 319406 - DNA, 25 bp, Mus musculus
ggaaagtggcctcagataatgattt

SEQ ID NO: 319407 - DNA, 25 bp, Mus musculus
ggaaagtggcctcaggtgcgttcat

SEQ ID NO: 319408 - DNA, 25 bp, Mus musculus
ggaaagtgggacaagatgcagcacc

SEQ ID NO: 319409 - DNA, 25 bp, Mus musculus
ggaaagtgtggagagcctcaagtca

SEQ ID NO: 319410 - DNA, 25 bp, Mus musculus
ggaaagttaggaagaagagctggag

SEQ ID NO: 319411 - DNA, 25 bp, Mus musculus
ggaaagttggggccctggagtccaa

SEQ ID NO: 319412 - DNA, 25 bp, Mus musculus
ggaaagttggggttcacggctggtg

SEQ ID NO: 319413 - DNA, 25 bp, Mus musculus
ggaaataacaaagatgctactacac

SEQ ID NO: 319414 - DNA, 25 bp, Mus musculus
ggaaataacaaaggctcaccatcat

SEQ ID NO: 319415 - DNA, 25 bp, Mus musculus
ggaaataagagatccagcccactca

SEQ ID NO: 319416 - DNA, 25 bp, Mus musculus
ggaaataatgctcttcatcttgcgg

SEQ ID NO: 319417 - DNA, 25 bp, Mus musculus
ggaaatacagatgctggcccgtgat

SEQ ID NO: 319418 - DNA, 25 bp, Mus musculus
ggaaatacagttattcatggtggac

SEQ ID NO: 319419 - DNA, 25 bp, Mus musculus
ggaaataccatgatttctaggcaag

SEQ ID NO: 319420 - DNA, 25 bp, Mus musculus
ggaaatacccaagtaccagcaagtc

SEQ ID NO: 319421 - DNA, 25 bp, Mus musculus
ggaaatacccggccccagcctgcag

SEQ ID NO: 319422 - DNA, 25 bp, Mus musculus
ggaaatatcagttactactcaacta

SEQ ID NO: 319423 - DNA, 25 bp, Mus musculus
ggaaatatccagagcgacgagattt

SEQ ID NO: 319424 - DNA, 25 bp, Mus musculus
ggaaatatccagatttagagcgacg

SEQ ID NO: 319425 - DNA, 25 bp, Mus musculus
ggaaatattgatgctgctgtccggc

SEQ ID NO: 319426 - DNA, 25 bp, Mus musculus
ggaaatcaaggaacttaatgagtta

SEQ ID NO: 319427 - DNA, 25 bp, Mus musculus
ggaaatcaaggactcgctggccgaa

SEQ ID NO: 319428 - DNA, 25 bp, Mus musculus
ggaaatcaaggattcttaatcactc

SEQ ID NO: 319429 - DNA, 25 bp, Mus musculus
ggaaatcagcatcagattccaaatc

SEQ ID NO: 319430 - DNA, 25 bp, Mus musculus
ggaaatcagcatcagtctggagcaa

SEQ ID NO: 319431 - DNA, 25 bp, Mus musculus
ggaaatcatcgaagtctttgtccag

SEQ ID NO: 319432 - DNA, 25 bp, Mus musculus
ggaaatccagacacgcagttacaga

SEQ ID NO: 319433 - DNA, 25 bp, Mus musculus
ggaaatccagacacgcattcctggg

SEQ ID NO: 319434 - DNA, 25 bp, Mus musculus
ggaaatccaggctgttcatcagcag

SEQ ID NO: 319435 - DNA, 25 bp, Mus musculus
ggaaatccagggcagagatgacctc

SEQ ID NO: 319436 - DNA, 25 bp, Mus musculus
ggaaatcctgtggtgggagcatgcc

SEQ ID NO: 319437 - DNA, 25 bp, Mus musculus
ggaaatccttacgatgctgatgaca

SEQ ID NO: 319438 - DNA, 25 bp, Mus musculus
ggaaatccttacggcatttttctgt

SEQ ID NO: 319439 - DNA, 25 bp, Mus musculus
ggaaatctaagataccaagtggtag

SEQ ID NO: 319440 - DNA, 25 bp, Mus musculus
ggaaatctagtgttctccagtttta

SEQ ID NO: 319441 - DNA, 25 bp, Mus musculus
ggaaatctatgatgattcttttatt

SEQ ID NO: 319442 - DNA, 25 bp, Mus musculus
ggaaatctgataactgatttgaata

SEQ ID NO: 319443 - DNA, 25 bp, Mus musculus
ggaaatctgataagtcctttgcaaa

SEQ ID NO: 319444 - DNA, 25 bp, Mus musculus
ggaaatctgggtcttcggatcagtg

SEQ ID NO: 319445 - DNA, 25 bp, Mus musculus
ggaaatctggtaaagacgagatgct

SEQ ID NO: 319446 - DNA, 25 bp, Mus musculus
ggaaatctgtcagggccagagaaca

SEQ ID NO: 319447 - DNA, 25 bp, Mus musculus
ggaaatctgtcagggggagatgact

SEQ ID NO: 319448 - DNA, 25 bp, Mus musculus
ggaaatcttgcatctgaaagctggg

SEQ ID NO: 319449 - DNA, 25 bp, Mus musculus
ggaaatcttgcatgacaacctggac

SEQ ID NO: 319450 - DNA, 25 bp, Mus musculus
ggaaatgaccgaggtgaaggcagct

SEQ ID NO: 319451 - DNA, 25 bp, Mus musculus
ggaaatgagacgagaatgatgtcac

SEQ ID NO: 319452 - DNA, 25 bp, Mus musculus
ggaaatgagacggaagctgccactt

SEQ ID NO: 319453 - DNA, 25 bp, Mus musculus
ggaaatgagacgtgctggagatcaa

SEQ ID NO: 319454 - DNA, 25 bp, Mus musculus
ggaaatgagcaaagccaaacaccat

SEQ ID NO: 319455 - DNA, 25 bp, Mus musculus
ggaaatgaggaggctgctcagtggg

SEQ ID NO: 319456 - DNA, 25 bp, Mus musculus
ggaaatgatcagcctcagtccgata

SEQ ID NO: 319457 - DNA, 25 bp, Mus musculus
ggaaatgatgagaatggcttggtag

SEQ ID NO: 319458 - DNA, 25 bp, Mus musculus
ggaaatgatgtggttgagaaatacg

SEQ ID NO: 319459 - DNA, 25 bp, Mus musculus
ggaaatgcagaccagcagaacttca

SEQ ID NO: 319460 - DNA, 25 bp, Mus musculus
ggaaatgcaggttttccttactgct

SEQ ID NO: 319461 - DNA, 25 bp, Mus musculus
ggaaatgcagtccctgcagatagct

SEQ ID NO: 319462 - DNA, 25 bp, Mus musculus
ggaaatgcctcagcccagcgtaagc

SEQ ID NO: 319463 - DNA, 25 bp, Mus musculus
ggaaatgcgccagttgatgaaggtt

SEQ ID NO: 319464 - DNA, 25 bp, Mus musculus
ggaaatggaaacacttgcagaagca

SEQ ID NO: 319465 - DNA, 25 bp, Mus musculus
ggaaatggaaagtccctgacaggct

SEQ ID NO: 319466 - DNA, 25 bp, Mus musculus
ggaaatggagcaggagccctgccta

SEQ ID NO: 319467 - DNA, 25 bp, Mus musculus
ggaaatggaggcaagaagacagcaa

SEQ ID NO: 319468 - DNA, 25 bp, Mus musculus
ggaaatggatctgctgcgaaagcca

SEQ ID NO: 319469 - DNA, 25 bp, Mus musculus
ggaaatggggaacttctgtggcctg

SEQ ID NO: 319470 - DNA, 25 bp, Mus musculus
ggaaatggggcactttctgcatctt

SEQ ID NO: 319471 - DNA, 25 bp, Mus musculus
ggaaatggggggtcttcttgtgttt

SEQ ID NO: 319472 - DNA, 25 bp, Mus musculus
ggaaatgtactcaattagcatgaca

SEQ ID NO: 319473 - DNA, 25 bp, Mus musculus
ggaaatgtagggtaagggtcgtcag

SEQ ID NO: 319474 - DNA, 25 bp, Mus musculus
ggaaatgtaggtggttgtgagccag

SEQ ID NO: 319475 - DNA, 25 bp, Mus musculus
ggaaatgtcctgcagggtttcaaag

SEQ ID NO: 319476 - DNA, 25 bp, Mus musculus
ggaaatgtggggctggcatggaaaa

SEQ ID NO: 319477 - DNA, 25 bp, Mus musculus
ggaaatgtggggctggtgtcaggca

SEQ ID NO: 319478 - DNA, 25 bp, Mus musculus
ggaaatgtttattggaaaaggaaga

SEQ ID NO: 319479 - DNA, 25 bp, Mus musculus
ggaaatgtttgcatctggccatccg

SEQ ID NO: 319480 - DNA, 25 bp, Mus musculus
ggaaatgtttgtgacccccctccag

SEQ ID NO: 319481 - DNA, 25 bp, Mus musculus
ggaaattacacctgctcctgaggtt

SEQ ID NO: 319482 - DNA, 25 bp, Mus musculus
ggaaattagggcaagagccagaggg

SEQ ID NO: 319483 - DNA, 25 bp, Mus musculus
ggaaattattagggatgccagtaaa

SEQ ID NO: 319484 - DNA, 25 bp, Mus musculus
ggaaattcagcctcaagtacctggc

SEQ ID NO: 319485 - DNA, 25 bp, Mus musculus
ggaaattcaggcgatgctgggcctc

SEQ ID NO: 319486 - DNA, 25 bp, Mus musculus
ggaaattcatagtgaccatctttcc

SEQ ID NO: 319487 - DNA, 25 bp, Mus musculus
ggaaattccaaggaacctggtggcc

SEQ ID NO: 319488 - DNA, 25 bp, Mus musculus
ggaaattcgcagggctatgtgctca

SEQ ID NO: 319489 - DNA, 25 bp, Mus musculus
ggaaattgtgaaggccctgtctcaa

SEQ ID NO: 319490 - DNA, 25 bp, Mus musculus
ggaaattgtgaaggtttgtctgggc

SEQ ID NO: 319491 - DNA, 25 bp, Mus musculus
ggaaatttcctaaaggagatataat

SEQ ID NO: 319492 - DNA, 25 bp, Mus musculus
ggaaatttgttagaaagcctgcaag

SEQ ID NO: 319493 - DNA, 25 bp, Mus musculus
ggaacaaaacagattaatagagaca

SEQ ID NO: 319494 - DNA, 25 bp, Mus musculus
ggaacaaaacaggcattggcagaga

SEQ ID NO: 319495 - DNA, 25 bp, Mus musculus
ggaacaaactcaagatgggaagtca

SEQ ID NO: 319496 - DNA, 25 bp, Mus musculus
ggaacaaactcaaggccctcatcaa

SEQ ID NO: 319497 - DNA, 25 bp, Mus musculus
ggaacaaactgaaggctcgatgaga

SEQ ID NO: 319498 - DNA, 25 bp, Mus musculus
ggaacaaactggttattaaatagat

SEQ ID NO: 319499 - DNA, 25 bp, Mus musculus
ggaacaaagagaagtgcagccccct

SEQ ID NO: 319500 - DNA, 25 bp, Mus musculus
ggaacaaagtaagaagctgtcttcc

SEQ ID NO: 319501 - DNA, 25 bp, Mus musculus
ggaacaaataagacggttagcacat

SEQ ID NO: 319502 - DNA, 25 bp, Mus musculus
ggaacaaataagcctggggaactca

SEQ ID NO: 319503 - DNA, 25 bp, Mus musculus
ggaacaaatggggagaaactccttt

SEQ ID NO: 319504 - DNA, 25 bp, Mus musculus
ggaacaacaataggtgtttcaccaa

SEQ ID NO: 319505 - DNA, 25 bp, Mus musculus
ggaacaacagaaaaggcagccggag

SEQ ID NO: 319506 - DNA, 25 bp, Mus musculus
ggaacaacagaaaatcaatctttcc

SEQ ID NO: 319507 - DNA, 25 bp, Mus musculus
ggaacaacaggtcctcagaatggtt

SEQ ID NO: 319508 - DNA, 25 bp, Mus musculus
ggaacaacccgcaatactggagtaa

SEQ ID NO: 319509 - DNA, 25 bp, Mus musculus
ggaacaacgcgggggaccttatgga

SEQ ID NO: 319510 - DNA, 25 bp, Mus musculus
ggaacaagagaataaaggccgcgct

SEQ ID NO: 319511 - DNA, 25 bp, Mus musculus
ggaacaagagaggcaatgggtgaca

SEQ ID NO: 319512 - DNA, 25 bp, Mus musculus
ggaacaagagataaaactattaaat

SEQ ID NO: 319513 - DNA, 25 bp, Mus musculus
ggaacaagctgaagagcatggagaa

SEQ ID NO: 319514 - DNA, 25 bp, Mus musculus
ggaacaaggccaggactgtggcggc

SEQ ID NO: 319515 - DNA, 25 bp, Mus musculus
ggaacaagtcaggctccaaaaacag

SEQ ID NO: 319516 - DNA, 25 bp, Mus musculus
ggaacaagtgcgcatctgtagccat

SEQ ID NO: 319517 - DNA, 25 bp, Mus musculus
ggaacaagtttcttagacctctcac

SEQ ID NO: 319518 - DNA, 25 bp, Mus musculus
ggaacaatagcacaggaatgattgg

SEQ ID NO: 319519 - DNA, 25 bp, Mus musculus
ggaacaatcacagacagcttacctc

SEQ ID NO: 319520 - DNA, 25 bp, Mus musculus
ggaacaatcacagaggccagaagag

SEQ ID NO: 319521 - DNA, 25 bp, Mus musculus
ggaacaatcacaggtgtagatgtca

SEQ ID NO: 319522 - DNA, 25 bp, Mus musculus
ggaacaatttcatacatgctatgct

SEQ ID NO: 319523 - DNA, 25 bp, Mus musculus
ggaacaatttcatagatgctatgct

SEQ ID NO: 319524 - DNA, 25 bp, Mus musculus
ggaacacaaaacgaaacctcgtgtt

SEQ ID NO: 319525 - DNA, 25 bp, Mus musculus
ggaacacaaaggtaagaaagcacgc

SEQ ID NO: 319526 - DNA, 25 bp, Mus musculus
ggaacacacaaagattcagagctgg

SEQ ID NO: 319527 - DNA, 25 bp, Mus musculus
ggaacacacaaaggttggttcctgt

SEQ ID NO: 319528 - DNA, 25 bp, Mus musculus
ggaacacagagcagctgcaggaaaa

SEQ ID NO: 319529 - DNA, 25 bp, Mus musculus
ggaacacagagttcttcttgctttg

SEQ ID NO: 319530 - DNA, 25 bp, Mus musculus
ggaacacatagcagataaacttctg

SEQ ID NO: 319531 - DNA, 25 bp, Mus musculus
ggaacacatgaacaggagtccttgc

SEQ ID NO: 319532 - DNA, 25 bp, Mus musculus
ggaacaccacaagagcatcgcaaca

SEQ ID NO: 319533 - DNA, 25 bp, Mus musculus
ggaacaccctagatgtgctcctgga

SEQ ID NO: 319534 - DNA, 25 bp, Mus musculus
ggaacaccggcaagatagttgaagt

SEQ ID NO: 319535 - DNA, 25 bp, Mus musculus
ggaacacctcaaaggccacgagacc

SEQ ID NO: 319536 - DNA, 25 bp, Mus musculus
ggaacacgaggttccgagtccgagg

SEQ ID NO: 319537 - DNA, 25 bp, Mus musculus
ggaacactactgaccacgatgatgc

SEQ ID NO: 319538 - DNA, 25 bp, Mus musculus
ggaacactatccaggtcaggctgct

SEQ ID NO: 319539 - DNA, 25 bp, Mus musculus
ggaacactatccagtgggatctgcc

SEQ ID NO: 319540 - DNA, 25 bp, Mus musculus
ggaacactgccccaggaaagggtca

SEQ ID NO: 319541 - DNA, 25 bp, Mus musculus
ggaacactgcttgggaaatcctcaa

SEQ ID NO: 319542 - DNA, 25 bp, Mus musculus
ggaacactgcttggttcgttccacc

SEQ ID NO: 319543 - DNA, 25 bp, Mus musculus
ggaacactgcttggttggtgttaag

SEQ ID NO: 319544 - DNA, 25 bp, Mus musculus
ggaacactggccggagaagctggag

SEQ ID NO: 319545 - DNA, 25 bp, Mus musculus
ggaacactggccggcacaatatgac

SEQ ID NO: 319546 - DNA, 25 bp, Mus musculus
ggaacacttatccaggctgaataaa

SEQ ID NO: 319547 - DNA, 25 bp, Mus musculus
ggaacacttatccagggtgtattga

SEQ ID NO: 319548 - DNA, 25 bp, Mus musculus
ggaacacttgggggagaagcgagct

SEQ ID NO: 319549 - DNA, 25 bp, Mus musculus
ggaacagaaacaggtgattttttca

SEQ ID NO: 319550 - DNA, 25 bp, Mus musculus
ggaacagaacggagtgcaagatccc

SEQ ID NO: 319551 - DNA, 25 bp, Mus musculus
ggaacagaacgggaggaactatacc

SEQ ID NO: 319552 - DNA, 25 bp, Mus musculus
ggaacagaatcgaggtacaaccagc

SEQ ID NO: 319553 - DNA, 25 bp, Mus musculus
ggaacagacacagctcacagacttc

SEQ ID NO: 319554 - DNA, 25 bp, Mus musculus
ggaacagacactctccccgaccatc

SEQ ID NO: 319555 - DNA, 25 bp, Mus musculus
ggaacagagtaccactcattcggcg

SEQ ID NO: 319556 - DNA, 25 bp, Mus musculus
ggaacagatcacaagggttctcttg

SEQ ID NO: 319557 - DNA, 25 bp, Mus musculus
ggaacagatccagcaattcttggcc

SEQ ID NO: 319558 - DNA, 25 bp, Mus musculus
ggaacagcaggcagttcctggcagc

SEQ ID NO: 319559 - DNA, 25 bp, Mus musculus
ggaacagccaggaggatgttggatg

SEQ ID NO: 319560 - DNA, 25 bp, Mus musculus
ggaacagccgtgaagcacctaaagt

SEQ ID NO: 319561 - DNA, 25 bp, Mus musculus
ggaacagccttagctacatcaaaat

SEQ ID NO: 319562 - DNA, 25 bp, Mus musculus
ggaacagcgcaggacccagaagctg

SEQ ID NO: 319563 - DNA, 25 bp, Mus musculus
ggaacagctggacatgcgccgggat

SEQ ID NO: 319564 - DNA, 25 bp, Mus musculus
ggaacagctgggccctgtctcaagc

SEQ ID NO: 319565 - DNA, 25 bp, Mus musculus
ggaacagctgggctccctttcctga

SEQ ID NO: 319566 - DNA, 25 bp, Mus musculus
ggaacagctgtgtcactacttcgat

SEQ ID NO: 319567 - DNA, 25 bp, Mus musculus
ggaacaggaactggtggattgtctg

SEQ ID NO: 319568 - DNA, 25 bp, Mus musculus
ggaacaggaatatgtggcatcagct

SEQ ID NO: 319569 - DNA, 25 bp, Mus musculus
ggaacaggagctcctcttgcggctg

SEQ ID NO: 319570 - DNA, 25 bp, Mus musculus
ggaacaggaggagctgatccgagca

SEQ ID NO: 319571 - DNA, 25 bp, Mus musculus
ggaacaggcaggatgagatagagca

SEQ ID NO: 319572 - DNA, 25 bp, Mus musculus
ggaacaggcaggtcacgaaagaagg

SEQ ID NO: 319573 - DNA, 25 bp, Mus musculus
ggaacagtcctgactatgccacctg

SEQ ID NO: 319574 - DNA, 25 bp, Mus musculus
ggaacagttcatgaaatcttttgag

SEQ ID NO: 319575 - DNA, 25 bp, Mus musculus
ggaacagttcatgaggttacgtccc

SEQ ID NO: 319576 - DNA, 25 bp, Mus musculus
ggaacataaacaaggcataatcaac

SEQ ID NO: 319577 - DNA, 25 bp, Mus musculus
ggaacataaacagtctgatgaaagt

SEQ ID NO: 319578 - DNA, 25 bp, Mus musculus
ggaacataacctggagacagcctgt

SEQ ID NO: 319579 - DNA, 25 bp, Mus musculus
ggaacatagccagatgaggaagctg

SEQ ID NO: 319580 - DNA, 25 bp, Mus musculus
ggaacatattggctccctgaccctg

SEQ ID NO: 319581 - DNA, 25 bp, Mus musculus
ggaacatcaccttggatggcaaggt

SEQ ID NO: 319582 - DNA, 25 bp, Mus musculus
ggaacatcagaggatctgagaaatg

SEQ ID NO: 319583 - DNA, 25 bp, Mus musculus
ggaacatcattgcatatgatcactc

SEQ ID NO: 319584 - DNA, 25 bp, Mus musculus
ggaacatcattgcatccatgccgag

SEQ ID NO: 319585 - DNA, 25 bp, Mus musculus
ggaacatctactttgactgcagcag

SEQ ID NO: 319586 - DNA, 25 bp, Mus musculus
ggaacatctactttgctcagcagat

SEQ ID NO: 319587 - DNA, 25 bp, Mus musculus
ggaacatcttggaacctaggtcctg

SEQ ID NO: 319588 - DNA, 25 bp, Mus musculus
ggaacatgaagttggtgagcccgag

SEQ ID NO: 319589 - DNA, 25 bp, Mus musculus
ggaacatgccggagttctctggggt

SEQ ID NO: 319590 - DNA, 25 bp, Mus musculus
ggaacatggaggaggattgtccgga

SEQ ID NO: 319591 - DNA, 25 bp, Mus musculus
ggaacatggagggccctgctcagtc

SEQ ID NO: 319592 - DNA, 25 bp, Mus musculus
ggaacatggagggttcactgtggga

SEQ ID NO: 319593 - DNA, 25 bp, Mus musculus
ggaacatggggcagcaggagcaatt

SEQ ID NO: 319594 - DNA, 25 bp, Mus musculus
ggaacatgggtgtagtgattttgac

SEQ ID NO: 319595 - DNA, 25 bp, Mus musculus
ggaacatgtaacaggtccactgcca

SEQ ID NO: 319596 - DNA, 25 bp, Mus musculus
ggaacattattgcttcacctctgct

SEQ ID NO: 319597 - DNA, 25 bp, Mus musculus
ggaacattcttctgccttggctgtc

SEQ ID NO: 319598 - DNA, 25 bp, Mus musculus
ggaacattgaagagcatgcctctgc

SEQ ID NO: 319599 - DNA, 25 bp, Mus musculus
ggaacattgaagagcatgcctctgg

SEQ ID NO: 319600 - DNA, 25 bp, Mus musculus
ggaacatttaccagggaagacagtg

SEQ ID NO: 319601 - DNA, 25 bp, Mus musculus
ggaacattttaaagacatttgagaa

SEQ ID NO: 319602 - DNA, 25 bp, Mus musculus
ggaacattttccctcctgtccttcc

SEQ ID NO: 319603 - DNA, 25 bp, Mus musculus
ggaaccaaaatcagggccctgtgga

SEQ ID NO: 319604 - DNA, 25 bp, Mus musculus
ggaaccaaacaaggttatatctgaa

SEQ ID NO: 319605 - DNA, 25 bp, Mus musculus
ggaaccaaagatatttccatatgag

SEQ ID NO: 319606 - DNA, 25 bp, Mus musculus
ggaaccaaccaaagccagacccaca

SEQ ID NO: 319607 - DNA, 25 bp, Mus musculus
ggaaccaagaaatcccaggcaggca

SEQ ID NO: 319608 - DNA, 25 bp, Mus musculus
ggaaccaagaagagtttgtccctga

SEQ ID NO: 319609 - DNA, 25 bp, Mus musculus
ggaaccaagaaggcacagacagaag

SEQ ID NO: 319610 - DNA, 25 bp, Mus musculus
ggaaccaagaaggcctcaggtccag

SEQ ID NO: 319611 - DNA, 25 bp, Mus musculus
ggaaccaagaatgcttttgggtcgc

SEQ ID NO: 319612 - DNA, 25 bp, Mus musculus
ggaaccaagagatgcaccttgcaag

SEQ ID NO: 319613 - DNA, 25 bp, Mus musculus
ggaaccaagagtttctagctctggg

SEQ ID NO: 319614 - DNA, 25 bp, Mus musculus
ggaaccaatgagacaccatgattcc

SEQ ID NO: 319615 - DNA, 25 bp, Mus musculus
ggaaccaatggagccattccgtagt

SEQ ID NO: 319616 - DNA, 25 bp, Mus musculus
ggaaccacagcgagggggcgctcct

SEQ ID NO: 319617 - DNA, 25 bp, Mus musculus
ggaaccacagggagttaatgagggg

SEQ ID NO: 319618 - DNA, 25 bp, Mus musculus
ggaaccactgaactggcattatgga

SEQ ID NO: 319619 - DNA, 25 bp, Mus musculus
ggaaccagaagctggaatcctttct

SEQ ID NO: 319620 - DNA, 25 bp, Mus musculus
ggaaccagagtcagaaaaatataac

SEQ ID NO: 319621 - DNA, 25 bp, Mus musculus
ggaaccagccgcaagggaaggtgtg

SEQ ID NO: 319622 - DNA, 25 bp, Mus musculus
ggaaccagccgcagagccccaagga

SEQ ID NO: 319623 - DNA, 25 bp, Mus musculus
ggaaccagtgggaggtgggacttcc

SEQ ID NO: 319624 - DNA, 25 bp, Mus musculus
ggaaccagtggtgactgccctgctg

SEQ ID NO: 319625 - DNA, 25 bp, Mus musculus
ggaaccatcaggctgctgattttcc

SEQ ID NO: 319626 - DNA, 25 bp, Mus musculus
ggaaccatcagggtgctgattttcc

SEQ ID NO: 319627 - DNA, 25 bp, Mus musculus
ggaaccatctggagaatgtgaggtg

SEQ ID NO: 319628 - DNA, 25 bp, Mus musculus
ggaaccatgaaaagaagagatgaga

SEQ ID NO: 319629 - DNA, 25 bp, Mus musculus
ggaaccatgaagaggaagttggtgt

SEQ ID NO: 319630 - DNA, 25 bp, Mus musculus
ggaaccatggcacagcgatggcagc

SEQ ID NO: 319631 - DNA, 25 bp, Mus musculus
ggaaccatggcagagcacctgaccc

SEQ ID NO: 319632 - DNA, 25 bp, Mus musculus
ggaaccatggcagagcgatggcagc

SEQ ID NO: 319633 - DNA, 25 bp, Mus musculus
ggaaccattacagccatccccaggc

SEQ ID NO: 319634 - DNA, 25 bp, Mus musculus
ggaacccaaaagatcttcccctgat

SEQ ID NO: 319635 - DNA, 25 bp, Mus musculus
ggaacccaaccatatgagagtctgt

SEQ ID NO: 319636 - DNA, 25 bp, Mus musculus
ggaacccaagaatttattgccaagc

SEQ ID NO: 319637 - DNA, 25 bp, Mus musculus
ggaacccaaggcctggcagaaccca

SEQ ID NO: 319638 - DNA, 25 bp, Mus musculus
ggaacccaagtcatcttggctgaag

SEQ ID NO: 319639 - DNA, 25 bp, Mus musculus
ggaacccacaggtgattcacatact

SEQ ID NO: 319640 - DNA, 25 bp, Mus musculus
ggaacccacagttacagatcaacat

SEQ ID NO: 319641 - DNA, 25 bp, Mus musculus
ggaacccaccagagagtgctgatcc

SEQ ID NO: 319642 - DNA, 25 bp, Mus musculus
ggaacccaccagagcccgagacagt

SEQ ID NO: 319643 - DNA, 25 bp, Mus musculus
ggaacccatcgcaggtgcagaccat

SEQ ID NO: 319644 - DNA, 25 bp, Mus musculus
ggaacccatctcagatcttctgccc

SEQ ID NO: 319645 - DNA, 25 bp, Mus musculus
ggaaccccaggcagaaagtaaatcc

SEQ ID NO: 319646 - DNA, 25 bp, Mus musculus
ggaacccccaatatgaacattttcc

SEQ ID NO: 319647 - DNA, 25 bp, Mus musculus
ggaacccggagtctggcacatccag

SEQ ID NO: 319648 - DNA, 25 bp, Mus musculus
ggaacccgtgaggtcaatatccaac

SEQ ID NO: 319649 - DNA, 25 bp, Mus musculus
ggaaccctccactagctggcattcc

SEQ ID NO: 319650 - DNA, 25 bp, Mus musculus
ggaaccctctagcacctaaaggaac

SEQ ID NO: 319651 - DNA, 25 bp, Mus musculus
ggaaccctctggctcatacatgtct

SEQ ID NO: 319652 - DNA, 25 bp, Mus musculus
ggaaccctctgtgcagagaggtgaa

SEQ ID NO: 319653 - DNA, 25 bp, Mus musculus
ggaaccctgaaggatcctcgctctg

SEQ ID NO: 319654 - DNA, 25 bp, Mus musculus
ggaaccctgaaggatgatgactggg

SEQ ID NO: 319655 - DNA, 25 bp, Mus musculus
ggaaccctggcaggtgcacaggctg

SEQ ID NO: 319656 - DNA, 25 bp, Mus musculus
ggaaccctgggaaaggtgctgggtg

SEQ ID NO: 319657 - DNA, 25 bp, Mus musculus
ggaaccctggggcatcccccgcaga

SEQ ID NO: 319658 - DNA, 25 bp, Mus musculus
ggaaccctgttgggaactgttgaca

SEQ ID NO: 319659 - DNA, 25 bp, Mus musculus
ggaaccctttatgctatgaaaccac

SEQ ID NO: 319660 - DNA, 25 bp, Mus musculus
ggaaccctttatgctcaatatgaag

SEQ ID NO: 319661 - DNA, 25 bp, Mus musculus
ggaaccctttatgctgattctctga

SEQ ID NO: 319662 - DNA, 25 bp, Mus musculus
ggaaccgatcagtatatacacttct

SEQ ID NO: 319663 - DNA, 25 bp, Mus musculus
ggaaccgcaggctgttgccgcacat

SEQ ID NO: 319664 - DNA, 25 bp, Mus musculus
ggaaccgccaaagccgagggttgat

SEQ ID NO: 319665 - DNA, 25 bp, Mus musculus
ggaaccgccaaaggctttctcctgg

SEQ ID NO: 319666 - DNA, 25 bp, Mus musculus
ggaaccgcccagggttcgctgatca

SEQ ID NO: 319667 - DNA, 25 bp, Mus musculus
ggaaccgcccaggtgctttttgaag

SEQ ID NO: 319668 - DNA, 25 bp, Mus musculus
ggaaccgccgatcggagaatgtcgt

SEQ ID NO: 319669 - DNA, 25 bp, Mus musculus
ggaaccggcattgatgtccagctcg

SEQ ID NO: 319670 - DNA, 25 bp, Mus musculus
ggaaccggcggcttcatggcggctg

SEQ ID NO: 319671 - DNA, 25 bp, Mus musculus
ggaaccgggtgccatgtttcctgaa

SEQ ID NO: 319672 - DNA, 25 bp, Mus musculus
ggaacctaaatggggggatcgcagc

SEQ ID NO: 319673 - DNA, 25 bp, Mus musculus
ggaacctaaatggtggagccacttt

SEQ ID NO: 319674 - DNA, 25 bp, Mus musculus
ggaacctagaagaagaggaatgggt

SEQ ID NO: 319675 - DNA, 25 bp, Mus musculus
ggaacctaggatagagattgttgtg

SEQ ID NO: 319676 - DNA, 25 bp, Mus musculus
ggaacctcaaagtcagtggctatct

SEQ ID NO: 319677 - DNA, 25 bp, Mus musculus
ggaacctcccagaactccgaggtga

SEQ ID NO: 319678 - DNA, 25 bp, Mus musculus
ggaacctctcacagatgaatcagca

SEQ ID NO: 319679 - DNA, 25 bp, Mus musculus
ggaacctctccacgtgctttagctc

SEQ ID NO: 319680 - DNA, 25 bp, Mus musculus
ggaacctggagggaaaagcagttca

SEQ ID NO: 319681 - DNA, 25 bp, Mus musculus
ggaacctggcgcccaatgaaccaga

SEQ ID NO: 319682 - DNA, 25 bp, Mus musculus
ggaacctggcgcggcactcctagaa

SEQ ID NO: 319683 - DNA, 25 bp, Mus musculus
ggaacctgggcaggagctcggggag

SEQ ID NO: 319684 - DNA, 25 bp, Mus musculus
ggaacctggttggcaaagtgatcgg

SEQ ID NO: 319685 - DNA, 25 bp, Mus musculus
ggaacctgtgaggtcatgcacttct

SEQ ID NO: 319686 - DNA, 25 bp, Mus musculus
ggaacctgtgtgtagccccatgtgg

SEQ ID NO: 319687 - DNA, 25 bp, Mus musculus
ggaaccttccagggctcactgatca

SEQ ID NO: 319688 - DNA, 25 bp, Mus musculus
ggaacgaaataatttgaagaggaca

SEQ ID NO: 319689 - DNA, 25 bp, Mus musculus
ggaacgaattttagatgcacagaga

SEQ ID NO: 319690 - DNA, 25 bp, Mus musculus
ggaacgaattttgttaagagcagga

SEQ ID NO: 319691 - DNA, 25 bp, Mus musculus
ggaacgaccgtgctatgtttcaggt

SEQ ID NO: 319692 - DNA, 25 bp, Mus musculus
ggaacgagaagccagaaagaaagat

SEQ ID NO: 319693 - DNA, 25 bp, Mus musculus
ggaacgaggacaaggaaccttacag

SEQ ID NO: 319694 - DNA, 25 bp, Mus musculus
ggaacgaggacaagtgccaatgcaa

SEQ ID NO: 319695 - DNA, 25 bp, Mus musculus
ggaacgatacaagtgaccttattca

SEQ ID NO: 319696 - DNA, 25 bp, Mus musculus
ggaacgcatcaactgtccagcagaa

SEQ ID NO: 319697 - DNA, 25 bp, Mus musculus
ggaacgcatcgtattgacgacagtg

SEQ ID NO: 319698 - DNA, 25 bp, Mus musculus
ggaacgcatgaaacggccttcctgg

SEQ ID NO: 319699 - DNA, 25 bp, Mus musculus
ggaacgcattcagccagaagacatg

SEQ ID NO: 319700 - DNA, 25 bp, Mus musculus
ggaacgccaattctaacggcaagtc

SEQ ID NO: 319701 - DNA, 25 bp, Mus musculus
ggaacgccgggaaaggtaatgatgt

SEQ ID NO: 319702 - DNA, 25 bp, Mus musculus
ggaacgcctcgggggtgtctgacgg

SEQ ID NO: 319703 - DNA, 25 bp, Mus musculus
ggaacgcgtgcgcagactttcctct

SEQ ID NO: 319704 - DNA, 25 bp, Mus musculus
ggaacgctgcttcggtggtgtagtg

SEQ ID NO: 319705 - DNA, 25 bp, Mus musculus
ggaacgcttaagggaacaggaagaa

SEQ ID NO: 319706 - DNA, 25 bp, Mus musculus
ggaacggaatcgcaacaaactgaca

SEQ ID NO: 319707 - DNA, 25 bp, Mus musculus
ggaacggaatcgcaaggacagatcc

SEQ ID NO: 319708 - DNA, 25 bp, Mus musculus
ggaacggaatgacttgtgtgcaaac

SEQ ID NO: 319709 - DNA, 25 bp, Mus musculus
ggaacggcagacccagtttcctatt

SEQ ID NO: 319710 - DNA, 25 bp, Mus musculus
ggaacggcagatcacagagcagcag

SEQ ID NO: 319711 - DNA, 25 bp, Mus musculus
ggaacggcagatgataatgttcact

SEQ ID NO: 319712 - DNA, 25 bp, Mus musculus
ggaacggcagatgtggtacacggat

SEQ ID NO: 319713 - DNA, 25 bp, Mus musculus
ggaacggcagcgtgttgaggagacg

SEQ ID NO: 319714 - DNA, 25 bp, Mus musculus
ggaacggcaggccgatctgtccccg

SEQ ID NO: 319715 - DNA, 25 bp, Mus musculus
ggaacggcaggtagagatgacccct

SEQ ID NO: 319716 - DNA, 25 bp, Mus musculus
ggaacgggaatgctgatcactggag

SEQ ID NO: 319717 - DNA, 25 bp, Mus musculus
ggaacgggagagtggccttgtgaat

SEQ ID NO: 319718 - DNA, 25 bp, Mus musculus
ggaacgggcagtgtggtgagcactc

SEQ ID NO: 319719 - DNA, 25 bp, Mus musculus
ggaacggtgaaggtgtggaatgtca

SEQ ID NO: 319720 - DNA, 25 bp, Mus musculus
ggaacgtactaaaactgtgcagggc

SEQ ID NO: 319721 - DNA, 25 bp, Mus musculus
ggaacgtatgatggaaatttctatg

SEQ ID NO: 319722 - DNA, 25 bp, Mus musculus
ggaacgtcccggagcttggccagag

SEQ ID NO: 319723 - DNA, 25 bp, Mus musculus
ggaacgtgatacgatgagcagctct

SEQ ID NO: 319724 - DNA, 25 bp, Mus musculus
ggaacgtggaggcccctttgtgtgt

SEQ ID NO: 319725 - DNA, 25 bp, Mus musculus
ggaacgttctggaagcctttgcttc

SEQ ID NO: 319726 - DNA, 25 bp, Mus musculus
ggaactaaagcaaatggttatgagc

SEQ ID NO: 319727 - DNA, 25 bp, Mus musculus
ggaactaaaggaaggccctcatacc

SEQ ID NO: 319728 - DNA, 25 bp, Mus musculus
ggaactacagggtccaactgagccc

SEQ ID NO: 319729 - DNA, 25 bp, Mus musculus
ggaactacaggtgaccccaaaggag

SEQ ID NO: 319730 - DNA, 25 bp, Mus musculus
ggaactacagtacagctaggtagaa

SEQ ID NO: 319731 - DNA, 25 bp, Mus musculus
ggaactacgagcgcgaggtagatcg

SEQ ID NO: 319732 - DNA, 25 bp, Mus musculus
ggaactatccgcaaagaagatatcc

SEQ ID NO: 319733 - DNA, 25 bp, Mus musculus
ggaactatcctgtggtctccattga

SEQ ID NO: 319734 - DNA, 25 bp, Mus musculus
ggaactatcgcaggattgggtttcc

SEQ ID NO: 319735 - DNA, 25 bp, Mus musculus
ggaactatcgcagggatcccaggct

SEQ ID NO: 319736 - DNA, 25 bp, Mus musculus
ggaactatcggctctttctacacag

SEQ ID NO: 319737 - DNA, 25 bp, Mus musculus
ggaactatcgtcttgaagaaccaca

SEQ ID NO: 319738 - DNA, 25 bp, Mus musculus
ggaactcaacaaggagatggcttca

SEQ ID NO: 319739 - DNA, 25 bp, Mus musculus
ggaactcaaggaatgactattccaa

SEQ ID NO: 319740 - DNA, 25 bp, Mus musculus
ggaactcaagggagctaagaagatt

SEQ ID NO: 319741 - DNA, 25 bp, Mus musculus
ggaactcaagttgaccgccttgctc

SEQ ID NO: 319742 - DNA, 25 bp, Mus musculus
ggaactccagcccttttacacagcc

SEQ ID NO: 319743 - DNA, 25 bp, Mus musculus
ggaactcccaggctatgaagagacc

SEQ ID NO: 319744 - DNA, 25 bp, Mus musculus
ggaactcgaggctcctggaggaatt

SEQ ID NO: 319745 - DNA, 25 bp, Mus musculus
ggaactcgatgagcctgtttgagct

SEQ ID NO: 319746 - DNA, 25 bp, Mus musculus
ggaactcgcggcggaagactgctag

SEQ ID NO: 319747 - DNA, 25 bp, Mus musculus
ggaactctagcattgaggcctttgc

SEQ ID NO: 319748 - DNA, 25 bp, Mus musculus
ggaactctgaacctctatgaagtct

SEQ ID NO: 319749 - DNA, 25 bp, Mus musculus
ggaactctgcgggaccttctgtcat

SEQ ID NO: 319750 - DNA, 25 bp, Mus musculus
ggaactctggaagatgggtgtgttt

SEQ ID NO: 319751 - DNA, 25 bp, Mus musculus
ggaactctttgggcctgccttaagt

SEQ ID NO: 319752 - DNA, 25 bp, Mus musculus
ggaactgaaagctgtcctctattgt

SEQ ID NO: 319753 - DNA, 25 bp, Mus musculus
ggaactgaaagctgttttaaaggac

SEQ ID NO: 319754 - DNA, 25 bp, Mus musculus
ggaactgaaagtgcctttgaaggag

SEQ ID NO: 319755 - DNA, 25 bp, Mus musculus
ggaactgaagacgagttggtgtcag

SEQ ID NO: 319756 - DNA, 25 bp, Mus musculus
ggaactgaagacgagttttcgtttc

SEQ ID NO: 319757 - DNA, 25 bp, Mus musculus
ggaactgaagcgcctttcagtggaa

SEQ ID NO: 319758 - DNA, 25 bp, Mus musculus
ggaactgaagcgttctgagaagaag

SEQ ID NO: 319759 - DNA, 25 bp, Mus musculus
ggaactgaaggagtctttgtctgaa

SEQ ID NO: 319760 - DNA, 25 bp, Mus musculus
ggaactgaggatttctcagctgatg

SEQ ID NO: 319761 - DNA, 25 bp, Mus musculus
ggaactgaggctccggagggtgtag

SEQ ID NO: 319762 - DNA, 25 bp, Mus musculus
ggaactgattgacccttcccatgct

SEQ ID NO: 319763 - DNA, 25 bp, Mus musculus
ggaactgcaggacagtaatgatgac

SEQ ID NO: 319764 - DNA, 25 bp, Mus musculus
ggaactgcaggcagggaggtgtgag

SEQ ID NO: 319765 - DNA, 25 bp, Mus musculus
ggaactgcaggggaagcacaggctc

SEQ ID NO: 319766 - DNA, 25 bp, Mus musculus
ggaactgcaggtaaggaactgccaa

SEQ ID NO: 319767 - DNA, 25 bp, Mus musculus
ggaactgcaggttgacgtgattgtg

SEQ ID NO: 319768 - DNA, 25 bp, Mus musculus
ggaactgcagtttccctgcaggtag

SEQ ID NO: 319769 - DNA, 25 bp, Mus musculus
ggaactgccatgcgcagtacaaccc

SEQ ID NO: 319770 - DNA, 25 bp, Mus musculus
ggaactgcctaaggagcctcaaggc

SEQ ID NO: 319771 - DNA, 25 bp, Mus musculus
ggaactgctgctcctccgttccctg

SEQ ID NO: 319772 - DNA, 25 bp, Mus musculus
ggaactgctggtgtgatccttgcac

SEQ ID NO: 319773 - DNA, 25 bp, Mus musculus
ggaactggacaaagaaacaacttcc

SEQ ID NO: 319774 - DNA, 25 bp, Mus musculus
ggaactggacaaaggactgaggtct

SEQ ID NO: 319775 - DNA, 25 bp, Mus musculus
ggaactggacaaaggatgttgggaa

SEQ ID NO: 319776 - DNA, 25 bp, Mus musculus
ggaactggacaagaaggagaagatc

SEQ ID NO: 319777 - DNA, 25 bp, Mus musculus
ggaactggacaaggccctgtgtgct

SEQ ID NO: 319778 - DNA, 25 bp, Mus musculus
ggaactggacaagtgtcttcttggt

SEQ ID NO: 319779 - DNA, 25 bp, Mus musculus
ggaactggcagccagcgctcctgtt

SEQ ID NO: 319780 - DNA, 25 bp, Mus musculus
ggaactggcggtcttctgttcccca

SEQ ID NO: 319781 - DNA, 25 bp, Mus musculus
ggaactgggaaagggagccttctct

SEQ ID NO: 319782 - DNA, 25 bp, Mus musculus
ggaactgggcagaatgaacacgaaa

SEQ ID NO: 319783 - DNA, 25 bp, Mus musculus
ggaactgggcagagaagaatatcaa

SEQ ID NO: 319784 - DNA, 25 bp, Mus musculus
ggaactgggtcaaggacacggcaaa

SEQ ID NO: 319785 - DNA, 25 bp, Mus musculus
ggaactgggtcaagtcaccctgtga

SEQ ID NO: 319786 - DNA, 25 bp, Mus musculus
ggaactggtcaaggcctggcagctc

SEQ ID NO: 319787 - DNA, 25 bp, Mus musculus
ggaactggttgggaagccagctgca

SEQ ID NO: 319788 - DNA, 25 bp, Mus musculus
ggaactgtcaggctggtctgctcag

SEQ ID NO: 319789 - DNA, 25 bp, Mus musculus
ggaactgtctttatccgtctacctt

SEQ ID NO: 319790 - DNA, 25 bp, Mus musculus
ggaactgtgaattagatgcaacgtg

SEQ ID NO: 319791 - DNA, 25 bp, Mus musculus
ggaactgtggaacaggtcccctgtt

SEQ ID NO: 319792 - DNA, 25 bp, Mus musculus
ggaactgtggaggcagctgtgtctg

SEQ ID NO: 319793 - DNA, 25 bp, Mus musculus
ggaactgtttggaggccaatgaggc

SEQ ID NO: 319794 - DNA, 25 bp, Mus musculus
ggaacttaaaaaggagcttcgacgc

SEQ ID NO: 319795 - DNA, 25 bp, Mus musculus
ggaacttaaaaaggtgattgaagcc

SEQ ID NO: 319796 - DNA, 25 bp, Mus musculus
ggaacttaaaaaggtgtcctcagat

SEQ ID NO: 319797 - DNA, 25 bp, Mus musculus
ggaacttaaggtgagggtggaactg

SEQ ID NO: 319798 - DNA, 25 bp, Mus musculus
ggaacttatccagtgaagaagttgc

SEQ ID NO: 319799 - DNA, 25 bp, Mus musculus
ggaacttcaaggatgaagaaacacg

SEQ ID NO: 319800 - DNA, 25 bp, Mus musculus
ggaacttcaagtcctcctgcatatg

SEQ ID NO: 319801 - DNA, 25 bp, Mus musculus
ggaacttcacgattcctgtgttgaa

SEQ ID NO: 319802 - DNA, 25 bp, Mus musculus
ggaacttcagtttgaaaatgaaaaa

SEQ ID NO: 319803 - DNA, 25 bp, Mus musculus
ggaacttccaggcacaaagtaccag

SEQ ID NO: 319804 - DNA, 25 bp, Mus musculus
ggaacttccgagcgggggaacctga

SEQ ID NO: 319805 - DNA, 25 bp, Mus musculus
ggaacttcctcgtcccatctctcca

SEQ ID NO: 319806 - DNA, 25 bp, Mus musculus
ggaacttcttgacagggtcctgcag

SEQ ID NO: 319807 - DNA, 25 bp, Mus musculus
ggaacttggaccgcagccctctgcc

SEQ ID NO: 319808 - DNA, 25 bp, Mus musculus
ggaacttggaccggaactgtccgac

SEQ ID NO: 319809 - DNA, 25 bp, Mus musculus
ggaacttggagggccatggcggact

SEQ ID NO: 319810 - DNA, 25 bp, Mus musculus
ggaacttgtaaagtcccacgagtcc

SEQ ID NO: 319811 - DNA, 25 bp, Mus musculus
ggaacttgtagtagacccttaagcc

SEQ ID NO: 319812 - DNA, 25 bp, Mus musculus
ggaactttgacaagatcctggctga

SEQ ID NO: 319813 - DNA, 25 bp, Mus musculus
ggaacttttcagctgccaaaagcct

SEQ ID NO: 319814 - DNA, 25 bp, Mus musculus
ggaacttttcagttggcaggcagag

SEQ ID NO: 319815 - DNA, 25 bp, Mus musculus
ggaacttttttgtaagaagacaaga

SEQ ID NO: 319816 - DNA, 25 bp, Mus musculus
ggaagaaaaaaagaccccagcgcat

SEQ ID NO: 319817 - DNA, 25 bp, Mus musculus
ggaagaaaaaccagaaccagatgga

SEQ ID NO: 319818 - DNA, 25 bp, Mus musculus
ggaagaaaaaccagaagaacaggag

SEQ ID NO: 319819 - DNA, 25 bp, Mus musculus
ggaagaaaagcactgcccctcgaag

SEQ ID NO: 319820 - DNA, 25 bp, Mus musculus
ggaagaaaagtggccctgtctccgc

SEQ ID NO: 319821 - DNA, 25 bp, Mus musculus
ggaagaaaataaagaataaactaga

SEQ ID NO: 319822 - DNA, 25 bp, Mus musculus
ggaagaaaatggaagcttggctgaa

SEQ ID NO: 319823 - DNA, 25 bp, Mus musculus
ggaagaaaattgcagcctggagcta

SEQ ID NO: 319824 - DNA, 25 bp, Mus musculus
ggaagaaagaaggatagatataagc

SEQ ID NO: 319825 - DNA, 25 bp, Mus musculus
ggaagaaagatgtgtacactctttt

SEQ ID NO: 319826 - DNA, 25 bp, Mus musculus
ggaagaaagcaaggaaggaaggtct

SEQ ID NO: 319827 - DNA, 25 bp, Mus musculus
ggaagaaagcttcgaagaaaagcaa

SEQ ID NO: 319828 - DNA, 25 bp, Mus musculus
ggaagaaatacaagaaaaattccta

SEQ ID NO: 319829 - DNA, 25 bp, Mus musculus
ggaagaaatggaggtgacagctact

SEQ ID NO: 319830 - DNA, 25 bp, Mus musculus
ggaagaacaaaaatgcaagctgggc

SEQ ID NO: 319831 - DNA, 25 bp, Mus musculus
ggaagaacaaaaggctgacgaatga

SEQ ID NO: 319832 - DNA, 25 bp, Mus musculus
ggaagaacaatgacctccgggaaaa

SEQ ID NO: 319833 - DNA, 25 bp, Mus musculus
ggaagaacaccaaagagtgagtaaa

SEQ ID NO: 319834 - DNA, 25 bp, Mus musculus
ggaagaacaccaaattttaagagtg

SEQ ID NO: 319835 - DNA, 25 bp, Mus musculus
ggaagaacctgcaggatagaaagag

SEQ ID NO: 319836 - DNA, 25 bp, Mus musculus
ggaagaacctgcagtaccatcccac

SEQ ID NO: 319837 - DNA, 25 bp, Mus musculus
ggaagaacgcggagggagctatgga

SEQ ID NO: 319838 - DNA, 25 bp, Mus musculus
ggaagaactcagcaaggagaagaca

SEQ ID NO: 319839 - DNA, 25 bp, Mus musculus
ggaagaagaaaggatacaagaccct

SEQ ID NO: 319840 - DNA, 25 bp, Mus musculus
ggaagaagaaaggttcatcctcaac

SEQ ID NO: 319841 - DNA, 25 bp, Mus musculus
ggaagaagaagaaggtgaccggaga

SEQ ID NO: 319842 - DNA, 25 bp, Mus musculus
ggaagaagaagaggcttctgtgtca

SEQ ID NO: 319843 - DNA, 25 bp, Mus musculus
ggaagaagaagcccagggtgctgag

SEQ ID NO: 319844 - DNA, 25 bp, Mus musculus
ggaagaagaatatgccccagagaag

SEQ ID NO: 319845 - DNA, 25 bp, Mus musculus
ggaagaagacacagagggctgacag

SEQ ID NO: 319846 - DNA, 25 bp, Mus musculus
ggaagaagacagatgagcttcccca

SEQ ID NO: 319847 - DNA, 25 bp, Mus musculus
ggaagaagacaggacaggaagctct

SEQ ID NO: 319848 - DNA, 25 bp, Mus musculus
ggaagaagacagttcaaaagacccc

SEQ ID NO: 319849 - DNA, 25 bp, Mus musculus
ggaagaagacggatctccatctttc

SEQ ID NO: 319850 - DNA, 25 bp, Mus musculus
ggaagaagagaaccacaaactccag

SEQ ID NO: 319851 - DNA, 25 bp, Mus musculus
ggaagaagagaagaaagatgaggca

SEQ ID NO: 319852 - DNA, 25 bp, Mus musculus
ggaagaagagaatgcccaggctgaa

SEQ ID NO: 319853 - DNA, 25 bp, Mus musculus
ggaagaagagaatggaccgggttca

SEQ ID NO: 319854 - DNA, 25 bp, Mus musculus
ggaagaagagcccttctccctaggc

SEQ ID NO: 319855 - DNA, 25 bp, Mus musculus
ggaagaagagtcaagcgaaggcagc

SEQ ID NO: 319856 - DNA, 25 bp, Mus musculus
ggaagaagcaaaaaggcagaagact

SEQ ID NO: 319857 - DNA, 25 bp, Mus musculus
ggaagaagcaaaaaggtctgtctgt

SEQ ID NO: 319858 - DNA, 25 bp, Mus musculus
ggaagaagcacagagagagattaag

SEQ ID NO: 319859 - DNA, 25 bp, Mus musculus
ggaagaagcaggtgattaaagttta

SEQ ID NO: 319860 - DNA, 25 bp, Mus musculus
ggaagaagccaaggcatgttatttg

SEQ ID NO: 319861 - DNA, 25 bp, Mus musculus
ggaagaagccaagtcccatggcctc

SEQ ID NO: 319862 - DNA, 25 bp, Mus musculus
ggaagaagccaagttggcgagaggc

SEQ ID NO: 319863 - DNA, 25 bp, Mus musculus
ggaagaagccacggatggtctcagc

SEQ ID NO: 319864 - DNA, 25 bp, Mus musculus
ggaagaagcccaaggatgatgaaaa

SEQ ID NO: 319865 - DNA, 25 bp, Mus musculus
ggaagaaggagaaagcaagctgttc

SEQ ID NO: 319866 - DNA, 25 bp, Mus musculus
ggaagaaggagagctcactactata

SEQ ID NO: 319867 - DNA, 25 bp, Mus musculus
ggaagaaggaggttccattttgggg

SEQ ID NO: 319868 - DNA, 25 bp, Mus musculus
ggaagaaggccaccgacgcattcca

SEQ ID NO: 319869 - DNA, 25 bp, Mus musculus
ggaagaagttcaagattgatgacca

SEQ ID NO: 319870 - DNA, 25 bp, Mus musculus
ggaagaatacgtatcaccaaactca

SEQ ID NO: 319871 - DNA, 25 bp, Mus musculus
ggaagaataggtatcgtgtccaggt

SEQ ID NO: 319872 - DNA, 25 bp, Mus musculus
ggaagaatcacagggctggaccctg

SEQ ID NO: 319873 - DNA, 25 bp, Mus musculus
ggaagaatggcatctagtgcttttt

SEQ ID NO: 319874 - DNA, 25 bp, Mus musculus
ggaagaatgtggcaaaaaaacattt

SEQ ID NO: 319875 - DNA, 25 bp, Mus musculus
ggaagaatgtggcgctttggagtct

SEQ ID NO: 319876 - DNA, 25 bp, Mus musculus
ggaagaattccacggacctagactc

SEQ ID NO: 319877 - DNA, 25 bp, Mus musculus
ggaagaatttcagatgcccgtgtgg

SEQ ID NO: 319878 - DNA, 25 bp, Mus musculus
ggaagaatttcagtgtctctgaaga

SEQ ID NO: 319879 - DNA, 25 bp, Mus musculus
ggaagacaaggggctgcactggatg

SEQ ID NO: 319880 - DNA, 25 bp, Mus musculus
ggaagacaaggtgatgatgagcaga

SEQ ID NO: 319881 - DNA, 25 bp, Mus musculus
ggaagacaagtgcctggagctggtg

SEQ ID NO: 319882 - DNA, 25 bp, Mus musculus
ggaagacaagttgctgtctcacagg

SEQ ID NO: 319883 - DNA, 25 bp, Mus musculus
ggaagacacagcctgcttctacctg

SEQ ID NO: 319884 - DNA, 25 bp, Mus musculus
ggaagacacagcgtgcttttacttg

SEQ ID NO: 319885 - DNA, 25 bp, Mus musculus
ggaagacacagcgtggccttgggtg

SEQ ID NO: 319886 - DNA, 25 bp, Mus musculus
ggaagacaccagcaccaatggaaca

SEQ ID NO: 319887 - DNA, 25 bp, Mus musculus
ggaagacacggagtatatatcctgg

SEQ ID NO: 319888 - DNA, 25 bp, Mus musculus
ggaagacagagaatttcatcttcat

SEQ ID NO: 319889 - DNA, 25 bp, Mus musculus
ggaagacagagttcctctgctaaag

SEQ ID NO: 319890 - DNA, 25 bp, Mus musculus
ggaagacagcacactagaaacccca

SEQ ID NO: 319891 - DNA, 25 bp, Mus musculus
ggaagacagtgatgaggatgaagat

SEQ ID NO: 319892 - DNA, 25 bp, Mus musculus
ggaagacatatgggctgatgtgatg

SEQ ID NO: 319893 - DNA, 25 bp, Mus musculus
ggaagacatatgggtggagcctttt

SEQ ID NO: 319894 - DNA, 25 bp, Mus musculus
ggaagacatccagaaactgaaggat

SEQ ID NO: 319895 - DNA, 25 bp, Mus musculus
ggaagacatccagccggatggcgca

SEQ ID NO: 319896 - DNA, 25 bp, Mus musculus
ggaagacattcacgattgttggtga

SEQ ID NO: 319897 - DNA, 25 bp, Mus musculus
ggaagacattggcgtatttgctgcc

SEQ ID NO: 319898 - DNA, 25 bp, Mus musculus
ggaagacctcactccagtcccgctc

SEQ ID NO: 319899 - DNA, 25 bp, Mus musculus
ggaagacctcactgacctctcactg

SEQ ID NO: 319900 - DNA, 25 bp, Mus musculus
ggaagacctcactgtttctctatat

SEQ ID NO: 319901 - DNA, 25 bp, Mus musculus
ggaagacctgatcctgtggaagagg

SEQ ID NO: 319902 - DNA, 25 bp, Mus musculus
ggaagacctggataactggactgcg

SEQ ID NO: 319903 - DNA, 25 bp, Mus musculus
ggaagacgcctatgcaggagcatct

SEQ ID NO: 319904 - DNA, 25 bp, Mus musculus
ggaagacgcctatggctcagaggac

SEQ ID NO: 319905 - DNA, 25 bp, Mus musculus
ggaagacgtgaaattgcaagctttc

SEQ ID NO: 319906 - DNA, 25 bp, Mus musculus
ggaagacgtgaatatccgctccatt

SEQ ID NO: 319907 - DNA, 25 bp, Mus musculus
ggaagactactacagtcacctgaag

SEQ ID NO: 319908 - DNA, 25 bp, Mus musculus
ggaagactatctgtctgcaatcctg

SEQ ID NO: 319909 - DNA, 25 bp, Mus musculus
ggaagactccaattcattgcttctt

SEQ ID NO: 319910 - DNA, 25 bp, Mus musculus
ggaagactctcaggccggggagcgt

SEQ ID NO: 319911 - DNA, 25 bp, Mus musculus
ggaagactgaaccagctctccagga

SEQ ID NO: 319912 - DNA, 25 bp, Mus musculus
ggaagacttcaagaggacgctggta

SEQ ID NO: 319913 - DNA, 25 bp, Mus musculus
ggaagacttctccaggctagaaaat

SEQ ID NO: 319914 - DNA, 25 bp, Mus musculus
ggaagacttgcactggttgttcatc

SEQ ID NO: 319915 - DNA, 25 bp, Mus musculus
ggaagagaaagggcggtctggtcga

SEQ ID NO: 319916 - DNA, 25 bp, Mus musculus
ggaagagaacaagaggtttgaagat

SEQ ID NO: 319917 - DNA, 25 bp, Mus musculus
ggaagagaaggctgaggcagacaaa

SEQ ID NO: 319918 - DNA, 25 bp, Mus musculus
ggaagagaaggcttcagatgctagc

SEQ ID NO: 319919 - DNA, 25 bp, Mus musculus
ggaagagaataggagaaagcatcca

SEQ ID NO: 319920 - DNA, 25 bp, Mus musculus
ggaagagacctccggaaatttgtga

SEQ ID NO: 319921 - DNA, 25 bp, Mus musculus
ggaagagacttcacagctcaggcgg

SEQ ID NO: 319922 - DNA, 25 bp, Mus musculus
ggaagagagacccaggcactccaga

SEQ ID NO: 319923 - DNA, 25 bp, Mus musculus
ggaagagaggaaaagaacaaattac

SEQ ID NO: 319924 - DNA, 25 bp, Mus musculus
ggaagagatcctcgagtgaggacga

SEQ ID NO: 319925 - DNA, 25 bp, Mus musculus
ggaagagatggccatatacgcctac

SEQ ID NO: 319926 - DNA, 25 bp, Mus musculus
ggaagagatggctacatgggaattg

SEQ ID NO: 319927 - DNA, 25 bp, Mus musculus
ggaagagatgggtattgctttcacc

SEQ ID NO: 319928 - DNA, 25 bp, Mus musculus
ggaagagattaaaaggatcttgctg

SEQ ID NO: 319929 - DNA, 25 bp, Mus musculus
ggaagagcaaagaaatctgcaggtg

SEQ ID NO: 319930 - DNA, 25 bp, Mus musculus
ggaagagcaacatgaccatgtggag

SEQ ID NO: 319931 - DNA, 25 bp, Mus musculus
ggaagagcaatgtggactttgtgaa

SEQ ID NO: 319932 - DNA, 25 bp, Mus musculus
ggaagagcacagtgggtgttggacg

SEQ ID NO: 319933 - DNA, 25 bp, Mus musculus
ggaagagcacagtggtttattgctg

SEQ ID NO: 319934 - DNA, 25 bp, Mus musculus
ggaagagcagcagagtggtaggatt

SEQ ID NO: 319935 - DNA, 25 bp, Mus musculus
ggaagagcagcagatcagacctact

SEQ ID NO: 319936 - DNA, 25 bp, Mus musculus
ggaagagcaggggaaggaagccagc

SEQ ID NO: 319937 - DNA, 25 bp, Mus musculus
ggaagagccggaatcggtgggacct

SEQ ID NO: 319938 - DNA, 25 bp, Mus musculus
ggaagagccgtctgggcaagcagga

SEQ ID NO: 319939 - DNA, 25 bp, Mus musculus
ggaagagccgtctggtgtggagggt

SEQ ID NO: 319940 - DNA, 25 bp, Mus musculus
ggaagagctcagagcagaaaactta

SEQ ID NO: 319941 - DNA, 25 bp, Mus musculus
ggaagagctggagagacaaaagata

SEQ ID NO: 319942 - DNA, 25 bp, Mus musculus
ggaagagctggatgccttattggag

SEQ ID NO: 319943 - DNA, 25 bp, Mus musculus
ggaagagctggattttgccatgccc

SEQ ID NO: 319944 - DNA, 25 bp, Mus musculus
ggaagagctggcatttcagtcgaac

SEQ ID NO: 319945 - DNA, 25 bp, Mus musculus
ggaagagctgggctctcccgcaatg

SEQ ID NO: 319946 - DNA, 25 bp, Mus musculus
ggaagaggaaagagatgagccgcca

SEQ ID NO: 319947 - DNA, 25 bp, Mus musculus
ggaagaggaacaggatctcatcatg

SEQ ID NO: 319948 - DNA, 25 bp, Mus musculus
ggaagaggaagaagtctgttcccag

SEQ ID NO: 319949 - DNA, 25 bp, Mus musculus
ggaagaggaagaggatacagtcatc

SEQ ID NO: 319950 - DNA, 25 bp, Mus musculus
ggaagaggacaggcttttccctggg

SEQ ID NO: 319951 - DNA, 25 bp, Mus musculus
ggaagaggaccgaggatccagatcg

SEQ ID NO: 319952 - DNA, 25 bp, Mus musculus
ggaagaggaccgaggcgttatcgaa

SEQ ID NO: 319953 - DNA, 25 bp, Mus musculus
ggaagaggagaaagaggacagagct

SEQ ID NO: 319954 - DNA, 25 bp, Mus musculus
ggaagaggaggaaactttggttttg

SEQ ID NO: 319955 - DNA, 25 bp, Mus musculus
ggaagaggaggaactatggtcctgg

SEQ ID NO: 319956 - DNA, 25 bp, Mus musculus
ggaagaggaggaccatatggtggag

SEQ ID NO: 319957 - DNA, 25 bp, Mus musculus
ggaagaggaggaggaggctccgccc

SEQ ID NO: 319958 - DNA, 25 bp, Mus musculus
ggaagaggagggagaatcccgtatc

SEQ ID NO: 319959 - DNA, 25 bp, Mus musculus
ggaagaggagttggaaaatcttcaa

SEQ ID NO: 319960 - DNA, 25 bp, Mus musculus
ggaagaggccaaaggaaatttgtga

SEQ ID NO: 319961 - DNA, 25 bp, Mus musculus
ggaagaggccaaagtaacctcaggc

SEQ ID NO: 319962 - DNA, 25 bp, Mus musculus
ggaagaggggaagcatccacaaact

SEQ ID NO: 319963 - DNA, 25 bp, Mus musculus
ggaagaggtcaaagaggcgccagct

SEQ ID NO: 319964 - DNA, 25 bp, Mus musculus
ggaagaggtgccagctacatcagaa

SEQ ID NO: 319965 - DNA, 25 bp, Mus musculus
ggaagaggtggagatcagcagagtg

SEQ ID NO: 319966 - DNA, 25 bp, Mus musculus
ggaagaggtggaggccccagtcaaa

SEQ ID NO: 319967 - DNA, 25 bp, Mus musculus
ggaagaggtggcaacgagtctccag

SEQ ID NO: 319968 - DNA, 25 bp, Mus musculus
ggaagagtacacagctccttccatc

SEQ ID NO: 319969 - DNA, 25 bp, Mus musculus
ggaagagtacacaggtgtgtgccat

SEQ ID NO: 319970 - DNA, 25 bp, Mus musculus
ggaagagtatatcgcggacctgtac

SEQ ID NO: 319971 - DNA, 25 bp, Mus musculus
ggaagagtattctttggtacaggtt

SEQ ID NO: 319972 - DNA, 25 bp, Mus musculus
ggaagagtgaggtgggccagacatc

SEQ ID NO: 319973 - DNA, 25 bp, Mus musculus
ggaagagttgcgagcgaatacagga

SEQ ID NO: 319974 - DNA, 25 bp, Mus musculus
ggaagagttgcgaggccaggtggtt

SEQ ID NO: 319975 - DNA, 25 bp, Mus musculus
ggaagataaaacagaaagagtagga

SEQ ID NO: 319976 - DNA, 25 bp, Mus musculus
ggaagataacaagactcagattagc

SEQ ID NO: 319977 - DNA, 25 bp, Mus musculus
ggaagatataaaggattctaaggtg

SEQ ID NO: 319978 - DNA, 25 bp, Mus musculus
ggaagatcaagaggtcagggccaaa

SEQ ID NO: 319979 - DNA, 25 bp, Mus musculus
ggaagatcagagatggacagcagca

SEQ ID NO: 319980 - DNA, 25 bp, Mus musculus
ggaagatcagagatgttactctcgt

SEQ ID NO: 319981 - DNA, 25 bp, Mus musculus
ggaagatctaagtacaccaaatgaa

SEQ ID NO: 319982 - DNA, 25 bp, Mus musculus
ggaagatctcgaaacggtaataagc

SEQ ID NO: 319983 - DNA, 25 bp, Mus musculus
ggaagatctcgaaacttcagaggat

SEQ ID NO: 319984 - DNA, 25 bp, Mus musculus
ggaagatcttctcagtcctagacca

SEQ ID NO: 319985 - DNA, 25 bp, Mus musculus
ggaagatcttgtggtcaagagcaat

SEQ ID NO: 319986 - DNA, 25 bp, Mus musculus
ggaagatgacagcctgtttgagctg

SEQ ID NO: 319987 - DNA, 25 bp, Mus musculus
ggaagatgaccgttcacctgcagat

SEQ ID NO: 319988 - DNA, 25 bp, Mus musculus
ggaagatgatgagtctgatgacagt

SEQ ID NO: 319989 - DNA, 25 bp, Mus musculus
ggaagatgcaagatgcagagagaaa

SEQ ID NO: 319990 - DNA, 25 bp, Mus musculus
ggaagatgcagaaattgctgcccgg

SEQ ID NO: 319991 - DNA, 25 bp, Mus musculus
ggaagatgcagaagttcctgctttg

SEQ ID NO: 319992 - DNA, 25 bp, Mus musculus
ggaagatgcccaggaaatagcagac

SEQ ID NO: 319993 - DNA, 25 bp, Mus musculus
ggaagatgcccaggtggctgctgag

SEQ ID NO: 319994 - DNA, 25 bp, Mus musculus
ggaagatgctagaagaatataaaaa

SEQ ID NO: 319995 - DNA, 25 bp, Mus musculus
ggaagatgctagaaggtcccttcag

SEQ ID NO: 319996 - DNA, 25 bp, Mus musculus
ggaagatggaggttccattttgggg

SEQ ID NO: 319997 - DNA, 25 bp, Mus musculus
ggaagatggcgctggcgatggagac

SEQ ID NO: 319998 - DNA, 25 bp, Mus musculus
ggaagatggtgcagattccatggag

SEQ ID NO: 319999 - DNA, 25 bp, Mus musculus
ggaagatgtcagttcatatggagag

SEQ ID NO: 320000 - DNA, 25 bp, Mus musculus
ggaagatgtcggtcaataggcttga

SEQ ID NO: 320001 - DNA, 25 bp, Mus musculus
ggaagatgtgccagcctgcccccaa

SEQ ID NO: 320002 - DNA, 25 bp, Mus musculus
ggaagattacaaagtgcgggtcgat

SEQ ID NO: 320003 - DNA, 25 bp, Mus musculus
ggaagattcattattgaagaagttc

SEQ ID NO: 320004 - DNA, 25 bp, Mus musculus
ggaagattcggatccctaccgtggt

SEQ ID NO: 320005 - DNA, 25 bp, Mus musculus
ggaagattcgggcttcagttgtgtt

SEQ ID NO: 320006 - DNA, 25 bp, Mus musculus
ggaagattgatgtcggcagctctgc

SEQ ID NO: 320007 - DNA, 25 bp, Mus musculus
ggaagattgtccagacggctgctct

SEQ ID NO: 320008 - DNA, 25 bp, Mus musculus
ggaagatttaaaaggtatgggtgag

SEQ ID NO: 320009 - DNA, 25 bp, Mus musculus
ggaagatttccagaggataacgaaa

SEQ ID NO: 320010 - DNA, 25 bp, Mus musculus
ggaagatttccgaactgaaagacaa

SEQ ID NO: 320011 - DNA, 25 bp, Mus musculus
ggaagcaaacattcgagatctattc

SEQ ID NO: 320012 - DNA, 25 bp, Mus musculus
ggaagcaaaggcaaagactctgagc

SEQ ID NO: 320013 - DNA, 25 bp, Mus musculus
ggaagcaaaggctcaagtcattctc

SEQ ID NO: 320014 - DNA, 25 bp, Mus musculus
ggaagcaacaaggctgagatggtag

SEQ ID NO: 320015 - DNA, 25 bp, Mus musculus
ggaagcaacgatagtatttttgaca

SEQ ID NO: 320016 - DNA, 25 bp, Mus musculus
ggaagcaagacccagatcctctctt

SEQ ID NO: 320017 - DNA, 25 bp, Mus musculus
ggaagcaagacccaggacctgttcc

SEQ ID NO: 320018 - DNA, 25 bp, Mus musculus
ggaagcaagaggttgcagaattcag

SEQ ID NO: 320019 - DNA, 25 bp, Mus musculus
ggaagcacaacagagacacagtgtc

SEQ ID NO: 320020 - DNA, 25 bp, Mus musculus
ggaagcacacaagcggatgaaggtt

SEQ ID NO: 320021 - DNA, 25 bp, Mus musculus
ggaagcacagaccagaagcccctgc

SEQ ID NO: 320022 - DNA, 25 bp, Mus musculus
ggaagcacagcgtggtcacctccag

SEQ ID NO: 320023 - DNA, 25 bp, Mus musculus
ggaagcacagctctggatgggtccc

SEQ ID NO: 320024 - DNA, 25 bp, Mus musculus
ggaagcacatccagaaggagcttgt

SEQ ID NO: 320025 - DNA, 25 bp, Mus musculus
ggaagcaccagctggaggaagagca

SEQ ID NO: 320026 - DNA, 25 bp, Mus musculus
ggaagcacctgccaatgttctctcg

SEQ ID NO: 320027 - DNA, 25 bp, Mus musculus
ggaagcacctgccattgtggctggg

SEQ ID NO: 320028 - DNA, 25 bp, Mus musculus
ggaagcaccttggtgaccagaatgg

SEQ ID NO: 320029 - DNA, 25 bp, Mus musculus
ggaagcactaacgtttgatccccag

SEQ ID NO: 320030 - DNA, 25 bp, Mus musculus
ggaagcactaactccagaactttcc

SEQ ID NO: 320031 - DNA, 25 bp, Mus musculus
ggaagcactggaggaggcagatgag

SEQ ID NO: 320032 - DNA, 25 bp, Mus musculus
ggaagcactggcaaggggaccagga

SEQ ID NO: 320033 - DNA, 25 bp, Mus musculus
ggaagcacttcaccagtaaaaagcc

SEQ ID NO: 320034 - DNA, 25 bp, Mus musculus
ggaagcagaagatgccatactccaa

SEQ ID NO: 320035 - DNA, 25 bp, Mus musculus
ggaagcagaatcgtatcgaattaaa

SEQ ID NO: 320036 - DNA, 25 bp, Mus musculus
ggaagcagaatcgttttggatccca

SEQ ID NO: 320037 - DNA, 25 bp, Mus musculus
ggaagcagactgcaggaaactacaa

SEQ ID NO: 320038 - DNA, 25 bp, Mus musculus
ggaagcagagaggagaaaaggagga

SEQ ID NO: 320039 - DNA, 25 bp, Mus musculus
ggaagcagagatgcccggaaccgcg

SEQ ID NO: 320040 - DNA, 25 bp, Mus musculus
ggaagcagagatggctatgaacggc

SEQ ID NO: 320041 - DNA, 25 bp, Mus musculus
ggaagcagagcgttggtcagactac

SEQ ID NO: 320042 - DNA, 25 bp, Mus musculus
ggaagcagaggatctctcagcatgg

SEQ ID NO: 320043 - DNA, 25 bp, Mus musculus
ggaagcagagggacctgtaccgccc

SEQ ID NO: 320044 - DNA, 25 bp, Mus musculus
ggaagcagagggctgagcccccgca

SEQ ID NO: 320045 - DNA, 25 bp, Mus musculus
ggaagcagagtcggagcagaagtgg

SEQ ID NO: 320046 - DNA, 25 bp, Mus musculus
ggaagcagctaaagactgtttttgt

SEQ ID NO: 320047 - DNA, 25 bp, Mus musculus
ggaagcagctaaagagaggatcacc

SEQ ID NO: 320048 - DNA, 25 bp, Mus musculus
ggaagcagctgccagactctgatag

SEQ ID NO: 320049 - DNA, 25 bp, Mus musculus
ggaagcagctggaggtggtcaagct

SEQ ID NO: 320050 - DNA, 25 bp, Mus musculus
ggaagcagctggagttgaactttct

SEQ ID NO: 320051 - DNA, 25 bp, Mus musculus
ggaagcaggcaacagatcagcacgg

SEQ ID NO: 320052 - DNA, 25 bp, Mus musculus
ggaagcagggaggtaaagcgttcgg

SEQ ID NO: 320053 - DNA, 25 bp, Mus musculus
ggaagcagtatgttgatgcaacgtg

SEQ ID NO: 320054 - DNA, 25 bp, Mus musculus
ggaagcagtatgttgatggagatca

SEQ ID NO: 320055 - DNA, 25 bp, Mus musculus
ggaagcatcagaaaggcaacatgtc

SEQ ID NO: 320056 - DNA, 25 bp, Mus musculus
ggaagcatggaaactagagagatgc

SEQ ID NO: 320057 - DNA, 25 bp, Mus musculus
ggaagcatggccgaccgcattccag

SEQ ID NO: 320058 - DNA, 25 bp, Mus musculus
ggaagcattctgggggtcaaccgga

SEQ ID NO: 320059 - DNA, 25 bp, Mus musculus
ggaagccaaaaagaagaagcactta

SEQ ID NO: 320060 - DNA, 25 bp, Mus musculus
ggaagccaaaaagagcaagaagcgg

SEQ ID NO: 320061 - DNA, 25 bp, Mus musculus
ggaagccaagatttcctggccatgg

SEQ ID NO: 320062 - DNA, 25 bp, Mus musculus
ggaagccaagatttctcagctgatg

SEQ ID NO: 320063 - DNA, 25 bp, Mus musculus
ggaagccaagggtgtaaattcccgg

SEQ ID NO: 320064 - DNA, 25 bp, Mus musculus
ggaagccaaggtgaaagccgccctc

SEQ ID NO: 320065 - DNA, 25 bp, Mus musculus
ggaagccaagttcaagcggtatgaa

SEQ ID NO: 320066 - DNA, 25 bp, Mus musculus
ggaagccaccttcagaatgaagagg

SEQ ID NO: 320067 - DNA, 25 bp, Mus musculus
ggaagccaccttcagtgattttata

SEQ ID NO: 320068 - DNA, 25 bp, Mus musculus
ggaagccacgctatggacgcactga

SEQ ID NO: 320069 - DNA, 25 bp, Mus musculus
ggaagccacgctatgggattccaac

SEQ ID NO: 320070 - DNA, 25 bp, Mus musculus
ggaagccagaaatggggctggtgtc

SEQ ID NO: 320071 - DNA, 25 bp, Mus musculus
ggaagccagagagggtctgcgagct

SEQ ID NO: 320072 - DNA, 25 bp, Mus musculus
ggaagccagataaaggatgccccag

SEQ ID NO: 320073 - DNA, 25 bp, Mus musculus
ggaagccaggagattagagtgggcc

SEQ ID NO: 320074 - DNA, 25 bp, Mus musculus
ggaagccaggagtgggcctgaggca

SEQ ID NO: 320075 - DNA, 25 bp, Mus musculus
ggaagccatggcaggacaaagagaa

SEQ ID NO: 320076 - DNA, 25 bp, Mus musculus
ggaagcccaccaggccatcatgatt

SEQ ID NO: 320077 - DNA, 25 bp, Mus musculus
ggaagcccagaagaaactgtggatg

SEQ ID NO: 320078 - DNA, 25 bp, Mus musculus
ggaagcccagcaggaggagactgca

SEQ ID NO: 320079 - DNA, 25 bp, Mus musculus
ggaagcccagcagggcagccaatga

SEQ ID NO: 320080 - DNA, 25 bp, Mus musculus
ggaagcccagcagtattcggaggcc

SEQ ID NO: 320081 - DNA, 25 bp, Mus musculus
ggaagcccagctcacaggaaggaga

SEQ ID NO: 320082 - DNA, 25 bp, Mus musculus
ggaagcccccaagttcctggccttc

SEQ ID NO: 320083 - DNA, 25 bp, Mus musculus
ggaagccctacactattaggaaacc

SEQ ID NO: 320084 - DNA, 25 bp, Mus musculus
ggaagccctacagaaacctgtggga

SEQ ID NO: 320085 - DNA, 25 bp, Mus musculus
ggaagccctagggcagaaaacaaaa

SEQ ID NO: 320086 - DNA, 25 bp, Mus musculus
ggaagccctcgatgccaattctcgg

SEQ ID NO: 320087 - DNA, 25 bp, Mus musculus
ggaagccctgaatgttctccctcct

SEQ ID NO: 320088 - DNA, 25 bp, Mus musculus
ggaagccctgaggtcacttggtcgc

SEQ ID NO: 320089 - DNA, 25 bp, Mus musculus
ggaagccctgaggtgtggttcccag

SEQ ID NO: 320090 - DNA, 25 bp, Mus musculus
ggaagccctggaggcactggttcca

SEQ ID NO: 320091 - DNA, 25 bp, Mus musculus
ggaagccctgtgacgaatggcacac

SEQ ID NO: 320092 - DNA, 25 bp, Mus musculus
ggaagcccttaccagcccagctttg

SEQ ID NO: 320093 - DNA, 25 bp, Mus musculus
ggaagccgaggaacgccgccactcc

SEQ ID NO: 320094 - DNA, 25 bp, Mus musculus
ggaagccgaggagctggaggagaaa

SEQ ID NO: 320095 - DNA, 25 bp, Mus musculus
ggaagccgaggtctgcattacattt

SEQ ID NO: 320096 - DNA, 25 bp, Mus musculus
ggaagccgcagtggtggaggtggat

SEQ ID NO: 320097 - DNA, 25 bp, Mus musculus
ggaagccgcgacatggcctcagtga

SEQ ID NO: 320098 - DNA, 25 bp, Mus musculus
ggaagccgcgccatggatttggtga

SEQ ID NO: 320099 - DNA, 25 bp, Mus musculus
ggaagccggataatgacggcgtgga

SEQ ID NO: 320100 - DNA, 25 bp, Mus musculus
ggaagccggataatgtgctagaatt

SEQ ID NO: 320101 - DNA, 25 bp, Mus musculus
ggaagccgtgccccggcagcccaac

SEQ ID NO: 320102 - DNA, 25 bp, Mus musculus
ggaagcctaaggatgatgctgttga

SEQ ID NO: 320103 - DNA, 25 bp, Mus musculus
ggaagcctcaggaactcaccccagg

SEQ ID NO: 320104 - DNA, 25 bp, Mus musculus
ggaagcctcaggctgtgggcgctga

SEQ ID NO: 320105 - DNA, 25 bp, Mus musculus
ggaagcctcagtgccactaagcctg

SEQ ID NO: 320106 - DNA, 25 bp, Mus musculus
ggaagcctctgagtcgcttcaaagt

SEQ ID NO: 320107 - DNA, 25 bp, Mus musculus
ggaagcctctggaattggaaatggg

SEQ ID NO: 320108 - DNA, 25 bp, Mus musculus
ggaagcctgagagtgaatgggcaag

SEQ ID NO: 320109 - DNA, 25 bp, Mus musculus
ggaagcctgagagtggtaatctttt

SEQ ID NO: 320110 - DNA, 25 bp, Mus musculus
ggaagcctggcaagggctactgaca

SEQ ID NO: 320111 - DNA, 25 bp, Mus musculus
ggaagcctgtgcccagtatagtgga

SEQ ID NO: 320112 - DNA, 25 bp, Mus musculus
ggaagccttggagaaaacagagaaa

SEQ ID NO: 320113 - DNA, 25 bp, Mus musculus
ggaagcgaaggcaaacttaaacaaa

SEQ ID NO: 320114 - DNA, 25 bp, Mus musculus
ggaagcgaatccgaaatgaagcaga

SEQ ID NO: 320115 - DNA, 25 bp, Mus musculus
ggaagcgaatccgtgaaatggccaa

SEQ ID NO: 320116 - DNA, 25 bp, Mus musculus
ggaagcgacatgcgtactgagcgct

SEQ ID NO: 320117 - DNA, 25 bp, Mus musculus
ggaagcgacatggtaagaatgattg

SEQ ID NO: 320118 - DNA, 25 bp, Mus musculus
ggaagcgagaagagaaaaggaacac

SEQ ID NO: 320119 - DNA, 25 bp, Mus musculus
ggaagcgagacagggactctgatgg

SEQ ID NO: 320120 - DNA, 25 bp, Mus musculus
ggaagcgaggccgaggttgcttcct

SEQ ID NO: 320121 - DNA, 25 bp, Mus musculus
ggaagcgagtgggcgtgtggaatgt

SEQ ID NO: 320122 - DNA, 25 bp, Mus musculus
ggaagcgcaacaggtcacctggagg

SEQ ID NO: 320123 - DNA, 25 bp, Mus musculus
ggaagcgcagaaccctgttctgcag

SEQ ID NO: 320124 - DNA, 25 bp, Mus musculus
ggaagcgcagcgagcaggacacaga

SEQ ID NO: 320125 - DNA, 25 bp, Mus musculus
ggaagcgcaggacacagaaaatatc

SEQ ID NO: 320126 - DNA, 25 bp, Mus musculus
ggaagcgccacacccccagaggaaa

SEQ ID NO: 320127 - DNA, 25 bp, Mus musculus
ggaagcggaggataggtcggccagt

SEQ ID NO: 320128 - DNA, 25 bp, Mus musculus
ggaagcggcggcgggttaacttcgg

SEQ ID NO: 320129 - DNA, 25 bp, Mus musculus
ggaagcggcggcgggttggagttca

SEQ ID NO: 320130 - DNA, 25 bp, Mus musculus
ggaagctaaaaatctggccgccccg

SEQ ID NO: 320131 - DNA, 25 bp, Mus musculus
ggaagctaaaagagcatgaaggaag

SEQ ID NO: 320132 - DNA, 25 bp, Mus musculus
ggaagctaagaaactgaggctcctt

SEQ ID NO: 320133 - DNA, 25 bp, Mus musculus
ggaagctaagctgtggtcctctaac

SEQ ID NO: 320134 - DNA, 25 bp, Mus musculus
ggaagctaatgcagtcccaccccct

SEQ ID NO: 320135 - DNA, 25 bp, Mus musculus
ggaagctactgggccgcgttggcct

SEQ ID NO: 320136 - DNA, 25 bp, Mus musculus
ggaagctagaccaactttgcagagt

SEQ ID NO: 320137 - DNA, 25 bp, Mus musculus
ggaagctatttaacattgaggcttg

SEQ ID NO: 320138 - DNA, 25 bp, Mus musculus
ggaagctcagatgctgcagttcgtg

SEQ ID NO: 320139 - DNA, 25 bp, Mus musculus
ggaagctccaaggcgtctgaatttc

SEQ ID NO: 320140 - DNA, 25 bp, Mus musculus
ggaagctcccagagggaattcctga

SEQ ID NO: 320141 - DNA, 25 bp, Mus musculus
ggaagctcctggagcaagaaaagca

SEQ ID NO: 320142 - DNA, 25 bp, Mus musculus
ggaagctcctggcggaggccatgaa

SEQ ID NO: 320143 - DNA, 25 bp, Mus musculus
ggaagctcctggcggatgccatgaa

SEQ ID NO: 320144 - DNA, 25 bp, Mus musculus
ggaagctgaaccaagtctgtgatga

SEQ ID NO: 320145 - DNA, 25 bp, Mus musculus
ggaagctgaggaaaccaatgtttta

SEQ ID NO: 320146 - DNA, 25 bp, Mus musculus
ggaagctgaggacctacctgtgcag

SEQ ID NO: 320147 - DNA, 25 bp, Mus musculus
ggaagctgaggaggtcataacttcc

SEQ ID NO: 320148 - DNA, 25 bp, Mus musculus
ggaagctgaggtctaatctcttggg

SEQ ID NO: 320149 - DNA, 25 bp, Mus musculus
ggaagctgcaggagtggcatctccc

SEQ ID NO: 320150 - DNA, 25 bp, Mus musculus
ggaagctgctatgcgtttctaatgt

SEQ ID NO: 320151 - DNA, 25 bp, Mus musculus
ggaagctgctgggcaccaagccaaa

SEQ ID NO: 320152 - DNA, 25 bp, Mus musculus
ggaagctggagggaagaagaagacc

SEQ ID NO: 320153 - DNA, 25 bp, Mus musculus
ggaagctggctctctgaacccccac

SEQ ID NO: 320154 - DNA, 25 bp, Mus musculus
ggaagctgtcagcattctgcctaca

SEQ ID NO: 320155 - DNA, 25 bp, Mus musculus
ggaagctgtcagtgggtttcaccag

SEQ ID NO: 320156 - DNA, 25 bp, Mus musculus
ggaagctgtcagttctgagaagtca

SEQ ID NO: 320157 - DNA, 25 bp, Mus musculus
ggaagctgtgctcagtagtcctatg

SEQ ID NO: 320158 - DNA, 25 bp, Mus musculus
ggaagcttattgtggggcatgaagg

SEQ ID NO: 320159 - DNA, 25 bp, Mus musculus
ggaagcttcagattataccgaaaag

SEQ ID NO: 320160 - DNA, 25 bp, Mus musculus
ggaagcttcagcgacagcagtctcc

SEQ ID NO: 320161 - DNA, 25 bp, Mus musculus
ggaagcttcaggctatgtctttcag

SEQ ID NO: 320162 - DNA, 25 bp, Mus musculus
ggaagctttgcagatctgaacgatg

SEQ ID NO: 320163 - DNA, 25 bp, Mus musculus
ggaagcttttagtacagagtcttgc

SEQ ID NO: 320164 - DNA, 25 bp, Mus musculus
ggaagcttttagtgccaaagcctca

SEQ ID NO: 320165 - DNA, 25 bp, Mus musculus
ggaagcttttagtgttgtaggaagt

SEQ ID NO: 320166 - DNA, 25 bp, Mus musculus
ggaaggaaaagaatgtggagaagaa

SEQ ID NO: 320167 - DNA, 25 bp, Mus musculus
ggaaggaaaagaggccttggaagat

SEQ ID NO: 320168 - DNA, 25 bp, Mus musculus
ggaaggaactatgctgttggctgct

SEQ ID NO: 320169 - DNA, 25 bp, Mus musculus
ggaaggaagaggtttatgggactgt

SEQ ID NO: 320170 - DNA, 25 bp, Mus musculus
ggaaggaagattgatgtcggcagct

SEQ ID NO: 320171 - DNA, 25 bp, Mus musculus
ggaaggaagggaggtgcatggagac

SEQ ID NO: 320172 - DNA, 25 bp, Mus musculus
ggaaggaagttctcctcggaccaga

SEQ ID NO: 320173 - DNA, 25 bp, Mus musculus
ggaaggaatggtgagccttcccggt

SEQ ID NO: 320174 - DNA, 25 bp, Mus musculus
ggaaggacaaggttgttgacctcct

SEQ ID NO: 320175 - DNA, 25 bp, Mus musculus
ggaaggacaggacagcaaggtactc

SEQ ID NO: 320176 - DNA, 25 bp, Mus musculus
ggaaggacaggttcaactggagagc

SEQ ID NO: 320177 - DNA, 25 bp, Mus musculus
ggaaggacatgaatgtgttaatatc

SEQ ID NO: 320178 - DNA, 25 bp, Mus musculus
ggaaggactgaccaggttccccagg

SEQ ID NO: 320179 - DNA, 25 bp, Mus musculus
ggaaggacttccggattaagcaatg

SEQ ID NO: 320180 - DNA, 25 bp, Mus musculus
ggaaggactttgggattttcagaaa

SEQ ID NO: 320181 - DNA, 25 bp, Mus musculus
ggaaggagaccggggaatcaaggat

SEQ ID NO: 320182 - DNA, 25 bp, Mus musculus
ggaaggagcagcaagctggggcttg

SEQ ID NO: 320183 - DNA, 25 bp, Mus musculus
ggaaggagcagctgcccagagcata

SEQ ID NO: 320184 - DNA, 25 bp, Mus musculus
ggaaggagcaggcctggcagaaccc

SEQ ID NO: 320185 - DNA, 25 bp, Mus musculus
ggaaggagctgactggccaatcaca

SEQ ID NO: 320186 - DNA, 25 bp, Mus musculus
ggaaggaggagagatactgttatct

SEQ ID NO: 320187 - DNA, 25 bp, Mus musculus
ggaaggaggagagcaataaactggt

SEQ ID NO: 320188 - DNA, 25 bp, Mus musculus
ggaaggaggagagcaccaatggaac

SEQ ID NO: 320189 - DNA, 25 bp, Mus musculus
ggaaggaggagaggctgtgacctct

SEQ ID NO: 320190 - DNA, 25 bp, Mus musculus
ggaaggaggagagttgctcttctgg

SEQ ID NO: 320191 - DNA, 25 bp, Mus musculus
ggaaggagggcagaatctagatctt

SEQ ID NO: 320192 - DNA, 25 bp, Mus musculus
ggaaggagtacgaggagattatgcg

SEQ ID NO: 320193 - DNA, 25 bp, Mus musculus
ggaaggagtccatggcaacgggcag

SEQ ID NO: 320194 - DNA, 25 bp, Mus musculus
ggaaggagttagaaacaggtgagaa

SEQ ID NO: 320195 - DNA, 25 bp, Mus musculus
ggaaggatcacgaggttgtacttgt

SEQ ID NO: 320196 - DNA, 25 bp, Mus musculus
ggaaggatgaagattcctatcacat

SEQ ID NO: 320197 - DNA, 25 bp, Mus musculus
ggaaggatgatgagctgaactttga

SEQ ID NO: 320198 - DNA, 25 bp, Mus musculus
ggaaggattagatctgccacctccc

SEQ ID NO: 320199 - DNA, 25 bp, Mus musculus
ggaaggcaaattcgtgattactggc

SEQ ID NO: 320200 - DNA, 25 bp, Mus musculus
ggaaggcaacaagatgaagaacaac

SEQ ID NO: 320201 - DNA, 25 bp, Mus musculus
ggaaggcaacaaggatgctacagct

SEQ ID NO: 320202 - DNA, 25 bp, Mus musculus
ggaaggcaagaagagacttgaggct

SEQ ID NO: 320203 - DNA, 25 bp, Mus musculus
ggaaggcaaggatagcatccatgtc

SEQ ID NO: 320204 - DNA, 25 bp, Mus musculus
ggaaggcaaggatagggagcgcctc

SEQ ID NO: 320205 - DNA, 25 bp, Mus musculus
ggaaggcaaggccaagaacgccctg

SEQ ID NO: 320206 - DNA, 25 bp, Mus musculus
ggaaggcagaaggtgatgtgggtcc

SEQ ID NO: 320207 - DNA, 25 bp, Mus musculus
ggaaggcagaggaggcattatgaga

SEQ ID NO: 320208 - DNA, 25 bp, Mus musculus
ggaaggcagaggcaggcgtgcccac

SEQ ID NO: 320209 - DNA, 25 bp, Mus musculus
ggaaggcagcactggattcccggtc

SEQ ID NO: 320210 - DNA, 25 bp, Mus musculus
ggaaggcatctggcacacctctata

SEQ ID NO: 320211 - DNA, 25 bp, Mus musculus
ggaaggcatctgggagggacattgc

SEQ ID NO: 320212 - DNA, 25 bp, Mus musculus
ggaaggcatgggtcccgagcattcc

SEQ ID NO: 320213 - DNA, 25 bp, Mus musculus
ggaaggccaatgtgggaagcaaagc

SEQ ID NO: 320214 - DNA, 25 bp, Mus musculus
ggaaggccagggtcatttctctgca

SEQ ID NO: 320215 - DNA, 25 bp, Mus musculus
ggaaggcctgaggagcttttcatgc

SEQ ID NO: 320216 - DNA, 25 bp, Mus musculus
ggaaggcctgtgagtgctgccgacc

SEQ ID NO: 320217 - DNA, 25 bp, Mus musculus
ggaaggcgaagatgagcgttcggcc

SEQ ID NO: 320218 - DNA, 25 bp, Mus musculus
ggaaggctcatagacagggtttctc

SEQ ID NO: 320219 - DNA, 25 bp, Mus musculus
ggaaggctcataggccaaactcaag

SEQ ID NO: 320220 - DNA, 25 bp, Mus musculus
ggaaggctctggagatggcaggttc

SEQ ID NO: 320221 - DNA, 25 bp, Mus musculus
ggaaggctgggttcctgaatgccac

SEQ ID NO: 320222 - DNA, 25 bp, Mus musculus
ggaaggcttcgttccttgcgcgctg

SEQ ID NO: 320223 - DNA, 25 bp, Mus musculus
ggaaggcttgccactttcctaaata

SEQ ID NO: 320224 - DNA, 25 bp, Mus musculus
ggaaggctttccagccatggccatg

SEQ ID NO: 320225 - DNA, 25 bp, Mus musculus
ggaaggctttccagctccagcacct

SEQ ID NO: 320226 - DNA, 25 bp, Mus musculus
ggaagggaagggatgcatgggcatg

SEQ ID NO: 320227 - DNA, 25 bp, Mus musculus
ggaagggaagggctcgggtccgcac

SEQ ID NO: 320228 - DNA, 25 bp, Mus musculus
ggaagggaagttcttccatcagtgt

SEQ ID NO: 320229 - DNA, 25 bp, Mus musculus
ggaagggactatattgatcagtgga

SEQ ID NO: 320230 - DNA, 25 bp, Mus musculus
ggaagggagctctggatgctgaatg

SEQ ID NO: 320231 - DNA, 25 bp, Mus musculus
ggaagggagctctgggaattaacaa

SEQ ID NO: 320232 - DNA, 25 bp, Mus musculus
ggaagggaggtgcatggagactcag

SEQ ID NO: 320233 - DNA, 25 bp, Mus musculus
ggaagggattgaccgacgcctcttc

SEQ ID NO: 320234 - DNA, 25 bp, Mus musculus
ggaagggcataggcagccacctaga

SEQ ID NO: 320235 - DNA, 25 bp, Mus musculus
ggaagggcatcaggcggtatgaata

SEQ ID NO: 320236 - DNA, 25 bp, Mus musculus
ggaagggcgggtcagcaagctccgg

SEQ ID NO: 320237 - DNA, 25 bp, Mus musculus
ggaagggcgggtcagcggccctgtg

SEQ ID NO: 320238 - DNA, 25 bp, Mus musculus
ggaagggcgtcttagatgacgtggt

SEQ ID NO: 320239 - DNA, 25 bp, Mus musculus
ggaagggctcagccagagtaacagt

SEQ ID NO: 320240 - DNA, 25 bp, Mus musculus
ggaaggggaaggtgatctgagcatc

SEQ ID NO: 320241 - DNA, 25 bp, Mus musculus
ggaaggggagtgggctcacccgaga

SEQ ID NO: 320242 - DNA, 25 bp, Mus musculus
ggaaggggctccaggcagaagcgat

SEQ ID NO: 320243 - DNA, 25 bp, Mus musculus
ggaagggttgggaaggttctggctg

SEQ ID NO: 320244 - DNA, 25 bp, Mus musculus
ggaaggtaaagatacacctatggct

SEQ ID NO: 320245 - DNA, 25 bp, Mus musculus
ggaaggtcaagtcactggtgacgct

SEQ ID NO: 320246 - DNA, 25 bp, Mus musculus
ggaaggtccagagaaggcaagctgg

SEQ ID NO: 320247 - DNA, 25 bp, Mus musculus
ggaaggtccaggacctcagacaaga

SEQ ID NO: 320248 - DNA, 25 bp, Mus musculus
ggaaggtcccggagcatgcaaaaca

SEQ ID NO: 320249 - DNA, 25 bp, Mus musculus
ggaaggtcccggagcatgcattctt

SEQ ID NO: 320250 - DNA, 25 bp, Mus musculus
ggaaggtcccggattgaaaagatga

SEQ ID NO: 320251 - DNA, 25 bp, Mus musculus
ggaaggtgctgctggaggcccggac

SEQ ID NO: 320252 - DNA, 25 bp, Mus musculus
ggaaggtggagaagctcaaggcaag

SEQ ID NO: 320253 - DNA, 25 bp, Mus musculus
ggaaggtggaggtgtggtacatcca

SEQ ID NO: 320254 - DNA, 25 bp, Mus musculus
ggaagtaaagcttgttttcaggcaa

SEQ ID NO: 320255 - DNA, 25 bp, Mus musculus
ggaagtaaaggtcaccttggctgtg

SEQ ID NO: 320256 - DNA, 25 bp, Mus musculus
ggaagtaacagacctgaccaaagtc

SEQ ID NO: 320257 - DNA, 25 bp, Mus musculus
ggaagtaacagactttgcatgaagt

SEQ ID NO: 320258 - DNA, 25 bp, Mus musculus
ggaagtaacctaggtctgctgcagg

SEQ ID NO: 320259 - DNA, 25 bp, Mus musculus
ggaagtacaaataatctgcaggaca

SEQ ID NO: 320260 - DNA, 25 bp, Mus musculus
ggaagtacccggacagagagagatg

SEQ ID NO: 320261 - DNA, 25 bp, Mus musculus
ggaagtactgcgaagatgtcaatga

SEQ ID NO: 320262 - DNA, 25 bp, Mus musculus
ggaagtagacacctacatacagact

SEQ ID NO: 320263 - DNA, 25 bp, Mus musculus
ggaagtagagccgccatgactaccc

SEQ ID NO: 320264 - DNA, 25 bp, Mus musculus
ggaagtagcctccggctatgcatat

SEQ ID NO: 320265 - DNA, 25 bp, Mus musculus
ggaagtagctaaaacattctcatac

SEQ ID NO: 320266 - DNA, 25 bp, Mus musculus
ggaagtataactcagggaatgggac

SEQ ID NO: 320267 - DNA, 25 bp, Mus musculus
ggaagtatattacaggattcactag

SEQ ID NO: 320268 - DNA, 25 bp, Mus musculus
ggaagtatattgcaggattcactag

SEQ ID NO: 320269 - DNA, 25 bp, Mus musculus
ggaagtatgaagaggtggcccgtaa

SEQ ID NO: 320270 - DNA, 25 bp, Mus musculus
ggaagtatgaagaggtggctcgtaa

SEQ ID NO: 320271 - DNA, 25 bp, Mus musculus
ggaagtatgacccacagggctctct

SEQ ID NO: 320272 - DNA, 25 bp, Mus musculus
ggaagtatggatgggtacctggaat

SEQ ID NO: 320273 - DNA, 25 bp, Mus musculus
ggaagtatttctggcctcggattac

SEQ ID NO: 320274 - DNA, 25 bp, Mus musculus
ggaagtatttgatcctgtgcccaag

SEQ ID NO: 320275 - DNA, 25 bp, Mus musculus
ggaagtatttgccagatcttctgga

SEQ ID NO: 320276 - DNA, 25 bp, Mus musculus
ggaagtcaaaaggatcgtcagtggc

SEQ ID NO: 320277 - DNA, 25 bp, Mus musculus
ggaagtcactgccaggtatgtgaag

SEQ ID NO: 320278 - DNA, 25 bp, Mus musculus
ggaagtcagtcagctttccctgctg

SEQ ID NO: 320279 - DNA, 25 bp, Mus musculus
ggaagtcagtcaggtcagctttggc

SEQ ID NO: 320280 - DNA, 25 bp, Mus musculus
ggaagtcagtgaaaaaaaattcaag

SEQ ID NO: 320281 - DNA, 25 bp, Mus musculus
ggaagtcagtgaaaaaattgtacaa

SEQ ID NO: 320282 - DNA, 25 bp, Mus musculus
ggaagtcatattcagagcctcagct

SEQ ID NO: 320283 - DNA, 25 bp, Mus musculus
ggaagtccaagaagaggagaaacca

SEQ ID NO: 320284 - DNA, 25 bp, Mus musculus
ggaagtccaagaagatgctgtcgcc

SEQ ID NO: 320285 - DNA, 25 bp, Mus musculus
ggaagtcccaggctctgtgtgagtg

SEQ ID NO: 320286 - DNA, 25 bp, Mus musculus
ggaagtccgagaaggaaaagtggtc

SEQ ID NO: 320287 - DNA, 25 bp, Mus musculus
ggaagtccgagaaggcctgtgtggg

SEQ ID NO: 320288 - DNA, 25 bp, Mus musculus
ggaagtccgcgagtggggttgcggc

SEQ ID NO: 320289 - DNA, 25 bp, Mus musculus
ggaagtccggcagtaggacagtcct

SEQ ID NO: 320290 - DNA, 25 bp, Mus musculus
ggaagtccggcggtagccaccaaga

SEQ ID NO: 320291 - DNA, 25 bp, Mus musculus
ggaagtccttaaggtgcagacccac

SEQ ID NO: 320292 - DNA, 25 bp, Mus musculus
ggaagtccttacagcaaattgctgt

SEQ ID NO: 320293 - DNA, 25 bp, Mus musculus
ggaagtccttacagttttaagtgga

SEQ ID NO: 320294 - DNA, 25 bp, Mus musculus
ggaagtcgccacgcgagcaagctct

SEQ ID NO: 320295 - DNA, 25 bp, Mus musculus
ggaagtcgctgatgaggagactgct

SEQ ID NO: 320296 - DNA, 25 bp, Mus musculus
ggaagtcggcttaggagccacatat

SEQ ID NO: 320297 - DNA, 25 bp, Mus musculus
ggaagtcggtgtgttatctctgatg

SEQ ID NO: 320298 - DNA, 25 bp, Mus musculus
ggaagtctcaggtgtcggtgacgtt

SEQ ID NO: 320299 - DNA, 25 bp, Mus musculus
ggaagtctgcactggaaccacctga

SEQ ID NO: 320300 - DNA, 25 bp, Mus musculus
ggaagtctgcagtgccggtgccccc

SEQ ID NO: 320301 - DNA, 25 bp, Mus musculus
ggaagtctggaagaccaccagactg

SEQ ID NO: 320302 - DNA, 25 bp, Mus musculus
ggaagtcttcattgtcagtcaggga

SEQ ID NO: 320303 - DNA, 25 bp, Mus musculus
ggaagtgaagaacccagattccaaa

SEQ ID NO: 320304 - DNA, 25 bp, Mus musculus
ggaagtgaagcccctgcccggatgg

SEQ ID NO: 320305 - DNA, 25 bp, Mus musculus
ggaagtgaaggcctgaaccaaaatg

SEQ ID NO: 320306 - DNA, 25 bp, Mus musculus
ggaagtgaagggggaggtgaccatc

SEQ ID NO: 320307 - DNA, 25 bp, Mus musculus
ggaagtgaagtgttgaagaaagtca

SEQ ID NO: 320308 - DNA, 25 bp, Mus musculus
ggaagtgacgagagctgtcggccat

SEQ ID NO: 320309 - DNA, 25 bp, Mus musculus
ggaagtgagggaagatggagatatt

SEQ ID NO: 320310 - DNA, 25 bp, Mus musculus
ggaagtgattccaggttcagtacct

SEQ ID NO: 320311 - DNA, 25 bp, Mus musculus
ggaagtgcaaaggaggtgttttagc

SEQ ID NO: 320312 - DNA, 25 bp, Mus musculus
ggaagtgcaggagaaagacgaaact

SEQ ID NO: 320313 - DNA, 25 bp, Mus musculus
ggaagtgcataggaggagcttcctg

SEQ ID NO: 320314 - DNA, 25 bp, Mus musculus
ggaagtgcataggagtggctgctac

SEQ ID NO: 320315 - DNA, 25 bp, Mus musculus
ggaagtgccaggatcacaacgaatg

SEQ ID NO: 320316 - DNA, 25 bp, Mus musculus
ggaagtgccaggttcacaacgaatg

SEQ ID NO: 320317 - DNA, 25 bp, Mus musculus
ggaagtgctccaaggatcgtggagt

SEQ ID NO: 320318 - DNA, 25 bp, Mus musculus
ggaagtgctgaaggcagggaagcgg

SEQ ID NO: 320319 - DNA, 25 bp, Mus musculus
ggaagtgctgataggatccacgcac

SEQ ID NO: 320320 - DNA, 25 bp, Mus musculus
ggaagtgctggaaagcacagaactt

SEQ ID NO: 320321 - DNA, 25 bp, Mus musculus
ggaagtgctggttcctacagcaccc

SEQ ID NO: 320322 - DNA, 25 bp, Mus musculus
ggaagtggaaagcgtgactccagaa

SEQ ID NO: 320323 - DNA, 25 bp, Mus musculus
ggaagtggagagggaccttcttcac

SEQ ID NO: 320324 - DNA, 25 bp, Mus musculus
ggaagtggaggcagagttcctcagg

SEQ ID NO: 320325 - DNA, 25 bp, Mus musculus
ggaagtggagggactgaacttttga

SEQ ID NO: 320326 - DNA, 25 bp, Mus musculus
ggaagtggaggtggaggaatgtgtg

SEQ ID NO: 320327 - DNA, 25 bp, Mus musculus
ggaagtggatcgcggggtcccagct

SEQ ID NO: 320328 - DNA, 25 bp, Mus musculus
ggaagtggcagcatgctaattccac

SEQ ID NO: 320329 - DNA, 25 bp, Mus musculus
ggaagtgggcaggcacccagcggaa

SEQ ID NO: 320330 - DNA, 25 bp, Mus musculus
ggaagtgggcagggtgaagtgtgtc

SEQ ID NO: 320331 - DNA, 25 bp, Mus musculus
ggaagtgggctgcggtatcagccta

SEQ ID NO: 320332 - DNA, 25 bp, Mus musculus
ggaagtggtataggatcttgaaaca

SEQ ID NO: 320333 - DNA, 25 bp, Mus musculus
ggaagtggtgggagccctatgctgc

SEQ ID NO: 320334 - DNA, 25 bp, Mus musculus
ggaagtgtaagcccggccgaattcg

SEQ ID NO: 320335 - DNA, 25 bp, Mus musculus
ggaagtgtactggataagaacaaga

SEQ ID NO: 320336 - DNA, 25 bp, Mus musculus
ggaagtgtatccaggctttaagcac

SEQ ID NO: 320337 - DNA, 25 bp, Mus musculus
ggaagtgtatccagggaccaccaca

SEQ ID NO: 320338 - DNA, 25 bp, Mus musculus
ggaagtgtatccagggataatcttg

SEQ ID NO: 320339 - DNA, 25 bp, Mus musculus
ggaagtgtccaggtgtaaccagcca

SEQ ID NO: 320340 - DNA, 25 bp, Mus musculus
ggaagtgtcgccagagaaacaataa

SEQ ID NO: 320341 - DNA, 25 bp, Mus musculus
ggaagtgtcgcttccaacagtgttc

SEQ ID NO: 320342 - DNA, 25 bp, Mus musculus
ggaagtgtctatggacgaccataaa

SEQ ID NO: 320343 - DNA, 25 bp, Mus musculus
ggaagtgtgtggacatcaatgagtg

SEQ ID NO: 320344 - DNA, 25 bp, Mus musculus
ggaagttaaagcacggtttgctccc

SEQ ID NO: 320345 - DNA, 25 bp, Mus musculus
ggaagttacaatccaagtaaacgcc

SEQ ID NO: 320346 - DNA, 25 bp, Mus musculus
ggaagttactccgagatgccgcgcc

SEQ ID NO: 320347 - DNA, 25 bp, Mus musculus
ggaagttcaaggactcccttacttt

SEQ ID NO: 320348 - DNA, 25 bp, Mus musculus
ggaagttcacaagataaccaacaac

SEQ ID NO: 320349 - DNA, 25 bp, Mus musculus
ggaagttcacaaggaatgtatcatt

SEQ ID NO: 320350 - DNA, 25 bp, Mus musculus
ggaagttcaggcagctgtgctcact

SEQ ID NO: 320351 - DNA, 25 bp, Mus musculus
ggaagttcaggcaggtaatgccatc

SEQ ID NO: 320352 - DNA, 25 bp, Mus musculus
ggaagttcaggcctggtgatgagca

SEQ ID NO: 320353 - DNA, 25 bp, Mus musculus
ggaagttccagggatccttgtgggc

SEQ ID NO: 320354 - DNA, 25 bp, Mus musculus
ggaagttccaggtctggaggctcat

SEQ ID NO: 320355 - DNA, 25 bp, Mus musculus
ggaagttccgattaatggaacggcg

SEQ ID NO: 320356 - DNA, 25 bp, Mus musculus
ggaagttcgtggaaggcaagaagaa

SEQ ID NO: 320357 - DNA, 25 bp, Mus musculus
ggaagttcgtggaaggggaagacag

SEQ ID NO: 320358 - DNA, 25 bp, Mus musculus
ggaagttcgtggaagggtggctggc

SEQ ID NO: 320359 - DNA, 25 bp, Mus musculus
ggaagttctacaggcacatcatctt

SEQ ID NO: 320360 - DNA, 25 bp, Mus musculus
ggaagttctttccttgcggaatata

SEQ ID NO: 320361 - DNA, 25 bp, Mus musculus
ggaagttctttcgttgcggaatata

SEQ ID NO: 320362 - DNA, 25 bp, Mus musculus
ggaagttgactgagcacgtgagtgc

SEQ ID NO: 320363 - DNA, 25 bp, Mus musculus
ggaagttgagaatgaaaagtcccca

SEQ ID NO: 320364 - DNA, 25 bp, Mus musculus
ggaagttgagaatttcaggaattga

SEQ ID NO: 320365 - DNA, 25 bp, Mus musculus
ggaagttgagcggcggctggtaaga

SEQ ID NO: 320366 - DNA, 25 bp, Mus musculus
ggaagttgaggtttaatagtcttgc

SEQ ID NO: 320367 - DNA, 25 bp, Mus musculus
ggaagttggtaaagagcatcataag

SEQ ID NO: 320368 - DNA, 25 bp, Mus musculus
ggaagttggttgggtgaatttcatg

SEQ ID NO: 320369 - DNA, 25 bp, Mus musculus
ggaagttgttggagacaaagctggc

SEQ ID NO: 320370 - DNA, 25 bp, Mus musculus
ggaagttgttggcagagaactgata

SEQ ID NO: 320371 - DNA, 25 bp, Mus musculus
ggaagttgttggcaggtattcaata

SEQ ID NO: 320372 - DNA, 25 bp, Mus musculus
ggaagtttgagaaatcagggatgtg

SEQ ID NO: 320373 - DNA, 25 bp, Mus musculus
ggaagtttgtgaatgattcccatca

SEQ ID NO: 320374 - DNA, 25 bp, Mus musculus
ggaagttttttgggcattgttgtga

SEQ ID NO: 320375 - DNA, 25 bp, Mus musculus
ggaagttttttggttgcaaggaagc

SEQ ID NO: 320376 - DNA, 25 bp, Mus musculus
ggaataaaaattgggatgaatgggt

SEQ ID NO: 320377 - DNA, 25 bp, Mus musculus
ggaataaagaaaggtgaccagaatg

SEQ ID NO: 320378 - DNA, 25 bp, Mus musculus
ggaataacactgcagaggactagag

SEQ ID NO: 320379 - DNA, 25 bp, Mus musculus
ggaataacactgcagggtctccaac

SEQ ID NO: 320380 - DNA, 25 bp, Mus musculus
ggaataagaccagatcatctttaga

SEQ ID NO: 320381 - DNA, 25 bp, Mus musculus
ggaataagagctcagtaagttctat

SEQ ID NO: 320382 - DNA, 25 bp, Mus musculus
ggaataagatgaggtcctccacctt

SEQ ID NO: 320383 - DNA, 25 bp, Mus musculus
ggaataagcagcctcaaaatgcagc

SEQ ID NO: 320384 - DNA, 25 bp, Mus musculus
ggaataataaaaagtgctctatgcc

SEQ ID NO: 320385 - DNA, 25 bp, Mus musculus
ggaataatcacactgaagtgatccc

SEQ ID NO: 320386 - DNA, 25 bp, Mus musculus
ggaataatgatacctcgttcgtgtc

SEQ ID NO: 320387 - DNA, 25 bp, Mus musculus
ggaataattgtgaggatgaagtttc

SEQ ID NO: 320388 - DNA, 25 bp, Mus musculus
ggaatacacagcagggcatcagccg

SEQ ID NO: 320389 - DNA, 25 bp, Mus musculus
ggaatacacagcctgcataccatga

SEQ ID NO: 320390 - DNA, 25 bp, Mus musculus
ggaatacacaggtgaactgtgtgag

SEQ ID NO: 320391 - DNA, 25 bp, Mus musculus
ggaatacactgcatctatattggaa

SEQ ID NO: 320392 - DNA, 25 bp, Mus musculus
ggaataccaggaaaatagtgatgtt

SEQ ID NO: 320393 - DNA, 25 bp, Mus musculus
ggaataccaggaaatgataatgcag

SEQ ID NO: 320394 - DNA, 25 bp, Mus musculus
ggaatacctaagctttctccagacc

SEQ ID NO: 320395 - DNA, 25 bp, Mus musculus
ggaatacctaagtagtgttggagtg

SEQ ID NO: 320396 - DNA, 25 bp, Mus musculus
ggaatacctagcaggtcctcatggg

SEQ ID NO: 320397 - DNA, 25 bp, Mus musculus
ggaatacgagaaagccctgcaggaa

SEQ ID NO: 320398 - DNA, 25 bp, Mus musculus
ggaatacgcatgggatgccaatgaa

SEQ ID NO: 320399 - DNA, 25 bp, Mus musculus
ggaatacgtgaagttctccaaggag

SEQ ID NO: 320400 - DNA, 25 bp, Mus musculus
ggaatactgtttggcatggctgcca

SEQ ID NO: 320401 - DNA, 25 bp, Mus musculus
ggaatagaaggctatcctacctaca

SEQ ID NO: 320402 - DNA, 25 bp, Mus musculus
ggaatagagggaaacaggccaccat

SEQ ID NO: 320403 - DNA, 25 bp, Mus musculus
ggaataggcgaggacgcggacctca

SEQ ID NO: 320404 - DNA, 25 bp, Mus musculus
ggaatagtgtgataattggcctttt

SEQ ID NO: 320405 - DNA, 25 bp, Mus musculus
ggaatagtgtgtgcagcttatgatg

SEQ ID NO: 320406 - DNA, 25 bp, Mus musculus
ggaatatacagctggcagggaagct

SEQ ID NO: 320407 - DNA, 25 bp, Mus musculus
ggaatatataaagaggcttgcacag

SEQ ID NO: 320408 - DNA, 25 bp, Mus musculus
ggaatatatacgggttctccttgct

SEQ ID NO: 320409 - DNA, 25 bp, Mus musculus
ggaatatatgtatatactgccccgg

SEQ ID NO: 320410 - DNA, 25 bp, Mus musculus
ggaatatcagaagtgacagacagga

SEQ ID NO: 320411 - DNA, 25 bp, Mus musculus
ggaatatgaagtatggatggaagaa

SEQ ID NO: 320412 - DNA, 25 bp, Mus musculus
ggaatatgtagatttgggtatccgg

SEQ ID NO: 320413 - DNA, 25 bp, Mus musculus
ggaatatgtcaacagaattccagag

SEQ ID NO: 320414 - DNA, 25 bp, Mus musculus
ggaatatgtcaacagcccagaaggc

SEQ ID NO: 320415 - DNA, 25 bp, Mus musculus
ggaatatgtcaacaggacccacagt

SEQ ID NO: 320416 - DNA, 25 bp, Mus musculus
ggaatatgttctcatccagagcctt

SEQ ID NO: 320417 - DNA, 25 bp, Mus musculus
ggaatattgaagtacttggttttaa

SEQ ID NO: 320418 - DNA, 25 bp, Mus musculus
ggaatcaaaaatcagataacaacta

SEQ ID NO: 320419 - DNA, 25 bp, Mus musculus
ggaatcaaaaatcagataagaaacc

SEQ ID NO: 320420 - DNA, 25 bp, Mus musculus
ggaatcacactattgggatggaaga

SEQ ID NO: 320421 - DNA, 25 bp, Mus musculus
ggaatcacactattggtcctgagtt

SEQ ID NO: 320422 - DNA, 25 bp, Mus musculus
ggaatcacaggccaactactgtatg

SEQ ID NO: 320423 - DNA, 25 bp, Mus musculus
ggaatcacatggatgaaaaaaagga

SEQ ID NO: 320424 - DNA, 25 bp, Mus musculus
ggaatcacatggatggtgttctcgg

SEQ ID NO: 320425 - DNA, 25 bp, Mus musculus
ggaatcactccgacacctcctgccc

SEQ ID NO: 320426 - DNA, 25 bp, Mus musculus
ggaatcactgcccatagaactagat

SEQ ID NO: 320427 - DNA, 25 bp, Mus musculus
ggaatcagacttcagatctgttgaa

SEQ ID NO: 320428 - DNA, 25 bp, Mus musculus
ggaatcagtctttaagtgccttcag

SEQ ID NO: 320429 - DNA, 25 bp, Mus musculus
ggaatcagtggcaacagtaccattc

SEQ ID NO: 320430 - DNA, 25 bp, Mus musculus
ggaatcatacatgacgcctttgact

SEQ ID NO: 320431 - DNA, 25 bp, Mus musculus
ggaatcatgacagaacagccttgtc

SEQ ID NO: 320432 - DNA, 25 bp, Mus musculus
ggaatcatgacaggcccattcttcc

SEQ ID NO: 320433 - DNA, 25 bp, Mus musculus
ggaatcatggggaaaagtgcgcaaa

SEQ ID NO: 320434 - DNA, 25 bp, Mus musculus
ggaatccacgttctagattggccgt

SEQ ID NO: 320435 - DNA, 25 bp, Mus musculus
ggaatccacgttctaggctcctgtg

SEQ ID NO: 320436 - DNA, 25 bp, Mus musculus
ggaatccagagatcattgatagtct

SEQ ID NO: 320437 - DNA, 25 bp, Mus musculus
ggaatccagatcaaggttccaggag

SEQ ID NO: 320438 - DNA, 25 bp, Mus musculus
ggaatccagatgactgcagtcaagg

SEQ ID NO: 320439 - DNA, 25 bp, Mus musculus
ggaatcccaccaagctctctgctgg

SEQ ID NO: 320440 - DNA, 25 bp, Mus musculus
ggaatccccaccaggacctgcaagc

SEQ ID NO: 320441 - DNA, 25 bp, Mus musculus
ggaatccccagttcttagaccctgt

SEQ ID NO: 320442 - DNA, 25 bp, Mus musculus
ggaatccccatgatgaatcagcaga

SEQ ID NO: 320443 - DNA, 25 bp, Mus musculus
ggaatccctgagatcaaaaccatcc

SEQ ID NO: 320444 - DNA, 25 bp, Mus musculus
ggaatcctcacagccaacgaggtga

SEQ ID NO: 320445 - DNA, 25 bp, Mus musculus
ggaatcctcagctgtcgagaaaccc

SEQ ID NO: 320446 - DNA, 25 bp, Mus musculus
ggaatcctcaggtatcagagaagaa

SEQ ID NO: 320447 - DNA, 25 bp, Mus musculus
ggaatcctcaggttcctgccctcct

SEQ ID NO: 320448 - DNA, 25 bp, Mus musculus
ggaatcctgaggctccagccaggct

SEQ ID NO: 320449 - DNA, 25 bp, Mus musculus
ggaatcctggacagaaccagctcct

SEQ ID NO: 320450 - DNA, 25 bp, Mus musculus
ggaatcctgtgtctccaatcgtgga

SEQ ID NO: 320451 - DNA, 25 bp, Mus musculus
ggaatccttgaaagccctctgggcg

SEQ ID NO: 320452 - DNA, 25 bp, Mus musculus
ggaatcctttttgtgttcttgggag

SEQ ID NO: 320453 - DNA, 25 bp, Mus musculus
ggaatcgcaacaaactgacaagaga

SEQ ID NO: 320454 - DNA, 25 bp, Mus musculus
ggaatcgcaaggacagatccagaaa

SEQ ID NO: 320455 - DNA, 25 bp, Mus musculus
ggaatcgcaggaaaccaacagaacc

SEQ ID NO: 320456 - DNA, 25 bp, Mus musculus
ggaatcgcaggactgtgcctggaat

SEQ ID NO: 320457 - DNA, 25 bp, Mus musculus
ggaatcgcagttactgtgggaaagc

SEQ ID NO: 320458 - DNA, 25 bp, Mus musculus
ggaatcgccgagaggaaccaagatg

SEQ ID NO: 320459 - DNA, 25 bp, Mus musculus
ggaatcgcgcgcgggggtgttccct

SEQ ID NO: 320460 - DNA, 25 bp, Mus musculus
ggaatcggaaccagttccctcagcc

SEQ ID NO: 320461 - DNA, 25 bp, Mus musculus
ggaatcggaaggcaggagagtatgg

SEQ ID NO: 320462 - DNA, 25 bp, Mus musculus
ggaatctaagaaggctacaaggtgg

SEQ ID NO: 320463 - DNA, 25 bp, Mus musculus
ggaatctaggagcccaccttgggac

SEQ ID NO: 320464 - DNA, 25 bp, Mus musculus
ggaatctcaaaaaggttactgcagg

SEQ ID NO: 320465 - DNA, 25 bp, Mus musculus
ggaatctcaacacctcacgaagggg

SEQ ID NO: 320466 - DNA, 25 bp, Mus musculus
ggaatctcaggcaaaacccatttat

SEQ ID NO: 320467 - DNA, 25 bp, Mus musculus
ggaatctccctgagcaagagtgggt

SEQ ID NO: 320468 - DNA, 25 bp, Mus musculus
ggaatctccgaaatcccgcaaggta

SEQ ID NO: 320469 - DNA, 25 bp, Mus musculus
ggaatctccggtcccgcacaccatg

SEQ ID NO: 320470 - DNA, 25 bp, Mus musculus
ggaatctgaattcagaggaggtggc

SEQ ID NO: 320471 - DNA, 25 bp, Mus musculus
ggaatcttaaaagaggtctggaaga

SEQ ID NO: 320472 - DNA, 25 bp, Mus musculus
ggaatcttgacaagtggagagtaca

SEQ ID NO: 320473 - DNA, 25 bp, Mus musculus
ggaatgaaagatttatgataaatct

SEQ ID NO: 320474 - DNA, 25 bp, Mus musculus
ggaatgaaaggcattttcccgactc

SEQ ID NO: 320475 - DNA, 25 bp, Mus musculus
ggaatgaaaggtgatgaagtctcga

SEQ ID NO: 320476 - DNA, 25 bp, Mus musculus
ggaatgaaaggtttcaacagctccc

SEQ ID NO: 320477 - DNA, 25 bp, Mus musculus
ggaatgaagaagcttctcttcagga

SEQ ID NO: 320478 - DNA, 25 bp, Mus musculus
ggaatgaagaaggaggtgaagattg

SEQ ID NO: 320479 - DNA, 25 bp, Mus musculus
ggaatgaagatctttctgagaccaa

SEQ ID NO: 320480 - DNA, 25 bp, Mus musculus
ggaatgaaggcgtggcaacatacgc

SEQ ID NO: 320481 - DNA, 25 bp, Mus musculus
ggaatgaagggtcctgtggctgtta

SEQ ID NO: 320482 - DNA, 25 bp, Mus musculus
ggaatgaatgcgggctttgaagact

SEQ ID NO: 320483 - DNA, 25 bp, Mus musculus
ggaatgacaaagaattactgacttt

SEQ ID NO: 320484 - DNA, 25 bp, Mus musculus
ggaatgacagatcagctcgaacggg

SEQ ID NO: 320485 - DNA, 25 bp, Mus musculus
ggaatgacagccgccgccatgatcc

SEQ ID NO: 320486 - DNA, 25 bp, Mus musculus
ggaatgaccaacagcaacatggcca

SEQ ID NO: 320487 - DNA, 25 bp, Mus musculus
ggaatgaccaacagtttgaaggaag

SEQ ID NO: 320488 - DNA, 25 bp, Mus musculus
ggaatgaccgagagtgggaccgtgg

SEQ ID NO: 320489 - DNA, 25 bp, Mus musculus
ggaatgactacctgggaattaccag

SEQ ID NO: 320490 - DNA, 25 bp, Mus musculus
ggaatgactacctgggacattcctg

SEQ ID NO: 320491 - DNA, 25 bp, Mus musculus
ggaatgagatttcctgactgctctt

SEQ ID NO: 320492 - DNA, 25 bp, Mus musculus
ggaatgagcaagcggcccttgattg

SEQ ID NO: 320493 - DNA, 25 bp, Mus musculus
ggaatgagcaagcggcttgttatgc

SEQ ID NO: 320494 - DNA, 25 bp, Mus musculus
ggaatgaggctgctgcagagcctac

SEQ ID NO: 320495 - DNA, 25 bp, Mus musculus
ggaatgatgagagccagctctcccc

SEQ ID NO: 320496 - DNA, 25 bp, Mus musculus
ggaatgatgagctctcccctgccac

SEQ ID NO: 320497 - DNA, 25 bp, Mus musculus
ggaatgattaatgacaccaattcta

SEQ ID NO: 320498 - DNA, 25 bp, Mus musculus
ggaatgccaatgcgactgctttttt

SEQ ID NO: 320499 - DNA, 25 bp, Mus musculus
ggaatgcccgaaggagccgggtcaa

SEQ ID NO: 320500 - DNA, 25 bp, Mus musculus
ggaatgcccgaaggtagagaaacct

SEQ ID NO: 320501 - DNA, 25 bp, Mus musculus
ggaatgcgcagattaagaaacaaac

SEQ ID NO: 320502 - DNA, 25 bp, Mus musculus
ggaatgctgatcaaccattgcagac

SEQ ID NO: 320503 - DNA, 25 bp, Mus musculus
ggaatgctgatcaagcaccacacag

SEQ ID NO: 320504 - DNA, 25 bp, Mus musculus
ggaatgcttgggaattgaatccagg

SEQ ID NO: 320505 - DNA, 25 bp, Mus musculus
ggaatgcttgggagagttaaccttg

SEQ ID NO: 320506 - DNA, 25 bp, Mus musculus
ggaatggaaggccttgttacccacc

SEQ ID NO: 320507 - DNA, 25 bp, Mus musculus
ggaatggcagcacagcttagaacca

SEQ ID NO: 320508 - DNA, 25 bp, Mus musculus
ggaatggcggaagatataacagact

SEQ ID NO: 320509 - DNA, 25 bp, Mus musculus
ggaatggcttccttcatgaagataa

SEQ ID NO: 320510 - DNA, 25 bp, Mus musculus
ggaatgggaaaagtacgagatgaga

SEQ ID NO: 320511 - DNA, 25 bp, Mus musculus
ggaatgggagaatgaagggggagaa

SEQ ID NO: 320512 - DNA, 25 bp, Mus musculus
ggaatgggagacgtacgcagcagtg

SEQ ID NO: 320513 - DNA, 25 bp, Mus musculus
ggaatgggagagatgcagaaagaga

SEQ ID NO: 320514 - DNA, 25 bp, Mus musculus
ggaatgggagagcttttgcctacca

SEQ ID NO: 320515 - DNA, 25 bp, Mus musculus
ggaatgggagctgatgttcaggtaa

SEQ ID NO: 320516 - DNA, 25 bp, Mus musculus
ggaatgggagctggtaaatgatgat

SEQ ID NO: 320517 - DNA, 25 bp, Mus musculus
ggaatgggcagcacatttaaaatcc

SEQ ID NO: 320518 - DNA, 25 bp, Mus musculus
ggaatgggcgcagacatgaaagctt

SEQ ID NO: 320519 - DNA, 25 bp, Mus musculus
ggaatgggctacataccatctgcca

SEQ ID NO: 320520 - DNA, 25 bp, Mus musculus
ggaatgggctacatcccgtatgtgc

SEQ ID NO: 320521 - DNA, 25 bp, Mus musculus
ggaatggtcatgatggtaccaggag

SEQ ID NO: 320522 - DNA, 25 bp, Mus musculus
ggaatgtcaagatgaagatgaatgt

SEQ ID NO: 320523 - DNA, 25 bp, Mus musculus
ggaatgtcaagatgttaacgaatgt

SEQ ID NO: 320524 - DNA, 25 bp, Mus musculus
ggaatgtcagagatgggcgtgtctt

SEQ ID NO: 320525 - DNA, 25 bp, Mus musculus
ggaatgtcagttcactcaccgctgt

SEQ ID NO: 320526 - DNA, 25 bp, Mus musculus
ggaatgtctcctgaacttcgaggcc

SEQ ID NO: 320527 - DNA, 25 bp, Mus musculus
ggaatgtctcctgtctgtggtgcaa

SEQ ID NO: 320528 - DNA, 25 bp, Mus musculus
ggaatgtgaaaagagtgtcccagca

SEQ ID NO: 320529 - DNA, 25 bp, Mus musculus
ggaatgtgagatacctttatcaatg

SEQ ID NO: 320530 - DNA, 25 bp, Mus musculus
ggaatgtgagatatgatgaatggat

SEQ ID NO: 320531 - DNA, 25 bp, Mus musculus
ggaatgtgtgttggcgctaccctga

SEQ ID NO: 320532 - DNA, 25 bp, Mus musculus
ggaatgttcaacagtgcacagtgtg

SEQ ID NO: 320533 - DNA, 25 bp, Mus musculus
ggaatgttccagacgtgaagccctt

SEQ ID NO: 320534 - DNA, 25 bp, Mus musculus
ggaatgtttcacagatagaagcttt

SEQ ID NO: 320535 - DNA, 25 bp, Mus musculus
ggaatgtttcacagttcttccagaa

SEQ ID NO: 320536 - DNA, 25 bp, Mus musculus
ggaattaaacaggcatgatgcacag

SEQ ID NO: 320537 - DNA, 25 bp, Mus musculus
ggaattaaactaggcctgaggagcg

SEQ ID NO: 320538 - DNA, 25 bp, Mus musculus
ggaattaaagctctaagaacaggtg

SEQ ID NO: 320539 - DNA, 25 bp, Mus musculus
ggaattaaaggaaactagaagtctc

SEQ ID NO: 320540 - DNA, 25 bp, Mus musculus
ggaattaagcaagatgagaagccag

SEQ ID NO: 320541 - DNA, 25 bp, Mus musculus
ggaattaagcaaggctgtggactta

SEQ ID NO: 320542 - DNA, 25 bp, Mus musculus
ggaattaaggaagttacaatgattt

SEQ ID NO: 320543 - DNA, 25 bp, Mus musculus
ggaattacagccgaagaagcaggca

SEQ ID NO: 320544 - DNA, 25 bp, Mus musculus
ggaattacaggatgagcctgcccgc

SEQ ID NO: 320545 - DNA, 25 bp, Mus musculus
ggaattacagggatcgcttacactt

SEQ ID NO: 320546 - DNA, 25 bp, Mus musculus
ggaattaccgatggatctggtggcc

SEQ ID NO: 320547 - DNA, 25 bp, Mus musculus
ggaattataaaaaggcacagaagaa

SEQ ID NO: 320548 - DNA, 25 bp, Mus musculus
ggaattatagccacaatcacaagtt

SEQ ID NO: 320549 - DNA, 25 bp, Mus musculus
ggaattatgtctgaggaagatggaa

SEQ ID NO: 320550 - DNA, 25 bp, Mus musculus
ggaattcaaaagaattactcagaag

SEQ ID NO: 320551 - DNA, 25 bp, Mus musculus
ggaattcaacaagaatttggatgta

SEQ ID NO: 320552 - DNA, 25 bp, Mus musculus
ggaattcaacaaggtgtcggtgctg

SEQ ID NO: 320553 - DNA, 25 bp, Mus musculus
ggaattcaagagtatggggaaaaag

SEQ ID NO: 320554 - DNA, 25 bp, Mus musculus
ggaattcaagatggtcaaataaaaa

SEQ ID NO: 320555 - DNA, 25 bp, Mus musculus
ggaattcactccagatctctatggc

SEQ ID NO: 320556 - DNA, 25 bp, Mus musculus
ggaattcactggaattcctgagcaa

SEQ ID NO: 320557 - DNA, 25 bp, Mus musculus
ggaattcatcttaggtcgggatggt

SEQ ID NO: 320558 - DNA, 25 bp, Mus musculus
ggaattccagattcgagtcaatagt

SEQ ID NO: 320559 - DNA, 25 bp, Mus musculus
ggaattccagctgatggagacctga

SEQ ID NO: 320560 - DNA, 25 bp, Mus musculus
ggaattccagctgggtgagtctgta

SEQ ID NO: 320561 - DNA, 25 bp, Mus musculus
ggaattccaggcacgtgctctaaca

SEQ ID NO: 320562 - DNA, 25 bp, Mus musculus
ggaattccaggtctcaagggattct

SEQ ID NO: 320563 - DNA, 25 bp, Mus musculus
ggaattctccaagaatgggaaatgc

SEQ ID NO: 320564 - DNA, 25 bp, Mus musculus
ggaattctcgcccgaacctcttgaa

SEQ ID NO: 320565 - DNA, 25 bp, Mus musculus
ggaattctcttcagtaccgggaggt

SEQ ID NO: 320566 - DNA, 25 bp, Mus musculus
ggaattgaactcaggccatattccc

SEQ ID NO: 320567 - DNA, 25 bp, Mus musculus
ggaattgaagatggatcacctactg

SEQ ID NO: 320568 - DNA, 25 bp, Mus musculus
ggaattgagaatatgaacgaggctc

SEQ ID NO: 320569 - DNA, 25 bp, Mus musculus
ggaattgagggaaggtccccaccct

SEQ ID NO: 320570 - DNA, 25 bp, Mus musculus
ggaattgatccgatttggaacctgg

SEQ ID NO: 320571 - DNA, 25 bp, Mus musculus
ggaattgatccgtgtgccattgaaa

SEQ ID NO: 320572 - DNA, 25 bp, Mus musculus
ggaattgcaaagatgtgtccaggtg

SEQ ID NO: 320573 - DNA, 25 bp, Mus musculus
ggaattgcaaagtgtactgggacta

SEQ ID NO: 320574 - DNA, 25 bp, Mus musculus
ggaattgcagtctgtgatgctccca

SEQ ID NO: 320575 - DNA, 25 bp, Mus musculus
ggaattgctcaggaggctttagaaa

SEQ ID NO: 320576 - DNA, 25 bp, Mus musculus
ggaattgctcaggcgagagcaggct

SEQ ID NO: 320577 - DNA, 25 bp, Mus musculus
ggaattgctgataagatctcccttg

SEQ ID NO: 320578 - DNA, 25 bp, Mus musculus
ggaattgctgataagatgtctggtg

SEQ ID NO: 320579 - DNA, 25 bp, Mus musculus
ggaattggaatcaggtggacagcag

SEQ ID NO: 320580 - DNA, 25 bp, Mus musculus
ggaattggtcctcatctctccaggc

SEQ ID NO: 320581 - DNA, 25 bp, Mus musculus
ggaattggtcctggctctgtctgta

SEQ ID NO: 320582 - DNA, 25 bp, Mus musculus
ggaattggtggtgtgacaaacggag

SEQ ID NO: 320583 - DNA, 25 bp, Mus musculus
ggaattgtacagatatcgatgagtg

SEQ ID NO: 320584 - DNA, 25 bp, Mus musculus
ggaattgtagagaatttcttgctgc

SEQ ID NO: 320585 - DNA, 25 bp, Mus musculus
ggaattgtagagttgctcacagact

SEQ ID NO: 320586 - DNA, 25 bp, Mus musculus
ggaattgtagagttggctcacgtct

SEQ ID NO: 320587 - DNA, 25 bp, Mus musculus
ggaattgtctcaaagaacttttgag

SEQ ID NO: 320588 - DNA, 25 bp, Mus musculus
ggaattgtgcatggcagaagaggaa

SEQ ID NO: 320589 - DNA, 25 bp, Mus musculus
ggaattgtgcatgttccccctacct

SEQ ID NO: 320590 - DNA, 25 bp, Mus musculus
ggaatttatctatgatgaagctgct

SEQ ID NO: 320591 - DNA, 25 bp, Mus musculus
ggaatttatctatggtcgaatattt

SEQ ID NO: 320592 - DNA, 25 bp, Mus musculus
ggaatttatgggatgaacaagaagc

SEQ ID NO: 320593 - DNA, 25 bp, Mus musculus
ggaatttatggtacaggaaaactcc

SEQ ID NO: 320594 - DNA, 25 bp, Mus musculus
ggaatttccaccggtttgctgagga

SEQ ID NO: 320595 - DNA, 25 bp, Mus musculus
ggaatttctaaagaagttggcatca

SEQ ID NO: 320596 - DNA, 25 bp, Mus musculus
ggaatttgctggggagaaggaactc

SEQ ID NO: 320597 - DNA, 25 bp, Mus musculus
ggaattttatgctcgacgccaatgg

SEQ ID NO: 320598 - DNA, 25 bp, Mus musculus
ggaattttatgtaagaccagctgtg

SEQ ID NO: 320599 - DNA, 25 bp, Mus musculus
ggaattttgtaagaggacaatgcgt

SEQ ID NO: 320600 - DNA, 25 bp, Mus musculus
ggaattttgtaagtacaaacaggcc

SEQ ID NO: 320601 - DNA, 25 bp, Mus musculus
ggacaaaaaacttgagcccagcggg

SEQ ID NO: 320602 - DNA, 25 bp, Mus musculus
ggacaaaaacacagagcttaccatc

SEQ ID NO: 320603 - DNA, 25 bp, Mus musculus
ggacaaaaacacagggggaagaggg

SEQ ID NO: 320604 - DNA, 25 bp, Mus musculus
ggacaaaacaggaatggaagcccta

SEQ ID NO: 320605 - DNA, 25 bp, Mus musculus
ggacaaaacagtgaccaagaagaag

SEQ ID NO: 320606 - DNA, 25 bp, Mus musculus
ggacaaaaccaaggatgtggagtac

SEQ ID NO: 320607 - DNA, 25 bp, Mus musculus
ggacaaaacgcaccctacctggaaa

SEQ ID NO: 320608 - DNA, 25 bp, Mus musculus
ggacaaaaggccggtcatggtatgg

SEQ ID NO: 320609 - DNA, 25 bp, Mus musculus
ggacaaaatggcagtggcagcccag

SEQ ID NO: 320610 - DNA, 25 bp, Mus musculus
ggacaaaccaaggctcatctgcggt

SEQ ID NO: 320611 - DNA, 25 bp, Mus musculus
ggacaaagacggttatattaagaac

SEQ ID NO: 320612 - DNA, 25 bp, Mus musculus
ggacaaagagaaagccagtgagacc

SEQ ID NO: 320613 - DNA, 25 bp, Mus musculus
ggacaaagagaatgatggatatatc

SEQ ID NO: 320614 - DNA, 25 bp, Mus musculus
ggacaaagagcatctaaagaaaaag

SEQ ID NO: 320615 - DNA, 25 bp, Mus musculus
ggacaaagatgagtggataagtgga

SEQ ID NO: 320616 - DNA, 25 bp, Mus musculus
ggacaaagcagaaaatggatcgaac

SEQ ID NO: 320617 - DNA, 25 bp, Mus musculus
ggacaaagcagacgttgattccgag

SEQ ID NO: 320618 - DNA, 25 bp, Mus musculus
ggacaaagcagatctgcaggtgtct

SEQ ID NO: 320619 - DNA, 25 bp, Mus musculus
ggacaaagcagcttccaggagctga

SEQ ID NO: 320620 - DNA, 25 bp, Mus musculus
ggacaaagcaggggtcgggtcagag

SEQ ID NO: 320621 - DNA, 25 bp, Mus musculus
ggacaaagctgcaggcatcgttctg

SEQ ID NO: 320622 - DNA, 25 bp, Mus musculus
ggacaaatccaggtggctcctccca

SEQ ID NO: 320623 - DNA, 25 bp, Mus musculus
ggacaaatcctcgtggctcctccca

SEQ ID NO: 320624 - DNA, 25 bp, Mus musculus
ggacaaatgtaaggcaaatgaccat

SEQ ID NO: 320625 - DNA, 25 bp, Mus musculus
ggacaaatttgtcaaagaactacta

SEQ ID NO: 320626 - DNA, 25 bp, Mus musculus
ggacaacaagcacaagttctgccta

SEQ ID NO: 320627 - DNA, 25 bp, Mus musculus
ggacaacagcaagcccaccaattcc

SEQ ID NO: 320628 - DNA, 25 bp, Mus musculus
ggacaacagtccagattccttctgg

SEQ ID NO: 320629 - DNA, 25 bp, Mus musculus
ggacaacataaggaagtcagacata

SEQ ID NO: 320630 - DNA, 25 bp, Mus musculus
ggacaacatcaaggtgtctttggac

SEQ ID NO: 320631 - DNA, 25 bp, Mus musculus
ggacaaccacagcgacccatacgtg

SEQ ID NO: 320632 - DNA, 25 bp, Mus musculus
ggacaaccacgagatgtctgcagtc

SEQ ID NO: 320633 - DNA, 25 bp, Mus musculus
ggacaaccacgtcattcacccatct

SEQ ID NO: 320634 - DNA, 25 bp, Mus musculus
ggacaacccagaagttctcctgatt

SEQ ID NO: 320635 - DNA, 25 bp, Mus musculus
ggacaacccatacctgcacctcgca

SEQ ID NO: 320636 - DNA, 25 bp, Mus musculus
ggacaacctatgtcttttgtgctag

SEQ ID NO: 320637 - DNA, 25 bp, Mus musculus
ggacaacgaaggtgaccccatctct

SEQ ID NO: 320638 - DNA, 25 bp, Mus musculus
ggacaacgagagctggggctttgtg

SEQ ID NO: 320639 - DNA, 25 bp, Mus musculus
ggacaacgagagttctgcctgctga

SEQ ID NO: 320640 - DNA, 25 bp, Mus musculus
ggacaacgagcgagtggtgacgtat

SEQ ID NO: 320641 - DNA, 25 bp, Mus musculus
ggacaacgagcgagttgggatggct

SEQ ID NO: 320642 - DNA, 25 bp, Mus musculus
ggacaactacgattcatcccatcag

SEQ ID NO: 320643 - DNA, 25 bp, Mus musculus
ggacaactacgattccatgtacacg

SEQ ID NO: 320644 - DNA, 25 bp, Mus musculus
ggacaactatgagtgaactccggga

SEQ ID NO: 320645 - DNA, 25 bp, Mus musculus
ggacaactatgggaagaagaagaag

SEQ ID NO: 320646 - DNA, 25 bp, Mus musculus
ggacaacttagaaactcctatcacg

SEQ ID NO: 320647 - DNA, 25 bp, Mus musculus
ggacaacttaggtgctggctacgcc

SEQ ID NO: 320648 - DNA, 25 bp, Mus musculus
ggacaagaaaactgttcattcgtat

SEQ ID NO: 320649 - DNA, 25 bp, Mus musculus
ggacaagaaaagactatctaagctg

SEQ ID NO: 320650 - DNA, 25 bp, Mus musculus
ggacaagaaaattgagcccagagtg

SEQ ID NO: 320651 - DNA, 25 bp, Mus musculus
ggacaagaaaattgagcccagcggg

SEQ ID NO: 320652 - DNA, 25 bp, Mus musculus
ggacaagaaaattgtgcccagggat

SEQ ID NO: 320653 - DNA, 25 bp, Mus musculus
ggacaagaacttagtgatgtggaga

SEQ ID NO: 320654 - DNA, 25 bp, Mus musculus
ggacaagaagaaagccggtggctgg

SEQ ID NO: 320655 - DNA, 25 bp, Mus musculus
ggacaagaagaattaaagcacgcac

SEQ ID NO: 320656 - DNA, 25 bp, Mus musculus
ggacaagaagacagagccaagtcag

SEQ ID NO: 320657 - DNA, 25 bp, Mus musculus
ggacaagaagacagatgttaaggaa

SEQ ID NO: 320658 - DNA, 25 bp, Mus musculus
ggacaagaaggacctgagggaccgg

SEQ ID NO: 320659 - DNA, 25 bp, Mus musculus
ggacaagaaggcacatgcaactatg

SEQ ID NO: 320660 - DNA, 25 bp, Mus musculus
ggacaagaatacagggaaaatggag

SEQ ID NO: 320661 - DNA, 25 bp, Mus musculus
ggacaagaatgtacgccaggccagc

SEQ ID NO: 320662 - DNA, 25 bp, Mus musculus
ggacaagagcggttccggagcctta

SEQ ID NO: 320663 - DNA, 25 bp, Mus musculus
ggacaagcaggtcccatgcatcatt

SEQ ID NO: 320664 - DNA, 25 bp, Mus musculus
ggacaagcccataggaacctggctg

SEQ ID NO: 320665 - DNA, 25 bp, Mus musculus
ggacaagcccataggttacaaggac

SEQ ID NO: 320666 - DNA, 25 bp, Mus musculus
ggacaagcctgactgcctctttaag

SEQ ID NO: 320667 - DNA, 25 bp, Mus musculus
ggacaagcctggcaagtcacgtgac

SEQ ID NO: 320668 - DNA, 25 bp, Mus musculus
ggacaagcggcagattgtagacctg

SEQ ID NO: 320669 - DNA, 25 bp, Mus musculus
ggacaagctcctagatcttgatgac

SEQ ID NO: 320670 - DNA, 25 bp, Mus musculus
ggacaagctccttccagtgacagca

SEQ ID NO: 320671 - DNA, 25 bp, Mus musculus
ggacaagcttaccagtgattttgag

SEQ ID NO: 320672 - DNA, 25 bp, Mus musculus
ggacaaggaaatgacaaatggttat

SEQ ID NO: 320673 - DNA, 25 bp, Mus musculus
ggacaaggaagactttctctgtgta

SEQ ID NO: 320674 - DNA, 25 bp, Mus musculus
ggacaaggaaggttctgagcctgga

SEQ ID NO: 320675 - DNA, 25 bp, Mus musculus
ggacaaggagaagacaggagtgcga

SEQ ID NO: 320676 - DNA, 25 bp, Mus musculus
ggacaaggagacagcttggtcacat

SEQ ID NO: 320677 - DNA, 25 bp, Mus musculus
ggacaaggaggacggtgtgccgatg

SEQ ID NO: 320678 - DNA, 25 bp, Mus musculus
ggacaagtgagaatgattggagcct

SEQ ID NO: 320679 - DNA, 25 bp, Mus musculus
ggacaagtgagaatgggttaactgc

SEQ ID NO: 320680 - DNA, 25 bp, Mus musculus
ggacaagtgagcagactcggagtgc

SEQ ID NO: 320681 - DNA, 25 bp, Mus musculus
ggacaagtgagcagggacggcctca

SEQ ID NO: 320682 - DNA, 25 bp, Mus musculus
ggacaagtggctggcacccgatggc

SEQ ID NO: 320683 - DNA, 25 bp, Mus musculus
ggacaagttcatgaggatctaccgt

SEQ ID NO: 320684 - DNA, 25 bp, Mus musculus
ggacaataaaaggaaagacaaagat

SEQ ID NO: 320685 - DNA, 25 bp, Mus musculus
ggacaataaggagaagaagaagccc

SEQ ID NO: 320686 - DNA, 25 bp, Mus musculus
ggacaatacaagaagagttatgaaa

SEQ ID NO: 320687 - DNA, 25 bp, Mus musculus
ggacaatacaggctaggggtgttct

SEQ ID NO: 320688 - DNA, 25 bp, Mus musculus
ggacaatcacttagcatgtgtgaac

SEQ ID NO: 320689 - DNA, 25 bp, Mus musculus
ggacaatcagccaaggttactccta

SEQ ID NO: 320690 - DNA, 25 bp, Mus musculus
ggacaatcagcgcctgttggtctgg

SEQ ID NO: 320691 - DNA, 25 bp, Mus musculus
ggacaatcagggtctatctacacag

SEQ ID NO: 320692 - DNA, 25 bp, Mus musculus
ggacaatcatggctgtcatggtatc

SEQ ID NO: 320693 - DNA, 25 bp, Mus musculus
ggacaatgaaaacgtatccaacggt

SEQ ID NO: 320694 - DNA, 25 bp, Mus musculus
ggacaatgaagattacgaacatgaa

SEQ ID NO: 320695 - DNA, 25 bp, Mus musculus
ggacaatgaggatggcagtacctgg

SEQ ID NO: 320696 - DNA, 25 bp, Mus musculus
ggacaatgcagcttcacttggttca

SEQ ID NO: 320697 - DNA, 25 bp, Mus musculus
ggacaatgcagtgctgaaaggagga

SEQ ID NO: 320698 - DNA, 25 bp, Mus musculus
ggacaatggttatggttatgcttca

SEQ ID NO: 320699 - DNA, 25 bp, Mus musculus
ggacaatgtaaagaaccctgtgtat

SEQ ID NO: 320700 - DNA, 25 bp, Mus musculus
ggacaattacggtgcccgagggcca

SEQ ID NO: 320701 - DNA, 25 bp, Mus musculus
ggacaattcaggacccttttgtgga

SEQ ID NO: 320702 - DNA, 25 bp, Mus musculus
ggacaattgaacaattgcctatagc

SEQ ID NO: 320703 - DNA, 25 bp, Mus musculus
ggacaattgactggctgtgttttgg

SEQ ID NO: 320704 - DNA, 25 bp, Mus musculus
ggacaatttaagaccctgctcacac

SEQ ID NO: 320705 - DNA, 25 bp, Mus musculus
ggacaatttaagccacaagatccgt

SEQ ID NO: 320706 - DNA, 25 bp, Mus musculus
ggacaatttaggctacagaacaggc

SEQ ID NO: 320707 - DNA, 25 bp, Mus musculus
ggacacaaaatcatggacgcattca

SEQ ID NO: 320708 - DNA, 25 bp, Mus musculus
ggacacaaacgaggtataagtattg

SEQ ID NO: 320709 - DNA, 25 bp, Mus musculus
ggacacaaagttcagtactagaaga

SEQ ID NO: 320710 - DNA, 25 bp, Mus musculus
ggacacaagaaaagtcaggccctgc

SEQ ID NO: 320711 - DNA, 25 bp, Mus musculus
ggacacacaatgggtgatccattca

SEQ ID NO: 320712 - DNA, 25 bp, Mus musculus
ggacacacaattggcggcggctgcc

SEQ ID NO: 320713 - DNA, 25 bp, Mus musculus
ggacacacaattgggccggcggcgg

SEQ ID NO: 320714 - DNA, 25 bp, Mus musculus
ggacacacaattggtggacgcagac

SEQ ID NO: 320715 - DNA, 25 bp, Mus musculus
ggacacacagacactgtcctgttgg

SEQ ID NO: 320716 - DNA, 25 bp, Mus musculus
ggacacacagagaaaacatcccagg

SEQ ID NO: 320717 - DNA, 25 bp, Mus musculus
ggacacacaggagagtactaaattt

SEQ ID NO: 320718 - DNA, 25 bp, Mus musculus
ggacacactccacgcagtatgagat

SEQ ID NO: 320719 - DNA, 25 bp, Mus musculus
ggacacagacatggactgtctaact

SEQ ID NO: 320720 - DNA, 25 bp, Mus musculus
ggacacagagatgactcgttggcta

SEQ ID NO: 320721 - DNA, 25 bp, Mus musculus
ggacacagagctgtcccacattggg

SEQ ID NO: 320722 - DNA, 25 bp, Mus musculus
ggacacagagctgttgccaaaacaa

SEQ ID NO: 320723 - DNA, 25 bp, Mus musculus
ggacacagagtcttcaagcagcgac

SEQ ID NO: 320724 - DNA, 25 bp, Mus musculus
ggacacagcagctggaactcattat

SEQ ID NO: 320725 - DNA, 25 bp, Mus musculus
ggacacagtgcccgtgcgcagttct

SEQ ID NO: 320726 - DNA, 25 bp, Mus musculus
ggacacataactggctctgtccacc

SEQ ID NO: 320727 - DNA, 25 bp, Mus musculus
ggacacatcaccagggaattcgtac

SEQ ID NO: 320728 - DNA, 25 bp, Mus musculus
ggacacatcaccaggtctcattatt

SEQ ID NO: 320729 - DNA, 25 bp, Mus musculus
ggacacatcagggggcgtcagtcat

SEQ ID NO: 320730 - DNA, 25 bp, Mus musculus
ggacacatgcagaaaagtaaagaac

SEQ ID NO: 320731 - DNA, 25 bp, Mus musculus
ggacacatgcagctggtgaatgagc

SEQ ID NO: 320732 - DNA, 25 bp, Mus musculus
ggacacatgcaggcgcatacctctt

SEQ ID NO: 320733 - DNA, 25 bp, Mus musculus
ggacacatggaagatctcaggccca

SEQ ID NO: 320734 - DNA, 25 bp, Mus musculus
ggacacattctggtgctggagacag

SEQ ID NO: 320735 - DNA, 25 bp, Mus musculus
ggacacattttaactgtgacaaacg

SEQ ID NO: 320736 - DNA, 25 bp, Mus musculus
ggacaccaacacaggttccttcctc

SEQ ID NO: 320737 - DNA, 25 bp, Mus musculus
ggacaccaagagggaagctgctcac

SEQ ID NO: 320738 - DNA, 25 bp, Mus musculus
ggacaccaagggtccaccaacagca

SEQ ID NO: 320739 - DNA, 25 bp, Mus musculus
ggacaccacagagctccttggtaga

SEQ ID NO: 320740 - DNA, 25 bp, Mus musculus
ggacaccacaggaaagaatgtttcc

SEQ ID NO: 320741 - DNA, 25 bp, Mus musculus
ggacaccacgcagaatggtggcatc

SEQ ID NO: 320742 - DNA, 25 bp, Mus musculus
ggacaccacgcagcccccacatcga

SEQ ID NO: 320743 - DNA, 25 bp, Mus musculus
ggacaccatgcataggaagcacctt

SEQ ID NO: 320744 - DNA, 25 bp, Mus musculus
ggacaccatggctgatcatcactcc

SEQ ID NO: 320745 - DNA, 25 bp, Mus musculus
ggacacccaaggatgtgaatgagtg

SEQ ID NO: 320746 - DNA, 25 bp, Mus musculus
ggacacccatggctttgagcacacc

SEQ ID NO: 320747 - DNA, 25 bp, Mus musculus
ggacacccccaagttcaatctcatc

SEQ ID NO: 320748 - DNA, 25 bp, Mus musculus
ggacacccctcatgtttctgcaggg

SEQ ID NO: 320749 - DNA, 25 bp, Mus musculus
ggacacccggaaaccctgatggact

SEQ ID NO: 320750 - DNA, 25 bp, Mus musculus
ggacaccctctctggactctatagc

SEQ ID NO: 320751 - DNA, 25 bp, Mus musculus
ggacaccgagcggagggcaagaggc

SEQ ID NO: 320752 - DNA, 25 bp, Mus musculus
ggacaccgccagctctgctgtggct

SEQ ID NO: 320753 - DNA, 25 bp, Mus musculus
ggacaccgcgcagatctcaagcata

SEQ ID NO: 320754 - DNA, 25 bp, Mus musculus
ggacaccggattcggtgtatcctgc

SEQ ID NO: 320755 - DNA, 25 bp, Mus musculus
ggacacctatgaacttgcgatgtag

SEQ ID NO: 320756 - DNA, 25 bp, Mus musculus
ggacacctatgttttcaaagataca

SEQ ID NO: 320757 - DNA, 25 bp, Mus musculus
ggacacctctcctggagtgtctgtg

SEQ ID NO: 320758 - DNA, 25 bp, Mus musculus
ggacacctctcctgggcctctgata

SEQ ID NO: 320759 - DNA, 25 bp, Mus musculus
ggacacctgcctgcagtacaaggtt

SEQ ID NO: 320760 - DNA, 25 bp, Mus musculus
ggacacctggaagctgaactcccac

SEQ ID NO: 320761 - DNA, 25 bp, Mus musculus
ggacacctgtcgcccatattttaat

SEQ ID NO: 320762 - DNA, 25 bp, Mus musculus
ggacacctgtcgcccctgagtgcaa

SEQ ID NO: 320763 - DNA, 25 bp, Mus musculus
ggacaccttaggtattggaaaagtg

SEQ ID NO: 320764 - DNA, 25 bp, Mus musculus
ggacacgagctggagtgagcaaacc

SEQ ID NO: 320765 - DNA, 25 bp, Mus musculus
ggacacgagggctccttcttctacg

SEQ ID NO: 320766 - DNA, 25 bp, Mus musculus
ggacacgatggaagcagaaaccagt

SEQ ID NO: 320767 - DNA, 25 bp, Mus musculus
ggacacgatggaagctcagctgcca

SEQ ID NO: 320768 - DNA, 25 bp, Mus musculus
ggacacgcaccagtggtatgtgtgc

SEQ ID NO: 320769 - DNA, 25 bp, Mus musculus
ggacacgcatggggtgtgattttgc

SEQ ID NO: 320770 - DNA, 25 bp, Mus musculus
ggacacgctatggcaatctttaaat

SEQ ID NO: 320771 - DNA, 25 bp, Mus musculus
ggacacggactggaggcgccagccc

SEQ ID NO: 320772 - DNA, 25 bp, Mus musculus
ggacacggagcagcccaccttggga

SEQ ID NO: 320773 - DNA, 25 bp, Mus musculus
ggacacggtccagctgcccaccatt

SEQ ID NO: 320774 - DNA, 25 bp, Mus musculus
ggacacggtggatggagcgagatgc

SEQ ID NO: 320775 - DNA, 25 bp, Mus musculus
ggacactacgaacagcacattagtt

SEQ ID NO: 320776 - DNA, 25 bp, Mus musculus
ggacactcaagaaaattacaacacc

SEQ ID NO: 320777 - DNA, 25 bp, Mus musculus
ggacactcaagagagggactcctgg

SEQ ID NO: 320778 - DNA, 25 bp, Mus musculus
ggacactcaaggcatttccccactg

SEQ ID NO: 320779 - DNA, 25 bp, Mus musculus
ggacactcaagtggctgatgtgaca

SEQ ID NO: 320780 - DNA, 25 bp, Mus musculus
ggacactcagacaggaccccgtcat

SEQ ID NO: 320781 - DNA, 25 bp, Mus musculus
ggacactcagagactgtctctggag

SEQ ID NO: 320782 - DNA, 25 bp, Mus musculus
ggacactcagaggatttccctagag

SEQ ID NO: 320783 - DNA, 25 bp, Mus musculus
ggacactcagcctgcagcctgatga

SEQ ID NO: 320784 - DNA, 25 bp, Mus musculus
ggacactctactaagtgccctgcat

SEQ ID NO: 320785 - DNA, 25 bp, Mus musculus
ggacactgaccaaagatgagaaagt

SEQ ID NO: 320786 - DNA, 25 bp, Mus musculus
ggacactgcaaaaacctggagccag

SEQ ID NO: 320787 - DNA, 25 bp, Mus musculus
ggacactgcgtgggcccagtgggca

SEQ ID NO: 320788 - DNA, 25 bp, Mus musculus
ggacactggagatgatccttacagc

SEQ ID NO: 320789 - DNA, 25 bp, Mus musculus
ggacactggcagcagggcagtttca

SEQ ID NO: 320790 - DNA, 25 bp, Mus musculus
ggacactggcagtttccaggcactt

SEQ ID NO: 320791 - DNA, 25 bp, Mus musculus
ggacactggtgtaagaaatgaagct

SEQ ID NO: 320792 - DNA, 25 bp, Mus musculus
ggacactggtgttagaaatgaagct

SEQ ID NO: 320793 - DNA, 25 bp, Mus musculus
ggacactgtatcggttccatgtaag

SEQ ID NO: 320794 - DNA, 25 bp, Mus musculus
ggacactgtcaacggcagggtcaaa

SEQ ID NO: 320795 - DNA, 25 bp, Mus musculus
ggacactgtcaagggcagggtcaaa

SEQ ID NO: 320796 - DNA, 25 bp, Mus musculus
ggacactgttgatccacagggatgg

SEQ ID NO: 320797 - DNA, 25 bp, Mus musculus
ggacacttaaagctgcgcaaaccat

SEQ ID NO: 320798 - DNA, 25 bp, Mus musculus
ggacacttaacaggtccccaggcaa

SEQ ID NO: 320799 - DNA, 25 bp, Mus musculus
ggacacttaccaggtctttgacaga

SEQ ID NO: 320800 - DNA, 25 bp, Mus musculus
ggacacttgagaggctacagacaca

SEQ ID NO: 320801 - DNA, 25 bp, Mus musculus
ggacacttgtgaagcagcaggaagc

SEQ ID NO: 320802 - DNA, 25 bp, Mus musculus
ggacacttgtggagcattctggaag

SEQ ID NO: 320803 - DNA, 25 bp, Mus musculus
ggacactttggagaagtattgaggc

SEQ ID NO: 320804 - DNA, 25 bp, Mus musculus
ggacagaaaccaagaccaaaaacac

SEQ ID NO: 320805 - DNA, 25 bp, Mus musculus
ggacagaaaccaagtgctaaactga

SEQ ID NO: 320806 - DNA, 25 bp, Mus musculus
ggacagaaagctttttacctttgtg

SEQ ID NO: 320807 - DNA, 25 bp, Mus musculus
ggacagaacggttgatttaggggat

SEQ ID NO: 320808 - DNA, 25 bp, Mus musculus
ggacagaagaggctcagaacactgg

SEQ ID NO: 320809 - DNA, 25 bp, Mus musculus
ggacagaagaggctctccctgaagt

SEQ ID NO: 320810 - DNA, 25 bp, Mus musculus
ggacagaaggagaagaataccagga

SEQ ID NO: 320811 - DNA, 25 bp, Mus musculus
ggacagaaggagaaggaaagcggta

SEQ ID NO: 320812 - DNA, 25 bp, Mus musculus
ggacagaatacatgcaagaccctga

SEQ ID NO: 320813 - DNA, 25 bp, Mus musculus
ggacagacaagaaattgcaaattca

SEQ ID NO: 320814 - DNA, 25 bp, Mus musculus
ggacagacaggctttccagggctca

SEQ ID NO: 320815 - DNA, 25 bp, Mus musculus
ggacagacagtgggaagtctgttgt

SEQ ID NO: 320816 - DNA, 25 bp, Mus musculus
ggacagaccctggacatcaacatgg

SEQ ID NO: 320817 - DNA, 25 bp, Mus musculus
ggacagaccctgggacagcaggtgc

SEQ ID NO: 320818 - DNA, 25 bp, Mus musculus
ggacagaccctgggctccaccctca

SEQ ID NO: 320819 - DNA, 25 bp, Mus musculus
ggacagaccctggtcactcatcagg

SEQ ID NO: 320820 - DNA, 25 bp, Mus musculus
ggacagacctgcaaatctcccagcc

SEQ ID NO: 320821 - DNA, 25 bp, Mus musculus
ggacagactgaaggacagggtggcc

SEQ ID NO: 320822 - DNA, 25 bp, Mus musculus
ggacagactggaggcattctggaat

SEQ ID NO: 320823 - DNA, 25 bp, Mus musculus
ggacagagacaccagcttgggggcc

SEQ ID NO: 320824 - DNA, 25 bp, Mus musculus
ggacagagactggggctgcaggatg

SEQ ID NO: 320825 - DNA, 25 bp, Mus musculus
ggacagagagattgtgacacgggtg

SEQ ID NO: 320826 - DNA, 25 bp, Mus musculus
ggacagagaggcgtcccagccaagc

SEQ ID NO: 320827 - DNA, 25 bp, Mus musculus
ggacagagagggtccgtcgtaacct

SEQ ID NO: 320828 - DNA, 25 bp, Mus musculus
ggacagagagttaattgacaagtac

SEQ ID NO: 320829 - DNA, 25 bp, Mus musculus
ggacagagatccaaggacaccactt

SEQ ID NO: 320830 - DNA, 25 bp, Mus musculus
ggacagagatccaaggttgaccaca

SEQ ID NO: 320831 - DNA, 25 bp, Mus musculus
ggacagagatcggtaccgttgctcc

SEQ ID NO: 320832 - DNA, 25 bp, Mus musculus
ggacagagcagaatttgatactagc

SEQ ID NO: 320833 - DNA, 25 bp, Mus musculus
ggacagagcaggggtgctcttctct

SEQ ID NO: 320834 - DNA, 25 bp, Mus musculus
ggacagagccagctgcgcaaaccat

SEQ ID NO: 320835 - DNA, 25 bp, Mus musculus
ggacagagccatggggaagctcttt

SEQ ID NO: 320836 - DNA, 25 bp, Mus musculus
ggacagagcgaggtgtggacagttc

SEQ ID NO: 320837 - DNA, 25 bp, Mus musculus
ggacagagggataagaaaaataagt

SEQ ID NO: 320838 - DNA, 25 bp, Mus musculus
ggacagagggtcagagagatggcac

SEQ ID NO: 320839 - DNA, 25 bp, Mus musculus
ggacagagggtcagttccaggaaga

SEQ ID NO: 320840 - DNA, 25 bp, Mus musculus
ggacagataagcagcgtgcttccgg

SEQ ID NO: 320841 - DNA, 25 bp, Mus musculus
ggacagatcaagaacctgctgggat

SEQ ID NO: 320842 - DNA, 25 bp, Mus musculus
ggacagatcaagcgtctcagaataa

SEQ ID NO: 320843 - DNA, 25 bp, Mus musculus
ggacagatctctgtggcaaggatta

SEQ ID NO: 320844 - DNA, 25 bp, Mus musculus
ggacagatctctgtgtggagctggc

SEQ ID NO: 320845 - DNA, 25 bp, Mus musculus
ggacagatgcaaagccgccatggat

SEQ ID NO: 320846 - DNA, 25 bp, Mus musculus
ggacagatgtccactcccgagactc

SEQ ID NO: 320847 - DNA, 25 bp, Mus musculus
ggacagatgttcatgataggagaca

SEQ ID NO: 320848 - DNA, 25 bp, Mus musculus
ggacagatgttcatgggactttcag

SEQ ID NO: 320849 - DNA, 25 bp, Mus musculus
ggacagattgctctgccatcacctg

SEQ ID NO: 320850 - DNA, 25 bp, Mus musculus
ggacagattggatctggccgccccg

SEQ ID NO: 320851 - DNA, 25 bp, Mus musculus
ggacagcaaaggccgggtaggaccg

SEQ ID NO: 320852 - DNA, 25 bp, Mus musculus
ggacagcaaaggttctggccgagaa

SEQ ID NO: 320853 - DNA, 25 bp, Mus musculus
ggacagcaaggccctcctttttctg

SEQ ID NO: 320854 - DNA, 25 bp, Mus musculus
ggacagcaagggccatgtgaaactt

SEQ ID NO: 320855 - DNA, 25 bp, Mus musculus
ggacagcaatgtgtgggttgaattt

SEQ ID NO: 320856 - DNA, 25 bp, Mus musculus
ggacagcacccctttgagcccgctg

SEQ ID NO: 320857 - DNA, 25 bp, Mus musculus
ggacagcacccctttgtactatgcc

SEQ ID NO: 320858 - DNA, 25 bp, Mus musculus
ggacagcagacactcatcagcctga

SEQ ID NO: 320859 - DNA, 25 bp, Mus musculus
ggacagcagcacctggctgactgcc

SEQ ID NO: 320860 - DNA, 25 bp, Mus musculus
ggacagcaggaacgattcaatccca

SEQ ID NO: 320861 - DNA, 25 bp, Mus musculus
ggacagcaggaacgtatatgactgc

SEQ ID NO: 320862 - DNA, 25 bp, Mus musculus
ggacagcagggtgtgcaggggcctt

SEQ ID NO: 320863 - DNA, 25 bp, Mus musculus
ggacagcagtcccagcgcttcccga

SEQ ID NO: 320864 - DNA, 25 bp, Mus musculus
ggacagccagaggaacagatggagt

SEQ ID NO: 320865 - DNA, 25 bp, Mus musculus
ggacagccagcccaggctatcctgg

SEQ ID NO: 320866 - DNA, 25 bp, Mus musculus
ggacagccagctgaagtgagtagtg

SEQ ID NO: 320867 - DNA, 25 bp, Mus musculus
ggacagccaggcctctggggacctg

SEQ ID NO: 320868 - DNA, 25 bp, Mus musculus
ggacagccagggtctctggaactcg

SEQ ID NO: 320869 - DNA, 25 bp, Mus musculus
ggacagccagggtgagtccagtgac

SEQ ID NO: 320870 - DNA, 25 bp, Mus musculus
ggacagccaggtaacaatttcaaga

SEQ ID NO: 320871 - DNA, 25 bp, Mus musculus
ggacagccaggtggagttgttacaa

SEQ ID NO: 320872 - DNA, 25 bp, Mus musculus
ggacagccaggtgtggagggcttca

SEQ ID NO: 320873 - DNA, 25 bp, Mus musculus
ggacagccagtgagccatgaggctg

SEQ ID NO: 320874 - DNA, 25 bp, Mus musculus
ggacagccagtgcgtccagttagac

SEQ ID NO: 320875 - DNA, 25 bp, Mus musculus
ggacagccagtggaggtccaggttc

SEQ ID NO: 320876 - DNA, 25 bp, Mus musculus
ggacagccagtttgtaggtgtggag

SEQ ID NO: 320877 - DNA, 25 bp, Mus musculus
ggacagccatgctgagcttcttgat

SEQ ID NO: 320878 - DNA, 25 bp, Mus musculus
ggacagccgtgtagtttccatttat

SEQ ID NO: 320879 - DNA, 25 bp, Mus musculus
ggacagcctggatacaggttcactg

SEQ ID NO: 320880 - DNA, 25 bp, Mus musculus
ggacagcgagcagtgttgcctctct

SEQ ID NO: 320881 - DNA, 25 bp, Mus musculus
ggacagcgaggcatgctacaccaag

SEQ ID NO: 320882 - DNA, 25 bp, Mus musculus
ggacagctatcccaggaccgggact

SEQ ID NO: 320883 - DNA, 25 bp, Mus musculus
ggacagctatcccaggcccctctgc

SEQ ID NO: 320884 - DNA, 25 bp, Mus musculus
ggacagctcaatcgagctgggagca

SEQ ID NO: 320885 - DNA, 25 bp, Mus musculus
ggacagctcagctgttgaatcacac

SEQ ID NO: 320886 - DNA, 25 bp, Mus musculus
ggacagctctctatgatcttaccaa

SEQ ID NO: 320887 - DNA, 25 bp, Mus musculus
ggacagctggaagaggacaagctgg

SEQ ID NO: 320888 - DNA, 25 bp, Mus musculus
ggacagctggaagaggactagtgtc

SEQ ID NO: 320889 - DNA, 25 bp, Mus musculus
ggacagctggaagagtaccgttccc

SEQ ID NO: 320890 - DNA, 25 bp, Mus musculus
ggacagcttgtcccaggtaaatcac

SEQ ID NO: 320891 - DNA, 25 bp, Mus musculus
ggacaggaaagaagaagacctgtct

SEQ ID NO: 320892 - DNA, 25 bp, Mus musculus
ggacaggaaagaaggtggtggaaga

SEQ ID NO: 320893 - DNA, 25 bp, Mus musculus
ggacaggaaagattgttttctgctc

SEQ ID NO: 320894 - DNA, 25 bp, Mus musculus
ggacaggaaagcccatgttaccaga

SEQ ID NO: 320895 - DNA, 25 bp, Mus musculus
ggacaggaaagggcactgtggagtc

SEQ ID NO: 320896 - DNA, 25 bp, Mus musculus
ggacaggaaaggtgtactcgggcat

SEQ ID NO: 320897 - DNA, 25 bp, Mus musculus
ggacaggaacaaacattcaggccaa

SEQ ID NO: 320898 - DNA, 25 bp, Mus musculus
ggacaggaagaggacgccctacctg

SEQ ID NO: 320899 - DNA, 25 bp, Mus musculus
ggacaggaaggtacttctccataca

SEQ ID NO: 320900 - DNA, 25 bp, Mus musculus
ggacaggaattgtttgttccttaca

SEQ ID NO: 320901 - DNA, 25 bp, Mus musculus
ggacaggacggggtccctccaatct

SEQ ID NO: 320902 - DNA, 25 bp, Mus musculus
ggacaggactacacagcatcctgcc

SEQ ID NO: 320903 - DNA, 25 bp, Mus musculus
ggacaggactagagaaagtgtgcaa

SEQ ID NO: 320904 - DNA, 25 bp, Mus musculus
ggacaggagaggatgggagccagga

SEQ ID NO: 320905 - DNA, 25 bp, Mus musculus
ggacaggaggggaagaaaatggaga

SEQ ID NO: 320906 - DNA, 25 bp, Mus musculus
ggacaggatgtgtgaagatctgtgg

SEQ ID NO: 320907 - DNA, 25 bp, Mus musculus
ggacaggccaaagcttcctgaaaga

SEQ ID NO: 320908 - DNA, 25 bp, Mus musculus
ggacaggccattggtggctatggcc

SEQ ID NO: 320909 - DNA, 25 bp, Mus musculus
ggacaggcctccgaatcacatgggt

SEQ ID NO: 320910 - DNA, 25 bp, Mus musculus
ggacaggccttgccagagccatgca

SEQ ID NO: 320911 - DNA, 25 bp, Mus musculus
ggacaggctacttctgcgacagtga

SEQ ID NO: 320912 - DNA, 25 bp, Mus musculus
ggacaggctacttcttctggatctc

SEQ ID NO: 320913 - DNA, 25 bp, Mus musculus
ggacagggaggtactgatactaact

SEQ ID NO: 320914 - DNA, 25 bp, Mus musculus
ggacagggaggttccagaatacctt

SEQ ID NO: 320915 - DNA, 25 bp, Mus musculus
ggacagggccttgaggacctgctct

SEQ ID NO: 320916 - DNA, 25 bp, Mus musculus
ggacaggggcacaatctgcagctca

SEQ ID NO: 320917 - DNA, 25 bp, Mus musculus
ggacagggtaaagaaggaatgggaa

SEQ ID NO: 320918 - DNA, 25 bp, Mus musculus
ggacagggtcagctggtcacttgct

SEQ ID NO: 320919 - DNA, 25 bp, Mus musculus
ggacagtaaaggaggcagcccgcgc

SEQ ID NO: 320920 - DNA, 25 bp, Mus musculus
ggacagtactctcccatggctattg

SEQ ID NO: 320921 - DNA, 25 bp, Mus musculus
ggacagtagggaagttgccacccaa

SEQ ID NO: 320922 - DNA, 25 bp, Mus musculus
ggacagtagggcagcaccagcgaat

SEQ ID NO: 320923 - DNA, 25 bp, Mus musculus
ggacagtattgaggagaaacgaaac

SEQ ID NO: 320924 - DNA, 25 bp, Mus musculus
ggacagtcactcggaggcttactgc

SEQ ID NO: 320925 - DNA, 25 bp, Mus musculus
ggacagtcatggtggaccagcacac

SEQ ID NO: 320926 - DNA, 25 bp, Mus musculus
ggacagtccagcgagtgtgctagag

SEQ ID NO: 320927 - DNA, 25 bp, Mus musculus
ggacagtctgacacagcaattacca

SEQ ID NO: 320928 - DNA, 25 bp, Mus musculus
ggacagtctgcagcatgtgtgaact

SEQ ID NO: 320929 - DNA, 25 bp, Mus musculus
ggacagtgaagatggagctggagga

SEQ ID NO: 320930 - DNA, 25 bp, Mus musculus
ggacagtgaaggtgacccttgtact

SEQ ID NO: 320931 - DNA, 25 bp, Mus musculus
ggacagtgacagcatcacggctgcg

SEQ ID NO: 320932 - DNA, 25 bp, Mus musculus
ggacagtgagagcgagcaaccttca

SEQ ID NO: 320933 - DNA, 25 bp, Mus musculus
ggacagtgagcctcgaggtctcctt

SEQ ID NO: 320934 - DNA, 25 bp, Mus musculus
ggacagtgagctggtgacccctcct

SEQ ID NO: 320935 - DNA, 25 bp, Mus musculus
ggacagtgaggggacgatccggagc

SEQ ID NO: 320936 - DNA, 25 bp, Mus musculus
ggacagtgccaacatttaaacgagt

SEQ ID NO: 320937 - DNA, 25 bp, Mus musculus
ggacagtgccaacctgtgtgtcaac

SEQ ID NO: 320938 - DNA, 25 bp, Mus musculus
ggacagtgccaacctttctacgtct

SEQ ID NO: 320939 - DNA, 25 bp, Mus musculus
ggacagtgccagctgaggatggttc

SEQ ID NO: 320940 - DNA, 25 bp, Mus musculus
ggacagtgccttcagagtgatccac

SEQ ID NO: 320941 - DNA, 25 bp, Mus musculus
ggacagtgccttcaggtgccttgga

SEQ ID NO: 320942 - DNA, 25 bp, Mus musculus
ggacagtgctctgagaacagtacgg

SEQ ID NO: 320943 - DNA, 25 bp, Mus musculus
ggacagtggtgaggtgtatggctgg

SEQ ID NO: 320944 - DNA, 25 bp, Mus musculus
ggacagtgtgaccgtaccgaccctt

SEQ ID NO: 320945 - DNA, 25 bp, Mus musculus
ggacagtgtggacgggcagtctctg

SEQ ID NO: 320946 - DNA, 25 bp, Mus musculus
ggacagtgtggaggggcagtctctg

SEQ ID NO: 320947 - DNA, 25 bp, Mus musculus
ggacagtgttcaagggtctcttgtg

SEQ ID NO: 320948 - DNA, 25 bp, Mus musculus
ggacagtgtttggattctccagtga

SEQ ID NO: 320949 - DNA, 25 bp, Mus musculus
ggacagtgtttgggcggttcgacaa

SEQ ID NO: 320950 - DNA, 25 bp, Mus musculus
ggacagttcagggagggaaggatgc

SEQ ID NO: 320951 - DNA, 25 bp, Mus musculus
ggacagttgaagggccttcagtggg

SEQ ID NO: 320952 - DNA, 25 bp, Mus musculus
ggacagtttccatagaaccagtctt

SEQ ID NO: 320953 - DNA, 25 bp, Mus musculus
ggacataaatattcttgtagacact

SEQ ID NO: 320954 - DNA, 25 bp, Mus musculus
ggacatacccggttacataggatga

SEQ ID NO: 320955 - DNA, 25 bp, Mus musculus
ggacatactgatagaccctgttgac

SEQ ID NO: 320956 - DNA, 25 bp, Mus musculus
ggacatactgccatttgatcacagc

SEQ ID NO: 320957 - DNA, 25 bp, Mus musculus
ggacatagaagggcttggctgagta

SEQ ID NO: 320958 - DNA, 25 bp, Mus musculus
ggacatagagaccatagaatccaac

SEQ ID NO: 320959 - DNA, 25 bp, Mus musculus
ggacatagtttaggtattgctttca

SEQ ID NO: 320960 - DNA, 25 bp, Mus musculus
ggacatatcaattactgggattcag

SEQ ID NO: 320961 - DNA, 25 bp, Mus musculus
ggacatatcatcataccccacatta

SEQ ID NO: 320962 - DNA, 25 bp, Mus musculus
ggacatcaagactgccaaggttact

SEQ ID NO: 320963 - DNA, 25 bp, Mus musculus
ggacatcacagcatggtttattgaa

SEQ ID NO: 320964 - DNA, 25 bp, Mus musculus
ggacatcacgggttatatatttggg

SEQ ID NO: 320965 - DNA, 25 bp, Mus musculus
ggacatcacttggctgtcggcgagc

SEQ ID NO: 320966 - DNA, 25 bp, Mus musculus
ggacatcagagtaggtttgattggc

SEQ ID NO: 320967 - DNA, 25 bp, Mus musculus
ggacatcatcacagatcttcggaac

SEQ ID NO: 320968 - DNA, 25 bp, Mus musculus
ggacatcatcacagtgctgaagaca

SEQ ID NO: 320969 - DNA, 25 bp, Mus musculus
ggacatcatccggcgcctgtctcac

SEQ ID NO: 320970 - DNA, 25 bp, Mus musculus
ggacatcatggagtatgctgtgaac

SEQ ID NO: 320971 - DNA, 25 bp, Mus musculus
ggacatcattcagaaatggcaaaat

SEQ ID NO: 320972 - DNA, 25 bp, Mus musculus
ggacatcattcagggctgcaaaata

SEQ ID NO: 320973 - DNA, 25 bp, Mus musculus
ggacatcatttcagaagcatgtaat

SEQ ID NO: 320974 - DNA, 25 bp, Mus musculus
ggacatcccagacaattttggaaat

SEQ ID NO: 320975 - DNA, 25 bp, Mus musculus
ggacatcccagcaaagaaacgatga

SEQ ID NO: 320976 - DNA, 25 bp, Mus musculus
ggacatccgtggctccattgtctac

SEQ ID NO: 320977 - DNA, 25 bp, Mus musculus
ggacatccgtgggctagcccatgcc

SEQ ID NO: 320978 - DNA, 25 bp, Mus musculus
ggacatcctgaactactttgagagc

SEQ ID NO: 320979 - DNA, 25 bp, Mus musculus
ggacatcctgaagaattacctggca

SEQ ID NO: 320980 - DNA, 25 bp, Mus musculus
ggacatcctgaagtgtcttatctgt

SEQ ID NO: 320981 - DNA, 25 bp, Mus musculus
ggacatcctgatcttaggacagctc

SEQ ID NO: 320982 - DNA, 25 bp, Mus musculus
ggacatcctgcctccttccttgtgt

SEQ ID NO: 320983 - DNA, 25 bp, Mus musculus
ggacatcgagcaggccctttccgat

SEQ ID NO: 320984 - DNA, 25 bp, Mus musculus
ggacatcgcccaggttctcggactc

SEQ ID NO: 320985 - DNA, 25 bp, Mus musculus
ggacatcgccccagctccaaggaaa

SEQ ID NO: 320986 - DNA, 25 bp, Mus musculus
ggacatcgggacagcataagcagta

SEQ ID NO: 320987 - DNA, 25 bp, Mus musculus
ggacatcgtcacgagctgaggtcag

SEQ ID NO: 320988 - DNA, 25 bp, Mus musculus
ggacatcgtcgggagcattactgta

SEQ ID NO: 320989 - DNA, 25 bp, Mus musculus
ggacatcgtcggggccagtgactat

SEQ ID NO: 320990 - DNA, 25 bp, Mus musculus
ggacatcgtggccagacttcatggg

SEQ ID NO: 320991 - DNA, 25 bp, Mus musculus
ggacatcgtggctcctgcttcctga

SEQ ID NO: 320992 - DNA, 25 bp, Mus musculus
ggacatctcacaaaaaacatcggac

SEQ ID NO: 320993 - DNA, 25 bp, Mus musculus
ggacatctccaagatgcacatgatc

SEQ ID NO: 320994 - DNA, 25 bp, Mus musculus
ggacatctgaaagctgagccccagg

SEQ ID NO: 320995 - DNA, 25 bp, Mus musculus
ggacatctgcaggatctgccactgt

SEQ ID NO: 320996 - DNA, 25 bp, Mus musculus
ggacatctggaagtaacttgaatcc

SEQ ID NO: 320997 - DNA, 25 bp, Mus musculus
ggacatctgtggttcggcagactcc

SEQ ID NO: 320998 - DNA, 25 bp, Mus musculus
ggacatcttcaccaggtccagctag

SEQ ID NO: 320999 - DNA, 25 bp, Mus musculus
ggacatcttcaccagtctaaatcca

SEQ ID NO: 321000 - DNA, 25 bp, Mus musculus
ggacatcttcctgaggaatgtcaca

SEQ ID NO: 321001 - DNA, 25 bp, Mus musculus
ggacatcttcctggacacatcttac

SEQ ID NO: 321002 - DNA, 25 bp, Mus musculus
ggacatgaaacagtacctttgaccg

SEQ ID NO: 321003 - DNA, 25 bp, Mus musculus
ggacatgaaagtggccgaggtcctg

SEQ ID NO: 321004 - DNA, 25 bp, Mus musculus
ggacatgaaatggtgccacatccca

SEQ ID NO: 321005 - DNA, 25 bp, Mus musculus
ggacatgaacctcagcattgtgatg

SEQ ID NO: 321006 - DNA, 25 bp, Mus musculus
ggacatgaagctgtttgtatggcag

SEQ ID NO: 321007 - DNA, 25 bp, Mus musculus
ggacatgaaggtagcatcgcctgcc

SEQ ID NO: 321008 - DNA, 25 bp, Mus musculus
ggacatgaaggtgcctcagccagga

SEQ ID NO: 321009 - DNA, 25 bp, Mus musculus
ggacatgaatttggacctcactgag

SEQ ID NO: 321010 - DNA, 25 bp, Mus musculus
ggacatgaccccctgcccggcgtca

SEQ ID NO: 321011 - DNA, 25 bp, Mus musculus
ggacatgacccggtctcaagggagc

SEQ ID NO: 321012 - DNA, 25 bp, Mus musculus
ggacatgatagacggcttgaagccc

SEQ ID NO: 321013 - DNA, 25 bp, Mus musculus
ggacatgatctccacatcttatcct

SEQ ID NO: 321014 - DNA, 25 bp, Mus musculus
ggacatgcagtggaaagttcgaagg

SEQ ID NO: 321015 - DNA, 25 bp, Mus musculus
ggacatgcatttcaggttaatatcc

SEQ ID NO: 321016 - DNA, 25 bp, Mus musculus
ggacatgccagggctgtagcagtgg

SEQ ID NO: 321017 - DNA, 25 bp, Mus musculus
ggacatgccaggtcctacatctcct

SEQ ID NO: 321018 - DNA, 25 bp, Mus musculus
ggacatgctgtgaatattctagagg

SEQ ID NO: 321019 - DNA, 25 bp, Mus musculus
ggacatgctgtgatggacatactaa

SEQ ID NO: 321020 - DNA, 25 bp, Mus musculus
ggacatgggactaggatgatgtcta

SEQ ID NO: 321021 - DNA, 25 bp, Mus musculus
ggacatggtggagcactacaccaag

SEQ ID NO: 321022 - DNA, 25 bp, Mus musculus
ggacatggtggagctggctggctac

SEQ ID NO: 321023 - DNA, 25 bp, Mus musculus
ggacatgtcagtggaaacctctgtg

SEQ ID NO: 321024 - DNA, 25 bp, Mus musculus
ggacatgtcgtccctaatgtggatc

SEQ ID NO: 321025 - DNA, 25 bp, Mus musculus
ggacatgtcgtgtttctttcagtcc

SEQ ID NO: 321026 - DNA, 25 bp, Mus musculus
ggacatgtggaaatccccagaggag

SEQ ID NO: 321027 - DNA, 25 bp, Mus musculus
ggacatgtgtattgcaagacagatc

SEQ ID NO: 321028 - DNA, 25 bp, Mus musculus
ggacatgtgtattggtgagaagcca

SEQ ID NO: 321029 - DNA, 25 bp, Mus musculus
ggacatgtgtgagggctgccggtca

SEQ ID NO: 321030 - DNA, 25 bp, Mus musculus
ggacatgttcagcctggccaaactg

SEQ ID NO: 321031 - DNA, 25 bp, Mus musculus
ggacatgttcaggtttggcaaacat

SEQ ID NO: 321032 - DNA, 25 bp, Mus musculus
ggacatgttgaagagactttcaaca

SEQ ID NO: 321033 - DNA, 25 bp, Mus musculus
ggacatgttgaaggtgttggctgcc

SEQ ID NO: 321034 - DNA, 25 bp, Mus musculus
ggacattaagagtggaaagctgagc

SEQ ID NO: 321035 - DNA, 25 bp, Mus musculus
ggacattaaggccacccgagacctc

SEQ ID NO: 321036 - DNA, 25 bp, Mus musculus
ggacattactggccagttcacaatg

SEQ ID NO: 321037 - DNA, 25 bp, Mus musculus
ggacattaggaaattagataggttt

SEQ ID NO: 321038 - DNA, 25 bp, Mus musculus
ggacattcaaagtaccattactatg

SEQ ID NO: 321039 - DNA, 25 bp, Mus musculus
ggacattcagggcttcctgaagaat

SEQ ID NO: 321040 - DNA, 25 bp, Mus musculus
ggacattcaggttggctcctgtcct

SEQ ID NO: 321041 - DNA, 25 bp, Mus musculus
ggacattcctggagggatcatgcct

SEQ ID NO: 321042 - DNA, 25 bp, Mus musculus
ggacattccttatcataacagaatc

SEQ ID NO: 321043 - DNA, 25 bp, Mus musculus
ggacattcggacccagatgacccag

SEQ ID NO: 321044 - DNA, 25 bp, Mus musculus
ggacattctggggaacggattgctg

SEQ ID NO: 321045 - DNA, 25 bp, Mus musculus
ggacattgagacagaaagacatggc

SEQ ID NO: 321046 - DNA, 25 bp, Mus musculus
ggacattgatgaaactgttattgga

SEQ ID NO: 321047 - DNA, 25 bp, Mus musculus
ggacattgcacgtggtggtaatcag

SEQ ID NO: 321048 - DNA, 25 bp, Mus musculus
ggacattgccaagttaaaaggagaa

SEQ ID NO: 321049 - DNA, 25 bp, Mus musculus
ggacattgccgagcgtgagagccaa

SEQ ID NO: 321050 - DNA, 25 bp, Mus musculus
ggacattgctaactgccttgcagtg

SEQ ID NO: 321051 - DNA, 25 bp, Mus musculus
ggacattggcacagaggctcagatc

SEQ ID NO: 321052 - DNA, 25 bp, Mus musculus
ggacattgtgtggggtcaccgacaa

SEQ ID NO: 321053 - DNA, 25 bp, Mus musculus
ggacattgtttactccctgaaggag

SEQ ID NO: 321054 - DNA, 25 bp, Mus musculus
ggacatttcaaaagaaaggacctat

SEQ ID NO: 321055 - DNA, 25 bp, Mus musculus
ggacatttcaaaagtttgatttcca

SEQ ID NO: 321056 - DNA, 25 bp, Mus musculus
ggacatttgtttgcaatcaattata

SEQ ID NO: 321057 - DNA, 25 bp, Mus musculus
ggaccaaaaatgtggacatcttcaa

SEQ ID NO: 321058 - DNA, 25 bp, Mus musculus
ggaccaaacacgtgaagaagagtct

SEQ ID NO: 321059 - DNA, 25 bp, Mus musculus
ggaccaaacggtgatggaaaacgtg

SEQ ID NO: 321060 - DNA, 25 bp, Mus musculus
ggaccaaagagcagccccggactca

SEQ ID NO: 321061 - DNA, 25 bp, Mus musculus
ggaccaaagagctgcctctgttcct

SEQ ID NO: 321062 - DNA, 25 bp, Mus musculus
ggaccaaagggaagggctccacctg

SEQ ID NO: 321063 - DNA, 25 bp, Mus musculus
ggaccaaatggaatgaataaaatgg

SEQ ID NO: 321064 - DNA, 25 bp, Mus musculus
ggaccaaattaatgacaagaacgga

SEQ ID NO: 321065 - DNA, 25 bp, Mus musculus
ggaccaaattaatgagtacaaggag

SEQ ID NO: 321066 - DNA, 25 bp, Mus musculus
ggaccaaattaatgtggatgatctt

SEQ ID NO: 321067 - DNA, 25 bp, Mus musculus
ggaccaaccaggggccttggcctta

SEQ ID NO: 321068 - DNA, 25 bp, Mus musculus
ggaccaaccagggtcatgccattgc

SEQ ID NO: 321069 - DNA, 25 bp, Mus musculus
ggaccaactttgctagatgtgtctt

SEQ ID NO: 321070 - DNA, 25 bp, Mus musculus
ggaccaactttgctgtcatttctca

SEQ ID NO: 321071 - DNA, 25 bp, Mus musculus
ggaccaactttgcttcattacagga

SEQ ID NO: 321072 - DNA, 25 bp, Mus musculus
ggaccaagaggacggtgtgccgatg

SEQ ID NO: 321073 - DNA, 25 bp, Mus musculus
ggaccaagatgcagacgacctggag

SEQ ID NO: 321074 - DNA, 25 bp, Mus musculus
ggaccaagctcagcctcctcttaga

SEQ ID NO: 321075 - DNA, 25 bp, Mus musculus
ggaccaagtgtgccgatcccgtgca

SEQ ID NO: 321076 - DNA, 25 bp, Mus musculus
ggaccaagtgtgccggagccagtgt

SEQ ID NO: 321077 - DNA, 25 bp, Mus musculus
ggaccaatcgccactgtgttcacac

SEQ ID NO: 321078 - DNA, 25 bp, Mus musculus
ggaccaatttgaaattgcagactgt

SEQ ID NO: 321079 - DNA, 25 bp, Mus musculus
ggaccacaccagcattcggaggggt

SEQ ID NO: 321080 - DNA, 25 bp, Mus musculus
ggaccacaccagttcctctaattct

SEQ ID NO: 321081 - DNA, 25 bp, Mus musculus
ggaccacagagggtggctgtctgcc

SEQ ID NO: 321082 - DNA, 25 bp, Mus musculus
ggaccacagggatgttggatggaag

SEQ ID NO: 321083 - DNA, 25 bp, Mus musculus
ggaccacagtcaccgagagtgagca

SEQ ID NO: 321084 - DNA, 25 bp, Mus musculus
ggaccacagtgctgccatagtggac

SEQ ID NO: 321085 - DNA, 25 bp, Mus musculus
ggaccacagtgggcctgtgctttaa

SEQ ID NO: 321086 - DNA, 25 bp, Mus musculus
ggaccacattaggactctgttggtg

SEQ ID NO: 321087 - DNA, 25 bp, Mus musculus
ggaccacattaggatctgaagtgaa

SEQ ID NO: 321088 - DNA, 25 bp, Mus musculus
ggaccaccaagacatccaggagctg

SEQ ID NO: 321089 - DNA, 25 bp, Mus musculus
ggaccaccaagactcacaccctaca

SEQ ID NO: 321090 - DNA, 25 bp, Mus musculus
ggaccaccagagcctgtactcctgg

SEQ ID NO: 321091 - DNA, 25 bp, Mus musculus
ggaccaccatgatattggaccatgt

SEQ ID NO: 321092 - DNA, 25 bp, Mus musculus
ggaccacccagctgtggctgcgacc

SEQ ID NO: 321093 - DNA, 25 bp, Mus musculus
ggaccacccttggtgaaggcagcta

SEQ ID NO: 321094 - DNA, 25 bp, Mus musculus
ggaccacctctagaggcctatacca

SEQ ID NO: 321095 - DNA, 25 bp, Mus musculus
ggaccacctctagagttgaccaagc

SEQ ID NO: 321096 - DNA, 25 bp, Mus musculus
ggaccacctggtccaagagggtttc

SEQ ID NO: 321097 - DNA, 25 bp, Mus musculus
ggaccacgaatgtgccgcttcatca

SEQ ID NO: 321098 - DNA, 25 bp, Mus musculus
ggaccactcaaatgggcataggtgg

SEQ ID NO: 321099 - DNA, 25 bp, Mus musculus
ggaccactccatggattgccggaac

SEQ ID NO: 321100 - DNA, 25 bp, Mus musculus
ggaccactcggagatgtggtcagct

SEQ ID NO: 321101 - DNA, 25 bp, Mus musculus
ggaccactcggcctctgcagagatg

SEQ ID NO: 321102 - DNA, 25 bp, Mus musculus
ggaccactgagaggcctacgtgaag

SEQ ID NO: 321103 - DNA, 25 bp, Mus musculus
ggaccactgagcctgagcagatggg

SEQ ID NO: 321104 - DNA, 25 bp, Mus musculus
ggaccacttcaacaggactcatttc

SEQ ID NO: 321105 - DNA, 25 bp, Mus musculus
ggaccagaagacagtgatggcgact

SEQ ID NO: 321106 - DNA, 25 bp, Mus musculus
ggaccagaagacagttgccctctat

SEQ ID NO: 321107 - DNA, 25 bp, Mus musculus
ggaccagacaaagacatggacccta

SEQ ID NO: 321108 - DNA, 25 bp, Mus musculus
ggaccagacaaagccgaccctttcc

SEQ ID NO: 321109 - DNA, 25 bp, Mus musculus
ggaccagagagggtccgggccatca

SEQ ID NO: 321110 - DNA, 25 bp, Mus musculus
ggaccagatggcttcctgtttggcc

SEQ ID NO: 321111 - DNA, 25 bp, Mus musculus
ggaccagcaaagaaaaaatggcgtc

SEQ ID NO: 321112 - DNA, 25 bp, Mus musculus
ggaccagcagagaaattcaaagggc

SEQ ID NO: 321113 - DNA, 25 bp, Mus musculus
ggaccagccctggggtacttgttga

SEQ ID NO: 321114 - DNA, 25 bp, Mus musculus
ggaccagcctttacaggacgccttt

SEQ ID NO: 321115 - DNA, 25 bp, Mus musculus
ggaccagctctcggggatcttgaaa

SEQ ID NO: 321116 - DNA, 25 bp, Mus musculus
ggaccagctgcactatgtgacggag

SEQ ID NO: 321117 - DNA, 25 bp, Mus musculus
ggaccagctgggagagcgaggggtt

SEQ ID NO: 321118 - DNA, 25 bp, Mus musculus
ggaccagctgggcccccagcatggt

SEQ ID NO: 321119 - DNA, 25 bp, Mus musculus
ggaccaggaagcaggtgtctagtca

SEQ ID NO: 321120 - DNA, 25 bp, Mus musculus
ggaccaggagcttttccagaccttc

SEQ ID NO: 321121 - DNA, 25 bp, Mus musculus
ggaccaggcacccagagttttgctc

SEQ ID NO: 321122 - DNA, 25 bp, Mus musculus
ggaccaggcagaagctgggaagtca

SEQ ID NO: 321123 - DNA, 25 bp, Mus musculus
ggaccaggcaggagtacctggagtt

SEQ ID NO: 321124 - DNA, 25 bp, Mus musculus
ggaccaggcagtacacctatggcgg

SEQ ID NO: 321125 - DNA, 25 bp, Mus musculus
ggaccaggcggttgtggatctcctg

SEQ ID NO: 321126 - DNA, 25 bp, Mus musculus
ggaccaggctgacgggtatcaccac

SEQ ID NO: 321127 - DNA, 25 bp, Mus musculus
ggaccagggacagactcactctgtg

SEQ ID NO: 321128 - DNA, 25 bp, Mus musculus
ggaccagggcagtgccctgcagaca

SEQ ID NO: 321129 - DNA, 25 bp, Mus musculus
ggaccagtgcaagacagggtctcat

SEQ ID NO: 321130 - DNA, 25 bp, Mus musculus
ggaccagtttcagcgtgcgggaggt

SEQ ID NO: 321131 - DNA, 25 bp, Mus musculus
ggaccataaagtctaaggttgtggg

SEQ ID NO: 321132 - DNA, 25 bp, Mus musculus
ggaccatagtggagggacggcttgg

SEQ ID NO: 321133 - DNA, 25 bp, Mus musculus
ggaccatatcaagtctatgcatgga

SEQ ID NO: 321134 - DNA, 25 bp, Mus musculus
ggaccatatgaacttggcatggaac

SEQ ID NO: 321135 - DNA, 25 bp, Mus musculus
ggaccatcaaacagacctttggcta

SEQ ID NO: 321136 - DNA, 25 bp, Mus musculus
ggaccatcacaagatctgatactct

SEQ ID NO: 321137 - DNA, 25 bp, Mus musculus
ggaccatcacaaggtctgatactct

SEQ ID NO: 321138 - DNA, 25 bp, Mus musculus
ggaccatcacccttcagagtcagcc

SEQ ID NO: 321139 - DNA, 25 bp, Mus musculus
ggaccatcactcgagcttctaggga

SEQ ID NO: 321140 - DNA, 25 bp, Mus musculus
ggaccatcagccttggggagttctg

SEQ ID NO: 321141 - DNA, 25 bp, Mus musculus
ggaccatcatcaatggcattgtgga

SEQ ID NO: 321142 - DNA, 25 bp, Mus musculus
ggaccatcattggcgattccggggt

SEQ ID NO: 321143 - DNA, 25 bp, Mus musculus
ggaccatcattggcggtgcccagat

SEQ ID NO: 321144 - DNA, 25 bp, Mus musculus
ggaccatccttaagtggccaaatgt

SEQ ID NO: 321145 - DNA, 25 bp, Mus musculus
ggaccatcggggtacctggaatggg

SEQ ID NO: 321146 - DNA, 25 bp, Mus musculus
ggaccatgcaggttcgcaacgttct

SEQ ID NO: 321147 - DNA, 25 bp, Mus musculus
ggaccatgcgaatgttcggagcgac

SEQ ID NO: 321148 - DNA, 25 bp, Mus musculus
ggaccatgcgcaatcaggattcaga

SEQ ID NO: 321149 - DNA, 25 bp, Mus musculus
ggaccatgcgcctgcggagttctac

SEQ ID NO: 321150 - DNA, 25 bp, Mus musculus
ggaccatgctccccacccccgatct

SEQ ID NO: 321151 - DNA, 25 bp, Mus musculus
ggaccatgctgttcttttcagggga

SEQ ID NO: 321152 - DNA, 25 bp, Mus musculus
ggaccatggagaccatagtctgtgt

SEQ ID NO: 321153 - DNA, 25 bp, Mus musculus
ggaccatggaggtgtgtgtacatgt

SEQ ID NO: 321154 - DNA, 25 bp, Mus musculus
ggaccatggcaggggagtcctcatg

SEQ ID NO: 321155 - DNA, 25 bp, Mus musculus
ggaccatggccttatgttgacttac

SEQ ID NO: 321156 - DNA, 25 bp, Mus musculus
ggaccattaaagtgtggagcacgag

SEQ ID NO: 321157 - DNA, 25 bp, Mus musculus
ggaccattggagggttcccagtggg

SEQ ID NO: 321158 - DNA, 25 bp, Mus musculus
ggaccattttagactacatccagca

SEQ ID NO: 321159 - DNA, 25 bp, Mus musculus
ggacccaaaccagggtgtggacatt

SEQ ID NO: 321160 - DNA, 25 bp, Mus musculus
ggacccaaagaggtctctcaccttc

SEQ ID NO: 321161 - DNA, 25 bp, Mus musculus
ggacccaaagaggtgtgaggttaat

SEQ ID NO: 321162 - DNA, 25 bp, Mus musculus
ggacccaaaggccctgcctgcctga

SEQ ID NO: 321163 - DNA, 25 bp, Mus musculus
ggacccaaatcaatactacaagatc

SEQ ID NO: 321164 - DNA, 25 bp, Mus musculus
ggacccaagggaaagcgtggagaga

SEQ ID NO: 321165 - DNA, 25 bp, Mus musculus
ggacccacagcgacccatacgtgaa

SEQ ID NO: 321166 - DNA, 25 bp, Mus musculus
ggacccacagggccctgtgtgctgc

SEQ ID NO: 321167 - DNA, 25 bp, Mus musculus
ggacccacatggttactgggaagtg

SEQ ID NO: 321168 - DNA, 25 bp, Mus musculus
ggacccaccgccaagagaataaaga

SEQ ID NO: 321169 - DNA, 25 bp, Mus musculus
ggacccaccgccaagatggattcat

SEQ ID NO: 321170 - DNA, 25 bp, Mus musculus
ggacccacctgcaagattctggtgc

SEQ ID NO: 321171 - DNA, 25 bp, Mus musculus
ggacccacctgcaagtctacagaga

SEQ ID NO: 321172 - DNA, 25 bp, Mus musculus
ggacccagaaagcatctgcatctct

SEQ ID NO: 321173 - DNA, 25 bp, Mus musculus
ggacccagaagatgatttttgatcc

SEQ ID NO: 321174 - DNA, 25 bp, Mus musculus
ggacccagaaggattgccacaaggc

SEQ ID NO: 321175 - DNA, 25 bp, Mus musculus
ggacccagaaggtttgaggctctgt

SEQ ID NO: 321176 - DNA, 25 bp, Mus musculus
ggacccagacaggtgcgtggtccaa

SEQ ID NO: 321177 - DNA, 25 bp, Mus musculus
ggacccagagcaagtccacatgcga

SEQ ID NO: 321178 - DNA, 25 bp, Mus musculus
ggacccagccagccccggaaagcca

SEQ ID NO: 321179 - DNA, 25 bp, Mus musculus
ggacccagctggagaaagattccag

SEQ ID NO: 321180 - DNA, 25 bp, Mus musculus
ggacccagctggaggtcacctcagc

SEQ ID NO: 321181 - DNA, 25 bp, Mus musculus
ggacccaggacagacagctgcagca

SEQ ID NO: 321182 - DNA, 25 bp, Mus musculus
ggacccaggcataggtcacctccaa

SEQ ID NO: 321183 - DNA, 25 bp, Mus musculus
ggacccaggcgatcaaccgagaaag

SEQ ID NO: 321184 - DNA, 25 bp, Mus musculus
ggacccagggaaggtgctgtgggac

SEQ ID NO: 321185 - DNA, 25 bp, Mus musculus
ggacccagtgacgggtgagcctgca

SEQ ID NO: 321186 - DNA, 25 bp, Mus musculus
ggacccatcagctatgtggtggtga

SEQ ID NO: 321187 - DNA, 25 bp, Mus musculus
ggacccatctacagaggctgatccc

SEQ ID NO: 321188 - DNA, 25 bp, Mus musculus
ggaccccaaaggccatgaagaagat

SEQ ID NO: 321189 - DNA, 25 bp, Mus musculus
ggaccccaaagtggttgatcggttg

SEQ ID NO: 321190 - DNA, 25 bp, Mus musculus
ggaccccaaatgattataagcacac

SEQ ID NO: 321191 - DNA, 25 bp, Mus musculus
ggaccccacagtcagccttttatgt

SEQ ID NO: 321192 - DNA, 25 bp, Mus musculus
ggaccccacagtgcaagaatccctg

SEQ ID NO: 321193 - DNA, 25 bp, Mus musculus
ggaccccaccccgctggctgccttc

SEQ ID NO: 321194 - DNA, 25 bp, Mus musculus
ggaccccactgaggcttctcaaacc

SEQ ID NO: 321195 - DNA, 25 bp, Mus musculus
ggaccccactgcactgctgttaatg

SEQ ID NO: 321196 - DNA, 25 bp, Mus musculus
ggaccccagaacaagagctgaggct

SEQ ID NO: 321197 - DNA, 25 bp, Mus musculus
ggaccccagacctgcagctaaagca

SEQ ID NO: 321198 - DNA, 25 bp, Mus musculus
ggaccccagatgcaccatgggcttg

SEQ ID NO: 321199 - DNA, 25 bp, Mus musculus
ggaccccagccaggcccccagcaaa

SEQ ID NO: 321200 - DNA, 25 bp, Mus musculus
ggaccccagccaggtcagtggctat

SEQ ID NO: 321201 - DNA, 25 bp, Mus musculus
ggaccccagggtccattcagaagct

SEQ ID NO: 321202 - DNA, 25 bp, Mus musculus
ggaccccatcatctgcactgctctg

SEQ ID NO: 321203 - DNA, 25 bp, Mus musculus
ggaccccatgaaggtacgggtggtt

SEQ ID NO: 321204 - DNA, 25 bp, Mus musculus
ggaccccatgaagtgtttggtgtac

SEQ ID NO: 321205 - DNA, 25 bp, Mus musculus
ggaccccatggcccctcaccgttcc

SEQ ID NO: 321206 - DNA, 25 bp, Mus musculus
ggacccccaccaggagagaaaggac

SEQ ID NO: 321207 - DNA, 25 bp, Mus musculus
ggacccccaggtgatgctggcgccc

SEQ ID NO: 321208 - DNA, 25 bp, Mus musculus
ggacccccgaggtgattcatggcag

SEQ ID NO: 321209 - DNA, 25 bp, Mus musculus
ggacccccgagtgtccaggttatgg

SEQ ID NO: 321210 - DNA, 25 bp, Mus musculus
ggaccccctttcgccacagcccaac

SEQ ID NO: 321211 - DNA, 25 bp, Mus musculus
ggaccccgaagcagaggatgaagga

SEQ ID NO: 321212 - DNA, 25 bp, Mus musculus
ggaccccgagagccccaaggacgat

SEQ ID NO: 321213 - DNA, 25 bp, Mus musculus
ggaccccgagatccagttggactcc

SEQ ID NO: 321214 - DNA, 25 bp, Mus musculus
ggaccccgagatcgccggggctctg

SEQ ID NO: 321215 - DNA, 25 bp, Mus musculus
ggaccccgagcaggatggtgaggat

SEQ ID NO: 321216 - DNA, 25 bp, Mus musculus
ggaccccgaggagccaacatgttgg

SEQ ID NO: 321217 - DNA, 25 bp, Mus musculus
ggaccccgaggcactgcctctgtac

SEQ ID NO: 321218 - DNA, 25 bp, Mus musculus
ggaccccgcgtctcggaagactctt

SEQ ID NO: 321219 - DNA, 25 bp, Mus musculus
ggaccccggattgcacaggcatgga

SEQ ID NO: 321220 - DNA, 25 bp, Mus musculus
ggaccccgggttccagtgacagcag

SEQ ID NO: 321221 - DNA, 25 bp, Mus musculus
ggaccccgtggatggtgtggtcctg

SEQ ID NO: 321222 - DNA, 25 bp, Mus musculus
ggaccccgtggtctacgtgacactg

SEQ ID NO: 321223 - DNA, 25 bp, Mus musculus
ggacccctatgaggagctcctagtt

SEQ ID NO: 321224 - DNA, 25 bp, Mus musculus
ggacccctgaaggacatagcattgt

SEQ ID NO: 321225 - DNA, 25 bp, Mus musculus
ggacccctgaaggttacagtctcta

SEQ ID NO: 321226 - DNA, 25 bp, Mus musculus
ggacccgatagcctcggccctgcga

SEQ ID NO: 321227 - DNA, 25 bp, Mus musculus
ggacccgatgtgcgcattaaagagg

SEQ ID NO: 321228 - DNA, 25 bp, Mus musculus
ggacccgatgtggctcttaaggact

SEQ ID NO: 321229 - DNA, 25 bp, Mus musculus
ggacccgcaaggttaataacttgaa

SEQ ID NO: 321230 - DNA, 25 bp, Mus musculus
ggacccgcaggtcctaatctgaagg

SEQ ID NO: 321231 - DNA, 25 bp, Mus musculus
ggacccgccgacagccaccatgcgg

SEQ ID NO: 321232 - DNA, 25 bp, Mus musculus
ggacccgcgaggagttggcatccat

SEQ ID NO: 321233 - DNA, 25 bp, Mus musculus
ggacccgcgaggcaagcagtctccc

SEQ ID NO: 321234 - DNA, 25 bp, Mus musculus
ggacccgctcagatcttgacagttg

SEQ ID NO: 321235 - DNA, 25 bp, Mus musculus
ggacccgctcagggaaacagatctt

SEQ ID NO: 321236 - DNA, 25 bp, Mus musculus
ggacccggaaaagcatgccttggac

SEQ ID NO: 321237 - DNA, 25 bp, Mus musculus
ggacccggaactgaaagcaaaatca

SEQ ID NO: 321238 - DNA, 25 bp, Mus musculus
ggacccggagggttgctatcggctg

SEQ ID NO: 321239 - DNA, 25 bp, Mus musculus
ggacccgtgtgagaaagtcagctct

SEQ ID NO: 321240 - DNA, 25 bp, Mus musculus
ggacccgtgtgaggctgaaaagacc

SEQ ID NO: 321241 - DNA, 25 bp, Mus musculus
ggaccctaacagagtacacacgaag

SEQ ID NO: 321242 - DNA, 25 bp, Mus musculus
ggaccctaaggagaaggagcgccag

SEQ ID NO: 321243 - DNA, 25 bp, Mus musculus
ggaccctaagtgcagctttgttgta

SEQ ID NO: 321244 - DNA, 25 bp, Mus musculus
ggaccctaggtcagagtcttgtcca

SEQ ID NO: 321245 - DNA, 25 bp, Mus musculus
ggaccctatgaagttgaaaacacag

SEQ ID NO: 321246 - DNA, 25 bp, Mus musculus
ggaccctcagattgatgacattgta

SEQ ID NO: 321247 - DNA, 25 bp, Mus musculus
ggaccctcagcaaagacaagattga

SEQ ID NO: 321248 - DNA, 25 bp, Mus musculus
ggaccctcaggcattatgagagact

SEQ ID NO: 321249 - DNA, 25 bp, Mus musculus
ggaccctcaggtactaggcggcctg

SEQ ID NO: 321250 - DNA, 25 bp, Mus musculus
ggaccctcaggtttgatgaagataa

SEQ ID NO: 321251 - DNA, 25 bp, Mus musculus
ggaccctccaaagaatcataacggt

SEQ ID NO: 321252 - DNA, 25 bp, Mus musculus
ggaccctccaaaggtcctgcttagg

SEQ ID NO: 321253 - DNA, 25 bp, Mus musculus
ggaccctcgaccgtttccaggatac

SEQ ID NO: 321254 - DNA, 25 bp, Mus musculus
ggaccctcgacgccttattcaggat

SEQ ID NO: 321255 - DNA, 25 bp, Mus musculus
ggaccctctgaggggcaccatgtac

SEQ ID NO: 321256 - DNA, 25 bp, Mus musculus
ggaccctgacccagccccaccattc

SEQ ID NO: 321257 - DNA, 25 bp, Mus musculus
ggaccctgagcaggctcctgctgaa

SEQ ID NO: 321258 - DNA, 25 bp, Mus musculus
ggaccctgagttccaccaggtgaga

SEQ ID NO: 321259 - DNA, 25 bp, Mus musculus
ggaccctgctcctgggcttgtggag

SEQ ID NO: 321260 - DNA, 25 bp, Mus musculus
ggaccctgctcctggtggcatcttt

SEQ ID NO: 321261 - DNA, 25 bp, Mus musculus
ggaccctgctcctggtttctgaact

SEQ ID NO: 321262 - DNA, 25 bp, Mus musculus
ggaccctgctctgacgtatgacttc

SEQ ID NO: 321263 - DNA, 25 bp, Mus musculus
ggaccctgctgaccctgtacacata

SEQ ID NO: 321264 - DNA, 25 bp, Mus musculus
ggaccctgcttactggtttctctcg

SEQ ID NO: 321265 - DNA, 25 bp, Mus musculus
ggaccctgcttactggtttctgtct

SEQ ID NO: 321266 - DNA, 25 bp, Mus musculus
ggaccctggacaaatgtcccttcac

SEQ ID NO: 321267 - DNA, 25 bp, Mus musculus
ggaccctggacaagttaatcgatgg

SEQ ID NO: 321268 - DNA, 25 bp, Mus musculus
ggaccctggacaatggtgaacaacc

SEQ ID NO: 321269 - DNA, 25 bp, Mus musculus
ggaccctggatgatgggctaggcca

SEQ ID NO: 321270 - DNA, 25 bp, Mus musculus
ggaccctggatgatggtgtgattgc

SEQ ID NO: 321271 - DNA, 25 bp, Mus musculus
ggaccctggcacaaggcaggcgaca

SEQ ID NO: 321272 - DNA, 25 bp, Mus musculus
ggaccctggcacaaggtaacacgga

SEQ ID NO: 321273 - DNA, 25 bp, Mus musculus
ggaccctggcctgcctgagggatct

SEQ ID NO: 321274 - DNA, 25 bp, Mus musculus
ggaccctgggagcctacttccagca

SEQ ID NO: 321275 - DNA, 25 bp, Mus musculus
ggaccctgtgacgaaagaagaaatt

SEQ ID NO: 321276 - DNA, 25 bp, Mus musculus
ggaccctgtgagctcggtcgaggag

SEQ ID NO: 321277 - DNA, 25 bp, Mus musculus
ggaccctgtggaagggcggctggtg

SEQ ID NO: 321278 - DNA, 25 bp, Mus musculus
ggacccttaagggccacaccaagga

SEQ ID NO: 321279 - DNA, 25 bp, Mus musculus
ggacccttcagcagatgaatggaaa

SEQ ID NO: 321280 - DNA, 25 bp, Mus musculus
ggacccttggcaggagctgtgaaat

SEQ ID NO: 321281 - DNA, 25 bp, Mus musculus
ggacccttgttcactgtacctcatc

SEQ ID NO: 321282 - DNA, 25 bp, Mus musculus
ggaccgaaagcagaggagcaccggg

SEQ ID NO: 321283 - DNA, 25 bp, Mus musculus
ggaccgacgagcccttgctgctctt

SEQ ID NO: 321284 - DNA, 25 bp, Mus musculus
ggaccgactgcttactgatgtcaag

SEQ ID NO: 321285 - DNA, 25 bp, Mus musculus
ggaccgactggttactgatgtcaag

SEQ ID NO: 321286 - DNA, 25 bp, Mus musculus
ggaccgacttttcagagccactcag

SEQ ID NO: 321287 - DNA, 25 bp, Mus musculus
ggaccgacttttcagggttcagact

SEQ ID NO: 321288 - DNA, 25 bp, Mus musculus
ggaccgagaataagtccaagtttgg

SEQ ID NO: 321289 - DNA, 25 bp, Mus musculus
ggaccgagacagctccttccgcttc

SEQ ID NO: 321290 - DNA, 25 bp, Mus musculus
ggaccgagagaaagtccctgagtac

SEQ ID NO: 321291 - DNA, 25 bp, Mus musculus
ggaccgagagggttacacatcattt

SEQ ID NO: 321292 - DNA, 25 bp, Mus musculus
ggaccgagaggtgagacgtggaatc

SEQ ID NO: 321293 - DNA, 25 bp, Mus musculus
ggaccgagaggtgatctgtaaatcg

SEQ ID NO: 321294 - DNA, 25 bp, Mus musculus
ggaccgagatgcagctgttgccgca

SEQ ID NO: 321295 - DNA, 25 bp, Mus musculus
ggaccgagcagcgaacagttgaata

SEQ ID NO: 321296 - DNA, 25 bp, Mus musculus
ggaccgagttccgggtcatgcatcc

SEQ ID NO: 321297 - DNA, 25 bp, Mus musculus
ggaccgagttccgggtgctgggtgt

SEQ ID NO: 321298 - DNA, 25 bp, Mus musculus
ggaccgagtttccagagccctgaag

SEQ ID NO: 321299 - DNA, 25 bp, Mus musculus
ggaccgatcacaggtcacttggcat

SEQ ID NO: 321300 - DNA, 25 bp, Mus musculus
ggaccgatgagtcggatgcagaggc

SEQ ID NO: 321301 - DNA, 25 bp, Mus musculus
ggaccgcaacaacgccatctatgag

SEQ ID NO: 321302 - DNA, 25 bp, Mus musculus
ggaccgcaccaaagtggagcccctg

SEQ ID NO: 321303 - DNA, 25 bp, Mus musculus
ggaccgcagaggagagccccccttg

SEQ ID NO: 321304 - DNA, 25 bp, Mus musculus
ggaccgcagcacttcatccaccaga

SEQ ID NO: 321305 - DNA, 25 bp, Mus musculus
ggaccgccacgggaagaagcgcacg

SEQ ID NO: 321306 - DNA, 25 bp, Mus musculus
ggaccgccagattgtgccttctgaa

SEQ ID NO: 321307 - DNA, 25 bp, Mus musculus
ggaccgccaggcactgggaaaacac

SEQ ID NO: 321308 - DNA, 25 bp, Mus musculus
ggaccgccggagctgttttatgacc

SEQ ID NO: 321309 - DNA, 25 bp, Mus musculus
ggaccgcctgagattgtcgcagcaa

SEQ ID NO: 321310 - DNA, 25 bp, Mus musculus
ggaccgcctgatccggacactgggg

SEQ ID NO: 321311 - DNA, 25 bp, Mus musculus
ggaccgcctggaggaggacatcttc

SEQ ID NO: 321312 - DNA, 25 bp, Mus musculus
ggaccgcgaagaggatgaaccttct

SEQ ID NO: 321313 - DNA, 25 bp, Mus musculus
ggaccgcgaaggtcatctaacttga

SEQ ID NO: 321314 - DNA, 25 bp, Mus musculus
ggaccgcgcggccacaaaaagaaga

SEQ ID NO: 321315 - DNA, 25 bp, Mus musculus
ggaccgctacagctcccaagtgcca

SEQ ID NO: 321316 - DNA, 25 bp, Mus musculus
ggaccgctccgcgtgagaatcaaat

SEQ ID NO: 321317 - DNA, 25 bp, Mus musculus
ggaccgctgaccaaggcgccatgga

SEQ ID NO: 321318 - DNA, 25 bp, Mus musculus
ggaccgcttatagcccaaggaacag

SEQ ID NO: 321319 - DNA, 25 bp, Mus musculus
ggaccgcttataggcttggggcata

SEQ ID NO: 321320 - DNA, 25 bp, Mus musculus
ggaccgcttctccaggagagggaag

SEQ ID NO: 321321 - DNA, 25 bp, Mus musculus
ggaccgcttggctctacagagggaa

SEQ ID NO: 321322 - DNA, 25 bp, Mus musculus
ggaccggaaagcgtctgcaccaggg

SEQ ID NO: 321323 - DNA, 25 bp, Mus musculus
ggaccggaacggatgtatacatctc

SEQ ID NO: 321324 - DNA, 25 bp, Mus musculus
ggaccggatgctcagcgaggacccg

SEQ ID NO: 321325 - DNA, 25 bp, Mus musculus
ggaccggcacgtgtcggagctccaa

SEQ ID NO: 321326 - DNA, 25 bp, Mus musculus
ggaccggcagcaggagaatcctcat

SEQ ID NO: 321327 - DNA, 25 bp, Mus musculus
ggaccggcagcaggagaatgccatc

SEQ ID NO: 321328 - DNA, 25 bp, Mus musculus
ggaccgggtgccggtcatcgtggag

SEQ ID NO: 321329 - DNA, 25 bp, Mus musculus
ggaccgtaggcgctgaggcatgtgt

SEQ ID NO: 321330 - DNA, 25 bp, Mus musculus
ggaccgtcctgtttggagtgcttaa

SEQ ID NO: 321331 - DNA, 25 bp, Mus musculus
ggaccgtggaggatgacttgattat

SEQ ID NO: 321332 - DNA, 25 bp, Mus musculus
ggaccgtgggagaactactatccag

SEQ ID NO: 321333 - DNA, 25 bp, Mus musculus
ggaccgttggtggcatagctctaat

SEQ ID NO: 321334 - DNA, 25 bp, Mus musculus
ggacctaaaactttgcagattcctt

SEQ ID NO: 321335 - DNA, 25 bp, Mus musculus
ggacctaaagcctgagaatatcttg

SEQ ID NO: 321336 - DNA, 25 bp, Mus musculus
ggacctaaagcctgagaatttgctt

SEQ ID NO: 321337 - DNA, 25 bp, Mus musculus
ggacctaaaggagacttgggagaaa

SEQ ID NO: 321338 - DNA, 25 bp, Mus musculus
ggacctacaacaccacctctgcagt

SEQ ID NO: 321339 - DNA, 25 bp, Mus musculus
ggacctaccatggggcgcagttctg

SEQ ID NO: 321340 - DNA, 25 bp, Mus musculus
ggacctactaagatcgagagcgatg

SEQ ID NO: 321341 - DNA, 25 bp, Mus musculus
ggacctacttggagccctataataa

SEQ ID NO: 321342 - DNA, 25 bp, Mus musculus
ggacctagaatggtgtgccaggaca

SEQ ID NO: 321343 - DNA, 25 bp, Mus musculus
ggacctagaatggtttgcaatagca

SEQ ID NO: 321344 - DNA, 25 bp, Mus musculus
ggacctagaatgtgggcacaatgcc

SEQ ID NO: 321345 - DNA, 25 bp, Mus musculus
ggacctagcaggcttacagttcctc

SEQ ID NO: 321346 - DNA, 25 bp, Mus musculus
ggacctatcaccagtatcatagtta

SEQ ID NO: 321347 - DNA, 25 bp, Mus musculus
ggacctatccaaaagataggaagtg

SEQ ID NO: 321348 - DNA, 25 bp, Mus musculus
ggacctcaacagggtgagccaggtc

SEQ ID NO: 321349 - DNA, 25 bp, Mus musculus
ggacctcaacagtgggcagctgatc

SEQ ID NO: 321350 - DNA, 25 bp, Mus musculus
ggacctcaaggaccttggtgtgacc

SEQ ID NO: 321351 - DNA, 25 bp, Mus musculus
ggacctcaaggacggtatttatata

SEQ ID NO: 321352 - DNA, 25 bp, Mus musculus
ggacctcaatcaccatgcccaccgc

SEQ ID NO: 321353 - DNA, 25 bp, Mus musculus
ggacctcaatggcaatgccctcgga

SEQ ID NO: 321354 - DNA, 25 bp, Mus musculus
ggacctcacagcagagtgccatctt

SEQ ID NO: 321355 - DNA, 25 bp, Mus musculus
ggacctcacagtggaagggttccaa

SEQ ID NO: 321356 - DNA, 25 bp, Mus musculus
ggacctcaggctgactgctgtccac

SEQ ID NO: 321357 - DNA, 25 bp, Mus musculus
ggacctcagttttcccaagcaaccc

SEQ ID NO: 321358 - DNA, 25 bp, Mus musculus
ggacctcatcaacagtgagggggac

SEQ ID NO: 321359 - DNA, 25 bp, Mus musculus
ggacctcatcaacagtttgcaggac

SEQ ID NO: 321360 - DNA, 25 bp, Mus musculus
ggacctccaagacagggtttttctg

SEQ ID NO: 321361 - DNA, 25 bp, Mus musculus
ggacctccaagcgctcatcgacatc

SEQ ID NO: 321362 - DNA, 25 bp, Mus musculus
ggacctccagactcagctggcggtg

SEQ ID NO: 321363 - DNA, 25 bp, Mus musculus
ggacctcccacagtgttatctttgt

SEQ ID NO: 321364 - DNA, 25 bp, Mus musculus
ggacctccccgtaatgctggtgaga

SEQ ID NO: 321365 - DNA, 25 bp, Mus musculus
ggacctccccgtaattacgctgggg

SEQ ID NO: 321366 - DNA, 25 bp, Mus musculus
ggacctcccggatttctgcaccccc

SEQ ID NO: 321367 - DNA, 25 bp, Mus musculus
ggacctccctggaggtggagccttt

SEQ ID NO: 321368 - DNA, 25 bp, Mus musculus
ggacctccggggatataaaattccg

SEQ ID NO: 321369 - DNA, 25 bp, Mus musculus
ggacctcctgggcattgtcgccagc

SEQ ID NO: 321370 - DNA, 25 bp, Mus musculus
ggacctcgagactgccactctccgc

SEQ ID NO: 321371 - DNA, 25 bp, Mus musculus
ggacctcgcaagttcttccatcagt

SEQ ID NO: 321372 - DNA, 25 bp, Mus musculus
ggacctcggagaacttccaggtcct

SEQ ID NO: 321373 - DNA, 25 bp, Mus musculus
ggacctcggagccacagagatcctt

SEQ ID NO: 321374 - DNA, 25 bp, Mus musculus
ggacctcggagctgcccagacccct

SEQ ID NO: 321375 - DNA, 25 bp, Mus musculus
ggacctcggagggatgactcgagat

SEQ ID NO: 321376 - DNA, 25 bp, Mus musculus
ggacctcggcctcaggaaattcctt

SEQ ID NO: 321377 - DNA, 25 bp, Mus musculus
ggacctcggcctcagtagagtgatg

SEQ ID NO: 321378 - DNA, 25 bp, Mus musculus
ggacctcgggagagaaattttaagc

SEQ ID NO: 321379 - DNA, 25 bp, Mus musculus
ggacctcggtgacagaacaaatcag

SEQ ID NO: 321380 - DNA, 25 bp, Mus musculus
ggacctcggtgacaggtttggggcc

SEQ ID NO: 321381 - DNA, 25 bp, Mus musculus
ggacctctatccaagggaaggaaaa

SEQ ID NO: 321382 - DNA, 25 bp, Mus musculus
ggacctctgggagccagcagaggcc

SEQ ID NO: 321383 - DNA, 25 bp, Mus musculus
ggacctctgggagcccacagagagt

SEQ ID NO: 321384 - DNA, 25 bp, Mus musculus
ggacctctgtgaaggcaatggtgct

SEQ ID NO: 321385 - DNA, 25 bp, Mus musculus
ggacctcttgtctacccagctgggt

SEQ ID NO: 321386 - DNA, 25 bp, Mus musculus
ggacctgaaaggattaataggcagt

SEQ ID NO: 321387 - DNA, 25 bp, Mus musculus
ggacctgaaatttcagattggagaa

SEQ ID NO: 321388 - DNA, 25 bp, Mus musculus
ggacctgaagcctgagaatttgctt

SEQ ID NO: 321389 - DNA, 25 bp, Mus musculus
ggacctgaagggcatgttcctgtca

SEQ ID NO: 321390 - DNA, 25 bp, Mus musculus
ggacctgacaggtgatctggagagc

SEQ ID NO: 321391 - DNA, 25 bp, Mus musculus
ggacctgaccagtctatatatattg

SEQ ID NO: 321392 - DNA, 25 bp, Mus musculus
ggacctgacctcaatgtctttacat

SEQ ID NO: 321393 - DNA, 25 bp, Mus musculus
ggacctgacgcaggcaaaacccatt

SEQ ID NO: 321394 - DNA, 25 bp, Mus musculus
ggacctgactcagagaggaagaacc

SEQ ID NO: 321395 - DNA, 25 bp, Mus musculus
ggacctgagtgatgatggaatcagc

SEQ ID NO: 321396 - DNA, 25 bp, Mus musculus
ggacctgcactgtcacgcggtgttt

SEQ ID NO: 321397 - DNA, 25 bp, Mus musculus
ggacctgcagacccaagaatcttta

SEQ ID NO: 321398 - DNA, 25 bp, Mus musculus
ggacctgcagcacgtgggataagca

SEQ ID NO: 321399 - DNA, 25 bp, Mus musculus
ggacctgcaggctgtgtggagatgg

SEQ ID NO: 321400 - DNA, 25 bp, Mus musculus
ggacctgcagtgctcccaccacctt

SEQ ID NO: 321401 - DNA, 25 bp, Mus musculus
ggacctgccaaaagttgtggagctc

SEQ ID NO: 321402 - DNA, 25 bp, Mus musculus
ggacctgcctcgggtgagccctaga

SEQ ID NO: 321403 - DNA, 25 bp, Mus musculus
ggacctgcctctgagtgctgcaccc

SEQ ID NO: 321404 - DNA, 25 bp, Mus musculus
ggacctgcttgtgatatatgttggg

SEQ ID NO: 321405 - DNA, 25 bp, Mus musculus
ggacctggaaaccaacctgaccttc

SEQ ID NO: 321406 - DNA, 25 bp, Mus musculus
ggacctggaaaccactaagaaactt

SEQ ID NO: 321407 - DNA, 25 bp, Mus musculus
ggacctggaactgctggcctctgga

SEQ ID NO: 321408 - DNA, 25 bp, Mus musculus
ggacctggagacagccttccctcgg

SEQ ID NO: 321409 - DNA, 25 bp, Mus musculus
ggacctggagcagaagtattgggaa

SEQ ID NO: 321410 - DNA, 25 bp, Mus musculus
ggacctggaggaaattatggaagtg

SEQ ID NO: 321411 - DNA, 25 bp, Mus musculus
ggacctggaggtggcaattttggag

SEQ ID NO: 321412 - DNA, 25 bp, Mus musculus
ggacctggagtgggaccctgaagat

SEQ ID NO: 321413 - DNA, 25 bp, Mus musculus
ggacctggataaagccgatcacgcg

SEQ ID NO: 321414 - DNA, 25 bp, Mus musculus
ggacctggcaggatgggagcctcct

SEQ ID NO: 321415 - DNA, 25 bp, Mus musculus
ggacctggcaggatgggccaccgct

SEQ ID NO: 321416 - DNA, 25 bp, Mus musculus
ggacctggccaggagtgaattggag

SEQ ID NO: 321417 - DNA, 25 bp, Mus musculus
ggacctggccgaagcatgacccgcc

SEQ ID NO: 321418 - DNA, 25 bp, Mus musculus
ggacctggctttgtctgttgctgtg

SEQ ID NO: 321419 - DNA, 25 bp, Mus musculus
ggacctgggggcagcccgggccaac

SEQ ID NO: 321420 - DNA, 25 bp, Mus musculus
ggacctgggtcagaacatctttgcc

SEQ ID NO: 321421 - DNA, 25 bp, Mus musculus
ggacctgggtgtctcttccaaggaa

SEQ ID NO: 321422 - DNA, 25 bp, Mus musculus
ggacctggtacatggtggtcaacct

SEQ ID NO: 321423 - DNA, 25 bp, Mus musculus
ggacctggtttagattctcaaacca

SEQ ID NO: 321424 - DNA, 25 bp, Mus musculus
ggacctgtaaagctcggatgcccaa

SEQ ID NO: 321425 - DNA, 25 bp, Mus musculus
ggacctgtaaagttgcttttagaca

SEQ ID NO: 321426 - DNA, 25 bp, Mus musculus
ggacctgtagagaacctccatgtac

SEQ ID NO: 321427 - DNA, 25 bp, Mus musculus
ggacctgtcacccagactaagaaac

SEQ ID NO: 321428 - DNA, 25 bp, Mus musculus
ggaccttaagatttcctattatgac

SEQ ID NO: 321429 - DNA, 25 bp, Mus musculus
ggaccttacacaggtcaccactcaa

SEQ ID NO: 321430 - DNA, 25 bp, Mus musculus
ggaccttatcaggtttgcacagacg

SEQ ID NO: 321431 - DNA, 25 bp, Mus musculus
ggaccttcagaaggaagacaacatg

SEQ ID NO: 321432 - DNA, 25 bp, Mus musculus
ggaccttccaggtgacgctgactgc

SEQ ID NO: 321433 - DNA, 25 bp, Mus musculus
ggaccttcccaactctgctcctgac

SEQ ID NO: 321434 - DNA, 25 bp, Mus musculus
ggaccttccggcaggcagttcctcc

SEQ ID NO: 321435 - DNA, 25 bp, Mus musculus
ggaccttcggggctgggcttcaaca

SEQ ID NO: 321436 - DNA, 25 bp, Mus musculus
ggaccttcgggtaaatggccaagat

SEQ ID NO: 321437 - DNA, 25 bp, Mus musculus
ggaccttctttggggttccttgtgg

SEQ ID NO: 321438 - DNA, 25 bp, Mus musculus
ggaccttgagcagcccaaagaagtg

SEQ ID NO: 321439 - DNA, 25 bp, Mus musculus
ggaccttgagcaggaggcttctcag

SEQ ID NO: 321440 - DNA, 25 bp, Mus musculus
ggaccttgcacgacctagtggttta

SEQ ID NO: 321441 - DNA, 25 bp, Mus musculus
ggaccttggaccaagaagttggtgt

SEQ ID NO: 321442 - DNA, 25 bp, Mus musculus
ggaccttggcaggggaatcaaagac

SEQ ID NO: 321443 - DNA, 25 bp, Mus musculus
ggaccttgtgcaggcaccttttgtg

SEQ ID NO: 321444 - DNA, 25 bp, Mus musculus
ggacctttctaggtgactactttgg

SEQ ID NO: 321445 - DNA, 25 bp, Mus musculus
ggaccttttcataggttggatgata

SEQ ID NO: 321446 - DNA, 25 bp, Mus musculus
ggaccttttcggactgggtgaaagc

SEQ ID NO: 321447 - DNA, 25 bp, Mus musculus
ggaccttttcggatcaagattatag

SEQ ID NO: 321448 - DNA, 25 bp, Mus musculus
ggaccttttcgtgggagccaagaag

SEQ ID NO: 321449 - DNA, 25 bp, Mus musculus
ggacgaaacaaaagtggtccatgcc

SEQ ID NO: 321450 - DNA, 25 bp, Mus musculus
ggacgaaaccacgaaccgcatgcac

SEQ ID NO: 321451 - DNA, 25 bp, Mus musculus
ggacgaagaagacctgtattccccg

SEQ ID NO: 321452 - DNA, 25 bp, Mus musculus
ggacgaagaagacctgtattcctcg

SEQ ID NO: 321453 - DNA, 25 bp, Mus musculus
ggacgaagaggatcttagtgaattc

SEQ ID NO: 321454 - DNA, 25 bp, Mus musculus
ggacgaagagtgaattcgggatagc

SEQ ID NO: 321455 - DNA, 25 bp, Mus musculus
ggacgaagatgaaggtcaaactggg

SEQ ID NO: 321456 - DNA, 25 bp, Mus musculus
ggacgaagcagaggagttttttgag

SEQ ID NO: 321457 - DNA, 25 bp, Mus musculus
ggacgaaggggatgcatgtggatgg

SEQ ID NO: 321458 - DNA, 25 bp, Mus musculus
ggacgaaggggatgttgtggaagtg

SEQ ID NO: 321459 - DNA, 25 bp, Mus musculus
ggacgaagtgtttgactttggcgac

SEQ ID NO: 321460 - DNA, 25 bp, Mus musculus
ggacgaatcttcgaggtgctggaaa

SEQ ID NO: 321461 - DNA, 25 bp, Mus musculus
ggacgaattggggactttgcttgtg

SEQ ID NO: 321462 - DNA, 25 bp, Mus musculus
ggacgacaagaactgctgagaagaa

SEQ ID NO: 321463 - DNA, 25 bp, Mus musculus
ggacgacagctttagccaggccctg

SEQ ID NO: 321464 - DNA, 25 bp, Mus musculus
ggacgacccaggaagagaaagagaa

SEQ ID NO: 321465 - DNA, 25 bp, Mus musculus
ggacgacccaggcaaagggaattac

SEQ ID NO: 321466 - DNA, 25 bp, Mus musculus
ggacgactacttggggctcgtgagc

SEQ ID NO: 321467 - DNA, 25 bp, Mus musculus
ggacgactgactggggatggaggta

SEQ ID NO: 321468 - DNA, 25 bp, Mus musculus
ggacgactgactgggtgatgcccac

SEQ ID NO: 321469 - DNA, 25 bp, Mus musculus
ggacgactgccccaagaggacctgc

SEQ ID NO: 321470 - DNA, 25 bp, Mus musculus
ggacgactggcgaagcagtgccccc

SEQ ID NO: 321471 - DNA, 25 bp, Mus musculus
ggacgacttagacagagctgaggac

SEQ ID NO: 321472 - DNA, 25 bp, Mus musculus
ggacgacttagacaggtgctgccag

SEQ ID NO: 321473 - DNA, 25 bp, Mus musculus
ggacgacttggagccccacgcaatc

SEQ ID NO: 321474 - DNA, 25 bp, Mus musculus
ggacgagaatggaaacttgagttcg

SEQ ID NO: 321475 - DNA, 25 bp, Mus musculus
ggacgagaatgggcaattgcttccc

SEQ ID NO: 321476 - DNA, 25 bp, Mus musculus
ggacgagacaaactgccagaaagta

SEQ ID NO: 321477 - DNA, 25 bp, Mus musculus
ggacgagacaaagtgctgctgtttt

SEQ ID NO: 321478 - DNA, 25 bp, Mus musculus
ggacgagagtttcggggccaggaaa

SEQ ID NO: 321479 - DNA, 25 bp, Mus musculus
ggacgagctaaagcggctgctgccc

SEQ ID NO: 321480 - DNA, 25 bp, Mus musculus
ggacgagctacagccctacacgaac

SEQ ID NO: 321481 - DNA, 25 bp, Mus musculus
ggacgagctgaattctttatacaat

SEQ ID NO: 321482 - DNA, 25 bp, Mus musculus
ggacgagctgtcggcattatgccag

SEQ ID NO: 321483 - DNA, 25 bp, Mus musculus
ggacgagctgtcgggagaaaatttt

SEQ ID NO: 321484 - DNA, 25 bp, Mus musculus
ggacgaggaagaggagaaaccaaga

SEQ ID NO: 321485 - DNA, 25 bp, Mus musculus
ggacgaggagcaggttgctatcggc

SEQ ID NO: 321486 - DNA, 25 bp, Mus musculus
ggacgaggagtctggctcgggtctt

SEQ ID NO: 321487 - DNA, 25 bp, Mus musculus
ggacgaggagtctggtggaggctcc

SEQ ID NO: 321488 - DNA, 25 bp, Mus musculus
ggacgaggatgaggactcgtccagt

SEQ ID NO: 321489 - DNA, 25 bp, Mus musculus
ggacgaggccgagcccctcggagcc

SEQ ID NO: 321490 - DNA, 25 bp, Mus musculus
ggacgagtctgatagctgctgcttc

SEQ ID NO: 321491 - DNA, 25 bp, Mus musculus
ggacgagtctgatatctgctgcttc

SEQ ID NO: 321492 - DNA, 25 bp, Mus musculus
ggacgatccagcttacattgcagtt

SEQ ID NO: 321493 - DNA, 25 bp, Mus musculus
ggacgatgactgaggtgcttcacct

SEQ ID NO: 321494 - DNA, 25 bp, Mus musculus
ggacgatgagcgaggctgctgcgca

SEQ ID NO: 321495 - DNA, 25 bp, Mus musculus
ggacgatgaggacctcgacctagaa

SEQ ID NO: 321496 - DNA, 25 bp, Mus musculus
ggacgatgatgtttgtgatcctgtg

SEQ ID NO: 321497 - DNA, 25 bp, Mus musculus
ggacgatttggggctcatcacaagc

SEQ ID NO: 321498 - DNA, 25 bp, Mus musculus
ggacgatttgggtgtcctgctccct

SEQ ID NO: 321499 - DNA, 25 bp, Mus musculus
ggacgcaaaggaggaagccagcaaa

SEQ ID NO: 321500 - DNA, 25 bp, Mus musculus
ggacgcaagaagaagaaggtgccat

SEQ ID NO: 321501 - DNA, 25 bp, Mus musculus
ggacgcaagaagaagcaccccactg

SEQ ID NO: 321502 - DNA, 25 bp, Mus musculus
ggacgcaaggaaatgcccggaaccg

SEQ ID NO: 321503 - DNA, 25 bp, Mus musculus
ggacgcaatgtgtctggaattctct

SEQ ID NO: 321504 - DNA, 25 bp, Mus musculus
ggacgcacagcctttgcttccttac

SEQ ID NO: 321505 - DNA, 25 bp, Mus musculus
ggacgcacaggcctcctgtgccacc

SEQ ID NO: 321506 - DNA, 25 bp, Mus musculus
ggacgcagaagagactgagaggaat

SEQ ID NO: 321507 - DNA, 25 bp, Mus musculus
ggacgcagaagagcctaccgaggac

SEQ ID NO: 321508 - DNA, 25 bp, Mus musculus
ggacgcagaagagtttgactttggc

SEQ ID NO: 321509 - DNA, 25 bp, Mus musculus
ggacgcagagaagggcccagtgtgc

SEQ ID NO: 321510 - DNA, 25 bp, Mus musculus
ggacgcagagcttgttgatgttggt

SEQ ID NO: 321511 - DNA, 25 bp, Mus musculus
ggacgcagcacgccatcaatgatga

SEQ ID NO: 321512 - DNA, 25 bp, Mus musculus
ggacgcagcacgccgtatgtgcagg

SEQ ID NO: 321513 - DNA, 25 bp, Mus musculus
ggacgcagccagagagggaaactga

SEQ ID NO: 321514 - DNA, 25 bp, Mus musculus
ggacgcagccagagcttgtccaggt

SEQ ID NO: 321515 - DNA, 25 bp, Mus musculus
ggacgcaggagaagaaccaccacca

SEQ ID NO: 321516 - DNA, 25 bp, Mus musculus
ggacgcaggagaagcacatcatgca

SEQ ID NO: 321517 - DNA, 25 bp, Mus musculus
ggacgcagtctatgggacgcctcag

SEQ ID NO: 321518 - DNA, 25 bp, Mus musculus
ggacgcatacctgtggcagcaccgg

SEQ ID NO: 321519 - DNA, 25 bp, Mus musculus
ggacgcatacctgtggtctcaccag

SEQ ID NO: 321520 - DNA, 25 bp, Mus musculus
ggacgccaaggagtgggtatggagg

SEQ ID NO: 321521 - DNA, 25 bp, Mus musculus
ggacgccatgccaggtatgcaggac

SEQ ID NO: 321522 - DNA, 25 bp, Mus musculus
ggacgccatgccaggtgtgtttgat

SEQ ID NO: 321523 - DNA, 25 bp, Mus musculus
ggacgccattcccccactttgttga

SEQ ID NO: 321524 - DNA, 25 bp, Mus musculus
ggacgcccaggaactgtatgaggct

SEQ ID NO: 321525 - DNA, 25 bp, Mus musculus
ggacgcccaggccggtcccggatgt

SEQ ID NO: 321526 - DNA, 25 bp, Mus musculus
ggacgcccaggtctttcaacactcc

SEQ ID NO: 321527 - DNA, 25 bp, Mus musculus
ggacgccccggctgccctcaaagcg

SEQ ID NO: 321528 - DNA, 25 bp, Mus musculus
ggacgccctctgatgtgaaagagct

SEQ ID NO: 321529 - DNA, 25 bp, Mus musculus
ggacgccgccttggggcatcatgac

SEQ ID NO: 321530 - DNA, 25 bp, Mus musculus
ggacgcctcagctgcacactgcccc

SEQ ID NO: 321531 - DNA, 25 bp, Mus musculus
ggacgcgatagttctgacacaacac

SEQ ID NO: 321532 - DNA, 25 bp, Mus musculus
ggacgcgatttacgaaatctaccag

SEQ ID NO: 321533 - DNA, 25 bp, Mus musculus
ggacgcggaaccggagctggactgg

SEQ ID NO: 321534 - DNA, 25 bp, Mus musculus
ggacgcggaagatctcagcggttct

SEQ ID NO: 321535 - DNA, 25 bp, Mus musculus
ggacgcggaagggaccagatttttg

SEQ ID NO: 321536 - DNA, 25 bp, Mus musculus
ggacgcggacggacccctggacttc

SEQ ID NO: 321537 - DNA, 25 bp, Mus musculus
ggacgcggacggacttgatgtggat

SEQ ID NO: 321538 - DNA, 25 bp, Mus musculus
ggacgcggcgacaggtcttctactt

SEQ ID NO: 321539 - DNA, 25 bp, Mus musculus
ggacgcggcgatctgccaggatcct

SEQ ID NO: 321540 - DNA, 25 bp, Mus musculus
ggacgcggcgcacacagggccagag

SEQ ID NO: 321541 - DNA, 25 bp, Mus musculus
ggacgcggctgccaaaagcggaggc

SEQ ID NO: 321542 - DNA, 25 bp, Mus musculus
ggacgcgggagagaagatggagggg

SEQ ID NO: 321543 - DNA, 25 bp, Mus musculus
ggacgcgggcagcagcttggcaaat

SEQ ID NO: 321544 - DNA, 25 bp, Mus musculus
ggacgcgggcagcaggtcactacgt

SEQ ID NO: 321545 - DNA, 25 bp, Mus musculus
ggacgcgggcagcagtgacagccct

SEQ ID NO: 321546 - DNA, 25 bp, Mus musculus
ggacgcggggaaatggactcagtgg

SEQ ID NO: 321547 - DNA, 25 bp, Mus musculus
ggacgcgtccgactgaggctccacg

SEQ ID NO: 321548 - DNA, 25 bp, Mus musculus
ggacgcgtccggccccagcggtgct

SEQ ID NO: 321549 - DNA, 25 bp, Mus musculus
ggacgctcagccttcaaacagtagg

SEQ ID NO: 321550 - DNA, 25 bp, Mus musculus
ggacgctcaggacccaccagaggac

SEQ ID NO: 321551 - DNA, 25 bp, Mus musculus
ggacgctcaggggaggggcgacatc

SEQ ID NO: 321552 - DNA, 25 bp, Mus musculus
ggacgctcggactgggctatatgcc

SEQ ID NO: 321553 - DNA, 25 bp, Mus musculus
ggacgctctgctcatttgggaggag

SEQ ID NO: 321554 - DNA, 25 bp, Mus musculus
ggacgctctggtcatccaacttgcc

SEQ ID NO: 321555 - DNA, 25 bp, Mus musculus
ggacgctgacgggctgacaggcgag

SEQ ID NO: 321556 - DNA, 25 bp, Mus musculus
ggacgctgacggggtggaggagcta

SEQ ID NO: 321557 - DNA, 25 bp, Mus musculus
ggacgctgccggccatcgtcgttct

SEQ ID NO: 321558 - DNA, 25 bp, Mus musculus
ggacgctgccgggtctcttccactg

SEQ ID NO: 321559 - DNA, 25 bp, Mus musculus
ggacgctgcgaggaagagccctggg

SEQ ID NO: 321560 - DNA, 25 bp, Mus musculus
ggacgctggaatctggccctggttc

SEQ ID NO: 321561 - DNA, 25 bp, Mus musculus
ggacgctggaatctgtgggcgggca

SEQ ID NO: 321562 - DNA, 25 bp, Mus musculus
ggacgctgtgctttcatggatcgct

SEQ ID NO: 321563 - DNA, 25 bp, Mus musculus
ggacgctgttaagagttcacatgag

SEQ ID NO: 321564 - DNA, 25 bp, Mus musculus
ggacggaaaaacaagagttactcac

SEQ ID NO: 321565 - DNA, 25 bp, Mus musculus
ggacggaaatcaaggattcttaatc

SEQ ID NO: 321566 - DNA, 25 bp, Mus musculus
ggacggaagacacggagtatatatc

SEQ ID NO: 321567 - DNA, 25 bp, Mus musculus
ggacggaataggggtcgaggatgtc

SEQ ID NO: 321568 - DNA, 25 bp, Mus musculus
ggacggacagaatacaccatcacca

SEQ ID NO: 321569 - DNA, 25 bp, Mus musculus
ggacggaccctgggagcctacttcc

SEQ ID NO: 321570 - DNA, 25 bp, Mus musculus
ggacggagactgaggatgaggctgt

SEQ ID NO: 321571 - DNA, 25 bp, Mus musculus
ggacggagcatggttggagcctctc

SEQ ID NO: 321572 - DNA, 25 bp, Mus musculus
ggacggatggcgggtttccgcttcc

SEQ ID NO: 321573 - DNA, 25 bp, Mus musculus
ggacggcatgccccccatcaacact

SEQ ID NO: 321574 - DNA, 25 bp, Mus musculus
ggacggcatggagccgttggtattt

SEQ ID NO: 321575 - DNA, 25 bp, Mus musculus
ggacggcatgggctcaagcccctga

SEQ ID NO: 321576 - DNA, 25 bp, Mus musculus
ggacggcatgtacgctaacttgggt

SEQ ID NO: 321577 - DNA, 25 bp, Mus musculus
ggacggccaaagcacatgctccatt

SEQ ID NO: 321578 - DNA, 25 bp, Mus musculus
ggacggccagggggtggcaccgaaa

SEQ ID NO: 321579 - DNA, 25 bp, Mus musculus
ggacggcccttggtgtggacagttc

SEQ ID NO: 321580 - DNA, 25 bp, Mus musculus
ggacggctcagaaaagggggatttc

SEQ ID NO: 321581 - DNA, 25 bp, Mus musculus
ggacggctgcacgagtcacaccgga

SEQ ID NO: 321582 - DNA, 25 bp, Mus musculus
ggacggctgccgggttgtgagcccc

SEQ ID NO: 321583 - DNA, 25 bp, Mus musculus
ggacggcttgactaaaatacaaatg

SEQ ID NO: 321584 - DNA, 25 bp, Mus musculus
ggacggcttgatgaggtctcccgcc

SEQ ID NO: 321585 - DNA, 25 bp, Mus musculus
ggacggcttgatgagtaagaaagcc

SEQ ID NO: 321586 - DNA, 25 bp, Mus musculus
ggacggcttggggatccagcaccca

SEQ ID NO: 321587 - DNA, 25 bp, Mus musculus
ggacgggaaagaacacatgtcggag

SEQ ID NO: 321588 - DNA, 25 bp, Mus musculus
ggacgggaccatagtggagggacgg

SEQ ID NO: 321589 - DNA, 25 bp, Mus musculus
ggacgggacccagggtgaaatggtc

SEQ ID NO: 321590 - DNA, 25 bp, Mus musculus
ggacgggagggacggtattcaggct

SEQ ID NO: 321591 - DNA, 25 bp, Mus musculus
ggacgggagtctcagatgaaagaaa

SEQ ID NO: 321592 - DNA, 25 bp, Mus musculus
ggacgggattaaggaatcttccgac

SEQ ID NO: 321593 - DNA, 25 bp, Mus musculus
ggacgggcaggctcgatggctcccg

SEQ ID NO: 321594 - DNA, 25 bp, Mus musculus
ggacggggagacccatataatgccc

SEQ ID NO: 321595 - DNA, 25 bp, Mus musculus
ggacggggaggtgctgacggagaaa

SEQ ID NO: 321596 - DNA, 25 bp, Mus musculus
ggacggggcaagtgcatttggcaca

SEQ ID NO: 321597 - DNA, 25 bp, Mus musculus
ggacggggcttggcagagatggagt

SEQ ID NO: 321598 - DNA, 25 bp, Mus musculus
ggacggggcttgtgtgttgcatact

SEQ ID NO: 321599 - DNA, 25 bp, Mus musculus
ggacggtacctgcattgtgcttctt

SEQ ID NO: 321600 - DNA, 25 bp, Mus musculus
ggacggtcaatgacaaatcaggacc

SEQ ID NO: 321601 - DNA, 25 bp, Mus musculus
ggacggtcctagcctcagcgttctc

SEQ ID NO: 321602 - DNA, 25 bp, Mus musculus
ggacggtggatttggtggagctaga

SEQ ID NO: 321603 - DNA, 25 bp, Mus musculus
ggacggtggtcagtgtcctcaagag

SEQ ID NO: 321604 - DNA, 25 bp, Mus musculus
ggacggttcagaccatgacacccga

SEQ ID NO: 321605 - DNA, 25 bp, Mus musculus
ggacggttgtgaggtagatgttgta

SEQ ID NO: 321606 - DNA, 25 bp, Mus musculus
ggacgtaagaccaatcgcagcctgc

SEQ ID NO: 321607 - DNA, 25 bp, Mus musculus
ggacgtaagaccagtgggagcaggt

SEQ ID NO: 321608 - DNA, 25 bp, Mus musculus
ggacgtagaaggcctctttgacagc

SEQ ID NO: 321609 - DNA, 25 bp, Mus musculus
ggacgtagcttcaggtgacctcact

SEQ ID NO: 321610 - DNA, 25 bp, Mus musculus
ggacgtccaggagataattgtgtgg

SEQ ID NO: 321611 - DNA, 25 bp, Mus musculus
ggacgtcccgcacgtagaagacccg

SEQ ID NO: 321612 - DNA, 25 bp, Mus musculus
ggacgtcctcgctttgtactggttc

SEQ ID NO: 321613 - DNA, 25 bp, Mus musculus
ggacgtccttgcggggcctgtgctc

SEQ ID NO: 321614 - DNA, 25 bp, Mus musculus
ggacgtctttcagacagacatgagt

SEQ ID NO: 321615 - DNA, 25 bp, Mus musculus
ggacgtgaagactgacaagcactgc

SEQ ID NO: 321616 - DNA, 25 bp, Mus musculus
ggacgtgaaggacttcaagaccgag

SEQ ID NO: 321617 - DNA, 25 bp, Mus musculus
ggacgtgacagaaaagatcaaggga

SEQ ID NO: 321618 - DNA, 25 bp, Mus musculus
ggacgtgacagggaggcccggatgc

SEQ ID NO: 321619 - DNA, 25 bp, Mus musculus
ggacgtgatgacagggtccaaggct

SEQ ID NO: 321620 - DNA, 25 bp, Mus musculus
ggacgtgcagaattaccatgagatt

SEQ ID NO: 321621 - DNA, 25 bp, Mus musculus
ggacgtgcagaccatcccatggctt

SEQ ID NO: 321622 - DNA, 25 bp, Mus musculus
ggacgtgccaagcccagcactatgg

SEQ ID NO: 321623 - DNA, 25 bp, Mus musculus
ggacgtggaaggcattttgtgactt

SEQ ID NO: 321624 - DNA, 25 bp, Mus musculus
ggacgtggaaggccttgatcctgct

SEQ ID NO: 321625 - DNA, 25 bp, Mus musculus
ggacgtggagcacctgggagatact

SEQ ID NO: 321626 - DNA, 25 bp, Mus musculus
ggacgtggcgaggggatcgtgggat

SEQ ID NO: 321627 - DNA, 25 bp, Mus musculus
ggacgtgtcgccaggtcagccatgt

SEQ ID NO: 321628 - DNA, 25 bp, Mus musculus
ggacgtgtcgccagtgtggaagggg

SEQ ID NO: 321629 - DNA, 25 bp, Mus musculus
ggacgtgttgttcggagatgggtat

SEQ ID NO: 321630 - DNA, 25 bp, Mus musculus
ggacgttacaagtgggatgcctgga

SEQ ID NO: 321631 - DNA, 25 bp, Mus musculus
ggacgttcagagttactacctggac

SEQ ID NO: 321632 - DNA, 25 bp, Mus musculus
ggacgttccggaagctgcagcttca

SEQ ID NO: 321633 - DNA, 25 bp, Mus musculus
ggacgttctaaagaccaaggacaag

SEQ ID NO: 321634 - DNA, 25 bp, Mus musculus
ggacgtttcccagatctgtctcgag

SEQ ID NO: 321635 - DNA, 25 bp, Mus musculus
ggacgtttgaaggaactctcaaggg

SEQ ID NO: 321636 - DNA, 25 bp, Mus musculus
ggacgtttgagcgaatctcattagg

SEQ ID NO: 321637 - DNA, 25 bp, Mus musculus
ggactaacaggactccaagccccct

SEQ ID NO: 321638 - DNA, 25 bp, Mus musculus
ggactaaggatcaccactactttaa

SEQ ID NO: 321639 - DNA, 25 bp, Mus musculus
ggactaataggactgaggatctcga

SEQ ID NO: 321640 - DNA, 25 bp, Mus musculus
ggactaataggcagatacatgcagc

SEQ ID NO: 321641 - DNA, 25 bp, Mus musculus
ggactaatctgaaggtgccctggga

SEQ ID NO: 321642 - DNA, 25 bp, Mus musculus
ggactaatttagagatgaaatcctt

SEQ ID NO: 321643 - DNA, 25 bp, Mus musculus
ggactaatttagaggggctccatag

SEQ ID NO: 321644 - DNA, 25 bp, Mus musculus
ggactacaaacagtactttgtgttc

SEQ ID NO: 321645 - DNA, 25 bp, Mus musculus
ggactacacagcatcctgcctctgc

SEQ ID NO: 321646 - DNA, 25 bp, Mus musculus
ggactacagagcagaaaaggaaggc

SEQ ID NO: 321647 - DNA, 25 bp, Mus musculus
ggactacatcgactccctgggctgt

SEQ ID NO: 321648 - DNA, 25 bp, Mus musculus
ggactacatgctcacagttacgtac

SEQ ID NO: 321649 - DNA, 25 bp, Mus musculus
ggactaccagcccaggtcaaccatt

SEQ ID NO: 321650 - DNA, 25 bp, Mus musculus
ggactaccaggcctgtacggagatc

SEQ ID NO: 321651 - DNA, 25 bp, Mus musculus
ggactacctcttaggtctctttgag

SEQ ID NO: 321652 - DNA, 25 bp, Mus musculus
ggactacctgtgggctctggggtgt

SEQ ID NO: 321653 - DNA, 25 bp, Mus musculus
ggactagattttagcaggtcaatgg

SEQ ID NO: 321654 - DNA, 25 bp, Mus musculus
ggactagcaaatcagaagttacgag

SEQ ID NO: 321655 - DNA, 25 bp, Mus musculus
ggactagcaaatcaggaggtgcttg

SEQ ID NO: 321656 - DNA, 25 bp, Mus musculus
ggactagggagtgttcagtcaccag

SEQ ID NO: 321657 - DNA, 25 bp, Mus musculus
ggactagtggcgagaatttgctgag

SEQ ID NO: 321658 - DNA, 25 bp, Mus musculus
ggactagtggcgagactttatgatg

SEQ ID NO: 321659 - DNA, 25 bp, Mus musculus
ggactagtggcgagcacatgccaac

SEQ ID NO: 321660 - DNA, 25 bp, Mus musculus
ggactatacaaggtggggatgcgtc

SEQ ID NO: 321661 - DNA, 25 bp, Mus musculus
ggactatataagatatccagaaagt

SEQ ID NO: 321662 - DNA, 25 bp, Mus musculus
ggactatataaggtaaatgaattgg

SEQ ID NO: 321663 - DNA, 25 bp, Mus musculus
ggactatcagtttaggattcagctg

SEQ ID NO: 321664 - DNA, 25 bp, Mus musculus
ggactatcgataattccggcgggag

SEQ ID NO: 321665 - DNA, 25 bp, Mus musculus
ggactatctccaagcatgctggact

SEQ ID NO: 321666 - DNA, 25 bp, Mus musculus
ggactatctccaagtcggttgtggg

SEQ ID NO: 321667 - DNA, 25 bp, Mus musculus
ggactatgaaacagaaaaacaccga

SEQ ID NO: 321668 - DNA, 25 bp, Mus musculus
ggactatgccctcagctggggccag

SEQ ID NO: 321669 - DNA, 25 bp, Mus musculus
ggactatggcagcagttttttatgg

SEQ ID NO: 321670 - DNA, 25 bp, Mus musculus
ggactatggctagatccagactaca

SEQ ID NO: 321671 - DNA, 25 bp, Mus musculus
ggactatggctagcattcaacatcc

SEQ ID NO: 321672 - DNA, 25 bp, Mus musculus
ggactatggtgtcagaaaaaatgtg

SEQ ID NO: 321673 - DNA, 25 bp, Mus musculus
ggactcaaagatgcagtgccagttt

SEQ ID NO: 321674 - DNA, 25 bp, Mus musculus
ggactcaacgctgcagccccaggac

SEQ ID NO: 321675 - DNA, 25 bp, Mus musculus
ggactcaatagcatagacatggact

SEQ ID NO: 321676 - DNA, 25 bp, Mus musculus
ggactcaatcagaggtgcttcttaa

SEQ ID NO: 321677 - DNA, 25 bp, Mus musculus
ggactcaatgcgatctggttctaca

SEQ ID NO: 321678 - DNA, 25 bp, Mus musculus
ggactcactgtccagtgcttctact

SEQ ID NO: 321679 - DNA, 25 bp, Mus musculus
ggactcactgtccagttaatgtgtt

SEQ ID NO: 321680 - DNA, 25 bp, Mus musculus
ggactcactttcagacatccggctc

SEQ ID NO: 321681 - DNA, 25 bp, Mus musculus
ggactcaggaggatatttccaccca

SEQ ID NO: 321682 - DNA, 25 bp, Mus musculus
ggactcaggtagatgagaggccagg

SEQ ID NO: 321683 - DNA, 25 bp, Mus musculus
ggactcaggtaggttgatggaaacc

SEQ ID NO: 321684 - DNA, 25 bp, Mus musculus
ggactcagtgcaagtacagagactc

SEQ ID NO: 321685 - DNA, 25 bp, Mus musculus
ggactcatctaaggaattagctgaa

SEQ ID NO: 321686 - DNA, 25 bp, Mus musculus
ggactccaccacagatgaagaagaa

SEQ ID NO: 321687 - DNA, 25 bp, Mus musculus
ggactccagggctgacagcttcgaa

SEQ ID NO: 321688 - DNA, 25 bp, Mus musculus
ggactccagggtttgctgagagtgg

SEQ ID NO: 321689 - DNA, 25 bp, Mus musculus
ggactccatttacaacttcagggtc

SEQ ID NO: 321690 - DNA, 25 bp, Mus musculus
ggactcccacagccagcgtttcccc

SEQ ID NO: 321691 - DNA, 25 bp, Mus musculus
ggactcccaccccagggttcctgct

SEQ ID NO: 321692 - DNA, 25 bp, Mus musculus
ggactcccaccccagtacggcctct

SEQ ID NO: 321693 - DNA, 25 bp, Mus musculus
ggactcccagaagatagtcacatgc

SEQ ID NO: 321694 - DNA, 25 bp, Mus musculus
ggactcccccaagcaggcggacgct

SEQ ID NO: 321695 - DNA, 25 bp, Mus musculus
ggactcccccaggaggcatcacagc

SEQ ID NO: 321696 - DNA, 25 bp, Mus musculus
ggactcccggagaagcctccccagc

SEQ ID NO: 321697 - DNA, 25 bp, Mus musculus
ggactcccgggagatgcagcttcag

SEQ ID NO: 321698 - DNA, 25 bp, Mus musculus
ggactcccgggaggctcaccatcat

SEQ ID NO: 321699 - DNA, 25 bp, Mus musculus
ggactccgctctccgaatcaagcta

SEQ ID NO: 321700 - DNA, 25 bp, Mus musculus
ggactccggaggaacctggctcacc

SEQ ID NO: 321701 - DNA, 25 bp, Mus musculus
ggactccggcggcagatgtgatggc

SEQ ID NO: 321702 - DNA, 25 bp, Mus musculus
ggactcctaggagggagcctccctg

SEQ ID NO: 321703 - DNA, 25 bp, Mus musculus
ggactcctctttgaagacctttgca

SEQ ID NO: 321704 - DNA, 25 bp, Mus musculus
ggactcctgagccgctctgcacagc

SEQ ID NO: 321705 - DNA, 25 bp, Mus musculus
ggactccttccagtgggatgatctg

SEQ ID NO: 321706 - DNA, 25 bp, Mus musculus
ggactccttgtgggaccgacgtctg

SEQ ID NO: 321707 - DNA, 25 bp, Mus musculus
ggactcgacagtgttagcaacaaga

SEQ ID NO: 321708 - DNA, 25 bp, Mus musculus
ggactcgagaggtcactggatgttc

SEQ ID NO: 321709 - DNA, 25 bp, Mus musculus
ggactcgagagttacaggtcactgg

SEQ ID NO: 321710 - DNA, 25 bp, Mus musculus
ggactcgcagaaagaagctctacaa

SEQ ID NO: 321711 - DNA, 25 bp, Mus musculus
ggactcgcatttgctgtccgctaca

SEQ ID NO: 321712 - DNA, 25 bp, Mus musculus
ggactcgcggagatcgtaccgagaa

SEQ ID NO: 321713 - DNA, 25 bp, Mus musculus
ggactcgctgagctccagttataaa

SEQ ID NO: 321714 - DNA, 25 bp, Mus musculus
ggactcggaagtggacagtggcatc

SEQ ID NO: 321715 - DNA, 25 bp, Mus musculus
ggactcggacacagagaagcagggt

SEQ ID NO: 321716 - DNA, 25 bp, Mus musculus
ggactcggacacagatgcctccagc

SEQ ID NO: 321717 - DNA, 25 bp, Mus musculus
ggactcggaggacagcataagcagt

SEQ ID NO: 321718 - DNA, 25 bp, Mus musculus
ggactcggaggcgggttcagccgac

SEQ ID NO: 321719 - DNA, 25 bp, Mus musculus
ggactcgggtggtggaggacaacca

SEQ ID NO: 321720 - DNA, 25 bp, Mus musculus
ggactcgggtggtggctctgtctct

SEQ ID NO: 321721 - DNA, 25 bp, Mus musculus
ggactctaaactggtcagcctgctg

SEQ ID NO: 321722 - DNA, 25 bp, Mus musculus
ggactctacaggagagtattgtctg

SEQ ID NO: 321723 - DNA, 25 bp, Mus musculus
ggactctactgtgaggtctacatca

SEQ ID NO: 321724 - DNA, 25 bp, Mus musculus
ggactctcaaaccacgcggagtgtc

SEQ ID NO: 321725 - DNA, 25 bp, Mus musculus
ggactctcaaaccacgtgacctctt

SEQ ID NO: 321726 - DNA, 25 bp, Mus musculus
ggactctcagagctgtggcagctca

SEQ ID NO: 321727 - DNA, 25 bp, Mus musculus
ggactctcaggttgtgaggactgag

SEQ ID NO: 321728 - DNA, 25 bp, Mus musculus
ggactctctcaaaccccttatccct

SEQ ID NO: 321729 - DNA, 25 bp, Mus musculus
ggactctctgaagagcactctggcc

SEQ ID NO: 321730 - DNA, 25 bp, Mus musculus
ggactctgaacaaatcctgctgcat

SEQ ID NO: 321731 - DNA, 25 bp, Mus musculus
ggactctgaaccagcctccagtccc

SEQ ID NO: 321732 - DNA, 25 bp, Mus musculus
ggactctgaacctggctctggtagc

SEQ ID NO: 321733 - DNA, 25 bp, Mus musculus
ggactctgacatagcctaggaagta

SEQ ID NO: 321734 - DNA, 25 bp, Mus musculus
ggactctgacatatggggcatcatg

SEQ ID NO: 321735 - DNA, 25 bp, Mus musculus
ggactctgagacgccacagggcctc

SEQ ID NO: 321736 - DNA, 25 bp, Mus musculus
ggactctgatggtgatggccgaggt

SEQ ID NO: 321737 - DNA, 25 bp, Mus musculus
ggactctgcacccagccaaggtagc

SEQ ID NO: 321738 - DNA, 25 bp, Mus musculus
ggactctggatccaggtggtacccg

SEQ ID NO: 321739 - DNA, 25 bp, Mus musculus
ggactctgggctatgtgggtgagcc

SEQ ID NO: 321740 - DNA, 25 bp, Mus musculus
ggactcttaaagatgagaattctcc

SEQ ID NO: 321741 - DNA, 25 bp, Mus musculus
ggactcttcaagccacttagccaag

SEQ ID NO: 321742 - DNA, 25 bp, Mus musculus
ggactcttcaaggtgctggaggact

SEQ ID NO: 321743 - DNA, 25 bp, Mus musculus
ggactcttctctaaaaaagattgat

SEQ ID NO: 321744 - DNA, 25 bp, Mus musculus
ggactctttgatgtaacccacggct

SEQ ID NO: 321745 - DNA, 25 bp, Mus musculus
ggactctttgcaggcttcctcccca

SEQ ID NO: 321746 - DNA, 25 bp, Mus musculus
ggactcttttatgagtttgaaggaa

SEQ ID NO: 321747 - DNA, 25 bp, Mus musculus
ggactgaagacccctatacaaccag

SEQ ID NO: 321748 - DNA, 25 bp, Mus musculus
ggactgaagatctctctgaaacaaa

SEQ ID NO: 321749 - DNA, 25 bp, Mus musculus
ggactgaagctgggatcaagcactt

SEQ ID NO: 321750 - DNA, 25 bp, Mus musculus
ggactgaaggacgcagatagagctc

SEQ ID NO: 321751 - DNA, 25 bp, Mus musculus
ggactgaaggcagatcatgcctggg

SEQ ID NO: 321752 - DNA, 25 bp, Mus musculus
ggactgaatatagtatgtgcagcac

SEQ ID NO: 321753 - DNA, 25 bp, Mus musculus
ggactgaccaggttccccaggatga

SEQ ID NO: 321754 - DNA, 25 bp, Mus musculus
ggactgacccaccaggtgccagcct

SEQ ID NO: 321755 - DNA, 25 bp, Mus musculus
ggactgacccaccaggtgtgccagg

SEQ ID NO: 321756 - DNA, 25 bp, Mus musculus
ggactgacgcagatgaagagctaga

SEQ ID NO: 321757 - DNA, 25 bp, Mus musculus
ggactgacttcactaaggcaaaaat

SEQ ID NO: 321758 - DNA, 25 bp, Mus musculus
ggactgagaagtcgggtacaaagta

SEQ ID NO: 321759 - DNA, 25 bp, Mus musculus
ggactgagaataaatccaagtttgg

SEQ ID NO: 321760 - DNA, 25 bp, Mus musculus
ggactgagaataaatccttggagct

SEQ ID NO: 321761 - DNA, 25 bp, Mus musculus
ggactgagaataaatgcctttaatg

SEQ ID NO: 321762 - DNA, 25 bp, Mus musculus
ggactgagcggtcttgacgaagtga

SEQ ID NO: 321763 - DNA, 25 bp, Mus musculus
ggactgaggcaggcagaagaagctt

SEQ ID NO: 321764 - DNA, 25 bp, Mus musculus
ggactgagtcagccaaggtagccac

SEQ ID NO: 321765 - DNA, 25 bp, Mus musculus
ggactgagtccaagaaatggcctcc

SEQ ID NO: 321766 - DNA, 25 bp, Mus musculus
ggactgatagaaaggtttacgaaag

SEQ ID NO: 321767 - DNA, 25 bp, Mus musculus
ggactgatagaaagttgatcttctt

SEQ ID NO: 321768 - DNA, 25 bp, Mus musculus
ggactgatgcagggtaatcaggaag

SEQ ID NO: 321769 - DNA, 25 bp, Mus musculus
ggactgatttaaggcttttgcctac

SEQ ID NO: 321770 - DNA, 25 bp, Mus musculus
ggactgatttaagggcagcagggaa

SEQ ID NO: 321771 - DNA, 25 bp, Mus musculus
ggactgcacagtgtacaaggcagat

SEQ ID NO: 321772 - DNA, 25 bp, Mus musculus
ggactgcagaatgacagatttgacc

SEQ ID NO: 321773 - DNA, 25 bp, Mus musculus
ggactgcagactgccgaatacacca

SEQ ID NO: 321774 - DNA, 25 bp, Mus musculus
ggactgcagactggcatccgtctct

SEQ ID NO: 321775 - DNA, 25 bp, Mus musculus
ggactgcagagaaagagggggcccg

SEQ ID NO: 321776 - DNA, 25 bp, Mus musculus
ggactgcagagaaatgtgatttgtt

SEQ ID NO: 321777 - DNA, 25 bp, Mus musculus
ggactgcagaggccacttcttcagt

SEQ ID NO: 321778 - DNA, 25 bp, Mus musculus
ggactgcagcacaggttctgattcg

SEQ ID NO: 321779 - DNA, 25 bp, Mus musculus
ggactgcagcctaaatggcaaaatg

SEQ ID NO: 321780 - DNA, 25 bp, Mus musculus
ggactgcagcctcttttatgaaaca

SEQ ID NO: 321781 - DNA, 25 bp, Mus musculus
ggactgcattacaagcccacagagc

SEQ ID NO: 321782 - DNA, 25 bp, Mus musculus
ggactgcattacaagccttcccgct

SEQ ID NO: 321783 - DNA, 25 bp, Mus musculus
ggactgccagggtcacgtggtactg

SEQ ID NO: 321784 - DNA, 25 bp, Mus musculus
ggactgccagtacttggctccagaa

SEQ ID NO: 321785 - DNA, 25 bp, Mus musculus
ggactgccagtgggatcccactaaa

SEQ ID NO: 321786 - DNA, 25 bp, Mus musculus
ggactgccagtgggatcgctgttgt

SEQ ID NO: 321787 - DNA, 25 bp, Mus musculus
ggactgccatgcagtgagctgctgg

SEQ ID NO: 321788 - DNA, 25 bp, Mus musculus
ggactgccccaaggctgacttcccc

SEQ ID NO: 321789 - DNA, 25 bp, Mus musculus
ggactgccggctgggctgctgattc

SEQ ID NO: 321790 - DNA, 25 bp, Mus musculus
ggactgcctgaacagggacaactac

SEQ ID NO: 321791 - DNA, 25 bp, Mus musculus
ggactgcctgccaggattttaccgg

SEQ ID NO: 321792 - DNA, 25 bp, Mus musculus
ggactgccttcaggacgaatgctac

SEQ ID NO: 321793 - DNA, 25 bp, Mus musculus
ggactgcgccatctctgtctgcccc

SEQ ID NO: 321794 - DNA, 25 bp, Mus musculus
ggactgcgggccttcatcaagtagt

SEQ ID NO: 321795 - DNA, 25 bp, Mus musculus
ggactgcgtcccgagggaaatggag

SEQ ID NO: 321796 - DNA, 25 bp, Mus musculus
ggactgctaagtcttcagcaaacga

SEQ ID NO: 321797 - DNA, 25 bp, Mus musculus
ggactgctacgacaggtacctgtgt

SEQ ID NO: 321798 - DNA, 25 bp, Mus musculus
ggactgctacgataggtacctgtgt

SEQ ID NO: 321799 - DNA, 25 bp, Mus musculus
ggactgctaggaagggacaaaggat

SEQ ID NO: 321800 - DNA, 25 bp, Mus musculus
ggactgctaggcaaagaacgttcta

SEQ ID NO: 321801 - DNA, 25 bp, Mus musculus
ggactgctggcctggtagaggagat

SEQ ID NO: 321802 - DNA, 25 bp, Mus musculus
ggactgctgtaggtctgaccacccg

SEQ ID NO: 321803 - DNA, 25 bp, Mus musculus
ggactgctgtcaatgggagccggtg

SEQ ID NO: 321804 - DNA, 25 bp, Mus musculus
ggactggaaaacagtgaaggcccac

SEQ ID NO: 321805 - DNA, 25 bp, Mus musculus
ggactggaaagatggagccagcact

SEQ ID NO: 321806 - DNA, 25 bp, Mus musculus
ggactggaaaggtggtctacttctc

SEQ ID NO: 321807 - DNA, 25 bp, Mus musculus
ggactggaaaggttggtttcttcat

SEQ ID NO: 321808 - DNA, 25 bp, Mus musculus
ggactggacagcaggtcatgttggg

SEQ ID NO: 321809 - DNA, 25 bp, Mus musculus
ggactggagagatcttgtggcgcca

SEQ ID NO: 321810 - DNA, 25 bp, Mus musculus
ggactggagccagaattcacactgg

SEQ ID NO: 321811 - DNA, 25 bp, Mus musculus
ggactggagggtgacagaagacaca

SEQ ID NO: 321812 - DNA, 25 bp, Mus musculus
ggactggagtgaggaaaatggcaca

SEQ ID NO: 321813 - DNA, 25 bp, Mus musculus
ggactggagtgaggagaagaaacac

SEQ ID NO: 321814 - DNA, 25 bp, Mus musculus
ggactggagtgaggtcaagggtctt

SEQ ID NO: 321815 - DNA, 25 bp, Mus musculus
ggactggagtgagtcagcagtgtat

SEQ ID NO: 321816 - DNA, 25 bp, Mus musculus
ggactggatagcctgcttggcagtg

SEQ ID NO: 321817 - DNA, 25 bp, Mus musculus
ggactggatagcctggtaggacagt

SEQ ID NO: 321818 - DNA, 25 bp, Mus musculus
ggactggattctcggagagtccttc

SEQ ID NO: 321819 - DNA, 25 bp, Mus musculus
ggactggattctcggtgggagccag

SEQ ID NO: 321820 - DNA, 25 bp, Mus musculus
ggactggcaaatcaccccttttcca

SEQ ID NO: 321821 - DNA, 25 bp, Mus musculus
ggactggcaagacggcttccttgtg

SEQ ID NO: 321822 - DNA, 25 bp, Mus musculus
ggactggcaggaccgtcacgacggc

SEQ ID NO: 321823 - DNA, 25 bp, Mus musculus
ggactggccgcaggaagctaagcaa

SEQ ID NO: 321824 - DNA, 25 bp, Mus musculus
ggactggccgcagggtacattcgcc

SEQ ID NO: 321825 - DNA, 25 bp, Mus musculus
ggactggcctggggtctacatcacc

SEQ ID NO: 321826 - DNA, 25 bp, Mus musculus
ggactggcgcaaggttcccaatcaa

SEQ ID NO: 321827 - DNA, 25 bp, Mus musculus
ggactggctagaaaatactaaagtt

SEQ ID NO: 321828 - DNA, 25 bp, Mus musculus
ggactggctcatggggaagtctaaa

SEQ ID NO: 321829 - DNA, 25 bp, Mus musculus
ggactggctcatgggttctgcaatc

SEQ ID NO: 321830 - DNA, 25 bp, Mus musculus
ggactgggaaaggacccagctgttg

SEQ ID NO: 321831 - DNA, 25 bp, Mus musculus
ggactgggaaaggagtgtgctcggg

SEQ ID NO: 321832 - DNA, 25 bp, Mus musculus
ggactgggaaaggatcatcgggtta

SEQ ID NO: 321833 - DNA, 25 bp, Mus musculus
ggactgggaaagggtgactgtggcc

SEQ ID NO: 321834 - DNA, 25 bp, Mus musculus
ggactgggaagatggatgacattca

SEQ ID NO: 321835 - DNA, 25 bp, Mus musculus
ggactgggaagccagctagacatca

SEQ ID NO: 321836 - DNA, 25 bp, Mus musculus
ggactgggacctcatcattctctgg

SEQ ID NO: 321837 - DNA, 25 bp, Mus musculus
ggactgggacctcatctacgtgggc

SEQ ID NO: 321838 - DNA, 25 bp, Mus musculus
ggactgggagagaaatatccacccc

SEQ ID NO: 321839 - DNA, 25 bp, Mus musculus
ggactgggagagggtgttacgtttc

SEQ ID NO: 321840 - DNA, 25 bp, Mus musculus
ggactgggaggtaggggtccatgga

SEQ ID NO: 321841 - DNA, 25 bp, Mus musculus
ggactggggtactgctgcaggtcct

SEQ ID NO: 321842 - DNA, 25 bp, Mus musculus
ggactggtcctcaggcattaacaag

SEQ ID NO: 321843 - DNA, 25 bp, Mus musculus
ggactggtgtgagccttctctgagg

SEQ ID NO: 321844 - DNA, 25 bp, Mus musculus
ggactggtttggtgttcatcatggg

SEQ ID NO: 321845 - DNA, 25 bp, Mus musculus
ggactgtacaccaggtcctgataag

SEQ ID NO: 321846 - DNA, 25 bp, Mus musculus
ggactgtaccccagctatcatgaac

SEQ ID NO: 321847 - DNA, 25 bp, Mus musculus
ggactgtaccgaggtctgatcccac

SEQ ID NO: 321848 - DNA, 25 bp, Mus musculus
ggactgtatcaagcaatgtgaccca

SEQ ID NO: 321849 - DNA, 25 bp, Mus musculus
ggactgtcacaacagctcgcaatgc

SEQ ID NO: 321850 - DNA, 25 bp, Mus musculus
ggactgtcacaggggcaggtggcag

SEQ ID NO: 321851 - DNA, 25 bp, Mus musculus
ggactgtcagactgctgggctgatc

SEQ ID NO: 321852 - DNA, 25 bp, Mus musculus
ggactgtcaggattctctttcaaaa

SEQ ID NO: 321853 - DNA, 25 bp, Mus musculus
ggactgtcccacaaggcatgctagt

SEQ ID NO: 321854 - DNA, 25 bp, Mus musculus
ggactgtcctttcccatggccggaa

SEQ ID NO: 321855 - DNA, 25 bp, Mus musculus
ggactgtcggatagggacttactat

SEQ ID NO: 321856 - DNA, 25 bp, Mus musculus
ggactgtcggggtacagcatgtttg

SEQ ID NO: 321857 - DNA, 25 bp, Mus musculus
ggactgtctggaaggtcgctgtgct

SEQ ID NO: 321858 - DNA, 25 bp, Mus musculus
ggactgtgaaacagacaagcagatg

SEQ ID NO: 321859 - DNA, 25 bp, Mus musculus
ggactgtgaaacagggaagcagctg

SEQ ID NO: 321860 - DNA, 25 bp, Mus musculus
ggactgtgacaggcatcatagctgc

SEQ ID NO: 321861 - DNA, 25 bp, Mus musculus
ggactgtgagtgaccatgaaagata

SEQ ID NO: 321862 - DNA, 25 bp, Mus musculus
ggactgtgatgggtgtacaatagac

SEQ ID NO: 321863 - DNA, 25 bp, Mus musculus
ggactgtgcaaggaagatctggaga

SEQ ID NO: 321864 - DNA, 25 bp, Mus musculus
ggactgtgcaggttgaaaacgaggc

SEQ ID NO: 321865 - DNA, 25 bp, Mus musculus
ggactgtgggctgggattcttcaag

SEQ ID NO: 321866 - DNA, 25 bp, Mus musculus
ggactgtgtgggtgaaagccggcgg

SEQ ID NO: 321867 - DNA, 25 bp, Mus musculus
ggactgtgtgtctggcgtgtgtgtg

SEQ ID NO: 321868 - DNA, 25 bp, Mus musculus
ggactgttaggaacagcctcaggcc

SEQ ID NO: 321869 - DNA, 25 bp, Mus musculus
ggactgttaggcaccgtgggcctaa

SEQ ID NO: 321870 - DNA, 25 bp, Mus musculus
ggacttaaaggtgcctggaagaatt

SEQ ID NO: 321871 - DNA, 25 bp, Mus musculus
ggacttaagttccagtggtaactca

SEQ ID NO: 321872 - DNA, 25 bp, Mus musculus
ggacttaatttgagcataaggagaa

SEQ ID NO: 321873 - DNA, 25 bp, Mus musculus
ggacttacacttcaacggtctgagc

SEQ ID NO: 321874 - DNA, 25 bp, Mus musculus
ggacttacacttcaagatgtttgat

SEQ ID NO: 321875 - DNA, 25 bp, Mus musculus
ggacttacaggtactatgggttgtc

SEQ ID NO: 321876 - DNA, 25 bp, Mus musculus
ggacttactacagctgggcatggca

SEQ ID NO: 321877 - DNA, 25 bp, Mus musculus
ggacttactacaggtggctgcggct

SEQ ID NO: 321878 - DNA, 25 bp, Mus musculus
ggacttagagcatcactcttacaga

SEQ ID NO: 321879 - DNA, 25 bp, Mus musculus
ggacttagcacactcctgggcatcc

SEQ ID NO: 321880 - DNA, 25 bp, Mus musculus
ggacttaggagtacagagactcagc

SEQ ID NO: 321881 - DNA, 25 bp, Mus musculus
ggacttatatatgacattatgcaga

SEQ ID NO: 321882 - DNA, 25 bp, Mus musculus
ggacttcaagaaaggtttcagactg

SEQ ID NO: 321883 - DNA, 25 bp, Mus musculus
ggacttcaagaacaagtatgaggat

SEQ ID NO: 321884 - DNA, 25 bp, Mus musculus
ggacttcaaggaaggaatcttttgt

SEQ ID NO: 321885 - DNA, 25 bp, Mus musculus
ggacttcactacacaacatgcctaa

SEQ ID NO: 321886 - DNA, 25 bp, Mus musculus
ggacttcactggaccttcaggcaag

SEQ ID NO: 321887 - DNA, 25 bp, Mus musculus
ggacttcactggaccttcatctcgg

SEQ ID NO: 321888 - DNA, 25 bp, Mus musculus
ggacttcagaaatgggacactacac

SEQ ID NO: 321889 - DNA, 25 bp, Mus musculus
ggacttcagaaattgtgaaggttcc

SEQ ID NO: 321890 - DNA, 25 bp, Mus musculus
ggacttcagcaaaggcacacaccga

SEQ ID NO: 321891 - DNA, 25 bp, Mus musculus
ggacttcagggaaggacctctccga

SEQ ID NO: 321892 - DNA, 25 bp, Mus musculus
ggacttcagggaagttttgctccag

SEQ ID NO: 321893 - DNA, 25 bp, Mus musculus
ggacttcagtgaaggtaatggaaaa

SEQ ID NO: 321894 - DNA, 25 bp, Mus musculus
ggacttcatgcgattgagaagattg

SEQ ID NO: 321895 - DNA, 25 bp, Mus musculus
ggacttcatgttgatcacagccgag

SEQ ID NO: 321896 - DNA, 25 bp, Mus musculus
ggacttcattgaccaggagctgtcc

SEQ ID NO: 321897 - DNA, 25 bp, Mus musculus
ggacttccacaagaaatttgccccg

SEQ ID NO: 321898 - DNA, 25 bp, Mus musculus
ggacttccacagccagaaaagaaaa

SEQ ID NO: 321899 - DNA, 25 bp, Mus musculus
ggacttccaggctcagtgtttagag

SEQ ID NO: 321900 - DNA, 25 bp, Mus musculus
ggacttccccacgatctccctggag

SEQ ID NO: 321901 - DNA, 25 bp, Mus musculus
ggacttccccacggaagacggcgct

SEQ ID NO: 321902 - DNA, 25 bp, Mus musculus
ggacttccggcagaggtatcgcatc

SEQ ID NO: 321903 - DNA, 25 bp, Mus musculus
ggacttcgacaggggaatctggtcg

SEQ ID NO: 321904 - DNA, 25 bp, Mus musculus
ggacttcgaggacgattacgtgcac

SEQ ID NO: 321905 - DNA, 25 bp, Mus musculus
ggacttcgtgcagtgactccactgg

SEQ ID NO: 321906 - DNA, 25 bp, Mus musculus
ggacttctatgtggtgctgggtagg

SEQ ID NO: 321907 - DNA, 25 bp, Mus musculus
ggacttctcaagatgaggttccagg

SEQ ID NO: 321908 - DNA, 25 bp, Mus musculus
ggacttctcaaggaatctgaatttt

SEQ ID NO: 321909 - DNA, 25 bp, Mus musculus
ggacttctcaagtctattgcatctg

SEQ ID NO: 321910 - DNA, 25 bp, Mus musculus
ggacttctcagagtctgtcccaggg

SEQ ID NO: 321911 - DNA, 25 bp, Mus musculus
ggacttcttcaagggtggggtaatt

SEQ ID NO: 321912 - DNA, 25 bp, Mus musculus
ggacttgaagtctggctgtacatca

SEQ ID NO: 321913 - DNA, 25 bp, Mus musculus
ggacttgcaagctctttacagtttt

SEQ ID NO: 321914 - DNA, 25 bp, Mus musculus
ggacttgcaagtctctttacagaaa

SEQ ID NO: 321915 - DNA, 25 bp, Mus musculus
ggacttgcggatggggaagccagct

SEQ ID NO: 321916 - DNA, 25 bp, Mus musculus
ggacttgctccaagggccccgccgt

SEQ ID NO: 321917 - DNA, 25 bp, Mus musculus
ggacttgctgtaggttatgatgagt

SEQ ID NO: 321918 - DNA, 25 bp, Mus musculus
ggacttggacaaacacagccagctt

SEQ ID NO: 321919 - DNA, 25 bp, Mus musculus
ggacttggacatgtcatctcctgaa

SEQ ID NO: 321920 - DNA, 25 bp, Mus musculus
ggacttggactgacctgaaaagatg

SEQ ID NO: 321921 - DNA, 25 bp, Mus musculus
ggacttggcaacagggtctctgtga

SEQ ID NO: 321922 - DNA, 25 bp, Mus musculus
ggacttggcagctcatgctgtttct

SEQ ID NO: 321923 - DNA, 25 bp, Mus musculus
ggacttggcaggtccaacgtcggaa

SEQ ID NO: 321924 - DNA, 25 bp, Mus musculus
ggacttggctagcaggtattcatgc

SEQ ID NO: 321925 - DNA, 25 bp, Mus musculus
ggacttggggcgacgtatgtgatga

SEQ ID NO: 321926 - DNA, 25 bp, Mus musculus
ggacttggggggacgtatgtgatga

SEQ ID NO: 321927 - DNA, 25 bp, Mus musculus
ggacttgtaataaagctgcgaagct

SEQ ID NO: 321928 - DNA, 25 bp, Mus musculus
ggacttgtaggtcagagtttttgtg

SEQ ID NO: 321929 - DNA, 25 bp, Mus musculus
ggacttgtcaggtttctaaacagcc

SEQ ID NO: 321930 - DNA, 25 bp, Mus musculus
ggacttgtgccggtcctgccccctt

SEQ ID NO: 321931 - DNA, 25 bp, Mus musculus
ggactttaaaagaagatccagtcct

SEQ ID NO: 321932 - DNA, 25 bp, Mus musculus
ggactttatggtagcttttcccaag

SEQ ID NO: 321933 - DNA, 25 bp, Mus musculus
ggactttatggtctttagtagcttt

SEQ ID NO: 321934 - DNA, 25 bp, Mus musculus
ggactttcaagatgacgggacgact

SEQ ID NO: 321935 - DNA, 25 bp, Mus musculus
ggactttcaagcctatgtgtttcga

SEQ ID NO: 321936 - DNA, 25 bp, Mus musculus
ggactttcaccagggaagacagtga

SEQ ID NO: 321937 - DNA, 25 bp, Mus musculus
ggactttcatacagcacgcatttga

SEQ ID NO: 321938 - DNA, 25 bp, Mus musculus
ggactttctcagatcgtttaggaaa

SEQ ID NO: 321939 - DNA, 25 bp, Mus musculus
ggactttctcaggagtctcatgaac

SEQ ID NO: 321940 - DNA, 25 bp, Mus musculus
ggactttgaaaaccaaatcactgag

SEQ ID NO: 321941 - DNA, 25 bp, Mus musculus
ggactttgaaaacttgtctttgcag

SEQ ID NO: 321942 - DNA, 25 bp, Mus musculus
ggactttgaagctgttaagaagaaa

SEQ ID NO: 321943 - DNA, 25 bp, Mus musculus
ggactttgagaaccctgactgaaat

SEQ ID NO: 321944 - DNA, 25 bp, Mus musculus
ggactttgagtctaacaaatgcttc

SEQ ID NO: 321945 - DNA, 25 bp, Mus musculus
ggactttgcaaggcagtactacgag

SEQ ID NO: 321946 - DNA, 25 bp, Mus musculus
ggactttgccaggacctgtgtcatg

SEQ ID NO: 321947 - DNA, 25 bp, Mus musculus
ggactttgccaggcgctgtgctttg

SEQ ID NO: 321948 - DNA, 25 bp, Mus musculus
ggactttgggattttcagaaagaag

SEQ ID NO: 321949 - DNA, 25 bp, Mus musculus
ggacttttatacaggactgacagac

SEQ ID NO: 321950 - DNA, 25 bp, Mus musculus
ggactttttgatcgatgatgaaaac

SEQ ID NO: 321951 - DNA, 25 bp, Mus musculus
ggacttttttgagacagaaaccaac

SEQ ID NO: 321952 - DNA, 25 bp, Mus musculus
ggagaaaaacagtaccaaggagtta

SEQ ID NO: 321953 - DNA, 25 bp, Mus musculus
ggagaaaaacgaaaatcttcaagct

SEQ ID NO: 321954 - DNA, 25 bp, Mus musculus
ggagaaaaaggggaccatggccttc

SEQ ID NO: 321955 - DNA, 25 bp, Mus musculus
ggagaaaacctgaagactgagcagt

SEQ ID NO: 321956 - DNA, 25 bp, Mus musculus
ggagaaaacgatgggatattcagag

SEQ ID NO: 321957 - DNA, 25 bp, Mus musculus
ggagaaaacggcacacatgttggcc

SEQ ID NO: 321958 - DNA, 25 bp, Mus musculus
ggagaaaactaagatgtcaacttgt

SEQ ID NO: 321959 - DNA, 25 bp, Mus musculus
ggagaaaagagaatattttccagat

SEQ ID NO: 321960 - DNA, 25 bp, Mus musculus
ggagaaaagaggaatattagttaga

SEQ ID NO: 321961 - DNA, 25 bp, Mus musculus
ggagaaaagcccaacaccagctaca

SEQ ID NO: 321962 - DNA, 25 bp, Mus musculus
ggagaaaatggccaccaccggccac

SEQ ID NO: 321963 - DNA, 25 bp, Mus musculus
ggagaaaattagagccccttccaat

SEQ ID NO: 321964 - DNA, 25 bp, Mus musculus
ggagaaacaatggagtccaacacaa

SEQ ID NO: 321965 - DNA, 25 bp, Mus musculus
ggagaaacacagcttttcttctcac

SEQ ID NO: 321966 - DNA, 25 bp, Mus musculus
ggagaaacacaggtggaaaaggagg

SEQ ID NO: 321967 - DNA, 25 bp, Mus musculus
ggagaaacacgtcggcttctgacga

SEQ ID NO: 321968 - DNA, 25 bp, Mus musculus
ggagaaacagccctgacggccgctg

SEQ ID NO: 321969 - DNA, 25 bp, Mus musculus
ggagaaacaggcaagtgctctccag

SEQ ID NO: 321970 - DNA, 25 bp, Mus musculus
ggagaaacagggtcatgatggtggc

SEQ ID NO: 321971 - DNA, 25 bp, Mus musculus
ggagaaacaggtcttgtccatggaa

SEQ ID NO: 321972 - DNA, 25 bp, Mus musculus
ggagaaaccaagacccagacttact

SEQ ID NO: 321973 - DNA, 25 bp, Mus musculus
ggagaaactccagatcaccatccgg

SEQ ID NO: 321974 - DNA, 25 bp, Mus musculus
ggagaaactgaggagatctagatcc

SEQ ID NO: 321975 - DNA, 25 bp, Mus musculus
ggagaaactgaggaggtcccgatca

SEQ ID NO: 321976 - DNA, 25 bp, Mus musculus
ggagaaacttaaagcacatacgtgt

SEQ ID NO: 321977 - DNA, 25 bp, Mus musculus
ggagaaacttaaaggggctgatcct

SEQ ID NO: 321978 - DNA, 25 bp, Mus musculus
ggagaaagaaggcatgtcatgttgc

SEQ ID NO: 321979 - DNA, 25 bp, Mus musculus
ggagaaagaatgtcgaagcggaggc

SEQ ID NO: 321980 - DNA, 25 bp, Mus musculus
ggagaaagacgaaagaatcctgtgg

SEQ ID NO: 321981 - DNA, 25 bp, Mus musculus
ggagaaagacgaaaggtacctgttg

SEQ ID NO: 321982 - DNA, 25 bp, Mus musculus
ggagaaagagaacgcctcaaagagt

SEQ ID NO: 321983 - DNA, 25 bp, Mus musculus
ggagaaagagaacggccctacccac

SEQ ID NO: 321984 - DNA, 25 bp, Mus musculus
ggagaaagagatgaaaccggcttgt

SEQ ID NO: 321985 - DNA, 25 bp, Mus musculus
ggagaaagaggctgccactcgctga

SEQ ID NO: 321986 - DNA, 25 bp, Mus musculus
ggagaaagagggtggagaggtcgtg

SEQ ID NO: 321987 - DNA, 25 bp, Mus musculus
ggagaaagaggtggaggtgattggc

SEQ ID NO: 321988 - DNA, 25 bp, Mus musculus
ggagaaagcagccgtgaagccgctc

SEQ ID NO: 321989 - DNA, 25 bp, Mus musculus
ggagaaagcaggccaccccttccac

SEQ ID NO: 321990 - DNA, 25 bp, Mus musculus
ggagaaagcgcctgctggagttcaa

SEQ ID NO: 321991 - DNA, 25 bp, Mus musculus
ggagaaagctgccaggctctgggtg

SEQ ID NO: 321992 - DNA, 25 bp, Mus musculus
ggagaaaggaaaggccttcgatatg

SEQ ID NO: 321993 - DNA, 25 bp, Mus musculus
ggagaaaggctggagctggaacctt

SEQ ID NO: 321994 - DNA, 25 bp, Mus musculus
ggagaaaggctgggtgaagaccctt

SEQ ID NO: 321995 - DNA, 25 bp, Mus musculus
ggagaaagtgaggacttttgctgcc

SEQ ID NO: 321996 - DNA, 25 bp, Mus musculus
ggagaaagtggcaagaaggaaaaca

SEQ ID NO: 321997 - DNA, 25 bp, Mus musculus
ggagaaagtggcaagatcttagggt

SEQ ID NO: 321998 - DNA, 25 bp, Mus musculus
ggagaaagtggcaagtcagtacagg

SEQ ID NO: 321999 - DNA, 25 bp, Mus musculus
ggagaaatacctccagttcagaaga

SEQ ID NO: 322000 - DNA, 25 bp, Mus musculus
ggagaaatagaagaggagcctgcag

SEQ ID NO: 322001 - DNA, 25 bp, Mus musculus
ggagaaatagaagtggacgacaacc

SEQ ID NO: 322002 - DNA, 25 bp, Mus musculus
ggagaaatagcatgattcagctact

SEQ ID NO: 322003 - DNA, 25 bp, Mus musculus
ggagaaatatgaggaacacatcaag

SEQ ID NO: 322004 - DNA, 25 bp, Mus musculus
ggagaaatatgagtggttccatgtc

SEQ ID NO: 322005 - DNA, 25 bp, Mus musculus
ggagaaatcattcagtctgtgtatg

SEQ ID NO: 322006 - DNA, 25 bp, Mus musculus
ggagaaatccaagcttttagccagg

SEQ ID NO: 322007 - DNA, 25 bp, Mus musculus
ggagaaatgcagacgtcttgtagaa

SEQ ID NO: 322008 - DNA, 25 bp, Mus musculus
ggagaaatgcataagttggttgatc

SEQ ID NO: 322009 - DNA, 25 bp, Mus musculus
ggagaaatgggccagcaatgccctt

SEQ ID NO: 322010 - DNA, 25 bp, Mus musculus
ggagaaattggtccttaccctattc

SEQ ID NO: 322011 - DNA, 25 bp, Mus musculus
ggagaaatttgagagtccaattggt

SEQ ID NO: 322012 - DNA, 25 bp, Mus musculus
ggagaaatttggaggaattgatatt

SEQ ID NO: 322013 - DNA, 25 bp, Mus musculus
ggagaacaagatcggttctctttgt

SEQ ID NO: 322014 - DNA, 25 bp, Mus musculus
ggagaacaagatcgttggaatgcca

SEQ ID NO: 322015 - DNA, 25 bp, Mus musculus
ggagaacaaggctgaatcagagatc

SEQ ID NO: 322016 - DNA, 25 bp, Mus musculus
ggagaacaagtgccagaaccagctc

SEQ ID NO: 322017 - DNA, 25 bp, Mus musculus
ggagaacagcagtaccactagccca

SEQ ID NO: 322018 - DNA, 25 bp, Mus musculus
ggagaacagcgaagccttggagctg

SEQ ID NO: 322019 - DNA, 25 bp, Mus musculus
ggagaacagctcggggactttctct

SEQ ID NO: 322020 - DNA, 25 bp, Mus musculus
ggagaacagctcgggtttgagtttt

SEQ ID NO: 322021 - DNA, 25 bp, Mus musculus
ggagaacagggcgtggtacccactc

SEQ ID NO: 322022 - DNA, 25 bp, Mus musculus
ggagaacatgattaatgacttccac

SEQ ID NO: 322023 - DNA, 25 bp, Mus musculus
ggagaacatggaggttgctatcggc

SEQ ID NO: 322024 - DNA, 25 bp, Mus musculus
ggagaacattgcagggccgtgcagg

SEQ ID NO: 322025 - DNA, 25 bp, Mus musculus
ggagaacattgcaggtaaagatgag

SEQ ID NO: 322026 - DNA, 25 bp, Mus musculus
ggagaaccaaaaataatctataagt

SEQ ID NO: 322027 - DNA, 25 bp, Mus musculus
ggagaaccaaacaaatgaagaagca

SEQ ID NO: 322028 - DNA, 25 bp, Mus musculus
ggagaaccaggagctctggttagac

SEQ ID NO: 322029 - DNA, 25 bp, Mus musculus
ggagaacccagatgagatggaccaa

SEQ ID NO: 322030 - DNA, 25 bp, Mus musculus
ggagaaccctcgatggtttcaaggc

SEQ ID NO: 322031 - DNA, 25 bp, Mus musculus
ggagaaccgggtgagccctatttct

SEQ ID NO: 322032 - DNA, 25 bp, Mus musculus
ggagaacctggagagatgctgtccc

SEQ ID NO: 322033 - DNA, 25 bp, Mus musculus
ggagaacgagagtctccatcatccc

SEQ ID NO: 322034 - DNA, 25 bp, Mus musculus
ggagaacgagcctggaattgtgtcg

SEQ ID NO: 322035 - DNA, 25 bp, Mus musculus
ggagaacgaggagatatccatcaat

SEQ ID NO: 322036 - DNA, 25 bp, Mus musculus
ggagaactcaaggcttctagagaac

SEQ ID NO: 322037 - DNA, 25 bp, Mus musculus
ggagaactccaaggtcctaggtgag

SEQ ID NO: 322038 - DNA, 25 bp, Mus musculus
ggagaactccagggaggtcctgatg

SEQ ID NO: 322039 - DNA, 25 bp, Mus musculus
ggagaactccaggtctttccagcat

SEQ ID NO: 322040 - DNA, 25 bp, Mus musculus
ggagaactcgcaccagggtccacgc

SEQ ID NO: 322041 - DNA, 25 bp, Mus musculus
ggagaactgaaagtgacaactggaa

SEQ ID NO: 322042 - DNA, 25 bp, Mus musculus
ggagaactgaaagtgggtccctgaa

SEQ ID NO: 322043 - DNA, 25 bp, Mus musculus
ggagaactgcacagcgaaccccctg

SEQ ID NO: 322044 - DNA, 25 bp, Mus musculus
ggagaactgcaggcatcagaagggg

SEQ ID NO: 322045 - DNA, 25 bp, Mus musculus
ggagaactgcaggttctcccatggg

SEQ ID NO: 322046 - DNA, 25 bp, Mus musculus
ggagaactgccccaccattctccag

SEQ ID NO: 322047 - DNA, 25 bp, Mus musculus
ggagaacttcttaacatatgacatc

SEQ ID NO: 322048 - DNA, 25 bp, Mus musculus
ggagaacttgggctctgctctgctt

SEQ ID NO: 322049 - DNA, 25 bp, Mus musculus
ggagaacttgttaaggctcaggcca

SEQ ID NO: 322050 - DNA, 25 bp, Mus musculus
ggagaagaaaatgaccctgccacat

SEQ ID NO: 322051 - DNA, 25 bp, Mus musculus
ggagaagaaaatgctttacacagat

SEQ ID NO: 322052 - DNA, 25 bp, Mus musculus
ggagaagaaaatggagttgaagcag

SEQ ID NO: 322053 - DNA, 25 bp, Mus musculus
ggagaagaaccatttgacattgtgc

SEQ ID NO: 322054 - DNA, 25 bp, Mus musculus
ggagaagaagaaggtagctacatca

SEQ ID NO: 322055 - DNA, 25 bp, Mus musculus
ggagaagaagaagtatgaacgaggc

SEQ ID NO: 322056 - DNA, 25 bp, Mus musculus
ggagaagaagaatttggaattttac

SEQ ID NO: 322057 - DNA, 25 bp, Mus musculus
ggagaagaagcaatgtctgaccgtc

SEQ ID NO: 322058 - DNA, 25 bp, Mus musculus
ggagaagaagcacaagcttctggcc

SEQ ID NO: 322059 - DNA, 25 bp, Mus musculus
ggagaagaagcaggaattcttaggc

SEQ ID NO: 322060 - DNA, 25 bp, Mus musculus
ggagaagaagcccaaagcatccaaa

SEQ ID NO: 322061 - DNA, 25 bp, Mus musculus
ggagaagaagggctccagcaccacc

SEQ ID NO: 322062 - DNA, 25 bp, Mus musculus
ggagaagaagttatgctgcaggcac

SEQ ID NO: 322063 - DNA, 25 bp, Mus musculus
ggagaagacaaggttctttaacgaa

SEQ ID NO: 322064 - DNA, 25 bp, Mus musculus
ggagaagacaagtccatctaccgcc

SEQ ID NO: 322065 - DNA, 25 bp, Mus musculus
ggagaagactacagatgggcagcag

SEQ ID NO: 322066 - DNA, 25 bp, Mus musculus
ggagaagactacaggacctgcaggg

SEQ ID NO: 322067 - DNA, 25 bp, Mus musculus
ggagaagactgcggttctacgggtg

SEQ ID NO: 322068 - DNA, 25 bp, Mus musculus
ggagaagagaaaggtctgtatccac

SEQ ID NO: 322069 - DNA, 25 bp, Mus musculus
ggagaagagaaggaagatccctgtg

SEQ ID NO: 322070 - DNA, 25 bp, Mus musculus
ggagaagagaagggactcggccaga

SEQ ID NO: 322071 - DNA, 25 bp, Mus musculus
ggagaagagcagtacactaggtacc

SEQ ID NO: 322072 - DNA, 25 bp, Mus musculus
ggagaagagccccagtcacgcggtg

SEQ ID NO: 322073 - DNA, 25 bp, Mus musculus
ggagaagatattgacacagcagtcc

SEQ ID NO: 322074 - DNA, 25 bp, Mus musculus
ggagaagatggttccatatctgcat

SEQ ID NO: 322075 - DNA, 25 bp, Mus musculus
ggagaagattgcaaagtatggtata

SEQ ID NO: 322076 - DNA, 25 bp, Mus musculus
ggagaagcaaaacttttaatccagg

SEQ ID NO: 322077 - DNA, 25 bp, Mus musculus
ggagaagcacctgggagagcccccc

SEQ ID NO: 322078 - DNA, 25 bp, Mus musculus
ggagaagcagaccatggtgaatccg

SEQ ID NO: 322079 - DNA, 25 bp, Mus musculus
ggagaagcagagcactggcagatcc

SEQ ID NO: 322080 - DNA, 25 bp, Mus musculus
ggagaagcagagcggaattcctaag

SEQ ID NO: 322081 - DNA, 25 bp, Mus musculus
ggagaagcagcttatggcaaacccc

SEQ ID NO: 322082 - DNA, 25 bp, Mus musculus
ggagaagcagggatctgggcactgc

SEQ ID NO: 322083 - DNA, 25 bp, Mus musculus
ggagaagcaggtctccctgggactc

SEQ ID NO: 322084 - DNA, 25 bp, Mus musculus
ggagaagcccacagaaacgcatccc

SEQ ID NO: 322085 - DNA, 25 bp, Mus musculus
ggagaagcccacagtccatggagac

SEQ ID NO: 322086 - DNA, 25 bp, Mus musculus
ggagaagccggcctcggtgtggtac

SEQ ID NO: 322087 - DNA, 25 bp, Mus musculus
ggagaagctctatgactttgtgaag

SEQ ID NO: 322088 - DNA, 25 bp, Mus musculus
ggagaagctgaggacaagatctaat

SEQ ID NO: 322089 - DNA, 25 bp, Mus musculus
ggagaagctgcggcccaccaggacc

SEQ ID NO: 322090 - DNA, 25 bp, Mus musculus
ggagaagctgctgaggctcacaact

SEQ ID NO: 322091 - DNA, 25 bp, Mus musculus
ggagaagctggtccctccaggaggc

SEQ ID NO: 322092 - DNA, 25 bp, Mus musculus
ggagaaggaacatgtttccagagtg

SEQ ID NO: 322093 - DNA, 25 bp, Mus musculus
ggagaaggaacggaggaagatgaca

SEQ ID NO: 322094 - DNA, 25 bp, Mus musculus
ggagaaggagctaggatgaacagca

SEQ ID NO: 322095 - DNA, 25 bp, Mus musculus
ggagaaggagctagtgacattcatt

SEQ ID NO: 322096 - DNA, 25 bp, Mus musculus
ggagaaggatagagatggttgtcca

SEQ ID NO: 322097 - DNA, 25 bp, Mus musculus
ggagaaggccagacccccatcccgg

SEQ ID NO: 322098 - DNA, 25 bp, Mus musculus
ggagaaggccagggtagacagcaag

SEQ ID NO: 322099 - DNA, 25 bp, Mus musculus
ggagaagggaaaggggaatgatgaa

SEQ ID NO: 322100 - DNA, 25 bp, Mus musculus
ggagaagggaaatatgctggcttat

SEQ ID NO: 322101 - DNA, 25 bp, Mus musculus
ggagaagggagtaaaggtatcagga

SEQ ID NO: 322102 - DNA, 25 bp, Mus musculus
ggagaagggtgagcaattgtgttcg

SEQ ID NO: 322103 - DNA, 25 bp, Mus musculus
ggagaagtaaatgacattaaagatt

SEQ ID NO: 322104 - DNA, 25 bp, Mus musculus
ggagaagtaaatgactttaagaagc

SEQ ID NO: 322105 - DNA, 25 bp, Mus musculus
ggagaagtaaatgcttgacaaaaaa

SEQ ID NO: 322106 - DNA, 25 bp, Mus musculus
ggagaagtacaaagatgaacgagac

SEQ ID NO: 322107 - DNA, 25 bp, Mus musculus
ggagaagtcaggttccaaggagcag

SEQ ID NO: 322108 - DNA, 25 bp, Mus musculus
ggagaagtcccgttgtatcagagta

SEQ ID NO: 322109 - DNA, 25 bp, Mus musculus
ggagaagtgaacaaagtctggtttt

SEQ ID NO: 322110 - DNA, 25 bp, Mus musculus
ggagaagtgcacgtaagttcatata

SEQ ID NO: 322111 - DNA, 25 bp, Mus musculus
ggagaagtggatgtcgcgtggaggg

SEQ ID NO: 322112 - DNA, 25 bp, Mus musculus
ggagaagtggtgaaggccttggagt

SEQ ID NO: 322113 - DNA, 25 bp, Mus musculus
ggagaataaaggacctttttcagaa

SEQ ID NO: 322114 - DNA, 25 bp, Mus musculus
ggagaataagtgttttgcagctgac

SEQ ID NO: 322115 - DNA, 25 bp, Mus musculus
ggagaatacagggattacagcaatg

SEQ ID NO: 322116 - DNA, 25 bp, Mus musculus
ggagaatacagggtctgttcactag

SEQ ID NO: 322117 - DNA, 25 bp, Mus musculus
ggagaatactataaggcaagaagtg

SEQ ID NO: 322118 - DNA, 25 bp, Mus musculus
ggagaatactatatgtggagacggt

SEQ ID NO: 322119 - DNA, 25 bp, Mus musculus
ggagaatactattgagtcagacgtt

SEQ ID NO: 322120 - DNA, 25 bp, Mus musculus
ggagaatatattaaccgggaatcac

SEQ ID NO: 322121 - DNA, 25 bp, Mus musculus
ggagaatcagagtggtgtctccttt

SEQ ID NO: 322122 - DNA, 25 bp, Mus musculus
ggagaatcaggcatcgcctccatgt

SEQ ID NO: 322123 - DNA, 25 bp, Mus musculus
ggagaatccgaggccacaggcctct

SEQ ID NO: 322124 - DNA, 25 bp, Mus musculus
ggagaatcggggtgcaccttcgttg

SEQ ID NO: 322125 - DNA, 25 bp, Mus musculus
ggagaatcgggttggaggggtgcag

SEQ ID NO: 322126 - DNA, 25 bp, Mus musculus
ggagaatctagaggtgaacgagatt

SEQ ID NO: 322127 - DNA, 25 bp, Mus musculus
ggagaatctaggcggcttcagcggg

SEQ ID NO: 322128 - DNA, 25 bp, Mus musculus
ggagaatctagggctcaccatcatg

SEQ ID NO: 322129 - DNA, 25 bp, Mus musculus
ggagaatgaagatgctgggttttca

SEQ ID NO: 322130 - DNA, 25 bp, Mus musculus
ggagaatgactggtgggtgtgcaaa

SEQ ID NO: 322131 - DNA, 25 bp, Mus musculus
ggagaatgcccaatggcacccaggc

SEQ ID NO: 322132 - DNA, 25 bp, Mus musculus
ggagaatggagttggctctgctctg

SEQ ID NO: 322133 - DNA, 25 bp, Mus musculus
ggagaatggcccgccctcctcgccc

SEQ ID NO: 322134 - DNA, 25 bp, Mus musculus
ggagaatgggacaggagacaagatc

SEQ ID NO: 322135 - DNA, 25 bp, Mus musculus
ggagaatgggcaggtggcactgatg

SEQ ID NO: 322136 - DNA, 25 bp, Mus musculus
ggagaatgggcagttgttacaggtg

SEQ ID NO: 322137 - DNA, 25 bp, Mus musculus
ggagaatgtcagattccagattacc

SEQ ID NO: 322138 - DNA, 25 bp, Mus musculus
ggagaatgtgctagagatcaataag

SEQ ID NO: 322139 - DNA, 25 bp, Mus musculus
ggagaatgtgggctcatggcagata

SEQ ID NO: 322140 - DNA, 25 bp, Mus musculus
ggagaatgtgtatggcctgcaggcg

SEQ ID NO: 322141 - DNA, 25 bp, Mus musculus
ggagaatgtttgcatattgatgagt

SEQ ID NO: 322142 - DNA, 25 bp, Mus musculus
ggagaatgtttggatattgatgagt

SEQ ID NO: 322143 - DNA, 25 bp, Mus musculus
ggagaatgtttttcttacttatcaa

SEQ ID NO: 322144 - DNA, 25 bp, Mus musculus
ggagaattacaagtgtgaagtagtc

SEQ ID NO: 322145 - DNA, 25 bp, Mus musculus
ggagaattacagtactgtttatcag

SEQ ID NO: 322146 - DNA, 25 bp, Mus musculus
ggagaattatgagctacagaagtta

SEQ ID NO: 322147 - DNA, 25 bp, Mus musculus
ggagaattatgaggtctacaagcag

SEQ ID NO: 322148 - DNA, 25 bp, Mus musculus
ggagaatttctgaaagtgcaacagt

SEQ ID NO: 322149 - DNA, 25 bp, Mus musculus
ggagaatttctgtaagtgcaacagt

SEQ ID NO: 322150 - DNA, 25 bp, Mus musculus
ggagaattttctgggggtcccacag

SEQ ID NO: 322151 - DNA, 25 bp, Mus musculus
ggagacaaaatgagtctggaatcag

SEQ ID NO: 322152 - DNA, 25 bp, Mus musculus
ggagacaaaattgcaatgcatgaac

SEQ ID NO: 322153 - DNA, 25 bp, Mus musculus
ggagacaaaattgtagaagaaccca

SEQ ID NO: 322154 - DNA, 25 bp, Mus musculus
ggagacaacaccctattttataggc

SEQ ID NO: 322155 - DNA, 25 bp, Mus musculus
ggagacaacatacaggataagaaca

SEQ ID NO: 322156 - DNA, 25 bp, Mus musculus
ggagacaacggaaagacgatgctca

SEQ ID NO: 322157 - DNA, 25 bp, Mus musculus
ggagacaagccaaaggcaccatggc

SEQ ID NO: 322158 - DNA, 25 bp, Mus musculus
ggagacaaggaacatggaataccta

SEQ ID NO: 322159 - DNA, 25 bp, Mus musculus
ggagacaatggtctgtgggagccca

SEQ ID NO: 322160 - DNA, 25 bp, Mus musculus
ggagacacagacgctgttccggcgc

SEQ ID NO: 322161 - DNA, 25 bp, Mus musculus
ggagacacagcatcttgcagcccca

SEQ ID NO: 322162 - DNA, 25 bp, Mus musculus
ggagacacagcctctgccaagcagt

SEQ ID NO: 322163 - DNA, 25 bp, Mus musculus
ggagacacagcttggtgacaatgcc

SEQ ID NO: 322164 - DNA, 25 bp, Mus musculus
ggagacacaggccccatggggatgg

SEQ ID NO: 322165 - DNA, 25 bp, Mus musculus
ggagacacaggtgacaaacttgaag

SEQ ID NO: 322166 - DNA, 25 bp, Mus musculus
ggagacacaggttttggctatggaa

SEQ ID NO: 322167 - DNA, 25 bp, Mus musculus
ggagacacctaaaggctcccctttg

SEQ ID NO: 322168 - DNA, 25 bp, Mus musculus
ggagacaccttcaggtggaagggag

SEQ ID NO: 322169 - DNA, 25 bp, Mus musculus
ggagacactgaggctttcaggtttc

SEQ ID NO: 322170 - DNA, 25 bp, Mus musculus
ggagacagaaaagaatgcagtcaca

SEQ ID NO: 322171 - DNA, 25 bp, Mus musculus
ggagacagagcagacgatttacatg

SEQ ID NO: 322172 - DNA, 25 bp, Mus musculus
ggagacagagcaggtggctgtagga

SEQ ID NO: 322173 - DNA, 25 bp, Mus musculus
ggagacagagcaggtgttttagaaa

SEQ ID NO: 322174 - DNA, 25 bp, Mus musculus
ggagacagaggaggtggtcctgggg

SEQ ID NO: 322175 - DNA, 25 bp, Mus musculus
ggagacagagggcatggtggcagtg

SEQ ID NO: 322176 - DNA, 25 bp, Mus musculus
ggagacagaggtattgacctcatgg

SEQ ID NO: 322177 - DNA, 25 bp, Mus musculus
ggagacagagtggtgattagaaatt

SEQ ID NO: 322178 - DNA, 25 bp, Mus musculus
ggagacagcaggcacaccaagatga

SEQ ID NO: 322179 - DNA, 25 bp, Mus musculus
ggagacagccatgatcaactgggac

SEQ ID NO: 322180 - DNA, 25 bp, Mus musculus
ggagacagccatgatcctacagatc

SEQ ID NO: 322181 - DNA, 25 bp, Mus musculus
ggagacagcccaaaggatgactcaa

SEQ ID NO: 322182 - DNA, 25 bp, Mus musculus
ggagacagcccaaggatgtcacagt

SEQ ID NO: 322183 - DNA, 25 bp, Mus musculus
ggagacagcccacaggatgactcaa

SEQ ID NO: 322184 - DNA, 25 bp, Mus musculus
ggagacagcctgccccgcgagaaag

SEQ ID NO: 322185 - DNA, 25 bp, Mus musculus
ggagacagcctgccgagggagcggg

SEQ ID NO: 322186 - DNA, 25 bp, Mus musculus
ggagacagcgaggtggattaagttt

SEQ ID NO: 322187 - DNA, 25 bp, Mus musculus
ggagacagggtgctggttggtggca

SEQ ID NO: 322188 - DNA, 25 bp, Mus musculus
ggagacaggtaacagtttcggccga

SEQ ID NO: 322189 - DNA, 25 bp, Mus musculus
ggagacaggtttaggaatcactggg

SEQ ID NO: 322190 - DNA, 25 bp, Mus musculus
ggagacagtctgaggaagcctaacc

SEQ ID NO: 322191 - DNA, 25 bp, Mus musculus
ggagacagtctgaggtgtcttcaga

SEQ ID NO: 322192 - DNA, 25 bp, Mus musculus
ggagacatcaagagttctaacgtgc

SEQ ID NO: 322193 - DNA, 25 bp, Mus musculus
ggagacatgagcagctactccatcc

SEQ ID NO: 322194 - DNA, 25 bp, Mus musculus
ggagacatgaggaactcagccacct

SEQ ID NO: 322195 - DNA, 25 bp, Mus musculus
ggagacatgaggatgcagagagaaa

SEQ ID NO: 322196 - DNA, 25 bp, Mus musculus
ggagacatgagggctcatccgctct

SEQ ID NO: 322197 - DNA, 25 bp, Mus musculus
ggagacatgagtctaaggttgtggg

SEQ ID NO: 322198 - DNA, 25 bp, Mus musculus
ggagacattctgaagatactaagca

SEQ ID NO: 322199 - DNA, 25 bp, Mus musculus
ggagacattctgaagatgtgggcac

SEQ ID NO: 322200 - DNA, 25 bp, Mus musculus
ggagacattctgaaggatttgacgt

SEQ ID NO: 322201 - DNA, 25 bp, Mus musculus
ggagaccaaactggatcccactgac

SEQ ID NO: 322202 - DNA, 25 bp, Mus musculus
ggagaccaacagacctgatagcaag

SEQ ID NO: 322203 - DNA, 25 bp, Mus musculus
ggagaccaacagcaagaactggcag

SEQ ID NO: 322204 - DNA, 25 bp, Mus musculus
ggagaccaaggtgacaggacccttt

SEQ ID NO: 322205 - DNA, 25 bp, Mus musculus
ggagaccacaagccggtgttcctgg

SEQ ID NO: 322206 - DNA, 25 bp, Mus musculus
ggagaccacttgccatgcataatct

SEQ ID NO: 322207 - DNA, 25 bp, Mus musculus
ggagaccagactgaggctgtgtttc

SEQ ID NO: 322208 - DNA, 25 bp, Mus musculus
ggagaccagcagcccagagtatgtt

SEQ ID NO: 322209 - DNA, 25 bp, Mus musculus
ggagaccaggtaagacccctgggcc

SEQ ID NO: 322210 - DNA, 25 bp, Mus musculus
ggagaccataggacaaggatgagag

SEQ ID NO: 322211 - DNA, 25 bp, Mus musculus
ggagaccatctctagatctccattc

SEQ ID NO: 322212 - DNA, 25 bp, Mus musculus
ggagacccaagacgatactgtatcc

SEQ ID NO: 322213 - DNA, 25 bp, Mus musculus
ggagacccaagctgtcctggaactc

SEQ ID NO: 322214 - DNA, 25 bp, Mus musculus
ggagacccacagtatcagaaattat

SEQ ID NO: 322215 - DNA, 25 bp, Mus musculus
ggagacccaggagggtgtctccaaa

SEQ ID NO: 322216 - DNA, 25 bp, Mus musculus
ggagacccaggctaggttatcaatg

SEQ ID NO: 322217 - DNA, 25 bp, Mus musculus
ggagacccaggtgataactccctag

SEQ ID NO: 322218 - DNA, 25 bp, Mus musculus
ggagacccattgtgccccaattcct

SEQ ID NO: 322219 - DNA, 25 bp, Mus musculus
ggagaccccagcaccacatctgcca

SEQ ID NO: 322220 - DNA, 25 bp, Mus musculus
ggagacccgggaccgggagctgctg

SEQ ID NO: 322221 - DNA, 25 bp, Mus musculus
ggagaccctctgtgggtgaacgtgg

SEQ ID NO: 322222 - DNA, 25 bp, Mus musculus
ggagaccctgagggagcgcttcagc

SEQ ID NO: 322223 - DNA, 25 bp, Mus musculus
ggagaccgaggaggcccagccagca

SEQ ID NO: 322224 - DNA, 25 bp, Mus musculus
ggagaccgcaggacgcggaaccatg

SEQ ID NO: 322225 - DNA, 25 bp, Mus musculus
ggagaccgcctgcaggtgatttccg

SEQ ID NO: 322226 - DNA, 25 bp, Mus musculus
ggagaccggggaaaatgcactgatg

SEQ ID NO: 322227 - DNA, 25 bp, Mus musculus
ggagaccgtcctcagctggcagctg

SEQ ID NO: 322228 - DNA, 25 bp, Mus musculus
ggagaccgtgcgcgctccccaggct

SEQ ID NO: 322229 - DNA, 25 bp, Mus musculus
ggagacctggaggatccccaggacg

SEQ ID NO: 322230 - DNA, 25 bp, Mus musculus
ggagacctggccaaccgctgcaaga

SEQ ID NO: 322231 - DNA, 25 bp, Mus musculus
ggagacctggtgggtgtgaacaaag

SEQ ID NO: 322232 - DNA, 25 bp, Mus musculus
ggagaccttataggagtaaagatgg

SEQ ID NO: 322233 - DNA, 25 bp, Mus musculus
ggagaccttgagacagatgggagct

SEQ ID NO: 322234 - DNA, 25 bp, Mus musculus
ggagacgaaacagcttggattctga

SEQ ID NO: 322235 - DNA, 25 bp, Mus musculus
ggagacgaaggcctggagcccagcc

SEQ ID NO: 322236 - DNA, 25 bp, Mus musculus
ggagacgaagggcagaggtgaccag

SEQ ID NO: 322237 - DNA, 25 bp, Mus musculus
ggagacgacagccaggtccccctgg

SEQ ID NO: 322238 - DNA, 25 bp, Mus musculus
ggagacgacgaagcaaacctttgac

SEQ ID NO: 322239 - DNA, 25 bp, Mus musculus
ggagacgacgaagcactggggaaga

SEQ ID NO: 322240 - DNA, 25 bp, Mus musculus
ggagacgacgaagtcgttctccccg

SEQ ID NO: 322241 - DNA, 25 bp, Mus musculus
ggagacgagggctcttgtgttaagg

SEQ ID NO: 322242 - DNA, 25 bp, Mus musculus
ggagacgcacaggcatatctgctgt

SEQ ID NO: 322243 - DNA, 25 bp, Mus musculus
ggagacgcctgctcggtcagtcagc

SEQ ID NO: 322244 - DNA, 25 bp, Mus musculus
ggagacgcctgctcgtgtgtataag

SEQ ID NO: 322245 - DNA, 25 bp, Mus musculus
ggagacgcggctcctgtgcggcaca

SEQ ID NO: 322246 - DNA, 25 bp, Mus musculus
ggagacgctcaaatcatgcactctc

SEQ ID NO: 322247 - DNA, 25 bp, Mus musculus
ggagacgctcaacttgtcccaaaac

SEQ ID NO: 322248 - DNA, 25 bp, Mus musculus
ggagacggaaaagtgtcattggtct

SEQ ID NO: 322249 - DNA, 25 bp, Mus musculus
ggagacggattcctcctcaagtact

SEQ ID NO: 322250 - DNA, 25 bp, Mus musculus
ggagacggattcctggtgggtattg

SEQ ID NO: 322251 - DNA, 25 bp, Mus musculus
ggagacggccctcgatggggcatcc

SEQ ID NO: 322252 - DNA, 25 bp, Mus musculus
ggagacggtggtgaccatgaaagat

SEQ ID NO: 322253 - DNA, 25 bp, Mus musculus
ggagacgtaagatcaacgagagatg

SEQ ID NO: 322254 - DNA, 25 bp, Mus musculus
ggagacgttgctgaggtattatgat

SEQ ID NO: 322255 - DNA, 25 bp, Mus musculus
ggagactaagccttctgatgatgag

SEQ ID NO: 322256 - DNA, 25 bp, Mus musculus
ggagactcaaactgaagtgagtagt

SEQ ID NO: 322257 - DNA, 25 bp, Mus musculus
ggagactcaagggatcctctgaagc

SEQ ID NO: 322258 - DNA, 25 bp, Mus musculus
ggagactcagcaggtgatgaggaat

SEQ ID NO: 322259 - DNA, 25 bp, Mus musculus
ggagactccaagggctactacatgg

SEQ ID NO: 322260 - DNA, 25 bp, Mus musculus
ggagactccagatgaggacgatgtg

SEQ ID NO: 322261 - DNA, 25 bp, Mus musculus
ggagactccaggccacaatggagaa

SEQ ID NO: 322262 - DNA, 25 bp, Mus musculus
ggagactccctggaggtttgcctca

SEQ ID NO: 322263 - DNA, 25 bp, Mus musculus
ggagactcgggggaactgatcacag

SEQ ID NO: 322264 - DNA, 25 bp, Mus musculus
ggagactctgtacggcttgtgaaat

SEQ ID NO: 322265 - DNA, 25 bp, Mus musculus
ggagactcttacggaattaattcga

SEQ ID NO: 322266 - DNA, 25 bp, Mus musculus
ggagactcttacggtcttaccacaa

SEQ ID NO: 322267 - DNA, 25 bp, Mus musculus
ggagactgaaggccttcggatgccc

SEQ ID NO: 322268 - DNA, 25 bp, Mus musculus
ggagactgaaggtgctggggggacc

SEQ ID NO: 322269 - DNA, 25 bp, Mus musculus
ggagactgaggaccacatgggtggc

SEQ ID NO: 322270 - DNA, 25 bp, Mus musculus
ggagactgaggatgaggctgtagag

SEQ ID NO: 322271 - DNA, 25 bp, Mus musculus
ggagactgaggtgctgggtgtgtgg

SEQ ID NO: 322272 - DNA, 25 bp, Mus musculus
ggagactgcattcacatagatgaat

SEQ ID NO: 322273 - DNA, 25 bp, Mus musculus
ggagactgcattgacatagatgaat

SEQ ID NO: 322274 - DNA, 25 bp, Mus musculus
ggagactggacagaacgattccggg

SEQ ID NO: 322275 - DNA, 25 bp, Mus musculus
ggagactggctaagaactgccagtg

SEQ ID NO: 322276 - DNA, 25 bp, Mus musculus
ggagactggctgtgcttgccatcaa

SEQ ID NO: 322277 - DNA, 25 bp, Mus musculus
ggagactggcttttcccacagtcag

SEQ ID NO: 322278 - DNA, 25 bp, Mus musculus
ggagactgtagcaaggtgtctgatg

SEQ ID NO: 322279 - DNA, 25 bp, Mus musculus
ggagactgtagcaattccttcttgg

SEQ ID NO: 322280 - DNA, 25 bp, Mus musculus
ggagacttcagaatcaagatgtgta

SEQ ID NO: 322281 - DNA, 25 bp, Mus musculus
ggagacttcaggctccaggatgact

SEQ ID NO: 322282 - DNA, 25 bp, Mus musculus
ggagacttggagacccagacccagc

SEQ ID NO: 322283 - DNA, 25 bp, Mus musculus
ggagacttggagctgaccacagtgg

SEQ ID NO: 322284 - DNA, 25 bp, Mus musculus
ggagacttggctcctactttctgca

SEQ ID NO: 322285 - DNA, 25 bp, Mus musculus
ggagacttggctcctgcctgaggag

SEQ ID NO: 322286 - DNA, 25 bp, Mus musculus
ggagacttttaggccatctcttggc

SEQ ID NO: 322287 - DNA, 25 bp, Mus musculus
ggagacttttagggccaaagatctc

SEQ ID NO: 322288 - DNA, 25 bp, Mus musculus
ggagagaaaagaaaaaacaagaagg

SEQ ID NO: 322289 - DNA, 25 bp, Mus musculus
ggagagaaaagattaatacacaaaa

SEQ ID NO: 322290 - DNA, 25 bp, Mus musculus
ggagagaaaagccttaccaatagtt

SEQ ID NO: 322291 - DNA, 25 bp, Mus musculus
ggagagaaaagggagctgtgattgg

SEQ ID NO: 322292 - DNA, 25 bp, Mus musculus
ggagagaaagacggtcgctgagtgt

SEQ ID NO: 322293 - DNA, 25 bp, Mus musculus
ggagagaaagtttgctcttcaaaaa

SEQ ID NO: 322294 - DNA, 25 bp, Mus musculus
ggagagaactcagaacatacaacat

SEQ ID NO: 322295 - DNA, 25 bp, Mus musculus
ggagagaactcagcagagcacccga

SEQ ID NO: 322296 - DNA, 25 bp, Mus musculus
ggagagaactcagctcatggcagct

SEQ ID NO: 322297 - DNA, 25 bp, Mus musculus
ggagagaactcaggccaggaacaag

SEQ ID NO: 322298 - DNA, 25 bp, Mus musculus
ggagagaacttggagatctcattcc

SEQ ID NO: 322299 - DNA, 25 bp, Mus musculus
ggagagaagatatgtagtcagaaga

SEQ ID NO: 322300 - DNA, 25 bp, Mus musculus
ggagagaagcaggaggatcatgcgg

SEQ ID NO: 322301 - DNA, 25 bp, Mus musculus
ggagagaaggattggaagaaagaag

SEQ ID NO: 322302 - DNA, 25 bp, Mus musculus
ggagagaagggaggtgtgaactgaa

SEQ ID NO: 322303 - DNA, 25 bp, Mus musculus
ggagagaaggtgtcttaccactgag

SEQ ID NO: 322304 - DNA, 25 bp, Mus musculus
ggagagaatatcagctgcaagaaaa

SEQ ID NO: 322305 - DNA, 25 bp, Mus musculus
ggagagaatcctgcgttttctggaa

SEQ ID NO: 322306 - DNA, 25 bp, Mus musculus
ggagagaatgcacaggtcctgtggc

SEQ ID NO: 322307 - DNA, 25 bp, Mus musculus
ggagagaatgggttcaatgtatcta

SEQ ID NO: 322308 - DNA, 25 bp, Mus musculus
ggagagacaaggcaagaaatacagc

SEQ ID NO: 322309 - DNA, 25 bp, Mus musculus
ggagagacaaggggatgacaatttt

SEQ ID NO: 322310 - DNA, 25 bp, Mus musculus
ggagagacagaacaaggatttgaag

SEQ ID NO: 322311 - DNA, 25 bp, Mus musculus
ggagagacagcagtcttcccagatt

SEQ ID NO: 322312 - DNA, 25 bp, Mus musculus
ggagagacagctttttcctgcaata

SEQ ID NO: 322313 - DNA, 25 bp, Mus musculus
ggagagacattgaaggagttaaaga

SEQ ID NO: 322314 - DNA, 25 bp, Mus musculus
ggagagaccagaagattcgtaagac

SEQ ID NO: 322315 - DNA, 25 bp, Mus musculus
ggagagaccaggtaggcgacgctgt

SEQ ID NO: 322316 - DNA, 25 bp, Mus musculus
ggagagacgcaggtcatacctcact

SEQ ID NO: 322317 - DNA, 25 bp, Mus musculus
ggagagactcaagggactttcggtg

SEQ ID NO: 322318 - DNA, 25 bp, Mus musculus
ggagagactgatgagacatcgttcg

SEQ ID NO: 322319 - DNA, 25 bp, Mus musculus
ggagagactgctgactcgataccag

SEQ ID NO: 322320 - DNA, 25 bp, Mus musculus
ggagagactgggatgagcacagctc

SEQ ID NO: 322321 - DNA, 25 bp, Mus musculus
ggagagagaaggaaccaacacaaga

SEQ ID NO: 322322 - DNA, 25 bp, Mus musculus
ggagagagagagaagagagagagag

SEQ ID NO: 322323 - DNA, 25 bp, Mus musculus
ggagagagccaagagcgccttgctg

SEQ ID NO: 322324 - DNA, 25 bp, Mus musculus
ggagagagccatcattgacatgtac

SEQ ID NO: 322325 - DNA, 25 bp, Mus musculus
ggagagaggaaaaggcatttatatg

SEQ ID NO: 322326 - DNA, 25 bp, Mus musculus
ggagagaggaaaagggctcggatgg

SEQ ID NO: 322327 - DNA, 25 bp, Mus musculus
ggagagaggaagaactacagagaac

SEQ ID NO: 322328 - DNA, 25 bp, Mus musculus
ggagagaggagaaagaacgtttgct

SEQ ID NO: 322329 - DNA, 25 bp, Mus musculus
ggagagaggaggacagttactacca

SEQ ID NO: 322330 - DNA, 25 bp, Mus musculus
ggagagaggagggagatggtgtttc

SEQ ID NO: 322331 - DNA, 25 bp, Mus musculus
ggagagaggcagatgtgagcccacc

SEQ ID NO: 322332 - DNA, 25 bp, Mus musculus
ggagagagtcctcagaatggcaatg

SEQ ID NO: 322333 - DNA, 25 bp, Mus musculus
ggagagagtcctcaggcacctccaa

SEQ ID NO: 322334 - DNA, 25 bp, Mus musculus
ggagagagtgctgttctctgcagct

SEQ ID NO: 322335 - DNA, 25 bp, Mus musculus
ggagagataaattgattgagtctgt

SEQ ID NO: 322336 - DNA, 25 bp, Mus musculus
ggagagatacagaatgaatgaagaa

SEQ ID NO: 322337 - DNA, 25 bp, Mus musculus
ggagagatacagagcactggtgaag

SEQ ID NO: 322338 - DNA, 25 bp, Mus musculus
ggagagatagatctagctagtgaag

SEQ ID NO: 322339 - DNA, 25 bp, Mus musculus
ggagagatcagtgttgaagatgaag

SEQ ID NO: 322340 - DNA, 25 bp, Mus musculus
ggagagatcttgtggcgccatgttg

SEQ ID NO: 322341 - DNA, 25 bp, Mus musculus
ggagagatgaaggatgatgaggaat

SEQ ID NO: 322342 - DNA, 25 bp, Mus musculus
ggagagatgagcaagttctatagtc

SEQ ID NO: 322343 - DNA, 25 bp, Mus musculus
ggagagattgatgctgcacctcctg

SEQ ID NO: 322344 - DNA, 25 bp, Mus musculus
ggagagattttatacaagctgtact

SEQ ID NO: 322345 - DNA, 25 bp, Mus musculus
ggagagattttatgagaggctgtaa

SEQ ID NO: 322346 - DNA, 25 bp, Mus musculus
ggagagcaaaaagaatcgggttgag

SEQ ID NO: 322347 - DNA, 25 bp, Mus musculus
ggagagcaaaaagtttcgtgaacag

SEQ ID NO: 322348 - DNA, 25 bp, Mus musculus
ggagagcaaagaaccccagctgaaa

SEQ ID NO: 322349 - DNA, 25 bp, Mus musculus
ggagagcaagactggtagtggctgt

SEQ ID NO: 322350 - DNA, 25 bp, Mus musculus
ggagagcaagaggatattatcagga

SEQ ID NO: 322351 - DNA, 25 bp, Mus musculus
ggagagcaagagggtttgttcctta

SEQ ID NO: 322352 - DNA, 25 bp, Mus musculus
ggagagcaagctgatcatcctggcc

SEQ ID NO: 322353 - DNA, 25 bp, Mus musculus
ggagagcaaggataagcgccgggac

SEQ ID NO: 322354 - DNA, 25 bp, Mus musculus
ggagagcaaggctctgtacaactca

SEQ ID NO: 322355 - DNA, 25 bp, Mus musculus
ggagagcaatatggtacctcacact

SEQ ID NO: 322356 - DNA, 25 bp, Mus musculus
ggagagcaatgtcacacttggtccc

SEQ ID NO: 322357 - DNA, 25 bp, Mus musculus
ggagagcacagcgttgaatctgcgt

SEQ ID NO: 322358 - DNA, 25 bp, Mus musculus
ggagagcacaggattcagtaaccta

SEQ ID NO: 322359 - DNA, 25 bp, Mus musculus
ggagagcagaggtgtggagaagaca

SEQ ID NO: 322360 - DNA, 25 bp, Mus musculus
ggagagcagctgctgaaagacctaa

SEQ ID NO: 322361 - DNA, 25 bp, Mus musculus
ggagagcagtctgaggcctctgggg

SEQ ID NO: 322362 - DNA, 25 bp, Mus musculus
ggagagcatcagacctttgaagacc

SEQ ID NO: 322363 - DNA, 25 bp, Mus musculus
ggagagcatgcagcaatgttgcttt

SEQ ID NO: 322364 - DNA, 25 bp, Mus musculus
ggagagcatgcagcacccaatgatg

SEQ ID NO: 322365 - DNA, 25 bp, Mus musculus
ggagagcatggatacgtattatcag

SEQ ID NO: 322366 - DNA, 25 bp, Mus musculus
ggagagccaacagatgaagaaacaa

SEQ ID NO: 322367 - DNA, 25 bp, Mus musculus
ggagagccagaagtacctgcactgc

SEQ ID NO: 322368 - DNA, 25 bp, Mus musculus
ggagagccagcctggcgacccagtg

SEQ ID NO: 322369 - DNA, 25 bp, Mus musculus
ggagagccaggcttagaatcagact

SEQ ID NO: 322370 - DNA, 25 bp, Mus musculus
ggagagccggcagccatcatgttaa

SEQ ID NO: 322371 - DNA, 25 bp, Mus musculus
ggagagccggcaggatttctccata

SEQ ID NO: 322372 - DNA, 25 bp, Mus musculus
ggagagcctgaaggctagatatgga

SEQ ID NO: 322373 - DNA, 25 bp, Mus musculus
ggagagcctgggcccccagattgcg

SEQ ID NO: 322374 - DNA, 25 bp, Mus musculus
ggagagcctgtgtgctgatatttta

SEQ ID NO: 322375 - DNA, 25 bp, Mus musculus
ggagagccttttccagggctccgga

SEQ ID NO: 322376 - DNA, 25 bp, Mus musculus
ggagagcgacctgtggaggcttggc

SEQ ID NO: 322377 - DNA, 25 bp, Mus musculus
ggagagcgagatttcaacaagaaaa

SEQ ID NO: 322378 - DNA, 25 bp, Mus musculus
ggagagcgagctgcagcgactccgc

SEQ ID NO: 322379 - DNA, 25 bp, Mus musculus
ggagagcgagtctgcggtgtgggag

SEQ ID NO: 322380 - DNA, 25 bp, Mus musculus
ggagagcgcatcagctgcagttaaa

SEQ ID NO: 322381 - DNA, 25 bp, Mus musculus
ggagagcggcgcgggtccaacccag

SEQ ID NO: 322382 - DNA, 25 bp, Mus musculus
ggagagcggcgcggtccccagagcc

SEQ ID NO: 322383 - DNA, 25 bp, Mus musculus
ggagagcggcggaccgcagcagaag

SEQ ID NO: 322384 - DNA, 25 bp, Mus musculus
ggagagcggtgagcgacatgtcctt

SEQ ID NO: 322385 - DNA, 25 bp, Mus musculus
ggagagctaaggatcaagcacttcc

SEQ ID NO: 322386 - DNA, 25 bp, Mus musculus
ggagagctaccggagccgcatcaat

SEQ ID NO: 322387 - DNA, 25 bp, Mus musculus
ggagagctaccggaggtatggggca

SEQ ID NO: 322388 - DNA, 25 bp, Mus musculus
ggagagctaggtcacttgtccagaa

SEQ ID NO: 322389 - DNA, 25 bp, Mus musculus
ggagagctagttgctgcttcaagcg

SEQ ID NO: 322390 - DNA, 25 bp, Mus musculus
ggagagctgaggcacctccaagtgg

SEQ ID NO: 322391 - DNA, 25 bp, Mus musculus
ggagagctgcctcagagtggggagt

SEQ ID NO: 322392 - DNA, 25 bp, Mus musculus
ggagagctgcctcaggctacaagga

SEQ ID NO: 322393 - DNA, 25 bp, Mus musculus
ggagagcttacggtcattcctgatc

SEQ ID NO: 322394 - DNA, 25 bp, Mus musculus
ggagaggaaaaacagagagagagaa

SEQ ID NO: 322395 - DNA, 25 bp, Mus musculus
ggagaggaaaaagagagaaaaggaa

SEQ ID NO: 322396 - DNA, 25 bp, Mus musculus
ggagaggaaaataaggtacttcaat

SEQ ID NO: 322397 - DNA, 25 bp, Mus musculus
ggagaggaaacgatcctggggcaga

SEQ ID NO: 322398 - DNA, 25 bp, Mus musculus
ggagaggaagaagagtcaagcgaag

SEQ ID NO: 322399 - DNA, 25 bp, Mus musculus
ggagaggaagaagcgacttgaagag

SEQ ID NO: 322400 - DNA, 25 bp, Mus musculus
ggagaggaagagatcaagcacttcc

SEQ ID NO: 322401 - DNA, 25 bp, Mus musculus
ggagaggaagatgacagcctgtttg

SEQ ID NO: 322402 - DNA, 25 bp, Mus musculus
ggagaggaaggcacagagaactgaa

SEQ ID NO: 322403 - DNA, 25 bp, Mus musculus
ggagaggaaggcgcgggctgggagc

SEQ ID NO: 322404 - DNA, 25 bp, Mus musculus
ggagaggacagaagagtgtgtttga

SEQ ID NO: 322405 - DNA, 25 bp, Mus musculus
ggagaggacgcagagcttgttgatg

SEQ ID NO: 322406 - DNA, 25 bp, Mus musculus
ggagaggacgcgtgagcatgccaac

SEQ ID NO: 322407 - DNA, 25 bp, Mus musculus
ggagaggagggtctggtcagctacc

SEQ ID NO: 322408 - DNA, 25 bp, Mus musculus
ggagaggatcgcccccaccccgcat

SEQ ID NO: 322409 - DNA, 25 bp, Mus musculus
ggagaggatgaggaagccatggcag

SEQ ID NO: 322410 - DNA, 25 bp, Mus musculus
ggagaggcaaacagtggctctgaag

SEQ ID NO: 322411 - DNA, 25 bp, Mus musculus
ggagaggcagactggtgccctggga

SEQ ID NO: 322412 - DNA, 25 bp, Mus musculus
ggagaggcagagatggacttcctga

SEQ ID NO: 322413 - DNA, 25 bp, Mus musculus
ggagaggcaggtctctggagctggg

SEQ ID NO: 322414 - DNA, 25 bp, Mus musculus
ggagaggcgcaggcggaggtcagac

SEQ ID NO: 322415 - DNA, 25 bp, Mus musculus
ggagagggaaaggtctgaaaaggag

SEQ ID NO: 322416 - DNA, 25 bp, Mus musculus
ggagagggaagtccagcggtggtgc

SEQ ID NO: 322417 - DNA, 25 bp, Mus musculus
ggagagggaggggctctgcctcctt

SEQ ID NO: 322418 - DNA, 25 bp, Mus musculus
ggagagggcagcggccgtctgggct

SEQ ID NO: 322419 - DNA, 25 bp, Mus musculus
ggagagggcagcggttccttcctcc

SEQ ID NO: 322420 - DNA, 25 bp, Mus musculus
ggagagggcggaaggccaccaggcc

SEQ ID NO: 322421 - DNA, 25 bp, Mus musculus
ggagagggggaccaagtcattgaga

SEQ ID NO: 322422 - DNA, 25 bp, Mus musculus
ggagagggggaggcatttgcaggcc

SEQ ID NO: 322423 - DNA, 25 bp, Mus musculus
ggagaggtaatgcctgtggtcgtcg

SEQ ID NO: 322424 - DNA, 25 bp, Mus musculus
ggagaggtcaatgaggaagtaagtg

SEQ ID NO: 322425 - DNA, 25 bp, Mus musculus
ggagaggtcaatgaggtggacatgg

SEQ ID NO: 322426 - DNA, 25 bp, Mus musculus
ggagaggtcagaggatgcaaagaag

SEQ ID NO: 322427 - DNA, 25 bp, Mus musculus
ggagaggtcagaggctgtcaaaata

SEQ ID NO: 322428 - DNA, 25 bp, Mus musculus
ggagaggtcggcagacggcgatgac

SEQ ID NO: 322429 - DNA, 25 bp, Mus musculus
ggagaggtgacacgtttcatcactt

SEQ ID NO: 322430 - DNA, 25 bp, Mus musculus
ggagaggttccagatggagctgaaa

SEQ ID NO: 322431 - DNA, 25 bp, Mus musculus
ggagaggttccagttaccagtaaga

SEQ ID NO: 322432 - DNA, 25 bp, Mus musculus
ggagaggtttggagaagcctgaaag

SEQ ID NO: 322433 - DNA, 25 bp, Mus musculus
ggagaggtttgggaaaagcttgttg

SEQ ID NO: 322434 - DNA, 25 bp, Mus musculus
ggagagtaaaaaagaatgcactgct

SEQ ID NO: 322435 - DNA, 25 bp, Mus musculus
ggagagtaactagctttgcatcatg

SEQ ID NO: 322436 - DNA, 25 bp, Mus musculus
ggagagtcacagctaaagaacgctt

SEQ ID NO: 322437 - DNA, 25 bp, Mus musculus
ggagagtcgggtgttaggagcaacg

SEQ ID NO: 322438 - DNA, 25 bp, Mus musculus
ggagagtgagccaaggagatggaga

SEQ ID NO: 322439 - DNA, 25 bp, Mus musculus
ggagagtgaggaagaagacgatgat

SEQ ID NO: 322440 - DNA, 25 bp, Mus musculus
ggagagtgaggctcaggccagcaca

SEQ ID NO: 322441 - DNA, 25 bp, Mus musculus
ggagagtgaggtgctggtaactcaa

SEQ ID NO: 322442 - DNA, 25 bp, Mus musculus
ggagagtggaacagatcgctgtagt

SEQ ID NO: 322443 - DNA, 25 bp, Mus musculus
ggagagtggaaggggttccatgatg

SEQ ID NO: 322444 - DNA, 25 bp, Mus musculus
ggagagttcatcacgactgtgcaac

SEQ ID NO: 322445 - DNA, 25 bp, Mus musculus
ggagagttcgaattgctctggcgtt

SEQ ID NO: 322446 - DNA, 25 bp, Mus musculus
ggagagttcgaattgttcactgagg

SEQ ID NO: 322447 - DNA, 25 bp, Mus musculus
ggagagttttgtgagcaccttcagc

SEQ ID NO: 322448 - DNA, 25 bp, Mus musculus
ggagataaaaggacggactgtggct

SEQ ID NO: 322449 - DNA, 25 bp, Mus musculus
ggagataaacgaaattaggtccaga

SEQ ID NO: 322450 - DNA, 25 bp, Mus musculus
ggagataaacgagtgtgcaactgcg

SEQ ID NO: 322451 - DNA, 25 bp, Mus musculus
ggagataaagggcagtcattcaatg

SEQ ID NO: 322452 - DNA, 25 bp, Mus musculus
ggagataaaggggagatccctgacg

SEQ ID NO: 322453 - DNA, 25 bp, Mus musculus
ggagatacagggcatggatgggcag

SEQ ID NO: 322454 - DNA, 25 bp, Mus musculus
ggagataccaaaaatagcgaccagt

SEQ ID NO: 322455 - DNA, 25 bp, Mus musculus
ggagataccaggcacaatcacttcc

SEQ ID NO: 322456 - DNA, 25 bp, Mus musculus
ggagatacccagagccctgcaactc

SEQ ID NO: 322457 - DNA, 25 bp, Mus musculus
ggagatacgggcgcgagggcgccga

SEQ ID NO: 322458 - DNA, 25 bp, Mus musculus
ggagatacttgatccttcttaccag

SEQ ID NO: 322459 - DNA, 25 bp, Mus musculus
ggagatagccaatgagatagatgga

SEQ ID NO: 322460 - DNA, 25 bp, Mus musculus
ggagatagtcgggcaatcctgtgtc

SEQ ID NO: 322461 - DNA, 25 bp, Mus musculus
ggagatataccaggtgaacctgagt

SEQ ID NO: 322462 - DNA, 25 bp, Mus musculus
ggagatataccagtccggttctcca

SEQ ID NO: 322463 - DNA, 25 bp, Mus musculus
ggagatatcagagatatcataggac

SEQ ID NO: 322464 - DNA, 25 bp, Mus musculus
ggagatatcagagatggacctgcag

SEQ ID NO: 322465 - DNA, 25 bp, Mus musculus
ggagatatgagacgaaagtaggtgg

SEQ ID NO: 322466 - DNA, 25 bp, Mus musculus
ggagatatgaggtactccatccgcc

SEQ ID NO: 322467 - DNA, 25 bp, Mus musculus
ggagatatgcgcaacaaaagcggta

SEQ ID NO: 322468 - DNA, 25 bp, Mus musculus
ggagatattggcaaaatatccagag

SEQ ID NO: 322469 - DNA, 25 bp, Mus musculus
ggagatattggtccttcattccaga

SEQ ID NO: 322470 - DNA, 25 bp, Mus musculus
ggagatcaaaatggctcgcgctgta

SEQ ID NO: 322471 - DNA, 25 bp, Mus musculus
ggagatcaagaggatagataggttc

SEQ ID NO: 322472 - DNA, 25 bp, Mus musculus
ggagatcaaggacttgcaccagagg

SEQ ID NO: 322473 - DNA, 25 bp, Mus musculus
ggagatcaatcgggagttcctctgt

SEQ ID NO: 322474 - DNA, 25 bp, Mus musculus
ggagatcacctcagtggctctggag

SEQ ID NO: 322475 - DNA, 25 bp, Mus musculus
ggagatcagcagagaactactttct

SEQ ID NO: 322476 - DNA, 25 bp, Mus musculus
ggagatcaggaggcgccagctgaca

SEQ ID NO: 322477 - DNA, 25 bp, Mus musculus
ggagatcaggtaatcacaggtcctt

SEQ ID NO: 322478 - DNA, 25 bp, Mus musculus
ggagatcaggttcaatgctcccttc

SEQ ID NO: 322479 - DNA, 25 bp, Mus musculus
ggagatcattgcagatgttcgagct

SEQ ID NO: 322480 - DNA, 25 bp, Mus musculus
ggagatccagccttggatccaatta

SEQ ID NO: 322481 - DNA, 25 bp, Mus musculus
ggagatccagctgatggtagaagag

SEQ ID NO: 322482 - DNA, 25 bp, Mus musculus
ggagatccaggagtggtacgaggag

SEQ ID NO: 322483 - DNA, 25 bp, Mus musculus
ggagatccaggcttccgtggggccc

SEQ ID NO: 322484 - DNA, 25 bp, Mus musculus
ggagatccagtgtcctgagcaagtg

SEQ ID NO: 322485 - DNA, 25 bp, Mus musculus
ggagatccccaaggcgagttctggc

SEQ ID NO: 322486 - DNA, 25 bp, Mus musculus
ggagatccccagagacagaacttct

SEQ ID NO: 322487 - DNA, 25 bp, Mus musculus
ggagatcccccaagagcaagagaag

SEQ ID NO: 322488 - DNA, 25 bp, Mus musculus
ggagatcccccaaggaagctctttg

SEQ ID NO: 322489 - DNA, 25 bp, Mus musculus
ggagatccgagagactacaggagcc

SEQ ID NO: 322490 - DNA, 25 bp, Mus musculus
ggagatccgggacagaggaccagga

SEQ ID NO: 322491 - DNA, 25 bp, Mus musculus
ggagatccgggacagcaagaagttc

SEQ ID NO: 322492 - DNA, 25 bp, Mus musculus
ggagatcctccgacagttcaaccag

SEQ ID NO: 322493 - DNA, 25 bp, Mus musculus
ggagatcctccgacagttcagtcaa

SEQ ID NO: 322494 - DNA, 25 bp, Mus musculus
ggagatcctcctagcccacagacgc

SEQ ID NO: 322495 - DNA, 25 bp, Mus musculus
ggagatcgagcaggtgaatgagcga

SEQ ID NO: 322496 - DNA, 25 bp, Mus musculus
ggagatcgagcaggttcctcatgag

SEQ ID NO: 322497 - DNA, 25 bp, Mus musculus
ggagatcgagggcctgatctcagcc

SEQ ID NO: 322498 - DNA, 25 bp, Mus musculus
ggagatcgatgagctatgtgccacc

SEQ ID NO: 322499 - DNA, 25 bp, Mus musculus
ggagatcgatgaggaagggaacctg

SEQ ID NO: 322500 - DNA, 25 bp, Mus musculus
ggagatcgcaggggtgccttctgta

SEQ ID NO: 322501 - DNA, 25 bp, Mus musculus
ggagatcgccaagcggacccagcca

SEQ ID NO: 322502 - DNA, 25 bp, Mus musculus
ggagatctaccagcaaaatcttgct

SEQ ID NO: 322503 - DNA, 25 bp, Mus musculus
ggagatctaccagggatgagtttgt

SEQ ID NO: 322504 - DNA, 25 bp, Mus musculus
ggagatctcaaagggggaaaaacca

SEQ ID NO: 322505 - DNA, 25 bp, Mus musculus
ggagatctccgaagatacttgaacc

SEQ ID NO: 322506 - DNA, 25 bp, Mus musculus
ggagatctgagcacagccagcgtgt

SEQ ID NO: 322507 - DNA, 25 bp, Mus musculus
ggagatctgagccatggatttcccc

SEQ ID NO: 322508 - DNA, 25 bp, Mus musculus
ggagatcttgacatcactgactgac

SEQ ID NO: 322509 - DNA, 25 bp, Mus musculus
ggagatcttggtgatccgcaggggc

SEQ ID NO: 322510 - DNA, 25 bp, Mus musculus
ggagatctttgacaagcactataag

SEQ ID NO: 322511 - DNA, 25 bp, Mus musculus
ggagatgaaactgctgccacaggtg

SEQ ID NO: 322512 - DNA, 25 bp, Mus musculus
ggagatgaaatcaagaatctcgatc

SEQ ID NO: 322513 - DNA, 25 bp, Mus musculus
ggagatgaagaaatccatgcgacag

SEQ ID NO: 322514 - DNA, 25 bp, Mus musculus
ggagatgaagatggagttttccctc

SEQ ID NO: 322515 - DNA, 25 bp, Mus musculus
ggagatgaagattcaatgagaggcc

SEQ ID NO: 322516 - DNA, 25 bp, Mus musculus
ggagatgaagggttggtgaaattct

SEQ ID NO: 322517 - DNA, 25 bp, Mus musculus
ggagatgaagtgacttcaatccccg

SEQ ID NO: 322518 - DNA, 25 bp, Mus musculus
ggagatgaagtgatgactcgttggc

SEQ ID NO: 322519 - DNA, 25 bp, Mus musculus
ggagatgacatgtttcattggcaag

SEQ ID NO: 322520 - DNA, 25 bp, Mus musculus
ggagatgacggcagaggagaggtcc

SEQ ID NO: 322521 - DNA, 25 bp, Mus musculus
ggagatgagaaattatgcttcagct

SEQ ID NO: 322522 - DNA, 25 bp, Mus musculus
ggagatgagattagcattaagaaga

SEQ ID NO: 322523 - DNA, 25 bp, Mus musculus
ggagatgagattgactgggaaacag

SEQ ID NO: 322524 - DNA, 25 bp, Mus musculus
ggagatgagcaggagccggccccgt

SEQ ID NO: 322525 - DNA, 25 bp, Mus musculus
ggagatgagtcaagattactatgac

SEQ ID NO: 322526 - DNA, 25 bp, Mus musculus
ggagatgagtcaagccgagatgact

SEQ ID NO: 322527 - DNA, 25 bp, Mus musculus
ggagatgcaaggagagtctcttccg

SEQ ID NO: 322528 - DNA, 25 bp, Mus musculus
ggagatgcacaaggccacagatgac

SEQ ID NO: 322529 - DNA, 25 bp, Mus musculus
ggagatgcacaagttcatattctct

SEQ ID NO: 322530 - DNA, 25 bp, Mus musculus
ggagatgcagatggtgaaagtgatg

SEQ ID NO: 322531 - DNA, 25 bp, Mus musculus
ggagatgccacagcccgtgttcctc

SEQ ID NO: 322532 - DNA, 25 bp, Mus musculus
ggagatgccacagctcccaacccct

SEQ ID NO: 322533 - DNA, 25 bp, Mus musculus
ggagatgcccaccagagcgagtaca

SEQ ID NO: 322534 - DNA, 25 bp, Mus musculus
ggagatgcccaccagttgacagggc

SEQ ID NO: 322535 - DNA, 25 bp, Mus musculus
ggagatgcccagatcatgagccacg

SEQ ID NO: 322536 - DNA, 25 bp, Mus musculus
ggagatgccccagctgaaaaaaaac

SEQ ID NO: 322537 - DNA, 25 bp, Mus musculus
ggagatgccccagctgagaaaaaac

SEQ ID NO: 322538 - DNA, 25 bp, Mus musculus
ggagatgcctgatcaacatgacaca

SEQ ID NO: 322539 - DNA, 25 bp, Mus musculus
ggagatgcgggtttgcctgcaatga

SEQ ID NO: 322540 - DNA, 25 bp, Mus musculus
ggagatgcggtggacaccaaagtga

SEQ ID NO: 322541 - DNA, 25 bp, Mus musculus
ggagatgcggtggtggtacgcctgg

SEQ ID NO: 322542 - DNA, 25 bp, Mus musculus
ggagatgctcagcaagccccgccca

SEQ ID NO: 322543 - DNA, 25 bp, Mus musculus
ggagatgctgagagctctggtgtac

SEQ ID NO: 322544 - DNA, 25 bp, Mus musculus
ggagatgctgagctgtcgatgccac

SEQ ID NO: 322545 - DNA, 25 bp, Mus musculus
ggagatgcttcagattctgaaggga

SEQ ID NO: 322546 - DNA, 25 bp, Mus musculus
ggagatgcttcaggactctctgatt

SEQ ID NO: 322547 - DNA, 25 bp, Mus musculus
ggagatgcttggtactacatgaggc

SEQ ID NO: 322548 - DNA, 25 bp, Mus musculus
ggagatggacggaatgggcaccaca

SEQ ID NO: 322549 - DNA, 25 bp, Mus musculus
ggagatggagagcagattgaaggtg

SEQ ID NO: 322550 - DNA, 25 bp, Mus musculus
ggagatggaggcaaccaaactgaag

SEQ ID NO: 322551 - DNA, 25 bp, Mus musculus
ggagatggaggctcagctgtctcag

SEQ ID NO: 322552 - DNA, 25 bp, Mus musculus
ggagatggcagttccctccaggctt

SEQ ID NO: 322553 - DNA, 25 bp, Mus musculus
ggagatggcggacagtttcctgtgg

SEQ ID NO: 322554 - DNA, 25 bp, Mus musculus
ggagatgggatgcctggattctgca

SEQ ID NO: 322555 - DNA, 25 bp, Mus musculus
ggagatgggccacgctctgtgcacc

SEQ ID NO: 322556 - DNA, 25 bp, Mus musculus
ggagatgggccacggaactcatctt

SEQ ID NO: 322557 - DNA, 25 bp, Mus musculus
ggagatggtcaagcaagaagcgaaa

SEQ ID NO: 322558 - DNA, 25 bp, Mus musculus
ggagatggtccaatttgtctagtgc

SEQ ID NO: 322559 - DNA, 25 bp, Mus musculus
ggagatgtacggttcctcatttgac

SEQ ID NO: 322560 - DNA, 25 bp, Mus musculus
ggagatgtatcagattcagctacta

SEQ ID NO: 322561 - DNA, 25 bp, Mus musculus
ggagatgtgagggatctaccaaggc

SEQ ID NO: 322562 - DNA, 25 bp, Mus musculus
ggagatgtgcagaggtccctgctgg

SEQ ID NO: 322563 - DNA, 25 bp, Mus musculus
ggagatgtggtgatggtacaccagg

SEQ ID NO: 322564 - DNA, 25 bp, Mus musculus
ggagatgttgctgaggggcggcctg

SEQ ID NO: 322565 - DNA, 25 bp, Mus musculus
ggagattaaagtaattggcaactgg

SEQ ID NO: 322566 - DNA, 25 bp, Mus musculus
ggagattactctaaggccttcctcc

SEQ ID NO: 322567 - DNA, 25 bp, Mus musculus
ggagattagcggagccaggtatgcc

SEQ ID NO: 322568 - DNA, 25 bp, Mus musculus
ggagattcattgaattctgtcttta

SEQ ID NO: 322569 - DNA, 25 bp, Mus musculus
ggagattccagcaattcctggagtg

SEQ ID NO: 322570 - DNA, 25 bp, Mus musculus
ggagattccagcctccaccgtcgtc

SEQ ID NO: 322571 - DNA, 25 bp, Mus musculus
ggagattccaggaagcccctgagga

SEQ ID NO: 322572 - DNA, 25 bp, Mus musculus
ggagattccagtactacagagccag

SEQ ID NO: 322573 - DNA, 25 bp, Mus musculus
ggagattcggcgacctgacaaagcc

SEQ ID NO: 322574 - DNA, 25 bp, Mus musculus
ggagattcggcggtttatcaagagc

SEQ ID NO: 322575 - DNA, 25 bp, Mus musculus
ggagattctgagaccttgctacatc

SEQ ID NO: 322576 - DNA, 25 bp, Mus musculus
ggagattctgaggcgaatggacccg

SEQ ID NO: 322577 - DNA, 25 bp, Mus musculus
ggagattgagaagtggatgactaca

SEQ ID NO: 322578 - DNA, 25 bp, Mus musculus
ggagattgagaagtttctagatcca

SEQ ID NO: 322579 - DNA, 25 bp, Mus musculus
ggagattgcagaggcccagcagctc

SEQ ID NO: 322580 - DNA, 25 bp, Mus musculus
ggagattgcccaggatgccctgaag

SEQ ID NO: 322581 - DNA, 25 bp, Mus musculus
ggagattggaggggactccttttca

SEQ ID NO: 322582 - DNA, 25 bp, Mus musculus
ggagatttagaagatcttttacagg

SEQ ID NO: 322583 - DNA, 25 bp, Mus musculus
ggagatttagaagatgatggtgagg

SEQ ID NO: 322584 - DNA, 25 bp, Mus musculus
ggagatttctgaaggggcttgtcaa

SEQ ID NO: 322585 - DNA, 25 bp, Mus musculus
ggagatttgcagtccaacgtcgtgc

SEQ ID NO: 322586 - DNA, 25 bp, Mus musculus
ggagattttgaaagacaagaagctg

SEQ ID NO: 322587 - DNA, 25 bp, Mus musculus
ggagattttgctctgatggttggca

SEQ ID NO: 322588 - DNA, 25 bp, Mus musculus
ggagcaaaagccagagcccaggctg

SEQ ID NO: 322589 - DNA, 25 bp, Mus musculus
ggagcaaaagccagtgttggaggtg

SEQ ID NO: 322590 - DNA, 25 bp, Mus musculus
ggagcaaacccaaagagatgtggtt

SEQ ID NO: 322591 - DNA, 25 bp, Mus musculus
ggagcaaaccggtggccagaacccc

SEQ ID NO: 322592 - DNA, 25 bp, Mus musculus
ggagcaaacggaagcgagaaaacag

SEQ ID NO: 322593 - DNA, 25 bp, Mus musculus
ggagcaaattaacagagtgtccaag

SEQ ID NO: 322594 - DNA, 25 bp, Mus musculus
ggagcaacaaggggaaagcgagagc

SEQ ID NO: 322595 - DNA, 25 bp, Mus musculus
ggagcaacaagtccgtgcactggag

SEQ ID NO: 322596 - DNA, 25 bp, Mus musculus
ggagcaacacagggactattccaac

SEQ ID NO: 322597 - DNA, 25 bp, Mus musculus
ggagcaacagcggcaacctttggca

SEQ ID NO: 322598 - DNA, 25 bp, Mus musculus
ggagcaacaggaggacttcaaggag

SEQ ID NO: 322599 - DNA, 25 bp, Mus musculus
ggagcaaccagagagcaccgtactg

SEQ ID NO: 322600 - DNA, 25 bp, Mus musculus
ggagcaaccagagcacctgtctcct

SEQ ID NO: 322601 - DNA, 25 bp, Mus musculus
ggagcaacgtcagggctacacatct

SEQ ID NO: 322602 - DNA, 25 bp, Mus musculus
ggagcaacgtcaggtaagaatgaca

SEQ ID NO: 322603 - DNA, 25 bp, Mus musculus
ggagcaagaagcagcaaagctggcc

SEQ ID NO: 322604 - DNA, 25 bp, Mus musculus
ggagcaagcagctcgaggaggacat

SEQ ID NO: 322605 - DNA, 25 bp, Mus musculus
ggagcaagcagctggaagatgagct

SEQ ID NO: 322606 - DNA, 25 bp, Mus musculus
ggagcaagccatcagaaggagtgaa

SEQ ID NO: 322607 - DNA, 25 bp, Mus musculus
ggagcaagccatcaggaaatccctt

SEQ ID NO: 322608 - DNA, 25 bp, Mus musculus
ggagcaagctggaagaagagacttt

SEQ ID NO: 322609 - DNA, 25 bp, Mus musculus
ggagcaagctggaagaagctgggag

SEQ ID NO: 322610 - DNA, 25 bp, Mus musculus
ggagcaagctggaagctgaaattaa

SEQ ID NO: 322611 - DNA, 25 bp, Mus musculus
ggagcaagctggaaggggctgcagt

SEQ ID NO: 322612 - DNA, 25 bp, Mus musculus
ggagcaaggaggctcatctgcggtg

SEQ ID NO: 322613 - DNA, 25 bp, Mus musculus
ggagcaaggcatggaactcagtggc

SEQ ID NO: 322614 - DNA, 25 bp, Mus musculus
ggagcaaggtggccctgacaagtga

SEQ ID NO: 322615 - DNA, 25 bp, Mus musculus
ggagcaattcaaggtattcacactg

SEQ ID NO: 322616 - DNA, 25 bp, Mus musculus
ggagcacagaaaaagagaagctgat

SEQ ID NO: 322617 - DNA, 25 bp, Mus musculus
ggagcacaggaagattcatgagata

SEQ ID NO: 322618 - DNA, 25 bp, Mus musculus
ggagcacagtaaaggtctgtggagg

SEQ ID NO: 322619 - DNA, 25 bp, Mus musculus
ggagcacatcaaggaacttctagcc

SEQ ID NO: 322620 - DNA, 25 bp, Mus musculus
ggagcacatcaagttacaacaggaa

SEQ ID NO: 322621 - DNA, 25 bp, Mus musculus
ggagcacatcgactccagcacccag

SEQ ID NO: 322622 - DNA, 25 bp, Mus musculus
ggagcacccatacaggtagtgctgc

SEQ ID NO: 322623 - DNA, 25 bp, Mus musculus
ggagcaccccagtgcccgaggcgcc

SEQ ID NO: 322624 - DNA, 25 bp, Mus musculus
ggagcacctaagggcagccagtcca

SEQ ID NO: 322625 - DNA, 25 bp, Mus musculus
ggagcacctaagggtgctggagagt

SEQ ID NO: 322626 - DNA, 25 bp, Mus musculus
ggagcacgagggttttttgcattga

SEQ ID NO: 322627 - DNA, 25 bp, Mus musculus
ggagcacgataaggaagagcggatc

SEQ ID NO: 322628 - DNA, 25 bp, Mus musculus
ggagcacgtctttgaccatccatgg

SEQ ID NO: 322629 - DNA, 25 bp, Mus musculus
ggagcacgtctttgacttattggtg

SEQ ID NO: 322630 - DNA, 25 bp, Mus musculus
ggagcactaatcaggaaaatggcag

SEQ ID NO: 322631 - DNA, 25 bp, Mus musculus
ggagcactaccaggaagacatggga

SEQ ID NO: 322632 - DNA, 25 bp, Mus musculus
ggagcactcccactgggtgtggagt

SEQ ID NO: 322633 - DNA, 25 bp, Mus musculus
ggagcactgaagaggaacctgcttt

SEQ ID NO: 322634 - DNA, 25 bp, Mus musculus
ggagcagaagaataaagagatagaa

SEQ ID NO: 322635 - DNA, 25 bp, Mus musculus
ggagcagaagacaaaagaaattgat

SEQ ID NO: 322636 - DNA, 25 bp, Mus musculus
ggagcagaagagtgaccaaatgacc

SEQ ID NO: 322637 - DNA, 25 bp, Mus musculus
ggagcagaagatctatccctatgag

SEQ ID NO: 322638 - DNA, 25 bp, Mus musculus
ggagcagaagcaaaggtctcagcca

SEQ ID NO: 322639 - DNA, 25 bp, Mus musculus
ggagcagaaggataaacaaaggtaa

SEQ ID NO: 322640 - DNA, 25 bp, Mus musculus
ggagcagaaggtatatgtggttgct

SEQ ID NO: 322641 - DNA, 25 bp, Mus musculus
ggagcagaaggttatgttcttgctg

SEQ ID NO: 322642 - DNA, 25 bp, Mus musculus
ggagcagaatgatttccagagcagg

SEQ ID NO: 322643 - DNA, 25 bp, Mus musculus
ggagcagacatcagaaaccttacaa

SEQ ID NO: 322644 - DNA, 25 bp, Mus musculus
ggagcagacatcagataatggaggt

SEQ ID NO: 322645 - DNA, 25 bp, Mus musculus
ggagcagaccaggtgactggttatc

SEQ ID NO: 322646 - DNA, 25 bp, Mus musculus
ggagcagaccagtaggggcaagcgc

SEQ ID NO: 322647 - DNA, 25 bp, Mus musculus
ggagcagacgcgaaactggatggct

SEQ ID NO: 322648 - DNA, 25 bp, Mus musculus
ggagcagagaggagcttggctttga

SEQ ID NO: 322649 - DNA, 25 bp, Mus musculus
ggagcagaggctcatctacctgccc

SEQ ID NO: 322650 - DNA, 25 bp, Mus musculus
ggagcagagggggatgccccatact

SEQ ID NO: 322651 - DNA, 25 bp, Mus musculus
ggagcagagtacaggtggagtttcg

SEQ ID NO: 322652 - DNA, 25 bp, Mus musculus
ggagcagagtcaggagcgcagggca

SEQ ID NO: 322653 - DNA, 25 bp, Mus musculus
ggagcagagtcagggaccaggactg

SEQ ID NO: 322654 - DNA, 25 bp, Mus musculus
ggagcagatatcggcacaacgatgg

SEQ ID NO: 322655 - DNA, 25 bp, Mus musculus
ggagcagatcaatgaaattggagat

SEQ ID NO: 322656 - DNA, 25 bp, Mus musculus
ggagcagatggaaaggtcgtgtctt

SEQ ID NO: 322657 - DNA, 25 bp, Mus musculus
ggagcagatgtagttcatcctatct

SEQ ID NO: 322658 - DNA, 25 bp, Mus musculus
ggagcagattcgcagaatagcagag

SEQ ID NO: 322659 - DNA, 25 bp, Mus musculus
ggagcagattttgaggtattcgtgg

SEQ ID NO: 322660 - DNA, 25 bp, Mus musculus
ggagcagattttgaggtcttgccgt

SEQ ID NO: 322661 - DNA, 25 bp, Mus musculus
ggagcagcacaaggccgaggccgtg

SEQ ID NO: 322662 - DNA, 25 bp, Mus musculus
ggagcagcaccagaaataccggtat

SEQ ID NO: 322663 - DNA, 25 bp, Mus musculus
ggagcagcagcagtaggcactggtg

SEQ ID NO: 322664 - DNA, 25 bp, Mus musculus
ggagcagcagcgagaatgcttcgtg

SEQ ID NO: 322665 - DNA, 25 bp, Mus musculus
ggagcagcagcttggtctgggaacg

SEQ ID NO: 322666 - DNA, 25 bp, Mus musculus
ggagcagcaggcgttgcagaaactg

SEQ ID NO: 322667 - DNA, 25 bp, Mus musculus
ggagcagcatacaaggtcaacatgg

SEQ ID NO: 322668 - DNA, 25 bp, Mus musculus
ggagcagcatgggatcccggagaac

SEQ ID NO: 322669 - DNA, 25 bp, Mus musculus
ggagcagcccaaggaggctccgccc

SEQ ID NO: 322670 - DNA, 25 bp, Mus musculus
ggagcagcccggacaccaaggactt

SEQ ID NO: 322671 - DNA, 25 bp, Mus musculus
ggagcagcgcggcaggccgcggtag

SEQ ID NO: 322672 - DNA, 25 bp, Mus musculus
ggagcagcggcgcaggttgccccgg

SEQ ID NO: 322673 - DNA, 25 bp, Mus musculus
ggagcagctagagattgcgctggct

SEQ ID NO: 322674 - DNA, 25 bp, Mus musculus
ggagcagctgcccagagcataaata

SEQ ID NO: 322675 - DNA, 25 bp, Mus musculus
ggagcagctggctgcagagctggca

SEQ ID NO: 322676 - DNA, 25 bp, Mus musculus
ggagcagctgtggggttccacagca

SEQ ID NO: 322677 - DNA, 25 bp, Mus musculus
ggagcagctgttgctttcccctgtg

SEQ ID NO: 322678 - DNA, 25 bp, Mus musculus
ggagcagcttggctatattgtcttc

SEQ ID NO: 322679 - DNA, 25 bp, Mus musculus
ggagcaggaaaaggtggtcactaac

SEQ ID NO: 322680 - DNA, 25 bp, Mus musculus
ggagcaggaaacaagattatccagc

SEQ ID NO: 322681 - DNA, 25 bp, Mus musculus
ggagcaggaacagggtcaagtcctc

SEQ ID NO: 322682 - DNA, 25 bp, Mus musculus
ggagcaggaacagggtttaatgtgg

SEQ ID NO: 322683 - DNA, 25 bp, Mus musculus
ggagcaggaattaccttgcattttt

SEQ ID NO: 322684 - DNA, 25 bp, Mus musculus
ggagcaggacaaagcatgtggggca

SEQ ID NO: 322685 - DNA, 25 bp, Mus musculus
ggagcaggacaaaggagtctcacct

SEQ ID NO: 322686 - DNA, 25 bp, Mus musculus
ggagcaggacatgctggcctcaaac

SEQ ID NO: 322687 - DNA, 25 bp, Mus musculus
ggagcaggacatggctgccaactgg

SEQ ID NO: 322688 - DNA, 25 bp, Mus musculus
ggagcaggacatgtttgcacaccct

SEQ ID NO: 322689 - DNA, 25 bp, Mus musculus
ggagcaggagagattgttgacgctg

SEQ ID NO: 322690 - DNA, 25 bp, Mus musculus
ggagcaggaggagccaagcaataag

SEQ ID NO: 322691 - DNA, 25 bp, Mus musculus
ggagcaggaggagccaggagcagcc

SEQ ID NO: 322692 - DNA, 25 bp, Mus musculus
ggagcaggatgagagcagacactgc

SEQ ID NO: 322693 - DNA, 25 bp, Mus musculus
ggagcaggatgaggaggaagatgag

SEQ ID NO: 322694 - DNA, 25 bp, Mus musculus
ggagcaggccaaggccaaggctgcc

SEQ ID NO: 322695 - DNA, 25 bp, Mus musculus
ggagcaggctcagagatgggcccag

SEQ ID NO: 322696 - DNA, 25 bp, Mus musculus
ggagcaggtaagcagctgctccctt

SEQ ID NO: 322697 - DNA, 25 bp, Mus musculus
ggagcaggtatcgaggaattctata

SEQ ID NO: 322698 - DNA, 25 bp, Mus musculus
ggagcaggtgagggggtcggggttt

SEQ ID NO: 322699 - DNA, 25 bp, Mus musculus
ggagcagtcgaaagaggcagacatc

SEQ ID NO: 322700 - DNA, 25 bp, Mus musculus
ggagcagtctcatggagccagatcc

SEQ ID NO: 322701 - DNA, 25 bp, Mus musculus
ggagcagtctggcatgctcccaaat

SEQ ID NO: 322702 - DNA, 25 bp, Mus musculus
ggagcagtgggagaaagatgatgac

SEQ ID NO: 322703 - DNA, 25 bp, Mus musculus
ggagcagttggggaccagagttggc

SEQ ID NO: 322704 - DNA, 25 bp, Mus musculus
ggagcagttgtttgtctgccaggaa

SEQ ID NO: 322705 - DNA, 25 bp, Mus musculus
ggagcataactcaggtccaaaggcc

SEQ ID NO: 322706 - DNA, 25 bp, Mus musculus
ggagcatatgctgatcctgggcata

SEQ ID NO: 322707 - DNA, 25 bp, Mus musculus
ggagcatcaaaaccctactgaaacc

SEQ ID NO: 322708 - DNA, 25 bp, Mus musculus
ggagcatcaagaagtcatgctcttg

SEQ ID NO: 322709 - DNA, 25 bp, Mus musculus
ggagcatcagaatttcagatgacaa

SEQ ID NO: 322710 - DNA, 25 bp, Mus musculus
ggagcatcagacatttccactgggc

SEQ ID NO: 322711 - DNA, 25 bp, Mus musculus
ggagcatcagattccagaatttgat

SEQ ID NO: 322712 - DNA, 25 bp, Mus musculus
ggagcatcagctgctgacctgataa

SEQ ID NO: 322713 - DNA, 25 bp, Mus musculus
ggagcatcagctgtggtcctctaac

SEQ ID NO: 322714 - DNA, 25 bp, Mus musculus
ggagcatcccgagatgacacgaatt

SEQ ID NO: 322715 - DNA, 25 bp, Mus musculus
ggagcatcccgaggtgtttacaatt

SEQ ID NO: 322716 - DNA, 25 bp, Mus musculus
ggagcatccgtgaggtatttgaata

SEQ ID NO: 322717 - DNA, 25 bp, Mus musculus
ggagcatcctgccgtggtgaaggca

SEQ ID NO: 322718 - DNA, 25 bp, Mus musculus
ggagcatcctggtccagggctaagt

SEQ ID NO: 322719 - DNA, 25 bp, Mus musculus
ggagcatcgagctggaatacgtcta

SEQ ID NO: 322720 - DNA, 25 bp, Mus musculus
ggagcatctcaagaacactcaccag

SEQ ID NO: 322721 - DNA, 25 bp, Mus musculus
ggagcatctcaagcaaaacgaagag

SEQ ID NO: 322722 - DNA, 25 bp, Mus musculus
ggagcatctcaagcccaagcagtag

SEQ ID NO: 322723 - DNA, 25 bp, Mus musculus
ggagcatctgtgcagggtgatagca

SEQ ID NO: 322724 - DNA, 25 bp, Mus musculus
ggagcatgaaagatcagacctgtcg

SEQ ID NO: 322725 - DNA, 25 bp, Mus musculus
ggagcatgaaaggacgtccacgtct

SEQ ID NO: 322726 - DNA, 25 bp, Mus musculus
ggagcatgaagaaaggctacagcag

SEQ ID NO: 322727 - DNA, 25 bp, Mus musculus
ggagcatgaagaagcctccaggact

SEQ ID NO: 322728 - DNA, 25 bp, Mus musculus
ggagcatgagagcgtagcaggagtg

SEQ ID NO: 322729 - DNA, 25 bp, Mus musculus
ggagcatgagcaggctactgccctg

SEQ ID NO: 322730 - DNA, 25 bp, Mus musculus
ggagcatgagccagatatactgcat

SEQ ID NO: 322731 - DNA, 25 bp, Mus musculus
ggagcatgaggagtggtggagagct

SEQ ID NO: 322732 - DNA, 25 bp, Mus musculus
ggagcatgcgcaggtggtggagctg

SEQ ID NO: 322733 - DNA, 25 bp, Mus musculus
ggagcatgtgtggctgacctgatcg

SEQ ID NO: 322734 - DNA, 25 bp, Mus musculus
ggagcatttcctcacaacaaacaat

SEQ ID NO: 322735 - DNA, 25 bp, Mus musculus
ggagcatttcctcacctccatctgc

SEQ ID NO: 322736 - DNA, 25 bp, Mus musculus
ggagcattttgagaaagcaattgag

SEQ ID NO: 322737 - DNA, 25 bp, Mus musculus
ggagcattttgaggttttctctgtg

SEQ ID NO: 322738 - DNA, 25 bp, Mus musculus
ggagccaaactaggaaatgccgctt

SEQ ID NO: 322739 - DNA, 25 bp, Mus musculus
ggagccaacatcaacagaatcaaag

SEQ ID NO: 322740 - DNA, 25 bp, Mus musculus
ggagccaagagagctgaagcgctgc

SEQ ID NO: 322741 - DNA, 25 bp, Mus musculus
ggagccaagagctatgagccagaat

SEQ ID NO: 322742 - DNA, 25 bp, Mus musculus
ggagccaagaggagtgaatggtgtg

SEQ ID NO: 322743 - DNA, 25 bp, Mus musculus
ggagccaagaggggtctccaatgac

SEQ ID NO: 322744 - DNA, 25 bp, Mus musculus
ggagccaagagtgaagaacaatcca

SEQ ID NO: 322745 - DNA, 25 bp, Mus musculus
ggagccaaggaagccaattaaaatg

SEQ ID NO: 322746 - DNA, 25 bp, Mus musculus
ggagccaaggagatcgttgtccaac

SEQ ID NO: 322747 - DNA, 25 bp, Mus musculus
ggagccaatatctatctactactct

SEQ ID NO: 322748 - DNA, 25 bp, Mus musculus
ggagccacaaactcctgcttcctga

SEQ ID NO: 322749 - DNA, 25 bp, Mus musculus
ggagccacaaattgcggttgccaat

SEQ ID NO: 322750 - DNA, 25 bp, Mus musculus
ggagccacaggatgaaataacagtt

SEQ ID NO: 322751 - DNA, 25 bp, Mus musculus
ggagccacaggatgatggcagtgaa

SEQ ID NO: 322752 - DNA, 25 bp, Mus musculus
ggagccaccaaaaaggaatcactgg

SEQ ID NO: 322753 - DNA, 25 bp, Mus musculus
ggagccaccaggttgacagacaagg

SEQ ID NO: 322754 - DNA, 25 bp, Mus musculus
ggagccaccccagacccaagaatct

SEQ ID NO: 322755 - DNA, 25 bp, Mus musculus
ggagccactctcagagttttgtaca

SEQ ID NO: 322756 - DNA, 25 bp, Mus musculus
ggagccactgacggaccagagtgag

SEQ ID NO: 322757 - DNA, 25 bp, Mus musculus
ggagccacttctcaggcctacaggg

SEQ ID NO: 322758 - DNA, 25 bp, Mus musculus
ggagccagaagcgacttgaagagat

SEQ ID NO: 322759 - DNA, 25 bp, Mus musculus
ggagccagcaggtctattttgtgga

SEQ ID NO: 322760 - DNA, 25 bp, Mus musculus
ggagccagcaggtggagcacgccct

SEQ ID NO: 322761 - DNA, 25 bp, Mus musculus
ggagccagcatgaatcagctgcccg

SEQ ID NO: 322762 - DNA, 25 bp, Mus musculus
ggagccagcatgccttcctgggcgc

SEQ ID NO: 322763 - DNA, 25 bp, Mus musculus
ggagccagcatgctcgtcaaggtga

SEQ ID NO: 322764 - DNA, 25 bp, Mus musculus
ggagccagcggatgaagctacccag

SEQ ID NO: 322765 - DNA, 25 bp, Mus musculus
ggagccagctatgtggccctagagt

SEQ ID NO: 322766 - DNA, 25 bp, Mus musculus
ggagccagctcctgctgctgaagat

SEQ ID NO: 322767 - DNA, 25 bp, Mus musculus
ggagccagcttcagattcccaggaa

SEQ ID NO: 322768 - DNA, 25 bp, Mus musculus
ggagccagcttggtctgacagaagt

SEQ ID NO: 322769 - DNA, 25 bp, Mus musculus
ggagccaggaccaggctttcttgat

SEQ ID NO: 322770 - DNA, 25 bp, Mus musculus
ggagccaggagaaggctgctatttt

SEQ ID NO: 322771 - DNA, 25 bp, Mus musculus
ggagccaggagagggctgctatttt

SEQ ID NO: 322772 - DNA, 25 bp, Mus musculus
ggagccaggcgtggggccgcagcct

SEQ ID NO: 322773 - DNA, 25 bp, Mus musculus
ggagccagggaaaaggtacaactga

SEQ ID NO: 322774 - DNA, 25 bp, Mus musculus
ggagccagggatgccctgctggcag

SEQ ID NO: 322775 - DNA, 25 bp, Mus musculus
ggagccagtgcagcctggagatgcc

SEQ ID NO: 322776 - DNA, 25 bp, Mus musculus
ggagccagtgcaggcaggatctcta

SEQ ID NO: 322777 - DNA, 25 bp, Mus musculus
ggagccagtgcaggcgcctcattgt

SEQ ID NO: 322778 - DNA, 25 bp, Mus musculus
ggagccatcccaagaccctcctcat

SEQ ID NO: 322779 - DNA, 25 bp, Mus musculus
ggagccatcccagtgatgaatctgg

SEQ ID NO: 322780 - DNA, 25 bp, Mus musculus
ggagccatcccagtgatggctacca

SEQ ID NO: 322781 - DNA, 25 bp, Mus musculus
ggagccattcagcctttggctacaa

SEQ ID NO: 322782 - DNA, 25 bp, Mus musculus
ggagcccaaaaagatggcacttcca

SEQ ID NO: 322783 - DNA, 25 bp, Mus musculus
ggagcccaagtttcagccatggctg

SEQ ID NO: 322784 - DNA, 25 bp, Mus musculus
ggagcccacgaaccttcttttaaag

SEQ ID NO: 322785 - DNA, 25 bp, Mus musculus
ggagcccacgagcacccggaggatg

SEQ ID NO: 322786 - DNA, 25 bp, Mus musculus
ggagcccacggtgacactgctgagc

SEQ ID NO: 322787 - DNA, 25 bp, Mus musculus
ggagcccagaaatgtacggagtttg

SEQ ID NO: 322788 - DNA, 25 bp, Mus musculus
ggagcccagaaattatttggtatga

SEQ ID NO: 322789 - DNA, 25 bp, Mus musculus
ggagcccagaaccaaggcaagaagg

SEQ ID NO: 322790 - DNA, 25 bp, Mus musculus
ggagcccagaaccaggccaagaaag

SEQ ID NO: 322791 - DNA, 25 bp, Mus musculus
ggagcccagaagatcgtgattttaa

SEQ ID NO: 322792 - DNA, 25 bp, Mus musculus
ggagcccagagagaggtcatcttcc

SEQ ID NO: 322793 - DNA, 25 bp, Mus musculus
ggagcccagcgcgtggcatgaagca

SEQ ID NO: 322794 - DNA, 25 bp, Mus musculus
ggagcccagcgcgtgggacgaattc

SEQ ID NO: 322795 - DNA, 25 bp, Mus musculus
ggagcccaggcctccagatctatcc

SEQ ID NO: 322796 - DNA, 25 bp, Mus musculus
ggagcccagggaagtggctacagat

SEQ ID NO: 322797 - DNA, 25 bp, Mus musculus
ggagcccagtgagcacttgcaggtg

SEQ ID NO: 322798 - DNA, 25 bp, Mus musculus
ggagcccatatccatgttccagccc

SEQ ID NO: 322799 - DNA, 25 bp, Mus musculus
ggagcccatggaaaagacgaagaga

SEQ ID NO: 322800 - DNA, 25 bp, Mus musculus
ggagccccacggatttcagtttttc

SEQ ID NO: 322801 - DNA, 25 bp, Mus musculus
ggagcccccaccagcttcccttcag

SEQ ID NO: 322802 - DNA, 25 bp, Mus musculus
ggagcccccaccaggcctcggtgtc

SEQ ID NO: 322803 - DNA, 25 bp, Mus musculus
ggagccccctctagtgagcactccc

SEQ ID NO: 322804 - DNA, 25 bp, Mus musculus
ggagccccgacccaggggagcagcg

SEQ ID NO: 322805 - DNA, 25 bp, Mus musculus
ggagccccgacccagtggctagacc

SEQ ID NO: 322806 - DNA, 25 bp, Mus musculus
ggagccccgagcccttccagcagga

SEQ ID NO: 322807 - DNA, 25 bp, Mus musculus
ggagccccgagctcctctaatttca

SEQ ID NO: 322808 - DNA, 25 bp, Mus musculus
ggagccccgcagggccagttcctga

SEQ ID NO: 322809 - DNA, 25 bp, Mus musculus
ggagccccgccccagaaacatcgaa

SEQ ID NO: 322810 - DNA, 25 bp, Mus musculus
ggagccccgccccagtgcaaacagc

SEQ ID NO: 322811 - DNA, 25 bp, Mus musculus
ggagccccggatggcatggaggagc

SEQ ID NO: 322812 - DNA, 25 bp, Mus musculus
ggagccccggatggccgggctcgtg

SEQ ID NO: 322813 - DNA, 25 bp, Mus musculus
ggagccccggtacatggagcttgtg

SEQ ID NO: 322814 - DNA, 25 bp, Mus musculus
ggagcccctagtggcaagggaaaac

SEQ ID NO: 322815 - DNA, 25 bp, Mus musculus
ggagcccctcggatgttctctatgt

SEQ ID NO: 322816 - DNA, 25 bp, Mus musculus
ggagcccctcgggccaatcccagtg

SEQ ID NO: 322817 - DNA, 25 bp, Mus musculus
ggagcccctgaaagagatgacatca

SEQ ID NO: 322818 - DNA, 25 bp, Mus musculus
ggagcccgaaggccgaatgttttgg

SEQ ID NO: 322819 - DNA, 25 bp, Mus musculus
ggagcccgaaggccggtcgctgtgg

SEQ ID NO: 322820 - DNA, 25 bp, Mus musculus
ggagcccgaccagaaccgggtggtg

SEQ ID NO: 322821 - DNA, 25 bp, Mus musculus
ggagcccgagacagggactattcca

SEQ ID NO: 322822 - DNA, 25 bp, Mus musculus
ggagcccgagggctactcttccgtg

SEQ ID NO: 322823 - DNA, 25 bp, Mus musculus
ggagcccgcgaagctctcggagact

SEQ ID NO: 322824 - DNA, 25 bp, Mus musculus
ggagcccgcgattctcattgaaatc

SEQ ID NO: 322825 - DNA, 25 bp, Mus musculus
ggagcccgcgggtcttactgtttac

SEQ ID NO: 322826 - DNA, 25 bp, Mus musculus
ggagcccggctcaggacaatggatt

SEQ ID NO: 322827 - DNA, 25 bp, Mus musculus
ggagccctcggcgggcatggcccct

SEQ ID NO: 322828 - DNA, 25 bp, Mus musculus
ggagccctgcaggtactccctggca

SEQ ID NO: 322829 - DNA, 25 bp, Mus musculus
ggagccctggaggagtctcagctag

SEQ ID NO: 322830 - DNA, 25 bp, Mus musculus
ggagccctggaggattaccaggcaa

SEQ ID NO: 322831 - DNA, 25 bp, Mus musculus
ggagccctgtgcagatttccctcag

SEQ ID NO: 322832 - DNA, 25 bp, Mus musculus
ggagccctgtgcagccttgtgacag

SEQ ID NO: 322833 - DNA, 25 bp, Mus musculus
ggagcccttgacgcctccttggcat

SEQ ID NO: 322834 - DNA, 25 bp, Mus musculus
ggagccgaagctcaatgacaatgtc

SEQ ID NO: 322835 - DNA, 25 bp, Mus musculus
ggagccgaataagggaagaaaggaa

SEQ ID NO: 322836 - DNA, 25 bp, Mus musculus
ggagccgactgggctgtttccaaca

SEQ ID NO: 322837 - DNA, 25 bp, Mus musculus
ggagccgactttgccagtatgttac

SEQ ID NO: 322838 - DNA, 25 bp, Mus musculus
ggagccgagcagcggatcttcctcc

SEQ ID NO: 322839 - DNA, 25 bp, Mus musculus
ggagccgagcagcggattggccaac

SEQ ID NO: 322840 - DNA, 25 bp, Mus musculus
ggagccgagcccggtccccagccaa

SEQ ID NO: 322841 - DNA, 25 bp, Mus musculus
ggagccgagcccgtaggtgagcctg

SEQ ID NO: 322842 - DNA, 25 bp, Mus musculus
ggagccgagtgatggggcgttgggc

SEQ ID NO: 322843 - DNA, 25 bp, Mus musculus
ggagccgagtgcagttcctccatca

SEQ ID NO: 322844 - DNA, 25 bp, Mus musculus
ggagccgcaaaggatgaaacgagga

SEQ ID NO: 322845 - DNA, 25 bp, Mus musculus
ggagccgcacgtgtcctgggtcatg

SEQ ID NO: 322846 - DNA, 25 bp, Mus musculus
ggagccgcagcagttgccccagaat

SEQ ID NO: 322847 - DNA, 25 bp, Mus musculus
ggagccgcagggtagaggcagtcat

SEQ ID NO: 322848 - DNA, 25 bp, Mus musculus
ggagccgccaagtgcctgaagacct

SEQ ID NO: 322849 - DNA, 25 bp, Mus musculus
ggagccgcccggaggtgcttgaggc

SEQ ID NO: 322850 - DNA, 25 bp, Mus musculus
ggagccgcgcgtgtctccacagagg

SEQ ID NO: 322851 - DNA, 25 bp, Mus musculus
ggagccgcgcttccgctccggccct

SEQ ID NO: 322852 - DNA, 25 bp, Mus musculus
ggagccgcgtagactttaagaaaca

SEQ ID NO: 322853 - DNA, 25 bp, Mus musculus
ggagccgctgcacgatttaccttca

SEQ ID NO: 322854 - DNA, 25 bp, Mus musculus
ggagccgctggcttacagggttcca

SEQ ID NO: 322855 - DNA, 25 bp, Mus musculus
ggagccggaaaggcggaggccaggc

SEQ ID NO: 322856 - DNA, 25 bp, Mus musculus
ggagccggccttcagcacacagcac

SEQ ID NO: 322857 - DNA, 25 bp, Mus musculus
ggagccggcgggaggctgacaattt

SEQ ID NO: 322858 - DNA, 25 bp, Mus musculus
ggagccggctgatctggaccccgag

SEQ ID NO: 322859 - DNA, 25 bp, Mus musculus
ggagccggctgatgccaagacggaa

SEQ ID NO: 322860 - DNA, 25 bp, Mus musculus
ggagccgggagccccgatgaccgag

SEQ ID NO: 322861 - DNA, 25 bp, Mus musculus
ggagccgggaggctacagactacaa

SEQ ID NO: 322862 - DNA, 25 bp, Mus musculus
ggagccggggctcgatgtctacact

SEQ ID NO: 322863 - DNA, 25 bp, Mus musculus
ggagccgtcgactctcaggtggacg

SEQ ID NO: 322864 - DNA, 25 bp, Mus musculus
ggagccgtctgaagaactgagtgtg

SEQ ID NO: 322865 - DNA, 25 bp, Mus musculus
ggagccgtctgaagactgctctttg

SEQ ID NO: 322866 - DNA, 25 bp, Mus musculus
ggagccgtgacggagatgctcacgt

SEQ ID NO: 322867 - DNA, 25 bp, Mus musculus
ggagccgtgcaggcagcggctgcgt

SEQ ID NO: 322868 - DNA, 25 bp, Mus musculus
ggagccgtgcagggttcactatcgt

SEQ ID NO: 322869 - DNA, 25 bp, Mus musculus
ggagcctaaggaaccacgggaagga

SEQ ID NO: 322870 - DNA, 25 bp, Mus musculus
ggagcctagacctgacgggacatcc

SEQ ID NO: 322871 - DNA, 25 bp, Mus musculus
ggagcctagacctgtcagaggcctg

SEQ ID NO: 322872 - DNA, 25 bp, Mus musculus
ggagcctatgaacgaaccacatgaa

SEQ ID NO: 322873 - DNA, 25 bp, Mus musculus
ggagcctatgaaggaaccacatgaa

SEQ ID NO: 322874 - DNA, 25 bp, Mus musculus
ggagcctcccaggaagagagggaga

SEQ ID NO: 322875 - DNA, 25 bp, Mus musculus
ggagcctccggttaagcctgatcac

SEQ ID NO: 322876 - DNA, 25 bp, Mus musculus
ggagcctccttcaggcctcaggctt

SEQ ID NO: 322877 - DNA, 25 bp, Mus musculus
ggagcctgaaaaatacattgcccta

SEQ ID NO: 322878 - DNA, 25 bp, Mus musculus
ggagcctgaaccgcccgttgaccga

SEQ ID NO: 322879 - DNA, 25 bp, Mus musculus
ggagcctgccaggctctagttcatt

SEQ ID NO: 322880 - DNA, 25 bp, Mus musculus
ggagcctgcccaagtcttcaactgc

SEQ ID NO: 322881 - DNA, 25 bp, Mus musculus
ggagcctggaatagagcaatcaaga

SEQ ID NO: 322882 - DNA, 25 bp, Mus musculus
ggagcctggcaatggtctgccagga

SEQ ID NO: 322883 - DNA, 25 bp, Mus musculus
ggagcctgggaagagaagaaccaaa

SEQ ID NO: 322884 - DNA, 25 bp, Mus musculus
ggagcctgggaagctccaggtgcgg

SEQ ID NO: 322885 - DNA, 25 bp, Mus musculus
ggagcctgtagaccaggatggaaac

SEQ ID NO: 322886 - DNA, 25 bp, Mus musculus
ggagcctgtggcctaaatgtagaaa

SEQ ID NO: 322887 - DNA, 25 bp, Mus musculus
ggagcctgttttggacccaacagac

SEQ ID NO: 322888 - DNA, 25 bp, Mus musculus
ggagccttatacccggagagagaag

SEQ ID NO: 322889 - DNA, 25 bp, Mus musculus
ggagccttcaacctgacgctgtcca

SEQ ID NO: 322890 - DNA, 25 bp, Mus musculus
ggagccttcaacctggatgccctcc

SEQ ID NO: 322891 - DNA, 25 bp, Mus musculus
ggagccttcctgagatactgcagcc

SEQ ID NO: 322892 - DNA, 25 bp, Mus musculus
ggagccttctggcagggtccctgca

SEQ ID NO: 322893 - DNA, 25 bp, Mus musculus
ggagcctttcccggtgggacgctcg

SEQ ID NO: 322894 - DNA, 25 bp, Mus musculus
ggagcctttgggaaggcgacagact

SEQ ID NO: 322895 - DNA, 25 bp, Mus musculus
ggagcgaaagtgacaccagcagtct

SEQ ID NO: 322896 - DNA, 25 bp, Mus musculus
ggagcgaatggagggtggagctttt

SEQ ID NO: 322897 - DNA, 25 bp, Mus musculus
ggagcgacaaggtaaaagaagaaat

SEQ ID NO: 322898 - DNA, 25 bp, Mus musculus
ggagcgacaccaggaacaccggaca

SEQ ID NO: 322899 - DNA, 25 bp, Mus musculus
ggagcgaccgggtcatgtaggaaat

SEQ ID NO: 322900 - DNA, 25 bp, Mus musculus
ggagcgactcgatcccctgaactta

SEQ ID NO: 322901 - DNA, 25 bp, Mus musculus
ggagcgactcgttctgcctccccta

SEQ ID NO: 322902 - DNA, 25 bp, Mus musculus
ggagcgagaccctgatctgggggat

SEQ ID NO: 322903 - DNA, 25 bp, Mus musculus
ggagcgagcaaaaagatttaaggca

SEQ ID NO: 322904 - DNA, 25 bp, Mus musculus
ggagcgagcaaaaagggcaacaata

SEQ ID NO: 322905 - DNA, 25 bp, Mus musculus
ggagcgagcccagcaggaagatgca

SEQ ID NO: 322906 - DNA, 25 bp, Mus musculus
ggagcgagcccaggcaagaagacag

SEQ ID NO: 322907 - DNA, 25 bp, Mus musculus
ggagcgagccgagctgtcacgaccg

SEQ ID NO: 322908 - DNA, 25 bp, Mus musculus
ggagcgagcggatttgataatgggc

SEQ ID NO: 322909 - DNA, 25 bp, Mus musculus
ggagcgaggaaggcacctgatgcag

SEQ ID NO: 322910 - DNA, 25 bp, Mus musculus
ggagcgaggaagggatcgcttacac

SEQ ID NO: 322911 - DNA, 25 bp, Mus musculus
ggagcgatcagaggaacaaggagcc

SEQ ID NO: 322912 - DNA, 25 bp, Mus musculus
ggagcgcacctgaggggaagattgc

SEQ ID NO: 322913 - DNA, 25 bp, Mus musculus
ggagcgcacctggtgattttaccca

SEQ ID NO: 322914 - DNA, 25 bp, Mus musculus
ggagcgcacgaccggtggcttgttg

SEQ ID NO: 322915 - DNA, 25 bp, Mus musculus
ggagcgcagaaggctgagaccgctg

SEQ ID NO: 322916 - DNA, 25 bp, Mus musculus
ggagcgcagcaaggtgtatgatgaa

SEQ ID NO: 322917 - DNA, 25 bp, Mus musculus
ggagcgcaggggccccacctgtcaa

SEQ ID NO: 322918 - DNA, 25 bp, Mus musculus
ggagcgcaggttgtgtcaccaacat

SEQ ID NO: 322919 - DNA, 25 bp, Mus musculus
ggagcgcagtgtgaaactggcccag

SEQ ID NO: 322920 - DNA, 25 bp, Mus musculus
ggagcgcatcaagacccttcgcagg

SEQ ID NO: 322921 - DNA, 25 bp, Mus musculus
ggagcgcatcaaggagctggagtca

SEQ ID NO: 322922 - DNA, 25 bp, Mus musculus
ggagcgcatcaaggggatatctagt

SEQ ID NO: 322923 - DNA, 25 bp, Mus musculus
ggagcgcatcggcaagctggtcgtt

SEQ ID NO: 322924 - DNA, 25 bp, Mus musculus
ggagcgcatgaggagccgagaggat

SEQ ID NO: 322925 - DNA, 25 bp, Mus musculus
ggagcgcatgcagagcagggtgggc

SEQ ID NO: 322926 - DNA, 25 bp, Mus musculus
ggagcgccagagccggtggcggtgg

SEQ ID NO: 322927 - DNA, 25 bp, Mus musculus
ggagcgcccagtctgatacactttt

SEQ ID NO: 322928 - DNA, 25 bp, Mus musculus
ggagcgcggaggtgatgctagcgag

SEQ ID NO: 322929 - DNA, 25 bp, Mus musculus
ggagcgcggcagtggagctggcctg

SEQ ID NO: 322930 - DNA, 25 bp, Mus musculus
ggagcgcggggtcagcacatggttt

SEQ ID NO: 322931 - DNA, 25 bp, Mus musculus
ggagcgcgtctcagggaactgagcc

SEQ ID NO: 322932 - DNA, 25 bp, Mus musculus
ggagcgctacaaagatgagcgggac

SEQ ID NO: 322933 - DNA, 25 bp, Mus musculus
ggagcgctgcctcagagcccaccgc

SEQ ID NO: 322934 - DNA, 25 bp, Mus musculus
ggagcgctgggcagggagatctgac

SEQ ID NO: 322935 - DNA, 25 bp, Mus musculus
ggagcggaagagccccagcgggaag

SEQ ID NO: 322936 - DNA, 25 bp, Mus musculus
ggagcggacgtgacgtatgacttct

SEQ ID NO: 322937 - DNA, 25 bp, Mus musculus
ggagcggagagcgacatgtccttcc

SEQ ID NO: 322938 - DNA, 25 bp, Mus musculus
ggagcggagcaatgcctaaatcaaa

SEQ ID NO: 322939 - DNA, 25 bp, Mus musculus
ggagcggagccagcaagccccgccc

SEQ ID NO: 322940 - DNA, 25 bp, Mus musculus
ggagcggagccccatcttgatatgg

SEQ ID NO: 322941 - DNA, 25 bp, Mus musculus
ggagcggcaaaagagctttatggat

SEQ ID NO: 322942 - DNA, 25 bp, Mus musculus
ggagcggcaaaagagtgatagaagg

SEQ ID NO: 322943 - DNA, 25 bp, Mus musculus
ggagcggcacatttgacctgctgga

SEQ ID NO: 322944 - DNA, 25 bp, Mus musculus
ggagcggcaggtaactgtagctgtc

SEQ ID NO: 322945 - DNA, 25 bp, Mus musculus
ggagcggcagtctcagagagaagct

SEQ ID NO: 322946 - DNA, 25 bp, Mus musculus
ggagcggccagagtatggcttccat

SEQ ID NO: 322947 - DNA, 25 bp, Mus musculus
ggagcggccaggtgtaagagtgttt

SEQ ID NO: 322948 - DNA, 25 bp, Mus musculus
ggagcggccgtaaggattcacctga

SEQ ID NO: 322949 - DNA, 25 bp, Mus musculus
ggagcggccgtaagtttgctaactg

SEQ ID NO: 322950 - DNA, 25 bp, Mus musculus
ggagcggcgctcagagatggagaga

SEQ ID NO: 322951 - DNA, 25 bp, Mus musculus
ggagcggcggtggtgtgccaagtgt

SEQ ID NO: 322952 - DNA, 25 bp, Mus musculus
ggagcggcggtgtgatccattgtag

SEQ ID NO: 322953 - DNA, 25 bp, Mus musculus
ggagcggctcagagctaccaggagc

SEQ ID NO: 322954 - DNA, 25 bp, Mus musculus
ggagcggctcaggttccagctacgg

SEQ ID NO: 322955 - DNA, 25 bp, Mus musculus
ggagcggctgacagaaggacatttg

SEQ ID NO: 322956 - DNA, 25 bp, Mus musculus
ggagcgggcaggatcctcttcgctg

SEQ ID NO: 322957 - DNA, 25 bp, Mus musculus
ggagcgggcaggggcctccctgtgg

SEQ ID NO: 322958 - DNA, 25 bp, Mus musculus
ggagcgggggcgcggtctggaagct

SEQ ID NO: 322959 - DNA, 25 bp, Mus musculus
ggagcggtagaggcaagagcttcac

SEQ ID NO: 322960 - DNA, 25 bp, Mus musculus
ggagcggtagagggagttgcatggt

SEQ ID NO: 322961 - DNA, 25 bp, Mus musculus
ggagcggtcctacagttggggaatg

SEQ ID NO: 322962 - DNA, 25 bp, Mus musculus
ggagcggtgtcctgtgccatctctg

SEQ ID NO: 322963 - DNA, 25 bp, Mus musculus
ggagcggtgtgctcggccatcgaca

SEQ ID NO: 322964 - DNA, 25 bp, Mus musculus
ggagcggtgtggtcattgggcttct

SEQ ID NO: 322965 - DNA, 25 bp, Mus musculus
ggagcggttcagctctgtgacgaga

SEQ ID NO: 322966 - DNA, 25 bp, Mus musculus
ggagcggttcaggtctgtgacgaga

SEQ ID NO: 322967 - DNA, 25 bp, Mus musculus
ggagcggttgcagacggcacgacca

SEQ ID NO: 322968 - DNA, 25 bp, Mus musculus
ggagcggttgcaggcctggcgtccg

SEQ ID NO: 322969 - DNA, 25 bp, Mus musculus
ggagcgtatcccagaacaacctgcg

SEQ ID NO: 322970 - DNA, 25 bp, Mus musculus
ggagcgtcaagcagactcgccagtg

SEQ ID NO: 322971 - DNA, 25 bp, Mus musculus
ggagcgtcaggtcttgagagagctt

SEQ ID NO: 322972 - DNA, 25 bp, Mus musculus
ggagcgtccatctgaagaaaaagaa

SEQ ID NO: 322973 - DNA, 25 bp, Mus musculus
ggagcgtccatctgacaatggattc

SEQ ID NO: 322974 - DNA, 25 bp, Mus musculus
ggagcgtccatctgcaaggaccatg

SEQ ID NO: 322975 - DNA, 25 bp, Mus musculus
ggagcgtctggtgctacaagtgtga

SEQ ID NO: 322976 - DNA, 25 bp, Mus musculus
ggagcgtggagaccatcttcaacaa

SEQ ID NO: 322977 - DNA, 25 bp, Mus musculus
ggagctaaagatccttcgtacctac

SEQ ID NO: 322978 - DNA, 25 bp, Mus musculus
ggagctaaagttctccctgggcagc

SEQ ID NO: 322979 - DNA, 25 bp, Mus musculus
ggagctaagaacggaaagaccaaga

SEQ ID NO: 322980 - DNA, 25 bp, Mus musculus
ggagctaagaataatagggcccagt

SEQ ID NO: 322981 - DNA, 25 bp, Mus musculus
ggagctacaggctggtaagaacagt

SEQ ID NO: 322982 - DNA, 25 bp, Mus musculus
ggagctaccagcggctctgctctgc

SEQ ID NO: 322983 - DNA, 25 bp, Mus musculus
ggagctacggctgggttacccagtg

SEQ ID NO: 322984 - DNA, 25 bp, Mus musculus
ggagctactctccagggtcttcctg

SEQ ID NO: 322985 - DNA, 25 bp, Mus musculus
ggagctactgcagagccatcctgac

SEQ ID NO: 322986 - DNA, 25 bp, Mus musculus
ggagctactggagaagccagatgcc

SEQ ID NO: 322987 - DNA, 25 bp, Mus musculus
ggagctagagaactacatggacccc

SEQ ID NO: 322988 - DNA, 25 bp, Mus musculus
ggagctagatgaggttgatatgtca

SEQ ID NO: 322989 - DNA, 25 bp, Mus musculus
ggagctagtgaaactgacgtctatt

SEQ ID NO: 322990 - DNA, 25 bp, Mus musculus
ggagctagtgcaaaactgccagtgt

SEQ ID NO: 322991 - DNA, 25 bp, Mus musculus
ggagctagtggcccacgcttgtgtt

SEQ ID NO: 322992 - DNA, 25 bp, Mus musculus
ggagctagtggtttaggtaatagcg

SEQ ID NO: 322993 - DNA, 25 bp, Mus musculus
ggagctcaacaagactgcaagtggc

SEQ ID NO: 322994 - DNA, 25 bp, Mus musculus
ggagctcaaccacttcggatatcat

SEQ ID NO: 322995 - DNA, 25 bp, Mus musculus
ggagctcaaggagtgtctagcccac

SEQ ID NO: 322996 - DNA, 25 bp, Mus musculus
ggagctcagagaaagcagaagatac

SEQ ID NO: 322997 - DNA, 25 bp, Mus musculus
ggagctcagagggcgggatgtctct

SEQ ID NO: 322998 - DNA, 25 bp, Mus musculus
ggagctcagaggtgttttctattac

SEQ ID NO: 322999 - DNA, 25 bp, Mus musculus
ggagctcagaggttgactcttcacc

SEQ ID NO: 323000 - DNA, 25 bp, Mus musculus
ggagctcagcaagtattcgactcac

SEQ ID NO: 323001 - DNA, 25 bp, Mus musculus
ggagctcagcaatagtctggaagaa

SEQ ID NO: 323002 - DNA, 25 bp, Mus musculus
ggagctcagctatggagtcagtgac

SEQ ID NO: 323003 - DNA, 25 bp, Mus musculus
ggagctcagctatggagtctgtatc

SEQ ID NO: 323004 - DNA, 25 bp, Mus musculus
ggagctcagggtgaggcgacccctc

SEQ ID NO: 323005 - DNA, 25 bp, Mus musculus
ggagctcatgaaggagctctttgat

SEQ ID NO: 323006 - DNA, 25 bp, Mus musculus
ggagctcatgaaggctctggtctca

SEQ ID NO: 323007 - DNA, 25 bp, Mus musculus
ggagctccgactggaaataccagag

SEQ ID NO: 323008 - DNA, 25 bp, Mus musculus
ggagctccgactggagtctccaaaa

SEQ ID NO: 323009 - DNA, 25 bp, Mus musculus
ggagctccgagaggagacattccaa

SEQ ID NO: 323010 - DNA, 25 bp, Mus musculus
ggagctccgagaggtagctctggct

SEQ ID NO: 323011 - DNA, 25 bp, Mus musculus
ggagctccggcaaatcagccacaca

SEQ ID NO: 323012 - DNA, 25 bp, Mus musculus
ggagctcctcctctcggtacttctc

SEQ ID NO: 323013 - DNA, 25 bp, Mus musculus
ggagctcctcttgagaatattctcc

SEQ ID NO: 323014 - DNA, 25 bp, Mus musculus
ggagctcctcttgagcattgcgcca

SEQ ID NO: 323015 - DNA, 25 bp, Mus musculus
ggagctcgaagcagaatcagagaag

SEQ ID NO: 323016 - DNA, 25 bp, Mus musculus
ggagctcgagaacttcaagttggag

SEQ ID NO: 323017 - DNA, 25 bp, Mus musculus
ggagctcgaggtaaagaaaacgtgc

SEQ ID NO: 323018 - DNA, 25 bp, Mus musculus
ggagctcgccaaggctggctggcta

SEQ ID NO: 323019 - DNA, 25 bp, Mus musculus
ggagctcgccccgagagactgaatt

SEQ ID NO: 323020 - DNA, 25 bp, Mus musculus
ggagctcgcgactcactgtgtgctg

SEQ ID NO: 323021 - DNA, 25 bp, Mus musculus
ggagctcggagcaggctcaggccat

SEQ ID NO: 323022 - DNA, 25 bp, Mus musculus
ggagctcggcaggcatttcagggaa

SEQ ID NO: 323023 - DNA, 25 bp, Mus musculus
ggagctcgggcggggaccggagctg

SEQ ID NO: 323024 - DNA, 25 bp, Mus musculus
ggagctcgttcaagagggagcccgc

SEQ ID NO: 323025 - DNA, 25 bp, Mus musculus
ggagctcgttcaagggggcgacttt

SEQ ID NO: 323026 - DNA, 25 bp, Mus musculus
ggagctctaccagaacctgacccgg

SEQ ID NO: 323027 - DNA, 25 bp, Mus musculus
ggagctctatggccgagaaccagat

SEQ ID NO: 323028 - DNA, 25 bp, Mus musculus
ggagctctatggccgagaaccatat

SEQ ID NO: 323029 - DNA, 25 bp, Mus musculus
ggagctctccgccggctgattatga

SEQ ID NO: 323030 - DNA, 25 bp, Mus musculus
ggagctctcgaagtgccctggaggt

SEQ ID NO: 323031 - DNA, 25 bp, Mus musculus
ggagctctcggtctcaactcataca

SEQ ID NO: 323032 - DNA, 25 bp, Mus musculus
ggagctctctgacaggtgtccccag

SEQ ID NO: 323033 - DNA, 25 bp, Mus musculus
ggagctctggatgctgaatgctccc

SEQ ID NO: 323034 - DNA, 25 bp, Mus musculus
ggagctctgggaacctcctctggga

SEQ ID NO: 323035 - DNA, 25 bp, Mus musculus
ggagctctgggaattaacaagctga

SEQ ID NO: 323036 - DNA, 25 bp, Mus musculus
ggagctctggggcccagcaacctcc

SEQ ID NO: 323037 - DNA, 25 bp, Mus musculus
ggagctcttcctgggcctctccaac

SEQ ID NO: 323038 - DNA, 25 bp, Mus musculus
ggagctcttcctgggcggcggccag

SEQ ID NO: 323039 - DNA, 25 bp, Mus musculus
ggagctcttctcagagaagaaaagc

SEQ ID NO: 323040 - DNA, 25 bp, Mus musculus
ggagctcttggagatttttgcagct

SEQ ID NO: 323041 - DNA, 25 bp, Mus musculus
ggagctgaaagcactgacacacagt

SEQ ID NO: 323042 - DNA, 25 bp, Mus musculus
ggagctgaaagcagggtgtggacag

SEQ ID NO: 323043 - DNA, 25 bp, Mus musculus
ggagctgaaagggactgccctgtac

SEQ ID NO: 323044 - DNA, 25 bp, Mus musculus
ggagctgaacaagtactctacgcac

SEQ ID NO: 323045 - DNA, 25 bp, Mus musculus
ggagctgaagaaggcgccctttgtg

SEQ ID NO: 323046 - DNA, 25 bp, Mus musculus
ggagctgaagaaggtggctgctggg

SEQ ID NO: 323047 - DNA, 25 bp, Mus musculus
ggagctgaaggctcgcaacaccaag

SEQ ID NO: 323048 - DNA, 25 bp, Mus musculus
ggagctgaatgaaagggagaagaag

SEQ ID NO: 323049 - DNA, 25 bp, Mus musculus
ggagctgaattcagaggtggcgagt

SEQ ID NO: 323050 - DNA, 25 bp, Mus musculus
ggagctgacagacagtatctgaaca

SEQ ID NO: 323051 - DNA, 25 bp, Mus musculus
ggagctgacagagcttttcttcatg

SEQ ID NO: 323052 - DNA, 25 bp, Mus musculus
ggagctgacagatgaggaaactgag

SEQ ID NO: 323053 - DNA, 25 bp, Mus musculus
ggagctgacaggcagtatctgaaca

SEQ ID NO: 323054 - DNA, 25 bp, Mus musculus
ggagctgacaggggttccacagcac

SEQ ID NO: 323055 - DNA, 25 bp, Mus musculus
ggagctgaccaaaccgggctccatg

SEQ ID NO: 323056 - DNA, 25 bp, Mus musculus
ggagctgaccggtctccctatgtag

SEQ ID NO: 323057 - DNA, 25 bp, Mus musculus
ggagctgagagttcttccagatgag

SEQ ID NO: 323058 - DNA, 25 bp, Mus musculus
ggagctgagcacggagcctggtgga

SEQ ID NO: 323059 - DNA, 25 bp, Mus musculus
ggagctgagggagacgcactacttc

SEQ ID NO: 323060 - DNA, 25 bp, Mus musculus
ggagctgatagaaacatctttctct

SEQ ID NO: 323061 - DNA, 25 bp, Mus musculus
ggagctgatcgatttgatctactgt

SEQ ID NO: 323062 - DNA, 25 bp, Mus musculus
ggagctgatgaggatcctcagctcc

SEQ ID NO: 323063 - DNA, 25 bp, Mus musculus
ggagctgatggaacacccattcttc

SEQ ID NO: 323064 - DNA, 25 bp, Mus musculus
ggagctgcacaagtcacgggtcaca

SEQ ID NO: 323065 - DNA, 25 bp, Mus musculus
ggagctgcacgtcaggacaaagtgg

SEQ ID NO: 323066 - DNA, 25 bp, Mus musculus
ggagctgcaggagaagaggaggaga

SEQ ID NO: 323067 - DNA, 25 bp, Mus musculus
ggagctgcagggatacaaactgcag

SEQ ID NO: 323068 - DNA, 25 bp, Mus musculus
ggagctgcagggcctgttgctcaag

SEQ ID NO: 323069 - DNA, 25 bp, Mus musculus
ggagctgcaggggctctgagacaga

SEQ ID NO: 323070 - DNA, 25 bp, Mus musculus
ggagctgcaggttcggggtgaaggg

SEQ ID NO: 323071 - DNA, 25 bp, Mus musculus
ggagctgccagaaaagcctttggct

SEQ ID NO: 323072 - DNA, 25 bp, Mus musculus
ggagctgccagcatttgacattgtg

SEQ ID NO: 323073 - DNA, 25 bp, Mus musculus
ggagctgccgccttcagggccgact

SEQ ID NO: 323074 - DNA, 25 bp, Mus musculus
ggagctgccttgccttactcagaca

SEQ ID NO: 323075 - DNA, 25 bp, Mus musculus
ggagctgcgagaatgtctgaagggg

SEQ ID NO: 323076 - DNA, 25 bp, Mus musculus
ggagctgcgagcagagggacctggg

SEQ ID NO: 323077 - DNA, 25 bp, Mus musculus
ggagctgcgaggactgatgacagag

SEQ ID NO: 323078 - DNA, 25 bp, Mus musculus
ggagctgcgagttacagaatgtctg

SEQ ID NO: 323079 - DNA, 25 bp, Mus musculus
ggagctgcgagttacagatttatca

SEQ ID NO: 323080 - DNA, 25 bp, Mus musculus
ggagctgctagccattctctgagga

SEQ ID NO: 323081 - DNA, 25 bp, Mus musculus
ggagctgctagcccttctctgagga

SEQ ID NO: 323082 - DNA, 25 bp, Mus musculus
ggagctgctccagagaatgacggac

SEQ ID NO: 323083 - DNA, 25 bp, Mus musculus
ggagctgctctggttgaaggtttga

SEQ ID NO: 323084 - DNA, 25 bp, Mus musculus
ggagctgctgacaggccgggtgacc

SEQ ID NO: 323085 - DNA, 25 bp, Mus musculus
ggagctgctgagatcttagcctcct

SEQ ID NO: 323086 - DNA, 25 bp, Mus musculus
ggagctgctgaggaacttgtatgaa

SEQ ID NO: 323087 - DNA, 25 bp, Mus musculus
ggagctgctgagggagctgaatctg

SEQ ID NO: 323088 - DNA, 25 bp, Mus musculus
ggagctgctgctcggagagcgggac

SEQ ID NO: 323089 - DNA, 25 bp, Mus musculus
ggagctgctgctggctttgaacatc

SEQ ID NO: 323090 - DNA, 25 bp, Mus musculus
ggagctgctggacatgctgctggtc

SEQ ID NO: 323091 - DNA, 25 bp, Mus musculus
ggagctgctggagtgggaactggta

SEQ ID NO: 323092 - DNA, 25 bp, Mus musculus
ggagctgctgggaagatgctaccaa

SEQ ID NO: 323093 - DNA, 25 bp, Mus musculus
ggagctgctgttccaggtgctgctg

SEQ ID NO: 323094 - DNA, 25 bp, Mus musculus
ggagctgctgttgctttcccctgtg

SEQ ID NO: 323095 - DNA, 25 bp, Mus musculus
ggagctgcttccctctttccatgaa

SEQ ID NO: 323096 - DNA, 25 bp, Mus musculus
ggagctgcttttaagtaacggcaca

SEQ ID NO: 323097 - DNA, 25 bp, Mus musculus
ggagctggaaggtcttgttgcagca

SEQ ID NO: 323098 - DNA, 25 bp, Mus musculus
ggagctggagagaaaaatatcagga

SEQ ID NO: 323099 - DNA, 25 bp, Mus musculus
ggagctggagaggaaagccatagag

SEQ ID NO: 323100 - DNA, 25 bp, Mus musculus
ggagctggaggaggtgcgctccaag

SEQ ID NO: 323101 - DNA, 25 bp, Mus musculus
ggagctggagggctaaaaccgactc

SEQ ID NO: 323102 - DNA, 25 bp, Mus musculus
ggagctggaggggaacctgatttga

SEQ ID NO: 323103 - DNA, 25 bp, Mus musculus
ggagctggaggttgcgagaacatgg

SEQ ID NO: 323104 - DNA, 25 bp, Mus musculus
ggagctggccaggactgccgcttcg

SEQ ID NO: 323105 - DNA, 25 bp, Mus musculus
ggagctggctgatagggtgggagag

SEQ ID NO: 323106 - DNA, 25 bp, Mus musculus
ggagctggctggaggcactttccca

SEQ ID NO: 323107 - DNA, 25 bp, Mus musculus
ggagctgggaagccctggcacaaaa

SEQ ID NO: 323108 - DNA, 25 bp, Mus musculus
ggagctgggacaggtggccctaaga

SEQ ID NO: 323109 - DNA, 25 bp, Mus musculus
ggagctgggacgagcggatacgggc

SEQ ID NO: 323110 - DNA, 25 bp, Mus musculus
ggagctgggaggcccagccagcaga

SEQ ID NO: 323111 - DNA, 25 bp, Mus musculus
ggagctgggccaggagctgaaggac

SEQ ID NO: 323112 - DNA, 25 bp, Mus musculus
ggagctgggctgcctgcctgcctgc

SEQ ID NO: 323113 - DNA, 25 bp, Mus musculus
ggagctgggtcaggtggccactcta

SEQ ID NO: 323114 - DNA, 25 bp, Mus musculus
ggagctggtcacaggagtcctttgg

SEQ ID NO: 323115 - DNA, 25 bp, Mus musculus
ggagctggtcacaggtgcccagcag

SEQ ID NO: 323116 - DNA, 25 bp, Mus musculus
ggagctggtccgagggctactgaca

SEQ ID NO: 323117 - DNA, 25 bp, Mus musculus
ggagctggttaagagaaaatccctg

SEQ ID NO: 323118 - DNA, 25 bp, Mus musculus
ggagctgtacaaggtgctgagttcc

SEQ ID NO: 323119 - DNA, 25 bp, Mus musculus
ggagctgtagatatggcataagata

SEQ ID NO: 323120 - DNA, 25 bp, Mus musculus
ggagctgtagctggcccatgagctt

SEQ ID NO: 323121 - DNA, 25 bp, Mus musculus
ggagctgtaggcaagagataacacc

SEQ ID NO: 323122 - DNA, 25 bp, Mus musculus
ggagctgtataaggtacatttgaag

SEQ ID NO: 323123 - DNA, 25 bp, Mus musculus
ggagctgtatgaggaagtaaagctc

SEQ ID NO: 323124 - DNA, 25 bp, Mus musculus
ggagctgtcaaggccctgtggacaa

SEQ ID NO: 323125 - DNA, 25 bp, Mus musculus
ggagctgtccaatgacgaagctgcg

SEQ ID NO: 323126 - DNA, 25 bp, Mus musculus
ggagctgtccaatttttggcctttg

SEQ ID NO: 323127 - DNA, 25 bp, Mus musculus
ggagctgtgaggaatgagttcctga

SEQ ID NO: 323128 - DNA, 25 bp, Mus musculus
ggagctgtgaggacagaaaataata

SEQ ID NO: 323129 - DNA, 25 bp, Mus musculus
ggagctgtggaagagtccctgattg

SEQ ID NO: 323130 - DNA, 25 bp, Mus musculus
ggagctgtgtagatgtcaatgagtg

SEQ ID NO: 323131 - DNA, 25 bp, Mus musculus
ggagctgtgtagttgtcaatgagtg

SEQ ID NO: 323132 - DNA, 25 bp, Mus musculus
ggagctgttcagagtaggtggcgat

SEQ ID NO: 323133 - DNA, 25 bp, Mus musculus
ggagctgttccagttacagattcat

SEQ ID NO: 323134 - DNA, 25 bp, Mus musculus
ggagctgttctgtatgcttcctgcg

SEQ ID NO: 323135 - DNA, 25 bp, Mus musculus
ggagctgttgtgatctcagttcacg

SEQ ID NO: 323136 - DNA, 25 bp, Mus musculus
ggagcttaacaggcaaacattctgc

SEQ ID NO: 323137 - DNA, 25 bp, Mus musculus
ggagcttaacagtttggaatggtca

SEQ ID NO: 323138 - DNA, 25 bp, Mus musculus
ggagcttacagacgggctgactcct

SEQ ID NO: 323139 - DNA, 25 bp, Mus musculus
ggagcttacagacgggctttgctgt

SEQ ID NO: 323140 - DNA, 25 bp, Mus musculus
ggagcttacgtagatgaagaacttc

SEQ ID NO: 323141 - DNA, 25 bp, Mus musculus
ggagcttacgtaggctccatggtgt

SEQ ID NO: 323142 - DNA, 25 bp, Mus musculus
ggagcttcagcaggcatccatcctg

SEQ ID NO: 323143 - DNA, 25 bp, Mus musculus
ggagcttcaggcacgcatcgaggag

SEQ ID NO: 323144 - DNA, 25 bp, Mus musculus
ggagcttcatgggaggatccaaagg

SEQ ID NO: 323145 - DNA, 25 bp, Mus musculus
ggagcttccgcaggcgccatggaaa

SEQ ID NO: 323146 - DNA, 25 bp, Mus musculus
ggagcttcctttgaggaggattctg

SEQ ID NO: 323147 - DNA, 25 bp, Mus musculus
ggagcttgaggcgggcagggagcta

SEQ ID NO: 323148 - DNA, 25 bp, Mus musculus
ggagcttgatgcagaatccaaatcc

SEQ ID NO: 323149 - DNA, 25 bp, Mus musculus
ggagcttgatgcagctgtggcagaa

SEQ ID NO: 323150 - DNA, 25 bp, Mus musculus
ggagcttgcaggaataacagaagcc

SEQ ID NO: 323151 - DNA, 25 bp, Mus musculus
ggagcttgctaatgacggtgcaggc

SEQ ID NO: 323152 - DNA, 25 bp, Mus musculus
ggagcttgtgcagccacgacccacc

SEQ ID NO: 323153 - DNA, 25 bp, Mus musculus
ggagcttgtgcaggtgacagcagca

SEQ ID NO: 323154 - DNA, 25 bp, Mus musculus
ggagctttcccatcagaaaccaact

SEQ ID NO: 323155 - DNA, 25 bp, Mus musculus
ggagctttgaagatgggaaacctgt

SEQ ID NO: 323156 - DNA, 25 bp, Mus musculus
ggagctttgaagttgggaaacctgt

SEQ ID NO: 323157 - DNA, 25 bp, Mus musculus
ggagctttgaatcgggaggaagcac

SEQ ID NO: 323158 - DNA, 25 bp, Mus musculus
ggagctttgagatgggtaacctttt

SEQ ID NO: 323159 - DNA, 25 bp, Mus musculus
ggagctttgagatggtctgctttac

SEQ ID NO: 323160 - DNA, 25 bp, Mus musculus
ggagctttgaggaaagatcaaactc

SEQ ID NO: 323161 - DNA, 25 bp, Mus musculus
ggagctttgaggaagttatcaacat

SEQ ID NO: 323162 - DNA, 25 bp, Mus musculus
ggagctttgaggacctcatggaacc

SEQ ID NO: 323163 - DNA, 25 bp, Mus musculus
ggagctttgagttgctggttgttgg

SEQ ID NO: 323164 - DNA, 25 bp, Mus musculus
ggagctttgatgctgcattccgtgg

SEQ ID NO: 323165 - DNA, 25 bp, Mus musculus
ggagctttgccaggaatctggtctg

SEQ ID NO: 323166 - DNA, 25 bp, Mus musculus
ggagctttgttttttgccatctctg

SEQ ID NO: 323167 - DNA, 25 bp, Mus musculus
ggagcttttaaaaattgttgcttcc

SEQ ID NO: 323168 - DNA, 25 bp, Mus musculus
ggagcttttcagcacctttggggaa

SEQ ID NO: 323169 - DNA, 25 bp, Mus musculus
ggagcttttgcaggtggctttgcag

SEQ ID NO: 323170 - DNA, 25 bp, Mus musculus
ggagcttttgcggtttgtagtgcat

SEQ ID NO: 323171 - DNA, 25 bp, Mus musculus
ggagcttttgcgttcagttcggtgg

SEQ ID NO: 323172 - DNA, 25 bp, Mus musculus
ggaggaaaaagctcgccacccccat

SEQ ID NO: 323173 - DNA, 25 bp, Mus musculus
ggaggaaaagaaagctgttcagagc

SEQ ID NO: 323174 - DNA, 25 bp, Mus musculus
ggaggaaaagaaagtctgccaaggc

SEQ ID NO: 323175 - DNA, 25 bp, Mus musculus
ggaggaaaaggaggagtcagacaca

SEQ ID NO: 323176 - DNA, 25 bp, Mus musculus
ggaggaaaatctgaatgaggtgtat

SEQ ID NO: 323177 - DNA, 25 bp, Mus musculus
ggaggaaaatgggatggagacaaca

SEQ ID NO: 323178 - DNA, 25 bp, Mus musculus
ggaggaaaatggtgaggaggttgga

SEQ ID NO: 323179 - DNA, 25 bp, Mus musculus
ggaggaaacacaagagcaggcaagg

SEQ ID NO: 323180 - DNA, 25 bp, Mus musculus
ggaggaaaccaggaatgggccttga

SEQ ID NO: 323181 - DNA, 25 bp, Mus musculus
ggaggaaagcctcagaaaccttgat

SEQ ID NO: 323182 - DNA, 25 bp, Mus musculus
ggaggaaagcctcagagccttttca

SEQ ID NO: 323183 - DNA, 25 bp, Mus musculus
ggaggaaatcaatcgcaagcaggac

SEQ ID NO: 323184 - DNA, 25 bp, Mus musculus
ggaggaaatggaggcaagaagacag

SEQ ID NO: 323185 - DNA, 25 bp, Mus musculus
ggaggaaattcatagtgaccatctt

SEQ ID NO: 323186 - DNA, 25 bp, Mus musculus
ggaggaacaaaacagattaatagag

SEQ ID NO: 323187 - DNA, 25 bp, Mus musculus
ggaggaacaaaacaggcattggcag

SEQ ID NO: 323188 - DNA, 25 bp, Mus musculus
ggaggaacacagagttcagaaagaa

SEQ ID NO: 323189 - DNA, 25 bp, Mus musculus
ggaggaacacaggattgagctgacc

SEQ ID NO: 323190 - DNA, 25 bp, Mus musculus
ggaggaacagagaagctcccgtccg

SEQ ID NO: 323191 - DNA, 25 bp, Mus musculus
ggaggaacagctgggccctgtctca

SEQ ID NO: 323192 - DNA, 25 bp, Mus musculus
ggaggaaccctgaaggatgatgact

SEQ ID NO: 323193 - DNA, 25 bp, Mus musculus
ggaggaactcccaggctatgaagag

SEQ ID NO: 323194 - DNA, 25 bp, Mus musculus
ggaggaactgagaagacattttcac

SEQ ID NO: 323195 - DNA, 25 bp, Mus musculus
ggaggaacttaaggtgagggtggaa

SEQ ID NO: 323196 - DNA, 25 bp, Mus musculus
ggaggaagaaaagcactgcccctcg

SEQ ID NO: 323197 - DNA, 25 bp, Mus musculus
ggaggaagaaaagtggccctgtctc

SEQ ID NO: 323198 - DNA, 25 bp, Mus musculus
ggaggaagaagacagatgagcttcc

SEQ ID NO: 323199 - DNA, 25 bp, Mus musculus
ggaggaagaagacaggacaggaagc

SEQ ID NO: 323200 - DNA, 25 bp, Mus musculus
ggaggaagaagacagttcaaaagac

SEQ ID NO: 323201 - DNA, 25 bp, Mus musculus
ggaggaagacagggttccagtgatc

SEQ ID NO: 323202 - DNA, 25 bp, Mus musculus
ggaggaagagagacgggtccagtga

SEQ ID NO: 323203 - DNA, 25 bp, Mus musculus
ggaggaagagcaaagaaatctgcag

SEQ ID NO: 323204 - DNA, 25 bp, Mus musculus
ggaggaagaggctcacgaggccctg

SEQ ID NO: 323205 - DNA, 25 bp, Mus musculus
ggaggaagagggctgcctctgaaga

SEQ ID NO: 323206 - DNA, 25 bp, Mus musculus
ggaggaagagttaacactcacgatc

SEQ ID NO: 323207 - DNA, 25 bp, Mus musculus
ggaggaagatgaccgttcacctgca

SEQ ID NO: 323208 - DNA, 25 bp, Mus musculus
ggaggaagcacagaccagaagcccc

SEQ ID NO: 323209 - DNA, 25 bp, Mus musculus
ggaggaagcacagctctggatgggt

SEQ ID NO: 323210 - DNA, 25 bp, Mus musculus
ggaggaagcagagggctgagccccc

SEQ ID NO: 323211 - DNA, 25 bp, Mus musculus
ggaggaagccaagaagaagctggct

SEQ ID NO: 323212 - DNA, 25 bp, Mus musculus
ggaggaagctgtccatggctgggga

SEQ ID NO: 323213 - DNA, 25 bp, Mus musculus
ggaggaaggcaaggccaagaacgcc

SEQ ID NO: 323214 - DNA, 25 bp, Mus musculus
ggaggaagtccggcagtaggacagt

SEQ ID NO: 323215 - DNA, 25 bp, Mus musculus
ggaggaagtggagggactgaacttt

SEQ ID NO: 323216 - DNA, 25 bp, Mus musculus
ggaggaatggtcatgatggtaccag

SEQ ID NO: 323217 - DNA, 25 bp, Mus musculus
ggaggacaaagaaatggtccttctc

SEQ ID NO: 323218 - DNA, 25 bp, Mus musculus
ggaggacaaaggctatgtgcttcac

SEQ ID NO: 323219 - DNA, 25 bp, Mus musculus
ggaggacaaaggggagacaccattg

SEQ ID NO: 323220 - DNA, 25 bp, Mus musculus
ggaggacaaaggtcaagcaggtaga

SEQ ID NO: 323221 - DNA, 25 bp, Mus musculus
ggaggacaagagcaacagtaccatt

SEQ ID NO: 323222 - DNA, 25 bp, Mus musculus
ggaggacaagattaggaatcagtgg

SEQ ID NO: 323223 - DNA, 25 bp, Mus musculus
ggaggacaaggagcgccatgaagct

SEQ ID NO: 323224 - DNA, 25 bp, Mus musculus
ggaggacaagggaccgtcacgacgg

SEQ ID NO: 323225 - DNA, 25 bp, Mus musculus
ggaggacaagggcaggattctggga

SEQ ID NO: 323226 - DNA, 25 bp, Mus musculus
ggaggacaaggtgactgcaaagggc

SEQ ID NO: 323227 - DNA, 25 bp, Mus musculus
ggaggacaataaggagaagaagaag

SEQ ID NO: 323228 - DNA, 25 bp, Mus musculus
ggaggacaatgtctgttctgagtac

SEQ ID NO: 323229 - DNA, 25 bp, Mus musculus
ggaggacaatgttttgatgagtggt

SEQ ID NO: 323230 - DNA, 25 bp, Mus musculus
ggaggacacagattccttctggaac

SEQ ID NO: 323231 - DNA, 25 bp, Mus musculus
ggaggacactcaagtggctgatgtg

SEQ ID NO: 323232 - DNA, 25 bp, Mus musculus
ggaggacactgaactcctacctgga

SEQ ID NO: 323233 - DNA, 25 bp, Mus musculus
ggaggacactggtgttagaaatgaa

SEQ ID NO: 323234 - DNA, 25 bp, Mus musculus
ggaggacagagggataagaaaaata

SEQ ID NO: 323235 - DNA, 25 bp, Mus musculus
ggaggacagcagtaccagcgctgaa

SEQ ID NO: 323236 - DNA, 25 bp, Mus musculus
ggaggacagctcaatcgagctggga

SEQ ID NO: 323237 - DNA, 25 bp, Mus musculus
ggaggacagctcagctgttgaatca

SEQ ID NO: 323238 - DNA, 25 bp, Mus musculus
ggaggacaggaaagattgttttctg

SEQ ID NO: 323239 - DNA, 25 bp, Mus musculus
ggaggacaggaaagcccatgttacc

SEQ ID NO: 323240 - DNA, 25 bp, Mus musculus
ggaggacaggaaagggcactgtgga

SEQ ID NO: 323241 - DNA, 25 bp, Mus musculus
ggaggacaggaaaggtgtactcggg

SEQ ID NO: 323242 - DNA, 25 bp, Mus musculus
ggaggacaggaattgtttgttcctt

SEQ ID NO: 323243 - DNA, 25 bp, Mus musculus
ggaggacatgaccccctgcccggcg

SEQ ID NO: 323244 - DNA, 25 bp, Mus musculus
ggaggacatgacccggtctcaaggg

SEQ ID NO: 323245 - DNA, 25 bp, Mus musculus
ggaggaccagcatttaagaagacca

SEQ ID NO: 323246 - DNA, 25 bp, Mus musculus
ggaggaccaggagggcactccttgc

SEQ ID NO: 323247 - DNA, 25 bp, Mus musculus
ggaggaccctggggtcaagagtgtc

SEQ ID NO: 323248 - DNA, 25 bp, Mus musculus
ggaggacctgcaggctgtgtggaga

SEQ ID NO: 323249 - DNA, 25 bp, Mus musculus
ggaggacctggaggaaattatggaa

SEQ ID NO: 323250 - DNA, 25 bp, Mus musculus
ggaggacctggaggtggcaattttg

SEQ ID NO: 323251 - DNA, 25 bp, Mus musculus
ggaggacgaggaagaggagaaacca

SEQ ID NO: 323252 - DNA, 25 bp, Mus musculus
ggaggacgaggtgctgctggtgagt

SEQ ID NO: 323253 - DNA, 25 bp, Mus musculus
ggaggacgcgatagttctgacacaa

SEQ ID NO: 323254 - DNA, 25 bp, Mus musculus
ggaggacgctgccggccatcgtcgt

SEQ ID NO: 323255 - DNA, 25 bp, Mus musculus
ggaggacgctgccgggtctcttcca

SEQ ID NO: 323256 - DNA, 25 bp, Mus musculus
ggaggacggcatgccccccatcaac

SEQ ID NO: 323257 - DNA, 25 bp, Mus musculus
ggaggacggcatggagccgttggta

SEQ ID NO: 323258 - DNA, 25 bp, Mus musculus
ggaggacggcatgggctcaagcccc

SEQ ID NO: 323259 - DNA, 25 bp, Mus musculus
ggaggacggggcttggcagagatgg

SEQ ID NO: 323260 - DNA, 25 bp, Mus musculus
ggaggacggggcttgtgtgttgcat

SEQ ID NO: 323261 - DNA, 25 bp, Mus musculus
ggaggacgtttgagcgaatctcatt

SEQ ID NO: 323262 - DNA, 25 bp, Mus musculus
ggaggactacaaacagtactttgtg

SEQ ID NO: 323263 - DNA, 25 bp, Mus musculus
ggaggactatggcgtttactggccc

SEQ ID NO: 323264 - DNA, 25 bp, Mus musculus
ggaggactatggggtcacatatgac

SEQ ID NO: 323265 - DNA, 25 bp, Mus musculus
ggaggactgaatagttgcagtaagg

SEQ ID NO: 323266 - DNA, 25 bp, Mus musculus
ggaggactgaggggggtccgcctac

SEQ ID NO: 323267 - DNA, 25 bp, Mus musculus
ggaggactgagtcagccaaggtagc

SEQ ID NO: 323268 - DNA, 25 bp, Mus musculus
ggaggactgtcctttcccatggccg

SEQ ID NO: 323269 - DNA, 25 bp, Mus musculus
ggaggactgtgtgggtgaaagccgg

SEQ ID NO: 323270 - DNA, 25 bp, Mus musculus
ggaggacttcaggtatccgtggtca

SEQ ID NO: 323271 - DNA, 25 bp, Mus musculus
ggaggacttcagtgtgtctccaggc

SEQ ID NO: 323272 - DNA, 25 bp, Mus musculus
ggaggactttgccaggcgctgtgct

SEQ ID NO: 323273 - DNA, 25 bp, Mus musculus
ggaggagaaagagggtggagaggtc

SEQ ID NO: 323274 - DNA, 25 bp, Mus musculus
ggaggagaagcagagcggaattcct

SEQ ID NO: 323275 - DNA, 25 bp, Mus musculus
ggaggagaaggaactatcccctcaa

SEQ ID NO: 323276 - DNA, 25 bp, Mus musculus
ggaggagaaggtcctgttgagtcag

SEQ ID NO: 323277 - DNA, 25 bp, Mus musculus
ggaggagaagtctggacagaggatc

SEQ ID NO: 323278 - DNA, 25 bp, Mus musculus
ggaggagaatttaaaagaagatgga

SEQ ID NO: 323279 - DNA, 25 bp, Mus musculus
ggaggagacagacaccatccaacac

SEQ ID NO: 323280 - DNA, 25 bp, Mus musculus
ggaggagacagatgtgaggtgagat

SEQ ID NO: 323281 - DNA, 25 bp, Mus musculus
ggaggagacaggaaggcgtagggaa

SEQ ID NO: 323282 - DNA, 25 bp, Mus musculus
ggaggagacggtggtgaccatgaaa

SEQ ID NO: 323283 - DNA, 25 bp, Mus musculus
ggaggagacttcaggctccaggatg

SEQ ID NO: 323284 - DNA, 25 bp, Mus musculus
ggaggagagacaaggcaagaaatac

SEQ ID NO: 323285 - DNA, 25 bp, Mus musculus
ggaggagagacaaggggatgacaat

SEQ ID NO: 323286 - DNA, 25 bp, Mus musculus
ggaggagagagaatgactctgtggt

SEQ ID NO: 323287 - DNA, 25 bp, Mus musculus
ggaggagagaggtacaatttcttca

SEQ ID NO: 323288 - DNA, 25 bp, Mus musculus
ggaggagagcaattatgaagccctt

SEQ ID NO: 323289 - DNA, 25 bp, Mus musculus
ggaggagagctgaggcacctccaag

SEQ ID NO: 323290 - DNA, 25 bp, Mus musculus
ggaggagatattggtccttcattcc

SEQ ID NO: 323291 - DNA, 25 bp, Mus musculus
ggaggagatccaggagtggtacgag

SEQ ID NO: 323292 - DNA, 25 bp, Mus musculus
ggaggagatggacgtggatgagtgc

SEQ ID NO: 323293 - DNA, 25 bp, Mus musculus
ggaggagatggagcacgccccagag

SEQ ID NO: 323294 - DNA, 25 bp, Mus musculus
ggaggagcaaacggaagcgagaaaa

SEQ ID NO: 323295 - DNA, 25 bp, Mus musculus
ggaggagcagaattttctacagaat

SEQ ID NO: 323296 - DNA, 25 bp, Mus musculus
ggaggagcagacgggcagcgggcaa

SEQ ID NO: 323297 - DNA, 25 bp, Mus musculus
ggaggagcagatattcagtgaactg

SEQ ID NO: 323298 - DNA, 25 bp, Mus musculus
ggaggagcaggatatcctcactctc

SEQ ID NO: 323299 - DNA, 25 bp, Mus musculus
ggaggagcagtgccctcagccagca

SEQ ID NO: 323300 - DNA, 25 bp, Mus musculus
ggaggagccaccaggttgacagaca

SEQ ID NO: 323301 - DNA, 25 bp, Mus musculus
ggaggagcccctcggatgttctcta

SEQ ID NO: 323302 - DNA, 25 bp, Mus musculus
ggaggagccggagccgttggtattt

SEQ ID NO: 323303 - DNA, 25 bp, Mus musculus
ggaggagctaaagatccttcgtacc

SEQ ID NO: 323304 - DNA, 25 bp, Mus musculus
ggaggagctaaagttctccctgggc

SEQ ID NO: 323305 - DNA, 25 bp, Mus musculus
ggaggagctagagaactacatggac

SEQ ID NO: 323306 - DNA, 25 bp, Mus musculus
ggaggagctctgggaacctcctctg

SEQ ID NO: 323307 - DNA, 25 bp, Mus musculus
ggaggagctctggggcccagcaacc

SEQ ID NO: 323308 - DNA, 25 bp, Mus musculus
ggaggagctgaattttctgaagaga

SEQ ID NO: 323309 - DNA, 25 bp, Mus musculus
ggaggagctgacagatgaggaaact

SEQ ID NO: 323310 - DNA, 25 bp, Mus musculus
ggaggagctggagcacagccaggac

SEQ ID NO: 323311 - DNA, 25 bp, Mus musculus
ggaggagctgggctttgactacggt

SEQ ID NO: 323312 - DNA, 25 bp, Mus musculus
ggaggagctgggtccatattgtggg

SEQ ID NO: 323313 - DNA, 25 bp, Mus musculus
ggaggagctgggtgatggctgtggg

SEQ ID NO: 323314 - DNA, 25 bp, Mus musculus
ggaggagctgttttctgaagagata

SEQ ID NO: 323315 - DNA, 25 bp, Mus musculus
ggaggagcttaacaggcaaacattc

SEQ ID NO: 323316 - DNA, 25 bp, Mus musculus
ggaggagcttaacagtttggaatgg

SEQ ID NO: 323317 - DNA, 25 bp, Mus musculus
ggaggagcttgaggcgggcagggag

SEQ ID NO: 323318 - DNA, 25 bp, Mus musculus
ggaggaggaaaagccgcacatgcct

SEQ ID NO: 323319 - DNA, 25 bp, Mus musculus
ggaggaggaaaaggcatgaggatcg

SEQ ID NO: 323320 - DNA, 25 bp, Mus musculus
ggaggaggaacacagagttcagaaa

SEQ ID NO: 323321 - DNA, 25 bp, Mus musculus
ggaggaggaacacaggattgagctg

SEQ ID NO: 323322 - DNA, 25 bp, Mus musculus
ggaggaggaagaggctcacgaggcc

SEQ ID NO: 323323 - DNA, 25 bp, Mus musculus
ggaggaggacaaggagcgccatgaa

SEQ ID NO: 323324 - DNA, 25 bp, Mus musculus
ggaggaggacactgaactcctacct

SEQ ID NO: 323325 - DNA, 25 bp, Mus musculus
ggaggaggagacagatgtgaggtga

SEQ ID NO: 323326 - DNA, 25 bp, Mus musculus
ggaggaggagacaggaaggcgtagg

SEQ ID NO: 323327 - DNA, 25 bp, Mus musculus
ggaggaggagagtataaaggagggg

SEQ ID NO: 323328 - DNA, 25 bp, Mus musculus
ggaggaggagccggagccgttggta

SEQ ID NO: 323329 - DNA, 25 bp, Mus musculus
ggaggaggagctgcagttctccctg

SEQ ID NO: 323330 - DNA, 25 bp, Mus musculus
ggaggaggaggaggaggctccgccc

SEQ ID NO: 323331 - DNA, 25 bp, Mus musculus
ggaggaggaggaggagtaggaggaa

SEQ ID NO: 323332 - DNA, 25 bp, Mus musculus
ggaggaggaggaggctccgccccca

SEQ ID NO: 323333 - DNA, 25 bp, Mus musculus
ggaggaggagggcagaaggctggag

SEQ ID NO: 323334 - DNA, 25 bp, Mus musculus
ggaggaggagtcaagttggacccac

SEQ ID NO: 323335 - DNA, 25 bp, Mus musculus
ggaggaggagtcagatgatctagca

SEQ ID NO: 323336 - DNA, 25 bp, Mus musculus
ggaggaggagtcagtgcaagggcca

SEQ ID NO: 323337 - DNA, 25 bp, Mus musculus
ggaggaggatggcttccgccttttc

SEQ ID NO: 323338 - DNA, 25 bp, Mus musculus
ggaggaggcagaagcctcacaggcc

SEQ ID NO: 323339 - DNA, 25 bp, Mus musculus
ggaggaggcagagcgcccgctgcac

SEQ ID NO: 323340 - DNA, 25 bp, Mus musculus
ggaggaggcagagggaagacttgcc

SEQ ID NO: 323341 - DNA, 25 bp, Mus musculus
ggaggaggccgaagaagcacttaaa

SEQ ID NO: 323342 - DNA, 25 bp, Mus musculus
ggaggaggccgccaggctggctcag

SEQ ID NO: 323343 - DNA, 25 bp, Mus musculus
ggaggaggccgccaggttcacggct

SEQ ID NO: 323344 - DNA, 25 bp, Mus musculus
ggaggaggccgggccaaagtagaga

SEQ ID NO: 323345 - DNA, 25 bp, Mus musculus
ggaggaggccgggtccagatagtat

SEQ ID NO: 323346 - DNA, 25 bp, Mus musculus
ggaggaggccgggttcagattcaga

SEQ ID NO: 323347 - DNA, 25 bp, Mus musculus
ggaggaggcgcgggctgtggaggag

SEQ ID NO: 323348 - DNA, 25 bp, Mus musculus
ggaggaggcggacgagcaaaaatca

SEQ ID NO: 323349 - DNA, 25 bp, Mus musculus
ggaggaggctgagatccagccgcag

SEQ ID NO: 323350 - DNA, 25 bp, Mus musculus
ggaggagggaagatcctccctcatc

SEQ ID NO: 323351 - DNA, 25 bp, Mus musculus
ggaggagggaaggacaggcctggca

SEQ ID NO: 323352 - DNA, 25 bp, Mus musculus
ggaggagggaaggggctggaaagtg

SEQ ID NO: 323353 - DNA, 25 bp, Mus musculus
ggaggagggagatggaaaagacatc

SEQ ID NO: 323354 - DNA, 25 bp, Mus musculus
ggaggagggcagcagaaccagacat

SEQ ID NO: 323355 - DNA, 25 bp, Mus musculus
ggaggagggcaggaatcccagccat

SEQ ID NO: 323356 - DNA, 25 bp, Mus musculus
ggaggagggggaggccgctcacgat

SEQ ID NO: 323357 - DNA, 25 bp, Mus musculus
ggaggaggggtggcggctcctccag

SEQ ID NO: 323358 - DNA, 25 bp, Mus musculus
ggaggaggtcaaggccaagaacgcg

SEQ ID NO: 323359 - DNA, 25 bp, Mus musculus
ggaggaggtcagaagattttgttga

SEQ ID NO: 323360 - DNA, 25 bp, Mus musculus
ggaggaggtcagaaggtgtgttata

SEQ ID NO: 323361 - DNA, 25 bp, Mus musculus
ggaggagtaagacgtcgcctcatct

SEQ ID NO: 323362 - DNA, 25 bp, Mus musculus
ggaggagtacgaggaggaacaggaa

SEQ ID NO: 323363 - DNA, 25 bp, Mus musculus
ggaggagtatggcagactgcacggg

SEQ ID NO: 323364 - DNA, 25 bp, Mus musculus
ggaggagtcagatgatctagcacta

SEQ ID NO: 323365 - DNA, 25 bp, Mus musculus
ggaggagtcagtgcaagggccatca

SEQ ID NO: 323366 - DNA, 25 bp, Mus musculus
ggaggagtgcgcccgggagaaggaa

SEQ ID NO: 323367 - DNA, 25 bp, Mus musculus
ggaggagtggagacgtcggatgcgc

SEQ ID NO: 323368 - DNA, 25 bp, Mus musculus
ggaggagtgggatcgagtgggatgg

SEQ ID NO: 323369 - DNA, 25 bp, Mus musculus
ggaggagttcaacatagactacacg

SEQ ID NO: 323370 - DNA, 25 bp, Mus musculus
ggaggagttcaaggacgacagccat

SEQ ID NO: 323371 - DNA, 25 bp, Mus musculus
ggaggagttgagttaaaagaagatg

SEQ ID NO: 323372 - DNA, 25 bp, Mus musculus
ggaggataaaaagaaacggcggctg

SEQ ID NO: 323373 - DNA, 25 bp, Mus musculus
ggaggatacgtcctctgccagagga

SEQ ID NO: 323374 - DNA, 25 bp, Mus musculus
ggaggatagaaccatcaggctgcag

SEQ ID NO: 323375 - DNA, 25 bp, Mus musculus
ggaggatagaaccgtgcgattgcaa

SEQ ID NO: 323376 - DNA, 25 bp, Mus musculus
ggaggatagagcagctcagtcctcc

SEQ ID NO: 323377 - DNA, 25 bp, Mus musculus
ggaggatcaagacgaaactgcagca

SEQ ID NO: 323378 - DNA, 25 bp, Mus musculus
ggaggatcaagagttgaaagcgctg

SEQ ID NO: 323379 - DNA, 25 bp, Mus musculus
ggaggatcaaggaactgcattggga

SEQ ID NO: 323380 - DNA, 25 bp, Mus musculus
ggaggatcagacactgacaaagcaa

SEQ ID NO: 323381 - DNA, 25 bp, Mus musculus
ggaggatcagacactggcactggtg

SEQ ID NO: 323382 - DNA, 25 bp, Mus musculus
ggaggatcagacatggtctcaccat

SEQ ID NO: 323383 - DNA, 25 bp, Mus musculus
ggaggatcagttggcaaagctccga

SEQ ID NO: 323384 - DNA, 25 bp, Mus musculus
ggaggatcctccaggtggccacggt

SEQ ID NO: 323385 - DNA, 25 bp, Mus musculus
ggaggatcctccaggtggctttgct

SEQ ID NO: 323386 - DNA, 25 bp, Mus musculus
ggaggatctcttggccagagaacag

SEQ ID NO: 323387 - DNA, 25 bp, Mus musculus
ggaggatctcttggtaggccaggaa

SEQ ID NO: 323388 - DNA, 25 bp, Mus musculus
ggaggatctggaaagagaacttgaa

SEQ ID NO: 323389 - DNA, 25 bp, Mus musculus
ggaggatgaagccaggtaattcaga

SEQ ID NO: 323390 - DNA, 25 bp, Mus musculus
ggaggatgaaggccattcaaactcc

SEQ ID NO: 323391 - DNA, 25 bp, Mus musculus
ggaggatgaagggaaaatgtttata

SEQ ID NO: 323392 - DNA, 25 bp, Mus musculus
ggaggatgaggaagctctgtgaagt

SEQ ID NO: 323393 - DNA, 25 bp, Mus musculus
ggaggatgaggatggtgggcattgg

SEQ ID NO: 323394 - DNA, 25 bp, Mus musculus
ggaggatgaggattttgattgggtc

SEQ ID NO: 323395 - DNA, 25 bp, Mus musculus
ggaggatgcgctgaggcccagtata

SEQ ID NO: 323396 - DNA, 25 bp, Mus musculus
ggaggatggatcagacagaaagtgt

SEQ ID NO: 323397 - DNA, 25 bp, Mus musculus
ggaggatggcagctcagctgttctg

SEQ ID NO: 323398 - DNA, 25 bp, Mus musculus
ggaggatggcagggccaggttgctt

SEQ ID NO: 323399 - DNA, 25 bp, Mus musculus
ggaggatgggctaggaaatcaagca

SEQ ID NO: 323400 - DNA, 25 bp, Mus musculus
ggaggatgtggagctggaccagatc

SEQ ID NO: 323401 - DNA, 25 bp, Mus musculus
ggaggattactgtccagtttgatgt

SEQ ID NO: 323402 - DNA, 25 bp, Mus musculus
ggaggattcacgtatgggacccagg

SEQ ID NO: 323403 - DNA, 25 bp, Mus musculus
ggaggattccagtgtgacctgctgt

SEQ ID NO: 323404 - DNA, 25 bp, Mus musculus
ggaggattccagtgtgtgtttcctg

SEQ ID NO: 323405 - DNA, 25 bp, Mus musculus
ggaggattgtgacctgcctgttcac

SEQ ID NO: 323406 - DNA, 25 bp, Mus musculus
ggaggatttgaggcctacctaggac

SEQ ID NO: 323407 - DNA, 25 bp, Mus musculus
ggaggatttgagttttaagctataa

SEQ ID NO: 323408 - DNA, 25 bp, Mus musculus
ggaggattttctcagggaggcgcct

SEQ ID NO: 323409 - DNA, 25 bp, Mus musculus
ggaggattttctcaggggccgatca

SEQ ID NO: 323410 - DNA, 25 bp, Mus musculus
ggaggcaaagatttttatcaccgtg

SEQ ID NO: 323411 - DNA, 25 bp, Mus musculus
ggaggcaaagccggctccagccaca

SEQ ID NO: 323412 - DNA, 25 bp, Mus musculus
ggaggcaaagcgtagaatgagaaga

SEQ ID NO: 323413 - DNA, 25 bp, Mus musculus
ggaggcaaagcgtagcttcatacta

SEQ ID NO: 323414 - DNA, 25 bp, Mus musculus
ggaggcaaagcgtagcttgaagtca

SEQ ID NO: 323415 - DNA, 25 bp, Mus musculus
ggaggcaaatatctgaaagattttc

SEQ ID NO: 323416 - DNA, 25 bp, Mus musculus
ggaggcaagatgcctttgcggggcc

SEQ ID NO: 323417 - DNA, 25 bp, Mus musculus
ggaggcaaggaagacatacatgggc

SEQ ID NO: 323418 - DNA, 25 bp, Mus musculus
ggaggcaaggagaggtacaaaatga

SEQ ID NO: 323419 - DNA, 25 bp, Mus musculus
ggaggcaaggcaagaggaagaatac

SEQ ID NO: 323420 - DNA, 25 bp, Mus musculus
ggaggcaaggcaagtacccagtgga

SEQ ID NO: 323421 - DNA, 25 bp, Mus musculus
ggaggcacagaaccaaaggacacag

SEQ ID NO: 323422 - DNA, 25 bp, Mus musculus
ggaggcacagtggagttaccctgca

SEQ ID NO: 323423 - DNA, 25 bp, Mus musculus
ggaggcacggagcacttgtctctgc

SEQ ID NO: 323424 - DNA, 25 bp, Mus musculus
ggaggcagaaagaattgcctatcag

SEQ ID NO: 323425 - DNA, 25 bp, Mus musculus
ggaggcagaagcctcacaggcctct

SEQ ID NO: 323426 - DNA, 25 bp, Mus musculus
ggaggcagagagtgctacaataacc

SEQ ID NO: 323427 - DNA, 25 bp, Mus musculus
ggaggcagagcctggatttatcgaa

SEQ ID NO: 323428 - DNA, 25 bp, Mus musculus
ggaggcagagcctggtgctgatggg

SEQ ID NO: 323429 - DNA, 25 bp, Mus musculus
ggaggcagaggaggtagaggaggct

SEQ ID NO: 323430 - DNA, 25 bp, Mus musculus
ggaggcagagggaagacttgccagc

SEQ ID NO: 323431 - DNA, 25 bp, Mus musculus
ggaggcagaggtaagaaagtgctca

SEQ ID NO: 323432 - DNA, 25 bp, Mus musculus
ggaggcagaggtccctggctgcatc

SEQ ID NO: 323433 - DNA, 25 bp, Mus musculus
ggaggcagcctaagggaggaatttg

SEQ ID NO: 323434 - DNA, 25 bp, Mus musculus
ggaggcagcgcaactacagggctgc

SEQ ID NO: 323435 - DNA, 25 bp, Mus musculus
ggaggcagcgcaactgctgcaggct

SEQ ID NO: 323436 - DNA, 25 bp, Mus musculus
ggaggcaggctgccccagcagttgt

SEQ ID NO: 323437 - DNA, 25 bp, Mus musculus
ggaggcagtaggacttagaagagtt

SEQ ID NO: 323438 - DNA, 25 bp, Mus musculus
ggaggcagtcttggattacctgttg

SEQ ID NO: 323439 - DNA, 25 bp, Mus musculus
ggaggcagtggcgagactgaaacag

SEQ ID NO: 323440 - DNA, 25 bp, Mus musculus
ggaggcagtggcgaggagtccgctc

SEQ ID NO: 323441 - DNA, 25 bp, Mus musculus
ggaggcagtggcgaggtgagccatg

SEQ ID NO: 323442 - DNA, 25 bp, Mus musculus
ggaggcatagctggtctgaagagcc

SEQ ID NO: 323443 - DNA, 25 bp, Mus musculus
ggaggccaaccgctatggattacag

SEQ ID NO: 323444 - DNA, 25 bp, Mus musculus
ggaggccaagcaggtgcaggcccag

SEQ ID NO: 323445 - DNA, 25 bp, Mus musculus
ggaggccaagcctttcatcacctat

SEQ ID NO: 323446 - DNA, 25 bp, Mus musculus
ggaggccaagctatggtccttccca

SEQ ID NO: 323447 - DNA, 25 bp, Mus musculus
ggaggccaagctatgtttttgagga

SEQ ID NO: 323448 - DNA, 25 bp, Mus musculus
ggaggccaagggagaagcaagccag

SEQ ID NO: 323449 - DNA, 25 bp, Mus musculus
ggaggccaaggggagtggagtaagg

SEQ ID NO: 323450 - DNA, 25 bp, Mus musculus
ggaggccacaagatatcagtattac

SEQ ID NO: 323451 - DNA, 25 bp, Mus musculus
ggaggccacaagcctacttggagga

SEQ ID NO: 323452 - DNA, 25 bp, Mus musculus
ggaggccacagcaggtttccactgt

SEQ ID NO: 323453 - DNA, 25 bp, Mus musculus
ggaggccagcggggctggcgctgtg

SEQ ID NO: 323454 - DNA, 25 bp, Mus musculus
ggaggccagcgggggctggcttaca

SEQ ID NO: 323455 - DNA, 25 bp, Mus musculus
ggaggccaggattgataagtatctg

SEQ ID NO: 323456 - DNA, 25 bp, Mus musculus
ggaggccaggctttttgatcacgtc

SEQ ID NO: 323457 - DNA, 25 bp, Mus musculus
ggaggccaggtgagaaatgtctcag

SEQ ID NO: 323458 - DNA, 25 bp, Mus musculus
ggaggccagttcctgagggcagtgg

SEQ ID NO: 323459 - DNA, 25 bp, Mus musculus
ggaggccatgaaaggaccccgagag

SEQ ID NO: 323460 - DNA, 25 bp, Mus musculus
ggaggccatgagcataccaacattt

SEQ ID NO: 323461 - DNA, 25 bp, Mus musculus
ggaggccatgagcatccagaggttg

SEQ ID NO: 323462 - DNA, 25 bp, Mus musculus
ggaggccatgagcgtaatctgcaga

SEQ ID NO: 323463 - DNA, 25 bp, Mus musculus
ggaggccatggttaaaccatatgag

SEQ ID NO: 323464 - DNA, 25 bp, Mus musculus
ggaggccatttcaggtttggtatgc

SEQ ID NO: 323465 - DNA, 25 bp, Mus musculus
ggaggcccaggatttggtgtcattt

SEQ ID NO: 323466 - DNA, 25 bp, Mus musculus
ggaggcccaggtgcgcaagttggag

SEQ ID NO: 323467 - DNA, 25 bp, Mus musculus
ggaggcccccaggattccccctctg

SEQ ID NO: 323468 - DNA, 25 bp, Mus musculus
ggaggccctgaccgattcacaatga

SEQ ID NO: 323469 - DNA, 25 bp, Mus musculus
ggaggccctggaccttggtgtgacc

SEQ ID NO: 323470 - DNA, 25 bp, Mus musculus
ggaggccctgttcacctctggggga

SEQ ID NO: 323471 - DNA, 25 bp, Mus musculus
ggaggcccttcaagttttcctggag

SEQ ID NO: 323472 - DNA, 25 bp, Mus musculus
ggaggccgaccagcccccgtcctgc

SEQ ID NO: 323473 - DNA, 25 bp, Mus musculus
ggaggccgagaaggctgcatctgtc

SEQ ID NO: 323474 - DNA, 25 bp, Mus musculus
ggaggccgagaagtactctcagaag

SEQ ID NO: 323475 - DNA, 25 bp, Mus musculus
ggaggccgagcagaaggagggagag

SEQ ID NO: 323476 - DNA, 25 bp, Mus musculus
ggaggccgagtgcaacatcctccgc

SEQ ID NO: 323477 - DNA, 25 bp, Mus musculus
ggaggccgcaggttggtgttcgagg

SEQ ID NO: 323478 - DNA, 25 bp, Mus musculus
ggaggccgccaggctggctcaggag

SEQ ID NO: 323479 - DNA, 25 bp, Mus musculus
ggaggccgccaggttcacggctcag

SEQ ID NO: 323480 - DNA, 25 bp, Mus musculus
ggaggccgcgtgtaatgttcaagcc

SEQ ID NO: 323481 - DNA, 25 bp, Mus musculus
ggaggccggagaggagccgctgctg

SEQ ID NO: 323482 - DNA, 25 bp, Mus musculus
ggaggcctcaaaggttaaggagctg

SEQ ID NO: 323483 - DNA, 25 bp, Mus musculus
ggaggcctcagattttacatgtgtg

SEQ ID NO: 323484 - DNA, 25 bp, Mus musculus
ggaggcctcagttcctggccccaga

SEQ ID NO: 323485 - DNA, 25 bp, Mus musculus
ggaggcctcatgatgcctggaatga

SEQ ID NO: 323486 - DNA, 25 bp, Mus musculus
ggaggcctcatgatggggcatcctg

SEQ ID NO: 323487 - DNA, 25 bp, Mus musculus
ggaggcctctgagatcgaggatgag

SEQ ID NO: 323488 - DNA, 25 bp, Mus musculus
ggaggcctgctgatgctcctgccag

SEQ ID NO: 323489 - DNA, 25 bp, Mus musculus
ggaggccttcctcagcccaggtcct

SEQ ID NO: 323490 - DNA, 25 bp, Mus musculus
ggaggccttcctcagcgagctggag

SEQ ID NO: 323491 - DNA, 25 bp, Mus musculus
ggaggccttctatcgaattcgctcc

SEQ ID NO: 323492 - DNA, 25 bp, Mus musculus
ggaggccttgaaggatttagttgtc

SEQ ID NO: 323493 - DNA, 25 bp, Mus musculus
ggaggccttgaagtgctttaggatt

SEQ ID NO: 323494 - DNA, 25 bp, Mus musculus
ggaggcctttcttagacacatgcag

SEQ ID NO: 323495 - DNA, 25 bp, Mus musculus
ggaggcgaagactcatgaaatggcc

SEQ ID NO: 323496 - DNA, 25 bp, Mus musculus
ggaggcgagaggccccacgcatggg

SEQ ID NO: 323497 - DNA, 25 bp, Mus musculus
ggaggcgagagttccagaaaccact

SEQ ID NO: 323498 - DNA, 25 bp, Mus musculus
ggaggcgagcgggcttggctgagta

SEQ ID NO: 323499 - DNA, 25 bp, Mus musculus
ggaggcgcgaggggacaaaggcgtt

SEQ ID NO: 323500 - DNA, 25 bp, Mus musculus
ggaggcgcggcaggcggtgatactt

SEQ ID NO: 323501 - DNA, 25 bp, Mus musculus
ggaggcgcggcaggtggagggagcg

SEQ ID NO: 323502 - DNA, 25 bp, Mus musculus
ggaggcgctcccaggtaggtgagct

SEQ ID NO: 323503 - DNA, 25 bp, Mus musculus
ggaggcgctgcgggtggcctggaga

SEQ ID NO: 323504 - DNA, 25 bp, Mus musculus
ggaggcggaagagcatctgatacgt

SEQ ID NO: 323505 - DNA, 25 bp, Mus musculus
ggaggcggaagaggtcaggaccccc

SEQ ID NO: 323506 - DNA, 25 bp, Mus musculus
ggaggcggccaagggagcagccgcc

SEQ ID NO: 323507 - DNA, 25 bp, Mus musculus
ggaggcggccagcggagagcaaaga

SEQ ID NO: 323508 - DNA, 25 bp, Mus musculus
ggaggcggtgtgaagtaagcaatgg

SEQ ID NO: 323509 - DNA, 25 bp, Mus musculus
ggaggctaacatggggttcggagcg

SEQ ID NO: 323510 - DNA, 25 bp, Mus musculus
ggaggctaaggggaggcccagcctc

SEQ ID NO: 323511 - DNA, 25 bp, Mus musculus
ggaggctataaggtacgaaaccagc

SEQ ID NO: 323512 - DNA, 25 bp, Mus musculus
ggaggctataaggtccccagggagg

SEQ ID NO: 323513 - DNA, 25 bp, Mus musculus
ggaggctatggtcgtggtggtggag

SEQ ID NO: 323514 - DNA, 25 bp, Mus musculus
ggaggctcaagcactgctacaggag

SEQ ID NO: 323515 - DNA, 25 bp, Mus musculus
ggaggctcaagtgagggcattgcca

SEQ ID NO: 323516 - DNA, 25 bp, Mus musculus
ggaggctcaagtgtgagggagatga

SEQ ID NO: 323517 - DNA, 25 bp, Mus musculus
ggaggctcaggattcagactcggac

SEQ ID NO: 323518 - DNA, 25 bp, Mus musculus
ggaggctccgtggaacactcgggcc

SEQ ID NO: 323519 - DNA, 25 bp, Mus musculus
ggaggctcctgatgcaccagattgt

SEQ ID NO: 323520 - DNA, 25 bp, Mus musculus
ggaggctcctgatggtgcctgatgg

SEQ ID NO: 323521 - DNA, 25 bp, Mus musculus
ggaggctcgatgaaaaacacaaaag

SEQ ID NO: 323522 - DNA, 25 bp, Mus musculus
ggaggctcgatggagaattttggtt

SEQ ID NO: 323523 - DNA, 25 bp, Mus musculus
ggaggctcgcagaggcaggggtaga

SEQ ID NO: 323524 - DNA, 25 bp, Mus musculus
ggaggctctacaggttttggctcac

SEQ ID NO: 323525 - DNA, 25 bp, Mus musculus
ggaggctctgactgttctctctctt

SEQ ID NO: 323526 - DNA, 25 bp, Mus musculus
ggaggctgacatgtgcctgagcgga

SEQ ID NO: 323527 - DNA, 25 bp, Mus musculus
ggaggctgacatgtggagcattggc

SEQ ID NO: 323528 - DNA, 25 bp, Mus musculus
ggaggctgagatcactggagattgc

SEQ ID NO: 323529 - DNA, 25 bp, Mus musculus
ggaggctgagatccagccgcagcca

SEQ ID NO: 323530 - DNA, 25 bp, Mus musculus
ggaggctgatgaaggacaaccctcc

SEQ ID NO: 323531 - DNA, 25 bp, Mus musculus
ggaggctgatgaaggagcttgaaga

SEQ ID NO: 323532 - DNA, 25 bp, Mus musculus
ggaggctgcaggatgatgcgattca

SEQ ID NO: 323533 - DNA, 25 bp, Mus musculus
ggaggctgccaacagcctatcttct

SEQ ID NO: 323534 - DNA, 25 bp, Mus musculus
ggaggctgccaacaggaggttctgc

SEQ ID NO: 323535 - DNA, 25 bp, Mus musculus
ggaggctgctgccaggaagaattca

SEQ ID NO: 323536 - DNA, 25 bp, Mus musculus
ggaggctggagagtccttagccagg

SEQ ID NO: 323537 - DNA, 25 bp, Mus musculus
ggaggctggagttggcgcgcaggct

SEQ ID NO: 323538 - DNA, 25 bp, Mus musculus
ggaggctggcagagcctcattaact

SEQ ID NO: 323539 - DNA, 25 bp, Mus musculus
ggaggctggtgcacgaccttctgcc

SEQ ID NO: 323540 - DNA, 25 bp, Mus musculus
ggaggctgtgagaggcttcctcccc

SEQ ID NO: 323541 - DNA, 25 bp, Mus musculus
ggaggctgtgagagtgaagccgccc

SEQ ID NO: 323542 - DNA, 25 bp, Mus musculus
ggaggcttggagaatctccccgagg

SEQ ID NO: 323543 - DNA, 25 bp, Mus musculus
ggaggcttggcaggatgacatgcac

SEQ ID NO: 323544 - DNA, 25 bp, Mus musculus
ggaggcttggcagtttgcgtcctcg

SEQ ID NO: 323545 - DNA, 25 bp, Mus musculus
ggaggctttggaggtagaggaggct

SEQ ID NO: 323546 - DNA, 25 bp, Mus musculus
ggaggctttttcagcttgcttccca

SEQ ID NO: 323547 - DNA, 25 bp, Mus musculus
ggaggctttttcaggaggcagtgac

SEQ ID NO: 323548 - DNA, 25 bp, Mus musculus
ggagggaaatctggaactttgttgc

SEQ ID NO: 323549 - DNA, 25 bp, Mus musculus
ggagggaacgtggaggcccctttgt

SEQ ID NO: 323550 - DNA, 25 bp, Mus musculus
ggagggaagagaaactgctcaggag

SEQ ID NO: 323551 - DNA, 25 bp, Mus musculus
ggagggaagataattatgccaccct

SEQ ID NO: 323552 - DNA, 25 bp, Mus musculus
ggagggaaggaaggcacagctgatg

SEQ ID NO: 323553 - DNA, 25 bp, Mus musculus
ggagggaaggacaggcctggcagaa

SEQ ID NO: 323554 - DNA, 25 bp, Mus musculus
ggagggaaggagcagcaagctgggg

SEQ ID NO: 323555 - DNA, 25 bp, Mus musculus
ggagggaaggagcaggcctggcaga

SEQ ID NO: 323556 - DNA, 25 bp, Mus musculus
ggagggaagtctggaagaccaccag

SEQ ID NO: 323557 - DNA, 25 bp, Mus musculus
ggagggaatgtcagagatgggcgtg

SEQ ID NO: 323558 - DNA, 25 bp, Mus musculus
ggagggaatgtcagttcactcaccg

SEQ ID NO: 323559 - DNA, 25 bp, Mus musculus
ggagggacagcaactgctttgctct

SEQ ID NO: 323560 - DNA, 25 bp, Mus musculus
ggagggacagcctggatacaggttc

SEQ ID NO: 323561 - DNA, 25 bp, Mus musculus
ggagggacagcgtccgatgcaagcc

SEQ ID NO: 323562 - DNA, 25 bp, Mus musculus
ggagggacaggaggtcagtggagct

SEQ ID NO: 323563 - DNA, 25 bp, Mus musculus
ggagggacagtgacaggtttctgga

SEQ ID NO: 323564 - DNA, 25 bp, Mus musculus
ggagggaccagtgacacaggaacaa

SEQ ID NO: 323565 - DNA, 25 bp, Mus musculus
ggagggacccaggcattttcccgac

SEQ ID NO: 323566 - DNA, 25 bp, Mus musculus
ggagggacctcaaggaccttggtgt

SEQ ID NO: 323567 - DNA, 25 bp, Mus musculus
ggagggacggcagcccttggagttc

SEQ ID NO: 323568 - DNA, 25 bp, Mus musculus
ggagggacggcaggtttttctcact

SEQ ID NO: 323569 - DNA, 25 bp, Mus musculus
ggagggactcaacgctgcagcccca

SEQ ID NO: 323570 - DNA, 25 bp, Mus musculus
ggagggactgggaagatggatgaca

SEQ ID NO: 323571 - DNA, 25 bp, Mus musculus
ggagggactgggaagccagctagac

SEQ ID NO: 323572 - DNA, 25 bp, Mus musculus
ggagggactgtgagtgaccatgaaa

SEQ ID NO: 323573 - DNA, 25 bp, Mus musculus
ggagggagaaatgggccagcaatgc

SEQ ID NO: 323574 - DNA, 25 bp, Mus musculus
ggagggagacagaagcaggtggcag

SEQ ID NO: 323575 - DNA, 25 bp, Mus musculus
ggagggagacagaaggaggtggtgg

SEQ ID NO: 323576 - DNA, 25 bp, Mus musculus
ggagggagacagagcaggtggcaga

SEQ ID NO: 323577 - DNA, 25 bp, Mus musculus
ggagggagagacgtgaaaaatgaag

SEQ ID NO: 323578 - DNA, 25 bp, Mus musculus
ggagggagatgaagatggagttttc

SEQ ID NO: 323579 - DNA, 25 bp, Mus musculus
ggagggagatggaaaagacatccct

SEQ ID NO: 323580 - DNA, 25 bp, Mus musculus
ggagggagccagcctggaggccggt

SEQ ID NO: 323581 - DNA, 25 bp, Mus musculus
ggagggagctgaggttttatctgtg

SEQ ID NO: 323582 - DNA, 25 bp, Mus musculus
ggagggagctgctagccattctctg

SEQ ID NO: 323583 - DNA, 25 bp, Mus musculus
ggagggagctgctagcccttctctg

SEQ ID NO: 323584 - DNA, 25 bp, Mus musculus
ggagggaggaagatttgctcccaga

SEQ ID NO: 323585 - DNA, 25 bp, Mus musculus
ggagggagtgacgtttgagtacagt

SEQ ID NO: 323586 - DNA, 25 bp, Mus musculus
ggagggagtgctacctgggaagatc

SEQ ID NO: 323587 - DNA, 25 bp, Mus musculus
ggagggattgatgctgcacctcctc

SEQ ID NO: 323588 - DNA, 25 bp, Mus musculus
ggagggattgatgctgcacctcctg

SEQ ID NO: 323589 - DNA, 25 bp, Mus musculus
ggagggattgatgctgcgcctcctg

SEQ ID NO: 323590 - DNA, 25 bp, Mus musculus
ggagggcaaaggtcccaatgctcgg

SEQ ID NO: 323591 - DNA, 25 bp, Mus musculus
ggagggcaagatattagcatttggc

SEQ ID NO: 323592 - DNA, 25 bp, Mus musculus
ggagggcacagcatttgacattgtg

SEQ ID NO: 323593 - DNA, 25 bp, Mus musculus
ggagggcacaggctggcaacatggc

SEQ ID NO: 323594 - DNA, 25 bp, Mus musculus
ggagggcaccaggtcactacttcag

SEQ ID NO: 323595 - DNA, 25 bp, Mus musculus
ggagggcagaaggaagaaaacggct

SEQ ID NO: 323596 - DNA, 25 bp, Mus musculus
ggagggcagaggctcagaggcacat

SEQ ID NO: 323597 - DNA, 25 bp, Mus musculus
ggagggcataactgagaatatttat

SEQ ID NO: 323598 - DNA, 25 bp, Mus musculus
ggagggcataactgttatagagaat

SEQ ID NO: 323599 - DNA, 25 bp, Mus musculus
ggagggcatcaccatcgtggaagac

SEQ ID NO: 323600 - DNA, 25 bp, Mus musculus
ggagggcatgagcctcaagatggtg

SEQ ID NO: 323601 - DNA, 25 bp, Mus musculus
ggagggcatgagcgggactcgccat

SEQ ID NO: 323602 - DNA, 25 bp, Mus musculus
ggagggcatgggcaacaggacctgt

SEQ ID NO: 323603 - DNA, 25 bp, Mus musculus
ggagggcatgggcgttaagatcatc

SEQ ID NO: 323604 - DNA, 25 bp, Mus musculus
ggagggccaaaaaagtgtgcgctca

SEQ ID NO: 323605 - DNA, 25 bp, Mus musculus
ggagggccatcaagaatgactctgt

SEQ ID NO: 323606 - DNA, 25 bp, Mus musculus
ggagggccatcatcagctgcagtta

SEQ ID NO: 323607 - DNA, 25 bp, Mus musculus
ggagggcctcgagctgaagggaacg

SEQ ID NO: 323608 - DNA, 25 bp, Mus musculus
ggagggcctcggtcacccagctggg

SEQ ID NO: 323609 - DNA, 25 bp, Mus musculus
ggagggcctgaaggacctccacagg

SEQ ID NO: 323610 - DNA, 25 bp, Mus musculus
ggagggcctggtttctcacttgagg

SEQ ID NO: 323611 - DNA, 25 bp, Mus musculus
ggagggcgagcgggaacagaactca

SEQ ID NO: 323612 - DNA, 25 bp, Mus musculus
ggagggcgaggtgctcctaatggcc

SEQ ID NO: 323613 - DNA, 25 bp, Mus musculus
ggagggctagatgggatgtgaccag

SEQ ID NO: 323614 - DNA, 25 bp, Mus musculus
ggagggctaggcttcaacttgcgca

SEQ ID NO: 323615 - DNA, 25 bp, Mus musculus
ggagggctcagatctggagctgcta

SEQ ID NO: 323616 - DNA, 25 bp, Mus musculus
ggagggctgaggtacagtcatgtcg

SEQ ID NO: 323617 - DNA, 25 bp, Mus musculus
ggagggctgcagtgtcctgctggga

SEQ ID NO: 323618 - DNA, 25 bp, Mus musculus
ggagggctgggcctgcagccgggag

SEQ ID NO: 323619 - DNA, 25 bp, Mus musculus
ggagggcttgcggttccaaagggcc

SEQ ID NO: 323620 - DNA, 25 bp, Mus musculus
ggaggggaaaagttgctggaaacca

SEQ ID NO: 323621 - DNA, 25 bp, Mus musculus
ggaggggaaaatgcgtcccatgaga

SEQ ID NO: 323622 - DNA, 25 bp, Mus musculus
ggaggggaaaatggcattgtatcat

SEQ ID NO: 323623 - DNA, 25 bp, Mus musculus
ggaggggaaaatgttttcgcatttc

SEQ ID NO: 323624 - DNA, 25 bp, Mus musculus
ggaggggaaagaaggaatcacaggc

SEQ ID NO: 323625 - DNA, 25 bp, Mus musculus
ggaggggaaagaggtgctggtggtt

SEQ ID NO: 323626 - DNA, 25 bp, Mus musculus
ggaggggaggaaatgagaaagatga

SEQ ID NO: 323627 - DNA, 25 bp, Mus musculus
ggaggggaggaagatggcactggat

SEQ ID NO: 323628 - DNA, 25 bp, Mus musculus
ggaggggaggaagcctagccgcccg

SEQ ID NO: 323629 - DNA, 25 bp, Mus musculus
ggaggggaggaaggcatcccccgca

SEQ ID NO: 323630 - DNA, 25 bp, Mus musculus
ggaggggatatggcatccagccagc

SEQ ID NO: 323631 - DNA, 25 bp, Mus musculus
ggaggggcaaaggagcatggcttgg

SEQ ID NO: 323632 - DNA, 25 bp, Mus musculus
ggaggggcactgggtcgtcatgtca

SEQ ID NO: 323633 - DNA, 25 bp, Mus musculus
ggaggggcagaggtagccattgcgg

SEQ ID NO: 323634 - DNA, 25 bp, Mus musculus
ggaggggcaggttctggtattggat

SEQ ID NO: 323635 - DNA, 25 bp, Mus musculus
ggaggggccccgcggcagactccgg

SEQ ID NO: 323636 - DNA, 25 bp, Mus musculus
ggaggggcgctggcaccttcaaaca

SEQ ID NO: 323637 - DNA, 25 bp, Mus musculus
ggaggggcgctgggctacgatggaa

SEQ ID NO: 323638 - DNA, 25 bp, Mus musculus
ggaggggctgaggaaaggaaacctc

SEQ ID NO: 323639 - DNA, 25 bp, Mus musculus
ggaggggcttcagacaccaatgact

SEQ ID NO: 323640 - DNA, 25 bp, Mus musculus
ggagggggcaaggctctgctccccc

SEQ ID NO: 323641 - DNA, 25 bp, Mus musculus
ggagggggtaagggaggccgctcac

SEQ ID NO: 323642 - DNA, 25 bp, Mus musculus
ggagggggtcagctagaagagtcct

SEQ ID NO: 323643 - DNA, 25 bp, Mus musculus
ggaggggtgagtgtggatctgcagc

SEQ ID NO: 323644 - DNA, 25 bp, Mus musculus
ggaggggtggaaaatgacattccca

SEQ ID NO: 323645 - DNA, 25 bp, Mus musculus
ggaggggtggcggctcctccaggcg

SEQ ID NO: 323646 - DNA, 25 bp, Mus musculus
ggaggggttatctggccgttcctca

SEQ ID NO: 323647 - DNA, 25 bp, Mus musculus
ggaggggttggtgatggattcatgg

SEQ ID NO: 323648 - DNA, 25 bp, Mus musculus
ggagggtagagacggggccctagct

SEQ ID NO: 323649 - DNA, 25 bp, Mus musculus
ggagggtatgagcgaagagaaagac

SEQ ID NO: 323650 - DNA, 25 bp, Mus musculus
ggagggtattcaaacacatagacat

SEQ ID NO: 323651 - DNA, 25 bp, Mus musculus
ggagggtccgggttgtggatcatta

SEQ ID NO: 323652 - DNA, 25 bp, Mus musculus
ggagggtcgagctgtcagagaagct

SEQ ID NO: 323653 - DNA, 25 bp, Mus musculus
ggagggtctgcaggtcttgtagaaa

SEQ ID NO: 323654 - DNA, 25 bp, Mus musculus
ggagggtgaggctctgggtgctcta

SEQ ID NO: 323655 - DNA, 25 bp, Mus musculus
ggagggtgcagcggccagaagatgc

SEQ ID NO: 323656 - DNA, 25 bp, Mus musculus
ggagggtgccaaaaaggccaacaag

SEQ ID NO: 323657 - DNA, 25 bp, Mus musculus
ggagggttcagcccttcccctgggg

SEQ ID NO: 323658 - DNA, 25 bp, Mus musculus
ggagggttcagctcggatgtggaag

SEQ ID NO: 323659 - DNA, 25 bp, Mus musculus
ggaggtaaagacagagctctgaaag

SEQ ID NO: 323660 - DNA, 25 bp, Mus musculus
ggaggtaaagacagtggattttgct

SEQ ID NO: 323661 - DNA, 25 bp, Mus musculus
ggaggtaagcgaagagaggaagcgg

SEQ ID NO: 323662 - DNA, 25 bp, Mus musculus
ggaggtaatgttgggaggaaagaag

SEQ ID NO: 323663 - DNA, 25 bp, Mus musculus
ggaggtacaagagggaagaagaaga

SEQ ID NO: 323664 - DNA, 25 bp, Mus musculus
ggaggtagaagaggaacgtacgaag

SEQ ID NO: 323665 - DNA, 25 bp, Mus musculus
ggaggtagagggtggagtttaccag

SEQ ID NO: 323666 - DNA, 25 bp, Mus musculus
ggaggtagatgcaggagatccccca

SEQ ID NO: 323667 - DNA, 25 bp, Mus musculus
ggaggtagtcttgtcctgggtggga

SEQ ID NO: 323668 - DNA, 25 bp, Mus musculus
ggaggtcaagattcgggaagaagct

SEQ ID NO: 323669 - DNA, 25 bp, Mus musculus
ggaggtcaaggccaagaacgcgctg

SEQ ID NO: 323670 - DNA, 25 bp, Mus musculus
ggaggtcagaagattttgttgacct

SEQ ID NO: 323671 - DNA, 25 bp, Mus musculus
ggaggtcagaaggtgtgttatattg

SEQ ID NO: 323672 - DNA, 25 bp, Mus musculus
ggaggtcagccacagctgttctagc

SEQ ID NO: 323673 - DNA, 25 bp, Mus musculus
ggaggtcatagcagggtgttcttct

SEQ ID NO: 323674 - DNA, 25 bp, Mus musculus
ggaggtcatgactgccatttgcttc

SEQ ID NO: 323675 - DNA, 25 bp, Mus musculus
ggaggtcatgactggggtgatctgc

SEQ ID NO: 323676 - DNA, 25 bp, Mus musculus
ggaggtcatggtgaaacatccacca

SEQ ID NO: 323677 - DNA, 25 bp, Mus musculus
ggaggtcatggtgaaacatgagctg

SEQ ID NO: 323678 - DNA, 25 bp, Mus musculus
ggaggtcatttcaggggagcgtttg

SEQ ID NO: 323679 - DNA, 25 bp, Mus musculus
ggaggtccagctgctcggcactgct

SEQ ID NO: 323680 - DNA, 25 bp, Mus musculus
ggaggtccagctgttcatgactgac

SEQ ID NO: 323681 - DNA, 25 bp, Mus musculus
ggaggtccccaagagtgggccaagc

SEQ ID NO: 323682 - DNA, 25 bp, Mus musculus
ggaggtccccaaggtatttctctga

SEQ ID NO: 323683 - DNA, 25 bp, Mus musculus
ggaggtccgagcacaccctgaaagc

SEQ ID NO: 323684 - DNA, 25 bp, Mus musculus
ggaggtccgaggcgagtgagctcag

SEQ ID NO: 323685 - DNA, 25 bp, Mus musculus
ggaggtccgagggtgacttcacctg

SEQ ID NO: 323686 - DNA, 25 bp, Mus musculus
ggaggtccggagtcaccggcctgag

SEQ ID NO: 323687 - DNA, 25 bp, Mus musculus
ggaggtccggatgctgttgacggag

SEQ ID NO: 323688 - DNA, 25 bp, Mus musculus
ggaggtcctaacaagacagaactgc

SEQ ID NO: 323689 - DNA, 25 bp, Mus musculus
ggaggtcctactggaacaaatgctt

SEQ ID NO: 323690 - DNA, 25 bp, Mus musculus
ggaggtcgagcccgtgacaccatag

SEQ ID NO: 323691 - DNA, 25 bp, Mus musculus
ggaggtctgccaggatatagctcct

SEQ ID NO: 323692 - DNA, 25 bp, Mus musculus
ggaggtcttcaaggaaccagcacct

SEQ ID NO: 323693 - DNA, 25 bp, Mus musculus
ggaggtgaaagaggtgacagctact

SEQ ID NO: 323694 - DNA, 25 bp, Mus musculus
ggaggtgaactcagacaaggtctgg

SEQ ID NO: 323695 - DNA, 25 bp, Mus musculus
ggaggtgaactcaggttcttgctat

SEQ ID NO: 323696 - DNA, 25 bp, Mus musculus
ggaggtgaagcccaggacccaggca

SEQ ID NO: 323697 - DNA, 25 bp, Mus musculus
ggaggtgaagcccctccaggccggc

SEQ ID NO: 323698 - DNA, 25 bp, Mus musculus
ggaggtgaaggccaatacatatgaa

SEQ ID NO: 323699 - DNA, 25 bp, Mus musculus
ggaggtgaagtatttaggtcagtta

SEQ ID NO: 323700 - DNA, 25 bp, Mus musculus
ggaggtgacaacgaaaatatctgca

SEQ ID NO: 323701 - DNA, 25 bp, Mus musculus
ggaggtgacgggtctcactctagct

SEQ ID NO: 323702 - DNA, 25 bp, Mus musculus
ggaggtgacggtgcagcggaactgc

SEQ ID NO: 323703 - DNA, 25 bp, Mus musculus
ggaggtgacgttgctgtcccagaaa

SEQ ID NO: 323704 - DNA, 25 bp, Mus musculus
ggaggtgactccaaggacaagacca

SEQ ID NO: 323705 - DNA, 25 bp, Mus musculus
ggaggtgaggggacttcaaaacatg

SEQ ID NO: 323706 - DNA, 25 bp, Mus musculus
ggaggtgagggggaggtccaacaca

SEQ ID NO: 323707 - DNA, 25 bp, Mus musculus
ggaggtgatcaaaggcattcctttg

SEQ ID NO: 323708 - DNA, 25 bp, Mus musculus
ggaggtgatcaaagggtgaagtcgg

SEQ ID NO: 323709 - DNA, 25 bp, Mus musculus
ggaggtgattggaggcctgggagct

SEQ ID NO: 323710 - DNA, 25 bp, Mus musculus
ggaggtgccacagccaccatgccaa

SEQ ID NO: 323711 - DNA, 25 bp, Mus musculus
ggaggtggaggacctcatggaaccc

SEQ ID NO: 323712 - DNA, 25 bp, Mus musculus
ggaggtggatgcttctcttcaggcc

SEQ ID NO: 323713 - DNA, 25 bp, Mus musculus
ggaggtggcaaggtgcaaatagtct

SEQ ID NO: 323714 - DNA, 25 bp, Mus musculus
ggaggtggcaaggtgcagataatta

SEQ ID NO: 323715 - DNA, 25 bp, Mus musculus
ggaggtggcaatgccccagttcctt

SEQ ID NO: 323716 - DNA, 25 bp, Mus musculus
ggaggtggcaatggaaaaagatctt

SEQ ID NO: 323717 - DNA, 25 bp, Mus musculus
ggaggtggcaatgttcagattcaga

SEQ ID NO: 323718 - DNA, 25 bp, Mus musculus
ggaggtggcagagtataaaggaggg

SEQ ID NO: 323719 - DNA, 25 bp, Mus musculus
ggaggtggcagggttaaggcagctt

SEQ ID NO: 323720 - DNA, 25 bp, Mus musculus
ggaggtggcccaggtccctgtccgc

SEQ ID NO: 323721 - DNA, 25 bp, Mus musculus
ggaggtggccgatgtgacagcatgg

SEQ ID NO: 323722 - DNA, 25 bp, Mus musculus
ggaggtggccgctgaccagtgaagt

SEQ ID NO: 323723 - DNA, 25 bp, Mus musculus
ggaggtggctacgagataacagaca

SEQ ID NO: 323724 - DNA, 25 bp, Mus musculus
ggaggtggctgtgtctttcagccct

SEQ ID NO: 323725 - DNA, 25 bp, Mus musculus
ggaggtggtccgagaggtgtgctct

SEQ ID NO: 323726 - DNA, 25 bp, Mus musculus
ggaggtggtccgagttcccacgaca

SEQ ID NO: 323727 - DNA, 25 bp, Mus musculus
ggaggtgttcagctcctgcttctag

SEQ ID NO: 323728 - DNA, 25 bp, Mus musculus
ggaggtgttcagggaggcagatcaa

SEQ ID NO: 323729 - DNA, 25 bp, Mus musculus
ggaggttaaagcttctgccacacac

SEQ ID NO: 323730 - DNA, 25 bp, Mus musculus
ggaggttatacagacagagggtacc

SEQ ID NO: 323731 - DNA, 25 bp, Mus musculus
ggaggttatcggcagcggagcaact

SEQ ID NO: 323732 - DNA, 25 bp, Mus musculus
ggaggttatcggtaaggcgagttcc

SEQ ID NO: 323733 - DNA, 25 bp, Mus musculus
ggaggttccagatcacacaagagtc

SEQ ID NO: 323734 - DNA, 25 bp, Mus musculus
ggaggttccaggtgtgtgtgacggc

SEQ ID NO: 323735 - DNA, 25 bp, Mus musculus
ggaggttctgcagaccatgccgtcc

SEQ ID NO: 323736 - DNA, 25 bp, Mus musculus
ggaggttctggaacagctaatccac

SEQ ID NO: 323737 - DNA, 25 bp, Mus musculus
ggaggttgagaactgggcgtggaaa

SEQ ID NO: 323738 - DNA, 25 bp, Mus musculus
ggaggttggaggctcggatggcgtc

SEQ ID NO: 323739 - DNA, 25 bp, Mus musculus
ggaggttgtcagggttacagccact

SEQ ID NO: 323740 - DNA, 25 bp, Mus musculus
ggaggttgtggtgggacaaccctcc

SEQ ID NO: 323741 - DNA, 25 bp, Mus musculus
ggaggttgttaaggacaaagcagga

SEQ ID NO: 323742 - DNA, 25 bp, Mus musculus
ggaggttgttaaggacctcataagg

SEQ ID NO: 323743 - DNA, 25 bp, Mus musculus
ggaggtttactgccggctcctgtac

SEQ ID NO: 323744 - DNA, 25 bp, Mus musculus
ggaggtttctgaggtggagtctttc

SEQ ID NO: 323745 - DNA, 25 bp, Mus musculus
ggaggtttgctgttatttcgctgca

SEQ ID NO: 323746 - DNA, 25 bp, Mus musculus
ggaggttttgttggtgtgcaacaga

SEQ ID NO: 323747 - DNA, 25 bp, Mus musculus
ggagtaaattagcatatgtatatca

SEQ ID NO: 323748 - DNA, 25 bp, Mus musculus
ggagtaaattcagatgggtggccta

SEQ ID NO: 323749 - DNA, 25 bp, Mus musculus
ggagtaacagctagaaattgcaaac

SEQ ID NO: 323750 - DNA, 25 bp, Mus musculus
ggagtaactgagttggcagatatcc

SEQ ID NO: 323751 - DNA, 25 bp, Mus musculus
ggagtaagaaagagcccagtaagag

SEQ ID NO: 323752 - DNA, 25 bp, Mus musculus
ggagtaagcagaggagacctgccag

SEQ ID NO: 323753 - DNA, 25 bp, Mus musculus
ggagtaagctggatggtccacctcc

SEQ ID NO: 323754 - DNA, 25 bp, Mus musculus
ggagtaagtcgaatctacaaaatgg

SEQ ID NO: 323755 - DNA, 25 bp, Mus musculus
ggagtaagtgaggtccagggaggga

SEQ ID NO: 323756 - DNA, 25 bp, Mus musculus
ggagtaagtgagtcctttcaggtct

SEQ ID NO: 323757 - DNA, 25 bp, Mus musculus
ggagtaatcagagagtgtcacgatg

SEQ ID NO: 323758 - DNA, 25 bp, Mus musculus
ggagtaatgacagacattgagatat

SEQ ID NO: 323759 - DNA, 25 bp, Mus musculus
ggagtaatgacagctcagttcctag

SEQ ID NO: 323760 - DNA, 25 bp, Mus musculus
ggagtaatgacagctccttcctcta

SEQ ID NO: 323761 - DNA, 25 bp, Mus musculus
ggagtaatgcctggcacttctgtga

SEQ ID NO: 323762 - DNA, 25 bp, Mus musculus
ggagtacaaaaagctgtgagtacca

SEQ ID NO: 323763 - DNA, 25 bp, Mus musculus
ggagtacaaaaaggtgcatccaagc

SEQ ID NO: 323764 - DNA, 25 bp, Mus musculus
ggagtacaagagccagatgaagtca

SEQ ID NO: 323765 - DNA, 25 bp, Mus musculus
ggagtacaaggccaagctacaaggg

SEQ ID NO: 323766 - DNA, 25 bp, Mus musculus
ggagtacaccaccacgcccggctta

SEQ ID NO: 323767 - DNA, 25 bp, Mus musculus
ggagtacagaggtgcaggtcctgcc

SEQ ID NO: 323768 - DNA, 25 bp, Mus musculus
ggagtacagtaagggatgttctgat

SEQ ID NO: 323769 - DNA, 25 bp, Mus musculus
ggagtacagtaagtactggctctgg

SEQ ID NO: 323770 - DNA, 25 bp, Mus musculus
ggagtacagtaagttcatagacaga

SEQ ID NO: 323771 - DNA, 25 bp, Mus musculus
ggagtaccaggagaccctgagcaga

SEQ ID NO: 323772 - DNA, 25 bp, Mus musculus
ggagtaccaggaggagctggagttc

SEQ ID NO: 323773 - DNA, 25 bp, Mus musculus
ggagtacgaatttcagcgaggagag

SEQ ID NO: 323774 - DNA, 25 bp, Mus musculus
ggagtacgaggagagagcaagagga

SEQ ID NO: 323775 - DNA, 25 bp, Mus musculus
ggagtacgaggagattatgcgggac

SEQ ID NO: 323776 - DNA, 25 bp, Mus musculus
ggagtacgaggaggaacaggaaggt

SEQ ID NO: 323777 - DNA, 25 bp, Mus musculus
ggagtacgcagtggaagcccacttc

SEQ ID NO: 323778 - DNA, 25 bp, Mus musculus
ggagtacgcctgcagagcccacatg

SEQ ID NO: 323779 - DNA, 25 bp, Mus musculus
ggagtacgcctgcagtgctgtgaag

SEQ ID NO: 323780 - DNA, 25 bp, Mus musculus
ggagtactgagaggtagccagaaat

SEQ ID NO: 323781 - DNA, 25 bp, Mus musculus
ggagtactttggtcggtgtggtggc

SEQ ID NO: 323782 - DNA, 25 bp, Mus musculus
ggagtagaaccaggggaaagcgcag

SEQ ID NO: 323783 - DNA, 25 bp, Mus musculus
ggagtagacaggctcctcatagtcc

SEQ ID NO: 323784 - DNA, 25 bp, Mus musculus
ggagtagagaaggtccatctctgta

SEQ ID NO: 323785 - DNA, 25 bp, Mus musculus
ggagtagaggcctttgtgaaaatgt

SEQ ID NO: 323786 - DNA, 25 bp, Mus musculus
ggagtagatttagatgccagcacct

SEQ ID NO: 323787 - DNA, 25 bp, Mus musculus
ggagtagcaaaggaatgggacagaa

SEQ ID NO: 323788 - DNA, 25 bp, Mus musculus
ggagtagcaaaggttcagcctatgg

SEQ ID NO: 323789 - DNA, 25 bp, Mus musculus
ggagtagcaactggtctctggactg

SEQ ID NO: 323790 - DNA, 25 bp, Mus musculus
ggagtagccaatgatcatgaagaag

SEQ ID NO: 323791 - DNA, 25 bp, Mus musculus
ggagtagccaatgatttatctgttt

SEQ ID NO: 323792 - DNA, 25 bp, Mus musculus
ggagtagctatgaaggagatgaaga

SEQ ID NO: 323793 - DNA, 25 bp, Mus musculus
ggagtataagacagatttcttctgc

SEQ ID NO: 323794 - DNA, 25 bp, Mus musculus
ggagtataagacagtaagcgtcacc

SEQ ID NO: 323795 - DNA, 25 bp, Mus musculus
ggagtatcaggatgctgtgcgcacg

SEQ ID NO: 323796 - DNA, 25 bp, Mus musculus
ggagtatccagagaaacatgacttt

SEQ ID NO: 323797 - DNA, 25 bp, Mus musculus
ggagtatgagggagccgtctaccct

SEQ ID NO: 323798 - DNA, 25 bp, Mus musculus
ggagtatgccagacagctgaggccc

SEQ ID NO: 323799 - DNA, 25 bp, Mus musculus
ggagtatgccaggtactacatgagg

SEQ ID NO: 323800 - DNA, 25 bp, Mus musculus
ggagtatgctaagttctttgaaacc

SEQ ID NO: 323801 - DNA, 25 bp, Mus musculus
ggagtatgctcgggagcatggcttg

SEQ ID NO: 323802 - DNA, 25 bp, Mus musculus
ggagtatggcagactgcacgggcgc

SEQ ID NO: 323803 - DNA, 25 bp, Mus musculus
ggagtatgtgaagagctggttttgg

SEQ ID NO: 323804 - DNA, 25 bp, Mus musculus
ggagtatgtgaagaggtttgttgtc

SEQ ID NO: 323805 - DNA, 25 bp, Mus musculus
ggagtattacaagcatccgatatca

SEQ ID NO: 323806 - DNA, 25 bp, Mus musculus
ggagtcaaagagtggcttcaccccg

SEQ ID NO: 323807 - DNA, 25 bp, Mus musculus
ggagtcaaagatgagattccatatt

SEQ ID NO: 323808 - DNA, 25 bp, Mus musculus
ggagtcaaagggctaacagaacaag

SEQ ID NO: 323809 - DNA, 25 bp, Mus musculus
ggagtcaaaggtccacgaaccagtt

SEQ ID NO: 323810 - DNA, 25 bp, Mus musculus
ggagtcaagagccttcgtgagcccc

SEQ ID NO: 323811 - DNA, 25 bp, Mus musculus
ggagtcaagaggttctccccaatcg

SEQ ID NO: 323812 - DNA, 25 bp, Mus musculus
ggagtcaagagtcccctgtcgctca

SEQ ID NO: 323813 - DNA, 25 bp, Mus musculus
ggagtcaccacggttcatggaaacc

SEQ ID NO: 323814 - DNA, 25 bp, Mus musculus
ggagtcacctctgtctggtagcagc

SEQ ID NO: 323815 - DNA, 25 bp, Mus musculus
ggagtcacgggaagtcctgcatgtc

SEQ ID NO: 323816 - DNA, 25 bp, Mus musculus
ggagtcagaccagggagcccccggg

SEQ ID NO: 323817 - DNA, 25 bp, Mus musculus
ggagtcagagaggagggccaaggag

SEQ ID NO: 323818 - DNA, 25 bp, Mus musculus
ggagtcagaggagtttgacaagaag

SEQ ID NO: 323819 - DNA, 25 bp, Mus musculus
ggagtcagagtcatgtatcgagtgg

SEQ ID NO: 323820 - DNA, 25 bp, Mus musculus
ggagtcagcaccagctcgcagtggt

SEQ ID NO: 323821 - DNA, 25 bp, Mus musculus
ggagtcagcaccagggattctgggc

SEQ ID NO: 323822 - DNA, 25 bp, Mus musculus
ggagtcaggggaaatgagcatctct

SEQ ID NO: 323823 - DNA, 25 bp, Mus musculus
ggagtcaggggtcactaggattgtg

SEQ ID NO: 323824 - DNA, 25 bp, Mus musculus
ggagtcataagaagacacacacagg

SEQ ID NO: 323825 - DNA, 25 bp, Mus musculus
ggagtcatcactgtcatccaggaca

SEQ ID NO: 323826 - DNA, 25 bp, Mus musculus
ggagtcatcaggggtttcctgagat

SEQ ID NO: 323827 - DNA, 25 bp, Mus musculus
ggagtcatgcctctgcagacgtgga

SEQ ID NO: 323828 - DNA, 25 bp, Mus musculus
ggagtcattagagtgttcagtgtca

SEQ ID NO: 323829 - DNA, 25 bp, Mus musculus
ggagtcattaggggccctgggaccc

SEQ ID NO: 323830 - DNA, 25 bp, Mus musculus
ggagtcattcaagtttatctccggc

SEQ ID NO: 323831 - DNA, 25 bp, Mus musculus
ggagtccataggctgtaccaactgt

SEQ ID NO: 323832 - DNA, 25 bp, Mus musculus
ggagtccatggcaacgggcagcatt

SEQ ID NO: 323833 - DNA, 25 bp, Mus musculus
ggagtccatgtgtaaagagctggcc

SEQ ID NO: 323834 - DNA, 25 bp, Mus musculus
ggagtccattcgacaaagatgacta

SEQ ID NO: 323835 - DNA, 25 bp, Mus musculus
ggagtcccaagtctccaggtggtcc

SEQ ID NO: 323836 - DNA, 25 bp, Mus musculus
ggagtcccagatccagtatgtacct

SEQ ID NO: 323837 - DNA, 25 bp, Mus musculus
ggagtcccagttcttgcttcagcat

SEQ ID NO: 323838 - DNA, 25 bp, Mus musculus
ggagtccccagtgaaagcagaagat

SEQ ID NO: 323839 - DNA, 25 bp, Mus musculus
ggagtccccgaggagatctcccctc

SEQ ID NO: 323840 - DNA, 25 bp, Mus musculus
ggagtccccgaggagctacagtttt

SEQ ID NO: 323841 - DNA, 25 bp, Mus musculus
ggagtcccctttaaggctccaggat

SEQ ID NO: 323842 - DNA, 25 bp, Mus musculus
ggagtccctagaggtgttggtggaa

SEQ ID NO: 323843 - DNA, 25 bp, Mus musculus
ggagtccctgtgcgatgactgtaag

SEQ ID NO: 323844 - DNA, 25 bp, Mus musculus
ggagtccctgtgtgacctcttggtt

SEQ ID NO: 323845 - DNA, 25 bp, Mus musculus
ggagtccgcccgaagccctattctg

SEQ ID NO: 323846 - DNA, 25 bp, Mus musculus
ggagtccgcccgaagcttggtgagg

SEQ ID NO: 323847 - DNA, 25 bp, Mus musculus
ggagtccgcccgaaggttaacaagc

SEQ ID NO: 323848 - DNA, 25 bp, Mus musculus
ggagtccgtcacgctggcggtggtg

SEQ ID NO: 323849 - DNA, 25 bp, Mus musculus
ggagtccgtgctgagacgtcatcat

SEQ ID NO: 323850 - DNA, 25 bp, Mus musculus
ggagtcctcacagtgagtgatagct

SEQ ID NO: 323851 - DNA, 25 bp, Mus musculus
ggagtcctttcagggcttcttcgtg

SEQ ID NO: 323852 - DNA, 25 bp, Mus musculus
ggagtcgactatgtgtacaagaccg

SEQ ID NO: 323853 - DNA, 25 bp, Mus musculus
ggagtcgacttcaggtacaggtccc

SEQ ID NO: 323854 - DNA, 25 bp, Mus musculus
ggagtcgacttcaggtggtaagaga

SEQ ID NO: 323855 - DNA, 25 bp, Mus musculus
ggagtcgcaggtgactccataccaa

SEQ ID NO: 323856 - DNA, 25 bp, Mus musculus
ggagtcgcaggtgttttgcaaactt

SEQ ID NO: 323857 - DNA, 25 bp, Mus musculus
ggagtcgccatgcctacaacacagc

SEQ ID NO: 323858 - DNA, 25 bp, Mus musculus
ggagtcgccatgtcaccccaggatg

SEQ ID NO: 323859 - DNA, 25 bp, Mus musculus
ggagtcggagatggcagccacagag

SEQ ID NO: 323860 - DNA, 25 bp, Mus musculus
ggagtcggaggccctaatgctggcc

SEQ ID NO: 323861 - DNA, 25 bp, Mus musculus
ggagtcggtgcttggctctggctga

SEQ ID NO: 323862 - DNA, 25 bp, Mus musculus
ggagtctatgtcagacagggaacaa

SEQ ID NO: 323863 - DNA, 25 bp, Mus musculus
ggagtctcaaacaataggtgaccag

SEQ ID NO: 323864 - DNA, 25 bp, Mus musculus
ggagtctcagatgaaagaaacaatc

SEQ ID NO: 323865 - DNA, 25 bp, Mus musculus
ggagtctccattcaggagacattcc

SEQ ID NO: 323866 - DNA, 25 bp, Mus musculus
ggagtctccattcagggttcccggg

SEQ ID NO: 323867 - DNA, 25 bp, Mus musculus
ggagtctccgggaacgtgccaatag

SEQ ID NO: 323868 - DNA, 25 bp, Mus musculus
ggagtctccgggctttggcgttgtt

SEQ ID NO: 323869 - DNA, 25 bp, Mus musculus
ggagtctccggggatgaattgtctg

SEQ ID NO: 323870 - DNA, 25 bp, Mus musculus
ggagtctcctgagagaaattttcct

SEQ ID NO: 323871 - DNA, 25 bp, Mus musculus
ggagtctcctgaggttcaggacctg

SEQ ID NO: 323872 - DNA, 25 bp, Mus musculus
ggagtctctggcgctgatcccactg

SEQ ID NO: 323873 - DNA, 25 bp, Mus musculus
ggagtctctggcggccccactgaag

SEQ ID NO: 323874 - DNA, 25 bp, Mus musculus
ggagtctctgttccgaggagaagcc

SEQ ID NO: 323875 - DNA, 25 bp, Mus musculus
ggagtctctgttccgtcacagtcac

SEQ ID NO: 323876 - DNA, 25 bp, Mus musculus
ggagtctgagagcccaccttctccc

SEQ ID NO: 323877 - DNA, 25 bp, Mus musculus
ggagtctgagaggcggaagaagctg

SEQ ID NO: 323878 - DNA, 25 bp, Mus musculus
ggagtctggagccggtgagcctgga

SEQ ID NO: 323879 - DNA, 25 bp, Mus musculus
ggagtctggaggagattggcatcca

SEQ ID NO: 323880 - DNA, 25 bp, Mus musculus
ggagtctggaggaggttcttcgtga

SEQ ID NO: 323881 - DNA, 25 bp, Mus musculus
ggagtctggcaggagtgctcaccaa

SEQ ID NO: 323882 - DNA, 25 bp, Mus musculus
ggagtctgtgaagagccacaatcat

SEQ ID NO: 323883 - DNA, 25 bp, Mus musculus
ggagtctgtgaaggagaagtttgag

SEQ ID NO: 323884 - DNA, 25 bp, Mus musculus
ggagtcttcccaggatgagtctgac

SEQ ID NO: 323885 - DNA, 25 bp, Mus musculus
ggagtcttgggcctgggcccatacc

SEQ ID NO: 323886 - DNA, 25 bp, Mus musculus
ggagtctttgcctaggttgagaaca

SEQ ID NO: 323887 - DNA, 25 bp, Mus musculus
ggagtgaacagtccctggatgacgc

SEQ ID NO: 323888 - DNA, 25 bp, Mus musculus
ggagtgaacgatcatgaaggaagtc

SEQ ID NO: 323889 - DNA, 25 bp, Mus musculus
ggagtgaacggtctcaggagctcca

SEQ ID NO: 323890 - DNA, 25 bp, Mus musculus
ggagtgaactgaagttgaaaagagc

SEQ ID NO: 323891 - DNA, 25 bp, Mus musculus
ggagtgaagaaatcttccatcctac

SEQ ID NO: 323892 - DNA, 25 bp, Mus musculus
ggagtgacaggtcctttcccataac

SEQ ID NO: 323893 - DNA, 25 bp, Mus musculus
ggagtgacatagagtgtgctgctct

SEQ ID NO: 323894 - DNA, 25 bp, Mus musculus
ggagtgacatatgcccccaaggtct

SEQ ID NO: 323895 - DNA, 25 bp, Mus musculus
ggagtgacatcctagacaacaacgg

SEQ ID NO: 323896 - DNA, 25 bp, Mus musculus
ggagtgagagagcctgtgctgtgga

SEQ ID NO: 323897 - DNA, 25 bp, Mus musculus
ggagtgagagaggaggagcgctttt

SEQ ID NO: 323898 - DNA, 25 bp, Mus musculus
ggagtgagagctgggaagtcatcaa

SEQ ID NO: 323899 - DNA, 25 bp, Mus musculus
ggagtgagcacggttatttttgaag

SEQ ID NO: 323900 - DNA, 25 bp, Mus musculus
ggagtgaggagtcaccactacttta

SEQ ID NO: 323901 - DNA, 25 bp, Mus musculus
ggagtgagtcaggaacaaagtattg

SEQ ID NO: 323902 - DNA, 25 bp, Mus musculus
ggagtgatcacaggattgctgctgg

SEQ ID NO: 323903 - DNA, 25 bp, Mus musculus
ggagtgatcacaggcctgggcatgt

SEQ ID NO: 323904 - DNA, 25 bp, Mus musculus
ggagtgatcacagggccaaaggcga

SEQ ID NO: 323905 - DNA, 25 bp, Mus musculus
ggagtgatttaggaatgttcttggg

SEQ ID NO: 323906 - DNA, 25 bp, Mus musculus
ggagtgcaaaggcaagcagaaggac

SEQ ID NO: 323907 - DNA, 25 bp, Mus musculus
ggagtgcaagaacctgatcctccag

SEQ ID NO: 323908 - DNA, 25 bp, Mus musculus
ggagtgcaagcagagagagaagacg

SEQ ID NO: 323909 - DNA, 25 bp, Mus musculus
ggagtgcaagcagttgcacgtttgt

SEQ ID NO: 323910 - DNA, 25 bp, Mus musculus
ggagtgcaagggctccagcataaaa

SEQ ID NO: 323911 - DNA, 25 bp, Mus musculus
ggagtgcagccaccaggacgcagag

SEQ ID NO: 323912 - DNA, 25 bp, Mus musculus
ggagtgcagcctcagccaagttgaa

SEQ ID NO: 323913 - DNA, 25 bp, Mus musculus
ggagtgcatcacacgatttgtgaaa

SEQ ID NO: 323914 - DNA, 25 bp, Mus musculus
ggagtgcatcacacggctcattcac

SEQ ID NO: 323915 - DNA, 25 bp, Mus musculus
ggagtgccaagacacaagcatctat

SEQ ID NO: 323916 - DNA, 25 bp, Mus musculus
ggagtgccaaggccggcagaggact

SEQ ID NO: 323917 - DNA, 25 bp, Mus musculus
ggagtgccaattattctgttttttt

SEQ ID NO: 323918 - DNA, 25 bp, Mus musculus
ggagtgccatagaaggttaatggag

SEQ ID NO: 323919 - DNA, 25 bp, Mus musculus
ggagtgcccaggcgaccacctccat

SEQ ID NO: 323920 - DNA, 25 bp, Mus musculus
ggagtgcctcagtgaagaaactgac

SEQ ID NO: 323921 - DNA, 25 bp, Mus musculus
ggagtgcctcagtgcttctacctgg

SEQ ID NO: 323922 - DNA, 25 bp, Mus musculus
ggagtgcctcagtggtggtgagctc

SEQ ID NO: 323923 - DNA, 25 bp, Mus musculus
ggagtgcgagacaaagctggctgcc

SEQ ID NO: 323924 - DNA, 25 bp, Mus musculus
ggagtgcgcccgggagaaggaactc

SEQ ID NO: 323925 - DNA, 25 bp, Mus musculus
ggagtgcggacacccggcctggcca

SEQ ID NO: 323926 - DNA, 25 bp, Mus musculus
ggagtgcggagggcgggggcagaga

SEQ ID NO: 323927 - DNA, 25 bp, Mus musculus
ggagtgcggagggggccccccagaa

SEQ ID NO: 323928 - DNA, 25 bp, Mus musculus
ggagtgcttggcgcgaaaaggtgga

SEQ ID NO: 323929 - DNA, 25 bp, Mus musculus
ggagtgcttggcgcgatatgctaat

SEQ ID NO: 323930 - DNA, 25 bp, Mus musculus
ggagtgcttggcgcggtgaaggcga

SEQ ID NO: 323931 - DNA, 25 bp, Mus musculus
ggagtggaagaggaggaaactttgg

SEQ ID NO: 323932 - DNA, 25 bp, Mus musculus
ggagtggaagaggaggaccatatgg

SEQ ID NO: 323933 - DNA, 25 bp, Mus musculus
ggagtggagaagtatattggatttt

SEQ ID NO: 323934 - DNA, 25 bp, Mus musculus
ggagtggcaggagaagcgtagaccc

SEQ ID NO: 323935 - DNA, 25 bp, Mus musculus
ggagtggcaggagccctggcctgag

SEQ ID NO: 323936 - DNA, 25 bp, Mus musculus
ggagtggcaggaggcctatgtgaac

SEQ ID NO: 323937 - DNA, 25 bp, Mus musculus
ggagtggcagtccggctctccaagg

SEQ ID NO: 323938 - DNA, 25 bp, Mus musculus
ggagtggcctcggtgattgaagtga

SEQ ID NO: 323939 - DNA, 25 bp, Mus musculus
ggagtgggagattactacaagggaa

SEQ ID NO: 323940 - DNA, 25 bp, Mus musculus
ggagtgggaggtagtgtcggtggct

SEQ ID NO: 323941 - DNA, 25 bp, Mus musculus
ggagtgggagtgcagattgaaaaat

SEQ ID NO: 323942 - DNA, 25 bp, Mus musculus
ggagtgggccacttgcccatgttac

SEQ ID NO: 323943 - DNA, 25 bp, Mus musculus
ggagtggggaacaggtctttcatag

SEQ ID NO: 323944 - DNA, 25 bp, Mus musculus
ggagtggggtcccgggctactcttc

SEQ ID NO: 323945 - DNA, 25 bp, Mus musculus
ggagtgggtggagagcatggggggg

SEQ ID NO: 323946 - DNA, 25 bp, Mus musculus
ggagtggtgggttcgagtgacggtg

SEQ ID NO: 323947 - DNA, 25 bp, Mus musculus
ggagtgtaagaggcggcccctgact

SEQ ID NO: 323948 - DNA, 25 bp, Mus musculus
ggagtgtaagtggcggcccctgact

SEQ ID NO: 323949 - DNA, 25 bp, Mus musculus
ggagtgtactggatgtttgagacag

SEQ ID NO: 323950 - DNA, 25 bp, Mus musculus
ggagtgtaggagaaggtccaacggg

SEQ ID NO: 323951 - DNA, 25 bp, Mus musculus
ggagtgtcagctacgcaggaagggc

SEQ ID NO: 323952 - DNA, 25 bp, Mus musculus
ggagtgtcagctacgccgatcgggt

SEQ ID NO: 323953 - DNA, 25 bp, Mus musculus
ggagtgtccacagtacctgagaaag

SEQ ID NO: 323954 - DNA, 25 bp, Mus musculus
ggagtgtctggcaccgtggacttgc

SEQ ID NO: 323955 - DNA, 25 bp, Mus musculus
ggagtgtcttttctatagatgccca

SEQ ID NO: 323956 - DNA, 25 bp, Mus musculus
ggagtgtgaaaaaagtcattgaaga

SEQ ID NO: 323957 - DNA, 25 bp, Mus musculus
ggagtgtgaagagatccaggcttac

SEQ ID NO: 323958 - DNA, 25 bp, Mus musculus
ggagtgtgacagtgattggaagtgc

SEQ ID NO: 323959 - DNA, 25 bp, Mus musculus
ggagtgtgagataacacgtataggg

SEQ ID NO: 323960 - DNA, 25 bp, Mus musculus
ggagtgtgagcctatccgcctccga

SEQ ID NO: 323961 - DNA, 25 bp, Mus musculus
ggagtgtgaggaggtaaatgaaaaa

SEQ ID NO: 323962 - DNA, 25 bp, Mus musculus
ggagtgtgaggcatgggtgtcagtg

SEQ ID NO: 323963 - DNA, 25 bp, Mus musculus
ggagtgtgagggaggagataggtgc

SEQ ID NO: 323964 - DNA, 25 bp, Mus musculus
ggagtgtgatcgtttggaaaacgaa

SEQ ID NO: 323965 - DNA, 25 bp, Mus musculus
ggagtgtgcgcctgccccgcgagaa

SEQ ID NO: 323966 - DNA, 25 bp, Mus musculus
ggagtgtgtgcagcggggagagtta

SEQ ID NO: 323967 - DNA, 25 bp, Mus musculus
ggagtgttcggggttaactgctctt

SEQ ID NO: 323968 - DNA, 25 bp, Mus musculus
ggagtgttgaacagagaaattagcc

SEQ ID NO: 323969 - DNA, 25 bp, Mus musculus
ggagtgttgagagtcctttgctgtt

SEQ ID NO: 323970 - DNA, 25 bp, Mus musculus
ggagtgttgtgaggagtccatgaag

SEQ ID NO: 323971 - DNA, 25 bp, Mus musculus
ggagttaaaggtccttcacgtcttg

SEQ ID NO: 323972 - DNA, 25 bp, Mus musculus
ggagttaagagaggtaatagaattg

SEQ ID NO: 323973 - DNA, 25 bp, Mus musculus
ggagttaatcttgtctcctcgaaga

SEQ ID NO: 323974 - DNA, 25 bp, Mus musculus
ggagttaatcttgtctcttctcaca

SEQ ID NO: 323975 - DNA, 25 bp, Mus musculus
ggagttaatcttgtttgagtcttca

SEQ ID NO: 323976 - DNA, 25 bp, Mus musculus
ggagttaatgaggggtattcagagt

SEQ ID NO: 323977 - DNA, 25 bp, Mus musculus
ggagttacagaaggtttggaggtac

SEQ ID NO: 323978 - DNA, 25 bp, Mus musculus
ggagttacagcttcgttacgacgat

SEQ ID NO: 323979 - DNA, 25 bp, Mus musculus
ggagttagaaacaggtgagaactca

SEQ ID NO: 323980 - DNA, 25 bp, Mus musculus
ggagttagagaaggctcatacaaca

SEQ ID NO: 323981 - DNA, 25 bp, Mus musculus
ggagttagagctgaccatttgaaga

SEQ ID NO: 323982 - DNA, 25 bp, Mus musculus
ggagttagaggtgaccatttgaaga

SEQ ID NO: 323983 - DNA, 25 bp, Mus musculus
ggagttagccagaatggagaatgga

SEQ ID NO: 323984 - DNA, 25 bp, Mus musculus
ggagttatttagacaagatcctgag

SEQ ID NO: 323985 - DNA, 25 bp, Mus musculus
ggagttcaaacatacagctttgtac

SEQ ID NO: 323986 - DNA, 25 bp, Mus musculus
ggagttcaacatagactacacgatt

SEQ ID NO: 323987 - DNA, 25 bp, Mus musculus
ggagttcaaggacgacagccatgtc

SEQ ID NO: 323988 - DNA, 25 bp, Mus musculus
ggagttcacagcatgaaggactttc

SEQ ID NO: 323989 - DNA, 25 bp, Mus musculus
ggagttcacagcgcactgtttgatt

SEQ ID NO: 323990 - DNA, 25 bp, Mus musculus
ggagttcagaagaggatgactgagt

SEQ ID NO: 323991 - DNA, 25 bp, Mus musculus
ggagttcagagacctcaacgaatcc

SEQ ID NO: 323992 - DNA, 25 bp, Mus musculus
ggagttcagtgatgacttggatgtt

SEQ ID NO: 323993 - DNA, 25 bp, Mus musculus
ggagttcatgacaagtgggccaatc

SEQ ID NO: 323994 - DNA, 25 bp, Mus musculus
ggagttcatgcactttgccacaggc

SEQ ID NO: 323995 - DNA, 25 bp, Mus musculus
ggagttccaagcagcatgggtcgga

SEQ ID NO: 323996 - DNA, 25 bp, Mus musculus
ggagttcccagtcagacactgcata

SEQ ID NO: 323997 - DNA, 25 bp, Mus musculus
ggagttcccagtcagagctctgaac

SEQ ID NO: 323998 - DNA, 25 bp, Mus musculus
ggagttcccatgttgttgctggttg

SEQ ID NO: 323999 - DNA, 25 bp, Mus musculus
ggagttcctgaaggttgctagacct

SEQ ID NO: 324000 - DNA, 25 bp, Mus musculus
ggagttcgaataccggcatgtcatg

SEQ ID NO: 324001 - DNA, 25 bp, Mus musculus
ggagttcgagactaccaggtatgga

SEQ ID NO: 324002 - DNA, 25 bp, Mus musculus
ggagttcgctatctgcaggtgtctc

SEQ ID NO: 324003 - DNA, 25 bp, Mus musculus
ggagttctaggaaacagctcaaaga

SEQ ID NO: 324004 - DNA, 25 bp, Mus musculus
ggagttctagggtatccctcctaag

SEQ ID NO: 324005 - DNA, 25 bp, Mus musculus
ggagttctctgtaagtgcctggtga

SEQ ID NO: 324006 - DNA, 25 bp, Mus musculus
ggagttctggctcagatgcgattca

SEQ ID NO: 324007 - DNA, 25 bp, Mus musculus
ggagttctggggacaatggtgacag

SEQ ID NO: 324008 - DNA, 25 bp, Mus musculus
ggagttctttctgaggtgtcagatg

SEQ ID NO: 324009 - DNA, 25 bp, Mus musculus
ggagttgaaagattcccccacagcg

SEQ ID NO: 324010 - DNA, 25 bp, Mus musculus
ggagttgaaaggagtgagcagcggc

SEQ ID NO: 324011 - DNA, 25 bp, Mus musculus
ggagttgaggcctgggtgtgcatta

SEQ ID NO: 324012 - DNA, 25 bp, Mus musculus
ggagttgcaagaccatagtctgtgt

SEQ ID NO: 324013 - DNA, 25 bp, Mus musculus
ggagttgcagagaaccccaaaggta

SEQ ID NO: 324014 - DNA, 25 bp, Mus musculus
ggagttgcagagacctcagacagct

SEQ ID NO: 324015 - DNA, 25 bp, Mus musculus
ggagttgcagctgttccatcgggac

SEQ ID NO: 324016 - DNA, 25 bp, Mus musculus
ggagttgcagtcctatcttcagagc

SEQ ID NO: 324017 - DNA, 25 bp, Mus musculus
ggagttgctggaaaatctggatgac

SEQ ID NO: 324018 - DNA, 25 bp, Mus musculus
ggagttgctggaacagattttctct

SEQ ID NO: 324019 - DNA, 25 bp, Mus musculus
ggagttgctgggagacattggggga

SEQ ID NO: 324020 - DNA, 25 bp, Mus musculus
ggagttggacattggtgcccaggga

SEQ ID NO: 324021 - DNA, 25 bp, Mus musculus
ggagttggagatgtgggctgcgacc

SEQ ID NO: 324022 - DNA, 25 bp, Mus musculus
ggagttggagatgtgtccagacctt

SEQ ID NO: 324023 - DNA, 25 bp, Mus musculus
ggagttggtaaatgtttatggagcc

SEQ ID NO: 324024 - DNA, 25 bp, Mus musculus
ggagttggtaggtgcgccaaacagt

SEQ ID NO: 324025 - DNA, 25 bp, Mus musculus
ggagttggttcaggtggaacatcca

SEQ ID NO: 324026 - DNA, 25 bp, Mus musculus
ggagttggttcagtatcctgtggaa

SEQ ID NO: 324027 - DNA, 25 bp, Mus musculus
ggagttgtccaagattttaccggaa

SEQ ID NO: 324028 - DNA, 25 bp, Mus musculus
ggagttgtccaaggaatgtggcttc

SEQ ID NO: 324029 - DNA, 25 bp, Mus musculus
ggagttgtgatcttattaattggag

SEQ ID NO: 324030 - DNA, 25 bp, Mus musculus
ggagtttaaagatgtcattgtccct

SEQ ID NO: 324031 - DNA, 25 bp, Mus musculus
ggagtttaaagtgtcgtgttctgaa

SEQ ID NO: 324032 - DNA, 25 bp, Mus musculus
ggagtttacagagaggaccatctgc

SEQ ID NO: 324033 - DNA, 25 bp, Mus musculus
ggagtttcaggaactaatgaccatt

SEQ ID NO: 324034 - DNA, 25 bp, Mus musculus
ggagtttcctgttcggaacctggac

SEQ ID NO: 324035 - DNA, 25 bp, Mus musculus
ggagtttctagcctcaaagcggagg

SEQ ID NO: 324036 - DNA, 25 bp, Mus musculus
ggagtttctcagtgacatcactgag

SEQ ID NO: 324037 - DNA, 25 bp, Mus musculus
ggagtttgaaaggatgtcttccaag

SEQ ID NO: 324038 - DNA, 25 bp, Mus musculus
ggagtttgagatcccactgagatgg

SEQ ID NO: 324039 - DNA, 25 bp, Mus musculus
ggagtttgaggaattagaaagtaaa

SEQ ID NO: 324040 - DNA, 25 bp, Mus musculus
ggagtttgccgcagccagccctctg

SEQ ID NO: 324041 - DNA, 25 bp, Mus musculus
ggagtttgccgcaggcccggcacag

SEQ ID NO: 324042 - DNA, 25 bp, Mus musculus
ggagtttgggttaatatttgccaat

SEQ ID NO: 324043 - DNA, 25 bp, Mus musculus
ggagttttaggaaagatataccgca

SEQ ID NO: 324044 - DNA, 25 bp, Mus musculus
ggagtttttcacagatcactggtgt

SEQ ID NO: 324045 - DNA, 25 bp, Mus musculus
ggataaaaagaaacggcggctggca

SEQ ID NO: 324046 - DNA, 25 bp, Mus musculus
ggataaaaagaatgctgccaagaag

SEQ ID NO: 324047 - DNA, 25 bp, Mus musculus
ggataaaaaggtagcaacaattgca

SEQ ID NO: 324048 - DNA, 25 bp, Mus musculus
ggataaagatgttaggggagcttct

SEQ ID NO: 324049 - DNA, 25 bp, Mus musculus
ggataaataattaaggaaagggctg

SEQ ID NO: 324050 - DNA, 25 bp, Mus musculus
ggataacaaaaaggccctaggcctg

SEQ ID NO: 324051 - DNA, 25 bp, Mus musculus
ggataacaaaaaggtgatgaaggac

SEQ ID NO: 324052 - DNA, 25 bp, Mus musculus
ggataacaacgtctatttttattcc

SEQ ID NO: 324053 - DNA, 25 bp, Mus musculus
ggataacaggctgaccacagtggct

SEQ ID NO: 324054 - DNA, 25 bp, Mus musculus
ggataacatgagcatcatcagctgg

SEQ ID NO: 324055 - DNA, 25 bp, Mus musculus
ggataacccaggctgcatgagtggt

SEQ ID NO: 324056 - DNA, 25 bp, Mus musculus
ggataactcaattcctctattgtat

SEQ ID NO: 324057 - DNA, 25 bp, Mus musculus
ggataactctctggacgcccctgtg

SEQ ID NO: 324058 - DNA, 25 bp, Mus musculus
ggataactgggaggatgagccccaa

SEQ ID NO: 324059 - DNA, 25 bp, Mus musculus
ggataacttaaagagtatagaaata

SEQ ID NO: 324060 - DNA, 25 bp, Mus musculus
ggataactttaaccagacacaccgg

SEQ ID NO: 324061 - DNA, 25 bp, Mus musculus
ggataactttgatgtgtatgctggc

SEQ ID NO: 324062 - DNA, 25 bp, Mus musculus
ggataagaaccagactgcagagaag

SEQ ID NO: 324063 - DNA, 25 bp, Mus musculus
ggataagaaccagagaaggaagaat

SEQ ID NO: 324064 - DNA, 25 bp, Mus musculus
ggataagaaccagtactgggttgaa

SEQ ID NO: 324065 - DNA, 25 bp, Mus musculus
ggataagacagatatgaaccgacac

SEQ ID NO: 324066 - DNA, 25 bp, Mus musculus
ggataagaccatcagattatgggac

SEQ ID NO: 324067 - DNA, 25 bp, Mus musculus
ggataagatgaaggctcacagcgag

SEQ ID NO: 324068 - DNA, 25 bp, Mus musculus
ggataagattgagaacctagctagc

SEQ ID NO: 324069 - DNA, 25 bp, Mus musculus
ggataagctctgacttcagaacatg

SEQ ID NO: 324070 - DNA, 25 bp, Mus musculus
ggataagctctggggatgaagagat

SEQ ID NO: 324071 - DNA, 25 bp, Mus musculus
ggataaggactgaatcttggtactt

SEQ ID NO: 324072 - DNA, 25 bp, Mus musculus
ggataaggaggatttcagggtccag

SEQ ID NO: 324073 - DNA, 25 bp, Mus musculus
ggataataaacaaatttctttcaac

SEQ ID NO: 324074 - DNA, 25 bp, Mus musculus
ggataataaagaagaagtaccagct

SEQ ID NO: 324075 - DNA, 25 bp, Mus musculus
ggataataaagatatccaattgtcc

SEQ ID NO: 324076 - DNA, 25 bp, Mus musculus
ggataatagaatgacagcagcaacc

SEQ ID NO: 324077 - DNA, 25 bp, Mus musculus
ggataatatcttggctttccccctt

SEQ ID NO: 324078 - DNA, 25 bp, Mus musculus
ggataatccacagctacacacttga

SEQ ID NO: 324079 - DNA, 25 bp, Mus musculus
ggataatgcactttgtggagaagtt

SEQ ID NO: 324080 - DNA, 25 bp, Mus musculus
ggataatggcggggaagctcagttt

SEQ ID NO: 324081 - DNA, 25 bp, Mus musculus
ggataatgtagagggtcctgttata

SEQ ID NO: 324082 - DNA, 25 bp, Mus musculus
ggataattccaatgatgttgcaaaa

SEQ ID NO: 324083 - DNA, 25 bp, Mus musculus
ggataattggcctgtggaagcagga

SEQ ID NO: 324084 - DNA, 25 bp, Mus musculus
ggataattgggtctggcaacttggg

SEQ ID NO: 324085 - DNA, 25 bp, Mus musculus
ggatacaacactggaagaaaatatc

SEQ ID NO: 324086 - DNA, 25 bp, Mus musculus
ggatacaacactggtgtgtcagtca

SEQ ID NO: 324087 - DNA, 25 bp, Mus musculus
ggatacacagagaacaaaggctcct

SEQ ID NO: 324088 - DNA, 25 bp, Mus musculus
ggatacacagagaagtatagaagaa

SEQ ID NO: 324089 - DNA, 25 bp, Mus musculus
ggatacaggtggaaacgtcctcatc

SEQ ID NO: 324090 - DNA, 25 bp, Mus musculus
ggataccaaactgttttctggactt

SEQ ID NO: 324091 - DNA, 25 bp, Mus musculus
ggatacccagacctgattgtgggag

SEQ ID NO: 324092 - DNA, 25 bp, Mus musculus
ggatacccaggcctgattgtgggag

SEQ ID NO: 324093 - DNA, 25 bp, Mus musculus
ggatacccagtttgcagatggcgtc

SEQ ID NO: 324094 - DNA, 25 bp, Mus musculus
ggataccctgctgggggctctcttc

SEQ ID NO: 324095 - DNA, 25 bp, Mus musculus
ggatacctcacaggacctggagttg

SEQ ID NO: 324096 - DNA, 25 bp, Mus musculus
ggatacgaacgtggatgaggctgta

SEQ ID NO: 324097 - DNA, 25 bp, Mus musculus
ggatacgagcaatcatttccatgtg

SEQ ID NO: 324098 - DNA, 25 bp, Mus musculus
ggatacgagcagtagtaccgttgtc

SEQ ID NO: 324099 - DNA, 25 bp, Mus musculus
ggatacgccacaagaactggaacag

SEQ ID NO: 324100 - DNA, 25 bp, Mus musculus
ggatacgccacaagtaatcagccag

SEQ ID NO: 324101 - DNA, 25 bp, Mus musculus
ggatacgcggcgagccggtgtgaga

SEQ ID NO: 324102 - DNA, 25 bp, Mus musculus
ggatacgcggcggcgcctgtgtctg

SEQ ID NO: 324103 - DNA, 25 bp, Mus musculus
ggatacgggattggcctagaaggag

SEQ ID NO: 324104 - DNA, 25 bp, Mus musculus
ggatacggttcggtcaccactcaag

SEQ ID NO: 324105 - DNA, 25 bp, Mus musculus
ggatactatgtatataacaggcaat

SEQ ID NO: 324106 - DNA, 25 bp, Mus musculus
ggatactcaggaatgggcaaaggac

SEQ ID NO: 324107 - DNA, 25 bp, Mus musculus
ggatactggaagaagccataatttg

SEQ ID NO: 324108 - DNA, 25 bp, Mus musculus
ggatactggagcttgcctctccacc

SEQ ID NO: 324109 - DNA, 25 bp, Mus musculus
ggatactgtaaggtatgtcactggc

SEQ ID NO: 324110 - DNA, 25 bp, Mus musculus
ggatactgtaagtgagggagctggc

SEQ ID NO: 324111 - DNA, 25 bp, Mus musculus
ggatacttacaggagctgatctttt

SEQ ID NO: 324112 - DNA, 25 bp, Mus musculus
ggatactttaaagagaatgtggtct

SEQ ID NO: 324113 - DNA, 25 bp, Mus musculus
ggatactttaaagatgaaaacttta

SEQ ID NO: 324114 - DNA, 25 bp, Mus musculus
ggatagaaagagctcagcagtcagc

SEQ ID NO: 324115 - DNA, 25 bp, Mus musculus
ggatagaaccatcaggctgcagctg

SEQ ID NO: 324116 - DNA, 25 bp, Mus musculus
ggatagaaccgtgcgattgcaatta

SEQ ID NO: 324117 - DNA, 25 bp, Mus musculus
ggatagacgtcaggtggccatcaaa

SEQ ID NO: 324118 - DNA, 25 bp, Mus musculus
ggatagagattaaggagctatcgaa

SEQ ID NO: 324119 - DNA, 25 bp, Mus musculus
ggatagagcagctcagtcctccgtg

SEQ ID NO: 324120 - DNA, 25 bp, Mus musculus
ggatagagccagcacgcatttgatg

SEQ ID NO: 324121 - DNA, 25 bp, Mus musculus
ggatagagccagtatccatggaatg

SEQ ID NO: 324122 - DNA, 25 bp, Mus musculus
ggatagatgtgaggtcacctcagca

SEQ ID NO: 324123 - DNA, 25 bp, Mus musculus
ggatagcaagggcaggactccttta

SEQ ID NO: 324124 - DNA, 25 bp, Mus musculus
ggatagcagccaggggggagctgct

SEQ ID NO: 324125 - DNA, 25 bp, Mus musculus
ggatagcagcctggcccatctccga

SEQ ID NO: 324126 - DNA, 25 bp, Mus musculus
ggatagccaggtcaaagcccagcgg

SEQ ID NO: 324127 - DNA, 25 bp, Mus musculus
ggatagccaggtgccagaactggga

SEQ ID NO: 324128 - DNA, 25 bp, Mus musculus
ggatagcctgcttggcagtgacctt

SEQ ID NO: 324129 - DNA, 25 bp, Mus musculus
ggatagcctggtaggacagtccttc

SEQ ID NO: 324130 - DNA, 25 bp, Mus musculus
ggatagcgtcagcgggggaacagta

SEQ ID NO: 324131 - DNA, 25 bp, Mus musculus
ggatagctttccaggacaagaagat

SEQ ID NO: 324132 - DNA, 25 bp, Mus musculus
ggataggcagaagggaactgagccg

SEQ ID NO: 324133 - DNA, 25 bp, Mus musculus
ggatagggagttcttccccagaggg

SEQ ID NO: 324134 - DNA, 25 bp, Mus musculus
ggatagtaaggtgaacatcattccc

SEQ ID NO: 324135 - DNA, 25 bp, Mus musculus
ggatagtagtgaattgaatccaggg

SEQ ID NO: 324136 - DNA, 25 bp, Mus musculus
ggatagtgaagatgaagatgatagc

SEQ ID NO: 324137 - DNA, 25 bp, Mus musculus
ggatagtgacagtgacgatggggag

SEQ ID NO: 324138 - DNA, 25 bp, Mus musculus
ggatagtggagggtgtcccctgaac

SEQ ID NO: 324139 - DNA, 25 bp, Mus musculus
ggatagtggcatgtgggcatcatcg

SEQ ID NO: 324140 - DNA, 25 bp, Mus musculus
ggatagtggcatgtggttcttcccg

SEQ ID NO: 324141 - DNA, 25 bp, Mus musculus
ggatagtgtggaaacctgctgcccc

SEQ ID NO: 324142 - DNA, 25 bp, Mus musculus
ggatagtgtgggcctgccagctccc

SEQ ID NO: 324143 - DNA, 25 bp, Mus musculus
ggatataaagaaaccagaccgtgat

SEQ ID NO: 324144 - DNA, 25 bp, Mus musculus
ggatataaagaccgtgatgactggg

SEQ ID NO: 324145 - DNA, 25 bp, Mus musculus
ggatataattcaggttgatgaaaaa

SEQ ID NO: 324146 - DNA, 25 bp, Mus musculus
ggatataattcagtgactcactatg

SEQ ID NO: 324147 - DNA, 25 bp, Mus musculus
ggatatacagaccttactgtggcct

SEQ ID NO: 324148 - DNA, 25 bp, Mus musculus
ggatatactcaaagggcagcacatg

SEQ ID NO: 324149 - DNA, 25 bp, Mus musculus
ggatatactcaaaggtgttggggcc

SEQ ID NO: 324150 - DNA, 25 bp, Mus musculus
ggatatacttcagaatctgaccaca

SEQ ID NO: 324151 - DNA, 25 bp, Mus musculus
ggatatacttcagctccaacagagg

SEQ ID NO: 324152 - DNA, 25 bp, Mus musculus
ggatatacttcaggaactaattctg

SEQ ID NO: 324153 - DNA, 25 bp, Mus musculus
ggatatatccgaaatggctaccaag

SEQ ID NO: 324154 - DNA, 25 bp, Mus musculus
ggatatatttgttaatggagtgttt

SEQ ID NO: 324155 - DNA, 25 bp, Mus musculus
ggatatcaaagaggtagtagtctgg

SEQ ID NO: 324156 - DNA, 25 bp, Mus musculus
ggatatcatgagctttcccgaaaga

SEQ ID NO: 324157 - DNA, 25 bp, Mus musculus
ggatatccctaagattttgttcctg

SEQ ID NO: 324158 - DNA, 25 bp, Mus musculus
ggatatcgacgtgatcatgggtggc

SEQ ID NO: 324159 - DNA, 25 bp, Mus musculus
ggatatcgatggccgccctgtcaaa

SEQ ID NO: 324160 - DNA, 25 bp, Mus musculus
ggatatcgcggcccaatggaagaga

SEQ ID NO: 324161 - DNA, 25 bp, Mus musculus
ggatatcgcgggacaggaacggttt

SEQ ID NO: 324162 - DNA, 25 bp, Mus musculus
ggatatctgaggttcccaatcaagg

SEQ ID NO: 324163 - DNA, 25 bp, Mus musculus
ggatatgaacagctggccgactgct

SEQ ID NO: 324164 - DNA, 25 bp, Mus musculus
ggatatgacagaagtctgcgtggtg

SEQ ID NO: 324165 - DNA, 25 bp, Mus musculus
ggatatgagaagtcaaactacaact

SEQ ID NO: 324166 - DNA, 25 bp, Mus musculus
ggatatgagcaaacgtatgcagaga

SEQ ID NO: 324167 - DNA, 25 bp, Mus musculus
ggatatgatggtggctatggaggtt

SEQ ID NO: 324168 - DNA, 25 bp, Mus musculus
ggatatgattccagatgcacgccat

SEQ ID NO: 324169 - DNA, 25 bp, Mus musculus
ggatatgattccaggctactagtca

SEQ ID NO: 324170 - DNA, 25 bp, Mus musculus
ggatatgcaagctcttgaagacagt

SEQ ID NO: 324171 - DNA, 25 bp, Mus musculus
ggatatgcaagttttgattatgaag

SEQ ID NO: 324172 - DNA, 25 bp, Mus musculus
ggatatgcaggtgcttcaccttttg

SEQ ID NO: 324173 - DNA, 25 bp, Mus musculus
ggatatggcaggatgttcaactaaa

SEQ ID NO: 324174 - DNA, 25 bp, Mus musculus
ggatatgtaagacacctgtggatga

SEQ ID NO: 324175 - DNA, 25 bp, Mus musculus
ggatatgtaagtgctcttgtgaaag

SEQ ID NO: 324176 - DNA, 25 bp, Mus musculus
ggatatgtgacctgaaggagccaac

SEQ ID NO: 324177 - DNA, 25 bp, Mus musculus
ggatatgtgacctggactcagcctt

SEQ ID NO: 324178 - DNA, 25 bp, Mus musculus
ggatatgtggggacatcagtgcagt

SEQ ID NO: 324179 - DNA, 25 bp, Mus musculus
ggatattagggtctctgctactggt

SEQ ID NO: 324180 - DNA, 25 bp, Mus musculus
ggatattcacaagagcgttataacc

SEQ ID NO: 324181 - DNA, 25 bp, Mus musculus
ggatattcctaggaccttctaccgt

SEQ ID NO: 324182 - DNA, 25 bp, Mus musculus
ggatattgagaccctacacttattc

SEQ ID NO: 324183 - DNA, 25 bp, Mus musculus
ggatattggagctccagccacaatg

SEQ ID NO: 324184 - DNA, 25 bp, Mus musculus
ggatattgtcaagaagcaagacttg

SEQ ID NO: 324185 - DNA, 25 bp, Mus musculus
ggatattgtcaaggaactgaaagac

SEQ ID NO: 324186 - DNA, 25 bp, Mus musculus
ggatattgtcagcaggttgatgcaa

SEQ ID NO: 324187 - DNA, 25 bp, Mus musculus
ggatattgtgtagaatatatttgaa

SEQ ID NO: 324188 - DNA, 25 bp, Mus musculus
ggatatttgcaagatgagatgaacg

SEQ ID NO: 324189 - DNA, 25 bp, Mus musculus
ggatattttcaggtgaaccagaaca

SEQ ID NO: 324190 - DNA, 25 bp, Mus musculus
ggatattttctacagctctcaacct

SEQ ID NO: 324191 - DNA, 25 bp, Mus musculus
ggatcaaaacagaggtgcaaagaaa

SEQ ID NO: 324192 - DNA, 25 bp, Mus musculus
ggatcaaaagcaggaggagccatct

SEQ ID NO: 324193 - DNA, 25 bp, Mus musculus
ggatcaaaagcaggttgtccagagc

SEQ ID NO: 324194 - DNA, 25 bp, Mus musculus
ggatcaaacatatgctgagaaatcc

SEQ ID NO: 324195 - DNA, 25 bp, Mus musculus
ggatcaaacatatggcacttcttgg

SEQ ID NO: 324196 - DNA, 25 bp, Mus musculus
ggatcaaagcctcggacgtatgtga

SEQ ID NO: 324197 - DNA, 25 bp, Mus musculus
ggatcaaagcctgggacgtatgtga

SEQ ID NO: 324198 - DNA, 25 bp, Mus musculus
ggatcaacagtgagcaactgatggt

SEQ ID NO: 324199 - DNA, 25 bp, Mus musculus
ggatcaagcgactgctctttacagc

SEQ ID NO: 324200 - DNA, 25 bp, Mus musculus
ggatcaagcgactgtttagcttttt

SEQ ID NO: 324201 - DNA, 25 bp, Mus musculus
ggatcaagcgacttaaagaaggtcc

SEQ ID NO: 324202 - DNA, 25 bp, Mus musculus
ggatcaaggagaaaatacaactgtg

SEQ ID NO: 324203 - DNA, 25 bp, Mus musculus
ggatcaaggtcagatctataccttc

SEQ ID NO: 324204 - DNA, 25 bp, Mus musculus
ggatcacaaagacctgtgcccctcc

SEQ ID NO: 324205 - DNA, 25 bp, Mus musculus
ggatcacaaagtgagtttcctgcgc

SEQ ID NO: 324206 - DNA, 25 bp, Mus musculus
ggatcacaagtgtgtctcaaaagat

SEQ ID NO: 324207 - DNA, 25 bp, Mus musculus
ggatcacactggatgcagcctacca

SEQ ID NO: 324208 - DNA, 25 bp, Mus musculus
ggatcacagaaggtccctagcagga

SEQ ID NO: 324209 - DNA, 25 bp, Mus musculus
ggatcaccaggtgttgatgctcatg

SEQ ID NO: 324210 - DNA, 25 bp, Mus musculus
ggatcacctctaagagacgtggagc

SEQ ID NO: 324211 - DNA, 25 bp, Mus musculus
ggatcacgaaggtaacttcatggaa

SEQ ID NO: 324212 - DNA, 25 bp, Mus musculus
ggatcacgaattgggccggtgtaca

SEQ ID NO: 324213 - DNA, 25 bp, Mus musculus
ggatcacgaggttgtacttgttttt

SEQ ID NO: 324214 - DNA, 25 bp, Mus musculus
ggatcacgggacaaggtcccatctg

SEQ ID NO: 324215 - DNA, 25 bp, Mus musculus
ggatcacgggacaagttaattcagg

SEQ ID NO: 324216 - DNA, 25 bp, Mus musculus
ggatcactgcaaaatgaacccacag

SEQ ID NO: 324217 - DNA, 25 bp, Mus musculus
ggatcagaagcaaggttttcgggtt

SEQ ID NO: 324218 - DNA, 25 bp, Mus musculus
ggatcagacactgacaaagcaatac

SEQ ID NO: 324219 - DNA, 25 bp, Mus musculus
ggatcagacactggcactggtgggg

SEQ ID NO: 324220 - DNA, 25 bp, Mus musculus
ggatcagaccacaggttctccccta

SEQ ID NO: 324221 - DNA, 25 bp, Mus musculus
ggatcagaccacaggtttgtccaga

SEQ ID NO: 324222 - DNA, 25 bp, Mus musculus
ggatcagataaagcaaattaaaaag

SEQ ID NO: 324223 - DNA, 25 bp, Mus musculus
ggatcagattcaggcaacaatatct

SEQ ID NO: 324224 - DNA, 25 bp, Mus musculus
ggatcagcagctgtggctaacttcg

SEQ ID NO: 324225 - DNA, 25 bp, Mus musculus
ggatcagcatagaagctgcgttgga

SEQ ID NO: 324226 - DNA, 25 bp, Mus musculus
ggatcagcataggatcaagtagaca

SEQ ID NO: 324227 - DNA, 25 bp, Mus musculus
ggatcagcgtgggagctccgctttg

SEQ ID NO: 324228 - DNA, 25 bp, Mus musculus
ggatcaggaagatcctggcccgccc

SEQ ID NO: 324229 - DNA, 25 bp, Mus musculus
ggatcaggaggttgagaacaaaaag

SEQ ID NO: 324230 - DNA, 25 bp, Mus musculus
ggatcaggtactggcccttgggatt

SEQ ID NO: 324231 - DNA, 25 bp, Mus musculus
ggatcaggtgggaggttgtgcccac

SEQ ID NO: 324232 - DNA, 25 bp, Mus musculus
ggatcagtggaagccaaggataacc

SEQ ID NO: 324233 - DNA, 25 bp, Mus musculus
ggatcagtggaaggcagttaaacca

SEQ ID NO: 324234 - DNA, 25 bp, Mus musculus
ggatcagtggaagtcttgaaataca

SEQ ID NO: 324235 - DNA, 25 bp, Mus musculus
ggatcagtgtatcaggatgatgctg

SEQ ID NO: 324236 - DNA, 25 bp, Mus musculus
ggatcagttatgagacttcagactg

SEQ ID NO: 324237 - DNA, 25 bp, Mus musculus
ggatcagttatggcagtaatggaac

SEQ ID NO: 324238 - DNA, 25 bp, Mus musculus
ggatcagttatgtttttatttcagg

SEQ ID NO: 324239 - DNA, 25 bp, Mus musculus
ggatcatcaaggtggaaagagacat

SEQ ID NO: 324240 - DNA, 25 bp, Mus musculus
ggatcatcaggaggtgcttacatgt

SEQ ID NO: 324241 - DNA, 25 bp, Mus musculus
ggatcatcagtttgttttctttgct

SEQ ID NO: 324242 - DNA, 25 bp, Mus musculus
ggatcatccagcatgtgtctaacaa

SEQ ID NO: 324243 - DNA, 25 bp, Mus musculus
ggatcatcgacccccttttgcaatg

SEQ ID NO: 324244 - DNA, 25 bp, Mus musculus
ggatcatgacagaattccagaggca

SEQ ID NO: 324245 - DNA, 25 bp, Mus musculus
ggatcatgagaaggctgctttgatt

SEQ ID NO: 324246 - DNA, 25 bp, Mus musculus
ggatcatggggtactcaatgcagga

SEQ ID NO: 324247 - DNA, 25 bp, Mus musculus
ggatcatgggttcctcggcctctga

SEQ ID NO: 324248 - DNA, 25 bp, Mus musculus
ggatcatgtgcagagcctggcccaa

SEQ ID NO: 324249 - DNA, 25 bp, Mus musculus
ggatcattcacagatcattctagaa

SEQ ID NO: 324250 - DNA, 25 bp, Mus musculus
ggatcattccaagaagaagcccggg

SEQ ID NO: 324251 - DNA, 25 bp, Mus musculus
ggatcattctgacagctgtgaactg

SEQ ID NO: 324252 - DNA, 25 bp, Mus musculus
ggatcatttcaaccgaattggcaag

SEQ ID NO: 324253 - DNA, 25 bp, Mus musculus
ggatccaaaatcaggtcacagacga

SEQ ID NO: 324254 - DNA, 25 bp, Mus musculus
ggatccaaagaggagatctttttgc

SEQ ID NO: 324255 - DNA, 25 bp, Mus musculus
ggatccaacaggtgtgggcccctcg

SEQ ID NO: 324256 - DNA, 25 bp, Mus musculus
ggatccaacctttgccatgggcctt

SEQ ID NO: 324257 - DNA, 25 bp, Mus musculus
ggatccaacgacaatcagcgccttg

SEQ ID NO: 324258 - DNA, 25 bp, Mus musculus
ggatccaacgacattgatacactaa

SEQ ID NO: 324259 - DNA, 25 bp, Mus musculus
ggatccaatagagaggttgatgttt

SEQ ID NO: 324260 - DNA, 25 bp, Mus musculus
ggatccacacagcaggacagttgtc

SEQ ID NO: 324261 - DNA, 25 bp, Mus musculus
ggatccacacaggcgagaagcctca

SEQ ID NO: 324262 - DNA, 25 bp, Mus musculus
ggatccaccagcactgccccccaaa

SEQ ID NO: 324263 - DNA, 25 bp, Mus musculus
ggatccacgaggacccgcctcgcat

SEQ ID NO: 324264 - DNA, 25 bp, Mus musculus
ggatccagaaggaactgactgatta

SEQ ID NO: 324265 - DNA, 25 bp, Mus musculus
ggatccagaaggttgctttcactac

SEQ ID NO: 324266 - DNA, 25 bp, Mus musculus
ggatccagacacagatggaggtagt

SEQ ID NO: 324267 - DNA, 25 bp, Mus musculus
ggatccagacacaggcaactggccc

SEQ ID NO: 324268 - DNA, 25 bp, Mus musculus
ggatccagaccaaaaccaacaaaac

SEQ ID NO: 324269 - DNA, 25 bp, Mus musculus
ggatccagacctcaggtttaacaca

SEQ ID NO: 324270 - DNA, 25 bp, Mus musculus
ggatccagagggctgactctgtggc

SEQ ID NO: 324271 - DNA, 25 bp, Mus musculus
ggatccagccgagcccggtcttgct

SEQ ID NO: 324272 - DNA, 25 bp, Mus musculus
ggatccagccggttactctccagga

SEQ ID NO: 324273 - DNA, 25 bp, Mus musculus
ggatccaggtggcacattggaagtt

SEQ ID NO: 324274 - DNA, 25 bp, Mus musculus
ggatccatctcagggttctggctgc

SEQ ID NO: 324275 - DNA, 25 bp, Mus musculus
ggatcccaaaattcccagttaagga

SEQ ID NO: 324276 - DNA, 25 bp, Mus musculus
ggatcccaagacagaccctgtgcgg

SEQ ID NO: 324277 - DNA, 25 bp, Mus musculus
ggatcccaatgctcggtccgcggag

SEQ ID NO: 324278 - DNA, 25 bp, Mus musculus
ggatcccactgatgccaagtatcac

SEQ ID NO: 324279 - DNA, 25 bp, Mus musculus
ggatcccagcgaaaagcccattgga

SEQ ID NO: 324280 - DNA, 25 bp, Mus musculus
ggatcccatctccgatggtggaacc

SEQ ID NO: 324281 - DNA, 25 bp, Mus musculus
ggatccccacaatgatctgcatcac

SEQ ID NO: 324282 - DNA, 25 bp, Mus musculus
ggatccccaggctgcccttggggcc

SEQ ID NO: 324283 - DNA, 25 bp, Mus musculus
ggatccccatagcagacaacaacag

SEQ ID NO: 324284 - DNA, 25 bp, Mus musculus
ggatccccatagcaggggaagaaga

SEQ ID NO: 324285 - DNA, 25 bp, Mus musculus
ggatccccatagcaggtattccagc

SEQ ID NO: 324286 - DNA, 25 bp, Mus musculus
ggatcccccagggtgaagcactgga

SEQ ID NO: 324287 - DNA, 25 bp, Mus musculus
ggatcccccagggttgtgacttaga

SEQ ID NO: 324288 - DNA, 25 bp, Mus musculus
ggatcccccgcagcgtttggaaaac

SEQ ID NO: 324289 - DNA, 25 bp, Mus musculus
ggatcccctgggagtgggaggagtg

SEQ ID NO: 324290 - DNA, 25 bp, Mus musculus
ggatcccgaggccacgtggcaccgg

SEQ ID NO: 324291 - DNA, 25 bp, Mus musculus
ggatccctccagcggaactggctca

SEQ ID NO: 324292 - DNA, 25 bp, Mus musculus
ggatccctccaggaggagcaggaca

SEQ ID NO: 324293 - DNA, 25 bp, Mus musculus
ggatccctctgtgcactgagcagcc

SEQ ID NO: 324294 - DNA, 25 bp, Mus musculus
ggatccctctgttttgccattgctg

SEQ ID NO: 324295 - DNA, 25 bp, Mus musculus
ggatccctgaattgacccagcccgg

SEQ ID NO: 324296 - DNA, 25 bp, Mus musculus
ggatcccttcagagggacagaccac

SEQ ID NO: 324297 - DNA, 25 bp, Mus musculus
ggatccgcaagctgccccccaagtg

SEQ ID NO: 324298 - DNA, 25 bp, Mus musculus
ggatccgcaagctgtctgatcagtg

SEQ ID NO: 324299 - DNA, 25 bp, Mus musculus
ggatccgcacgaaataaatcataat

SEQ ID NO: 324300 - DNA, 25 bp, Mus musculus
ggatccgcctccccgatcccgcccg

SEQ ID NO: 324301 - DNA, 25 bp, Mus musculus
ggatccggatggagcttttaaggaa

SEQ ID NO: 324302 - DNA, 25 bp, Mus musculus
ggatccggatgggtatagtgccaaa

SEQ ID NO: 324303 - DNA, 25 bp, Mus musculus
ggatccggcagcttaggttgtccta

SEQ ID NO: 324304 - DNA, 25 bp, Mus musculus
ggatccggcaggaattgaagttaaa

SEQ ID NO: 324305 - DNA, 25 bp, Mus musculus
ggatccggctgcaagatgagcctgg

SEQ ID NO: 324306 - DNA, 25 bp, Mus musculus
ggatccggctgcaagggttgttaaa

SEQ ID NO: 324307 - DNA, 25 bp, Mus musculus
ggatccgggaggaacatcacaagtg

SEQ ID NO: 324308 - DNA, 25 bp, Mus musculus
ggatccggtcgagatgaccggttcg

SEQ ID NO: 324309 - DNA, 25 bp, Mus musculus
ggatccgtggacaacctggacagct

SEQ ID NO: 324310 - DNA, 25 bp, Mus musculus
ggatcctaaagtggccgtgcctgca

SEQ ID NO: 324311 - DNA, 25 bp, Mus musculus
ggatcctacagcttcacatggagtg

SEQ ID NO: 324312 - DNA, 25 bp, Mus musculus
ggatcctcaggaggaagaacctgct

SEQ ID NO: 324313 - DNA, 25 bp, Mus musculus
ggatcctccaacaatcctccatgtg

SEQ ID NO: 324314 - DNA, 25 bp, Mus musculus
ggatcctccaggtggccacggtgaa

SEQ ID NO: 324315 - DNA, 25 bp, Mus musculus
ggatcctccagtgtctccagaacaa

SEQ ID NO: 324316 - DNA, 25 bp, Mus musculus
ggatcctcccagccactggtgtgac

SEQ ID NO: 324317 - DNA, 25 bp, Mus musculus
ggatcctcccagggttcactgatca

SEQ ID NO: 324318 - DNA, 25 bp, Mus musculus
ggatcctccgagagttctgtccttg

SEQ ID NO: 324319 - DNA, 25 bp, Mus musculus
ggatcctccggggcaacattttgat

SEQ ID NO: 324320 - DNA, 25 bp, Mus musculus
ggatcctccggggcatccagggaaa

SEQ ID NO: 324321 - DNA, 25 bp, Mus musculus
ggatcctctaagcaggtaaacgagt

SEQ ID NO: 324322 - DNA, 25 bp, Mus musculus
ggatcctctaagcaggtttctaccc

SEQ ID NO: 324323 - DNA, 25 bp, Mus musculus
ggatcctctcaatgaattcctggag

SEQ ID NO: 324324 - DNA, 25 bp, Mus musculus
ggatcctgattgagggccgcaaaca

SEQ ID NO: 324325 - DNA, 25 bp, Mus musculus
ggatcctgccagaggaagcccgtgc

SEQ ID NO: 324326 - DNA, 25 bp, Mus musculus
ggatcctgcccagtgttgaagaaat

SEQ ID NO: 324327 - DNA, 25 bp, Mus musculus
ggatccttacatgcgctgtaagatg

SEQ ID NO: 324328 - DNA, 25 bp, Mus musculus
ggatccttacatgctcctgaccact

SEQ ID NO: 324329 - DNA, 25 bp, Mus musculus
ggatccttggatggtggcaccatgg

SEQ ID NO: 324330 - DNA, 25 bp, Mus musculus
ggatcgaagcggccttgggatgtct

SEQ ID NO: 324331 - DNA, 25 bp, Mus musculus
ggatcgaaggcctgcaagacgacaa

SEQ ID NO: 324332 - DNA, 25 bp, Mus musculus
ggatcgaaggcctggtcattcaata

SEQ ID NO: 324333 - DNA, 25 bp, Mus musculus
ggatcgacaaccacagcaaaccctt

SEQ ID NO: 324334 - DNA, 25 bp, Mus musculus
ggatcgacgacctccacaaggttct

SEQ ID NO: 324335 - DNA, 25 bp, Mus musculus
ggatcgagagaaagtgcaacagtat

SEQ ID NO: 324336 - DNA, 25 bp, Mus musculus
ggatcgagagcgtctgtcctgtgca

SEQ ID NO: 324337 - DNA, 25 bp, Mus musculus
ggatcgagagggtctgtcctgtgca

SEQ ID NO: 324338 - DNA, 25 bp, Mus musculus
ggatcgagagtaagtgcaacagtat

SEQ ID NO: 324339 - DNA, 25 bp, Mus musculus
ggatcgattccgaatctgcctcagc

SEQ ID NO: 324340 - DNA, 25 bp, Mus musculus
ggatcgattccgatttgtgctagtg

SEQ ID NO: 324341 - DNA, 25 bp, Mus musculus
ggatcgcagaggggacaatgccaag

SEQ ID NO: 324342 - DNA, 25 bp, Mus musculus
ggatcgcatgggctaccagctgcat

SEQ ID NO: 324343 - DNA, 25 bp, Mus musculus
ggatcgcccctaagccttcaagatg

SEQ ID NO: 324344 - DNA, 25 bp, Mus musculus
ggatcgcccctaaggtaagttctcg

SEQ ID NO: 324345 - DNA, 25 bp, Mus musculus
ggatcgcctgcagagaggaagacga

SEQ ID NO: 324346 - DNA, 25 bp, Mus musculus
ggatcgcctgcagggtgagttggtg

SEQ ID NO: 324347 - DNA, 25 bp, Mus musculus
ggatcgcgtcccggcccagggcctt

SEQ ID NO: 324348 - DNA, 25 bp, Mus musculus
ggatcgctgtccagctcgtagtgca

SEQ ID NO: 324349 - DNA, 25 bp, Mus musculus
ggatcgctgtccaggagctggagaa

SEQ ID NO: 324350 - DNA, 25 bp, Mus musculus
ggatcggaacaagtctgggacctgt

SEQ ID NO: 324351 - DNA, 25 bp, Mus musculus
ggatcggaacaattggtacccttgt

SEQ ID NO: 324352 - DNA, 25 bp, Mus musculus
ggatcggactaggtctgcctgggct

SEQ ID NO: 324353 - DNA, 25 bp, Mus musculus
ggatcggactagtggccacagttaa

SEQ ID NO: 324354 - DNA, 25 bp, Mus musculus
ggatcggagccgcagcagttgcccc

SEQ ID NO: 324355 - DNA, 25 bp, Mus musculus
ggatcggcattgcctgcaggtgtat

SEQ ID NO: 324356 - DNA, 25 bp, Mus musculus
ggatcggccagtgagcccatcatct

SEQ ID NO: 324357 - DNA, 25 bp, Mus musculus
ggatcggccagtgccaaggcctggc

SEQ ID NO: 324358 - DNA, 25 bp, Mus musculus
ggatcggcggttcattacagcatca

SEQ ID NO: 324359 - DNA, 25 bp, Mus musculus
ggatcgggcgagctgtaaaagctgg

SEQ ID NO: 324360 - DNA, 25 bp, Mus musculus
ggatcggggcaggatggcagccaca

SEQ ID NO: 324361 - DNA, 25 bp, Mus musculus
ggatcgtctgagtggagaacttcac

SEQ ID NO: 324362 - DNA, 25 bp, Mus musculus
ggatcgtggttacagagccgagcag

SEQ ID NO: 324363 - DNA, 25 bp, Mus musculus
ggatcgtggttacaggaaataatga

SEQ ID NO: 324364 - DNA, 25 bp, Mus musculus
ggatctaacaaggagcgagattttg

SEQ ID NO: 324365 - DNA, 25 bp, Mus musculus
ggatctaacaaggttcatttaattc

SEQ ID NO: 324366 - DNA, 25 bp, Mus musculus
ggatctaacccaggtgatgaagtct

SEQ ID NO: 324367 - DNA, 25 bp, Mus musculus
ggatctacagaagagagacatctcc

SEQ ID NO: 324368 - DNA, 25 bp, Mus musculus
ggatctacaggtgaaagagctggtc

SEQ ID NO: 324369 - DNA, 25 bp, Mus musculus
ggatctaccaaagtctcactttatc

SEQ ID NO: 324370 - DNA, 25 bp, Mus musculus
ggatctactcctcagctggaatttt

SEQ ID NO: 324371 - DNA, 25 bp, Mus musculus
ggatctactgagcgcagccttgggt

SEQ ID NO: 324372 - DNA, 25 bp, Mus musculus
ggatctactggttctgcagtacagc

SEQ ID NO: 324373 - DNA, 25 bp, Mus musculus
ggatctactgtgggcccagccacgg

SEQ ID NO: 324374 - DNA, 25 bp, Mus musculus
ggatctatgaggaaatgaataacag

SEQ ID NO: 324375 - DNA, 25 bp, Mus musculus
ggatctatgagttaaacgccaagcc

SEQ ID NO: 324376 - DNA, 25 bp, Mus musculus
ggatctattaaaagccccagaccct

SEQ ID NO: 324377 - DNA, 25 bp, Mus musculus
ggatctattaaaaggtcaccaccat

SEQ ID NO: 324378 - DNA, 25 bp, Mus musculus
ggatctcacaacgggcaccaccaca

SEQ ID NO: 324379 - DNA, 25 bp, Mus musculus
ggatctcaccagggcccagtcattt

SEQ ID NO: 324380 - DNA, 25 bp, Mus musculus
ggatctcactgtggtccagattata

SEQ ID NO: 324381 - DNA, 25 bp, Mus musculus
ggatctcagagggatttgacccatt

SEQ ID NO: 324382 - DNA, 25 bp, Mus musculus
ggatctcagataataaccaaagagt

SEQ ID NO: 324383 - DNA, 25 bp, Mus musculus
ggatctcataagagaggagccaaaa

SEQ ID NO: 324384 - DNA, 25 bp, Mus musculus
ggatctcatggagagtaaaagttgg

SEQ ID NO: 324385 - DNA, 25 bp, Mus musculus
ggatctccaagacctcactatctca

SEQ ID NO: 324386 - DNA, 25 bp, Mus musculus
ggatctccaaggaccacaatgctgc

SEQ ID NO: 324387 - DNA, 25 bp, Mus musculus
ggatctccacttgggtgaaagacaa

SEQ ID NO: 324388 - DNA, 25 bp, Mus musculus
ggatctccaggggagttttgtgctg

SEQ ID NO: 324389 - DNA, 25 bp, Mus musculus
ggatctccttatcaggacgcacatg

SEQ ID NO: 324390 - DNA, 25 bp, Mus musculus
ggatctccttccaaagaggatttgt

SEQ ID NO: 324391 - DNA, 25 bp, Mus musculus
ggatctctcagcaccatatcctctg

SEQ ID NO: 324392 - DNA, 25 bp, Mus musculus
ggatctctgaaactgatgcagtgac

SEQ ID NO: 324393 - DNA, 25 bp, Mus musculus
ggatctctgggtctgaaaaggagcc

SEQ ID NO: 324394 - DNA, 25 bp, Mus musculus
ggatctcttccaggaatgtctcgag

SEQ ID NO: 324395 - DNA, 25 bp, Mus musculus
ggatctcttgcctcaatcaagacat

SEQ ID NO: 324396 - DNA, 25 bp, Mus musculus
ggatctcttggccagagaacagctt

SEQ ID NO: 324397 - DNA, 25 bp, Mus musculus
ggatctcttggtaggccaggaaatg

SEQ ID NO: 324398 - DNA, 25 bp, Mus musculus
ggatctgaaagaggatatcaagttc

SEQ ID NO: 324399 - DNA, 25 bp, Mus musculus
ggatctgaagaacgggtatggcttt

SEQ ID NO: 324400 - DNA, 25 bp, Mus musculus
ggatctgaagaacggtctgttatgt

SEQ ID NO: 324401 - DNA, 25 bp, Mus musculus
ggatctgaagatccttcttgatgaa

SEQ ID NO: 324402 - DNA, 25 bp, Mus musculus
ggatctgaaggcggcacgttttcta

SEQ ID NO: 324403 - DNA, 25 bp, Mus musculus
ggatctgaataagtgcggacctatg

SEQ ID NO: 324404 - DNA, 25 bp, Mus musculus
ggatctgagtcaggatgcgtacact

SEQ ID NO: 324405 - DNA, 25 bp, Mus musculus
ggatctgatcagaacaggacgcggg

SEQ ID NO: 324406 - DNA, 25 bp, Mus musculus
ggatctgatcaggtccagcctgatg

SEQ ID NO: 324407 - DNA, 25 bp, Mus musculus
ggatctgatcagtctcggcatctct

SEQ ID NO: 324408 - DNA, 25 bp, Mus musculus
ggatctgcagagctcagtcagaagg

SEQ ID NO: 324409 - DNA, 25 bp, Mus musculus
ggatctgcagaggtcagtcagaagg

SEQ ID NO: 324410 - DNA, 25 bp, Mus musculus
ggatctgcagccatgtcatatccag

SEQ ID NO: 324411 - DNA, 25 bp, Mus musculus
ggatctgccagtgtgcccctggatt

SEQ ID NO: 324412 - DNA, 25 bp, Mus musculus
ggatctgcctgcgatctagggcggc

SEQ ID NO: 324413 - DNA, 25 bp, Mus musculus
ggatctgcctggtacaactgtaacc

SEQ ID NO: 324414 - DNA, 25 bp, Mus musculus
ggatctgctaaaagatttctgcatg

SEQ ID NO: 324415 - DNA, 25 bp, Mus musculus
ggatctggaacagacacagcccttg

SEQ ID NO: 324416 - DNA, 25 bp, Mus musculus
ggatctggacctcacctccttatag

SEQ ID NO: 324417 - DNA, 25 bp, Mus musculus
ggatctggagcctgatctctcaaca

SEQ ID NO: 324418 - DNA, 25 bp, Mus musculus
ggatctggataaagagttcaggaag

SEQ ID NO: 324419 - DNA, 25 bp, Mus musculus
ggatctggcccagaggccaagtgag

SEQ ID NO: 324420 - DNA, 25 bp, Mus musculus
ggatctggcgacatgatatttgaag

SEQ ID NO: 324421 - DNA, 25 bp, Mus musculus
ggatctgggacactgaatggagccc

SEQ ID NO: 324422 - DNA, 25 bp, Mus musculus
ggatctgtaactgaggctttaacag

SEQ ID NO: 324423 - DNA, 25 bp, Mus musculus
ggatctgtacaagggtgaaaaagga

SEQ ID NO: 324424 - DNA, 25 bp, Mus musculus
ggatctgtccccgaggctgcttatg

SEQ ID NO: 324425 - DNA, 25 bp, Mus musculus
ggatctgtgattataaaagctttga

SEQ ID NO: 324426 - DNA, 25 bp, Mus musculus
ggatcttaaagagcaaatcccatat

SEQ ID NO: 324427 - DNA, 25 bp, Mus musculus
ggatcttaactggagttggtcgaat

SEQ ID NO: 324428 - DNA, 25 bp, Mus musculus
ggatcttaagaaatgctgcggcacc

SEQ ID NO: 324429 - DNA, 25 bp, Mus musculus
ggatcttacccaaagcccacctgga

SEQ ID NO: 324430 - DNA, 25 bp, Mus musculus
ggatcttacggagggctggatcgtg

SEQ ID NO: 324431 - DNA, 25 bp, Mus musculus
ggatcttcagagggttcccagcccc

SEQ ID NO: 324432 - DNA, 25 bp, Mus musculus
ggatcttcccgctctgtgaccagcc

SEQ ID NO: 324433 - DNA, 25 bp, Mus musculus
ggatcttcccggttctcggactccc

SEQ ID NO: 324434 - DNA, 25 bp, Mus musculus
ggatcttccggccccggaagctgac

SEQ ID NO: 324435 - DNA, 25 bp, Mus musculus
ggatcttcctgcaagaactgagcct

SEQ ID NO: 324436 - DNA, 25 bp, Mus musculus
ggatcttcctgcaagcagccttcag

SEQ ID NO: 324437 - DNA, 25 bp, Mus musculus
ggatcttcctgcaagggtggccatg

SEQ ID NO: 324438 - DNA, 25 bp, Mus musculus
ggatcttcgtactagaggctgctgt

SEQ ID NO: 324439 - DNA, 25 bp, Mus musculus
ggatcttcgtactagctcacttcat

SEQ ID NO: 324440 - DNA, 25 bp, Mus musculus
ggatcttcgtactagctcctggact

SEQ ID NO: 324441 - DNA, 25 bp, Mus musculus
ggatcttctagtgaacagcgtcacg

SEQ ID NO: 324442 - DNA, 25 bp, Mus musculus
ggatcttctgaaagctctgtacaac

SEQ ID NO: 324443 - DNA, 25 bp, Mus musculus
ggatcttcttaaggagagcgattca

SEQ ID NO: 324444 - DNA, 25 bp, Mus musculus
ggatcttcttccagtgcaggtccta

SEQ ID NO: 324445 - DNA, 25 bp, Mus musculus
ggatcttgagactaccaaaggagct

SEQ ID NO: 324446 - DNA, 25 bp, Mus musculus
ggatcttgagtttaccaaattacca

SEQ ID NO: 324447 - DNA, 25 bp, Mus musculus
ggatcttgcaactccatctcggaag

SEQ ID NO: 324448 - DNA, 25 bp, Mus musculus
ggatcttgcaactgaatctgcctgt

SEQ ID NO: 324449 - DNA, 25 bp, Mus musculus
ggatctttaaagcgcagtgctaact

SEQ ID NO: 324450 - DNA, 25 bp, Mus musculus
ggatctttaatgcctctccagcttc

SEQ ID NO: 324451 - DNA, 25 bp, Mus musculus
ggatctttccagttacaaatttcca

SEQ ID NO: 324452 - DNA, 25 bp, Mus musculus
ggatctttgggcttgtgatgcctgg

SEQ ID NO: 324453 - DNA, 25 bp, Mus musculus
ggatctttgggtctgaacgggatga

SEQ ID NO: 324454 - DNA, 25 bp, Mus musculus
ggatgaaaacccagtgagatgagtc

SEQ ID NO: 324455 - DNA, 25 bp, Mus musculus
ggatgaaaaccgcagacctgtgttg

SEQ ID NO: 324456 - DNA, 25 bp, Mus musculus
ggatgaaaaccgcaggtatggcatt

SEQ ID NO: 324457 - DNA, 25 bp, Mus musculus
ggatgaaaaccgcaggtgagaagac

SEQ ID NO: 324458 - DNA, 25 bp, Mus musculus
ggatgaaaagcctgacagaagtcga

SEQ ID NO: 324459 - DNA, 25 bp, Mus musculus
ggatgaaaagcctgctccaggtctg

SEQ ID NO: 324460 - DNA, 25 bp, Mus musculus
ggatgaaacagcatcaaaagacgta

SEQ ID NO: 324461 - DNA, 25 bp, Mus musculus
ggatgaaacggaacattttccctca

SEQ ID NO: 324462 - DNA, 25 bp, Mus musculus
ggatgaaacggttctgtgatgacat

SEQ ID NO: 324463 - DNA, 25 bp, Mus musculus
ggatgaaatcacacaatatgtagct

SEQ ID NO: 324464 - DNA, 25 bp, Mus musculus
ggatgaaatcacacagttttcagat

SEQ ID NO: 324465 - DNA, 25 bp, Mus musculus
ggatgaacagaatgagatcatcgat

SEQ ID NO: 324466 - DNA, 25 bp, Mus musculus
ggatgaactcctgaaagaaattcaa

SEQ ID NO: 324467 - DNA, 25 bp, Mus musculus
ggatgaactgaggagacttcttcga

SEQ ID NO: 324468 - DNA, 25 bp, Mus musculus
ggatgaactgaggagggtggccaaa

SEQ ID NO: 324469 - DNA, 25 bp, Mus musculus
ggatgaactgcgcaggttacatcca

SEQ ID NO: 324470 - DNA, 25 bp, Mus musculus
ggatgaagaatctagagctgatcat

SEQ ID NO: 324471 - DNA, 25 bp, Mus musculus
ggatgaagacaaggtgctggtctcc

SEQ ID NO: 324472 - DNA, 25 bp, Mus musculus
ggatgaagagaaatggttcccataa

SEQ ID NO: 324473 - DNA, 25 bp, Mus musculus
ggatgaagagaggcatgttggagac

SEQ ID NO: 324474 - DNA, 25 bp, Mus musculus
ggatgaagagctaaggcgcatgcag

SEQ ID NO: 324475 - DNA, 25 bp, Mus musculus
ggatgaagagggccccgtggggcgc

SEQ ID NO: 324476 - DNA, 25 bp, Mus musculus
ggatgaagatttagagagttccagt

SEQ ID NO: 324477 - DNA, 25 bp, Mus musculus
ggatgaagccagagatttaaggcaa

SEQ ID NO: 324478 - DNA, 25 bp, Mus musculus
ggatgaagccaggtaattcagagat

SEQ ID NO: 324479 - DNA, 25 bp, Mus musculus
ggatgaaggactttacctcgctgag

SEQ ID NO: 324480 - DNA, 25 bp, Mus musculus
ggatgaagtgaaacgcttcgttaag

SEQ ID NO: 324481 - DNA, 25 bp, Mus musculus
ggatgaagttagcaggagatgcggg

SEQ ID NO: 324482 - DNA, 25 bp, Mus musculus
ggatgaattcaaggtggacattcgc

SEQ ID NO: 324483 - DNA, 25 bp, Mus musculus
ggatgaatttcagagggccttcagc

SEQ ID NO: 324484 - DNA, 25 bp, Mus musculus
ggatgaatttcaggaatataccatg

SEQ ID NO: 324485 - DNA, 25 bp, Mus musculus
ggatgaatttgacttcttagcactt

SEQ ID NO: 324486 - DNA, 25 bp, Mus musculus
ggatgacaaaaaggtttgcacctga

SEQ ID NO: 324487 - DNA, 25 bp, Mus musculus
ggatgacaagcaggtttgctgagga

SEQ ID NO: 324488 - DNA, 25 bp, Mus musculus
ggatgacaagccaagcccgatcaaa

SEQ ID NO: 324489 - DNA, 25 bp, Mus musculus
ggatgacaaggcatctgtgggctct

SEQ ID NO: 324490 - DNA, 25 bp, Mus musculus
ggatgacactggacccccctttgtg

SEQ ID NO: 324491 - DNA, 25 bp, Mus musculus
ggatgacagcaacagttagagatgg

SEQ ID NO: 324492 - DNA, 25 bp, Mus musculus
ggatgacattcacctgctgtcttcc

SEQ ID NO: 324493 - DNA, 25 bp, Mus musculus
ggatgacattccttcattagtgaaa

SEQ ID NO: 324494 - DNA, 25 bp, Mus musculus
ggatgaccagagagtgatgtggaga

SEQ ID NO: 324495 - DNA, 25 bp, Mus musculus
ggatgaccagagccccgggcctctg

SEQ ID NO: 324496 - DNA, 25 bp, Mus musculus
ggatgaccaggtagagaccttttcc

SEQ ID NO: 324497 - DNA, 25 bp, Mus musculus
ggatgaccagttggcaaagctccga

SEQ ID NO: 324498 - DNA, 25 bp, Mus musculus
ggatgaccagtttcagaaagctctt

SEQ ID NO: 324499 - DNA, 25 bp, Mus musculus
ggatgacctgggccttttgctcgag

SEQ ID NO: 324500 - DNA, 25 bp, Mus musculus
ggatgacgaggaagaggaacaggaa

SEQ ID NO: 324501 - DNA, 25 bp, Mus musculus
ggatgactacagcattacacccgtc

SEQ ID NO: 324502 - DNA, 25 bp, Mus musculus
ggatgactatcgatgatgtgatgag

SEQ ID NO: 324503 - DNA, 25 bp, Mus musculus
ggatgactctgctcactggagggtt

SEQ ID NO: 324504 - DNA, 25 bp, Mus musculus
ggatgactgaaatctacttaaaatt

SEQ ID NO: 324505 - DNA, 25 bp, Mus musculus
ggatgactgtgtggtgtcgattgat

SEQ ID NO: 324506 - DNA, 25 bp, Mus musculus
ggatgactgtgtggttgcagaagct

SEQ ID NO: 324507 - DNA, 25 bp, Mus musculus
ggatgacttcagggactcaccagct

SEQ ID NO: 324508 - DNA, 25 bp, Mus musculus
ggatgacttccgggactcaccagct

SEQ ID NO: 324509 - DNA, 25 bp, Mus musculus
ggatgacttggagattttgcatgga

SEQ ID NO: 324510 - DNA, 25 bp, Mus musculus
ggatgagaaagttgatgaagatgag

SEQ ID NO: 324511 - DNA, 25 bp, Mus musculus
ggatgagaacaggatggacagtctc

SEQ ID NO: 324512 - DNA, 25 bp, Mus musculus
ggatgagaacagggtaggtgagctc

SEQ ID NO: 324513 - DNA, 25 bp, Mus musculus
ggatgagaataatctttgtgcgctc

SEQ ID NO: 324514 - DNA, 25 bp, Mus musculus
ggatgagaataatgtttgctttgag

SEQ ID NO: 324515 - DNA, 25 bp, Mus musculus
ggatgagacagatggaccctcctca

SEQ ID NO: 324516 - DNA, 25 bp, Mus musculus
ggatgagaccacagatgccaattca

SEQ ID NO: 324517 - DNA, 25 bp, Mus musculus
ggatgagagcaccccgatcccagag

SEQ ID NO: 324518 - DNA, 25 bp, Mus musculus
ggatgagagggtttaccagcccctg

SEQ ID NO: 324519 - DNA, 25 bp, Mus musculus
ggatgagattctggtcattcgaaag

SEQ ID NO: 324520 - DNA, 25 bp, Mus musculus
ggatgagcaagatgaacgagaccgt

SEQ ID NO: 324521 - DNA, 25 bp, Mus musculus
ggatgagcaaggcgaacaactcgat

SEQ ID NO: 324522 - DNA, 25 bp, Mus musculus
ggatgagcaaggcgaacaactggaa

SEQ ID NO: 324523 - DNA, 25 bp, Mus musculus
ggatgagcagagaccactgctattt

SEQ ID NO: 324524 - DNA, 25 bp, Mus musculus
ggatgagcatcaccctggaatgact

SEQ ID NO: 324525 - DNA, 25 bp, Mus musculus
ggatgagcccaaagcacccatgctg

SEQ ID NO: 324526 - DNA, 25 bp, Mus musculus
ggatgagcgagctggagcagaactt

SEQ ID NO: 324527 - DNA, 25 bp, Mus musculus
ggatgagcgcaggctgtactacgag

SEQ ID NO: 324528 - DNA, 25 bp, Mus musculus
ggatgagcggcaggttgggtcggaa

SEQ ID NO: 324529 - DNA, 25 bp, Mus musculus
ggatgagctgggttcaggaggtgag

SEQ ID NO: 324530 - DNA, 25 bp, Mus musculus
ggatgaggaagctctgtgaagtcca

SEQ ID NO: 324531 - DNA, 25 bp, Mus musculus
ggatgaggagaacaacgagaacgac

SEQ ID NO: 324532 - DNA, 25 bp, Mus musculus
ggatgaggaggaagtttacagtagc

SEQ ID NO: 324533 - DNA, 25 bp, Mus musculus
ggatgaggaggagaaagaaaagaag

SEQ ID NO: 324534 - DNA, 25 bp, Mus musculus
ggatgaggcgagaggtgaaagagct

SEQ ID NO: 324535 - DNA, 25 bp, Mus musculus
ggatgaggtccaggagatacttcaa

SEQ ID NO: 324536 - DNA, 25 bp, Mus musculus
ggatgaggtccaggtgacaataaat

SEQ ID NO: 324537 - DNA, 25 bp, Mus musculus
ggatgagtacgccatgaacgacacc

SEQ ID NO: 324538 - DNA, 25 bp, Mus musculus
ggatgagtacggtgggaatgctgaa

SEQ ID NO: 324539 - DNA, 25 bp, Mus musculus
ggatgagtatgtgctggaggatctg

SEQ ID NO: 324540 - DNA, 25 bp, Mus musculus
ggatgagtctctgagtgaggagacc

SEQ ID NO: 324541 - DNA, 25 bp, Mus musculus
ggatgagtggatctccacttgggtt

SEQ ID NO: 324542 - DNA, 25 bp, Mus musculus
ggatgagtgggatgcagtcatgctg

SEQ ID NO: 324543 - DNA, 25 bp, Mus musculus
ggatgagtggggttggccgaattct

SEQ ID NO: 324544 - DNA, 25 bp, Mus musculus
ggatgagttgcttcagaggttcagt

SEQ ID NO: 324545 - DNA, 25 bp, Mus musculus
ggatgataaagaggaagaagaaaga

SEQ ID NO: 324546 - DNA, 25 bp, Mus musculus
ggatgatacagacgtcctacaacca

SEQ ID NO: 324547 - DNA, 25 bp, Mus musculus
ggatgatacctggaaaaatggtgaa

SEQ ID NO: 324548 - DNA, 25 bp, Mus musculus
ggatgatagtagtgtcctggaggcc

SEQ ID NO: 324549 - DNA, 25 bp, Mus musculus
ggatgatagtagttacacctctaag

SEQ ID NO: 324550 - DNA, 25 bp, Mus musculus
ggatgatattgggtttgatctgtgg

SEQ ID NO: 324551 - DNA, 25 bp, Mus musculus
ggatgatattggtgatgtaaccatt

SEQ ID NO: 324552 - DNA, 25 bp, Mus musculus
ggatgatcaaaaccaggggctgtca

SEQ ID NO: 324553 - DNA, 25 bp, Mus musculus
ggatgatcaagggcatccaccacgg

SEQ ID NO: 324554 - DNA, 25 bp, Mus musculus
ggatgatcggggaatcatcactgcc

SEQ ID NO: 324555 - DNA, 25 bp, Mus musculus
ggatgatctagtttgtttggtgtac

SEQ ID NO: 324556 - DNA, 25 bp, Mus musculus
ggatgatctatacctactcaggcct

SEQ ID NO: 324557 - DNA, 25 bp, Mus musculus
ggatgatctggacgatgattctgac

SEQ ID NO: 324558 - DNA, 25 bp, Mus musculus
ggatgatgacaattttgaagaaggc

SEQ ID NO: 324559 - DNA, 25 bp, Mus musculus
ggatgatgagctgaactttgacctg

SEQ ID NO: 324560 - DNA, 25 bp, Mus musculus
ggatgatgaggagaaagagaagaag

SEQ ID NO: 324561 - DNA, 25 bp, Mus musculus
ggatgatgatggaaaggaagaagaa

SEQ ID NO: 324562 - DNA, 25 bp, Mus musculus
ggatgatgatggtacaaaatgctag

SEQ ID NO: 324563 - DNA, 25 bp, Mus musculus
ggatgatgcaatgagttccttcggg

SEQ ID NO: 324564 - DNA, 25 bp, Mus musculus
ggatgatgccatagcatggaagact

SEQ ID NO: 324565 - DNA, 25 bp, Mus musculus
ggatgatgccatgtacgcgtctaca

SEQ ID NO: 324566 - DNA, 25 bp, Mus musculus
ggatgatgggccagatcatctgtct

SEQ ID NO: 324567 - DNA, 25 bp, Mus musculus
ggatgatgggtcctggagtgaaccc

SEQ ID NO: 324568 - DNA, 25 bp, Mus musculus
ggatgatgtgctctgtgcagccctg

SEQ ID NO: 324569 - DNA, 25 bp, Mus musculus
ggatgattaaggactttctgagccc

SEQ ID NO: 324570 - DNA, 25 bp, Mus musculus
ggatgattcagagccccagggcttc

SEQ ID NO: 324571 - DNA, 25 bp, Mus musculus
ggatgattgaggatgcaattcgaag

SEQ ID NO: 324572 - DNA, 25 bp, Mus musculus
ggatgcaaagcagaacaggggctac

SEQ ID NO: 324573 - DNA, 25 bp, Mus musculus
ggatgcaactgatgtttcccagaaa

SEQ ID NO: 324574 - DNA, 25 bp, Mus musculus
ggatgcaactgggaagagagcacag

SEQ ID NO: 324575 - DNA, 25 bp, Mus musculus
ggatgcaagtgggagaatccacctc

SEQ ID NO: 324576 - DNA, 25 bp, Mus musculus
ggatgcacacagccaaccccaacaa

SEQ ID NO: 324577 - DNA, 25 bp, Mus musculus
ggatgcacagcagtatgagttcacc

SEQ ID NO: 324578 - DNA, 25 bp, Mus musculus
ggatgcacaggagtatgagttcacc

SEQ ID NO: 324579 - DNA, 25 bp, Mus musculus
ggatgcacatagaagccgtatcaag

SEQ ID NO: 324580 - DNA, 25 bp, Mus musculus
ggatgcacctggaagatgctggaga

SEQ ID NO: 324581 - DNA, 25 bp, Mus musculus
ggatgcacctggaaggtatgacatt

SEQ ID NO: 324582 - DNA, 25 bp, Mus musculus
ggatgcactcagggtgactacaacc

SEQ ID NO: 324583 - DNA, 25 bp, Mus musculus
ggatgcactcaggttgaaggtggag

SEQ ID NO: 324584 - DNA, 25 bp, Mus musculus
ggatgcagaccttcaatttggttta

SEQ ID NO: 324585 - DNA, 25 bp, Mus musculus
ggatgcagagggacgccctgactac

SEQ ID NO: 324586 - DNA, 25 bp, Mus musculus
ggatgcagaggttcgccatcgatgg

SEQ ID NO: 324587 - DNA, 25 bp, Mus musculus
ggatgcagcgcgcagacgggtccag

SEQ ID NO: 324588 - DNA, 25 bp, Mus musculus
ggatgcagcgcgcagcccctggagg

SEQ ID NO: 324589 - DNA, 25 bp, Mus musculus
ggatgcagctgccatcaaacttcag

SEQ ID NO: 324590 - DNA, 25 bp, Mus musculus
ggatgcaggcacaagcctccattga

SEQ ID NO: 324591 - DNA, 25 bp, Mus musculus
ggatgcagtgtaaagattgcaaatt

SEQ ID NO: 324592 - DNA, 25 bp, Mus musculus
ggatgcataaggaaagacaagaaaa

SEQ ID NO: 324593 - DNA, 25 bp, Mus musculus
ggatgcattcaggggtgattcagac

SEQ ID NO: 324594 - DNA, 25 bp, Mus musculus
ggatgccaataaggctgtggaagaa

SEQ ID NO: 324595 - DNA, 25 bp, Mus musculus
ggatgccacaaaaggagccataatt

SEQ ID NO: 324596 - DNA, 25 bp, Mus musculus
ggatgccacacagaggacggctgaa

SEQ ID NO: 324597 - DNA, 25 bp, Mus musculus
ggatgccacgaaagcgctaactgat

SEQ ID NO: 324598 - DNA, 25 bp, Mus musculus
ggatgccacggatccttttgtggca

SEQ ID NO: 324599 - DNA, 25 bp, Mus musculus
ggatgccactggtaagaccacactg

SEQ ID NO: 324600 - DNA, 25 bp, Mus musculus
ggatgccactggtactggcatagca

SEQ ID NO: 324601 - DNA, 25 bp, Mus musculus
ggatgccagatgaggagtccctggt

SEQ ID NO: 324602 - DNA, 25 bp, Mus musculus
ggatgccagatgaggatcatggctg

SEQ ID NO: 324603 - DNA, 25 bp, Mus musculus
ggatgccagatgatcttcccccacc

SEQ ID NO: 324604 - DNA, 25 bp, Mus musculus
ggatgccatattgtttccatccttt

SEQ ID NO: 324605 - DNA, 25 bp, Mus musculus
ggatgccatcgatgccctcatgaag

SEQ ID NO: 324606 - DNA, 25 bp, Mus musculus
ggatgccccaggaactggatgcctt

SEQ ID NO: 324607 - DNA, 25 bp, Mus musculus
ggatgccccagttttataggcaatg

SEQ ID NO: 324608 - DNA, 25 bp, Mus musculus
ggatgccctagtcctgcgcttcttt

SEQ ID NO: 324609 - DNA, 25 bp, Mus musculus
ggatgccgtggaggaccccagcagc

SEQ ID NO: 324610 - DNA, 25 bp, Mus musculus
ggatgccgttgactgtgtactcgat

SEQ ID NO: 324611 - DNA, 25 bp, Mus musculus
ggatgcctcggcggtgttcacctac

SEQ ID NO: 324612 - DNA, 25 bp, Mus musculus
ggatgcctcttacgtgtgttctcag

SEQ ID NO: 324613 - DNA, 25 bp, Mus musculus
ggatgcctgcaggatctgccactgt

SEQ ID NO: 324614 - DNA, 25 bp, Mus musculus
ggatgcctgggaggccatggaggaa

SEQ ID NO: 324615 - DNA, 25 bp, Mus musculus
ggatgcgaagaaagccttcaatgcg

SEQ ID NO: 324616 - DNA, 25 bp, Mus musculus
ggatgcgctgaggcccagtatagtg

SEQ ID NO: 324617 - DNA, 25 bp, Mus musculus
ggatgcgggagccaggagaacggga

SEQ ID NO: 324618 - DNA, 25 bp, Mus musculus
ggatgcgggagccagttccaggcga

SEQ ID NO: 324619 - DNA, 25 bp, Mus musculus
ggatgcgggcgcaaggcctctcttt

SEQ ID NO: 324620 - DNA, 25 bp, Mus musculus
ggatgcgtctaggtcttccaagttg

SEQ ID NO: 324621 - DNA, 25 bp, Mus musculus
ggatgcgtggcggagatggcgcggc

SEQ ID NO: 324622 - DNA, 25 bp, Mus musculus
ggatgctaatgcactgtctcaaaat

SEQ ID NO: 324623 - DNA, 25 bp, Mus musculus
ggatgctacggaggtgccttagctg

SEQ ID NO: 324624 - DNA, 25 bp, Mus musculus
ggatgctactcaggggcagttggtg

SEQ ID NO: 324625 - DNA, 25 bp, Mus musculus
ggatgctagaggtctgtgaggaaca

SEQ ID NO: 324626 - DNA, 25 bp, Mus musculus
ggatgctatgagctgatacaagtga

SEQ ID NO: 324627 - DNA, 25 bp, Mus musculus
ggatgctcaaggacagtgctatgct

SEQ ID NO: 324628 - DNA, 25 bp, Mus musculus
ggatgctcacggaacgaatgttcag

SEQ ID NO: 324629 - DNA, 25 bp, Mus musculus
ggatgctcagacatggtgcctggtg

SEQ ID NO: 324630 - DNA, 25 bp, Mus musculus
ggatgctcagagacaatgtctatgt

SEQ ID NO: 324631 - DNA, 25 bp, Mus musculus
ggatgctcagcgaggacccgtggag

SEQ ID NO: 324632 - DNA, 25 bp, Mus musculus
ggatgctcatggtagcgaccacctg

SEQ ID NO: 324633 - DNA, 25 bp, Mus musculus
ggatgctctcaggagttcctggtct

SEQ ID NO: 324634 - DNA, 25 bp, Mus musculus
ggatgctgaaactgatgccatgcag

SEQ ID NO: 324635 - DNA, 25 bp, Mus musculus
ggatgctgaaactgtatgccatgtt

SEQ ID NO: 324636 - DNA, 25 bp, Mus musculus
ggatgctgagatggtttttgatcat

SEQ ID NO: 324637 - DNA, 25 bp, Mus musculus
ggatgctgagcgaggagtgactgca

SEQ ID NO: 324638 - DNA, 25 bp, Mus musculus
ggatgctgaggacatcgtgaacaca

SEQ ID NO: 324639 - DNA, 25 bp, Mus musculus
ggatgctgaggatattgtaggcact

SEQ ID NO: 324640 - DNA, 25 bp, Mus musculus
ggatgctgagggcactctgaggcca

SEQ ID NO: 324641 - DNA, 25 bp, Mus musculus
ggatgctgatccagtgaagtcgagt

SEQ ID NO: 324642 - DNA, 25 bp, Mus musculus
ggatgctgatgagttcttgaccatg

SEQ ID NO: 324643 - DNA, 25 bp, Mus musculus
ggatgctgatggcaatggcaccatt

SEQ ID NO: 324644 - DNA, 25 bp, Mus musculus
ggatgctgatggcaatgggaccatt

SEQ ID NO: 324645 - DNA, 25 bp, Mus musculus
ggatgctgcaggttactcggcggcc

SEQ ID NO: 324646 - DNA, 25 bp, Mus musculus
ggatgctgcattctggcgcctagtg

SEQ ID NO: 324647 - DNA, 25 bp, Mus musculus
ggatgctgccagctggacaggcctg

SEQ ID NO: 324648 - DNA, 25 bp, Mus musculus
ggatgctggagctctcttgagtcat

SEQ ID NO: 324649 - DNA, 25 bp, Mus musculus
ggatgctggaggtcacatctgtcaa

SEQ ID NO: 324650 - DNA, 25 bp, Mus musculus
ggatgctggaggtgagccttcccgg

SEQ ID NO: 324651 - DNA, 25 bp, Mus musculus
ggatgctggcaggtatctgtgtgac

SEQ ID NO: 324652 - DNA, 25 bp, Mus musculus
ggatgctggctttttcacttgatac

SEQ ID NO: 324653 - DNA, 25 bp, Mus musculus
ggatgctgtcaaggcccgcctggct

SEQ ID NO: 324654 - DNA, 25 bp, Mus musculus
ggatgctgtcggtggctacagatgt

SEQ ID NO: 324655 - DNA, 25 bp, Mus musculus
ggatgctgtgctgggtcacttttca

SEQ ID NO: 324656 - DNA, 25 bp, Mus musculus
ggatgctgtggtggaatgcaattct

SEQ ID NO: 324657 - DNA, 25 bp, Mus musculus
ggatgctgtgtccaccacggcccca

SEQ ID NO: 324658 - DNA, 25 bp, Mus musculus
ggatgcttaggacctgatatttgtg

SEQ ID NO: 324659 - DNA, 25 bp, Mus musculus
ggatgcttcagatacgggaagccag

SEQ ID NO: 324660 - DNA, 25 bp, Mus musculus
ggatgcttcctttctagtgagtgcc

SEQ ID NO: 324661 - DNA, 25 bp, Mus musculus
ggatgcttcggcaggttttgtcgct

SEQ ID NO: 324662 - DNA, 25 bp, Mus musculus
ggatgctttaaaagcaaggatcatg

SEQ ID NO: 324663 - DNA, 25 bp, Mus musculus
ggatgctttaaaaggaaaatacata

SEQ ID NO: 324664 - DNA, 25 bp, Mus musculus
ggatgctttggtaagctgcgatatt

SEQ ID NO: 324665 - DNA, 25 bp, Mus musculus
ggatggaaaagcacctggatgcttt

SEQ ID NO: 324666 - DNA, 25 bp, Mus musculus
ggatggaaagaaagatctgatgttg

SEQ ID NO: 324667 - DNA, 25 bp, Mus musculus
ggatggaaagagcttaacaaaagat

SEQ ID NO: 324668 - DNA, 25 bp, Mus musculus
ggatggaaaggtgaagctggagact

SEQ ID NO: 324669 - DNA, 25 bp, Mus musculus
ggatggaaccgggcgcagcgcgttt

SEQ ID NO: 324670 - DNA, 25 bp, Mus musculus
ggatggaacctgttcgatttctcgg

SEQ ID NO: 324671 - DNA, 25 bp, Mus musculus
ggatggaacggtgtggaccgtgtct

SEQ ID NO: 324672 - DNA, 25 bp, Mus musculus
ggatggaaggggtgaccactgactg

SEQ ID NO: 324673 - DNA, 25 bp, Mus musculus
ggatggaagtgtcatctgccaggtg

SEQ ID NO: 324674 - DNA, 25 bp, Mus musculus
ggatggaatcctcagctgtcgagaa

SEQ ID NO: 324675 - DNA, 25 bp, Mus musculus
ggatggaatcctcaggtatcagaga

SEQ ID NO: 324676 - DNA, 25 bp, Mus musculus
ggatggaatcctcaggttcctgccc

SEQ ID NO: 324677 - DNA, 25 bp, Mus musculus
ggatggaatgtgagatatgatgaat

SEQ ID NO: 324678 - DNA, 25 bp, Mus musculus
ggatggacaaagctggtcagtacac

SEQ ID NO: 324679 - DNA, 25 bp, Mus musculus
ggatggacaatcagcgcctgttggt

SEQ ID NO: 324680 - DNA, 25 bp, Mus musculus
ggatggacaatcagggtctatctac

SEQ ID NO: 324681 - DNA, 25 bp, Mus musculus
ggatggacacggtggatggagcgag

SEQ ID NO: 324682 - DNA, 25 bp, Mus musculus
ggatggacagcgagcagtgttgcct

SEQ ID NO: 324683 - DNA, 25 bp, Mus musculus
ggatggacagcgaggcatgctacac

SEQ ID NO: 324684 - DNA, 25 bp, Mus musculus
ggatggaccaagggccaagtgtgga

SEQ ID NO: 324685 - DNA, 25 bp, Mus musculus
ggatggacctgaagggcatgttcct

SEQ ID NO: 324686 - DNA, 25 bp, Mus musculus
ggatggaccttcccctgtctctgca

SEQ ID NO: 324687 - DNA, 25 bp, Mus musculus
ggatggagaatatattcctcctttg

SEQ ID NO: 324688 - DNA, 25 bp, Mus musculus
ggatggagagaatgccacggtcctg

SEQ ID NO: 324689 - DNA, 25 bp, Mus musculus
ggatggagagggccctggatgtcac

SEQ ID NO: 324690 - DNA, 25 bp, Mus musculus
ggatggagaggttacagctgtggtc

SEQ ID NO: 324691 - DNA, 25 bp, Mus musculus
ggatggagccaaacatttctcggga

SEQ ID NO: 324692 - DNA, 25 bp, Mus musculus
ggatggagccaaagaatgaataaaa

SEQ ID NO: 324693 - DNA, 25 bp, Mus musculus
ggatggagccccacggatttcagtt

SEQ ID NO: 324694 - DNA, 25 bp, Mus musculus
ggatggagctctatggccgagaacc

SEQ ID NO: 324695 - DNA, 25 bp, Mus musculus
ggatggaggacaagattaggaatca

SEQ ID NO: 324696 - DNA, 25 bp, Mus musculus
ggatggaggagagggctctgctctg

SEQ ID NO: 324697 - DNA, 25 bp, Mus musculus
ggatggaggagggaagagtctgagg

SEQ ID NO: 324698 - DNA, 25 bp, Mus musculus
ggatggatcagacagaaagtgtgga

SEQ ID NO: 324699 - DNA, 25 bp, Mus musculus
ggatggcacaggagctgatacaagt

SEQ ID NO: 324700 - DNA, 25 bp, Mus musculus
ggatggcactgattggtgctgtcag

SEQ ID NO: 324701 - DNA, 25 bp, Mus musculus
ggatggcagggtatttatgagcctc

SEQ ID NO: 324702 - DNA, 25 bp, Mus musculus
ggatggcatcacctttattgacagt

SEQ ID NO: 324703 - DNA, 25 bp, Mus musculus
ggatggccagacgggcagcgggcaa

SEQ ID NO: 324704 - DNA, 25 bp, Mus musculus
ggatggccagccttggcctcacgct

SEQ ID NO: 324705 - DNA, 25 bp, Mus musculus
ggatggccagctaccatatttgcag

SEQ ID NO: 324706 - DNA, 25 bp, Mus musculus
ggatggccaggatatcctcactctc

SEQ ID NO: 324707 - DNA, 25 bp, Mus musculus
ggatggccaggtactgcagggtgct

SEQ ID NO: 324708 - DNA, 25 bp, Mus musculus
ggatggccagtcgtggggcctgtgc

SEQ ID NO: 324709 - DNA, 25 bp, Mus musculus
ggatggccagtggaagaaacactgg

SEQ ID NO: 324710 - DNA, 25 bp, Mus musculus
ggatggccagtttgtccctttattt

SEQ ID NO: 324711 - DNA, 25 bp, Mus musculus
ggatggcccaaagagggagcggaag

SEQ ID NO: 324712 - DNA, 25 bp, Mus musculus
ggatggcgacgatttccagagcagg

SEQ ID NO: 324713 - DNA, 25 bp, Mus musculus
ggatggcgaggaggatctgatggac

SEQ ID NO: 324714 - DNA, 25 bp, Mus musculus
ggatggcggccgaggtctgactggg

SEQ ID NO: 324715 - DNA, 25 bp, Mus musculus
ggatggctacggaatgtcacttgca

SEQ ID NO: 324716 - DNA, 25 bp, Mus musculus
ggatggctacggccatctttttttg

SEQ ID NO: 324717 - DNA, 25 bp, Mus musculus
ggatggcttttatgatcattttaag

SEQ ID NO: 324718 - DNA, 25 bp, Mus musculus
ggatgggaaaggtgactctggcacc

SEQ ID NO: 324719 - DNA, 25 bp, Mus musculus
ggatgggaagatggaccggcagatg

SEQ ID NO: 324720 - DNA, 25 bp, Mus musculus
ggatgggagacaatcccagctggct

SEQ ID NO: 324721 - DNA, 25 bp, Mus musculus
ggatgggagacctggaaccctacat

SEQ ID NO: 324722 - DNA, 25 bp, Mus musculus
ggatgggagacgatctggacgtggt

SEQ ID NO: 324723 - DNA, 25 bp, Mus musculus
ggatgggatccagagggctgactct

SEQ ID NO: 324724 - DNA, 25 bp, Mus musculus
ggatgggcagctgagattcctgctg

SEQ ID NO: 324725 - DNA, 25 bp, Mus musculus
ggatgggcagctgaggtgtgacttt

SEQ ID NO: 324726 - DNA, 25 bp, Mus musculus
ggatgggccgaaagaattcagtagc

SEQ ID NO: 324727 - DNA, 25 bp, Mus musculus
ggatgggccgccagaattcagtagc

SEQ ID NO: 324728 - DNA, 25 bp, Mus musculus
ggatgggctccccaggagatggcct

SEQ ID NO: 324729 - DNA, 25 bp, Mus musculus
ggatggggacgaaagcatccacaaa

SEQ ID NO: 324730 - DNA, 25 bp, Mus musculus
ggatggggagagttggagtttggag

SEQ ID NO: 324731 - DNA, 25 bp, Mus musculus
ggatgggtgaacgagcgtcagtgct

SEQ ID NO: 324732 - DNA, 25 bp, Mus musculus
ggatggtcgaggacttgcactaaga

SEQ ID NO: 324733 - DNA, 25 bp, Mus musculus
ggatggtctccgacatcaacaatgg

SEQ ID NO: 324734 - DNA, 25 bp, Mus musculus
ggatggtgaaccgggtgaccctggt

SEQ ID NO: 324735 - DNA, 25 bp, Mus musculus
ggatggtgaaggagacaaaattcta

SEQ ID NO: 324736 - DNA, 25 bp, Mus musculus
ggatggtgacctgctggcaggggcc

SEQ ID NO: 324737 - DNA, 25 bp, Mus musculus
ggatggtgagctccctgtggaggac

SEQ ID NO: 324738 - DNA, 25 bp, Mus musculus
ggatggtgctctgggtttcctgtgg

SEQ ID NO: 324739 - DNA, 25 bp, Mus musculus
ggatggtgcttcggtacctgggcca

SEQ ID NO: 324740 - DNA, 25 bp, Mus musculus
ggatggtggccacctgggtgcagtg

SEQ ID NO: 324741 - DNA, 25 bp, Mus musculus
ggatggtgtagcacatttccttctg

SEQ ID NO: 324742 - DNA, 25 bp, Mus musculus
ggatgtaaagacctctcgggaactg

SEQ ID NO: 324743 - DNA, 25 bp, Mus musculus
ggatgtaatggacgggcattttgtt

SEQ ID NO: 324744 - DNA, 25 bp, Mus musculus
ggatgtacaaaacgcccattttcct

SEQ ID NO: 324745 - DNA, 25 bp, Mus musculus
ggatgtacaaataaaagtcttactc

SEQ ID NO: 324746 - DNA, 25 bp, Mus musculus
ggatgtacaggggagcagcgcggtg

SEQ ID NO: 324747 - DNA, 25 bp, Mus musculus
ggatgtaccagaagactctaacagg

SEQ ID NO: 324748 - DNA, 25 bp, Mus musculus
ggatgtaccaggtgatttcagactg

SEQ ID NO: 324749 - DNA, 25 bp, Mus musculus
ggatgtactggacaaacaaacaaac

SEQ ID NO: 324750 - DNA, 25 bp, Mus musculus
ggatgtagaaaagaagctcaataaa

SEQ ID NO: 324751 - DNA, 25 bp, Mus musculus
ggatgtagagaaggccatcgcccac

SEQ ID NO: 324752 - DNA, 25 bp, Mus musculus
ggatgtagcaggcgccctggaggac

SEQ ID NO: 324753 - DNA, 25 bp, Mus musculus
ggatgtagcaggcgcgcggtgacat

SEQ ID NO: 324754 - DNA, 25 bp, Mus musculus
ggatgtatacgacgacccgtctcga

SEQ ID NO: 324755 - DNA, 25 bp, Mus musculus
ggatgtatacgacgactcgtccgtc

SEQ ID NO: 324756 - DNA, 25 bp, Mus musculus
ggatgtatacgacgatgttgagact

SEQ ID NO: 324757 - DNA, 25 bp, Mus musculus
ggatgtatatacaggaaaactcctc

SEQ ID NO: 324758 - DNA, 25 bp, Mus musculus
ggatgtatccaggctcacccagact

SEQ ID NO: 324759 - DNA, 25 bp, Mus musculus
ggatgtatccaggtcacccagatct

SEQ ID NO: 324760 - DNA, 25 bp, Mus musculus
ggatgtcagggaggtataagtgcta

SEQ ID NO: 324761 - DNA, 25 bp, Mus musculus
ggatgtcagtcaggggacgtggaac

SEQ ID NO: 324762 - DNA, 25 bp, Mus musculus
ggatgtcagttctgtgaacagatgt

SEQ ID NO: 324763 - DNA, 25 bp, Mus musculus
ggatgtccaccatggtaggtgagct

SEQ ID NO: 324764 - DNA, 25 bp, Mus musculus
ggatgtccagctggctaacctcaca

SEQ ID NO: 324765 - DNA, 25 bp, Mus musculus
ggatgtcgagatgcagatctcttgg

SEQ ID NO: 324766 - DNA, 25 bp, Mus musculus
ggatgtcgaggtacggtcagaatag

SEQ ID NO: 324767 - DNA, 25 bp, Mus musculus
ggatgtctagaagctctaggaatga

SEQ ID NO: 324768 - DNA, 25 bp, Mus musculus
ggatgtctcacaatgccatcaggtt

SEQ ID NO: 324769 - DNA, 25 bp, Mus musculus
ggatgtctcacaatggagatcagaa

SEQ ID NO: 324770 - DNA, 25 bp, Mus musculus
ggatgtctctgcaccatcggtttgt

SEQ ID NO: 324771 - DNA, 25 bp, Mus musculus
ggatgtctgtgagcagtctcgaatg

SEQ ID NO: 324772 - DNA, 25 bp, Mus musculus
ggatgtgaaagcacaggtggacgtg

SEQ ID NO: 324773 - DNA, 25 bp, Mus musculus
ggatgtgaagatcatcagaaactag

SEQ ID NO: 324774 - DNA, 25 bp, Mus musculus
ggatgtgaccagatgcatattcctg

SEQ ID NO: 324775 - DNA, 25 bp, Mus musculus
ggatgtgaccaggagatggctggca

SEQ ID NO: 324776 - DNA, 25 bp, Mus musculus
ggatgtgaccaggtggccttgaact

SEQ ID NO: 324777 - DNA, 25 bp, Mus musculus
ggatgtgaccatcaggtactgcagg

SEQ ID NO: 324778 - DNA, 25 bp, Mus musculus
ggatgtgagtggcgttatatgaata

SEQ ID NO: 324779 - DNA, 25 bp, Mus musculus
ggatgtgatgctctttctcatcatt

SEQ ID NO: 324780 - DNA, 25 bp, Mus musculus
ggatgtgatgctttagatgagcagt

SEQ ID NO: 324781 - DNA, 25 bp, Mus musculus
ggatgtgatggaggatgtggtggag

SEQ ID NO: 324782 - DNA, 25 bp, Mus musculus
ggatgtgcagtattcccccacagcg

SEQ ID NO: 324783 - DNA, 25 bp, Mus musculus
ggatgtgccagaacaagctgtttga

SEQ ID NO: 324784 - DNA, 25 bp, Mus musculus
ggatgtgccgacggtggttcctgta

SEQ ID NO: 324785 - DNA, 25 bp, Mus musculus
ggatgtgccggaatgcaggctcctg

SEQ ID NO: 324786 - DNA, 25 bp, Mus musculus
ggatgtgcttctgagaagaggccga

SEQ ID NO: 324787 - DNA, 25 bp, Mus musculus
ggatgtgcttctgatgatgagagta

SEQ ID NO: 324788 - DNA, 25 bp, Mus musculus
ggatgtggacgcctctgcccatttc

SEQ ID NO: 324789 - DNA, 25 bp, Mus musculus
ggatgtggacgcttctgccagactc

SEQ ID NO: 324790 - DNA, 25 bp, Mus musculus
ggatgtggacggccgagctctgctt

SEQ ID NO: 324791 - DNA, 25 bp, Mus musculus
ggatgtggagcggccaaccccaaca

SEQ ID NO: 324792 - DNA, 25 bp, Mus musculus
ggatgtggagctggaccagatctgc

SEQ ID NO: 324793 - DNA, 25 bp, Mus musculus
ggatgtggataaaaatatccagcaa

SEQ ID NO: 324794 - DNA, 25 bp, Mus musculus
ggatgtggatgacagacacccctgc

SEQ ID NO: 324795 - DNA, 25 bp, Mus musculus
ggatgtggatgacagagcagagcct

SEQ ID NO: 324796 - DNA, 25 bp, Mus musculus
ggatgtggatgcaaatgaaaagaaa

SEQ ID NO: 324797 - DNA, 25 bp, Mus musculus
ggatgtggatgggttgacgagcgtc

SEQ ID NO: 324798 - DNA, 25 bp, Mus musculus
ggatgtgggccagctacctgggtgc

SEQ ID NO: 324799 - DNA, 25 bp, Mus musculus
ggatgtgggttatgttcagggcatg

SEQ ID NO: 324800 - DNA, 25 bp, Mus musculus
ggatgtgtaccagatgacagaaggc

SEQ ID NO: 324801 - DNA, 25 bp, Mus musculus
ggatgtgtgagccagagaagccatc

SEQ ID NO: 324802 - DNA, 25 bp, Mus musculus
ggatgtgtgagccaggtacattctt

SEQ ID NO: 324803 - DNA, 25 bp, Mus musculus
ggatgttaaggagagggcgcgagtg

SEQ ID NO: 324804 - DNA, 25 bp, Mus musculus
ggatgttaaggtgccaagtcggggc

SEQ ID NO: 324805 - DNA, 25 bp, Mus musculus
ggatgttacggaggacccgagtcag

SEQ ID NO: 324806 - DNA, 25 bp, Mus musculus
ggatgttatggagggagtgaagcca

SEQ ID NO: 324807 - DNA, 25 bp, Mus musculus
ggatgttcaaattggggaatggcgg

SEQ ID NO: 324808 - DNA, 25 bp, Mus musculus
ggatgttcaagacgcaagtgggacg

SEQ ID NO: 324809 - DNA, 25 bp, Mus musculus
ggatgttcaattggcttcgtgaggc

SEQ ID NO: 324810 - DNA, 25 bp, Mus musculus
ggatgttcacaagagcgttataacc

SEQ ID NO: 324811 - DNA, 25 bp, Mus musculus
ggatgttgaggttctctgctgccct

SEQ ID NO: 324812 - DNA, 25 bp, Mus musculus
ggatgttggcccagaggcagcttcc

SEQ ID NO: 324813 - DNA, 25 bp, Mus musculus
ggatgttggcccagtgtcaccagac

SEQ ID NO: 324814 - DNA, 25 bp, Mus musculus
ggatgttggctgaatgtttgttaac

SEQ ID NO: 324815 - DNA, 25 bp, Mus musculus
ggatgttgggaatgtccggcggttt

SEQ ID NO: 324816 - DNA, 25 bp, Mus musculus
ggatgtttaacagtattgcagaaac

SEQ ID NO: 324817 - DNA, 25 bp, Mus musculus
ggatgtttccaagtttggtgtgatt

SEQ ID NO: 324818 - DNA, 25 bp, Mus musculus
ggatgtttccaggaaatgcccatgg

SEQ ID NO: 324819 - DNA, 25 bp, Mus musculus
ggatgtttccagggctgcacagaga

SEQ ID NO: 324820 - DNA, 25 bp, Mus musculus
ggatgtttcctgagatgtaaagaaa

SEQ ID NO: 324821 - DNA, 25 bp, Mus musculus
ggatgtttcctgaggctactgaaag

SEQ ID NO: 324822 - DNA, 25 bp, Mus musculus
ggatgtttcctgtctagtgagtgcc

SEQ ID NO: 324823 - DNA, 25 bp, Mus musculus
ggatgtttcctgtctggtgagtgtc

SEQ ID NO: 324824 - DNA, 25 bp, Mus musculus
ggatgttttgggtcgcagacacttt

SEQ ID NO: 324825 - DNA, 25 bp, Mus musculus
ggattaaaaaggatcagttcttaag

SEQ ID NO: 324826 - DNA, 25 bp, Mus musculus
ggattaaaaagggccaaatccttgt

SEQ ID NO: 324827 - DNA, 25 bp, Mus musculus
ggattaaaaagtgcctgcacccgct

SEQ ID NO: 324828 - DNA, 25 bp, Mus musculus
ggattaaagcccagattcagtttgc

SEQ ID NO: 324829 - DNA, 25 bp, Mus musculus
ggattaagtagaagaactatactat

SEQ ID NO: 324830 - DNA, 25 bp, Mus musculus
ggattaatgctgtaggcaccagacc

SEQ ID NO: 324831 - DNA, 25 bp, Mus musculus
ggattaattagaaaaggaggcgctt

SEQ ID NO: 324832 - DNA, 25 bp, Mus musculus
ggattaattcaggagtgggaggtgc

SEQ ID NO: 324833 - DNA, 25 bp, Mus musculus
ggattacaaactgagtagcactcag

SEQ ID NO: 324834 - DNA, 25 bp, Mus musculus
ggattacaagactccactgcaaaat

SEQ ID NO: 324835 - DNA, 25 bp, Mus musculus
ggattacaggcgaccccctcggctg

SEQ ID NO: 324836 - DNA, 25 bp, Mus musculus
ggattacatagccaacaaggagagc

SEQ ID NO: 324837 - DNA, 25 bp, Mus musculus
ggattacataggttttactatatat

SEQ ID NO: 324838 - DNA, 25 bp, Mus musculus
ggattacatagtgtatcccctactc

SEQ ID NO: 324839 - DNA, 25 bp, Mus musculus
ggattaccacaaatactggatgtaa

SEQ ID NO: 324840 - DNA, 25 bp, Mus musculus
ggattaccatctagatgttggctgc

SEQ ID NO: 324841 - DNA, 25 bp, Mus musculus
ggattaccgaaggcaaatggaaaaa

SEQ ID NO: 324842 - DNA, 25 bp, Mus musculus
ggattacctggaaagagctgttatt

SEQ ID NO: 324843 - DNA, 25 bp, Mus musculus
ggattacctggaaaggtggtggtgg

SEQ ID NO: 324844 - DNA, 25 bp, Mus musculus
ggattaccttaccagttttacagga

SEQ ID NO: 324845 - DNA, 25 bp, Mus musculus
ggattagcaccaggaatgtcactgt

SEQ ID NO: 324846 - DNA, 25 bp, Mus musculus
ggattaggctcccgagttctacaca

SEQ ID NO: 324847 - DNA, 25 bp, Mus musculus
ggattataccggctgcagtacctca

SEQ ID NO: 324848 - DNA, 25 bp, Mus musculus
ggattataccggggcccagtcattt

SEQ ID NO: 324849 - DNA, 25 bp, Mus musculus
ggattatagatgcttatgtggatat

SEQ ID NO: 324850 - DNA, 25 bp, Mus musculus
ggattatcagaacaaaacgtgtgtg

SEQ ID NO: 324851 - DNA, 25 bp, Mus musculus
ggattatcgggctcagcgttgttca

SEQ ID NO: 324852 - DNA, 25 bp, Mus musculus
ggattatcggggaagcgtttctctc

SEQ ID NO: 324853 - DNA, 25 bp, Mus musculus
ggattatctgaagagcccagagcgt

SEQ ID NO: 324854 - DNA, 25 bp, Mus musculus
ggattatctgaaggcctgggagctg

SEQ ID NO: 324855 - DNA, 25 bp, Mus musculus
ggattatgaggactccaagccccct

SEQ ID NO: 324856 - DNA, 25 bp, Mus musculus
ggattattatgctttctcccagatg

SEQ ID NO: 324857 - DNA, 25 bp, Mus musculus
ggattattccagtacttccaggtgg

SEQ ID NO: 324858 - DNA, 25 bp, Mus musculus
ggattattgggcttgggtgactcag

SEQ ID NO: 324859 - DNA, 25 bp, Mus musculus
ggattatttagcacaggtgatgaac

SEQ ID NO: 324860 - DNA, 25 bp, Mus musculus
ggattattttcaataatggacgctg

SEQ ID NO: 324861 - DNA, 25 bp, Mus musculus
ggattcaaggggaagaagccagctg

SEQ ID NO: 324862 - DNA, 25 bp, Mus musculus
ggattcaatcgaagatgctggtggt

SEQ ID NO: 324863 - DNA, 25 bp, Mus musculus
ggattcacacagattctggaacaag

SEQ ID NO: 324864 - DNA, 25 bp, Mus musculus
ggattcacaggaattcactgtgaag

SEQ ID NO: 324865 - DNA, 25 bp, Mus musculus
ggattcagaagaataccacaaccgc

SEQ ID NO: 324866 - DNA, 25 bp, Mus musculus
ggattcagaaggacattaacgagct

SEQ ID NO: 324867 - DNA, 25 bp, Mus musculus
ggattcagacccgattagtggagta

SEQ ID NO: 324868 - DNA, 25 bp, Mus musculus
ggattcagaggaagccaagggatgc

SEQ ID NO: 324869 - DNA, 25 bp, Mus musculus
ggattcagagtccagaactttcctc

SEQ ID NO: 324870 - DNA, 25 bp, Mus musculus
ggattcagcatttaagcaaaactgg

SEQ ID NO: 324871 - DNA, 25 bp, Mus musculus
ggattcagctcaaggctgtcaagtc

SEQ ID NO: 324872 - DNA, 25 bp, Mus musculus
ggattcaggctcggtcttttccggg

SEQ ID NO: 324873 - DNA, 25 bp, Mus musculus
ggattcagtgcaggtttggatgcat

SEQ ID NO: 324874 - DNA, 25 bp, Mus musculus
ggattcagtgcttttaatcagctta

SEQ ID NO: 324875 - DNA, 25 bp, Mus musculus
ggattcagtggcattgaatccagct

SEQ ID NO: 324876 - DNA, 25 bp, Mus musculus
ggattcagtggcgccgacatcgcca

SEQ ID NO: 324877 - DNA, 25 bp, Mus musculus
ggattcagtgggcagagccagcagc

SEQ ID NO: 324878 - DNA, 25 bp, Mus musculus
ggattcagtggggctccacctgttc

SEQ ID NO: 324879 - DNA, 25 bp, Mus musculus
ggattcagtgggggagtttgtgaca

SEQ ID NO: 324880 - DNA, 25 bp, Mus musculus
ggattcagtgggggatttccaattt

SEQ ID NO: 324881 - DNA, 25 bp, Mus musculus
ggattcagtttctttagaatgtgat

SEQ ID NO: 324882 - DNA, 25 bp, Mus musculus
ggattcataggggcttcttctgcca

SEQ ID NO: 324883 - DNA, 25 bp, Mus musculus
ggattcatcacagagccggctgatc

SEQ ID NO: 324884 - DNA, 25 bp, Mus musculus
ggattcatgaaagtcctgaagtgtg

SEQ ID NO: 324885 - DNA, 25 bp, Mus musculus
ggattcatgactcaggcccacaatg

SEQ ID NO: 324886 - DNA, 25 bp, Mus musculus
ggattcatggtactgctgtattttc

SEQ ID NO: 324887 - DNA, 25 bp, Mus musculus
ggattccaaaatgccattctagttc

SEQ ID NO: 324888 - DNA, 25 bp, Mus musculus
ggattccaagctaccacagtgaact

SEQ ID NO: 324889 - DNA, 25 bp, Mus musculus
ggattccaagctcctactactcagg

SEQ ID NO: 324890 - DNA, 25 bp, Mus musculus
ggattccagagtgtgtgggtttcaa

SEQ ID NO: 324891 - DNA, 25 bp, Mus musculus
ggattccagccagaccagcggagtc

SEQ ID NO: 324892 - DNA, 25 bp, Mus musculus
ggattccagtgtgacctgctgtcta

SEQ ID NO: 324893 - DNA, 25 bp, Mus musculus
ggattccagtgtgtgtttcctggct

SEQ ID NO: 324894 - DNA, 25 bp, Mus musculus
ggattcccaagccatgtattctcat

SEQ ID NO: 324895 - DNA, 25 bp, Mus musculus
ggattcccaggtgaggacacttgtg

SEQ ID NO: 324896 - DNA, 25 bp, Mus musculus
ggattcccaggtgctcctggctcta

SEQ ID NO: 324897 - DNA, 25 bp, Mus musculus
ggattcccgtcttctccctcctgca

SEQ ID NO: 324898 - DNA, 25 bp, Mus musculus
ggattcctacccatgttcctgaatg

SEQ ID NO: 324899 - DNA, 25 bp, Mus musculus
ggattcctaggaagaggatgtacat

SEQ ID NO: 324900 - DNA, 25 bp, Mus musculus
ggattcctcacaggaaagcaaagat

SEQ ID NO: 324901 - DNA, 25 bp, Mus musculus
ggattcctcagacaggcttccatac

SEQ ID NO: 324902 - DNA, 25 bp, Mus musculus
ggattcctcagacagtgaaaacaaa

SEQ ID NO: 324903 - DNA, 25 bp, Mus musculus
ggattcctgcctgctccaggacagg

SEQ ID NO: 324904 - DNA, 25 bp, Mus musculus
ggattccttacagtgtcctagatga

SEQ ID NO: 324905 - DNA, 25 bp, Mus musculus
ggattccttatggatcgcagctcca

SEQ ID NO: 324906 - DNA, 25 bp, Mus musculus
ggattccttgtccagattatgaagt

SEQ ID NO: 324907 - DNA, 25 bp, Mus musculus
ggattccttgtccagtggttttagg

SEQ ID NO: 324908 - DNA, 25 bp, Mus musculus
ggattcgctccggtgtaatggatag

SEQ ID NO: 324909 - DNA, 25 bp, Mus musculus
ggattcgttaagagaggagaacttt

SEQ ID NO: 324910 - DNA, 25 bp, Mus musculus
ggattctaaaaggaatattattggc

SEQ ID NO: 324911 - DNA, 25 bp, Mus musculus
ggattctacaaagctgggcatggaa

SEQ ID NO: 324912 - DNA, 25 bp, Mus musculus
ggattctatgacccctcaccatcct

SEQ ID NO: 324913 - DNA, 25 bp, Mus musculus
ggattctatgctgggcacacaggac

SEQ ID NO: 324914 - DNA, 25 bp, Mus musculus
ggattctcagttcagcgtcgccaac

SEQ ID NO: 324915 - DNA, 25 bp, Mus musculus
ggattctcgacatagatatcccaat

SEQ ID NO: 324916 - DNA, 25 bp, Mus musculus
ggattctcgacataggtgcactgca

SEQ ID NO: 324917 - DNA, 25 bp, Mus musculus
ggattctcgggaggatccgagcgtg

SEQ ID NO: 324918 - DNA, 25 bp, Mus musculus
ggattctcgggaggtggctgtctgc

SEQ ID NO: 324919 - DNA, 25 bp, Mus musculus
ggattctgaagtgagtaatagttcc

SEQ ID NO: 324920 - DNA, 25 bp, Mus musculus
ggattctgacatcctgcagagccta

SEQ ID NO: 324921 - DNA, 25 bp, Mus musculus
ggattctgacattgatggcgaggct

SEQ ID NO: 324922 - DNA, 25 bp, Mus musculus
ggattctgattgtggaagcttaccc

SEQ ID NO: 324923 - DNA, 25 bp, Mus musculus
ggattctgctcttgctgtccatctg

SEQ ID NO: 324924 - DNA, 25 bp, Mus musculus
ggattctgggaggctccccagcaca

SEQ ID NO: 324925 - DNA, 25 bp, Mus musculus
ggattcttagcaagggtctgtcacc

SEQ ID NO: 324926 - DNA, 25 bp, Mus musculus
ggattcttcagcacaggggatgaac

SEQ ID NO: 324927 - DNA, 25 bp, Mus musculus
ggattcttcaggaacaagatcctgg

SEQ ID NO: 324928 - DNA, 25 bp, Mus musculus
ggattcttccttgaaatttgccttg

SEQ ID NO: 324929 - DNA, 25 bp, Mus musculus
ggattcttctcaatgtaaatttaac

SEQ ID NO: 324930 - DNA, 25 bp, Mus musculus
ggattctttgggaatgccctctacg

SEQ ID NO: 324931 - DNA, 25 bp, Mus musculus
ggattgaacttcgtgggcatcgatt

SEQ ID NO: 324932 - DNA, 25 bp, Mus musculus
ggattgacaggtcccaggtcgctgg

SEQ ID NO: 324933 - DNA, 25 bp, Mus musculus
ggattgacaggtctgaacggcgttc

SEQ ID NO: 324934 - DNA, 25 bp, Mus musculus
ggattgaccacaggaataactcaac

SEQ ID NO: 324935 - DNA, 25 bp, Mus musculus
ggattgaccgacgcctcttcgccct

SEQ ID NO: 324936 - DNA, 25 bp, Mus musculus
ggattgagcggtcctcgtctttcag

SEQ ID NO: 324937 - DNA, 25 bp, Mus musculus
ggattgcattaggaaagaatgtttc

SEQ ID NO: 324938 - DNA, 25 bp, Mus musculus
ggattgccctgagaattcatataaa

SEQ ID NO: 324939 - DNA, 25 bp, Mus musculus
ggattgccctgagagagaattctgt

SEQ ID NO: 324940 - DNA, 25 bp, Mus musculus
ggattgccgggagccaccatgttca

SEQ ID NO: 324941 - DNA, 25 bp, Mus musculus
ggattgccgggagctgaccggaaga

SEQ ID NO: 324942 - DNA, 25 bp, Mus musculus
ggattgcctggagagtgtgaaggat

SEQ ID NO: 324943 - DNA, 25 bp, Mus musculus
ggattgcgaggatcgccacgactcg

SEQ ID NO: 324944 - DNA, 25 bp, Mus musculus
ggattgctcagaaaaagatcattca

SEQ ID NO: 324945 - DNA, 25 bp, Mus musculus
ggattgctcagaacttctcggtatc

SEQ ID NO: 324946 - DNA, 25 bp, Mus musculus
ggattgctcagctgccttggctgtc

SEQ ID NO: 324947 - DNA, 25 bp, Mus musculus
ggattgctcagggcattgaaaacat

SEQ ID NO: 324948 - DNA, 25 bp, Mus musculus
ggattgctgttaatactgtggattt

SEQ ID NO: 324949 - DNA, 25 bp, Mus musculus
ggattgctgttaatagtgtcccttt

SEQ ID NO: 324950 - DNA, 25 bp, Mus musculus
ggattgcttgccttccagacctatc

SEQ ID NO: 324951 - DNA, 25 bp, Mus musculus
ggattggaaaggttccaggatggct

SEQ ID NO: 324952 - DNA, 25 bp, Mus musculus
ggattggcacctggggtggaggcag

SEQ ID NO: 324953 - DNA, 25 bp, Mus musculus
ggattggccggctatggggcatgga

SEQ ID NO: 324954 - DNA, 25 bp, Mus musculus
ggattggccgggctggtccctctgt

SEQ ID NO: 324955 - DNA, 25 bp, Mus musculus
ggattggcttccaggaggcaggcaa

SEQ ID NO: 324956 - DNA, 25 bp, Mus musculus
ggattgggaagaaaaagaagaggag

SEQ ID NO: 324957 - DNA, 25 bp, Mus musculus
ggattgggaagagaacagacaaggt

SEQ ID NO: 324958 - DNA, 25 bp, Mus musculus
ggattgggaagggctcctgtgctag

SEQ ID NO: 324959 - DNA, 25 bp, Mus musculus
ggattgggcacctcgagaagcctgt

SEQ ID NO: 324960 - DNA, 25 bp, Mus musculus
ggattgggcacctcgattgcagccc

SEQ ID NO: 324961 - DNA, 25 bp, Mus musculus
ggattgggtttatgcagaactctca

SEQ ID NO: 324962 - DNA, 25 bp, Mus musculus
ggattgggtttgaactcggagagta

SEQ ID NO: 324963 - DNA, 25 bp, Mus musculus
ggattgtaagaaaagtgatgctgca

SEQ ID NO: 324964 - DNA, 25 bp, Mus musculus
ggattgtagaacttcaatgcaggag

SEQ ID NO: 324965 - DNA, 25 bp, Mus musculus
ggattgtagcaaggtatggtgcgga

SEQ ID NO: 324966 - DNA, 25 bp, Mus musculus
ggattgtcccgaaagggtctcctgt

SEQ ID NO: 324967 - DNA, 25 bp, Mus musculus
ggattgtcccgatgtgaaacatttt

SEQ ID NO: 324968 - DNA, 25 bp, Mus musculus
ggattgtcttcctagccacgagtct

SEQ ID NO: 324969 - DNA, 25 bp, Mus musculus
ggattgtgaagccaccagcatctgc

SEQ ID NO: 324970 - DNA, 25 bp, Mus musculus
ggattgtgaagccagtattcccctt

SEQ ID NO: 324971 - DNA, 25 bp, Mus musculus
ggattgtgacctgcctgttcacctc

SEQ ID NO: 324972 - DNA, 25 bp, Mus musculus
ggattgtgatatcgtgtcccgagat

SEQ ID NO: 324973 - DNA, 25 bp, Mus musculus
ggattgtggaaggggaggagcgcta

SEQ ID NO: 324974 - DNA, 25 bp, Mus musculus
ggattgtggtaacaaataacaaagg

SEQ ID NO: 324975 - DNA, 25 bp, Mus musculus
ggattgtgtgagagattggtgtcct

SEQ ID NO: 324976 - DNA, 25 bp, Mus musculus
ggattgtgtgtctggcttatggtag

SEQ ID NO: 324977 - DNA, 25 bp, Mus musculus
ggattgtgtgtctgggagaagatga

SEQ ID NO: 324978 - DNA, 25 bp, Mus musculus
ggatttaacacaggtgtgatcctgc

SEQ ID NO: 324979 - DNA, 25 bp, Mus musculus
ggatttaaccagagctgtctgtcta

SEQ ID NO: 324980 - DNA, 25 bp, Mus musculus
ggatttaaccaggtgccagatttac

SEQ ID NO: 324981 - DNA, 25 bp, Mus musculus
ggatttaaccattcaaaatgtaggc

SEQ ID NO: 324982 - DNA, 25 bp, Mus musculus
ggatttaaccctgagataccagaga

SEQ ID NO: 324983 - DNA, 25 bp, Mus musculus
ggatttaaccgtgagataccagaga

SEQ ID NO: 324984 - DNA, 25 bp, Mus musculus
ggatttaagattgagatttttttga

SEQ ID NO: 324985 - DNA, 25 bp, Mus musculus
ggatttaatggttgctctctgaaaa

SEQ ID NO: 324986 - DNA, 25 bp, Mus musculus
ggatttacagggctgcagaatggaa

SEQ ID NO: 324987 - DNA, 25 bp, Mus musculus
ggatttagaggaggatatgatggtt

SEQ ID NO: 324988 - DNA, 25 bp, Mus musculus
ggatttagtctggcgtgtgcagcct

SEQ ID NO: 324989 - DNA, 25 bp, Mus musculus
ggatttataaaaatggtgtcctttg

SEQ ID NO: 324990 - DNA, 25 bp, Mus musculus
ggatttatccaggtgtgaaattgaa

SEQ ID NO: 324991 - DNA, 25 bp, Mus musculus
ggatttcacagggggttcaccgtct

SEQ ID NO: 324992 - DNA, 25 bp, Mus musculus
ggatttcagattgccagatcagtat

SEQ ID NO: 324993 - DNA, 25 bp, Mus musculus
ggatttcagattggtggaccttcct

SEQ ID NO: 324994 - DNA, 25 bp, Mus musculus
ggatttcaggataacctctttcttg

SEQ ID NO: 324995 - DNA, 25 bp, Mus musculus
ggatttcatcaagctcctggttgaa

SEQ ID NO: 324996 - DNA, 25 bp, Mus musculus
ggatttcatcaaggctatggcaata

SEQ ID NO: 324997 - DNA, 25 bp, Mus musculus
ggatttcatgtttgagatcagtcgt

SEQ ID NO: 324998 - DNA, 25 bp, Mus musculus
ggatttcccaggtaagcttcaagct

SEQ ID NO: 324999 - DNA, 25 bp, Mus musculus
ggatttccccagccagatcttctgg

SEQ ID NO: 325000 - DNA, 25 bp, Mus musculus
ggatttctaagcattccatattgga

SEQ ID NO: 325001 - DNA, 25 bp, Mus musculus
ggatttctaaggcttcagaagaggt

SEQ ID NO: 325002 - DNA, 25 bp, Mus musculus
ggatttctggacttggcagtgtaag

SEQ ID NO: 325003 - DNA, 25 bp, Mus musculus
ggatttctggagccctgctttaagg

SEQ ID NO: 325004 - DNA, 25 bp, Mus musculus
ggatttgaaagagctgaatgataag

SEQ ID NO: 325005 - DNA, 25 bp, Mus musculus
ggatttgacggagccacggccgcag

SEQ ID NO: 325006 - DNA, 25 bp, Mus musculus
ggatttgagtggaatgcgctcttcg

SEQ ID NO: 325007 - DNA, 25 bp, Mus musculus
ggatttgatagacgtgaacgaagct

SEQ ID NO: 325008 - DNA, 25 bp, Mus musculus
ggatttgccaactgtttctatactg

SEQ ID NO: 325009 - DNA, 25 bp, Mus musculus
ggatttgccaagaggagctctggct

SEQ ID NO: 325010 - DNA, 25 bp, Mus musculus
ggatttgccaatgcccagcagagga

SEQ ID NO: 325011 - DNA, 25 bp, Mus musculus
ggatttgctcaaaccagaacttgtt

SEQ ID NO: 325012 - DNA, 25 bp, Mus musculus
ggatttgctgagaggttttctcaag

SEQ ID NO: 325013 - DNA, 25 bp, Mus musculus
ggatttgctgagagtgctcacaggc

SEQ ID NO: 325014 - DNA, 25 bp, Mus musculus
ggatttgctggttttaggctagcca

SEQ ID NO: 325015 - DNA, 25 bp, Mus musculus
ggatttggagatataaccaagaact

SEQ ID NO: 325016 - DNA, 25 bp, Mus musculus
ggatttggagtagatcaatcccctt

SEQ ID NO: 325017 - DNA, 25 bp, Mus musculus
ggatttggagtctgtctccaaggag

SEQ ID NO: 325018 - DNA, 25 bp, Mus musculus
ggatttggcacatacgtgcagttct

SEQ ID NO: 325019 - DNA, 25 bp, Mus musculus
ggatttggggaatacacatgccaat

SEQ ID NO: 325020 - DNA, 25 bp, Mus musculus
ggatttgggggtcctgttacagaag

SEQ ID NO: 325021 - DNA, 25 bp, Mus musculus
ggatttgtcgccagagagacaagaa

SEQ ID NO: 325022 - DNA, 25 bp, Mus musculus
ggatttgtgaagaaacccccagttg

SEQ ID NO: 325023 - DNA, 25 bp, Mus musculus
ggatttgtgaaggtatccgccccca

SEQ ID NO: 325024 - DNA, 25 bp, Mus musculus
ggatttgtgaaggtttcagaggatt

SEQ ID NO: 325025 - DNA, 25 bp, Mus musculus
ggatttgtggagtctggccacagat

SEQ ID NO: 325026 - DNA, 25 bp, Mus musculus
ggatttgtgggggccagaacaatga

SEQ ID NO: 325027 - DNA, 25 bp, Mus musculus
ggatttgtgtgctcgaaaattggag

SEQ ID NO: 325028 - DNA, 25 bp, Mus musculus
ggatttgttgtggctttttaaagtc

SEQ ID NO: 325029 - DNA, 25 bp, Mus musculus
ggattttaaaaggaaacagacagct

SEQ ID NO: 325030 - DNA, 25 bp, Mus musculus
ggattttaaagacggctatggatgt

SEQ ID NO: 325031 - DNA, 25 bp, Mus musculus
ggattttaaagagtattcaaattgc

SEQ ID NO: 325032 - DNA, 25 bp, Mus musculus
ggattttaaagagttgattccagaa

SEQ ID NO: 325033 - DNA, 25 bp, Mus musculus
ggattttaaagtggacatcccagaa

SEQ ID NO: 325034 - DNA, 25 bp, Mus musculus
ggattttaagggtctcacaccagct

SEQ ID NO: 325035 - DNA, 25 bp, Mus musculus
ggattttaaggtgagactgtggaga

SEQ ID NO: 325036 - DNA, 25 bp, Mus musculus
ggattttcgcaactgcgcaaaccat

SEQ ID NO: 325037 - DNA, 25 bp, Mus musculus
ggattttcggcctggccgagtggtg

SEQ ID NO: 325038 - DNA, 25 bp, Mus musculus
ggattttctcacaaacattaaccag

SEQ ID NO: 325039 - DNA, 25 bp, Mus musculus
ggattttctcacaataggtgacctt

SEQ ID NO: 325040 - DNA, 25 bp, Mus musculus
ggattttctcacatcttggaggagg

SEQ ID NO: 325041 - DNA, 25 bp, Mus musculus
ggattttctcagggaggcgccttgt

SEQ ID NO: 325042 - DNA, 25 bp, Mus musculus
ggattttctcaggggccgatcaaca

SEQ ID NO: 325043 - DNA, 25 bp, Mus musculus
ggattttctgtgcagcagatttact

SEQ ID NO: 325044 - DNA, 25 bp, Mus musculus
ggattttctgtgcctttattgcttg

SEQ ID NO: 325045 - DNA, 25 bp, Mus musculus
ggattttgagaacctgggtgtggtc

SEQ ID NO: 325046 - DNA, 25 bp, Mus musculus
ggattttgagatgtccatatgtggt

SEQ ID NO: 325047 - DNA, 25 bp, Mus musculus
ggattttgcccaggaccagccatgg

SEQ ID NO: 325048 - DNA, 25 bp, Mus musculus
ggatttttctagcaagttgcgaatc

SEQ ID NO: 325049 - DNA, 25 bp, Mus musculus
ggatttttctaggacatgtatgcat

SEQ ID NO: 325050 - DNA, 25 bp, Mus musculus
ggatttttgtcctacttggaggaaa

SEQ ID NO: 325051 - DNA, 25 bp, Mus musculus
ggcaaaaaaagtggacgctcagggt

SEQ ID NO: 325052 - DNA, 25 bp, Mus musculus
ggcaaaaaatgtaacatttcacttg

SEQ ID NO: 325053 - DNA, 25 bp, Mus musculus
ggcaaaaaatgttggtttgccatcc

SEQ ID NO: 325054 - DNA, 25 bp, Mus musculus
ggcaaaacagaaacgttcctgagac

SEQ ID NO: 325055 - DNA, 25 bp, Mus musculus
ggcaaaaccaggtgcagatccctgc

SEQ ID NO: 325056 - DNA, 25 bp, Mus musculus
ggcaaaacccaggcaagtgctctcc

SEQ ID NO: 325057 - DNA, 25 bp, Mus musculus
ggcaaaactgagtgaccttcagaat

SEQ ID NO: 325058 - DNA, 25 bp, Mus musculus
ggcaaaagagatatatccagtgatg

SEQ ID NO: 325059 - DNA, 25 bp, Mus musculus
ggcaaaagagttatatccagtgatg

SEQ ID NO: 325060 - DNA, 25 bp, Mus musculus
ggcaaaagatgccagtctaattgaa

SEQ ID NO: 325061 - DNA, 25 bp, Mus musculus
ggcaaaagatgtgtggtatctcttg

SEQ ID NO: 325062 - DNA, 25 bp, Mus musculus
ggcaaaagcagaaccgggatggacc

SEQ ID NO: 325063 - DNA, 25 bp, Mus musculus
ggcaaaagcagattttatcatgtgg

SEQ ID NO: 325064 - DNA, 25 bp, Mus musculus
ggcaaaagccagtgggaagagcatg

SEQ ID NO: 325065 - DNA, 25 bp, Mus musculus
ggcaaaagccgaggctctgctaagg

SEQ ID NO: 325066 - DNA, 25 bp, Mus musculus
ggcaaaagtgagtggagctcctctg

SEQ ID NO: 325067 - DNA, 25 bp, Mus musculus
ggcaaaatagcgatgtctggaataa

SEQ ID NO: 325068 - DNA, 25 bp, Mus musculus
ggcaaaatctgtctccagtagaagg

SEQ ID NO: 325069 - DNA, 25 bp, Mus musculus
ggcaaaatctgtgagaaggaccgaa

SEQ ID NO: 325070 - DNA, 25 bp, Mus musculus
ggcaaaatgagccgcacggaaggaa

SEQ ID NO: 325071 - DNA, 25 bp, Mus musculus
ggcaaaattggaaagagaacttgaa

SEQ ID NO: 325072 - DNA, 25 bp, Mus musculus
ggcaaaattgtctgtccactctgtg

SEQ ID NO: 325073 - DNA, 25 bp, Mus musculus
ggcaaacaacagggcagcagaagaa

SEQ ID NO: 325074 - DNA, 25 bp, Mus musculus
ggcaaacaacagggtggcagacgaa

SEQ ID NO: 325075 - DNA, 25 bp, Mus musculus
ggcaaacacctccctctcccagtac

SEQ ID NO: 325076 - DNA, 25 bp, Mus musculus
ggcaaacagacagtgattgtatgtg

SEQ ID NO: 325077 - DNA, 25 bp, Mus musculus
ggcaaacagtcagtgtgaatttgaa

SEQ ID NO: 325078 - DNA, 25 bp, Mus musculus
ggcaaacatgacctggctcacctac

SEQ ID NO: 325079 - DNA, 25 bp, Mus musculus
ggcaaaccactggatatattgggtt

SEQ ID NO: 325080 - DNA, 25 bp, Mus musculus
ggcaaaccactggggagtagagcaa

SEQ ID NO: 325081 - DNA, 25 bp, Mus musculus
ggcaaaccatgacatgtactatgcg

SEQ ID NO: 325082 - DNA, 25 bp, Mus musculus
ggcaaaccattcaaaatacaagtcc

SEQ ID NO: 325083 - DNA, 25 bp, Mus musculus
ggcaaaccattcaaatcctggttga

SEQ ID NO: 325084 - DNA, 25 bp, Mus musculus
ggcaaaccctatgtttgatgaccct

SEQ ID NO: 325085 - DNA, 25 bp, Mus musculus
ggcaaactaacaaggacaatcagta

SEQ ID NO: 325086 - DNA, 25 bp, Mus musculus
ggcaaactaacaaggatattacaaa

SEQ ID NO: 325087 - DNA, 25 bp, Mus musculus
ggcaaactcttcctaagaaacctca

SEQ ID NO: 325088 - DNA, 25 bp, Mus musculus
ggcaaactgttctgcggtggaggga

SEQ ID NO: 325089 - DNA, 25 bp, Mus musculus
ggcaaactgttctgtggtggttcca

SEQ ID NO: 325090 - DNA, 25 bp, Mus musculus
ggcaaacttgcagtatgatgatggc

SEQ ID NO: 325091 - DNA, 25 bp, Mus musculus
ggcaaagaaaatagctccggtacct

SEQ ID NO: 325092 - DNA, 25 bp, Mus musculus
ggcaaagacaaggaggcagaagatg

SEQ ID NO: 325093 - DNA, 25 bp, Mus musculus
ggcaaagagaaagggaaaaactctc

SEQ ID NO: 325094 - DNA, 25 bp, Mus musculus
ggcaaagaggaaaagagtgtttgag

SEQ ID NO: 325095 - DNA, 25 bp, Mus musculus
ggcaaagaggaacagagtgtttgag

SEQ ID NO: 325096 - DNA, 25 bp, Mus musculus
ggcaaagaggtgcaggcggctggag

SEQ ID NO: 325097 - DNA, 25 bp, Mus musculus
ggcaaagaggtgcaggctggttcga

SEQ ID NO: 325098 - DNA, 25 bp, Mus musculus
ggcaaagagtcagacatttacattg

SEQ ID NO: 325099 - DNA, 25 bp, Mus musculus
ggcaaagatacagagtcaggggatg

SEQ ID NO: 325100 - DNA, 25 bp, Mus musculus
ggcaaagatccagacaaggagggca

SEQ ID NO: 325101 - DNA, 25 bp, Mus musculus
ggcaaagatgtcagtgctctcttcc

SEQ ID NO: 325102 - DNA, 25 bp, Mus musculus
ggcaaagattgtgtgctgttccacc

SEQ ID NO: 325103 - DNA, 25 bp, Mus musculus
ggcaaagcaagagattcgagtaaga

SEQ ID NO: 325104 - DNA, 25 bp, Mus musculus
ggcaaagccgacgcagtatgagatg

SEQ ID NO: 325105 - DNA, 25 bp, Mus musculus
ggcaaagccggctccagccacaatg

SEQ ID NO: 325106 - DNA, 25 bp, Mus musculus
ggcaaagcgtagaatgagaagactt

SEQ ID NO: 325107 - DNA, 25 bp, Mus musculus
ggcaaagcgtagcttcatactaggg

SEQ ID NO: 325108 - DNA, 25 bp, Mus musculus
ggcaaagcgtagcttgaagtcaatg

SEQ ID NO: 325109 - DNA, 25 bp, Mus musculus
ggcaaagctagacaagttggatggc

SEQ ID NO: 325110 - DNA, 25 bp, Mus musculus
ggcaaagctgaccagaaggaaaaga

SEQ ID NO: 325111 - DNA, 25 bp, Mus musculus
ggcaaagctttggagggctccactc

SEQ ID NO: 325112 - DNA, 25 bp, Mus musculus
ggcaaaggaagatttgatgaaaaag

SEQ ID NO: 325113 - DNA, 25 bp, Mus musculus
ggcaaaggatctagatgagaatgaa

SEQ ID NO: 325114 - DNA, 25 bp, Mus musculus
ggcaaaggccctggggaatgtatca

SEQ ID NO: 325115 - DNA, 25 bp, Mus musculus
ggcaaaggcttttggggcaggggct

SEQ ID NO: 325116 - DNA, 25 bp, Mus musculus
ggcaaaggcttttggggctgacttt

SEQ ID NO: 325117 - DNA, 25 bp, Mus musculus
ggcaaaggtgggttccagcactgct

SEQ ID NO: 325118 - DNA, 25 bp, Mus musculus
ggcaaaggtgtgccccagctcctgg

SEQ ID NO: 325119 - DNA, 25 bp, Mus musculus
ggcaaagtacgcaagatgaacacta

SEQ ID NO: 325120 - DNA, 25 bp, Mus musculus
ggcaaagtaggagttggcatccatt

SEQ ID NO: 325121 - DNA, 25 bp, Mus musculus
ggcaaatcagaatgagttgcaagca

SEQ ID NO: 325122 - DNA, 25 bp, Mus musculus
ggcaaatcaggaaaggatgtggccg

SEQ ID NO: 325123 - DNA, 25 bp, Mus musculus
ggcaaatctgtcaggtatacagata

SEQ ID NO: 325124 - DNA, 25 bp, Mus musculus
ggcaaatggaaggaaacttcatggc

SEQ ID NO: 325125 - DNA, 25 bp, Mus musculus
ggcaaatgtcagccatgcaagtgca

SEQ ID NO: 325126 - DNA, 25 bp, Mus musculus
ggcaaatgtccctccacctcctggc

SEQ ID NO: 325127 - DNA, 25 bp, Mus musculus
ggcaaatgtgagaatgaaactttgc

SEQ ID NO: 325128 - DNA, 25 bp, Mus musculus
ggcaaatgtgagttgtctgttgatg

SEQ ID NO: 325129 - DNA, 25 bp, Mus musculus
ggcaaattaggtctgactttgtgac

SEQ ID NO: 325130 - DNA, 25 bp, Mus musculus
ggcaaatttccagaaatcaacacta

SEQ ID NO: 325131 - DNA, 25 bp, Mus musculus
ggcaaatttccagggctatgtgctt

SEQ ID NO: 325132 - DNA, 25 bp, Mus musculus
ggcaaattttggtgctggggacatt

SEQ ID NO: 325133 - DNA, 25 bp, Mus musculus
ggcaacaacgctctggtgcaagtgt

SEQ ID NO: 325134 - DNA, 25 bp, Mus musculus
ggcaacacagtgctgctcttagcat

SEQ ID NO: 325135 - DNA, 25 bp, Mus musculus
ggcaacaccctgggaaatgtgtgtc

SEQ ID NO: 325136 - DNA, 25 bp, Mus musculus
ggcaacaccctgggcattggggctt

SEQ ID NO: 325137 - DNA, 25 bp, Mus musculus
ggcaacaccctgggttttagatgcc

SEQ ID NO: 325138 - DNA, 25 bp, Mus musculus
ggcaacactggccggacccacattg

SEQ ID NO: 325139 - DNA, 25 bp, Mus musculus
ggcaacactgggtaacctccgtgct

SEQ ID NO: 325140 - DNA, 25 bp, Mus musculus
ggcaacagcaaggtgcacatgtatg

SEQ ID NO: 325141 - DNA, 25 bp, Mus musculus
ggcaacagcaagtgctgacagtaga

SEQ ID NO: 325142 - DNA, 25 bp, Mus musculus
ggcaacaggccaggaaggaaaaaca

SEQ ID NO: 325143 - DNA, 25 bp, Mus musculus
ggcaacatcagaaagtgactcagac

SEQ ID NO: 325144 - DNA, 25 bp, Mus musculus
ggcaacatcagaattggaaaagtca

SEQ ID NO: 325145 - DNA, 25 bp, Mus musculus
ggcaacatcgctgtgggcaaatcca

SEQ ID NO: 325146 - DNA, 25 bp, Mus musculus
ggcaacatcggatggcacttccaaa

SEQ ID NO: 325147 - DNA, 25 bp, Mus musculus
ggcaacatggaagtgaaggatgcga

SEQ ID NO: 325148 - DNA, 25 bp, Mus musculus
ggcaaccaagcattatgagatgctt

SEQ ID NO: 325149 - DNA, 25 bp, Mus musculus
ggcaacccacgcaagatggctgcca

SEQ ID NO: 325150 - DNA, 25 bp, Mus musculus
ggcaacccagaactgatagtgcatc

SEQ ID NO: 325151 - DNA, 25 bp, Mus musculus
ggcaacccagattgacttgatgcaa

SEQ ID NO: 325152 - DNA, 25 bp, Mus musculus
ggcaaccgcaggactactggtgcct

SEQ ID NO: 325153 - DNA, 25 bp, Mus musculus
ggcaacctaggtgttgactttaaga

SEQ ID NO: 325154 - DNA, 25 bp, Mus musculus
ggcaacctcataaaggttgacctat

SEQ ID NO: 325155 - DNA, 25 bp, Mus musculus
ggcaacctggcctctagacgtcctc

SEQ ID NO: 325156 - DNA, 25 bp, Mus musculus
ggcaacctttctagatgatttaagc

SEQ ID NO: 325157 - DNA, 25 bp, Mus musculus
ggcaacctttggtagagaccttttc

SEQ ID NO: 325158 - DNA, 25 bp, Mus musculus
ggcaacgaaaggtctccgggcacaa

SEQ ID NO: 325159 - DNA, 25 bp, Mus musculus
ggcaacgacccccagggagaggcag

SEQ ID NO: 325160 - DNA, 25 bp, Mus musculus
ggcaacgagcggaggaggtcccagg

SEQ ID NO: 325161 - DNA, 25 bp, Mus musculus
ggcaacgattcaagctcttgcttct

SEQ ID NO: 325162 - DNA, 25 bp, Mus musculus
ggcaacgattcaaggaggagccccg

SEQ ID NO: 325163 - DNA, 25 bp, Mus musculus
ggcaacgctgaatggtgccatgaca

SEQ ID NO: 325164 - DNA, 25 bp, Mus musculus
ggcaacgctgtcagcgaaggcctga

SEQ ID NO: 325165 - DNA, 25 bp, Mus musculus
ggcaacggacagctcggattctgaa

SEQ ID NO: 325166 - DNA, 25 bp, Mus musculus
ggcaacgggggtctctttaggtggt

SEQ ID NO: 325167 - DNA, 25 bp, Mus musculus
ggcaacgtgatggagctggtgggga

SEQ ID NO: 325168 - DNA, 25 bp, Mus musculus
ggcaacgtttccaggtatgagatgt

SEQ ID NO: 325169 - DNA, 25 bp, Mus musculus
ggcaacgtttccagtgcaaacatac

SEQ ID NO: 325170 - DNA, 25 bp, Mus musculus
ggcaactaggaggctggattgtcct

SEQ ID NO: 325171 - DNA, 25 bp, Mus musculus
ggcaactatgacgctgatttccaaa

SEQ ID NO: 325172 - DNA, 25 bp, Mus musculus
ggcaactccgagtttgtggggacat

SEQ ID NO: 325173 - DNA, 25 bp, Mus musculus
ggcaactcttattgggctgtgccta

SEQ ID NO: 325174 - DNA, 25 bp, Mus musculus
ggcaactcttattgttggaaatcta

SEQ ID NO: 325175 - DNA, 25 bp, Mus musculus
ggcaactgagaacaaagcaacaagc

SEQ ID NO: 325176 - DNA, 25 bp, Mus musculus
ggcaactgagaacaaagcaacaata

SEQ ID NO: 325177 - DNA, 25 bp, Mus musculus
ggcaactgtgtggacatcaacgaat

SEQ ID NO: 325178 - DNA, 25 bp, Mus musculus
ggcaacttcctttcacgtgactgac

SEQ ID NO: 325179 - DNA, 25 bp, Mus musculus
ggcaactttgtggacctctgcaggg

SEQ ID NO: 325180 - DNA, 25 bp, Mus musculus
ggcaagaaagatgaacgagaccgtg

SEQ ID NO: 325181 - DNA, 25 bp, Mus musculus
ggcaagaaccggagacaatcaggct

SEQ ID NO: 325182 - DNA, 25 bp, Mus musculus
ggcaagaaccgttctcaagaaccct

SEQ ID NO: 325183 - DNA, 25 bp, Mus musculus
ggcaagaactccagtgtttcccgag

SEQ ID NO: 325184 - DNA, 25 bp, Mus musculus
ggcaagaagtcctgccacactgggg

SEQ ID NO: 325185 - DNA, 25 bp, Mus musculus
ggcaagaatgggataatactgtgaa

SEQ ID NO: 325186 - DNA, 25 bp, Mus musculus
ggcaagacagattacaaaagaagac

SEQ ID NO: 325187 - DNA, 25 bp, Mus musculus
ggcaagacatacaggtgtaaggtct

SEQ ID NO: 325188 - DNA, 25 bp, Mus musculus
ggcaagacatgtaccagtgcttggt

SEQ ID NO: 325189 - DNA, 25 bp, Mus musculus
ggcaagaccaagatcaccgatgtga

SEQ ID NO: 325190 - DNA, 25 bp, Mus musculus
ggcaagaccggcttctcctcggacc

SEQ ID NO: 325191 - DNA, 25 bp, Mus musculus
ggcaagagacggaagaacgagccat

SEQ ID NO: 325192 - DNA, 25 bp, Mus musculus
ggcaagagagatctccagtcctgat

SEQ ID NO: 325193 - DNA, 25 bp, Mus musculus
ggcaagagccagcagcagcagcagc

SEQ ID NO: 325194 - DNA, 25 bp, Mus musculus
ggcaagagcgcagatctcccctagc

SEQ ID NO: 325195 - DNA, 25 bp, Mus musculus
ggcaagagcgcaggtccaacttcag

SEQ ID NO: 325196 - DNA, 25 bp, Mus musculus
ggcaagagctctcagcacgggggcg

SEQ ID NO: 325197 - DNA, 25 bp, Mus musculus
ggcaagagctctcaggtactgtact

SEQ ID NO: 325198 - DNA, 25 bp, Mus musculus
ggcaagagctctcaggttcctcagt

SEQ ID NO: 325199 - DNA, 25 bp, Mus musculus
ggcaagaggagccatgaatgtatca

SEQ ID NO: 325200 - DNA, 25 bp, Mus musculus
ggcaagatacacggcatcatcgcag

SEQ ID NO: 325201 - DNA, 25 bp, Mus musculus
ggcaagatcaaagcctcagcgttct

SEQ ID NO: 325202 - DNA, 25 bp, Mus musculus
ggcaagatcaagccccacctgatga

SEQ ID NO: 325203 - DNA, 25 bp, Mus musculus
ggcaagatctctcccaatccatagt

SEQ ID NO: 325204 - DNA, 25 bp, Mus musculus
ggcaagatctctgccaatccatagt

SEQ ID NO: 325205 - DNA, 25 bp, Mus musculus
ggcaagattaaagctaaggaatatt

SEQ ID NO: 325206 - DNA, 25 bp, Mus musculus
ggcaagattaaaggaaccaatgaag

SEQ ID NO: 325207 - DNA, 25 bp, Mus musculus
ggcaagatttggacgacagtgatca

SEQ ID NO: 325208 - DNA, 25 bp, Mus musculus
ggcaagcaagaacaaggatgagagc

SEQ ID NO: 325209 - DNA, 25 bp, Mus musculus
ggcaagcacagacaaagtggacacc

SEQ ID NO: 325210 - DNA, 25 bp, Mus musculus
ggcaagcacgatctgcccatggaaa

SEQ ID NO: 325211 - DNA, 25 bp, Mus musculus
ggcaagcagactaggaatctcgatc

SEQ ID NO: 325212 - DNA, 25 bp, Mus musculus
ggcaagcagcaggggaccagcctca

SEQ ID NO: 325213 - DNA, 25 bp, Mus musculus
ggcaagcccctgccgacacccatcg

SEQ ID NO: 325214 - DNA, 25 bp, Mus musculus
ggcaagcccctgcgacacctgcggc

SEQ ID NO: 325215 - DNA, 25 bp, Mus musculus
ggcaagccctgtgagcactctgact

SEQ ID NO: 325216 - DNA, 25 bp, Mus musculus
ggcaagccctgtgaggacctggaac

SEQ ID NO: 325217 - DNA, 25 bp, Mus musculus
ggcaagccctgtgaggttgaacttc

SEQ ID NO: 325218 - DNA, 25 bp, Mus musculus
ggcaagcctgaacctgtcacaggca

SEQ ID NO: 325219 - DNA, 25 bp, Mus musculus
ggcaagcgggtcaagttacagattt

SEQ ID NO: 325220 - DNA, 25 bp, Mus musculus
ggcaagcgtctaaagcttcaagtta

SEQ ID NO: 325221 - DNA, 25 bp, Mus musculus
ggcaagcgtctaaaggaaattgatg

SEQ ID NO: 325222 - DNA, 25 bp, Mus musculus
ggcaagctcaacaaggctctccaga

SEQ ID NO: 325223 - DNA, 25 bp, Mus musculus
ggcaagctctggaggttgctgaacg

SEQ ID NO: 325224 - DNA, 25 bp, Mus musculus
ggcaagctggtgaagagcatattcc

SEQ ID NO: 325225 - DNA, 25 bp, Mus musculus
ggcaagctttttagatgggagaccg

SEQ ID NO: 325226 - DNA, 25 bp, Mus musculus
ggcaaggaaccagaggaattctgga

SEQ ID NO: 325227 - DNA, 25 bp, Mus musculus
ggcaaggaaggagaccggggaatca

SEQ ID NO: 325228 - DNA, 25 bp, Mus musculus
ggcaaggacagtctcatgcttgcat

SEQ ID NO: 325229 - DNA, 25 bp, Mus musculus
ggcaaggactacctggaccagctga

SEQ ID NO: 325230 - DNA, 25 bp, Mus musculus
ggcaaggagaggtacaaaatgaagc

SEQ ID NO: 325231 - DNA, 25 bp, Mus musculus
ggcaaggagatggaatccaagtgaa

SEQ ID NO: 325232 - DNA, 25 bp, Mus musculus
ggcaaggaggagtcatctctcatgg

SEQ ID NO: 325233 - DNA, 25 bp, Mus musculus
ggcaaggatagcatccatgtcttac

SEQ ID NO: 325234 - DNA, 25 bp, Mus musculus
ggcaaggatagggagcgcctcatct

SEQ ID NO: 325235 - DNA, 25 bp, Mus musculus
ggcaaggatggtgagctccctgtgg

SEQ ID NO: 325236 - DNA, 25 bp, Mus musculus
ggcaaggcaagaggaagaatacaaa

SEQ ID NO: 325237 - DNA, 25 bp, Mus musculus
ggcaaggcaagtacccagtggattg

SEQ ID NO: 325238 - DNA, 25 bp, Mus musculus
ggcaaggcggtggggtaagtgtgga

SEQ ID NO: 325239 - DNA, 25 bp, Mus musculus
ggcaagggaggaccgggctcatcat

SEQ ID NO: 325240 - DNA, 25 bp, Mus musculus
ggcaagggagggcgtggacgggtgg

SEQ ID NO: 325241 - DNA, 25 bp, Mus musculus
ggcaaggggagactggccaatcaca

SEQ ID NO: 325242 - DNA, 25 bp, Mus musculus
ggcaagggttcacaggcacactggc

SEQ ID NO: 325243 - DNA, 25 bp, Mus musculus
ggcaaggtgaggagtactgaacctt

SEQ ID NO: 325244 - DNA, 25 bp, Mus musculus
ggcaagtacctggcttcctgtgtcc

SEQ ID NO: 325245 - DNA, 25 bp, Mus musculus
ggcaagtacctggtctggtcactcg

SEQ ID NO: 325246 - DNA, 25 bp, Mus musculus
ggcaagtcagaatcaacctaccgac

SEQ ID NO: 325247 - DNA, 25 bp, Mus musculus
ggcaagtcagacagtatctcactat

SEQ ID NO: 325248 - DNA, 25 bp, Mus musculus
ggcaagtcagcgattgtagtgagat

SEQ ID NO: 325249 - DNA, 25 bp, Mus musculus
ggcaagtccagcctgctcctgaggt

SEQ ID NO: 325250 - DNA, 25 bp, Mus musculus
ggcaagtccctcagggtgatgtgaa

SEQ ID NO: 325251 - DNA, 25 bp, Mus musculus
ggcaagtctgaccttcatcacttct

SEQ ID NO: 325252 - DNA, 25 bp, Mus musculus
ggcaagtctgccctgacggtgaagt

SEQ ID NO: 325253 - DNA, 25 bp, Mus musculus
ggcaagtgagtccgatgccttacgg

SEQ ID NO: 325254 - DNA, 25 bp, Mus musculus
ggcaagtgagtccgcaccttcaggg

SEQ ID NO: 325255 - DNA, 25 bp, Mus musculus
ggcaagtgatggagactcagaaagc

SEQ ID NO: 325256 - DNA, 25 bp, Mus musculus
ggcaagtgctcaggaagactcttca

SEQ ID NO: 325257 - DNA, 25 bp, Mus musculus
ggcaagtgctcaggaggccatgaca

SEQ ID NO: 325258 - DNA, 25 bp, Mus musculus
ggcaagtgctccggccattccagct

SEQ ID NO: 325259 - DNA, 25 bp, Mus musculus
ggcaagtgctggaacacctgctgaa

SEQ ID NO: 325260 - DNA, 25 bp, Mus musculus
ggcaagtggaggatccattttctca

SEQ ID NO: 325261 - DNA, 25 bp, Mus musculus
ggcaagtggctgagtatctccagac

SEQ ID NO: 325262 - DNA, 25 bp, Mus musculus
ggcaagttaactgctcttcagggca

SEQ ID NO: 325263 - DNA, 25 bp, Mus musculus
ggcaagtttgactggagacagcagt

SEQ ID NO: 325264 - DNA, 25 bp, Mus musculus
ggcaagtttgactgggccatgccgc

SEQ ID NO: 325265 - DNA, 25 bp, Mus musculus
ggcaagtttgggcctgccttaagtg

SEQ ID NO: 325266 - DNA, 25 bp, Mus musculus
ggcaataaactacagactccatgaa

SEQ ID NO: 325267 - DNA, 25 bp, Mus musculus
ggcaataaatatgcttcatcttcag

SEQ ID NO: 325268 - DNA, 25 bp, Mus musculus
ggcaataaattggagagaggtcaga

SEQ ID NO: 325269 - DNA, 25 bp, Mus musculus
ggcaataacagtgactggtcctatt

SEQ ID NO: 325270 - DNA, 25 bp, Mus musculus
ggcaataaggagaggatggctgtgc

SEQ ID NO: 325271 - DNA, 25 bp, Mus musculus
ggcaataatctatagaccatggagc

SEQ ID NO: 325272 - DNA, 25 bp, Mus musculus
ggcaataatctgaagaccatggagc

SEQ ID NO: 325273 - DNA, 25 bp, Mus musculus
ggcaataatggaagtgggaagagtg

SEQ ID NO: 325274 - DNA, 25 bp, Mus musculus
ggcaataccaatatagggggctact

SEQ ID NO: 325275 - DNA, 25 bp, Mus musculus
ggcaatacgtgtcatagaatgtcgt

SEQ ID NO: 325276 - DNA, 25 bp, Mus musculus
ggcaatatcatgattgaccccgtcc

SEQ ID NO: 325277 - DNA, 25 bp, Mus musculus
ggcaatcacatgtatgtctctgccc

SEQ ID NO: 325278 - DNA, 25 bp, Mus musculus
ggcaatcccactgtgcaaactctgg

SEQ ID NO: 325279 - DNA, 25 bp, Mus musculus
ggcaatctatgattcctgtgttgaa

SEQ ID NO: 325280 - DNA, 25 bp, Mus musculus
ggcaatctcagagctaagtaaaaac

SEQ ID NO: 325281 - DNA, 25 bp, Mus musculus
ggcaatctcagtttgtgactctgtt

SEQ ID NO: 325282 - DNA, 25 bp, Mus musculus
ggcaatgaaggaagaagaaagaaaa

SEQ ID NO: 325283 - DNA, 25 bp, Mus musculus
ggcaatgaaggctccatatatttag

SEQ ID NO: 325284 - DNA, 25 bp, Mus musculus
ggcaatgaaggtaaatgatctccga

SEQ ID NO: 325285 - DNA, 25 bp, Mus musculus
ggcaatgacattggtccctatggtg

SEQ ID NO: 325286 - DNA, 25 bp, Mus musculus
ggcaatgactggtgtccactcccag

SEQ ID NO: 325287 - DNA, 25 bp, Mus musculus
ggcaatgactgtcattttagtgaat

SEQ ID NO: 325288 - DNA, 25 bp, Mus musculus
ggcaatgatggaagcaattttggag

SEQ ID NO: 325289 - DNA, 25 bp, Mus musculus
ggcaatgatggtggctatggcggtt

SEQ ID NO: 325290 - DNA, 25 bp, Mus musculus
ggcaatgatggtggttatggaggag

SEQ ID NO: 325291 - DNA, 25 bp, Mus musculus
ggcaatgcaaaacttgcagtaatgt

SEQ ID NO: 325292 - DNA, 25 bp, Mus musculus
ggcaatgcaaataagtgaaaaggaa

SEQ ID NO: 325293 - DNA, 25 bp, Mus musculus
ggcaatgccaggtggcccagagtgg

SEQ ID NO: 325294 - DNA, 25 bp, Mus musculus
ggcaatgccaggttgaacgacatgt

SEQ ID NO: 325295 - DNA, 25 bp, Mus musculus
ggcaatggacttcaggcaatccaaa

SEQ ID NO: 325296 - DNA, 25 bp, Mus musculus
ggcaatggcagaaagaactcacggc

SEQ ID NO: 325297 - DNA, 25 bp, Mus musculus
ggcaatggcagtgagcaccactctg

SEQ ID NO: 325298 - DNA, 25 bp, Mus musculus
ggcaatggcttcgcaggctgcatgc

SEQ ID NO: 325299 - DNA, 25 bp, Mus musculus
ggcaatggctttgcgggctgcgtgc

SEQ ID NO: 325300 - DNA, 25 bp, Mus musculus
ggcaatgtatccaagggagcccagg

SEQ ID NO: 325301 - DNA, 25 bp, Mus musculus
ggcaatgtccaggaccgcattggtc

SEQ ID NO: 325302 - DNA, 25 bp, Mus musculus
ggcaatgtggagaaggtgaaattta

SEQ ID NO: 325303 - DNA, 25 bp, Mus musculus
ggcaatgtgttcagcccgcatgccc

SEQ ID NO: 325304 - DNA, 25 bp, Mus musculus
ggcaattcaggttcattttgctggc

SEQ ID NO: 325305 - DNA, 25 bp, Mus musculus
ggcaattcaggttcccaggtggtga

SEQ ID NO: 325306 - DNA, 25 bp, Mus musculus
ggcaattcaggttctcttgccacat

SEQ ID NO: 325307 - DNA, 25 bp, Mus musculus
ggcaattcccttaggaacctcctct

SEQ ID NO: 325308 - DNA, 25 bp, Mus musculus
ggcaattctagtggctgcggcttcc

SEQ ID NO: 325309 - DNA, 25 bp, Mus musculus
ggcaattgttatcccaactgtaaat

SEQ ID NO: 325310 - DNA, 25 bp, Mus musculus
ggcaatttcaaggcaactttccacc

SEQ ID NO: 325311 - DNA, 25 bp, Mus musculus
ggcacaaaatcagcgcctgggagag

SEQ ID NO: 325312 - DNA, 25 bp, Mus musculus
ggcacaaacaaatgacatgtttttc

SEQ ID NO: 325313 - DNA, 25 bp, Mus musculus
ggcacaaacgccagacgtgaaaaat

SEQ ID NO: 325314 - DNA, 25 bp, Mus musculus
ggcacaaactacacggaagaaaagc

SEQ ID NO: 325315 - DNA, 25 bp, Mus musculus
ggcacaaatcaaaaggtgtgatcct

SEQ ID NO: 325316 - DNA, 25 bp, Mus musculus
ggcacaacaatctagagcccttact

SEQ ID NO: 325317 - DNA, 25 bp, Mus musculus
ggcacaacagtggggtgagtttaag

SEQ ID NO: 325318 - DNA, 25 bp, Mus musculus
ggcacaacccgcggggcgccctgca

SEQ ID NO: 325319 - DNA, 25 bp, Mus musculus
ggcacaaccttcgagtcctcaaatg

SEQ ID NO: 325320 - DNA, 25 bp, Mus musculus
ggcacaactcctggtcatctagtag

SEQ ID NO: 325321 - DNA, 25 bp, Mus musculus
ggcacaactctagagaagtttattg

SEQ ID NO: 325322 - DNA, 25 bp, Mus musculus
ggcacaagacgatacagcacgggca

SEQ ID NO: 325323 - DNA, 25 bp, Mus musculus
ggcacaagacggatcttgaaacagg

SEQ ID NO: 325324 - DNA, 25 bp, Mus musculus
ggcacaagcaaagaccggtgtgtga

SEQ ID NO: 325325 - DNA, 25 bp, Mus musculus
ggcacaagcaaaggaaagaggccga

SEQ ID NO: 325326 - DNA, 25 bp, Mus musculus
ggcacaagcaaagtggtagtgtgaa

SEQ ID NO: 325327 - DNA, 25 bp, Mus musculus
ggcacaagcagccaggccccatgaa

SEQ ID NO: 325328 - DNA, 25 bp, Mus musculus
ggcacaagtgctgagagctaagtga

SEQ ID NO: 325329 - DNA, 25 bp, Mus musculus
ggcacaatcagagccttggctgtta

SEQ ID NO: 325330 - DNA, 25 bp, Mus musculus
ggcacaatcaggcgacaggtgaaca

SEQ ID NO: 325331 - DNA, 25 bp, Mus musculus
ggcacaatcaggttcttgagaggaa

SEQ ID NO: 325332 - DNA, 25 bp, Mus musculus
ggcacaatgcgaccttcttcgggaa

SEQ ID NO: 325333 - DNA, 25 bp, Mus musculus
ggcacaatttttaggccccgtcatt

SEQ ID NO: 325334 - DNA, 25 bp, Mus musculus
ggcacacaatctgccattatttgca

SEQ ID NO: 325335 - DNA, 25 bp, Mus musculus
ggcacacaccctaaggtaaaagttg

SEQ ID NO: 325336 - DNA, 25 bp, Mus musculus
ggcacacaccctaagtatttagaaa

SEQ ID NO: 325337 - DNA, 25 bp, Mus musculus
ggcacacagagcaggtcatacctca

SEQ ID NO: 325338 - DNA, 25 bp, Mus musculus
ggcacacagagcagtacctcaaatc

SEQ ID NO: 325339 - DNA, 25 bp, Mus musculus
ggcacacatcctcaggaaagctgtg

SEQ ID NO: 325340 - DNA, 25 bp, Mus musculus
ggcacacatcctcaggagccaggga

SEQ ID NO: 325341 - DNA, 25 bp, Mus musculus
ggcacacatggacaggtgacgccat

SEQ ID NO: 325342 - DNA, 25 bp, Mus musculus
ggcacaccactgcagtgtttgtaag

SEQ ID NO: 325343 - DNA, 25 bp, Mus musculus
ggcacaccagggcaccctcagatca

SEQ ID NO: 325344 - DNA, 25 bp, Mus musculus
ggcacaccgcagggagaaaactggt

SEQ ID NO: 325345 - DNA, 25 bp, Mus musculus
ggcacacctagtcagtccccagttg

SEQ ID NO: 325346 - DNA, 25 bp, Mus musculus
ggcacacgcaggtgcctcctcctgg

SEQ ID NO: 325347 - DNA, 25 bp, Mus musculus
ggcacactcgatctgatttgtactc

SEQ ID NO: 325348 - DNA, 25 bp, Mus musculus
ggcacagaaccaaaggacacagctg

SEQ ID NO: 325349 - DNA, 25 bp, Mus musculus
ggcacagaagatgctgacaaatctg

SEQ ID NO: 325350 - DNA, 25 bp, Mus musculus
ggcacagacatgatggtgggcattg

SEQ ID NO: 325351 - DNA, 25 bp, Mus musculus
ggcacagacatggagtcagtgactt

SEQ ID NO: 325352 - DNA, 25 bp, Mus musculus
ggcacagagattcaggttctcccct

SEQ ID NO: 325353 - DNA, 25 bp, Mus musculus
ggcacagcaggacgcagagaccaca

SEQ ID NO: 325354 - DNA, 25 bp, Mus musculus
ggcacagcaggagatagggtttcaa

SEQ ID NO: 325355 - DNA, 25 bp, Mus musculus
ggcacagcaggagttcaagaacgcc

SEQ ID NO: 325356 - DNA, 25 bp, Mus musculus
ggcacagcagttccgcagaggacgt

SEQ ID NO: 325357 - DNA, 25 bp, Mus musculus
ggcacagctccgggaggcctttgaa

SEQ ID NO: 325358 - DNA, 25 bp, Mus musculus
ggcacagctggctggaccagatctg

SEQ ID NO: 325359 - DNA, 25 bp, Mus musculus
ggcacaggaaactggccaaggtgga

SEQ ID NO: 325360 - DNA, 25 bp, Mus musculus
ggcacaggagagggaggcctggagg

SEQ ID NO: 325361 - DNA, 25 bp, Mus musculus
ggcacaggaggcctggaggagctgg

SEQ ID NO: 325362 - DNA, 25 bp, Mus musculus
ggcacaggctccaggctgttggaaa

SEQ ID NO: 325363 - DNA, 25 bp, Mus musculus
ggcacagggaggcagtttgcaggga

SEQ ID NO: 325364 - DNA, 25 bp, Mus musculus
ggcacagtggagttaccctgcatct

SEQ ID NO: 325365 - DNA, 25 bp, Mus musculus
ggcacataaaaaggagacagagtca

SEQ ID NO: 325366 - DNA, 25 bp, Mus musculus
ggcacataaaaaggctgagaaggca

SEQ ID NO: 325367 - DNA, 25 bp, Mus musculus
ggcacatacccaggatcaaaaccct

SEQ ID NO: 325368 - DNA, 25 bp, Mus musculus
ggcacatacccaggttgctgccttg

SEQ ID NO: 325369 - DNA, 25 bp, Mus musculus
ggcacatcttcaggactcggaaggt

SEQ ID NO: 325370 - DNA, 25 bp, Mus musculus
ggcacatgtttcagaaatgaagcag

SEQ ID NO: 325371 - DNA, 25 bp, Mus musculus
ggcacatgtttcagccggataccaa

SEQ ID NO: 325372 - DNA, 25 bp, Mus musculus
ggcacattcaaggacatcgaggaag

SEQ ID NO: 325373 - DNA, 25 bp, Mus musculus
ggcacattcaaggactgggctgacg

SEQ ID NO: 325374 - DNA, 25 bp, Mus musculus
ggcacattgtcggtgtacttgggag

SEQ ID NO: 325375 - DNA, 25 bp, Mus musculus
ggcacatttccagcgttcccaggct

SEQ ID NO: 325376 - DNA, 25 bp, Mus musculus
ggcacatttccagcgttcccatgcc

SEQ ID NO: 325377 - DNA, 25 bp, Mus musculus
ggcacatttttcgacatccgcagac

SEQ ID NO: 325378 - DNA, 25 bp, Mus musculus
ggcaccaaactactaaaggtgttaa

SEQ ID NO: 325379 - DNA, 25 bp, Mus musculus
ggcaccaaactccatagattgtaag

SEQ ID NO: 325380 - DNA, 25 bp, Mus musculus
ggcaccaaactgcttgatttaaatt

SEQ ID NO: 325381 - DNA, 25 bp, Mus musculus
ggcaccaacagcgccaggcagcacg

SEQ ID NO: 325382 - DNA, 25 bp, Mus musculus
ggcaccaacaggcctgatgggacca

SEQ ID NO: 325383 - DNA, 25 bp, Mus musculus
ggcaccaacaggggagtatgtgctc

SEQ ID NO: 325384 - DNA, 25 bp, Mus musculus
ggcaccaataaaatggatcttcatt

SEQ ID NO: 325385 - DNA, 25 bp, Mus musculus
ggcaccaataaaattggtgttcccc

SEQ ID NO: 325386 - DNA, 25 bp, Mus musculus
ggcaccacacgctacaggtacatca

SEQ ID NO: 325387 - DNA, 25 bp, Mus musculus
ggcaccagaagcagccaggcttctc

SEQ ID NO: 325388 - DNA, 25 bp, Mus musculus
ggcaccagaagcagccatggaccct

SEQ ID NO: 325389 - DNA, 25 bp, Mus musculus
ggcaccagaggtattagaagataat

SEQ ID NO: 325390 - DNA, 25 bp, Mus musculus
ggcaccagccctttgcttatgggac

SEQ ID NO: 325391 - DNA, 25 bp, Mus musculus
ggcaccagcgcagggaatggatacg

SEQ ID NO: 325392 - DNA, 25 bp, Mus musculus
ggcaccaggacttggagagctgtca

SEQ ID NO: 325393 - DNA, 25 bp, Mus musculus
ggcaccaggcctggaagcaccagcc

SEQ ID NO: 325394 - DNA, 25 bp, Mus musculus
ggcaccaggcctggggtccccttcc

SEQ ID NO: 325395 - DNA, 25 bp, Mus musculus
ggcaccagtctgcgttaagcatctg

SEQ ID NO: 325396 - DNA, 25 bp, Mus musculus
ggcaccagtgggaggtctggactcg

SEQ ID NO: 325397 - DNA, 25 bp, Mus musculus
ggcaccatcaccaaaaatgggtaca

SEQ ID NO: 325398 - DNA, 25 bp, Mus musculus
ggcaccatcaccaagctcctccaga

SEQ ID NO: 325399 - DNA, 25 bp, Mus musculus
ggcaccatcaccaagtcggatgctc

SEQ ID NO: 325400 - DNA, 25 bp, Mus musculus
ggcaccatctgaaggacaaggagct

SEQ ID NO: 325401 - DNA, 25 bp, Mus musculus
ggcaccatgccggcccgcaggccca

SEQ ID NO: 325402 - DNA, 25 bp, Mus musculus
ggcaccatgccgggtggataccttg

SEQ ID NO: 325403 - DNA, 25 bp, Mus musculus
ggcaccatggcaaccgaagaacctt

SEQ ID NO: 325404 - DNA, 25 bp, Mus musculus
ggcaccatgggaccctctagagtaa

SEQ ID NO: 325405 - DNA, 25 bp, Mus musculus
ggcaccatggggtgcagggaagggg

SEQ ID NO: 325406 - DNA, 25 bp, Mus musculus
ggcacccaaatgcctggggaggata

SEQ ID NO: 325407 - DNA, 25 bp, Mus musculus
ggcacccaaatgttgataaaaatgg

SEQ ID NO: 325408 - DNA, 25 bp, Mus musculus
ggcacccaagaatcagagcgagaga

SEQ ID NO: 325409 - DNA, 25 bp, Mus musculus
ggcacccaagctttcagatgcagtc

SEQ ID NO: 325410 - DNA, 25 bp, Mus musculus
ggcacccaaggtgaaagcagaaatg

SEQ ID NO: 325411 - DNA, 25 bp, Mus musculus
ggcacccagaaggacctcttaaagt

SEQ ID NO: 325412 - DNA, 25 bp, Mus musculus
ggcacccagggaaaagttattaaat

SEQ ID NO: 325413 - DNA, 25 bp, Mus musculus
ggcacccatcagaagcaagacgacc

SEQ ID NO: 325414 - DNA, 25 bp, Mus musculus
ggcacccatggctcaaactaccatc

SEQ ID NO: 325415 - DNA, 25 bp, Mus musculus
ggcaccccagctggagtccttgaag

SEQ ID NO: 325416 - DNA, 25 bp, Mus musculus
ggcaccccaggaatgcaccatgcct

SEQ ID NO: 325417 - DNA, 25 bp, Mus musculus
ggcacccctgagtacttggctccag

SEQ ID NO: 325418 - DNA, 25 bp, Mus musculus
ggcacccgagctaggggaagacacc

SEQ ID NO: 325419 - DNA, 25 bp, Mus musculus
ggcacccgccgaggtatttcaacaa

SEQ ID NO: 325420 - DNA, 25 bp, Mus musculus
ggcaccgaagagagtgtgaacatgg

SEQ ID NO: 325421 - DNA, 25 bp, Mus musculus
ggcaccgaagaggctaaccattttg

SEQ ID NO: 325422 - DNA, 25 bp, Mus musculus
ggcaccgagagtgttgagggcgagg

SEQ ID NO: 325423 - DNA, 25 bp, Mus musculus
ggcaccgagtggcagtgatcatggg

SEQ ID NO: 325424 - DNA, 25 bp, Mus musculus
ggcaccgatcgtgtatgacggagag

SEQ ID NO: 325425 - DNA, 25 bp, Mus musculus
ggcaccgcaaatgagagtcagtcct

SEQ ID NO: 325426 - DNA, 25 bp, Mus musculus
ggcaccgccacacagacagatgatg

SEQ ID NO: 325427 - DNA, 25 bp, Mus musculus
ggcaccggcctgacggaatgtatcc

SEQ ID NO: 325428 - DNA, 25 bp, Mus musculus
ggcaccggcctgacgttatacaaaa

SEQ ID NO: 325429 - DNA, 25 bp, Mus musculus
ggcaccgtcaggctcaagtccaccc

SEQ ID NO: 325430 - DNA, 25 bp, Mus musculus
ggcaccgtggaggcccccgtcctgc

SEQ ID NO: 325431 - DNA, 25 bp, Mus musculus
ggcacctctgggaggacactgtgtg

SEQ ID NO: 325432 - DNA, 25 bp, Mus musculus
ggcacctctgggagtttgtcctggg

SEQ ID NO: 325433 - DNA, 25 bp, Mus musculus
ggcacctgaaaacagcaatgcaggg

SEQ ID NO: 325434 - DNA, 25 bp, Mus musculus
ggcacctgacaaaggttctgggaga

SEQ ID NO: 325435 - DNA, 25 bp, Mus musculus
ggcacctgagagagaagacacagtt

SEQ ID NO: 325436 - DNA, 25 bp, Mus musculus
ggcacctgaggacaaagtctggagc

SEQ ID NO: 325437 - DNA, 25 bp, Mus musculus
ggcacctgcagactctgcagaggca

SEQ ID NO: 325438 - DNA, 25 bp, Mus musculus
ggcacctgcagcctgctccccaggg

SEQ ID NO: 325439 - DNA, 25 bp, Mus musculus
ggcacctggaagaccgatgctgtga

SEQ ID NO: 325440 - DNA, 25 bp, Mus musculus
ggcacctggaagctgtggtgtacct

SEQ ID NO: 325441 - DNA, 25 bp, Mus musculus
ggcacctggaaggcctccccaggag

SEQ ID NO: 325442 - DNA, 25 bp, Mus musculus
ggcacctggaagtcccctcctggcc

SEQ ID NO: 325443 - DNA, 25 bp, Mus musculus
ggcacctggaagtcttccccaggcc

SEQ ID NO: 325444 - DNA, 25 bp, Mus musculus
ggcacctggctgagttcactcacgt

SEQ ID NO: 325445 - DNA, 25 bp, Mus musculus
ggcacctggggtggaggcagggaag

SEQ ID NO: 325446 - DNA, 25 bp, Mus musculus
ggcacctggtcagtgagcctggagg

SEQ ID NO: 325447 - DNA, 25 bp, Mus musculus
ggcacctgttacctgggcccccaga

SEQ ID NO: 325448 - DNA, 25 bp, Mus musculus
ggcaccttcagaggcagagagagat

SEQ ID NO: 325449 - DNA, 25 bp, Mus musculus
ggcaccttcagctacatcaggtagt

SEQ ID NO: 325450 - DNA, 25 bp, Mus musculus
ggcaccttccggcagaaaggtgttg

SEQ ID NO: 325451 - DNA, 25 bp, Mus musculus
ggcaccttgaagatccttcgtacct

SEQ ID NO: 325452 - DNA, 25 bp, Mus musculus
ggcaccttgggtcctgggccttgta

SEQ ID NO: 325453 - DNA, 25 bp, Mus musculus
ggcacgaaagtgagggaagactccc

SEQ ID NO: 325454 - DNA, 25 bp, Mus musculus
ggcacgaattgcagcatttgctgat

SEQ ID NO: 325455 - DNA, 25 bp, Mus musculus
ggcacgagaggacaatagccttaaa

SEQ ID NO: 325456 - DNA, 25 bp, Mus musculus
ggcacgagcaagagtactgtttggc

SEQ ID NO: 325457 - DNA, 25 bp, Mus musculus
ggcacgatgtaaccagcctcaggag

SEQ ID NO: 325458 - DNA, 25 bp, Mus musculus
ggcacgccacaggactacagtggga

SEQ ID NO: 325459 - DNA, 25 bp, Mus musculus
ggcacgccggagctccctgtggcct

SEQ ID NO: 325460 - DNA, 25 bp, Mus musculus
ggcacgccgttcggggtctaatgga

SEQ ID NO: 325461 - DNA, 25 bp, Mus musculus
ggcacgcgggagaggtaaggctgac

SEQ ID NO: 325462 - DNA, 25 bp, Mus musculus
ggcacgcgggagagttttctctgtc

SEQ ID NO: 325463 - DNA, 25 bp, Mus musculus
ggcacggagtggactgctggatccc

SEQ ID NO: 325464 - DNA, 25 bp, Mus musculus
ggcacggagtgtctcgctgtcactg

SEQ ID NO: 325465 - DNA, 25 bp, Mus musculus
ggcacggcaggattcacagatggag

SEQ ID NO: 325466 - DNA, 25 bp, Mus musculus
ggcacggcgggagtcagcattggca

SEQ ID NO: 325467 - DNA, 25 bp, Mus musculus
ggcacggcgggtttcaaatgatata

SEQ ID NO: 325468 - DNA, 25 bp, Mus musculus
ggcacgggaaggcagaagaaatact

SEQ ID NO: 325469 - DNA, 25 bp, Mus musculus
ggcacgggagcctatgggaaggtgt

SEQ ID NO: 325470 - DNA, 25 bp, Mus musculus
ggcacgggagtccgggtttgcacat

SEQ ID NO: 325471 - DNA, 25 bp, Mus musculus
ggcacgggcgaccagccaggtccca

SEQ ID NO: 325472 - DNA, 25 bp, Mus musculus
ggcacgggcgaccaggacctataag

SEQ ID NO: 325473 - DNA, 25 bp, Mus musculus
ggcacgtaagagatgatgatggact

SEQ ID NO: 325474 - DNA, 25 bp, Mus musculus
ggcacgtctacaagacgctgaagga

SEQ ID NO: 325475 - DNA, 25 bp, Mus musculus
ggcacgtctacaaggccatgacgtt

SEQ ID NO: 325476 - DNA, 25 bp, Mus musculus
ggcacgtctgcagctggtgagccgc

SEQ ID NO: 325477 - DNA, 25 bp, Mus musculus
ggcacgtctgccagtgcgaccagta

SEQ ID NO: 325478 - DNA, 25 bp, Mus musculus
ggcacgtgtgggatctttctcaagt

SEQ ID NO: 325479 - DNA, 25 bp, Mus musculus
ggcactaaaacggatggctctccaa

SEQ ID NO: 325480 - DNA, 25 bp, Mus musculus
ggcactaacagaacctttagaagta

SEQ ID NO: 325481 - DNA, 25 bp, Mus musculus
ggcactacagatgctcatgacatct

SEQ ID NO: 325482 - DNA, 25 bp, Mus musculus
ggcactacagatgttcatctagaaa

SEQ ID NO: 325483 - DNA, 25 bp, Mus musculus
ggcactacggatgatctgagaatta

SEQ ID NO: 325484 - DNA, 25 bp, Mus musculus
ggcactacgggttccaatattgaag

SEQ ID NO: 325485 - DNA, 25 bp, Mus musculus
ggcactactggcctgcccaaggctg

SEQ ID NO: 325486 - DNA, 25 bp, Mus musculus
ggcactatcgaagttgagaatacca

SEQ ID NO: 325487 - DNA, 25 bp, Mus musculus
ggcactatgggagaaataccgacag

SEQ ID NO: 325488 - DNA, 25 bp, Mus musculus
ggcactcaaatgaacatggttggtg

SEQ ID NO: 325489 - DNA, 25 bp, Mus musculus
ggcactcatgggtggaggtgggaaa

SEQ ID NO: 325490 - DNA, 25 bp, Mus musculus
ggcactccagatgaaagcttgcggc

SEQ ID NO: 325491 - DNA, 25 bp, Mus musculus
ggcactccagtcaatgggtcacagg

SEQ ID NO: 325492 - DNA, 25 bp, Mus musculus
ggcactgaaaagaggacagaactag

SEQ ID NO: 325493 - DNA, 25 bp, Mus musculus
ggcactgaaaagggttcccagcccc

SEQ ID NO: 325494 - DNA, 25 bp, Mus musculus
ggcactgaagggccacacatggttg

SEQ ID NO: 325495 - DNA, 25 bp, Mus musculus
ggcactgaagtggactgcctgcgag

SEQ ID NO: 325496 - DNA, 25 bp, Mus musculus
ggcactgacatggttcctgccatct

SEQ ID NO: 325497 - DNA, 25 bp, Mus musculus
ggcactgacttcaatggggttgcgg

SEQ ID NO: 325498 - DNA, 25 bp, Mus musculus
ggcactgagacagggctttctgagg

SEQ ID NO: 325499 - DNA, 25 bp, Mus musculus
ggcactgagctctgggatcagtttg

SEQ ID NO: 325500 - DNA, 25 bp, Mus musculus
ggcactgaggtgagggaaccagacc

SEQ ID NO: 325501 - DNA, 25 bp, Mus musculus
ggcactgatatcaggaggagccatg

SEQ ID NO: 325502 - DNA, 25 bp, Mus musculus
ggcactgatgaggacagctcagatg

SEQ ID NO: 325503 - DNA, 25 bp, Mus musculus
ggcactgatgaggattctcaggaca

SEQ ID NO: 325504 - DNA, 25 bp, Mus musculus
ggcactgatggaggagacacgggcc

SEQ ID NO: 325505 - DNA, 25 bp, Mus musculus
ggcactgattggtgctgtcagatgc

SEQ ID NO: 325506 - DNA, 25 bp, Mus musculus
ggcactgcagagcaaaaaaacactg

SEQ ID NO: 325507 - DNA, 25 bp, Mus musculus
ggcactgcagctgctcctggcacaa

SEQ ID NO: 325508 - DNA, 25 bp, Mus musculus
ggcactgcaggaagaagaggaaagg

SEQ ID NO: 325509 - DNA, 25 bp, Mus musculus
ggcactgcagtggagaaagcatgcg

SEQ ID NO: 325510 - DNA, 25 bp, Mus musculus
ggcactgcatttggtggagtgtgac

SEQ ID NO: 325511 - DNA, 25 bp, Mus musculus
ggcactgccaccgcgttcacattct

SEQ ID NO: 325512 - DNA, 25 bp, Mus musculus
ggcactgccaccgctcacgaagttg

SEQ ID NO: 325513 - DNA, 25 bp, Mus musculus
ggcactgcctagagacttcctgctt

SEQ ID NO: 325514 - DNA, 25 bp, Mus musculus
ggcactgctgtgcttatggcaaacc

SEQ ID NO: 325515 - DNA, 25 bp, Mus musculus
ggcactggcaaccagcatctgatga

SEQ ID NO: 325516 - DNA, 25 bp, Mus musculus
ggcactggcaaccaggaagctgccc

SEQ ID NO: 325517 - DNA, 25 bp, Mus musculus
ggcactggcacgaaatcctagtttc

SEQ ID NO: 325518 - DNA, 25 bp, Mus musculus
ggcactggcaggcctgtacggagat

SEQ ID NO: 325519 - DNA, 25 bp, Mus musculus
ggcactggcagggctggtctacaac

SEQ ID NO: 325520 - DNA, 25 bp, Mus musculus
ggcactggcctcgatctactccccg

SEQ ID NO: 325521 - DNA, 25 bp, Mus musculus
ggcactggctaagagctgcttttag

SEQ ID NO: 325522 - DNA, 25 bp, Mus musculus
ggcactggtttatcgggaccagaat

SEQ ID NO: 325523 - DNA, 25 bp, Mus musculus
ggcactgtggatggaccagggaaag

SEQ ID NO: 325524 - DNA, 25 bp, Mus musculus
ggcacttaaggaaattggggatgtg

SEQ ID NO: 325525 - DNA, 25 bp, Mus musculus
ggcacttaggagcagttctccgacc

SEQ ID NO: 325526 - DNA, 25 bp, Mus musculus
ggcacttcaaaaaagatggtttttg

SEQ ID NO: 325527 - DNA, 25 bp, Mus musculus
ggcacttccatgaaggcattgtcgc

SEQ ID NO: 325528 - DNA, 25 bp, Mus musculus
ggcacttccatgaaggcctgcgggc

SEQ ID NO: 325529 - DNA, 25 bp, Mus musculus
ggcacttccatgaaggcgagcctgt

SEQ ID NO: 325530 - DNA, 25 bp, Mus musculus
ggcacttccattatcggaatgtgcg

SEQ ID NO: 325531 - DNA, 25 bp, Mus musculus
ggcacttccggcagctccgtaaccg

SEQ ID NO: 325532 - DNA, 25 bp, Mus musculus
ggcacttggtgagagccctgaagac

SEQ ID NO: 325533 - DNA, 25 bp, Mus musculus
ggcacttttgaaatggccatgaaga

SEQ ID NO: 325534 - DNA, 25 bp, Mus musculus
ggcagaaactggccagcaagcctgc

SEQ ID NO: 325535 - DNA, 25 bp, Mus musculus
ggcagaaagagtaaataacagatgc

SEQ ID NO: 325536 - DNA, 25 bp, Mus musculus
ggcagaaagcaaaaaattgcaaatt

SEQ ID NO: 325537 - DNA, 25 bp, Mus musculus
ggcagaaagcagtgagtacggctcc

SEQ ID NO: 325538 - DNA, 25 bp, Mus musculus
ggcagaacatcccagattgctgaag

SEQ ID NO: 325539 - DNA, 25 bp, Mus musculus
ggcagaacatcccagcccactggtt

SEQ ID NO: 325540 - DNA, 25 bp, Mus musculus
ggcagaacctggccaagatcctgcg

SEQ ID NO: 325541 - DNA, 25 bp, Mus musculus
ggcagaacctgggccgcatgtatct

SEQ ID NO: 325542 - DNA, 25 bp, Mus musculus
ggcagaacgaggcaaagacaagaaa

SEQ ID NO: 325543 - DNA, 25 bp, Mus musculus
ggcagaacgaggttgtgaaccatgg

SEQ ID NO: 325544 - DNA, 25 bp, Mus musculus
ggcagaactacctggacttccaccg

SEQ ID NO: 325545 - DNA, 25 bp, Mus musculus
ggcagaactacctgggtctcagcct

SEQ ID NO: 325546 - DNA, 25 bp, Mus musculus
ggcagaagaggagaaagagaaaaaa

SEQ ID NO: 325547 - DNA, 25 bp, Mus musculus
ggcagaagaggaggtggcttacaag

SEQ ID NO: 325548 - DNA, 25 bp, Mus musculus
ggcagaagatctatctaagtaagaa

SEQ ID NO: 325549 - DNA, 25 bp, Mus musculus
ggcagaagcaagaggaagaggagca

SEQ ID NO: 325550 - DNA, 25 bp, Mus musculus
ggcagaagcacagaactgctgagtg

SEQ ID NO: 325551 - DNA, 25 bp, Mus musculus
ggcagaagcacagatccatgcatga

SEQ ID NO: 325552 - DNA, 25 bp, Mus musculus
ggcagaagcacagggcatctgttat

SEQ ID NO: 325553 - DNA, 25 bp, Mus musculus
ggcagaagcagtggctctagtctgg

SEQ ID NO: 325554 - DNA, 25 bp, Mus musculus
ggcagaagcagtgggtacaaacaaa

SEQ ID NO: 325555 - DNA, 25 bp, Mus musculus
ggcagaaggagacaggagtcatcca

SEQ ID NO: 325556 - DNA, 25 bp, Mus musculus
ggcagaaggcaaggttcggctcctg

SEQ ID NO: 325557 - DNA, 25 bp, Mus musculus
ggcagaaggcacagatggacagatg

SEQ ID NO: 325558 - DNA, 25 bp, Mus musculus
ggcagaaggcacaggtgaaggagac

SEQ ID NO: 325559 - DNA, 25 bp, Mus musculus
ggcagaaggtgatgtgggtcctccc

SEQ ID NO: 325560 - DNA, 25 bp, Mus musculus
ggcagaagtagagaaggatgtccat

SEQ ID NO: 325561 - DNA, 25 bp, Mus musculus
ggcagaagttgctcaagatgctgag

SEQ ID NO: 325562 - DNA, 25 bp, Mus musculus
ggcagaatcatagggagaggcggtg

SEQ ID NO: 325563 - DNA, 25 bp, Mus musculus
ggcagaatcatcgagaaacctgaaa

SEQ ID NO: 325564 - DNA, 25 bp, Mus musculus
ggcagaatgagaatgtgattctgct

SEQ ID NO: 325565 - DNA, 25 bp, Mus musculus
ggcagaatgctatcaaaagccccag

SEQ ID NO: 325566 - DNA, 25 bp, Mus musculus
ggcagaatggacagttgctcagaca

SEQ ID NO: 325567 - DNA, 25 bp, Mus musculus
ggcagaatgggtgcagacctctgac

SEQ ID NO: 325568 - DNA, 25 bp, Mus musculus
ggcagacaacggttggcatcgaaca

SEQ ID NO: 325569 - DNA, 25 bp, Mus musculus
ggcagacaacgttcactttaattga

SEQ ID NO: 325570 - DNA, 25 bp, Mus musculus
ggcagacagagaggctccgcaggag

SEQ ID NO: 325571 - DNA, 25 bp, Mus musculus
ggcagaccatggtgagcccattggc

SEQ ID NO: 325572 - DNA, 25 bp, Mus musculus
ggcagacccgagttgaaaaatctgg

SEQ ID NO: 325573 - DNA, 25 bp, Mus musculus
ggcagacctaaccattcaggccaca

SEQ ID NO: 325574 - DNA, 25 bp, Mus musculus
ggcagacctaacgattcaggccaca

SEQ ID NO: 325575 - DNA, 25 bp, Mus musculus
ggcagacctgctggggtgacagtcc

SEQ ID NO: 325576 - DNA, 25 bp, Mus musculus
ggcagacgatgttgaatgacaaaga

SEQ ID NO: 325577 - DNA, 25 bp, Mus musculus
ggcagacgcagcttcggcttcatta

SEQ ID NO: 325578 - DNA, 25 bp, Mus musculus
ggcagacgtgttcaattttcacagc

SEQ ID NO: 325579 - DNA, 25 bp, Mus musculus
ggcagacgtgttcacattctggtgg

SEQ ID NO: 325580 - DNA, 25 bp, Mus musculus
ggcagacgtgttcagattccagcat

SEQ ID NO: 325581 - DNA, 25 bp, Mus musculus
ggcagactcagctgtgctggatgcc

SEQ ID NO: 325582 - DNA, 25 bp, Mus musculus
ggcagactcaggcacctctgtcagc

SEQ ID NO: 325583 - DNA, 25 bp, Mus musculus
ggcagactgcagcctaggatgtcag

SEQ ID NO: 325584 - DNA, 25 bp, Mus musculus
ggcagactgcagtttcaggtcagag

SEQ ID NO: 325585 - DNA, 25 bp, Mus musculus
ggcagacttcttctcctcggaccag

SEQ ID NO: 325586 - DNA, 25 bp, Mus musculus
ggcagagaaatggagagaagcccgg

SEQ ID NO: 325587 - DNA, 25 bp, Mus musculus
ggcagagaacgaatcttggagagac

SEQ ID NO: 325588 - DNA, 25 bp, Mus musculus
ggcagagaactacttgtctacccac

SEQ ID NO: 325589 - DNA, 25 bp, Mus musculus
ggcagagaagcaacatggcttctgc

SEQ ID NO: 325590 - DNA, 25 bp, Mus musculus
ggcagagaagcaataccacatcaca

SEQ ID NO: 325591 - DNA, 25 bp, Mus musculus
ggcagagaagctggcttgctggaac

SEQ ID NO: 325592 - DNA, 25 bp, Mus musculus
ggcagagaagcttaagtgtgataca

SEQ ID NO: 325593 - DNA, 25 bp, Mus musculus
ggcagagaaggaggccgcatccacg

SEQ ID NO: 325594 - DNA, 25 bp, Mus musculus
ggcagagaaggcagtattgcaacaa

SEQ ID NO: 325595 - DNA, 25 bp, Mus musculus
ggcagagaagggcaaacattgtatc

SEQ ID NO: 325596 - DNA, 25 bp, Mus musculus
ggcagagacgatagattgctaacaa

SEQ ID NO: 325597 - DNA, 25 bp, Mus musculus
ggcagagacggagggcatgctcaaa

SEQ ID NO: 325598 - DNA, 25 bp, Mus musculus
ggcagagactgtgagccaaaaagca

SEQ ID NO: 325599 - DNA, 25 bp, Mus musculus
ggcagagagcaacaggagcaccagg

SEQ ID NO: 325600 - DNA, 25 bp, Mus musculus
ggcagagagtaagaactgtgccaag

SEQ ID NO: 325601 - DNA, 25 bp, Mus musculus
ggcagagataagcagagtccagttc

SEQ ID NO: 325602 - DNA, 25 bp, Mus musculus
ggcagagatctcggcacaacggtcg

SEQ ID NO: 325603 - DNA, 25 bp, Mus musculus
ggcagagatctcgggtgagcacctg

SEQ ID NO: 325604 - DNA, 25 bp, Mus musculus
ggcagagcaagccactcaggctctc

SEQ ID NO: 325605 - DNA, 25 bp, Mus musculus
ggcagagcaaggtggagctcacctg

SEQ ID NO: 325606 - DNA, 25 bp, Mus musculus
ggcagagcagatgggatgagccggc

SEQ ID NO: 325607 - DNA, 25 bp, Mus musculus
ggcagagcagcaggtttccaggcaa

SEQ ID NO: 325608 - DNA, 25 bp, Mus musculus
ggcagagcaggatgcccggggcatg

SEQ ID NO: 325609 - DNA, 25 bp, Mus musculus
ggcagagcaggccaaggagatccag

SEQ ID NO: 325610 - DNA, 25 bp, Mus musculus
ggcagagcaggcgggactgtcctgt

SEQ ID NO: 325611 - DNA, 25 bp, Mus musculus
ggcagagcagggatcagtggtgaac

SEQ ID NO: 325612 - DNA, 25 bp, Mus musculus
ggcagagcaggtgacggtgtgggaa

SEQ ID NO: 325613 - DNA, 25 bp, Mus musculus
ggcagagcaggttatttcgcttggc

SEQ ID NO: 325614 - DNA, 25 bp, Mus musculus
ggcagagccaagcacttacgcctgg

SEQ ID NO: 325615 - DNA, 25 bp, Mus musculus
ggcagagccagagaatgttgctgag

SEQ ID NO: 325616 - DNA, 25 bp, Mus musculus
ggcagagccaggctagtgaaccgga

SEQ ID NO: 325617 - DNA, 25 bp, Mus musculus
ggcagagcctgagatctggtggctc

SEQ ID NO: 325618 - DNA, 25 bp, Mus musculus
ggcagagcctgaggcccaggatggg

SEQ ID NO: 325619 - DNA, 25 bp, Mus musculus
ggcagagcctggatttatcgaatta

SEQ ID NO: 325620 - DNA, 25 bp, Mus musculus
ggcagagcctggtgctgatgggaac

SEQ ID NO: 325621 - DNA, 25 bp, Mus musculus
ggcagagctaaagggtttggatcca

SEQ ID NO: 325622 - DNA, 25 bp, Mus musculus
ggcagagctcaggatttctggtagg

SEQ ID NO: 325623 - DNA, 25 bp, Mus musculus
ggcagagctgcccagagacccttcg

SEQ ID NO: 325624 - DNA, 25 bp, Mus musculus
ggcagagctggaaaaggtgcagcat

SEQ ID NO: 325625 - DNA, 25 bp, Mus musculus
ggcagagctggcaccagaaaccagt

SEQ ID NO: 325626 - DNA, 25 bp, Mus musculus
ggcagaggaacgggtttccgcttcc

SEQ ID NO: 325627 - DNA, 25 bp, Mus musculus
ggcagaggagaaccctcttggctcg

SEQ ID NO: 325628 - DNA, 25 bp, Mus musculus
ggcagaggagcctggaggagggacg

SEQ ID NO: 325629 - DNA, 25 bp, Mus musculus
ggcagaggaggcattatgagagact

SEQ ID NO: 325630 - DNA, 25 bp, Mus musculus
ggcagaggaggctccgtgcccgcag

SEQ ID NO: 325631 - DNA, 25 bp, Mus musculus
ggcagaggaggtagaggaggcttcc

SEQ ID NO: 325632 - DNA, 25 bp, Mus musculus
ggcagaggagtgacatcactgagga

SEQ ID NO: 325633 - DNA, 25 bp, Mus musculus
ggcagaggcaccgcgatgtgctggc

SEQ ID NO: 325634 - DNA, 25 bp, Mus musculus
ggcagaggcaccgcggaccgtctgg

SEQ ID NO: 325635 - DNA, 25 bp, Mus musculus
ggcagaggcaggcgtgcccacactt

SEQ ID NO: 325636 - DNA, 25 bp, Mus musculus
ggcagaggcctgcctcaaaatgcag

SEQ ID NO: 325637 - DNA, 25 bp, Mus musculus
ggcagaggcgtaacgtgatgtcctc

SEQ ID NO: 325638 - DNA, 25 bp, Mus musculus
ggcagagggagcaggaacctgtcac

SEQ ID NO: 325639 - DNA, 25 bp, Mus musculus
ggcagaggtaggaagatgaggacct

SEQ ID NO: 325640 - DNA, 25 bp, Mus musculus
ggcagaggtgaagggaagacaaagg

SEQ ID NO: 325641 - DNA, 25 bp, Mus musculus
ggcagaggtgagtaaaaagaagaag

SEQ ID NO: 325642 - DNA, 25 bp, Mus musculus
ggcagaggtggataactgcacaagc

SEQ ID NO: 325643 - DNA, 25 bp, Mus musculus
ggcagaggtggtcagtgctcaagaa

SEQ ID NO: 325644 - DNA, 25 bp, Mus musculus
ggcagagtaaaagtgaaatgactgt

SEQ ID NO: 325645 - DNA, 25 bp, Mus musculus
ggcagagtctagccaccaagatcca

SEQ ID NO: 325646 - DNA, 25 bp, Mus musculus
ggcagagtgtatgagggccagaacg

SEQ ID NO: 325647 - DNA, 25 bp, Mus musculus
ggcagataaagataatggaggtgac

SEQ ID NO: 325648 - DNA, 25 bp, Mus musculus
ggcagataagaagggcaggattctg

SEQ ID NO: 325649 - DNA, 25 bp, Mus musculus
ggcagatacaaaagcacaaccagtg

SEQ ID NO: 325650 - DNA, 25 bp, Mus musculus
ggcagatacaaaagtaagaagttgt

SEQ ID NO: 325651 - DNA, 25 bp, Mus musculus
ggcagatacaacagcacaaccagtg

SEQ ID NO: 325652 - DNA, 25 bp, Mus musculus
ggcagatcacagacactgcagaagg

SEQ ID NO: 325653 - DNA, 25 bp, Mus musculus
ggcagatcagagattgttattgacg

SEQ ID NO: 325654 - DNA, 25 bp, Mus musculus
ggcagatcagaggttgagcttgttc

SEQ ID NO: 325655 - DNA, 25 bp, Mus musculus
ggcagatcagcagggatggcaagag

SEQ ID NO: 325656 - DNA, 25 bp, Mus musculus
ggcagatcagctgtcctggaagatg

SEQ ID NO: 325657 - DNA, 25 bp, Mus musculus
ggcagatcagtccgcactggagatg

SEQ ID NO: 325658 - DNA, 25 bp, Mus musculus
ggcagatccggcgaatacaggagga

SEQ ID NO: 325659 - DNA, 25 bp, Mus musculus
ggcagatcctctgatggagccagag

SEQ ID NO: 325660 - DNA, 25 bp, Mus musculus
ggcagatctggtattcttttggtaa

SEQ ID NO: 325661 - DNA, 25 bp, Mus musculus
ggcagatgaggagaaaaagttacgt

SEQ ID NO: 325662 - DNA, 25 bp, Mus musculus
ggcagatgatctttaagaatggtcc

SEQ ID NO: 325663 - DNA, 25 bp, Mus musculus
ggcagatgccccaaatattcttaca

SEQ ID NO: 325664 - DNA, 25 bp, Mus musculus
ggcagatgcccgacactccagaaga

SEQ ID NO: 325665 - DNA, 25 bp, Mus musculus
ggcagatgcccggatgctgatgtac

SEQ ID NO: 325666 - DNA, 25 bp, Mus musculus
ggcagatgctcaggtatgggcttat

SEQ ID NO: 325667 - DNA, 25 bp, Mus musculus
ggcagatgggagcctctttttcctg

SEQ ID NO: 325668 - DNA, 25 bp, Mus musculus
ggcagattcagcacagagctgatga

SEQ ID NO: 325669 - DNA, 25 bp, Mus musculus
ggcagattcaggtgattctcgggcc

SEQ ID NO: 325670 - DNA, 25 bp, Mus musculus
ggcagattccccgctgtcctacagt

SEQ ID NO: 325671 - DNA, 25 bp, Mus musculus
ggcagattgaacgcaagggggaagc

SEQ ID NO: 325672 - DNA, 25 bp, Mus musculus
ggcagattgctcacgtatcacgaca

SEQ ID NO: 325673 - DNA, 25 bp, Mus musculus
ggcagatttaagattattaaaaact

SEQ ID NO: 325674 - DNA, 25 bp, Mus musculus
ggcagcaaaaggtctccatagaaca

SEQ ID NO: 325675 - DNA, 25 bp, Mus musculus
ggcagcaacgcccagagagatgtct

SEQ ID NO: 325676 - DNA, 25 bp, Mus musculus
ggcagcaagatcctgcttgagaaaa

SEQ ID NO: 325677 - DNA, 25 bp, Mus musculus
ggcagcaagcggccgaccttgcact

SEQ ID NO: 325678 - DNA, 25 bp, Mus musculus
ggcagcaagcggccggcttcctttc

SEQ ID NO: 325679 - DNA, 25 bp, Mus musculus
ggcagcaagctagtgagcagtggga

SEQ ID NO: 325680 - DNA, 25 bp, Mus musculus
ggcagcaatggaagcccctaagatg

SEQ ID NO: 325681 - DNA, 25 bp, Mus musculus
ggcagcacacgagatttttatcacc

SEQ ID NO: 325682 - DNA, 25 bp, Mus musculus
ggcagcacagatacctttatcaatg

SEQ ID NO: 325683 - DNA, 25 bp, Mus musculus
ggcagcacagcttagaaccataccc

SEQ ID NO: 325684 - DNA, 25 bp, Mus musculus
ggcagcaccggaaaactcaaggaca

SEQ ID NO: 325685 - DNA, 25 bp, Mus musculus
ggcagcaccgggctaaagaagccca

SEQ ID NO: 325686 - DNA, 25 bp, Mus musculus
ggcagcacgcttgatgtggggcctg

SEQ ID NO: 325687 - DNA, 25 bp, Mus musculus
ggcagcactggattcccggtcgggt

SEQ ID NO: 325688 - DNA, 25 bp, Mus musculus
ggcagcagaaaccgtaaaagccttg

SEQ ID NO: 325689 - DNA, 25 bp, Mus musculus
ggcagcagaaagagactaacggtta

SEQ ID NO: 325690 - DNA, 25 bp, Mus musculus
ggcagcagaaagagatctatcaagt

SEQ ID NO: 325691 - DNA, 25 bp, Mus musculus
ggcagcagaaagaggtagaagaaag

SEQ ID NO: 325692 - DNA, 25 bp, Mus musculus
ggcagcagagaaccatgtgtgctca

SEQ ID NO: 325693 - DNA, 25 bp, Mus musculus
ggcagcagagaagaaagcccgctgg

SEQ ID NO: 325694 - DNA, 25 bp, Mus musculus
ggcagcagagaagggcggtgctggt

SEQ ID NO: 325695 - DNA, 25 bp, Mus musculus
ggcagcagaggtggtttgtgcaccg

SEQ ID NO: 325696 - DNA, 25 bp, Mus musculus
ggcagcagattaacagagactctgc

SEQ ID NO: 325697 - DNA, 25 bp, Mus musculus
ggcagcagcaccagatttcaatggg

SEQ ID NO: 325698 - DNA, 25 bp, Mus musculus
ggcagcagcaccagggcctgtccac

SEQ ID NO: 325699 - DNA, 25 bp, Mus musculus
ggcagcagcagaaggtttgatgagc

SEQ ID NO: 325700 - DNA, 25 bp, Mus musculus
ggcagcagcagcagactcaagaatg

SEQ ID NO: 325701 - DNA, 25 bp, Mus musculus
ggcagcagcaggagaggctacagca

SEQ ID NO: 325702 - DNA, 25 bp, Mus musculus
ggcagcagccaaggacacttagcct

SEQ ID NO: 325703 - DNA, 25 bp, Mus musculus
ggcagcagcctttggcctctctgtc

SEQ ID NO: 325704 - DNA, 25 bp, Mus musculus
ggcagcagcctttggtgcgcccggc

SEQ ID NO: 325705 - DNA, 25 bp, Mus musculus
ggcagcagcgcagcctcaggctggc

SEQ ID NO: 325706 - DNA, 25 bp, Mus musculus
ggcagcagcggcaggaggatgagtc

SEQ ID NO: 325707 - DNA, 25 bp, Mus musculus
ggcagcaggccgcgctagaaaatgc

SEQ ID NO: 325708 - DNA, 25 bp, Mus musculus
ggcagcaggccgggggacagtaaat

SEQ ID NO: 325709 - DNA, 25 bp, Mus musculus
ggcagcaggtggcagagaaggaagc

SEQ ID NO: 325710 - DNA, 25 bp, Mus musculus
ggcagcagttgagaatcccagctgg

SEQ ID NO: 325711 - DNA, 25 bp, Mus musculus
ggcagcatcagcccccggcagcagc

SEQ ID NO: 325712 - DNA, 25 bp, Mus musculus
ggcagcatcatattgaacgagaaaa

SEQ ID NO: 325713 - DNA, 25 bp, Mus musculus
ggcagcattagaggagctgaccaag

SEQ ID NO: 325714 - DNA, 25 bp, Mus musculus
ggcagccaaacagcccatcacggtg

SEQ ID NO: 325715 - DNA, 25 bp, Mus musculus
ggcagccaaacatgatactggatga

SEQ ID NO: 325716 - DNA, 25 bp, Mus musculus
ggcagccaacaagatgtcatggcac

SEQ ID NO: 325717 - DNA, 25 bp, Mus musculus
ggcagccaacaaggacaaagtcggt

SEQ ID NO: 325718 - DNA, 25 bp, Mus musculus
ggcagccacacgaatctgcagaaga

SEQ ID NO: 325719 - DNA, 25 bp, Mus musculus
ggcagccacacggaatacccggagg

SEQ ID NO: 325720 - DNA, 25 bp, Mus musculus
ggcagccacacggtgcagcacagtg

SEQ ID NO: 325721 - DNA, 25 bp, Mus musculus
ggcagccaccagaggtgatccaaca

SEQ ID NO: 325722 - DNA, 25 bp, Mus musculus
ggcagccacgatgagtgaacagagt

SEQ ID NO: 325723 - DNA, 25 bp, Mus musculus
ggcagccagcaagtggatctggcga

SEQ ID NO: 325724 - DNA, 25 bp, Mus musculus
ggcagccaggcgcaacctgcgggag

SEQ ID NO: 325725 - DNA, 25 bp, Mus musculus
ggcagccagtaacagcacccaggca

SEQ ID NO: 325726 - DNA, 25 bp, Mus musculus
ggcagccagtccaggcgcctctagc

SEQ ID NO: 325727 - DNA, 25 bp, Mus musculus
ggcagccatgaggcggcaggccctg

SEQ ID NO: 325728 - DNA, 25 bp, Mus musculus
ggcagccatggtcacgtctctggga

SEQ ID NO: 325729 - DNA, 25 bp, Mus musculus
ggcagcccaaggattccagctttct

SEQ ID NO: 325730 - DNA, 25 bp, Mus musculus
ggcagcccaagtctttgcagattct

SEQ ID NO: 325731 - DNA, 25 bp, Mus musculus
ggcagcccagcagggcatcctggcc

SEQ ID NO: 325732 - DNA, 25 bp, Mus musculus
ggcagccccttgagtatggcaagaa

SEQ ID NO: 325733 - DNA, 25 bp, Mus musculus
ggcagccgacagcagctcctgagaa

SEQ ID NO: 325734 - DNA, 25 bp, Mus musculus
ggcagccgacagcagtaatctacag

SEQ ID NO: 325735 - DNA, 25 bp, Mus musculus
ggcagccgacgatacagacggcagc

SEQ ID NO: 325736 - DNA, 25 bp, Mus musculus
ggcagccgacgctgaagctgaggtg

SEQ ID NO: 325737 - DNA, 25 bp, Mus musculus
ggcagccgacggaggacccgctctc

SEQ ID NO: 325738 - DNA, 25 bp, Mus musculus
ggcagccgacggcaccagagttttt

SEQ ID NO: 325739 - DNA, 25 bp, Mus musculus
ggcagccgaggttcctgcctcaaga

SEQ ID NO: 325740 - DNA, 25 bp, Mus musculus
ggcagccgatccagggagaagtcaa

SEQ ID NO: 325741 - DNA, 25 bp, Mus musculus
ggcagccgatccaggtcccggtcct

SEQ ID NO: 325742 - DNA, 25 bp, Mus musculus
ggcagccgcacaggcagcatatcta

SEQ ID NO: 325743 - DNA, 25 bp, Mus musculus
ggcagccggcaggaccagtggctgc

SEQ ID NO: 325744 - DNA, 25 bp, Mus musculus
ggcagccggcatatcattgcttatt

SEQ ID NO: 325745 - DNA, 25 bp, Mus musculus
ggcagccggcatatccctgattgtc

SEQ ID NO: 325746 - DNA, 25 bp, Mus musculus
ggcagcctaaggactaacggttatg

SEQ ID NO: 325747 - DNA, 25 bp, Mus musculus
ggcagcctaagggaggaatttggct

SEQ ID NO: 325748 - DNA, 25 bp, Mus musculus
ggcagcctaagggcacagcccgagc

SEQ ID NO: 325749 - DNA, 25 bp, Mus musculus
ggcagcctacccaaggaaactgcca

SEQ ID NO: 325750 - DNA, 25 bp, Mus musculus
ggcagcctcccagagatcctcttcc

SEQ ID NO: 325751 - DNA, 25 bp, Mus musculus
ggcagcctccccgactcggccatcg

SEQ ID NO: 325752 - DNA, 25 bp, Mus musculus
ggcagcctctttgactatgaacaac

SEQ ID NO: 325753 - DNA, 25 bp, Mus musculus
ggcagcctctttgggttcgtttcca

SEQ ID NO: 325754 - DNA, 25 bp, Mus musculus
ggcagcctgtataagagccctgaag

SEQ ID NO: 325755 - DNA, 25 bp, Mus musculus
ggcagcctgtataaggtaggtgcac

SEQ ID NO: 325756 - DNA, 25 bp, Mus musculus
ggcagcctgtcaacaatggctcaac

SEQ ID NO: 325757 - DNA, 25 bp, Mus musculus
ggcagcctgtcaagaatatcgccaa

SEQ ID NO: 325758 - DNA, 25 bp, Mus musculus
ggcagcctgtggggacaggttgcag

SEQ ID NO: 325759 - DNA, 25 bp, Mus musculus
ggcagcctgtggttgcagctcctcg

SEQ ID NO: 325760 - DNA, 25 bp, Mus musculus
ggcagccttacactacttctaaaga

SEQ ID NO: 325761 - DNA, 25 bp, Mus musculus
ggcagccttggctggtcgtttgatg

SEQ ID NO: 325762 - DNA, 25 bp, Mus musculus
ggcagcgaagatcacaaggtttaca

SEQ ID NO: 325763 - DNA, 25 bp, Mus musculus
ggcagcgaaggcctccttgaacatt

SEQ ID NO: 325764 - DNA, 25 bp, Mus musculus
ggcagcgacaagatgcctggccgag

SEQ ID NO: 325765 - DNA, 25 bp, Mus musculus
ggcagcgacgaggttcagattctgg

SEQ ID NO: 325766 - DNA, 25 bp, Mus musculus
ggcagcgagcgagtggtgatcatgt

SEQ ID NO: 325767 - DNA, 25 bp, Mus musculus
ggcagcgatacgcttgcctggttcc

SEQ ID NO: 325768 - DNA, 25 bp, Mus musculus
ggcagcgatacggctttggaccttg

SEQ ID NO: 325769 - DNA, 25 bp, Mus musculus
ggcagcgataggaaggacctggatc

SEQ ID NO: 325770 - DNA, 25 bp, Mus musculus
ggcagcgataggcttcattctcatt

SEQ ID NO: 325771 - DNA, 25 bp, Mus musculus
ggcagcgatagggcttacccactct

SEQ ID NO: 325772 - DNA, 25 bp, Mus musculus
ggcagcgataggtcacttgcccaga

SEQ ID NO: 325773 - DNA, 25 bp, Mus musculus
ggcagcgcaactacagggctgccct

SEQ ID NO: 325774 - DNA, 25 bp, Mus musculus
ggcagcgcaactgctgcaggctctg

SEQ ID NO: 325775 - DNA, 25 bp, Mus musculus
ggcagcgcaggtatcgccaggccga

SEQ ID NO: 325776 - DNA, 25 bp, Mus musculus
ggcagcgcaggtgccccgtgctcca

SEQ ID NO: 325777 - DNA, 25 bp, Mus musculus
ggcagcgccagtggctccgcgggcc

SEQ ID NO: 325778 - DNA, 25 bp, Mus musculus
ggcagcgccgatgccgcctgcagaa

SEQ ID NO: 325779 - DNA, 25 bp, Mus musculus
ggcagcgcgcgcagagacactgtac

SEQ ID NO: 325780 - DNA, 25 bp, Mus musculus
ggcagcggaagaccagactctgaga

SEQ ID NO: 325781 - DNA, 25 bp, Mus musculus
ggcagcggcggcagaaatgatggaa

SEQ ID NO: 325782 - DNA, 25 bp, Mus musculus
ggcagcgggagctggaacagcagct

SEQ ID NO: 325783 - DNA, 25 bp, Mus musculus
ggcagcgggagggagctgaatctga

SEQ ID NO: 325784 - DNA, 25 bp, Mus musculus
ggcagcgggcaccagtgagatccca

SEQ ID NO: 325785 - DNA, 25 bp, Mus musculus
ggcagcgggctagcgcatttcagat

SEQ ID NO: 325786 - DNA, 25 bp, Mus musculus
ggcagcggggcctgcggctcgacgg

SEQ ID NO: 325787 - DNA, 25 bp, Mus musculus
ggcagcggttttgcgaaggatgcac

SEQ ID NO: 325788 - DNA, 25 bp, Mus musculus
ggcagcggttttgcgccccctcctc

SEQ ID NO: 325789 - DNA, 25 bp, Mus musculus
ggcagcgtcaggggacagaccaccg

SEQ ID NO: 325790 - DNA, 25 bp, Mus musculus
ggcagcgtgaaggaaatggaattta

SEQ ID NO: 325791 - DNA, 25 bp, Mus musculus
ggcagcgtgtcaacccaaagtttac

SEQ ID NO: 325792 - DNA, 25 bp, Mus musculus
ggcagcgtgtttcccacgacagcag

SEQ ID NO: 325793 - DNA, 25 bp, Mus musculus
ggcagctacttggttccctgccgct

SEQ ID NO: 325794 - DNA, 25 bp, Mus musculus
ggcagctagaatgcactggggctgc

SEQ ID NO: 325795 - DNA, 25 bp, Mus musculus
ggcagctagagacagtccgagaact

SEQ ID NO: 325796 - DNA, 25 bp, Mus musculus
ggcagctagagagaattccagaatt

SEQ ID NO: 325797 - DNA, 25 bp, Mus musculus
ggcagctagagaggacccttatggt

SEQ ID NO: 325798 - DNA, 25 bp, Mus musculus
ggcagctagctggatcaccgacaac

SEQ ID NO: 325799 - DNA, 25 bp, Mus musculus
ggcagctagctggttgcagaggttt

SEQ ID NO: 325800 - DNA, 25 bp, Mus musculus
ggcagctatgggaaagagataccac

SEQ ID NO: 325801 - DNA, 25 bp, Mus musculus
ggcagctcaacaaggagctggtgat

SEQ ID NO: 325802 - DNA, 25 bp, Mus musculus
ggcagctcaacatgtatggcttccg

SEQ ID NO: 325803 - DNA, 25 bp, Mus musculus
ggcagctcaacatgtctcattcagt

SEQ ID NO: 325804 - DNA, 25 bp, Mus musculus
ggcagctcaaggaggctcaacgcac

SEQ ID NO: 325805 - DNA, 25 bp, Mus musculus
ggcagctccaggtataatggccgga

SEQ ID NO: 325806 - DNA, 25 bp, Mus musculus
ggcagctccccctctacctggaaca

SEQ ID NO: 325807 - DNA, 25 bp, Mus musculus
ggcagctcctccggcactttgacac

SEQ ID NO: 325808 - DNA, 25 bp, Mus musculus
ggcagctcctccggtacaaggttct

SEQ ID NO: 325809 - DNA, 25 bp, Mus musculus
ggcagctcgacagatgccaaagtct

SEQ ID NO: 325810 - DNA, 25 bp, Mus musculus
ggcagctcgacaggtgcagggccct

SEQ ID NO: 325811 - DNA, 25 bp, Mus musculus
ggcagctctcgcagagacgtggagc

SEQ ID NO: 325812 - DNA, 25 bp, Mus musculus
ggcagctgagaaacttggaaaagag

SEQ ID NO: 325813 - DNA, 25 bp, Mus musculus
ggcagctgagattcctgctgcttag

SEQ ID NO: 325814 - DNA, 25 bp, Mus musculus
ggcagctgaggtgtgactttgaggt

SEQ ID NO: 325815 - DNA, 25 bp, Mus musculus
ggcagctgatgagggttctggggac

SEQ ID NO: 325816 - DNA, 25 bp, Mus musculus
ggcagctgcgatgagcttaaaagat

SEQ ID NO: 325817 - DNA, 25 bp, Mus musculus
ggcagctgctcaaggactcggagac

SEQ ID NO: 325818 - DNA, 25 bp, Mus musculus
ggcagctgctcaaggtactccagga

SEQ ID NO: 325819 - DNA, 25 bp, Mus musculus
ggcagctgctgaccctgagcaatga

SEQ ID NO: 325820 - DNA, 25 bp, Mus musculus
ggcagctgggcccagaccctggcct

SEQ ID NO: 325821 - DNA, 25 bp, Mus musculus
ggcagctgtgaaaagccattggcac

SEQ ID NO: 325822 - DNA, 25 bp, Mus musculus
ggcagctgtgaaaagggtcaagcag

SEQ ID NO: 325823 - DNA, 25 bp, Mus musculus
ggcagctgtgtgatgattgaagatt

SEQ ID NO: 325824 - DNA, 25 bp, Mus musculus
ggcagcttctcctgggttggattga

SEQ ID NO: 325825 - DNA, 25 bp, Mus musculus
ggcagcttctcctggtggaccacag

SEQ ID NO: 325826 - DNA, 25 bp, Mus musculus
ggcagcttgaaaatgcagaacagct

SEQ ID NO: 325827 - DNA, 25 bp, Mus musculus
ggcagcttggagccggaagctggac

SEQ ID NO: 325828 - DNA, 25 bp, Mus musculus
ggcagctttgcagcatgctcacgca

SEQ ID NO: 325829 - DNA, 25 bp, Mus musculus
ggcaggaacacacagtggggagggg

SEQ ID NO: 325830 - DNA, 25 bp, Mus musculus
ggcaggaactaaatcttccatccga

SEQ ID NO: 325831 - DNA, 25 bp, Mus musculus
ggcaggaactgtgtggacgaccccc

SEQ ID NO: 325832 - DNA, 25 bp, Mus musculus
ggcaggaagatttccgaactgaaag

SEQ ID NO: 325833 - DNA, 25 bp, Mus musculus
ggcaggaagccagatatctcacaga

SEQ ID NO: 325834 - DNA, 25 bp, Mus musculus
ggcaggaagctgggccggcacatgg

SEQ ID NO: 325835 - DNA, 25 bp, Mus musculus
ggcaggacaagaaggcaaattagat

SEQ ID NO: 325836 - DNA, 25 bp, Mus musculus
ggcaggacacactccacgcagtatg

SEQ ID NO: 325837 - DNA, 25 bp, Mus musculus
ggcaggacagtcatggtggaccagc

SEQ ID NO: 325838 - DNA, 25 bp, Mus musculus
ggcaggaccaccaagacatccagga

SEQ ID NO: 325839 - DNA, 25 bp, Mus musculus
ggcaggaccaccaagactcacaccc

SEQ ID NO: 325840 - DNA, 25 bp, Mus musculus
ggcaggaccctcgaccgtttccagg

SEQ ID NO: 325841 - DNA, 25 bp, Mus musculus
ggcaggaccctcgacgccttattca

SEQ ID NO: 325842 - DNA, 25 bp, Mus musculus
ggcaggagaaggaggtggtggagaa

SEQ ID NO: 325843 - DNA, 25 bp, Mus musculus
ggcaggagacaagaacttcatcact

SEQ ID NO: 325844 - DNA, 25 bp, Mus musculus
ggcaggagagcctgtgtcctgacct

SEQ ID NO: 325845 - DNA, 25 bp, Mus musculus
ggcaggagagggctgtagcagtggc

SEQ ID NO: 325846 - DNA, 25 bp, Mus musculus
ggcaggagatcgcaggggtgccttc

SEQ ID NO: 325847 - DNA, 25 bp, Mus musculus
ggcaggagatgcttggtactacatg

SEQ ID NO: 325848 - DNA, 25 bp, Mus musculus
ggcaggagccgaaatgtctcaggct

SEQ ID NO: 325849 - DNA, 25 bp, Mus musculus
ggcaggagccgagtctccttatata

SEQ ID NO: 325850 - DNA, 25 bp, Mus musculus
ggcaggagccgatcccttttcaaag

SEQ ID NO: 325851 - DNA, 25 bp, Mus musculus
ggcaggagctgagctgtagccctca

SEQ ID NO: 325852 - DNA, 25 bp, Mus musculus
ggcaggagctgctttttaaattggc

SEQ ID NO: 325853 - DNA, 25 bp, Mus musculus
ggcaggaggattactgtccagtttg

SEQ ID NO: 325854 - DNA, 25 bp, Mus musculus
ggcaggaggcagaaaggatgagcgc

SEQ ID NO: 325855 - DNA, 25 bp, Mus musculus
ggcaggaggcaggtcattcattcaa

SEQ ID NO: 325856 - DNA, 25 bp, Mus musculus
ggcaggaggctggagagtccttagc

SEQ ID NO: 325857 - DNA, 25 bp, Mus musculus
ggcaggagggacagcgtccgatgca

SEQ ID NO: 325858 - DNA, 25 bp, Mus musculus
ggcaggatactatgtatataacagg

SEQ ID NO: 325859 - DNA, 25 bp, Mus musculus
ggcaggatgcttaggacctgatatt

SEQ ID NO: 325860 - DNA, 25 bp, Mus musculus
ggcaggatggtctccgacatcaaca

SEQ ID NO: 325861 - DNA, 25 bp, Mus musculus
ggcaggattacaggactggatcctg

SEQ ID NO: 325862 - DNA, 25 bp, Mus musculus
ggcaggattacaggcgaccccctcg

SEQ ID NO: 325863 - DNA, 25 bp, Mus musculus
ggcaggattcacgttggtgaccaga

SEQ ID NO: 325864 - DNA, 25 bp, Mus musculus
ggcaggcacacgcaggtgcctcctc

SEQ ID NO: 325865 - DNA, 25 bp, Mus musculus
ggcaggcaccgaggtggtttgtgca

SEQ ID NO: 325866 - DNA, 25 bp, Mus musculus
ggcaggcactggtgtaatggatagg

SEQ ID NO: 325867 - DNA, 25 bp, Mus musculus
ggcaggcagaggcagatatcaagaa

SEQ ID NO: 325868 - DNA, 25 bp, Mus musculus
ggcaggcaggagctgctttttaaat

SEQ ID NO: 325869 - DNA, 25 bp, Mus musculus
ggcaggcaggaggtggtggagttgt

SEQ ID NO: 325870 - DNA, 25 bp, Mus musculus
ggcaggcagtcagagaatttaagaa

SEQ ID NO: 325871 - DNA, 25 bp, Mus musculus
ggcaggcagtcagagatttgattga

SEQ ID NO: 325872 - DNA, 25 bp, Mus musculus
ggcaggcagtgtggattgtctggaa

SEQ ID NO: 325873 - DNA, 25 bp, Mus musculus
ggcaggcatccgggtgatcatggtg

SEQ ID NO: 325874 - DNA, 25 bp, Mus musculus
ggcaggccgcggagcaaccgaagaa

SEQ ID NO: 325875 - DNA, 25 bp, Mus musculus
ggcaggcctaggagatgcaagttgt

SEQ ID NO: 325876 - DNA, 25 bp, Mus musculus
ggcaggcctaggaggggcgtccaaa

SEQ ID NO: 325877 - DNA, 25 bp, Mus musculus
ggcaggcctgtgataagacgctgtc

SEQ ID NO: 325878 - DNA, 25 bp, Mus musculus
ggcaggcctgtgctcatatgaaatc

SEQ ID NO: 325879 - DNA, 25 bp, Mus musculus
ggcaggctaggtatctccggtttag

SEQ ID NO: 325880 - DNA, 25 bp, Mus musculus
ggcaggctaggttcctccggtttag

SEQ ID NO: 325881 - DNA, 25 bp, Mus musculus
ggcaggctcagctgcaggctgtgac

SEQ ID NO: 325882 - DNA, 25 bp, Mus musculus
ggcaggctcaggccaccccacatca

SEQ ID NO: 325883 - DNA, 25 bp, Mus musculus
ggcaggctcaggctaccgagtctat

SEQ ID NO: 325884 - DNA, 25 bp, Mus musculus
ggcaggctcgatggctcccgcaaag

SEQ ID NO: 325885 - DNA, 25 bp, Mus musculus
ggcaggctctgtcccaggtaaatca

SEQ ID NO: 325886 - DNA, 25 bp, Mus musculus
ggcaggctgacattgattctgggct

SEQ ID NO: 325887 - DNA, 25 bp, Mus musculus
ggcaggctgcaggagctcttaggga

SEQ ID NO: 325888 - DNA, 25 bp, Mus musculus
ggcaggctgcaggtaactagttctc

SEQ ID NO: 325889 - DNA, 25 bp, Mus musculus
ggcagggaacgccaattctaacggc

SEQ ID NO: 325890 - DNA, 25 bp, Mus musculus
ggcagggactgggctgcaggtcctg

SEQ ID NO: 325891 - DNA, 25 bp, Mus musculus
ggcagggactggtccagcacctgct

SEQ ID NO: 325892 - DNA, 25 bp, Mus musculus
ggcagggagcacagaacctttgaca

SEQ ID NO: 325893 - DNA, 25 bp, Mus musculus
ggcagggagcacagctcatcctgtg

SEQ ID NO: 325894 - DNA, 25 bp, Mus musculus
ggcagggatttgcttcaacctggct

SEQ ID NO: 325895 - DNA, 25 bp, Mus musculus
ggcagggatttgtttcgcctgcagc

SEQ ID NO: 325896 - DNA, 25 bp, Mus musculus
ggcagggcagggaagaagtacgaga

SEQ ID NO: 325897 - DNA, 25 bp, Mus musculus
ggcagggccgaggcccgatttcccg

SEQ ID NO: 325898 - DNA, 25 bp, Mus musculus
ggcagggctaacttcccgctcggcc

SEQ ID NO: 325899 - DNA, 25 bp, Mus musculus
ggcagggctgagagatgggaaagag

SEQ ID NO: 325900 - DNA, 25 bp, Mus musculus
ggcaggggattgattatgagaagat

SEQ ID NO: 325901 - DNA, 25 bp, Mus musculus
ggcaggggcggaggatcaacgagga

SEQ ID NO: 325902 - DNA, 25 bp, Mus musculus
ggcaggggctggctgaatcatgatg

SEQ ID NO: 325903 - DNA, 25 bp, Mus musculus
ggcagggtccctttgcacttggaat

SEQ ID NO: 325904 - DNA, 25 bp, Mus musculus
ggcaggtaattgcgctccagatgaa

SEQ ID NO: 325905 - DNA, 25 bp, Mus musculus
ggcaggtagccaagcttgaggcggc

SEQ ID NO: 325906 - DNA, 25 bp, Mus musculus
ggcaggtcaaccagggaaaatgcca

SEQ ID NO: 325907 - DNA, 25 bp, Mus musculus
ggcaggtcaatagccttcctgggag

SEQ ID NO: 325908 - DNA, 25 bp, Mus musculus
ggcaggtcatcaccaccggcgcctg

SEQ ID NO: 325909 - DNA, 25 bp, Mus musculus
ggcaggtccaaggcttgagattttt

SEQ ID NO: 325910 - DNA, 25 bp, Mus musculus
ggcaggtcccaagggtgcccctgga

SEQ ID NO: 325911 - DNA, 25 bp, Mus musculus
ggcaggtcccaggtatgaataccac

SEQ ID NO: 325912 - DNA, 25 bp, Mus musculus
ggcaggtgaaggcctatgagaagca

SEQ ID NO: 325913 - DNA, 25 bp, Mus musculus
ggcaggtggatctgttacccacagg

SEQ ID NO: 325914 - DNA, 25 bp, Mus musculus
ggcaggtggatggagtgggtaactt

SEQ ID NO: 325915 - DNA, 25 bp, Mus musculus
ggcaggtggatggagttcgacagaa

SEQ ID NO: 325916 - DNA, 25 bp, Mus musculus
ggcaggtgtccctgccgtgtgtctg

SEQ ID NO: 325917 - DNA, 25 bp, Mus musculus
ggcagtaactggcaagaagacagca

SEQ ID NO: 325918 - DNA, 25 bp, Mus musculus
ggcagtaccgagaggtcgactcatg

SEQ ID NO: 325919 - DNA, 25 bp, Mus musculus
ggcagtactggcaccttctccacgt

SEQ ID NO: 325920 - DNA, 25 bp, Mus musculus
ggcagtactggtcctaaccgtaggc

SEQ ID NO: 325921 - DNA, 25 bp, Mus musculus
ggcagtacttcaagagcctgcacag

SEQ ID NO: 325922 - DNA, 25 bp, Mus musculus
ggcagtagagtcagatacagagttc

SEQ ID NO: 325923 - DNA, 25 bp, Mus musculus
ggcagtagctcagcttcttcagctg

SEQ ID NO: 325924 - DNA, 25 bp, Mus musculus
ggcagtagctcaggaatgtcaagtg

SEQ ID NO: 325925 - DNA, 25 bp, Mus musculus
ggcagtcaagccggtgtcctgggtc

SEQ ID NO: 325926 - DNA, 25 bp, Mus musculus
ggcagtcacagaatgatgtgagccc

SEQ ID NO: 325927 - DNA, 25 bp, Mus musculus
ggcagtcacaggttggatgaaaaat

SEQ ID NO: 325928 - DNA, 25 bp, Mus musculus
ggcagtcagagaatttaagaagtgc

SEQ ID NO: 325929 - DNA, 25 bp, Mus musculus
ggcagtcagagatttgattgagcac

SEQ ID NO: 325930 - DNA, 25 bp, Mus musculus
ggcagtcagcaaacaaaaccggggg

SEQ ID NO: 325931 - DNA, 25 bp, Mus musculus
ggcagtcagcaaccaccctcccctg

SEQ ID NO: 325932 - DNA, 25 bp, Mus musculus
ggcagtcctggcagactgtaccatc

SEQ ID NO: 325933 - DNA, 25 bp, Mus musculus
ggcagtcctggcagagacagagatg

SEQ ID NO: 325934 - DNA, 25 bp, Mus musculus
ggcagtctctgggttcagacaatga

SEQ ID NO: 325935 - DNA, 25 bp, Mus musculus
ggcagtctgggcctgccacccctag

SEQ ID NO: 325936 - DNA, 25 bp, Mus musculus
ggcagtctgggctgctggctctaca

SEQ ID NO: 325937 - DNA, 25 bp, Mus musculus
ggcagtcttctcgatctttgggacc

SEQ ID NO: 325938 - DNA, 25 bp, Mus musculus
ggcagtcttggattacctgttgcag

SEQ ID NO: 325939 - DNA, 25 bp, Mus musculus
ggcagtgaaacagctgggtgttaac

SEQ ID NO: 325940 - DNA, 25 bp, Mus musculus
ggcagtgaagcggatacgggccaca

SEQ ID NO: 325941 - DNA, 25 bp, Mus musculus
ggcagtgaaggaccgtgcaggcagc

SEQ ID NO: 325942 - DNA, 25 bp, Mus musculus
ggcagtgaaggcccttgctgctgga

SEQ ID NO: 325943 - DNA, 25 bp, Mus musculus
ggcagtgagtggctggattcctatc

SEQ ID NO: 325944 - DNA, 25 bp, Mus musculus
ggcagtgatatacaggtggaatgac

SEQ ID NO: 325945 - DNA, 25 bp, Mus musculus
ggcagtgattcatcagaaaagttcc

SEQ ID NO: 325946 - DNA, 25 bp, Mus musculus
ggcagtgcagcaggttcaccgtctc

SEQ ID NO: 325947 - DNA, 25 bp, Mus musculus
ggcagtgcaggggtacgcacgcggt

SEQ ID NO: 325948 - DNA, 25 bp, Mus musculus
ggcagtgccagggaggtgtgaatga

SEQ ID NO: 325949 - DNA, 25 bp, Mus musculus
ggcagtgcctttgaggtcaatcttg

SEQ ID NO: 325950 - DNA, 25 bp, Mus musculus
ggcagtgcggcagccgtggtcatag

SEQ ID NO: 325951 - DNA, 25 bp, Mus musculus
ggcagtgctcataggaattcactgt

SEQ ID NO: 325952 - DNA, 25 bp, Mus musculus
ggcagtgcttctgtgaaagaattga

SEQ ID NO: 325953 - DNA, 25 bp, Mus musculus
ggcagtggaagccagctttttgatc

SEQ ID NO: 325954 - DNA, 25 bp, Mus musculus
ggcagtggagggccctgtctgtact

SEQ ID NO: 325955 - DNA, 25 bp, Mus musculus
ggcagtggccagacaggtggagtca

SEQ ID NO: 325956 - DNA, 25 bp, Mus musculus
ggcagtggcgaaggcgaatctggtt

SEQ ID NO: 325957 - DNA, 25 bp, Mus musculus
ggcagtggcgagactgaaacagtcc

SEQ ID NO: 325958 - DNA, 25 bp, Mus musculus
ggcagtggcgaggagtccgctcaga

SEQ ID NO: 325959 - DNA, 25 bp, Mus musculus
ggcagtggcgaggtgagccatgatg

SEQ ID NO: 325960 - DNA, 25 bp, Mus musculus
ggcagtggcgcaggatggcgcagaa

SEQ ID NO: 325961 - DNA, 25 bp, Mus musculus
ggcagtggcgcagttttactttcaa

SEQ ID NO: 325962 - DNA, 25 bp, Mus musculus
ggcagtggcgccgtccagaggacca

SEQ ID NO: 325963 - DNA, 25 bp, Mus musculus
ggcagtggctcagctctgccatttc

SEQ ID NO: 325964 - DNA, 25 bp, Mus musculus
ggcagtgggaaagggagtcatgtgg

SEQ ID NO: 325965 - DNA, 25 bp, Mus musculus
ggcagtggtggaggtcagagtcaga

SEQ ID NO: 325966 - DNA, 25 bp, Mus musculus
ggcagtggtggaggtcagggtagta

SEQ ID NO: 325967 - DNA, 25 bp, Mus musculus
ggcagtggtggtgaccaaccacttg

SEQ ID NO: 325968 - DNA, 25 bp, Mus musculus
ggcagtgtccatgctcttttgtgac

SEQ ID NO: 325969 - DNA, 25 bp, Mus musculus
ggcagtgtccccaccttcaaacacc

SEQ ID NO: 325970 - DNA, 25 bp, Mus musculus
ggcagtgtgagctagcccttcttca

SEQ ID NO: 325971 - DNA, 25 bp, Mus musculus
ggcagtgtgagtgatttccggtgtc

SEQ ID NO: 325972 - DNA, 25 bp, Mus musculus
ggcagtgtgcagatttgtgaataaa

SEQ ID NO: 325973 - DNA, 25 bp, Mus musculus
ggcagtgttttcagggccctcagcc

SEQ ID NO: 325974 - DNA, 25 bp, Mus musculus
ggcagttaaagaggtgaactgccct

SEQ ID NO: 325975 - DNA, 25 bp, Mus musculus
ggcagttagacttgcaagcaccttt

SEQ ID NO: 325976 - DNA, 25 bp, Mus musculus
ggcagttatatcaggggtcggcaca

SEQ ID NO: 325977 - DNA, 25 bp, Mus musculus
ggcagttcaagccaaccatctgcca

SEQ ID NO: 325978 - DNA, 25 bp, Mus musculus
ggcagttcaaggcaataaaagcgaa

SEQ ID NO: 325979 - DNA, 25 bp, Mus musculus
ggcagttcaagggctaacttaaaga

SEQ ID NO: 325980 - DNA, 25 bp, Mus musculus
ggcagttccattgactaggccaggg

SEQ ID NO: 325981 - DNA, 25 bp, Mus musculus
ggcagttgcgggagtgggaggtgct

SEQ ID NO: 325982 - DNA, 25 bp, Mus musculus
ggcagtttagaaatgcacttagcga

SEQ ID NO: 325983 - DNA, 25 bp, Mus musculus
ggcagtttgaggagtgcatttccca

SEQ ID NO: 325984 - DNA, 25 bp, Mus musculus
ggcagttttgaaggctctgctaagg

SEQ ID NO: 325985 - DNA, 25 bp, Mus musculus
ggcagttttgggggctcgccatacg

SEQ ID NO: 325986 - DNA, 25 bp, Mus musculus
ggcagttttttgcatgttacatgga

SEQ ID NO: 325987 - DNA, 25 bp, Mus musculus
ggcataactgagaatatttataaga

SEQ ID NO: 325988 - DNA, 25 bp, Mus musculus
ggcataactgttatagagaatattt

SEQ ID NO: 325989 - DNA, 25 bp, Mus musculus
ggcataccaggctccagaaatgttt

SEQ ID NO: 325990 - DNA, 25 bp, Mus musculus
ggcatactacaggatctatgggcag

SEQ ID NO: 325991 - DNA, 25 bp, Mus musculus
ggcatactgcagtgcttaaatgtaa

SEQ ID NO: 325992 - DNA, 25 bp, Mus musculus
ggcatactgctcaatccatcgagac

SEQ ID NO: 325993 - DNA, 25 bp, Mus musculus
ggcatagacttcaggaataaagtgg

SEQ ID NO: 325994 - DNA, 25 bp, Mus musculus
ggcatagctggtctgaagagccatc

SEQ ID NO: 325995 - DNA, 25 bp, Mus musculus
ggcataggagaacattctggctcac

SEQ ID NO: 325996 - DNA, 25 bp, Mus musculus
ggcataggaggtaacaacaacaaaa

SEQ ID NO: 325997 - DNA, 25 bp, Mus musculus
ggcatagtcactaaggagatgttag

SEQ ID NO: 325998 - DNA, 25 bp, Mus musculus
ggcatagtggagtcccagaggcacc

SEQ ID NO: 325999 - DNA, 25 bp, Mus musculus
ggcatagttggagcgataggtctcc

SEQ ID NO: 326000 - DNA, 25 bp, Mus musculus
ggcatagtttttctgatggtctgca

SEQ ID NO: 326001 - DNA, 25 bp, Mus musculus
ggcatatcaagaatgctgtgaacct

SEQ ID NO: 326002 - DNA, 25 bp, Mus musculus
ggcatatcagatacgagggcaccat

SEQ ID NO: 326003 - DNA, 25 bp, Mus musculus
ggcatatcagccatggacggagtcc

SEQ ID NO: 326004 - DNA, 25 bp, Mus musculus
ggcatatcaggtcaggggtcaccac

SEQ ID NO: 326005 - DNA, 25 bp, Mus musculus
ggcatatgacatagcttgtgacgaa

SEQ ID NO: 326006 - DNA, 25 bp, Mus musculus
ggcatatgagcagatgaaacggctt

SEQ ID NO: 326007 - DNA, 25 bp, Mus musculus
ggcatatgcttccttggggactgat

SEQ ID NO: 326008 - DNA, 25 bp, Mus musculus
ggcatatgcttcggagactcgggcg

SEQ ID NO: 326009 - DNA, 25 bp, Mus musculus
ggcatattgggaacgaccaaggact

SEQ ID NO: 326010 - DNA, 25 bp, Mus musculus
ggcatatttgagggattttatatat

SEQ ID NO: 326011 - DNA, 25 bp, Mus musculus
ggcatattttggaaaccagtaaagt

SEQ ID NO: 326012 - DNA, 25 bp, Mus musculus
ggcatattttggttcttcatgcttt

SEQ ID NO: 326013 - DNA, 25 bp, Mus musculus
ggcatcaaaacaaatggcctccacc

SEQ ID NO: 326014 - DNA, 25 bp, Mus musculus
ggcatcaaagggatggttcaggctg

SEQ ID NO: 326015 - DNA, 25 bp, Mus musculus
ggcatcaagaaaggctccgtgctgc

SEQ ID NO: 326016 - DNA, 25 bp, Mus musculus
ggcatcaagcacggcacagtttgtc

SEQ ID NO: 326017 - DNA, 25 bp, Mus musculus
ggcatcaaggagacatcaacaagga

SEQ ID NO: 326018 - DNA, 25 bp, Mus musculus
ggcatcaaggagcaggacatcaaca

SEQ ID NO: 326019 - DNA, 25 bp, Mus musculus
ggcatcaatcatggaaaggatttgg

SEQ ID NO: 326020 - DNA, 25 bp, Mus musculus
ggcatcaatgctgttttctactatt

SEQ ID NO: 326021 - DNA, 25 bp, Mus musculus
ggcatcacagagctctgcaggtcca

SEQ ID NO: 326022 - DNA, 25 bp, Mus musculus
ggcatcacagatggcctgcaatgcc

SEQ ID NO: 326023 - DNA, 25 bp, Mus musculus
ggcatcacagtcagtacaggctacc

SEQ ID NO: 326024 - DNA, 25 bp, Mus musculus
ggcatcacatgaccagtggctgctc

SEQ ID NO: 326025 - DNA, 25 bp, Mus musculus
ggcatcaccacgatcagagtgatgt

SEQ ID NO: 326026 - DNA, 25 bp, Mus musculus
ggcatcaccatcgtggaagacatca

SEQ ID NO: 326027 - DNA, 25 bp, Mus musculus
ggcatcagagaggatgtaacttatc

SEQ ID NO: 326028 - DNA, 25 bp, Mus musculus
ggcatcagagagggaagaaaatgga

SEQ ID NO: 326029 - DNA, 25 bp, Mus musculus
ggcatcagagccaaggctaaactca

SEQ ID NO: 326030 - DNA, 25 bp, Mus musculus
ggcatcatacaagtttgtgtggcca

SEQ ID NO: 326031 - DNA, 25 bp, Mus musculus
ggcatcataggtggcatcatggcag

SEQ ID NO: 326032 - DNA, 25 bp, Mus musculus
ggcatcatcaactctatattagctc

SEQ ID NO: 326033 - DNA, 25 bp, Mus musculus
ggcatcatcaagaagagcctcccca

SEQ ID NO: 326034 - DNA, 25 bp, Mus musculus
ggcatcatcaagaaggtgcaggtgg

SEQ ID NO: 326035 - DNA, 25 bp, Mus musculus
ggcatcatcctggtgttcctgctgg

SEQ ID NO: 326036 - DNA, 25 bp, Mus musculus
ggcatcatccttagcagggagaaga

SEQ ID NO: 326037 - DNA, 25 bp, Mus musculus
ggcatcatcgaagctcccatctcca

SEQ ID NO: 326038 - DNA, 25 bp, Mus musculus
ggcatcatcgaagtggaaaacatgg

SEQ ID NO: 326039 - DNA, 25 bp, Mus musculus
ggcatcatggctcacctgtgccagg

SEQ ID NO: 326040 - DNA, 25 bp, Mus musculus
ggcatcatttgtaccatctgtaccg

SEQ ID NO: 326041 - DNA, 25 bp, Mus musculus
ggcatccaagaaagatcgctccttt

SEQ ID NO: 326042 - DNA, 25 bp, Mus musculus
ggcatccaagagcaactggtggttg

SEQ ID NO: 326043 - DNA, 25 bp, Mus musculus
ggcatccaagcaagcgaagatgtca

SEQ ID NO: 326044 - DNA, 25 bp, Mus musculus
ggcatccaaggtccagggagttggc

SEQ ID NO: 326045 - DNA, 25 bp, Mus musculus
ggcatccacggaagaagtgccttcc

SEQ ID NO: 326046 - DNA, 25 bp, Mus musculus
ggcatccacggaggaggagctgatc

SEQ ID NO: 326047 - DNA, 25 bp, Mus musculus
ggcatccacggaggccctgcccagg

SEQ ID NO: 326048 - DNA, 25 bp, Mus musculus
ggcatccacggccatgggttctccg

SEQ ID NO: 326049 - DNA, 25 bp, Mus musculus
ggcatccacggcggaaccttagagg

SEQ ID NO: 326050 - DNA, 25 bp, Mus musculus
ggcatccacggggctccacctgaag

SEQ ID NO: 326051 - DNA, 25 bp, Mus musculus
ggcatccaggaacctctcctcctgg

SEQ ID NO: 326052 - DNA, 25 bp, Mus musculus
ggcatccagtgagctgcttatcata

SEQ ID NO: 326053 - DNA, 25 bp, Mus musculus
ggcatcccgactgtgatctgtgagt

SEQ ID NO: 326054 - DNA, 25 bp, Mus musculus
ggcatccctaccattctgtccggtc

SEQ ID NO: 326055 - DNA, 25 bp, Mus musculus
ggcatccgggactaggctctgtagg

SEQ ID NO: 326056 - DNA, 25 bp, Mus musculus
ggcatcctaggccagtctccctatg

SEQ ID NO: 326057 - DNA, 25 bp, Mus musculus
ggcatcctcaaggacacccagttgc

SEQ ID NO: 326058 - DNA, 25 bp, Mus musculus
ggcatcctgaaagatcttggtgggc

SEQ ID NO: 326059 - DNA, 25 bp, Mus musculus
ggcatcctgaaagggctgtgcggac

SEQ ID NO: 326060 - DNA, 25 bp, Mus musculus
ggcatcctggtcatttgaagactga

SEQ ID NO: 326061 - DNA, 25 bp, Mus musculus
ggcatcctgtcccgaaacaagcctt

SEQ ID NO: 326062 - DNA, 25 bp, Mus musculus
ggcatccttatcagacgaaagagcc

SEQ ID NO: 326063 - DNA, 25 bp, Mus musculus
ggcatccttgactccaagcggggct

SEQ ID NO: 326064 - DNA, 25 bp, Mus musculus
ggcatcgacttcaaggacacagcag

SEQ ID NO: 326065 - DNA, 25 bp, Mus musculus
ggcatcgagaggagtggctcaggag

SEQ ID NO: 326066 - DNA, 25 bp, Mus musculus
ggcatcgagggcttcttcggcttcg

SEQ ID NO: 326067 - DNA, 25 bp, Mus musculus
ggcatcgcacagctctatggtatcg

SEQ ID NO: 326068 - DNA, 25 bp, Mus musculus
ggcatcgcggaggatcggtcatggg

SEQ ID NO: 326069 - DNA, 25 bp, Mus musculus
ggcatcgctggtgaggaaccacagc

SEQ ID NO: 326070 - DNA, 25 bp, Mus musculus
ggcatcgctggtgggggcgctcctg

SEQ ID NO: 326071 - DNA, 25 bp, Mus musculus
ggcatcgcttagcagacgcttaaag

SEQ ID NO: 326072 - DNA, 25 bp, Mus musculus
ggcatcggaagcctggacaaactac

SEQ ID NO: 326073 - DNA, 25 bp, Mus musculus
ggcatcggatgctggggctgcacga

SEQ ID NO: 326074 - DNA, 25 bp, Mus musculus
ggcatcggtgcccctgaccccatga

SEQ ID NO: 326075 - DNA, 25 bp, Mus musculus
ggcatcgtcaagaccactgggaggc

SEQ ID NO: 326076 - DNA, 25 bp, Mus musculus
ggcatcgtcacatgatcatggatat

SEQ ID NO: 326077 - DNA, 25 bp, Mus musculus
ggcatcgtgcaccgcctgaccccca

SEQ ID NO: 326078 - DNA, 25 bp, Mus musculus
ggcatcgtgcaccgggatttaaagt

SEQ ID NO: 326079 - DNA, 25 bp, Mus musculus
ggcatcgtggaagccttgccatgca

SEQ ID NO: 326080 - DNA, 25 bp, Mus musculus
ggcatcgtggaagtggaaaacccag

SEQ ID NO: 326081 - DNA, 25 bp, Mus musculus
ggcatctaattcagatcatgattct

SEQ ID NO: 326082 - DNA, 25 bp, Mus musculus
ggcatctacaaggctcacttgtata

SEQ ID NO: 326083 - DNA, 25 bp, Mus musculus
ggcatctacaagggcgccaaagcat

SEQ ID NO: 326084 - DNA, 25 bp, Mus musculus
ggcatctcaagagttctatccagga

SEQ ID NO: 326085 - DNA, 25 bp, Mus musculus
ggcatctcaagcctccagaggtgaa

SEQ ID NO: 326086 - DNA, 25 bp, Mus musculus
ggcatctcaagcctccggtcagcgg

SEQ ID NO: 326087 - DNA, 25 bp, Mus musculus
ggcatctcacaagttagccctagaa

SEQ ID NO: 326088 - DNA, 25 bp, Mus musculus
ggcatctcactgcaatgcctgtcac

SEQ ID NO: 326089 - DNA, 25 bp, Mus musculus
ggcatctcactggtggagctggcaa

SEQ ID NO: 326090 - DNA, 25 bp, Mus musculus
ggcatctcagatacgaacagaacac

SEQ ID NO: 326091 - DNA, 25 bp, Mus musculus
ggcatctctcccttctgcatgcaga

SEQ ID NO: 326092 - DNA, 25 bp, Mus musculus
ggcatctctgagctcatgacccata

SEQ ID NO: 326093 - DNA, 25 bp, Mus musculus
ggcatctctgaggtccgatctgacc

SEQ ID NO: 326094 - DNA, 25 bp, Mus musculus
ggcatctgaaggtctgccttgacca

SEQ ID NO: 326095 - DNA, 25 bp, Mus musculus
ggcatctgagtgatataaaaacaac

SEQ ID NO: 326096 - DNA, 25 bp, Mus musculus
ggcatctgcaatgccgcgccagttc

SEQ ID NO: 326097 - DNA, 25 bp, Mus musculus
ggcatctggaaagacaggagcttat

SEQ ID NO: 326098 - DNA, 25 bp, Mus musculus
ggcatctggaaaggtttccaaaatg

SEQ ID NO: 326099 - DNA, 25 bp, Mus musculus
ggcatctggttttaggtccagcgag

SEQ ID NO: 326100 - DNA, 25 bp, Mus musculus
ggcatctgtgggcatgtatttaatt

SEQ ID NO: 326101 - DNA, 25 bp, Mus musculus
ggcatctgtggtggttctttcagct

SEQ ID NO: 326102 - DNA, 25 bp, Mus musculus
ggcatctgtgtgatctcagtgaaaa

SEQ ID NO: 326103 - DNA, 25 bp, Mus musculus
ggcatcttcaactccgagctggaat

SEQ ID NO: 326104 - DNA, 25 bp, Mus musculus
ggcatcttgaaggtaagtgacctgc

SEQ ID NO: 326105 - DNA, 25 bp, Mus musculus
ggcatcttgcagaagaacatgtttg

SEQ ID NO: 326106 - DNA, 25 bp, Mus musculus
ggcatcttgcagaagagtcaggagc

SEQ ID NO: 326107 - DNA, 25 bp, Mus musculus
ggcatcttgcagaggaggatgactc

SEQ ID NO: 326108 - DNA, 25 bp, Mus musculus
ggcatgaaaaggcccttgctgctgg

SEQ ID NO: 326109 - DNA, 25 bp, Mus musculus
ggcatgaaaggaggaagcggctgga

SEQ ID NO: 326110 - DNA, 25 bp, Mus musculus
ggcatgaaaggcccagcttcggtca

SEQ ID NO: 326111 - DNA, 25 bp, Mus musculus
ggcatgaaaggttttgttttgtttc

SEQ ID NO: 326112 - DNA, 25 bp, Mus musculus
ggcatgaaccacaagacctgctaca

SEQ ID NO: 326113 - DNA, 25 bp, Mus musculus
ggcatgaactatgaagatgactgtg

SEQ ID NO: 326114 - DNA, 25 bp, Mus musculus
ggcatgaagctgagtgaagatggca

SEQ ID NO: 326115 - DNA, 25 bp, Mus musculus
ggcatgacaggagctggagaagctg

SEQ ID NO: 326116 - DNA, 25 bp, Mus musculus
ggcatgaccaaactccgatgatcgc

SEQ ID NO: 326117 - DNA, 25 bp, Mus musculus
ggcatgaccaagatgccaaagaccc

SEQ ID NO: 326118 - DNA, 25 bp, Mus musculus
ggcatgaccaaggtacttcctggac

SEQ ID NO: 326119 - DNA, 25 bp, Mus musculus
ggcatgaccaagttcatgaagcctg

SEQ ID NO: 326120 - DNA, 25 bp, Mus musculus
ggcatgaccagtgtcagcgcaagca

SEQ ID NO: 326121 - DNA, 25 bp, Mus musculus
ggcatgagcaagcacgtcgcgtttg

SEQ ID NO: 326122 - DNA, 25 bp, Mus musculus
ggcatgagcctcagggccccttagg

SEQ ID NO: 326123 - DNA, 25 bp, Mus musculus
ggcatgaggagaagcctatgggaag

SEQ ID NO: 326124 - DNA, 25 bp, Mus musculus
ggcatgaggctgctggcgttccccg

SEQ ID NO: 326125 - DNA, 25 bp, Mus musculus
ggcatgagtggagccagagaacagc

SEQ ID NO: 326126 - DNA, 25 bp, Mus musculus
ggcatgatatggttccttgttccca

SEQ ID NO: 326127 - DNA, 25 bp, Mus musculus
ggcatgatctttagaagactgctgg

SEQ ID NO: 326128 - DNA, 25 bp, Mus musculus
ggcatgatgcccccgcctcctccct

SEQ ID NO: 326129 - DNA, 25 bp, Mus musculus
ggcatgatgtgaggcactaagtgac

SEQ ID NO: 326130 - DNA, 25 bp, Mus musculus
ggcatgccaggtactgctggagaga

SEQ ID NO: 326131 - DNA, 25 bp, Mus musculus
ggcatgccagtgaagagagagctaa

SEQ ID NO: 326132 - DNA, 25 bp, Mus musculus
ggcatgccgggtggctttgctgagt

SEQ ID NO: 326133 - DNA, 25 bp, Mus musculus
ggcatgcggcctcctcctccaggca

SEQ ID NO: 326134 - DNA, 25 bp, Mus musculus
ggcatgctcggggggaaggcccaaa

SEQ ID NO: 326135 - DNA, 25 bp, Mus musculus
ggcatggaagatgaaagagaagatg

SEQ ID NO: 326136 - DNA, 25 bp, Mus musculus
ggcatggaagccaaggtgaaagccg

SEQ ID NO: 326137 - DNA, 25 bp, Mus musculus
ggcatggaaggcatgggtcccgagc

SEQ ID NO: 326138 - DNA, 25 bp, Mus musculus
ggcatggacaagtccagttcagctg

SEQ ID NO: 326139 - DNA, 25 bp, Mus musculus
ggcatggacgagatggcagttgagt

SEQ ID NO: 326140 - DNA, 25 bp, Mus musculus
ggcatggagccagaccactcggccc

SEQ ID NO: 326141 - DNA, 25 bp, Mus musculus
ggcatggagtatcaggatgctgtgc

SEQ ID NO: 326142 - DNA, 25 bp, Mus musculus
ggcatggatgaagaactcgacagcc

SEQ ID NO: 326143 - DNA, 25 bp, Mus musculus
ggcatggattcagaaaattaatgag

SEQ ID NO: 326144 - DNA, 25 bp, Mus musculus
ggcatggcacccaggcacggaggga

SEQ ID NO: 326145 - DNA, 25 bp, Mus musculus
ggcatggcacccaggcgcgaaggga

SEQ ID NO: 326146 - DNA, 25 bp, Mus musculus
ggcatggcacccaggtacgcaggga

SEQ ID NO: 326147 - DNA, 25 bp, Mus musculus
ggcatggcagagcaccttaaggatg

SEQ ID NO: 326148 - DNA, 25 bp, Mus musculus
ggcatggcagagctccaggccgggc

SEQ ID NO: 326149 - DNA, 25 bp, Mus musculus
ggcatggcagccaaagcttaattaa

SEQ ID NO: 326150 - DNA, 25 bp, Mus musculus
ggcatggctagctcgtgtgccgtgc

SEQ ID NO: 326151 - DNA, 25 bp, Mus musculus
ggcatgggatacatgccttctgcca

SEQ ID NO: 326152 - DNA, 25 bp, Mus musculus
ggcatgggatatgaggtgcagcaga

SEQ ID NO: 326153 - DNA, 25 bp, Mus musculus
ggcatgggatggagagtctgtattg

SEQ ID NO: 326154 - DNA, 25 bp, Mus musculus
ggcatgggatgggggacagctgttg

SEQ ID NO: 326155 - DNA, 25 bp, Mus musculus
ggcatgggcagaggtatatgtggtt

SEQ ID NO: 326156 - DNA, 25 bp, Mus musculus
ggcatgggctacatgccctcagcca

SEQ ID NO: 326157 - DNA, 25 bp, Mus musculus
ggcatgggctacatggcctcttcct

SEQ ID NO: 326158 - DNA, 25 bp, Mus musculus
ggcatgggctacattgcacacttga

SEQ ID NO: 326159 - DNA, 25 bp, Mus musculus
ggcatgggcttgtcaaaccagtcca

SEQ ID NO: 326160 - DNA, 25 bp, Mus musculus
ggcatggggcggcgtcgcggcttta

SEQ ID NO: 326161 - DNA, 25 bp, Mus musculus
ggcatgggtttgtcaaaccagtcca

SEQ ID NO: 326162 - DNA, 25 bp, Mus musculus
ggcatggtagaaagatctaaagggg

SEQ ID NO: 326163 - DNA, 25 bp, Mus musculus
ggcatggtagaaaggcctttgtaga

SEQ ID NO: 326164 - DNA, 25 bp, Mus musculus
ggcatggtgttatcaagctgaggat

SEQ ID NO: 326165 - DNA, 25 bp, Mus musculus
ggcatggtttggatttgcgggaacg

SEQ ID NO: 326166 - DNA, 25 bp, Mus musculus
ggcatgtacgctaacttgggtattg

SEQ ID NO: 326167 - DNA, 25 bp, Mus musculus
ggcatgtagagtgatcgatggctgc

SEQ ID NO: 326168 - DNA, 25 bp, Mus musculus
ggcatgtcatctacatagaccagcc

SEQ ID NO: 326169 - DNA, 25 bp, Mus musculus
ggcatgtcatctacatagaccagga

SEQ ID NO: 326170 - DNA, 25 bp, Mus musculus
ggcatgtctaagccaatcaaagttg

SEQ ID NO: 326171 - DNA, 25 bp, Mus musculus
ggcatgtgactcaagctcgtgtggc

SEQ ID NO: 326172 - DNA, 25 bp, Mus musculus
ggcatgtgcgggtctatgaatgagc

SEQ ID NO: 326173 - DNA, 25 bp, Mus musculus
ggcatgtggctcgacatgaacgaac

SEQ ID NO: 326174 - DNA, 25 bp, Mus musculus
ggcatgttcccaaatagctttctga

SEQ ID NO: 326175 - DNA, 25 bp, Mus musculus
ggcatgttcgtgtggacaaatgtcg

SEQ ID NO: 326176 - DNA, 25 bp, Mus musculus
ggcatgttctctgaattcctgtccc

SEQ ID NO: 326177 - DNA, 25 bp, Mus musculus
ggcatgttggaagttcccatggccg

SEQ ID NO: 326178 - DNA, 25 bp, Mus musculus
ggcatgttggagcctgctatgggat

SEQ ID NO: 326179 - DNA, 25 bp, Mus musculus
ggcatgttggagcttcaaggagaaa

SEQ ID NO: 326180 - DNA, 25 bp, Mus musculus
ggcatgttggaggtaataaagctct

SEQ ID NO: 326181 - DNA, 25 bp, Mus musculus
ggcatgtttacagtggccggcctca

SEQ ID NO: 326182 - DNA, 25 bp, Mus musculus
ggcatgtttacagttaggtgacagc

SEQ ID NO: 326183 - DNA, 25 bp, Mus musculus
ggcatgtttattagtggaatctttg

SEQ ID NO: 326184 - DNA, 25 bp, Mus musculus
ggcattaaacaggacattcaccttg

SEQ ID NO: 326185 - DNA, 25 bp, Mus musculus
ggcattaccttggttctgaccagaa

SEQ ID NO: 326186 - DNA, 25 bp, Mus musculus
ggcattacgtcatgtactatgagat

SEQ ID NO: 326187 - DNA, 25 bp, Mus musculus
ggcattatccactcaattttaaaga

SEQ ID NO: 326188 - DNA, 25 bp, Mus musculus
ggcattatggactggcatgcacaca

SEQ ID NO: 326189 - DNA, 25 bp, Mus musculus
ggcattatgtgatggctgcacccca

SEQ ID NO: 326190 - DNA, 25 bp, Mus musculus
ggcattatgtgatgtactacgagat

SEQ ID NO: 326191 - DNA, 25 bp, Mus musculus
ggcattcatgcggaaagacgtgcga

SEQ ID NO: 326192 - DNA, 25 bp, Mus musculus
ggcattcatgcggatgcgttttgac

SEQ ID NO: 326193 - DNA, 25 bp, Mus musculus
ggcattccccggaagacgaagagcc

SEQ ID NO: 326194 - DNA, 25 bp, Mus musculus
ggcattccccggaagcactctgaca

SEQ ID NO: 326195 - DNA, 25 bp, Mus musculus
ggcattctaccccagacaagaataa

SEQ ID NO: 326196 - DNA, 25 bp, Mus musculus
ggcattctaccccagttcccaaagt

SEQ ID NO: 326197 - DNA, 25 bp, Mus musculus
ggcattcttcccttagaccgtcacg

SEQ ID NO: 326198 - DNA, 25 bp, Mus musculus
ggcattgacccttcttggagcttgt

SEQ ID NO: 326199 - DNA, 25 bp, Mus musculus
ggcattgaccgctcatcctaaagta

SEQ ID NO: 326200 - DNA, 25 bp, Mus musculus
ggcattgaggcaaagaacctagcca

SEQ ID NO: 326201 - DNA, 25 bp, Mus musculus
ggcattgatgcgtgcagggcgacag

SEQ ID NO: 326202 - DNA, 25 bp, Mus musculus
ggcattgcacaagaaaagaaggctg

SEQ ID NO: 326203 - DNA, 25 bp, Mus musculus
ggcattgcagatggaaggattacaa

SEQ ID NO: 326204 - DNA, 25 bp, Mus musculus
ggcattgcagatttatttcctgggc

SEQ ID NO: 326205 - DNA, 25 bp, Mus musculus
ggcattgcagcgtgcaatgatgcgc

SEQ ID NO: 326206 - DNA, 25 bp, Mus musculus
ggcattgcaggccgaggagaatctc

SEQ ID NO: 326207 - DNA, 25 bp, Mus musculus
ggcattgccaataaagttctttgtg

SEQ ID NO: 326208 - DNA, 25 bp, Mus musculus
ggcattgccaataaatcagagtcct

SEQ ID NO: 326209 - DNA, 25 bp, Mus musculus
ggcattgcccaggtgaaaatccagg

SEQ ID NO: 326210 - DNA, 25 bp, Mus musculus
ggcattgcccgcccatgtgcctcct

SEQ ID NO: 326211 - DNA, 25 bp, Mus musculus
ggcattgctaaaagaggcatccacc

SEQ ID NO: 326212 - DNA, 25 bp, Mus musculus
ggcattgggattccaggcatagtca

SEQ ID NO: 326213 - DNA, 25 bp, Mus musculus
ggcattgtaactctggttttcttat

SEQ ID NO: 326214 - DNA, 25 bp, Mus musculus
ggcattgtgaggggagctgttgtgg

SEQ ID NO: 326215 - DNA, 25 bp, Mus musculus
ggcattgtgaggggtgttctgtagt

SEQ ID NO: 326216 - DNA, 25 bp, Mus musculus
ggcattgtggactctagaaaaagaa

SEQ ID NO: 326217 - DNA, 25 bp, Mus musculus
ggcattgtggattatcagactctag

SEQ ID NO: 326218 - DNA, 25 bp, Mus musculus
ggcattgttatccagatggtttcaa

SEQ ID NO: 326219 - DNA, 25 bp, Mus musculus
ggcattgttcgaggaaatgctgtca

SEQ ID NO: 326220 - DNA, 25 bp, Mus musculus
ggcatttagagagacactgtactac

SEQ ID NO: 326221 - DNA, 25 bp, Mus musculus
ggcatttccggaatgcaggtttcaa

SEQ ID NO: 326222 - DNA, 25 bp, Mus musculus
ggcatttctgatgggcagccccatc

SEQ ID NO: 326223 - DNA, 25 bp, Mus musculus
ggcatttctgtggctaacttcgacc

SEQ ID NO: 326224 - DNA, 25 bp, Mus musculus
ggcatttgcgttctcaggatccaaa

SEQ ID NO: 326225 - DNA, 25 bp, Mus musculus
ggcatttgcgttctcgagcttcatg

SEQ ID NO: 326226 - DNA, 25 bp, Mus musculus
ggcatttgctgttctgtgattctta

SEQ ID NO: 326227 - DNA, 25 bp, Mus musculus
ggcatttggtgttcccttgccaaga

SEQ ID NO: 326228 - DNA, 25 bp, Mus musculus
ggcatttgtataagagagttctgga

SEQ ID NO: 326229 - DNA, 25 bp, Mus musculus
ggcatttgtataaggtactgggaag

SEQ ID NO: 326230 - DNA, 25 bp, Mus musculus
ggcatttgtgacaaagcccaatggc

SEQ ID NO: 326231 - DNA, 25 bp, Mus musculus
ggcattttcctgaagataggacggg

SEQ ID NO: 326232 - DNA, 25 bp, Mus musculus
ggccaaaaagagcttggacagagtg

SEQ ID NO: 326233 - DNA, 25 bp, Mus musculus
ggccaaaaagagtgtgcaaagaccc

SEQ ID NO: 326234 - DNA, 25 bp, Mus musculus
ggccaaaataaaggattcacagaaa

SEQ ID NO: 326235 - DNA, 25 bp, Mus musculus
ggccaaaatgatgaagaaaatactc

SEQ ID NO: 326236 - DNA, 25 bp, Mus musculus
ggccaaaatgatggatgcatcccta

SEQ ID NO: 326237 - DNA, 25 bp, Mus musculus
ggccaaaattagatcatagcagtct

SEQ ID NO: 326238 - DNA, 25 bp, Mus musculus
ggccaaaatttatgagaagatcttg

SEQ ID NO: 326239 - DNA, 25 bp, Mus musculus
ggccaaaatttcctctgtgaagctg

SEQ ID NO: 326240 - DNA, 25 bp, Mus musculus
ggccaaacaaaagccgaaatagaaa

SEQ ID NO: 326241 - DNA, 25 bp, Mus musculus
ggccaaacaaagagcacagtcagat

SEQ ID NO: 326242 - DNA, 25 bp, Mus musculus
ggccaaacaagttgtcaagttgctt

SEQ ID NO: 326243 - DNA, 25 bp, Mus musculus
ggccaaacagctcaggcctgcatgc

SEQ ID NO: 326244 - DNA, 25 bp, Mus musculus
ggccaaacccaaggaggcggatgag

SEQ ID NO: 326245 - DNA, 25 bp, Mus musculus
ggccaaaccccaagaatctcgagaa

SEQ ID NO: 326246 - DNA, 25 bp, Mus musculus
ggccaaaccccaaggagcggctgca

SEQ ID NO: 326247 - DNA, 25 bp, Mus musculus
ggccaaacgaaagctgggctctccc

SEQ ID NO: 326248 - DNA, 25 bp, Mus musculus
ggccaaactcaaggaccaggcagct

SEQ ID NO: 326249 - DNA, 25 bp, Mus musculus
ggccaaactcaagttttggcaagga

SEQ ID NO: 326250 - DNA, 25 bp, Mus musculus
ggccaaagaagattgcagagttcaa

SEQ ID NO: 326251 - DNA, 25 bp, Mus musculus
ggccaaagaccctatcgtcaacgtg

SEQ ID NO: 326252 - DNA, 25 bp, Mus musculus
ggccaaagacccttctggagaggtg

SEQ ID NO: 326253 - DNA, 25 bp, Mus musculus
ggccaaagcaaaaatgaggagtggg

SEQ ID NO: 326254 - DNA, 25 bp, Mus musculus
ggccaaagcacatgctccatttgct

SEQ ID NO: 326255 - DNA, 25 bp, Mus musculus
ggccaaagcctacagacacagaggc

SEQ ID NO: 326256 - DNA, 25 bp, Mus musculus
ggccaaaggctgcagatgcagccgg

SEQ ID NO: 326257 - DNA, 25 bp, Mus musculus
ggccaaaggctgcagctcttaaccg

SEQ ID NO: 326258 - DNA, 25 bp, Mus musculus
ggccaaagttatctccctaggcgat

SEQ ID NO: 326259 - DNA, 25 bp, Mus musculus
ggccaaatccttcgcgtctcagaat

SEQ ID NO: 326260 - DNA, 25 bp, Mus musculus
ggccaaattcactgctttctgtgag

SEQ ID NO: 326261 - DNA, 25 bp, Mus musculus
ggccaaattcactgtatataaaatc

SEQ ID NO: 326262 - DNA, 25 bp, Mus musculus
ggccaacaagagtcctcgttgaaaa

SEQ ID NO: 326263 - DNA, 25 bp, Mus musculus
ggccaacaagagtgatctgtcccct

SEQ ID NO: 326264 - DNA, 25 bp, Mus musculus
ggccaacaagcaggatggacgacag

SEQ ID NO: 326265 - DNA, 25 bp, Mus musculus
ggccaacaaggtacgcacgcggtcc

SEQ ID NO: 326266 - DNA, 25 bp, Mus musculus
ggccaacaaggtcgtatacaacgtg

SEQ ID NO: 326267 - DNA, 25 bp, Mus musculus
ggccaacaatcctactccaggtctg

SEQ ID NO: 326268 - DNA, 25 bp, Mus musculus
ggccaacacaaagatgggtgttacg

SEQ ID NO: 326269 - DNA, 25 bp, Mus musculus
ggccaacagctgaacctgaatctcc

SEQ ID NO: 326270 - DNA, 25 bp, Mus musculus
ggccaacatgtcaggggagctgaag

SEQ ID NO: 326271 - DNA, 25 bp, Mus musculus
ggccaaccagtctgcctaactctgt

SEQ ID NO: 326272 - DNA, 25 bp, Mus musculus
ggccaacccagatggcaagaagaag

SEQ ID NO: 326273 - DNA, 25 bp, Mus musculus
ggccaacgtcaagaagagtggtctt

SEQ ID NO: 326274 - DNA, 25 bp, Mus musculus
ggccaacgtcaagaaggagatccag

SEQ ID NO: 326275 - DNA, 25 bp, Mus musculus
ggccaactccgacgtgtggagagga

SEQ ID NO: 326276 - DNA, 25 bp, Mus musculus
ggccaactgctacaggaggaacccc

SEQ ID NO: 326277 - DNA, 25 bp, Mus musculus
ggccaagaaacgagagcttaaagaa

SEQ ID NO: 326278 - DNA, 25 bp, Mus musculus
ggccaagaaactaggactaactgaa

SEQ ID NO: 326279 - DNA, 25 bp, Mus musculus
ggccaagaagaacaaagctgtatgt

SEQ ID NO: 326280 - DNA, 25 bp, Mus musculus
ggccaagaagaactttcattttcag

SEQ ID NO: 326281 - DNA, 25 bp, Mus musculus
ggccaagaagacatccctgaagtca

SEQ ID NO: 326282 - DNA, 25 bp, Mus musculus
ggccaagaagatagatcctggatga

SEQ ID NO: 326283 - DNA, 25 bp, Mus musculus
ggccaagaaggggatgaggtgttga

SEQ ID NO: 326284 - DNA, 25 bp, Mus musculus
ggccaagaagggggatggaaatccc

SEQ ID NO: 326285 - DNA, 25 bp, Mus musculus
ggccaagaagttccaacctagatac

SEQ ID NO: 326286 - DNA, 25 bp, Mus musculus
ggccaagaagttccaagaccccaga

SEQ ID NO: 326287 - DNA, 25 bp, Mus musculus
ggccaagacatagctcattctggag

SEQ ID NO: 326288 - DNA, 25 bp, Mus musculus
ggccaagacatagtcttgccatgta

SEQ ID NO: 326289 - DNA, 25 bp, Mus musculus
ggccaagacattgagggtcactttt

SEQ ID NO: 326290 - DNA, 25 bp, Mus musculus
ggccaagagagcaaaggcttatttc

SEQ ID NO: 326291 - DNA, 25 bp, Mus musculus
ggccaagattagattgctttattca

SEQ ID NO: 326292 - DNA, 25 bp, Mus musculus
ggccaagcacacagttcctagtcac

SEQ ID NO: 326293 - DNA, 25 bp, Mus musculus
ggccaagcacgataaatacatggca

SEQ ID NO: 326294 - DNA, 25 bp, Mus musculus
ggccaagcacgtggacgagaaaaga

SEQ ID NO: 326295 - DNA, 25 bp, Mus musculus
ggccaagcagcagatgcatattgac

SEQ ID NO: 326296 - DNA, 25 bp, Mus musculus
ggccaagcaggcttgtgatgcctgg

SEQ ID NO: 326297 - DNA, 25 bp, Mus musculus
ggccaagcagggactggaatacgct

SEQ ID NO: 326298 - DNA, 25 bp, Mus musculus
ggccaagcaggggtttgatttcctc

SEQ ID NO: 326299 - DNA, 25 bp, Mus musculus
ggccaagcatcaggtgtggagggtg

SEQ ID NO: 326300 - DNA, 25 bp, Mus musculus
ggccaagccatgctggccaagacgg

SEQ ID NO: 326301 - DNA, 25 bp, Mus musculus
ggccaagcgctcaggctcagtttat

SEQ ID NO: 326302 - DNA, 25 bp, Mus musculus
ggccaagcgctcagtttagcgtgca

SEQ ID NO: 326303 - DNA, 25 bp, Mus musculus
ggccaagcgtgcatggttctgcagc

SEQ ID NO: 326304 - DNA, 25 bp, Mus musculus
ggccaagctatggtccttcccaaac

SEQ ID NO: 326305 - DNA, 25 bp, Mus musculus
ggccaagctatgtttttgaggacaa

SEQ ID NO: 326306 - DNA, 25 bp, Mus musculus
ggccaagctcaagcaggtgttgcag

SEQ ID NO: 326307 - DNA, 25 bp, Mus musculus
ggccaagctgaacatccagagtctg

SEQ ID NO: 326308 - DNA, 25 bp, Mus musculus
ggccaagctggccctgcttgtcaac

SEQ ID NO: 326309 - DNA, 25 bp, Mus musculus
ggccaagcttaagcaaagtgagaag

SEQ ID NO: 326310 - DNA, 25 bp, Mus musculus
ggccaagcttaagctatgtacttaa

SEQ ID NO: 326311 - DNA, 25 bp, Mus musculus
ggccaagcttaaggccttggaagat

SEQ ID NO: 326312 - DNA, 25 bp, Mus musculus
ggccaaggaaggcaccagacctgtt

SEQ ID NO: 326313 - DNA, 25 bp, Mus musculus
ggccaaggacgaggaacctagtaac

SEQ ID NO: 326314 - DNA, 25 bp, Mus musculus
ggccaaggagcccaggccggctcaa

SEQ ID NO: 326315 - DNA, 25 bp, Mus musculus
ggccaaggagggggctgagaaaata

SEQ ID NO: 326316 - DNA, 25 bp, Mus musculus
ggccaaggatccatctgcagttgca

SEQ ID NO: 326317 - DNA, 25 bp, Mus musculus
ggccaaggatgctgggaagtccgtg

SEQ ID NO: 326318 - DNA, 25 bp, Mus musculus
ggccaaggcaaggggatgaaagctt

SEQ ID NO: 326319 - DNA, 25 bp, Mus musculus
ggccaaggcgtgattaaggttgagg

SEQ ID NO: 326320 - DNA, 25 bp, Mus musculus
ggccaagggcacaagctcctgacga

SEQ ID NO: 326321 - DNA, 25 bp, Mus musculus
ggccaagggcacaagctgagcgggg

SEQ ID NO: 326322 - DNA, 25 bp, Mus musculus
ggccaagtacacagtgtgtgattca

SEQ ID NO: 326323 - DNA, 25 bp, Mus musculus
ggccaagtactgtgaggtgctgacc

SEQ ID NO: 326324 - DNA, 25 bp, Mus musculus
ggccaagtatctcagaaagacccaa

SEQ ID NO: 326325 - DNA, 25 bp, Mus musculus
ggccaagtatctcagattgaagacc

SEQ ID NO: 326326 - DNA, 25 bp, Mus musculus
ggccaagtctacaggtggtgtctac

SEQ ID NO: 326327 - DNA, 25 bp, Mus musculus
ggccaagtctcgggtggatgaaact

SEQ ID NO: 326328 - DNA, 25 bp, Mus musculus
ggccaagtctgtgaggctgggaccc

SEQ ID NO: 326329 - DNA, 25 bp, Mus musculus
ggccaagttcaaggacagcagcctg

SEQ ID NO: 326330 - DNA, 25 bp, Mus musculus
ggccaataagaagttgtgaagttat

SEQ ID NO: 326331 - DNA, 25 bp, Mus musculus
ggccaataaggatcgcctgaattct

SEQ ID NO: 326332 - DNA, 25 bp, Mus musculus
ggccaatcagggtccctgagttgga

SEQ ID NO: 326333 - DNA, 25 bp, Mus musculus
ggccaatgcgaacgacttcttcgcc

SEQ ID NO: 326334 - DNA, 25 bp, Mus musculus
ggccaatgtgggaagcaaagctgct

SEQ ID NO: 326335 - DNA, 25 bp, Mus musculus
ggccaattactgagcaaattgctgt

SEQ ID NO: 326336 - DNA, 25 bp, Mus musculus
ggccaattctggaccaccaaggcct

SEQ ID NO: 326337 - DNA, 25 bp, Mus musculus
ggccaattgttcctgtaccaggccc

SEQ ID NO: 326338 - DNA, 25 bp, Mus musculus
ggccacaaattatgtgagtgactgg

SEQ ID NO: 326339 - DNA, 25 bp, Mus musculus
ggccacaaccgcggaagaaaacggc

SEQ ID NO: 326340 - DNA, 25 bp, Mus musculus
ggccacacaggatcagaacttatct

SEQ ID NO: 326341 - DNA, 25 bp, Mus musculus
ggccacacatggaagcatggaatca

SEQ ID NO: 326342 - DNA, 25 bp, Mus musculus
ggccacacatggaaggaaaggactt

SEQ ID NO: 326343 - DNA, 25 bp, Mus musculus
ggccacaccaaggtgttcttcaagg

SEQ ID NO: 326344 - DNA, 25 bp, Mus musculus
ggccacacggctggatagccggtcc

SEQ ID NO: 326345 - DNA, 25 bp, Mus musculus
ggccacactcgctggagctggtgga

SEQ ID NO: 326346 - DNA, 25 bp, Mus musculus
ggccacactctctcaaattgcctat

SEQ ID NO: 326347 - DNA, 25 bp, Mus musculus
ggccacactgctatcatccagcagg

SEQ ID NO: 326348 - DNA, 25 bp, Mus musculus
ggccacactggtgctgtgacatgca

SEQ ID NO: 326349 - DNA, 25 bp, Mus musculus
ggccacagagacactggagctccca

SEQ ID NO: 326350 - DNA, 25 bp, Mus musculus
ggccacagatgctgaagctgacgta

SEQ ID NO: 326351 - DNA, 25 bp, Mus musculus
ggccacagcctgggtgcctatagca

SEQ ID NO: 326352 - DNA, 25 bp, Mus musculus
ggccacagctcggctcctgggcagc

SEQ ID NO: 326353 - DNA, 25 bp, Mus musculus
ggccacagctcggtcgtccagtcct

SEQ ID NO: 326354 - DNA, 25 bp, Mus musculus
ggccacagctgctaactctcttctg

SEQ ID NO: 326355 - DNA, 25 bp, Mus musculus
ggccacaggattaccaccatgttca

SEQ ID NO: 326356 - DNA, 25 bp, Mus musculus
ggccacagtcatggccttccctccg

SEQ ID NO: 326357 - DNA, 25 bp, Mus musculus
ggccacagttcgcagatacactttt

SEQ ID NO: 326358 - DNA, 25 bp, Mus musculus
ggccacagttcgcaggaggcagagt

SEQ ID NO: 326359 - DNA, 25 bp, Mus musculus
ggccacatgcagcagggtggaagcc

SEQ ID NO: 326360 - DNA, 25 bp, Mus musculus
ggccacattctgattcaaagaatac

SEQ ID NO: 326361 - DNA, 25 bp, Mus musculus
ggccacattctgtaccaaggaagag

SEQ ID NO: 326362 - DNA, 25 bp, Mus musculus
ggccacattgattttcctcgcatct

SEQ ID NO: 326363 - DNA, 25 bp, Mus musculus
ggccacattgccctgtcagcctcaa

SEQ ID NO: 326364 - DNA, 25 bp, Mus musculus
ggccaccaaagagagacctcctaag

SEQ ID NO: 326365 - DNA, 25 bp, Mus musculus
ggccaccaaccagattctcagccac

SEQ ID NO: 326366 - DNA, 25 bp, Mus musculus
ggccaccacagtgactcatctgccc

SEQ ID NO: 326367 - DNA, 25 bp, Mus musculus
ggccaccagaagattcagaatgtgt

SEQ ID NO: 326368 - DNA, 25 bp, Mus musculus
ggccaccagcaggccgaggaaagca

SEQ ID NO: 326369 - DNA, 25 bp, Mus musculus
ggccaccaggctattacaagccaga

SEQ ID NO: 326370 - DNA, 25 bp, Mus musculus
ggccaccatgccgatcaataagtcg

SEQ ID NO: 326371 - DNA, 25 bp, Mus musculus
ggccaccccgtgtcctatgcaccag

SEQ ID NO: 326372 - DNA, 25 bp, Mus musculus
ggccaccccttaaatgtaggtataa

SEQ ID NO: 326373 - DNA, 25 bp, Mus musculus
ggccaccccttcctgcaaggccatc

SEQ ID NO: 326374 - DNA, 25 bp, Mus musculus
ggccacccgagcaagatcaacgagg

SEQ ID NO: 326375 - DNA, 25 bp, Mus musculus
ggccacccggagccgttatcctagg

SEQ ID NO: 326376 - DNA, 25 bp, Mus musculus
ggccaccctaaaaggaagtgctgca

SEQ ID NO: 326377 - DNA, 25 bp, Mus musculus
ggccacccttgaaggtgaacaaggc

SEQ ID NO: 326378 - DNA, 25 bp, Mus musculus
ggccaccgccgcggcatggatgggc

SEQ ID NO: 326379 - DNA, 25 bp, Mus musculus
ggccaccgcgcaggcttgacatcta

SEQ ID NO: 326380 - DNA, 25 bp, Mus musculus
ggccaccgcttgaatctccccgagg

SEQ ID NO: 326381 - DNA, 25 bp, Mus musculus
ggccaccggacagcattcacaacga

SEQ ID NO: 326382 - DNA, 25 bp, Mus musculus
ggccaccggacagcccaacggtagc

SEQ ID NO: 326383 - DNA, 25 bp, Mus musculus
ggccaccggcaggggactttgtgca

SEQ ID NO: 326384 - DNA, 25 bp, Mus musculus
ggccacctactcccagatggccggg

SEQ ID NO: 326385 - DNA, 25 bp, Mus musculus
ggccacctacttgctggggcttcac

SEQ ID NO: 326386 - DNA, 25 bp, Mus musculus
ggccacctaggcctgcagctgagcc

SEQ ID NO: 326387 - DNA, 25 bp, Mus musculus
ggccacctaggcttcagtggggatg

SEQ ID NO: 326388 - DNA, 25 bp, Mus musculus
ggccacctccaagaatggtggcatc

SEQ ID NO: 326389 - DNA, 25 bp, Mus musculus
ggccacctccggggccaagatggga

SEQ ID NO: 326390 - DNA, 25 bp, Mus musculus
ggccacctcgggcaaggtggctgcc

SEQ ID NO: 326391 - DNA, 25 bp, Mus musculus
ggccacctctacaagtgacatcttg

SEQ ID NO: 326392 - DNA, 25 bp, Mus musculus
ggccacctctgcgatgctcaaaaca

SEQ ID NO: 326393 - DNA, 25 bp, Mus musculus
ggccacctcttctgtggttggagac

SEQ ID NO: 326394 - DNA, 25 bp, Mus musculus
ggccacctcttctgttggccgtgtt

SEQ ID NO: 326395 - DNA, 25 bp, Mus musculus
ggccacctttgaagactcggtgtgg

SEQ ID NO: 326396 - DNA, 25 bp, Mus musculus
ggccacctttgaggaaaccaggaaa

SEQ ID NO: 326397 - DNA, 25 bp, Mus musculus
ggccaccttttattctctcttgcct

SEQ ID NO: 326398 - DNA, 25 bp, Mus musculus
ggccacgcagactagcatttcagat

SEQ ID NO: 326399 - DNA, 25 bp, Mus musculus
ggccacgcatcctccacctgtccct

SEQ ID NO: 326400 - DNA, 25 bp, Mus musculus
ggccacgccagagtttctcaggaat

SEQ ID NO: 326401 - DNA, 25 bp, Mus musculus
ggccacgcgcctcagagtttgctat

SEQ ID NO: 326402 - DNA, 25 bp, Mus musculus
ggccacgcgcctcaggtagcacttt

SEQ ID NO: 326403 - DNA, 25 bp, Mus musculus
ggccacgctactcagggatgttccc

SEQ ID NO: 326404 - DNA, 25 bp, Mus musculus
ggccacgctgccataatgaagaaga

SEQ ID NO: 326405 - DNA, 25 bp, Mus musculus
ggccacggaatccagatggtgaact

SEQ ID NO: 326406 - DNA, 25 bp, Mus musculus
ggccacggaatccaggagtacaaga

SEQ ID NO: 326407 - DNA, 25 bp, Mus musculus
ggccacggaatccaggcacatggat

SEQ ID NO: 326408 - DNA, 25 bp, Mus musculus
ggccacggcagggttaacctctgct

SEQ ID NO: 326409 - DNA, 25 bp, Mus musculus
ggccacgggcgaggacctatatcca

SEQ ID NO: 326410 - DNA, 25 bp, Mus musculus
ggccacggggacaggcaagtacatt

SEQ ID NO: 326411 - DNA, 25 bp, Mus musculus
ggccacgtcaagactctggaagctg

SEQ ID NO: 326412 - DNA, 25 bp, Mus musculus
ggccacgtcaagatgtcacgtgacc

SEQ ID NO: 326413 - DNA, 25 bp, Mus musculus
ggccacgtgagagggtcgttgctcc

SEQ ID NO: 326414 - DNA, 25 bp, Mus musculus
ggccacgtgagaggttggtactaag

SEQ ID NO: 326415 - DNA, 25 bp, Mus musculus
ggccacgtgcaggaaacatccgagc

SEQ ID NO: 326416 - DNA, 25 bp, Mus musculus
ggccacgttgccgacttcctggtgg

SEQ ID NO: 326417 - DNA, 25 bp, Mus musculus
ggccacgttgccgagaacctgccag

SEQ ID NO: 326418 - DNA, 25 bp, Mus musculus
ggccacgttgccgattttgtcctgg

SEQ ID NO: 326419 - DNA, 25 bp, Mus musculus
ggccactaccgacatctagagcctg

SEQ ID NO: 326420 - DNA, 25 bp, Mus musculus
ggccactaccgcacggactcccgtg

SEQ ID NO: 326421 - DNA, 25 bp, Mus musculus
ggccactagtcggaggtgtatcgtt

SEQ ID NO: 326422 - DNA, 25 bp, Mus musculus
ggccactagtcggagttacagccgc

SEQ ID NO: 326423 - DNA, 25 bp, Mus musculus
ggccactcaacccaccctcagcctc

SEQ ID NO: 326424 - DNA, 25 bp, Mus musculus
ggccactcaaggttttgaggacttc

SEQ ID NO: 326425 - DNA, 25 bp, Mus musculus
ggccactcaggatcggaacgtcaat

SEQ ID NO: 326426 - DNA, 25 bp, Mus musculus
ggccactcattcagggagtgttgtg

SEQ ID NO: 326427 - DNA, 25 bp, Mus musculus
ggccactccctacaagtccctgagt

SEQ ID NO: 326428 - DNA, 25 bp, Mus musculus
ggccactccctaccgaggatgcttg

SEQ ID NO: 326429 - DNA, 25 bp, Mus musculus
ggccactgaccgagaagtgcccccg

SEQ ID NO: 326430 - DNA, 25 bp, Mus musculus
ggccactgagctcaccctcgttctt

SEQ ID NO: 326431 - DNA, 25 bp, Mus musculus
ggccactgaggacccctataataca

SEQ ID NO: 326432 - DNA, 25 bp, Mus musculus
ggccactgagtcttctggccgaact

SEQ ID NO: 326433 - DNA, 25 bp, Mus musculus
ggccactgatagtgcctttgatgtg

SEQ ID NO: 326434 - DNA, 25 bp, Mus musculus
ggccactgctccagggatccagaag

SEQ ID NO: 326435 - DNA, 25 bp, Mus musculus
ggccactgcttggcctgtccactgg

SEQ ID NO: 326436 - DNA, 25 bp, Mus musculus
ggccactggtcaaggcaactattgg

SEQ ID NO: 326437 - DNA, 25 bp, Mus musculus
ggccactgtcacggtctgtctgaca

SEQ ID NO: 326438 - DNA, 25 bp, Mus musculus
ggccactgtggcctcctgagtgaaa

SEQ ID NO: 326439 - DNA, 25 bp, Mus musculus
ggccactgtggtctctgtgatgagc

SEQ ID NO: 326440 - DNA, 25 bp, Mus musculus
ggccacttgcaggagttcgaggagg

SEQ ID NO: 326441 - DNA, 25 bp, Mus musculus
ggccacttgcaggctgtggggtcgt

SEQ ID NO: 326442 - DNA, 25 bp, Mus musculus
ggccagaaacagatctggagaattg

SEQ ID NO: 326443 - DNA, 25 bp, Mus musculus
ggccagaaagtactggatccactgg

SEQ ID NO: 326444 - DNA, 25 bp, Mus musculus
ggccagaaatcacaaacttcgtgtg

SEQ ID NO: 326445 - DNA, 25 bp, Mus musculus
ggccagaagaagagtcgaaaggaca

SEQ ID NO: 326446 - DNA, 25 bp, Mus musculus
ggccagaagaattgtgtctggaatt

SEQ ID NO: 326447 - DNA, 25 bp, Mus musculus
ggccagacacccagaggctggtcca

SEQ ID NO: 326448 - DNA, 25 bp, Mus musculus
ggccagacactacagggctcccagt

SEQ ID NO: 326449 - DNA, 25 bp, Mus musculus
ggccagacactacaggtaacaggat

SEQ ID NO: 326450 - DNA, 25 bp, Mus musculus
ggccagacagaaacgggacttatct

SEQ ID NO: 326451 - DNA, 25 bp, Mus musculus
ggccagacagacaggcttttgaggc

SEQ ID NO: 326452 - DNA, 25 bp, Mus musculus
ggccagacagacgggtccacctcag

SEQ ID NO: 326453 - DNA, 25 bp, Mus musculus
ggccagacagctgagaaggtagagg

SEQ ID NO: 326454 - DNA, 25 bp, Mus musculus
ggccagacccggcatcaggaagatg

SEQ ID NO: 326455 - DNA, 25 bp, Mus musculus
ggccagacctcgggacagattgtga

SEQ ID NO: 326456 - DNA, 25 bp, Mus musculus
ggccagactacctgaagaaacagca

SEQ ID NO: 326457 - DNA, 25 bp, Mus musculus
ggccagactacctgactctttgaga

SEQ ID NO: 326458 - DNA, 25 bp, Mus musculus
ggccagactcagacacaacaacaga

SEQ ID NO: 326459 - DNA, 25 bp, Mus musculus
ggccagactcaggtatctgctatag

SEQ ID NO: 326460 - DNA, 25 bp, Mus musculus
ggccagagaaggtgcttgacatcct

SEQ ID NO: 326461 - DNA, 25 bp, Mus musculus
ggccagagaagtctttctgtcttgt

SEQ ID NO: 326462 - DNA, 25 bp, Mus musculus
ggccagagacacaggaacctgagga

SEQ ID NO: 326463 - DNA, 25 bp, Mus musculus
ggccagagaggccggggcccgccgc

SEQ ID NO: 326464 - DNA, 25 bp, Mus musculus
ggccagagatacccaggggccatac

SEQ ID NO: 326465 - DNA, 25 bp, Mus musculus
ggccagagatagccgactgcagatg

SEQ ID NO: 326466 - DNA, 25 bp, Mus musculus
ggccagagatagccgggcatcagca

SEQ ID NO: 326467 - DNA, 25 bp, Mus musculus
ggccagagcacagaggcgccgagcg

SEQ ID NO: 326468 - DNA, 25 bp, Mus musculus
ggccagagcagagaggaggtggacc

SEQ ID NO: 326469 - DNA, 25 bp, Mus musculus
ggccagagcagatgaagtgagagac

SEQ ID NO: 326470 - DNA, 25 bp, Mus musculus
ggccagagcagcagggccctgttct

SEQ ID NO: 326471 - DNA, 25 bp, Mus musculus
ggccagagcaggctccttaggctta

SEQ ID NO: 326472 - DNA, 25 bp, Mus musculus
ggccagagcttctcggtgtggatca

SEQ ID NO: 326473 - DNA, 25 bp, Mus musculus
ggccagagtcatggatttgatagac

SEQ ID NO: 326474 - DNA, 25 bp, Mus musculus
ggccagatctaggcagtgcacagcc

SEQ ID NO: 326475 - DNA, 25 bp, Mus musculus
ggccagatctagtgctcacatggtc

SEQ ID NO: 326476 - DNA, 25 bp, Mus musculus
ggccagatgagctcctcttgcggct

SEQ ID NO: 326477 - DNA, 25 bp, Mus musculus
ggccagatgcctgggccgatgatgc

SEQ ID NO: 326478 - DNA, 25 bp, Mus musculus
ggccagatgcctgggcctaaccata

SEQ ID NO: 326479 - DNA, 25 bp, Mus musculus
ggccagatgtgaaagatgcaggtga

SEQ ID NO: 326480 - DNA, 25 bp, Mus musculus
ggccagatgtgaaaggtgatgaaag

SEQ ID NO: 326481 - DNA, 25 bp, Mus musculus
ggccagcaaatagatcagagccact

SEQ ID NO: 326482 - DNA, 25 bp, Mus musculus
ggccagcaaatagttccagggtcac

SEQ ID NO: 326483 - DNA, 25 bp, Mus musculus
ggccagcaacacaacaacatttttt

SEQ ID NO: 326484 - DNA, 25 bp, Mus musculus
ggccagcaagatgatgactctgctg

SEQ ID NO: 326485 - DNA, 25 bp, Mus musculus
ggccagcacccggctacctgaggac

SEQ ID NO: 326486 - DNA, 25 bp, Mus musculus
ggccagcacccgggctgtggctgta

SEQ ID NO: 326487 - DNA, 25 bp, Mus musculus
ggccagcacgcaatcagcggagtgg

SEQ ID NO: 326488 - DNA, 25 bp, Mus musculus
ggccagcagcagaatcggaagactc

SEQ ID NO: 326489 - DNA, 25 bp, Mus musculus
ggccagcagccagaatgaaggcttg

SEQ ID NO: 326490 - DNA, 25 bp, Mus musculus
ggccagcagccagatgaaggtctga

SEQ ID NO: 326491 - DNA, 25 bp, Mus musculus
ggccagcaggctccagcccactcct

SEQ ID NO: 326492 - DNA, 25 bp, Mus musculus
ggccagcaggtgcttgtgtgtaacc

SEQ ID NO: 326493 - DNA, 25 bp, Mus musculus
ggccagcattgagattgaccagaag

SEQ ID NO: 326494 - DNA, 25 bp, Mus musculus
ggccagccacctattgacccaagga

SEQ ID NO: 326495 - DNA, 25 bp, Mus musculus
ggccagccagataagtacggtttct

SEQ ID NO: 326496 - DNA, 25 bp, Mus musculus
ggccagccaggcctgcagcatcaat

SEQ ID NO: 326497 - DNA, 25 bp, Mus musculus
ggccagccatagctcttggatgcga

SEQ ID NO: 326498 - DNA, 25 bp, Mus musculus
ggccagcccagggcaaacgctacaa

SEQ ID NO: 326499 - DNA, 25 bp, Mus musculus
ggccagcccaggggcacctacccgc

SEQ ID NO: 326500 - DNA, 25 bp, Mus musculus
ggccagccctgctctcggagactgg

SEQ ID NO: 326501 - DNA, 25 bp, Mus musculus
ggccagcctggcacggatgcttgca

SEQ ID NO: 326502 - DNA, 25 bp, Mus musculus
ggccagcctggtctccgttatgact

SEQ ID NO: 326503 - DNA, 25 bp, Mus musculus
ggccagcggcaagatgtcattgatc

SEQ ID NO: 326504 - DNA, 25 bp, Mus musculus
ggccagcggcaaggtgcgccgtcat

SEQ ID NO: 326505 - DNA, 25 bp, Mus musculus
ggccagcgggagaccgggtcccagc

SEQ ID NO: 326506 - DNA, 25 bp, Mus musculus
ggccagcggggacaatcccagaaca

SEQ ID NO: 326507 - DNA, 25 bp, Mus musculus
ggccagcgggttcccgaggagatcc

SEQ ID NO: 326508 - DNA, 25 bp, Mus musculus
ggccagctcaggagcgccccaccca

SEQ ID NO: 326509 - DNA, 25 bp, Mus musculus
ggccagctccaggtcacaggatgct

SEQ ID NO: 326510 - DNA, 25 bp, Mus musculus
ggccagctcgcaagcaggctgacag

SEQ ID NO: 326511 - DNA, 25 bp, Mus musculus
ggccagctcgcttgaagctcctgac

SEQ ID NO: 326512 - DNA, 25 bp, Mus musculus
ggccagctgaaggctctgtgggtga

SEQ ID NO: 326513 - DNA, 25 bp, Mus musculus
ggccagctgagcaattgtgttcgga

SEQ ID NO: 326514 - DNA, 25 bp, Mus musculus
ggccagctgatcgctggtgttcgac

SEQ ID NO: 326515 - DNA, 25 bp, Mus musculus
ggccagctgcagacgaagcttcttc

SEQ ID NO: 326516 - DNA, 25 bp, Mus musculus
ggccagctgcagagaatgttgctga

SEQ ID NO: 326517 - DNA, 25 bp, Mus musculus
ggccagctgcagagcgaagtcaccc

SEQ ID NO: 326518 - DNA, 25 bp, Mus musculus
ggccagctgcagctgctgataaaga

SEQ ID NO: 326519 - DNA, 25 bp, Mus musculus
ggccagcttgctgccacagctgcca

SEQ ID NO: 326520 - DNA, 25 bp, Mus musculus
ggccagcttgcttgaaactttggga

SEQ ID NO: 326521 - DNA, 25 bp, Mus musculus
ggccagcttgcttggctgaagccaa

SEQ ID NO: 326522 - DNA, 25 bp, Mus musculus
ggccagctttggaatctctgttgga

SEQ ID NO: 326523 - DNA, 25 bp, Mus musculus
ggccagctttggcactttctaggta

SEQ ID NO: 326524 - DNA, 25 bp, Mus musculus
ggccagctttggggggctggctgtg

SEQ ID NO: 326525 - DNA, 25 bp, Mus musculus
ggccaggaaaagaaggtgggcgact

SEQ ID NO: 326526 - DNA, 25 bp, Mus musculus
ggccaggaaaagaagttctgggagt

SEQ ID NO: 326527 - DNA, 25 bp, Mus musculus
ggccaggaacggagggcatggctgc

SEQ ID NO: 326528 - DNA, 25 bp, Mus musculus
ggccaggaacggagttatggcattc

SEQ ID NO: 326529 - DNA, 25 bp, Mus musculus
ggccaggaaggggagccaggccgtc

SEQ ID NO: 326530 - DNA, 25 bp, Mus musculus
ggccaggaatggacatttggtcagc

SEQ ID NO: 326531 - DNA, 25 bp, Mus musculus
ggccaggacaccagctgaggagggc

SEQ ID NO: 326532 - DNA, 25 bp, Mus musculus
ggccaggacctgtgtgctcccacac

SEQ ID NO: 326533 - DNA, 25 bp, Mus musculus
ggccaggacgacggcccttcaaatt

SEQ ID NO: 326534 - DNA, 25 bp, Mus musculus
ggccaggacggaataggaaccaaga

SEQ ID NO: 326535 - DNA, 25 bp, Mus musculus
ggccaggacgtggctccttccagcc

SEQ ID NO: 326536 - DNA, 25 bp, Mus musculus
ggccaggagagaggggagaaagggg

SEQ ID NO: 326537 - DNA, 25 bp, Mus musculus
ggccaggaggaagaaaattatgatc

SEQ ID NO: 326538 - DNA, 25 bp, Mus musculus
ggccaggaggaggacccaggtcaag

SEQ ID NO: 326539 - DNA, 25 bp, Mus musculus
ggccaggagggctcgctcgaagagc

SEQ ID NO: 326540 - DNA, 25 bp, Mus musculus
ggccaggagtgagaagacataattc

SEQ ID NO: 326541 - DNA, 25 bp, Mus musculus
ggccaggatcgaaagccagcctgct

SEQ ID NO: 326542 - DNA, 25 bp, Mus musculus
ggccaggcaaggcgggcatctcctc

SEQ ID NO: 326543 - DNA, 25 bp, Mus musculus
ggccaggcaaggcgttcacagacga

SEQ ID NO: 326544 - DNA, 25 bp, Mus musculus
ggccaggccactcaggatcggaacg

SEQ ID NO: 326545 - DNA, 25 bp, Mus musculus
ggccaggccatgccatgggttctct

SEQ ID NO: 326546 - DNA, 25 bp, Mus musculus
ggccaggcctagccaggtgtagaag

SEQ ID NO: 326547 - DNA, 25 bp, Mus musculus
ggccaggcgctagagctagtctacc

SEQ ID NO: 326548 - DNA, 25 bp, Mus musculus
ggccaggcgctagaggtgacccttc

SEQ ID NO: 326549 - DNA, 25 bp, Mus musculus
ggccaggcggaaaaagtggataatt

SEQ ID NO: 326550 - DNA, 25 bp, Mus musculus
ggccaggcggaaggtgatgttcgtc

SEQ ID NO: 326551 - DNA, 25 bp, Mus musculus
ggccaggcttaacagagccatcgtg

SEQ ID NO: 326552 - DNA, 25 bp, Mus musculus
ggccaggcttgtagaaaatgatgta

SEQ ID NO: 326553 - DNA, 25 bp, Mus musculus
ggccagggaagagagagagagagag

SEQ ID NO: 326554 - DNA, 25 bp, Mus musculus
ggccagggacgcgcggtgagcccca

SEQ ID NO: 326555 - DNA, 25 bp, Mus musculus
ggccagggagacaaggcggactatt

SEQ ID NO: 326556 - DNA, 25 bp, Mus musculus
ggccagggaggatggctgatcatat

SEQ ID NO: 326557 - DNA, 25 bp, Mus musculus
ggccagggaggatgggaaaacctgg

SEQ ID NO: 326558 - DNA, 25 bp, Mus musculus
ggccagggatctctctctccacccc

SEQ ID NO: 326559 - DNA, 25 bp, Mus musculus
ggccagggatctgatgcgggctcct

SEQ ID NO: 326560 - DNA, 25 bp, Mus musculus
ggccagggccattgtgacttcttcg

SEQ ID NO: 326561 - DNA, 25 bp, Mus musculus
ggccagggctcaggagctccttcct

SEQ ID NO: 326562 - DNA, 25 bp, Mus musculus
ggccagggctgaggcttgttccccc

SEQ ID NO: 326563 - DNA, 25 bp, Mus musculus
ggccaggggttgaagacgttgatgt

SEQ ID NO: 326564 - DNA, 25 bp, Mus musculus
ggccaggtaaagcctgccgggagtg

SEQ ID NO: 326565 - DNA, 25 bp, Mus musculus
ggccaggtacctgggagcccgaacc

SEQ ID NO: 326566 - DNA, 25 bp, Mus musculus
ggccaggtattgagacaatgatggt

SEQ ID NO: 326567 - DNA, 25 bp, Mus musculus
ggccaggtccagaacggaggttcca

SEQ ID NO: 326568 - DNA, 25 bp, Mus musculus
ggccaggtccagctggacccccaaa

SEQ ID NO: 326569 - DNA, 25 bp, Mus musculus
ggccaggtgagaaatgtctcaggct

SEQ ID NO: 326570 - DNA, 25 bp, Mus musculus
ggccaggtgaggctccatcaaggtg

SEQ ID NO: 326571 - DNA, 25 bp, Mus musculus
ggccaggtgccccagataagccaaa

SEQ ID NO: 326572 - DNA, 25 bp, Mus musculus
ggccagtaaggcccgaatggctggt

SEQ ID NO: 326573 - DNA, 25 bp, Mus musculus
ggccagtacccaggtctgtgaactc

SEQ ID NO: 326574 - DNA, 25 bp, Mus musculus
ggccagtatggagacacggactatt

SEQ ID NO: 326575 - DNA, 25 bp, Mus musculus
ggccagtatggagatcctcaccacg

SEQ ID NO: 326576 - DNA, 25 bp, Mus musculus
ggccagtcaagatagccagccctgg

SEQ ID NO: 326577 - DNA, 25 bp, Mus musculus
ggccagtcagaatacagtttggtca

SEQ ID NO: 326578 - DNA, 25 bp, Mus musculus
ggccagtcctacagtgtctacagct

SEQ ID NO: 326579 - DNA, 25 bp, Mus musculus
ggccagtcctagaggccgggataac

SEQ ID NO: 326580 - DNA, 25 bp, Mus musculus
ggccagtcctgtggtagaagaaaga

SEQ ID NO: 326581 - DNA, 25 bp, Mus musculus
ggccagtctcagatgatacaactct

SEQ ID NO: 326582 - DNA, 25 bp, Mus musculus
ggccagtctcagattgttatagatg

SEQ ID NO: 326583 - DNA, 25 bp, Mus musculus
ggccagtgaaccggttccacttgaa

SEQ ID NO: 326584 - DNA, 25 bp, Mus musculus
ggccagtgatcttctagagtggatt

SEQ ID NO: 326585 - DNA, 25 bp, Mus musculus
ggccagtgatgagatgccatccacc

SEQ ID NO: 326586 - DNA, 25 bp, Mus musculus
ggccagtgcacaagtgcacttaatg

SEQ ID NO: 326587 - DNA, 25 bp, Mus musculus
ggccagtgttcacactacctttctg

SEQ ID NO: 326588 - DNA, 25 bp, Mus musculus
ggccagttcagcttccaaaggcctt

SEQ ID NO: 326589 - DNA, 25 bp, Mus musculus
ggccagttcaggatttccacttaaa

SEQ ID NO: 326590 - DNA, 25 bp, Mus musculus
ggccagttcctgagggcagtggctc

SEQ ID NO: 326591 - DNA, 25 bp, Mus musculus
ggccagttgggctgtgactcgaggc

SEQ ID NO: 326592 - DNA, 25 bp, Mus musculus
ggccagttggggtgctgtggacagg

SEQ ID NO: 326593 - DNA, 25 bp, Mus musculus
ggccataaagactcactccgaagcc

SEQ ID NO: 326594 - DNA, 25 bp, Mus musculus
ggccataaaggcttctggggatggg

SEQ ID NO: 326595 - DNA, 25 bp, Mus musculus
ggccatacagctggtaaacaccaga

SEQ ID NO: 326596 - DNA, 25 bp, Mus musculus
ggccatacaggtcctgtccagagtg

SEQ ID NO: 326597 - DNA, 25 bp, Mus musculus
ggccatacatagggaaaggcaggag

SEQ ID NO: 326598 - DNA, 25 bp, Mus musculus
ggccataccctgttgtggcctcttc

SEQ ID NO: 326599 - DNA, 25 bp, Mus musculus
ggccatactatctatgcaaaagtag

SEQ ID NO: 326600 - DNA, 25 bp, Mus musculus
ggccatatatgcagagatgagccgc

SEQ ID NO: 326601 - DNA, 25 bp, Mus musculus
ggccatatcatctcagatggaggct

SEQ ID NO: 326602 - DNA, 25 bp, Mus musculus
ggccatatgcagcagatttttatca

SEQ ID NO: 326603 - DNA, 25 bp, Mus musculus
ggccatatgcagcaggggggagcac

SEQ ID NO: 326604 - DNA, 25 bp, Mus musculus
ggccatattcaggcaaatgctgaac

SEQ ID NO: 326605 - DNA, 25 bp, Mus musculus
ggccatcaagaatgactctgtggtg

SEQ ID NO: 326606 - DNA, 25 bp, Mus musculus
ggccatcaagacctctcacagccca

SEQ ID NO: 326607 - DNA, 25 bp, Mus musculus
ggccatcaatgttggccccacgggt

SEQ ID NO: 326608 - DNA, 25 bp, Mus musculus
ggccatcaatgttggtggtggcttc

SEQ ID NO: 326609 - DNA, 25 bp, Mus musculus
ggccatcacagatgccgcaatgatg

SEQ ID NO: 326610 - DNA, 25 bp, Mus musculus
ggccatcaccagggtgtttccacag

SEQ ID NO: 326611 - DNA, 25 bp, Mus musculus
ggccatcactgacaaaagaaagata

SEQ ID NO: 326612 - DNA, 25 bp, Mus musculus
ggccatcactgatgtgtccttccgg

SEQ ID NO: 326613 - DNA, 25 bp, Mus musculus
ggccatcactgcttcaccacgacca

SEQ ID NO: 326614 - DNA, 25 bp, Mus musculus
ggccatcagacactggtgaggagca

SEQ ID NO: 326615 - DNA, 25 bp, Mus musculus
ggccatcagtcctctacgaatgtcc

SEQ ID NO: 326616 - DNA, 25 bp, Mus musculus
ggccatcataggtacccaggatatt

SEQ ID NO: 326617 - DNA, 25 bp, Mus musculus
ggccatcatcagctgcagttaaagc

SEQ ID NO: 326618 - DNA, 25 bp, Mus musculus
ggccatccagaagcctccccagctt

SEQ ID NO: 326619 - DNA, 25 bp, Mus musculus
ggccatcccagccaatggcagcccc

SEQ ID NO: 326620 - DNA, 25 bp, Mus musculus
ggccatcccagccaccctgggcgga

SEQ ID NO: 326621 - DNA, 25 bp, Mus musculus
ggccatccctgctgtgggcctccct

SEQ ID NO: 326622 - DNA, 25 bp, Mus musculus
ggccatccgagcagtggcaaagcaa

SEQ ID NO: 326623 - DNA, 25 bp, Mus musculus
ggccatcctcaggtgagactttcaa

SEQ ID NO: 326624 - DNA, 25 bp, Mus musculus
ggccatcctcaggtgtgtggtagaa

SEQ ID NO: 326625 - DNA, 25 bp, Mus musculus
ggccatcctgggttgctcttctggt

SEQ ID NO: 326626 - DNA, 25 bp, Mus musculus
ggccatcgaaagaacttgtcaatgt

SEQ ID NO: 326627 - DNA, 25 bp, Mus musculus
ggccatcggacctgatttcaagtcc

SEQ ID NO: 326628 - DNA, 25 bp, Mus musculus
ggccatcggacctgctatctgatgt

SEQ ID NO: 326629 - DNA, 25 bp, Mus musculus
ggccatctcagctgtggtcctctaa

SEQ ID NO: 326630 - DNA, 25 bp, Mus musculus
ggccatctcaggtgagttggagtga

SEQ ID NO: 326631 - DNA, 25 bp, Mus musculus
ggccatctcaggtgttcctgtataa

SEQ ID NO: 326632 - DNA, 25 bp, Mus musculus
ggccatctcaggttgtactttctcc

SEQ ID NO: 326633 - DNA, 25 bp, Mus musculus
ggccatctgccggctctgggggacc

SEQ ID NO: 326634 - DNA, 25 bp, Mus musculus
ggccatctgccgggaaggaagcaca

SEQ ID NO: 326635 - DNA, 25 bp, Mus musculus
ggccatctgtgggagtatgtcatgg

SEQ ID NO: 326636 - DNA, 25 bp, Mus musculus
ggccatcttgtggggatctacttca

SEQ ID NO: 326637 - DNA, 25 bp, Mus musculus
ggccatcttgtgggggtcttctggg

SEQ ID NO: 326638 - DNA, 25 bp, Mus musculus
ggccatgaaaggaccccgagaggag

SEQ ID NO: 326639 - DNA, 25 bp, Mus musculus
ggccatgaaaggcgttaagcatctg

SEQ ID NO: 326640 - DNA, 25 bp, Mus musculus
ggccatgaagaacaattgccagcca

SEQ ID NO: 326641 - DNA, 25 bp, Mus musculus
ggccatgaagaacgtgaccgagctg

SEQ ID NO: 326642 - DNA, 25 bp, Mus musculus
ggccatgaagaacttccacaggaga

SEQ ID NO: 326643 - DNA, 25 bp, Mus musculus
ggccatgaagcacgagaacgaggcc

SEQ ID NO: 326644 - DNA, 25 bp, Mus musculus
ggccatgaagcatgtctgctgtgac

SEQ ID NO: 326645 - DNA, 25 bp, Mus musculus
ggccatgaaggcgggtgctacttct

SEQ ID NO: 326646 - DNA, 25 bp, Mus musculus
ggccatgaagtgggctttgttatcc

SEQ ID NO: 326647 - DNA, 25 bp, Mus musculus
ggccatgaccaaggacaaacagaag

SEQ ID NO: 326648 - DNA, 25 bp, Mus musculus
ggccatgaccggatttaattggtga

SEQ ID NO: 326649 - DNA, 25 bp, Mus musculus
ggccatgaccggcttccttcaataa

SEQ ID NO: 326650 - DNA, 25 bp, Mus musculus
ggccatgagagagatcccatggttt

SEQ ID NO: 326651 - DNA, 25 bp, Mus musculus
ggccatgagagaggactgcctccag

SEQ ID NO: 326652 - DNA, 25 bp, Mus musculus
ggccatgagagaggtatatgctatg

SEQ ID NO: 326653 - DNA, 25 bp, Mus musculus
ggccatgagcataccaacatttttt

SEQ ID NO: 326654 - DNA, 25 bp, Mus musculus
ggccatgagcatccagaggttgtca

SEQ ID NO: 326655 - DNA, 25 bp, Mus musculus
ggccatgagcgtaatctgcagaatg

SEQ ID NO: 326656 - DNA, 25 bp, Mus musculus
ggccatgatccagagtcaggtgtgg

SEQ ID NO: 326657 - DNA, 25 bp, Mus musculus
ggccatgatgagtacctataccaga

SEQ ID NO: 326658 - DNA, 25 bp, Mus musculus
ggccatgatggctgaccatgatgtg

SEQ ID NO: 326659 - DNA, 25 bp, Mus musculus
ggccatgatttatgggctcattgtt

SEQ ID NO: 326660 - DNA, 25 bp, Mus musculus
ggccatgatttatgtttgagattgc

SEQ ID NO: 326661 - DNA, 25 bp, Mus musculus
ggccatgcaaactcgccctgggcag

SEQ ID NO: 326662 - DNA, 25 bp, Mus musculus
ggccatgcaggatgccagccccgcc

SEQ ID NO: 326663 - DNA, 25 bp, Mus musculus
ggccatggaacaggaggaagtgaac

SEQ ID NO: 326664 - DNA, 25 bp, Mus musculus
ggccatggagctctttctacctcca

SEQ ID NO: 326665 - DNA, 25 bp, Mus musculus
ggccatggagttaagcacggaaata

SEQ ID NO: 326666 - DNA, 25 bp, Mus musculus
ggccatggagttaagtggctaaaag

SEQ ID NO: 326667 - DNA, 25 bp, Mus musculus
ggccatggatggcggggatctgatg

SEQ ID NO: 326668 - DNA, 25 bp, Mus musculus
ggccatggatggtgttgttacagat

SEQ ID NO: 326669 - DNA, 25 bp, Mus musculus
ggccatggatgttggcaaggcccga

SEQ ID NO: 326670 - DNA, 25 bp, Mus musculus
ggccatggcggggcccctaacggct

SEQ ID NO: 326671 - DNA, 25 bp, Mus musculus
ggccatggctcgcaggtttgcctgc

SEQ ID NO: 326672 - DNA, 25 bp, Mus musculus
ggccatggctgagactctgaagact

SEQ ID NO: 326673 - DNA, 25 bp, Mus musculus
ggccatgggctgaactacgctgcca

SEQ ID NO: 326674 - DNA, 25 bp, Mus musculus
ggccatggggcaggcagtgacgcgc

SEQ ID NO: 326675 - DNA, 25 bp, Mus musculus
ggccatgtaagcagctgtccggcag

SEQ ID NO: 326676 - DNA, 25 bp, Mus musculus
ggccatgtacccagaggatcattac

SEQ ID NO: 326677 - DNA, 25 bp, Mus musculus
ggccatgtacccccatgcccggtta

SEQ ID NO: 326678 - DNA, 25 bp, Mus musculus
ggccatgtacccgcacgtgacacaa

SEQ ID NO: 326679 - DNA, 25 bp, Mus musculus
ggccatgtattccccgtgaatccct

SEQ ID NO: 326680 - DNA, 25 bp, Mus musculus
ggccatgtcactcacccccaattcc

SEQ ID NO: 326681 - DNA, 25 bp, Mus musculus
ggccatgtggactggcaggctgtgg

SEQ ID NO: 326682 - DNA, 25 bp, Mus musculus
ggccatgtgtttgagatcctgtcaa

SEQ ID NO: 326683 - DNA, 25 bp, Mus musculus
ggccatgttactgcacgaccacagg

SEQ ID NO: 326684 - DNA, 25 bp, Mus musculus
ggccatgttactggagtgccgatgg

SEQ ID NO: 326685 - DNA, 25 bp, Mus musculus
ggccatgttcctagagtacaacaaa

SEQ ID NO: 326686 - DNA, 25 bp, Mus musculus
ggccatgttgcagaggttctcagga

SEQ ID NO: 326687 - DNA, 25 bp, Mus musculus
ggccattaacaaggaccctgcagtg

SEQ ID NO: 326688 - DNA, 25 bp, Mus musculus
ggccattaacaaggagacgactgca

SEQ ID NO: 326689 - DNA, 25 bp, Mus musculus
ggccattcacacaggccgatacaaa

SEQ ID NO: 326690 - DNA, 25 bp, Mus musculus
ggccattcacaggcatcctacatca

SEQ ID NO: 326691 - DNA, 25 bp, Mus musculus
ggccattcatctctggtcttgacga

SEQ ID NO: 326692 - DNA, 25 bp, Mus musculus
ggccattctgcttagcctgctgagg

SEQ ID NO: 326693 - DNA, 25 bp, Mus musculus
ggccattctgcttagtgcctgcacg

SEQ ID NO: 326694 - DNA, 25 bp, Mus musculus
ggccattgaggtgaggcacagagtt

SEQ ID NO: 326695 - DNA, 25 bp, Mus musculus
ggccattgccaagaagaacgctgtg

SEQ ID NO: 326696 - DNA, 25 bp, Mus musculus
ggccattgccagagatccttgtgtg

SEQ ID NO: 326697 - DNA, 25 bp, Mus musculus
ggccattggaggagtctgcggtgtt

SEQ ID NO: 326698 - DNA, 25 bp, Mus musculus
ggccattggcaggttgtccgattgc

SEQ ID NO: 326699 - DNA, 25 bp, Mus musculus
ggccattggtgagtatggcccaccc

SEQ ID NO: 326700 - DNA, 25 bp, Mus musculus
ggccattgtggaaagcccccctaca

SEQ ID NO: 326701 - DNA, 25 bp, Mus musculus
ggccattgttactgttacagatttg

SEQ ID NO: 326702 - DNA, 25 bp, Mus musculus
ggccatttcaggtttggtatgcctc

SEQ ID NO: 326703 - DNA, 25 bp, Mus musculus
ggccatttccaagcgcctgagaaga

SEQ ID NO: 326704 - DNA, 25 bp, Mus musculus
ggcccaaagaagacacccatataat

SEQ ID NO: 326705 - DNA, 25 bp, Mus musculus
ggcccaaagagatgaagttggcgct

SEQ ID NO: 326706 - DNA, 25 bp, Mus musculus
ggcccaacagagagggcccccagca

SEQ ID NO: 326707 - DNA, 25 bp, Mus musculus
ggcccaacccagtgacaatgcccct

SEQ ID NO: 326708 - DNA, 25 bp, Mus musculus
ggcccaagaaaaaggtgcgcatggt

SEQ ID NO: 326709 - DNA, 25 bp, Mus musculus
ggcccaagacacagataagccagga

SEQ ID NO: 326710 - DNA, 25 bp, Mus musculus
ggcccaagacatccaggccagccac

SEQ ID NO: 326711 - DNA, 25 bp, Mus musculus
ggcccaagaggaagaagtccaggag

SEQ ID NO: 326712 - DNA, 25 bp, Mus musculus
ggcccaagaggaagaggaagtccaa

SEQ ID NO: 326713 - DNA, 25 bp, Mus musculus
ggcccaagaggcattatcgacctgt

SEQ ID NO: 326714 - DNA, 25 bp, Mus musculus
ggcccaagaggcctcaaagagctac

SEQ ID NO: 326715 - DNA, 25 bp, Mus musculus
ggcccaagaggcctcgtggagccgg

SEQ ID NO: 326716 - DNA, 25 bp, Mus musculus
ggcccaagttgagttcatggcatct

SEQ ID NO: 326717 - DNA, 25 bp, Mus musculus
ggcccaattgtcttgcttcattaaa

SEQ ID NO: 326718 - DNA, 25 bp, Mus musculus
ggcccaattgtcttgcttcattaac

SEQ ID NO: 326719 - DNA, 25 bp, Mus musculus
ggcccacaacgctgcttctgaacca

SEQ ID NO: 326720 - DNA, 25 bp, Mus musculus
ggcccacaagacccgccctagttgc

SEQ ID NO: 326721 - DNA, 25 bp, Mus musculus
ggcccacaagcccccactgtgaatg

SEQ ID NO: 326722 - DNA, 25 bp, Mus musculus
ggcccacaaggaatgtgggtgccag

SEQ ID NO: 326723 - DNA, 25 bp, Mus musculus
ggcccacaccccaggaagtcagagg

SEQ ID NO: 326724 - DNA, 25 bp, Mus musculus
ggcccacactggcagccaccaccaa

SEQ ID NO: 326725 - DNA, 25 bp, Mus musculus
ggcccacactggccgccactgggaa

SEQ ID NO: 326726 - DNA, 25 bp, Mus musculus
ggcccacagtgggggctgaagaata

SEQ ID NO: 326727 - DNA, 25 bp, Mus musculus
ggcccacagtggttctcactgtgga

SEQ ID NO: 326728 - DNA, 25 bp, Mus musculus
ggcccacccctcaggtgttacatgt

SEQ ID NO: 326729 - DNA, 25 bp, Mus musculus
ggcccacccggtgtgacttctttaa

SEQ ID NO: 326730 - DNA, 25 bp, Mus musculus
ggcccacctcctggcatgcggcctc

SEQ ID NO: 326731 - DNA, 25 bp, Mus musculus
ggcccacctggagctacattgcctc

SEQ ID NO: 326732 - DNA, 25 bp, Mus musculus
ggcccacctttgagatgacagagac

SEQ ID NO: 326733 - DNA, 25 bp, Mus musculus
ggcccacctttgagtgactgccagg

SEQ ID NO: 326734 - DNA, 25 bp, Mus musculus
ggcccacgaggatcgtctgaaggac

SEQ ID NO: 326735 - DNA, 25 bp, Mus musculus
ggcccacgcaggatcatgtgttcaa

SEQ ID NO: 326736 - DNA, 25 bp, Mus musculus
ggcccacgcctgtgtaggcttgtga

SEQ ID NO: 326737 - DNA, 25 bp, Mus musculus
ggcccacgcgcagcaacacctccag

SEQ ID NO: 326738 - DNA, 25 bp, Mus musculus
ggcccacgcgcagcgctgtgtagtt

SEQ ID NO: 326739 - DNA, 25 bp, Mus musculus
ggcccacggacgaccatgacacccg

SEQ ID NO: 326740 - DNA, 25 bp, Mus musculus
ggcccagaaccagggcaaaaaggca

SEQ ID NO: 326741 - DNA, 25 bp, Mus musculus
ggcccagaaccagggcaagaaagga

SEQ ID NO: 326742 - DNA, 25 bp, Mus musculus
ggcccagaagaatatgctggaccgc

SEQ ID NO: 326743 - DNA, 25 bp, Mus musculus
ggcccagaaggagatccttaagctg

SEQ ID NO: 326744 - DNA, 25 bp, Mus musculus
ggcccagaaggaggtcaagatgggg

SEQ ID NO: 326745 - DNA, 25 bp, Mus musculus
ggcccagaaggctgagaccgctgcc

SEQ ID NO: 326746 - DNA, 25 bp, Mus musculus
ggcccagaatcctgggccaccaatt

SEQ ID NO: 326747 - DNA, 25 bp, Mus musculus
ggcccagacagtgactcaggtgcag

SEQ ID NO: 326748 - DNA, 25 bp, Mus musculus
ggcccagacgaattggaatcccagt

SEQ ID NO: 326749 - DNA, 25 bp, Mus musculus
ggcccagagatgggcacctccgtct

SEQ ID NO: 326750 - DNA, 25 bp, Mus musculus
ggcccagaggagaaattgtgaaaat

SEQ ID NO: 326751 - DNA, 25 bp, Mus musculus
ggcccagattaaagtcaaataattt

SEQ ID NO: 326752 - DNA, 25 bp, Mus musculus
ggcccagattaagtctcctgaaagg

SEQ ID NO: 326753 - DNA, 25 bp, Mus musculus
ggcccagcaatggcaattggcatcc

SEQ ID NO: 326754 - DNA, 25 bp, Mus musculus
ggcccagcagctggagcaattcaac

SEQ ID NO: 326755 - DNA, 25 bp, Mus musculus
ggcccagcaggaccaaactcttact

SEQ ID NO: 326756 - DNA, 25 bp, Mus musculus
ggcccagcagtgcatcctgcctctg

SEQ ID NO: 326757 - DNA, 25 bp, Mus musculus
ggcccagcatttgggggagagcacg

SEQ ID NO: 326758 - DNA, 25 bp, Mus musculus
ggcccagccaggtagccatcccttg

SEQ ID NO: 326759 - DNA, 25 bp, Mus musculus
ggcccagccaggttttcaggcttgg

SEQ ID NO: 326760 - DNA, 25 bp, Mus musculus
ggcccagcccggtcaagcaggtaga

SEQ ID NO: 326761 - DNA, 25 bp, Mus musculus
ggcccagccctgctcctgccatgcc

SEQ ID NO: 326762 - DNA, 25 bp, Mus musculus
ggcccagcctcaggtcacgcccggg

SEQ ID NO: 326763 - DNA, 25 bp, Mus musculus
ggcccagctagctgtgcgcagttcc

SEQ ID NO: 326764 - DNA, 25 bp, Mus musculus
ggcccagctctgggatgggttgaag

SEQ ID NO: 326765 - DNA, 25 bp, Mus musculus
ggcccagctctggggagaactctga

SEQ ID NO: 326766 - DNA, 25 bp, Mus musculus
ggcccaggaaccgcgtctcttgcaa

SEQ ID NO: 326767 - DNA, 25 bp, Mus musculus
ggcccaggaagaaacatgtatcatg

SEQ ID NO: 326768 - DNA, 25 bp, Mus musculus
ggcccaggaagaagaatgtcccttc

SEQ ID NO: 326769 - DNA, 25 bp, Mus musculus
ggcccaggacagctggatcgccggg

SEQ ID NO: 326770 - DNA, 25 bp, Mus musculus
ggcccaggagccctgccacattgtc

SEQ ID NO: 326771 - DNA, 25 bp, Mus musculus
ggcccaggagccctgtgcttgatgg

SEQ ID NO: 326772 - DNA, 25 bp, Mus musculus
ggcccaggaggtcctgtccttggga

SEQ ID NO: 326773 - DNA, 25 bp, Mus musculus
ggcccaggaggtgtctgagactgag

SEQ ID NO: 326774 - DNA, 25 bp, Mus musculus
ggcccaggcccaccctgcaactccc

SEQ ID NO: 326775 - DNA, 25 bp, Mus musculus
ggcccaggcccattattgtgatcac

SEQ ID NO: 326776 - DNA, 25 bp, Mus musculus
ggcccaggccgcccaaacccaagca

SEQ ID NO: 326777 - DNA, 25 bp, Mus musculus
ggcccaggcctgcgggtggacaaat

SEQ ID NO: 326778 - DNA, 25 bp, Mus musculus
ggcccaggcctggcttcttcacaaa

SEQ ID NO: 326779 - DNA, 25 bp, Mus musculus
ggcccaggcgagcgggctaaccatt

SEQ ID NO: 326780 - DNA, 25 bp, Mus musculus
ggcccaggctgagtaccagctccaa

SEQ ID NO: 326781 - DNA, 25 bp, Mus musculus
ggcccagggagagcagcaggaggac

SEQ ID NO: 326782 - DNA, 25 bp, Mus musculus
ggcccagtccaaaagagtacacacg

SEQ ID NO: 326783 - DNA, 25 bp, Mus musculus
ggcccagtcctgcagagtagagctc

SEQ ID NO: 326784 - DNA, 25 bp, Mus musculus
ggcccagtcctgcagccctctctcc

SEQ ID NO: 326785 - DNA, 25 bp, Mus musculus
ggcccagtgcagcaggccacgcggg

SEQ ID NO: 326786 - DNA, 25 bp, Mus musculus
ggcccagtgcagcgctgtagcatcc

SEQ ID NO: 326787 - DNA, 25 bp, Mus musculus
ggcccataacgtgtttcatcccctg

SEQ ID NO: 326788 - DNA, 25 bp, Mus musculus
ggcccatccgctgtgctttgacctc

SEQ ID NO: 326789 - DNA, 25 bp, Mus musculus
ggcccatctcaggagcaggcgagca

SEQ ID NO: 326790 - DNA, 25 bp, Mus musculus
ggcccatctcccagactgataatgg

SEQ ID NO: 326791 - DNA, 25 bp, Mus musculus
ggcccatgagcagggtgtccctgta

SEQ ID NO: 326792 - DNA, 25 bp, Mus musculus
ggcccatgagctagggcacgttctc

SEQ ID NO: 326793 - DNA, 25 bp, Mus musculus
ggcccatgtccatccctatcatccc

SEQ ID NO: 326794 - DNA, 25 bp, Mus musculus
ggcccatgtgaccctgctgacatca

SEQ ID NO: 326795 - DNA, 25 bp, Mus musculus
ggcccatgttggaggacaagacatt

SEQ ID NO: 326796 - DNA, 25 bp, Mus musculus
ggcccatgttggagggagttaaata

SEQ ID NO: 326797 - DNA, 25 bp, Mus musculus
ggcccattaaggtgaacctcctcgt

SEQ ID NO: 326798 - DNA, 25 bp, Mus musculus
ggccccaaaattaggctgcgggaca

SEQ ID NO: 326799 - DNA, 25 bp, Mus musculus
ggccccaaaggagggaccgctgaca

SEQ ID NO: 326800 - DNA, 25 bp, Mus musculus
ggccccaaaggtgtgaacattggcg

SEQ ID NO: 326801 - DNA, 25 bp, Mus musculus
ggccccaacagcgggccacagattg

SEQ ID NO: 326802 - DNA, 25 bp, Mus musculus
ggccccaacagcgggtctggaggag

SEQ ID NO: 326803 - DNA, 25 bp, Mus musculus
ggccccacaagatccgtgtgaatgc

SEQ ID NO: 326804 - DNA, 25 bp, Mus musculus
ggccccacaaggacctgctctcctt

SEQ ID NO: 326805 - DNA, 25 bp, Mus musculus
ggccccacaggtgccaaaggcgtca

SEQ ID NO: 326806 - DNA, 25 bp, Mus musculus
ggccccacggctggggactcctttt

SEQ ID NO: 326807 - DNA, 25 bp, Mus musculus
ggccccagacaggttcagaacttag

SEQ ID NO: 326808 - DNA, 25 bp, Mus musculus
ggccccagcaggcagctgccagacc

SEQ ID NO: 326809 - DNA, 25 bp, Mus musculus
ggccccagctgtttcagccatggct

SEQ ID NO: 326810 - DNA, 25 bp, Mus musculus
ggccccagtgcagattaaggttgag

SEQ ID NO: 326811 - DNA, 25 bp, Mus musculus
ggccccatcctcaggctgcgctaca

SEQ ID NO: 326812 - DNA, 25 bp, Mus musculus
ggccccatcggaagctcagaaccaa

SEQ ID NO: 326813 - DNA, 25 bp, Mus musculus
ggccccatttacagggagaagctgg

SEQ ID NO: 326814 - DNA, 25 bp, Mus musculus
ggcccccaacacggcgagcctcgtg

SEQ ID NO: 326815 - DNA, 25 bp, Mus musculus
ggcccccaaggccatgaagaagatg

SEQ ID NO: 326816 - DNA, 25 bp, Mus musculus
ggcccccacagccgtgtttgaccgg

SEQ ID NO: 326817 - DNA, 25 bp, Mus musculus
ggcccccacagtttgtatctacttg

SEQ ID NO: 326818 - DNA, 25 bp, Mus musculus
ggcccccagggtcccgcaagaatca

SEQ ID NO: 326819 - DNA, 25 bp, Mus musculus
ggcccccagtcagatctgtctcgag

SEQ ID NO: 326820 - DNA, 25 bp, Mus musculus
ggcccccagtcaggccggggctgtg

SEQ ID NO: 326821 - DNA, 25 bp, Mus musculus
ggcccccatggttcagcatgggctc

SEQ ID NO: 326822 - DNA, 25 bp, Mus musculus
ggccccccagccaggatgatgtcta

SEQ ID NO: 326823 - DNA, 25 bp, Mus musculus
ggccccccagccagtgtgaccccac

SEQ ID NO: 326824 - DNA, 25 bp, Mus musculus
ggccccccgcggacttccaatagta

SEQ ID NO: 326825 - DNA, 25 bp, Mus musculus
ggccccccgggattgcctatcctct

SEQ ID NO: 326826 - DNA, 25 bp, Mus musculus
ggcccccgaaagagggtggtgtcat

SEQ ID NO: 326827 - DNA, 25 bp, Mus musculus
ggcccccgaggatgtcagtgctctt

SEQ ID NO: 326828 - DNA, 25 bp, Mus musculus
ggccccctagcctggtctgggacct

SEQ ID NO: 326829 - DNA, 25 bp, Mus musculus
ggccccctcacagctctcagggcct

SEQ ID NO: 326830 - DNA, 25 bp, Mus musculus
ggccccctcgtctgctccacttcca

SEQ ID NO: 326831 - DNA, 25 bp, Mus musculus
ggccccctctccaggtgtctccagt

SEQ ID NO: 326832 - DNA, 25 bp, Mus musculus
ggccccgaaacgccagcgatgggct

SEQ ID NO: 326833 - DNA, 25 bp, Mus musculus
ggccccgaacaacagacgagctaaa

SEQ ID NO: 326834 - DNA, 25 bp, Mus musculus
ggccccgaacaacaggtcttcacac

SEQ ID NO: 326835 - DNA, 25 bp, Mus musculus
ggccccgcccgaggcactagagcag

SEQ ID NO: 326836 - DNA, 25 bp, Mus musculus
ggccccgcggcacgagacaatgaat

SEQ ID NO: 326837 - DNA, 25 bp, Mus musculus
ggccccgctacggctcaatcgtgga

SEQ ID NO: 326838 - DNA, 25 bp, Mus musculus
ggccccggaagcaggtgcggtgcta

SEQ ID NO: 326839 - DNA, 25 bp, Mus musculus
ggccccggaaggaaaagcgcaatgg

SEQ ID NO: 326840 - DNA, 25 bp, Mus musculus
ggccccggacagagacagggcaggg

SEQ ID NO: 326841 - DNA, 25 bp, Mus musculus
ggccccggacccctggttctccaca

SEQ ID NO: 326842 - DNA, 25 bp, Mus musculus
ggccccggccctctgcgcctgtgtc

SEQ ID NO: 326843 - DNA, 25 bp, Mus musculus
ggcccctacataaaatggttcctac

SEQ ID NO: 326844 - DNA, 25 bp, Mus musculus
ggcccctaccaggcgggatggagag

SEQ ID NO: 326845 - DNA, 25 bp, Mus musculus
ggcccctcccatggagggtgctcga

SEQ ID NO: 326846 - DNA, 25 bp, Mus musculus
ggcccctgagcagggtgttcctgta

SEQ ID NO: 326847 - DNA, 25 bp, Mus musculus
ggcccctgatatttgacattaacga

SEQ ID NO: 326848 - DNA, 25 bp, Mus musculus
ggcccctgcagaagactgctagcta

SEQ ID NO: 326849 - DNA, 25 bp, Mus musculus
ggcccctgtcgatctttgggttcct

SEQ ID NO: 326850 - DNA, 25 bp, Mus musculus
ggcccctgtcggaactgctgcacta

SEQ ID NO: 326851 - DNA, 25 bp, Mus musculus
ggcccctgttggcatcctcaaatcc

SEQ ID NO: 326852 - DNA, 25 bp, Mus musculus
ggccccttgcaagtgcccctctcac

SEQ ID NO: 326853 - DNA, 25 bp, Mus musculus
ggccccttgcaagttctgggccaag

SEQ ID NO: 326854 - DNA, 25 bp, Mus musculus
ggcccgaaactgagaagaccagagc

SEQ ID NO: 326855 - DNA, 25 bp, Mus musculus
ggcccgaacaggtcttattttagtc

SEQ ID NO: 326856 - DNA, 25 bp, Mus musculus
ggcccgaagaagagctgtggtttct

SEQ ID NO: 326857 - DNA, 25 bp, Mus musculus
ggcccgacttgccgggtctggaatg

SEQ ID NO: 326858 - DNA, 25 bp, Mus musculus
ggcccgagaaactgaaggagccctg

SEQ ID NO: 326859 - DNA, 25 bp, Mus musculus
ggcccgagaggttcgtctgctttgc

SEQ ID NO: 326860 - DNA, 25 bp, Mus musculus
ggcccgaggacgtgccaagccgcaa

SEQ ID NO: 326861 - DNA, 25 bp, Mus musculus
ggcccgaggcagaggatttggacgt

SEQ ID NO: 326862 - DNA, 25 bp, Mus musculus
ggcccgcagtgtgagtgcctgctca

SEQ ID NO: 326863 - DNA, 25 bp, Mus musculus
ggcccgcagtgtggaggcagttggc

SEQ ID NO: 326864 - DNA, 25 bp, Mus musculus
ggcccgccacagctgagctgctcct

SEQ ID NO: 326865 - DNA, 25 bp, Mus musculus
ggcccgccacaggctggagcaggct

SEQ ID NO: 326866 - DNA, 25 bp, Mus musculus
ggcccgccaggaattgtggaggcac

SEQ ID NO: 326867 - DNA, 25 bp, Mus musculus
ggcccgccaggactgcagtaatgga

SEQ ID NO: 326868 - DNA, 25 bp, Mus musculus
ggcccgccaggatatgaattggctc

SEQ ID NO: 326869 - DNA, 25 bp, Mus musculus
ggcccgcccaaccagcagaggcctc

SEQ ID NO: 326870 - DNA, 25 bp, Mus musculus
ggcccgcccggattgatgaactccc

SEQ ID NO: 326871 - DNA, 25 bp, Mus musculus
ggcccgcccggtgcatttctaggtc

SEQ ID NO: 326872 - DNA, 25 bp, Mus musculus
ggcccgcctatcaaccgtggccttc

SEQ ID NO: 326873 - DNA, 25 bp, Mus musculus
ggcccgcctcctgatccaggaccag

SEQ ID NO: 326874 - DNA, 25 bp, Mus musculus
ggcccgcgattgcagggagtcattc

SEQ ID NO: 326875 - DNA, 25 bp, Mus musculus
ggcccgcgattgcaggtctgttgtg

SEQ ID NO: 326876 - DNA, 25 bp, Mus musculus
ggcccgcgcgggctgagctggactg

SEQ ID NO: 326877 - DNA, 25 bp, Mus musculus
ggcccgcgcgtaggcgtcaagatca

SEQ ID NO: 326878 - DNA, 25 bp, Mus musculus
ggcccgctcaccggctgtaaaaaat

SEQ ID NO: 326879 - DNA, 25 bp, Mus musculus
ggcccgctggtcggtctgggaacgt

SEQ ID NO: 326880 - DNA, 25 bp, Mus musculus
ggcccggaaaaggagtcaggcggag

SEQ ID NO: 326881 - DNA, 25 bp, Mus musculus
ggcccggaagtcgggtgacagaaga

SEQ ID NO: 326882 - DNA, 25 bp, Mus musculus
ggcccggaagttcctgttcctctca

SEQ ID NO: 326883 - DNA, 25 bp, Mus musculus
ggcccggagagagctctcagggcct

SEQ ID NO: 326884 - DNA, 25 bp, Mus musculus
ggcccggagcacgcagcccgactca

SEQ ID NO: 326885 - DNA, 25 bp, Mus musculus
ggcccggagctgaccaaaccgggct

SEQ ID NO: 326886 - DNA, 25 bp, Mus musculus
ggcccggagctgaccggtctcccta

SEQ ID NO: 326887 - DNA, 25 bp, Mus musculus
ggcccggatcccgaggccacgtggc

SEQ ID NO: 326888 - DNA, 25 bp, Mus musculus
ggcccggattaaggggacctggctg

SEQ ID NO: 326889 - DNA, 25 bp, Mus musculus
ggcccggcagaatggctcccgcaaa

SEQ ID NO: 326890 - DNA, 25 bp, Mus musculus
ggcccggcccactcagaggctgaga

SEQ ID NO: 326891 - DNA, 25 bp, Mus musculus
ggcccggccctcctgaagccctttt

SEQ ID NO: 326892 - DNA, 25 bp, Mus musculus
ggcccggcctctgatgacccccgga

SEQ ID NO: 326893 - DNA, 25 bp, Mus musculus
ggcccggcctctgatgcttgattat

SEQ ID NO: 326894 - DNA, 25 bp, Mus musculus
ggcccggcctggcaggtagcagagg

SEQ ID NO: 326895 - DNA, 25 bp, Mus musculus
ggcccggcctggcaggtttaagttt

SEQ ID NO: 326896 - DNA, 25 bp, Mus musculus
ggcccggcctggcagtttctagtcc

SEQ ID NO: 326897 - DNA, 25 bp, Mus musculus
ggcccggcgggcgggtaaataacag

SEQ ID NO: 326898 - DNA, 25 bp, Mus musculus
ggcccggctgtacacttccggcctg

SEQ ID NO: 326899 - DNA, 25 bp, Mus musculus
ggcccggcttcgtgtatcctcagag

SEQ ID NO: 326900 - DNA, 25 bp, Mus musculus
ggcccggcttctgcaggcacaaggg

SEQ ID NO: 326901 - DNA, 25 bp, Mus musculus
ggcccgggacccagtgcaggtccta

SEQ ID NO: 326902 - DNA, 25 bp, Mus musculus
ggcccgggagcaggctgaagctgag

SEQ ID NO: 326903 - DNA, 25 bp, Mus musculus
ggcccgggccgcgccatgggctgcc

SEQ ID NO: 326904 - DNA, 25 bp, Mus musculus
ggcccgggcttccagacgatactgt

SEQ ID NO: 326905 - DNA, 25 bp, Mus musculus
ggcccgggcttccgtgacctcgtga

SEQ ID NO: 326906 - DNA, 25 bp, Mus musculus
ggcccggggggaaggattggatggt

SEQ ID NO: 326907 - DNA, 25 bp, Mus musculus
ggcccggggtgaaggtgagcctcat

SEQ ID NO: 326908 - DNA, 25 bp, Mus musculus
ggcccggtaaagtgccggcagagca

SEQ ID NO: 326909 - DNA, 25 bp, Mus musculus
ggcccggtctccgcccggcagaaca

SEQ ID NO: 326910 - DNA, 25 bp, Mus musculus
ggcccggtctccgtttgcagcgggg

SEQ ID NO: 326911 - DNA, 25 bp, Mus musculus
ggcccggtgaggagctgtgggaacc

SEQ ID NO: 326912 - DNA, 25 bp, Mus musculus
ggcccgtatcctgaagctgtttggg

SEQ ID NO: 326913 - DNA, 25 bp, Mus musculus
ggcccgtgaccacctctctggccct

SEQ ID NO: 326914 - DNA, 25 bp, Mus musculus
ggcccgtgaggtggtgatgctttac

SEQ ID NO: 326915 - DNA, 25 bp, Mus musculus
ggcccgtgagttcatattctttgga

SEQ ID NO: 326916 - DNA, 25 bp, Mus musculus
ggcccgtggagaggaggtggtgtca

SEQ ID NO: 326917 - DNA, 25 bp, Mus musculus
ggcccgtggagaggtctgcaaacag

SEQ ID NO: 326918 - DNA, 25 bp, Mus musculus
ggcccgtggcaaaggtcttttggct

SEQ ID NO: 326919 - DNA, 25 bp, Mus musculus
ggcccgtgtggaagagttcaagctg

SEQ ID NO: 326920 - DNA, 25 bp, Mus musculus
ggcccgtgtggttgcaccctcagga

SEQ ID NO: 326921 - DNA, 25 bp, Mus musculus
ggcccgttcagggctgggcttcaac

SEQ ID NO: 326922 - DNA, 25 bp, Mus musculus
ggccctaaaggggttggtgctatct

SEQ ID NO: 326923 - DNA, 25 bp, Mus musculus
ggccctaaataaaagcctgactaag

SEQ ID NO: 326924 - DNA, 25 bp, Mus musculus
ggccctaacaaaggtgacactcgag

SEQ ID NO: 326925 - DNA, 25 bp, Mus musculus
ggccctaagaagggttgtgagcccc

SEQ ID NO: 326926 - DNA, 25 bp, Mus musculus
ggccctaatgacattatgccctaca

SEQ ID NO: 326927 - DNA, 25 bp, Mus musculus
ggccctacagtgcctgagcaatgtg

SEQ ID NO: 326928 - DNA, 25 bp, Mus musculus
ggccctacctggactttgatcctca

SEQ ID NO: 326929 - DNA, 25 bp, Mus musculus
ggccctacgcagctcccacagatac

SEQ ID NO: 326930 - DNA, 25 bp, Mus musculus
ggccctacgcaggtcctgtccagag

SEQ ID NO: 326931 - DNA, 25 bp, Mus musculus
ggccctactgggggtgaacctggtc

SEQ ID NO: 326932 - DNA, 25 bp, Mus musculus
ggccctagcagatgaaaaacgactg

SEQ ID NO: 326933 - DNA, 25 bp, Mus musculus
ggccctagcgcggaaacatcatccc

SEQ ID NO: 326934 - DNA, 25 bp, Mus musculus
ggccctagcgcgggctgggaaggtg

SEQ ID NO: 326935 - DNA, 25 bp, Mus musculus
ggccctatcagaacaccatcggggc

SEQ ID NO: 326936 - DNA, 25 bp, Mus musculus
ggccctcaagtctcacatcatggct

SEQ ID NO: 326937 - DNA, 25 bp, Mus musculus
ggccctcaatgcagtgactggattt

SEQ ID NO: 326938 - DNA, 25 bp, Mus musculus
ggccctcacggtatatgctatgatg

SEQ ID NO: 326939 - DNA, 25 bp, Mus musculus
ggccctcagctccatgaagagtctt

SEQ ID NO: 326940 - DNA, 25 bp, Mus musculus
ggccctcagctccatgaagagttgg

SEQ ID NO: 326941 - DNA, 25 bp, Mus musculus
ggccctcagtggctcccacagatac

SEQ ID NO: 326942 - DNA, 25 bp, Mus musculus
ggccctcagtggtcccctttaccac

SEQ ID NO: 326943 - DNA, 25 bp, Mus musculus
ggccctcatctgcagggtccacgcc

SEQ ID NO: 326944 - DNA, 25 bp, Mus musculus
ggccctcccagagccgtactggatt

SEQ ID NO: 326945 - DNA, 25 bp, Mus musculus
ggccctcccagtgacgtactggatt

SEQ ID NO: 326946 - DNA, 25 bp, Mus musculus
ggccctccctcagacctgggaagat

SEQ ID NO: 326947 - DNA, 25 bp, Mus musculus
ggccctccgcctcagatggcagtca

SEQ ID NO: 326948 - DNA, 25 bp, Mus musculus
ggccctccgcctcagtaccaaacgt

SEQ ID NO: 326949 - DNA, 25 bp, Mus musculus
ggccctccttcacgtagaaaatcca

SEQ ID NO: 326950 - DNA, 25 bp, Mus musculus
ggccctcgaatgtgccgttctctga

SEQ ID NO: 326951 - DNA, 25 bp, Mus musculus
ggccctcgatgagatgtgatcttcg

SEQ ID NO: 326952 - DNA, 25 bp, Mus musculus
ggccctcgctcctccctcgagagga

SEQ ID NO: 326953 - DNA, 25 bp, Mus musculus
ggccctctacaggagtgtgcaccgt

SEQ ID NO: 326954 - DNA, 25 bp, Mus musculus
ggccctctgaatgtcaagccccgcc

SEQ ID NO: 326955 - DNA, 25 bp, Mus musculus
ggccctctgtggacggaatcttgga

SEQ ID NO: 326956 - DNA, 25 bp, Mus musculus
ggccctcttcaacaggttctactca

SEQ ID NO: 326957 - DNA, 25 bp, Mus musculus
ggccctgaagaagaggtcacgaaag

SEQ ID NO: 326958 - DNA, 25 bp, Mus musculus
ggccctgaagagcatgacgttcctc

SEQ ID NO: 326959 - DNA, 25 bp, Mus musculus
ggccctgaccgattcacaatgacat

SEQ ID NO: 326960 - DNA, 25 bp, Mus musculus
ggccctgacctcaggattggaaaac

SEQ ID NO: 326961 - DNA, 25 bp, Mus musculus
ggccctgagactgccagcaaattcc

SEQ ID NO: 326962 - DNA, 25 bp, Mus musculus
ggccctgagcagagtcactgagggc

SEQ ID NO: 326963 - DNA, 25 bp, Mus musculus
ggccctgagccccgagggtcctgcg

SEQ ID NO: 326964 - DNA, 25 bp, Mus musculus
ggccctgagccccgtgtactggttc

SEQ ID NO: 326965 - DNA, 25 bp, Mus musculus
ggccctgcagatcaccagcaaaagt

SEQ ID NO: 326966 - DNA, 25 bp, Mus musculus
ggccctgcagcagctgattagagta

SEQ ID NO: 326967 - DNA, 25 bp, Mus musculus
ggccctgcagcccagggcgctgtga

SEQ ID NO: 326968 - DNA, 25 bp, Mus musculus
ggccctgcaggactgttcccgacgc

SEQ ID NO: 326969 - DNA, 25 bp, Mus musculus
ggccctgcaggagtgactagcacgg

SEQ ID NO: 326970 - DNA, 25 bp, Mus musculus
ggccctgcccagagcctgaccccag

SEQ ID NO: 326971 - DNA, 25 bp, Mus musculus
ggccctgcccagatactccccccag

SEQ ID NO: 326972 - DNA, 25 bp, Mus musculus
ggccctgccccagctctgggcgtgg

SEQ ID NO: 326973 - DNA, 25 bp, Mus musculus
ggccctgccccaggtggggaacctg

SEQ ID NO: 326974 - DNA, 25 bp, Mus musculus
ggccctgcctgtcaggcttcctgcg

SEQ ID NO: 326975 - DNA, 25 bp, Mus musculus
ggccctgcgaatcggagccccagat

SEQ ID NO: 326976 - DNA, 25 bp, Mus musculus
ggccctgcgtaccagcatcgagaag

SEQ ID NO: 326977 - DNA, 25 bp, Mus musculus
ggccctgcgtaccaggtatggcatc

SEQ ID NO: 326978 - DNA, 25 bp, Mus musculus
ggccctggaagctgcagactttgtg

SEQ ID NO: 326979 - DNA, 25 bp, Mus musculus
ggccctggaggaaggaattctttgt

SEQ ID NO: 326980 - DNA, 25 bp, Mus musculus
ggccctggatggggtggtgaagcga

SEQ ID NO: 326981 - DNA, 25 bp, Mus musculus
ggccctggcagagaacacagcaggg

SEQ ID NO: 326982 - DNA, 25 bp, Mus musculus
ggccctggcagatgagcgtgaagct

SEQ ID NO: 326983 - DNA, 25 bp, Mus musculus
ggccctggcaggacaacagtccagg

SEQ ID NO: 326984 - DNA, 25 bp, Mus musculus
ggccctggcaggtctccctgcaggt

SEQ ID NO: 326985 - DNA, 25 bp, Mus musculus
ggccctgggcaggctgctggttgtc

SEQ ID NO: 326986 - DNA, 25 bp, Mus musculus
ggccctggggaagaagagtctgagg

SEQ ID NO: 326987 - DNA, 25 bp, Mus musculus
ggccctggggctgggtccttggctg

SEQ ID NO: 326988 - DNA, 25 bp, Mus musculus
ggccctggggttatgagggctggag

SEQ ID NO: 326989 - DNA, 25 bp, Mus musculus
ggccctggtaaaagcagaagcagca

SEQ ID NO: 326990 - DNA, 25 bp, Mus musculus
ggccctggtcacaggtgcgggtagc

SEQ ID NO: 326991 - DNA, 25 bp, Mus musculus
ggccctggtgtacagggatcagaac

SEQ ID NO: 326992 - DNA, 25 bp, Mus musculus
ggccctgtacccagatgaagttgcc

SEQ ID NO: 326993 - DNA, 25 bp, Mus musculus
ggccctgtcacctacatggataaga

SEQ ID NO: 326994 - DNA, 25 bp, Mus musculus
ggccctgtcctgccatcatgaaggt

SEQ ID NO: 326995 - DNA, 25 bp, Mus musculus
ggccctgtcgcctgtctgccacaac

SEQ ID NO: 326996 - DNA, 25 bp, Mus musculus
ggccctgttcagagccctgaagaca

SEQ ID NO: 326997 - DNA, 25 bp, Mus musculus
ggccctgttgcagccccaccatgga

SEQ ID NO: 326998 - DNA, 25 bp, Mus musculus
ggccctgttgcaggttctgccacca

SEQ ID NO: 326999 - DNA, 25 bp, Mus musculus
ggcccttacgctctcctactccgtg

SEQ ID NO: 327000 - DNA, 25 bp, Mus musculus
ggcccttcaagttttcctggagcaa

SEQ ID NO: 327001 - DNA, 25 bp, Mus musculus
ggcccttcaggagccacgtcagtgt

SEQ ID NO: 327002 - DNA, 25 bp, Mus musculus
ggcccttcaggaggcagcagaagct

SEQ ID NO: 327003 - DNA, 25 bp, Mus musculus
ggcccttcccagggtctgaatttcc

SEQ ID NO: 327004 - DNA, 25 bp, Mus musculus
ggcccttcgtggcagatctgattgc

SEQ ID NO: 327005 - DNA, 25 bp, Mus musculus
ggcccttcgtggcaggttgttccta

SEQ ID NO: 327006 - DNA, 25 bp, Mus musculus
ggcccttctagacacccaggacatg

SEQ ID NO: 327007 - DNA, 25 bp, Mus musculus
ggcccttctcatcaaggtgattctg

SEQ ID NO: 327008 - DNA, 25 bp, Mus musculus
ggcccttctggcgacccccaggatc

SEQ ID NO: 327009 - DNA, 25 bp, Mus musculus
ggcccttgaagccacccgcggtcag

SEQ ID NO: 327010 - DNA, 25 bp, Mus musculus
ggcccttgaagcgcggctgggttcc

SEQ ID NO: 327011 - DNA, 25 bp, Mus musculus
ggcccttgcagaaaaaaagatgcag

SEQ ID NO: 327012 - DNA, 25 bp, Mus musculus
ggcccttggaagattggctctttgt

SEQ ID NO: 327013 - DNA, 25 bp, Mus musculus
ggcccttggagcaggtcaaagctgc

SEQ ID NO: 327014 - DNA, 25 bp, Mus musculus
ggccctttacccctgcttcctgcct

SEQ ID NO: 327015 - DNA, 25 bp, Mus musculus
ggccctttatgaacaaaggaagaac

SEQ ID NO: 327016 - DNA, 25 bp, Mus musculus
ggccctttatggaacagacggagcg

SEQ ID NO: 327017 - DNA, 25 bp, Mus musculus
ggcccttttcagtgagaaagcgctg

SEQ ID NO: 327018 - DNA, 25 bp, Mus musculus
ggccgaaagtggggatgcaaacttg

SEQ ID NO: 327019 - DNA, 25 bp, Mus musculus
ggccgaaccagtggctgcagcactc

SEQ ID NO: 327020 - DNA, 25 bp, Mus musculus
ggccgaagagctcaagaagttaagt

SEQ ID NO: 327021 - DNA, 25 bp, Mus musculus
ggccgaagaggagcttggctttgat

SEQ ID NO: 327022 - DNA, 25 bp, Mus musculus
ggccgaagcccccagttgtaccgag

SEQ ID NO: 327023 - DNA, 25 bp, Mus musculus
ggccgaagctgagatactccatgtt

SEQ ID NO: 327024 - DNA, 25 bp, Mus musculus
ggccgaatccctttctaaataaagc

SEQ ID NO: 327025 - DNA, 25 bp, Mus musculus
ggccgacagtacagaaccaacgaaa

SEQ ID NO: 327026 - DNA, 25 bp, Mus musculus
ggccgacagtacagggttagctgag

SEQ ID NO: 327027 - DNA, 25 bp, Mus musculus
ggccgaccagatgtgaggtgagatg

SEQ ID NO: 327028 - DNA, 25 bp, Mus musculus
ggccgaccagcccccgtcctgcggc

SEQ ID NO: 327029 - DNA, 25 bp, Mus musculus
ggccgacgcccaaggaccacctacc

SEQ ID NO: 327030 - DNA, 25 bp, Mus musculus
ggccgactccgggacagacaatcta

SEQ ID NO: 327031 - DNA, 25 bp, Mus musculus
ggccgactccgtggaaacctctgtg

SEQ ID NO: 327032 - DNA, 25 bp, Mus musculus
ggccgactgctcaccaggaccctgc

SEQ ID NO: 327033 - DNA, 25 bp, Mus musculus
ggccgagaagcggcgtagggccaca

SEQ ID NO: 327034 - DNA, 25 bp, Mus musculus
ggccgagaagcggggcctacagcgt

SEQ ID NO: 327035 - DNA, 25 bp, Mus musculus
ggccgagaaggagtttcgaaactgc

SEQ ID NO: 327036 - DNA, 25 bp, Mus musculus
ggccgagaaggctgcatctgtctgc

SEQ ID NO: 327037 - DNA, 25 bp, Mus musculus
ggccgagaagtactctcagaaggaa

SEQ ID NO: 327038 - DNA, 25 bp, Mus musculus
ggccgagaagttgacctcctcctct

SEQ ID NO: 327039 - DNA, 25 bp, Mus musculus
ggccgagaagttgacctcgtcctcc

SEQ ID NO: 327040 - DNA, 25 bp, Mus musculus
ggccgagacctacgacttcctcttc

SEQ ID NO: 327041 - DNA, 25 bp, Mus musculus
ggccgagaggggagcccagaggagg

SEQ ID NO: 327042 - DNA, 25 bp, Mus musculus
ggccgagagtgactcatgaaatggc

SEQ ID NO: 327043 - DNA, 25 bp, Mus musculus
ggccgagatgttcagctacgagtcc

SEQ ID NO: 327044 - DNA, 25 bp, Mus musculus
ggccgagatgttcagttatgaggag

SEQ ID NO: 327045 - DNA, 25 bp, Mus musculus
ggccgagcaccagagacagccattc

SEQ ID NO: 327046 - DNA, 25 bp, Mus musculus
ggccgagcagaaggagggagagttc

SEQ ID NO: 327047 - DNA, 25 bp, Mus musculus
ggccgagccaagaaactatgttcca

SEQ ID NO: 327048 - DNA, 25 bp, Mus musculus
ggccgagccaaggattttaaacagt

SEQ ID NO: 327049 - DNA, 25 bp, Mus musculus
ggccgagccaaggtgtgagatgcac

SEQ ID NO: 327050 - DNA, 25 bp, Mus musculus
ggccgagccggacccctctgaccct

SEQ ID NO: 327051 - DNA, 25 bp, Mus musculus
ggccgagccggaccgattcagactc

SEQ ID NO: 327052 - DNA, 25 bp, Mus musculus
ggccgagccggaccgccgcaaggtc

SEQ ID NO: 327053 - DNA, 25 bp, Mus musculus
ggccgagcgaacgagtatcagcatg

SEQ ID NO: 327054 - DNA, 25 bp, Mus musculus
ggccgagctagcaacctttcccctc

SEQ ID NO: 327055 - DNA, 25 bp, Mus musculus
ggccgagctagctgctgcctgttgc

SEQ ID NO: 327056 - DNA, 25 bp, Mus musculus
ggccgaggaagaactccagttctca

SEQ ID NO: 327057 - DNA, 25 bp, Mus musculus
ggccgaggaggtccagattatctct

SEQ ID NO: 327058 - DNA, 25 bp, Mus musculus
ggccgaggcaagtttccttttagac

SEQ ID NO: 327059 - DNA, 25 bp, Mus musculus
ggccgaggccaaccgtccagaagga

SEQ ID NO: 327060 - DNA, 25 bp, Mus musculus
ggccgaggccaaccgtgtgctgctg

SEQ ID NO: 327061 - DNA, 25 bp, Mus musculus
ggccgaggccgaggacatatgggtg

SEQ ID NO: 327062 - DNA, 25 bp, Mus musculus
ggccgaggcgcgccggaagcccgac

SEQ ID NO: 327063 - DNA, 25 bp, Mus musculus
ggccgaggcggcagtgagctcctat

SEQ ID NO: 327064 - DNA, 25 bp, Mus musculus
ggccgaggcggcccagggccttgct

SEQ ID NO: 327065 - DNA, 25 bp, Mus musculus
ggccgaggggtgaggagatttgaaa

SEQ ID NO: 327066 - DNA, 25 bp, Mus musculus
ggccgagtaccagagcccacagacg

SEQ ID NO: 327067 - DNA, 25 bp, Mus musculus
ggccgagtaccaggacctgacgttc

SEQ ID NO: 327068 - DNA, 25 bp, Mus musculus
ggccgagtaccaggctaaccctttc

SEQ ID NO: 327069 - DNA, 25 bp, Mus musculus
ggccgagtataagcaattaaccctg

SEQ ID NO: 327070 - DNA, 25 bp, Mus musculus
ggccgagtgcaacatcctccgcaaa

SEQ ID NO: 327071 - DNA, 25 bp, Mus musculus
ggccgagtgttgctgaacacaaccg

SEQ ID NO: 327072 - DNA, 25 bp, Mus musculus
ggccgagttcggactttctgcactg

SEQ ID NO: 327073 - DNA, 25 bp, Mus musculus
ggccgataaagattactctgtgaca

SEQ ID NO: 327074 - DNA, 25 bp, Mus musculus
ggccgataggaagtatgaacatcat

SEQ ID NO: 327075 - DNA, 25 bp, Mus musculus
ggccgatcaggaggcaggttgtcac

SEQ ID NO: 327076 - DNA, 25 bp, Mus musculus
ggccgatcgccaatggttggttttg

SEQ ID NO: 327077 - DNA, 25 bp, Mus musculus
ggccgatgaggtaatcactgtgttc

SEQ ID NO: 327078 - DNA, 25 bp, Mus musculus
ggccgatgagtaatatgcagactga

SEQ ID NO: 327079 - DNA, 25 bp, Mus musculus
ggccgcacagaactgactgtccctt

SEQ ID NO: 327080 - DNA, 25 bp, Mus musculus
ggccgcacagacccgaagtgtggag

SEQ ID NO: 327081 - DNA, 25 bp, Mus musculus
ggccgcacagacccgttcacgaacc

SEQ ID NO: 327082 - DNA, 25 bp, Mus musculus
ggccgcacagacccgttccaggagg

SEQ ID NO: 327083 - DNA, 25 bp, Mus musculus
ggccgcacagcctgctcttcctcct

SEQ ID NO: 327084 - DNA, 25 bp, Mus musculus
ggccgcacctgccaggccacagacc

SEQ ID NO: 327085 - DNA, 25 bp, Mus musculus
ggccgcacctgccaggtaagaagaa

SEQ ID NO: 327086 - DNA, 25 bp, Mus musculus
ggccgcagcagccctgtttgatctg

SEQ ID NO: 327087 - DNA, 25 bp, Mus musculus
ggccgcagcctggtaacgaaggcag

SEQ ID NO: 327088 - DNA, 25 bp, Mus musculus
ggccgcagcctgttgggcaaggcgg

SEQ ID NO: 327089 - DNA, 25 bp, Mus musculus
ggccgcagggttgcagaaactgagg

SEQ ID NO: 327090 - DNA, 25 bp, Mus musculus
ggccgcatgtttgtcattgcctttc

SEQ ID NO: 327091 - DNA, 25 bp, Mus musculus
ggccgcattgctgctcagaggaaga

SEQ ID NO: 327092 - DNA, 25 bp, Mus musculus
ggccgccaaggacagtcacgaggac

SEQ ID NO: 327093 - DNA, 25 bp, Mus musculus
ggccgccaaggtatgccatcatgcc

SEQ ID NO: 327094 - DNA, 25 bp, Mus musculus
ggccgccaaggttcgcttatcttgg

SEQ ID NO: 327095 - DNA, 25 bp, Mus musculus
ggccgccacagcgtggtgtccttgt

SEQ ID NO: 327096 - DNA, 25 bp, Mus musculus
ggccgccacgatgtgtgccgtgcag

SEQ ID NO: 327097 - DNA, 25 bp, Mus musculus
ggccgccacggatgggtgctacagt

SEQ ID NO: 327098 - DNA, 25 bp, Mus musculus
ggccgccagccaggattggatccag

SEQ ID NO: 327099 - DNA, 25 bp, Mus musculus
ggccgccatatgagacggtttaagc

SEQ ID NO: 327100 - DNA, 25 bp, Mus musculus
ggccgccatattcattccttggaag

SEQ ID NO: 327101 - DNA, 25 bp, Mus musculus
ggccgccatcatgtctgccacaact

SEQ ID NO: 327102 - DNA, 25 bp, Mus musculus
ggccgccatccacacgttccgccag

SEQ ID NO: 327103 - DNA, 25 bp, Mus musculus
ggccgccatgggtattaagagctgc

SEQ ID NO: 327104 - DNA, 25 bp, Mus musculus
ggccgcccaagacctccctgggcct

SEQ ID NO: 327105 - DNA, 25 bp, Mus musculus
ggccgcccaagagtcctttgctgtt

SEQ ID NO: 327106 - DNA, 25 bp, Mus musculus
ggccgccctataggaaatggaattt

SEQ ID NO: 327107 - DNA, 25 bp, Mus musculus
ggccgccgcagatataaagacttga

SEQ ID NO: 327108 - DNA, 25 bp, Mus musculus
ggccgccgccaggtgtgcaacagaa

SEQ ID NO: 327109 - DNA, 25 bp, Mus musculus
ggccgccgcgcgcgttccagggctc

SEQ ID NO: 327110 - DNA, 25 bp, Mus musculus
ggccgccgctgagcgccggagtact

SEQ ID NO: 327111 - DNA, 25 bp, Mus musculus
ggccgccgctgcagcatggtttatt

SEQ ID NO: 327112 - DNA, 25 bp, Mus musculus
ggccgccggcggaggacccagcccc

SEQ ID NO: 327113 - DNA, 25 bp, Mus musculus
ggccgccggcgtcgcacccctctct

SEQ ID NO: 327114 - DNA, 25 bp, Mus musculus
ggccgccggcgtcggcctttctttt

SEQ ID NO: 327115 - DNA, 25 bp, Mus musculus
ggccgccggtgacagacgatactgt

SEQ ID NO: 327116 - DNA, 25 bp, Mus musculus
ggccgcctacttcgggctaacaggc

SEQ ID NO: 327117 - DNA, 25 bp, Mus musculus
ggccgcctagcaggaactgtctacc

SEQ ID NO: 327118 - DNA, 25 bp, Mus musculus
ggccgcctagcagtttgttttgttt

SEQ ID NO: 327119 - DNA, 25 bp, Mus musculus
ggccgcctccaggactgaccaaggc

SEQ ID NO: 327120 - DNA, 25 bp, Mus musculus
ggccgcctcccaaggttacactgtg

SEQ ID NO: 327121 - DNA, 25 bp, Mus musculus
ggccgcctgcagcagagatgctgag

SEQ ID NO: 327122 - DNA, 25 bp, Mus musculus
ggccgcctgcagcatgtttgtacac

SEQ ID NO: 327123 - DNA, 25 bp, Mus musculus
ggccgcctgcgcggctggccagcta

SEQ ID NO: 327124 - DNA, 25 bp, Mus musculus
ggccgcctgctgctgatgcgtcgag

SEQ ID NO: 327125 - DNA, 25 bp, Mus musculus
ggccgcctgctgctgatggatgtcg

SEQ ID NO: 327126 - DNA, 25 bp, Mus musculus
ggccgccttcctagccctcgtggta

SEQ ID NO: 327127 - DNA, 25 bp, Mus musculus
ggccgccttggcttcctttctgact

SEQ ID NO: 327128 - DNA, 25 bp, Mus musculus
ggccgccttttccagcaatccgaag

SEQ ID NO: 327129 - DNA, 25 bp, Mus musculus
ggccgcgaacaagaccccctctatg

SEQ ID NO: 327130 - DNA, 25 bp, Mus musculus
ggccgcgacatggactgtcctgtgc

SEQ ID NO: 327131 - DNA, 25 bp, Mus musculus
ggccgcgatggaagagacattgatg

SEQ ID NO: 327132 - DNA, 25 bp, Mus musculus
ggccgcgcagaactgtcattattga

SEQ ID NO: 327133 - DNA, 25 bp, Mus musculus
ggccgcgcagccagcgttccatgtt

SEQ ID NO: 327134 - DNA, 25 bp, Mus musculus
ggccgcgccatcactcggaacccac

SEQ ID NO: 327135 - DNA, 25 bp, Mus musculus
ggccgcgcctactgactatcaatgt

SEQ ID NO: 327136 - DNA, 25 bp, Mus musculus
ggccgcgcctactgttccaggacta

SEQ ID NO: 327137 - DNA, 25 bp, Mus musculus
ggccgcgcgcgcgttattggaaata

SEQ ID NO: 327138 - DNA, 25 bp, Mus musculus
ggccgcgcgcggggtgctgtgagtg

SEQ ID NO: 327139 - DNA, 25 bp, Mus musculus
ggccgcgcggccatggagcagctga

SEQ ID NO: 327140 - DNA, 25 bp, Mus musculus
ggccgcgctgggaggcatgtcatgt

SEQ ID NO: 327141 - DNA, 25 bp, Mus musculus
ggccgcggacagagcagactgtatc

SEQ ID NO: 327142 - DNA, 25 bp, Mus musculus
ggccgcggagcaaccgaagaacctt

SEQ ID NO: 327143 - DNA, 25 bp, Mus musculus
ggccgcggaggtcacaggctctgtt

SEQ ID NO: 327144 - DNA, 25 bp, Mus musculus
ggccgcggccgaacatgggtgcaag

SEQ ID NO: 327145 - DNA, 25 bp, Mus musculus
ggccgcggccgaacgacagagactg

SEQ ID NO: 327146 - DNA, 25 bp, Mus musculus
ggccgcggccttcgggctaacaggc

SEQ ID NO: 327147 - DNA, 25 bp, Mus musculus
ggccgcggcgcaaggaccggctccg

SEQ ID NO: 327148 - DNA, 25 bp, Mus musculus
ggccgcgggaaagagtccagcctct

SEQ ID NO: 327149 - DNA, 25 bp, Mus musculus
ggccgcgggaaaggataaagcatca

SEQ ID NO: 327150 - DNA, 25 bp, Mus musculus
ggccgcggggcgatgtgagccccag

SEQ ID NO: 327151 - DNA, 25 bp, Mus musculus
ggccgcgggggcgaggtggccaggc

SEQ ID NO: 327152 - DNA, 25 bp, Mus musculus
ggccgcgggggcgaggtgtccccat

SEQ ID NO: 327153 - DNA, 25 bp, Mus musculus
ggccgcgtcatggccgtgcctgcag

SEQ ID NO: 327154 - DNA, 25 bp, Mus musculus
ggccgcgtcatgggggttaattcct

SEQ ID NO: 327155 - DNA, 25 bp, Mus musculus
ggccgcgtccgggtgatctctgggc

SEQ ID NO: 327156 - DNA, 25 bp, Mus musculus
ggccgctacctcaatcacagttgca

SEQ ID NO: 327157 - DNA, 25 bp, Mus musculus
ggccgctacggaagcctttgcttcc

SEQ ID NO: 327158 - DNA, 25 bp, Mus musculus
ggccgctacggatacaggttcactg

SEQ ID NO: 327159 - DNA, 25 bp, Mus musculus
ggccgctacgtgaatgagatcaagg

SEQ ID NO: 327160 - DNA, 25 bp, Mus musculus
ggccgctagcacaggcttctaaacc

SEQ ID NO: 327161 - DNA, 25 bp, Mus musculus
ggccgctagcacaggggttgtgtgg

SEQ ID NO: 327162 - DNA, 25 bp, Mus musculus
ggccgctatcagatccatttgggct

SEQ ID NO: 327163 - DNA, 25 bp, Mus musculus
ggccgctcagaaaagatgtctttga

SEQ ID NO: 327164 - DNA, 25 bp, Mus musculus
ggccgctcagcttactattaccata

SEQ ID NO: 327165 - DNA, 25 bp, Mus musculus
ggccgctcagtgtcttaaaacataa

SEQ ID NO: 327166 - DNA, 25 bp, Mus musculus
ggccgctctggggatgtcaacctac

SEQ ID NO: 327167 - DNA, 25 bp, Mus musculus
ggccgctgaatctcacttcaggccc

SEQ ID NO: 327168 - DNA, 25 bp, Mus musculus
ggccgctgaatctcactttagatag

SEQ ID NO: 327169 - DNA, 25 bp, Mus musculus
ggccgctgctgggaataacagacaa

SEQ ID NO: 327170 - DNA, 25 bp, Mus musculus
ggccgctgtagaattggaaaagcaa

SEQ ID NO: 327171 - DNA, 25 bp, Mus musculus
ggccgctgtcaaaagtcttgcgctc

SEQ ID NO: 327172 - DNA, 25 bp, Mus musculus
ggccgctgtctgagcgcaggctgtg

SEQ ID NO: 327173 - DNA, 25 bp, Mus musculus
ggccgcttcttcactgactatggtt

SEQ ID NO: 327174 - DNA, 25 bp, Mus musculus
ggccgcttgcggaggtttggattca

SEQ ID NO: 327175 - DNA, 25 bp, Mus musculus
ggccgctttcaggtagcactttgta

SEQ ID NO: 327176 - DNA, 25 bp, Mus musculus
ggccggaaaagacaaggaccagcag

SEQ ID NO: 327177 - DNA, 25 bp, Mus musculus
ggccggaaataagactgcagcttta

SEQ ID NO: 327178 - DNA, 25 bp, Mus musculus
ggccggacaggattgtggaattcag

SEQ ID NO: 327179 - DNA, 25 bp, Mus musculus
ggccggacagtgtctcgttcgatcc

SEQ ID NO: 327180 - DNA, 25 bp, Mus musculus
ggccggaccacaggccacaaaaaga

SEQ ID NO: 327181 - DNA, 25 bp, Mus musculus
ggccggaccgagaaagggctatgtg

SEQ ID NO: 327182 - DNA, 25 bp, Mus musculus
ggccggaccgcacagagaatgaacc

SEQ ID NO: 327183 - DNA, 25 bp, Mus musculus
ggccggacctacaacttctgaaaag

SEQ ID NO: 327184 - DNA, 25 bp, Mus musculus
ggccggacctacactgatgaagagt

SEQ ID NO: 327185 - DNA, 25 bp, Mus musculus
ggccggacgcagatcgcccacgtcc

SEQ ID NO: 327186 - DNA, 25 bp, Mus musculus
ggccggactcagatttgataatggg

SEQ ID NO: 327187 - DNA, 25 bp, Mus musculus
ggccggagacacagcttggtgacaa

SEQ ID NO: 327188 - DNA, 25 bp, Mus musculus
ggccggagacacaggccccatgggg

SEQ ID NO: 327189 - DNA, 25 bp, Mus musculus
ggccggagcagagtctggccacaga

SEQ ID NO: 327190 - DNA, 25 bp, Mus musculus
ggccggagcggagcaatgcctaaat

SEQ ID NO: 327191 - DNA, 25 bp, Mus musculus
ggccggaggactgaatagttgcagt

SEQ ID NO: 327192 - DNA, 25 bp, Mus musculus
ggccggagggattcatcagtgggaa

SEQ ID NO: 327193 - DNA, 25 bp, Mus musculus
ggccggagggattcgaggacgcgtt

SEQ ID NO: 327194 - DNA, 25 bp, Mus musculus
ggccggagtctccgggctttggcgt

SEQ ID NO: 327195 - DNA, 25 bp, Mus musculus
ggccggagtggcctctgcatcctag

SEQ ID NO: 327196 - DNA, 25 bp, Mus musculus
ggccggagtgggctggtgttcccgg

SEQ ID NO: 327197 - DNA, 25 bp, Mus musculus
ggccggcaagagacggaagaacgag

SEQ ID NO: 327198 - DNA, 25 bp, Mus musculus
ggccggcagcaccggaaaactcaag

SEQ ID NO: 327199 - DNA, 25 bp, Mus musculus
ggccggcatccacggcggaacctta

SEQ ID NO: 327200 - DNA, 25 bp, Mus musculus
ggccggcatccacggggctccacct

SEQ ID NO: 327201 - DNA, 25 bp, Mus musculus
ggccggcatcgccgcttacaagcac

SEQ ID NO: 327202 - DNA, 25 bp, Mus musculus
ggccggccagactacagcaatgaat

SEQ ID NO: 327203 - DNA, 25 bp, Mus musculus
ggccggccagatgggcaagagttca

SEQ ID NO: 327204 - DNA, 25 bp, Mus musculus
ggccggcccgaggcccggtcggtga

SEQ ID NO: 327205 - DNA, 25 bp, Mus musculus
ggccggcccgcaagctataagcgag

SEQ ID NO: 327206 - DNA, 25 bp, Mus musculus
ggccggcccgcagactttgtgttgc

SEQ ID NO: 327207 - DNA, 25 bp, Mus musculus
ggccggcccggattgatgacattgc

SEQ ID NO: 327208 - DNA, 25 bp, Mus musculus
ggccggcccgggacccagtgcaggt

SEQ ID NO: 327209 - DNA, 25 bp, Mus musculus
ggccggccgaaggatcatctgtccc

SEQ ID NO: 327210 - DNA, 25 bp, Mus musculus
ggccggccgaaggttcttgattgtc

SEQ ID NO: 327211 - DNA, 25 bp, Mus musculus
ggccggccggcgggtgcccagatca

SEQ ID NO: 327212 - DNA, 25 bp, Mus musculus
ggccggccgtcgggactctaatgag

SEQ ID NO: 327213 - DNA, 25 bp, Mus musculus
ggccggcgcccctccttcctgagca

SEQ ID NO: 327214 - DNA, 25 bp, Mus musculus
ggccggcgccgggagtcctgttgaa

SEQ ID NO: 327215 - DNA, 25 bp, Mus musculus
ggccggcgtgacagcatttgacatt

SEQ ID NO: 327216 - DNA, 25 bp, Mus musculus
ggccggctccattcagaacaacccc

SEQ ID NO: 327217 - DNA, 25 bp, Mus musculus
ggccggctggcagaacacagatctg

SEQ ID NO: 327218 - DNA, 25 bp, Mus musculus
ggccggctggcagccatggagaacg

SEQ ID NO: 327219 - DNA, 25 bp, Mus musculus
ggccgggaagaccaaatacacactg

SEQ ID NO: 327220 - DNA, 25 bp, Mus musculus
ggccgggaagatgccagtgtacggt

SEQ ID NO: 327221 - DNA, 25 bp, Mus musculus
ggccgggacaaggtaatgttctcct

SEQ ID NO: 327222 - DNA, 25 bp, Mus musculus
ggccgggagagaccctcaggacttg

SEQ ID NO: 327223 - DNA, 25 bp, Mus musculus
ggccgggagagacgcagtgagaaag

SEQ ID NO: 327224 - DNA, 25 bp, Mus musculus
ggccgggatcaggtggatcaactga

SEQ ID NO: 327225 - DNA, 25 bp, Mus musculus
ggccgggcaagctgccaaaagccta

SEQ ID NO: 327226 - DNA, 25 bp, Mus musculus
ggccgggcccgaaccctcttggctc

SEQ ID NO: 327227 - DNA, 25 bp, Mus musculus
ggccgggcccgggccaccaagcacc

SEQ ID NO: 327228 - DNA, 25 bp, Mus musculus
ggccgggccgccaaggtatgccatc

SEQ ID NO: 327229 - DNA, 25 bp, Mus musculus
ggccgggccgccatatgagacggtt

SEQ ID NO: 327230 - DNA, 25 bp, Mus musculus
ggccgggccgccatattcattcctt

SEQ ID NO: 327231 - DNA, 25 bp, Mus musculus
ggccgggcggccagccttgcactat

SEQ ID NO: 327232 - DNA, 25 bp, Mus musculus
ggccgggctaactggactcatgcag

SEQ ID NO: 327233 - DNA, 25 bp, Mus musculus
ggccgggctgaggagcatgaacggt

SEQ ID NO: 327234 - DNA, 25 bp, Mus musculus
ggccgggctggtccctctgtcacct

SEQ ID NO: 327235 - DNA, 25 bp, Mus musculus
ggccggggagaggtgggaaaagctt

SEQ ID NO: 327236 - DNA, 25 bp, Mus musculus
ggccggggcgaggttctctccacta

SEQ ID NO: 327237 - DNA, 25 bp, Mus musculus
ggccggggcgggacccagctgacct

SEQ ID NO: 327238 - DNA, 25 bp, Mus musculus
ggccggggtgtgcacatggaagatg

SEQ ID NO: 327239 - DNA, 25 bp, Mus musculus
ggccgggtaacagaggaaccgatga

SEQ ID NO: 327240 - DNA, 25 bp, Mus musculus
ggccgggtaggcggatctgggacga

SEQ ID NO: 327241 - DNA, 25 bp, Mus musculus
ggccgggttttcagatccttaagct

SEQ ID NO: 327242 - DNA, 25 bp, Mus musculus
ggccgggttttcagcacactgcccc

SEQ ID NO: 327243 - DNA, 25 bp, Mus musculus
ggccgggttttcagcctgaatacca

SEQ ID NO: 327244 - DNA, 25 bp, Mus musculus
ggccggtacaagcttcctgacagtg

SEQ ID NO: 327245 - DNA, 25 bp, Mus musculus
ggccggtcaagacagggtcttactg

SEQ ID NO: 327246 - DNA, 25 bp, Mus musculus
ggccggtcaagagttataccctgac

SEQ ID NO: 327247 - DNA, 25 bp, Mus musculus
ggccggtcaaggtgtaaactcttcc

SEQ ID NO: 327248 - DNA, 25 bp, Mus musculus
ggccggtcaagtgcacaaccctggc

SEQ ID NO: 327249 - DNA, 25 bp, Mus musculus
ggccggttagaactggtgcaggtcc

SEQ ID NO: 327250 - DNA, 25 bp, Mus musculus
ggccggttaggcctgaggctgcttc

SEQ ID NO: 327251 - DNA, 25 bp, Mus musculus
ggccggttccgagggaggttcagaa

SEQ ID NO: 327252 - DNA, 25 bp, Mus musculus
ggccggttccgaggtgtgtgaggac

SEQ ID NO: 327253 - DNA, 25 bp, Mus musculus
ggccgtaaaatcgaggttaataatg

SEQ ID NO: 327254 - DNA, 25 bp, Mus musculus
ggccgtaaatggttcagactgggca

SEQ ID NO: 327255 - DNA, 25 bp, Mus musculus
ggccgtaagagtgcagaccataatg

SEQ ID NO: 327256 - DNA, 25 bp, Mus musculus
ggccgtacaatggtggtccatgaga

SEQ ID NO: 327257 - DNA, 25 bp, Mus musculus
ggccgtacacccagagaacctgtct

SEQ ID NO: 327258 - DNA, 25 bp, Mus musculus
ggccgtacacccagcttccggaata

SEQ ID NO: 327259 - DNA, 25 bp, Mus musculus
ggccgtaccaccggcatcgtgttgg

SEQ ID NO: 327260 - DNA, 25 bp, Mus musculus
ggccgtacttccgcacctcctctcc

SEQ ID NO: 327261 - DNA, 25 bp, Mus musculus
ggccgtagagcatgcactcttggct

SEQ ID NO: 327262 - DNA, 25 bp, Mus musculus
ggccgtagaggtgctgggattacaa

SEQ ID NO: 327263 - DNA, 25 bp, Mus musculus
ggccgtagggctgttgacctatcaa

SEQ ID NO: 327264 - DNA, 25 bp, Mus musculus
ggccgtattgagagttgcattgtag

SEQ ID NO: 327265 - DNA, 25 bp, Mus musculus
ggccgtattgaggaacaaaggactc

SEQ ID NO: 327266 - DNA, 25 bp, Mus musculus
ggccgtccaagaacatgtaccctag

SEQ ID NO: 327267 - DNA, 25 bp, Mus musculus
ggccgtccacatgcttgtttatgaa

SEQ ID NO: 327268 - DNA, 25 bp, Mus musculus
ggccgtccactccagggctctctaa

SEQ ID NO: 327269 - DNA, 25 bp, Mus musculus
ggccgtcctgaaactgtaccagttc

SEQ ID NO: 327270 - DNA, 25 bp, Mus musculus
ggccgtcgcgcacaggattacatct

SEQ ID NO: 327271 - DNA, 25 bp, Mus musculus
ggccgtcgcgcacaggccctaccgt

SEQ ID NO: 327272 - DNA, 25 bp, Mus musculus
ggccgtcgtcaggtgggtccgagcc

SEQ ID NO: 327273 - DNA, 25 bp, Mus musculus
ggccgtcgtgtgcacgcagtcaggg

SEQ ID NO: 327274 - DNA, 25 bp, Mus musculus
ggccgtcgtgtgcaggcagtcaggg

SEQ ID NO: 327275 - DNA, 25 bp, Mus musculus
ggccgtgaagagtgagccggtggag

SEQ ID NO: 327276 - DNA, 25 bp, Mus musculus
ggccgtgaaggtggaggcagggaag

SEQ ID NO: 327277 - DNA, 25 bp, Mus musculus
ggccgtgatgggaaggtatggatgt

SEQ ID NO: 327278 - DNA, 25 bp, Mus musculus
ggccgtgcagcaagacccagaagct

SEQ ID NO: 327279 - DNA, 25 bp, Mus musculus
ggccgtgcggagctcttggatgcga

SEQ ID NO: 327280 - DNA, 25 bp, Mus musculus
ggccgtgcggccagtgtgtgtgtat

SEQ ID NO: 327281 - DNA, 25 bp, Mus musculus
ggccgtggaagagtgaagacacctc

SEQ ID NO: 327282 - DNA, 25 bp, Mus musculus
ggccgtggcagaggtagttctggta

SEQ ID NO: 327283 - DNA, 25 bp, Mus musculus
ggccgtggttgtgattgaacgggct

SEQ ID NO: 327284 - DNA, 25 bp, Mus musculus
ggccgtggttgtgcatgggcgcctg

SEQ ID NO: 327285 - DNA, 25 bp, Mus musculus
ggccgtgtgagagattggtgtcctt

SEQ ID NO: 327286 - DNA, 25 bp, Mus musculus
ggccgttacacatgagagcagcatg

SEQ ID NO: 327287 - DNA, 25 bp, Mus musculus
ggccgttacacatgctatacctgct

SEQ ID NO: 327288 - DNA, 25 bp, Mus musculus
ggccgttagtggcggcttgacatct

SEQ ID NO: 327289 - DNA, 25 bp, Mus musculus
ggccgttatccagcatttccaggag

SEQ ID NO: 327290 - DNA, 25 bp, Mus musculus
ggccgttatctcacggcgaactttc

SEQ ID NO: 327291 - DNA, 25 bp, Mus musculus
ggccgttcttcataaaactctgaag

SEQ ID NO: 327292 - DNA, 25 bp, Mus musculus
ggccgttgtgaacagaccctgctgt

SEQ ID NO: 327293 - DNA, 25 bp, Mus musculus
ggccgttgtgctcccatgtgtgaag

SEQ ID NO: 327294 - DNA, 25 bp, Mus musculus
ggccgttgtgggcaataccctttct

SEQ ID NO: 327295 - DNA, 25 bp, Mus musculus
ggccgttgttggagccactggcaag

SEQ ID NO: 327296 - DNA, 25 bp, Mus musculus
ggccgtttccacggaagatgctacc

SEQ ID NO: 327297 - DNA, 25 bp, Mus musculus
ggccgtttttgtgatctgccagctt

SEQ ID NO: 327298 - DNA, 25 bp, Mus musculus
ggcctaaaaggctgctctttggcgt

SEQ ID NO: 327299 - DNA, 25 bp, Mus musculus
ggcctaaaagggctccttctcctac

SEQ ID NO: 327300 - DNA, 25 bp, Mus musculus
ggcctaaacgccaggagcccttgcc

SEQ ID NO: 327301 - DNA, 25 bp, Mus musculus
ggcctaaacgccagggaacctttgc

SEQ ID NO: 327302 - DNA, 25 bp, Mus musculus
ggcctaactggtttgcatttcctcc

SEQ ID NO: 327303 - DNA, 25 bp, Mus musculus
ggcctaagcacaggcagcagagctt

SEQ ID NO: 327304 - DNA, 25 bp, Mus musculus
ggcctaagccacagtgacaacagct

SEQ ID NO: 327305 - DNA, 25 bp, Mus musculus
ggcctaaggaatgattggatccagt

SEQ ID NO: 327306 - DNA, 25 bp, Mus musculus
ggcctaatcatgcaggaggatctgc

SEQ ID NO: 327307 - DNA, 25 bp, Mus musculus
ggcctaatcatgcagggtcccacct

SEQ ID NO: 327308 - DNA, 25 bp, Mus musculus
ggcctaatgacagtaattatgccac

SEQ ID NO: 327309 - DNA, 25 bp, Mus musculus
ggcctacacctcggagacctacctg

SEQ ID NO: 327310 - DNA, 25 bp, Mus musculus
ggcctacagaagaggaggccactgg

SEQ ID NO: 327311 - DNA, 25 bp, Mus musculus
ggcctacagtattcagaggaaatat

SEQ ID NO: 327312 - DNA, 25 bp, Mus musculus
ggcctacagtattcagttacggtct

SEQ ID NO: 327313 - DNA, 25 bp, Mus musculus
ggcctacagtattcatgagaacctg

SEQ ID NO: 327314 - DNA, 25 bp, Mus musculus
ggcctaccagagcaatttttatatg

SEQ ID NO: 327315 - DNA, 25 bp, Mus musculus
ggcctaccaggataaggaagcctgt

SEQ ID NO: 327316 - DNA, 25 bp, Mus musculus
ggcctaccaggtcagcttgcaaggt

SEQ ID NO: 327317 - DNA, 25 bp, Mus musculus
ggcctaccgtgtggataaacgtttt

SEQ ID NO: 327318 - DNA, 25 bp, Mus musculus
ggcctaccgtgtggccttcagtggg

SEQ ID NO: 327319 - DNA, 25 bp, Mus musculus
ggcctaccttcttctgtatatgcac

SEQ ID NO: 327320 - DNA, 25 bp, Mus musculus
ggcctacggatcaggtcgtgtctta

SEQ ID NO: 327321 - DNA, 25 bp, Mus musculus
ggcctacggatcagtgacctgaggg

SEQ ID NO: 327322 - DNA, 25 bp, Mus musculus
ggcctactactcttaaaaaacagtt

SEQ ID NO: 327323 - DNA, 25 bp, Mus musculus
ggcctactactgtcgtttatatgct

SEQ ID NO: 327324 - DNA, 25 bp, Mus musculus
ggcctactataagaagatggactaa

SEQ ID NO: 327325 - DNA, 25 bp, Mus musculus
ggcctactataagccagattcccct

SEQ ID NO: 327326 - DNA, 25 bp, Mus musculus
ggcctagaagctgagggttcaagga

SEQ ID NO: 327327 - DNA, 25 bp, Mus musculus
ggcctagactttctgagtaccatgg

SEQ ID NO: 327328 - DNA, 25 bp, Mus musculus
ggcctagagagcaagttcattacag

SEQ ID NO: 327329 - DNA, 25 bp, Mus musculus
ggcctagatctaaggaactaatgaa

SEQ ID NO: 327330 - DNA, 25 bp, Mus musculus
ggcctagcagtggcatctttcttac

SEQ ID NO: 327331 - DNA, 25 bp, Mus musculus
ggcctagcctatgctgctggggcct

SEQ ID NO: 327332 - DNA, 25 bp, Mus musculus
ggcctagcgtctcagagtgcctggt

SEQ ID NO: 327333 - DNA, 25 bp, Mus musculus
ggcctagcgtctcagccaacaagat

SEQ ID NO: 327334 - DNA, 25 bp, Mus musculus
ggcctagctcaagtcttttattcaa

SEQ ID NO: 327335 - DNA, 25 bp, Mus musculus
ggcctaggactgctgatggaattgt

SEQ ID NO: 327336 - DNA, 25 bp, Mus musculus
ggcctaggagatgcaagttgttctg

SEQ ID NO: 327337 - DNA, 25 bp, Mus musculus
ggcctaggaggggcgtccaaagaag

SEQ ID NO: 327338 - DNA, 25 bp, Mus musculus
ggcctagggaaagagacagcacggc

SEQ ID NO: 327339 - DNA, 25 bp, Mus musculus
ggcctatacgctgcctggctcacta

SEQ ID NO: 327340 - DNA, 25 bp, Mus musculus
ggcctatagataagaatagcagaga

SEQ ID NO: 327341 - DNA, 25 bp, Mus musculus
ggcctatcagcgggcttatccgctg

SEQ ID NO: 327342 - DNA, 25 bp, Mus musculus
ggcctatcagcgggtcatagaagag

SEQ ID NO: 327343 - DNA, 25 bp, Mus musculus
ggcctatctcgacgtcggatgcgcc

SEQ ID NO: 327344 - DNA, 25 bp, Mus musculus
ggcctatgaaggaggttccgagttg

SEQ ID NO: 327345 - DNA, 25 bp, Mus musculus
ggcctatgatgatcctcatgggtgt

SEQ ID NO: 327346 - DNA, 25 bp, Mus musculus
ggcctatgatggatctgatgaacga

SEQ ID NO: 327347 - DNA, 25 bp, Mus musculus
ggcctatgcaggagggagcctcaca

SEQ ID NO: 327348 - DNA, 25 bp, Mus musculus
ggcctatgcaggtgtgctgatgatg

SEQ ID NO: 327349 - DNA, 25 bp, Mus musculus
ggcctatggagagttcctcaccatg

SEQ ID NO: 327350 - DNA, 25 bp, Mus musculus
ggcctatggataaggttaaaaattt

SEQ ID NO: 327351 - DNA, 25 bp, Mus musculus
ggcctatggcggagtagtgtatcaa

SEQ ID NO: 327352 - DNA, 25 bp, Mus musculus
ggcctatggcggtgttgtttaccag

SEQ ID NO: 327353 - DNA, 25 bp, Mus musculus
ggcctatgggacaccactgtcccaa

SEQ ID NO: 327354 - DNA, 25 bp, Mus musculus
ggcctatgtcagcactttaatgggt

SEQ ID NO: 327355 - DNA, 25 bp, Mus musculus
ggcctatgtggcaggctgggtccta

SEQ ID NO: 327356 - DNA, 25 bp, Mus musculus
ggcctattaagctgatccacaccga

SEQ ID NO: 327357 - DNA, 25 bp, Mus musculus
ggcctattaagggctcgctgctgaa

SEQ ID NO: 327358 - DNA, 25 bp, Mus musculus
ggcctattacatgccaacaattctc

SEQ ID NO: 327359 - DNA, 25 bp, Mus musculus
ggcctattacatggatacatgggcg

SEQ ID NO: 327360 - DNA, 25 bp, Mus musculus
ggcctattttggatttcagtgaatt

SEQ ID NO: 327361 - DNA, 25 bp, Mus musculus
ggcctattttggcaactccgaagat

SEQ ID NO: 327362 - DNA, 25 bp, Mus musculus
ggcctcaaaaatactgggcggttgc

SEQ ID NO: 327363 - DNA, 25 bp, Mus musculus
ggcctcaaaggttaaggagctgaat

SEQ ID NO: 327364 - DNA, 25 bp, Mus musculus
ggcctcaaatgaagaatcaccgccg

SEQ ID NO: 327365 - DNA, 25 bp, Mus musculus
ggcctcaacagttcctgggtggagc

SEQ ID NO: 327366 - DNA, 25 bp, Mus musculus
ggcctcaactataagtcttgcttcc

SEQ ID NO: 327367 - DNA, 25 bp, Mus musculus
ggcctcacacaagtttaaaaggatg

SEQ ID NO: 327368 - DNA, 25 bp, Mus musculus
ggcctcacaccaagcctgaagaaca

SEQ ID NO: 327369 - DNA, 25 bp, Mus musculus
ggcctcacagatccgtgaagaggtg

SEQ ID NO: 327370 - DNA, 25 bp, Mus musculus
ggcctcaccagtgaagcggcccctg

SEQ ID NO: 327371 - DNA, 25 bp, Mus musculus
ggcctcaccatcctggtatccgtgg

SEQ ID NO: 327372 - DNA, 25 bp, Mus musculus
ggcctcacccagcagcaccctcagc

SEQ ID NO: 327373 - DNA, 25 bp, Mus musculus
ggcctcacctctcaattgtgggttg

SEQ ID NO: 327374 - DNA, 25 bp, Mus musculus
ggcctcacttcggtgggctcggatg

SEQ ID NO: 327375 - DNA, 25 bp, Mus musculus
ggcctcagaaggtggccttcccagg

SEQ ID NO: 327376 - DNA, 25 bp, Mus musculus
ggcctcagcaatgtgaagctgaacg

SEQ ID NO: 327377 - DNA, 25 bp, Mus musculus
ggcctcagggagagatgagcaataa

SEQ ID NO: 327378 - DNA, 25 bp, Mus musculus
ggcctcatcctggtgacatctccca

SEQ ID NO: 327379 - DNA, 25 bp, Mus musculus
ggcctcatgaagacgtcttcatcat

SEQ ID NO: 327380 - DNA, 25 bp, Mus musculus
ggcctcatgaaggttcctttggctt

SEQ ID NO: 327381 - DNA, 25 bp, Mus musculus
ggcctcatgcctttgggcttggaag

SEQ ID NO: 327382 - DNA, 25 bp, Mus musculus
ggcctcatgcttaagctgaagtggt

SEQ ID NO: 327383 - DNA, 25 bp, Mus musculus
ggcctcatgcttaaggctctctatc

SEQ ID NO: 327384 - DNA, 25 bp, Mus musculus
ggcctcatttccgctgcccgtatgg

SEQ ID NO: 327385 - DNA, 25 bp, Mus musculus
ggcctccaacacccgctgcctcaac

SEQ ID NO: 327386 - DNA, 25 bp, Mus musculus
ggcctccaacgtatcccaccaaata

SEQ ID NO: 327387 - DNA, 25 bp, Mus musculus
ggcctccacagagctggtggttcca

SEQ ID NO: 327388 - DNA, 25 bp, Mus musculus
ggcctccacagaggttgtgcccacc

SEQ ID NO: 327389 - DNA, 25 bp, Mus musculus
ggcctccacccacctctcactcccc

SEQ ID NO: 327390 - DNA, 25 bp, Mus musculus
ggcctccagagcagagtgccagctg

SEQ ID NO: 327391 - DNA, 25 bp, Mus musculus
ggcctccagcagataagagtaaaga

SEQ ID NO: 327392 - DNA, 25 bp, Mus musculus
ggcctccagcaggaacacagaggaa

SEQ ID NO: 327393 - DNA, 25 bp, Mus musculus
ggcctccagcaggggctggattcag

SEQ ID NO: 327394 - DNA, 25 bp, Mus musculus
ggcctccagtagagaagctgaaggg

SEQ ID NO: 327395 - DNA, 25 bp, Mus musculus
ggcctccatacagtgctctgtgaag

SEQ ID NO: 327396 - DNA, 25 bp, Mus musculus
ggcctccatggaccctggacttcgg

SEQ ID NO: 327397 - DNA, 25 bp, Mus musculus
ggcctccatgtggatataccgctgt

SEQ ID NO: 327398 - DNA, 25 bp, Mus musculus
ggcctccatgtggcatttggcacat

SEQ ID NO: 327399 - DNA, 25 bp, Mus musculus
ggcctcccaagaaaccagctcttcg

SEQ ID NO: 327400 - DNA, 25 bp, Mus musculus
ggcctcccaagttcttggggacaca

SEQ ID NO: 327401 - DNA, 25 bp, Mus musculus
ggcctcccagcagaaggagtgtcct

SEQ ID NO: 327402 - DNA, 25 bp, Mus musculus
ggcctcccagcagaaggcagcaagc

SEQ ID NO: 327403 - DNA, 25 bp, Mus musculus
ggcctccccagcagtcctttgagaa

SEQ ID NO: 327404 - DNA, 25 bp, Mus musculus
ggcctccccagcgaggggacaaagg

SEQ ID NO: 327405 - DNA, 25 bp, Mus musculus
ggcctccccaggtccccctgacttt

SEQ ID NO: 327406 - DNA, 25 bp, Mus musculus
ggcctccctaccaggaggaagcagt

SEQ ID NO: 327407 - DNA, 25 bp, Mus musculus
ggcctccgagaggttggcctgcttg

SEQ ID NO: 327408 - DNA, 25 bp, Mus musculus
ggcctccgctcaggaacgagttcaa

SEQ ID NO: 327409 - DNA, 25 bp, Mus musculus
ggcctccgctcaggtaaacagaatc

SEQ ID NO: 327410 - DNA, 25 bp, Mus musculus
ggcctccgtcaacactgaggccttc

SEQ ID NO: 327411 - DNA, 25 bp, Mus musculus
ggcctccgtcagctgcagccgactc

SEQ ID NO: 327412 - DNA, 25 bp, Mus musculus
ggcctccgtcccccacacacctgct

SEQ ID NO: 327413 - DNA, 25 bp, Mus musculus
ggcctccgtggagcgactatcctgg

SEQ ID NO: 327414 - DNA, 25 bp, Mus musculus
ggcctcctcaagctaaagaacgctt

SEQ ID NO: 327415 - DNA, 25 bp, Mus musculus
ggcctcctcctaccccatcccagca

SEQ ID NO: 327416 - DNA, 25 bp, Mus musculus
ggcctcctggaatgccgccatgact

SEQ ID NO: 327417 - DNA, 25 bp, Mus musculus
ggcctcctggactgtgctgggggct

SEQ ID NO: 327418 - DNA, 25 bp, Mus musculus
ggcctcctggccaggtggccattga

SEQ ID NO: 327419 - DNA, 25 bp, Mus musculus
ggcctcctgggtggtgcagactgtg

SEQ ID NO: 327420 - DNA, 25 bp, Mus musculus
ggcctcgacagcctgatgggggatg

SEQ ID NO: 327421 - DNA, 25 bp, Mus musculus
ggcctcgacagcctgattggagata

SEQ ID NO: 327422 - DNA, 25 bp, Mus musculus
ggcctcgcaccggaagaaaagatgt

SEQ ID NO: 327423 - DNA, 25 bp, Mus musculus
ggcctcgccaagagttcctccagca

SEQ ID NO: 327424 - DNA, 25 bp, Mus musculus
ggcctcgccaaggtatgtggaccga

SEQ ID NO: 327425 - DNA, 25 bp, Mus musculus
ggcctcgccagaagccccccagcac

SEQ ID NO: 327426 - DNA, 25 bp, Mus musculus
ggcctcgcccgactatctctcacct

SEQ ID NO: 327427 - DNA, 25 bp, Mus musculus
ggcctcgccgcgcagactgggaaga

SEQ ID NO: 327428 - DNA, 25 bp, Mus musculus
ggcctcgccgcgcaggatctaccaa

SEQ ID NO: 327429 - DNA, 25 bp, Mus musculus
ggcctcgcgctataaccacttccga

SEQ ID NO: 327430 - DNA, 25 bp, Mus musculus
ggcctcgctaggatgcttcatttct

SEQ ID NO: 327431 - DNA, 25 bp, Mus musculus
ggcctcgctggtggctggaggggta

SEQ ID NO: 327432 - DNA, 25 bp, Mus musculus
ggcctcggtgattgaagtgagtgaa

SEQ ID NO: 327433 - DNA, 25 bp, Mus musculus
ggcctcgtactcagaaacgaaagct

SEQ ID NO: 327434 - DNA, 25 bp, Mus musculus
ggcctcgtctaggtgccgccccagt

SEQ ID NO: 327435 - DNA, 25 bp, Mus musculus
ggcctcgtggagttcaggaccttgc

SEQ ID NO: 327436 - DNA, 25 bp, Mus musculus
ggcctcgttctctgaaccttcagct

SEQ ID NO: 327437 - DNA, 25 bp, Mus musculus
ggcctctaagtgccatcacctgttt

SEQ ID NO: 327438 - DNA, 25 bp, Mus musculus
ggcctctaagttgctgactgtccag

SEQ ID NO: 327439 - DNA, 25 bp, Mus musculus
ggcctctaccggacacacctgctct

SEQ ID NO: 327440 - DNA, 25 bp, Mus musculus
ggcctctaggaaggtatggcctcac

SEQ ID NO: 327441 - DNA, 25 bp, Mus musculus
ggcctctatctggggactgcctcca

SEQ ID NO: 327442 - DNA, 25 bp, Mus musculus
ggcctctatctgggttggacctcga

SEQ ID NO: 327443 - DNA, 25 bp, Mus musculus
ggcctctcaaaggacagtgaacttt

SEQ ID NO: 327444 - DNA, 25 bp, Mus musculus
ggcctctcaactggtgtggtgtgga

SEQ ID NO: 327445 - DNA, 25 bp, Mus musculus
ggcctctcagaaaacatccagtaca

SEQ ID NO: 327446 - DNA, 25 bp, Mus musculus
ggcctctcagaagacaaaagagagc

SEQ ID NO: 327447 - DNA, 25 bp, Mus musculus
ggcctctcagaagcatcactatttc

SEQ ID NO: 327448 - DNA, 25 bp, Mus musculus
ggcctctcaggtcaaaggctgagag

SEQ ID NO: 327449 - DNA, 25 bp, Mus musculus
ggcctctcatctccgacttcttcgc

SEQ ID NO: 327450 - DNA, 25 bp, Mus musculus
ggcctctgagaaggagcgcagaccc

SEQ ID NO: 327451 - DNA, 25 bp, Mus musculus
ggcctctgaggccttcttgctaagg

SEQ ID NO: 327452 - DNA, 25 bp, Mus musculus
ggcctctgataaaggcaactgttgg

SEQ ID NO: 327453 - DNA, 25 bp, Mus musculus
ggcctctgatgacccccggagcaaa

SEQ ID NO: 327454 - DNA, 25 bp, Mus musculus
ggcctctgatgcttgattatacatc

SEQ ID NO: 327455 - DNA, 25 bp, Mus musculus
ggcctctgcaggtggcgacctgcac

SEQ ID NO: 327456 - DNA, 25 bp, Mus musculus
ggcctctgctgtgctgaaatggagg

SEQ ID NO: 327457 - DNA, 25 bp, Mus musculus
ggcctctggagccgattcaaaaggt

SEQ ID NO: 327458 - DNA, 25 bp, Mus musculus
ggcctctggcagagcctgccccagt

SEQ ID NO: 327459 - DNA, 25 bp, Mus musculus
ggcctctggcctcaggtaaccatgg

SEQ ID NO: 327460 - DNA, 25 bp, Mus musculus
ggcctctgtctgggcggcaatctgc

SEQ ID NO: 327461 - DNA, 25 bp, Mus musculus
ggcctctgtgtggatgccttcaaag

SEQ ID NO: 327462 - DNA, 25 bp, Mus musculus
ggcctctgtgtgggtactatcttgg

SEQ ID NO: 327463 - DNA, 25 bp, Mus musculus
ggcctcttcacaattacgctcgatt

SEQ ID NO: 327464 - DNA, 25 bp, Mus musculus
ggcctcttcgcttggggtgcacaca

SEQ ID NO: 327465 - DNA, 25 bp, Mus musculus
ggcctcttgcctgctagcagccaca

SEQ ID NO: 327466 - DNA, 25 bp, Mus musculus
ggcctctttaaaagaacagatgcac

SEQ ID NO: 327467 - DNA, 25 bp, Mus musculus
ggcctctttaaattgaaaatacaga

SEQ ID NO: 327468 - DNA, 25 bp, Mus musculus
ggcctctttggaggctcatccaaaa

SEQ ID NO: 327469 - DNA, 25 bp, Mus musculus
ggcctctttggctgctgggaacgct

SEQ ID NO: 327470 - DNA, 25 bp, Mus musculus
ggcctgaaaagagattcatctgttt

SEQ ID NO: 327471 - DNA, 25 bp, Mus musculus
ggcctgaaaagagatttcgatagtg

SEQ ID NO: 327472 - DNA, 25 bp, Mus musculus
ggcctgaacagaaaggtcaaatcat

SEQ ID NO: 327473 - DNA, 25 bp, Mus musculus
ggcctgaagaaggagctgcgggagc

SEQ ID NO: 327474 - DNA, 25 bp, Mus musculus
ggcctgaagcaaggtattggttttc

SEQ ID NO: 327475 - DNA, 25 bp, Mus musculus
ggcctgaagccggtcgacaatggat

SEQ ID NO: 327476 - DNA, 25 bp, Mus musculus
ggcctgaaggacctccacaggagtg

SEQ ID NO: 327477 - DNA, 25 bp, Mus musculus
ggcctgaagtgtcagcttgatactc

SEQ ID NO: 327478 - DNA, 25 bp, Mus musculus
ggcctgaagtgtcaggcgtttgcac

SEQ ID NO: 327479 - DNA, 25 bp, Mus musculus
ggcctgaatgatatgtttggacccc

SEQ ID NO: 327480 - DNA, 25 bp, Mus musculus
ggcctgaatggctccgtgctctgtc

SEQ ID NO: 327481 - DNA, 25 bp, Mus musculus
ggcctgaatgtctcttacagatatg

SEQ ID NO: 327482 - DNA, 25 bp, Mus musculus
ggcctgacactgactctcatggtac

SEQ ID NO: 327483 - DNA, 25 bp, Mus musculus
ggcctgacaggagtccccggcatgt

SEQ ID NO: 327484 - DNA, 25 bp, Mus musculus
ggcctgacccagaggtctttgaccc

SEQ ID NO: 327485 - DNA, 25 bp, Mus musculus
ggcctgacccggctccactctagcc

SEQ ID NO: 327486 - DNA, 25 bp, Mus musculus
ggcctgaccttataaacttcagtgc

SEQ ID NO: 327487 - DNA, 25 bp, Mus musculus
ggcctgactcaggtctgctggcagg

SEQ ID NO: 327488 - DNA, 25 bp, Mus musculus
ggcctgagcaaggaggacttcgtgg

SEQ ID NO: 327489 - DNA, 25 bp, Mus musculus
ggcctgagcaaggagtggctccgcg

SEQ ID NO: 327490 - DNA, 25 bp, Mus musculus
ggcctgagcattggaaacaagctcc

SEQ ID NO: 327491 - DNA, 25 bp, Mus musculus
ggcctgagcctccagtgttgagtgg

SEQ ID NO: 327492 - DNA, 25 bp, Mus musculus
ggcctgaggaatagacttttcactg

SEQ ID NO: 327493 - DNA, 25 bp, Mus musculus
ggcctgaggaatagccctggctttc

SEQ ID NO: 327494 - DNA, 25 bp, Mus musculus
ggcctgaggaatagcttctggaatt

SEQ ID NO: 327495 - DNA, 25 bp, Mus musculus
ggcctgaggagcttttcatgcagat

SEQ ID NO: 327496 - DNA, 25 bp, Mus musculus
ggcctgaggtccagatgggctcctc

SEQ ID NO: 327497 - DNA, 25 bp, Mus musculus
ggcctgaggtccaggaactgttaag

SEQ ID NO: 327498 - DNA, 25 bp, Mus musculus
ggcctgatctggaagtggctcagga

SEQ ID NO: 327499 - DNA, 25 bp, Mus musculus
ggcctgatgcattcacagggtgatc

SEQ ID NO: 327500 - DNA, 25 bp, Mus musculus
ggcctgatgggcaggcaccaggaga

SEQ ID NO: 327501 - DNA, 25 bp, Mus musculus
ggcctgcaagttataccacatcaca

SEQ ID NO: 327502 - DNA, 25 bp, Mus musculus
ggcctgcagagaggaaaaccaaaga

SEQ ID NO: 327503 - DNA, 25 bp, Mus musculus
ggcctgcagagccagagccagctga

SEQ ID NO: 327504 - DNA, 25 bp, Mus musculus
ggcctgcagagccagagtctgcaga

SEQ ID NO: 327505 - DNA, 25 bp, Mus musculus
ggcctgccaccaaaggtcgggtcat

SEQ ID NO: 327506 - DNA, 25 bp, Mus musculus
ggcctgccagggacatcacagtggc

SEQ ID NO: 327507 - DNA, 25 bp, Mus musculus
ggcctgcccgaaagagtctaaagcg

SEQ ID NO: 327508 - DNA, 25 bp, Mus musculus
ggcctgccgctgggcgtccgacctc

SEQ ID NO: 327509 - DNA, 25 bp, Mus musculus
ggcctgccgctggtaagactttgaa

SEQ ID NO: 327510 - DNA, 25 bp, Mus musculus
ggcctgcgaagatataaatgagtgt

SEQ ID NO: 327511 - DNA, 25 bp, Mus musculus
ggcctgcgacggccagggtggaact

SEQ ID NO: 327512 - DNA, 25 bp, Mus musculus
ggcctgcgcaggaatcttgggaagc

SEQ ID NO: 327513 - DNA, 25 bp, Mus musculus
ggcctgcggaggataagacctctga

SEQ ID NO: 327514 - DNA, 25 bp, Mus musculus
ggcctgcggtagaaaaagcagacgg

SEQ ID NO: 327515 - DNA, 25 bp, Mus musculus
ggcctgctacaaggtgcagcagaaa

SEQ ID NO: 327516 - DNA, 25 bp, Mus musculus
ggcctgctcctcagccctaaagaac

SEQ ID NO: 327517 - DNA, 25 bp, Mus musculus
ggcctgctgaccgacaggctctgcg

SEQ ID NO: 327518 - DNA, 25 bp, Mus musculus
ggcctgctgaccgatttctgcatga

SEQ ID NO: 327519 - DNA, 25 bp, Mus musculus
ggcctgctgaggactggctgcccca

SEQ ID NO: 327520 - DNA, 25 bp, Mus musculus
ggcctgctggcagcctccggacccc

SEQ ID NO: 327521 - DNA, 25 bp, Mus musculus
ggcctgctggctggcggggtgccac

SEQ ID NO: 327522 - DNA, 25 bp, Mus musculus
ggcctgctgggttcacggctcagca

SEQ ID NO: 327523 - DNA, 25 bp, Mus musculus
ggcctgcttacaggaagccgagata

SEQ ID NO: 327524 - DNA, 25 bp, Mus musculus
ggcctgctttacagatcgctgtgga

SEQ ID NO: 327525 - DNA, 25 bp, Mus musculus
ggcctgctttacagctgacttggag

SEQ ID NO: 327526 - DNA, 25 bp, Mus musculus
ggcctggaaaggtacagttaaagaa

SEQ ID NO: 327527 - DNA, 25 bp, Mus musculus
ggcctggaccgagagaaagtccctg

SEQ ID NO: 327528 - DNA, 25 bp, Mus musculus
ggcctggacctacaacaccacctct

SEQ ID NO: 327529 - DNA, 25 bp, Mus musculus
ggcctggacgaaaaccacgagctgt

SEQ ID NO: 327530 - DNA, 25 bp, Mus musculus
ggcctggacgacgctgagcaggggt

SEQ ID NO: 327531 - DNA, 25 bp, Mus musculus
ggcctggactgatgggaaggaggcc

SEQ ID NO: 327532 - DNA, 25 bp, Mus musculus
ggcctggagaaagaggctgccactc

SEQ ID NO: 327533 - DNA, 25 bp, Mus musculus
ggcctggagaaagaggtggaggtga

SEQ ID NO: 327534 - DNA, 25 bp, Mus musculus
ggcctggagaaagagtggaggtgat

SEQ ID NO: 327535 - DNA, 25 bp, Mus musculus
ggcctggaggaggacagtggtcacc

SEQ ID NO: 327536 - DNA, 25 bp, Mus musculus
ggcctggaggttgcagaggacagtg

SEQ ID NO: 327537 - DNA, 25 bp, Mus musculus
ggcctggcacatgccctggtggaac

SEQ ID NO: 327538 - DNA, 25 bp, Mus musculus
ggcctggcaggcccttttagctacc

SEQ ID NO: 327539 - DNA, 25 bp, Mus musculus
ggcctggcaggggctgcgatggacc

SEQ ID NO: 327540 - DNA, 25 bp, Mus musculus
ggcctggcaggtagcagaggcagca

SEQ ID NO: 327541 - DNA, 25 bp, Mus musculus
ggcctggcaggtcctgaaacaccta

SEQ ID NO: 327542 - DNA, 25 bp, Mus musculus
ggcctggcaggtgcccttctccaac

SEQ ID NO: 327543 - DNA, 25 bp, Mus musculus
ggcctggcaggttcagtcctcgccc

SEQ ID NO: 327544 - DNA, 25 bp, Mus musculus
ggcctggcaggtttaagtttctagt

SEQ ID NO: 327545 - DNA, 25 bp, Mus musculus
ggcctggcagtgtgtctccaggcta

SEQ ID NO: 327546 - DNA, 25 bp, Mus musculus
ggcctggcagtttctagtcctggca

SEQ ID NO: 327547 - DNA, 25 bp, Mus musculus
ggcctggccaccagccccactctgc

SEQ ID NO: 327548 - DNA, 25 bp, Mus musculus
ggcctggccaccaggataaagcatg

SEQ ID NO: 327549 - DNA, 25 bp, Mus musculus
ggcctggccaggagtgaattggagg

SEQ ID NO: 327550 - DNA, 25 bp, Mus musculus
ggcctggcccacagaattacggcag

SEQ ID NO: 327551 - DNA, 25 bp, Mus musculus
ggcctggcccacagactgacccttg

SEQ ID NO: 327552 - DNA, 25 bp, Mus musculus
ggcctggcccggacttagcattcag

SEQ ID NO: 327553 - DNA, 25 bp, Mus musculus
ggcctggcgcttaatgaaaaactat

SEQ ID NO: 327554 - DNA, 25 bp, Mus musculus
ggcctggcgttcatggaatatgaag

SEQ ID NO: 327555 - DNA, 25 bp, Mus musculus
ggcctggctgggatgggtgctacag

SEQ ID NO: 327556 - DNA, 25 bp, Mus musculus
ggcctgggaacaaaggaggaggaca

SEQ ID NO: 327557 - DNA, 25 bp, Mus musculus
ggcctgggaggcccggcacaaggac

SEQ ID NO: 327558 - DNA, 25 bp, Mus musculus
ggcctgggatgggaggtcccacgtg

SEQ ID NO: 327559 - DNA, 25 bp, Mus musculus
ggcctgggattaaagattcatcagt

SEQ ID NO: 327560 - DNA, 25 bp, Mus musculus
ggcctgggctgcgggagccaatgtc

SEQ ID NO: 327561 - DNA, 25 bp, Mus musculus
ggcctgggctgcgggtttgttttct

SEQ ID NO: 327562 - DNA, 25 bp, Mus musculus
ggcctggggaaagcattgtggaatt

SEQ ID NO: 327563 - DNA, 25 bp, Mus musculus
ggcctggggttgggcgacagagaga

SEQ ID NO: 327564 - DNA, 25 bp, Mus musculus
ggcctggtgacaagggagaccaggg

SEQ ID NO: 327565 - DNA, 25 bp, Mus musculus
ggcctggtgcagctggtgctgctgg

SEQ ID NO: 327566 - DNA, 25 bp, Mus musculus
ggcctggtggatgactatgggctca

SEQ ID NO: 327567 - DNA, 25 bp, Mus musculus
ggcctggtggtgcacaatcctggag

SEQ ID NO: 327568 - DNA, 25 bp, Mus musculus
ggcctggtgtgggctaaattggttc

SEQ ID NO: 327569 - DNA, 25 bp, Mus musculus
ggcctgtaccattgcctatggcctg

SEQ ID NO: 327570 - DNA, 25 bp, Mus musculus
ggcctgtcatcctcgaagccaagct

SEQ ID NO: 327571 - DNA, 25 bp, Mus musculus
ggcctgtcatcctcgtgcctggctg

SEQ ID NO: 327572 - DNA, 25 bp, Mus musculus
ggcctgtctcagatgtcttcagtac

SEQ ID NO: 327573 - DNA, 25 bp, Mus musculus
ggcctgtctgaggccctggccagat

SEQ ID NO: 327574 - DNA, 25 bp, Mus musculus
ggcctgtgagctggatctcatggag

SEQ ID NO: 327575 - DNA, 25 bp, Mus musculus
ggcctgtgagtgctgccgacctaag

SEQ ID NO: 327576 - DNA, 25 bp, Mus musculus
ggcctgtgccaaggtcgagtatgcc

SEQ ID NO: 327577 - DNA, 25 bp, Mus musculus
ggcctgtggagggttgtctaccgga

SEQ ID NO: 327578 - DNA, 25 bp, Mus musculus
ggcctgtgggacccgaacaatttcg

SEQ ID NO: 327579 - DNA, 25 bp, Mus musculus
ggcctgtggtatcctgcctgtttat

SEQ ID NO: 327580 - DNA, 25 bp, Mus musculus
ggcctgtgttgctacccctctgggc

SEQ ID NO: 327581 - DNA, 25 bp, Mus musculus
ggcctgttaagaccactgttccctt

SEQ ID NO: 327582 - DNA, 25 bp, Mus musculus
ggccttaaagactattaagataatg

SEQ ID NO: 327583 - DNA, 25 bp, Mus musculus
ggccttaaaggaaatgaaagtgccc

SEQ ID NO: 327584 - DNA, 25 bp, Mus musculus
ggccttaaagtctttaagaaataga

SEQ ID NO: 327585 - DNA, 25 bp, Mus musculus
ggccttaaatcagtgtcggtgacgt

SEQ ID NO: 327586 - DNA, 25 bp, Mus musculus
ggccttaatgggcaacgtggttctg

SEQ ID NO: 327587 - DNA, 25 bp, Mus musculus
ggccttaccatgtgccctggggggc

SEQ ID NO: 327588 - DNA, 25 bp, Mus musculus
ggccttagagtttctgcgccccctg

SEQ ID NO: 327589 - DNA, 25 bp, Mus musculus
ggccttagggcaagattctcagcca

SEQ ID NO: 327590 - DNA, 25 bp, Mus musculus
ggccttagtcctgatgctgtctatg

SEQ ID NO: 327591 - DNA, 25 bp, Mus musculus
ggccttagtctgctacatagcccat

SEQ ID NO: 327592 - DNA, 25 bp, Mus musculus
ggccttagtctggtacatagcccat

SEQ ID NO: 327593 - DNA, 25 bp, Mus musculus
ggccttagtgcaggaaacttcgcgg

SEQ ID NO: 327594 - DNA, 25 bp, Mus musculus
ggccttatggaggaaggtcgtggac

SEQ ID NO: 327595 - DNA, 25 bp, Mus musculus
ggccttcaaccgaaacaagctccca

SEQ ID NO: 327596 - DNA, 25 bp, Mus musculus
ggccttcaagaaaattacaacacca

SEQ ID NO: 327597 - DNA, 25 bp, Mus musculus
ggccttcaagacagatcctcaagaa

SEQ ID NO: 327598 - DNA, 25 bp, Mus musculus
ggccttcaagacagcgtgggtgggc

SEQ ID NO: 327599 - DNA, 25 bp, Mus musculus
ggccttcaaggcctgacaacatcgc

SEQ ID NO: 327600 - DNA, 25 bp, Mus musculus
ggccttcaaggttgtagccctcgga

SEQ ID NO: 327601 - DNA, 25 bp, Mus musculus
ggccttcacaatctccagaactaca

SEQ ID NO: 327602 - DNA, 25 bp, Mus musculus
ggccttcactggggcactcagaaag

SEQ ID NO: 327603 - DNA, 25 bp, Mus musculus
ggccttcagagctccagatacctgt

SEQ ID NO: 327604 - DNA, 25 bp, Mus musculus
ggccttcagccacatcccagagggt

SEQ ID NO: 327605 - DNA, 25 bp, Mus musculus
ggccttcagccggtttcaccgcgtg

SEQ ID NO: 327606 - DNA, 25 bp, Mus musculus
ggccttcatgccatttcagtgcccg

SEQ ID NO: 327607 - DNA, 25 bp, Mus musculus
ggccttccacgagttcgaggaagcc

SEQ ID NO: 327608 - DNA, 25 bp, Mus musculus
ggccttccagccatgctgcaagctg

SEQ ID NO: 327609 - DNA, 25 bp, Mus musculus
ggccttccaggagatggagttgcta

SEQ ID NO: 327610 - DNA, 25 bp, Mus musculus
ggccttccaggaggggctggagggt

SEQ ID NO: 327611 - DNA, 25 bp, Mus musculus
ggccttccagggctgaccagtttga

SEQ ID NO: 327612 - DNA, 25 bp, Mus musculus
ggccttccccttagctcagagctct

SEQ ID NO: 327613 - DNA, 25 bp, Mus musculus
ggccttccgggctccctggtcctga

SEQ ID NO: 327614 - DNA, 25 bp, Mus musculus
ggccttcctcagcccaggtcctgag

SEQ ID NO: 327615 - DNA, 25 bp, Mus musculus
ggccttcctcagcgagctggagccc

SEQ ID NO: 327616 - DNA, 25 bp, Mus musculus
ggccttcgagtttgatcctgagttg

SEQ ID NO: 327617 - DNA, 25 bp, Mus musculus
ggccttcgcgtcacggtcttgttgc

SEQ ID NO: 327618 - DNA, 25 bp, Mus musculus
ggccttctatagcccgtgtgattga

SEQ ID NO: 327619 - DNA, 25 bp, Mus musculus
ggccttctataggcctctgctcgat

SEQ ID NO: 327620 - DNA, 25 bp, Mus musculus
ggccttctatagtgagattatatag

SEQ ID NO: 327621 - DNA, 25 bp, Mus musculus
ggccttctatcgaattcgctccaac

SEQ ID NO: 327622 - DNA, 25 bp, Mus musculus
ggccttctctctgaaggtgttcctc

SEQ ID NO: 327623 - DNA, 25 bp, Mus musculus
ggccttctggagcacatcttatact

SEQ ID NO: 327624 - DNA, 25 bp, Mus musculus
ggccttctgtcaggtgagcgtcctc

SEQ ID NO: 327625 - DNA, 25 bp, Mus musculus
ggccttcttgagctgaaaattgaga

SEQ ID NO: 327626 - DNA, 25 bp, Mus musculus
ggccttcttgagggccttcttgaag

SEQ ID NO: 327627 - DNA, 25 bp, Mus musculus
ggccttctttgatgtgaagacaaca

SEQ ID NO: 327628 - DNA, 25 bp, Mus musculus
ggccttgaaaagatgaatgagaaca

SEQ ID NO: 327629 - DNA, 25 bp, Mus musculus
ggccttgaaaagattggccacctgc

SEQ ID NO: 327630 - DNA, 25 bp, Mus musculus
ggccttgaaaaggtagacccacaac

SEQ ID NO: 327631 - DNA, 25 bp, Mus musculus
ggccttgaaggatttagttgtcttt

SEQ ID NO: 327632 - DNA, 25 bp, Mus musculus
ggccttgaagtgctttaggatttag

SEQ ID NO: 327633 - DNA, 25 bp, Mus musculus
ggccttgacaatatcaacatgacac

SEQ ID NO: 327634 - DNA, 25 bp, Mus musculus
ggccttgacctgttgaggagacttc

SEQ ID NO: 327635 - DNA, 25 bp, Mus musculus
ggccttgacgagatgctgttggctg

SEQ ID NO: 327636 - DNA, 25 bp, Mus musculus
ggccttgacgaggggatgagagagt

SEQ ID NO: 327637 - DNA, 25 bp, Mus musculus
ggccttgatgtgagccatgagcctc

SEQ ID NO: 327638 - DNA, 25 bp, Mus musculus
ggccttgcaagcaaggtgcagagct

SEQ ID NO: 327639 - DNA, 25 bp, Mus musculus
ggccttgcaagctatgtctgagctc

SEQ ID NO: 327640 - DNA, 25 bp, Mus musculus
ggccttgcaaggggagagttagatt

SEQ ID NO: 327641 - DNA, 25 bp, Mus musculus
ggccttgcagagacattttgagcag

SEQ ID NO: 327642 - DNA, 25 bp, Mus musculus
ggccttgccaaggtccacccgactc

SEQ ID NO: 327643 - DNA, 25 bp, Mus musculus
ggccttgccaggaaaatactaaagt

SEQ ID NO: 327644 - DNA, 25 bp, Mus musculus
ggccttgctaatccgaataatttaa

SEQ ID NO: 327645 - DNA, 25 bp, Mus musculus
ggccttgcttcacgcgtctgtggag

SEQ ID NO: 327646 - DNA, 25 bp, Mus musculus
ggccttgcttcaggcgtctgtggag

SEQ ID NO: 327647 - DNA, 25 bp, Mus musculus
ggccttggaaggaggtgggcctccc

SEQ ID NO: 327648 - DNA, 25 bp, Mus musculus
ggccttggaggaaactttgcttccc

SEQ ID NO: 327649 - DNA, 25 bp, Mus musculus
ggccttggaggacagatgccctgct

SEQ ID NO: 327650 - DNA, 25 bp, Mus musculus
ggccttggaggtttgcctggagaca

SEQ ID NO: 327651 - DNA, 25 bp, Mus musculus
ggccttggcaacagaccccaatatc

SEQ ID NO: 327652 - DNA, 25 bp, Mus musculus
ggccttggcaattatttgtataact

SEQ ID NO: 327653 - DNA, 25 bp, Mus musculus
ggccttggcagcacaaacttgacct

SEQ ID NO: 327654 - DNA, 25 bp, Mus musculus
ggccttggcaggggccagtccctgt

SEQ ID NO: 327655 - DNA, 25 bp, Mus musculus
ggccttggcaggtctctcttcagta

SEQ ID NO: 327656 - DNA, 25 bp, Mus musculus
ggccttgggaagatgctgctctttg

SEQ ID NO: 327657 - DNA, 25 bp, Mus musculus
ggccttgggaagatgctggagacct

SEQ ID NO: 327658 - DNA, 25 bp, Mus musculus
ggccttgggaagatggctccttctc

SEQ ID NO: 327659 - DNA, 25 bp, Mus musculus
ggccttggggctcggatggtaaaac

SEQ ID NO: 327660 - DNA, 25 bp, Mus musculus
ggccttggggctcggcatctatatt

SEQ ID NO: 327661 - DNA, 25 bp, Mus musculus
ggccttggtcgatccactctctcat

SEQ ID NO: 327662 - DNA, 25 bp, Mus musculus
ggccttgtaaacatcagctgcgggc

SEQ ID NO: 327663 - DNA, 25 bp, Mus musculus
ggccttgtacaggtatcacaaggct

SEQ ID NO: 327664 - DNA, 25 bp, Mus musculus
ggccttgtcgggtgtgatcatggtg

SEQ ID NO: 327665 - DNA, 25 bp, Mus musculus
ggccttgtggaaaacaacaggttta

SEQ ID NO: 327666 - DNA, 25 bp, Mus musculus
ggccttgtggaaaagctgacaacgt

SEQ ID NO: 327667 - DNA, 25 bp, Mus musculus
ggccttgtggagcgggtaatggatg

SEQ ID NO: 327668 - DNA, 25 bp, Mus musculus
ggccttgtgttttttcagttctacc

SEQ ID NO: 327669 - DNA, 25 bp, Mus musculus
ggcctttaagcctggaaaggaaatt

SEQ ID NO: 327670 - DNA, 25 bp, Mus musculus
ggcctttacagagatgagcatcagg

SEQ ID NO: 327671 - DNA, 25 bp, Mus musculus
ggcctttaccagcctgccgacataa

SEQ ID NO: 327672 - DNA, 25 bp, Mus musculus
ggcctttaccaggacagccacttcc

SEQ ID NO: 327673 - DNA, 25 bp, Mus musculus
ggcctttaccagggtctcagcactg

SEQ ID NO: 327674 - DNA, 25 bp, Mus musculus
ggcctttactttcaacatcaaagtg

SEQ ID NO: 327675 - DNA, 25 bp, Mus musculus
ggcctttagccccagtggatctaaa

SEQ ID NO: 327676 - DNA, 25 bp, Mus musculus
ggcctttaggatgggaaagttgaca

SEQ ID NO: 327677 - DNA, 25 bp, Mus musculus
ggcctttaggctccccatatatact

SEQ ID NO: 327678 - DNA, 25 bp, Mus musculus
ggcctttatcggatccggaaggggg

SEQ ID NO: 327679 - DNA, 25 bp, Mus musculus
ggcctttatggcatctgaacgcctt

SEQ ID NO: 327680 - DNA, 25 bp, Mus musculus
ggcctttattaagtacagtccaccc

SEQ ID NO: 327681 - DNA, 25 bp, Mus musculus
ggcctttcagagacgaagagagtat

SEQ ID NO: 327682 - DNA, 25 bp, Mus musculus
ggcctttcagcttcaagaaaagaag

SEQ ID NO: 327683 - DNA, 25 bp, Mus musculus
ggcctttcaggtctgcctcggccac

SEQ ID NO: 327684 - DNA, 25 bp, Mus musculus
ggcctttcaggtgatctgtctggcc

SEQ ID NO: 327685 - DNA, 25 bp, Mus musculus
ggcctttcttagacacatgcagccg

SEQ ID NO: 327686 - DNA, 25 bp, Mus musculus
ggcctttgaaaaagcgctctccagt

SEQ ID NO: 327687 - DNA, 25 bp, Mus musculus
ggcctttgaaaaagctgtcaagagc

SEQ ID NO: 327688 - DNA, 25 bp, Mus musculus
ggcctttgatgccgtcctgcttgag

SEQ ID NO: 327689 - DNA, 25 bp, Mus musculus
ggcctttgctggggacagtaaatcc

SEQ ID NO: 327690 - DNA, 25 bp, Mus musculus
ggcctttgttcaagcacacaaccat

SEQ ID NO: 327691 - DNA, 25 bp, Mus musculus
ggcctttgttcaggaatatcgttca

SEQ ID NO: 327692 - DNA, 25 bp, Mus musculus
ggccttttatcaggttccttagctg

SEQ ID NO: 327693 - DNA, 25 bp, Mus musculus
ggccttttcagaactcaagctcttc

SEQ ID NO: 327694 - DNA, 25 bp, Mus musculus
ggccttttcagggctacagtgcatg

SEQ ID NO: 327695 - DNA, 25 bp, Mus musculus
ggccttttgaaggtcaattcttcaa

SEQ ID NO: 327696 - DNA, 25 bp, Mus musculus
ggccttttgaaggtgaattcttcaa

SEQ ID NO: 327697 - DNA, 25 bp, Mus musculus
ggcctttttcctatattgttgatct

SEQ ID NO: 327698 - DNA, 25 bp, Mus musculus
ggcctttttcctattcttctgccct

SEQ ID NO: 327699 - DNA, 25 bp, Mus musculus
ggcctttttgcctccagcgtctcct

SEQ ID NO: 327700 - DNA, 25 bp, Mus musculus
ggcgaaaatcagatcaaagatgaga

SEQ ID NO: 327701 - DNA, 25 bp, Mus musculus
ggcgaaagaagagtggaggaaccac

SEQ ID NO: 327702 - DNA, 25 bp, Mus musculus
ggcgaaagctgataacacatgatcc

SEQ ID NO: 327703 - DNA, 25 bp, Mus musculus
ggcgaaagctgattccaaattacag

SEQ ID NO: 327704 - DNA, 25 bp, Mus musculus
ggcgaaagctggttccttgtggaga

SEQ ID NO: 327705 - DNA, 25 bp, Mus musculus
ggcgaaagctggtttaactcacatt

SEQ ID NO: 327706 - DNA, 25 bp, Mus musculus
ggcgaaatgtagctttggcaccgac

SEQ ID NO: 327707 - DNA, 25 bp, Mus musculus
ggcgaaatgtgtaagctgctggctc

SEQ ID NO: 327708 - DNA, 25 bp, Mus musculus
ggcgaaccacagaaagcgtccatcc

SEQ ID NO: 327709 - DNA, 25 bp, Mus musculus
ggcgaaccaggtgatcaggtgtaag

SEQ ID NO: 327710 - DNA, 25 bp, Mus musculus
ggcgaacgagagagctgttctctac

SEQ ID NO: 327711 - DNA, 25 bp, Mus musculus
ggcgaacgagagatgctcccttcgg

SEQ ID NO: 327712 - DNA, 25 bp, Mus musculus
ggcgaagaagcaatgatggagcagg

SEQ ID NO: 327713 - DNA, 25 bp, Mus musculus
ggcgaagctcaaggccacttcttac

SEQ ID NO: 327714 - DNA, 25 bp, Mus musculus
ggcgaaggaggatgaggaacctggg

SEQ ID NO: 327715 - DNA, 25 bp, Mus musculus
ggcgaaggagggtggccggactgca

SEQ ID NO: 327716 - DNA, 25 bp, Mus musculus
ggcgaatcagaataatttaaaaatg

SEQ ID NO: 327717 - DNA, 25 bp, Mus musculus
ggcgaatgatcagatgagaggctgt

SEQ ID NO: 327718 - DNA, 25 bp, Mus musculus
ggcgaatgggaaagggccaaataaa

SEQ ID NO: 327719 - DNA, 25 bp, Mus musculus
ggcgaatggtttttggtctcagtgt

SEQ ID NO: 327720 - DNA, 25 bp, Mus musculus
ggcgaatttaacacagtgttgctgg

SEQ ID NO: 327721 - DNA, 25 bp, Mus musculus
ggcgacaccggcagaaaaagttacg

SEQ ID NO: 327722 - DNA, 25 bp, Mus musculus
ggcgacaccggcagttccagttact

SEQ ID NO: 327723 - DNA, 25 bp, Mus musculus
ggcgacacggagacgaccatgccgt

SEQ ID NO: 327724 - DNA, 25 bp, Mus musculus
ggcgacagaaaggaatcccaatgct

SEQ ID NO: 327725 - DNA, 25 bp, Mus musculus
ggcgacagcaggaagacaggaagat

SEQ ID NO: 327726 - DNA, 25 bp, Mus musculus
ggcgacagcaggaaggaaagaaagg

SEQ ID NO: 327727 - DNA, 25 bp, Mus musculus
ggcgacagtacctggaggagctgca

SEQ ID NO: 327728 - DNA, 25 bp, Mus musculus
ggcgacatcacaagagccccatgct

SEQ ID NO: 327729 - DNA, 25 bp, Mus musculus
ggcgacatcacaaggatgatgaggg

SEQ ID NO: 327730 - DNA, 25 bp, Mus musculus
ggcgacatcactcagctttccactg

SEQ ID NO: 327731 - DNA, 25 bp, Mus musculus
ggcgacatggaagcaagtgtggagg

SEQ ID NO: 327732 - DNA, 25 bp, Mus musculus
ggcgaccagatgcggtggtagcaaa

SEQ ID NO: 327733 - DNA, 25 bp, Mus musculus
ggcgacccagagcttagttcacaag

SEQ ID NO: 327734 - DNA, 25 bp, Mus musculus
ggcgaccccggcaggtcagaagaca

SEQ ID NO: 327735 - DNA, 25 bp, Mus musculus
ggcgaccctctaaagacaagattga

SEQ ID NO: 327736 - DNA, 25 bp, Mus musculus
ggcgaccctctaaagacatcgcctg

SEQ ID NO: 327737 - DNA, 25 bp, Mus musculus
ggcgaccgcagcaacccttctgggt

SEQ ID NO: 327738 - DNA, 25 bp, Mus musculus
ggcgaccgcccgaaacaagaagcac

SEQ ID NO: 327739 - DNA, 25 bp, Mus musculus
ggcgaccgcccggtagtgtctctat

SEQ ID NO: 327740 - DNA, 25 bp, Mus musculus
ggcgaccgcccggtgttgcttctgc

SEQ ID NO: 327741 - DNA, 25 bp, Mus musculus
ggcgaccttcagggaaaatgccaag

SEQ ID NO: 327742 - DNA, 25 bp, Mus musculus
ggcgacgcaggttgatatcaaaatt

SEQ ID NO: 327743 - DNA, 25 bp, Mus musculus
ggcgacgccgcgaggatctaagatg

SEQ ID NO: 327744 - DNA, 25 bp, Mus musculus
ggcgacgcgggaagaagtcccagac

SEQ ID NO: 327745 - DNA, 25 bp, Mus musculus
ggcgacggaagctgagccagaccca

SEQ ID NO: 327746 - DNA, 25 bp, Mus musculus
ggcgacggaagctgatcctcttccc

SEQ ID NO: 327747 - DNA, 25 bp, Mus musculus
ggcgacggaggcagcatctgcatct

SEQ ID NO: 327748 - DNA, 25 bp, Mus musculus
ggcgacggcgctatggtggattgtc

SEQ ID NO: 327749 - DNA, 25 bp, Mus musculus
ggcgacggttccgagctgtagccct

SEQ ID NO: 327750 - DNA, 25 bp, Mus musculus
ggcgactacatggccatccacaagg

SEQ ID NO: 327751 - DNA, 25 bp, Mus musculus
ggcgactcaggcaccatgagccagg

SEQ ID NO: 327752 - DNA, 25 bp, Mus musculus
ggcgactctaggttgcagtgtgtgc

SEQ ID NO: 327753 - DNA, 25 bp, Mus musculus
ggcgactgagcacacctgaggagag

SEQ ID NO: 327754 - DNA, 25 bp, Mus musculus
ggcgactgcagcctattccaagcct

SEQ ID NO: 327755 - DNA, 25 bp, Mus musculus
ggcgactgcaggtaacgggcaacca

SEQ ID NO: 327756 - DNA, 25 bp, Mus musculus
ggcgactggagaaggtcttcgctta

SEQ ID NO: 327757 - DNA, 25 bp, Mus musculus
ggcgactggagaagtatgtgggtgc

SEQ ID NO: 327758 - DNA, 25 bp, Mus musculus
ggcgactgtggagtgtgcacagccc

SEQ ID NO: 327759 - DNA, 25 bp, Mus musculus
ggcgacttaccaaagaggaattcaa

SEQ ID NO: 327760 - DNA, 25 bp, Mus musculus
ggcgagaaacagcaacattacttca

SEQ ID NO: 327761 - DNA, 25 bp, Mus musculus
ggcgagaaacagcgtcatagcagga

SEQ ID NO: 327762 - DNA, 25 bp, Mus musculus
ggcgagaaactgatgaagtgactga

SEQ ID NO: 327763 - DNA, 25 bp, Mus musculus
ggcgagaaatgagagaaacgcacca

SEQ ID NO: 327764 - DNA, 25 bp, Mus musculus
ggcgagaaatggaaacagctgctgt

SEQ ID NO: 327765 - DNA, 25 bp, Mus musculus
ggcgagaacctggagacggaccagt

SEQ ID NO: 327766 - DNA, 25 bp, Mus musculus
ggcgagaagaaggagaaaatcactt

SEQ ID NO: 327767 - DNA, 25 bp, Mus musculus
ggcgagaagaaggagccagctattc

SEQ ID NO: 327768 - DNA, 25 bp, Mus musculus
ggcgagaaggacccggctcgcgctg

SEQ ID NO: 327769 - DNA, 25 bp, Mus musculus
ggcgagacaactaaattttccaatg

SEQ ID NO: 327770 - DNA, 25 bp, Mus musculus
ggcgagacacattgcgctggctcca

SEQ ID NO: 327771 - DNA, 25 bp, Mus musculus
ggcgagacccaaatcttggtgggct

SEQ ID NO: 327772 - DNA, 25 bp, Mus musculus
ggcgagaccggggcatggaacaaga

SEQ ID NO: 327773 - DNA, 25 bp, Mus musculus
ggcgagactgagagccctgagcccg

SEQ ID NO: 327774 - DNA, 25 bp, Mus musculus
ggcgagactgagaggctatcagggc

SEQ ID NO: 327775 - DNA, 25 bp, Mus musculus
ggcgagagactgacctagtctggct

SEQ ID NO: 327776 - DNA, 25 bp, Mus musculus
ggcgagaggagggctctggtctggc

SEQ ID NO: 327777 - DNA, 25 bp, Mus musculus
ggcgagaggaggtctcgaagtcctc

SEQ ID NO: 327778 - DNA, 25 bp, Mus musculus
ggcgagaggtcaaggccccacgcat

SEQ ID NO: 327779 - DNA, 25 bp, Mus musculus
ggcgagagtgggctgtaaaaaatgg

SEQ ID NO: 327780 - DNA, 25 bp, Mus musculus
ggcgagatcaaagcactggcgcctg

SEQ ID NO: 327781 - DNA, 25 bp, Mus musculus
ggcgagatcaaagcactgggggagc

SEQ ID NO: 327782 - DNA, 25 bp, Mus musculus
ggcgagatcatcaaaccagaagatt

SEQ ID NO: 327783 - DNA, 25 bp, Mus musculus
ggcgagcaaggtctgctgaagacag

SEQ ID NO: 327784 - DNA, 25 bp, Mus musculus
ggcgagcacccgggatacacttttg

SEQ ID NO: 327785 - DNA, 25 bp, Mus musculus
ggcgagcacccggggaggcagagta

SEQ ID NO: 327786 - DNA, 25 bp, Mus musculus
ggcgagcagaaacttggacccttct

SEQ ID NO: 327787 - DNA, 25 bp, Mus musculus
ggcgagccaaaatgggctccgggcc

SEQ ID NO: 327788 - DNA, 25 bp, Mus musculus
ggcgagccaaaatgggttttatgga

SEQ ID NO: 327789 - DNA, 25 bp, Mus musculus
ggcgagccaggatgtccacctcgta

SEQ ID NO: 327790 - DNA, 25 bp, Mus musculus
ggcgagccagggcaaaggagcattt

SEQ ID NO: 327791 - DNA, 25 bp, Mus musculus
ggcgagccatcacaggccggatccc

SEQ ID NO: 327792 - DNA, 25 bp, Mus musculus
ggcgagcccaagatctataacaatc

SEQ ID NO: 327793 - DNA, 25 bp, Mus musculus
ggcgagcccaggatgggctctaagt

SEQ ID NO: 327794 - DNA, 25 bp, Mus musculus
ggcgagcccagggaatatttttagt

SEQ ID NO: 327795 - DNA, 25 bp, Mus musculus
ggcgagcccagtacgctccagaagg

SEQ ID NO: 327796 - DNA, 25 bp, Mus musculus
ggcgagccccaaatgaaaacgggcc

SEQ ID NO: 327797 - DNA, 25 bp, Mus musculus
ggcgagccccaacggcagccacaag

SEQ ID NO: 327798 - DNA, 25 bp, Mus musculus
ggcgagcccctcggtcttcaaagct

SEQ ID NO: 327799 - DNA, 25 bp, Mus musculus
ggcgagcccgcgaggtcactatcgt

SEQ ID NO: 327800 - DNA, 25 bp, Mus musculus
ggcgagcccgtggttgtgccccctc

SEQ ID NO: 327801 - DNA, 25 bp, Mus musculus
ggcgagcgaagtaagcggaggcctg

SEQ ID NO: 327802 - DNA, 25 bp, Mus musculus
ggcgagctccggaaaattgtgcaag

SEQ ID NO: 327803 - DNA, 25 bp, Mus musculus
ggcgagctgttgatgtgatggcacc

SEQ ID NO: 327804 - DNA, 25 bp, Mus musculus
ggcgaggaagaaaaaagtcatgatt

SEQ ID NO: 327805 - DNA, 25 bp, Mus musculus
ggcgaggaaggcattgggagagaca

SEQ ID NO: 327806 - DNA, 25 bp, Mus musculus
ggcgaggacagcgactttgaagatt

SEQ ID NO: 327807 - DNA, 25 bp, Mus musculus
ggcgaggacagcggctggaatggtc

SEQ ID NO: 327808 - DNA, 25 bp, Mus musculus
ggcgaggacgagagctctatttcag

SEQ ID NO: 327809 - DNA, 25 bp, Mus musculus
ggcgaggacgagagctctggtgcaa

SEQ ID NO: 327810 - DNA, 25 bp, Mus musculus
ggcgaggactagtgttacaggtggg

SEQ ID NO: 327811 - DNA, 25 bp, Mus musculus
ggcgaggacttcaggtggaccagca

SEQ ID NO: 327812 - DNA, 25 bp, Mus musculus
ggcgaggagcagaggctgtgtgaag

SEQ ID NO: 327813 - DNA, 25 bp, Mus musculus
ggcgaggcatgtggctctggtttcc

SEQ ID NO: 327814 - DNA, 25 bp, Mus musculus
ggcgaggccccactcctgaaaggac

SEQ ID NO: 327815 - DNA, 25 bp, Mus musculus
ggcgaggccgatactccatgtttcc

SEQ ID NO: 327816 - DNA, 25 bp, Mus musculus
ggcgaggctcaaagcccgatttggc

SEQ ID NO: 327817 - DNA, 25 bp, Mus musculus
ggcgaggttcaagtagtatctttac

SEQ ID NO: 327818 - DNA, 25 bp, Mus musculus
ggcgagtagcaggaataaacacgtt

SEQ ID NO: 327819 - DNA, 25 bp, Mus musculus
ggcgagtatttgctggtgctgtagc

SEQ ID NO: 327820 - DNA, 25 bp, Mus musculus
ggcgagtccttatgacacgtcccca

SEQ ID NO: 327821 - DNA, 25 bp, Mus musculus
ggcgagtctcggcaaagtctactga

SEQ ID NO: 327822 - DNA, 25 bp, Mus musculus
ggcgagtctcgggactgaggctcag

SEQ ID NO: 327823 - DNA, 25 bp, Mus musculus
ggcgagtctgtgaaggccccaaagc

SEQ ID NO: 327824 - DNA, 25 bp, Mus musculus
ggcgagtgatgcttattctttggga

SEQ ID NO: 327825 - DNA, 25 bp, Mus musculus
ggcgagtggaaggtcctcatcatgg

SEQ ID NO: 327826 - DNA, 25 bp, Mus musculus
ggcgagtggaagtcgtggaagacat

SEQ ID NO: 327827 - DNA, 25 bp, Mus musculus
ggcgagtggacccagaggagacttg

SEQ ID NO: 327828 - DNA, 25 bp, Mus musculus
ggcgagtggacccagccccgggaac

SEQ ID NO: 327829 - DNA, 25 bp, Mus musculus
ggcgagtggacccagggctgttggg

SEQ ID NO: 327830 - DNA, 25 bp, Mus musculus
ggcgagttaaagcacatggtgatga

SEQ ID NO: 327831 - DNA, 25 bp, Mus musculus
ggcgagttacaggagggaatcttga

SEQ ID NO: 327832 - DNA, 25 bp, Mus musculus
ggcgatatccgtaaagaacttgtct

SEQ ID NO: 327833 - DNA, 25 bp, Mus musculus
ggcgatattccctgactgctgcccg

SEQ ID NO: 327834 - DNA, 25 bp, Mus musculus
ggcgatattccctgatgttgcattg

SEQ ID NO: 327835 - DNA, 25 bp, Mus musculus
ggcgatcccacagatccaactttta

SEQ ID NO: 327836 - DNA, 25 bp, Mus musculus
ggcgatcccacagtgcaatttggtc

SEQ ID NO: 327837 - DNA, 25 bp, Mus musculus
ggcgatctccgagaaaattttgcca

SEQ ID NO: 327838 - DNA, 25 bp, Mus musculus
ggcgatcttgagcaaaagagcccga

SEQ ID NO: 327839 - DNA, 25 bp, Mus musculus
ggcgatcttgaggtggctaccgtct

SEQ ID NO: 327840 - DNA, 25 bp, Mus musculus
ggcgatgaatcacaggacctggagt

SEQ ID NO: 327841 - DNA, 25 bp, Mus musculus
ggcgatgctcctccgggaagaatgg

SEQ ID NO: 327842 - DNA, 25 bp, Mus musculus
ggcgatgctcctccggtgccagtga

SEQ ID NO: 327843 - DNA, 25 bp, Mus musculus
ggcgatgtggagaggtggagaatct

SEQ ID NO: 327844 - DNA, 25 bp, Mus musculus
ggcgattaaaggcctgaagctcatg

SEQ ID NO: 327845 - DNA, 25 bp, Mus musculus
ggcgattagactctgccttcagggt

SEQ ID NO: 327846 - DNA, 25 bp, Mus musculus
ggcgattagaggtctgacatggctc

SEQ ID NO: 327847 - DNA, 25 bp, Mus musculus
ggcgattggggtggtcctgccgaca

SEQ ID NO: 327848 - DNA, 25 bp, Mus musculus
ggcgcaaacagaaaactcagaactt

SEQ ID NO: 327849 - DNA, 25 bp, Mus musculus
ggcgcaaagactggcggaggccagg

SEQ ID NO: 327850 - DNA, 25 bp, Mus musculus
ggcgcaataacgttacaaattataa

SEQ ID NO: 327851 - DNA, 25 bp, Mus musculus
ggcgcacagcggggactcgaggcca

SEQ ID NO: 327852 - DNA, 25 bp, Mus musculus
ggcgcacagcggtaaaatgtcggct

SEQ ID NO: 327853 - DNA, 25 bp, Mus musculus
ggcgcaccaaggccatggtggcgtg

SEQ ID NO: 327854 - DNA, 25 bp, Mus musculus
ggcgcaccgcaaagatgtgaaattt

SEQ ID NO: 327855 - DNA, 25 bp, Mus musculus
ggcgcacgaagaagactggaaacag

SEQ ID NO: 327856 - DNA, 25 bp, Mus musculus
ggcgcacgaagaagcctcagcaaaa

SEQ ID NO: 327857 - DNA, 25 bp, Mus musculus
ggcgcacgagtccggggaagtgtgt

SEQ ID NO: 327858 - DNA, 25 bp, Mus musculus
ggcgcacggttcagcaactgcgctc

SEQ ID NO: 327859 - DNA, 25 bp, Mus musculus
ggcgcactgtgcgagaaaaagcgga

SEQ ID NO: 327860 - DNA, 25 bp, Mus musculus
ggcgcactgtgcgaggcatgctgcc

SEQ ID NO: 327861 - DNA, 25 bp, Mus musculus
ggcgcagaaggatcgccacgactcg

SEQ ID NO: 327862 - DNA, 25 bp, Mus musculus
ggcgcagaccaggatggctgcccaa

SEQ ID NO: 327863 - DNA, 25 bp, Mus musculus
ggcgcagacgagagtctcggccacc

SEQ ID NO: 327864 - DNA, 25 bp, Mus musculus
ggcgcagagaagagcaccctccaag

SEQ ID NO: 327865 - DNA, 25 bp, Mus musculus
ggcgcagagaaggtcctaaaggggt

SEQ ID NO: 327866 - DNA, 25 bp, Mus musculus
ggcgcagagcgggcgatactgcagc

SEQ ID NO: 327867 - DNA, 25 bp, Mus musculus
ggcgcagatgatggctctgtggcct

SEQ ID NO: 327868 - DNA, 25 bp, Mus musculus
ggcgcagatgggatacagatttctg

SEQ ID NO: 327869 - DNA, 25 bp, Mus musculus
ggcgcagatggtcaccctgctgatt

SEQ ID NO: 327870 - DNA, 25 bp, Mus musculus
ggcgcagatttggatgacttttttt

SEQ ID NO: 327871 - DNA, 25 bp, Mus musculus
ggcgcagatttgggattttgaactt

SEQ ID NO: 327872 - DNA, 25 bp, Mus musculus
ggcgcagccaccgcacctgcgggag

SEQ ID NO: 327873 - DNA, 25 bp, Mus musculus
ggcgcagccaccgcgctcatgcgtg

SEQ ID NO: 327874 - DNA, 25 bp, Mus musculus
ggcgcagcccgcgggggagccgccg

SEQ ID NO: 327875 - DNA, 25 bp, Mus musculus
ggcgcagcccgggtgcaattaaaag

SEQ ID NO: 327876 - DNA, 25 bp, Mus musculus
ggcgcaggagcgtggattggtgacc

SEQ ID NO: 327877 - DNA, 25 bp, Mus musculus
ggcgcaggatgcaggagttcctcag

SEQ ID NO: 327878 - DNA, 25 bp, Mus musculus
ggcgcaggcaggggggacctgaacc

SEQ ID NO: 327879 - DNA, 25 bp, Mus musculus
ggcgcagggaggcaatggcagctac

SEQ ID NO: 327880 - DNA, 25 bp, Mus musculus
ggcgcaggtcattggcgacagggtt

SEQ ID NO: 327881 - DNA, 25 bp, Mus musculus
ggcgcaggtcattggggttccccag

SEQ ID NO: 327882 - DNA, 25 bp, Mus musculus
ggcgcagtcctaaatggtggccctc

SEQ ID NO: 327883 - DNA, 25 bp, Mus musculus
ggcgcagtcctaggactgcatttac

SEQ ID NO: 327884 - DNA, 25 bp, Mus musculus
ggcgcagtcctagggcctggtggcc

SEQ ID NO: 327885 - DNA, 25 bp, Mus musculus
ggcgcagtcctaggtgaagaagact

SEQ ID NO: 327886 - DNA, 25 bp, Mus musculus
ggcgcagtcttgagtaatccagaat

SEQ ID NO: 327887 - DNA, 25 bp, Mus musculus
ggcgcatcaggtgaagaagagtctc

SEQ ID NO: 327888 - DNA, 25 bp, Mus musculus
ggcgcatcccagggttctgcctgtg

SEQ ID NO: 327889 - DNA, 25 bp, Mus musculus
ggcgcatcccgtttcaagaaagtat

SEQ ID NO: 327890 - DNA, 25 bp, Mus musculus
ggcgcatcgcagagttgacatcctg

SEQ ID NO: 327891 - DNA, 25 bp, Mus musculus
ggcgcatcgcggcctcaaagcggag

SEQ ID NO: 327892 - DNA, 25 bp, Mus musculus
ggcgcattcgcaaaggaacgggaga

SEQ ID NO: 327893 - DNA, 25 bp, Mus musculus
ggcgcattcgcaaaggacgcatgga

SEQ ID NO: 327894 - DNA, 25 bp, Mus musculus
ggcgccaaagctgatggtgaggcca

SEQ ID NO: 327895 - DNA, 25 bp, Mus musculus
ggcgccaaaggggccaaggagaaga

SEQ ID NO: 327896 - DNA, 25 bp, Mus musculus
ggcgccaatgagaaagataagggcc

SEQ ID NO: 327897 - DNA, 25 bp, Mus musculus
ggcgccactgccaggtcagatgctg

SEQ ID NO: 327898 - DNA, 25 bp, Mus musculus
ggcgccactgccagtggccaaacga

SEQ ID NO: 327899 - DNA, 25 bp, Mus musculus
ggcgccagatgctggaggtaaagat

SEQ ID NO: 327900 - DNA, 25 bp, Mus musculus
ggcgccagcacatctgcagagaaaa

SEQ ID NO: 327901 - DNA, 25 bp, Mus musculus
ggcgccagccaggacggcttcacgc

SEQ ID NO: 327902 - DNA, 25 bp, Mus musculus
ggcgccagccaggagcatagaagac

SEQ ID NO: 327903 - DNA, 25 bp, Mus musculus
ggcgccagctcagaggcaggttttt

SEQ ID NO: 327904 - DNA, 25 bp, Mus musculus
ggcgccaggctcagccgagatgccg

SEQ ID NO: 327905 - DNA, 25 bp, Mus musculus
ggcgccagggcaaggaggtcagacc

SEQ ID NO: 327906 - DNA, 25 bp, Mus musculus
ggcgccagtaaagcagtggtggcag

SEQ ID NO: 327907 - DNA, 25 bp, Mus musculus
ggcgccagtaaagcagttttccttt

SEQ ID NO: 327908 - DNA, 25 bp, Mus musculus
ggcgccatcaaccaggaaagccggg

SEQ ID NO: 327909 - DNA, 25 bp, Mus musculus
ggcgcccaaagtctcaggggcctac

SEQ ID NO: 327910 - DNA, 25 bp, Mus musculus
ggcgcccacgttgggatctgaacca

SEQ ID NO: 327911 - DNA, 25 bp, Mus musculus
ggcgcccaggggagatgtataccag

SEQ ID NO: 327912 - DNA, 25 bp, Mus musculus
ggcgcccatgcagatggcctctgca

SEQ ID NO: 327913 - DNA, 25 bp, Mus musculus
ggcgccccaacagattccacgagga

SEQ ID NO: 327914 - DNA, 25 bp, Mus musculus
ggcgccccacagcttgaggaggcac

SEQ ID NO: 327915 - DNA, 25 bp, Mus musculus
ggcgccccaccagaaaacgaggagg

SEQ ID NO: 327916 - DNA, 25 bp, Mus musculus
ggcgcccccgccgcgccttcatcaa

SEQ ID NO: 327917 - DNA, 25 bp, Mus musculus
ggcgccccctgcagttggacatttg

SEQ ID NO: 327918 - DNA, 25 bp, Mus musculus
ggcgccccgcaccgatgatattatc

SEQ ID NO: 327919 - DNA, 25 bp, Mus musculus
ggcgcccctccttcctgagcatgat

SEQ ID NO: 327920 - DNA, 25 bp, Mus musculus
ggcgcccgaccctaggtacccaggt

SEQ ID NO: 327921 - DNA, 25 bp, Mus musculus
ggcgcccggagcaagactgtcaagg

SEQ ID NO: 327922 - DNA, 25 bp, Mus musculus
ggcgcccggagcaaggacgaaggtg

SEQ ID NO: 327923 - DNA, 25 bp, Mus musculus
ggcgcccggagcaaggtaacaaata

SEQ ID NO: 327924 - DNA, 25 bp, Mus musculus
ggcgcccggggagagatactccatg

SEQ ID NO: 327925 - DNA, 25 bp, Mus musculus
ggcgcccgtcacaagggcggtgacg

SEQ ID NO: 327926 - DNA, 25 bp, Mus musculus
ggcgccctcctcagaaagcagtgcc

SEQ ID NO: 327927 - DNA, 25 bp, Mus musculus
ggcgccctggaagaccagagccctg

SEQ ID NO: 327928 - DNA, 25 bp, Mus musculus
ggcgccgaacagcagcgggcgggga

SEQ ID NO: 327929 - DNA, 25 bp, Mus musculus
ggcgccgagcggggcgaggtggcac

SEQ ID NO: 327930 - DNA, 25 bp, Mus musculus
ggcgccgagcgggtcctcaggactc

SEQ ID NO: 327931 - DNA, 25 bp, Mus musculus
ggcgccgatcaggttaaagatcgag

SEQ ID NO: 327932 - DNA, 25 bp, Mus musculus
ggcgccgcaggacggtgactgtccc

SEQ ID NO: 327933 - DNA, 25 bp, Mus musculus
ggcgccgccccactgaagggcagtg

SEQ ID NO: 327934 - DNA, 25 bp, Mus musculus
ggcgccgccgggttcaagcgctgtc

SEQ ID NO: 327935 - DNA, 25 bp, Mus musculus
ggcgccgcggcagccactaagcccc

SEQ ID NO: 327936 - DNA, 25 bp, Mus musculus
ggcgccgcggcagccgctttcacta

SEQ ID NO: 327937 - DNA, 25 bp, Mus musculus
ggcgccggacgaccgaagccaggac

SEQ ID NO: 327938 - DNA, 25 bp, Mus musculus
ggcgccggccacggcccggacacag

SEQ ID NO: 327939 - DNA, 25 bp, Mus musculus
ggcgccgggagtcgattttaggtga

SEQ ID NO: 327940 - DNA, 25 bp, Mus musculus
ggcgccgtctctggcaggcactgta

SEQ ID NO: 327941 - DNA, 25 bp, Mus musculus
ggcgcctactcagggctaacatcag

SEQ ID NO: 327942 - DNA, 25 bp, Mus musculus
ggcgcctactctatcgctgcaggtg

SEQ ID NO: 327943 - DNA, 25 bp, Mus musculus
ggcgcctactctatgtgtgctcatc

SEQ ID NO: 327944 - DNA, 25 bp, Mus musculus
ggcgcctactgccagcggactcaga

SEQ ID NO: 327945 - DNA, 25 bp, Mus musculus
ggcgcctactgccaggctccggtcg

SEQ ID NO: 327946 - DNA, 25 bp, Mus musculus
ggcgcctagagaagcctccccagct

SEQ ID NO: 327947 - DNA, 25 bp, Mus musculus
ggcgcctagcgctttgagcttccag

SEQ ID NO: 327948 - DNA, 25 bp, Mus musculus
ggcgcctatgatgggaagattaaag

SEQ ID NO: 327949 - DNA, 25 bp, Mus musculus
ggcgcctccagaacagcatgttttg

SEQ ID NO: 327950 - DNA, 25 bp, Mus musculus
ggcgcctccaggaacacttctgttt

SEQ ID NO: 327951 - DNA, 25 bp, Mus musculus
ggcgcctgagctaggattggtagct

SEQ ID NO: 327952 - DNA, 25 bp, Mus musculus
ggcgcctgaggtgctagaggacaat

SEQ ID NO: 327953 - DNA, 25 bp, Mus musculus
ggcgcctgcagcaggaattggggaa

SEQ ID NO: 327954 - DNA, 25 bp, Mus musculus
ggcgcctgccccgaaatcacactgt

SEQ ID NO: 327955 - DNA, 25 bp, Mus musculus
ggcgcctgccccgccaaatgcagag

SEQ ID NO: 327956 - DNA, 25 bp, Mus musculus
ggcgcctgtgaaaaagcttgtggcg

SEQ ID NO: 327957 - DNA, 25 bp, Mus musculus
ggcgcgaccccagctctatttcaga

SEQ ID NO: 327958 - DNA, 25 bp, Mus musculus
ggcgcgaccccaggaccagctctct

SEQ ID NO: 327959 - DNA, 25 bp, Mus musculus
ggcgcgactggaggataccagttca

SEQ ID NO: 327960 - DNA, 25 bp, Mus musculus
ggcgcgactgggtggggctgcttcg

SEQ ID NO: 327961 - DNA, 25 bp, Mus musculus
ggcgcgaggagctccagaaatcttg

SEQ ID NO: 327962 - DNA, 25 bp, Mus musculus
ggcgcgaggcagcatggtctgagac

SEQ ID NO: 327963 - DNA, 25 bp, Mus musculus
ggcgcgcacagagctgaagcgctgc

SEQ ID NO: 327964 - DNA, 25 bp, Mus musculus
ggcgcgcacagccgttgactacttt

SEQ ID NO: 327965 - DNA, 25 bp, Mus musculus
ggcgcgcacagctgggtggctgtgg

SEQ ID NO: 327966 - DNA, 25 bp, Mus musculus
ggcgcgcacgtagtggacaagctac

SEQ ID NO: 327967 - DNA, 25 bp, Mus musculus
ggcgcgcacgtagtggtcacaggag

SEQ ID NO: 327968 - DNA, 25 bp, Mus musculus
ggcgcgcagcccaagagactgaatt

SEQ ID NO: 327969 - DNA, 25 bp, Mus musculus
ggcgcgccctcaagaacagaagcag

SEQ ID NO: 327970 - DNA, 25 bp, Mus musculus
ggcgcgccctcacgtctgactctac

SEQ ID NO: 327971 - DNA, 25 bp, Mus musculus
ggcgcgccgagggtgtgtgggatga

SEQ ID NO: 327972 - DNA, 25 bp, Mus musculus
ggcgcgccgagttgaactttctaga

SEQ ID NO: 327973 - DNA, 25 bp, Mus musculus
ggcgcgcctgcaggactttaagctc

SEQ ID NO: 327974 - DNA, 25 bp, Mus musculus
ggcgcgcctgcaggcaagaaggagt

SEQ ID NO: 327975 - DNA, 25 bp, Mus musculus
ggcgcgcgagaagctcgcgctgtat

SEQ ID NO: 327976 - DNA, 25 bp, Mus musculus
ggcgcgcgcagaggtttcatagtcc

SEQ ID NO: 327977 - DNA, 25 bp, Mus musculus
ggcgcgcgccagttggacatttggc

SEQ ID NO: 327978 - DNA, 25 bp, Mus musculus
ggcgcgcgcgtgacgagtgaccaaa

SEQ ID NO: 327979 - DNA, 25 bp, Mus musculus
ggcgcgcggacccagagtgcttggg

SEQ ID NO: 327980 - DNA, 25 bp, Mus musculus
ggcgcgcggagcagactgtcgctaa

SEQ ID NO: 327981 - DNA, 25 bp, Mus musculus
ggcgcgcggagcagccctctctata

SEQ ID NO: 327982 - DNA, 25 bp, Mus musculus
ggcgcgcggccaggtcttggtttcc

SEQ ID NO: 327983 - DNA, 25 bp, Mus musculus
ggcgcgcgtccgaaatgctgagctt

SEQ ID NO: 327984 - DNA, 25 bp, Mus musculus
ggcgcgctaaaaatgcttgtttctg

SEQ ID NO: 327985 - DNA, 25 bp, Mus musculus
ggcgcgctcggagacattccaaatg

SEQ ID NO: 327986 - DNA, 25 bp, Mus musculus
ggcgcggacacagcatgcccatttc

SEQ ID NO: 327987 - DNA, 25 bp, Mus musculus
ggcgcggacgcggagacgtttgaat

SEQ ID NO: 327988 - DNA, 25 bp, Mus musculus
ggcgcggacgcggagtctggtccat

SEQ ID NO: 327989 - DNA, 25 bp, Mus musculus
ggcgcggagactgaggtgctgggtg

SEQ ID NO: 327990 - DNA, 25 bp, Mus musculus
ggcgcggagagagaactgctctgat

SEQ ID NO: 327991 - DNA, 25 bp, Mus musculus
ggcgcggagagaggcctgctgaaaa

SEQ ID NO: 327992 - DNA, 25 bp, Mus musculus
ggcgcggagcagggcggcgagtcca

SEQ ID NO: 327993 - DNA, 25 bp, Mus musculus
ggcgcggagccggttcgaggagcag

SEQ ID NO: 327994 - DNA, 25 bp, Mus musculus
ggcgcggcaaccaaccgtctggatc

SEQ ID NO: 327995 - DNA, 25 bp, Mus musculus
ggcgcggcaggcggtgatacttctg

SEQ ID NO: 327996 - DNA, 25 bp, Mus musculus
ggcgcggcaggtaccagctggagga

SEQ ID NO: 327997 - DNA, 25 bp, Mus musculus
ggcgcggcaggtggagggagcggct

SEQ ID NO: 327998 - DNA, 25 bp, Mus musculus
ggcgcggcagtctgcgagtaaactt

SEQ ID NO: 327999 - DNA, 25 bp, Mus musculus
ggcgcggccaaaaggcggacgccgc

SEQ ID NO: 328000 - DNA, 25 bp, Mus musculus
ggcgcggccagggcaaagtgcaaac

SEQ ID NO: 328001 - DNA, 25 bp, Mus musculus
ggcgcggccgaggctgcttccgccc

SEQ ID NO: 328002 - DNA, 25 bp, Mus musculus
ggcgcggcgggagccgctcccgttc

SEQ ID NO: 328003 - DNA, 25 bp, Mus musculus
ggcgcggcgtggctggtcgggatgg

SEQ ID NO: 328004 - DNA, 25 bp, Mus musculus
ggcgcggctgcagtctttaagaaat

SEQ ID NO: 328005 - DNA, 25 bp, Mus musculus
ggcgcgggaggcggagagtgtcact

SEQ ID NO: 328006 - DNA, 25 bp, Mus musculus
ggcgcgggaggcggctctagatggc

SEQ ID NO: 328007 - DNA, 25 bp, Mus musculus
ggcgcgggaggcgtacgagatgaga

SEQ ID NO: 328008 - DNA, 25 bp, Mus musculus
ggcgcgggaggtgctggagagtcag

SEQ ID NO: 328009 - DNA, 25 bp, Mus musculus
ggcgcgggcagcggtaaaatgtcgg

SEQ ID NO: 328010 - DNA, 25 bp, Mus musculus
ggcgcgggctccagaggcgtccggt

SEQ ID NO: 328011 - DNA, 25 bp, Mus musculus
ggcgcggggagagttaagaatcatg

SEQ ID NO: 328012 - DNA, 25 bp, Mus musculus
ggcgcggggtgatggcaggagaact

SEQ ID NO: 328013 - DNA, 25 bp, Mus musculus
ggcgcggtagcggtgaacgctgttg

SEQ ID NO: 328014 - DNA, 25 bp, Mus musculus
ggcgcggtagcggtgccttctctcc

SEQ ID NO: 328015 - DNA, 25 bp, Mus musculus
ggcgcggtagcggtgggtgtcaccg

SEQ ID NO: 328016 - DNA, 25 bp, Mus musculus
ggcgcggtagcggtgtatgtgggat

SEQ ID NO: 328017 - DNA, 25 bp, Mus musculus
ggcgcggtcaagaaaggctctggag

SEQ ID NO: 328018 - DNA, 25 bp, Mus musculus
ggcgcggtcaaggatcatctgcttc

SEQ ID NO: 328019 - DNA, 25 bp, Mus musculus
ggcgcgtcagtgggtacccagaaag

SEQ ID NO: 328020 - DNA, 25 bp, Mus musculus
ggcgcgtgagacgcagaggcagggc

SEQ ID NO: 328021 - DNA, 25 bp, Mus musculus
ggcgcgtgagatgcccggaaccgac

SEQ ID NO: 328022 - DNA, 25 bp, Mus musculus
ggcgctaaaaggtcctgtttcttct

SEQ ID NO: 328023 - DNA, 25 bp, Mus musculus
ggcgctaaaagtgatgcgattgact

SEQ ID NO: 328024 - DNA, 25 bp, Mus musculus
ggcgctacagggcttttctccagag

SEQ ID NO: 328025 - DNA, 25 bp, Mus musculus
ggcgctacaggtggacaacatcagt

SEQ ID NO: 328026 - DNA, 25 bp, Mus musculus
ggcgctagagctagtctacccaagt

SEQ ID NO: 328027 - DNA, 25 bp, Mus musculus
ggcgctagaggtgacccttccctat

SEQ ID NO: 328028 - DNA, 25 bp, Mus musculus
ggcgctatgggtcatctgttccggc

SEQ ID NO: 328029 - DNA, 25 bp, Mus musculus
ggcgctcaagcggctcacccaggaa

SEQ ID NO: 328030 - DNA, 25 bp, Mus musculus
ggcgctcaccctgattgactcgtgg

SEQ ID NO: 328031 - DNA, 25 bp, Mus musculus
ggcgctcaccctgcgactactgtga

SEQ ID NO: 328032 - DNA, 25 bp, Mus musculus
ggcgctcatcatgctccgtcgggag

SEQ ID NO: 328033 - DNA, 25 bp, Mus musculus
ggcgctcatcatggctcgcctgcgc

SEQ ID NO: 328034 - DNA, 25 bp, Mus musculus
ggcgctccagactgtacccacaggt

SEQ ID NO: 328035 - DNA, 25 bp, Mus musculus
ggcgctccagaggctggaggagcca

SEQ ID NO: 328036 - DNA, 25 bp, Mus musculus
ggcgctccagcagattgctttattc

SEQ ID NO: 328037 - DNA, 25 bp, Mus musculus
ggcgctccagcagcactctgttttc

SEQ ID NO: 328038 - DNA, 25 bp, Mus musculus
ggcgctccagggacctctgagctgc

SEQ ID NO: 328039 - DNA, 25 bp, Mus musculus
ggcgctccaggtgcccatcagcttc

SEQ ID NO: 328040 - DNA, 25 bp, Mus musculus
ggcgctcccaggtaggtgagctcca

SEQ ID NO: 328041 - DNA, 25 bp, Mus musculus
ggcgctccccgaggtgtgaatgagg

SEQ ID NO: 328042 - DNA, 25 bp, Mus musculus
ggcgctccgccgattcctttgtgat

SEQ ID NO: 328043 - DNA, 25 bp, Mus musculus
ggcgctccgccggtgagcacgagcc

SEQ ID NO: 328044 - DNA, 25 bp, Mus musculus
ggcgctcgagtatgcctgtggtatc

SEQ ID NO: 328045 - DNA, 25 bp, Mus musculus
ggcgctcgggaaggctcctcgccgt

SEQ ID NO: 328046 - DNA, 25 bp, Mus musculus
ggcgctcgggaaggcttttgacccg

SEQ ID NO: 328047 - DNA, 25 bp, Mus musculus
ggcgctgacaggtactgggtttgga

SEQ ID NO: 328048 - DNA, 25 bp, Mus musculus
ggcgctgagggtcgagaatacaaga

SEQ ID NO: 328049 - DNA, 25 bp, Mus musculus
ggcgctgagggtcggtgccagcaca

SEQ ID NO: 328050 - DNA, 25 bp, Mus musculus
ggcgctgatatggagaaccttcaca

SEQ ID NO: 328051 - DNA, 25 bp, Mus musculus
ggcgctgcacgccttcagagacggc

SEQ ID NO: 328052 - DNA, 25 bp, Mus musculus
ggcgctgcaggggctgacatggacc

SEQ ID NO: 328053 - DNA, 25 bp, Mus musculus
ggcgctgcagggtaattcagagatc

SEQ ID NO: 328054 - DNA, 25 bp, Mus musculus
ggcgctgcagtcaggcatcaaggag

SEQ ID NO: 328055 - DNA, 25 bp, Mus musculus
ggcgctgccacagcgctgtgtagtt

SEQ ID NO: 328056 - DNA, 25 bp, Mus musculus
ggcgctgcccaggctgaaggcatcc

SEQ ID NO: 328057 - DNA, 25 bp, Mus musculus
ggcgctgccttgagagtcgcttcaa

SEQ ID NO: 328058 - DNA, 25 bp, Mus musculus
ggcgctgcggagagctcagagctat

SEQ ID NO: 328059 - DNA, 25 bp, Mus musculus
ggcgctgcggcaatgccaagtgagt

SEQ ID NO: 328060 - DNA, 25 bp, Mus musculus
ggcgctgcggcaccgcttgtcctgg

SEQ ID NO: 328061 - DNA, 25 bp, Mus musculus
ggcgctgcggcaccggctggcccgc

SEQ ID NO: 328062 - DNA, 25 bp, Mus musculus
ggcgctgcggcaccgtttcctctac

SEQ ID NO: 328063 - DNA, 25 bp, Mus musculus
ggcgctgcgggtggcctggagagct

SEQ ID NO: 328064 - DNA, 25 bp, Mus musculus
ggcgctgctcggagcctggtggagg

SEQ ID NO: 328065 - DNA, 25 bp, Mus musculus
ggcgctgctttagagtctccagagc

SEQ ID NO: 328066 - DNA, 25 bp, Mus musculus
ggcgctgctttaggcccaggagggt

SEQ ID NO: 328067 - DNA, 25 bp, Mus musculus
ggcgctggaagagactctcatggac

SEQ ID NO: 328068 - DNA, 25 bp, Mus musculus
ggcgctggagagcctgaccagacag

SEQ ID NO: 328069 - DNA, 25 bp, Mus musculus
ggcgctggagcctggaatgcttccg

SEQ ID NO: 328070 - DNA, 25 bp, Mus musculus
ggcgctggcgcaagatgacgttgca

SEQ ID NO: 328071 - DNA, 25 bp, Mus musculus
ggcgctggcggaatggcttcctttg

SEQ ID NO: 328072 - DNA, 25 bp, Mus musculus
ggcgctggcgggtgatgaagcctgg

SEQ ID NO: 328073 - DNA, 25 bp, Mus musculus
ggcgctggcgggtgttccgaatgcc

SEQ ID NO: 328074 - DNA, 25 bp, Mus musculus
ggcgctggctgtggatctcaggtga

SEQ ID NO: 328075 - DNA, 25 bp, Mus musculus
ggcgctgggcagacgaaagagcctg

SEQ ID NO: 328076 - DNA, 25 bp, Mus musculus
ggcgctgggcagtccattctctttg

SEQ ID NO: 328077 - DNA, 25 bp, Mus musculus
ggcgctgggctcctggtctctgggc

SEQ ID NO: 328078 - DNA, 25 bp, Mus musculus
ggcgctggtcgggctgtggcagttt

SEQ ID NO: 328079 - DNA, 25 bp, Mus musculus
ggcgctgtacaagcttggcttcttc

SEQ ID NO: 328080 - DNA, 25 bp, Mus musculus
ggcgctgtacaaggttcactctaat

SEQ ID NO: 328081 - DNA, 25 bp, Mus musculus
ggcgctgtacgaggctccagcatac

SEQ ID NO: 328082 - DNA, 25 bp, Mus musculus
ggcgctgtcagatcaagatccactt

SEQ ID NO: 328083 - DNA, 25 bp, Mus musculus
ggcgctgtccagggtcttcaaagct

SEQ ID NO: 328084 - DNA, 25 bp, Mus musculus
ggcgctgtggagataaagaagctga

SEQ ID NO: 328085 - DNA, 25 bp, Mus musculus
ggcgcttcctgtccgtacagagact

SEQ ID NO: 328086 - DNA, 25 bp, Mus musculus
ggcgcttctagtgccgcttctcgaa

SEQ ID NO: 328087 - DNA, 25 bp, Mus musculus
ggcgcttgcagaaggggcgcctaag

SEQ ID NO: 328088 - DNA, 25 bp, Mus musculus
ggcgcttgcaggcatgacgagtgtg

SEQ ID NO: 328089 - DNA, 25 bp, Mus musculus
ggcgcttggagaatggcagcagcag

SEQ ID NO: 328090 - DNA, 25 bp, Mus musculus
ggcgctttcaggtaaaatggaacta

SEQ ID NO: 328091 - DNA, 25 bp, Mus musculus
ggcgctttcccgagacttcccaaga

SEQ ID NO: 328092 - DNA, 25 bp, Mus musculus
ggcgctttcttagatgttgccttca

SEQ ID NO: 328093 - DNA, 25 bp, Mus musculus
ggcgctttggagagcgtcaagatca

SEQ ID NO: 328094 - DNA, 25 bp, Mus musculus
ggcgctttggcagcggatctccatc

SEQ ID NO: 328095 - DNA, 25 bp, Mus musculus
ggcgctttgtgcaggaagaagacta

SEQ ID NO: 328096 - DNA, 25 bp, Mus musculus
ggcggaaagatggcgtaccttctca

SEQ ID NO: 328097 - DNA, 25 bp, Mus musculus
ggcggaacaggtaattgctggcttt

SEQ ID NO: 328098 - DNA, 25 bp, Mus musculus
ggcggaacgggaatgctgatcactg

SEQ ID NO: 328099 - DNA, 25 bp, Mus musculus
ggcggaagaagagaagaaagatgag

SEQ ID NO: 328100 - DNA, 25 bp, Mus musculus
ggcggaagagcatctgatacgtcat

SEQ ID NO: 328101 - DNA, 25 bp, Mus musculus
ggcggaagaggtcaggacccccagc

SEQ ID NO: 328102 - DNA, 25 bp, Mus musculus
ggcggaagtggttctgctgccttaa

SEQ ID NO: 328103 - DNA, 25 bp, Mus musculus
ggcggacaggagatgaccggttcga

SEQ ID NO: 328104 - DNA, 25 bp, Mus musculus
ggcggaccaagcacagcctcctctt

SEQ ID NO: 328105 - DNA, 25 bp, Mus musculus
ggcggacgcagaattcggcccctgc

SEQ ID NO: 328106 - DNA, 25 bp, Mus musculus
ggcggacgcaggtccgctacagagc

SEQ ID NO: 328107 - DNA, 25 bp, Mus musculus
ggcggacgcggaagatctcagcggt

SEQ ID NO: 328108 - DNA, 25 bp, Mus musculus
ggcggacgcggaagggaccagattt

SEQ ID NO: 328109 - DNA, 25 bp, Mus musculus
ggcggactaataggactgaggatct

SEQ ID NO: 328110 - DNA, 25 bp, Mus musculus
ggcggactaataggcagatacatgc

SEQ ID NO: 328111 - DNA, 25 bp, Mus musculus
ggcggacttcaggtgactcggactc

SEQ ID NO: 328112 - DNA, 25 bp, Mus musculus
ggcggacttcaggtgattcacaaga

SEQ ID NO: 328113 - DNA, 25 bp, Mus musculus
ggcggacttccaggctcagtgttta

SEQ ID NO: 328114 - DNA, 25 bp, Mus musculus
ggcggagaagctgaggacaagatct

SEQ ID NO: 328115 - DNA, 25 bp, Mus musculus
ggcggagaagtactctcaaaaagaa

SEQ ID NO: 328116 - DNA, 25 bp, Mus musculus
ggcggagaccagaaccccagctgaa

SEQ ID NO: 328117 - DNA, 25 bp, Mus musculus
ggcggagagagcaacttcttcggga

SEQ ID NO: 328118 - DNA, 25 bp, Mus musculus
ggcggagagcatggatacgtattat

SEQ ID NO: 328119 - DNA, 25 bp, Mus musculus
ggcggagaggcaggtctctggagct

SEQ ID NO: 328120 - DNA, 25 bp, Mus musculus
ggcggagcaaaccggtggccagaac

SEQ ID NO: 328121 - DNA, 25 bp, Mus musculus
ggcggagcagaaatagatgaagacc

SEQ ID NO: 328122 - DNA, 25 bp, Mus musculus
ggcggagcagaccatgctcgcattc

SEQ ID NO: 328123 - DNA, 25 bp, Mus musculus
ggcggagcagattcggaggcgccgc

SEQ ID NO: 328124 - DNA, 25 bp, Mus musculus
ggcggagcaggggaagagacacagg

SEQ ID NO: 328125 - DNA, 25 bp, Mus musculus
ggcggagccagatttagatgaaaaa

SEQ ID NO: 328126 - DNA, 25 bp, Mus musculus
ggcggagccgaatcctattctaaga

SEQ ID NO: 328127 - DNA, 25 bp, Mus musculus
ggcggagcggtagaggcaagagctt

SEQ ID NO: 328128 - DNA, 25 bp, Mus musculus
ggcggagcggtagagggagttgcat

SEQ ID NO: 328129 - DNA, 25 bp, Mus musculus
ggcggagctgggaggcccagccagc

SEQ ID NO: 328130 - DNA, 25 bp, Mus musculus
ggcggagctgtagatatggcataag

SEQ ID NO: 328131 - DNA, 25 bp, Mus musculus
ggcggagctgtagctggcccatgag

SEQ ID NO: 328132 - DNA, 25 bp, Mus musculus
ggcggagctgtaggcaagagataac

SEQ ID NO: 328133 - DNA, 25 bp, Mus musculus
ggcggaggacaagggaccgtcacga

SEQ ID NO: 328134 - DNA, 25 bp, Mus musculus
ggcggaggactgaggggggtccgcc

SEQ ID NO: 328135 - DNA, 25 bp, Mus musculus
ggcggaggagataggcgtttctaat

SEQ ID NO: 328136 - DNA, 25 bp, Mus musculus
ggcggaggagctgggtccatattgt

SEQ ID NO: 328137 - DNA, 25 bp, Mus musculus
ggcggaggagctgggtgatggctgt

SEQ ID NO: 328138 - DNA, 25 bp, Mus musculus
ggcggaggaggagttctccaacaca

SEQ ID NO: 328139 - DNA, 25 bp, Mus musculus
ggcggaggaggcggacgagcaaaaa

SEQ ID NO: 328140 - DNA, 25 bp, Mus musculus
ggcggaggagggcagcagaaccaga

SEQ ID NO: 328141 - DNA, 25 bp, Mus musculus
ggcggaggagggcaggaatcccagc

SEQ ID NO: 328142 - DNA, 25 bp, Mus musculus
ggcggaggagggggaggccgctcac

SEQ ID NO: 328143 - DNA, 25 bp, Mus musculus
ggcggaggattcacgtatgggaccc

SEQ ID NO: 328144 - DNA, 25 bp, Mus musculus
ggcggaggccgcaggttggtgttcg

SEQ ID NO: 328145 - DNA, 25 bp, Mus musculus
ggcggaggccgcgtgtaatgttcaa

SEQ ID NO: 328146 - DNA, 25 bp, Mus musculus
ggcggaggcctgctgatgctcctgc

SEQ ID NO: 328147 - DNA, 25 bp, Mus musculus
ggcggagggaagtgttgacgctgct

SEQ ID NO: 328148 - DNA, 25 bp, Mus musculus
ggcggaggggcactgggtcgtcatg

SEQ ID NO: 328149 - DNA, 25 bp, Mus musculus
ggcggaggggcaggttctggtattg

SEQ ID NO: 328150 - DNA, 25 bp, Mus musculus
ggcggagtcgcaggtgactccatac

SEQ ID NO: 328151 - DNA, 25 bp, Mus musculus
ggcggagtcgcaggtgttttgcaaa

SEQ ID NO: 328152 - DNA, 25 bp, Mus musculus
ggcggagtcggaggccctaatgctg

SEQ ID NO: 328153 - DNA, 25 bp, Mus musculus
ggcggagtctggagccgccatggat

SEQ ID NO: 328154 - DNA, 25 bp, Mus musculus
ggcggagtgaacgatcatgaaggaa

SEQ ID NO: 328155 - DNA, 25 bp, Mus musculus
ggcggagtggagaagtatattggat

SEQ ID NO: 328156 - DNA, 25 bp, Mus musculus
ggcggagttcgagactaccaggtat

SEQ ID NO: 328157 - DNA, 25 bp, Mus musculus
ggcggatcaaccccccttaagacag

SEQ ID NO: 328158 - DNA, 25 bp, Mus musculus
ggcggatcaagatcagtataactcc

SEQ ID NO: 328159 - DNA, 25 bp, Mus musculus
ggcggatcatgtgcagagcctggcc

SEQ ID NO: 328160 - DNA, 25 bp, Mus musculus
ggcggatccggcagcttaggttgtc

SEQ ID NO: 328161 - DNA, 25 bp, Mus musculus
ggcggatccggcaggaattgaagtt

SEQ ID NO: 328162 - DNA, 25 bp, Mus musculus
ggcggatctgggtacgcgtctacag

SEQ ID NO: 328163 - DNA, 25 bp, Mus musculus
ggcggatgaagagaggcatgttgga

SEQ ID NO: 328164 - DNA, 25 bp, Mus musculus
ggcggatgaagttagcaggagatgc

SEQ ID NO: 328165 - DNA, 25 bp, Mus musculus
ggcggattccagcccaacatgcaaa

SEQ ID NO: 328166 - DNA, 25 bp, Mus musculus
ggcggattcgggttcgggagcagcg

SEQ ID NO: 328167 - DNA, 25 bp, Mus musculus
ggcggcaacggacagctcggattct

SEQ ID NO: 328168 - DNA, 25 bp, Mus musculus
ggcggcacagctggctggaccagat

SEQ ID NO: 328169 - DNA, 25 bp, Mus musculus
ggcggcacgggaaggcagaagaaat

SEQ ID NO: 328170 - DNA, 25 bp, Mus musculus
ggcggcagacgcagcttcggcttca

SEQ ID NO: 328171 - DNA, 25 bp, Mus musculus
ggcggcagagtctagccaccaagat

SEQ ID NO: 328172 - DNA, 25 bp, Mus musculus
ggcggcagcaggcaaggagatgaga

SEQ ID NO: 328173 - DNA, 25 bp, Mus musculus
ggcggcagcaggcattaaaaaaata

SEQ ID NO: 328174 - DNA, 25 bp, Mus musculus
ggcggcagccggtcactatcgtctg

SEQ ID NO: 328175 - DNA, 25 bp, Mus musculus
ggcggcagcgccgatgccgcctgca

SEQ ID NO: 328176 - DNA, 25 bp, Mus musculus
ggcggcagcggggcctgcggctcga

SEQ ID NO: 328177 - DNA, 25 bp, Mus musculus
ggcggcagcgtgcctgaagacctgt

SEQ ID NO: 328178 - DNA, 25 bp, Mus musculus
ggcggcaggcactggtgtaatggat

SEQ ID NO: 328179 - DNA, 25 bp, Mus musculus
ggcggcaggcgggtacaaaaatata

SEQ ID NO: 328180 - DNA, 25 bp, Mus musculus
ggcggcagtgattcatcagaaaagt

SEQ ID NO: 328181 - DNA, 25 bp, Mus musculus
ggcggccaagggagcagccgcccac

SEQ ID NO: 328182 - DNA, 25 bp, Mus musculus
ggcggccaccgcttgaatctccccg

SEQ ID NO: 328183 - DNA, 25 bp, Mus musculus
ggcggccacctaggcctgcagctga

SEQ ID NO: 328184 - DNA, 25 bp, Mus musculus
ggcggccacctaggcttcagtgggg

SEQ ID NO: 328185 - DNA, 25 bp, Mus musculus
ggcggccagagggttggtcctgtgg

SEQ ID NO: 328186 - DNA, 25 bp, Mus musculus
ggcggccagcagatcgtgtccagcc

SEQ ID NO: 328187 - DNA, 25 bp, Mus musculus
ggcggccagcaggtactcctgagca

SEQ ID NO: 328188 - DNA, 25 bp, Mus musculus
ggcggccagcccagggcaaacgcta

SEQ ID NO: 328189 - DNA, 25 bp, Mus musculus
ggcggccagcccaggggcacctacc

SEQ ID NO: 328190 - DNA, 25 bp, Mus musculus
ggcggccagccttgcactatgtccc

SEQ ID NO: 328191 - DNA, 25 bp, Mus musculus
ggcggccagcggagagcaaagacca

SEQ ID NO: 328192 - DNA, 25 bp, Mus musculus
ggcggccagttggggtgctgtggac

SEQ ID NO: 328193 - DNA, 25 bp, Mus musculus
ggcggcccagacaggtgatttggct

SEQ ID NO: 328194 - DNA, 25 bp, Mus musculus
ggcggccccggagaagatggagggg

SEQ ID NO: 328195 - DNA, 25 bp, Mus musculus
ggcggcccctgcagaagactgctag

SEQ ID NO: 328196 - DNA, 25 bp, Mus musculus
ggcggccctacctggactttgatcc

SEQ ID NO: 328197 - DNA, 25 bp, Mus musculus
ggcggccgaccagatgtgaggtgag

SEQ ID NO: 328198 - DNA, 25 bp, Mus musculus
ggcggccgaggcggcagtgagctcc

SEQ ID NO: 328199 - DNA, 25 bp, Mus musculus
ggcggccgaggtctgtctgcaggtt

SEQ ID NO: 328200 - DNA, 25 bp, Mus musculus
ggcggccgccaaggacagtcacgag

SEQ ID NO: 328201 - DNA, 25 bp, Mus musculus
ggcggccgcctccaggactgaccaa

SEQ ID NO: 328202 - DNA, 25 bp, Mus musculus
ggcggccggagtggcctctgcatcc

SEQ ID NO: 328203 - DNA, 25 bp, Mus musculus
ggcggccggagtgggctggtgttcc

SEQ ID NO: 328204 - DNA, 25 bp, Mus musculus
ggcggccggccgaaggatcatctgt

SEQ ID NO: 328205 - DNA, 25 bp, Mus musculus
ggcggccggccgaaggttcttgatt

SEQ ID NO: 328206 - DNA, 25 bp, Mus musculus
ggcggccgggagagaccctcaggac

SEQ ID NO: 328207 - DNA, 25 bp, Mus musculus
ggcggccgggagagacgcagtgaga

SEQ ID NO: 328208 - DNA, 25 bp, Mus musculus
ggcggccgtcaggagcagccatgtc

SEQ ID NO: 328209 - DNA, 25 bp, Mus musculus
ggcggcctccgtcagctgcagccga

SEQ ID NO: 328210 - DNA, 25 bp, Mus musculus
ggcggcctgatctggaagtggctca

SEQ ID NO: 328211 - DNA, 25 bp, Mus musculus
ggcggcctttaggatgggaaagttg

SEQ ID NO: 328212 - DNA, 25 bp, Mus musculus
ggcggcctttaggctccccatatat

SEQ ID NO: 328213 - DNA, 25 bp, Mus musculus
ggcggcgaaatgtagctttggcacc

SEQ ID NO: 328214 - DNA, 25 bp, Mus musculus
ggcggcgaacgagagagctgttctc

SEQ ID NO: 328215 - DNA, 25 bp, Mus musculus
ggcggcgaacgagagatgctccctt

SEQ ID NO: 328216 - DNA, 25 bp, Mus musculus
ggcggcgaagaggtcctgagttcaa

SEQ ID NO: 328217 - DNA, 25 bp, Mus musculus
ggcggcgaagtctcccctcaccagg

SEQ ID NO: 328218 - DNA, 25 bp, Mus musculus
ggcggcgacgcgggaagaagtccca

SEQ ID NO: 328219 - DNA, 25 bp, Mus musculus
ggcggcgagaaggacccggctcgcg

SEQ ID NO: 328220 - DNA, 25 bp, Mus musculus
ggcggcgagacccaaatcttggtgg

SEQ ID NO: 328221 - DNA, 25 bp, Mus musculus
ggcggcgagccccaaatgaaaacgg

SEQ ID NO: 328222 - DNA, 25 bp, Mus musculus
ggcggcgagccccaacggcagccac

SEQ ID NO: 328223 - DNA, 25 bp, Mus musculus
ggcggcgcagaccaggatggctgcc

SEQ ID NO: 328224 - DNA, 25 bp, Mus musculus
ggcggcgccacgagctggtgattgc

SEQ ID NO: 328225 - DNA, 25 bp, Mus musculus
ggcggcgccaggtctgaccacccgg

SEQ ID NO: 328226 - DNA, 25 bp, Mus musculus
ggcggcgccggacgaccgaagccag

SEQ ID NO: 328227 - DNA, 25 bp, Mus musculus
ggcggcgccggtgccaagtgctggt

SEQ ID NO: 328228 - DNA, 25 bp, Mus musculus
ggcggcgcgaggcagcatggtctga

SEQ ID NO: 328229 - DNA, 25 bp, Mus musculus
ggcggcgcgcacagagctgaagcgc

SEQ ID NO: 328230 - DNA, 25 bp, Mus musculus
ggcggcgcgcacagctgggtggctg

SEQ ID NO: 328231 - DNA, 25 bp, Mus musculus
ggcggcgcgggaggtgctggagagt

SEQ ID NO: 328232 - DNA, 25 bp, Mus musculus
ggcggcgctggcgggtgatgaagcc

SEQ ID NO: 328233 - DNA, 25 bp, Mus musculus
ggcggcgctggcgggtgttccgaat

SEQ ID NO: 328234 - DNA, 25 bp, Mus musculus
ggcggcggaccggcggcggcggcag

SEQ ID NO: 328235 - DNA, 25 bp, Mus musculus
ggcggcggagagttgtctgctggtt

SEQ ID NO: 328236 - DNA, 25 bp, Mus musculus
ggcggcggagatcctgagggaagag

SEQ ID NO: 328237 - DNA, 25 bp, Mus musculus
ggcggcggagcagaaatagatgaag

SEQ ID NO: 328238 - DNA, 25 bp, Mus musculus
ggcggcggagcagattcggaggcgc

SEQ ID NO: 328239 - DNA, 25 bp, Mus musculus
ggcggcggcagaacccagcagtgat

SEQ ID NO: 328240 - DNA, 25 bp, Mus musculus
ggcggcggcagccggtcactatcgt

SEQ ID NO: 328241 - DNA, 25 bp, Mus musculus
ggcggcggcaggcgggtacaaaaat

SEQ ID NO: 328242 - DNA, 25 bp, Mus musculus
ggcggcggcccagacaggtgatttg

SEQ ID NO: 328243 - DNA, 25 bp, Mus musculus
ggcggcggcggaccggcggcggcgg

SEQ ID NO: 328244 - DNA, 25 bp, Mus musculus
ggcggcggcggcagaacccagcagt

SEQ ID NO: 328245 - DNA, 25 bp, Mus musculus
ggcggcggcggcggggagaactacg

SEQ ID NO: 328246 - DNA, 25 bp, Mus musculus
ggcggcggcggggagaactacgatg

SEQ ID NO: 328247 - DNA, 25 bp, Mus musculus
ggcggcggctcgcgacctcaatgta

SEQ ID NO: 328248 - DNA, 25 bp, Mus musculus
ggcggcgggacaagctggggtctca

SEQ ID NO: 328249 - DNA, 25 bp, Mus musculus
ggcggcgggacaaggagcagggcag

SEQ ID NO: 328250 - DNA, 25 bp, Mus musculus
ggcggcgggacaaggaggtctgaag

SEQ ID NO: 328251 - DNA, 25 bp, Mus musculus
ggcggcgggagcgagggagcggaca

SEQ ID NO: 328252 - DNA, 25 bp, Mus musculus
ggcggcggggaggacttgcactaag

SEQ ID NO: 328253 - DNA, 25 bp, Mus musculus
ggcggcggtgcagatttcttgacct

SEQ ID NO: 328254 - DNA, 25 bp, Mus musculus
ggcggcgtccgcgcgccgctgtgcc

SEQ ID NO: 328255 - DNA, 25 bp, Mus musculus
ggcggcgtgagcccagatcatgcag

SEQ ID NO: 328256 - DNA, 25 bp, Mus musculus
ggcggctaccggggcggtgatactt

SEQ ID NO: 328257 - DNA, 25 bp, Mus musculus
ggcggctcacaaagaacaagggaga

SEQ ID NO: 328258 - DNA, 25 bp, Mus musculus
ggcggctcaccgcgtcgattctggc

SEQ ID NO: 328259 - DNA, 25 bp, Mus musculus
ggcggctcaccgggtcgattctggc

SEQ ID NO: 328260 - DNA, 25 bp, Mus musculus
ggcggctcaggtgttatagactgca

SEQ ID NO: 328261 - DNA, 25 bp, Mus musculus
ggcggctcaggtttctcccatttcc

SEQ ID NO: 328262 - DNA, 25 bp, Mus musculus
ggcggctcccccaggtttccatcgt

SEQ ID NO: 328263 - DNA, 25 bp, Mus musculus
ggcggctcgcgacctcaatgtacct

SEQ ID NO: 328264 - DNA, 25 bp, Mus musculus
ggcggctcgggcatggaaactatca

SEQ ID NO: 328265 - DNA, 25 bp, Mus musculus
ggcggctctacagccagaatgtcac

SEQ ID NO: 328266 - DNA, 25 bp, Mus musculus
ggcggctctaggctccagcagccag

SEQ ID NO: 328267 - DNA, 25 bp, Mus musculus
ggcggctctagggcgtcccggggcc

SEQ ID NO: 328268 - DNA, 25 bp, Mus musculus
ggcggctctagggggccagagtttg

SEQ ID NO: 328269 - DNA, 25 bp, Mus musculus
ggcggctgacagcgtcctgaggtta

SEQ ID NO: 328270 - DNA, 25 bp, Mus musculus
ggcggctgacaggttcttacagtct

SEQ ID NO: 328271 - DNA, 25 bp, Mus musculus
ggcggctgatagcgatcattgctgt

SEQ ID NO: 328272 - DNA, 25 bp, Mus musculus
ggcggctgatagcggggatcccagc

SEQ ID NO: 328273 - DNA, 25 bp, Mus musculus
ggcggctgcagcaggccaccatggc

SEQ ID NO: 328274 - DNA, 25 bp, Mus musculus
ggcggctgcagcgggaagatgtcat

SEQ ID NO: 328275 - DNA, 25 bp, Mus musculus
ggcggctgcagtgtggtggcacaag

SEQ ID NO: 328276 - DNA, 25 bp, Mus musculus
ggcggctgccctgagaaacctcgac

SEQ ID NO: 328277 - DNA, 25 bp, Mus musculus
ggcggctgcgagcgctgtagacctg

SEQ ID NO: 328278 - DNA, 25 bp, Mus musculus
ggcggctggaggaggcgggcgtccg

SEQ ID NO: 328279 - DNA, 25 bp, Mus musculus
ggcggctggagtcgaatttggaaat

SEQ ID NO: 328280 - DNA, 25 bp, Mus musculus
ggcggctggcagaacttgatcacca

SEQ ID NO: 328281 - DNA, 25 bp, Mus musculus
ggcggctggcagagactcctgaaag

SEQ ID NO: 328282 - DNA, 25 bp, Mus musculus
ggcggctggcagctgcagaagagac

SEQ ID NO: 328283 - DNA, 25 bp, Mus musculus
ggcggctgggaccctgtacacatac

SEQ ID NO: 328284 - DNA, 25 bp, Mus musculus
ggcggcttctgctgcaggagtcagc

SEQ ID NO: 328285 - DNA, 25 bp, Mus musculus
ggcgggaaccaggtgctacagaaga

SEQ ID NO: 328286 - DNA, 25 bp, Mus musculus
ggcgggaaggccagggtcatttctc

SEQ ID NO: 328287 - DNA, 25 bp, Mus musculus
ggcgggacaagctggggtctcagaa

SEQ ID NO: 328288 - DNA, 25 bp, Mus musculus
ggcgggacaaggagcagggcaggag

SEQ ID NO: 328289 - DNA, 25 bp, Mus musculus
ggcgggacaaggaggtctgaagaag

SEQ ID NO: 328290 - DNA, 25 bp, Mus musculus
ggcgggacagttgggcaaggcgggc

SEQ ID NO: 328291 - DNA, 25 bp, Mus musculus
ggcgggacccgagatccacgtgtcg

SEQ ID NO: 328292 - DNA, 25 bp, Mus musculus
ggcgggacccgagctgtgtctcttc

SEQ ID NO: 328293 - DNA, 25 bp, Mus musculus
ggcgggacccgggtcctgataagcc

SEQ ID NO: 328294 - DNA, 25 bp, Mus musculus
ggcgggaccgcagattatttttaat

SEQ ID NO: 328295 - DNA, 25 bp, Mus musculus
ggcgggaccgcagggattctcctga

SEQ ID NO: 328296 - DNA, 25 bp, Mus musculus
ggcgggactggtctccaaaaatgct

SEQ ID NO: 328297 - DNA, 25 bp, Mus musculus
ggcgggagagatggatgcgagttca

SEQ ID NO: 328298 - DNA, 25 bp, Mus musculus
ggcgggagatgagacgtgacttgta

SEQ ID NO: 328299 - DNA, 25 bp, Mus musculus
ggcgggagcgagggagcggacatgg

SEQ ID NO: 328300 - DNA, 25 bp, Mus musculus
ggcgggaggcgaagactcatgaaat

SEQ ID NO: 328301 - DNA, 25 bp, Mus musculus
ggcgggagggctgggcctgcagccg

SEQ ID NO: 328302 - DNA, 25 bp, Mus musculus
ggcgggatccgcacgaaataaatca

SEQ ID NO: 328303 - DNA, 25 bp, Mus musculus
ggcgggatcctataagttgcaaggt

SEQ ID NO: 328304 - DNA, 25 bp, Mus musculus
ggcgggatcctatgcatatttttca

SEQ ID NO: 328305 - DNA, 25 bp, Mus musculus
ggcgggattgctcagaaaaagatca

SEQ ID NO: 328306 - DNA, 25 bp, Mus musculus
ggcgggattgctcagaacttctcgg

SEQ ID NO: 328307 - DNA, 25 bp, Mus musculus
ggcgggattgctcagctgccttggc

SEQ ID NO: 328308 - DNA, 25 bp, Mus musculus
ggcgggattgctcagggcattgaaa

SEQ ID NO: 328309 - DNA, 25 bp, Mus musculus
ggcgggcaacagttcactgaggaat

SEQ ID NO: 328310 - DNA, 25 bp, Mus musculus
ggcgggcatatcaagaatgctgtga

SEQ ID NO: 328311 - DNA, 25 bp, Mus musculus
ggcgggccaccaggctattacaagc

SEQ ID NO: 328312 - DNA, 25 bp, Mus musculus
ggcgggcccgggccgcgccatgggc

SEQ ID NO: 328313 - DNA, 25 bp, Mus musculus
ggcgggccggactatgcaagctgcg

SEQ ID NO: 328314 - DNA, 25 bp, Mus musculus
ggcgggccgggtttctgttgatgcc

SEQ ID NO: 328315 - DNA, 25 bp, Mus musculus
ggcgggcgaaggggaactgatcaca

SEQ ID NO: 328316 - DNA, 25 bp, Mus musculus
ggcgggcgagcagagcagacccagg

SEQ ID NO: 328317 - DNA, 25 bp, Mus musculus
ggcgggcgagcaggtggaagggact

SEQ ID NO: 328318 - DNA, 25 bp, Mus musculus
ggcgggcgcagagctgagatactgg

SEQ ID NO: 328319 - DNA, 25 bp, Mus musculus
ggcgggcgcagtgttatccacacag

SEQ ID NO: 328320 - DNA, 25 bp, Mus musculus
ggcgggcgctaggtccgtctcccag

SEQ ID NO: 328321 - DNA, 25 bp, Mus musculus
ggcgggcgggtaaataacagatgcg

SEQ ID NO: 328322 - DNA, 25 bp, Mus musculus
ggcgggcgttaaagctctcgtggcg

SEQ ID NO: 328323 - DNA, 25 bp, Mus musculus
ggcgggctgcgtggcattgtcgcca

SEQ ID NO: 328324 - DNA, 25 bp, Mus musculus
ggcgggctggtgagaagacgcttcc

SEQ ID NO: 328325 - DNA, 25 bp, Mus musculus
ggcgggcttagggtggagcgaccct

SEQ ID NO: 328326 - DNA, 25 bp, Mus musculus
ggcggggaacggtaatcccgctcaa

SEQ ID NO: 328327 - DNA, 25 bp, Mus musculus
ggcggggacagatctcaagaccaga

SEQ ID NO: 328328 - DNA, 25 bp, Mus musculus
ggcggggaggctggggaaggaagcc

SEQ ID NO: 328329 - DNA, 25 bp, Mus musculus
ggcggggaggctggtgcaaacagct

SEQ ID NO: 328330 - DNA, 25 bp, Mus musculus
ggcggggcagactgaagtgttggaa

SEQ ID NO: 328331 - DNA, 25 bp, Mus musculus
ggcggggcaggagcaaaacaattgg

SEQ ID NO: 328332 - DNA, 25 bp, Mus musculus
ggcggggcaggtgtagtaacatgca

SEQ ID NO: 328333 - DNA, 25 bp, Mus musculus
ggcggggcctcggaaccgtctggat

SEQ ID NO: 328334 - DNA, 25 bp, Mus musculus
ggcggggcgaggccgatactccatg

SEQ ID NO: 328335 - DNA, 25 bp, Mus musculus
ggcggggcgcagctgggcaccacaa

SEQ ID NO: 328336 - DNA, 25 bp, Mus musculus
ggcgggggcggcagttctggcaggt

SEQ ID NO: 328337 - DNA, 25 bp, Mus musculus
ggcggggtgagccaggcctcgagca

SEQ ID NO: 328338 - DNA, 25 bp, Mus musculus
ggcggggtgagccagtgactccact

SEQ ID NO: 328339 - DNA, 25 bp, Mus musculus
ggcggggttgggaatggctttgctg

SEQ ID NO: 328340 - DNA, 25 bp, Mus musculus
ggcggggttggggggcttctgcttc

SEQ ID NO: 328341 - DNA, 25 bp, Mus musculus
ggcggggttggggtcgatactgaca

SEQ ID NO: 328342 - DNA, 25 bp, Mus musculus
ggcgggtacggcctacgagttacaa

SEQ ID NO: 328343 - DNA, 25 bp, Mus musculus
ggcgggtcagcaagctccgggcctc

SEQ ID NO: 328344 - DNA, 25 bp, Mus musculus
ggcgggtcagcggccctgtgagtgg

SEQ ID NO: 328345 - DNA, 25 bp, Mus musculus
ggcgggtcctgcgttcttggcccag

SEQ ID NO: 328346 - DNA, 25 bp, Mus musculus
ggcgggtcgcgaggtgcagacatgg

SEQ ID NO: 328347 - DNA, 25 bp, Mus musculus
ggcgggtctcagaaagaagaaacaa

SEQ ID NO: 328348 - DNA, 25 bp, Mus musculus
ggcgggtctcaggacaagccaatga

SEQ ID NO: 328349 - DNA, 25 bp, Mus musculus
ggcgggtctcccaggaccgtcagaa

SEQ ID NO: 328350 - DNA, 25 bp, Mus musculus
ggcgggtggcgccagctagccggat

SEQ ID NO: 328351 - DNA, 25 bp, Mus musculus
ggcgggtgtggcaggaatgattaat

SEQ ID NO: 328352 - DNA, 25 bp, Mus musculus
ggcgggtttgccacaatctgcctgt

SEQ ID NO: 328353 - DNA, 25 bp, Mus musculus
ggcggtaaatgggcttcttggtaat

SEQ ID NO: 328354 - DNA, 25 bp, Mus musculus
ggcggtaacagagtactgtttggca

SEQ ID NO: 328355 - DNA, 25 bp, Mus musculus
ggcggtaccagcccctctcccgagg

SEQ ID NO: 328356 - DNA, 25 bp, Mus musculus
ggcggtatggaggagaaaccaaggt

SEQ ID NO: 328357 - DNA, 25 bp, Mus musculus
ggcggtcaaggccctcagcctcccc

SEQ ID NO: 328358 - DNA, 25 bp, Mus musculus
ggcggtcaaggtcacggtctcggtc

SEQ ID NO: 328359 - DNA, 25 bp, Mus musculus
ggcggtcgcccaggctccgccccca

SEQ ID NO: 328360 - DNA, 25 bp, Mus musculus
ggcggtcgcgcggaccatcggggct

SEQ ID NO: 328361 - DNA, 25 bp, Mus musculus
ggcggtgacaatgagttttcttgga

SEQ ID NO: 328362 - DNA, 25 bp, Mus musculus
ggcggtgacaatggtaaacctagcc

SEQ ID NO: 328363 - DNA, 25 bp, Mus musculus
ggcggtgacagataagaactgagtc

SEQ ID NO: 328364 - DNA, 25 bp, Mus musculus
ggcggtgacagataagtgtccagct

SEQ ID NO: 328365 - DNA, 25 bp, Mus musculus
ggcggtgacagataagttcggaata

SEQ ID NO: 328366 - DNA, 25 bp, Mus musculus
ggcggtgaggagaggtttcatagtc

SEQ ID NO: 328367 - DNA, 25 bp, Mus musculus
ggcggtgataacggatagacaggaa

SEQ ID NO: 328368 - DNA, 25 bp, Mus musculus
ggcggtgcaagcaggttatgaggtg

SEQ ID NO: 328369 - DNA, 25 bp, Mus musculus
ggcggtgcagatttcttgacctaca

SEQ ID NO: 328370 - DNA, 25 bp, Mus musculus
ggcggtgcgtaaaaaaatatttctt

SEQ ID NO: 328371 - DNA, 25 bp, Mus musculus
ggcggtgctccaggacagcatcgca

SEQ ID NO: 328372 - DNA, 25 bp, Mus musculus
ggcggtggaggcgggggccctagct

SEQ ID NO: 328373 - DNA, 25 bp, Mus musculus
ggcggtgggatccaccaccacgggc

SEQ ID NO: 328374 - DNA, 25 bp, Mus musculus
ggcggtggggtaagtgtggacattc

SEQ ID NO: 328375 - DNA, 25 bp, Mus musculus
ggcggtggtagtggaagcaattttg

SEQ ID NO: 328376 - DNA, 25 bp, Mus musculus
ggcggtggtagtggtggctatggcg

SEQ ID NO: 328377 - DNA, 25 bp, Mus musculus
ggcggtgtacggcgcaacctgcggc

SEQ ID NO: 328378 - DNA, 25 bp, Mus musculus
ggcggtgtcaagaaaaggaagtcga

SEQ ID NO: 328379 - DNA, 25 bp, Mus musculus
ggcggtgtcaagccacagagcaaca

SEQ ID NO: 328380 - DNA, 25 bp, Mus musculus
ggcggtgtcaaggaaccacaaacca

SEQ ID NO: 328381 - DNA, 25 bp, Mus musculus
ggcggtgtgaagtaagcaatggctt

SEQ ID NO: 328382 - DNA, 25 bp, Mus musculus
ggcggttcaggaattacacagtcga

SEQ ID NO: 328383 - DNA, 25 bp, Mus musculus
ggcggttcaggggtatggaaactgg

SEQ ID NO: 328384 - DNA, 25 bp, Mus musculus
ggcggttgagacttctccattccct

SEQ ID NO: 328385 - DNA, 25 bp, Mus musculus
ggcggttgcctgtagtcagaagatg

SEQ ID NO: 328386 - DNA, 25 bp, Mus musculus
ggcggttgggcagtgaatccaaaac

SEQ ID NO: 328387 - DNA, 25 bp, Mus musculus
ggcggtttcaggacaatctctcctg

SEQ ID NO: 328388 - DNA, 25 bp, Mus musculus
ggcgtaaagagactgatgtctggac

SEQ ID NO: 328389 - DNA, 25 bp, Mus musculus
ggcgtaaagaggttctccccaatca

SEQ ID NO: 328390 - DNA, 25 bp, Mus musculus
ggcgtaacaagccgcattttctggc

SEQ ID NO: 328391 - DNA, 25 bp, Mus musculus
ggcgtaccctacagaaacactcaag

SEQ ID NO: 328392 - DNA, 25 bp, Mus musculus
ggcgtacgctggcccttctgtatta

SEQ ID NO: 328393 - DNA, 25 bp, Mus musculus
ggcgtacgctggttatttgctggcg

SEQ ID NO: 328394 - DNA, 25 bp, Mus musculus
ggcgtagctctggtgcaccctctgc

SEQ ID NO: 328395 - DNA, 25 bp, Mus musculus
ggcgtagctctgttcccacttcacc

SEQ ID NO: 328396 - DNA, 25 bp, Mus musculus
ggcgtaggatgcagggcattttccc

SEQ ID NO: 328397 - DNA, 25 bp, Mus musculus
ggcgtaggatgcaggggtctcactg

SEQ ID NO: 328398 - DNA, 25 bp, Mus musculus
ggcgtatgctgggtgaacttcgagg

SEQ ID NO: 328399 - DNA, 25 bp, Mus musculus
ggcgtatttcagatgatgacactgc

SEQ ID NO: 328400 - DNA, 25 bp, Mus musculus
ggcgtcaggagcctgatgggaaggt

SEQ ID NO: 328401 - DNA, 25 bp, Mus musculus
ggcgtcagtaagccagaccactgag

SEQ ID NO: 328402 - DNA, 25 bp, Mus musculus
ggcgtcatcaaccctggagaatgca

SEQ ID NO: 328403 - DNA, 25 bp, Mus musculus
ggcgtcatggggtgtgtgagtgtta

SEQ ID NO: 328404 - DNA, 25 bp, Mus musculus
ggcgtccaagagtaagctaaaaaag

SEQ ID NO: 328405 - DNA, 25 bp, Mus musculus
ggcgtccaagagtccatatgttgtg

SEQ ID NO: 328406 - DNA, 25 bp, Mus musculus
ggcgtccaagctcccagcagcaaag

SEQ ID NO: 328407 - DNA, 25 bp, Mus musculus
ggcgtccaaggccatcagctccaga

SEQ ID NO: 328408 - DNA, 25 bp, Mus musculus
ggcgtcccaggcctggaatgcttcc

SEQ ID NO: 328409 - DNA, 25 bp, Mus musculus
ggcgtccccggtgaggcatatgcta

SEQ ID NO: 328410 - DNA, 25 bp, Mus musculus
ggcgtccccggtgaggtataaagag

SEQ ID NO: 328411 - DNA, 25 bp, Mus musculus
ggcgtccgcaggtttgatgagatct

SEQ ID NO: 328412 - DNA, 25 bp, Mus musculus
ggcgtccgcgccaggttcatcattt

SEQ ID NO: 328413 - DNA, 25 bp, Mus musculus
ggcgtccgcgcgccgctgtgccccc

SEQ ID NO: 328414 - DNA, 25 bp, Mus musculus
ggcgtccgctcagaccagcagtgcc

SEQ ID NO: 328415 - DNA, 25 bp, Mus musculus
ggcgtcctcagatatagccatattt

SEQ ID NO: 328416 - DNA, 25 bp, Mus musculus
ggcgtcctgaagcgctgtgctttgg

SEQ ID NO: 328417 - DNA, 25 bp, Mus musculus
ggcgtcgcagtcaggcctcagctgc

SEQ ID NO: 328418 - DNA, 25 bp, Mus musculus
ggcgtcgcagtcagtactgttacat

SEQ ID NO: 328419 - DNA, 25 bp, Mus musculus
ggcgtcgccggggatagaagtggaa

SEQ ID NO: 328420 - DNA, 25 bp, Mus musculus
ggcgtcgtagtcagcattttcttga

SEQ ID NO: 328421 - DNA, 25 bp, Mus musculus
ggcgtctaaagccattgaaaaggac

SEQ ID NO: 328422 - DNA, 25 bp, Mus musculus
ggcgtctaaagccgccctcaccttt

SEQ ID NO: 328423 - DNA, 25 bp, Mus musculus
ggcgtctactccagtaaatcctgtc

SEQ ID NO: 328424 - DNA, 25 bp, Mus musculus
ggcgtctcagctccgcgtgagtcgg

SEQ ID NO: 328425 - DNA, 25 bp, Mus musculus
ggcgtctcccaggtgttcttgaagt

SEQ ID NO: 328426 - DNA, 25 bp, Mus musculus
ggcgtctccgctggcgagcctccct

SEQ ID NO: 328427 - DNA, 25 bp, Mus musculus
ggcgtctcctgcacgtgaggagcat

SEQ ID NO: 328428 - DNA, 25 bp, Mus musculus
ggcgtctcgagcctatcctctactc

SEQ ID NO: 328429 - DNA, 25 bp, Mus musculus
ggcgtctcgaggaacgcctcgatgc

SEQ ID NO: 328430 - DNA, 25 bp, Mus musculus
ggcgtctggcacagctgctgaacca

SEQ ID NO: 328431 - DNA, 25 bp, Mus musculus
ggcgtctggcacaggcttctgccct

SEQ ID NO: 328432 - DNA, 25 bp, Mus musculus
ggcgtctgggcaagacctgcaggcg

SEQ ID NO: 328433 - DNA, 25 bp, Mus musculus
ggcgtcttagatgacgtggtctcca

SEQ ID NO: 328434 - DNA, 25 bp, Mus musculus
ggcgtcttatgggttggaggatgaa

SEQ ID NO: 328435 - DNA, 25 bp, Mus musculus
ggcgtcttggtggtgtgtcggagct

SEQ ID NO: 328436 - DNA, 25 bp, Mus musculus
ggcgtgaaactgacaccccggaggc

SEQ ID NO: 328437 - DNA, 25 bp, Mus musculus
ggcgtgaaccctaggttctgctgcc

SEQ ID NO: 328438 - DNA, 25 bp, Mus musculus
ggcgtgaagaacctaatatcaggac

SEQ ID NO: 328439 - DNA, 25 bp, Mus musculus
ggcgtgaagaacctgcaactggaca

SEQ ID NO: 328440 - DNA, 25 bp, Mus musculus
ggcgtgacagcatttgacattgtgc

SEQ ID NO: 328441 - DNA, 25 bp, Mus musculus
ggcgtgacctccaactacattgact

SEQ ID NO: 328442 - DNA, 25 bp, Mus musculus
ggcgtgactggctggtgtgcaggat

SEQ ID NO: 328443 - DNA, 25 bp, Mus musculus
ggcgtgatcagaggtcaacagtctg

SEQ ID NO: 328444 - DNA, 25 bp, Mus musculus
ggcgtgatcaggggttcttattggt

SEQ ID NO: 328445 - DNA, 25 bp, Mus musculus
ggcgtgcagtggagctccgcgtgag

SEQ ID NO: 328446 - DNA, 25 bp, Mus musculus
ggcgtgccgacagactaacctaaca

SEQ ID NO: 328447 - DNA, 25 bp, Mus musculus
ggcgtgccgacaggagatgatttct

SEQ ID NO: 328448 - DNA, 25 bp, Mus musculus
ggcgtgcgacaaggaaacttatgga

SEQ ID NO: 328449 - DNA, 25 bp, Mus musculus
ggcgtgcgacaagggtgactattat

SEQ ID NO: 328450 - DNA, 25 bp, Mus musculus
ggcgtgcgacaaggtccgcagatgc

SEQ ID NO: 328451 - DNA, 25 bp, Mus musculus
ggcgtgcgggtgtgaacaacgtggg

SEQ ID NO: 328452 - DNA, 25 bp, Mus musculus
ggcgtgctccgagggaagctctaca

SEQ ID NO: 328453 - DNA, 25 bp, Mus musculus
ggcgtggaagaggtcagcagagcac

SEQ ID NO: 328454 - DNA, 25 bp, Mus musculus
ggcgtggaagaggtcagggccaaaa

SEQ ID NO: 328455 - DNA, 25 bp, Mus musculus
ggcgtggaagggggaggcacacggt

SEQ ID NO: 328456 - DNA, 25 bp, Mus musculus
ggcgtggagcagggccgactgatct

SEQ ID NO: 328457 - DNA, 25 bp, Mus musculus
ggcgtggaggtggggtgctgtgagt

SEQ ID NO: 328458 - DNA, 25 bp, Mus musculus
ggcgtggatgacaaggcatctgtgg

SEQ ID NO: 328459 - DNA, 25 bp, Mus musculus
ggcgtggcagtgtacagctgtaaga

SEQ ID NO: 328460 - DNA, 25 bp, Mus musculus
ggcgtggcccccgaggatgtcagtg

SEQ ID NO: 328461 - DNA, 25 bp, Mus musculus
ggcgtggcggacccaggcaccccgc

SEQ ID NO: 328462 - DNA, 25 bp, Mus musculus
ggcgtggctggtcgggatggtggct

SEQ ID NO: 328463 - DNA, 25 bp, Mus musculus
ggcgtgggaacagagccctttggga

SEQ ID NO: 328464 - DNA, 25 bp, Mus musculus
ggcgtgtctgagaaccttctcccgg

SEQ ID NO: 328465 - DNA, 25 bp, Mus musculus
ggcgtgtgatggggccaaactgagc

SEQ ID NO: 328466 - DNA, 25 bp, Mus musculus
ggcgtgttctgagatgacagtcatg

SEQ ID NO: 328467 - DNA, 25 bp, Mus musculus
ggcgtgttctgaggatcctggaaag

SEQ ID NO: 328468 - DNA, 25 bp, Mus musculus
ggcgttaaagctctcgtggcgctct

SEQ ID NO: 328469 - DNA, 25 bp, Mus musculus
ggcgttattgctcggggtgacaaag

SEQ ID NO: 328470 - DNA, 25 bp, Mus musculus
ggcgttcaacgctccagttataaac

SEQ ID NO: 328471 - DNA, 25 bp, Mus musculus
ggcgttcaagttaattatgacctgg

SEQ ID NO: 328472 - DNA, 25 bp, Mus musculus
ggcgttcaagttaattctgtcagac

SEQ ID NO: 328473 - DNA, 25 bp, Mus musculus
ggcgttcagtatgcctgtgtcttga

SEQ ID NO: 328474 - DNA, 25 bp, Mus musculus
ggcgttcatggaatatgaagacaag

SEQ ID NO: 328475 - DNA, 25 bp, Mus musculus
ggcgttcttgctaactgtccagtta

SEQ ID NO: 328476 - DNA, 25 bp, Mus musculus
ggcgttggagatctcatcccgtaca

SEQ ID NO: 328477 - DNA, 25 bp, Mus musculus
ggcgttggagggtgctgagtactcc

SEQ ID NO: 328478 - DNA, 25 bp, Mus musculus
ggcgttggagtgtcccatcctgatc

SEQ ID NO: 328479 - DNA, 25 bp, Mus musculus
ggcgttggatggttacatccaggca

SEQ ID NO: 328480 - DNA, 25 bp, Mus musculus
ggcgttgtcacctgaggcccttctc

SEQ ID NO: 328481 - DNA, 25 bp, Mus musculus
ggcgttgtcacctggagcattccag

SEQ ID NO: 328482 - DNA, 25 bp, Mus musculus
ggcgttgttaggaagatgatccata

SEQ ID NO: 328483 - DNA, 25 bp, Mus musculus
ggcgttgttaggattatgtactgaa

SEQ ID NO: 328484 - DNA, 25 bp, Mus musculus
ggcgtttgcacaaagttcgagaagg

SEQ ID NO: 328485 - DNA, 25 bp, Mus musculus
ggcgttttagtgaacaacgtgggca

SEQ ID NO: 328486 - DNA, 25 bp, Mus musculus
ggctaaaaaaagaaatcacaattca

SEQ ID NO: 328487 - DNA, 25 bp, Mus musculus
ggctaaaaaaagaaggtgacacagc

SEQ ID NO: 328488 - DNA, 25 bp, Mus musculus
ggctaaaactgtgcagttgtactat

SEQ ID NO: 328489 - DNA, 25 bp, Mus musculus
ggctaaaagccaagcacggaaataa

SEQ ID NO: 328490 - DNA, 25 bp, Mus musculus
ggctaaacttcaaggctgtagagag

SEQ ID NO: 328491 - DNA, 25 bp, Mus musculus
ggctaaagcagaggtgcagtgagcc

SEQ ID NO: 328492 - DNA, 25 bp, Mus musculus
ggctaaataaccagagtatgctgga

SEQ ID NO: 328493 - DNA, 25 bp, Mus musculus
ggctaacatgaagctgttctttcta

SEQ ID NO: 328494 - DNA, 25 bp, Mus musculus
ggctaacatgaaggcagacaagttg

SEQ ID NO: 328495 - DNA, 25 bp, Mus musculus
ggctaacatggggttcggagcgacc

SEQ ID NO: 328496 - DNA, 25 bp, Mus musculus
ggctaacccaggaactggtgctcct

SEQ ID NO: 328497 - DNA, 25 bp, Mus musculus
ggctaacctcaaagcctctccgacc

SEQ ID NO: 328498 - DNA, 25 bp, Mus musculus
ggctaacgaggacgtctgcctggca

SEQ ID NO: 328499 - DNA, 25 bp, Mus musculus
ggctaacggatttgtcccactcact

SEQ ID NO: 328500 - DNA, 25 bp, Mus musculus
ggctaacggatttgttggatggatt

SEQ ID NO: 328501 - DNA, 25 bp, Mus musculus
ggctaactctgagggcacgtcagag

SEQ ID NO: 328502 - DNA, 25 bp, Mus musculus
ggctaactctgagttcctgaaattc

SEQ ID NO: 328503 - DNA, 25 bp, Mus musculus
ggctaactgaggggttggcaaaaca

SEQ ID NO: 328504 - DNA, 25 bp, Mus musculus
ggctaagaaggaggggtgaggctgc

SEQ ID NO: 328505 - DNA, 25 bp, Mus musculus
ggctaagcaggtgaagtccacggga

SEQ ID NO: 328506 - DNA, 25 bp, Mus musculus
ggctaaggcgagggattttaggtga

SEQ ID NO: 328507 - DNA, 25 bp, Mus musculus
ggctaagggacagatggctatgaac

SEQ ID NO: 328508 - DNA, 25 bp, Mus musculus
ggctaagggacagggggctgaaaga

SEQ ID NO: 328509 - DNA, 25 bp, Mus musculus
ggctaagtctgacccccattgttcc

SEQ ID NO: 328510 - DNA, 25 bp, Mus musculus
ggctaagtggctctgtatttctgtc

SEQ ID NO: 328511 - DNA, 25 bp, Mus musculus
ggctaagtggctgagccaaaccagc

SEQ ID NO: 328512 - DNA, 25 bp, Mus musculus
ggctaagtgggccctgcattatccg

SEQ ID NO: 328513 - DNA, 25 bp, Mus musculus
ggctaatcagcaaggagctagctga

SEQ ID NO: 328514 - DNA, 25 bp, Mus musculus
ggctaatgacatcaggacccgggtc

SEQ ID NO: 328515 - DNA, 25 bp, Mus musculus
ggctaatgatgcctatcctggcccg

SEQ ID NO: 328516 - DNA, 25 bp, Mus musculus
ggctaatgcagagatccactgccag

SEQ ID NO: 328517 - DNA, 25 bp, Mus musculus
ggctaatgcagaggggagtttgccc

SEQ ID NO: 328518 - DNA, 25 bp, Mus musculus
ggctaatgccttgctgtgcttctac

SEQ ID NO: 328519 - DNA, 25 bp, Mus musculus
ggctaatgccttgggcgctgggctg

SEQ ID NO: 328520 - DNA, 25 bp, Mus musculus
ggctaatggctcagctttcaacatt

SEQ ID NO: 328521 - DNA, 25 bp, Mus musculus
ggctaatgggaagagtacatctcgg

SEQ ID NO: 328522 - DNA, 25 bp, Mus musculus
ggctaatgtaagaatgtctacaagc

SEQ ID NO: 328523 - DNA, 25 bp, Mus musculus
ggctaattagcatctgaagttgaga

SEQ ID NO: 328524 - DNA, 25 bp, Mus musculus
ggctaatttatgatcgttgtccaac

SEQ ID NO: 328525 - DNA, 25 bp, Mus musculus
ggctacaaaaggtgcaccaatgggc

SEQ ID NO: 328526 - DNA, 25 bp, Mus musculus
ggctacaaaaggtgcttccactcag

SEQ ID NO: 328527 - DNA, 25 bp, Mus musculus
ggctacaaagaacccaagagatgaa

SEQ ID NO: 328528 - DNA, 25 bp, Mus musculus
ggctacaagaagagatacgaggagg

SEQ ID NO: 328529 - DNA, 25 bp, Mus musculus
ggctacaagcagtgccggctacagt

SEQ ID NO: 328530 - DNA, 25 bp, Mus musculus
ggctacaatccctctacttcggaac

SEQ ID NO: 328531 - DNA, 25 bp, Mus musculus
ggctacacaaaaggtggttgttgga

SEQ ID NO: 328532 - DNA, 25 bp, Mus musculus
ggctacacagaagttcagttccggc

SEQ ID NO: 328533 - DNA, 25 bp, Mus musculus
ggctacacagatgttcactgaaggc

SEQ ID NO: 328534 - DNA, 25 bp, Mus musculus
ggctacacagatttgacataattga

SEQ ID NO: 328535 - DNA, 25 bp, Mus musculus
ggctacacagtctgggtgtttgggc

SEQ ID NO: 328536 - DNA, 25 bp, Mus musculus
ggctacactgggcgccctgtgcttt

SEQ ID NO: 328537 - DNA, 25 bp, Mus musculus
ggctacagaggtgggcttactgtaa

SEQ ID NO: 328538 - DNA, 25 bp, Mus musculus
ggctacagaggtgtccaacaggcca

SEQ ID NO: 328539 - DNA, 25 bp, Mus musculus
ggctacagcagaggaataaatgaag

SEQ ID NO: 328540 - DNA, 25 bp, Mus musculus
ggctacagtctgcctttcagtcaga

SEQ ID NO: 328541 - DNA, 25 bp, Mus musculus
ggctacagtgatcaggttcagcgtc

SEQ ID NO: 328542 - DNA, 25 bp, Mus musculus
ggctacatggggttgacctgtagtg

SEQ ID NO: 328543 - DNA, 25 bp, Mus musculus
ggctacattcctcagggaactgaaa

SEQ ID NO: 328544 - DNA, 25 bp, Mus musculus
ggctacattgagagtcaggtacagt

SEQ ID NO: 328545 - DNA, 25 bp, Mus musculus
ggctacattgagagtcatccttttt

SEQ ID NO: 328546 - DNA, 25 bp, Mus musculus
ggctaccacaaccagctgctgaacc

SEQ ID NO: 328547 - DNA, 25 bp, Mus musculus
ggctaccacagaagctgaaccggaa

SEQ ID NO: 328548 - DNA, 25 bp, Mus musculus
ggctaccacagaggccttgcccctt

SEQ ID NO: 328549 - DNA, 25 bp, Mus musculus
ggctaccagccacaggagctcttag

SEQ ID NO: 328550 - DNA, 25 bp, Mus musculus
ggctaccatgggagccccgcaaggt

SEQ ID NO: 328551 - DNA, 25 bp, Mus musculus
ggctacccaaggccgcacatgccta

SEQ ID NO: 328552 - DNA, 25 bp, Mus musculus
ggctacccagctcgatcgagagctg

SEQ ID NO: 328553 - DNA, 25 bp, Mus musculus
ggctaccgatcaccgcaacggccat

SEQ ID NO: 328554 - DNA, 25 bp, Mus musculus
ggctaccgatcaccggggctaccgt

SEQ ID NO: 328555 - DNA, 25 bp, Mus musculus
ggctaccggacagctttcttcggaa

SEQ ID NO: 328556 - DNA, 25 bp, Mus musculus
ggctaccggggcggtgatacttctg

SEQ ID NO: 328557 - DNA, 25 bp, Mus musculus
ggctaccgtcatacctcactacaga

SEQ ID NO: 328558 - DNA, 25 bp, Mus musculus
ggctaccgtcgctttctccagctga

SEQ ID NO: 328559 - DNA, 25 bp, Mus musculus
ggctaccgtcttgctggtgagcacc

SEQ ID NO: 328560 - DNA, 25 bp, Mus musculus
ggctacctagaaagtcccaaggaaa

SEQ ID NO: 328561 - DNA, 25 bp, Mus musculus
ggctacctagaacatcagaaacctg

SEQ ID NO: 328562 - DNA, 25 bp, Mus musculus
ggctacctctggggtgaatgagagt

SEQ ID NO: 328563 - DNA, 25 bp, Mus musculus
ggctacctctgtgcaatgaaggtaa

SEQ ID NO: 328564 - DNA, 25 bp, Mus musculus
ggctacctgcaccagagacggaaaa

SEQ ID NO: 328565 - DNA, 25 bp, Mus musculus
ggctacctgcaccaggattctaatc

SEQ ID NO: 328566 - DNA, 25 bp, Mus musculus
ggctacctgggagccatcgagggaa

SEQ ID NO: 328567 - DNA, 25 bp, Mus musculus
ggctacgacccgggagcccataagt

SEQ ID NO: 328568 - DNA, 25 bp, Mus musculus
ggctacgacgtgctgtgtgcagcag

SEQ ID NO: 328569 - DNA, 25 bp, Mus musculus
ggctacgacgtggttgcgcagacag

SEQ ID NO: 328570 - DNA, 25 bp, Mus musculus
ggctacgactacagtcagggtagta

SEQ ID NO: 328571 - DNA, 25 bp, Mus musculus
ggctacgaggaagtaccatttaggt

SEQ ID NO: 328572 - DNA, 25 bp, Mus musculus
ggctacgaggcaaaggtgtacagtg

SEQ ID NO: 328573 - DNA, 25 bp, Mus musculus
ggctacggaggctatggggcatgga

SEQ ID NO: 328574 - DNA, 25 bp, Mus musculus
ggctacggcaaatactggtaaccca

SEQ ID NO: 328575 - DNA, 25 bp, Mus musculus
ggctacgggcacggctcggatggcg

SEQ ID NO: 328576 - DNA, 25 bp, Mus musculus
ggctacgtcaaggtcccaaagccca

SEQ ID NO: 328577 - DNA, 25 bp, Mus musculus
ggctactaaggagggcgcagatgtc

SEQ ID NO: 328578 - DNA, 25 bp, Mus musculus
ggctactaaggagggcgctctctgt

SEQ ID NO: 328579 - DNA, 25 bp, Mus musculus
ggctactacacgtgggctgtcttct

SEQ ID NO: 328580 - DNA, 25 bp, Mus musculus
ggctactatactctgtattctgtca

SEQ ID NO: 328581 - DNA, 25 bp, Mus musculus
ggctactccaggaggcaccatgtgg

SEQ ID NO: 328582 - DNA, 25 bp, Mus musculus
ggctactctgagataaagccactct

SEQ ID NO: 328583 - DNA, 25 bp, Mus musculus
ggctactctgagtgttataggctcc

SEQ ID NO: 328584 - DNA, 25 bp, Mus musculus
ggctactgccaggcaatgaacatcg

SEQ ID NO: 328585 - DNA, 25 bp, Mus musculus
ggctactgtatgcccggagcacaga

SEQ ID NO: 328586 - DNA, 25 bp, Mus musculus
ggctactgtatgccgggagcacaga

SEQ ID NO: 328587 - DNA, 25 bp, Mus musculus
ggctacttagaaccaccataacaca

SEQ ID NO: 328588 - DNA, 25 bp, Mus musculus
ggctacttcgcgtgggctgtcttct

SEQ ID NO: 328589 - DNA, 25 bp, Mus musculus
ggctacttctccaaggaaaaggaat

SEQ ID NO: 328590 - DNA, 25 bp, Mus musculus
ggctacttctgggaacatcatgaca

SEQ ID NO: 328591 - DNA, 25 bp, Mus musculus
ggctactttacctctctgcagaaag

SEQ ID NO: 328592 - DNA, 25 bp, Mus musculus
ggctagaaagcagatggaaaggcag

SEQ ID NO: 328593 - DNA, 25 bp, Mus musculus
ggctagaaaggaagatcctggccct

SEQ ID NO: 328594 - DNA, 25 bp, Mus musculus
ggctagacaggcaggacaggtcctg

SEQ ID NO: 328595 - DNA, 25 bp, Mus musculus
ggctagaccgtaggggttcacgaac

SEQ ID NO: 328596 - DNA, 25 bp, Mus musculus
ggctagactacagggaaagccaccc

SEQ ID NO: 328597 - DNA, 25 bp, Mus musculus
ggctagactggctgcgaagctgggg

SEQ ID NO: 328598 - DNA, 25 bp, Mus musculus
ggctagagaggctgccctgggagct

SEQ ID NO: 328599 - DNA, 25 bp, Mus musculus
ggctagagcataaggtttatctcaa

SEQ ID NO: 328600 - DNA, 25 bp, Mus musculus
ggctagagtcattgcaggcccggca

SEQ ID NO: 328601 - DNA, 25 bp, Mus musculus
ggctagagtttatggatccgcctcc

SEQ ID NO: 328602 - DNA, 25 bp, Mus musculus
ggctagatcacagtcaagcaggtag

SEQ ID NO: 328603 - DNA, 25 bp, Mus musculus
ggctagattgagatgagcagctctc

SEQ ID NO: 328604 - DNA, 25 bp, Mus musculus
ggctagcagatgaagatctcaggcc

SEQ ID NO: 328605 - DNA, 25 bp, Mus musculus
ggctagcagcccaggatcaaagaat

SEQ ID NO: 328606 - DNA, 25 bp, Mus musculus
ggctagcagcccaggggaacggggg

SEQ ID NO: 328607 - DNA, 25 bp, Mus musculus
ggctagcagcccaggggtggaggag

SEQ ID NO: 328608 - DNA, 25 bp, Mus musculus
ggctagcatgagaacaaatataaag

SEQ ID NO: 328609 - DNA, 25 bp, Mus musculus
ggctagcatgagcatcagttgggga

SEQ ID NO: 328610 - DNA, 25 bp, Mus musculus
ggctagctagttcaggcactggctc

SEQ ID NO: 328611 - DNA, 25 bp, Mus musculus
ggctagctcgtgtgccgtgcaggtg

SEQ ID NO: 328612 - DNA, 25 bp, Mus musculus
ggctagctgaggtgcggagctgacc

SEQ ID NO: 328613 - DNA, 25 bp, Mus musculus
ggctaggaaggttctgtttgttttt

SEQ ID NO: 328614 - DNA, 25 bp, Mus musculus
ggctaggtatctccggtttaggctc

SEQ ID NO: 328615 - DNA, 25 bp, Mus musculus
ggctagtaagcagtctgcaaacagc

SEQ ID NO: 328616 - DNA, 25 bp, Mus musculus
ggctagtgcaaagatcagctactat

SEQ ID NO: 328617 - DNA, 25 bp, Mus musculus
ggctagtgcattagcctgccaccac

SEQ ID NO: 328618 - DNA, 25 bp, Mus musculus
ggctataacacacgagtcatactac

SEQ ID NO: 328619 - DNA, 25 bp, Mus musculus
ggctataacacaggagtcatactac

SEQ ID NO: 328620 - DNA, 25 bp, Mus musculus
ggctataacgtctgcatactatcgt

SEQ ID NO: 328621 - DNA, 25 bp, Mus musculus
ggctataatctggtatgtgtatcac

SEQ ID NO: 328622 - DNA, 25 bp, Mus musculus
ggctatagaaaggctgaaggcactg

SEQ ID NO: 328623 - DNA, 25 bp, Mus musculus
ggctatagaaagggcgctttcgttg

SEQ ID NO: 328624 - DNA, 25 bp, Mus musculus
ggctatatcaagtttcatgcaggct

SEQ ID NO: 328625 - DNA, 25 bp, Mus musculus
ggctatattcagggctacaacaagg

SEQ ID NO: 328626 - DNA, 25 bp, Mus musculus
ggctatattcaggtgacagacttcg

SEQ ID NO: 328627 - DNA, 25 bp, Mus musculus
ggctatcaggatgactttctgctct

SEQ ID NO: 328628 - DNA, 25 bp, Mus musculus
ggctatcatactgctgataaagatg

SEQ ID NO: 328629 - DNA, 25 bp, Mus musculus
ggctatccagatattgctgttggag

SEQ ID NO: 328630 - DNA, 25 bp, Mus musculus
ggctatcctgaggttgcaggtcagc

SEQ ID NO: 328631 - DNA, 25 bp, Mus musculus
ggctatcgtgtgagccagatcttct

SEQ ID NO: 328632 - DNA, 25 bp, Mus musculus
ggctatgaagaatgcccatatcaca

SEQ ID NO: 328633 - DNA, 25 bp, Mus musculus
ggctatgaagccacattgggattgt

SEQ ID NO: 328634 - DNA, 25 bp, Mus musculus
ggctatgaaggggtcagaatacaag

SEQ ID NO: 328635 - DNA, 25 bp, Mus musculus
ggctatgacagccagcccgctttca

SEQ ID NO: 328636 - DNA, 25 bp, Mus musculus
ggctatgacccccctctctcccttc

SEQ ID NO: 328637 - DNA, 25 bp, Mus musculus
ggctatgaccttgaggacagacaag

SEQ ID NO: 328638 - DNA, 25 bp, Mus musculus
ggctatgcaagggctacagagcccc

SEQ ID NO: 328639 - DNA, 25 bp, Mus musculus
ggctatgcagatggctatgaacggc

SEQ ID NO: 328640 - DNA, 25 bp, Mus musculus
ggctatgccagctcttctcctatgc

SEQ ID NO: 328641 - DNA, 25 bp, Mus musculus
ggctatgccaggaacccatctctca

SEQ ID NO: 328642 - DNA, 25 bp, Mus musculus
ggctatgccttctaggtttgatatc

SEQ ID NO: 328643 - DNA, 25 bp, Mus musculus
ggctatgctcatagggtacagcatg

SEQ ID NO: 328644 - DNA, 25 bp, Mus musculus
ggctatgctctcagaggttcctgac

SEQ ID NO: 328645 - DNA, 25 bp, Mus musculus
ggctatgctctcaggctggcatcat

SEQ ID NO: 328646 - DNA, 25 bp, Mus musculus
ggctatggaaaggtttttcaagtac

SEQ ID NO: 328647 - DNA, 25 bp, Mus musculus
ggctatggagagaagcaaatttcca

SEQ ID NO: 328648 - DNA, 25 bp, Mus musculus
ggctatggagagaagcaggagcttg

SEQ ID NO: 328649 - DNA, 25 bp, Mus musculus
ggctatggagagagtatgctggata

SEQ ID NO: 328650 - DNA, 25 bp, Mus musculus
ggctatggagaggtgggaaaggggt

SEQ ID NO: 328651 - DNA, 25 bp, Mus musculus
ggctatggagctggtgctgtccgcc

SEQ ID NO: 328652 - DNA, 25 bp, Mus musculus
ggctatggagtcccaacaggagggc

SEQ ID NO: 328653 - DNA, 25 bp, Mus musculus
ggctatggcaaggtgttccaggtga

SEQ ID NO: 328654 - DNA, 25 bp, Mus musculus
ggctatgggagatgataaaagcttt

SEQ ID NO: 328655 - DNA, 25 bp, Mus musculus
ggctatggggggacctgcactcagc

SEQ ID NO: 328656 - DNA, 25 bp, Mus musculus
ggctatggtggaggtagaagatttt

SEQ ID NO: 328657 - DNA, 25 bp, Mus musculus
ggctatgtctgccagtgtgccccag

SEQ ID NO: 328658 - DNA, 25 bp, Mus musculus
ggctatgtgctgcagactgaagtgg

SEQ ID NO: 328659 - DNA, 25 bp, Mus musculus
ggctatgtgctgcaggctacatgtg

SEQ ID NO: 328660 - DNA, 25 bp, Mus musculus
ggctatgtgtatggcttggcaaatt

SEQ ID NO: 328661 - DNA, 25 bp, Mus musculus
ggctatgtgtatggtgattccacca

SEQ ID NO: 328662 - DNA, 25 bp, Mus musculus
ggctatgttgagattcattttatgt

SEQ ID NO: 328663 - DNA, 25 bp, Mus musculus
ggctatgttgagcttcgttacgacg

SEQ ID NO: 328664 - DNA, 25 bp, Mus musculus
ggctattaaccaggtcttcaagatg

SEQ ID NO: 328665 - DNA, 25 bp, Mus musculus
ggctattaccgctctagccgcagcc

SEQ ID NO: 328666 - DNA, 25 bp, Mus musculus
ggctattacgagtatggctacatct

SEQ ID NO: 328667 - DNA, 25 bp, Mus musculus
ggctattagagccagatcatctgtc

SEQ ID NO: 328668 - DNA, 25 bp, Mus musculus
ggctattagagtgtgctcaagagta

SEQ ID NO: 328669 - DNA, 25 bp, Mus musculus
ggctattctaggaaggctgccttga

SEQ ID NO: 328670 - DNA, 25 bp, Mus musculus
ggctattctagtgacgccaagagac

SEQ ID NO: 328671 - DNA, 25 bp, Mus musculus
ggctattgagctcttcctcatggtc

SEQ ID NO: 328672 - DNA, 25 bp, Mus musculus
ggctatttacagagcccatggatgg

SEQ ID NO: 328673 - DNA, 25 bp, Mus musculus
ggctatttaccagaccaagaaggtc

SEQ ID NO: 328674 - DNA, 25 bp, Mus musculus
ggctatttaccaggacattcgacat

SEQ ID NO: 328675 - DNA, 25 bp, Mus musculus
ggctatttaccaggtgaggacactt

SEQ ID NO: 328676 - DNA, 25 bp, Mus musculus
ggctatttcaggctttgatgggaca

SEQ ID NO: 328677 - DNA, 25 bp, Mus musculus
ggctatttccctgcagtctgacctc

SEQ ID NO: 328678 - DNA, 25 bp, Mus musculus
ggctatttcttgttgccaaaacaaa

SEQ ID NO: 328679 - DNA, 25 bp, Mus musculus
ggctcaaaaaaaaaaagcctctaag

SEQ ID NO: 328680 - DNA, 25 bp, Mus musculus
ggctcaaaatgtgcctctcccagtg

SEQ ID NO: 328681 - DNA, 25 bp, Mus musculus
ggctcaaactaagtggcctgcttga

SEQ ID NO: 328682 - DNA, 25 bp, Mus musculus
ggctcaaagattcaggctggacaat

SEQ ID NO: 328683 - DNA, 25 bp, Mus musculus
ggctcaaagattcaggttctcccca

SEQ ID NO: 328684 - DNA, 25 bp, Mus musculus
ggctcaaagtcaagaaaaaacaaga

SEQ ID NO: 328685 - DNA, 25 bp, Mus musculus
ggctcaaagtcaagatctcaaaatg

SEQ ID NO: 328686 - DNA, 25 bp, Mus musculus
ggctcaaattctcacgacagcagcc

SEQ ID NO: 328687 - DNA, 25 bp, Mus musculus
ggctcaaattctcaggacagcagcc

SEQ ID NO: 328688 - DNA, 25 bp, Mus musculus
ggctcaacagatccaaaaggtaatt

SEQ ID NO: 328689 - DNA, 25 bp, Mus musculus
ggctcaagaggaaggctacgtgttc

SEQ ID NO: 328690 - DNA, 25 bp, Mus musculus
ggctcaagcaggaacctagcaaaac

SEQ ID NO: 328691 - DNA, 25 bp, Mus musculus
ggctcaagcagggccacaatgccac

SEQ ID NO: 328692 - DNA, 25 bp, Mus musculus
ggctcaagcaggtaacaaatcacaa

SEQ ID NO: 328693 - DNA, 25 bp, Mus musculus
ggctcaagtgagggcattgccagag

SEQ ID NO: 328694 - DNA, 25 bp, Mus musculus
ggctcaagtgtgagggagatgaacc

SEQ ID NO: 328695 - DNA, 25 bp, Mus musculus
ggctcaatacggttattactctggg

SEQ ID NO: 328696 - DNA, 25 bp, Mus musculus
ggctcaatgaacaggttgataaaga

SEQ ID NO: 328697 - DNA, 25 bp, Mus musculus
ggctcacaaaaaacttcatcaaaga

SEQ ID NO: 328698 - DNA, 25 bp, Mus musculus
ggctcacaaagaacaagggagaagc

SEQ ID NO: 328699 - DNA, 25 bp, Mus musculus
ggctcacaagaaataccattctctt

SEQ ID NO: 328700 - DNA, 25 bp, Mus musculus
ggctcacaaggcagaaaaaaaaatg

SEQ ID NO: 328701 - DNA, 25 bp, Mus musculus
ggctcacaccgacctgagaaatgcc

SEQ ID NO: 328702 - DNA, 25 bp, Mus musculus
ggctcacaccgactgcgtaattcga

SEQ ID NO: 328703 - DNA, 25 bp, Mus musculus
ggctcacaccgataaccctaacaag

SEQ ID NO: 328704 - DNA, 25 bp, Mus musculus
ggctcacacgaggtagctcgcggcg

SEQ ID NO: 328705 - DNA, 25 bp, Mus musculus
ggctcacagaagagagctgtgaatt

SEQ ID NO: 328706 - DNA, 25 bp, Mus musculus
ggctcacagaaggctgttcatttag

SEQ ID NO: 328707 - DNA, 25 bp, Mus musculus
ggctcacagcctagcctgtgtttgt

SEQ ID NO: 328708 - DNA, 25 bp, Mus musculus
ggctcacagctgtgatgagtgcaga

SEQ ID NO: 328709 - DNA, 25 bp, Mus musculus
ggctcacaggaatagatttcttatc

SEQ ID NO: 328710 - DNA, 25 bp, Mus musculus
ggctcaccaggatgtcttccaagcg

SEQ ID NO: 328711 - DNA, 25 bp, Mus musculus
ggctcaccggctcgattctggccgt

SEQ ID NO: 328712 - DNA, 25 bp, Mus musculus
ggctcaccgggtcgattctggccgt

SEQ ID NO: 328713 - DNA, 25 bp, Mus musculus
ggctcacctggttccggaagcagag

SEQ ID NO: 328714 - DNA, 25 bp, Mus musculus
ggctcaccttgaaaatgaagtccct

SEQ ID NO: 328715 - DNA, 25 bp, Mus musculus
ggctcaccttgtgttcgacttccac

SEQ ID NO: 328716 - DNA, 25 bp, Mus musculus
ggctcacgaaagaaaggccagaggg

SEQ ID NO: 328717 - DNA, 25 bp, Mus musculus
ggctcacggagggaccaacatcaat

SEQ ID NO: 328718 - DNA, 25 bp, Mus musculus
ggctcacggcggaaggcaagattga

SEQ ID NO: 328719 - DNA, 25 bp, Mus musculus
ggctcactgaggctggaccacgttc

SEQ ID NO: 328720 - DNA, 25 bp, Mus musculus
ggctcacttgggtgctggtctccta

SEQ ID NO: 328721 - DNA, 25 bp, Mus musculus
ggctcagaaaggatgtcaaagtctt

SEQ ID NO: 328722 - DNA, 25 bp, Mus musculus
ggctcagaatgctggtggacaagaa

SEQ ID NO: 328723 - DNA, 25 bp, Mus musculus
ggctcagaccttaagggatagagaa

SEQ ID NO: 328724 - DNA, 25 bp, Mus musculus
ggctcagagacaaggttctccccac

SEQ ID NO: 328725 - DNA, 25 bp, Mus musculus
ggctcagagggaggaggacagcctc

SEQ ID NO: 328726 - DNA, 25 bp, Mus musculus
ggctcagattacagatttctgctcc

SEQ ID NO: 328727 - DNA, 25 bp, Mus musculus
ggctcagcaaaggcagctgagatgc

SEQ ID NO: 328728 - DNA, 25 bp, Mus musculus
ggctcagcaggaaacaaggaccaag

SEQ ID NO: 328729 - DNA, 25 bp, Mus musculus
ggctcagcagggacgcccgaggagc

SEQ ID NO: 328730 - DNA, 25 bp, Mus musculus
ggctcagcagggtgctacagtgcca

SEQ ID NO: 328731 - DNA, 25 bp, Mus musculus
ggctcagcgatcaggatatgacatt

SEQ ID NO: 328732 - DNA, 25 bp, Mus musculus
ggctcagcgtgaagatgtactggtt

SEQ ID NO: 328733 - DNA, 25 bp, Mus musculus
ggctcagctacaggctcagaaagaa

SEQ ID NO: 328734 - DNA, 25 bp, Mus musculus
ggctcagctacctcggtaccagtac

SEQ ID NO: 328735 - DNA, 25 bp, Mus musculus
ggctcagctatggactgtctaactt

SEQ ID NO: 328736 - DNA, 25 bp, Mus musculus
ggctcaggagcaagattgccaaggg

SEQ ID NO: 328737 - DNA, 25 bp, Mus musculus
ggctcaggagcaagtttcaggttag

SEQ ID NO: 328738 - DNA, 25 bp, Mus musculus
ggctcaggatcctaccctctagacg

SEQ ID NO: 328739 - DNA, 25 bp, Mus musculus
ggctcagggcacaggaataacagaa

SEQ ID NO: 328740 - DNA, 25 bp, Mus musculus
ggctcagtaacaagcttcttaaccc

SEQ ID NO: 328741 - DNA, 25 bp, Mus musculus
ggctcagtcaatggagagaacaagc

SEQ ID NO: 328742 - DNA, 25 bp, Mus musculus
ggctcagtggatgagaccctttttg

SEQ ID NO: 328743 - DNA, 25 bp, Mus musculus
ggctcagtgggctccgtgaagactg

SEQ ID NO: 328744 - DNA, 25 bp, Mus musculus
ggctcagtggttgttgacctcctgt

SEQ ID NO: 328745 - DNA, 25 bp, Mus musculus
ggctcataggacagtctcccatggc

SEQ ID NO: 328746 - DNA, 25 bp, Mus musculus
ggctcatcagatgtaaacagaaagt

SEQ ID NO: 328747 - DNA, 25 bp, Mus musculus
ggctcatcagccacggcaagctcat

SEQ ID NO: 328748 - DNA, 25 bp, Mus musculus
ggctcatcagctggctctgtccacc

SEQ ID NO: 328749 - DNA, 25 bp, Mus musculus
ggctcatcaggaggactgacaaacg

SEQ ID NO: 328750 - DNA, 25 bp, Mus musculus
ggctcatcagttggcagttctgcaa

SEQ ID NO: 328751 - DNA, 25 bp, Mus musculus
ggctcatcatacagaacagtacctt

SEQ ID NO: 328752 - DNA, 25 bp, Mus musculus
ggctcatctacaggtgccaagtcgg

SEQ ID NO: 328753 - DNA, 25 bp, Mus musculus
ggctcatggggaagtctaaagctaa

SEQ ID NO: 328754 - DNA, 25 bp, Mus musculus
ggctcatgggttctgcaatcttcac

SEQ ID NO: 328755 - DNA, 25 bp, Mus musculus
ggctcatgtgcagaaggtctcgagg

SEQ ID NO: 328756 - DNA, 25 bp, Mus musculus
ggctcattctgctggctgctgctgc

SEQ ID NO: 328757 - DNA, 25 bp, Mus musculus
ggctcattgaaggttcaaccatttt

SEQ ID NO: 328758 - DNA, 25 bp, Mus musculus
ggctcattgaggtgaatgggcagaa

SEQ ID NO: 328759 - DNA, 25 bp, Mus musculus
ggctcattgttgtagaggatctgag

SEQ ID NO: 328760 - DNA, 25 bp, Mus musculus
ggctccaaagagggctatgtgctca

SEQ ID NO: 328761 - DNA, 25 bp, Mus musculus
ggctccaaagtcggtttctgtatgc

SEQ ID NO: 328762 - DNA, 25 bp, Mus musculus
ggctccaaccccccggccctgcctg

SEQ ID NO: 328763 - DNA, 25 bp, Mus musculus
ggctccaactggcgtccctacagcc

SEQ ID NO: 328764 - DNA, 25 bp, Mus musculus
ggctccaactgggtctgagtgcccg

SEQ ID NO: 328765 - DNA, 25 bp, Mus musculus
ggctccaagagcgatatgagatcgt

SEQ ID NO: 328766 - DNA, 25 bp, Mus musculus
ggctccaatgtcaaatgtgactatg

SEQ ID NO: 328767 - DNA, 25 bp, Mus musculus
ggctccacaaacgtgcagttcagtc

SEQ ID NO: 328768 - DNA, 25 bp, Mus musculus
ggctccacaaacgtggtgaatacat

SEQ ID NO: 328769 - DNA, 25 bp, Mus musculus
ggctccacaagcaaaaccttgagat

SEQ ID NO: 328770 - DNA, 25 bp, Mus musculus
ggctccacacgggacaagctctgac

SEQ ID NO: 328771 - DNA, 25 bp, Mus musculus
ggctccacacggttacaggcccaaa

SEQ ID NO: 328772 - DNA, 25 bp, Mus musculus
ggctccacactgtcccggagagtgg

SEQ ID NO: 328773 - DNA, 25 bp, Mus musculus
ggctccacagattgcagcccgggag

SEQ ID NO: 328774 - DNA, 25 bp, Mus musculus
ggctccacaggagatggctttcacg

SEQ ID NO: 328775 - DNA, 25 bp, Mus musculus
ggctccacatacaagggacagtggc

SEQ ID NO: 328776 - DNA, 25 bp, Mus musculus
ggctccaccactgagtttgaagagc

SEQ ID NO: 328777 - DNA, 25 bp, Mus musculus
ggctccacccaggctaccttcatgg

SEQ ID NO: 328778 - DNA, 25 bp, Mus musculus
ggctccaccgcggtctgacagcgga

SEQ ID NO: 328779 - DNA, 25 bp, Mus musculus
ggctccaccgcggttggaattcgag

SEQ ID NO: 328780 - DNA, 25 bp, Mus musculus
ggctccaccgcggttggtgttcgag

SEQ ID NO: 328781 - DNA, 25 bp, Mus musculus
ggctccacctaaaagtgctggacga

SEQ ID NO: 328782 - DNA, 25 bp, Mus musculus
ggctccacctaaagagccactggac

SEQ ID NO: 328783 - DNA, 25 bp, Mus musculus
ggctccacctaaagtactgaccaag

SEQ ID NO: 328784 - DNA, 25 bp, Mus musculus
ggctccacggcaatagacccagtga

SEQ ID NO: 328785 - DNA, 25 bp, Mus musculus
ggctccactgctcaggttgaaggtt

SEQ ID NO: 328786 - DNA, 25 bp, Mus musculus
ggctccactgtcttatatcggatct

SEQ ID NO: 328787 - DNA, 25 bp, Mus musculus
ggctccagaaccagataattagcac

SEQ ID NO: 328788 - DNA, 25 bp, Mus musculus
ggctccagaaggatctgttccaaat

SEQ ID NO: 328789 - DNA, 25 bp, Mus musculus
ggctccagacagtccaatgccactt

SEQ ID NO: 328790 - DNA, 25 bp, Mus musculus
ggctccagacagtcctaacaggggc

SEQ ID NO: 328791 - DNA, 25 bp, Mus musculus
ggctccagagataaagctgctcaaa

SEQ ID NO: 328792 - DNA, 25 bp, Mus musculus
ggctccagagattatttgtctttat

SEQ ID NO: 328793 - DNA, 25 bp, Mus musculus
ggctccagagctctctgtggttgcc

SEQ ID NO: 328794 - DNA, 25 bp, Mus musculus
ggctccagatgatgagaagctgtat

SEQ ID NO: 328795 - DNA, 25 bp, Mus musculus
ggctccagatgctgtggccagcgtc

SEQ ID NO: 328796 - DNA, 25 bp, Mus musculus
ggctccagattcaggcgacaactgg

SEQ ID NO: 328797 - DNA, 25 bp, Mus musculus
ggctccagcctgagagcttcggtgc

SEQ ID NO: 328798 - DNA, 25 bp, Mus musculus
ggctccagctccaggtacttcgagt

SEQ ID NO: 328799 - DNA, 25 bp, Mus musculus
ggctccagcttcctgaatgttttgg

SEQ ID NO: 328800 - DNA, 25 bp, Mus musculus
ggctccaggacaagatgcgagctac

SEQ ID NO: 328801 - DNA, 25 bp, Mus musculus
ggctccaggacaaggaagaaaccgt

SEQ ID NO: 328802 - DNA, 25 bp, Mus musculus
ggctccaggagagggaaaagatgcc

SEQ ID NO: 328803 - DNA, 25 bp, Mus musculus
ggctccagtcctgccaacccatctg

SEQ ID NO: 328804 - DNA, 25 bp, Mus musculus
ggctccagtgtgactggtttcatat

SEQ ID NO: 328805 - DNA, 25 bp, Mus musculus
ggctccataaagcccatgcaggtgc

SEQ ID NO: 328806 - DNA, 25 bp, Mus musculus
ggctccatatatcaaatctggaggt

SEQ ID NO: 328807 - DNA, 25 bp, Mus musculus
ggctccatcaaggtgctctcgtcag

SEQ ID NO: 328808 - DNA, 25 bp, Mus musculus
ggctccatcctggcctccctttttt

SEQ ID NO: 328809 - DNA, 25 bp, Mus musculus
ggctccatcctgttactgagctgcg

SEQ ID NO: 328810 - DNA, 25 bp, Mus musculus
ggctccatgaagtacaaaggcatat

SEQ ID NO: 328811 - DNA, 25 bp, Mus musculus
ggctccatgcagctgaggtctacat

SEQ ID NO: 328812 - DNA, 25 bp, Mus musculus
ggctccattcagagcataccagaaa

SEQ ID NO: 328813 - DNA, 25 bp, Mus musculus
ggctccattcagttttcctttttca

SEQ ID NO: 328814 - DNA, 25 bp, Mus musculus
ggctcccacagagctgatttatcca

SEQ ID NO: 328815 - DNA, 25 bp, Mus musculus
ggctcccacgcagagggtctggaga

SEQ ID NO: 328816 - DNA, 25 bp, Mus musculus
ggctcccaggccttgggaaaagctg

SEQ ID NO: 328817 - DNA, 25 bp, Mus musculus
ggctcccaggtcgggaccctggtga

SEQ ID NO: 328818 - DNA, 25 bp, Mus musculus
ggctcccaggtcggtgttttatctg

SEQ ID NO: 328819 - DNA, 25 bp, Mus musculus
ggctcccagtgtgctccaactgctg

SEQ ID NO: 328820 - DNA, 25 bp, Mus musculus
ggctccccaacagggagttggcacg

SEQ ID NO: 328821 - DNA, 25 bp, Mus musculus
ggctccccaccagcacctcctaccg

SEQ ID NO: 328822 - DNA, 25 bp, Mus musculus
ggctcccccaggtttccatcgtgtg

SEQ ID NO: 328823 - DNA, 25 bp, Mus musculus
ggctcccctcaggctggcctgcctt

SEQ ID NO: 328824 - DNA, 25 bp, Mus musculus
ggctcccctcagggtcatgtaggga

SEQ ID NO: 328825 - DNA, 25 bp, Mus musculus
ggctcccgagagagggaaacaacag

SEQ ID NO: 328826 - DNA, 25 bp, Mus musculus
ggctcccgagagagggtcagcctct

SEQ ID NO: 328827 - DNA, 25 bp, Mus musculus
ggctcccgagggatcatgcctggcc

SEQ ID NO: 328828 - DNA, 25 bp, Mus musculus
ggctcccgccagagctcaggccctg

SEQ ID NO: 328829 - DNA, 25 bp, Mus musculus
ggctcccgccagctcaaggtgatgc

SEQ ID NO: 328830 - DNA, 25 bp, Mus musculus
ggctcccgccaggagaatggtgcca

SEQ ID NO: 328831 - DNA, 25 bp, Mus musculus
ggctcccgcccctggtgtgctacca

SEQ ID NO: 328832 - DNA, 25 bp, Mus musculus
ggctcccgggagcagagaagaaagc

SEQ ID NO: 328833 - DNA, 25 bp, Mus musculus
ggctcccgggagcagtgatgaaaag

SEQ ID NO: 328834 - DNA, 25 bp, Mus musculus
ggctcccgggagcggggcagccaca

SEQ ID NO: 328835 - DNA, 25 bp, Mus musculus
ggctcccgggagcggtcgagctaga

SEQ ID NO: 328836 - DNA, 25 bp, Mus musculus
ggctcccgtccgaggtacccagact

SEQ ID NO: 328837 - DNA, 25 bp, Mus musculus
ggctcccgtccgaggtgtgaatgac

SEQ ID NO: 328838 - DNA, 25 bp, Mus musculus
ggctccctcaggtataagtattgtt

SEQ ID NO: 328839 - DNA, 25 bp, Mus musculus
ggctccctcccgatgagaagaagca

SEQ ID NO: 328840 - DNA, 25 bp, Mus musculus
ggctccctcccgggatatttgcttg

SEQ ID NO: 328841 - DNA, 25 bp, Mus musculus
ggctccctgaggggtacctcggaat

SEQ ID NO: 328842 - DNA, 25 bp, Mus musculus
ggctccctgcacaggggtgacagtc

SEQ ID NO: 328843 - DNA, 25 bp, Mus musculus
ggctccctgcagggtcccacaaaac

SEQ ID NO: 328844 - DNA, 25 bp, Mus musculus
ggctccctgcatgtacccctcaatg

SEQ ID NO: 328845 - DNA, 25 bp, Mus musculus
ggctccctgggtgtcactggtgcag

SEQ ID NO: 328846 - DNA, 25 bp, Mus musculus
ggctcccttactcagttcccttaca

SEQ ID NO: 328847 - DNA, 25 bp, Mus musculus
ggctcccttgggaagccggaggaag

SEQ ID NO: 328848 - DNA, 25 bp, Mus musculus
ggctcccttgggaatttagaagccg

SEQ ID NO: 328849 - DNA, 25 bp, Mus musculus
ggctcccttggggttctcacgcggt

SEQ ID NO: 328850 - DNA, 25 bp, Mus musculus
ggctccctttgggttctcaggccgc

SEQ ID NO: 328851 - DNA, 25 bp, Mus musculus
ggctccgactcagatcagctcgaac

SEQ ID NO: 328852 - DNA, 25 bp, Mus musculus
ggctccgactcagattctttataca

SEQ ID NO: 328853 - DNA, 25 bp, Mus musculus
ggctccgagccaggattgaaattcc

SEQ ID NO: 328854 - DNA, 25 bp, Mus musculus
ggctccgcagacaagatgccttgga

SEQ ID NO: 328855 - DNA, 25 bp, Mus musculus
ggctccgcagcaagatcgaggagct

SEQ ID NO: 328856 - DNA, 25 bp, Mus musculus
ggctccgcagcagaatgccaagaga

SEQ ID NO: 328857 - DNA, 25 bp, Mus musculus
ggctccgcagcccgaatcctattct

SEQ ID NO: 328858 - DNA, 25 bp, Mus musculus
ggctccgccgagcacagtgtatgaa

SEQ ID NO: 328859 - DNA, 25 bp, Mus musculus
ggctccgccgaggaagaaaatactc

SEQ ID NO: 328860 - DNA, 25 bp, Mus musculus
ggctccgcctacgtggcctataaca

SEQ ID NO: 328861 - DNA, 25 bp, Mus musculus
ggctccgcgggctgaggaaatataa

SEQ ID NO: 328862 - DNA, 25 bp, Mus musculus
ggctccggaaaatccactgtgggtg

SEQ ID NO: 328863 - DNA, 25 bp, Mus musculus
ggctccggaaactgctccccagggt

SEQ ID NO: 328864 - DNA, 25 bp, Mus musculus
ggctccggaaagggctctatcacgg

SEQ ID NO: 328865 - DNA, 25 bp, Mus musculus
ggctccggacagaccatggcaacgt

SEQ ID NO: 328866 - DNA, 25 bp, Mus musculus
ggctccggacaggatgcatttgctt

SEQ ID NO: 328867 - DNA, 25 bp, Mus musculus
ggctccggacagtttccttttagac

SEQ ID NO: 328868 - DNA, 25 bp, Mus musculus
ggctccggaggaaagccatcatgtt

SEQ ID NO: 328869 - DNA, 25 bp, Mus musculus
ggctccggaggaaaggatttctcca

SEQ ID NO: 328870 - DNA, 25 bp, Mus musculus
ggctccggcagggaagcccagccct

SEQ ID NO: 328871 - DNA, 25 bp, Mus musculus
ggctccggcggccgctacaaggtgg

SEQ ID NO: 328872 - DNA, 25 bp, Mus musculus
ggctccgggagaaggatcagtggtg

SEQ ID NO: 328873 - DNA, 25 bp, Mus musculus
ggctccgtcaagcccccggaagcct

SEQ ID NO: 328874 - DNA, 25 bp, Mus musculus
ggctcctaccactgacaaagtctcc

SEQ ID NO: 328875 - DNA, 25 bp, Mus musculus
ggctcctacctgaagagcaccaagc

SEQ ID NO: 328876 - DNA, 25 bp, Mus musculus
ggctcctactggaaggtacccaggg

SEQ ID NO: 328877 - DNA, 25 bp, Mus musculus
ggctcctatatcatagcaagaggag

SEQ ID NO: 328878 - DNA, 25 bp, Mus musculus
ggctcctcagatatagccatatttg

SEQ ID NO: 328879 - DNA, 25 bp, Mus musculus
ggctcctcagtattgtggaatgtgg

SEQ ID NO: 328880 - DNA, 25 bp, Mus musculus
ggctcctcagtgtcggcggcggagg

SEQ ID NO: 328881 - DNA, 25 bp, Mus musculus
ggctcctccagatgtcaacttgtgg

SEQ ID NO: 328882 - DNA, 25 bp, Mus musculus
ggctcctccagcaggcttgtgacat

SEQ ID NO: 328883 - DNA, 25 bp, Mus musculus
ggctcctccagcagtgggtttttct

SEQ ID NO: 328884 - DNA, 25 bp, Mus musculus
ggctcctccagggtccggtactggg

SEQ ID NO: 328885 - DNA, 25 bp, Mus musculus
ggctcctccaggtgtttgtggtagc

SEQ ID NO: 328886 - DNA, 25 bp, Mus musculus
ggctcctccatcttggcatgtgctc

SEQ ID NO: 328887 - DNA, 25 bp, Mus musculus
ggctcctctgatgaccacggctcct

SEQ ID NO: 328888 - DNA, 25 bp, Mus musculus
ggctcctctggcatgaacctctcag

SEQ ID NO: 328889 - DNA, 25 bp, Mus musculus
ggctcctctgggatttgttttggcc

SEQ ID NO: 328890 - DNA, 25 bp, Mus musculus
ggctcctctggggcttagtccttgg

SEQ ID NO: 328891 - DNA, 25 bp, Mus musculus
ggctcctcttctctggggcctggaa

SEQ ID NO: 328892 - DNA, 25 bp, Mus musculus
ggctcctgagcagggacctgaggtg

SEQ ID NO: 328893 - DNA, 25 bp, Mus musculus
ggctcctgagcaggtcttgggaccc

SEQ ID NO: 328894 - DNA, 25 bp, Mus musculus
ggctcctgagccaggttgatgtagg

SEQ ID NO: 328895 - DNA, 25 bp, Mus musculus
ggctcctgaggcatggaggggtcta

SEQ ID NO: 328896 - DNA, 25 bp, Mus musculus
ggctcctgatgcaccagattgtaca

SEQ ID NO: 328897 - DNA, 25 bp, Mus musculus
ggctcctgatggtgcctgatggctt

SEQ ID NO: 328898 - DNA, 25 bp, Mus musculus
ggctcctgatgtcactggtctccat

SEQ ID NO: 328899 - DNA, 25 bp, Mus musculus
ggctcctgcaggagggctgctggcc

SEQ ID NO: 328900 - DNA, 25 bp, Mus musculus
ggctcctgcatttggggttcctgct

SEQ ID NO: 328901 - DNA, 25 bp, Mus musculus
ggctcctgcggcaaggggacatgct

SEQ ID NO: 328902 - DNA, 25 bp, Mus musculus
ggctcctgcttccggtgttccgaat

SEQ ID NO: 328903 - DNA, 25 bp, Mus musculus
ggctcctggaacaggaacgttggcg

SEQ ID NO: 328904 - DNA, 25 bp, Mus musculus
ggctcctgtacaggttggcggacct

SEQ ID NO: 328905 - DNA, 25 bp, Mus musculus
ggctccttaccaggagatcgagact

SEQ ID NO: 328906 - DNA, 25 bp, Mus musculus
ggctccttcacccgggaggaagctg

SEQ ID NO: 328907 - DNA, 25 bp, Mus musculus
ggctccttctacagagccttgggga

SEQ ID NO: 328908 - DNA, 25 bp, Mus musculus
ggctccttctacagtgctcctttgt

SEQ ID NO: 328909 - DNA, 25 bp, Mus musculus
ggctccttgataagctcgttggcga

SEQ ID NO: 328910 - DNA, 25 bp, Mus musculus
ggctcgaaaaaacatgcagagatct

SEQ ID NO: 328911 - DNA, 25 bp, Mus musculus
ggctcgaaaatggggtccaagggta

SEQ ID NO: 328912 - DNA, 25 bp, Mus musculus
ggctcgagactcaaggtcaacatgg

SEQ ID NO: 328913 - DNA, 25 bp, Mus musculus
ggctcgagactcaagtttagctgtt

SEQ ID NO: 328914 - DNA, 25 bp, Mus musculus
ggctcgagcagagtccgtctcccag

SEQ ID NO: 328915 - DNA, 25 bp, Mus musculus
ggctcgagtcaccgtttgccatctc

SEQ ID NO: 328916 - DNA, 25 bp, Mus musculus
ggctcgagttgctccttcctctcca

SEQ ID NO: 328917 - DNA, 25 bp, Mus musculus
ggctcgcagaggcaggggtagagcc

SEQ ID NO: 328918 - DNA, 25 bp, Mus musculus
ggctcgcataggcagttctcccaga

SEQ ID NO: 328919 - DNA, 25 bp, Mus musculus
ggctcgccaggctggaacgctttag

SEQ ID NO: 328920 - DNA, 25 bp, Mus musculus
ggctcgccagggaagtctactgacc

SEQ ID NO: 328921 - DNA, 25 bp, Mus musculus
ggctcgccagggtggctgtctgccc

SEQ ID NO: 328922 - DNA, 25 bp, Mus musculus
ggctcgccgtggggctgcagcagcc

SEQ ID NO: 328923 - DNA, 25 bp, Mus musculus
ggctcgcctgcaaggttcctgctgc

SEQ ID NO: 328924 - DNA, 25 bp, Mus musculus
ggctcgcctgcaagtgtctcacttt

SEQ ID NO: 328925 - DNA, 25 bp, Mus musculus
ggctcgcgctgacgcagtatgagat

SEQ ID NO: 328926 - DNA, 25 bp, Mus musculus
ggctcgcgctgggtgcatgtaccaa

SEQ ID NO: 328927 - DNA, 25 bp, Mus musculus
ggctcgcgctgtatttcagggtgca

SEQ ID NO: 328928 - DNA, 25 bp, Mus musculus
ggctcgcggcgagggtggtcctgga

SEQ ID NO: 328929 - DNA, 25 bp, Mus musculus
ggctcgcggcgaggtaattgaagat

SEQ ID NO: 328930 - DNA, 25 bp, Mus musculus
ggctcgctaagccacactcattctc

SEQ ID NO: 328931 - DNA, 25 bp, Mus musculus
ggctcgctaagccggctgccctttc

SEQ ID NO: 328932 - DNA, 25 bp, Mus musculus
ggctcgctacgaggtgtgggctcac

SEQ ID NO: 328933 - DNA, 25 bp, Mus musculus
ggctcggaaacgaatacctccacgg

SEQ ID NO: 328934 - DNA, 25 bp, Mus musculus
ggctcggaagaaattgataattatc

SEQ ID NO: 328935 - DNA, 25 bp, Mus musculus
ggctcggcaggttcgcttatcttgg

SEQ ID NO: 328936 - DNA, 25 bp, Mus musculus
ggctcggcccagggctcccagtttg

SEQ ID NO: 328937 - DNA, 25 bp, Mus musculus
ggctcggcctggtgtctccaaacaa

SEQ ID NO: 328938 - DNA, 25 bp, Mus musculus
ggctcggcgccctggaagaccagag

SEQ ID NO: 328939 - DNA, 25 bp, Mus musculus
ggctcggcgtcgccggcagctgcag

SEQ ID NO: 328940 - DNA, 25 bp, Mus musculus
ggctcgggaaaagttagctttatac

SEQ ID NO: 328941 - DNA, 25 bp, Mus musculus
ggctcgggacggagatgaaaccaga

SEQ ID NO: 328942 - DNA, 25 bp, Mus musculus
ggctcgggacggttcagtgtatctt

SEQ ID NO: 328943 - DNA, 25 bp, Mus musculus
ggctcgggcagctgtgtgcctgctt

SEQ ID NO: 328944 - DNA, 25 bp, Mus musculus
ggctcgggcatggaaactatcaata

SEQ ID NO: 328945 - DNA, 25 bp, Mus musculus
ggctcgggctgcagatttattgcca

SEQ ID NO: 328946 - DNA, 25 bp, Mus musculus
ggctcggggcggtaggaaatcagtc

SEQ ID NO: 328947 - DNA, 25 bp, Mus musculus
ggctcggtacaggttgtaagttcta

SEQ ID NO: 328948 - DNA, 25 bp, Mus musculus
ggctcggtgtgtcccttagaagatt

SEQ ID NO: 328949 - DNA, 25 bp, Mus musculus
ggctcggtgtgtgctgcttttgata

SEQ ID NO: 328950 - DNA, 25 bp, Mus musculus
ggctcgtcaggcacagaaggagctg

SEQ ID NO: 328951 - DNA, 25 bp, Mus musculus
ggctcgtgaaactagaaatgatgga

SEQ ID NO: 328952 - DNA, 25 bp, Mus musculus
ggctcgtgaaagattcaactggcat

SEQ ID NO: 328953 - DNA, 25 bp, Mus musculus
ggctcgtgaaagtgcattgttggtg

SEQ ID NO: 328954 - DNA, 25 bp, Mus musculus
ggctcgtgcaagcgtgccaagtatc

SEQ ID NO: 328955 - DNA, 25 bp, Mus musculus
ggctctaaagaaggatgtggactgt

SEQ ID NO: 328956 - DNA, 25 bp, Mus musculus
ggctctaaatgggatatccttctcg

SEQ ID NO: 328957 - DNA, 25 bp, Mus musculus
ggctctaacctgcctgtgatggtat

SEQ ID NO: 328958 - DNA, 25 bp, Mus musculus
ggctctacaggttttggctcacctg

SEQ ID NO: 328959 - DNA, 25 bp, Mus musculus
ggctctacattcccaaggtgatggt

SEQ ID NO: 328960 - DNA, 25 bp, Mus musculus
ggctctacgggtgacaccaggtcta

SEQ ID NO: 328961 - DNA, 25 bp, Mus musculus
ggctctactgccagactactggact

SEQ ID NO: 328962 - DNA, 25 bp, Mus musculus
ggctctactgccagtgtctgttgta

SEQ ID NO: 328963 - DNA, 25 bp, Mus musculus
ggctctacttctgttcgttaaaaag

SEQ ID NO: 328964 - DNA, 25 bp, Mus musculus
ggctctagagaaggagctagaagcg

SEQ ID NO: 328965 - DNA, 25 bp, Mus musculus
ggctctataaacaggcggcagcagc

SEQ ID NO: 328966 - DNA, 25 bp, Mus musculus
ggctctataaacaggtcttagagcc

SEQ ID NO: 328967 - DNA, 25 bp, Mus musculus
ggctctatcacaggccaaaacaact

SEQ ID NO: 328968 - DNA, 25 bp, Mus musculus
ggctctatgaaaaactgatgagccc

SEQ ID NO: 328969 - DNA, 25 bp, Mus musculus
ggctctatgaaaagtctgtcagttt

SEQ ID NO: 328970 - DNA, 25 bp, Mus musculus
ggctctattacccaggggaccccag

SEQ ID NO: 328971 - DNA, 25 bp, Mus musculus
ggctctcaaaacagatctgtctgat

SEQ ID NO: 328972 - DNA, 25 bp, Mus musculus
ggctctcaaaatgagccccggcagc

SEQ ID NO: 328973 - DNA, 25 bp, Mus musculus
ggctctcaaactcctgccctgcata

SEQ ID NO: 328974 - DNA, 25 bp, Mus musculus
ggctctcaagcagaaaaatggctac

SEQ ID NO: 328975 - DNA, 25 bp, Mus musculus
ggctctcaaggaggccaaagcaaaa

SEQ ID NO: 328976 - DNA, 25 bp, Mus musculus
ggctctcactgaccctctcccctta

SEQ ID NO: 328977 - DNA, 25 bp, Mus musculus
ggctctcacttccagaggaactcaa

SEQ ID NO: 328978 - DNA, 25 bp, Mus musculus
ggctctcagcagatgatcctctagg

SEQ ID NO: 328979 - DNA, 25 bp, Mus musculus
ggctctcagcagatggtacctggac

SEQ ID NO: 328980 - DNA, 25 bp, Mus musculus
ggctctcattgaggcttatgtaaac

SEQ ID NO: 328981 - DNA, 25 bp, Mus musculus
ggctctccaaaagtaaagcaccgtg

SEQ ID NO: 328982 - DNA, 25 bp, Mus musculus
ggctctccaggcagtgcttttacat

SEQ ID NO: 328983 - DNA, 25 bp, Mus musculus
ggctctccaggggaaaataagtcac

SEQ ID NO: 328984 - DNA, 25 bp, Mus musculus
ggctctccaggtagcctttccagta

SEQ ID NO: 328985 - DNA, 25 bp, Mus musculus
ggctctccaggtttgtgtaagtcag

SEQ ID NO: 328986 - DNA, 25 bp, Mus musculus
ggctctccggcaccggactttttcc

SEQ ID NO: 328987 - DNA, 25 bp, Mus musculus
ggctctccggcaccgggccatggcg

SEQ ID NO: 328988 - DNA, 25 bp, Mus musculus
ggctctccgggtgtaaagatctttc

SEQ ID NO: 328989 - DNA, 25 bp, Mus musculus
ggctctcctacactgggctcctcca

SEQ ID NO: 328990 - DNA, 25 bp, Mus musculus
ggctctcctacactggtgacaagac

SEQ ID NO: 328991 - DNA, 25 bp, Mus musculus
ggctctcctgccttcctttctttga

SEQ ID NO: 328992 - DNA, 25 bp, Mus musculus
ggctctccttcagtaaattcaagat

SEQ ID NO: 328993 - DNA, 25 bp, Mus musculus
ggctctcctttcaagaattacaggc

SEQ ID NO: 328994 - DNA, 25 bp, Mus musculus
ggctctcgagagaagcgagagaagc

SEQ ID NO: 328995 - DNA, 25 bp, Mus musculus
ggctctctcggcagagtcattcccg

SEQ ID NO: 328996 - DNA, 25 bp, Mus musculus
ggctctctcggcaggcctggctgag

SEQ ID NO: 328997 - DNA, 25 bp, Mus musculus
ggctctctgaccgggactttgaata

SEQ ID NO: 328998 - DNA, 25 bp, Mus musculus
ggctctctgaggtggaggctctcct

SEQ ID NO: 328999 - DNA, 25 bp, Mus musculus
ggctctctggtggttcatccctgag

SEQ ID NO: 329000 - DNA, 25 bp, Mus musculus
ggctctgaagaaggatgtggactgt

SEQ ID NO: 329001 - DNA, 25 bp, Mus musculus
ggctctgaagattgccctctatgag

SEQ ID NO: 329002 - DNA, 25 bp, Mus musculus
ggctctgaagggtacaccatgaggc

SEQ ID NO: 329003 - DNA, 25 bp, Mus musculus
ggctctgaagggtggaataagcagc

SEQ ID NO: 329004 - DNA, 25 bp, Mus musculus
ggctctgacctgggacccctcatgg

SEQ ID NO: 329005 - DNA, 25 bp, Mus musculus
ggctctgactgttctctctcttgcc

SEQ ID NO: 329006 - DNA, 25 bp, Mus musculus
ggctctgagaacaggaagcccagcc

SEQ ID NO: 329007 - DNA, 25 bp, Mus musculus
ggctctgagaggcccctgcccggat

SEQ ID NO: 329008 - DNA, 25 bp, Mus musculus
ggctctgagataggtgtcttccacc

SEQ ID NO: 329009 - DNA, 25 bp, Mus musculus
ggctctgaggcaggtacccacccgg

SEQ ID NO: 329010 - DNA, 25 bp, Mus musculus
ggctctgaggtaggtgtcttccacc

SEQ ID NO: 329011 - DNA, 25 bp, Mus musculus
ggctctgattaaaggtggagcagcc

SEQ ID NO: 329012 - DNA, 25 bp, Mus musculus
ggctctgattaaagtaacgacattc

SEQ ID NO: 329013 - DNA, 25 bp, Mus musculus
ggctctgattggaggtcggtgagct

SEQ ID NO: 329014 - DNA, 25 bp, Mus musculus
ggctctgcagactgcacagaagatg

SEQ ID NO: 329015 - DNA, 25 bp, Mus musculus
ggctctgcagattctcattgccaag

SEQ ID NO: 329016 - DNA, 25 bp, Mus musculus
ggctctgcagcatctcagctgcctt

SEQ ID NO: 329017 - DNA, 25 bp, Mus musculus
ggctctgcagcctgaagaacagaga

SEQ ID NO: 329018 - DNA, 25 bp, Mus musculus
ggctctgcaggaagcctgctgacag

SEQ ID NO: 329019 - DNA, 25 bp, Mus musculus
ggctctgcaggtagccagaaatgga

SEQ ID NO: 329020 - DNA, 25 bp, Mus musculus
ggctctgcgggccagaatcaccgcc

SEQ ID NO: 329021 - DNA, 25 bp, Mus musculus
ggctctgcggggcgcctctgaagcg

SEQ ID NO: 329022 - DNA, 25 bp, Mus musculus
ggctctgctatcaaggtgcagagcc

SEQ ID NO: 329023 - DNA, 25 bp, Mus musculus
ggctctgctcaggatcccagccagc

SEQ ID NO: 329024 - DNA, 25 bp, Mus musculus
ggctctggagaaagagtttgagagg

SEQ ID NO: 329025 - DNA, 25 bp, Mus musculus
ggctctggagatggcaggttcagcg

SEQ ID NO: 329026 - DNA, 25 bp, Mus musculus
ggctctggaggtacccactgatggc

SEQ ID NO: 329027 - DNA, 25 bp, Mus musculus
ggctctggatctggtgaagcaggaa

SEQ ID NO: 329028 - DNA, 25 bp, Mus musculus
ggctctggcaaggactcacacacga

SEQ ID NO: 329029 - DNA, 25 bp, Mus musculus
ggctctggcaaggtaccctggctaa

SEQ ID NO: 329030 - DNA, 25 bp, Mus musculus
ggctctggcacagccggagagaagc

SEQ ID NO: 329031 - DNA, 25 bp, Mus musculus
ggctctggcacaggtgctttgccag

SEQ ID NO: 329032 - DNA, 25 bp, Mus musculus
ggctctggccaggttccgggagacc

SEQ ID NO: 329033 - DNA, 25 bp, Mus musculus
ggctctggctgcagggaattgatgt

SEQ ID NO: 329034 - DNA, 25 bp, Mus musculus
ggctctgggtgagaggctgcccctg

SEQ ID NO: 329035 - DNA, 25 bp, Mus musculus
ggctctggtcgtggacgcagacgat

SEQ ID NO: 329036 - DNA, 25 bp, Mus musculus
ggctctgtagcaggtctagtgacag

SEQ ID NO: 329037 - DNA, 25 bp, Mus musculus
ggctctgtaggttgtgaaccatggc

SEQ ID NO: 329038 - DNA, 25 bp, Mus musculus
ggctctgtccagaaggacaaggtgg

SEQ ID NO: 329039 - DNA, 25 bp, Mus musculus
ggctctgtctagagctgaggacctg

SEQ ID NO: 329040 - DNA, 25 bp, Mus musculus
ggctctgtctaggtatcttttggat

SEQ ID NO: 329041 - DNA, 25 bp, Mus musculus
ggctctgtgaagccgaggaagtgga

SEQ ID NO: 329042 - DNA, 25 bp, Mus musculus
ggctctgtgacctcctcctctactg

SEQ ID NO: 329043 - DNA, 25 bp, Mus musculus
ggctctgtgctcctggcacacactt

SEQ ID NO: 329044 - DNA, 25 bp, Mus musculus
ggctctgtgtgcgggagaaaccact

SEQ ID NO: 329045 - DNA, 25 bp, Mus musculus
ggctctgtgtgcggggatctgaagt

SEQ ID NO: 329046 - DNA, 25 bp, Mus musculus
ggctctgttgctaacggacatggcg

SEQ ID NO: 329047 - DNA, 25 bp, Mus musculus
ggctcttaagatcttctgtgtgcat

SEQ ID NO: 329048 - DNA, 25 bp, Mus musculus
ggctcttaggtaagaagacaagatg

SEQ ID NO: 329049 - DNA, 25 bp, Mus musculus
ggctcttatcaggtatggggcagat

SEQ ID NO: 329050 - DNA, 25 bp, Mus musculus
ggctcttcaagtacggggtacagct

SEQ ID NO: 329051 - DNA, 25 bp, Mus musculus
ggctcttcagacaggcccagtgctc

SEQ ID NO: 329052 - DNA, 25 bp, Mus musculus
ggctcttcaggtctacatgtgggtt

SEQ ID NO: 329053 - DNA, 25 bp, Mus musculus
ggctcttcaggtgctccaatgagaa

SEQ ID NO: 329054 - DNA, 25 bp, Mus musculus
ggctcttcatccagcagatccgaat

SEQ ID NO: 329055 - DNA, 25 bp, Mus musculus
ggctcttcatccagcattccatgat

SEQ ID NO: 329056 - DNA, 25 bp, Mus musculus
ggctcttccacaggtctgttggtgc

SEQ ID NO: 329057 - DNA, 25 bp, Mus musculus
ggctcttctaaagacctcaaaggaa

SEQ ID NO: 329058 - DNA, 25 bp, Mus musculus
ggctcttgagccagcccatacccag

SEQ ID NO: 329059 - DNA, 25 bp, Mus musculus
ggctcttggcgcgatgaggaaactg

SEQ ID NO: 329060 - DNA, 25 bp, Mus musculus
ggctcttgggtgacaattggtgcga

SEQ ID NO: 329061 - DNA, 25 bp, Mus musculus
ggctcttgtctggggcttcaatggg

SEQ ID NO: 329062 - DNA, 25 bp, Mus musculus
ggctctttgggtatgtgcagcacta

SEQ ID NO: 329063 - DNA, 25 bp, Mus musculus
ggctcttttccaggtggttttcctg

SEQ ID NO: 329064 - DNA, 25 bp, Mus musculus
ggctgaaaaagagctgcatgagaaa

SEQ ID NO: 329065 - DNA, 25 bp, Mus musculus
ggctgaaaaagcaatacgaggattc

SEQ ID NO: 329066 - DNA, 25 bp, Mus musculus
ggctgaaaacaaacgatacaaggag

SEQ ID NO: 329067 - DNA, 25 bp, Mus musculus
ggctgaaaacaaacggtcctgctgt

SEQ ID NO: 329068 - DNA, 25 bp, Mus musculus
ggctgaaaagacactacaagaagcg

SEQ ID NO: 329069 - DNA, 25 bp, Mus musculus
ggctgaaaggagatgagtccccggc

SEQ ID NO: 329070 - DNA, 25 bp, Mus musculus
ggctgaaagtttggcttttcatggc

SEQ ID NO: 329071 - DNA, 25 bp, Mus musculus
ggctgaaatactaggttgcaggaat

SEQ ID NO: 329072 - DNA, 25 bp, Mus musculus
ggctgaacaaaccttatatctacgg

SEQ ID NO: 329073 - DNA, 25 bp, Mus musculus
ggctgaacaagttggtgacacatcc

SEQ ID NO: 329074 - DNA, 25 bp, Mus musculus
ggctgaacagacttggctttcttgc

SEQ ID NO: 329075 - DNA, 25 bp, Mus musculus
ggctgaacagagaacagagtttccg

SEQ ID NO: 329076 - DNA, 25 bp, Mus musculus
ggctgaacaggaacatagcggcgga

SEQ ID NO: 329077 - DNA, 25 bp, Mus musculus
ggctgaacagtgagcttcactagac

SEQ ID NO: 329078 - DNA, 25 bp, Mus musculus
ggctgaacagtttccgctgccttgc

SEQ ID NO: 329079 - DNA, 25 bp, Mus musculus
ggctgaagacacaggggctccttat

SEQ ID NO: 329080 - DNA, 25 bp, Mus musculus
ggctgaagagaatatccggtctctg

SEQ ID NO: 329081 - DNA, 25 bp, Mus musculus
ggctgaagagatttgaaagtgacct

SEQ ID NO: 329082 - DNA, 25 bp, Mus musculus
ggctgaagagcagacttggaggtaa

SEQ ID NO: 329083 - DNA, 25 bp, Mus musculus
ggctgaagaggaagaagagctggag

SEQ ID NO: 329084 - DNA, 25 bp, Mus musculus
ggctgaagaggtcccaggtaaatca

SEQ ID NO: 329085 - DNA, 25 bp, Mus musculus
ggctgaagagtgatgacattacttg

SEQ ID NO: 329086 - DNA, 25 bp, Mus musculus
ggctgaagcaggaatagcctgcaca

SEQ ID NO: 329087 - DNA, 25 bp, Mus musculus
ggctgaagcaggaatggacagacca

SEQ ID NO: 329088 - DNA, 25 bp, Mus musculus
ggctgaagcaggctattgaagagga

SEQ ID NO: 329089 - DNA, 25 bp, Mus musculus
ggctgaagcaggtaaaaaacaagaa

SEQ ID NO: 329090 - DNA, 25 bp, Mus musculus
ggctgaagccagcatcgagatcaac

SEQ ID NO: 329091 - DNA, 25 bp, Mus musculus
ggctgaagccaggagccaaaccaga

SEQ ID NO: 329092 - DNA, 25 bp, Mus musculus
ggctgaagcgggatctgttctctca

SEQ ID NO: 329093 - DNA, 25 bp, Mus musculus
ggctgaagctaagccccaagcattc

SEQ ID NO: 329094 - DNA, 25 bp, Mus musculus
ggctgaagctcggaaacaagctccc

SEQ ID NO: 329095 - DNA, 25 bp, Mus musculus
ggctgaaggagaacttgagagagat

SEQ ID NO: 329096 - DNA, 25 bp, Mus musculus
ggctgaaggaggtctctctgctcct

SEQ ID NO: 329097 - DNA, 25 bp, Mus musculus
ggctgaagggagagttcgtgtcgat

SEQ ID NO: 329098 - DNA, 25 bp, Mus musculus
ggctgaagtcatgaactccaatgtg

SEQ ID NO: 329099 - DNA, 25 bp, Mus musculus
ggctgaagtgaggggggtccagcga

SEQ ID NO: 329100 - DNA, 25 bp, Mus musculus
ggctgaagtgagtgggcccagccac

SEQ ID NO: 329101 - DNA, 25 bp, Mus musculus
ggctgaatagcctgagaaatgccag

SEQ ID NO: 329102 - DNA, 25 bp, Mus musculus
ggctgaatcagctcaaatctaataa

SEQ ID NO: 329103 - DNA, 25 bp, Mus musculus
ggctgaattctgagggactaactac

SEQ ID NO: 329104 - DNA, 25 bp, Mus musculus
ggctgacaaagagcttccactttcc

SEQ ID NO: 329105 - DNA, 25 bp, Mus musculus
ggctgacaaagggcactggttcaat

SEQ ID NO: 329106 - DNA, 25 bp, Mus musculus
ggctgacaaatgacacccagtcttc

SEQ ID NO: 329107 - DNA, 25 bp, Mus musculus
ggctgacaagatgcaggtactacgg

SEQ ID NO: 329108 - DNA, 25 bp, Mus musculus
ggctgacaagcctatcctctactcc

SEQ ID NO: 329109 - DNA, 25 bp, Mus musculus
ggctgacaaggaaagctggtgaagc

SEQ ID NO: 329110 - DNA, 25 bp, Mus musculus
ggctgacaaggaaagctgtctgcaa

SEQ ID NO: 329111 - DNA, 25 bp, Mus musculus
ggctgacaaggaagcggcctttgac

SEQ ID NO: 329112 - DNA, 25 bp, Mus musculus
ggctgacaaggaaggcctgaaggga

SEQ ID NO: 329113 - DNA, 25 bp, Mus musculus
ggctgacaaggaatttcggcagaaa

SEQ ID NO: 329114 - DNA, 25 bp, Mus musculus
ggctgacaaggacacctgctttgaa

SEQ ID NO: 329115 - DNA, 25 bp, Mus musculus
ggctgacaaggcacccacatctttt

SEQ ID NO: 329116 - DNA, 25 bp, Mus musculus
ggctgacaaggcccttttagctacc

SEQ ID NO: 329117 - DNA, 25 bp, Mus musculus
ggctgacaaggctacagcggagcaa

SEQ ID NO: 329118 - DNA, 25 bp, Mus musculus
ggctgacaagtggagaaatgattag

SEQ ID NO: 329119 - DNA, 25 bp, Mus musculus
ggctgacaagtggagtcattttata

SEQ ID NO: 329120 - DNA, 25 bp, Mus musculus
ggctgacacaggaggacctccacca

SEQ ID NO: 329121 - DNA, 25 bp, Mus musculus
ggctgacacgcttccaggtccgagg

SEQ ID NO: 329122 - DNA, 25 bp, Mus musculus
ggctgacacggtccgaggagacata

SEQ ID NO: 329123 - DNA, 25 bp, Mus musculus
ggctgacactagctgcagccgactc

SEQ ID NO: 329124 - DNA, 25 bp, Mus musculus
ggctgacagagaaacgtctgtctgc

SEQ ID NO: 329125 - DNA, 25 bp, Mus musculus
ggctgacatgtgcctgagcggagcg

SEQ ID NO: 329126 - DNA, 25 bp, Mus musculus
ggctgacatgtggagcattggcgtc

SEQ ID NO: 329127 - DNA, 25 bp, Mus musculus
ggctgacattacaggaccaggtgga

SEQ ID NO: 329128 - DNA, 25 bp, Mus musculus
ggctgaccagcatattttcaatgct

SEQ ID NO: 329129 - DNA, 25 bp, Mus musculus
ggctgaccaggatattttcaatgct

SEQ ID NO: 329130 - DNA, 25 bp, Mus musculus
ggctgaccggggcaggaagtggtcc

SEQ ID NO: 329131 - DNA, 25 bp, Mus musculus
ggctgacctgcaaatctggttcttg

SEQ ID NO: 329132 - DNA, 25 bp, Mus musculus
ggctgacctggccctctgtcctgga

SEQ ID NO: 329133 - DNA, 25 bp, Mus musculus
ggctgacctgttgaacactctgaac

SEQ ID NO: 329134 - DNA, 25 bp, Mus musculus
ggctgaccttcatgcaaggctgggc

SEQ ID NO: 329135 - DNA, 25 bp, Mus musculus
ggctgaccttgctggactcgccagt

SEQ ID NO: 329136 - DNA, 25 bp, Mus musculus
ggctgacgctcagagagggggaggc

SEQ ID NO: 329137 - DNA, 25 bp, Mus musculus
ggctgacgctcagaggttttctctt

SEQ ID NO: 329138 - DNA, 25 bp, Mus musculus
ggctgacggagggtgaggagttcta

SEQ ID NO: 329139 - DNA, 25 bp, Mus musculus
ggctgacggaggtgtcccctgaact

SEQ ID NO: 329140 - DNA, 25 bp, Mus musculus
ggctgactctcacaggggagaagcg

SEQ ID NO: 329141 - DNA, 25 bp, Mus musculus
ggctgactgcagatctgatttgtac

SEQ ID NO: 329142 - DNA, 25 bp, Mus musculus
ggctgactgctgtacacttcctgaa

SEQ ID NO: 329143 - DNA, 25 bp, Mus musculus
ggctgactgggtttaccagcccctg

SEQ ID NO: 329144 - DNA, 25 bp, Mus musculus
ggctgacttgatagcatagaaaatt

SEQ ID NO: 329145 - DNA, 25 bp, Mus musculus
ggctgagaaacagcacacagggcca

SEQ ID NO: 329146 - DNA, 25 bp, Mus musculus
ggctgagaaagacaggttgcagctg

SEQ ID NO: 329147 - DNA, 25 bp, Mus musculus
ggctgagaaccgggaccgcgtggcg

SEQ ID NO: 329148 - DNA, 25 bp, Mus musculus
ggctgagaacggaaacctccacatg

SEQ ID NO: 329149 - DNA, 25 bp, Mus musculus
ggctgagaagcggaggctgctgaac

SEQ ID NO: 329150 - DNA, 25 bp, Mus musculus
ggctgagaaggtgaggtggccttga

SEQ ID NO: 329151 - DNA, 25 bp, Mus musculus
ggctgagaagtactctcagaaggaa

SEQ ID NO: 329152 - DNA, 25 bp, Mus musculus
ggctgagaatccagaaatggcctcc

SEQ ID NO: 329153 - DNA, 25 bp, Mus musculus
ggctgagacaggcacataagacttt

SEQ ID NO: 329154 - DNA, 25 bp, Mus musculus
ggctgagagctggctcccttcccca

SEQ ID NO: 329155 - DNA, 25 bp, Mus musculus
ggctgagcaccagggcttccagctg

SEQ ID NO: 329156 - DNA, 25 bp, Mus musculus
ggctgagcagaagggccttcttgaa

SEQ ID NO: 329157 - DNA, 25 bp, Mus musculus
ggctgagcagcaaaggtgaatgaag

SEQ ID NO: 329158 - DNA, 25 bp, Mus musculus
ggctgagcagcacgcctccggtcta

SEQ ID NO: 329159 - DNA, 25 bp, Mus musculus
ggctgagcagcaggctgacgaggtc

SEQ ID NO: 329160 - DNA, 25 bp, Mus musculus
ggctgagcagcaggtgaaccagctg

SEQ ID NO: 329161 - DNA, 25 bp, Mus musculus
ggctgagccgagagaagagccctgg

SEQ ID NO: 329162 - DNA, 25 bp, Mus musculus
ggctgagcttgcaggcatctagtct

SEQ ID NO: 329163 - DNA, 25 bp, Mus musculus
ggctgaggacctcctttcttatttg

SEQ ID NO: 329164 - DNA, 25 bp, Mus musculus
ggctgaggacctcggatgggtcccc

SEQ ID NO: 329165 - DNA, 25 bp, Mus musculus
ggctgaggagaagcaaaccaagagt

SEQ ID NO: 329166 - DNA, 25 bp, Mus musculus
ggctgaggagagggaactagttccc

SEQ ID NO: 329167 - DNA, 25 bp, Mus musculus
ggctgaggagcatgaacggtgcctt

SEQ ID NO: 329168 - DNA, 25 bp, Mus musculus
ggctgaggaggcagctgacctagat

SEQ ID NO: 329169 - DNA, 25 bp, Mus musculus
ggctgaggaggccaccatggcagaa

SEQ ID NO: 329170 - DNA, 25 bp, Mus musculus
ggctgaggagggaggagcaggccaa

SEQ ID NO: 329171 - DNA, 25 bp, Mus musculus
ggctgaggattttccatctttaaat

SEQ ID NO: 329172 - DNA, 25 bp, Mus musculus
ggctgaggccaggtctcttaacctt

SEQ ID NO: 329173 - DNA, 25 bp, Mus musculus
ggctgaggccgggaccggagctgat

SEQ ID NO: 329174 - DNA, 25 bp, Mus musculus
ggctgaggcgaaagagagccgggtc

SEQ ID NO: 329175 - DNA, 25 bp, Mus musculus
ggctgaggctcaggagaccaccatc

SEQ ID NO: 329176 - DNA, 25 bp, Mus musculus
ggctgaggctcagtggagaccagag

SEQ ID NO: 329177 - DNA, 25 bp, Mus musculus
ggctgagggaccagacaaaaagtcc

SEQ ID NO: 329178 - DNA, 25 bp, Mus musculus
ggctgagggctctagcttggacagc

SEQ ID NO: 329179 - DNA, 25 bp, Mus musculus
ggctgagggctctagtgtcactgct

SEQ ID NO: 329180 - DNA, 25 bp, Mus musculus
ggctgagtaccacgcggacatctat

SEQ ID NO: 329181 - DNA, 25 bp, Mus musculus
ggctgagtaccacgcgggggaaggg

SEQ ID NO: 329182 - DNA, 25 bp, Mus musculus
ggctgagtatagacaactgtcatca

SEQ ID NO: 329183 - DNA, 25 bp, Mus musculus
ggctgagtataggaaggggccagat

SEQ ID NO: 329184 - DNA, 25 bp, Mus musculus
ggctgagttccagagcccccttcac

SEQ ID NO: 329185 - DNA, 25 bp, Mus musculus
ggctgatagcgatcattgctgtctt

SEQ ID NO: 329186 - DNA, 25 bp, Mus musculus
ggctgatagcggggatcccagcatt

SEQ ID NO: 329187 - DNA, 25 bp, Mus musculus
ggctgatcaaaggaaaggactcagc

SEQ ID NO: 329188 - DNA, 25 bp, Mus musculus
ggctgatctgcatccccaaaagcat

SEQ ID NO: 329189 - DNA, 25 bp, Mus musculus
ggctgatgaaatgggtctaggaaag

SEQ ID NO: 329190 - DNA, 25 bp, Mus musculus
ggctgatgaagccatcaaaggattt

SEQ ID NO: 329191 - DNA, 25 bp, Mus musculus
ggctgatgaaggacaaccctccata

SEQ ID NO: 329192 - DNA, 25 bp, Mus musculus
ggctgatgaaggagcttgaagagat

SEQ ID NO: 329193 - DNA, 25 bp, Mus musculus
ggctgatgacccagtcttatctcct

SEQ ID NO: 329194 - DNA, 25 bp, Mus musculus
ggctgatgaggtataccaagacaat

SEQ ID NO: 329195 - DNA, 25 bp, Mus musculus
ggctgatggaattgaacttttgagc

SEQ ID NO: 329196 - DNA, 25 bp, Mus musculus
ggctgatggagtatggtgatgaagc

SEQ ID NO: 329197 - DNA, 25 bp, Mus musculus
ggctgatggagtgatgggagccagg

SEQ ID NO: 329198 - DNA, 25 bp, Mus musculus
ggctgatggcagcctctccaggcag

SEQ ID NO: 329199 - DNA, 25 bp, Mus musculus
ggctgatggcatgtgtccaaatgat

SEQ ID NO: 329200 - DNA, 25 bp, Mus musculus
ggctgatggcttccctaggattctt

SEQ ID NO: 329201 - DNA, 25 bp, Mus musculus
ggctgattccagttacttcctgcct

SEQ ID NO: 329202 - DNA, 25 bp, Mus musculus
ggctgattcgagcgacttcggagca

SEQ ID NO: 329203 - DNA, 25 bp, Mus musculus
ggctgattcgagcggggttccttgt

SEQ ID NO: 329204 - DNA, 25 bp, Mus musculus
ggctgattgtagacaccggtaccaa

SEQ ID NO: 329205 - DNA, 25 bp, Mus musculus
ggctgattttcccgaatactcctca

SEQ ID NO: 329206 - DNA, 25 bp, Mus musculus
ggctgcaaaaacaaagctcctgggc

SEQ ID NO: 329207 - DNA, 25 bp, Mus musculus
ggctgcaaaaacttgagaattacat

SEQ ID NO: 329208 - DNA, 25 bp, Mus musculus
ggctgcaaaaaggtcctggtctctc

SEQ ID NO: 329209 - DNA, 25 bp, Mus musculus
ggctgcaaaggccactttgccaagg

SEQ ID NO: 329210 - DNA, 25 bp, Mus musculus
ggctgcaaatgacacaacacggaaa

SEQ ID NO: 329211 - DNA, 25 bp, Mus musculus
ggctgcaaatggtaacgatcggaac

SEQ ID NO: 329212 - DNA, 25 bp, Mus musculus
ggctgcaaccatgagaccagcacca

SEQ ID NO: 329213 - DNA, 25 bp, Mus musculus
ggctgcaaccatgatcaagcacttc

SEQ ID NO: 329214 - DNA, 25 bp, Mus musculus
ggctgcaaccatggatgacaaggag

SEQ ID NO: 329215 - DNA, 25 bp, Mus musculus
ggctgcaactttaagatggagccag

SEQ ID NO: 329216 - DNA, 25 bp, Mus musculus
ggctgcaagaaaccttgtcactaga

SEQ ID NO: 329217 - DNA, 25 bp, Mus musculus
ggctgcaagcggattgggtttcctt

SEQ ID NO: 329218 - DNA, 25 bp, Mus musculus
ggctgcaagtgggtctccaacaagt

SEQ ID NO: 329219 - DNA, 25 bp, Mus musculus
ggctgcaatcatcaggagcaaagag

SEQ ID NO: 329220 - DNA, 25 bp, Mus musculus
ggctgcaatgaggtcaactccgtca

SEQ ID NO: 329221 - DNA, 25 bp, Mus musculus
ggctgcacaaacgagctccttatgt

SEQ ID NO: 329222 - DNA, 25 bp, Mus musculus
ggctgcacaaacgaggggaatatat

SEQ ID NO: 329223 - DNA, 25 bp, Mus musculus
ggctgcacagaaagactaccaccat

SEQ ID NO: 329224 - DNA, 25 bp, Mus musculus
ggctgcacagaaagccaggggctgg

SEQ ID NO: 329225 - DNA, 25 bp, Mus musculus
ggctgcacagaaagggagagtcctg

SEQ ID NO: 329226 - DNA, 25 bp, Mus musculus
ggctgcacagcccatctctgagcga

SEQ ID NO: 329227 - DNA, 25 bp, Mus musculus
ggctgcacaggagcaacacgtcggg

SEQ ID NO: 329228 - DNA, 25 bp, Mus musculus
ggctgcacagtgacatgaaattgta

SEQ ID NO: 329229 - DNA, 25 bp, Mus musculus
ggctgcacagtgtatgagaagcagc

SEQ ID NO: 329230 - DNA, 25 bp, Mus musculus
ggctgcacctatatcctgaataaaa

SEQ ID NO: 329231 - DNA, 25 bp, Mus musculus
ggctgcactcagaaccattgttgga

SEQ ID NO: 329232 - DNA, 25 bp, Mus musculus
ggctgcactcagctgccaactccag

SEQ ID NO: 329233 - DNA, 25 bp, Mus musculus
ggctgcagaagcgtctcctgtaacg

SEQ ID NO: 329234 - DNA, 25 bp, Mus musculus
ggctgcagaaggactggcccagcct

SEQ ID NO: 329235 - DNA, 25 bp, Mus musculus
ggctgcagacttgacatcgtcttta

SEQ ID NO: 329236 - DNA, 25 bp, Mus musculus
ggctgcagagcgggaggagactcgg

SEQ ID NO: 329237 - DNA, 25 bp, Mus musculus
ggctgcagagcttcgagcttccatt

SEQ ID NO: 329238 - DNA, 25 bp, Mus musculus
ggctgcagaggattctcattgtcga

SEQ ID NO: 329239 - DNA, 25 bp, Mus musculus
ggctgcagaggtagaccctgacttt

SEQ ID NO: 329240 - DNA, 25 bp, Mus musculus
ggctgcagaggtggaccctgatcag

SEQ ID NO: 329241 - DNA, 25 bp, Mus musculus
ggctgcagagtgtcctttatttctc

SEQ ID NO: 329242 - DNA, 25 bp, Mus musculus
ggctgcagatccgcccctccttctc

SEQ ID NO: 329243 - DNA, 25 bp, Mus musculus
ggctgcagatccggtcctctccggg

SEQ ID NO: 329244 - DNA, 25 bp, Mus musculus
ggctgcagcaggccaccatggcaga

SEQ ID NO: 329245 - DNA, 25 bp, Mus musculus
ggctgcagccgatacgacaaataga

SEQ ID NO: 329246 - DNA, 25 bp, Mus musculus
ggctgcagccggaaggatccctgtg

SEQ ID NO: 329247 - DNA, 25 bp, Mus musculus
ggctgcagcgctagatggaggtgaa

SEQ ID NO: 329248 - DNA, 25 bp, Mus musculus
ggctgcagcgggaagatgtcatgac

SEQ ID NO: 329249 - DNA, 25 bp, Mus musculus
ggctgcagctgcccaggccaagcag

SEQ ID NO: 329250 - DNA, 25 bp, Mus musculus
ggctgcagctggaggtgtggaacac

SEQ ID NO: 329251 - DNA, 25 bp, Mus musculus
ggctgcagcttcctgcctgttcacc

SEQ ID NO: 329252 - DNA, 25 bp, Mus musculus
ggctgcaggatgatgcgattcatgc

SEQ ID NO: 329253 - DNA, 25 bp, Mus musculus
ggctgcaggcatgaggtgttctggc

SEQ ID NO: 329254 - DNA, 25 bp, Mus musculus
ggctgcaggcggcccaagatgtcca

SEQ ID NO: 329255 - DNA, 25 bp, Mus musculus
ggctgcaggcggcttgaagatgagc

SEQ ID NO: 329256 - DNA, 25 bp, Mus musculus
ggctgcagtcgtgaggtaccgaaag

SEQ ID NO: 329257 - DNA, 25 bp, Mus musculus
ggctgcagtggatgagcaacatgtt

SEQ ID NO: 329258 - DNA, 25 bp, Mus musculus
ggctgcagtggatgatgagtctgac

SEQ ID NO: 329259 - DNA, 25 bp, Mus musculus
ggctgcagtgtcctgctgggagttt

SEQ ID NO: 329260 - DNA, 25 bp, Mus musculus
ggctgcagtgtggtggcacaagact

SEQ ID NO: 329261 - DNA, 25 bp, Mus musculus
ggctgcatagatgacgccacacgcg

SEQ ID NO: 329262 - DNA, 25 bp, Mus musculus
ggctgcatccagaggtctggtagca

SEQ ID NO: 329263 - DNA, 25 bp, Mus musculus
ggctgcatgcggaccaggccttgtt

SEQ ID NO: 329264 - DNA, 25 bp, Mus musculus
ggctgcattgcatgcagcgtgcagg

SEQ ID NO: 329265 - DNA, 25 bp, Mus musculus
ggctgcattggaggttaaaattata

SEQ ID NO: 329266 - DNA, 25 bp, Mus musculus
ggctgccaaaacagatgaagaacca

SEQ ID NO: 329267 - DNA, 25 bp, Mus musculus
ggctgccaacagcctatcttcttcc

SEQ ID NO: 329268 - DNA, 25 bp, Mus musculus
ggctgccaacaggaggttctgcagt

SEQ ID NO: 329269 - DNA, 25 bp, Mus musculus
ggctgccaatcaacaatgtgcccag

SEQ ID NO: 329270 - DNA, 25 bp, Mus musculus
ggctgccacacaatcaggacttccc

SEQ ID NO: 329271 - DNA, 25 bp, Mus musculus
ggctgccacgcagactgtatcgtga

SEQ ID NO: 329272 - DNA, 25 bp, Mus musculus
ggctgccagattgtggctctgaact

SEQ ID NO: 329273 - DNA, 25 bp, Mus musculus
ggctgccagcgggcgaactttctga

SEQ ID NO: 329274 - DNA, 25 bp, Mus musculus
ggctgccagtagataaaagatctgc

SEQ ID NO: 329275 - DNA, 25 bp, Mus musculus
ggctgccagtcttcaattagtgggg

SEQ ID NO: 329276 - DNA, 25 bp, Mus musculus
ggctgccatagcaaaaaagcaagaa

SEQ ID NO: 329277 - DNA, 25 bp, Mus musculus
ggctgccataggagtcagtgacttt

SEQ ID NO: 329278 - DNA, 25 bp, Mus musculus
ggctgccatgcctgtgactgcagta

SEQ ID NO: 329279 - DNA, 25 bp, Mus musculus
ggctgccattcaaacacacacagga

SEQ ID NO: 329280 - DNA, 25 bp, Mus musculus
ggctgccattcaaattcatgagata

SEQ ID NO: 329281 - DNA, 25 bp, Mus musculus
ggctgccattcaagaaggagaaaat

SEQ ID NO: 329282 - DNA, 25 bp, Mus musculus
ggctgcccaaagagcatgccaccag

SEQ ID NO: 329283 - DNA, 25 bp, Mus musculus
ggctgcccaaagagccccctcagag

SEQ ID NO: 329284 - DNA, 25 bp, Mus musculus
ggctgcccaaagcctgagacccacc

SEQ ID NO: 329285 - DNA, 25 bp, Mus musculus
ggctgcccaaagggacactacatga

SEQ ID NO: 329286 - DNA, 25 bp, Mus musculus
ggctgcccaaggtgaacttgatctt

SEQ ID NO: 329287 - DNA, 25 bp, Mus musculus
ggctgcccaaggttgttgctaagtt

SEQ ID NO: 329288 - DNA, 25 bp, Mus musculus
ggctgcccagtttgccactgcgctg

SEQ ID NO: 329289 - DNA, 25 bp, Mus musculus
ggctgccccaggatccacctgatgg

SEQ ID NO: 329290 - DNA, 25 bp, Mus musculus
ggctgccccaggttgccactgatgt

SEQ ID NO: 329291 - DNA, 25 bp, Mus musculus
ggctgcccgggcctgactaccagaa

SEQ ID NO: 329292 - DNA, 25 bp, Mus musculus
ggctgccctgagaaacctcgacctt

SEQ ID NO: 329293 - DNA, 25 bp, Mus musculus
ggctgccctgcccattgtgtcctgg

SEQ ID NO: 329294 - DNA, 25 bp, Mus musculus
ggctgcccttgaagggtaagtggag

SEQ ID NO: 329295 - DNA, 25 bp, Mus musculus
ggctgccgaatgaaaaggtgcagca

SEQ ID NO: 329296 - DNA, 25 bp, Mus musculus
ggctgccgactaggatgaaggacgc

SEQ ID NO: 329297 - DNA, 25 bp, Mus musculus
ggctgccgactatcaagaatgaccc

SEQ ID NO: 329298 - DNA, 25 bp, Mus musculus
ggctgccgactatggaaatcctatg

SEQ ID NO: 329299 - DNA, 25 bp, Mus musculus
ggctgccgactgcgaatcgccagga

SEQ ID NO: 329300 - DNA, 25 bp, Mus musculus
ggctgccgactgctgatctcttcgt

SEQ ID NO: 329301 - DNA, 25 bp, Mus musculus
ggctgccgactggacccagctgaag

SEQ ID NO: 329302 - DNA, 25 bp, Mus musculus
ggctgccgactggtcaatatagacc

SEQ ID NO: 329303 - DNA, 25 bp, Mus musculus
ggctgccgactgtgtccatgttgga

SEQ ID NO: 329304 - DNA, 25 bp, Mus musculus
ggctgccgagatgtggacgagtgtg

SEQ ID NO: 329305 - DNA, 25 bp, Mus musculus
ggctgccgagttgtggacgagtgtg

SEQ ID NO: 329306 - DNA, 25 bp, Mus musculus
ggctgccggggtagctcgcggcgtc

SEQ ID NO: 329307 - DNA, 25 bp, Mus musculus
ggctgccgtaagaatttcatcctat

SEQ ID NO: 329308 - DNA, 25 bp, Mus musculus
ggctgccgtgacgcatgatctttct

SEQ ID NO: 329309 - DNA, 25 bp, Mus musculus
ggctgccgtgacggttgcaggccga

SEQ ID NO: 329310 - DNA, 25 bp, Mus musculus
ggctgcctaggttctggtattggat

SEQ ID NO: 329311 - DNA, 25 bp, Mus musculus
ggctgcctcaggtcgcatagggcat

SEQ ID NO: 329312 - DNA, 25 bp, Mus musculus
ggctgcctcgaatcttaggtgcccg

SEQ ID NO: 329313 - DNA, 25 bp, Mus musculus
ggctgcctctaagatctcaggatgg

SEQ ID NO: 329314 - DNA, 25 bp, Mus musculus
ggctgcctctcaaatgaacctctag

SEQ ID NO: 329315 - DNA, 25 bp, Mus musculus
ggctgcctggctcacctctgctatt

SEQ ID NO: 329316 - DNA, 25 bp, Mus musculus
ggctgcgaaggaagtactattactg

SEQ ID NO: 329317 - DNA, 25 bp, Mus musculus
ggctgcgaccaggctttggcgttgt

SEQ ID NO: 329318 - DNA, 25 bp, Mus musculus
ggctgcgactccgagcaccactccc

SEQ ID NO: 329319 - DNA, 25 bp, Mus musculus
ggctgcgagcgcagttacccagcat

SEQ ID NO: 329320 - DNA, 25 bp, Mus musculus
ggctgcgagcgctgtagacctggac

SEQ ID NO: 329321 - DNA, 25 bp, Mus musculus
ggctgcgaggggcatgaaggatggc

SEQ ID NO: 329322 - DNA, 25 bp, Mus musculus
ggctgcgattacatcaccctgacct

SEQ ID NO: 329323 - DNA, 25 bp, Mus musculus
ggctgcgcagctgcccctgtcgaac

SEQ ID NO: 329324 - DNA, 25 bp, Mus musculus
ggctgcgcaggaaagtgcccatctt

SEQ ID NO: 329325 - DNA, 25 bp, Mus musculus
ggctgcgccctgggattcatcactc

SEQ ID NO: 329326 - DNA, 25 bp, Mus musculus
ggctgcgcggttggacgagtgacca

SEQ ID NO: 329327 - DNA, 25 bp, Mus musculus
ggctgcgcgtcccagggacccagct

SEQ ID NO: 329328 - DNA, 25 bp, Mus musculus
ggctgcgctgaggctccagccttcc

SEQ ID NO: 329329 - DNA, 25 bp, Mus musculus
ggctgcgctgcgagagaggaagacg

SEQ ID NO: 329330 - DNA, 25 bp, Mus musculus
ggctgcggacctcagcctttatcct

SEQ ID NO: 329331 - DNA, 25 bp, Mus musculus
ggctgcggacctcaggaaccctgat

SEQ ID NO: 329332 - DNA, 25 bp, Mus musculus
ggctgcggcagcaagaacagaagca

SEQ ID NO: 329333 - DNA, 25 bp, Mus musculus
ggctgcggcagcacgtctgactcta

SEQ ID NO: 329334 - DNA, 25 bp, Mus musculus
ggctgcggcagggcatcatgaagca

SEQ ID NO: 329335 - DNA, 25 bp, Mus musculus
ggctgcggctgcccgggcagtgacg

SEQ ID NO: 329336 - DNA, 25 bp, Mus musculus
ggctgcggctggaggttttcccgct

SEQ ID NO: 329337 - DNA, 25 bp, Mus musculus
ggctgcggctggagtgcccacgatg

SEQ ID NO: 329338 - DNA, 25 bp, Mus musculus
ggctgcgggcccggaaatgcactta

SEQ ID NO: 329339 - DNA, 25 bp, Mus musculus
ggctgcgggcccgggactgtgcagc

SEQ ID NO: 329340 - DNA, 25 bp, Mus musculus
ggctgcgggccggcgaaatggcaaa

SEQ ID NO: 329341 - DNA, 25 bp, Mus musculus
ggctgcgtaagtggccctcaaagcg

SEQ ID NO: 329342 - DNA, 25 bp, Mus musculus
ggctgcgtgcagattaccttatgct

SEQ ID NO: 329343 - DNA, 25 bp, Mus musculus
ggctgcgttgagatttggtgactga

SEQ ID NO: 329344 - DNA, 25 bp, Mus musculus
ggctgcgtttgagcctgagcctttg

SEQ ID NO: 329345 - DNA, 25 bp, Mus musculus
ggctgctaaactgcaacacggctaa

SEQ ID NO: 329346 - DNA, 25 bp, Mus musculus
ggctgctaaccgggtctttggggct

SEQ ID NO: 329347 - DNA, 25 bp, Mus musculus
ggctgctagtggagatgccgttcct

SEQ ID NO: 329348 - DNA, 25 bp, Mus musculus
ggctgctagtggagggggttacaac

SEQ ID NO: 329349 - DNA, 25 bp, Mus musculus
ggctgctagtggagtgcactgaggc

SEQ ID NO: 329350 - DNA, 25 bp, Mus musculus
ggctgctatggatggtgctttgcaa

SEQ ID NO: 329351 - DNA, 25 bp, Mus musculus
ggctgctcaacaggacttggatgtt

SEQ ID NO: 329352 - DNA, 25 bp, Mus musculus
ggctgctcaacaggctcacaccact

SEQ ID NO: 329353 - DNA, 25 bp, Mus musculus
ggctgctcaccattggagaccggtt

SEQ ID NO: 329354 - DNA, 25 bp, Mus musculus
ggctgctcagagtatagaaatatca

SEQ ID NO: 329355 - DNA, 25 bp, Mus musculus
ggctgctcagcaaggctgagcgccg

SEQ ID NO: 329356 - DNA, 25 bp, Mus musculus
ggctgctcagcaagggccgcgtgtt

SEQ ID NO: 329357 - DNA, 25 bp, Mus musculus
ggctgctcagctgcactgagctgtc

SEQ ID NO: 329358 - DNA, 25 bp, Mus musculus
ggctgctcaggtccaatcagcataa

SEQ ID NO: 329359 - DNA, 25 bp, Mus musculus
ggctgctcagtgtttcctttcagaa

SEQ ID NO: 329360 - DNA, 25 bp, Mus musculus
ggctgctcatggaaacgtgtgccgt

SEQ ID NO: 329361 - DNA, 25 bp, Mus musculus
ggctgctccaagcagtgcctggctg

SEQ ID NO: 329362 - DNA, 25 bp, Mus musculus
ggctgctccacgcggtagcactcag

SEQ ID NO: 329363 - DNA, 25 bp, Mus musculus
ggctgctccagagcatctaaagaaa

SEQ ID NO: 329364 - DNA, 25 bp, Mus musculus
ggctgctccagagctggagaagcgg

SEQ ID NO: 329365 - DNA, 25 bp, Mus musculus
ggctgctccattgacacaattgttc

SEQ ID NO: 329366 - DNA, 25 bp, Mus musculus
ggctgctccattgacgatggcacga

SEQ ID NO: 329367 - DNA, 25 bp, Mus musculus
ggctgctcccagcatggcggacaag

SEQ ID NO: 329368 - DNA, 25 bp, Mus musculus
ggctgctcccagcgtttcccaacag

SEQ ID NO: 329369 - DNA, 25 bp, Mus musculus
ggctgctcccatgatgttcctgtac

SEQ ID NO: 329370 - DNA, 25 bp, Mus musculus
ggctgctctgagacctcgccatgcc

SEQ ID NO: 329371 - DNA, 25 bp, Mus musculus
ggctgctcttcgggaatcatggccc

SEQ ID NO: 329372 - DNA, 25 bp, Mus musculus
ggctgctgaagaaagaattgatatt

SEQ ID NO: 329373 - DNA, 25 bp, Mus musculus
ggctgctgaagaaattgaagcagct

SEQ ID NO: 329374 - DNA, 25 bp, Mus musculus
ggctgctgaagctggggggtcgtgt

SEQ ID NO: 329375 - DNA, 25 bp, Mus musculus
ggctgctgactccaggaggaatgct

SEQ ID NO: 329376 - DNA, 25 bp, Mus musculus
ggctgctgactccaggtctgttctc

SEQ ID NO: 329377 - DNA, 25 bp, Mus musculus
ggctgctgactcctctgcaggtgtc

SEQ ID NO: 329378 - DNA, 25 bp, Mus musculus
ggctgctgactctgctctccctgtc

SEQ ID NO: 329379 - DNA, 25 bp, Mus musculus
ggctgctgactgtgtcaacaaggct

SEQ ID NO: 329380 - DNA, 25 bp, Mus musculus
ggctgctgagcaggtagataataaa

SEQ ID NO: 329381 - DNA, 25 bp, Mus musculus
ggctgctgagcgctgagattggtgt

SEQ ID NO: 329382 - DNA, 25 bp, Mus musculus
ggctgctgagcgctgattcctgagt

SEQ ID NO: 329383 - DNA, 25 bp, Mus musculus
ggctgctgagtacaggatatgaatc

SEQ ID NO: 329384 - DNA, 25 bp, Mus musculus
ggctgctgagtacaggcgtgggtga

SEQ ID NO: 329385 - DNA, 25 bp, Mus musculus
ggctgctgcacagccctcctaaggg

SEQ ID NO: 329386 - DNA, 25 bp, Mus musculus
ggctgctgcacaggaataaaggaca

SEQ ID NO: 329387 - DNA, 25 bp, Mus musculus
ggctgctgcaggtcctgtgggaatg

SEQ ID NO: 329388 - DNA, 25 bp, Mus musculus
ggctgctgcaggttgctgagaaatg

SEQ ID NO: 329389 - DNA, 25 bp, Mus musculus
ggctgctgcagtgctggggatcaaa

SEQ ID NO: 329390 - DNA, 25 bp, Mus musculus
ggctgctgccactgcccacccccgc

SEQ ID NO: 329391 - DNA, 25 bp, Mus musculus
ggctgctgccaggaagaattcagtt

SEQ ID NO: 329392 - DNA, 25 bp, Mus musculus
ggctgctgcgagtctgttgctgtgg

SEQ ID NO: 329393 - DNA, 25 bp, Mus musculus
ggctgctgctctgtaaagaagaaga

SEQ ID NO: 329394 - DNA, 25 bp, Mus musculus
ggctgctgctgccagataaagatag

SEQ ID NO: 329395 - DNA, 25 bp, Mus musculus
ggctgctgctggccggtataactgc

SEQ ID NO: 329396 - DNA, 25 bp, Mus musculus
ggctgctggaagtgagagggtccaa

SEQ ID NO: 329397 - DNA, 25 bp, Mus musculus
ggctgctggacctaccggcatgttc

SEQ ID NO: 329398 - DNA, 25 bp, Mus musculus
ggctgctggacggagcgggatgacc

SEQ ID NO: 329399 - DNA, 25 bp, Mus musculus
ggctgctggagagagggaaatctac

SEQ ID NO: 329400 - DNA, 25 bp, Mus musculus
ggctgctggaggtctctcctggtga

SEQ ID NO: 329401 - DNA, 25 bp, Mus musculus
ggctgctggatcagaaaaggaagtg

SEQ ID NO: 329402 - DNA, 25 bp, Mus musculus
ggctgctggatcagaccctgaatct

SEQ ID NO: 329403 - DNA, 25 bp, Mus musculus
ggctgctggatcagactaagagcag

SEQ ID NO: 329404 - DNA, 25 bp, Mus musculus
ggctgctggatcagaggtatcctgt

SEQ ID NO: 329405 - DNA, 25 bp, Mus musculus
ggctgctggccagggtttaacgttt

SEQ ID NO: 329406 - DNA, 25 bp, Mus musculus
ggctgctgggaagtccgcccgtgct

SEQ ID NO: 329407 - DNA, 25 bp, Mus musculus
ggctgctggtgagaggaagctttgt

SEQ ID NO: 329408 - DNA, 25 bp, Mus musculus
ggctgctgttaaggaagaagagctg

SEQ ID NO: 329409 - DNA, 25 bp, Mus musculus
ggctgctgtttcctcctaggatgtc

SEQ ID NO: 329410 - DNA, 25 bp, Mus musculus
ggctgcttagttcaaaccggaggat

SEQ ID NO: 329411 - DNA, 25 bp, Mus musculus
ggctgcttataagagagcttcatgg

SEQ ID NO: 329412 - DNA, 25 bp, Mus musculus
ggctgcttataaggtgcacacagga

SEQ ID NO: 329413 - DNA, 25 bp, Mus musculus
ggctgcttcaagaggcttggctttc

SEQ ID NO: 329414 - DNA, 25 bp, Mus musculus
ggctgcttccaggcttttatttgtg

SEQ ID NO: 329415 - DNA, 25 bp, Mus musculus
ggctgcttgctcatcccagcctgct

SEQ ID NO: 329416 - DNA, 25 bp, Mus musculus
ggctgcttgtgtcgggaatgtgttt

SEQ ID NO: 329417 - DNA, 25 bp, Mus musculus
ggctgctttgcggactttgaatgtg

SEQ ID NO: 329418 - DNA, 25 bp, Mus musculus
ggctgctttgcggtactggaattgc

SEQ ID NO: 329419 - DNA, 25 bp, Mus musculus
ggctggaaaggaagaggagccgctg

SEQ ID NO: 329420 - DNA, 25 bp, Mus musculus
ggctggaacggctattcgctgcctg

SEQ ID NO: 329421 - DNA, 25 bp, Mus musculus
ggctggaagagtattctttggtaca

SEQ ID NO: 329422 - DNA, 25 bp, Mus musculus
ggctggaagcagatgttttgggtcc

SEQ ID NO: 329423 - DNA, 25 bp, Mus musculus
ggctggaataaaaattgggatgaat

SEQ ID NO: 329424 - DNA, 25 bp, Mus musculus
ggctggaatgaaaggcattttcccg

SEQ ID NO: 329425 - DNA, 25 bp, Mus musculus
ggctggaatgcagataacaattgaa

SEQ ID NO: 329426 - DNA, 25 bp, Mus musculus
ggctggaatgcagcttgaaggtctt

SEQ ID NO: 329427 - DNA, 25 bp, Mus musculus
ggctggaattccagattcgagtcaa

SEQ ID NO: 329428 - DNA, 25 bp, Mus musculus
ggctggaattccaggcacgtgctct

SEQ ID NO: 329429 - DNA, 25 bp, Mus musculus
ggctggacagatctgctcattttag

SEQ ID NO: 329430 - DNA, 25 bp, Mus musculus
ggctggacagattcagataacaatt

SEQ ID NO: 329431 - DNA, 25 bp, Mus musculus
ggctggacaggatgtgtgaagatct

SEQ ID NO: 329432 - DNA, 25 bp, Mus musculus
ggctggacattctggggaacggatt

SEQ ID NO: 329433 - DNA, 25 bp, Mus musculus
ggctggaccagatgcggtgagcacc

SEQ ID NO: 329434 - DNA, 25 bp, Mus musculus
ggctggaccaggagcagccatgtct

SEQ ID NO: 329435 - DNA, 25 bp, Mus musculus
ggctggacccagaaggattgccaca

SEQ ID NO: 329436 - DNA, 25 bp, Mus musculus
ggctggacccagaaggtttgaggct

SEQ ID NO: 329437 - DNA, 25 bp, Mus musculus
ggctggaccgaagcccaaagcccac

SEQ ID NO: 329438 - DNA, 25 bp, Mus musculus
ggctggacgcacagcctttgcttcc

SEQ ID NO: 329439 - DNA, 25 bp, Mus musculus
ggctggactgcagaggccacttctt

SEQ ID NO: 329440 - DNA, 25 bp, Mus musculus
ggctggagagaaggataaaggggag

SEQ ID NO: 329441 - DNA, 25 bp, Mus musculus
ggctggagagaaggcctgcctgcct

SEQ ID NO: 329442 - DNA, 25 bp, Mus musculus
ggctggagagaagggctattggctt

SEQ ID NO: 329443 - DNA, 25 bp, Mus musculus
ggctggagagaaggtcatttgagac

SEQ ID NO: 329444 - DNA, 25 bp, Mus musculus
ggctggagagctgtgtggctgagca

SEQ ID NO: 329445 - DNA, 25 bp, Mus musculus
ggctggagcggaagggtttgttcgt

SEQ ID NO: 329446 - DNA, 25 bp, Mus musculus
ggctggagctgaggagattattggt

SEQ ID NO: 329447 - DNA, 25 bp, Mus musculus
ggctggaggacaaaggggagacacc

SEQ ID NO: 329448 - DNA, 25 bp, Mus musculus
ggctggaggaggcgggcgtccgaaa

SEQ ID NO: 329449 - DNA, 25 bp, Mus musculus
ggctggaggcctctgagatcgagga

SEQ ID NO: 329450 - DNA, 25 bp, Mus musculus
ggctggaggggatgccaacaaggag

SEQ ID NO: 329451 - DNA, 25 bp, Mus musculus
ggctggaggggtgatggtaatgccc

SEQ ID NO: 329452 - DNA, 25 bp, Mus musculus
ggctggaggttaaagcttctgccac

SEQ ID NO: 329453 - DNA, 25 bp, Mus musculus
ggctggagtcgaatttggaaatact

SEQ ID NO: 329454 - DNA, 25 bp, Mus musculus
ggctggagttggcgcgcaggctacc

SEQ ID NO: 329455 - DNA, 25 bp, Mus musculus
ggctggatacagttaccagtaagat

SEQ ID NO: 329456 - DNA, 25 bp, Mus musculus
ggctggatccggtggacacaccact

SEQ ID NO: 329457 - DNA, 25 bp, Mus musculus
ggctggatccgtaccccaagtacca

SEQ ID NO: 329458 - DNA, 25 bp, Mus musculus
ggctggatccgtattcttgttccta

SEQ ID NO: 329459 - DNA, 25 bp, Mus musculus
ggctggatgaccggttctaatcaga

SEQ ID NO: 329460 - DNA, 25 bp, Mus musculus
ggctggatggcagccatagattgta

SEQ ID NO: 329461 - DNA, 25 bp, Mus musculus
ggctggatgtcagctctctgctgga

SEQ ID NO: 329462 - DNA, 25 bp, Mus musculus
ggctggattcaaggggaagaagcca

SEQ ID NO: 329463 - DNA, 25 bp, Mus musculus
ggctggcaaggtcaaacctgcgagg

SEQ ID NO: 329464 - DNA, 25 bp, Mus musculus
ggctggcacaggagagggaggcctg

SEQ ID NO: 329465 - DNA, 25 bp, Mus musculus
ggctggcacaggaggcctggaggag

SEQ ID NO: 329466 - DNA, 25 bp, Mus musculus
ggctggcagagactcctgaaaggac

SEQ ID NO: 329467 - DNA, 25 bp, Mus musculus
ggctggcagagcctcattaacttcg

SEQ ID NO: 329468 - DNA, 25 bp, Mus musculus
ggctggcaggaaccacacagagccc

SEQ ID NO: 329469 - DNA, 25 bp, Mus musculus
ggctggcaggaaggccatattgaca

SEQ ID NO: 329470 - DNA, 25 bp, Mus musculus
ggctggcaggaaggccatcttgaca

SEQ ID NO: 329471 - DNA, 25 bp, Mus musculus
ggctggcaggtgctcaccgagtctg

SEQ ID NO: 329472 - DNA, 25 bp, Mus musculus
ggctggcatgaaatcctggggcaga

SEQ ID NO: 329473 - DNA, 25 bp, Mus musculus
ggctggccacgtgtggttgaatcta

SEQ ID NO: 329474 - DNA, 25 bp, Mus musculus
ggctggccagcaacacaacaacatt

SEQ ID NO: 329475 - DNA, 25 bp, Mus musculus
ggctggccagtgggttgatttcttc

SEQ ID NO: 329476 - DNA, 25 bp, Mus musculus
ggctggcccaggaggtgtctgagac

SEQ ID NO: 329477 - DNA, 25 bp, Mus musculus
ggctggccctctggtgtgccacaga

SEQ ID NO: 329478 - DNA, 25 bp, Mus musculus
ggctggccgcaggctggcaacatgg

SEQ ID NO: 329479 - DNA, 25 bp, Mus musculus
ggctggccggattggtggaggtagg

SEQ ID NO: 329480 - DNA, 25 bp, Mus musculus
ggctggccggccagactacagcaat

SEQ ID NO: 329481 - DNA, 25 bp, Mus musculus
ggctggccggtttggtggaggtagg

SEQ ID NO: 329482 - DNA, 25 bp, Mus musculus
ggctggcctacattctaaggtgatt

SEQ ID NO: 329483 - DNA, 25 bp, Mus musculus
ggctggcgaaggatgatgccctggg

SEQ ID NO: 329484 - DNA, 25 bp, Mus musculus
ggctggcgactattcttctatgagt

SEQ ID NO: 329485 - DNA, 25 bp, Mus musculus
ggctggcgctggagagcctgaccag

SEQ ID NO: 329486 - DNA, 25 bp, Mus musculus
ggctggcggtaacagagtactgttt

SEQ ID NO: 329487 - DNA, 25 bp, Mus musculus
ggctggcgtagatcgactgtgccgc

SEQ ID NO: 329488 - DNA, 25 bp, Mus musculus
ggctggctaccatgggagccccgca

SEQ ID NO: 329489 - DNA, 25 bp, Mus musculus
ggctggctcaaggaaccatctggtg

SEQ ID NO: 329490 - DNA, 25 bp, Mus musculus
ggctggctcagaggtgtctgcctta

SEQ ID NO: 329491 - DNA, 25 bp, Mus musculus
ggctggctcagagttctcagtatgt

SEQ ID NO: 329492 - DNA, 25 bp, Mus musculus
ggctggctcagctcccaagtgccaa

SEQ ID NO: 329493 - DNA, 25 bp, Mus musculus
ggctggctgtcagctgctgactgtg

SEQ ID NO: 329494 - DNA, 25 bp, Mus musculus
ggctggcttacagacaaagcctatt

SEQ ID NO: 329495 - DNA, 25 bp, Mus musculus
ggctggcttacaggttcagaggttc

SEQ ID NO: 329496 - DNA, 25 bp, Mus musculus
ggctgggaaccaccgtcacttccag

SEQ ID NO: 329497 - DNA, 25 bp, Mus musculus
ggctgggaagaccctgtttgggaag

SEQ ID NO: 329498 - DNA, 25 bp, Mus musculus
ggctgggaagtgtcgccagagaaac

SEQ ID NO: 329499 - DNA, 25 bp, Mus musculus
ggctgggaagtgtcgcttccaacag

SEQ ID NO: 329500 - DNA, 25 bp, Mus musculus
ggctgggacaggaaatgctgtcatt

SEQ ID NO: 329501 - DNA, 25 bp, Mus musculus
ggctgggagcccaggcctccagatc

SEQ ID NO: 329502 - DNA, 25 bp, Mus musculus
ggctgggatcattgtctgcgtggtg

SEQ ID NO: 329503 - DNA, 25 bp, Mus musculus
ggctgggatccagaatccaactgtg

SEQ ID NO: 329504 - DNA, 25 bp, Mus musculus
ggctgggcaaagaggtgcgtgagca

SEQ ID NO: 329505 - DNA, 25 bp, Mus musculus
ggctgggcacagattggtgttggta

SEQ ID NO: 329506 - DNA, 25 bp, Mus musculus
ggctgggcactcatgcatgctagtc

SEQ ID NO: 329507 - DNA, 25 bp, Mus musculus
ggctgggcagattggccacctgctt

SEQ ID NO: 329508 - DNA, 25 bp, Mus musculus
ggctgggccctgtttttgggaataa

SEQ ID NO: 329509 - DNA, 25 bp, Mus musculus
ggctgggccttgggggcctgggctg

SEQ ID NO: 329510 - DNA, 25 bp, Mus musculus
ggctgggctccagatctactactct

SEQ ID NO: 329511 - DNA, 25 bp, Mus musculus
ggctggggaagaccttgcacttgac

SEQ ID NO: 329512 - DNA, 25 bp, Mus musculus
ggctggggctactacggttgcaatg

SEQ ID NO: 329513 - DNA, 25 bp, Mus musculus
ggctgggggagtccagggccgcgtc

SEQ ID NO: 329514 - DNA, 25 bp, Mus musculus
ggctggggtgcagaatttctgaagt

SEQ ID NO: 329515 - DNA, 25 bp, Mus musculus
ggctgggtcgctaccaccagtgcta

SEQ ID NO: 329516 - DNA, 25 bp, Mus musculus
ggctgggtgacagagtggaccagat

SEQ ID NO: 329517 - DNA, 25 bp, Mus musculus
ggctgggtgcagtgacccttaccct

SEQ ID NO: 329518 - DNA, 25 bp, Mus musculus
ggctgggttcccagtgatagaaaac

SEQ ID NO: 329519 - DNA, 25 bp, Mus musculus
ggctggtaaagctgtcctgcctgtt

SEQ ID NO: 329520 - DNA, 25 bp, Mus musculus
ggctggtaaaggagagaatgaagat

SEQ ID NO: 329521 - DNA, 25 bp, Mus musculus
ggctggtacccgagctgatgtacct

SEQ ID NO: 329522 - DNA, 25 bp, Mus musculus
ggctggtacccgtgctgatgtacct

SEQ ID NO: 329523 - DNA, 25 bp, Mus musculus
ggctggtatcatgggtataggtcca

SEQ ID NO: 329524 - DNA, 25 bp, Mus musculus
ggctggtatctgaagacgctcatga

SEQ ID NO: 329525 - DNA, 25 bp, Mus musculus
ggctggtcacatggtgacctggcct

SEQ ID NO: 329526 - DNA, 25 bp, Mus musculus
ggctggtccaccgtgtcagactcag

SEQ ID NO: 329527 - DNA, 25 bp, Mus musculus
ggctggtccagctggtcttcacagt

SEQ ID NO: 329528 - DNA, 25 bp, Mus musculus
ggctggtccaggtacatccctgagg

SEQ ID NO: 329529 - DNA, 25 bp, Mus musculus
ggctggtccatcctctggaccgtga

SEQ ID NO: 329530 - DNA, 25 bp, Mus musculus
ggctggtcgcagaagtacagcacgt

SEQ ID NO: 329531 - DNA, 25 bp, Mus musculus
ggctggtcttcttctacatctccca

SEQ ID NO: 329532 - DNA, 25 bp, Mus musculus
ggctggtgaaatgaggaagaaaagc

SEQ ID NO: 329533 - DNA, 25 bp, Mus musculus
ggctggtgatcaaggtgttcctgga

SEQ ID NO: 329534 - DNA, 25 bp, Mus musculus
ggctggtgcacgaccttctgccccc

SEQ ID NO: 329535 - DNA, 25 bp, Mus musculus
ggctggtgcctgactttaagcaaga

SEQ ID NO: 329536 - DNA, 25 bp, Mus musculus
ggctggtgctatttatattttggtc

SEQ ID NO: 329537 - DNA, 25 bp, Mus musculus
ggctggtgctgcatgggctcccctc

SEQ ID NO: 329538 - DNA, 25 bp, Mus musculus
ggctggtgctgtgtggatctctcag

SEQ ID NO: 329539 - DNA, 25 bp, Mus musculus
ggctggtggaggaacatggccacca

SEQ ID NO: 329540 - DNA, 25 bp, Mus musculus
ggctggtggagtgttctccagtttt

SEQ ID NO: 329541 - DNA, 25 bp, Mus musculus
ggctggtggcattccattgacaatt

SEQ ID NO: 329542 - DNA, 25 bp, Mus musculus
ggctggtgggaccagtttaaaagga

SEQ ID NO: 329543 - DNA, 25 bp, Mus musculus
ggctggtgtcaacattgtggagatg

SEQ ID NO: 329544 - DNA, 25 bp, Mus musculus
ggctggtgtcggaggatataaaatt

SEQ ID NO: 329545 - DNA, 25 bp, Mus musculus
ggctggttggatgggcacacgctgc

SEQ ID NO: 329546 - DNA, 25 bp, Mus musculus
ggctggtttccgaggtctctgtgtt

SEQ ID NO: 329547 - DNA, 25 bp, Mus musculus
ggctgtaactacagaggcctccagg

SEQ ID NO: 329548 - DNA, 25 bp, Mus musculus
ggctgtaactacagttgtgcccctg

SEQ ID NO: 329549 - DNA, 25 bp, Mus musculus
ggctgtaagaaggtgattttaaaaa

SEQ ID NO: 329550 - DNA, 25 bp, Mus musculus
ggctgtacagggatggctaccagag

SEQ ID NO: 329551 - DNA, 25 bp, Mus musculus
ggctgtaccaccttcccaggaccag

SEQ ID NO: 329552 - DNA, 25 bp, Mus musculus
ggctgtactcaaggagaatctggga

SEQ ID NO: 329553 - DNA, 25 bp, Mus musculus
ggctgtactccacgtgatccgagga

SEQ ID NO: 329554 - DNA, 25 bp, Mus musculus
ggctgtagcagctgcaccacatatc

SEQ ID NO: 329555 - DNA, 25 bp, Mus musculus
ggctgtagcagtgcaccacatatct

SEQ ID NO: 329556 - DNA, 25 bp, Mus musculus
ggctgtagccaaagagactgcttct

SEQ ID NO: 329557 - DNA, 25 bp, Mus musculus
ggctgtatccataggagttttaaag

SEQ ID NO: 329558 - DNA, 25 bp, Mus musculus
ggctgtatccataggatttacatgg

SEQ ID NO: 329559 - DNA, 25 bp, Mus musculus
ggctgtatggcgatgagaatgaagt

SEQ ID NO: 329560 - DNA, 25 bp, Mus musculus
ggctgtatggcggcccgtgggacgt

SEQ ID NO: 329561 - DNA, 25 bp, Mus musculus
ggctgtatgggtctgacagaagttg

SEQ ID NO: 329562 - DNA, 25 bp, Mus musculus
ggctgtatgtggacggatgacgact

SEQ ID NO: 329563 - DNA, 25 bp, Mus musculus
ggctgtatttgaaaaaactggccac

SEQ ID NO: 329564 - DNA, 25 bp, Mus musculus
ggctgtatttggaatgggctgcttc

SEQ ID NO: 329565 - DNA, 25 bp, Mus musculus
ggctgtcaaaggggagaagctgctt

SEQ ID NO: 329566 - DNA, 25 bp, Mus musculus
ggctgtcaacctaatgtctgcgaca

SEQ ID NO: 329567 - DNA, 25 bp, Mus musculus
ggctgtcacaaagatcatagcccag

SEQ ID NO: 329568 - DNA, 25 bp, Mus musculus
ggctgtcaccaaggaccccaactgg

SEQ ID NO: 329569 - DNA, 25 bp, Mus musculus
ggctgtcaccaaggcccacgttttt

SEQ ID NO: 329570 - DNA, 25 bp, Mus musculus
ggctgtcactcctgctggttgcatg

SEQ ID NO: 329571 - DNA, 25 bp, Mus musculus
ggctgtcagagactatgaaatccct

SEQ ID NO: 329572 - DNA, 25 bp, Mus musculus
ggctgtcaggaagaggagctttggc

SEQ ID NO: 329573 - DNA, 25 bp, Mus musculus
ggctgtcaggaagaggctgtcaaca

SEQ ID NO: 329574 - DNA, 25 bp, Mus musculus
ggctgtcaggaagagggagtcccag

SEQ ID NO: 329575 - DNA, 25 bp, Mus musculus
ggctgtcaggcagaatgggcttatg

SEQ ID NO: 329576 - DNA, 25 bp, Mus musculus
ggctgtcattcactgtataagcatg

SEQ ID NO: 329577 - DNA, 25 bp, Mus musculus
ggctgtccaacaggtgcgccaggag

SEQ ID NO: 329578 - DNA, 25 bp, Mus musculus
ggctgtcccacctcagcaccaggac

SEQ ID NO: 329579 - DNA, 25 bp, Mus musculus
ggctgtcccaccttgtgcgccccgc

SEQ ID NO: 329580 - DNA, 25 bp, Mus musculus
ggctgtcccattctctggtgccctg

SEQ ID NO: 329581 - DNA, 25 bp, Mus musculus
ggctgtcccgagttgaggccggcgc

SEQ ID NO: 329582 - DNA, 25 bp, Mus musculus
ggctgtccgtgccagacctcgcagt

SEQ ID NO: 329583 - DNA, 25 bp, Mus musculus
ggctgtccgtgccagtaaccctgac

SEQ ID NO: 329584 - DNA, 25 bp, Mus musculus
ggctgtcctggaactgtgttacatc

SEQ ID NO: 329585 - DNA, 25 bp, Mus musculus
ggctgtcgcatccatgtcattgacc

SEQ ID NO: 329586 - DNA, 25 bp, Mus musculus
ggctgtctcaggtggcccctgtgct

SEQ ID NO: 329587 - DNA, 25 bp, Mus musculus
ggctgtctctcagatgaccactcta

SEQ ID NO: 329588 - DNA, 25 bp, Mus musculus
ggctgtctgtggctgtcctccagga

SEQ ID NO: 329589 - DNA, 25 bp, Mus musculus
ggctgtctgttgtttctctgctgcc

SEQ ID NO: 329590 - DNA, 25 bp, Mus musculus
ggctgtgaaagctgtccagcagaag

SEQ ID NO: 329591 - DNA, 25 bp, Mus musculus
ggctgtgaagccacgcttgcctctc

SEQ ID NO: 329592 - DNA, 25 bp, Mus musculus
ggctgtgaagccacgttgtgggacc

SEQ ID NO: 329593 - DNA, 25 bp, Mus musculus
ggctgtgaatgaaataatagctact

SEQ ID NO: 329594 - DNA, 25 bp, Mus musculus
ggctgtgacccaccaacatgacctg

SEQ ID NO: 329595 - DNA, 25 bp, Mus musculus
ggctgtgaccgagatcaagatccac

SEQ ID NO: 329596 - DNA, 25 bp, Mus musculus
ggctgtgaccgaggttgaacatttc

SEQ ID NO: 329597 - DNA, 25 bp, Mus musculus
ggctgtgactttgcagtttcaccaa

SEQ ID NO: 329598 - DNA, 25 bp, Mus musculus
ggctgtgagaggcttcctccccagg

SEQ ID NO: 329599 - DNA, 25 bp, Mus musculus
ggctgtgagagtgaagccgcccaga

SEQ ID NO: 329600 - DNA, 25 bp, Mus musculus
ggctgtgagccggtgatctctgggc

SEQ ID NO: 329601 - DNA, 25 bp, Mus musculus
ggctgtgaggacagcatccctggca

SEQ ID NO: 329602 - DNA, 25 bp, Mus musculus
ggctgtgatcgctgggttcctgaga

SEQ ID NO: 329603 - DNA, 25 bp, Mus musculus
ggctgtgatggaatttcacgtttct

SEQ ID NO: 329604 - DNA, 25 bp, Mus musculus
ggctgtgatggtagcatcgcctgcc

SEQ ID NO: 329605 - DNA, 25 bp, Mus musculus
ggctgtgcaggtataatggccggac

SEQ ID NO: 329606 - DNA, 25 bp, Mus musculus
ggctgtgctgcagaaaaagcagacg

SEQ ID NO: 329607 - DNA, 25 bp, Mus musculus
ggctgtgctgtgttggtccggaccg

SEQ ID NO: 329608 - DNA, 25 bp, Mus musculus
ggctgtggaaatattgcatactcct

SEQ ID NO: 329609 - DNA, 25 bp, Mus musculus
ggctgtggagacaaatgaattcctt

SEQ ID NO: 329610 - DNA, 25 bp, Mus musculus
ggctgtggagcaggctcctagaagg

SEQ ID NO: 329611 - DNA, 25 bp, Mus musculus
ggctgtggaggaacgggattttcca

SEQ ID NO: 329612 - DNA, 25 bp, Mus musculus
ggctgtggcagactaactccagtct

SEQ ID NO: 329613 - DNA, 25 bp, Mus musculus
ggctgtggctgctgatgccatactc

SEQ ID NO: 329614 - DNA, 25 bp, Mus musculus
ggctgtggctgctgtctccccattc

SEQ ID NO: 329615 - DNA, 25 bp, Mus musculus
ggctgtggcttcaagttttggaaac

SEQ ID NO: 329616 - DNA, 25 bp, Mus musculus
ggctgtgggaggtgctgtggacagg

SEQ ID NO: 329617 - DNA, 25 bp, Mus musculus
ggctgtgggattatctgaacgatgc

SEQ ID NO: 329618 - DNA, 25 bp, Mus musculus
ggctgtggggtccctggctcctggc

SEQ ID NO: 329619 - DNA, 25 bp, Mus musculus
ggctgtgtcctcaggtggcagttta

SEQ ID NO: 329620 - DNA, 25 bp, Mus musculus
ggctgtgtctgatgtcctggaatcg

SEQ ID NO: 329621 - DNA, 25 bp, Mus musculus
ggctgtgtgcggtctgttcctgcgc

SEQ ID NO: 329622 - DNA, 25 bp, Mus musculus
ggctgtgtgtcggagaggctggtcc

SEQ ID NO: 329623 - DNA, 25 bp, Mus musculus
ggctgtgtgtcggagcctccgaagt

SEQ ID NO: 329624 - DNA, 25 bp, Mus musculus
ggctgttagtaagaatcccagtaaa

SEQ ID NO: 329625 - DNA, 25 bp, Mus musculus
ggctgttattgaaaggtgacattcc

SEQ ID NO: 329626 - DNA, 25 bp, Mus musculus
ggctgttcagaaggctgtgggctcc

SEQ ID NO: 329627 - DNA, 25 bp, Mus musculus
ggctgttcagagactgggtgggtct

SEQ ID NO: 329628 - DNA, 25 bp, Mus musculus
ggctgttcagagatggtggagactg

SEQ ID NO: 329629 - DNA, 25 bp, Mus musculus
ggctgttcagagtcatgcagttgct

SEQ ID NO: 329630 - DNA, 25 bp, Mus musculus
ggctgttcaggtcctgctctccctc

SEQ ID NO: 329631 - DNA, 25 bp, Mus musculus
ggctgttcgcgaagaatcgagatcc

SEQ ID NO: 329632 - DNA, 25 bp, Mus musculus
ggctgttcgcgaagtgcgtccccac

SEQ ID NO: 329633 - DNA, 25 bp, Mus musculus
ggctgttgaggatgtgctcgagacc

SEQ ID NO: 329634 - DNA, 25 bp, Mus musculus
ggctgttggacttcaagaaaagaag

SEQ ID NO: 329635 - DNA, 25 bp, Mus musculus
ggctgttggcagttctggcaggtga

SEQ ID NO: 329636 - DNA, 25 bp, Mus musculus
ggctgttgtaaaatggtatggcctc

SEQ ID NO: 329637 - DNA, 25 bp, Mus musculus
ggctgtttatcgcaggaggcagaag

SEQ ID NO: 329638 - DNA, 25 bp, Mus musculus
ggctgtttatggatgaccaggaagt

SEQ ID NO: 329639 - DNA, 25 bp, Mus musculus
ggctgtttctgggtgtggccatccc

SEQ ID NO: 329640 - DNA, 25 bp, Mus musculus
ggctgtttgccgagattgctctctc

SEQ ID NO: 329641 - DNA, 25 bp, Mus musculus
ggctgttttcacaggaactggtgac

SEQ ID NO: 329642 - DNA, 25 bp, Mus musculus
ggctgttttggtgtgcacatcccga

SEQ ID NO: 329643 - DNA, 25 bp, Mus musculus
ggcttaaaagagtctcccccacagc

SEQ ID NO: 329644 - DNA, 25 bp, Mus musculus
ggcttaaaagccgaagaagcaggca

SEQ ID NO: 329645 - DNA, 25 bp, Mus musculus
ggcttaaaagctcgtgtggccagca

SEQ ID NO: 329646 - DNA, 25 bp, Mus musculus
ggcttaaaaggcatccaaggaatgc

SEQ ID NO: 329647 - DNA, 25 bp, Mus musculus
ggcttaaacgccataacccagacca

SEQ ID NO: 329648 - DNA, 25 bp, Mus musculus
ggcttaaagagggcttggggcatat

SEQ ID NO: 329649 - DNA, 25 bp, Mus musculus
ggcttaacagaaaaggagtgtgtga

SEQ ID NO: 329650 - DNA, 25 bp, Mus musculus
ggcttaacagaacaggagtgtgtga

SEQ ID NO: 329651 - DNA, 25 bp, Mus musculus
ggcttaacagagccatcgtgacttt

SEQ ID NO: 329652 - DNA, 25 bp, Mus musculus
ggcttaactggttacaaaatgtcct

SEQ ID NO: 329653 - DNA, 25 bp, Mus musculus
ggcttaagggacagcaaggagtccg

SEQ ID NO: 329654 - DNA, 25 bp, Mus musculus
ggcttaataaagaagatatgcacct

SEQ ID NO: 329655 - DNA, 25 bp, Mus musculus
ggcttaatgacaaattaaaagagat

SEQ ID NO: 329656 - DNA, 25 bp, Mus musculus
ggcttaattcctgaggtaaagggga

SEQ ID NO: 329657 - DNA, 25 bp, Mus musculus
ggcttaattcctgaggttcttaata

SEQ ID NO: 329658 - DNA, 25 bp, Mus musculus
ggcttacagtggaatgggcctgctc

SEQ ID NO: 329659 - DNA, 25 bp, Mus musculus
ggcttacagtgggaagacatgggat

SEQ ID NO: 329660 - DNA, 25 bp, Mus musculus
ggcttaccaacagggagtacacctt

SEQ ID NO: 329661 - DNA, 25 bp, Mus musculus
ggcttaccaacagtctcaagaagga

SEQ ID NO: 329662 - DNA, 25 bp, Mus musculus
ggcttaccaagcccgttctcaaaag

SEQ ID NO: 329663 - DNA, 25 bp, Mus musculus
ggcttacccaggtttggcatagaaa

SEQ ID NO: 329664 - DNA, 25 bp, Mus musculus
ggcttacgtcattgggaggaaaact

SEQ ID NO: 329665 - DNA, 25 bp, Mus musculus
ggcttacgtcattgggtgggtgttc

SEQ ID NO: 329666 - DNA, 25 bp, Mus musculus
ggcttactcagactctaaggaggga

SEQ ID NO: 329667 - DNA, 25 bp, Mus musculus
ggcttactcaggatgtcaatgggcc

SEQ ID NO: 329668 - DNA, 25 bp, Mus musculus
ggcttactgcaccgatcctagttcc

SEQ ID NO: 329669 - DNA, 25 bp, Mus musculus
ggcttagacaggataaggaagcctg

SEQ ID NO: 329670 - DNA, 25 bp, Mus musculus
ggcttagagagaagaaagaatatct

SEQ ID NO: 329671 - DNA, 25 bp, Mus musculus
ggcttagagagaagaaatctccaca

SEQ ID NO: 329672 - DNA, 25 bp, Mus musculus
ggcttagagagaagcaactggtctc

SEQ ID NO: 329673 - DNA, 25 bp, Mus musculus
ggcttagataagaaggtcggagctg

SEQ ID NO: 329674 - DNA, 25 bp, Mus musculus
ggcttagatggaaaggtgtcgcaac

SEQ ID NO: 329675 - DNA, 25 bp, Mus musculus
ggcttaggaccagctcgcaggatta

SEQ ID NO: 329676 - DNA, 25 bp, Mus musculus
ggcttaggagccagaagctgactgc

SEQ ID NO: 329677 - DNA, 25 bp, Mus musculus
ggcttaggagccagaaggaggctgg

SEQ ID NO: 329678 - DNA, 25 bp, Mus musculus
ggcttaggagccagaggaagtcaca

SEQ ID NO: 329679 - DNA, 25 bp, Mus musculus
ggcttatacctcaagctggcacagt

SEQ ID NO: 329680 - DNA, 25 bp, Mus musculus
ggcttatatgtgcacatggcgactg

SEQ ID NO: 329681 - DNA, 25 bp, Mus musculus
ggcttatatgtggagctgtgtggac

SEQ ID NO: 329682 - DNA, 25 bp, Mus musculus
ggcttatctgaggtggggaaagatc

SEQ ID NO: 329683 - DNA, 25 bp, Mus musculus
ggcttatgaacagatcaagcgggcc

SEQ ID NO: 329684 - DNA, 25 bp, Mus musculus
ggcttattccaggatggctaatcgc

SEQ ID NO: 329685 - DNA, 25 bp, Mus musculus
ggcttattcttttggcctaagatca

SEQ ID NO: 329686 - DNA, 25 bp, Mus musculus
ggcttattgttcctgacaaccctcc

SEQ ID NO: 329687 - DNA, 25 bp, Mus musculus
ggcttattgttcctggtttctcttt

SEQ ID NO: 329688 - DNA, 25 bp, Mus musculus
ggcttattttgaagtgatgagacta

SEQ ID NO: 329689 - DNA, 25 bp, Mus musculus
ggcttcaaaaatagctcggtcgagg

SEQ ID NO: 329690 - DNA, 25 bp, Mus musculus
ggcttcaaacaagttcaaaaggatg

SEQ ID NO: 329691 - DNA, 25 bp, Mus musculus
ggcttcaaagattacatgaaagaat

SEQ ID NO: 329692 - DNA, 25 bp, Mus musculus
ggcttcaaagttgcacctgcttagc

SEQ ID NO: 329693 - DNA, 25 bp, Mus musculus
ggcttcaagcaagtaaaggccggcg

SEQ ID NO: 329694 - DNA, 25 bp, Mus musculus
ggcttcaagcagattaacctgtgga

SEQ ID NO: 329695 - DNA, 25 bp, Mus musculus
ggcttcaagccagaagcctgcctgg

SEQ ID NO: 329696 - DNA, 25 bp, Mus musculus
ggcttcaagggcaagatcctattta

SEQ ID NO: 329697 - DNA, 25 bp, Mus musculus
ggcttcaagtgcaaggtcatcttcc

SEQ ID NO: 329698 - DNA, 25 bp, Mus musculus
ggcttcaatatggaatctttctgac

SEQ ID NO: 329699 - DNA, 25 bp, Mus musculus
ggcttcaccccaggagaaagaaagc

SEQ ID NO: 329700 - DNA, 25 bp, Mus musculus
ggcttcaccccaggtgaacaccttt

SEQ ID NO: 329701 - DNA, 25 bp, Mus musculus
ggcttcaccccaggtttgtatggag

SEQ ID NO: 329702 - DNA, 25 bp, Mus musculus
ggcttcactgcgctggcattgacca

SEQ ID NO: 329703 - DNA, 25 bp, Mus musculus
ggcttcactggtaaacaggtgatcc

SEQ ID NO: 329704 - DNA, 25 bp, Mus musculus
ggcttcagagatcatgtgtgcccca

SEQ ID NO: 329705 - DNA, 25 bp, Mus musculus
ggcttcagatcagagttggtgtgga

SEQ ID NO: 329706 - DNA, 25 bp, Mus musculus
ggcttcaggatgagctgcaaaggct

SEQ ID NO: 329707 - DNA, 25 bp, Mus musculus
ggcttcagtggaccaaattttcagg

SEQ ID NO: 329708 - DNA, 25 bp, Mus musculus
ggcttcagtggaccagccttcgtgg

SEQ ID NO: 329709 - DNA, 25 bp, Mus musculus
ggcttcataactcgaatgaaacttt

SEQ ID NO: 329710 - DNA, 25 bp, Mus musculus
ggcttcattggaggtttaggattag

SEQ ID NO: 329711 - DNA, 25 bp, Mus musculus
ggcttccaacatactgcagggttgt

SEQ ID NO: 329712 - DNA, 25 bp, Mus musculus
ggcttccaaggcccttgtccaccca

SEQ ID NO: 329713 - DNA, 25 bp, Mus musculus
ggcttccaaggctaaggtggcatca

SEQ ID NO: 329714 - DNA, 25 bp, Mus musculus
ggcttccaaggttcctacttgaaat

SEQ ID NO: 329715 - DNA, 25 bp, Mus musculus
ggcttccaagtctgttcttcaggag

SEQ ID NO: 329716 - DNA, 25 bp, Mus musculus
ggcttccaatccagagacctctttt

SEQ ID NO: 329717 - DNA, 25 bp, Mus musculus
ggcttccaatccagcctgaggtctc

SEQ ID NO: 329718 - DNA, 25 bp, Mus musculus
ggcttccacaggattttcaccttgt

SEQ ID NO: 329719 - DNA, 25 bp, Mus musculus
ggcttccaccgttgtggccagaacc

SEQ ID NO: 329720 - DNA, 25 bp, Mus musculus
ggcttccatctacaggcctgtccac

SEQ ID NO: 329721 - DNA, 25 bp, Mus musculus
ggcttccatttctgcaaggagtcct

SEQ ID NO: 329722 - DNA, 25 bp, Mus musculus
ggcttcccaaaaatgtatccatcga

SEQ ID NO: 329723 - DNA, 25 bp, Mus musculus
ggcttcccaatcctcaaccagttct

SEQ ID NO: 329724 - DNA, 25 bp, Mus musculus
ggcttcccaatcctcgagccctgac

SEQ ID NO: 329725 - DNA, 25 bp, Mus musculus
ggcttcccagaaaagatcaggcaaa

SEQ ID NO: 329726 - DNA, 25 bp, Mus musculus
ggcttcccagaagaatctgatgcca

SEQ ID NO: 329727 - DNA, 25 bp, Mus musculus
ggcttcccagacactccgtggtgct

SEQ ID NO: 329728 - DNA, 25 bp, Mus musculus
ggcttcccagagaagcgatgtccta

SEQ ID NO: 329729 - DNA, 25 bp, Mus musculus
ggcttcccagatgaatgcactgatc

SEQ ID NO: 329730 - DNA, 25 bp, Mus musculus
ggcttcccaggatctggagactcac

SEQ ID NO: 329731 - DNA, 25 bp, Mus musculus
ggcttcccagggccaacaggtgacc

SEQ ID NO: 329732 - DNA, 25 bp, Mus musculus
ggcttccccatctggcatgcccacg

SEQ ID NO: 329733 - DNA, 25 bp, Mus musculus
ggcttcccccagcagactggagggt

SEQ ID NO: 329734 - DNA, 25 bp, Mus musculus
ggcttcccctcagtgaatgtggctc

SEQ ID NO: 329735 - DNA, 25 bp, Mus musculus
ggcttcccctgtgaccctagtctct

SEQ ID NO: 329736 - DNA, 25 bp, Mus musculus
ggcttccctgagctgggaacactcc

SEQ ID NO: 329737 - DNA, 25 bp, Mus musculus
ggcttccctgcaagatatggttgca

SEQ ID NO: 329738 - DNA, 25 bp, Mus musculus
ggcttccctgcaaggagtgttacgg

SEQ ID NO: 329739 - DNA, 25 bp, Mus musculus
ggcttccgaggctccggcttcgtca

SEQ ID NO: 329740 - DNA, 25 bp, Mus musculus
ggcttccgagtccctcctggggggt

SEQ ID NO: 329741 - DNA, 25 bp, Mus musculus
ggcttccgatcaattcgaagccgat

SEQ ID NO: 329742 - DNA, 25 bp, Mus musculus
ggcttccgatcaggagagaaaagaa

SEQ ID NO: 329743 - DNA, 25 bp, Mus musculus
ggcttccggaaggaactggtgagca

SEQ ID NO: 329744 - DNA, 25 bp, Mus musculus
ggcttccggaaggcctctggattct

SEQ ID NO: 329745 - DNA, 25 bp, Mus musculus
ggcttccggagatatgacgtgttca

SEQ ID NO: 329746 - DNA, 25 bp, Mus musculus
ggcttccggagtttgtgatcctgtg

SEQ ID NO: 329747 - DNA, 25 bp, Mus musculus
ggcttccgtatcaatttctgccaaa

SEQ ID NO: 329748 - DNA, 25 bp, Mus musculus
ggcttccgtatctatttctgccaaa

SEQ ID NO: 329749 - DNA, 25 bp, Mus musculus
ggcttcctcaatattgatgaaagcc

SEQ ID NO: 329750 - DNA, 25 bp, Mus musculus
ggcttcctcagcactggagacaagc

SEQ ID NO: 329751 - DNA, 25 bp, Mus musculus
ggcttcctgaagccccagtcttatt

SEQ ID NO: 329752 - DNA, 25 bp, Mus musculus
ggcttcctgagaggctggcctccac

SEQ ID NO: 329753 - DNA, 25 bp, Mus musculus
ggcttcctgagatgaagaaactgaa

SEQ ID NO: 329754 - DNA, 25 bp, Mus musculus
ggcttcctgcctggcacggcgcagg

SEQ ID NO: 329755 - DNA, 25 bp, Mus musculus
ggcttcctgcggcagagagtacttc

SEQ ID NO: 329756 - DNA, 25 bp, Mus musculus
ggcttcctggatgtccagaaggatg

SEQ ID NO: 329757 - DNA, 25 bp, Mus musculus
ggcttcctggtagtcccatattatg

SEQ ID NO: 329758 - DNA, 25 bp, Mus musculus
ggcttcctgtttgcagtatgatctg

SEQ ID NO: 329759 - DNA, 25 bp, Mus musculus
ggcttccttaagacagatgggagct

SEQ ID NO: 329760 - DNA, 25 bp, Mus musculus
ggcttcctttccgtagccagcccag

SEQ ID NO: 329761 - DNA, 25 bp, Mus musculus
ggcttcctttgcttggccacagaca

SEQ ID NO: 329762 - DNA, 25 bp, Mus musculus
ggcttcgagaacgaagaaagaaaca

SEQ ID NO: 329763 - DNA, 25 bp, Mus musculus
ggcttcgagaacgtgactacgagaa

SEQ ID NO: 329764 - DNA, 25 bp, Mus musculus
ggcttcgccatgcagtggccccggg

SEQ ID NO: 329765 - DNA, 25 bp, Mus musculus
ggcttcgccatggtagcgatggtgg

SEQ ID NO: 329766 - DNA, 25 bp, Mus musculus
ggcttcgccatggtggccatggtgg

SEQ ID NO: 329767 - DNA, 25 bp, Mus musculus
ggcttcgtggcgaagcagcaggatg

SEQ ID NO: 329768 - DNA, 25 bp, Mus musculus
ggcttcgtggcgatcaagaagaagc

SEQ ID NO: 329769 - DNA, 25 bp, Mus musculus
ggcttcgttccttgcgcgctggggt

SEQ ID NO: 329770 - DNA, 25 bp, Mus musculus
ggcttcgttcttagatgagcccagg

SEQ ID NO: 329771 - DNA, 25 bp, Mus musculus
ggcttctaactcaggaaggcgaagt

SEQ ID NO: 329772 - DNA, 25 bp, Mus musculus
ggcttctactcaaattctggaatat

SEQ ID NO: 329773 - DNA, 25 bp, Mus musculus
ggcttctagacccaggagttttgct

SEQ ID NO: 329774 - DNA, 25 bp, Mus musculus
ggcttctagggacagaacaacagct

SEQ ID NO: 329775 - DNA, 25 bp, Mus musculus
ggcttctcaccgcttagaattacat

SEQ ID NO: 329776 - DNA, 25 bp, Mus musculus
ggcttctcaccgggcgagcctttcc

SEQ ID NO: 329777 - DNA, 25 bp, Mus musculus
ggcttctcaccggtgcacgcctcct

SEQ ID NO: 329778 - DNA, 25 bp, Mus musculus
ggcttctcaccgttatcctaggcgt

SEQ ID NO: 329779 - DNA, 25 bp, Mus musculus
ggcttctcagatgggagctcagaat

SEQ ID NO: 329780 - DNA, 25 bp, Mus musculus
ggcttctcagttccagagcctctgc

SEQ ID NO: 329781 - DNA, 25 bp, Mus musculus
ggcttctcccaaattaaatgatgaa

SEQ ID NO: 329782 - DNA, 25 bp, Mus musculus
ggcttctcgctgggaaatctacaaa

SEQ ID NO: 329783 - DNA, 25 bp, Mus musculus
ggcttctctccagtggtggatgtga

SEQ ID NO: 329784 - DNA, 25 bp, Mus musculus
ggcttctctctcggtggagacacag

SEQ ID NO: 329785 - DNA, 25 bp, Mus musculus
ggcttctctcttccacttgtagtgt

SEQ ID NO: 329786 - DNA, 25 bp, Mus musculus
ggcttctctgtctagggctgacggt

SEQ ID NO: 329787 - DNA, 25 bp, Mus musculus
ggcttctgagaaactggtcaaaatc

SEQ ID NO: 329788 - DNA, 25 bp, Mus musculus
ggcttctgcacagacttggagcagt

SEQ ID NO: 329789 - DNA, 25 bp, Mus musculus
ggcttctgcacgcccctccaggccg

SEQ ID NO: 329790 - DNA, 25 bp, Mus musculus
ggcttctgccaaggacctccctgca

SEQ ID NO: 329791 - DNA, 25 bp, Mus musculus
ggcttctgccaaggcgcagcacctc

SEQ ID NO: 329792 - DNA, 25 bp, Mus musculus
ggcttctgcgaaactgaagaagatg

SEQ ID NO: 329793 - DNA, 25 bp, Mus musculus
ggcttctgctacagcggctgtacag

SEQ ID NO: 329794 - DNA, 25 bp, Mus musculus
ggcttctgctacaggagtcagcagc

SEQ ID NO: 329795 - DNA, 25 bp, Mus musculus
ggcttctggcctcagatgccctgct

SEQ ID NO: 329796 - DNA, 25 bp, Mus musculus
ggcttctgggcgaggaaaaagtaaa

SEQ ID NO: 329797 - DNA, 25 bp, Mus musculus
ggcttctgggcgaggagagaacaca

SEQ ID NO: 329798 - DNA, 25 bp, Mus musculus
ggcttctgtagaaaggaacatgtct

SEQ ID NO: 329799 - DNA, 25 bp, Mus musculus
ggcttctgtcggacggggctgaaaa

SEQ ID NO: 329800 - DNA, 25 bp, Mus musculus
ggcttctgtcggacttagaagaatt

SEQ ID NO: 329801 - DNA, 25 bp, Mus musculus
ggcttctgtgtcaagcccaacaagc

SEQ ID NO: 329802 - DNA, 25 bp, Mus musculus
ggcttctgttcaggatatagatctg

SEQ ID NO: 329803 - DNA, 25 bp, Mus musculus
ggcttctgtttgaggttcctgggtg

SEQ ID NO: 329804 - DNA, 25 bp, Mus musculus
ggcttcttaatataacttgcaccga

SEQ ID NO: 329805 - DNA, 25 bp, Mus musculus
ggcttcttaggtcgcaagtctggga

SEQ ID NO: 329806 - DNA, 25 bp, Mus musculus
ggcttcttcagacgaacagtcagca

SEQ ID NO: 329807 - DNA, 25 bp, Mus musculus
ggcttcttcagcactggagaccagc

SEQ ID NO: 329808 - DNA, 25 bp, Mus musculus
ggcttcttcaggactctttcatgga

SEQ ID NO: 329809 - DNA, 25 bp, Mus musculus
ggcttcttcagtgatactgtcagca

SEQ ID NO: 329810 - DNA, 25 bp, Mus musculus
ggcttcttctcgaccaacttgcagc

SEQ ID NO: 329811 - DNA, 25 bp, Mus musculus
ggcttcttgccggccccgcccccgc

SEQ ID NO: 329812 - DNA, 25 bp, Mus musculus
ggcttcttgccgggatctgacccag

SEQ ID NO: 329813 - DNA, 25 bp, Mus musculus
ggcttcttggtgtctgaccgagacc

SEQ ID NO: 329814 - DNA, 25 bp, Mus musculus
ggcttctttacccacgtttttgcag

SEQ ID NO: 329815 - DNA, 25 bp, Mus musculus
ggcttctttagctctcctcacatgg

SEQ ID NO: 329816 - DNA, 25 bp, Mus musculus
ggcttctttaggacgacagccatgt

SEQ ID NO: 329817 - DNA, 25 bp, Mus musculus
ggcttctttaggtctcctcacatgg

SEQ ID NO: 329818 - DNA, 25 bp, Mus musculus
ggcttctttcagacaagcgtgagaa

SEQ ID NO: 329819 - DNA, 25 bp, Mus musculus
ggcttgaaacagccgctgcaggagc

SEQ ID NO: 329820 - DNA, 25 bp, Mus musculus
ggcttgaaacaggccggtagtggtg

SEQ ID NO: 329821 - DNA, 25 bp, Mus musculus
ggcttgaagatgataattagcacca

SEQ ID NO: 329822 - DNA, 25 bp, Mus musculus
ggcttgaatctcaggactccagagg

SEQ ID NO: 329823 - DNA, 25 bp, Mus musculus
ggcttgactattgacctagccccat

SEQ ID NO: 329824 - DNA, 25 bp, Mus musculus
ggcttgactcccaaagcctacaagg

SEQ ID NO: 329825 - DNA, 25 bp, Mus musculus
ggcttgactgctccttctggccgca

SEQ ID NO: 329826 - DNA, 25 bp, Mus musculus
ggcttgagagagagagccagctgct

SEQ ID NO: 329827 - DNA, 25 bp, Mus musculus
ggcttgagtgggccttcccgctcca

SEQ ID NO: 329828 - DNA, 25 bp, Mus musculus
ggcttgataaagggaggtatgaaag

SEQ ID NO: 329829 - DNA, 25 bp, Mus musculus
ggcttgatagtgagattggcagact

SEQ ID NO: 329830 - DNA, 25 bp, Mus musculus
ggcttgcaaggctaccaaggccctc

SEQ ID NO: 329831 - DNA, 25 bp, Mus musculus
ggcttgcagattttcttctaacgag

SEQ ID NO: 329832 - DNA, 25 bp, Mus musculus
ggcttgcatgaggcaaaagagattt

SEQ ID NO: 329833 - DNA, 25 bp, Mus musculus
ggcttgcatgagggctcgctgccca

SEQ ID NO: 329834 - DNA, 25 bp, Mus musculus
ggcttgccaggtgaatattggcttg

SEQ ID NO: 329835 - DNA, 25 bp, Mus musculus
ggcttgcccagctggctcctccaag

SEQ ID NO: 329836 - DNA, 25 bp, Mus musculus
ggcttgccccggggacagaccaccg

SEQ ID NO: 329837 - DNA, 25 bp, Mus musculus
ggcttgcctccggaggtgtatgcag

SEQ ID NO: 329838 - DNA, 25 bp, Mus musculus
ggcttgcggagggtcctggaaacac

SEQ ID NO: 329839 - DNA, 25 bp, Mus musculus
ggcttgctcaggtagctaaagcagt

SEQ ID NO: 329840 - DNA, 25 bp, Mus musculus
ggcttgctgaagctcaggtacctga

SEQ ID NO: 329841 - DNA, 25 bp, Mus musculus
ggcttgctgaagtggcttttcatgg

SEQ ID NO: 329842 - DNA, 25 bp, Mus musculus
ggcttgctgacaagcccttcaaatt

SEQ ID NO: 329843 - DNA, 25 bp, Mus musculus
ggcttgctgtgtggctgagagtgct

SEQ ID NO: 329844 - DNA, 25 bp, Mus musculus
ggcttgcttgttggtgattgtatcg

SEQ ID NO: 329845 - DNA, 25 bp, Mus musculus
ggcttggaatgagactgcagatctt

SEQ ID NO: 329846 - DNA, 25 bp, Mus musculus
ggcttggactgaaggtacgcaggga

SEQ ID NO: 329847 - DNA, 25 bp, Mus musculus
ggcttggagcaagatgagatggacc

SEQ ID NO: 329848 - DNA, 25 bp, Mus musculus
ggcttggatcgaaggcacggaggga

SEQ ID NO: 329849 - DNA, 25 bp, Mus musculus
ggcttggcagagcaacttattttca

SEQ ID NO: 329850 - DNA, 25 bp, Mus musculus
ggcttggcaggatgacatgcacagg

SEQ ID NO: 329851 - DNA, 25 bp, Mus musculus
ggcttggcagtttgcgtcctcgggg

SEQ ID NO: 329852 - DNA, 25 bp, Mus musculus
ggcttgggaattgacaggcatcgcc

SEQ ID NO: 329853 - DNA, 25 bp, Mus musculus
ggcttgggaggaactgagtggtagg

SEQ ID NO: 329854 - DNA, 25 bp, Mus musculus
ggcttgggagggtgacacttcccaa

SEQ ID NO: 329855 - DNA, 25 bp, Mus musculus
ggcttggggcaagatcgacatgcta

SEQ ID NO: 329856 - DNA, 25 bp, Mus musculus
ggcttggggcaaggtggatacgacg

SEQ ID NO: 329857 - DNA, 25 bp, Mus musculus
ggcttggtagcgtacattgcaaaca

SEQ ID NO: 329858 - DNA, 25 bp, Mus musculus
ggcttggtgtctggatgatgcatcc

SEQ ID NO: 329859 - DNA, 25 bp, Mus musculus
ggcttggttgggaagtggattataa

SEQ ID NO: 329860 - DNA, 25 bp, Mus musculus
ggcttgtattgaaaaagcttgtggc

SEQ ID NO: 329861 - DNA, 25 bp, Mus musculus
ggcttgtcaatgaggcagaattcca

SEQ ID NO: 329862 - DNA, 25 bp, Mus musculus
ggcttgtcacattcccacgaggttc

SEQ ID NO: 329863 - DNA, 25 bp, Mus musculus
ggcttgtccagggtatcttattttc

SEQ ID NO: 329864 - DNA, 25 bp, Mus musculus
ggcttgtcctacaagcctggacaaa

SEQ ID NO: 329865 - DNA, 25 bp, Mus musculus
ggcttgtcctacaaggccctcgttg

SEQ ID NO: 329866 - DNA, 25 bp, Mus musculus
ggcttgtgagggtgactacgggggc

SEQ ID NO: 329867 - DNA, 25 bp, Mus musculus
ggcttgtgcaggtctggtcactcga

SEQ ID NO: 329868 - DNA, 25 bp, Mus musculus
ggcttgtgctcaaacaggctctgga

SEQ ID NO: 329869 - DNA, 25 bp, Mus musculus
ggcttgtggctgctcccgcaggctg

SEQ ID NO: 329870 - DNA, 25 bp, Mus musculus
ggcttgtgggcagaagctgacgttt

SEQ ID NO: 329871 - DNA, 25 bp, Mus musculus
ggcttgttctgggggtggtggagtt

SEQ ID NO: 329872 - DNA, 25 bp, Mus musculus
ggcttgttgaacaacagatgcagcg

SEQ ID NO: 329873 - DNA, 25 bp, Mus musculus
ggcttgttggaggggactttcccaa

SEQ ID NO: 329874 - DNA, 25 bp, Mus musculus
ggctttaacaatctccattcggaca

SEQ ID NO: 329875 - DNA, 25 bp, Mus musculus
ggctttaataaaccacgtttacgca

SEQ ID NO: 329876 - DNA, 25 bp, Mus musculus
ggctttaatatgggcggcaacgacg

SEQ ID NO: 329877 - DNA, 25 bp, Mus musculus
ggctttacaggaaatctgacgtttg

SEQ ID NO: 329878 - DNA, 25 bp, Mus musculus
ggctttaccagaagagggcatcaga

SEQ ID NO: 329879 - DNA, 25 bp, Mus musculus
ggctttaccagtctattgcatctgc

SEQ ID NO: 329880 - DNA, 25 bp, Mus musculus
ggctttagcaagagcatggtcaata

SEQ ID NO: 329881 - DNA, 25 bp, Mus musculus
ggctttagcaaggcccgcggccatg

SEQ ID NO: 329882 - DNA, 25 bp, Mus musculus
ggctttaggagggttggtggtcgga

SEQ ID NO: 329883 - DNA, 25 bp, Mus musculus
ggctttaggagtccggtgagttgga

SEQ ID NO: 329884 - DNA, 25 bp, Mus musculus
ggctttatatccttttagtgttggg

SEQ ID NO: 329885 - DNA, 25 bp, Mus musculus
ggctttatcaggcgttctgtcaaag

SEQ ID NO: 329886 - DNA, 25 bp, Mus musculus
ggctttatcaggggcgttcaatttg

SEQ ID NO: 329887 - DNA, 25 bp, Mus musculus
ggctttatcaggtcctcatgggtat

SEQ ID NO: 329888 - DNA, 25 bp, Mus musculus
ggctttcaaaaacaggatctgagtc

SEQ ID NO: 329889 - DNA, 25 bp, Mus musculus
ggctttcaaaaacaggtcagccctt

SEQ ID NO: 329890 - DNA, 25 bp, Mus musculus
ggctttcaagctaactgatgatgtg

SEQ ID NO: 329891 - DNA, 25 bp, Mus musculus
ggctttcaagggaacaaagaatcgg

SEQ ID NO: 329892 - DNA, 25 bp, Mus musculus
ggctttcaagttgtggagctcctgg

SEQ ID NO: 329893 - DNA, 25 bp, Mus musculus
ggctttcacttaggaatgtgactct

SEQ ID NO: 329894 - DNA, 25 bp, Mus musculus
ggctttcagagacgagttacaattt

SEQ ID NO: 329895 - DNA, 25 bp, Mus musculus
ggctttcagatacataccaaggagg

SEQ ID NO: 329896 - DNA, 25 bp, Mus musculus
ggctttcagtaggagtgtgacttgg

SEQ ID NO: 329897 - DNA, 25 bp, Mus musculus
ggctttccaaatgtgacgagaagaa

SEQ ID NO: 329898 - DNA, 25 bp, Mus musculus
ggctttccaagttacctgatttaaa

SEQ ID NO: 329899 - DNA, 25 bp, Mus musculus
ggctttccagccatggccatgcaaa

SEQ ID NO: 329900 - DNA, 25 bp, Mus musculus
ggctttccagctccagcacctgcct

SEQ ID NO: 329901 - DNA, 25 bp, Mus musculus
ggctttccccaggccctccatgatg

SEQ ID NO: 329902 - DNA, 25 bp, Mus musculus
ggctttccctgagaagcagctgagc

SEQ ID NO: 329903 - DNA, 25 bp, Mus musculus
ggctttcctgaggagcggcggcatg

SEQ ID NO: 329904 - DNA, 25 bp, Mus musculus
ggctttcctttgggtattcccatct

SEQ ID NO: 329905 - DNA, 25 bp, Mus musculus
ggctttcgaggagaaaattctatag

SEQ ID NO: 329906 - DNA, 25 bp, Mus musculus
ggctttcgcagagcagtcctcagag

SEQ ID NO: 329907 - DNA, 25 bp, Mus musculus
ggctttcgcagagctgctcttggaa

SEQ ID NO: 329908 - DNA, 25 bp, Mus musculus
ggctttctaaatgaacttcagtaac

SEQ ID NO: 329909 - DNA, 25 bp, Mus musculus
ggctttctaatagcagcgtccccat

SEQ ID NO: 329910 - DNA, 25 bp, Mus musculus
ggctttctatagagctgggctcgtc

SEQ ID NO: 329911 - DNA, 25 bp, Mus musculus
ggctttctataggtatggggactgc

SEQ ID NO: 329912 - DNA, 25 bp, Mus musculus
ggctttctcagggctctggcgcact

SEQ ID NO: 329913 - DNA, 25 bp, Mus musculus
ggctttctgatcaggtgttgtttgt

SEQ ID NO: 329914 - DNA, 25 bp, Mus musculus
ggctttctggagggagttggtggaa

SEQ ID NO: 329915 - DNA, 25 bp, Mus musculus
ggctttgaagaatcaggcccaggac

SEQ ID NO: 329916 - DNA, 25 bp, Mus musculus
ggctttgacagctgcaggtcctggt

SEQ ID NO: 329917 - DNA, 25 bp, Mus musculus
ggctttgactacagcacggtggatg

SEQ ID NO: 329918 - DNA, 25 bp, Mus musculus
ggctttgacttcaacaccctcttca

SEQ ID NO: 329919 - DNA, 25 bp, Mus musculus
ggctttgagtggaacgcaaccttcc

SEQ ID NO: 329920 - DNA, 25 bp, Mus musculus
ggctttgatcacagtattttcacaa

SEQ ID NO: 329921 - DNA, 25 bp, Mus musculus
ggctttgatgatctattggatgata

SEQ ID NO: 329922 - DNA, 25 bp, Mus musculus
ggctttgcaaaagtacgatcagagc

SEQ ID NO: 329923 - DNA, 25 bp, Mus musculus
ggctttgcaaagtgattcgtaaggg

SEQ ID NO: 329924 - DNA, 25 bp, Mus musculus
ggctttgcaaatgctcagcagagga

SEQ ID NO: 329925 - DNA, 25 bp, Mus musculus
ggctttgcaaggaagccatcactcc

SEQ ID NO: 329926 - DNA, 25 bp, Mus musculus
ggctttgcactcagcccccactgta

SEQ ID NO: 329927 - DNA, 25 bp, Mus musculus
ggctttgcactcagcgtacatgttg

SEQ ID NO: 329928 - DNA, 25 bp, Mus musculus
ggctttgccaatgctcagcagagaa

SEQ ID NO: 329929 - DNA, 25 bp, Mus musculus
ggctttgccacacagtgaagatgcc

SEQ ID NO: 329930 - DNA, 25 bp, Mus musculus
ggctttgccgcagggggtgctacag

SEQ ID NO: 329931 - DNA, 25 bp, Mus musculus
ggctttgccgcaggggtcatgttag

SEQ ID NO: 329932 - DNA, 25 bp, Mus musculus
ggctttgcctgtgaggtttctgttt

SEQ ID NO: 329933 - DNA, 25 bp, Mus musculus
ggctttgctacaacgctaacagttc

SEQ ID NO: 329934 - DNA, 25 bp, Mus musculus
ggctttgctcagccttctggccggg

SEQ ID NO: 329935 - DNA, 25 bp, Mus musculus
ggctttgctggagtatattgaaaaa

SEQ ID NO: 329936 - DNA, 25 bp, Mus musculus
ggctttgctgggttgctatgatatg

SEQ ID NO: 329937 - DNA, 25 bp, Mus musculus
ggctttggaaattgccgcagatgac

SEQ ID NO: 329938 - DNA, 25 bp, Mus musculus
ggctttggagctcctgatggtttga

SEQ ID NO: 329939 - DNA, 25 bp, Mus musculus
ggctttggaggaagtggccagatgt

SEQ ID NO: 329940 - DNA, 25 bp, Mus musculus
ggctttggaggggctgtgggtttgg

SEQ ID NO: 329941 - DNA, 25 bp, Mus musculus
ggctttggaggtagaggaggcttcc

SEQ ID NO: 329942 - DNA, 25 bp, Mus musculus
ggctttggaggtcggtgagctggta

SEQ ID NO: 329943 - DNA, 25 bp, Mus musculus
ggctttggagtaggccagactcctg

SEQ ID NO: 329944 - DNA, 25 bp, Mus musculus
ggctttgggccggttgctgatgacg

SEQ ID NO: 329945 - DNA, 25 bp, Mus musculus
ggctttgtcactatgccacagccca

SEQ ID NO: 329946 - DNA, 25 bp, Mus musculus
ggctttgtgatatgatgagaaaacc

SEQ ID NO: 329947 - DNA, 25 bp, Mus musculus
ggctttgtgtactgctctgctgctg

SEQ ID NO: 329948 - DNA, 25 bp, Mus musculus
ggctttgtgtgggcttgcaaaattg

SEQ ID NO: 329949 - DNA, 25 bp, Mus musculus
ggctttgttcagtcgggctctaagc

SEQ ID NO: 329950 - DNA, 25 bp, Mus musculus
ggctttgttcagtcggtttccgtga

SEQ ID NO: 329951 - DNA, 25 bp, Mus musculus
ggctttgttgcttagcctcctgtac

SEQ ID NO: 329952 - DNA, 25 bp, Mus musculus
ggctttgttgcttaggattccctgc

SEQ ID NO: 329953 - DNA, 25 bp, Mus musculus
ggcttttaatgatctagtgaagcca

SEQ ID NO: 329954 - DNA, 25 bp, Mus musculus
ggcttttacagacccataactggtg

SEQ ID NO: 329955 - DNA, 25 bp, Mus musculus
ggcttttacagggagggtagacctg

SEQ ID NO: 329956 - DNA, 25 bp, Mus musculus
ggcttttacagttgttctgatgttc

SEQ ID NO: 329957 - DNA, 25 bp, Mus musculus
ggcttttcaggtcacctagcattgg

SEQ ID NO: 329958 - DNA, 25 bp, Mus musculus
ggcttttcataccagctgcttttat

SEQ ID NO: 329959 - DNA, 25 bp, Mus musculus
ggcttttctgattcaccccaccatt

SEQ ID NO: 329960 - DNA, 25 bp, Mus musculus
ggcttttctgattttcagaaagaag

SEQ ID NO: 329961 - DNA, 25 bp, Mus musculus
ggcttttgaaagctctgcggagtcg

SEQ ID NO: 329962 - DNA, 25 bp, Mus musculus
ggcttttgaaaggaacagattatac

SEQ ID NO: 329963 - DNA, 25 bp, Mus musculus
ggcttttgagagctgtctctctttt

SEQ ID NO: 329964 - DNA, 25 bp, Mus musculus
ggcttttgcagaggtttcctggcag

SEQ ID NO: 329965 - DNA, 25 bp, Mus musculus
ggcttttgcaggcacaacccggtct

SEQ ID NO: 329966 - DNA, 25 bp, Mus musculus
ggcttttgcaggtctgacagcggat

SEQ ID NO: 329967 - DNA, 25 bp, Mus musculus
ggcttttgcggctaagtaagaagta

SEQ ID NO: 329968 - DNA, 25 bp, Mus musculus
ggcttttgctggagggagctgggaa

SEQ ID NO: 329969 - DNA, 25 bp, Mus musculus
ggcttttggaagtgaagtttggtga

SEQ ID NO: 329970 - DNA, 25 bp, Mus musculus
ggcttttggtaatagaggatctgag

SEQ ID NO: 329971 - DNA, 25 bp, Mus musculus
ggctttttaaaggaaggcatcccac

SEQ ID NO: 329972 - DNA, 25 bp, Mus musculus
ggctttttcagcttgcttcccagag

SEQ ID NO: 329973 - DNA, 25 bp, Mus musculus
ggctttttcaggaggcagtgacttt

SEQ ID NO: 329974 - DNA, 25 bp, Mus musculus
ggctttttcccaggcttggatttag

SEQ ID NO: 329975 - DNA, 25 bp, Mus musculus
ggctttttgtggagccccgcaatct

SEQ ID NO: 329976 - DNA, 25 bp, Mus musculus
ggctttttttggccggacgagcaat

SEQ ID NO: 329977 - DNA, 25 bp, Mus musculus
gggaaaaagaacaagaccgtggcta

SEQ ID NO: 329978 - DNA, 25 bp, Mus musculus
gggaaaaagatatccttttggataa

SEQ ID NO: 329979 - DNA, 25 bp, Mus musculus
gggaaaaatgaaggattcagaaacc

SEQ ID NO: 329980 - DNA, 25 bp, Mus musculus
gggaaaaatgccagatctctatggc

SEQ ID NO: 329981 - DNA, 25 bp, Mus musculus
gggaaaacagaattataacaattga

SEQ ID NO: 329982 - DNA, 25 bp, Mus musculus
gggaaaaccaaaggtccagaatagc

SEQ ID NO: 329983 - DNA, 25 bp, Mus musculus
gggaaaactgtccggccaggtatca

SEQ ID NO: 329984 - DNA, 25 bp, Mus musculus
gggaaaagaactaaatggcagcaca

SEQ ID NO: 329985 - DNA, 25 bp, Mus musculus
gggaaaagaactaatttcagcatat

SEQ ID NO: 329986 - DNA, 25 bp, Mus musculus
gggaaaagaactgttcagctcctaa

SEQ ID NO: 329987 - DNA, 25 bp, Mus musculus
gggaaaagactgtaatgaaacctca

SEQ ID NO: 329988 - DNA, 25 bp, Mus musculus
gggaaaagagctggattctaatccc

SEQ ID NO: 329989 - DNA, 25 bp, Mus musculus
gggaaaagttgctggaaaccatggc

SEQ ID NO: 329990 - DNA, 25 bp, Mus musculus
gggaaaatatctttgtatcttaaaa

SEQ ID NO: 329991 - DNA, 25 bp, Mus musculus
gggaaaatgaaacttggggaccatg

SEQ ID NO: 329992 - DNA, 25 bp, Mus musculus
gggaaaatggctcagggggagcacc

SEQ ID NO: 329993 - DNA, 25 bp, Mus musculus
gggaaaatgggcaaggtgaaattgg

SEQ ID NO: 329994 - DNA, 25 bp, Mus musculus
gggaaacaactgggctcgggccatc

SEQ ID NO: 329995 - DNA, 25 bp, Mus musculus
gggaaacaagaaagacagagtccat

SEQ ID NO: 329996 - DNA, 25 bp, Mus musculus
gggaaacacagaaatatgccgagcg

SEQ ID NO: 329997 - DNA, 25 bp, Mus musculus
gggaaaccaaggacacactgaagcc

SEQ ID NO: 329998 - DNA, 25 bp, Mus musculus
gggaaaccataacgtcaaactccgt

SEQ ID NO: 329999 - DNA, 25 bp, Mus musculus
gggaaaccatgtggtgctctaagaa

SEQ ID NO: 330000 - DNA, 25 bp, Mus musculus
gggaaacccaagcttatggcaaacc

SEQ ID NO: 330001 - DNA, 25 bp, Mus musculus
gggaaaccccacagccaaggcctgg

SEQ ID NO: 330002 - DNA, 25 bp, Mus musculus
gggaaaccgaggactcagagaggct

SEQ ID NO: 330003 - DNA, 25 bp, Mus musculus
gggaaacctgaatctgtatcgattc

SEQ ID NO: 330004 - DNA, 25 bp, Mus musculus
gggaaaccttggtcttgccacctca

SEQ ID NO: 330005 - DNA, 25 bp, Mus musculus
gggaaacgcgaagatgtgacagcat

SEQ ID NO: 330006 - DNA, 25 bp, Mus musculus
gggaaactatgatctcttcactggt

SEQ ID NO: 330007 - DNA, 25 bp, Mus musculus
gggaaactcatcctgactctcactc

SEQ ID NO: 330008 - DNA, 25 bp, Mus musculus
gggaaactctacaccctagaggaga

SEQ ID NO: 330009 - DNA, 25 bp, Mus musculus
gggaaactgccgccacagtacatgt

SEQ ID NO: 330010 - DNA, 25 bp, Mus musculus
gggaaactggtacagtacaatatct

SEQ ID NO: 330011 - DNA, 25 bp, Mus musculus
gggaaagaaagaatggaatctatag

SEQ ID NO: 330012 - DNA, 25 bp, Mus musculus
gggaaagaaagccgctctgcacagc

SEQ ID NO: 330013 - DNA, 25 bp, Mus musculus
gggaaagaaagtcacagacaagttc

SEQ ID NO: 330014 - DNA, 25 bp, Mus musculus
gggaaagaagatgaaagcagaagtc

SEQ ID NO: 330015 - DNA, 25 bp, Mus musculus
gggaaagaaggaatcacaggcctct

SEQ ID NO: 330016 - DNA, 25 bp, Mus musculus
gggaaagaagggactcgtactgggt

SEQ ID NO: 330017 - DNA, 25 bp, Mus musculus
gggaaagaagtgagaagataaagat

SEQ ID NO: 330018 - DNA, 25 bp, Mus musculus
gggaaagaccagacatcatcccaca

SEQ ID NO: 330019 - DNA, 25 bp, Mus musculus
gggaaagaccaggacctcaccatcc

SEQ ID NO: 330020 - DNA, 25 bp, Mus musculus
gggaaagagataacagcagacagga

SEQ ID NO: 330021 - DNA, 25 bp, Mus musculus
gggaaagatttctgaaaattaatga

SEQ ID NO: 330022 - DNA, 25 bp, Mus musculus
gggaaagatttctggggtgatgact

SEQ ID NO: 330023 - DNA, 25 bp, Mus musculus
gggaaagcaccagcccacctaaacc

SEQ ID NO: 330024 - DNA, 25 bp, Mus musculus
gggaaagcagctgcagaggcattgc

SEQ ID NO: 330025 - DNA, 25 bp, Mus musculus
gggaaagcagctggtcaaccctccc

SEQ ID NO: 330026 - DNA, 25 bp, Mus musculus
gggaaagcaggggagaagtcaataa

SEQ ID NO: 330027 - DNA, 25 bp, Mus musculus
gggaaagccaagatgccagaccagt

SEQ ID NO: 330028 - DNA, 25 bp, Mus musculus
gggaaagctgacggacgaatgctac

SEQ ID NO: 330029 - DNA, 25 bp, Mus musculus
gggaaagctgatgaatgcacccttg

SEQ ID NO: 330030 - DNA, 25 bp, Mus musculus
gggaaagctggccgaggagttgtct

SEQ ID NO: 330031 - DNA, 25 bp, Mus musculus
gggaaaggacacgagttgcctagca

SEQ ID NO: 330032 - DNA, 25 bp, Mus musculus
gggaaaggccataaggagctggtgg

SEQ ID NO: 330033 - DNA, 25 bp, Mus musculus
gggaaaggccggatggaccaagagt

SEQ ID NO: 330034 - DNA, 25 bp, Mus musculus
gggaaaggtgaacgctgctggttgt

SEQ ID NO: 330035 - DNA, 25 bp, Mus musculus
gggaaagtcttacagcctttgtttc

SEQ ID NO: 330036 - DNA, 25 bp, Mus musculus
gggaaagtcttacaggagttaggat

SEQ ID NO: 330037 - DNA, 25 bp, Mus musculus
gggaaagtcttacagtattaccagg

SEQ ID NO: 330038 - DNA, 25 bp, Mus musculus
gggaaagtcttagcacctccgcacc

SEQ ID NO: 330039 - DNA, 25 bp, Mus musculus
gggaaagtcttagtgtcgagcacag

SEQ ID NO: 330040 - DNA, 25 bp, Mus musculus
gggaaataagagatccagcccactc

SEQ ID NO: 330041 - DNA, 25 bp, Mus musculus
gggaaatacagttattcatggtgga

SEQ ID NO: 330042 - DNA, 25 bp, Mus musculus
gggaaatacccaagtaccagcaagt

SEQ ID NO: 330043 - DNA, 25 bp, Mus musculus
gggaaatacggtatcaccagcctcc

SEQ ID NO: 330044 - DNA, 25 bp, Mus musculus
gggaaatcaaggaacttaatgagtt

SEQ ID NO: 330045 - DNA, 25 bp, Mus musculus
gggaaatcaaggactcgctggccga

SEQ ID NO: 330046 - DNA, 25 bp, Mus musculus
gggaaatctaagataccaagtggta

SEQ ID NO: 330047 - DNA, 25 bp, Mus musculus
gggaaatctggaactttgttgcctt

SEQ ID NO: 330048 - DNA, 25 bp, Mus musculus
gggaaatctgtcagggccagagaac

SEQ ID NO: 330049 - DNA, 25 bp, Mus musculus
gggaaatctgtcagggggagatgac

SEQ ID NO: 330050 - DNA, 25 bp, Mus musculus
gggaaatgatgagaatggcttggta

SEQ ID NO: 330051 - DNA, 25 bp, Mus musculus
gggaaatgatgtggttgagaaatac

SEQ ID NO: 330052 - DNA, 25 bp, Mus musculus
gggaaatggaaacacttgcagaagc

SEQ ID NO: 330053 - DNA, 25 bp, Mus musculus
gggaaatggaaagtccctgacaggc

SEQ ID NO: 330054 - DNA, 25 bp, Mus musculus
gggaaattattagggatgccagtaa

SEQ ID NO: 330055 - DNA, 25 bp, Mus musculus
gggaacaaaggaggaggacatcttc

SEQ ID NO: 330056 - DNA, 25 bp, Mus musculus
gggaacaagagaataaaggccgcgc

SEQ ID NO: 330057 - DNA, 25 bp, Mus musculus
gggaacaagagaggcaatgggtgac

SEQ ID NO: 330058 - DNA, 25 bp, Mus musculus
gggaacaagagataaaactattaaa

SEQ ID NO: 330059 - DNA, 25 bp, Mus musculus
gggaacaaggccaggactgtggcgg

SEQ ID NO: 330060 - DNA, 25 bp, Mus musculus
gggaacaagtaccattaattaaggc

SEQ ID NO: 330061 - DNA, 25 bp, Mus musculus
gggaacacacaaagattcagagctg

SEQ ID NO: 330062 - DNA, 25 bp, Mus musculus
gggaacacacaaaggttggttcctg

SEQ ID NO: 330063 - DNA, 25 bp, Mus musculus
gggaacacagagcagctgcaggaaa

SEQ ID NO: 330064 - DNA, 25 bp, Mus musculus
gggaacacagagttcttcttgcttt

SEQ ID NO: 330065 - DNA, 25 bp, Mus musculus
gggaacaccctagatgtgctcctgg

SEQ ID NO: 330066 - DNA, 25 bp, Mus musculus
gggaacaccggcaagatagttgaag

SEQ ID NO: 330067 - DNA, 25 bp, Mus musculus
gggaacacgaggttccgagtccgag

SEQ ID NO: 330068 - DNA, 25 bp, Mus musculus
gggaacacttgggggagaagcgagc

SEQ ID NO: 330069 - DNA, 25 bp, Mus musculus
gggaacagaagccggatggtgtctt

SEQ ID NO: 330070 - DNA, 25 bp, Mus musculus
gggaacagacactctccccgaccat

SEQ ID NO: 330071 - DNA, 25 bp, Mus musculus
gggaacagagtaccactcattcggc

SEQ ID NO: 330072 - DNA, 25 bp, Mus musculus
gggaacagccaggaggatgttggat

SEQ ID NO: 330073 - DNA, 25 bp, Mus musculus
gggaacagccttagctacatcaaaa

SEQ ID NO: 330074 - DNA, 25 bp, Mus musculus
gggaacaggagctcctcttgcggct

SEQ ID NO: 330075 - DNA, 25 bp, Mus musculus
gggaacaggcaggatgagatagagc

SEQ ID NO: 330076 - DNA, 25 bp, Mus musculus
gggaacaggcaggtcacgaaagaag

SEQ ID NO: 330077 - DNA, 25 bp, Mus musculus
gggaacagtcctgactatgccacct

SEQ ID NO: 330078 - DNA, 25 bp, Mus musculus
gggaacatgaagttggtgagcccga

SEQ ID NO: 330079 - DNA, 25 bp, Mus musculus
gggaaccaaaatcagggccctgtgg

SEQ ID NO: 330080 - DNA, 25 bp, Mus musculus
gggaaccaagaaatcccaggcaggc

SEQ ID NO: 330081 - DNA, 25 bp, Mus musculus
gggaaccaagaaggcacagacagaa

SEQ ID NO: 330082 - DNA, 25 bp, Mus musculus
gggaaccagccgcaagggaaggtgt

SEQ ID NO: 330083 - DNA, 25 bp, Mus musculus
gggaaccagccgcagagccccaagg

SEQ ID NO: 330084 - DNA, 25 bp, Mus musculus
gggaaccagtgggaggtgggacttc

SEQ ID NO: 330085 - DNA, 25 bp, Mus musculus
gggaaccagtggtgactgccctgct

SEQ ID NO: 330086 - DNA, 25 bp, Mus musculus
gggaacccaaccatatgagagtctg

SEQ ID NO: 330087 - DNA, 25 bp, Mus musculus
gggaacccaaggcctggcagaaccc

SEQ ID NO: 330088 - DNA, 25 bp, Mus musculus
gggaaccgccgatcggagaatgtcg

SEQ ID NO: 330089 - DNA, 25 bp, Mus musculus
gggaaccggcattgatgtccagctc

SEQ ID NO: 330090 - DNA, 25 bp, Mus musculus
gggaaccggcggcttcatggcggct

SEQ ID NO: 330091 - DNA, 25 bp, Mus musculus
gggaacctaaatggggggatcgcag

SEQ ID NO: 330092 - DNA, 25 bp, Mus musculus
gggaacctaaatggtggagccactt

SEQ ID NO: 330093 - DNA, 25 bp, Mus musculus
gggaacctcccagaactccgaggtg

SEQ ID NO: 330094 - DNA, 25 bp, Mus musculus
gggaacctgtgaggtcatgcacttc

SEQ ID NO: 330095 - DNA, 25 bp, Mus musculus
gggaacgcagagcagtgggaagagc

SEQ ID NO: 330096 - DNA, 25 bp, Mus musculus
gggaacgcatcgtattgacgacagt

SEQ ID NO: 330097 - DNA, 25 bp, Mus musculus
gggaacgccaattctaacggcaagt

SEQ ID NO: 330098 - DNA, 25 bp, Mus musculus
gggaacgcctcgggggtgtctgacg

SEQ ID NO: 330099 - DNA, 25 bp, Mus musculus
gggaacggcaggccgatctgtcccc

SEQ ID NO: 330100 - DNA, 25 bp, Mus musculus
gggaacgggagagtggccttgtgaa

SEQ ID NO: 330101 - DNA, 25 bp, Mus musculus
gggaacgtactaaaactgtgcaggg

SEQ ID NO: 330102 - DNA, 25 bp, Mus musculus
gggaacgtgatacgatgagcagctc

SEQ ID NO: 330103 - DNA, 25 bp, Mus musculus
gggaacgtggaggcccctttgtgtg

SEQ ID NO: 330104 - DNA, 25 bp, Mus musculus
gggaactcaacaaggagatggcttc

SEQ ID NO: 330105 - DNA, 25 bp, Mus musculus
gggaactccagcccttttacacagc

SEQ ID NO: 330106 - DNA, 25 bp, Mus musculus
gggaactgcaggtaaggaactgcca

SEQ ID NO: 330107 - DNA, 25 bp, Mus musculus
gggaactgcagtttccctgcaggta

SEQ ID NO: 330108 - DNA, 25 bp, Mus musculus
gggaactgctggtgtgatccttgca

SEQ ID NO: 330109 - DNA, 25 bp, Mus musculus
gggaactggttgggaagccagctgc

SEQ ID NO: 330110 - DNA, 25 bp, Mus musculus
gggaacttcagacccagccacctcc

SEQ ID NO: 330111 - DNA, 25 bp, Mus musculus
gggaacttccaggcacaaagtacca

SEQ ID NO: 330112 - DNA, 25 bp, Mus musculus
gggaacttgtagtagacccttaagc

SEQ ID NO: 330113 - DNA, 25 bp, Mus musculus
gggaagaaaaaaagaccccagcgca

SEQ ID NO: 330114 - DNA, 25 bp, Mus musculus
gggaagaaaattgcagcctggagct

SEQ ID NO: 330115 - DNA, 25 bp, Mus musculus
gggaagaaagaaggatagatataag

SEQ ID NO: 330116 - DNA, 25 bp, Mus musculus
gggaagaaagatgtgtacactcttt

SEQ ID NO: 330117 - DNA, 25 bp, Mus musculus
gggaagaaagcttcgaagaaaagca

SEQ ID NO: 330118 - DNA, 25 bp, Mus musculus
gggaagaaagtgtctggactctcct

SEQ ID NO: 330119 - DNA, 25 bp, Mus musculus
gggaagaacaaaaggctgacgaatg

SEQ ID NO: 330120 - DNA, 25 bp, Mus musculus
gggaagaacaatgacctccgggaaa

SEQ ID NO: 330121 - DNA, 25 bp, Mus musculus
gggaagaacactgctgtgctgggac

SEQ ID NO: 330122 - DNA, 25 bp, Mus musculus
gggaagaagaagcccagggtgctga

SEQ ID NO: 330123 - DNA, 25 bp, Mus musculus
gggaagaagacggatctccatcttt

SEQ ID NO: 330124 - DNA, 25 bp, Mus musculus
gggaagaagagcccttctccctagg

SEQ ID NO: 330125 - DNA, 25 bp, Mus musculus
gggaagaaggccaccgacgcattcc

SEQ ID NO: 330126 - DNA, 25 bp, Mus musculus
gggaagaataggtatcgtgtccagg

SEQ ID NO: 330127 - DNA, 25 bp, Mus musculus
gggaagaatggaaaatgtttatagg

SEQ ID NO: 330128 - DNA, 25 bp, Mus musculus
gggaagacaaggtgatgatgagcag

SEQ ID NO: 330129 - DNA, 25 bp, Mus musculus
gggaagacatatgggctgatgtgat

SEQ ID NO: 330130 - DNA, 25 bp, Mus musculus
gggaagacatatgggtggagccttt

SEQ ID NO: 330131 - DNA, 25 bp, Mus musculus
gggaagacattggcgtatttgctgc

SEQ ID NO: 330132 - DNA, 25 bp, Mus musculus
gggaagacctcactccagtcccgct

SEQ ID NO: 330133 - DNA, 25 bp, Mus musculus
gggaagacctcactgacctctcact

SEQ ID NO: 330134 - DNA, 25 bp, Mus musculus
gggaagacctcactgtttctctata

SEQ ID NO: 330135 - DNA, 25 bp, Mus musculus
gggaagactccaattcattgcttct

SEQ ID NO: 330136 - DNA, 25 bp, Mus musculus
gggaagactgccgtgagcatccagt

SEQ ID NO: 330137 - DNA, 25 bp, Mus musculus
gggaagactggcgcaagcggcggaa

SEQ ID NO: 330138 - DNA, 25 bp, Mus musculus
gggaagactgggagatggaacacat

SEQ ID NO: 330139 - DNA, 25 bp, Mus musculus
gggaagactggtccctgtggcccct

SEQ ID NO: 330140 - DNA, 25 bp, Mus musculus
gggaagactggtctctaactggttt

SEQ ID NO: 330141 - DNA, 25 bp, Mus musculus
gggaagagaaactgctcaggaggag

SEQ ID NO: 330142 - DNA, 25 bp, Mus musculus
gggaagagaataggagaaagcatcc

SEQ ID NO: 330143 - DNA, 25 bp, Mus musculus
gggaagagatggctacatgggaatt

SEQ ID NO: 330144 - DNA, 25 bp, Mus musculus
gggaagagatgggtattgctttcac

SEQ ID NO: 330145 - DNA, 25 bp, Mus musculus
gggaagagctggcatttcagtcgaa

SEQ ID NO: 330146 - DNA, 25 bp, Mus musculus
gggaagaggaagaagtctgttccca

SEQ ID NO: 330147 - DNA, 25 bp, Mus musculus
gggaagaggacaggcttttccctgg

SEQ ID NO: 330148 - DNA, 25 bp, Mus musculus
gggaagaggggaagcatccacaaac

SEQ ID NO: 330149 - DNA, 25 bp, Mus musculus
gggaagaggtcaaagaggcgccagc

SEQ ID NO: 330150 - DNA, 25 bp, Mus musculus
gggaagaggtgccagctacatcaga

SEQ ID NO: 330151 - DNA, 25 bp, Mus musculus
gggaagagtgccatgacaatgcagt

SEQ ID NO: 330152 - DNA, 25 bp, Mus musculus
gggaagagtgtgtcctgagttgcat

SEQ ID NO: 330153 - DNA, 25 bp, Mus musculus
gggaagataaaacagaaagagtagg

SEQ ID NO: 330154 - DNA, 25 bp, Mus musculus
gggaagatcaagaggtcagggccaa

SEQ ID NO: 330155 - DNA, 25 bp, Mus musculus
gggaagatgcagaaattgctgcccg

SEQ ID NO: 330156 - DNA, 25 bp, Mus musculus
gggaagatgcagaagttcctgcttt

SEQ ID NO: 330157 - DNA, 25 bp, Mus musculus
gggaagatgccagtgtacggtcagc

SEQ ID NO: 330158 - DNA, 25 bp, Mus musculus
gggaagatggaccggcagatgttcc

SEQ ID NO: 330159 - DNA, 25 bp, Mus musculus
gggaagatggcgctggcgatggaga

SEQ ID NO: 330160 - DNA, 25 bp, Mus musculus
gggaagatgtgccagcctgccccca

SEQ ID NO: 330161 - DNA, 25 bp, Mus musculus
gggaagattacaaagtgcgggtcga

SEQ ID NO: 330162 - DNA, 25 bp, Mus musculus
gggaagattcggatccctaccgtgg

SEQ ID NO: 330163 - DNA, 25 bp, Mus musculus
gggaagcaaacattcgagatctatt

SEQ ID NO: 330164 - DNA, 25 bp, Mus musculus
gggaagcaaaggcaaagactctgag

SEQ ID NO: 330165 - DNA, 25 bp, Mus musculus
gggaagcaaaggctcaagtcattct

SEQ ID NO: 330166 - DNA, 25 bp, Mus musculus
gggaagcacgggacgcctcagaaat

SEQ ID NO: 330167 - DNA, 25 bp, Mus musculus
gggaagcacttcaccagtaaaaagc

SEQ ID NO: 330168 - DNA, 25 bp, Mus musculus
gggaagccagagagggtctgcgagc

SEQ ID NO: 330169 - DNA, 25 bp, Mus musculus
gggaagccagggtctttgtgaacac

SEQ ID NO: 330170 - DNA, 25 bp, Mus musculus
gggaagcccagcagtattcggaggc

SEQ ID NO: 330171 - DNA, 25 bp, Mus musculus
gggaagcctcaggaactcaccccag

SEQ ID NO: 330172 - DNA, 25 bp, Mus musculus
gggaagcctcaggctgtgggcgctg

SEQ ID NO: 330173 - DNA, 25 bp, Mus musculus
gggaagcctcagtgccactaagcct

SEQ ID NO: 330174 - DNA, 25 bp, Mus musculus
gggaagcctggcaagggctactgac

SEQ ID NO: 330175 - DNA, 25 bp, Mus musculus
gggaagcctgggtcacgtgaagaaa

SEQ ID NO: 330176 - DNA, 25 bp, Mus musculus
gggaagccttggagaaaacagagaa

SEQ ID NO: 330177 - DNA, 25 bp, Mus musculus
gggaagcgaatccgaaatgaagcag

SEQ ID NO: 330178 - DNA, 25 bp, Mus musculus
gggaagcgaatccgtgaaatggcca

SEQ ID NO: 330179 - DNA, 25 bp, Mus musculus
gggaagcgacatgcgtactgagcgc

SEQ ID NO: 330180 - DNA, 25 bp, Mus musculus
gggaagcgacatggtaagaatgatt

SEQ ID NO: 330181 - DNA, 25 bp, Mus musculus
gggaagcgcaacaggtcacctggag

SEQ ID NO: 330182 - DNA, 25 bp, Mus musculus
gggaagcgcagcgagcaggacacag

SEQ ID NO: 330183 - DNA, 25 bp, Mus musculus
gggaagcgcaggacacagaaaatat

SEQ ID NO: 330184 - DNA, 25 bp, Mus musculus
gggaagcggcggcgggttaacttcg

SEQ ID NO: 330185 - DNA, 25 bp, Mus musculus
gggaagcggcggcgggttggagttc

SEQ ID NO: 330186 - DNA, 25 bp, Mus musculus
gggaagctaagaaactgaggctcct

SEQ ID NO: 330187 - DNA, 25 bp, Mus musculus
gggaagctaatgcagtcccaccccc

SEQ ID NO: 330188 - DNA, 25 bp, Mus musculus
gggaagctcccagagggaattcctg

SEQ ID NO: 330189 - DNA, 25 bp, Mus musculus
gggaagctcctggcggaggccatga

SEQ ID NO: 330190 - DNA, 25 bp, Mus musculus
gggaagctcctggcggatgccatga

SEQ ID NO: 330191 - DNA, 25 bp, Mus musculus
gggaagctgaggaaaccaatgtttt

SEQ ID NO: 330192 - DNA, 25 bp, Mus musculus
gggaagctgaggaggtcataacttc

SEQ ID NO: 330193 - DNA, 25 bp, Mus musculus
gggaagctgaggtctaatctcttgg

SEQ ID NO: 330194 - DNA, 25 bp, Mus musculus
gggaagctgctatgcgtttctaatg

SEQ ID NO: 330195 - DNA, 25 bp, Mus musculus
gggaagctggagggaagaagaagac

SEQ ID NO: 330196 - DNA, 25 bp, Mus musculus
gggaagctggctgtgactcgaggcg

SEQ ID NO: 330197 - DNA, 25 bp, Mus musculus
gggaagctgggatctcaagcacagg

SEQ ID NO: 330198 - DNA, 25 bp, Mus musculus
gggaagctgtcagcattctgcctac

SEQ ID NO: 330199 - DNA, 25 bp, Mus musculus
gggaagctgtcagtgggtttcacca

SEQ ID NO: 330200 - DNA, 25 bp, Mus musculus
gggaagctgtcagttctgagaagtc

SEQ ID NO: 330201 - DNA, 25 bp, Mus musculus
gggaagctgtgctcagtagtcctat

SEQ ID NO: 330202 - DNA, 25 bp, Mus musculus
gggaaggaaggcacagctgatgaaa

SEQ ID NO: 330203 - DNA, 25 bp, Mus musculus
gggaaggaaggtgaccattgttgaa

SEQ ID NO: 330204 - DNA, 25 bp, Mus musculus
gggaaggaagtgagcctggtggtac

SEQ ID NO: 330205 - DNA, 25 bp, Mus musculus
gggaaggacaggacagcaaggtact

SEQ ID NO: 330206 - DNA, 25 bp, Mus musculus
gggaaggacaggttcaactggagag

SEQ ID NO: 330207 - DNA, 25 bp, Mus musculus
gggaaggacatgaatgtgttaatat

SEQ ID NO: 330208 - DNA, 25 bp, Mus musculus
gggaaggacgcatctcttcgccgaa

SEQ ID NO: 330209 - DNA, 25 bp, Mus musculus
gggaaggactttgggattttcagaa

SEQ ID NO: 330210 - DNA, 25 bp, Mus musculus
gggaaggagcagcaagctggggctt

SEQ ID NO: 330211 - DNA, 25 bp, Mus musculus
gggaaggagcaggcctggcagaacc

SEQ ID NO: 330212 - DNA, 25 bp, Mus musculus
gggaaggagtggaaaagagagacat

SEQ ID NO: 330213 - DNA, 25 bp, Mus musculus
gggaaggagttatccagcttgtcca

SEQ ID NO: 330214 - DNA, 25 bp, Mus musculus
gggaaggatcacgaggttgtacttg

SEQ ID NO: 330215 - DNA, 25 bp, Mus musculus
gggaaggatgaagattcctatcaca

SEQ ID NO: 330216 - DNA, 25 bp, Mus musculus
gggaaggatgggtaacaaaggagga

SEQ ID NO: 330217 - DNA, 25 bp, Mus musculus
gggaaggatgtcctttcaacagggt

SEQ ID NO: 330218 - DNA, 25 bp, Mus musculus
gggaaggattagatctgccacctcc

SEQ ID NO: 330219 - DNA, 25 bp, Mus musculus
gggaaggcagaaggtgatgtgggtc

SEQ ID NO: 330220 - DNA, 25 bp, Mus musculus
gggaaggcagaggaggcattatgag

SEQ ID NO: 330221 - DNA, 25 bp, Mus musculus
gggaaggccagggtcatttctctgc

SEQ ID NO: 330222 - DNA, 25 bp, Mus musculus
gggaaggcttgccactttcctaaat

SEQ ID NO: 330223 - DNA, 25 bp, Mus musculus
gggaaggggctccaggcagaagcga

SEQ ID NO: 330224 - DNA, 25 bp, Mus musculus
gggaaggtaaagatacacctatggc

SEQ ID NO: 330225 - DNA, 25 bp, Mus musculus
gggaaggtggaggtgtggtacatcc

SEQ ID NO: 330226 - DNA, 25 bp, Mus musculus
gggaagtatggatgggtacctggaa

SEQ ID NO: 330227 - DNA, 25 bp, Mus musculus
gggaagtatttctggcctcggatta

SEQ ID NO: 330228 - DNA, 25 bp, Mus musculus
gggaagtcagtcagctttccctgct

SEQ ID NO: 330229 - DNA, 25 bp, Mus musculus
gggaagtcagtcaggtcagctttgg

SEQ ID NO: 330230 - DNA, 25 bp, Mus musculus
gggaagtccgcgagtggggttgcgg

SEQ ID NO: 330231 - DNA, 25 bp, Mus musculus
gggaagtccttacagcaaattgctg

SEQ ID NO: 330232 - DNA, 25 bp, Mus musculus
gggaagtccttacagttttaagtgg

SEQ ID NO: 330233 - DNA, 25 bp, Mus musculus
gggaagtcgctgatgaggagactgc

SEQ ID NO: 330234 - DNA, 25 bp, Mus musculus
gggaagtcggcttaggagccacata

SEQ ID NO: 330235 - DNA, 25 bp, Mus musculus
gggaagtctcaggtgtcggtgacgt

SEQ ID NO: 330236 - DNA, 25 bp, Mus musculus
gggaagtctggaagaccaccagact

SEQ ID NO: 330237 - DNA, 25 bp, Mus musculus
gggaagtcttcattgtcagtcaggg

SEQ ID NO: 330238 - DNA, 25 bp, Mus musculus
gggaagtgctgataggatccacgca

SEQ ID NO: 330239 - DNA, 25 bp, Mus musculus
gggaagtgtcgccagagaaacaata

SEQ ID NO: 330240 - DNA, 25 bp, Mus musculus
gggaagtgtcgcttccaacagtgtt

SEQ ID NO: 330241 - DNA, 25 bp, Mus musculus
gggaagttactccgagatgccgcgc

SEQ ID NO: 330242 - DNA, 25 bp, Mus musculus
gggaagttaggcacaatcacttcct

SEQ ID NO: 330243 - DNA, 25 bp, Mus musculus
gggaagttcaggcagctgtgctcac

SEQ ID NO: 330244 - DNA, 25 bp, Mus musculus
gggaagttcaggcaggtaatgccat

SEQ ID NO: 330245 - DNA, 25 bp, Mus musculus
gggaagttcaggcctggtgatgagc

SEQ ID NO: 330246 - DNA, 25 bp, Mus musculus
gggaagttggtaaagagcatcataa

SEQ ID NO: 330247 - DNA, 25 bp, Mus musculus
gggaagttggtacagagcatcataa

SEQ ID NO: 330248 - DNA, 25 bp, Mus musculus
gggaagtttgagaaatcagggatgt

SEQ ID NO: 330249 - DNA, 25 bp, Mus musculus
gggaataagcagcctcaaaatgcag

SEQ ID NO: 330250 - DNA, 25 bp, Mus musculus
gggaataattgtgaggatgaagttt

SEQ ID NO: 330251 - DNA, 25 bp, Mus musculus
gggaatacaggagacagaaaagagc

SEQ ID NO: 330252 - DNA, 25 bp, Mus musculus
gggaatagaaggctatcctacctac

SEQ ID NO: 330253 - DNA, 25 bp, Mus musculus
gggaatatatgtatatactgccccg

SEQ ID NO: 330254 - DNA, 25 bp, Mus musculus
gggaatatggctctggcccacaggg

SEQ ID NO: 330255 - DNA, 25 bp, Mus musculus
gggaatattcctacctccactccag

SEQ ID NO: 330256 - DNA, 25 bp, Mus musculus
gggaatattgaagtacttggtttta

SEQ ID NO: 330257 - DNA, 25 bp, Mus musculus
gggaatcaaagttgctacaactatc

SEQ ID NO: 330258 - DNA, 25 bp, Mus musculus
gggaatcatacatgacgcctttgac

SEQ ID NO: 330259 - DNA, 25 bp, Mus musculus
gggaatcatgacagaacagccttgt

SEQ ID NO: 330260 - DNA, 25 bp, Mus musculus
gggaatcatgacaggcccattcttc

SEQ ID NO: 330261 - DNA, 25 bp, Mus musculus
gggaatccagagatcattgatagtc

SEQ ID NO: 330262 - DNA, 25 bp, Mus musculus
gggaatccagatcaaggttccagga

SEQ ID NO: 330263 - DNA, 25 bp, Mus musculus
gggaatccagatgactgcagtcaag

SEQ ID NO: 330264 - DNA, 25 bp, Mus musculus
gggaatcccaccaagctctctgctg

SEQ ID NO: 330265 - DNA, 25 bp, Mus musculus
gggaatcctggcctcccagtaaagg

SEQ ID NO: 330266 - DNA, 25 bp, Mus musculus
gggaatcctggggacacttaacaaa

SEQ ID NO: 330267 - DNA, 25 bp, Mus musculus
gggaatccttgaaagccctctgggc

SEQ ID NO: 330268 - DNA, 25 bp, Mus musculus
gggaatctcaacacctcacgaaggg

SEQ ID NO: 330269 - DNA, 25 bp, Mus musculus
gggaatctccgaaatcccgcaaggt

SEQ ID NO: 330270 - DNA, 25 bp, Mus musculus
gggaatctccggtcccgcacaccat

SEQ ID NO: 330271 - DNA, 25 bp, Mus musculus
gggaatgaaaggtgatgaagtctcg

SEQ ID NO: 330272 - DNA, 25 bp, Mus musculus
gggaatgacagccgccgccatgatc

SEQ ID NO: 330273 - DNA, 25 bp, Mus musculus
gggaatgagatttcctgactgctct

SEQ ID NO: 330274 - DNA, 25 bp, Mus musculus
gggaatgccaatgcgactgcttttt

SEQ ID NO: 330275 - DNA, 25 bp, Mus musculus
gggaatgggagagatgcagaaagag

SEQ ID NO: 330276 - DNA, 25 bp, Mus musculus
gggaatgggagagcttttgcctacc

SEQ ID NO: 330277 - DNA, 25 bp, Mus musculus
gggaatgggcagcacatttaaaatc

SEQ ID NO: 330278 - DNA, 25 bp, Mus musculus
gggaatgggctacataccatctgcc

SEQ ID NO: 330279 - DNA, 25 bp, Mus musculus
gggaatgggctacatcccgtatgtg

SEQ ID NO: 330280 - DNA, 25 bp, Mus musculus
gggaatgtcagagatgggcgtgtct

SEQ ID NO: 330281 - DNA, 25 bp, Mus musculus
gggaatgtcagttcactcaccgctg

SEQ ID NO: 330282 - DNA, 25 bp, Mus musculus
gggaatgtgagatacctttatcaat

SEQ ID NO: 330283 - DNA, 25 bp, Mus musculus
gggaatgttcaacagtgcacagtgt

SEQ ID NO: 330284 - DNA, 25 bp, Mus musculus
gggaattataaaaaggcacagaaga

SEQ ID NO: 330285 - DNA, 25 bp, Mus musculus
gggaattcactccagatctctatgg

SEQ ID NO: 330286 - DNA, 25 bp, Mus musculus
gggaattcactggaattcctgagca

SEQ ID NO: 330287 - DNA, 25 bp, Mus musculus
gggaattcatatgactgtgatgagc

SEQ ID NO: 330288 - DNA, 25 bp, Mus musculus
gggaattcatgtctgcccggacaaa

SEQ ID NO: 330289 - DNA, 25 bp, Mus musculus
gggaattccagctgatggagacctg

SEQ ID NO: 330290 - DNA, 25 bp, Mus musculus
gggaattccagctgggtgagtctgt

SEQ ID NO: 330291 - DNA, 25 bp, Mus musculus
gggaattccaggtctcaagggattc

SEQ ID NO: 330292 - DNA, 25 bp, Mus musculus
gggaattctcgcccgaacctcttga

SEQ ID NO: 330293 - DNA, 25 bp, Mus musculus
gggaattgaactcaggccatattcc

SEQ ID NO: 330294 - DNA, 25 bp, Mus musculus
gggaattgagaatatgaacgaggct

SEQ ID NO: 330295 - DNA, 25 bp, Mus musculus
gggaattgcaaagatgtgtccaggt

SEQ ID NO: 330296 - DNA, 25 bp, Mus musculus
gggaattgcaaagtgtactgggact

SEQ ID NO: 330297 - DNA, 25 bp, Mus musculus
gggaattgctcaggaggctttagaa

SEQ ID NO: 330298 - DNA, 25 bp, Mus musculus
gggaattgctcaggcgagagcaggc

SEQ ID NO: 330299 - DNA, 25 bp, Mus musculus
gggaattggtcctggctctgtctgt

SEQ ID NO: 330300 - DNA, 25 bp, Mus musculus
gggaattgtacagatatcgatgagt

SEQ ID NO: 330301 - DNA, 25 bp, Mus musculus
gggaatttgctggggagaaggaact

SEQ ID NO: 330302 - DNA, 25 bp, Mus musculus
gggaattttatgtaagaccagctgt

SEQ ID NO: 330303 - DNA, 25 bp, Mus musculus
gggacaaaacgcaccctacctggaa

SEQ ID NO: 330304 - DNA, 25 bp, Mus musculus
gggacaaaaggccggtcatggtatg

SEQ ID NO: 330305 - DNA, 25 bp, Mus musculus
gggacaaagctgcaggcatcgttct

SEQ ID NO: 330306 - DNA, 25 bp, Mus musculus
gggacaacaccagcgactgctgtgg

SEQ ID NO: 330307 - DNA, 25 bp, Mus musculus
gggacaacagtttacctacgttgcc

SEQ ID NO: 330308 - DNA, 25 bp, Mus musculus
gggacaaccaggcaaccgagggctc

SEQ ID NO: 330309 - DNA, 25 bp, Mus musculus
gggacaacccatacctgcacctcgc

SEQ ID NO: 330310 - DNA, 25 bp, Mus musculus
gggacaacgaaggtgaccccatctc

SEQ ID NO: 330311 - DNA, 25 bp, Mus musculus
gggacaactatgggaagaagaagaa

SEQ ID NO: 330312 - DNA, 25 bp, Mus musculus
gggacaactgcttcggcccacaaca

SEQ ID NO: 330313 - DNA, 25 bp, Mus musculus
gggacaacttaggtgctggctacgc

SEQ ID NO: 330314 - DNA, 25 bp, Mus musculus
gggacaagaatacagggaaaatgga

SEQ ID NO: 330315 - DNA, 25 bp, Mus musculus
gggacaagaggttgcctgcaggagg

SEQ ID NO: 330316 - DNA, 25 bp, Mus musculus
gggacaaggagaagacaggagtgcg

SEQ ID NO: 330317 - DNA, 25 bp, Mus musculus
gggacaaggagacagcttggtcaca

SEQ ID NO: 330318 - DNA, 25 bp, Mus musculus
gggacaagtggctggcacccgatgg

SEQ ID NO: 330319 - DNA, 25 bp, Mus musculus
gggacaattcaggacccttttgtgg

SEQ ID NO: 330320 - DNA, 25 bp, Mus musculus
gggacaattgaacaattgcctatag

SEQ ID NO: 330321 - DNA, 25 bp, Mus musculus
gggacaattgactggctgtgttttg

SEQ ID NO: 330322 - DNA, 25 bp, Mus musculus
gggacaatttaagaccctgctcaca

SEQ ID NO: 330323 - DNA, 25 bp, Mus musculus
gggacaatttaagccacaagatccg

SEQ ID NO: 330324 - DNA, 25 bp, Mus musculus
gggacacaaacgaggtataagtatt

SEQ ID NO: 330325 - DNA, 25 bp, Mus musculus
gggacacaaggtgtcccaaatggcc

SEQ ID NO: 330326 - DNA, 25 bp, Mus musculus
gggacacacaggagagtactaaatt

SEQ ID NO: 330327 - DNA, 25 bp, Mus musculus
gggacacagagtcttcaagcagcga

SEQ ID NO: 330328 - DNA, 25 bp, Mus musculus
gggacacagcagctggaactcatta

SEQ ID NO: 330329 - DNA, 25 bp, Mus musculus
gggacacatcagggggcgtcagtca

SEQ ID NO: 330330 - DNA, 25 bp, Mus musculus
gggacacatgcagaaaagtaaagaa

SEQ ID NO: 330331 - DNA, 25 bp, Mus musculus
gggacacatgcagctggtgaatgag

SEQ ID NO: 330332 - DNA, 25 bp, Mus musculus
gggacacatgcaggcgcatacctct

SEQ ID NO: 330333 - DNA, 25 bp, Mus musculus
gggacaccgagcggagggcaagagg

SEQ ID NO: 330334 - DNA, 25 bp, Mus musculus
gggacacctgcctgcagtacaaggt

SEQ ID NO: 330335 - DNA, 25 bp, Mus musculus
gggacacctggaagctgaactccca

SEQ ID NO: 330336 - DNA, 25 bp, Mus musculus
gggacacgagggctccttcttctac

SEQ ID NO: 330337 - DNA, 25 bp, Mus musculus
gggacacggagcagcccaccttggg

SEQ ID NO: 330338 - DNA, 25 bp, Mus musculus
gggacagaacggttgatttagggga

SEQ ID NO: 330339 - DNA, 25 bp, Mus musculus
gggacagaagggtgaccagggcgag

SEQ ID NO: 330340 - DNA, 25 bp, Mus musculus
gggacagaatacatgcaagaccctg

SEQ ID NO: 330341 - DNA, 25 bp, Mus musculus
gggacagagaggcgtcccagccaag

SEQ ID NO: 330342 - DNA, 25 bp, Mus musculus
gggacagagagggtccgtcgtaacc

SEQ ID NO: 330343 - DNA, 25 bp, Mus musculus
gggacagagcagaatttgatactag

SEQ ID NO: 330344 - DNA, 25 bp, Mus musculus
gggacagagcaggggtgctcttctc

SEQ ID NO: 330345 - DNA, 25 bp, Mus musculus
gggacagagccagctgcgcaaacca

SEQ ID NO: 330346 - DNA, 25 bp, Mus musculus
gggacagataagcagcgtgcttccg

SEQ ID NO: 330347 - DNA, 25 bp, Mus musculus
gggacagatgcaaagccgccatgga

SEQ ID NO: 330348 - DNA, 25 bp, Mus musculus
gggacagattggatctggccgcccc

SEQ ID NO: 330349 - DNA, 25 bp, Mus musculus
gggacagcaaaggccgggtaggacc

SEQ ID NO: 330350 - DNA, 25 bp, Mus musculus
gggacagcaaaggttctggccgaga

SEQ ID NO: 330351 - DNA, 25 bp, Mus musculus
gggacagcagatccatgcccgcaac

SEQ ID NO: 330352 - DNA, 25 bp, Mus musculus
gggacagcaggaacgattcaatccc

SEQ ID NO: 330353 - DNA, 25 bp, Mus musculus
gggacagcaggaacgtatatgactg

SEQ ID NO: 330354 - DNA, 25 bp, Mus musculus
gggacagcagggccgcctcagtgag

SEQ ID NO: 330355 - DNA, 25 bp, Mus musculus
gggacagccagaggaacagatggag

SEQ ID NO: 330356 - DNA, 25 bp, Mus musculus
gggacagccagctgaagtgagtagt

SEQ ID NO: 330357 - DNA, 25 bp, Mus musculus
gggacagccaggtaacaatttcaag

SEQ ID NO: 330358 - DNA, 25 bp, Mus musculus
gggacagccaggtggagttgttaca

SEQ ID NO: 330359 - DNA, 25 bp, Mus musculus
gggacagccagtgagccatgaggct

SEQ ID NO: 330360 - DNA, 25 bp, Mus musculus
gggacagccagtgcgtccagttaga

SEQ ID NO: 330361 - DNA, 25 bp, Mus musculus
gggacagccagtggaggtccaggtt

SEQ ID NO: 330362 - DNA, 25 bp, Mus musculus
gggacagcctggatacaggttcact

SEQ ID NO: 330363 - DNA, 25 bp, Mus musculus
gggacagctggttccgtggcttcat

SEQ ID NO: 330364 - DNA, 25 bp, Mus musculus
gggacaggaaagaagaagacctgtc

SEQ ID NO: 330365 - DNA, 25 bp, Mus musculus
gggacaggaaagaaggtggtggaag

SEQ ID NO: 330366 - DNA, 25 bp, Mus musculus
gggacaggaacaaacattcaggcca

SEQ ID NO: 330367 - DNA, 25 bp, Mus musculus
gggacaggacctttgagcagccagg

SEQ ID NO: 330368 - DNA, 25 bp, Mus musculus
gggacaggactagagaaagtgtgca

SEQ ID NO: 330369 - DNA, 25 bp, Mus musculus
gggacaggagacaattacaatggaa

SEQ ID NO: 330370 - DNA, 25 bp, Mus musculus
gggacaggagccgtccagagatcac

SEQ ID NO: 330371 - DNA, 25 bp, Mus musculus
gggacaggaggcgtccagagatcac

SEQ ID NO: 330372 - DNA, 25 bp, Mus musculus
gggacaggaggtcagtggagctctc

SEQ ID NO: 330373 - DNA, 25 bp, Mus musculus
gggacaggagtgtctcttcttgcag

SEQ ID NO: 330374 - DNA, 25 bp, Mus musculus
gggacaggcaagcacaagctgctga

SEQ ID NO: 330375 - DNA, 25 bp, Mus musculus
gggacaggcaccttctgtatttcca

SEQ ID NO: 330376 - DNA, 25 bp, Mus musculus
gggacaggccttgccagagccatgc

SEQ ID NO: 330377 - DNA, 25 bp, Mus musculus
gggacaggctacttctgcgacagtg

SEQ ID NO: 330378 - DNA, 25 bp, Mus musculus
gggacaggctacttcttctggatct

SEQ ID NO: 330379 - DNA, 25 bp, Mus musculus
gggacagggtcagctggtcacttgc

SEQ ID NO: 330380 - DNA, 25 bp, Mus musculus
gggacagtagggaagttgccaccca

SEQ ID NO: 330381 - DNA, 25 bp, Mus musculus
gggacagtagggcagcaccagcgaa

SEQ ID NO: 330382 - DNA, 25 bp, Mus musculus
gggacagtattgaggagaaacgaaa

SEQ ID NO: 330383 - DNA, 25 bp, Mus musculus
gggacagtgaggggacgatccggag

SEQ ID NO: 330384 - DNA, 25 bp, Mus musculus
gggacagtgccaacatttaaacgag

SEQ ID NO: 330385 - DNA, 25 bp, Mus musculus
gggacagtgccaacctgtgtgtcaa

SEQ ID NO: 330386 - DNA, 25 bp, Mus musculus
gggacagtgccaacctttctacgtc

SEQ ID NO: 330387 - DNA, 25 bp, Mus musculus
gggacagtgtttggattctccagtg

SEQ ID NO: 330388 - DNA, 25 bp, Mus musculus
gggacagtgtttgggcggttcgaca

SEQ ID NO: 330389 - DNA, 25 bp, Mus musculus
gggacagttcagggagggaaggatg

SEQ ID NO: 330390 - DNA, 25 bp, Mus musculus
gggacagttgaagggccttcagtgg

SEQ ID NO: 330391 - DNA, 25 bp, Mus musculus
gggacataagttctacggccccagg

SEQ ID NO: 330392 - DNA, 25 bp, Mus musculus
gggacatcagttccagacacgaggc

SEQ ID NO: 330393 - DNA, 25 bp, Mus musculus
gggacatccgtgggctagcccatgc

SEQ ID NO: 330394 - DNA, 25 bp, Mus musculus
gggacatcgcccaggttctcggact

SEQ ID NO: 330395 - DNA, 25 bp, Mus musculus
gggacatcgggacagcataagcagt

SEQ ID NO: 330396 - DNA, 25 bp, Mus musculus
gggacatcgtcgggagcattactgt

SEQ ID NO: 330397 - DNA, 25 bp, Mus musculus
gggacatcgtcggggccagtgacta

SEQ ID NO: 330398 - DNA, 25 bp, Mus musculus
gggacatgaaggtagcatcgcctgc

SEQ ID NO: 330399 - DNA, 25 bp, Mus musculus
gggacatgaatttggacctcactga

SEQ ID NO: 330400 - DNA, 25 bp, Mus musculus
gggacatgatgtgattaagacgcta

SEQ ID NO: 330401 - DNA, 25 bp, Mus musculus
gggacatgccaggtcctacatctcc

SEQ ID NO: 330402 - DNA, 25 bp, Mus musculus
gggacatgtgtattgcaagacagat

SEQ ID NO: 330403 - DNA, 25 bp, Mus musculus
gggacatgtgtattggtgagaagcc

SEQ ID NO: 330404 - DNA, 25 bp, Mus musculus
gggacatgttcagcctggccaaact

SEQ ID NO: 330405 - DNA, 25 bp, Mus musculus
gggacatgttcaggtttggcaaaca

SEQ ID NO: 330406 - DNA, 25 bp, Mus musculus
gggacattcaggttggctcctgtcc

SEQ ID NO: 330407 - DNA, 25 bp, Mus musculus
gggacattcctggagggatcatgcc

SEQ ID NO: 330408 - DNA, 25 bp, Mus musculus
gggacattccttatcataacagaat

SEQ ID NO: 330409 - DNA, 25 bp, Mus musculus
gggacattcggacccagatgaccca

SEQ ID NO: 330410 - DNA, 25 bp, Mus musculus
gggacattgcacgtggtggtaatca

SEQ ID NO: 330411 - DNA, 25 bp, Mus musculus
gggacattgccgagcgtgagagcca

SEQ ID NO: 330412 - DNA, 25 bp, Mus musculus
gggacattgtgtggggtcaccgaca

SEQ ID NO: 330413 - DNA, 25 bp, Mus musculus
gggaccaaacggtgatggaaaacgt

SEQ ID NO: 330414 - DNA, 25 bp, Mus musculus
gggaccaaagagcagccccggactc

SEQ ID NO: 330415 - DNA, 25 bp, Mus musculus
gggaccaaagagctgcctctgttcc

SEQ ID NO: 330416 - DNA, 25 bp, Mus musculus
gggaccaaagggaagggctccacct

SEQ ID NO: 330417 - DNA, 25 bp, Mus musculus
gggaccaaccaggggccttggcctt

SEQ ID NO: 330418 - DNA, 25 bp, Mus musculus
gggaccaaccagggtcatgccattg

SEQ ID NO: 330419 - DNA, 25 bp, Mus musculus
gggaccaactcagtacctgtggcag

SEQ ID NO: 330420 - DNA, 25 bp, Mus musculus
gggaccaaggaagctcgaagcggtc

SEQ ID NO: 330421 - DNA, 25 bp, Mus musculus
gggaccaatgctcaggtctagagaa

SEQ ID NO: 330422 - DNA, 25 bp, Mus musculus
gggaccacagcctccaggatcacta

SEQ ID NO: 330423 - DNA, 25 bp, Mus musculus
gggaccactgagaggcctacgtgaa

SEQ ID NO: 330424 - DNA, 25 bp, Mus musculus
gggaccactgagcctgagcagatgg

SEQ ID NO: 330425 - DNA, 25 bp, Mus musculus
gggaccagaagacagtgatggcgac

SEQ ID NO: 330426 - DNA, 25 bp, Mus musculus
gggaccagaagacagttgccctcta

SEQ ID NO: 330427 - DNA, 25 bp, Mus musculus
gggaccagagagggtccgggccatc

SEQ ID NO: 330428 - DNA, 25 bp, Mus musculus
gggaccagctgggagagcgaggggt

SEQ ID NO: 330429 - DNA, 25 bp, Mus musculus
gggaccagctgggcccccagcatgg

SEQ ID NO: 330430 - DNA, 25 bp, Mus musculus
gggaccaggagcttttccagacctt

SEQ ID NO: 330431 - DNA, 25 bp, Mus musculus
gggaccagtgcaagacagggtctca

SEQ ID NO: 330432 - DNA, 25 bp, Mus musculus
gggaccataaagtctaaggttgtgg

SEQ ID NO: 330433 - DNA, 25 bp, Mus musculus
gggaccatagtggagggacggcttg

SEQ ID NO: 330434 - DNA, 25 bp, Mus musculus
gggaccatcacaagatctgatactc

SEQ ID NO: 330435 - DNA, 25 bp, Mus musculus
gggaccatccttaagtggccaaatg

SEQ ID NO: 330436 - DNA, 25 bp, Mus musculus
gggaccatggagaccatagtctgtg

SEQ ID NO: 330437 - DNA, 25 bp, Mus musculus
gggaccatggaggtgtgtgtacatg

SEQ ID NO: 330438 - DNA, 25 bp, Mus musculus
gggacccaaaccagggtgtggacat

SEQ ID NO: 330439 - DNA, 25 bp, Mus musculus
gggacccacatggttactgggaagt

SEQ ID NO: 330440 - DNA, 25 bp, Mus musculus
gggacccagaagatgatttttgatc

SEQ ID NO: 330441 - DNA, 25 bp, Mus musculus
gggacccagccagccccggaaagcc

SEQ ID NO: 330442 - DNA, 25 bp, Mus musculus
gggacccaggacagacagctgcagc

SEQ ID NO: 330443 - DNA, 25 bp, Mus musculus
gggacccaggcgatcaaccgagaaa

SEQ ID NO: 330444 - DNA, 25 bp, Mus musculus
gggaccccactgaggcttctcaaac

SEQ ID NO: 330445 - DNA, 25 bp, Mus musculus
gggaccccactgcactgctgttaat

SEQ ID NO: 330446 - DNA, 25 bp, Mus musculus
gggaccccgagatcgccggggctct

SEQ ID NO: 330447 - DNA, 25 bp, Mus musculus
gggaccccggattgcacaggcatgg

SEQ ID NO: 330448 - DNA, 25 bp, Mus musculus
gggacccgagatccacgtgtcggaa

SEQ ID NO: 330449 - DNA, 25 bp, Mus musculus
gggacccgagctgtgtctcttcaga

SEQ ID NO: 330450 - DNA, 25 bp, Mus musculus
gggacccgcaggtcctaatctgaag

SEQ ID NO: 330451 - DNA, 25 bp, Mus musculus
gggacccgcgaggagttggcatcca

SEQ ID NO: 330452 - DNA, 25 bp, Mus musculus
gggacccgcgaggcaagcagtctcc

SEQ ID NO: 330453 - DNA, 25 bp, Mus musculus
gggaccctagggctgtgcctggctc

SEQ ID NO: 330454 - DNA, 25 bp, Mus musculus
gggaccctaggtcagagtcttgtcc

SEQ ID NO: 330455 - DNA, 25 bp, Mus musculus
gggaccctccaaagaatcataacgg

SEQ ID NO: 330456 - DNA, 25 bp, Mus musculus
gggaccctccaaaggtcctgcttag

SEQ ID NO: 330457 - DNA, 25 bp, Mus musculus
gggacccttaagggccacaccaagg

SEQ ID NO: 330458 - DNA, 25 bp, Mus musculus
gggaccgagatgcagctgttgccgc

SEQ ID NO: 330459 - DNA, 25 bp, Mus musculus
gggaccgagcagcgaacagttgaat

SEQ ID NO: 330460 - DNA, 25 bp, Mus musculus
gggaccgagttccgggtcatgcatc

SEQ ID NO: 330461 - DNA, 25 bp, Mus musculus
gggaccgagttccgggtgctgggtg

SEQ ID NO: 330462 - DNA, 25 bp, Mus musculus
gggaccgatgaatccttcacacctg

SEQ ID NO: 330463 - DNA, 25 bp, Mus musculus
gggaccgcagattatttttaatgaa

SEQ ID NO: 330464 - DNA, 25 bp, Mus musculus
gggaccgcagggattctcctgatga

SEQ ID NO: 330465 - DNA, 25 bp, Mus musculus
gggaccgcaggtgtgggatatgggg

SEQ ID NO: 330466 - DNA, 25 bp, Mus musculus
gggaccgcagttgagtggtgatttt

SEQ ID NO: 330467 - DNA, 25 bp, Mus musculus
gggaccgcctgatccggacactggg

SEQ ID NO: 330468 - DNA, 25 bp, Mus musculus
gggaccgcctggaggaggacatctt

SEQ ID NO: 330469 - DNA, 25 bp, Mus musculus
gggaccggcagcaggagaatcctca

SEQ ID NO: 330470 - DNA, 25 bp, Mus musculus
gggaccggcagcaggagaatgccat

SEQ ID NO: 330471 - DNA, 25 bp, Mus musculus
gggaccgtaggcgctgaggcatgtg

SEQ ID NO: 330472 - DNA, 25 bp, Mus musculus
gggaccgtcctgtttggagtgctta

SEQ ID NO: 330473 - DNA, 25 bp, Mus musculus
gggaccgtggaggatgacttgatta

SEQ ID NO: 330474 - DNA, 25 bp, Mus musculus
gggaccgttggtggcatagctctaa

SEQ ID NO: 330475 - DNA, 25 bp, Mus musculus
gggacctaaaactttgcagattcct

SEQ ID NO: 330476 - DNA, 25 bp, Mus musculus
gggacctaaagcctgagaatttgct

SEQ ID NO: 330477 - DNA, 25 bp, Mus musculus
gggacctcaacagggtgagccaggt

SEQ ID NO: 330478 - DNA, 25 bp, Mus musculus
gggacctcaacagtgggcagctgat

SEQ ID NO: 330479 - DNA, 25 bp, Mus musculus
gggacctcaaggaccttggtgtgac

SEQ ID NO: 330480 - DNA, 25 bp, Mus musculus
gggacctcaggctgactgctgtcca

SEQ ID NO: 330481 - DNA, 25 bp, Mus musculus
gggacctcaggtctgttgtgggggc

SEQ ID NO: 330482 - DNA, 25 bp, Mus musculus
gggacctcatcattctctggcaggt

SEQ ID NO: 330483 - DNA, 25 bp, Mus musculus
gggacctcatctacgtgggccggaa

SEQ ID NO: 330484 - DNA, 25 bp, Mus musculus
gggacctccagactcagctggcggt

SEQ ID NO: 330485 - DNA, 25 bp, Mus musculus
gggacctccctggaggtggagcctt

SEQ ID NO: 330486 - DNA, 25 bp, Mus musculus
gggacctccgggcctagctggggaa

SEQ ID NO: 330487 - DNA, 25 bp, Mus musculus
gggacctcctgggcattgtcgccag

SEQ ID NO: 330488 - DNA, 25 bp, Mus musculus
gggacctcgagactgccactctccg

SEQ ID NO: 330489 - DNA, 25 bp, Mus musculus
gggacctcgcaagttcttccatcag

SEQ ID NO: 330490 - DNA, 25 bp, Mus musculus
gggacctcgggagagaaattttaag

SEQ ID NO: 330491 - DNA, 25 bp, Mus musculus
gggacctctgggagccagcagaggc

SEQ ID NO: 330492 - DNA, 25 bp, Mus musculus
gggacctctgggagcccacagagag

SEQ ID NO: 330493 - DNA, 25 bp, Mus musculus
gggacctgaagcctgagaatttgct

SEQ ID NO: 330494 - DNA, 25 bp, Mus musculus
gggacctgacctcaatgtctttaca

SEQ ID NO: 330495 - DNA, 25 bp, Mus musculus
gggacctgacgtgtgctgtgatcac

SEQ ID NO: 330496 - DNA, 25 bp, Mus musculus
gggacctgagggtacagtcctcagg

SEQ ID NO: 330497 - DNA, 25 bp, Mus musculus
gggacctgcactgtcacgcggtgtt

SEQ ID NO: 330498 - DNA, 25 bp, Mus musculus
gggacctgcctcgggtgagccctag

SEQ ID NO: 330499 - DNA, 25 bp, Mus musculus
gggacctggagacagccttccctcg

SEQ ID NO: 330500 - DNA, 25 bp, Mus musculus
gggacctgggtgtctcttccaagga

SEQ ID NO: 330501 - DNA, 25 bp, Mus musculus
gggacctggtacatggtggtcaacc

SEQ ID NO: 330502 - DNA, 25 bp, Mus musculus
gggacctgtaaagctcggatgccca

SEQ ID NO: 330503 - DNA, 25 bp, Mus musculus
gggacctgtaaagttgcttttagac

SEQ ID NO: 330504 - DNA, 25 bp, Mus musculus
gggaccttccaggtgacgctgactg

SEQ ID NO: 330505 - DNA, 25 bp, Mus musculus
gggacctttctaggtgactactttg

SEQ ID NO: 330506 - DNA, 25 bp, Mus musculus
gggacgaaaggagtctgagggtggc

SEQ ID NO: 330507 - DNA, 25 bp, Mus musculus
gggacgaagaagacctgtattcccc

SEQ ID NO: 330508 - DNA, 25 bp, Mus musculus
gggacgaagaagacctgtattcctc

SEQ ID NO: 330509 - DNA, 25 bp, Mus musculus
gggacgatgaggacctcgacctaga

SEQ ID NO: 330510 - DNA, 25 bp, Mus musculus
gggacgcaaaggaggaagccagcaa

SEQ ID NO: 330511 - DNA, 25 bp, Mus musculus
gggacgcaatgtgtctggaattctc

SEQ ID NO: 330512 - DNA, 25 bp, Mus musculus
gggacgcagcacgccatcaatgatg

SEQ ID NO: 330513 - DNA, 25 bp, Mus musculus
gggacgcagcacgccgtatgtgcag

SEQ ID NO: 330514 - DNA, 25 bp, Mus musculus
gggacgcgcggtgagccccaggtgt

SEQ ID NO: 330515 - DNA, 25 bp, Mus musculus
gggacgcggaaccggagctggactg

SEQ ID NO: 330516 - DNA, 25 bp, Mus musculus
gggacgcggcgatctgccaggatcc

SEQ ID NO: 330517 - DNA, 25 bp, Mus musculus
gggacgcggcgcacacagggccaga

SEQ ID NO: 330518 - DNA, 25 bp, Mus musculus
gggacgcgtccgactgaggctccac

SEQ ID NO: 330519 - DNA, 25 bp, Mus musculus
gggacgcgtccggccccagcggtgc

SEQ ID NO: 330520 - DNA, 25 bp, Mus musculus
gggacgctgacgggctgacaggcga

SEQ ID NO: 330521 - DNA, 25 bp, Mus musculus
gggacgctgacggggtggaggagct

SEQ ID NO: 330522 - DNA, 25 bp, Mus musculus
gggacgctgcgaggaagagccctgg

SEQ ID NO: 330523 - DNA, 25 bp, Mus musculus
gggacgctgtgctttcatggatcgc

SEQ ID NO: 330524 - DNA, 25 bp, Mus musculus
gggacgctgttaagagttcacatga

SEQ ID NO: 330525 - DNA, 25 bp, Mus musculus
gggacgcttggtaaagcgttcggct

SEQ ID NO: 330526 - DNA, 25 bp, Mus musculus
gggacggcagcccttggagttccac

SEQ ID NO: 330527 - DNA, 25 bp, Mus musculus
gggacggcaggtttttctcactgga

SEQ ID NO: 330528 - DNA, 25 bp, Mus musculus
gggacggcccttggtgtggacagtt

SEQ ID NO: 330529 - DNA, 25 bp, Mus musculus
gggacggtacctgcattgtgcttct

SEQ ID NO: 330530 - DNA, 25 bp, Mus musculus
gggacgtgaaggacttcaagaccga

SEQ ID NO: 330531 - DNA, 25 bp, Mus musculus
gggacgtgcagaattaccatgagat

SEQ ID NO: 330532 - DNA, 25 bp, Mus musculus
gggacgtgcagaccatcccatggct

SEQ ID NO: 330533 - DNA, 25 bp, Mus musculus
gggacgtggcgaggggatcgtggga

SEQ ID NO: 330534 - DNA, 25 bp, Mus musculus
gggacgttccggaagctgcagcttc

SEQ ID NO: 330535 - DNA, 25 bp, Mus musculus
gggacgtttcccagatctgtctcga

SEQ ID NO: 330536 - DNA, 25 bp, Mus musculus
gggactaaagagatggatgtccttt

SEQ ID NO: 330537 - DNA, 25 bp, Mus musculus
gggactaaaggggacagctgttgta

SEQ ID NO: 330538 - DNA, 25 bp, Mus musculus
gggactaacaggactccaagccccc

SEQ ID NO: 330539 - DNA, 25 bp, Mus musculus
gggactacaggcgagcggcgtgctg

SEQ ID NO: 330540 - DNA, 25 bp, Mus musculus
gggactacagggatccgtgaaccac

SEQ ID NO: 330541 - DNA, 25 bp, Mus musculus
gggactacagggtcaacgtggtgtt

SEQ ID NO: 330542 - DNA, 25 bp, Mus musculus
gggactacagtggacaaggcgttgt

SEQ ID NO: 330543 - DNA, 25 bp, Mus musculus
gggactacatattctgtcccctctg

SEQ ID NO: 330544 - DNA, 25 bp, Mus musculus
gggactacatgacattaagaacgct

SEQ ID NO: 330545 - DNA, 25 bp, Mus musculus
gggactaccaggcctgtacggagat

SEQ ID NO: 330546 - DNA, 25 bp, Mus musculus
gggactacctgtgggctctggggtg

SEQ ID NO: 330547 - DNA, 25 bp, Mus musculus
gggactagggagtgttcagtcacca

SEQ ID NO: 330548 - DNA, 25 bp, Mus musculus
gggactatctccaagcatgctggac

SEQ ID NO: 330549 - DNA, 25 bp, Mus musculus
gggactatctccaagtcggttgtgg

SEQ ID NO: 330550 - DNA, 25 bp, Mus musculus
gggactatggctagatccagactac

SEQ ID NO: 330551 - DNA, 25 bp, Mus musculus
gggactatggctagcattcaacatc

SEQ ID NO: 330552 - DNA, 25 bp, Mus musculus
gggactcaacgctgcagccccagga

SEQ ID NO: 330553 - DNA, 25 bp, Mus musculus
gggactcactttcagacatccggct

SEQ ID NO: 330554 - DNA, 25 bp, Mus musculus
gggactcagtgcaagtacagagact

SEQ ID NO: 330555 - DNA, 25 bp, Mus musculus
gggactcccagaagatagtcacatg

SEQ ID NO: 330556 - DNA, 25 bp, Mus musculus
gggactcctgagccgctctgcacag

SEQ ID NO: 330557 - DNA, 25 bp, Mus musculus
gggactccttgtgggaccgacgtct

SEQ ID NO: 330558 - DNA, 25 bp, Mus musculus
gggactcgcggagatcgtaccgaga

SEQ ID NO: 330559 - DNA, 25 bp, Mus musculus
gggactcggggctgagcagcaagtc

SEQ ID NO: 330560 - DNA, 25 bp, Mus musculus
gggactcgggggacaggcacgagga

SEQ ID NO: 330561 - DNA, 25 bp, Mus musculus
gggactctctgcgccctttgtggca

SEQ ID NO: 330562 - DNA, 25 bp, Mus musculus
gggactctgaacaaatcctgctgca

SEQ ID NO: 330563 - DNA, 25 bp, Mus musculus
gggactctgaaccagcctccagtcc

SEQ ID NO: 330564 - DNA, 25 bp, Mus musculus
gggactctgaacctggctctggtag

SEQ ID NO: 330565 - DNA, 25 bp, Mus musculus
gggactcttaaagatgagaattctc

SEQ ID NO: 330566 - DNA, 25 bp, Mus musculus
gggactcttcaagccacttagccaa

SEQ ID NO: 330567 - DNA, 25 bp, Mus musculus
gggactcttcaaggtgctggaggac

SEQ ID NO: 330568 - DNA, 25 bp, Mus musculus
gggactctttgcaggcttcctcccc

SEQ ID NO: 330569 - DNA, 25 bp, Mus musculus
gggactgaagacccctatacaacca

SEQ ID NO: 330570 - DNA, 25 bp, Mus musculus
gggactgaagactcggatgacgccc

SEQ ID NO: 330571 - DNA, 25 bp, Mus musculus
gggactgaagctgggatcaagcact

SEQ ID NO: 330572 - DNA, 25 bp, Mus musculus
gggactgaatatagtatgtgcagca

SEQ ID NO: 330573 - DNA, 25 bp, Mus musculus
gggactgagcggtcttgacgaagtg

SEQ ID NO: 330574 - DNA, 25 bp, Mus musculus
gggactgagggtggttgctgtatac

SEQ ID NO: 330575 - DNA, 25 bp, Mus musculus
gggactgatgcagggtaatcaggaa

SEQ ID NO: 330576 - DNA, 25 bp, Mus musculus
gggactgcagaatgacagatttgac

SEQ ID NO: 330577 - DNA, 25 bp, Mus musculus
gggactgcaggtgtgagagtgtcag

SEQ ID NO: 330578 - DNA, 25 bp, Mus musculus
gggactgctacgacaggtacctgtg

SEQ ID NO: 330579 - DNA, 25 bp, Mus musculus
gggactgctaggaagggacaaagga

SEQ ID NO: 330580 - DNA, 25 bp, Mus musculus
gggactgctaggcaaagaacgttct

SEQ ID NO: 330581 - DNA, 25 bp, Mus musculus
gggactggaaagatggagccagcac

SEQ ID NO: 330582 - DNA, 25 bp, Mus musculus
gggactggacagcaggtcatgttgg

SEQ ID NO: 330583 - DNA, 25 bp, Mus musculus
gggactggagccagaattcacactg

SEQ ID NO: 330584 - DNA, 25 bp, Mus musculus
gggactggagggcttcgtggcggcc

SEQ ID NO: 330585 - DNA, 25 bp, Mus musculus
gggactggagggcttctcattccta

SEQ ID NO: 330586 - DNA, 25 bp, Mus musculus
gggactggagggtgacagaagacac

SEQ ID NO: 330587 - DNA, 25 bp, Mus musculus
gggactggagtgaggaaaatggcac

SEQ ID NO: 330588 - DNA, 25 bp, Mus musculus
gggactggagtgaggagaagaaaca

SEQ ID NO: 330589 - DNA, 25 bp, Mus musculus
gggactggagtgaggtcaagggtct

SEQ ID NO: 330590 - DNA, 25 bp, Mus musculus
gggactggcaagacggcttccttgt

SEQ ID NO: 330591 - DNA, 25 bp, Mus musculus
gggactggcaggaccgtcacgacgg

SEQ ID NO: 330592 - DNA, 25 bp, Mus musculus
gggactggctagaaaatactaaagt

SEQ ID NO: 330593 - DNA, 25 bp, Mus musculus
gggactgggaagatggatgacattc

SEQ ID NO: 330594 - DNA, 25 bp, Mus musculus
gggactgggaagccagctagacatc

SEQ ID NO: 330595 - DNA, 25 bp, Mus musculus
gggactggggtactgctgcaggtcc

SEQ ID NO: 330596 - DNA, 25 bp, Mus musculus
gggactggtcctcaggcattaacaa

SEQ ID NO: 330597 - DNA, 25 bp, Mus musculus
gggactgtcggatagggacttacta

SEQ ID NO: 330598 - DNA, 25 bp, Mus musculus
gggactgtcggggtacagcatgttt

SEQ ID NO: 330599 - DNA, 25 bp, Mus musculus
gggactgtgaaacagacaagcagat

SEQ ID NO: 330600 - DNA, 25 bp, Mus musculus
gggactgtgaaacagggaagcagct

SEQ ID NO: 330601 - DNA, 25 bp, Mus musculus
gggactgtgagtgaccatgaaagat

SEQ ID NO: 330602 - DNA, 25 bp, Mus musculus
gggactgtgcaggttgaaaacgagg

SEQ ID NO: 330603 - DNA, 25 bp, Mus musculus
gggactgtgggctgggattcttcaa

SEQ ID NO: 330604 - DNA, 25 bp, Mus musculus
gggacttaatttgagcataaggaga

SEQ ID NO: 330605 - DNA, 25 bp, Mus musculus
gggacttactacagctgggcatggc

SEQ ID NO: 330606 - DNA, 25 bp, Mus musculus
gggacttactacaggtggctgcggc

SEQ ID NO: 330607 - DNA, 25 bp, Mus musculus
gggacttcaggccttctcccaactc

SEQ ID NO: 330608 - DNA, 25 bp, Mus musculus
gggacttcagggaaggacctctccg

SEQ ID NO: 330609 - DNA, 25 bp, Mus musculus
gggacttcagggaagttttgctcca

SEQ ID NO: 330610 - DNA, 25 bp, Mus musculus
gggacttcagtgaaggtaatggaaa

SEQ ID NO: 330611 - DNA, 25 bp, Mus musculus
gggacttcatgcgattgagaagatt

SEQ ID NO: 330612 - DNA, 25 bp, Mus musculus
gggacttcatgttgatcacagccga

SEQ ID NO: 330613 - DNA, 25 bp, Mus musculus
gggacttccacagccagaaaagaaa

SEQ ID NO: 330614 - DNA, 25 bp, Mus musculus
gggacttcgtgcagtgactccactg

SEQ ID NO: 330615 - DNA, 25 bp, Mus musculus
gggacttggcagctcatgctgtttc

SEQ ID NO: 330616 - DNA, 25 bp, Mus musculus
gggacttggcaggtccaacgtcgga

SEQ ID NO: 330617 - DNA, 25 bp, Mus musculus
gggacttggggacggctgttctcag

SEQ ID NO: 330618 - DNA, 25 bp, Mus musculus
gggacttgtcaggtttctaaacagc

SEQ ID NO: 330619 - DNA, 25 bp, Mus musculus
gggacttgtgccggtcctgccccct

SEQ ID NO: 330620 - DNA, 25 bp, Mus musculus
gggactttcaccagggaagacagtg

SEQ ID NO: 330621 - DNA, 25 bp, Mus musculus
gggactttcatacagcacgcatttg

SEQ ID NO: 330622 - DNA, 25 bp, Mus musculus
gggactttgagtctaacaaatgctt

SEQ ID NO: 330623 - DNA, 25 bp, Mus musculus
gggactttgccaggacctgtgtcat

SEQ ID NO: 330624 - DNA, 25 bp, Mus musculus
gggagaaaactaagatgtcaacttg

SEQ ID NO: 330625 - DNA, 25 bp, Mus musculus
gggagaaaagaacttcgcggctcag

SEQ ID NO: 330626 - DNA, 25 bp, Mus musculus
gggagaaaagcccaacaccagctac

SEQ ID NO: 330627 - DNA, 25 bp, Mus musculus
gggagaaaagctggcactcgactat

SEQ ID NO: 330628 - DNA, 25 bp, Mus musculus
gggagaaaagggtgcgcctggaccc

SEQ ID NO: 330629 - DNA, 25 bp, Mus musculus
gggagaaaatggccaccaccggcca

SEQ ID NO: 330630 - DNA, 25 bp, Mus musculus
gggagaaacagccctgacggccgct

SEQ ID NO: 330631 - DNA, 25 bp, Mus musculus
gggagaaactccagatcaccatccg

SEQ ID NO: 330632 - DNA, 25 bp, Mus musculus
gggagaaacttaaagcacatacgtg

SEQ ID NO: 330633 - DNA, 25 bp, Mus musculus
gggagaaacttaaaggggctgatcc

SEQ ID NO: 330634 - DNA, 25 bp, Mus musculus
gggagaaagaaggcatgtcatgttg

SEQ ID NO: 330635 - DNA, 25 bp, Mus musculus
gggagaaaggggcgctcctggcaat

SEQ ID NO: 330636 - DNA, 25 bp, Mus musculus
gggagaaagtgagagcaccacttca

SEQ ID NO: 330637 - DNA, 25 bp, Mus musculus
gggagaaatgcagacgtcttgtaga

SEQ ID NO: 330638 - DNA, 25 bp, Mus musculus
gggagaaatgggccagcaatgccct

SEQ ID NO: 330639 - DNA, 25 bp, Mus musculus
gggagaaatttgagagtccaattgg

SEQ ID NO: 330640 - DNA, 25 bp, Mus musculus
gggagaacagatacaaaggatgggc

SEQ ID NO: 330641 - DNA, 25 bp, Mus musculus
gggagaacccagatgagatggacca

SEQ ID NO: 330642 - DNA, 25 bp, Mus musculus
gggagaactcgcaccagggtccacg

SEQ ID NO: 330643 - DNA, 25 bp, Mus musculus
gggagaacttgggctctgctctgct

SEQ ID NO: 330644 - DNA, 25 bp, Mus musculus
gggagaagaaccatttgacattgtg

SEQ ID NO: 330645 - DNA, 25 bp, Mus musculus
gggagaagagaaggaagatccctgt

SEQ ID NO: 330646 - DNA, 25 bp, Mus musculus
gggagaagagaagggactcggccag

SEQ ID NO: 330647 - DNA, 25 bp, Mus musculus
gggagaagagacaattgggaagaag

SEQ ID NO: 330648 - DNA, 25 bp, Mus musculus
gggagaagcacctgggagagccccc

SEQ ID NO: 330649 - DNA, 25 bp, Mus musculus
gggagaagcagaccatggtgaatcc

SEQ ID NO: 330650 - DNA, 25 bp, Mus musculus
gggagaagcagcttatggcaaaccc

SEQ ID NO: 330651 - DNA, 25 bp, Mus musculus
gggagaagcagggatctgggcactg

SEQ ID NO: 330652 - DNA, 25 bp, Mus musculus
gggagaagctctatgactttgtgaa

SEQ ID NO: 330653 - DNA, 25 bp, Mus musculus
gggagaaggaacatgtttccagagt

SEQ ID NO: 330654 - DNA, 25 bp, Mus musculus
gggagaagtacaaagatgaacgaga

SEQ ID NO: 330655 - DNA, 25 bp, Mus musculus
gggagaagtgatgccttattggagg

SEQ ID NO: 330656 - DNA, 25 bp, Mus musculus
gggagaataagtgttttgcagctga

SEQ ID NO: 330657 - DNA, 25 bp, Mus musculus
gggagaatacagggattacagcaat

SEQ ID NO: 330658 - DNA, 25 bp, Mus musculus
gggagaatacagggtctgttcacta

SEQ ID NO: 330659 - DNA, 25 bp, Mus musculus
gggagaatcaggcatcgcctccatg

SEQ ID NO: 330660 - DNA, 25 bp, Mus musculus
gggagaatcggggtgcaccttcgtt

SEQ ID NO: 330661 - DNA, 25 bp, Mus musculus
gggagaatcgggttggaggggtgca

SEQ ID NO: 330662 - DNA, 25 bp, Mus musculus
gggagaatgggacaggagacaagat

SEQ ID NO: 330663 - DNA, 25 bp, Mus musculus
gggagaatgtttttcttacttatca

SEQ ID NO: 330664 - DNA, 25 bp, Mus musculus
gggagacaaggcggactatttcagc

SEQ ID NO: 330665 - DNA, 25 bp, Mus musculus
gggagacacctaaaggctccccttt

SEQ ID NO: 330666 - DNA, 25 bp, Mus musculus
gggagacactgaggctttcaggttt

SEQ ID NO: 330667 - DNA, 25 bp, Mus musculus
gggagacagaggcattcaaggttcc

SEQ ID NO: 330668 - DNA, 25 bp, Mus musculus
gggagacagaggcgatgttggcgag

SEQ ID NO: 330669 - DNA, 25 bp, Mus musculus
gggagacaggtttaggaatcactgg

SEQ ID NO: 330670 - DNA, 25 bp, Mus musculus
gggagaccaaggtgacaggaccctt

SEQ ID NO: 330671 - DNA, 25 bp, Mus musculus
gggagaccacaagccggtgttcctg

SEQ ID NO: 330672 - DNA, 25 bp, Mus musculus
gggagacccaagacgatactgtatc

SEQ ID NO: 330673 - DNA, 25 bp, Mus musculus
gggagacccaagctgtcctggaact

SEQ ID NO: 330674 - DNA, 25 bp, Mus musculus
gggagaccctggtctccctggtcct

SEQ ID NO: 330675 - DNA, 25 bp, Mus musculus
gggagaccggggaaaatgcactgat

SEQ ID NO: 330676 - DNA, 25 bp, Mus musculus
gggagaccgtgcgcgctccccaggc

SEQ ID NO: 330677 - DNA, 25 bp, Mus musculus
gggagaccttgagacagatgggagc

SEQ ID NO: 330678 - DNA, 25 bp, Mus musculus
gggagacgaaggcctggagcccagc

SEQ ID NO: 330679 - DNA, 25 bp, Mus musculus
gggagacgaagggcagaggtgacca

SEQ ID NO: 330680 - DNA, 25 bp, Mus musculus
gggagacgcacaggcatatctgctg

SEQ ID NO: 330681 - DNA, 25 bp, Mus musculus
gggagacgtggtactcagttcgtgt

SEQ ID NO: 330682 - DNA, 25 bp, Mus musculus
gggagactagcgtggcgactccatg

SEQ ID NO: 330683 - DNA, 25 bp, Mus musculus
gggagactaggtcacgagcctgggc

SEQ ID NO: 330684 - DNA, 25 bp, Mus musculus
gggagactcaagggatcctctgaag

SEQ ID NO: 330685 - DNA, 25 bp, Mus musculus
gggagactcgggggaactgatcaca

SEQ ID NO: 330686 - DNA, 25 bp, Mus musculus
gggagagaaaagaaaaaacaagaag

SEQ ID NO: 330687 - DNA, 25 bp, Mus musculus
gggagagaaaagccttaccaatagt

SEQ ID NO: 330688 - DNA, 25 bp, Mus musculus
gggagagaagatatgtagtcagaag

SEQ ID NO: 330689 - DNA, 25 bp, Mus musculus
gggagagaagggaggtgtgaactga

SEQ ID NO: 330690 - DNA, 25 bp, Mus musculus
gggagagaaggtgtcttaccactga

SEQ ID NO: 330691 - DNA, 25 bp, Mus musculus
gggagagacagctttttcctgcaat

SEQ ID NO: 330692 - DNA, 25 bp, Mus musculus
gggagagacgcaggtcatacctcac

SEQ ID NO: 330693 - DNA, 25 bp, Mus musculus
gggagagacgggtatcccaggagca

SEQ ID NO: 330694 - DNA, 25 bp, Mus musculus
gggagagactcaagggactttcggt

SEQ ID NO: 330695 - DNA, 25 bp, Mus musculus
gggagagactgatgagacatcgttc

SEQ ID NO: 330696 - DNA, 25 bp, Mus musculus
gggagagactggacctgctgggccc

SEQ ID NO: 330697 - DNA, 25 bp, Mus musculus
gggagagaggaagaactacagagaa

SEQ ID NO: 330698 - DNA, 25 bp, Mus musculus
gggagagagtgctgttctctgcagc

SEQ ID NO: 330699 - DNA, 25 bp, Mus musculus
gggagagataaattgattgagtctg

SEQ ID NO: 330700 - DNA, 25 bp, Mus musculus
gggagagcaagaggatattatcagg

SEQ ID NO: 330701 - DNA, 25 bp, Mus musculus
gggagagcaagagggtttgttcctt

SEQ ID NO: 330702 - DNA, 25 bp, Mus musculus
gggagagcaatgtcacacttggtcc

SEQ ID NO: 330703 - DNA, 25 bp, Mus musculus
gggagagcagcgggaacttcattgc

SEQ ID NO: 330704 - DNA, 25 bp, Mus musculus
gggagagcaggaggtgtaaagaaac

SEQ ID NO: 330705 - DNA, 25 bp, Mus musculus
gggagagcatcagacctttgaagac

SEQ ID NO: 330706 - DNA, 25 bp, Mus musculus
gggagagccggcagccatcatgtta

SEQ ID NO: 330707 - DNA, 25 bp, Mus musculus
gggagagccggcaggatttctccat

SEQ ID NO: 330708 - DNA, 25 bp, Mus musculus
gggagagccttttccagggctccgg

SEQ ID NO: 330709 - DNA, 25 bp, Mus musculus
gggagagcgacctgtggaggcttgg

SEQ ID NO: 330710 - DNA, 25 bp, Mus musculus
gggagagcgcatcagctgcagttaa

SEQ ID NO: 330711 - DNA, 25 bp, Mus musculus
gggagagcgtggtcactgacaatat

SEQ ID NO: 330712 - DNA, 25 bp, Mus musculus
gggagagctaaggatcaagcacttc

SEQ ID NO: 330713 - DNA, 25 bp, Mus musculus
gggagagctaggtcacttgtccaga

SEQ ID NO: 330714 - DNA, 25 bp, Mus musculus
gggagagctagttgctgcttcaagc

SEQ ID NO: 330715 - DNA, 25 bp, Mus musculus
gggagagcttacggtcattcctgat

SEQ ID NO: 330716 - DNA, 25 bp, Mus musculus
gggagaggacgcgtgagcatgccaa

SEQ ID NO: 330717 - DNA, 25 bp, Mus musculus
gggagaggagccgccgccatgtccg

SEQ ID NO: 330718 - DNA, 25 bp, Mus musculus
gggagaggagccgcctgtccacggc

SEQ ID NO: 330719 - DNA, 25 bp, Mus musculus
gggagaggagggtctggtcagctac

SEQ ID NO: 330720 - DNA, 25 bp, Mus musculus
gggagaggcaaacagtggctctgaa

SEQ ID NO: 330721 - DNA, 25 bp, Mus musculus
gggagaggcattcagtggctctgaa

SEQ ID NO: 330722 - DNA, 25 bp, Mus musculus
gggagaggccaacttatttgtccaa

SEQ ID NO: 330723 - DNA, 25 bp, Mus musculus
gggagagggggaccaagtcattgag

SEQ ID NO: 330724 - DNA, 25 bp, Mus musculus
gggagaggtcagaggatgcaaagaa

SEQ ID NO: 330725 - DNA, 25 bp, Mus musculus
gggagaggtcagaggctgtcaaaat

SEQ ID NO: 330726 - DNA, 25 bp, Mus musculus
gggagaggtcggcagacggcgatga

SEQ ID NO: 330727 - DNA, 25 bp, Mus musculus
gggagaggtgacacgtttcatcact

SEQ ID NO: 330728 - DNA, 25 bp, Mus musculus
gggagagtaactagctttgcatcat

SEQ ID NO: 330729 - DNA, 25 bp, Mus musculus
gggagagtgaggctcaggccagcac

SEQ ID NO: 330730 - DNA, 25 bp, Mus musculus
gggagatacagggcatggatgggca

SEQ ID NO: 330731 - DNA, 25 bp, Mus musculus
gggagatacttgatccttcttacca

SEQ ID NO: 330732 - DNA, 25 bp, Mus musculus
gggagatattggcaaaatatccaga

SEQ ID NO: 330733 - DNA, 25 bp, Mus musculus
gggagatcacctcagtggctctgga

SEQ ID NO: 330734 - DNA, 25 bp, Mus musculus
gggagatcattgcagatgttcgagc

SEQ ID NO: 330735 - DNA, 25 bp, Mus musculus
gggagatcccccaagagcaagagaa

SEQ ID NO: 330736 - DNA, 25 bp, Mus musculus
gggagatcccccaaggaagctcttt

SEQ ID NO: 330737 - DNA, 25 bp, Mus musculus
gggagatcctccgacagttcaacca

SEQ ID NO: 330738 - DNA, 25 bp, Mus musculus
gggagatcctccgacagttcagtca

SEQ ID NO: 330739 - DNA, 25 bp, Mus musculus
gggagatcgagcaggtgaatgagcg

SEQ ID NO: 330740 - DNA, 25 bp, Mus musculus
gggagatcgagcaggttcctcatga

SEQ ID NO: 330741 - DNA, 25 bp, Mus musculus
gggagatcggctttgaattcatgag

SEQ ID NO: 330742 - DNA, 25 bp, Mus musculus
gggagatcttgacatcactgactga

SEQ ID NO: 330743 - DNA, 25 bp, Mus musculus
gggagatcttggtgatccgcagggg

SEQ ID NO: 330744 - DNA, 25 bp, Mus musculus
gggagatgaagatggagttttccct

SEQ ID NO: 330745 - DNA, 25 bp, Mus musculus
gggagatgaagcgggagatcgttgg

SEQ ID NO: 330746 - DNA, 25 bp, Mus musculus
gggagatgacggcagaggagaggtc

SEQ ID NO: 330747 - DNA, 25 bp, Mus musculus
gggagatgagaaattatgcttcagc

SEQ ID NO: 330748 - DNA, 25 bp, Mus musculus
gggagatgagacgtgacttgtagct

SEQ ID NO: 330749 - DNA, 25 bp, Mus musculus
gggagatgcacaaggccacagatga

SEQ ID NO: 330750 - DNA, 25 bp, Mus musculus
gggagatgcacaagttcatattctc

SEQ ID NO: 330751 - DNA, 25 bp, Mus musculus
gggagatgtgagggatctaccaagg

SEQ ID NO: 330752 - DNA, 25 bp, Mus musculus
gggagatgtgcagaggtccctgctg

SEQ ID NO: 330753 - DNA, 25 bp, Mus musculus
gggagattggaggggactccttttc

SEQ ID NO: 330754 - DNA, 25 bp, Mus musculus
gggagcaaggaggctcatctgcggt

SEQ ID NO: 330755 - DNA, 25 bp, Mus musculus
gggagcacagaacctttgacatgga

SEQ ID NO: 330756 - DNA, 25 bp, Mus musculus
gggagcacagaggggaaggcccacc

SEQ ID NO: 330757 - DNA, 25 bp, Mus musculus
gggagcacagctcatcctgtgctga

SEQ ID NO: 330758 - DNA, 25 bp, Mus musculus
gggagcacagtgtgcagcttgcagg

SEQ ID NO: 330759 - DNA, 25 bp, Mus musculus
gggagcacatcgactccagcaccca

SEQ ID NO: 330760 - DNA, 25 bp, Mus musculus
gggagcacgagggttttttgcattg

SEQ ID NO: 330761 - DNA, 25 bp, Mus musculus
gggagcactaccaggaagacatggg

SEQ ID NO: 330762 - DNA, 25 bp, Mus musculus
gggagcactggactccttcagtgcg

SEQ ID NO: 330763 - DNA, 25 bp, Mus musculus
gggagcactggccctgctccctggg

SEQ ID NO: 330764 - DNA, 25 bp, Mus musculus
gggagcactggctcacccatgacat

SEQ ID NO: 330765 - DNA, 25 bp, Mus musculus
gggagcagaccaggtgactggttat

SEQ ID NO: 330766 - DNA, 25 bp, Mus musculus
gggagcagaccagtaggggcaagcg

SEQ ID NO: 330767 - DNA, 25 bp, Mus musculus
gggagcagagaggagcttggctttg

SEQ ID NO: 330768 - DNA, 25 bp, Mus musculus
gggagcagaggtggagcgaccctgt

SEQ ID NO: 330769 - DNA, 25 bp, Mus musculus
gggagcagagtacaggtggagtttc

SEQ ID NO: 330770 - DNA, 25 bp, Mus musculus
gggagcagcatgggatcccggagaa

SEQ ID NO: 330771 - DNA, 25 bp, Mus musculus
gggagcagcccaaggaggctccgcc

SEQ ID NO: 330772 - DNA, 25 bp, Mus musculus
gggagcagctgttgctttcccctgt

SEQ ID NO: 330773 - DNA, 25 bp, Mus musculus
gggagcaggaacagggtcaagtcct

SEQ ID NO: 330774 - DNA, 25 bp, Mus musculus
gggagcaggaacagggtttaatgtg

SEQ ID NO: 330775 - DNA, 25 bp, Mus musculus
gggagcaggaattaccttgcatttt

SEQ ID NO: 330776 - DNA, 25 bp, Mus musculus
gggagcaggaggagccaagcaataa

SEQ ID NO: 330777 - DNA, 25 bp, Mus musculus
gggagcaggaggagccaggagcagc

SEQ ID NO: 330778 - DNA, 25 bp, Mus musculus
gggagcaggtaagcagctgctccct

SEQ ID NO: 330779 - DNA, 25 bp, Mus musculus
gggagcatcaaaaccctactgaaac

SEQ ID NO: 330780 - DNA, 25 bp, Mus musculus
gggagcatcaagaagtcatgctctt

SEQ ID NO: 330781 - DNA, 25 bp, Mus musculus
gggagcatgagcaggctactgccct

SEQ ID NO: 330782 - DNA, 25 bp, Mus musculus
gggagcatgtgtggctgacctgatc

SEQ ID NO: 330783 - DNA, 25 bp, Mus musculus
gggagccactctcagagttttgtac

SEQ ID NO: 330784 - DNA, 25 bp, Mus musculus
gggagccagcttggtctgacagaag

SEQ ID NO: 330785 - DNA, 25 bp, Mus musculus
gggagcccagaaccaaggcaagaag

SEQ ID NO: 330786 - DNA, 25 bp, Mus musculus
gggagcccaggcctccagatctatc

SEQ ID NO: 330787 - DNA, 25 bp, Mus musculus
gggagccccggtacatggagcttgt

SEQ ID NO: 330788 - DNA, 25 bp, Mus musculus
gggagcccgcgaagctctcggagac

SEQ ID NO: 330789 - DNA, 25 bp, Mus musculus
gggagccctggaggagtctcagcta

SEQ ID NO: 330790 - DNA, 25 bp, Mus musculus
gggagccctggaggattaccaggca

SEQ ID NO: 330791 - DNA, 25 bp, Mus musculus
gggagccgagcactccgccagagtg

SEQ ID NO: 330792 - DNA, 25 bp, Mus musculus
gggagccgagcccggtccccagcca

SEQ ID NO: 330793 - DNA, 25 bp, Mus musculus
gggagccgagcccgtaggtgagcct

SEQ ID NO: 330794 - DNA, 25 bp, Mus musculus
gggagccgcacgtgtcctgggtcat

SEQ ID NO: 330795 - DNA, 25 bp, Mus musculus
gggagccgcagggtagaggcagtca

SEQ ID NO: 330796 - DNA, 25 bp, Mus musculus
gggagccggctgatctggaccccga

SEQ ID NO: 330797 - DNA, 25 bp, Mus musculus
gggagccggctgatgccaagacgga

SEQ ID NO: 330798 - DNA, 25 bp, Mus musculus
gggagccgggagccccgatgaccga

SEQ ID NO: 330799 - DNA, 25 bp, Mus musculus
gggagccgggaggctacagactaca

SEQ ID NO: 330800 - DNA, 25 bp, Mus musculus
gggagccgtgcaggcagcggctgcg

SEQ ID NO: 330801 - DNA, 25 bp, Mus musculus
gggagccgtgcagggttcactatcg

SEQ ID NO: 330802 - DNA, 25 bp, Mus musculus
gggagcctagacctgacgggacatc

SEQ ID NO: 330803 - DNA, 25 bp, Mus musculus
gggagcctagacctgtcagaggcct

SEQ ID NO: 330804 - DNA, 25 bp, Mus musculus
gggagcctgaaaaatacattgccct

SEQ ID NO: 330805 - DNA, 25 bp, Mus musculus
gggagcctgcccaagtcttcaactg

SEQ ID NO: 330806 - DNA, 25 bp, Mus musculus
gggagcctgtggcctaaatgtagaa

SEQ ID NO: 330807 - DNA, 25 bp, Mus musculus
gggagcgacgatgtcaacctacaag

SEQ ID NO: 330808 - DNA, 25 bp, Mus musculus
gggagcgagccgagctgtcacgacc

SEQ ID NO: 330809 - DNA, 25 bp, Mus musculus
gggagcgcacctgaggggaagattg

SEQ ID NO: 330810 - DNA, 25 bp, Mus musculus
gggagcgcacctggtgattttaccc

SEQ ID NO: 330811 - DNA, 25 bp, Mus musculus
gggagcgcagcaaggtgtatgatga

SEQ ID NO: 330812 - DNA, 25 bp, Mus musculus
gggagcgcatcaagacccttcgcag

SEQ ID NO: 330813 - DNA, 25 bp, Mus musculus
gggagcgcatcaaggagctggagtc

SEQ ID NO: 330814 - DNA, 25 bp, Mus musculus
gggagcgcatcaaggggatatctag

SEQ ID NO: 330815 - DNA, 25 bp, Mus musculus
gggagcgcggcagtggagctggcct

SEQ ID NO: 330816 - DNA, 25 bp, Mus musculus
gggagcgcgtctcagggaactgagc

SEQ ID NO: 330817 - DNA, 25 bp, Mus musculus
gggagcgctgatcatggctccttgg

SEQ ID NO: 330818 - DNA, 25 bp, Mus musculus
gggagcgctgggcagggagatctga

SEQ ID NO: 330819 - DNA, 25 bp, Mus musculus
gggagcggagagcgacatgtccttc

SEQ ID NO: 330820 - DNA, 25 bp, Mus musculus
gggagcggagccagcaagccccgcc

SEQ ID NO: 330821 - DNA, 25 bp, Mus musculus
gggagcggccagagtatggcttcca

SEQ ID NO: 330822 - DNA, 25 bp, Mus musculus
gggagcggccaggtgtaagagtgtt

SEQ ID NO: 330823 - DNA, 25 bp, Mus musculus
gggagcggcgctcagagatggagag

SEQ ID NO: 330824 - DNA, 25 bp, Mus musculus
gggagcggcggtggtgtgccaagtg

SEQ ID NO: 330825 - DNA, 25 bp, Mus musculus
gggagcggcggtgtgatccattgta

SEQ ID NO: 330826 - DNA, 25 bp, Mus musculus
gggagcgggggcgcggtctggaagc

SEQ ID NO: 330827 - DNA, 25 bp, Mus musculus
gggagcgtcaggtcttgagagagct

SEQ ID NO: 330828 - DNA, 25 bp, Mus musculus
gggagcgtccatctgaagaaaaaga

SEQ ID NO: 330829 - DNA, 25 bp, Mus musculus
gggagcgtccatctgacaatggatt

SEQ ID NO: 330830 - DNA, 25 bp, Mus musculus
gggagcgtccatctgcaaggaccat

SEQ ID NO: 330831 - DNA, 25 bp, Mus musculus
gggagctaagaataatagggcccag

SEQ ID NO: 330832 - DNA, 25 bp, Mus musculus
gggagctacggctgggttacccagt

SEQ ID NO: 330833 - DNA, 25 bp, Mus musculus
gggagctagatgaggttgatatgtc

SEQ ID NO: 330834 - DNA, 25 bp, Mus musculus
gggagctagtgaaactgacgtctat

SEQ ID NO: 330835 - DNA, 25 bp, Mus musculus
gggagctagtggcccacgcttgtgt

SEQ ID NO: 330836 - DNA, 25 bp, Mus musculus
gggagctagtggtttaggtaatagc

SEQ ID NO: 330837 - DNA, 25 bp, Mus musculus
gggagctctcgaagtgccctggagg

SEQ ID NO: 330838 - DNA, 25 bp, Mus musculus
gggagctctcggtctcaactcatac

SEQ ID NO: 330839 - DNA, 25 bp, Mus musculus
gggagctctggatgctgaatgctcc

SEQ ID NO: 330840 - DNA, 25 bp, Mus musculus
gggagctctgggaattaacaagctg

SEQ ID NO: 330841 - DNA, 25 bp, Mus musculus
gggagctcttggagatttttgcagc

SEQ ID NO: 330842 - DNA, 25 bp, Mus musculus
gggagctgacagagcttttcttcat

SEQ ID NO: 330843 - DNA, 25 bp, Mus musculus
gggagctgctagccattctctgagg

SEQ ID NO: 330844 - DNA, 25 bp, Mus musculus
gggagctgctagcccttctctgagg

SEQ ID NO: 330845 - DNA, 25 bp, Mus musculus
gggagctgctgacaggccgggtgac

SEQ ID NO: 330846 - DNA, 25 bp, Mus musculus
gggagctgctgttgctttcccctgt

SEQ ID NO: 330847 - DNA, 25 bp, Mus musculus
gggagctgcttccctctttccatga

SEQ ID NO: 330848 - DNA, 25 bp, Mus musculus
gggagctggaggggaacctgatttg

SEQ ID NO: 330849 - DNA, 25 bp, Mus musculus
gggagctggctggaggcactttccc

SEQ ID NO: 330850 - DNA, 25 bp, Mus musculus
gggagctgggttcgctcccagcaat

SEQ ID NO: 330851 - DNA, 25 bp, Mus musculus
gggagctgggttcggtcccagcaat

SEQ ID NO: 330852 - DNA, 25 bp, Mus musculus
gggagctggtcacaggagtcctttg

SEQ ID NO: 330853 - DNA, 25 bp, Mus musculus
gggagctgtggccatgttcatagac

SEQ ID NO: 330854 - DNA, 25 bp, Mus musculus
gggagctgtgtacatgtcaatgagt

SEQ ID NO: 330855 - DNA, 25 bp, Mus musculus
gggagctgtgtagatgtcaatgagt

SEQ ID NO: 330856 - DNA, 25 bp, Mus musculus
gggagctgttgtgatctcagttcac

SEQ ID NO: 330857 - DNA, 25 bp, Mus musculus
gggagcttcagcaggcatccatcct

SEQ ID NO: 330858 - DNA, 25 bp, Mus musculus
gggagcttgtgcagccacgacccac

SEQ ID NO: 330859 - DNA, 25 bp, Mus musculus
gggagcttgtgcaggtgacagcagc

SEQ ID NO: 330860 - DNA, 25 bp, Mus musculus
gggagctttcccatcagaaaccaac

SEQ ID NO: 330861 - DNA, 25 bp, Mus musculus
gggagctttgaacatgggaaacctg

SEQ ID NO: 330862 - DNA, 25 bp, Mus musculus
gggagctttgaagatgggaaacctg

SEQ ID NO: 330863 - DNA, 25 bp, Mus musculus
gggagctttgaggacctcatggaac

SEQ ID NO: 330864 - DNA, 25 bp, Mus musculus
gggagcttttcagcacctttgggga

SEQ ID NO: 330865 - DNA, 25 bp, Mus musculus
gggaggaaatggaggcaagaagaca

SEQ ID NO: 330866 - DNA, 25 bp, Mus musculus
gggaggaagctgtccatggctgggg

SEQ ID NO: 330867 - DNA, 25 bp, Mus musculus
gggaggaccagcatttaagaagacc

SEQ ID NO: 330868 - DNA, 25 bp, Mus musculus
gggaggaccaggagggcactccttg

SEQ ID NO: 330869 - DNA, 25 bp, Mus musculus
gggaggactgtcctttcccatggcc

SEQ ID NO: 330870 - DNA, 25 bp, Mus musculus
gggaggagaagcagagcggaattcc

SEQ ID NO: 330871 - DNA, 25 bp, Mus musculus
gggaggagaaggtcctgttgagtca

SEQ ID NO: 330872 - DNA, 25 bp, Mus musculus
gggaggagacagacaccatccaaca

SEQ ID NO: 330873 - DNA, 25 bp, Mus musculus
gggaggagacggtggtgaccatgaa

SEQ ID NO: 330874 - DNA, 25 bp, Mus musculus
gggaggagagaaggaagaattctgt

SEQ ID NO: 330875 - DNA, 25 bp, Mus musculus
gggaggagagctgaggcacctccaa

SEQ ID NO: 330876 - DNA, 25 bp, Mus musculus
gggaggagatattggtccttcattc

SEQ ID NO: 330877 - DNA, 25 bp, Mus musculus
gggaggagcagatattcagtgaact

SEQ ID NO: 330878 - DNA, 25 bp, Mus musculus
gggaggagctgggctttgactacgg

SEQ ID NO: 330879 - DNA, 25 bp, Mus musculus
gggaggaggaacgctatcaagcaga

SEQ ID NO: 330880 - DNA, 25 bp, Mus musculus
gggaggaggaagaggctcacgaggc

SEQ ID NO: 330881 - DNA, 25 bp, Mus musculus
gggaggaggagacagatgtgaggtg

SEQ ID NO: 330882 - DNA, 25 bp, Mus musculus
gggaggaggagacaggaaggcgtag

SEQ ID NO: 330883 - DNA, 25 bp, Mus musculus
gggaggagggagatggaaaagacat

SEQ ID NO: 330884 - DNA, 25 bp, Mus musculus
gggaggatcagacactgacaaagca

SEQ ID NO: 330885 - DNA, 25 bp, Mus musculus
gggaggatcagacactggcactggt

SEQ ID NO: 330886 - DNA, 25 bp, Mus musculus
gggaggatggcagctcagctgttct

SEQ ID NO: 330887 - DNA, 25 bp, Mus musculus
gggaggatggcagggccaggttgct

SEQ ID NO: 330888 - DNA, 25 bp, Mus musculus
gggaggatggctgatcatatgatgt

SEQ ID NO: 330889 - DNA, 25 bp, Mus musculus
gggaggatgggaaaacctggagagc

SEQ ID NO: 330890 - DNA, 25 bp, Mus musculus
gggaggcaaagccggctccagccac

SEQ ID NO: 330891 - DNA, 25 bp, Mus musculus
gggaggcacagaaccaaaggacaca

SEQ ID NO: 330892 - DNA, 25 bp, Mus musculus
gggaggcagcgcaactacagggctg

SEQ ID NO: 330893 - DNA, 25 bp, Mus musculus
gggaggcagcgcaactgctgcaggc

SEQ ID NO: 330894 - DNA, 25 bp, Mus musculus
gggaggcaggctgccccagcagttg

SEQ ID NO: 330895 - DNA, 25 bp, Mus musculus
gggaggcagtaaattacagagaagc

SEQ ID NO: 330896 - DNA, 25 bp, Mus musculus
gggaggcagtgttcagggaggttac

SEQ ID NO: 330897 - DNA, 25 bp, Mus musculus
gggaggcatagctggtctgaagagc

SEQ ID NO: 330898 - DNA, 25 bp, Mus musculus
gggaggccaaccgctatggattaca

SEQ ID NO: 330899 - DNA, 25 bp, Mus musculus
gggaggccaggattgataagtatct

SEQ ID NO: 330900 - DNA, 25 bp, Mus musculus
gggaggccaggctttttgatcacgt

SEQ ID NO: 330901 - DNA, 25 bp, Mus musculus
gggaggccaggtgagaaatgtctca

SEQ ID NO: 330902 - DNA, 25 bp, Mus musculus
gggaggccagtggtgagaaaccctt

SEQ ID NO: 330903 - DNA, 25 bp, Mus musculus
gggaggccagttcctgagggcagtg

SEQ ID NO: 330904 - DNA, 25 bp, Mus musculus
gggaggcgaagactcatgaaatggc

SEQ ID NO: 330905 - DNA, 25 bp, Mus musculus
gggaggcgagagttccagaaaccac

SEQ ID NO: 330906 - DNA, 25 bp, Mus musculus
gggaggcggaagagcatctgatacg

SEQ ID NO: 330907 - DNA, 25 bp, Mus musculus
gggaggcggaagaggtcaggacccc

SEQ ID NO: 330908 - DNA, 25 bp, Mus musculus
gggaggctaaggggaggcccagcct

SEQ ID NO: 330909 - DNA, 25 bp, Mus musculus
gggaggctatggtcgtggtggtgga

SEQ ID NO: 330910 - DNA, 25 bp, Mus musculus
gggaggctcaagcactgctacagga

SEQ ID NO: 330911 - DNA, 25 bp, Mus musculus
gggaggctcgatgaaaaacacaaaa

SEQ ID NO: 330912 - DNA, 25 bp, Mus musculus
gggaggctcgatggagaattttggt

SEQ ID NO: 330913 - DNA, 25 bp, Mus musculus
gggaggctttggaggtagaggaggc

SEQ ID NO: 330914 - DNA, 25 bp, Mus musculus
gggagggaagtctggaagaccacca

SEQ ID NO: 330915 - DNA, 25 bp, Mus musculus
gggagggaccagtgacacaggaaca

SEQ ID NO: 330916 - DNA, 25 bp, Mus musculus
gggagggacggcagcccttggagtt

SEQ ID NO: 330917 - DNA, 25 bp, Mus musculus
gggagggacggcaggtttttctcac

SEQ ID NO: 330918 - DNA, 25 bp, Mus musculus
gggagggacggtattcaggctgtga

SEQ ID NO: 330919 - DNA, 25 bp, Mus musculus
gggagggagccagcctggaggccgg

SEQ ID NO: 330920 - DNA, 25 bp, Mus musculus
gggagggaggaagatttgctcccag

SEQ ID NO: 330921 - DNA, 25 bp, Mus musculus
gggagggagtgctacctgggaagat

SEQ ID NO: 330922 - DNA, 25 bp, Mus musculus
gggagggcaccaggtcactacttca

SEQ ID NO: 330923 - DNA, 25 bp, Mus musculus
gggagggcgaggtgctcctaatggc

SEQ ID NO: 330924 - DNA, 25 bp, Mus musculus
gggagggctgggcctgcagccggga

SEQ ID NO: 330925 - DNA, 25 bp, Mus musculus
gggaggggatatggcatccagccag

SEQ ID NO: 330926 - DNA, 25 bp, Mus musculus
gggaggggcaaaggagcatggcttg

SEQ ID NO: 330927 - DNA, 25 bp, Mus musculus
gggagggggcaaggctctgctcccc

SEQ ID NO: 330928 - DNA, 25 bp, Mus musculus
gggaggggttatctggccgttcctc

SEQ ID NO: 330929 - DNA, 25 bp, Mus musculus
gggagggtccgggttgtggatcatt

SEQ ID NO: 330930 - DNA, 25 bp, Mus musculus
gggaggtaaagacagagctctgaaa

SEQ ID NO: 330931 - DNA, 25 bp, Mus musculus
gggaggtaaagacagtggattttgc

SEQ ID NO: 330932 - DNA, 25 bp, Mus musculus
gggaggtaagcgaagagaggaagcg

SEQ ID NO: 330933 - DNA, 25 bp, Mus musculus
gggaggtcagatgtctctcttaaat

SEQ ID NO: 330934 - DNA, 25 bp, Mus musculus
gggaggtccccaagagtgggccaag

SEQ ID NO: 330935 - DNA, 25 bp, Mus musculus
gggaggtccccaaggtatttctctg

SEQ ID NO: 330936 - DNA, 25 bp, Mus musculus
gggaggtccggatgctgttgacgga

SEQ ID NO: 330937 - DNA, 25 bp, Mus musculus
gggaggtgaactcagacaaggtctg

SEQ ID NO: 330938 - DNA, 25 bp, Mus musculus
gggaggtgaactcaggttcttgcta

SEQ ID NO: 330939 - DNA, 25 bp, Mus musculus
gggaggtgaagcccctccaggccgg

SEQ ID NO: 330940 - DNA, 25 bp, Mus musculus
gggaggtgaggaggaagaagtgcta

SEQ ID NO: 330941 - DNA, 25 bp, Mus musculus
gggaggttccagatcacacaagagt

SEQ ID NO: 330942 - DNA, 25 bp, Mus musculus
gggaggttccaggtgtgtgtgacgg

SEQ ID NO: 330943 - DNA, 25 bp, Mus musculus
gggaggttctgcagaccatgccgtc

SEQ ID NO: 330944 - DNA, 25 bp, Mus musculus
gggaggttgtggtgggacaaccctc

SEQ ID NO: 330945 - DNA, 25 bp, Mus musculus
gggagtaaagacctgttgtactgga

SEQ ID NO: 330946 - DNA, 25 bp, Mus musculus
gggagtaaaggaaacagacagctga

SEQ ID NO: 330947 - DNA, 25 bp, Mus musculus
gggagtaaaggcagtctaaagtcat

SEQ ID NO: 330948 - DNA, 25 bp, Mus musculus
gggagtaaagggacatctctacact

SEQ ID NO: 330949 - DNA, 25 bp, Mus musculus
gggagtaaagtggcagacctgttgt

SEQ ID NO: 330950 - DNA, 25 bp, Mus musculus
gggagtaaatatttctaccattttc

SEQ ID NO: 330951 - DNA, 25 bp, Mus musculus
gggagtaaattagcatatgtatatc

SEQ ID NO: 330952 - DNA, 25 bp, Mus musculus
gggagtaagtcgaatctacaaaatg

SEQ ID NO: 330953 - DNA, 25 bp, Mus musculus
gggagtaatgcctggcacttctgtg

SEQ ID NO: 330954 - DNA, 25 bp, Mus musculus
gggagtacagaggtgcaggtcctgc

SEQ ID NO: 330955 - DNA, 25 bp, Mus musculus
gggagtacagctgactcaagagact

SEQ ID NO: 330956 - DNA, 25 bp, Mus musculus
gggagtacgaatttcagcgaggaga

SEQ ID NO: 330957 - DNA, 25 bp, Mus musculus
gggagtactttggtcggtgtggtgg

SEQ ID NO: 330958 - DNA, 25 bp, Mus musculus
gggagtagaggaacattgaccatgt

SEQ ID NO: 330959 - DNA, 25 bp, Mus musculus
gggagtattacaagcatccgatatc

SEQ ID NO: 330960 - DNA, 25 bp, Mus musculus
gggagtcaaagggctaacagaacaa

SEQ ID NO: 330961 - DNA, 25 bp, Mus musculus
gggagtcaccacggttcatggaaac

SEQ ID NO: 330962 - DNA, 25 bp, Mus musculus
gggagtcagagtcatgtatcgagtg

SEQ ID NO: 330963 - DNA, 25 bp, Mus musculus
gggagtcagcaccagctcgcagtgg

SEQ ID NO: 330964 - DNA, 25 bp, Mus musculus
gggagtcagcaccagggattctggg

SEQ ID NO: 330965 - DNA, 25 bp, Mus musculus
gggagtccctagaggtgttggtgga

SEQ ID NO: 330966 - DNA, 25 bp, Mus musculus
gggagtccctgtgcgatgactgtaa

SEQ ID NO: 330967 - DNA, 25 bp, Mus musculus
gggagtccctgtgtgacctcttggt

SEQ ID NO: 330968 - DNA, 25 bp, Mus musculus
gggagtcgagagactgaccaaccac

SEQ ID NO: 330969 - DNA, 25 bp, Mus musculus
gggagtcgagttctaaaacaacaag

SEQ ID NO: 330970 - DNA, 25 bp, Mus musculus
gggagtctcagatgaaagaaacaat

SEQ ID NO: 330971 - DNA, 25 bp, Mus musculus
gggagtctcttgtacagaggagaag

SEQ ID NO: 330972 - DNA, 25 bp, Mus musculus
gggagtgaacggtctcaggagctcc

SEQ ID NO: 330973 - DNA, 25 bp, Mus musculus
gggagtgaagaaatcttccatccta

SEQ ID NO: 330974 - DNA, 25 bp, Mus musculus
gggagtgacatatgcccccaaggtc

SEQ ID NO: 330975 - DNA, 25 bp, Mus musculus
gggagtgacgtttgagtacagtgat

SEQ ID NO: 330976 - DNA, 25 bp, Mus musculus
gggagtgaggggagctaccgtcatc

SEQ ID NO: 330977 - DNA, 25 bp, Mus musculus
gggagtgagtcaggaacaaagtatt

SEQ ID NO: 330978 - DNA, 25 bp, Mus musculus
gggagtgcagattgaaaaatgcaga

SEQ ID NO: 330979 - DNA, 25 bp, Mus musculus
gggagtgcgagacaaagctggctgc

SEQ ID NO: 330980 - DNA, 25 bp, Mus musculus
gggagtgcgggaacagaactcaaac

SEQ ID NO: 330981 - DNA, 25 bp, Mus musculus
gggagtgggagattactacaaggga

SEQ ID NO: 330982 - DNA, 25 bp, Mus musculus
gggagtgggaggtagtgtcggtggc

SEQ ID NO: 330983 - DNA, 25 bp, Mus musculus
gggagtggtgggttcgagtgacggt

SEQ ID NO: 330984 - DNA, 25 bp, Mus musculus
gggagtgtctggcaccgtggacttg

SEQ ID NO: 330985 - DNA, 25 bp, Mus musculus
gggagtgtgacagtgattggaagtg

SEQ ID NO: 330986 - DNA, 25 bp, Mus musculus
gggagtgtgagcctatccgcctccg

SEQ ID NO: 330987 - DNA, 25 bp, Mus musculus
gggagtgtgttgatgtgaacgagtg

SEQ ID NO: 330988 - DNA, 25 bp, Mus musculus
gggagtgtgttgttgtgaacgagtg

SEQ ID NO: 330989 - DNA, 25 bp, Mus musculus
gggagttaagagaggtaatagaatt

SEQ ID NO: 330990 - DNA, 25 bp, Mus musculus
gggagttaatgaggggtattcagag

SEQ ID NO: 330991 - DNA, 25 bp, Mus musculus
gggagttcatgcactttgccacagg

SEQ ID NO: 330992 - DNA, 25 bp, Mus musculus
gggagttcgctatctgcaggtgtct

SEQ ID NO: 330993 - DNA, 25 bp, Mus musculus
gggagttgaggcctgggtgtgcatt

SEQ ID NO: 330994 - DNA, 25 bp, Mus musculus
gggagttggtaaatgtttatggagc

SEQ ID NO: 330995 - DNA, 25 bp, Mus musculus
gggagtttacagagaggaccatctg

SEQ ID NO: 330996 - DNA, 25 bp, Mus musculus
gggagtttgagatcccactgagatg

SEQ ID NO: 330997 - DNA, 25 bp, Mus musculus
gggagtttgaggaattagaaagtaa

SEQ ID NO: 330998 - DNA, 25 bp, Mus musculus
gggagtttttcacagatcactggtg

SEQ ID NO: 330999 - DNA, 25 bp, Mus musculus
gggataaaaagaatgctgccaagaa

SEQ ID NO: 331000 - DNA, 25 bp, Mus musculus
gggataaagtgtactggaattaatt

SEQ ID NO: 331001 - DNA, 25 bp, Mus musculus
gggataacaacgtctatttttattc

SEQ ID NO: 331002 - DNA, 25 bp, Mus musculus
gggataacagttcccaaagtggctg

SEQ ID NO: 331003 - DNA, 25 bp, Mus musculus
gggataactgggaggatgagcccca

SEQ ID NO: 331004 - DNA, 25 bp, Mus musculus
gggataagattgagaacctagctag

SEQ ID NO: 331005 - DNA, 25 bp, Mus musculus
gggataataaagaagaagtaccagc

SEQ ID NO: 331006 - DNA, 25 bp, Mus musculus
gggataataaagatatccaattgtc

SEQ ID NO: 331007 - DNA, 25 bp, Mus musculus
gggataatccacagctacacacttg

SEQ ID NO: 331008 - DNA, 25 bp, Mus musculus
gggataatgcactttgtggagaagt

SEQ ID NO: 331009 - DNA, 25 bp, Mus musculus
gggataattggcctgtggaagcagg

SEQ ID NO: 331010 - DNA, 25 bp, Mus musculus
gggataattgggtctggcaacttgg

SEQ ID NO: 331011 - DNA, 25 bp, Mus musculus
gggatacacagagaacaaaggctcc

SEQ ID NO: 331012 - DNA, 25 bp, Mus musculus
gggatacacagagaagtatagaaga

SEQ ID NO: 331013 - DNA, 25 bp, Mus musculus
gggatacacgggacctcactgcgct

SEQ ID NO: 331014 - DNA, 25 bp, Mus musculus
gggatacgaacgtggatgaggctgt

SEQ ID NO: 331015 - DNA, 25 bp, Mus musculus
gggatagaagggcttcttggtaatg

SEQ ID NO: 331016 - DNA, 25 bp, Mus musculus
gggatagagccagcacgcatttgat

SEQ ID NO: 331017 - DNA, 25 bp, Mus musculus
gggatagagccagtatccatggaat

SEQ ID NO: 331018 - DNA, 25 bp, Mus musculus
gggatagatccccacagactttgca

SEQ ID NO: 331019 - DNA, 25 bp, Mus musculus
gggatagatccccagagactttgca

SEQ ID NO: 331020 - DNA, 25 bp, Mus musculus
gggatagctttccaggacaagaaga

SEQ ID NO: 331021 - DNA, 25 bp, Mus musculus
gggataggcagaagggaactgagcc

SEQ ID NO: 331022 - DNA, 25 bp, Mus musculus
gggatagtggagggtgtcccctgaa

SEQ ID NO: 331023 - DNA, 25 bp, Mus musculus
gggatataattcaggttgatgaaaa

SEQ ID NO: 331024 - DNA, 25 bp, Mus musculus
gggatataattcagtgactcactat

SEQ ID NO: 331025 - DNA, 25 bp, Mus musculus
gggatatatttgttaatggagtgtt

SEQ ID NO: 331026 - DNA, 25 bp, Mus musculus
gggatatcaagtttgcttgtcggaa

SEQ ID NO: 331027 - DNA, 25 bp, Mus musculus
gggatatccctaagattttgttcct

SEQ ID NO: 331028 - DNA, 25 bp, Mus musculus
gggatatcgcggcccaatggaagag

SEQ ID NO: 331029 - DNA, 25 bp, Mus musculus
gggatatcgcgggacaggaacggtt

SEQ ID NO: 331030 - DNA, 25 bp, Mus musculus
gggatatgaggtgcagcagaaagat

SEQ ID NO: 331031 - DNA, 25 bp, Mus musculus
gggatatgattccagatgcacgcca

SEQ ID NO: 331032 - DNA, 25 bp, Mus musculus
gggatatgattccaggctactagtc

SEQ ID NO: 331033 - DNA, 25 bp, Mus musculus
gggatatggtgaacttgaccagaat

SEQ ID NO: 331034 - DNA, 25 bp, Mus musculus
gggatatggttgcctgtaatctcaa

SEQ ID NO: 331035 - DNA, 25 bp, Mus musculus
gggatatgtaagacacctgtggatg

SEQ ID NO: 331036 - DNA, 25 bp, Mus musculus
gggatatgtaagtgctcttgtgaaa

SEQ ID NO: 331037 - DNA, 25 bp, Mus musculus
gggatatgtgacctgaaggagccaa

SEQ ID NO: 331038 - DNA, 25 bp, Mus musculus
gggatatgtgacctggactcagcct

SEQ ID NO: 331039 - DNA, 25 bp, Mus musculus
gggatatgtggggacatcagtgcag

SEQ ID NO: 331040 - DNA, 25 bp, Mus musculus
gggatattcacaagagcgttataac

SEQ ID NO: 331041 - DNA, 25 bp, Mus musculus
gggatatttgcaagatgagatgaac

SEQ ID NO: 331042 - DNA, 25 bp, Mus musculus
gggatcaaaacagaggtgcaaagaa

SEQ ID NO: 331043 - DNA, 25 bp, Mus musculus
gggatcaaacatatgctgagaaatc

SEQ ID NO: 331044 - DNA, 25 bp, Mus musculus
gggatcaaacatatggcacttcttg

SEQ ID NO: 331045 - DNA, 25 bp, Mus musculus
gggatcaagcgactgctctttacag

SEQ ID NO: 331046 - DNA, 25 bp, Mus musculus
gggatcaagcgactgtttagctttt

SEQ ID NO: 331047 - DNA, 25 bp, Mus musculus
gggatcaagcgacttaaagaaggtc

SEQ ID NO: 331048 - DNA, 25 bp, Mus musculus
gggatcacaagtgtgtctcaaaaga

SEQ ID NO: 331049 - DNA, 25 bp, Mus musculus
gggatcagcgtgggagctccgcttt

SEQ ID NO: 331050 - DNA, 25 bp, Mus musculus
gggatcaggaggttgagaacaaaaa

SEQ ID NO: 331051 - DNA, 25 bp, Mus musculus
gggatcagtgggcgagcttcacaag

SEQ ID NO: 331052 - DNA, 25 bp, Mus musculus
gggatcagtggtaccgggctttcat

SEQ ID NO: 331053 - DNA, 25 bp, Mus musculus
gggatcatcaaggtggaaagagaca

SEQ ID NO: 331054 - DNA, 25 bp, Mus musculus
gggatcatcaggaggtgcttacatg

SEQ ID NO: 331055 - DNA, 25 bp, Mus musculus
gggatcatgtcggtcacacagcaaa

SEQ ID NO: 331056 - DNA, 25 bp, Mus musculus
gggatcattcacagatcattctaga

SEQ ID NO: 331057 - DNA, 25 bp, Mus musculus
gggatcattccaagaagaagcccgg

SEQ ID NO: 331058 - DNA, 25 bp, Mus musculus
gggatccaaaatcaggtcacagacg

SEQ ID NO: 331059 - DNA, 25 bp, Mus musculus
gggatccaaagaggagatctttttg

SEQ ID NO: 331060 - DNA, 25 bp, Mus musculus
gggatccaacgacaatcagcgcctt

SEQ ID NO: 331061 - DNA, 25 bp, Mus musculus
gggatccaacgacattgatacacta

SEQ ID NO: 331062 - DNA, 25 bp, Mus musculus
gggatccacgaggacccgcctcgca

SEQ ID NO: 331063 - DNA, 25 bp, Mus musculus
gggatccagaatccaactgtgttat

SEQ ID NO: 331064 - DNA, 25 bp, Mus musculus
gggatccagagggctgactctgtgg

SEQ ID NO: 331065 - DNA, 25 bp, Mus musculus
gggatccagccgagcccggtcttgc

SEQ ID NO: 331066 - DNA, 25 bp, Mus musculus
gggatccagccggttactctccagg

SEQ ID NO: 331067 - DNA, 25 bp, Mus musculus
gggatccaggtggcacattggaagt

SEQ ID NO: 331068 - DNA, 25 bp, Mus musculus
gggatccatctcagggttctggctg

SEQ ID NO: 331069 - DNA, 25 bp, Mus musculus
gggatcccaggtcttcctggccggc

SEQ ID NO: 331070 - DNA, 25 bp, Mus musculus
gggatcccccagggtgaagcactgg

SEQ ID NO: 331071 - DNA, 25 bp, Mus musculus
gggatcccccagggttgtgacttag

SEQ ID NO: 331072 - DNA, 25 bp, Mus musculus
gggatcccccgcagcgtttggaaaa

SEQ ID NO: 331073 - DNA, 25 bp, Mus musculus
gggatccctgctttgtggaaggacc

SEQ ID NO: 331074 - DNA, 25 bp, Mus musculus
gggatcccttcagagggacagacca

SEQ ID NO: 331075 - DNA, 25 bp, Mus musculus
gggatccgcacgaaataaatcataa

SEQ ID NO: 331076 - DNA, 25 bp, Mus musculus
gggatccggtcgagatgaccggttc

SEQ ID NO: 331077 - DNA, 25 bp, Mus musculus
gggatccgtggacaacctggacagc

SEQ ID NO: 331078 - DNA, 25 bp, Mus musculus
gggatcctaaagtggccgtgcctgc

SEQ ID NO: 331079 - DNA, 25 bp, Mus musculus
gggatcctacagcttcacatggagt

SEQ ID NO: 331080 - DNA, 25 bp, Mus musculus
gggatcctccaacaatcctccatgt

SEQ ID NO: 331081 - DNA, 25 bp, Mus musculus
gggatcctgattgagggccgcaaac

SEQ ID NO: 331082 - DNA, 25 bp, Mus musculus
gggatcctgggagaatttagagcta

SEQ ID NO: 331083 - DNA, 25 bp, Mus musculus
gggatccttggatggtggcaccatg

SEQ ID NO: 331084 - DNA, 25 bp, Mus musculus
gggatcgacaaccacagcaaaccct

SEQ ID NO: 331085 - DNA, 25 bp, Mus musculus
gggatcggcattgcctgcaggtgta

SEQ ID NO: 331086 - DNA, 25 bp, Mus musculus
gggatctaagtaaaattggagaaga

SEQ ID NO: 331087 - DNA, 25 bp, Mus musculus
gggatctcacaacgggcaccaccac

SEQ ID NO: 331088 - DNA, 25 bp, Mus musculus
gggatctcagactatggcgacaagc

SEQ ID NO: 331089 - DNA, 25 bp, Mus musculus
gggatctcagagggatttgacccat

SEQ ID NO: 331090 - DNA, 25 bp, Mus musculus
gggatctccaagacctcactatctc

SEQ ID NO: 331091 - DNA, 25 bp, Mus musculus
gggatctccaaggaccacaatgctg

SEQ ID NO: 331092 - DNA, 25 bp, Mus musculus
gggatctccaggggagttttgtgct

SEQ ID NO: 331093 - DNA, 25 bp, Mus musculus
gggatctgcagacctcagtcagaag

SEQ ID NO: 331094 - DNA, 25 bp, Mus musculus
gggatctgcagagctcagtcagaag

SEQ ID NO: 331095 - DNA, 25 bp, Mus musculus
gggatctgccagtgtgcccctggat

SEQ ID NO: 331096 - DNA, 25 bp, Mus musculus
gggatctggaacagacacagccctt

SEQ ID NO: 331097 - DNA, 25 bp, Mus musculus
gggatctgggacactgaatggagcc

SEQ ID NO: 331098 - DNA, 25 bp, Mus musculus
gggatctttaatgcctctccagctt

SEQ ID NO: 331099 - DNA, 25 bp, Mus musculus
gggatctttgagagaaatacaagag

SEQ ID NO: 331100 - DNA, 25 bp, Mus musculus
gggatgaaacggaacattttccctc

SEQ ID NO: 331101 - DNA, 25 bp, Mus musculus
gggatgaaacggttctgtgatgaca

SEQ ID NO: 331102 - DNA, 25 bp, Mus musculus
gggatgacaagcaggtttgctgagg

SEQ ID NO: 331103 - DNA, 25 bp, Mus musculus
gggatgacgaggaagaggaacagga

SEQ ID NO: 331104 - DNA, 25 bp, Mus musculus
gggatgacttcagggactcaccagc

SEQ ID NO: 331105 - DNA, 25 bp, Mus musculus
gggatgacttccgggactcaccagc

SEQ ID NO: 331106 - DNA, 25 bp, Mus musculus
gggatgagaaagttgatgaagatga

SEQ ID NO: 331107 - DNA, 25 bp, Mus musculus
gggatgagaacaggatggacagtct

SEQ ID NO: 331108 - DNA, 25 bp, Mus musculus
gggatgagaacagggtaggtgagct

SEQ ID NO: 331109 - DNA, 25 bp, Mus musculus
gggatgaggcgagaggtgaaagagc

SEQ ID NO: 331110 - DNA, 25 bp, Mus musculus
gggatgatgcaatgagttccttcgg

SEQ ID NO: 331111 - DNA, 25 bp, Mus musculus
gggatgatgccatagcatggaagac

SEQ ID NO: 331112 - DNA, 25 bp, Mus musculus
gggatgatgccatgtacgcgtctac

SEQ ID NO: 331113 - DNA, 25 bp, Mus musculus
gggatgatgtgctctgtgcagccct

SEQ ID NO: 331114 - DNA, 25 bp, Mus musculus
gggatgcaactgatgtttcccagaa

SEQ ID NO: 331115 - DNA, 25 bp, Mus musculus
gggatgcaactgggaagagagcaca

SEQ ID NO: 331116 - DNA, 25 bp, Mus musculus
gggatgcacacagccaaccccaaca

SEQ ID NO: 331117 - DNA, 25 bp, Mus musculus
gggatgccacacagaggacggctga

SEQ ID NO: 331118 - DNA, 25 bp, Mus musculus
gggatgccagatgaggagtccctgg

SEQ ID NO: 331119 - DNA, 25 bp, Mus musculus
gggatgccagatgatcttcccccac

SEQ ID NO: 331120 - DNA, 25 bp, Mus musculus
gggatgccatattgtttccatcctt

SEQ ID NO: 331121 - DNA, 25 bp, Mus musculus
gggatgcctgatcgtaccgagaagc

SEQ ID NO: 331122 - DNA, 25 bp, Mus musculus
gggatgcctgcaggatctgccactg

SEQ ID NO: 331123 - DNA, 25 bp, Mus musculus
gggatgctactcaggggcagttggt

SEQ ID NO: 331124 - DNA, 25 bp, Mus musculus
gggatgctcaaggacagtgctatgc

SEQ ID NO: 331125 - DNA, 25 bp, Mus musculus
gggatgcttcagatacgggaagcca

SEQ ID NO: 331126 - DNA, 25 bp, Mus musculus
gggatggacagcgagcagtgttgcc

SEQ ID NO: 331127 - DNA, 25 bp, Mus musculus
gggatggacagcgaggcatgctaca

SEQ ID NO: 331128 - DNA, 25 bp, Mus musculus
gggatggaggagggaagagtctgag

SEQ ID NO: 331129 - DNA, 25 bp, Mus musculus
gggatggcagaggagctggcttcgg

SEQ ID NO: 331130 - DNA, 25 bp, Mus musculus
gggatggcagattcctgtccatgct

SEQ ID NO: 331131 - DNA, 25 bp, Mus musculus
gggatggcagcataggtggcaggaa

SEQ ID NO: 331132 - DNA, 25 bp, Mus musculus
gggatggcaggatccaagtgaacga

SEQ ID NO: 331133 - DNA, 25 bp, Mus musculus
gggatggcaggctcaaagacttgga

SEQ ID NO: 331134 - DNA, 25 bp, Mus musculus
gggatggcaggtagaagaggcagat

SEQ ID NO: 331135 - DNA, 25 bp, Mus musculus
gggatgggaaaggtgactctggcac

SEQ ID NO: 331136 - DNA, 25 bp, Mus musculus
gggatgggaggtcccacgtgatctg

SEQ ID NO: 331137 - DNA, 25 bp, Mus musculus
gggatggggagagttggagtttgga

SEQ ID NO: 331138 - DNA, 25 bp, Mus musculus
gggatggtcgaggacttgcactaag

SEQ ID NO: 331139 - DNA, 25 bp, Mus musculus
gggatggtgaaccgggtgaccctgg

SEQ ID NO: 331140 - DNA, 25 bp, Mus musculus
gggatggtgaaggagacaaaattct

SEQ ID NO: 331141 - DNA, 25 bp, Mus musculus
gggatgtagcaggcgccctggagga

SEQ ID NO: 331142 - DNA, 25 bp, Mus musculus
gggatgtagcaggcgcgcggtgaca

SEQ ID NO: 331143 - DNA, 25 bp, Mus musculus
gggatgtatatacaggaaaactcct

SEQ ID NO: 331144 - DNA, 25 bp, Mus musculus
gggatgtcagtcaggggacgtggaa

SEQ ID NO: 331145 - DNA, 25 bp, Mus musculus
gggatgtgaagatcatcagaaacta

SEQ ID NO: 331146 - DNA, 25 bp, Mus musculus
gggatgtgaccagatgcatattcct

SEQ ID NO: 331147 - DNA, 25 bp, Mus musculus
gggatgtgaccaggagatggctggc

SEQ ID NO: 331148 - DNA, 25 bp, Mus musculus
gggatgtgaccaggtggccttgaac

SEQ ID NO: 331149 - DNA, 25 bp, Mus musculus
gggatgtgatgctctttctcatcat

SEQ ID NO: 331150 - DNA, 25 bp, Mus musculus
gggatgtgccgacggtggttcctgt

SEQ ID NO: 331151 - DNA, 25 bp, Mus musculus
gggatgtgccggaatgcaggctcct

SEQ ID NO: 331152 - DNA, 25 bp, Mus musculus
gggatgtgcttctgagaagaggccg

SEQ ID NO: 331153 - DNA, 25 bp, Mus musculus
gggatgtgcttctgatgatgagagt

SEQ ID NO: 331154 - DNA, 25 bp, Mus musculus
gggatgtggagcggccaaccccaac

SEQ ID NO: 331155 - DNA, 25 bp, Mus musculus
gggatgtgtaccagatgacagaagg

SEQ ID NO: 331156 - DNA, 25 bp, Mus musculus
gggatgttcacaagagcgttataac

SEQ ID NO: 331157 - DNA, 25 bp, Mus musculus
gggatgttggcctgatgccctcaga

SEQ ID NO: 331158 - DNA, 25 bp, Mus musculus
gggatgttgggaatgtccggcggtt

SEQ ID NO: 331159 - DNA, 25 bp, Mus musculus
gggatgttgggtagcggaaagaccg

SEQ ID NO: 331160 - DNA, 25 bp, Mus musculus
gggatgttgggtgtttgaagcttat

SEQ ID NO: 331161 - DNA, 25 bp, Mus musculus
gggatgttttgggtcgcagacactt

SEQ ID NO: 331162 - DNA, 25 bp, Mus musculus
gggattaaaaagaatggaatcatca

SEQ ID NO: 331163 - DNA, 25 bp, Mus musculus
gggattaaagagacttccttgagct

SEQ ID NO: 331164 - DNA, 25 bp, Mus musculus
gggattaaagagcaaaagagaggac

SEQ ID NO: 331165 - DNA, 25 bp, Mus musculus
gggattaaagagtctattttcatgg

SEQ ID NO: 331166 - DNA, 25 bp, Mus musculus
gggattaaagatccagctgagctca

SEQ ID NO: 331167 - DNA, 25 bp, Mus musculus
gggattaaagatggcagactttctg

SEQ ID NO: 331168 - DNA, 25 bp, Mus musculus
gggattaaagattcatcagtgggaa

SEQ ID NO: 331169 - DNA, 25 bp, Mus musculus
gggattaaagcagatataatttcta

SEQ ID NO: 331170 - DNA, 25 bp, Mus musculus
gggattaaagcccagattcagtttg

SEQ ID NO: 331171 - DNA, 25 bp, Mus musculus
gggattaaagcgtgagggtcacaca

SEQ ID NO: 331172 - DNA, 25 bp, Mus musculus
gggattaaaggaaacaaatgtcctc

SEQ ID NO: 331173 - DNA, 25 bp, Mus musculus
gggattaaaggatgaaaatgagtgg

SEQ ID NO: 331174 - DNA, 25 bp, Mus musculus
gggattaaagggcatgaatctttct

SEQ ID NO: 331175 - DNA, 25 bp, Mus musculus
gggattaaaggggtccctccaatct

SEQ ID NO: 331176 - DNA, 25 bp, Mus musculus
gggattaaaggtatagtccagatgt

SEQ ID NO: 331177 - DNA, 25 bp, Mus musculus
gggattaaaggtgtgggaacaagca

SEQ ID NO: 331178 - DNA, 25 bp, Mus musculus
gggattaaaggttgtaagcatcaat

SEQ ID NO: 331179 - DNA, 25 bp, Mus musculus
gggattaaagtgctctgtgaagaac

SEQ ID NO: 331180 - DNA, 25 bp, Mus musculus
gggattaatgatgctctccaagttc

SEQ ID NO: 331181 - DNA, 25 bp, Mus musculus
gggattaattcaggagtgggaggtg

SEQ ID NO: 331182 - DNA, 25 bp, Mus musculus
gggattacagactcctccaccctgc

SEQ ID NO: 331183 - DNA, 25 bp, Mus musculus
gggattacaggggctgagatttatt

SEQ ID NO: 331184 - DNA, 25 bp, Mus musculus
gggattacaggttaaaatgagcttg

SEQ ID NO: 331185 - DNA, 25 bp, Mus musculus
gggattacaggttccacagcactgg

SEQ ID NO: 331186 - DNA, 25 bp, Mus musculus
gggattacaggttggcttcctgaag

SEQ ID NO: 331187 - DNA, 25 bp, Mus musculus
gggattacagtcttgaaatacagcc

SEQ ID NO: 331188 - DNA, 25 bp, Mus musculus
gggattaccacaaatactggatgta

SEQ ID NO: 331189 - DNA, 25 bp, Mus musculus
gggattagaggagttggaaccctgt

SEQ ID NO: 331190 - DNA, 25 bp, Mus musculus
gggattataccggctgcagtacctc

SEQ ID NO: 331191 - DNA, 25 bp, Mus musculus
gggattataccggggcccagtcatt

SEQ ID NO: 331192 - DNA, 25 bp, Mus musculus
gggattatcagaacaaaacgtgtgt

SEQ ID NO: 331193 - DNA, 25 bp, Mus musculus
gggattatcgggctcagcgttgttc

SEQ ID NO: 331194 - DNA, 25 bp, Mus musculus
gggattatcggggaagcgtttctct

SEQ ID NO: 331195 - DNA, 25 bp, Mus musculus
gggattatgaggactccaagccccc

SEQ ID NO: 331196 - DNA, 25 bp, Mus musculus
gggattattatgctttctcccagat

SEQ ID NO: 331197 - DNA, 25 bp, Mus musculus
gggattatttagcacaggtgatgaa

SEQ ID NO: 331198 - DNA, 25 bp, Mus musculus
gggattcagaggaagccaagggatg

SEQ ID NO: 331199 - DNA, 25 bp, Mus musculus
gggattcagctcaaggctgtcaagt

SEQ ID NO: 331200 - DNA, 25 bp, Mus musculus
gggattcagtggggctccacctgtt

SEQ ID NO: 331201 - DNA, 25 bp, Mus musculus
gggattcagtgggggagtttgtgac

SEQ ID NO: 331202 - DNA, 25 bp, Mus musculus
gggattcagtgggggatttccaatt

SEQ ID NO: 331203 - DNA, 25 bp, Mus musculus
gggattcatcacagagccggctgat

SEQ ID NO: 331204 - DNA, 25 bp, Mus musculus
gggattcatgctgtattttcatctg

SEQ ID NO: 331205 - DNA, 25 bp, Mus musculus
gggattccagagtgtgtgggtttca

SEQ ID NO: 331206 - DNA, 25 bp, Mus musculus
gggattccaggacgcccctgtgaaa

SEQ ID NO: 331207 - DNA, 25 bp, Mus musculus
gggattccaggagaaccacaatgtg

SEQ ID NO: 331208 - DNA, 25 bp, Mus musculus
gggattccaggatggcagctcctgc

SEQ ID NO: 331209 - DNA, 25 bp, Mus musculus
gggattccaggtgacagagtgccac

SEQ ID NO: 331210 - DNA, 25 bp, Mus musculus
gggattcccgtcttctccctcctgc

SEQ ID NO: 331211 - DNA, 25 bp, Mus musculus
gggattcctgcctgctccaggacag

SEQ ID NO: 331212 - DNA, 25 bp, Mus musculus
gggattctacaaagctgggcatgga

SEQ ID NO: 331213 - DNA, 25 bp, Mus musculus
gggattcttcagcacaggggatgaa

SEQ ID NO: 331214 - DNA, 25 bp, Mus musculus
gggattcttcaggaacaagatcctg

SEQ ID NO: 331215 - DNA, 25 bp, Mus musculus
gggattgaacttcgtgggcatcgat

SEQ ID NO: 331216 - DNA, 25 bp, Mus musculus
gggattgaccgacgcctcttcgccc

SEQ ID NO: 331217 - DNA, 25 bp, Mus musculus
gggattgcagttttcaaagatacat

SEQ ID NO: 331218 - DNA, 25 bp, Mus musculus
gggattgccctgagaattcatataa

SEQ ID NO: 331219 - DNA, 25 bp, Mus musculus
gggattgccctgagagagaattctg

SEQ ID NO: 331220 - DNA, 25 bp, Mus musculus
gggattgctcagaaaaagatcattc

SEQ ID NO: 331221 - DNA, 25 bp, Mus musculus
gggattgctcagaacttctcggtat

SEQ ID NO: 331222 - DNA, 25 bp, Mus musculus
gggattgctcagctgccttggctgt

SEQ ID NO: 331223 - DNA, 25 bp, Mus musculus
gggattgctcagggcattgaaaaca

SEQ ID NO: 331224 - DNA, 25 bp, Mus musculus
gggattgggaagagaacagacaagg

SEQ ID NO: 331225 - DNA, 25 bp, Mus musculus
gggattgggcacctcgagaagcctg

SEQ ID NO: 331226 - DNA, 25 bp, Mus musculus
gggattgggcacctcgattgcagcc

SEQ ID NO: 331227 - DNA, 25 bp, Mus musculus
gggattgtagcaaggtatggtgcgg

SEQ ID NO: 331228 - DNA, 25 bp, Mus musculus
gggattgtaggtcacgctggagttc

SEQ ID NO: 331229 - DNA, 25 bp, Mus musculus
gggatttaacacaggtgtgatcctg

SEQ ID NO: 331230 - DNA, 25 bp, Mus musculus
gggatttaagtctgtgcgagggtgt

SEQ ID NO: 331231 - DNA, 25 bp, Mus musculus
gggatttacagggctgcagaatgga

SEQ ID NO: 331232 - DNA, 25 bp, Mus musculus
gggatttagtctggcgtgtgcagcc

SEQ ID NO: 331233 - DNA, 25 bp, Mus musculus
gggatttcagacaggtggagtcact

SEQ ID NO: 331234 - DNA, 25 bp, Mus musculus
gggatttcagatgataaaggcagta

SEQ ID NO: 331235 - DNA, 25 bp, Mus musculus
gggatttcaggataacctctttctt

SEQ ID NO: 331236 - DNA, 25 bp, Mus musculus
gggatttcaggctgggaatgcgtta

SEQ ID NO: 331237 - DNA, 25 bp, Mus musculus
gggatttcaggtctctggctttcct

SEQ ID NO: 331238 - DNA, 25 bp, Mus musculus
gggatttcagtctggaaatgtcttt

SEQ ID NO: 331239 - DNA, 25 bp, Mus musculus
gggatttctggacttggcagtgtaa

SEQ ID NO: 331240 - DNA, 25 bp, Mus musculus
gggatttgctggttttaggctagcc

SEQ ID NO: 331241 - DNA, 25 bp, Mus musculus
gggatttgtcgccagagagacaaga

SEQ ID NO: 331242 - DNA, 25 bp, Mus musculus
gggcaaaagccgaggctctgctaag

SEQ ID NO: 331243 - DNA, 25 bp, Mus musculus
gggcaaaatctgtctccagtagaag

SEQ ID NO: 331244 - DNA, 25 bp, Mus musculus
gggcaaaatctgtgagaaggaccga

SEQ ID NO: 331245 - DNA, 25 bp, Mus musculus
gggcaaaatggagctcgacgccatg

SEQ ID NO: 331246 - DNA, 25 bp, Mus musculus
gggcaaaccactggatatattgggt

SEQ ID NO: 331247 - DNA, 25 bp, Mus musculus
gggcaaaccactggggagtagagca

SEQ ID NO: 331248 - DNA, 25 bp, Mus musculus
gggcaaagaggtgcaggcggctgga

SEQ ID NO: 331249 - DNA, 25 bp, Mus musculus
gggcaaagaggtgcaggctggttcg

SEQ ID NO: 331250 - DNA, 25 bp, Mus musculus
gggcaaagaggtgcgtgagcacatg

SEQ ID NO: 331251 - DNA, 25 bp, Mus musculus
gggcaaagagtcagacatttacatt

SEQ ID NO: 331252 - DNA, 25 bp, Mus musculus
gggcaaagatgtcagtgctctcttc

SEQ ID NO: 331253 - DNA, 25 bp, Mus musculus
gggcaaaggaagatttgatgaaaaa

SEQ ID NO: 331254 - DNA, 25 bp, Mus musculus
gggcaaatcaggaaaggatgtggcc

SEQ ID NO: 331255 - DNA, 25 bp, Mus musculus
gggcaaatctgtcaggtatacagat

SEQ ID NO: 331256 - DNA, 25 bp, Mus musculus
gggcaacaaaatggcagtgaaaatg

SEQ ID NO: 331257 - DNA, 25 bp, Mus musculus
gggcaacaaagatttctgaaaagag

SEQ ID NO: 331258 - DNA, 25 bp, Mus musculus
gggcaacaaagtgcactaggccttc

SEQ ID NO: 331259 - DNA, 25 bp, Mus musculus
gggcaacaaatatgtctggatttgg

SEQ ID NO: 331260 - DNA, 25 bp, Mus musculus
gggcaacaagggaaatactggggct

SEQ ID NO: 331261 - DNA, 25 bp, Mus musculus
gggcaacaaggtggaccccctttca

SEQ ID NO: 331262 - DNA, 25 bp, Mus musculus
gggcaacaccctgggaaatgtgtgt

SEQ ID NO: 331263 - DNA, 25 bp, Mus musculus
gggcaacaccctgggcattggggct

SEQ ID NO: 331264 - DNA, 25 bp, Mus musculus
gggcaacaccctgggttttagatgc

SEQ ID NO: 331265 - DNA, 25 bp, Mus musculus
gggcaacagtcatcatctgactgct

SEQ ID NO: 331266 - DNA, 25 bp, Mus musculus
gggcaacagtgaactaatgctggat

SEQ ID NO: 331267 - DNA, 25 bp, Mus musculus
gggcaacctaggtgttgactttaag

SEQ ID NO: 331268 - DNA, 25 bp, Mus musculus
gggcaacctttggtagagacctttt

SEQ ID NO: 331269 - DNA, 25 bp, Mus musculus
gggcaacgctgaatggtgccatgac

SEQ ID NO: 331270 - DNA, 25 bp, Mus musculus
gggcaacgctgtcagcgaaggcctg

SEQ ID NO: 331271 - DNA, 25 bp, Mus musculus
gggcaacgtgatggagctggtgggg

SEQ ID NO: 331272 - DNA, 25 bp, Mus musculus
gggcaactgtgtggacatcaacgaa

SEQ ID NO: 331273 - DNA, 25 bp, Mus musculus
gggcaacttcctttcacgtgactga

SEQ ID NO: 331274 - DNA, 25 bp, Mus musculus
gggcaactttgtggacctctgcagg

SEQ ID NO: 331275 - DNA, 25 bp, Mus musculus
gggcaagaaagatgaacgagaccgt

SEQ ID NO: 331276 - DNA, 25 bp, Mus musculus
gggcaagaagcatcctcctccttgc

SEQ ID NO: 331277 - DNA, 25 bp, Mus musculus
gggcaagaagcctggaattgtgtcg

SEQ ID NO: 331278 - DNA, 25 bp, Mus musculus
gggcaagaaggctgcgaaaagacat

SEQ ID NO: 331279 - DNA, 25 bp, Mus musculus
gggcaagaaggtgggaatcctagat

SEQ ID NO: 331280 - DNA, 25 bp, Mus musculus
gggcaagaagtatttaggtcagtta

SEQ ID NO: 331281 - DNA, 25 bp, Mus musculus
gggcaagacatacaggtgtaaggtc

SEQ ID NO: 331282 - DNA, 25 bp, Mus musculus
gggcaagacatccacatcttttcga

SEQ ID NO: 331283 - DNA, 25 bp, Mus musculus
gggcaagaccaagatcaccgatgtg

SEQ ID NO: 331284 - DNA, 25 bp, Mus musculus
gggcaagaccggcttctcctcggac

SEQ ID NO: 331285 - DNA, 25 bp, Mus musculus
gggcaagacgggcgcagttctgaaa

SEQ ID NO: 331286 - DNA, 25 bp, Mus musculus
gggcaagatacacggcatcatcgca

SEQ ID NO: 331287 - DNA, 25 bp, Mus musculus
gggcaagatcaagccccacctgatg

SEQ ID NO: 331288 - DNA, 25 bp, Mus musculus
gggcaagcctgaacctgtcacaggc

SEQ ID NO: 331289 - DNA, 25 bp, Mus musculus
gggcaagctggtggtaacggaaaac

SEQ ID NO: 331290 - DNA, 25 bp, Mus musculus
gggcaagctttttagatgggagacc

SEQ ID NO: 331291 - DNA, 25 bp, Mus musculus
gggcaaggactacctggaccagctg

SEQ ID NO: 331292 - DNA, 25 bp, Mus musculus
gggcaaggagatccacgatttgttc

SEQ ID NO: 331293 - DNA, 25 bp, Mus musculus
gggcaaggagatggaatccaagtga

SEQ ID NO: 331294 - DNA, 25 bp, Mus musculus
gggcaaggaggagtcatctctcatg

SEQ ID NO: 331295 - DNA, 25 bp, Mus musculus
gggcaagtcagaatcaacctaccga

SEQ ID NO: 331296 - DNA, 25 bp, Mus musculus
gggcaagtcagacagtatctcacta

SEQ ID NO: 331297 - DNA, 25 bp, Mus musculus
gggcaagtcagcgattgtagtgaga

SEQ ID NO: 331298 - DNA, 25 bp, Mus musculus
gggcaagtccagcctgctcctgagg

SEQ ID NO: 331299 - DNA, 25 bp, Mus musculus
gggcaagtctgaccttcatcacttc

SEQ ID NO: 331300 - DNA, 25 bp, Mus musculus
gggcaagtctgccctgacggtgaag

SEQ ID NO: 331301 - DNA, 25 bp, Mus musculus
gggcaagtttgactggagacagcag

SEQ ID NO: 331302 - DNA, 25 bp, Mus musculus
gggcaagtttgactgggccatgccg

SEQ ID NO: 331303 - DNA, 25 bp, Mus musculus
gggcaataaatatgcttcatcttca

SEQ ID NO: 331304 - DNA, 25 bp, Mus musculus
gggcaataatctatagaccatggag

SEQ ID NO: 331305 - DNA, 25 bp, Mus musculus
gggcaatacaatgaggagactgacc

SEQ ID NO: 331306 - DNA, 25 bp, Mus musculus
gggcaatacattgctatagctcaag

SEQ ID NO: 331307 - DNA, 25 bp, Mus musculus
gggcaataccaatatagggggctac

SEQ ID NO: 331308 - DNA, 25 bp, Mus musculus
gggcaatatcatgattgaccccgtc

SEQ ID NO: 331309 - DNA, 25 bp, Mus musculus
gggcaatggacttcaggcaatccaa

SEQ ID NO: 331310 - DNA, 25 bp, Mus musculus
gggcaatggcttcgcaggctgcatg

SEQ ID NO: 331311 - DNA, 25 bp, Mus musculus
gggcaatggctttgcgggctgcgtg

SEQ ID NO: 331312 - DNA, 25 bp, Mus musculus
gggcaattcccttaggaacctcctc

SEQ ID NO: 331313 - DNA, 25 bp, Mus musculus
gggcacaaaggtgacctcactgacc

SEQ ID NO: 331314 - DNA, 25 bp, Mus musculus
gggcacaaccttcgagtcctcaaat

SEQ ID NO: 331315 - DNA, 25 bp, Mus musculus
gggcacaagcaaagaccggtgtgtg

SEQ ID NO: 331316 - DNA, 25 bp, Mus musculus
gggcacaagcaaaggaaagaggccg

SEQ ID NO: 331317 - DNA, 25 bp, Mus musculus
gggcacaagcaaagtggtagtgtga

SEQ ID NO: 331318 - DNA, 25 bp, Mus musculus
gggcacaagtgctgagagctaagtg

SEQ ID NO: 331319 - DNA, 25 bp, Mus musculus
gggcacaatgcgaccttcttcggga

SEQ ID NO: 331320 - DNA, 25 bp, Mus musculus
gggcacacaggccagcggtgtgagg

SEQ ID NO: 331321 - DNA, 25 bp, Mus musculus
gggcacacagggttttgaaggcccc

SEQ ID NO: 331322 - DNA, 25 bp, Mus musculus
gggcacaccgcagggagaaaactgg

SEQ ID NO: 331323 - DNA, 25 bp, Mus musculus
gggcacagacatggagtcagtgact

SEQ ID NO: 331324 - DNA, 25 bp, Mus musculus
gggcacatttttcgacatccgcaga

SEQ ID NO: 331325 - DNA, 25 bp, Mus musculus
gggcaccaagcactgaaaactgatg

SEQ ID NO: 331326 - DNA, 25 bp, Mus musculus
gggcaccaaggctgctttggcagga

SEQ ID NO: 331327 - DNA, 25 bp, Mus musculus
gggcaccaagttctccagccaacaa

SEQ ID NO: 331328 - DNA, 25 bp, Mus musculus
gggcaccaggcctggaagcaccagc

SEQ ID NO: 331329 - DNA, 25 bp, Mus musculus
gggcaccaggcctggggtccccttc

SEQ ID NO: 331330 - DNA, 25 bp, Mus musculus
gggcaccatctgaaggacaaggagc

SEQ ID NO: 331331 - DNA, 25 bp, Mus musculus
gggcacccaaggtgaaagcagaaat

SEQ ID NO: 331332 - DNA, 25 bp, Mus musculus
gggcaccccagctggagtccttgaa

SEQ ID NO: 331333 - DNA, 25 bp, Mus musculus
gggcaccccaggaatgcaccatgcc

SEQ ID NO: 331334 - DNA, 25 bp, Mus musculus
gggcaccgaagaggctaaccatttt

SEQ ID NO: 331335 - DNA, 25 bp, Mus musculus
gggcaccgagagtgttgagggcgag

SEQ ID NO: 331336 - DNA, 25 bp, Mus musculus
gggcaccgaggtctccagcagaagg

SEQ ID NO: 331337 - DNA, 25 bp, Mus musculus
gggcaccgagtcaaataatttagta

SEQ ID NO: 331338 - DNA, 25 bp, Mus musculus
gggcaccgatcgtgtatgacggaga

SEQ ID NO: 331339 - DNA, 25 bp, Mus musculus
gggcaccgtcaggctcaagtccacc

SEQ ID NO: 331340 - DNA, 25 bp, Mus musculus
gggcaccgtggaggcccccgtcctg

SEQ ID NO: 331341 - DNA, 25 bp, Mus musculus
gggcacctctgggaggacactgtgt

SEQ ID NO: 331342 - DNA, 25 bp, Mus musculus
gggcacctctgggagtttgtcctgg

SEQ ID NO: 331343 - DNA, 25 bp, Mus musculus
gggcacctgagagagaagacacagt

SEQ ID NO: 331344 - DNA, 25 bp, Mus musculus
gggcacctggaagaccgatgctgtg

SEQ ID NO: 331345 - DNA, 25 bp, Mus musculus
gggcacctggaagctgtggtgtacc

SEQ ID NO: 331346 - DNA, 25 bp, Mus musculus
gggcacctggaaggcctccccagga

SEQ ID NO: 331347 - DNA, 25 bp, Mus musculus
gggcacctggaagtcccctcctggc

SEQ ID NO: 331348 - DNA, 25 bp, Mus musculus
gggcacctggaagtcttccccaggc

SEQ ID NO: 331349 - DNA, 25 bp, Mus musculus
gggcacgaggctggaaggctgcgtg

SEQ ID NO: 331350 - DNA, 25 bp, Mus musculus
gggcacgatgtaaccagcctcagga

SEQ ID NO: 331351 - DNA, 25 bp, Mus musculus
gggcacgccggagctccctgtggcc

SEQ ID NO: 331352 - DNA, 25 bp, Mus musculus
gggcacgcgggagaggtaaggctga

SEQ ID NO: 331353 - DNA, 25 bp, Mus musculus
gggcacgcgggagagttttctctgt

SEQ ID NO: 331354 - DNA, 25 bp, Mus musculus
gggcacggagtgtctcgctgtcact

SEQ ID NO: 331355 - DNA, 25 bp, Mus musculus
gggcacgggagcctatgggaaggtg

SEQ ID NO: 331356 - DNA, 25 bp, Mus musculus
gggcacgggagtccgggtttgcaca

SEQ ID NO: 331357 - DNA, 25 bp, Mus musculus
gggcacgtaagagatgatgatggac

SEQ ID NO: 331358 - DNA, 25 bp, Mus musculus
gggcacgtctgccagtgcgaccagt

SEQ ID NO: 331359 - DNA, 25 bp, Mus musculus
gggcactaaaacggatggctctcca

SEQ ID NO: 331360 - DNA, 25 bp, Mus musculus
gggcactatcgaagttgagaatacc

SEQ ID NO: 331361 - DNA, 25 bp, Mus musculus
gggcactcagggcccaggacggctg

SEQ ID NO: 331362 - DNA, 25 bp, Mus musculus
gggcactcaggtgaagccaacaccc

SEQ ID NO: 331363 - DNA, 25 bp, Mus musculus
gggcactcaggttcgagtgacggtg

SEQ ID NO: 331364 - DNA, 25 bp, Mus musculus
gggcactcatgcatgctagtcccac

SEQ ID NO: 331365 - DNA, 25 bp, Mus musculus
gggcactgacatggttcctgccatc

SEQ ID NO: 331366 - DNA, 25 bp, Mus musculus
gggcactgacttcaatggggttgcg

SEQ ID NO: 331367 - DNA, 25 bp, Mus musculus
gggcactgagacagggctttctgag

SEQ ID NO: 331368 - DNA, 25 bp, Mus musculus
gggcactgatgaggacagctcagat

SEQ ID NO: 331369 - DNA, 25 bp, Mus musculus
gggcactgatgaggattctcaggac

SEQ ID NO: 331370 - DNA, 25 bp, Mus musculus
gggcactgatggaggagacacgggc

SEQ ID NO: 331371 - DNA, 25 bp, Mus musculus
gggcactgcatttggtggagtgtga

SEQ ID NO: 331372 - DNA, 25 bp, Mus musculus
gggcactgctgtgcttatggcaaac

SEQ ID NO: 331373 - DNA, 25 bp, Mus musculus
gggcactggcaggcctgtacggaga

SEQ ID NO: 331374 - DNA, 25 bp, Mus musculus
gggcactggcagggctggtctacaa

SEQ ID NO: 331375 - DNA, 25 bp, Mus musculus
gggcacttttgaaatggccatgaag

SEQ ID NO: 331376 - DNA, 25 bp, Mus musculus
gggcagaaactggccagcaagcctg

SEQ ID NO: 331377 - DNA, 25 bp, Mus musculus
gggcagaaaggtgatcgagggtcgc

SEQ ID NO: 331378 - DNA, 25 bp, Mus musculus
gggcagaacctggccaagatcctgc

SEQ ID NO: 331379 - DNA, 25 bp, Mus musculus
gggcagaacgaggttgtgaaccatg

SEQ ID NO: 331380 - DNA, 25 bp, Mus musculus
gggcagaagaggaggtggcttacaa

SEQ ID NO: 331381 - DNA, 25 bp, Mus musculus
gggcagaagctgcgagacgctttta

SEQ ID NO: 331382 - DNA, 25 bp, Mus musculus
gggcagaagttgctcaagatgctga

SEQ ID NO: 331383 - DNA, 25 bp, Mus musculus
gggcagaatcatagggagaggcggt

SEQ ID NO: 331384 - DNA, 25 bp, Mus musculus
gggcagacaacggttggcatcgaac

SEQ ID NO: 331385 - DNA, 25 bp, Mus musculus
gggcagacaacgttcactttaattg

SEQ ID NO: 331386 - DNA, 25 bp, Mus musculus
gggcagaccatggtgagcccattgg

SEQ ID NO: 331387 - DNA, 25 bp, Mus musculus
gggcagagaagctggcttgctggaa

SEQ ID NO: 331388 - DNA, 25 bp, Mus musculus
gggcagagaggaactaggaagtaac

SEQ ID NO: 331389 - DNA, 25 bp, Mus musculus
gggcagagcaggccaaggagatcca

SEQ ID NO: 331390 - DNA, 25 bp, Mus musculus
gggcagagcaggcgggactgtcctg

SEQ ID NO: 331391 - DNA, 25 bp, Mus musculus
gggcagagcagggatcagtggtgaa

SEQ ID NO: 331392 - DNA, 25 bp, Mus musculus
gggcagagccaagcacttacgcctg

SEQ ID NO: 331393 - DNA, 25 bp, Mus musculus
gggcagagccagagaatgttgctga

SEQ ID NO: 331394 - DNA, 25 bp, Mus musculus
gggcagagctcaggatttctggtag

SEQ ID NO: 331395 - DNA, 25 bp, Mus musculus
gggcagaggcggaacgtgatgtcct

SEQ ID NO: 331396 - DNA, 25 bp, Mus musculus
gggcagaggcgtaacgtgatgtcct

SEQ ID NO: 331397 - DNA, 25 bp, Mus musculus
gggcagagggaatccggagatcgtc

SEQ ID NO: 331398 - DNA, 25 bp, Mus musculus
gggcagaggtggtcagtgctcaaga

SEQ ID NO: 331399 - DNA, 25 bp, Mus musculus
gggcagataagaagggcaggattct

SEQ ID NO: 331400 - DNA, 25 bp, Mus musculus
gggcagatcacagacactgcagaag

SEQ ID NO: 331401 - DNA, 25 bp, Mus musculus
gggcagatcagctgtcctggaagat

SEQ ID NO: 331402 - DNA, 25 bp, Mus musculus
gggcagatcagtccgcactggagat

SEQ ID NO: 331403 - DNA, 25 bp, Mus musculus
gggcagatcctctgatggagccaga

SEQ ID NO: 331404 - DNA, 25 bp, Mus musculus
gggcagatctggtattcttttggta

SEQ ID NO: 331405 - DNA, 25 bp, Mus musculus
gggcagattcagcacagagctgatg

SEQ ID NO: 331406 - DNA, 25 bp, Mus musculus
gggcagattcaggtgattctcgggc

SEQ ID NO: 331407 - DNA, 25 bp, Mus musculus
gggcagcagagttcattccgacagg

SEQ ID NO: 331408 - DNA, 25 bp, Mus musculus
gggcagcagcaccagatttcaatgg

SEQ ID NO: 331409 - DNA, 25 bp, Mus musculus
gggcagcagcaccagggcctgtcca

SEQ ID NO: 331410 - DNA, 25 bp, Mus musculus
gggcagcagccaaggacacttagcc

SEQ ID NO: 331411 - DNA, 25 bp, Mus musculus
gggcagcaggtggcagagaaggaag

SEQ ID NO: 331412 - DNA, 25 bp, Mus musculus
gggcagcatcagcccccggcagcag

SEQ ID NO: 331413 - DNA, 25 bp, Mus musculus
gggcagccaaacagcccatcacggt

SEQ ID NO: 331414 - DNA, 25 bp, Mus musculus
gggcagccaggcaccacctaccctg

SEQ ID NO: 331415 - DNA, 25 bp, Mus musculus
gggcagccaggctggggatgacaac

SEQ ID NO: 331416 - DNA, 25 bp, Mus musculus
gggcagccagtccaggcgcctctag

SEQ ID NO: 331417 - DNA, 25 bp, Mus musculus
gggcagccagtcttcctgtcccagt

SEQ ID NO: 331418 - DNA, 25 bp, Mus musculus
gggcagccatgaggcggcaggccct

SEQ ID NO: 331419 - DNA, 25 bp, Mus musculus
gggcagccggcaggaccagtggctg

SEQ ID NO: 331420 - DNA, 25 bp, Mus musculus
gggcagcctgtggggacaggttgca

SEQ ID NO: 331421 - DNA, 25 bp, Mus musculus
gggcagcctgtggttgcagctcctc

SEQ ID NO: 331422 - DNA, 25 bp, Mus musculus
gggcagcgacgaggttcagattctg

SEQ ID NO: 331423 - DNA, 25 bp, Mus musculus
gggcagcgaggttgtaagtgtctta

SEQ ID NO: 331424 - DNA, 25 bp, Mus musculus
gggcagcgatacgcttgcctggttc

SEQ ID NO: 331425 - DNA, 25 bp, Mus musculus
gggcagcgatacggctttggacctt

SEQ ID NO: 331426 - DNA, 25 bp, Mus musculus
gggcagcgcaggtatcgccaggccg

SEQ ID NO: 331427 - DNA, 25 bp, Mus musculus
gggcagcgcaggtgccccgtgctcc

SEQ ID NO: 331428 - DNA, 25 bp, Mus musculus
gggcagcgccagtggctccgcgggc

SEQ ID NO: 331429 - DNA, 25 bp, Mus musculus
gggcagcgcgcgcagagacactgta

SEQ ID NO: 331430 - DNA, 25 bp, Mus musculus
gggcagcggaagaccagactctgag

SEQ ID NO: 331431 - DNA, 25 bp, Mus musculus
gggcagctacttggttccctgccgc

SEQ ID NO: 331432 - DNA, 25 bp, Mus musculus
gggcagctagctggatcaccgacaa

SEQ ID NO: 331433 - DNA, 25 bp, Mus musculus
gggcagctagctggttgcagaggtt

SEQ ID NO: 331434 - DNA, 25 bp, Mus musculus
gggcagctcaaggaggctcaacgca

SEQ ID NO: 331435 - DNA, 25 bp, Mus musculus
gggcagctccccagtgaggtggctc

SEQ ID NO: 331436 - DNA, 25 bp, Mus musculus
gggcagctccccctctacctggaac

SEQ ID NO: 331437 - DNA, 25 bp, Mus musculus
gggcagctgagattcctgctgctta

SEQ ID NO: 331438 - DNA, 25 bp, Mus musculus
gggcagctgaggtgtgactttgagg

SEQ ID NO: 331439 - DNA, 25 bp, Mus musculus
gggcagctgctcaaggactcggaga

SEQ ID NO: 331440 - DNA, 25 bp, Mus musculus
gggcagctgctcaaggtactccagg

SEQ ID NO: 331441 - DNA, 25 bp, Mus musculus
gggcagctgtgtgcctgctttggtt

SEQ ID NO: 331442 - DNA, 25 bp, Mus musculus
gggcagcttgaaaatgcagaacagc

SEQ ID NO: 331443 - DNA, 25 bp, Mus musculus
gggcagcttggagccggaagctgga

SEQ ID NO: 331444 - DNA, 25 bp, Mus musculus
gggcaggaagtgtcgagtggctggt

SEQ ID NO: 331445 - DNA, 25 bp, Mus musculus
gggcaggagccgaaatgtctcaggc

SEQ ID NO: 331446 - DNA, 25 bp, Mus musculus
gggcaggagccgagtctccttatat

SEQ ID NO: 331447 - DNA, 25 bp, Mus musculus
gggcaggagccgatcccttttcaaa

SEQ ID NO: 331448 - DNA, 25 bp, Mus musculus
gggcaggagctgagctgtagccctc

SEQ ID NO: 331449 - DNA, 25 bp, Mus musculus
gggcaggatactatgtatataacag

SEQ ID NO: 331450 - DNA, 25 bp, Mus musculus
gggcaggatgcttaggacctgatat

SEQ ID NO: 331451 - DNA, 25 bp, Mus musculus
gggcaggcagccactcccgagactc

SEQ ID NO: 331452 - DNA, 25 bp, Mus musculus
gggcaggcaggaggtggtggagttg

SEQ ID NO: 331453 - DNA, 25 bp, Mus musculus
gggcaggcctgtgataagacgctgt

SEQ ID NO: 331454 - DNA, 25 bp, Mus musculus
gggcaggcctgtgctcatatgaaat

SEQ ID NO: 331455 - DNA, 25 bp, Mus musculus
gggcaggcgggtgattatagagcga

SEQ ID NO: 331456 - DNA, 25 bp, Mus musculus
gggcaggctcgatggctcccgcaaa

SEQ ID NO: 331457 - DNA, 25 bp, Mus musculus
gggcagggaagaagtacgagaaagt

SEQ ID NO: 331458 - DNA, 25 bp, Mus musculus
gggcagggagacgatactgtatccg

SEQ ID NO: 331459 - DNA, 25 bp, Mus musculus
gggcagggcagggaagaagtacgag

SEQ ID NO: 331460 - DNA, 25 bp, Mus musculus
gggcagggcgggagagtattgtctg

SEQ ID NO: 331461 - DNA, 25 bp, Mus musculus
gggcaggggattgattatgagaaga

SEQ ID NO: 331462 - DNA, 25 bp, Mus musculus
gggcaggtaattgcgctccagatga

SEQ ID NO: 331463 - DNA, 25 bp, Mus musculus
gggcaggtagccaagcttgaggcgg

SEQ ID NO: 331464 - DNA, 25 bp, Mus musculus
gggcaggtcaatagccttcctggga

SEQ ID NO: 331465 - DNA, 25 bp, Mus musculus
gggcaggtgcccatgttggaagatg

SEQ ID NO: 331466 - DNA, 25 bp, Mus musculus
gggcagtacactgcctcaggcgatg

SEQ ID NO: 331467 - DNA, 25 bp, Mus musculus
gggcagtacattgccattacccagg

SEQ ID NO: 331468 - DNA, 25 bp, Mus musculus
gggcagtcaagccggtgtcctgggt

SEQ ID NO: 331469 - DNA, 25 bp, Mus musculus
gggcagtctgggcctgccaccccta

SEQ ID NO: 331470 - DNA, 25 bp, Mus musculus
gggcagtctgggctgctggctctac

SEQ ID NO: 331471 - DNA, 25 bp, Mus musculus
gggcagtggagggccctgtctgtac

SEQ ID NO: 331472 - DNA, 25 bp, Mus musculus
gggcagtggcgaaggcgaatctggt

SEQ ID NO: 331473 - DNA, 25 bp, Mus musculus
gggcagtggctcagctctgccattt

SEQ ID NO: 331474 - DNA, 25 bp, Mus musculus
gggcagtgtgagctagcccttcttc

SEQ ID NO: 331475 - DNA, 25 bp, Mus musculus
gggcagtgtgagtgatttccggtgt

SEQ ID NO: 331476 - DNA, 25 bp, Mus musculus
gggcagttcaagccaaccatctgcc

SEQ ID NO: 331477 - DNA, 25 bp, Mus musculus
gggcagtttagaaatgcacttagcg

SEQ ID NO: 331478 - DNA, 25 bp, Mus musculus
gggcagttttgaaggctctgctaag

SEQ ID NO: 331479 - DNA, 25 bp, Mus musculus
gggcataactgagaatatttataag

SEQ ID NO: 331480 - DNA, 25 bp, Mus musculus
gggcataactgttatagagaatatt

SEQ ID NO: 331481 - DNA, 25 bp, Mus musculus
gggcatactgcagtgcttaaatgta

SEQ ID NO: 331482 - DNA, 25 bp, Mus musculus
gggcataggagaacattctggctca

SEQ ID NO: 331483 - DNA, 25 bp, Mus musculus
gggcataggaggtaacaacaacaaa

SEQ ID NO: 331484 - DNA, 25 bp, Mus musculus
gggcatatcaagaatgctgtgaacc

SEQ ID NO: 331485 - DNA, 25 bp, Mus musculus
gggcatatcagatacgagggcacca

SEQ ID NO: 331486 - DNA, 25 bp, Mus musculus
gggcatatcaggtcaggggtcacca

SEQ ID NO: 331487 - DNA, 25 bp, Mus musculus
gggcatcaagaagtcaacaaaaggc

SEQ ID NO: 331488 - DNA, 25 bp, Mus musculus
gggcatcaagtattggctggatccc

SEQ ID NO: 331489 - DNA, 25 bp, Mus musculus
gggcatcacagtcagtacaggctac

SEQ ID NO: 331490 - DNA, 25 bp, Mus musculus
gggcatcaccacgatcagagtgatg

SEQ ID NO: 331491 - DNA, 25 bp, Mus musculus
gggcatcaccatcgtggaagacatc

SEQ ID NO: 331492 - DNA, 25 bp, Mus musculus
gggcatcagagaggatgtaacttat

SEQ ID NO: 331493 - DNA, 25 bp, Mus musculus
gggcatcagagagggaagaaaatgg

SEQ ID NO: 331494 - DNA, 25 bp, Mus musculus
gggcatcagtgatatgtcaagaacc

SEQ ID NO: 331495 - DNA, 25 bp, Mus musculus
gggcatcagtgctaatggaggttgg

SEQ ID NO: 331496 - DNA, 25 bp, Mus musculus
gggcatcatccttagcagggagaag

SEQ ID NO: 331497 - DNA, 25 bp, Mus musculus
gggcatcatcgaagctcccatctcc

SEQ ID NO: 331498 - DNA, 25 bp, Mus musculus
gggcatcatcgaagtggaaaacatg

SEQ ID NO: 331499 - DNA, 25 bp, Mus musculus
gggcatccaagaaagatcgctcctt

SEQ ID NO: 331500 - DNA, 25 bp, Mus musculus
gggcatccacggaggaggagctgat

SEQ ID NO: 331501 - DNA, 25 bp, Mus musculus
gggcatccacggaggccctgcccag

SEQ ID NO: 331502 - DNA, 25 bp, Mus musculus
gggcatccagataagatctgtgacc

SEQ ID NO: 331503 - DNA, 25 bp, Mus musculus
gggcatccctaccattctgtccggt

SEQ ID NO: 331504 - DNA, 25 bp, Mus musculus
gggcatccgggactaggctctgtag

SEQ ID NO: 331505 - DNA, 25 bp, Mus musculus
gggcatcctgtcccgaaacaagcct

SEQ ID NO: 331506 - DNA, 25 bp, Mus musculus
gggcatccttgactccaagcggggc

SEQ ID NO: 331507 - DNA, 25 bp, Mus musculus
gggcatcgcacagctctatggtatc

SEQ ID NO: 331508 - DNA, 25 bp, Mus musculus
gggcatcggatgctggggctgcacg

SEQ ID NO: 331509 - DNA, 25 bp, Mus musculus
gggcatcgtgcaccgcctgaccccc

SEQ ID NO: 331510 - DNA, 25 bp, Mus musculus
gggcatcgtgcaccgggatttaaag

SEQ ID NO: 331511 - DNA, 25 bp, Mus musculus
gggcatcgtggaagccttgccatgc

SEQ ID NO: 331512 - DNA, 25 bp, Mus musculus
gggcatcgtggaagtggaaaaccca

SEQ ID NO: 331513 - DNA, 25 bp, Mus musculus
gggcatctcacaagttagccctaga

SEQ ID NO: 331514 - DNA, 25 bp, Mus musculus
gggcatctcactgcaatgcctgtca

SEQ ID NO: 331515 - DNA, 25 bp, Mus musculus
gggcatctcactggtggagctggca

SEQ ID NO: 331516 - DNA, 25 bp, Mus musculus
gggcatctctgagctcatgacccat

SEQ ID NO: 331517 - DNA, 25 bp, Mus musculus
gggcatctctgaggtccgatctgac

SEQ ID NO: 331518 - DNA, 25 bp, Mus musculus
gggcatctgaaggtctgccttgacc

SEQ ID NO: 331519 - DNA, 25 bp, Mus musculus
gggcatctgtgggcatgtatttaat

SEQ ID NO: 331520 - DNA, 25 bp, Mus musculus
gggcatctgtgtgatctcagtgaaa

SEQ ID NO: 331521 - DNA, 25 bp, Mus musculus
gggcatcttcaactccgagctggaa

SEQ ID NO: 331522 - DNA, 25 bp, Mus musculus
gggcatcttgcagaggaggatgact

SEQ ID NO: 331523 - DNA, 25 bp, Mus musculus
gggcatgaagctgagtgaagatggc

SEQ ID NO: 331524 - DNA, 25 bp, Mus musculus
gggcatgagcaagcacgtcgcgttt

SEQ ID NO: 331525 - DNA, 25 bp, Mus musculus
gggcatgagcctcagggccccttag

SEQ ID NO: 331526 - DNA, 25 bp, Mus musculus
gggcatgaggagaagcctatgggaa

SEQ ID NO: 331527 - DNA, 25 bp, Mus musculus
gggcatgaggctgctggcgttcccc

SEQ ID NO: 331528 - DNA, 25 bp, Mus musculus
gggcatgatgcccccgcctcctccc

SEQ ID NO: 331529 - DNA, 25 bp, Mus musculus
gggcatgcaggcttcctgctttttc

SEQ ID NO: 331530 - DNA, 25 bp, Mus musculus
gggcatggacaagtccagttcagct

SEQ ID NO: 331531 - DNA, 25 bp, Mus musculus
gggcatggcagagcaccttaaggat

SEQ ID NO: 331532 - DNA, 25 bp, Mus musculus
gggcatggcagagctccaggccggg

SEQ ID NO: 331533 - DNA, 25 bp, Mus musculus
gggcatggcagccaaagcttaatta

SEQ ID NO: 331534 - DNA, 25 bp, Mus musculus
gggcatgggatacatgccttctgcc

SEQ ID NO: 331535 - DNA, 25 bp, Mus musculus
gggcatggtgggcagcaaagattca

SEQ ID NO: 331536 - DNA, 25 bp, Mus musculus
gggcatgtagagtgatcgatggctg

SEQ ID NO: 331537 - DNA, 25 bp, Mus musculus
gggcatgtgcgggtctatgaatgag

SEQ ID NO: 331538 - DNA, 25 bp, Mus musculus
gggcatgtttacagtggccggcctc

SEQ ID NO: 331539 - DNA, 25 bp, Mus musculus
gggcatgtttacagttaggtgacag

SEQ ID NO: 331540 - DNA, 25 bp, Mus musculus
gggcattgcagatggaaggattaca

SEQ ID NO: 331541 - DNA, 25 bp, Mus musculus
gggcattgcagcgtgcaatgatgcg

SEQ ID NO: 331542 - DNA, 25 bp, Mus musculus
gggcattgcccaggtgaaaatccag

SEQ ID NO: 331543 - DNA, 25 bp, Mus musculus
gggccaaaccaatatattgtggctt

SEQ ID NO: 331544 - DNA, 25 bp, Mus musculus
gggccaaacccaaggaggcggatga

SEQ ID NO: 331545 - DNA, 25 bp, Mus musculus
gggccaaagaagattgcagagttca

SEQ ID NO: 331546 - DNA, 25 bp, Mus musculus
gggccaaattcactgctttctgtga

SEQ ID NO: 331547 - DNA, 25 bp, Mus musculus
gggccaaattcactgtatataaaat

SEQ ID NO: 331548 - DNA, 25 bp, Mus musculus
gggccaacagctgaacctgaatctc

SEQ ID NO: 331549 - DNA, 25 bp, Mus musculus
gggccaacatgtcaggggagctgaa

SEQ ID NO: 331550 - DNA, 25 bp, Mus musculus
gggccaagaagtctacatgtgggtt

SEQ ID NO: 331551 - DNA, 25 bp, Mus musculus
gggccaagcgctcaggctcagttta

SEQ ID NO: 331552 - DNA, 25 bp, Mus musculus
gggccaagcgctcagtttagcgtgc

SEQ ID NO: 331553 - DNA, 25 bp, Mus musculus
gggccaagcgtgcatggttctgcag

SEQ ID NO: 331554 - DNA, 25 bp, Mus musculus
gggccaagctcaagcaggtgttgca

SEQ ID NO: 331555 - DNA, 25 bp, Mus musculus
gggccaaggatgctgggaagtccgt

SEQ ID NO: 331556 - DNA, 25 bp, Mus musculus
gggccaaggcgtgattaaggttgag

SEQ ID NO: 331557 - DNA, 25 bp, Mus musculus
gggccaagtacacagtgtgtgattc

SEQ ID NO: 331558 - DNA, 25 bp, Mus musculus
gggccaagtctcgggtggatgaaac

SEQ ID NO: 331559 - DNA, 25 bp, Mus musculus
gggccaataagaagttgtgaagtta

SEQ ID NO: 331560 - DNA, 25 bp, Mus musculus
gggccaatcagggtccctgagttgg

SEQ ID NO: 331561 - DNA, 25 bp, Mus musculus
gggccaattctggaccaccaaggcc

SEQ ID NO: 331562 - DNA, 25 bp, Mus musculus
gggccacaaattatgtgagtgactg

SEQ ID NO: 331563 - DNA, 25 bp, Mus musculus
gggccacaagccctagcatccctgt

SEQ ID NO: 331564 - DNA, 25 bp, Mus musculus
gggccacaaggtgaccgaggcttcc

SEQ ID NO: 331565 - DNA, 25 bp, Mus musculus
gggccacactggtgctgtgacatgc

SEQ ID NO: 331566 - DNA, 25 bp, Mus musculus
gggccacagcctgggtgcctatagc

SEQ ID NO: 331567 - DNA, 25 bp, Mus musculus
gggccacagctcggtcgtccagtcc

SEQ ID NO: 331568 - DNA, 25 bp, Mus musculus
gggccacagctgctaactctcttct

SEQ ID NO: 331569 - DNA, 25 bp, Mus musculus
gggccacagggacttggatgttgtg

SEQ ID NO: 331570 - DNA, 25 bp, Mus musculus
gggccaccagcaggccgaggaaagc

SEQ ID NO: 331571 - DNA, 25 bp, Mus musculus
gggccaccaggctattacaagccag

SEQ ID NO: 331572 - DNA, 25 bp, Mus musculus
gggccacccgagcaagatcaacgag

SEQ ID NO: 331573 - DNA, 25 bp, Mus musculus
gggccaccctaaaaggaagtgctgc

SEQ ID NO: 331574 - DNA, 25 bp, Mus musculus
gggccacgtgcaggaaacatccgag

SEQ ID NO: 331575 - DNA, 25 bp, Mus musculus
gggccactaccgacatctagagcct

SEQ ID NO: 331576 - DNA, 25 bp, Mus musculus
gggccactaccgcacggactcccgt

SEQ ID NO: 331577 - DNA, 25 bp, Mus musculus
gggccactcaacccaccctcagcct

SEQ ID NO: 331578 - DNA, 25 bp, Mus musculus
gggccactcaaggttttgaggactt

SEQ ID NO: 331579 - DNA, 25 bp, Mus musculus
gggccacttgcccatgttaccagaa

SEQ ID NO: 331580 - DNA, 25 bp, Mus musculus
gggccagaagaagagtcgaaaggac

SEQ ID NO: 331581 - DNA, 25 bp, Mus musculus
gggccagaaggagctcccagcgagc

SEQ ID NO: 331582 - DNA, 25 bp, Mus musculus
gggccagaaggtgatggtgcagggc

SEQ ID NO: 331583 - DNA, 25 bp, Mus musculus
gggccagactacctgaagaaacagc

SEQ ID NO: 331584 - DNA, 25 bp, Mus musculus
gggccagactacctgactctttgag

SEQ ID NO: 331585 - DNA, 25 bp, Mus musculus
gggccagactcaggtatctgctata

SEQ ID NO: 331586 - DNA, 25 bp, Mus musculus
gggccagagacacaggaacctgagg

SEQ ID NO: 331587 - DNA, 25 bp, Mus musculus
gggccagagcacagaggcgccgagc

SEQ ID NO: 331588 - DNA, 25 bp, Mus musculus
gggccagagcagcagggccctgttc

SEQ ID NO: 331589 - DNA, 25 bp, Mus musculus
gggccagatgggccctcctggtcca

SEQ ID NO: 331590 - DNA, 25 bp, Mus musculus
gggccagcaaatagatcagagccac

SEQ ID NO: 331591 - DNA, 25 bp, Mus musculus
gggccagcaaatagttccagggtca

SEQ ID NO: 331592 - DNA, 25 bp, Mus musculus
gggccagcagactggaagctcctgg

SEQ ID NO: 331593 - DNA, 25 bp, Mus musculus
gggccagcaggtggcccgaggcagc

SEQ ID NO: 331594 - DNA, 25 bp, Mus musculus
gggccagcattgagattgaccagaa

SEQ ID NO: 331595 - DNA, 25 bp, Mus musculus
gggccagctcaggagcgccccaccc

SEQ ID NO: 331596 - DNA, 25 bp, Mus musculus
gggccagctccaggtcacaggatgc

SEQ ID NO: 331597 - DNA, 25 bp, Mus musculus
gggccagctcgcaagcaggctgaca

SEQ ID NO: 331598 - DNA, 25 bp, Mus musculus
gggccagctcgcttgaagctcctga

SEQ ID NO: 331599 - DNA, 25 bp, Mus musculus
gggccagctgaaggctctgtgggtg

SEQ ID NO: 331600 - DNA, 25 bp, Mus musculus
gggccagctgagcaattgtgttcgg

SEQ ID NO: 331601 - DNA, 25 bp, Mus musculus
gggccagctgcagagaatgttgctg

SEQ ID NO: 331602 - DNA, 25 bp, Mus musculus
gggccagctggctctggaatcatgc

SEQ ID NO: 331603 - DNA, 25 bp, Mus musculus
gggccagcttgctgccacagctgcc

SEQ ID NO: 331604 - DNA, 25 bp, Mus musculus
gggccaggacaccagctgaggaggg

SEQ ID NO: 331605 - DNA, 25 bp, Mus musculus
gggccaggacctgtgtgctcccaca

SEQ ID NO: 331606 - DNA, 25 bp, Mus musculus
gggccaggacgtggctccttccagc

SEQ ID NO: 331607 - DNA, 25 bp, Mus musculus
gggccagggatctctctctccaccc

SEQ ID NO: 331608 - DNA, 25 bp, Mus musculus
gggccagggatctgatgcgggctcc

SEQ ID NO: 331609 - DNA, 25 bp, Mus musculus
gggccagtagagtatagaaatatca

SEQ ID NO: 331610 - DNA, 25 bp, Mus musculus
gggccagtaggtccaatcagcataa

SEQ ID NO: 331611 - DNA, 25 bp, Mus musculus
gggccagtatggagacacggactat

SEQ ID NO: 331612 - DNA, 25 bp, Mus musculus
gggccagtatggagatcctcaccac

SEQ ID NO: 331613 - DNA, 25 bp, Mus musculus
gggccagtcctgtggtagaagaaag

SEQ ID NO: 331614 - DNA, 25 bp, Mus musculus
gggccagtgatgagatgccatccac

SEQ ID NO: 331615 - DNA, 25 bp, Mus musculus
gggccagtgttcacactacctttct

SEQ ID NO: 331616 - DNA, 25 bp, Mus musculus
gggccatattcaggcaaatgctgaa

SEQ ID NO: 331617 - DNA, 25 bp, Mus musculus
gggccatcaagaatgactctgtggt

SEQ ID NO: 331618 - DNA, 25 bp, Mus musculus
gggccatcaatgttggccccacggg

SEQ ID NO: 331619 - DNA, 25 bp, Mus musculus
gggccatcaatgttggtggtggctt

SEQ ID NO: 331620 - DNA, 25 bp, Mus musculus
gggccatcatcagctgcagttaaag

SEQ ID NO: 331621 - DNA, 25 bp, Mus musculus
gggccatgaagtgggctttgttatc

SEQ ID NO: 331622 - DNA, 25 bp, Mus musculus
gggccatgaccaaggacaaacagaa

SEQ ID NO: 331623 - DNA, 25 bp, Mus musculus
gggccatgaccggatttaattggtg

SEQ ID NO: 331624 - DNA, 25 bp, Mus musculus
gggccatgaccggcttccttcaata

SEQ ID NO: 331625 - DNA, 25 bp, Mus musculus
gggccatgatgagtacctataccag

SEQ ID NO: 331626 - DNA, 25 bp, Mus musculus
gggccatggagctctttctacctcc

SEQ ID NO: 331627 - DNA, 25 bp, Mus musculus
gggccatggatggcggggatctgat

SEQ ID NO: 331628 - DNA, 25 bp, Mus musculus
gggccatggatggtgttgttacaga

SEQ ID NO: 331629 - DNA, 25 bp, Mus musculus
gggccatggggcaggcagtgacgcg

SEQ ID NO: 331630 - DNA, 25 bp, Mus musculus
gggccatgtaagcagctgtccggca

SEQ ID NO: 331631 - DNA, 25 bp, Mus musculus
gggccatgtcttccctctcatggga

SEQ ID NO: 331632 - DNA, 25 bp, Mus musculus
gggccattaacaaggaccctgcagt

SEQ ID NO: 331633 - DNA, 25 bp, Mus musculus
gggccattaacaaggagacgactgc

SEQ ID NO: 331634 - DNA, 25 bp, Mus musculus
gggccattcacacaggccgatacaa

SEQ ID NO: 331635 - DNA, 25 bp, Mus musculus
gggccattcacaggcatcctacatc

SEQ ID NO: 331636 - DNA, 25 bp, Mus musculus
gggccattggaggagtctgcggtgt

SEQ ID NO: 331637 - DNA, 25 bp, Mus musculus
gggcccaaagaagacacccatataa

SEQ ID NO: 331638 - DNA, 25 bp, Mus musculus
gggcccaacagagagggcccccagc

SEQ ID NO: 331639 - DNA, 25 bp, Mus musculus
gggcccaagaaaaaggtgcgcatgg

SEQ ID NO: 331640 - DNA, 25 bp, Mus musculus
gggcccaagaggcctcaaagagcta

SEQ ID NO: 331641 - DNA, 25 bp, Mus musculus
gggcccaagaggcctcgtggagccg

SEQ ID NO: 331642 - DNA, 25 bp, Mus musculus
gggcccacagactgcagcaatggca

SEQ ID NO: 331643 - DNA, 25 bp, Mus musculus
gggcccacaggtgcagttggtgaac

SEQ ID NO: 331644 - DNA, 25 bp, Mus musculus
gggcccacagtgggggctgaagaat

SEQ ID NO: 331645 - DNA, 25 bp, Mus musculus
gggcccacagtggttctcactgtgg

SEQ ID NO: 331646 - DNA, 25 bp, Mus musculus
gggcccacagttggtgaacaactcc

SEQ ID NO: 331647 - DNA, 25 bp, Mus musculus
gggcccacctcctggcatgcggcct

SEQ ID NO: 331648 - DNA, 25 bp, Mus musculus
gggcccagaaccagggcaaaaaggc

SEQ ID NO: 331649 - DNA, 25 bp, Mus musculus
gggcccagaaccagggcaagaaagg

SEQ ID NO: 331650 - DNA, 25 bp, Mus musculus
gggcccagaaggctgagaccgctgc

SEQ ID NO: 331651 - DNA, 25 bp, Mus musculus
gggcccagagggtcgttgctccaga

SEQ ID NO: 331652 - DNA, 25 bp, Mus musculus
gggcccagccaggtagccatccctt

SEQ ID NO: 331653 - DNA, 25 bp, Mus musculus
gggcccagccaggttttcaggcttg

SEQ ID NO: 331654 - DNA, 25 bp, Mus musculus
gggcccagtgcagcaggccacgcgg

SEQ ID NO: 331655 - DNA, 25 bp, Mus musculus
gggcccagtgcagcgctgtagcatc

SEQ ID NO: 331656 - DNA, 25 bp, Mus musculus
gggcccataacgtgtttcatcccct

SEQ ID NO: 331657 - DNA, 25 bp, Mus musculus
gggcccatctcaggagcaggcgagc

SEQ ID NO: 331658 - DNA, 25 bp, Mus musculus
gggcccatctcccagactgataatg

SEQ ID NO: 331659 - DNA, 25 bp, Mus musculus
gggccccaacagcgggccacagatt

SEQ ID NO: 331660 - DNA, 25 bp, Mus musculus
gggccccaacagcgggtctggagga

SEQ ID NO: 331661 - DNA, 25 bp, Mus musculus
gggccccaagggcttctagactgga

SEQ ID NO: 331662 - DNA, 25 bp, Mus musculus
gggccccacaagatccgtgtgaatg

SEQ ID NO: 331663 - DNA, 25 bp, Mus musculus
gggccccacaaggacctgctctcct

SEQ ID NO: 331664 - DNA, 25 bp, Mus musculus
gggccccacggatgctggtggactg

SEQ ID NO: 331665 - DNA, 25 bp, Mus musculus
gggccccacggctggggactccttt

SEQ ID NO: 331666 - DNA, 25 bp, Mus musculus
gggccccagctgtttcagccatggc

SEQ ID NO: 331667 - DNA, 25 bp, Mus musculus
gggccccatcctcaggctgcgctac

SEQ ID NO: 331668 - DNA, 25 bp, Mus musculus
gggccccatcggaagctcagaacca

SEQ ID NO: 331669 - DNA, 25 bp, Mus musculus
gggcccccaagccttggaaatacag

SEQ ID NO: 331670 - DNA, 25 bp, Mus musculus
gggccccggacagagacagggcagg

SEQ ID NO: 331671 - DNA, 25 bp, Mus musculus
gggcccgaggcagaggatttggacg

SEQ ID NO: 331672 - DNA, 25 bp, Mus musculus
gggcccgcagtgtgagtgcctgctc

SEQ ID NO: 331673 - DNA, 25 bp, Mus musculus
gggcccgcagtgtggaggcagttgg

SEQ ID NO: 331674 - DNA, 25 bp, Mus musculus
gggcccgccacagctgagctgctcc

SEQ ID NO: 331675 - DNA, 25 bp, Mus musculus
gggcccgccacaggctggagcaggc

SEQ ID NO: 331676 - DNA, 25 bp, Mus musculus
gggcccgcccaaccagcagaggcct

SEQ ID NO: 331677 - DNA, 25 bp, Mus musculus
gggcccgcctcctgatccaggacca

SEQ ID NO: 331678 - DNA, 25 bp, Mus musculus
gggcccgcgcgtaggcgtcaagatc

SEQ ID NO: 331679 - DNA, 25 bp, Mus musculus
gggcccggcagaatggctcccgcaa

SEQ ID NO: 331680 - DNA, 25 bp, Mus musculus
gggcccgggagcaggctgaagctga

SEQ ID NO: 331681 - DNA, 25 bp, Mus musculus
gggcccgggccgcgccatgggctgc

SEQ ID NO: 331682 - DNA, 25 bp, Mus musculus
gggcccgggcttccgtgacctcgtg

SEQ ID NO: 331683 - DNA, 25 bp, Mus musculus
gggcccggggggaaggattggatgg

SEQ ID NO: 331684 - DNA, 25 bp, Mus musculus
gggcccgtgaggtggtgatgcttta

SEQ ID NO: 331685 - DNA, 25 bp, Mus musculus
gggcccgtgagttcatattctttgg

SEQ ID NO: 331686 - DNA, 25 bp, Mus musculus
gggcccgtggcaaaggtcttttggc

SEQ ID NO: 331687 - DNA, 25 bp, Mus musculus
gggcccgttcagggctgggcttcaa

SEQ ID NO: 331688 - DNA, 25 bp, Mus musculus
gggccctaaataaaagcctgactaa

SEQ ID NO: 331689 - DNA, 25 bp, Mus musculus
gggccctagcgcggaaacatcatcc

SEQ ID NO: 331690 - DNA, 25 bp, Mus musculus
gggccctagcgcgggctgggaaggt

SEQ ID NO: 331691 - DNA, 25 bp, Mus musculus
gggccctatcagaacaccatcgggg

SEQ ID NO: 331692 - DNA, 25 bp, Mus musculus
gggccctcagccctaccagcagtag

SEQ ID NO: 331693 - DNA, 25 bp, Mus musculus
gggccctcaggaacaatggcccaag

SEQ ID NO: 331694 - DNA, 25 bp, Mus musculus
gggccctcaggccagggggaagggc

SEQ ID NO: 331695 - DNA, 25 bp, Mus musculus
gggccctcagtgagttgcagacatt

SEQ ID NO: 331696 - DNA, 25 bp, Mus musculus
gggccctccctcagacctgggaaga

SEQ ID NO: 331697 - DNA, 25 bp, Mus musculus
gggccctccgggcagagcgccgacc

SEQ ID NO: 331698 - DNA, 25 bp, Mus musculus
gggccctcgatgagatgtgatcttc

SEQ ID NO: 331699 - DNA, 25 bp, Mus musculus
gggccctctgggaccaagaggaatg

SEQ ID NO: 331700 - DNA, 25 bp, Mus musculus
gggccctgaagagcatgacgttcct

SEQ ID NO: 331701 - DNA, 25 bp, Mus musculus
gggccctgacgatctgctggtatca

SEQ ID NO: 331702 - DNA, 25 bp, Mus musculus
gggccctgcaggactgttcccgacg

SEQ ID NO: 331703 - DNA, 25 bp, Mus musculus
gggccctgcaggaggacctggcgca

SEQ ID NO: 331704 - DNA, 25 bp, Mus musculus
gggccctggcaggacaacagtccag

SEQ ID NO: 331705 - DNA, 25 bp, Mus musculus
gggccctggggttatgagggctgga

SEQ ID NO: 331706 - DNA, 25 bp, Mus musculus
gggccctgtacccagatgaagttgc

SEQ ID NO: 331707 - DNA, 25 bp, Mus musculus
gggccctgtcacctacatggataag

SEQ ID NO: 331708 - DNA, 25 bp, Mus musculus
gggccctgtcgcctgtctgccacaa

SEQ ID NO: 331709 - DNA, 25 bp, Mus musculus
gggcccttgaagccacccgcggtca

SEQ ID NO: 331710 - DNA, 25 bp, Mus musculus
gggcccttgaagcgcggctgggttc

SEQ ID NO: 331711 - DNA, 25 bp, Mus musculus
gggcccttggaagattggctctttg

SEQ ID NO: 331712 - DNA, 25 bp, Mus musculus
gggccctttacccctgcttcctgcc

SEQ ID NO: 331713 - DNA, 25 bp, Mus musculus
gggcccttttcagtgagaaagcgct

SEQ ID NO: 331714 - DNA, 25 bp, Mus musculus
gggccgaagaggagcttggctttga

SEQ ID NO: 331715 - DNA, 25 bp, Mus musculus
gggccgactccgggacagacaatct

SEQ ID NO: 331716 - DNA, 25 bp, Mus musculus
gggccgactccgtggaaacctctgt

SEQ ID NO: 331717 - DNA, 25 bp, Mus musculus
gggccgagcgaacgagtatcagcat

SEQ ID NO: 331718 - DNA, 25 bp, Mus musculus
gggccgaggaagaactccagttctc

SEQ ID NO: 331719 - DNA, 25 bp, Mus musculus
gggccgaggcgaagcccgacatccc

SEQ ID NO: 331720 - DNA, 25 bp, Mus musculus
gggccgaggggtgaggagatttgaa

SEQ ID NO: 331721 - DNA, 25 bp, Mus musculus
gggccgcacggttggtacacgatgt

SEQ ID NO: 331722 - DNA, 25 bp, Mus musculus
gggccgcagcctggtaacgaaggca

SEQ ID NO: 331723 - DNA, 25 bp, Mus musculus
gggccgcagcctgttgggcaaggcg

SEQ ID NO: 331724 - DNA, 25 bp, Mus musculus
gggccgccaaggtatgccatcatgc

SEQ ID NO: 331725 - DNA, 25 bp, Mus musculus
gggccgccagaattcagtagctttg

SEQ ID NO: 331726 - DNA, 25 bp, Mus musculus
gggccgccagatagaaggacaagga

SEQ ID NO: 331727 - DNA, 25 bp, Mus musculus
gggccgccagccaggattggatcca

SEQ ID NO: 331728 - DNA, 25 bp, Mus musculus
gggccgccatatgagacggtttaag

SEQ ID NO: 331729 - DNA, 25 bp, Mus musculus
gggccgccatattcattccttggaa

SEQ ID NO: 331730 - DNA, 25 bp, Mus musculus
gggccgccctataggaaatggaatt

SEQ ID NO: 331731 - DNA, 25 bp, Mus musculus
gggccgccgccaggtgtgcaacaga

SEQ ID NO: 331732 - DNA, 25 bp, Mus musculus
gggccgccgctgagcgccggagtac

SEQ ID NO: 331733 - DNA, 25 bp, Mus musculus
gggccgccggcgtcgcacccctctc

SEQ ID NO: 331734 - DNA, 25 bp, Mus musculus
gggccgccggcgtcggcctttcttt

SEQ ID NO: 331735 - DNA, 25 bp, Mus musculus
gggccgcctcccaaggttacactgt

SEQ ID NO: 331736 - DNA, 25 bp, Mus musculus
gggccgcctgcgcggctggccagct

SEQ ID NO: 331737 - DNA, 25 bp, Mus musculus
gggccgccttggcttcctttctgac

SEQ ID NO: 331738 - DNA, 25 bp, Mus musculus
gggccgcgacatggactgtcctgtg

SEQ ID NO: 331739 - DNA, 25 bp, Mus musculus
gggccgcgcctactgactatcaatg

SEQ ID NO: 331740 - DNA, 25 bp, Mus musculus
gggccgcgcctactgttccaggact

SEQ ID NO: 331741 - DNA, 25 bp, Mus musculus
gggccgcgctgggaggcatgtcatg

SEQ ID NO: 331742 - DNA, 25 bp, Mus musculus
gggccgcggggcgatgtgagcccca

SEQ ID NO: 331743 - DNA, 25 bp, Mus musculus
gggccgctacggaagcctttgcttc

SEQ ID NO: 331744 - DNA, 25 bp, Mus musculus
gggccgctacgtgaatgagatcaag

SEQ ID NO: 331745 - DNA, 25 bp, Mus musculus
gggccgctcagcttactattaccat

SEQ ID NO: 331746 - DNA, 25 bp, Mus musculus
gggccgctcgatgaacctctagtct

SEQ ID NO: 331747 - DNA, 25 bp, Mus musculus
gggccgctgctgggaataacagaca

SEQ ID NO: 331748 - DNA, 25 bp, Mus musculus
gggccggaaaagacaaggaccagca

SEQ ID NO: 331749 - DNA, 25 bp, Mus musculus
gggccggacaggattgtggaattca

SEQ ID NO: 331750 - DNA, 25 bp, Mus musculus
gggccggacagtgtctcgttcgatc

SEQ ID NO: 331751 - DNA, 25 bp, Mus musculus
gggccggaccgagaaagggctatgt

SEQ ID NO: 331752 - DNA, 25 bp, Mus musculus
gggccggaccgcacagagaatgaac

SEQ ID NO: 331753 - DNA, 25 bp, Mus musculus
gggccggacctacaacttctgaaaa

SEQ ID NO: 331754 - DNA, 25 bp, Mus musculus
gggccggacctacactgatgaagag

SEQ ID NO: 331755 - DNA, 25 bp, Mus musculus
gggccggagacacagcttggtgaca

SEQ ID NO: 331756 - DNA, 25 bp, Mus musculus
gggccggagacacaggccccatggg

SEQ ID NO: 331757 - DNA, 25 bp, Mus musculus
gggccggccagatgggcaagagttc

SEQ ID NO: 331758 - DNA, 25 bp, Mus musculus
gggccggcgccgggagtcctgttga

SEQ ID NO: 331759 - DNA, 25 bp, Mus musculus
gggccggctgcacaatctgcctgtg

SEQ ID NO: 331760 - DNA, 25 bp, Mus musculus
gggccggctggcagaacacagatct

SEQ ID NO: 331761 - DNA, 25 bp, Mus musculus
gggccggctgtgtggcctcttcctg

SEQ ID NO: 331762 - DNA, 25 bp, Mus musculus
gggccggggtgtgcacatggaagat

SEQ ID NO: 331763 - DNA, 25 bp, Mus musculus
gggccgtaagagtgcagaccataat

SEQ ID NO: 331764 - DNA, 25 bp, Mus musculus
gggccgtacacccagagaacctgtc

SEQ ID NO: 331765 - DNA, 25 bp, Mus musculus
gggccgtacacccagcttccggaat

SEQ ID NO: 331766 - DNA, 25 bp, Mus musculus
gggccgtagggctgttgacctatca

SEQ ID NO: 331767 - DNA, 25 bp, Mus musculus
gggccgtgaggaggataaaagcagc

SEQ ID NO: 331768 - DNA, 25 bp, Mus musculus
gggccgtgaggtatccagctcatat

SEQ ID NO: 331769 - DNA, 25 bp, Mus musculus
gggccgtggaagagtgaagacacct

SEQ ID NO: 331770 - DNA, 25 bp, Mus musculus
gggccgtgtgagagattggtgtcct

SEQ ID NO: 331771 - DNA, 25 bp, Mus musculus
gggccgttagtggcggcttgacatc

SEQ ID NO: 331772 - DNA, 25 bp, Mus musculus
gggccgttatctcacggcgaacttt

SEQ ID NO: 331773 - DNA, 25 bp, Mus musculus
gggccgttgggcgtcgcggctttac

SEQ ID NO: 331774 - DNA, 25 bp, Mus musculus
gggcctaactggtttgcatttcctc

SEQ ID NO: 331775 - DNA, 25 bp, Mus musculus
gggcctaatgacagtaattatgcca

SEQ ID NO: 331776 - DNA, 25 bp, Mus musculus
gggcctacacctcggagacctacct

SEQ ID NO: 331777 - DNA, 25 bp, Mus musculus
gggcctacagaagaggaggccactg

SEQ ID NO: 331778 - DNA, 25 bp, Mus musculus
gggcctaccaggataaggaagcctg

SEQ ID NO: 331779 - DNA, 25 bp, Mus musculus
gggcctagactttctgagtaccatg

SEQ ID NO: 331780 - DNA, 25 bp, Mus musculus
gggcctagatctaaggaactaatga

SEQ ID NO: 331781 - DNA, 25 bp, Mus musculus
gggcctagcagtggcatctttctta

SEQ ID NO: 331782 - DNA, 25 bp, Mus musculus
gggcctatacgctgcctggctcact

SEQ ID NO: 331783 - DNA, 25 bp, Mus musculus
gggcctatagataagaatagcagag

SEQ ID NO: 331784 - DNA, 25 bp, Mus musculus
gggcctatgggacaccactgtccca

SEQ ID NO: 331785 - DNA, 25 bp, Mus musculus
gggcctattaagctgatccacaccg

SEQ ID NO: 331786 - DNA, 25 bp, Mus musculus
gggcctattaagggctcgctgctga

SEQ ID NO: 331787 - DNA, 25 bp, Mus musculus
gggcctcacaccaagcctgaagaac

SEQ ID NO: 331788 - DNA, 25 bp, Mus musculus
gggcctcaccagtgaagcggcccct

SEQ ID NO: 331789 - DNA, 25 bp, Mus musculus
gggcctccagcaggaacacagagga

SEQ ID NO: 331790 - DNA, 25 bp, Mus musculus
gggcctccatacagtgctctgtgaa

SEQ ID NO: 331791 - DNA, 25 bp, Mus musculus
gggcctccccagcagtcctttgaga

SEQ ID NO: 331792 - DNA, 25 bp, Mus musculus
gggcctccgagaggttggcctgctt

SEQ ID NO: 331793 - DNA, 25 bp, Mus musculus
gggcctccgtcccccacacacctgc

SEQ ID NO: 331794 - DNA, 25 bp, Mus musculus
gggcctcctggaatgccgccatgac

SEQ ID NO: 331795 - DNA, 25 bp, Mus musculus
gggcctcctggccaggtggccattg

SEQ ID NO: 331796 - DNA, 25 bp, Mus musculus
gggcctcgtactcagaaacgaaagc

SEQ ID NO: 331797 - DNA, 25 bp, Mus musculus
gggcctcgtggagttcaggaccttg

SEQ ID NO: 331798 - DNA, 25 bp, Mus musculus
gggcctctaggaaggtatggcctca

SEQ ID NO: 331799 - DNA, 25 bp, Mus musculus
gggcctctcaaaggacagtgaactt

SEQ ID NO: 331800 - DNA, 25 bp, Mus musculus
gggcctctcaactggtgtggtgtgg

SEQ ID NO: 331801 - DNA, 25 bp, Mus musculus
gggcctctgagaaggagcgcagacc

SEQ ID NO: 331802 - DNA, 25 bp, Mus musculus
gggcctctgctgtgctgaaatggag

SEQ ID NO: 331803 - DNA, 25 bp, Mus musculus
gggcctctgtgtggatgccttcaaa

SEQ ID NO: 331804 - DNA, 25 bp, Mus musculus
gggcctctgtgtgggtactatcttg

SEQ ID NO: 331805 - DNA, 25 bp, Mus musculus
gggcctgaagccggtcgacaatgga

SEQ ID NO: 331806 - DNA, 25 bp, Mus musculus
gggcctgaaggacctccacaggagt

SEQ ID NO: 331807 - DNA, 25 bp, Mus musculus
gggcctgaatgatatgtttggaccc

SEQ ID NO: 331808 - DNA, 25 bp, Mus musculus
gggcctgaatggctccgtgctctgt

SEQ ID NO: 331809 - DNA, 25 bp, Mus musculus
gggcctgaatgtctcttacagatat

SEQ ID NO: 331810 - DNA, 25 bp, Mus musculus
gggcctgaccttccaatctgaacat

SEQ ID NO: 331811 - DNA, 25 bp, Mus musculus
gggcctgagcattggaaacaagctc

SEQ ID NO: 331812 - DNA, 25 bp, Mus musculus
gggcctgatgggcaggcaccaggag

SEQ ID NO: 331813 - DNA, 25 bp, Mus musculus
gggcctgcagagaggaaaaccaaag

SEQ ID NO: 331814 - DNA, 25 bp, Mus musculus
gggcctgccagggacatcacagtgg

SEQ ID NO: 331815 - DNA, 25 bp, Mus musculus
gggcctgccgctgggcgtccgacct

SEQ ID NO: 331816 - DNA, 25 bp, Mus musculus
gggcctgccgctggtaagactttga

SEQ ID NO: 331817 - DNA, 25 bp, Mus musculus
gggcctgcggtagaaaaagcagacg

SEQ ID NO: 331818 - DNA, 25 bp, Mus musculus
gggcctgctacaaggtgcagcagaa

SEQ ID NO: 331819 - DNA, 25 bp, Mus musculus
gggcctgctggcagcctccggaccc

SEQ ID NO: 331820 - DNA, 25 bp, Mus musculus
gggcctggagaaagagtggaggtga

SEQ ID NO: 331821 - DNA, 25 bp, Mus musculus
gggcctggaggacatcatgttcatg

SEQ ID NO: 331822 - DNA, 25 bp, Mus musculus
gggcctggcaggggctgcgatggac

SEQ ID NO: 331823 - DNA, 25 bp, Mus musculus
gggcctggcaggttcagtcctcgcc

SEQ ID NO: 331824 - DNA, 25 bp, Mus musculus
gggcctggccaggagtgaattggag

SEQ ID NO: 331825 - DNA, 25 bp, Mus musculus
gggcctggcccacagaattacggca

SEQ ID NO: 331826 - DNA, 25 bp, Mus musculus
gggcctggcccacagactgaccctt

SEQ ID NO: 331827 - DNA, 25 bp, Mus musculus
gggcctggctgggatgggtgctaca

SEQ ID NO: 331828 - DNA, 25 bp, Mus musculus
gggcctggtgcagctggtgctgctg

SEQ ID NO: 331829 - DNA, 25 bp, Mus musculus
gggccttaaatcagtgtcggtgacg

SEQ ID NO: 331830 - DNA, 25 bp, Mus musculus
gggccttcaaccgaaacaagctccc

SEQ ID NO: 331831 - DNA, 25 bp, Mus musculus
gggccttcaagaaaattacaacacc

SEQ ID NO: 331832 - DNA, 25 bp, Mus musculus
gggccttcactggggcactcagaaa

SEQ ID NO: 331833 - DNA, 25 bp, Mus musculus
gggccttcaggaagatgctaccaag

SEQ ID NO: 331834 - DNA, 25 bp, Mus musculus
gggccttccagccatgctgcaagct

SEQ ID NO: 331835 - DNA, 25 bp, Mus musculus
gggccttccgctctgtgcctcactc

SEQ ID NO: 331836 - DNA, 25 bp, Mus musculus
gggccttgaggacctgctctccttg

SEQ ID NO: 331837 - DNA, 25 bp, Mus musculus
gggccttgccaaggtccacccgact

SEQ ID NO: 331838 - DNA, 25 bp, Mus musculus
gggccttgggggcctgggctggtgc

SEQ ID NO: 331839 - DNA, 25 bp, Mus musculus
gggccttgtacaggtatcacaaggc

SEQ ID NO: 331840 - DNA, 25 bp, Mus musculus
gggccttgtgttttttcagttctac

SEQ ID NO: 331841 - DNA, 25 bp, Mus musculus
gggcctttatggcatctgaacgcct

SEQ ID NO: 331842 - DNA, 25 bp, Mus musculus
gggcctttgctggggacagtaaatc

SEQ ID NO: 331843 - DNA, 25 bp, Mus musculus
gggcctttgttcaagcacacaacca

SEQ ID NO: 331844 - DNA, 25 bp, Mus musculus
gggccttttggtctggaagctgaca

SEQ ID NO: 331845 - DNA, 25 bp, Mus musculus
gggcctttttcctatattgttgatc

SEQ ID NO: 331846 - DNA, 25 bp, Mus musculus
gggcctttttcctattcttctgccc

SEQ ID NO: 331847 - DNA, 25 bp, Mus musculus
gggcgaaagaagagtggaggaacca

SEQ ID NO: 331848 - DNA, 25 bp, Mus musculus
gggcgaagctcaaggccacttctta

SEQ ID NO: 331849 - DNA, 25 bp, Mus musculus
gggcgacaccggcagaaaaagttac

SEQ ID NO: 331850 - DNA, 25 bp, Mus musculus
gggcgacaccggcagttccagttac

SEQ ID NO: 331851 - DNA, 25 bp, Mus musculus
gggcgaccagatgcggtggtagcaa

SEQ ID NO: 331852 - DNA, 25 bp, Mus musculus
gggcgaccagccaggtcccagtgat

SEQ ID NO: 331853 - DNA, 25 bp, Mus musculus
gggcgaccaggacctataagaacag

SEQ ID NO: 331854 - DNA, 25 bp, Mus musculus
gggcgaccccggcaggtcagaagac

SEQ ID NO: 331855 - DNA, 25 bp, Mus musculus
gggcgacgccgcgaggatctaagat

SEQ ID NO: 331856 - DNA, 25 bp, Mus musculus
gggcgacggaagctgagccagaccc

SEQ ID NO: 331857 - DNA, 25 bp, Mus musculus
gggcgacggaagctgatcctcttcc

SEQ ID NO: 331858 - DNA, 25 bp, Mus musculus
gggcgacggcgctatggtggattgt

SEQ ID NO: 331859 - DNA, 25 bp, Mus musculus
gggcgactcaggcaccatgagccag

SEQ ID NO: 331860 - DNA, 25 bp, Mus musculus
gggcgagaaactgatgaagtgactg

SEQ ID NO: 331861 - DNA, 25 bp, Mus musculus
gggcgagaacctggagacggaccag

SEQ ID NO: 331862 - DNA, 25 bp, Mus musculus
gggcgagaagggagatcctggtatt

SEQ ID NO: 331863 - DNA, 25 bp, Mus musculus
gggcgagacacattgcgctggctcc

SEQ ID NO: 331864 - DNA, 25 bp, Mus musculus
gggcgagagtgggctgtaaaaaatg

SEQ ID NO: 331865 - DNA, 25 bp, Mus musculus
gggcgagatgagcaaccctggggaa

SEQ ID NO: 331866 - DNA, 25 bp, Mus musculus
gggcgagcagagcagacccaggaga

SEQ ID NO: 331867 - DNA, 25 bp, Mus musculus
gggcgagcaggtggaagggactcag

SEQ ID NO: 331868 - DNA, 25 bp, Mus musculus
gggcgagcccaagatctataacaat

SEQ ID NO: 331869 - DNA, 25 bp, Mus musculus
gggcgagcccaggatgggctctaag

SEQ ID NO: 331870 - DNA, 25 bp, Mus musculus
gggcgagcgaagtaagcggaggcct

SEQ ID NO: 331871 - DNA, 25 bp, Mus musculus
gggcgagcgggaacagaactcaaac

SEQ ID NO: 331872 - DNA, 25 bp, Mus musculus
gggcgagctccggaaaattgtgcaa

SEQ ID NO: 331873 - DNA, 25 bp, Mus musculus
gggcgagctgtaaaagctggcaggc

SEQ ID NO: 331874 - DNA, 25 bp, Mus musculus
gggcgagctgttgatgtgatggcac

SEQ ID NO: 331875 - DNA, 25 bp, Mus musculus
gggcgaggagcagaggctgtgtgaa

SEQ ID NO: 331876 - DNA, 25 bp, Mus musculus
gggcgaggccgatactccatgtttc

SEQ ID NO: 331877 - DNA, 25 bp, Mus musculus
gggcgagtctcggcaaagtctactg

SEQ ID NO: 331878 - DNA, 25 bp, Mus musculus
gggcgagtctcgggactgaggctca

SEQ ID NO: 331879 - DNA, 25 bp, Mus musculus
gggcgagtgcggtttcgtggtggct

SEQ ID NO: 331880 - DNA, 25 bp, Mus musculus
gggcgagttaaagcacatggtgatg

SEQ ID NO: 331881 - DNA, 25 bp, Mus musculus
gggcgatcccacagatccaactttt

SEQ ID NO: 331882 - DNA, 25 bp, Mus musculus
gggcgatcccacagtgcaatttggt

SEQ ID NO: 331883 - DNA, 25 bp, Mus musculus
gggcgatccggaacctggtggccat

SEQ ID NO: 331884 - DNA, 25 bp, Mus musculus
gggcgatccgggaaggccatagcca

SEQ ID NO: 331885 - DNA, 25 bp, Mus musculus
gggcgatggggcactggctccagca

SEQ ID NO: 331886 - DNA, 25 bp, Mus musculus
gggcgcaaacagaaaactcagaact

SEQ ID NO: 331887 - DNA, 25 bp, Mus musculus
gggcgcacagccctgtgaagccaga

SEQ ID NO: 331888 - DNA, 25 bp, Mus musculus
gggcgcaccaaggccatggtggcgt

SEQ ID NO: 331889 - DNA, 25 bp, Mus musculus
gggcgcacgaagaagactggaaaca

SEQ ID NO: 331890 - DNA, 25 bp, Mus musculus
gggcgcacgaagaagcctcagcaaa

SEQ ID NO: 331891 - DNA, 25 bp, Mus musculus
gggcgcacggttcagcaactgcgct

SEQ ID NO: 331892 - DNA, 25 bp, Mus musculus
gggcgcagacatgaaagcttgcggc

SEQ ID NO: 331893 - DNA, 25 bp, Mus musculus
gggcgcagacgagagtctcggccac

SEQ ID NO: 331894 - DNA, 25 bp, Mus musculus
gggcgcagagaagagcaccctccaa

SEQ ID NO: 331895 - DNA, 25 bp, Mus musculus
gggcgcagagaaggtcctaaagggg

SEQ ID NO: 331896 - DNA, 25 bp, Mus musculus
gggcgcagatgatggctctgtggcc

SEQ ID NO: 331897 - DNA, 25 bp, Mus musculus
gggcgcagtcctaaatggtggccct

SEQ ID NO: 331898 - DNA, 25 bp, Mus musculus
gggcgcatcgcagagttgacatcct

SEQ ID NO: 331899 - DNA, 25 bp, Mus musculus
gggcgcatcgcggcctcaaagcgga

SEQ ID NO: 331900 - DNA, 25 bp, Mus musculus
gggcgccactgccaggtcagatgct

SEQ ID NO: 331901 - DNA, 25 bp, Mus musculus
gggcgccactgccagtggccaaacg

SEQ ID NO: 331902 - DNA, 25 bp, Mus musculus
gggcgccagatgctggaggtaaaga

SEQ ID NO: 331903 - DNA, 25 bp, Mus musculus
gggcgcccaggggagatgtatacca

SEQ ID NO: 331904 - DNA, 25 bp, Mus musculus
gggcgccccctgcagttggacattt

SEQ ID NO: 331905 - DNA, 25 bp, Mus musculus
gggcgccggccacggcccggacaca

SEQ ID NO: 331906 - DNA, 25 bp, Mus musculus
gggcgccgggagtcgattttaggtg

SEQ ID NO: 331907 - DNA, 25 bp, Mus musculus
gggcgccgggcttcttcacaaaatc

SEQ ID NO: 331908 - DNA, 25 bp, Mus musculus
gggcgccgtctctggcaggcactgt

SEQ ID NO: 331909 - DNA, 25 bp, Mus musculus
gggcgcctagcgctttgagcttcca

SEQ ID NO: 331910 - DNA, 25 bp, Mus musculus
gggcgcctccagaacagcatgtttt

SEQ ID NO: 331911 - DNA, 25 bp, Mus musculus
gggcgcctccaggaacacttctgtt

SEQ ID NO: 331912 - DNA, 25 bp, Mus musculus
gggcgcgcaggtgtccacagaactg

SEQ ID NO: 331913 - DNA, 25 bp, Mus musculus
gggcgcgccctcaagaacagaagca

SEQ ID NO: 331914 - DNA, 25 bp, Mus musculus
gggcgcgccctcacgtctgactcta

SEQ ID NO: 331915 - DNA, 25 bp, Mus musculus
gggcgcgcgccagttggacatttgg

SEQ ID NO: 331916 - DNA, 25 bp, Mus musculus
gggcgcgcgcgtgacgagtgaccaa

SEQ ID NO: 331917 - DNA, 25 bp, Mus musculus
gggcgcgcggtgtgaagaaaaaggg

SEQ ID NO: 331918 - DNA, 25 bp, Mus musculus
gggcgcgctaaaaatgcttgtttct

SEQ ID NO: 331919 - DNA, 25 bp, Mus musculus
gggcgcgctcggagacattccaaat

SEQ ID NO: 331920 - DNA, 25 bp, Mus musculus
gggcgcggagcagggcggcgagtcc

SEQ ID NO: 331921 - DNA, 25 bp, Mus musculus
gggcgcggagccggttcgaggagca

SEQ ID NO: 331922 - DNA, 25 bp, Mus musculus
gggcgcggccagggcaaagtgcaaa

SEQ ID NO: 331923 - DNA, 25 bp, Mus musculus
gggcgcggtcaagaaaggctctgga

SEQ ID NO: 331924 - DNA, 25 bp, Mus musculus
gggcgcggtcaaggatcatctgctt

SEQ ID NO: 331925 - DNA, 25 bp, Mus musculus
gggcgctacagggcttttctccaga

SEQ ID NO: 331926 - DNA, 25 bp, Mus musculus
gggcgctacaggtggacaacatcag

SEQ ID NO: 331927 - DNA, 25 bp, Mus musculus
gggcgctcagcagttctccgacctg

SEQ ID NO: 331928 - DNA, 25 bp, Mus musculus
gggcgctgacaggtactgggtttgg

SEQ ID NO: 331929 - DNA, 25 bp, Mus musculus
gggcgctgcacgccttcagagacgg

SEQ ID NO: 331930 - DNA, 25 bp, Mus musculus
gggcgctgcaggggctgacatggac

SEQ ID NO: 331931 - DNA, 25 bp, Mus musculus
gggcgctgcagggtaattcagagat

SEQ ID NO: 331932 - DNA, 25 bp, Mus musculus
gggcgctgccacagcgctgtgtagt

SEQ ID NO: 331933 - DNA, 25 bp, Mus musculus
gggcgctggaagagactctcatgga

SEQ ID NO: 331934 - DNA, 25 bp, Mus musculus
gggcgctggcgcaagatgacgttgc

SEQ ID NO: 331935 - DNA, 25 bp, Mus musculus
gggcgctggcggaatggcttccttt

SEQ ID NO: 331936 - DNA, 25 bp, Mus musculus
gggcgctgggcagacgaaagagcct

SEQ ID NO: 331937 - DNA, 25 bp, Mus musculus
gggcgctgggcagtccattctcttt

SEQ ID NO: 331938 - DNA, 25 bp, Mus musculus
gggcgctggtcgggctgtggcagtt

SEQ ID NO: 331939 - DNA, 25 bp, Mus musculus
gggcgctgtggagataaagaagctg

SEQ ID NO: 331940 - DNA, 25 bp, Mus musculus
gggcgctttgtgcaggaagaagact

SEQ ID NO: 331941 - DNA, 25 bp, Mus musculus
gggcggacagacctacgcaatgatg

SEQ ID NO: 331942 - DNA, 25 bp, Mus musculus
gggcggacagatctgacacacatga

SEQ ID NO: 331943 - DNA, 25 bp, Mus musculus
gggcggactaataggactgaggatc

SEQ ID NO: 331944 - DNA, 25 bp, Mus musculus
gggcggactaataggcagatacatg

SEQ ID NO: 331945 - DNA, 25 bp, Mus musculus
gggcggacttcaggtgactcggact

SEQ ID NO: 331946 - DNA, 25 bp, Mus musculus
gggcggacttcaggtgattcacaag

SEQ ID NO: 331947 - DNA, 25 bp, Mus musculus
gggcggacttccaggctcagtgttt

SEQ ID NO: 331948 - DNA, 25 bp, Mus musculus
gggcggagaggcaggtctctggagc

SEQ ID NO: 331949 - DNA, 25 bp, Mus musculus
gggcggagatctgagtgcccgtcct

SEQ ID NO: 331950 - DNA, 25 bp, Mus musculus
gggcggagccagatttagatgaaaa

SEQ ID NO: 331951 - DNA, 25 bp, Mus musculus
gggcggagctgtagatatggcataa

SEQ ID NO: 331952 - DNA, 25 bp, Mus musculus
gggcggagctgtagctggcccatga

SEQ ID NO: 331953 - DNA, 25 bp, Mus musculus
gggcggagctgtaggcaagagataa

SEQ ID NO: 331954 - DNA, 25 bp, Mus musculus
gggcggaggccgcgtgtaatgttca

SEQ ID NO: 331955 - DNA, 25 bp, Mus musculus
gggcggagtcgcaggtgactccata

SEQ ID NO: 331956 - DNA, 25 bp, Mus musculus
gggcggagtcgcaggtgttttgcaa

SEQ ID NO: 331957 - DNA, 25 bp, Mus musculus
gggcggcacgggaaggcagaagaaa

SEQ ID NO: 331958 - DNA, 25 bp, Mus musculus
gggcggcagcgtgcctgaagacctg

SEQ ID NO: 331959 - DNA, 25 bp, Mus musculus
gggcggccagagggttggtcctgtg

SEQ ID NO: 331960 - DNA, 25 bp, Mus musculus
gggcggccagccttgcactatgtcc

SEQ ID NO: 331961 - DNA, 25 bp, Mus musculus
gggcggccagttggggtgctgtgga

SEQ ID NO: 331962 - DNA, 25 bp, Mus musculus
gggcggccgggagagaccctcagga

SEQ ID NO: 331963 - DNA, 25 bp, Mus musculus
gggcggccgggagagacgcagtgag

SEQ ID NO: 331964 - DNA, 25 bp, Mus musculus
gggcggccgtcaggagcagccatgt

SEQ ID NO: 331965 - DNA, 25 bp, Mus musculus
gggcggcctgatctggaagtggctc

SEQ ID NO: 331966 - DNA, 25 bp, Mus musculus
gggcggcgccaggtctgaccacccg

SEQ ID NO: 331967 - DNA, 25 bp, Mus musculus
gggcggcggagagttgtctgctggt

SEQ ID NO: 331968 - DNA, 25 bp, Mus musculus
gggcggcggggaggacttgcactaa

SEQ ID NO: 331969 - DNA, 25 bp, Mus musculus
gggcggcggtgcagatttcttgacc

SEQ ID NO: 331970 - DNA, 25 bp, Mus musculus
gggcggctgacagcgtcctgaggtt

SEQ ID NO: 331971 - DNA, 25 bp, Mus musculus
gggcggctgacaggttcttacagtc

SEQ ID NO: 331972 - DNA, 25 bp, Mus musculus
gggcggctggaggaggcgggcgtcc

SEQ ID NO: 331973 - DNA, 25 bp, Mus musculus
gggcgggaaccaggtgctacagaag

SEQ ID NO: 331974 - DNA, 25 bp, Mus musculus
gggcgggacccagctgaccttaaga

SEQ ID NO: 331975 - DNA, 25 bp, Mus musculus
gggcgggaccgcagattatttttaa

SEQ ID NO: 331976 - DNA, 25 bp, Mus musculus
gggcgggaccgcagggattctcctg

SEQ ID NO: 331977 - DNA, 25 bp, Mus musculus
gggcgggactggtctccaaaaatgc

SEQ ID NO: 331978 - DNA, 25 bp, Mus musculus
gggcgggagagatggatgcgagttc

SEQ ID NO: 331979 - DNA, 25 bp, Mus musculus
gggcgggaggcgaagactcatgaaa

SEQ ID NO: 331980 - DNA, 25 bp, Mus musculus
gggcgggagggctgggcctgcagcc

SEQ ID NO: 331981 - DNA, 25 bp, Mus musculus
gggcgggccaccaggctattacaag

SEQ ID NO: 331982 - DNA, 25 bp, Mus musculus
gggcgggcgcagagctgagatactg

SEQ ID NO: 331983 - DNA, 25 bp, Mus musculus
gggcgggcgcagtgttatccacaca

SEQ ID NO: 331984 - DNA, 25 bp, Mus musculus
gggcgggctgacgcttcccaacctg

SEQ ID NO: 331985 - DNA, 25 bp, Mus musculus
gggcgggctgctgagaagacgcttc

SEQ ID NO: 331986 - DNA, 25 bp, Mus musculus
gggcgggctggtatgcgtcttctgc

SEQ ID NO: 331987 - DNA, 25 bp, Mus musculus
gggcgggctggtgagaagacgcttc

SEQ ID NO: 331988 - DNA, 25 bp, Mus musculus
gggcgggcttagggtggagcgaccc

SEQ ID NO: 331989 - DNA, 25 bp, Mus musculus
gggcggggcctcggaaccgtctgga

SEQ ID NO: 331990 - DNA, 25 bp, Mus musculus
gggcgggtacggcctacgagttaca

SEQ ID NO: 331991 - DNA, 25 bp, Mus musculus
gggcgggtcagcaagctccgggcct

SEQ ID NO: 331992 - DNA, 25 bp, Mus musculus
gggcgggtcagcggccctgtgagtg

SEQ ID NO: 331993 - DNA, 25 bp, Mus musculus
gggcgggtgtggcaggaatgattaa

SEQ ID NO: 331994 - DNA, 25 bp, Mus musculus
gggcggttgcctgtagtcagaagat

SEQ ID NO: 331995 - DNA, 25 bp, Mus musculus
gggcggttgggcagtgaatccaaaa

SEQ ID NO: 331996 - DNA, 25 bp, Mus musculus
gggcgtaacaagccgcattttctgg

SEQ ID NO: 331997 - DNA, 25 bp, Mus musculus
gggcgtagctctggtgcaccctctg

SEQ ID NO: 331998 - DNA, 25 bp, Mus musculus
gggcgtagctctgttcccacttcac

SEQ ID NO: 331999 - DNA, 25 bp, Mus musculus
gggcgtatgctgggtgaacttcgag

SEQ ID NO: 332000 - DNA, 25 bp, Mus musculus
gggcgtcctgaagcgctgtgctttg

SEQ ID NO: 332001 - DNA, 25 bp, Mus musculus
gggcgtctcctgcacgtgaggagca

SEQ ID NO: 332002 - DNA, 25 bp, Mus musculus
gggcgtctgggcaagacctgcaggc

SEQ ID NO: 332003 - DNA, 25 bp, Mus musculus
gggcgtcttagatgacgtggtctcc

SEQ ID NO: 332004 - DNA, 25 bp, Mus musculus
gggcgtgaaactgacaccccggagg

SEQ ID NO: 332005 - DNA, 25 bp, Mus musculus
gggcgtgccgacagactaacctaac

SEQ ID NO: 332006 - DNA, 25 bp, Mus musculus
gggcgtgccgacaggagatgatttc

SEQ ID NO: 332007 - DNA, 25 bp, Mus musculus
gggcgtgcggattgtcgcagcaata

SEQ ID NO: 332008 - DNA, 25 bp, Mus musculus
gggcgtggaagaggtcagcagagca

SEQ ID NO: 332009 - DNA, 25 bp, Mus musculus
gggcgtggaagaggtcagggccaaa

SEQ ID NO: 332010 - DNA, 25 bp, Mus musculus
gggcgtggaagctatggaggttttg

SEQ ID NO: 332011 - DNA, 25 bp, Mus musculus
gggcgttaaagctctcgtggcgctc

SEQ ID NO: 332012 - DNA, 25 bp, Mus musculus
gggcgttcaacgctccagttataaa

SEQ ID NO: 332013 - DNA, 25 bp, Mus musculus
gggcgttcagtatgcctgtgtcttg

SEQ ID NO: 332014 - DNA, 25 bp, Mus musculus
gggcgttcttgctaactgtccagtt

SEQ ID NO: 332015 - DNA, 25 bp, Mus musculus
gggcgttgtcacctgaggcccttct

SEQ ID NO: 332016 - DNA, 25 bp, Mus musculus
gggcgttgtcacctggagcattcca

SEQ ID NO: 332017 - DNA, 25 bp, Mus musculus
gggctaacatgaagctgttctttct

SEQ ID NO: 332018 - DNA, 25 bp, Mus musculus
gggctaacatgaaggcagacaagtt

SEQ ID NO: 332019 - DNA, 25 bp, Mus musculus
gggctaacggatttgtcccactcac

SEQ ID NO: 332020 - DNA, 25 bp, Mus musculus
gggctaacggatttgttggatggat

SEQ ID NO: 332021 - DNA, 25 bp, Mus musculus
gggctaagggacagatggctatgaa

SEQ ID NO: 332022 - DNA, 25 bp, Mus musculus
gggctaagggacagggggctgaaag

SEQ ID NO: 332023 - DNA, 25 bp, Mus musculus
gggctaatgcagagatccactgcca

SEQ ID NO: 332024 - DNA, 25 bp, Mus musculus
gggctaatgcagaggggagtttgcc

SEQ ID NO: 332025 - DNA, 25 bp, Mus musculus
gggctaatgggaagagtacatctcg

SEQ ID NO: 332026 - DNA, 25 bp, Mus musculus
gggctacaaagctgctgatgagacc

SEQ ID NO: 332027 - DNA, 25 bp, Mus musculus
gggctacaagaagagatacgaggag

SEQ ID NO: 332028 - DNA, 25 bp, Mus musculus
gggctacaaggtgaagaagcatcta

SEQ ID NO: 332029 - DNA, 25 bp, Mus musculus
gggctacacaaaaggtggttgttgg

SEQ ID NO: 332030 - DNA, 25 bp, Mus musculus
gggctacagagctcaccatgcctac

SEQ ID NO: 332031 - DNA, 25 bp, Mus musculus
gggctacagaggtgggcttactgta

SEQ ID NO: 332032 - DNA, 25 bp, Mus musculus
gggctacagaggtgtccaacaggcc

SEQ ID NO: 332033 - DNA, 25 bp, Mus musculus
gggctacagcagaggaataaatgaa

SEQ ID NO: 332034 - DNA, 25 bp, Mus musculus
gggctaccagattttgttcggatcg

SEQ ID NO: 332035 - DNA, 25 bp, Mus musculus
gggctaccagtggttgtccccatca

SEQ ID NO: 332036 - DNA, 25 bp, Mus musculus
gggctaccgtcatacctcactacag

SEQ ID NO: 332037 - DNA, 25 bp, Mus musculus
gggctaccgtcttgctggtgagcac

SEQ ID NO: 332038 - DNA, 25 bp, Mus musculus
gggctacggcaaatactggtaaccc

SEQ ID NO: 332039 - DNA, 25 bp, Mus musculus
gggctacgtcaaggtcccaaagccc

SEQ ID NO: 332040 - DNA, 25 bp, Mus musculus
gggctactaaggagggcgcagatgt

SEQ ID NO: 332041 - DNA, 25 bp, Mus musculus
gggctactaaggagggcgctctctg

SEQ ID NO: 332042 - DNA, 25 bp, Mus musculus
gggctactccaggaggcaccatgtg

SEQ ID NO: 332043 - DNA, 25 bp, Mus musculus
gggctacttcgcgtgggctgtcttc

SEQ ID NO: 332044 - DNA, 25 bp, Mus musculus
gggctagagcataaggtttatctca

SEQ ID NO: 332045 - DNA, 25 bp, Mus musculus
gggctagctgaggtgcggagctgac

SEQ ID NO: 332046 - DNA, 25 bp, Mus musculus
gggctaggaaggttctgtttgtttt

SEQ ID NO: 332047 - DNA, 25 bp, Mus musculus
gggctagtgcattagcctgccacca

SEQ ID NO: 332048 - DNA, 25 bp, Mus musculus
gggctataagacccagttgtagctc

SEQ ID NO: 332049 - DNA, 25 bp, Mus musculus
gggctataaggatgtctcccgtgct

SEQ ID NO: 332050 - DNA, 25 bp, Mus musculus
gggctatattcagggctacaacaag

SEQ ID NO: 332051 - DNA, 25 bp, Mus musculus
gggctatattcaggtgacagacttc

SEQ ID NO: 332052 - DNA, 25 bp, Mus musculus
gggctatgacagccagcccgctttc

SEQ ID NO: 332053 - DNA, 25 bp, Mus musculus
gggctatgacccccctctctccctt

SEQ ID NO: 332054 - DNA, 25 bp, Mus musculus
gggctatgagatattactacaaacg

SEQ ID NO: 332055 - DNA, 25 bp, Mus musculus
gggctatgagccaacttccatgaga

SEQ ID NO: 332056 - DNA, 25 bp, Mus musculus
gggctatgcagatggctatgaacgg

SEQ ID NO: 332057 - DNA, 25 bp, Mus musculus
gggctatggaaaggtttttcaagta

SEQ ID NO: 332058 - DNA, 25 bp, Mus musculus
gggctatggagctggtgctgtccgc

SEQ ID NO: 332059 - DNA, 25 bp, Mus musculus
gggctatggagtcccaacaggaggg

SEQ ID NO: 332060 - DNA, 25 bp, Mus musculus
gggctatggcaaggtgttccaggtg

SEQ ID NO: 332061 - DNA, 25 bp, Mus musculus
gggctatttccctgcagtctgacct

SEQ ID NO: 332062 - DNA, 25 bp, Mus musculus
gggctatttcttgttgccaaaacaa

SEQ ID NO: 332063 - DNA, 25 bp, Mus musculus
gggctcaaaatgtgcctctcccagt

SEQ ID NO: 332064 - DNA, 25 bp, Mus musculus
gggctcacaccgacctgagaaatgc

SEQ ID NO: 332065 - DNA, 25 bp, Mus musculus
gggctcacaccgactgcgtaattcg

SEQ ID NO: 332066 - DNA, 25 bp, Mus musculus
gggctcacaccgataaccctaacaa

SEQ ID NO: 332067 - DNA, 25 bp, Mus musculus
gggctcacacgaggtagctcgcggc

SEQ ID NO: 332068 - DNA, 25 bp, Mus musculus
gggctcacagcctagcctgtgtttg

SEQ ID NO: 332069 - DNA, 25 bp, Mus musculus
gggctcaccttgaaaatgaagtccc

SEQ ID NO: 332070 - DNA, 25 bp, Mus musculus
gggctcaccttgtgttcgacttcca

SEQ ID NO: 332071 - DNA, 25 bp, Mus musculus
gggctcacggagggaccaacatcaa

SEQ ID NO: 332072 - DNA, 25 bp, Mus musculus
gggctcagagggagtggggccggcc

SEQ ID NO: 332073 - DNA, 25 bp, Mus musculus
gggctcagattacagatttctgctc

SEQ ID NO: 332074 - DNA, 25 bp, Mus musculus
gggctcagcaaaggcagctgagatg

SEQ ID NO: 332075 - DNA, 25 bp, Mus musculus
gggctcagcgatcaggatatgacat

SEQ ID NO: 332076 - DNA, 25 bp, Mus musculus
gggctcagctatggactgtctaact

SEQ ID NO: 332077 - DNA, 25 bp, Mus musculus
gggctcagtaacaagcttcttaacc

SEQ ID NO: 332078 - DNA, 25 bp, Mus musculus
gggctcagtggatgagacccttttt

SEQ ID NO: 332079 - DNA, 25 bp, Mus musculus
gggctcagtggttgttgacctcctg

SEQ ID NO: 332080 - DNA, 25 bp, Mus musculus
gggctcatcatacagaacagtacct

SEQ ID NO: 332081 - DNA, 25 bp, Mus musculus
gggctccaaatctgaggttatgcga

SEQ ID NO: 332082 - DNA, 25 bp, Mus musculus
gggctccacaagcaaaaccttgaga

SEQ ID NO: 332083 - DNA, 25 bp, Mus musculus
gggctccacactgtcccggagagtg

SEQ ID NO: 332084 - DNA, 25 bp, Mus musculus
gggctccaccgcggttggtgttcga

SEQ ID NO: 332085 - DNA, 25 bp, Mus musculus
gggctccagacagtccaatgccact

SEQ ID NO: 332086 - DNA, 25 bp, Mus musculus
gggctccagacagtcctaacagggg

SEQ ID NO: 332087 - DNA, 25 bp, Mus musculus
gggctccagagataaagctgctcaa

SEQ ID NO: 332088 - DNA, 25 bp, Mus musculus
gggctccagagattatttgtcttta

SEQ ID NO: 332089 - DNA, 25 bp, Mus musculus
gggctccagattcaggcgacaactg

SEQ ID NO: 332090 - DNA, 25 bp, Mus musculus
gggctccagcagcccaagcccagca

SEQ ID NO: 332091 - DNA, 25 bp, Mus musculus
gggctccataaagcccatgcaggtg

SEQ ID NO: 332092 - DNA, 25 bp, Mus musculus
gggctccccaccagcacctcctacc

SEQ ID NO: 332093 - DNA, 25 bp, Mus musculus
gggctccccgcctccgctgaagaac

SEQ ID NO: 332094 - DNA, 25 bp, Mus musculus
gggctcccctcaggctggcctgcct

SEQ ID NO: 332095 - DNA, 25 bp, Mus musculus
gggctcccctcagggtcatgtaggg

SEQ ID NO: 332096 - DNA, 25 bp, Mus musculus
gggctccctgcagggtcccacaaaa

SEQ ID NO: 332097 - DNA, 25 bp, Mus musculus
gggctcccttactcagttcccttac

SEQ ID NO: 332098 - DNA, 25 bp, Mus musculus
gggctccctttgggttctcaggccg

SEQ ID NO: 332099 - DNA, 25 bp, Mus musculus
gggctccgcagcccgaatcctattc

SEQ ID NO: 332100 - DNA, 25 bp, Mus musculus
gggctccggcggccgctacaaggtg

SEQ ID NO: 332101 - DNA, 25 bp, Mus musculus
gggctcctccagcaggcttgtgaca

SEQ ID NO: 332102 - DNA, 25 bp, Mus musculus
gggctcctccagcagtgggtttttc

SEQ ID NO: 332103 - DNA, 25 bp, Mus musculus
gggctcctctgggatttgttttggc

SEQ ID NO: 332104 - DNA, 25 bp, Mus musculus
gggctcctgaggcatggaggggtct

SEQ ID NO: 332105 - DNA, 25 bp, Mus musculus
gggctcctgatgtcactggtctcca

SEQ ID NO: 332106 - DNA, 25 bp, Mus musculus
gggctcctgcaggagggctgctggc

SEQ ID NO: 332107 - DNA, 25 bp, Mus musculus
gggctcctgcggcaaggggacatgc

SEQ ID NO: 332108 - DNA, 25 bp, Mus musculus
gggctcgaaaatggggtccaagggt

SEQ ID NO: 332109 - DNA, 25 bp, Mus musculus
gggctcgaagggcaggtaaaccacc

SEQ ID NO: 332110 - DNA, 25 bp, Mus musculus
gggctcgagtcaccgtttgccatct

SEQ ID NO: 332111 - DNA, 25 bp, Mus musculus
gggctcgcaggatccctgctgcctt

SEQ ID NO: 332112 - DNA, 25 bp, Mus musculus
gggctcgccgtggggctgcagcagc

SEQ ID NO: 332113 - DNA, 25 bp, Mus musculus
gggctcgcctgcaaggttcctgctg

SEQ ID NO: 332114 - DNA, 25 bp, Mus musculus
gggctcgcctgcaagtgtctcactt

SEQ ID NO: 332115 - DNA, 25 bp, Mus musculus
gggctcgctacgaggtgtgggctca

SEQ ID NO: 332116 - DNA, 25 bp, Mus musculus
gggctcggaggtccctgacccttgg

SEQ ID NO: 332117 - DNA, 25 bp, Mus musculus
gggctcggagttttcaggaagagct

SEQ ID NO: 332118 - DNA, 25 bp, Mus musculus
gggctcggcaggttcgcttatcttg

SEQ ID NO: 332119 - DNA, 25 bp, Mus musculus
gggctcggggcggtaggaaatcagt

SEQ ID NO: 332120 - DNA, 25 bp, Mus musculus
gggctctacgggtgacaccaggtct

SEQ ID NO: 332121 - DNA, 25 bp, Mus musculus
gggctctacttctgttcgttaaaaa

SEQ ID NO: 332122 - DNA, 25 bp, Mus musculus
gggctctatgaaccagacttgggat

SEQ ID NO: 332123 - DNA, 25 bp, Mus musculus
gggctctcacttccagaggaactca

SEQ ID NO: 332124 - DNA, 25 bp, Mus musculus
gggctctccaggggaaaataagtca

SEQ ID NO: 332125 - DNA, 25 bp, Mus musculus
gggctctccgaacctagctagcatc

SEQ ID NO: 332126 - DNA, 25 bp, Mus musculus
gggctctccgagaccgaagccccgc

SEQ ID NO: 332127 - DNA, 25 bp, Mus musculus
gggctctccggcgcatctcccaatt

SEQ ID NO: 332128 - DNA, 25 bp, Mus musculus
gggctctctcggcagagtcattccc

SEQ ID NO: 332129 - DNA, 25 bp, Mus musculus
gggctctctcggcaggcctggctga

SEQ ID NO: 332130 - DNA, 25 bp, Mus musculus
gggctctctggtggttcatccctga

SEQ ID NO: 332131 - DNA, 25 bp, Mus musculus
gggctctgaagggtacaccatgagg

SEQ ID NO: 332132 - DNA, 25 bp, Mus musculus
gggctctgaagggtggaataagcag

SEQ ID NO: 332133 - DNA, 25 bp, Mus musculus
gggctctgacctgggacccctcatg

SEQ ID NO: 332134 - DNA, 25 bp, Mus musculus
gggctctgagaggcccctgcccgga

SEQ ID NO: 332135 - DNA, 25 bp, Mus musculus
gggctctgaggttgaactggagcac

SEQ ID NO: 332136 - DNA, 25 bp, Mus musculus
gggctctgcagattctcattgccaa

SEQ ID NO: 332137 - DNA, 25 bp, Mus musculus
gggctctgcaggaagcctgctgaca

SEQ ID NO: 332138 - DNA, 25 bp, Mus musculus
gggctctggaggtacccactgatgg

SEQ ID NO: 332139 - DNA, 25 bp, Mus musculus
gggctctggcaaggactcacacacg

SEQ ID NO: 332140 - DNA, 25 bp, Mus musculus
gggctctggcaaggtaccctggcta

SEQ ID NO: 332141 - DNA, 25 bp, Mus musculus
gggctctgtagcaggtctagtgaca

SEQ ID NO: 332142 - DNA, 25 bp, Mus musculus
gggctctgtaggttgtgaaccatgg

SEQ ID NO: 332143 - DNA, 25 bp, Mus musculus
gggctctgtgctcctggcacacact

SEQ ID NO: 332144 - DNA, 25 bp, Mus musculus
gggctctgtgggggcagctggcatc

SEQ ID NO: 332145 - DNA, 25 bp, Mus musculus
gggctcttcaggtctacatgtgggt

SEQ ID NO: 332146 - DNA, 25 bp, Mus musculus
gggctcttcaggtgctccaatgaga

SEQ ID NO: 332147 - DNA, 25 bp, Mus musculus
gggctctttgggtatgtgcagcact

SEQ ID NO: 332148 - DNA, 25 bp, Mus musculus
gggctgaaaagacactacaagaagc

SEQ ID NO: 332149 - DNA, 25 bp, Mus musculus
gggctgaaaggagatgagtccccgg

SEQ ID NO: 332150 - DNA, 25 bp, Mus musculus
gggctgaaatactaggttgcaggaa

SEQ ID NO: 332151 - DNA, 25 bp, Mus musculus
gggctgaacaggaacatagcggcgg

SEQ ID NO: 332152 - DNA, 25 bp, Mus musculus
gggctgaagagaatatccggtctct

SEQ ID NO: 332153 - DNA, 25 bp, Mus musculus
gggctgaagagatttgaaagtgacc

SEQ ID NO: 332154 - DNA, 25 bp, Mus musculus
gggctgaagagtgatgacattactt

SEQ ID NO: 332155 - DNA, 25 bp, Mus musculus
gggctgacagatcaacttatgagac

SEQ ID NO: 332156 - DNA, 25 bp, Mus musculus
gggctgacggagggtgaggagttct

SEQ ID NO: 332157 - DNA, 25 bp, Mus musculus
gggctgagaaagacaggttgcagct

SEQ ID NO: 332158 - DNA, 25 bp, Mus musculus
gggctgagaagcggaggctgctgaa

SEQ ID NO: 332159 - DNA, 25 bp, Mus musculus
gggctgagaaggtgaggtggccttg

SEQ ID NO: 332160 - DNA, 25 bp, Mus musculus
gggctgagaatccagaaatggcctc

SEQ ID NO: 332161 - DNA, 25 bp, Mus musculus
gggctgagaggcaggaaatgttgca

SEQ ID NO: 332162 - DNA, 25 bp, Mus musculus
gggctgagcaccagggcttccagct

SEQ ID NO: 332163 - DNA, 25 bp, Mus musculus
gggctgaggagagggaactagttcc

SEQ ID NO: 332164 - DNA, 25 bp, Mus musculus
gggctgaggagcatgaacggtgcct

SEQ ID NO: 332165 - DNA, 25 bp, Mus musculus
gggctgaggccgggaccggagctga

SEQ ID NO: 332166 - DNA, 25 bp, Mus musculus
gggctgagtaccacgcggacatcta

SEQ ID NO: 332167 - DNA, 25 bp, Mus musculus
gggctgagtaccacgcgggggaagg

SEQ ID NO: 332168 - DNA, 25 bp, Mus musculus
gggctgatcgaaaaggactctaatg

SEQ ID NO: 332169 - DNA, 25 bp, Mus musculus
gggctgatcgtgaccatctttccac

SEQ ID NO: 332170 - DNA, 25 bp, Mus musculus
gggctgatgacccagtcttatctcc

SEQ ID NO: 332171 - DNA, 25 bp, Mus musculus
gggctgatggcttccctaggattct

SEQ ID NO: 332172 - DNA, 25 bp, Mus musculus
gggctgattccagttacttcctgcc

SEQ ID NO: 332173 - DNA, 25 bp, Mus musculus
gggctgattcgagcgacttcggagc

SEQ ID NO: 332174 - DNA, 25 bp, Mus musculus
gggctgattcgagcggggttccttg

SEQ ID NO: 332175 - DNA, 25 bp, Mus musculus
gggctgattgtagacaccggtacca

SEQ ID NO: 332176 - DNA, 25 bp, Mus musculus
gggctgcaaccatgagaccagcacc

SEQ ID NO: 332177 - DNA, 25 bp, Mus musculus
gggctgcaaccatgatcaagcactt

SEQ ID NO: 332178 - DNA, 25 bp, Mus musculus
gggctgcaaccatggatgacaagga

SEQ ID NO: 332179 - DNA, 25 bp, Mus musculus
gggctgcaagcggattgggtttcct

SEQ ID NO: 332180 - DNA, 25 bp, Mus musculus
gggctgcaagtgggtctccaacaag

SEQ ID NO: 332181 - DNA, 25 bp, Mus musculus
gggctgcagaggattctcattgtcg

SEQ ID NO: 332182 - DNA, 25 bp, Mus musculus
gggctgcagagtgtcctttatttct

SEQ ID NO: 332183 - DNA, 25 bp, Mus musculus
gggctgcagccgatacgacaaatag

SEQ ID NO: 332184 - DNA, 25 bp, Mus musculus
gggctgcagccggaaggatccctgt

SEQ ID NO: 332185 - DNA, 25 bp, Mus musculus
gggctgcagcttcctgcctgttcac

SEQ ID NO: 332186 - DNA, 25 bp, Mus musculus
gggctgcaggggacacccgtcagca

SEQ ID NO: 332187 - DNA, 25 bp, Mus musculus
gggctgcagtgtcctgctgggagtt

SEQ ID NO: 332188 - DNA, 25 bp, Mus musculus
gggctgcatgcattgtggctgggga

SEQ ID NO: 332189 - DNA, 25 bp, Mus musculus
gggctgcatgcggaccaggccttgt

SEQ ID NO: 332190 - DNA, 25 bp, Mus musculus
gggctgcattggaggttaaaattat

SEQ ID NO: 332191 - DNA, 25 bp, Mus musculus
gggctgccacacaatcaggacttcc

SEQ ID NO: 332192 - DNA, 25 bp, Mus musculus
gggctgccaggagatggacatgata

SEQ ID NO: 332193 - DNA, 25 bp, Mus musculus
gggctgccaggttgaattctcttac

SEQ ID NO: 332194 - DNA, 25 bp, Mus musculus
gggctgccatgcctgtgactgcagt

SEQ ID NO: 332195 - DNA, 25 bp, Mus musculus
gggctgcccaaagagcatgccacca

SEQ ID NO: 332196 - DNA, 25 bp, Mus musculus
gggctgcccaaagagccccctcaga

SEQ ID NO: 332197 - DNA, 25 bp, Mus musculus
gggctgcccaaagcctgagacccac

SEQ ID NO: 332198 - DNA, 25 bp, Mus musculus
gggctgcccaaagggacactacatg

SEQ ID NO: 332199 - DNA, 25 bp, Mus musculus
gggctgccccaggatccacctgatg

SEQ ID NO: 332200 - DNA, 25 bp, Mus musculus
gggctgccgaatgaaaaggtgcagc

SEQ ID NO: 332201 - DNA, 25 bp, Mus musculus
gggctgccgactaggatgaaggacg

SEQ ID NO: 332202 - DNA, 25 bp, Mus musculus
gggctgccgactatcaagaatgacc

SEQ ID NO: 332203 - DNA, 25 bp, Mus musculus
gggctgccgactatggaaatcctat

SEQ ID NO: 332204 - DNA, 25 bp, Mus musculus
gggctgccgactgctgatctcttcg

SEQ ID NO: 332205 - DNA, 25 bp, Mus musculus
gggctgccgactggacccagctgaa

SEQ ID NO: 332206 - DNA, 25 bp, Mus musculus
gggctgccgactggtcaatatagac

SEQ ID NO: 332207 - DNA, 25 bp, Mus musculus
gggctgccgactgtgtccatgttgg

SEQ ID NO: 332208 - DNA, 25 bp, Mus musculus
gggctgccggggtagctcgcggcgt

SEQ ID NO: 332209 - DNA, 25 bp, Mus musculus
gggctgcctcaggtcgcatagggca

SEQ ID NO: 332210 - DNA, 25 bp, Mus musculus
gggctgcctctaagatctcaggatg

SEQ ID NO: 332211 - DNA, 25 bp, Mus musculus
gggctgcctgcctacagactacaag

SEQ ID NO: 332212 - DNA, 25 bp, Mus musculus
gggctgcctggcgtggccgagaaga

SEQ ID NO: 332213 - DNA, 25 bp, Mus musculus
gggctgcctgtctccctccagaggc

SEQ ID NO: 332214 - DNA, 25 bp, Mus musculus
gggctgcgaggggcatgaaggatgg

SEQ ID NO: 332215 - DNA, 25 bp, Mus musculus
gggctgcgccctgggattcatcact

SEQ ID NO: 332216 - DNA, 25 bp, Mus musculus
gggctgcgcggttggacgagtgacc

SEQ ID NO: 332217 - DNA, 25 bp, Mus musculus
gggctgcggcagcaagaacagaagc

SEQ ID NO: 332218 - DNA, 25 bp, Mus musculus
gggctgcggcagcacgtctgactct

SEQ ID NO: 332219 - DNA, 25 bp, Mus musculus
gggctgcggcagggcatcatgaagc

SEQ ID NO: 332220 - DNA, 25 bp, Mus musculus
gggctgcgggagccaatgtccctac

SEQ ID NO: 332221 - DNA, 25 bp, Mus musculus
gggctgcgggcccggaaatgcactt

SEQ ID NO: 332222 - DNA, 25 bp, Mus musculus
gggctgcgggcccgggactgtgcag

SEQ ID NO: 332223 - DNA, 25 bp, Mus musculus
gggctgcgggtttgttttctgccgg

SEQ ID NO: 332224 - DNA, 25 bp, Mus musculus
gggctgcgtggcattgtcgccagca

SEQ ID NO: 332225 - DNA, 25 bp, Mus musculus
gggctgcgttgagatttggtgactg

SEQ ID NO: 332226 - DNA, 25 bp, Mus musculus
gggctgctagtggagatgccgttcc

SEQ ID NO: 332227 - DNA, 25 bp, Mus musculus
gggctgctagtggagggggttacaa

SEQ ID NO: 332228 - DNA, 25 bp, Mus musculus
gggctgctagtggagtgcactgagg

SEQ ID NO: 332229 - DNA, 25 bp, Mus musculus
gggctgctatggatggtgctttgca

SEQ ID NO: 332230 - DNA, 25 bp, Mus musculus
gggctgctcaacaggacttggatgt

SEQ ID NO: 332231 - DNA, 25 bp, Mus musculus
gggctgctcaacaggctcacaccac

SEQ ID NO: 332232 - DNA, 25 bp, Mus musculus
gggctgctcaccattggagaccggt

SEQ ID NO: 332233 - DNA, 25 bp, Mus musculus
gggctgctccaagcagtgcctggct

SEQ ID NO: 332234 - DNA, 25 bp, Mus musculus
gggctgctcccagcatggcggacaa

SEQ ID NO: 332235 - DNA, 25 bp, Mus musculus
gggctgctgactcctctgcaggtgt

SEQ ID NO: 332236 - DNA, 25 bp, Mus musculus
gggctgctgactgtgtcaacaaggc

SEQ ID NO: 332237 - DNA, 25 bp, Mus musculus
gggctgctgagcaggtagataataa

SEQ ID NO: 332238 - DNA, 25 bp, Mus musculus
gggctgctgctctgtaaagaagaag

SEQ ID NO: 332239 - DNA, 25 bp, Mus musculus
gggctgctggaaagggataaacagc

SEQ ID NO: 332240 - DNA, 25 bp, Mus musculus
gggctgctggacctaccggcatgtt

SEQ ID NO: 332241 - DNA, 25 bp, Mus musculus
gggctgctggacggagcgggatgac

SEQ ID NO: 332242 - DNA, 25 bp, Mus musculus
gggctgctgttaaggaagaagagct

SEQ ID NO: 332243 - DNA, 25 bp, Mus musculus
gggctgcttagttcaaaccggagga

SEQ ID NO: 332244 - DNA, 25 bp, Mus musculus
gggctgcttcaagaggcttggcttt

SEQ ID NO: 332245 - DNA, 25 bp, Mus musculus
gggctgcttgctctctaactgatgg

SEQ ID NO: 332246 - DNA, 25 bp, Mus musculus
gggctgcttggcttacttctttgat

SEQ ID NO: 332247 - DNA, 25 bp, Mus musculus
gggctggaaaggaagaggagccgct

SEQ ID NO: 332248 - DNA, 25 bp, Mus musculus
gggctggaagagtattctttggtac

SEQ ID NO: 332249 - DNA, 25 bp, Mus musculus
gggctggaatgaaaggcattttccc

SEQ ID NO: 332250 - DNA, 25 bp, Mus musculus
gggctggaattccagattcgagtca

SEQ ID NO: 332251 - DNA, 25 bp, Mus musculus
gggctggaattccaggcacgtgctc

SEQ ID NO: 332252 - DNA, 25 bp, Mus musculus
gggctggaccaggagcagccatgtc

SEQ ID NO: 332253 - DNA, 25 bp, Mus musculus
gggctggacgcacagcctttgcttc

SEQ ID NO: 332254 - DNA, 25 bp, Mus musculus
gggctggagctgaggagattattgg

SEQ ID NO: 332255 - DNA, 25 bp, Mus musculus
gggctggatgtcagctctctgctgg

SEQ ID NO: 332256 - DNA, 25 bp, Mus musculus
gggctggccggccagactacagcaa

SEQ ID NO: 332257 - DNA, 25 bp, Mus musculus
gggctggcctacattctaaggtgat

SEQ ID NO: 332258 - DNA, 25 bp, Mus musculus
gggctggcgctggagagcctgacca

SEQ ID NO: 332259 - DNA, 25 bp, Mus musculus
gggctggctcagctcccaagtgcca

SEQ ID NO: 332260 - DNA, 25 bp, Mus musculus
gggctggctgaatcatgatgaaacc

SEQ ID NO: 332261 - DNA, 25 bp, Mus musculus
gggctggcttacagacaaagcctat

SEQ ID NO: 332262 - DNA, 25 bp, Mus musculus
gggctggcttacaggttcagaggtt

SEQ ID NO: 332263 - DNA, 25 bp, Mus musculus
gggctgggacaggaaatgctgtcat

SEQ ID NO: 332264 - DNA, 25 bp, Mus musculus
gggctgggatcattgtctgcgtggt

SEQ ID NO: 332265 - DNA, 25 bp, Mus musculus
gggctgggctccagatctactactc

SEQ ID NO: 332266 - DNA, 25 bp, Mus musculus
gggctggggctactacggttgcaat

SEQ ID NO: 332267 - DNA, 25 bp, Mus musculus
gggctgggggagtccagggccgcgt

SEQ ID NO: 332268 - DNA, 25 bp, Mus musculus
gggctgggtgacagagtggaccaga

SEQ ID NO: 332269 - DNA, 25 bp, Mus musculus
gggctggtcacatggtgacctggcc

SEQ ID NO: 332270 - DNA, 25 bp, Mus musculus
gggctggtcgcagaagtacagcacg

SEQ ID NO: 332271 - DNA, 25 bp, Mus musculus
gggctggtgagaagacgcttcccaa

SEQ ID NO: 332272 - DNA, 25 bp, Mus musculus
gggctggtgctgcatgggctcccct

SEQ ID NO: 332273 - DNA, 25 bp, Mus musculus
gggctggtggcattccattgacaat

SEQ ID NO: 332274 - DNA, 25 bp, Mus musculus
gggctggtttccgaggtctctgtgt

SEQ ID NO: 332275 - DNA, 25 bp, Mus musculus
gggctgtcagattggtgacccagaa

SEQ ID NO: 332276 - DNA, 25 bp, Mus musculus
gggctgtcaggcacagaggatctta

SEQ ID NO: 332277 - DNA, 25 bp, Mus musculus
gggctgtcccattctctggtgccct

SEQ ID NO: 332278 - DNA, 25 bp, Mus musculus
gggctgtcctgctaaggaagagctg

SEQ ID NO: 332279 - DNA, 25 bp, Mus musculus
gggctgtctgttgtttctctgctgc

SEQ ID NO: 332280 - DNA, 25 bp, Mus musculus
gggctgtgaccgagatcaagatcca

SEQ ID NO: 332281 - DNA, 25 bp, Mus musculus
gggctgtgaccgaggttgaacattt

SEQ ID NO: 332282 - DNA, 25 bp, Mus musculus
gggctgtgagccggtgatctctggg

SEQ ID NO: 332283 - DNA, 25 bp, Mus musculus
gggctgtgaggacagcatccctggc

SEQ ID NO: 332284 - DNA, 25 bp, Mus musculus
gggctgtgatggaatttcacgtttc

SEQ ID NO: 332285 - DNA, 25 bp, Mus musculus
gggctgtgatggtagcatcgcctgc

SEQ ID NO: 332286 - DNA, 25 bp, Mus musculus
gggctgtggagacaaatgaattcct

SEQ ID NO: 332287 - DNA, 25 bp, Mus musculus
gggctgtggaggaacgggattttcc

SEQ ID NO: 332288 - DNA, 25 bp, Mus musculus
gggctgtggcagactaactccagtc

SEQ ID NO: 332289 - DNA, 25 bp, Mus musculus
gggctgtggctgctgatgccatact

SEQ ID NO: 332290 - DNA, 25 bp, Mus musculus
gggctgtggctgctgtctccccatt

SEQ ID NO: 332291 - DNA, 25 bp, Mus musculus
gggctgtgggattatctgaacgatg

SEQ ID NO: 332292 - DNA, 25 bp, Mus musculus
gggctgtgtcctcaggtggcagttt

SEQ ID NO: 332293 - DNA, 25 bp, Mus musculus
gggctgttgaggatgtgctcgagac

SEQ ID NO: 332294 - DNA, 25 bp, Mus musculus
gggctgttggacttcaagaaaagaa

SEQ ID NO: 332295 - DNA, 25 bp, Mus musculus
gggctgttttggtgtgcacatcccg

SEQ ID NO: 332296 - DNA, 25 bp, Mus musculus
gggcttaaaaggcatccaaggaatg

SEQ ID NO: 332297 - DNA, 25 bp, Mus musculus
gggcttaaagagggcttggggcata

SEQ ID NO: 332298 - DNA, 25 bp, Mus musculus
gggcttaactggttacaaaatgtcc

SEQ ID NO: 332299 - DNA, 25 bp, Mus musculus
gggcttaagggacagcaaggagtcc

SEQ ID NO: 332300 - DNA, 25 bp, Mus musculus
gggcttaccaacagggagtacacct

SEQ ID NO: 332301 - DNA, 25 bp, Mus musculus
gggcttaccaacagtctcaagaagg

SEQ ID NO: 332302 - DNA, 25 bp, Mus musculus
gggcttaccaggtgtccctggaatc

SEQ ID NO: 332303 - DNA, 25 bp, Mus musculus
gggcttactcaggatgtcaatgggc

SEQ ID NO: 332304 - DNA, 25 bp, Mus musculus
gggcttagacaggataaggaagcct

SEQ ID NO: 332305 - DNA, 25 bp, Mus musculus
gggcttaggagccagaagctgactg

SEQ ID NO: 332306 - DNA, 25 bp, Mus musculus
gggcttaggagccagaaggaggctg

SEQ ID NO: 332307 - DNA, 25 bp, Mus musculus
gggcttaggagccagaggaagtcac

SEQ ID NO: 332308 - DNA, 25 bp, Mus musculus
gggcttattgttcctgacaaccctc

SEQ ID NO: 332309 - DNA, 25 bp, Mus musculus
gggcttattgttcctggtttctctt

SEQ ID NO: 332310 - DNA, 25 bp, Mus musculus
gggcttcactggtaaacaggtgatc

SEQ ID NO: 332311 - DNA, 25 bp, Mus musculus
gggcttcagagatcatgtgtgcccc

SEQ ID NO: 332312 - DNA, 25 bp, Mus musculus
gggcttccaaaccctgctcacacta

SEQ ID NO: 332313 - DNA, 25 bp, Mus musculus
gggcttccaaagggtcctctgcaga

SEQ ID NO: 332314 - DNA, 25 bp, Mus musculus
gggcttccaaggcccttgtccaccc

SEQ ID NO: 332315 - DNA, 25 bp, Mus musculus
gggcttccagacgatactgtatccg

SEQ ID NO: 332316 - DNA, 25 bp, Mus musculus
gggcttcccagaaaagatcaggcaa

SEQ ID NO: 332317 - DNA, 25 bp, Mus musculus
gggcttcccagacactccgtggtgc

SEQ ID NO: 332318 - DNA, 25 bp, Mus musculus
gggcttcccagagaagcgatgtcct

SEQ ID NO: 332319 - DNA, 25 bp, Mus musculus
gggcttcccaggatctggagactca

SEQ ID NO: 332320 - DNA, 25 bp, Mus musculus
gggcttcccccagcagactggaggg

SEQ ID NO: 332321 - DNA, 25 bp, Mus musculus
gggcttcccgatacgacatttcatt

SEQ ID NO: 332322 - DNA, 25 bp, Mus musculus
gggcttcccgattctgtttaggcac

SEQ ID NO: 332323 - DNA, 25 bp, Mus musculus
gggcttcccggagccgaggacctgc

SEQ ID NO: 332324 - DNA, 25 bp, Mus musculus
gggcttcctcaatattgatgaaagc

SEQ ID NO: 332325 - DNA, 25 bp, Mus musculus
gggcttcgccatgcagtggccccgg

SEQ ID NO: 332326 - DNA, 25 bp, Mus musculus
gggcttcgccatggtggccatggtg

SEQ ID NO: 332327 - DNA, 25 bp, Mus musculus
gggcttctagccagagccatgcaga

SEQ ID NO: 332328 - DNA, 25 bp, Mus musculus
gggcttctgcgaaactgaagaagat

SEQ ID NO: 332329 - DNA, 25 bp, Mus musculus
gggcttctgttcaggatatagatct

SEQ ID NO: 332330 - DNA, 25 bp, Mus musculus
gggcttcttaggtcgcaagtctggg

SEQ ID NO: 332331 - DNA, 25 bp, Mus musculus
gggcttcttcagacgaacagtcagc

SEQ ID NO: 332332 - DNA, 25 bp, Mus musculus
gggcttcttcagtgatactgtcagc

SEQ ID NO: 332333 - DNA, 25 bp, Mus musculus
gggcttcttctcgaccaacttgcag

SEQ ID NO: 332334 - DNA, 25 bp, Mus musculus
gggcttcttggtgtctgaccgagac

SEQ ID NO: 332335 - DNA, 25 bp, Mus musculus
gggcttctttcagacaagcgtgaga

SEQ ID NO: 332336 - DNA, 25 bp, Mus musculus
gggcttgaatctcaggactccagag

SEQ ID NO: 332337 - DNA, 25 bp, Mus musculus
gggcttgacgacaatggaggtagag

SEQ ID NO: 332338 - DNA, 25 bp, Mus musculus
gggcttgacgtgtccaacctgtcac

SEQ ID NO: 332339 - DNA, 25 bp, Mus musculus
gggcttgataaagggaggtatgaaa

SEQ ID NO: 332340 - DNA, 25 bp, Mus musculus
gggcttgcagaggcctacgtgaaga

SEQ ID NO: 332341 - DNA, 25 bp, Mus musculus
gggcttgcagattttcttctaacga

SEQ ID NO: 332342 - DNA, 25 bp, Mus musculus
gggcttgcatgaggcaaaagagatt

SEQ ID NO: 332343 - DNA, 25 bp, Mus musculus
gggcttgcatgagggctcgctgccc

SEQ ID NO: 332344 - DNA, 25 bp, Mus musculus
gggcttgcccagctggctcctccaa

SEQ ID NO: 332345 - DNA, 25 bp, Mus musculus
gggcttgcggttccaaagggcctgc

SEQ ID NO: 332346 - DNA, 25 bp, Mus musculus
gggcttgctgtgtggctgagagtgc

SEQ ID NO: 332347 - DNA, 25 bp, Mus musculus
gggcttgctgttctcctcttgcctc

SEQ ID NO: 332348 - DNA, 25 bp, Mus musculus
gggcttggaggcaagggcagtgagc

SEQ ID NO: 332349 - DNA, 25 bp, Mus musculus
gggcttggcaaatggaatctataga

SEQ ID NO: 332350 - DNA, 25 bp, Mus musculus
gggcttggggaagtcccagatctac

SEQ ID NO: 332351 - DNA, 25 bp, Mus musculus
gggcttgtattgaaaaagcttgtgg

SEQ ID NO: 332352 - DNA, 25 bp, Mus musculus
gggcttgtcaatgaggcagaattcc

SEQ ID NO: 332353 - DNA, 25 bp, Mus musculus
gggcttgtgagggtgactacggggg

SEQ ID NO: 332354 - DNA, 25 bp, Mus musculus
gggcttgtgcaggtctggtcactcg

SEQ ID NO: 332355 - DNA, 25 bp, Mus musculus
gggctttaccagaagagggcatcag

SEQ ID NO: 332356 - DNA, 25 bp, Mus musculus
gggctttaccagtctattgcatctg

SEQ ID NO: 332357 - DNA, 25 bp, Mus musculus
gggctttaggagggttggtggtcgg

SEQ ID NO: 332358 - DNA, 25 bp, Mus musculus
gggctttatcaggtcctcatgggta

SEQ ID NO: 332359 - DNA, 25 bp, Mus musculus
gggctttcacttaggaatgtgactc

SEQ ID NO: 332360 - DNA, 25 bp, Mus musculus
gggctttcagggggactgcaggcca

SEQ ID NO: 332361 - DNA, 25 bp, Mus musculus
gggctttccaagttacctgatttaa

SEQ ID NO: 332362 - DNA, 25 bp, Mus musculus
gggctttccctgagaagcagctgag

SEQ ID NO: 332363 - DNA, 25 bp, Mus musculus
gggctttcctgaggagcggcggcat

SEQ ID NO: 332364 - DNA, 25 bp, Mus musculus
gggctttctcagggctctggcgcac

SEQ ID NO: 332365 - DNA, 25 bp, Mus musculus
gggctttctggagggagttggtgga

SEQ ID NO: 332366 - DNA, 25 bp, Mus musculus
gggctttgactacagcacggtggat

SEQ ID NO: 332367 - DNA, 25 bp, Mus musculus
gggctttgggccggttgctgatgac

SEQ ID NO: 332368 - DNA, 25 bp, Mus musculus
gggcttttcaggtcacctagcattg

SEQ ID NO: 332369 - DNA, 25 bp, Mus musculus
gggcttttgcaggcacaacccggtc

SEQ ID NO: 332370 - DNA, 25 bp, Mus musculus
gggcttttgcggctaagtaagaagt

SEQ ID NO: 332371 - DNA, 25 bp, Mus musculus
ggggaaaagttgctggaaaccatgg

SEQ ID NO: 332372 - DNA, 25 bp, Mus musculus
ggggaaaatgcgtcccatgagaatt

SEQ ID NO: 332373 - DNA, 25 bp, Mus musculus
ggggaaaatggcattgtatcatcat

SEQ ID NO: 332374 - DNA, 25 bp, Mus musculus
ggggaaaatgttttcgcatttccag

SEQ ID NO: 332375 - DNA, 25 bp, Mus musculus
ggggaaacaactgggctcgggccat

SEQ ID NO: 332376 - DNA, 25 bp, Mus musculus
ggggaaaccaaggacacactgaagc

SEQ ID NO: 332377 - DNA, 25 bp, Mus musculus
ggggaaaccccacagccaaggcctg

SEQ ID NO: 332378 - DNA, 25 bp, Mus musculus
ggggaaaccgaggactcagagaggc

SEQ ID NO: 332379 - DNA, 25 bp, Mus musculus
ggggaaagaaagaatggaatctata

SEQ ID NO: 332380 - DNA, 25 bp, Mus musculus
ggggaaagaaggaatcacaggcctc

SEQ ID NO: 332381 - DNA, 25 bp, Mus musculus
ggggaaagaggtgctggtggttaac

SEQ ID NO: 332382 - DNA, 25 bp, Mus musculus
ggggaaagctgacggacgaatgcta

SEQ ID NO: 332383 - DNA, 25 bp, Mus musculus
ggggaaaggtgaacgctgctggttg

SEQ ID NO: 332384 - DNA, 25 bp, Mus musculus
ggggaaatctaagataccaagtggt

SEQ ID NO: 332385 - DNA, 25 bp, Mus musculus
ggggaacagaagccggatggtgtct

SEQ ID NO: 332386 - DNA, 25 bp, Mus musculus
ggggaacaggcaggatgagatagag

SEQ ID NO: 332387 - DNA, 25 bp, Mus musculus
ggggaacaggcaggtcacgaaagaa

SEQ ID NO: 332388 - DNA, 25 bp, Mus musculus
ggggaacatggaaagctgccttttc

SEQ ID NO: 332389 - DNA, 25 bp, Mus musculus
ggggaaccagtgggaggtgggactt

SEQ ID NO: 332390 - DNA, 25 bp, Mus musculus
ggggaaccagtggtgactgccctgc

SEQ ID NO: 332391 - DNA, 25 bp, Mus musculus
ggggaaccggcattgatgtccagct

SEQ ID NO: 332392 - DNA, 25 bp, Mus musculus
ggggaacctcccagaactccgaggt

SEQ ID NO: 332393 - DNA, 25 bp, Mus musculus
ggggaacctggagctgcccatcgac

SEQ ID NO: 332394 - DNA, 25 bp, Mus musculus
ggggaacctgggagccacccaagac

SEQ ID NO: 332395 - DNA, 25 bp, Mus musculus
ggggaacggtaatcccgctcaagaa

SEQ ID NO: 332396 - DNA, 25 bp, Mus musculus
ggggaactggttgggaagccagctg

SEQ ID NO: 332397 - DNA, 25 bp, Mus musculus
ggggaacttccaggcacaaagtacc

SEQ ID NO: 332398 - DNA, 25 bp, Mus musculus
ggggaagaacaatgacctccgggaa

SEQ ID NO: 332399 - DNA, 25 bp, Mus musculus
ggggaagaagagcccttctccctag

SEQ ID NO: 332400 - DNA, 25 bp, Mus musculus
ggggaagacatatgggctgatgtga

SEQ ID NO: 332401 - DNA, 25 bp, Mus musculus
ggggaagacatatgggtggagcctt

SEQ ID NO: 332402 - DNA, 25 bp, Mus musculus
ggggaagacgatcactttttaattc

SEQ ID NO: 332403 - DNA, 25 bp, Mus musculus
ggggaagacgatgtgtggtgtcgaa

SEQ ID NO: 332404 - DNA, 25 bp, Mus musculus
ggggaagactgccgtgagcatccag

SEQ ID NO: 332405 - DNA, 25 bp, Mus musculus
ggggaagactggcgcaagcggcgga

SEQ ID NO: 332406 - DNA, 25 bp, Mus musculus
ggggaagactgggagatggaacaca

SEQ ID NO: 332407 - DNA, 25 bp, Mus musculus
ggggaagactggtccctgtggcccc

SEQ ID NO: 332408 - DNA, 25 bp, Mus musculus
ggggaagactggtctctaactggtt

SEQ ID NO: 332409 - DNA, 25 bp, Mus musculus
ggggaagatgcagaaattgctgccc

SEQ ID NO: 332410 - DNA, 25 bp, Mus musculus
ggggaagatgcagaagttcctgctt

SEQ ID NO: 332411 - DNA, 25 bp, Mus musculus
ggggaagatgtgccagcctgccccc

SEQ ID NO: 332412 - DNA, 25 bp, Mus musculus
ggggaagcagatggagttccagaag

SEQ ID NO: 332413 - DNA, 25 bp, Mus musculus
ggggaagcctgggtcacgtgaagaa

SEQ ID NO: 332414 - DNA, 25 bp, Mus musculus
ggggaagcgcagcgagcaggacaca

SEQ ID NO: 332415 - DNA, 25 bp, Mus musculus
ggggaagcgcaggacacagaaaata

SEQ ID NO: 332416 - DNA, 25 bp, Mus musculus
ggggaagctgctatgcgtttctaat

SEQ ID NO: 332417 - DNA, 25 bp, Mus musculus
ggggaagctggagggaagaagaaga

SEQ ID NO: 332418 - DNA, 25 bp, Mus musculus
ggggaagctggctgtgactcgaggc

SEQ ID NO: 332419 - DNA, 25 bp, Mus musculus
ggggaagctgggatctcaagcacag

SEQ ID NO: 332420 - DNA, 25 bp, Mus musculus
ggggaaggaaggtgaccattgttga

SEQ ID NO: 332421 - DNA, 25 bp, Mus musculus
ggggaaggaagtgagcctggtggta

SEQ ID NO: 332422 - DNA, 25 bp, Mus musculus
ggggaaggacgcatctcttcgccga

SEQ ID NO: 332423 - DNA, 25 bp, Mus musculus
ggggaagtatttctggcctcggatt

SEQ ID NO: 332424 - DNA, 25 bp, Mus musculus
ggggaatatggctctggcccacagg

SEQ ID NO: 332425 - DNA, 25 bp, Mus musculus
ggggaatattcctacctccactcca

SEQ ID NO: 332426 - DNA, 25 bp, Mus musculus
ggggaatcaaagttgctacaactat

SEQ ID NO: 332427 - DNA, 25 bp, Mus musculus
ggggaatctccgaaatcccgcaagg

SEQ ID NO: 332428 - DNA, 25 bp, Mus musculus
ggggaatctccggtcccgcacacca

SEQ ID NO: 332429 - DNA, 25 bp, Mus musculus
ggggaatgacagccgccgccatgat

SEQ ID NO: 332430 - DNA, 25 bp, Mus musculus
ggggaatgagatttcctgactgctc

SEQ ID NO: 332431 - DNA, 25 bp, Mus musculus
ggggaatgggagagatgcagaaaga

SEQ ID NO: 332432 - DNA, 25 bp, Mus musculus
ggggaatgggagagcttttgcctac

SEQ ID NO: 332433 - DNA, 25 bp, Mus musculus
ggggaattcactccagatctctatg

SEQ ID NO: 332434 - DNA, 25 bp, Mus musculus
ggggaattcactggaattcctgagc

SEQ ID NO: 332435 - DNA, 25 bp, Mus musculus
ggggacaaaaggccggtcatggtat

SEQ ID NO: 332436 - DNA, 25 bp, Mus musculus
ggggacaacaccagcgactgctgtg

SEQ ID NO: 332437 - DNA, 25 bp, Mus musculus
ggggacaacccatacctgcacctcg

SEQ ID NO: 332438 - DNA, 25 bp, Mus musculus
ggggacaacgaaggtgaccccatct

SEQ ID NO: 332439 - DNA, 25 bp, Mus musculus
ggggacaagaggttgcctgcaggag

SEQ ID NO: 332440 - DNA, 25 bp, Mus musculus
ggggacaaggacccagcatggtatc

SEQ ID NO: 332441 - DNA, 25 bp, Mus musculus
ggggacaaggagaagacaggagtgc

SEQ ID NO: 332442 - DNA, 25 bp, Mus musculus
ggggacaagggtgccagtgatccgg

SEQ ID NO: 332443 - DNA, 25 bp, Mus musculus
ggggacacatcagggggcgtcagtc

SEQ ID NO: 332444 - DNA, 25 bp, Mus musculus
ggggacacctggaagctgaactccc

SEQ ID NO: 332445 - DNA, 25 bp, Mus musculus
ggggacagagaggcgtcccagccaa

SEQ ID NO: 332446 - DNA, 25 bp, Mus musculus
ggggacagagcagaatttgatacta

SEQ ID NO: 332447 - DNA, 25 bp, Mus musculus
ggggacagagcaggggtgctcttct

SEQ ID NO: 332448 - DNA, 25 bp, Mus musculus
ggggacagccagtgagccatgaggc

SEQ ID NO: 332449 - DNA, 25 bp, Mus musculus
ggggacagccagtggaggtccaggt

SEQ ID NO: 332450 - DNA, 25 bp, Mus musculus
ggggacaggacctttgagcagccag

SEQ ID NO: 332451 - DNA, 25 bp, Mus musculus
ggggacagtgaggggacgatccgga

SEQ ID NO: 332452 - DNA, 25 bp, Mus musculus
ggggacagtgccaacatttaaacga

SEQ ID NO: 332453 - DNA, 25 bp, Mus musculus
ggggacagtgccaacctgtgtgtca

SEQ ID NO: 332454 - DNA, 25 bp, Mus musculus
ggggacagtgccaacctttctacgt

SEQ ID NO: 332455 - DNA, 25 bp, Mus musculus
ggggacagttcagggagggaaggat

SEQ ID NO: 332456 - DNA, 25 bp, Mus musculus
ggggacatgttcagcctggccaaac

SEQ ID NO: 332457 - DNA, 25 bp, Mus musculus
ggggacatgttcaggtttggcaaac

SEQ ID NO: 332458 - DNA, 25 bp, Mus musculus
ggggacattcaggttggctcctgtc

SEQ ID NO: 332459 - DNA, 25 bp, Mus musculus
ggggacattgccgagcgtgagagcc

SEQ ID NO: 332460 - DNA, 25 bp, Mus musculus
ggggaccaaacggtgatggaaaacg

SEQ ID NO: 332461 - DNA, 25 bp, Mus musculus
ggggaccaaccaggggccttggcct

SEQ ID NO: 332462 - DNA, 25 bp, Mus musculus
ggggaccaaccagggtcatgccatt

SEQ ID NO: 332463 - DNA, 25 bp, Mus musculus
ggggaccagctgggagagcgagggg

SEQ ID NO: 332464 - DNA, 25 bp, Mus musculus
ggggaccagctgggcccccagcatg

SEQ ID NO: 332465 - DNA, 25 bp, Mus musculus
ggggaccaggagcttttccagacct

SEQ ID NO: 332466 - DNA, 25 bp, Mus musculus
ggggaccagtgcaagacagggtctc

SEQ ID NO: 332467 - DNA, 25 bp, Mus musculus
ggggaccataaagtctaaggttgtg

SEQ ID NO: 332468 - DNA, 25 bp, Mus musculus
ggggacccagccagccccggaaagc

SEQ ID NO: 332469 - DNA, 25 bp, Mus musculus
ggggacccaggcgatcaaccgagaa

SEQ ID NO: 332470 - DNA, 25 bp, Mus musculus
ggggaccccggattgcacaggcatg

SEQ ID NO: 332471 - DNA, 25 bp, Mus musculus
ggggacccgcgaggagttggcatcc

SEQ ID NO: 332472 - DNA, 25 bp, Mus musculus
ggggacccgcgaggcaagcagtctc

SEQ ID NO: 332473 - DNA, 25 bp, Mus musculus
ggggaccctagggctgtgcctggct

SEQ ID NO: 332474 - DNA, 25 bp, Mus musculus
ggggaccgagccctctgattgccct

SEQ ID NO: 332475 - DNA, 25 bp, Mus musculus
ggggaccggcagcaggagaatcctc

SEQ ID NO: 332476 - DNA, 25 bp, Mus musculus
ggggaccggcagcaggagaatgcca

SEQ ID NO: 332477 - DNA, 25 bp, Mus musculus
ggggacctcagaaggtctatatgga

SEQ ID NO: 332478 - DNA, 25 bp, Mus musculus
ggggacctcctgggcattgtcgcca

SEQ ID NO: 332479 - DNA, 25 bp, Mus musculus
ggggacctcgagacagccttccctc

SEQ ID NO: 332480 - DNA, 25 bp, Mus musculus
ggggacctcgcaagttcttccatca

SEQ ID NO: 332481 - DNA, 25 bp, Mus musculus
ggggacctgcactgtcacgcggtgt

SEQ ID NO: 332482 - DNA, 25 bp, Mus musculus
ggggacctggagacagccttccctc

SEQ ID NO: 332483 - DNA, 25 bp, Mus musculus
ggggacctgtaaagctcggatgccc

SEQ ID NO: 332484 - DNA, 25 bp, Mus musculus
ggggacctgtaaagttgcttttaga

SEQ ID NO: 332485 - DNA, 25 bp, Mus musculus
ggggaccttccaggtgacgctgact

SEQ ID NO: 332486 - DNA, 25 bp, Mus musculus
ggggacgatgaggacctcgacctag

SEQ ID NO: 332487 - DNA, 25 bp, Mus musculus
ggggacgcaatgtgtctggaattct

SEQ ID NO: 332488 - DNA, 25 bp, Mus musculus
ggggacgcggcgatctgccaggatc

SEQ ID NO: 332489 - DNA, 25 bp, Mus musculus
ggggacgcggcgcacacagggccag

SEQ ID NO: 332490 - DNA, 25 bp, Mus musculus
ggggacgcgtccgactgaggctcca

SEQ ID NO: 332491 - DNA, 25 bp, Mus musculus
ggggacgcgtccggccccagcggtg

SEQ ID NO: 332492 - DNA, 25 bp, Mus musculus
ggggacgctgcaagtgtggaggcaa

SEQ ID NO: 332493 - DNA, 25 bp, Mus musculus
ggggacgctgggatttgaactgtct

SEQ ID NO: 332494 - DNA, 25 bp, Mus musculus
ggggacggcccttggtgtggacagt

SEQ ID NO: 332495 - DNA, 25 bp, Mus musculus
ggggacggtacctgcattgtgcttc

SEQ ID NO: 332496 - DNA, 25 bp, Mus musculus
ggggacgtgcagaattaccatgaga

SEQ ID NO: 332497 - DNA, 25 bp, Mus musculus
ggggacgtgcagaccatcccatggc

SEQ ID NO: 332498 - DNA, 25 bp, Mus musculus
ggggactaacaggactccaagcccc

SEQ ID NO: 332499 - DNA, 25 bp, Mus musculus
ggggactacctgtgggctctggggt

SEQ ID NO: 332500 - DNA, 25 bp, Mus musculus
ggggactcgcggagatcgtaccgag

SEQ ID NO: 332501 - DNA, 25 bp, Mus musculus
ggggactcttaaagatgagaattct

SEQ ID NO: 332502 - DNA, 25 bp, Mus musculus
ggggactctttgcaggcttcctccc

SEQ ID NO: 332503 - DNA, 25 bp, Mus musculus
ggggactgaagacccctatacaacc

SEQ ID NO: 332504 - DNA, 25 bp, Mus musculus
ggggactgagcggtcttgacgaagt

SEQ ID NO: 332505 - DNA, 25 bp, Mus musculus
ggggactgctacgacaggtacctgt

SEQ ID NO: 332506 - DNA, 25 bp, Mus musculus
ggggactggaaagatggagccagca

SEQ ID NO: 332507 - DNA, 25 bp, Mus musculus
ggggactggacacctgggctgtccc

SEQ ID NO: 332508 - DNA, 25 bp, Mus musculus
ggggactggagccagaattcacact

SEQ ID NO: 332509 - DNA, 25 bp, Mus musculus
ggggactggagggcttcgtggcggc

SEQ ID NO: 332510 - DNA, 25 bp, Mus musculus
ggggactggagggcttctcattcct

SEQ ID NO: 332511 - DNA, 25 bp, Mus musculus
ggggactggcaggaccgtcacgacg

SEQ ID NO: 332512 - DNA, 25 bp, Mus musculus
ggggactgtcggatagggacttact

SEQ ID NO: 332513 - DNA, 25 bp, Mus musculus
ggggactgtcggggtacagcatgtt

SEQ ID NO: 332514 - DNA, 25 bp, Mus musculus
ggggactgtgcaggttgaaaacgag

SEQ ID NO: 332515 - DNA, 25 bp, Mus musculus
ggggacttccacagccagaaaagaa

SEQ ID NO: 332516 - DNA, 25 bp, Mus musculus
ggggacttggcagctcatgctgttt

SEQ ID NO: 332517 - DNA, 25 bp, Mus musculus
ggggacttggcaggtccaacgtcgg

SEQ ID NO: 332518 - DNA, 25 bp, Mus musculus
ggggacttggggacggctgttctca

SEQ ID NO: 332519 - DNA, 25 bp, Mus musculus
ggggactttgccaggacctgtgtca

SEQ ID NO: 332520 - DNA, 25 bp, Mus musculus
ggggagaaaacaccagctacatcat

SEQ ID NO: 332521 - DNA, 25 bp, Mus musculus
ggggagaaaagctggcactcgacta

SEQ ID NO: 332522 - DNA, 25 bp, Mus musculus
ggggagaaacagccctgacggccgc

SEQ ID NO: 332523 - DNA, 25 bp, Mus musculus
ggggagaaactccagatcaccatcc

SEQ ID NO: 332524 - DNA, 25 bp, Mus musculus
ggggagaacccagatgagatggacc

SEQ ID NO: 332525 - DNA, 25 bp, Mus musculus
ggggagaacttgggctctgctctgc

SEQ ID NO: 332526 - DNA, 25 bp, Mus musculus
ggggagaagaaccatttgacattgt

SEQ ID NO: 332527 - DNA, 25 bp, Mus musculus
ggggagaagcagaccatggtgaatc

SEQ ID NO: 332528 - DNA, 25 bp, Mus musculus
ggggagaagtgatgccttattggag

SEQ ID NO: 332529 - DNA, 25 bp, Mus musculus
ggggagaataagtgttttgcagctg

SEQ ID NO: 332530 - DNA, 25 bp, Mus musculus
ggggagaccggtactttgatccggc

SEQ ID NO: 332531 - DNA, 25 bp, Mus musculus
ggggagacgtggtactcagttcgtg

SEQ ID NO: 332532 - DNA, 25 bp, Mus musculus
ggggagactcgggggaactgatcac

SEQ ID NO: 332533 - DNA, 25 bp, Mus musculus
ggggagagactcaagggactttcgg

SEQ ID NO: 332534 - DNA, 25 bp, Mus musculus
ggggagagactgatgagacatcgtt

SEQ ID NO: 332535 - DNA, 25 bp, Mus musculus
ggggagagaggaagaactacagaga

SEQ ID NO: 332536 - DNA, 25 bp, Mus musculus
ggggagagagtgctgttctctgcag

SEQ ID NO: 332537 - DNA, 25 bp, Mus musculus
ggggagagcaagaggatattatcag

SEQ ID NO: 332538 - DNA, 25 bp, Mus musculus
ggggagagcaagagggtttgttcct

SEQ ID NO: 332539 - DNA, 25 bp, Mus musculus
ggggagagcatcagacctttgaaga

SEQ ID NO: 332540 - DNA, 25 bp, Mus musculus
ggggagagccttttccagggctccg

SEQ ID NO: 332541 - DNA, 25 bp, Mus musculus
ggggagagctaggtcacttgtccag

SEQ ID NO: 332542 - DNA, 25 bp, Mus musculus
ggggagagctagttgctgcttcaag

SEQ ID NO: 332543 - DNA, 25 bp, Mus musculus
ggggagagcttacggtcattcctga

SEQ ID NO: 332544 - DNA, 25 bp, Mus musculus
ggggagaggccaacttatttgtcca

SEQ ID NO: 332545 - DNA, 25 bp, Mus musculus
ggggagaggggcgtagtggcaacat

SEQ ID NO: 332546 - DNA, 25 bp, Mus musculus
ggggagaggtgggaaaagcttgttg

SEQ ID NO: 332547 - DNA, 25 bp, Mus musculus
ggggagagtgaggctcaggccagca

SEQ ID NO: 332548 - DNA, 25 bp, Mus musculus
ggggagatcacctcagtggctctgg

SEQ ID NO: 332549 - DNA, 25 bp, Mus musculus
ggggagatcttgacatcactgactg

SEQ ID NO: 332550 - DNA, 25 bp, Mus musculus
ggggagatcttggtgatccgcaggg

SEQ ID NO: 332551 - DNA, 25 bp, Mus musculus
ggggagatgacggcagaggagaggt

SEQ ID NO: 332552 - DNA, 25 bp, Mus musculus
ggggagatgtgagggatctaccaag

SEQ ID NO: 332553 - DNA, 25 bp, Mus musculus
ggggagcacgagggttttttgcatt

SEQ ID NO: 332554 - DNA, 25 bp, Mus musculus
ggggagcactggactccttcagtgc

SEQ ID NO: 332555 - DNA, 25 bp, Mus musculus
ggggagcactggccctgctccctgg

SEQ ID NO: 332556 - DNA, 25 bp, Mus musculus
ggggagcagaccaggtgactggtta

SEQ ID NO: 332557 - DNA, 25 bp, Mus musculus
ggggagcagaccagtaggggcaagc

SEQ ID NO: 332558 - DNA, 25 bp, Mus musculus
ggggagcagcccaaggaggctccgc

SEQ ID NO: 332559 - DNA, 25 bp, Mus musculus
ggggagccagattatcacaaagatt

SEQ ID NO: 332560 - DNA, 25 bp, Mus musculus
ggggagcccaggtccggtgagcaac

SEQ ID NO: 332561 - DNA, 25 bp, Mus musculus
ggggagccccggtacatggagcttg

SEQ ID NO: 332562 - DNA, 25 bp, Mus musculus
ggggagccctggaggagtctcagct

SEQ ID NO: 332563 - DNA, 25 bp, Mus musculus
ggggagccctggaggattaccaggc

SEQ ID NO: 332564 - DNA, 25 bp, Mus musculus
ggggagccgagcactccgccagagt

SEQ ID NO: 332565 - DNA, 25 bp, Mus musculus
ggggagccgcacgtgtcctgggtca

SEQ ID NO: 332566 - DNA, 25 bp, Mus musculus
ggggagccgggaggctacagactac

SEQ ID NO: 332567 - DNA, 25 bp, Mus musculus
ggggagccgggggcactatgaacga

SEQ ID NO: 332568 - DNA, 25 bp, Mus musculus
ggggagcgcggcagtggagctggcc

SEQ ID NO: 332569 - DNA, 25 bp, Mus musculus
ggggagcggagagcgacatgtcctt

SEQ ID NO: 332570 - DNA, 25 bp, Mus musculus
ggggagcggccagagtatggcttcc

SEQ ID NO: 332571 - DNA, 25 bp, Mus musculus
ggggagcggccaggtgtaagagtgt

SEQ ID NO: 332572 - DNA, 25 bp, Mus musculus
ggggagcggcggtggtgtgccaagt

SEQ ID NO: 332573 - DNA, 25 bp, Mus musculus
ggggagcggcggtgtgatccattgt

SEQ ID NO: 332574 - DNA, 25 bp, Mus musculus
ggggagctctcgaagtgccctggag

SEQ ID NO: 332575 - DNA, 25 bp, Mus musculus
ggggagctctcggtctcaactcata

SEQ ID NO: 332576 - DNA, 25 bp, Mus musculus
ggggagctcttggagatttttgcag

SEQ ID NO: 332577 - DNA, 25 bp, Mus musculus
ggggagctggaggggaacctgattt

SEQ ID NO: 332578 - DNA, 25 bp, Mus musculus
ggggagctggccccacagggcttgg

SEQ ID NO: 332579 - DNA, 25 bp, Mus musculus
ggggagctggctaagctggtgctgg

SEQ ID NO: 332580 - DNA, 25 bp, Mus musculus
ggggagctgtggccatgttcataga

SEQ ID NO: 332581 - DNA, 25 bp, Mus musculus
ggggagcttgtgcagccacgaccca

SEQ ID NO: 332582 - DNA, 25 bp, Mus musculus
ggggagcttgtgcaggtgacagcag

SEQ ID NO: 332583 - DNA, 25 bp, Mus musculus
ggggagctttgaggacctcatggaa

SEQ ID NO: 332584 - DNA, 25 bp, Mus musculus
ggggaggagaagcagagcggaattc

SEQ ID NO: 332585 - DNA, 25 bp, Mus musculus
ggggaggagacagacaccatccaac

SEQ ID NO: 332586 - DNA, 25 bp, Mus musculus
ggggaggagctgggctttgactacg

SEQ ID NO: 332587 - DNA, 25 bp, Mus musculus
ggggaggaggaagaggctcacgagg

SEQ ID NO: 332588 - DNA, 25 bp, Mus musculus
ggggaggcagcgcaactacagggct

SEQ ID NO: 332589 - DNA, 25 bp, Mus musculus
ggggaggcagcgcaactgctgcagg

SEQ ID NO: 332590 - DNA, 25 bp, Mus musculus
ggggaggcaggtatggatgtattgt

SEQ ID NO: 332591 - DNA, 25 bp, Mus musculus
ggggaggcagtaaattacagagaag

SEQ ID NO: 332592 - DNA, 25 bp, Mus musculus
ggggaggcagtgttcagggaggtta

SEQ ID NO: 332593 - DNA, 25 bp, Mus musculus
ggggaggccaaccgctatggattac

SEQ ID NO: 332594 - DNA, 25 bp, Mus musculus
ggggaggccagtggtgagaaaccct

SEQ ID NO: 332595 - DNA, 25 bp, Mus musculus
ggggaggcgagagttccagaaacca

SEQ ID NO: 332596 - DNA, 25 bp, Mus musculus
ggggaggcggaagagcatctgatac

SEQ ID NO: 332597 - DNA, 25 bp, Mus musculus
ggggaggcggaagaggtcaggaccc

SEQ ID NO: 332598 - DNA, 25 bp, Mus musculus
ggggaggctaaggggaggcccagcc

SEQ ID NO: 332599 - DNA, 25 bp, Mus musculus
ggggaggctggggaaggaagccagc

SEQ ID NO: 332600 - DNA, 25 bp, Mus musculus
ggggaggctggtgcaaacagctgca

SEQ ID NO: 332601 - DNA, 25 bp, Mus musculus
ggggaggctttggaggtagaggagg

SEQ ID NO: 332602 - DNA, 25 bp, Mus musculus
ggggagggacggcagcccttggagt

SEQ ID NO: 332603 - DNA, 25 bp, Mus musculus
ggggagggacggcaggtttttctca

SEQ ID NO: 332604 - DNA, 25 bp, Mus musculus
ggggagggcaccaggtcactacttc

SEQ ID NO: 332605 - DNA, 25 bp, Mus musculus
ggggagggcgaggtgctcctaatgg

SEQ ID NO: 332606 - DNA, 25 bp, Mus musculus
ggggaggtcagatgtctctcttaaa

SEQ ID NO: 332607 - DNA, 25 bp, Mus musculus
ggggaggtccccaagagtgggccaa

SEQ ID NO: 332608 - DNA, 25 bp, Mus musculus
ggggaggtccccaaggtatttctct

SEQ ID NO: 332609 - DNA, 25 bp, Mus musculus
ggggaggtgaagcccctccaggccg

SEQ ID NO: 332610 - DNA, 25 bp, Mus musculus
ggggagtaaagacctgttgtactgg

SEQ ID NO: 332611 - DNA, 25 bp, Mus musculus
ggggagtaaagtggcagacctgttg

SEQ ID NO: 332612 - DNA, 25 bp, Mus musculus
ggggagtacagaggtgcaggtcctg

SEQ ID NO: 332613 - DNA, 25 bp, Mus musculus
ggggagtactttggtcggtgtggtg

SEQ ID NO: 332614 - DNA, 25 bp, Mus musculus
ggggagtccctgtgcgatgactgta

SEQ ID NO: 332615 - DNA, 25 bp, Mus musculus
ggggagtccctgtgtgacctcttgg

SEQ ID NO: 332616 - DNA, 25 bp, Mus musculus
ggggagtctcttgtacagaggagaa

SEQ ID NO: 332617 - DNA, 25 bp, Mus musculus
ggggagtctggtaaataagctgaag

SEQ ID NO: 332618 - DNA, 25 bp, Mus musculus
ggggagtgaggggagctaccgtcat

SEQ ID NO: 332619 - DNA, 25 bp, Mus musculus
ggggagtgcgagacaaagctggctg

SEQ ID NO: 332620 - DNA, 25 bp, Mus musculus
ggggagtgcgggaacagaactcaaa

SEQ ID NO: 332621 - DNA, 25 bp, Mus musculus
ggggagtgtgagcctatccgcctcc

SEQ ID NO: 332622 - DNA, 25 bp, Mus musculus
ggggagttcatgcactttgccacag

SEQ ID NO: 332623 - DNA, 25 bp, Mus musculus
ggggagtttgagatcccactgagat

SEQ ID NO: 332624 - DNA, 25 bp, Mus musculus
ggggataaagtgtactggaattaat

SEQ ID NO: 332625 - DNA, 25 bp, Mus musculus
ggggataatgcactttgtggagaag

SEQ ID NO: 332626 - DNA, 25 bp, Mus musculus
ggggataattggcctgtggaagcag

SEQ ID NO: 332627 - DNA, 25 bp, Mus musculus
ggggataattgggtctggcaacttg

SEQ ID NO: 332628 - DNA, 25 bp, Mus musculus
ggggatacagaacatctcccgggac

SEQ ID NO: 332629 - DNA, 25 bp, Mus musculus
ggggatacagctttggggcgatggt

SEQ ID NO: 332630 - DNA, 25 bp, Mus musculus
ggggatataattcaggttgatgaaa

SEQ ID NO: 332631 - DNA, 25 bp, Mus musculus
ggggatataattcagtgactcacta

SEQ ID NO: 332632 - DNA, 25 bp, Mus musculus
ggggatatggtgaacttgaccagaa

SEQ ID NO: 332633 - DNA, 25 bp, Mus musculus
ggggatatggttgcctgtaatctca

SEQ ID NO: 332634 - DNA, 25 bp, Mus musculus
ggggatatgtaagacacctgtggat

SEQ ID NO: 332635 - DNA, 25 bp, Mus musculus
ggggatatgtaagtgctcttgtgaa

SEQ ID NO: 332636 - DNA, 25 bp, Mus musculus
ggggatcaagcgactgctctttaca

SEQ ID NO: 332637 - DNA, 25 bp, Mus musculus
ggggatcaagcgactgtttagcttt

SEQ ID NO: 332638 - DNA, 25 bp, Mus musculus
ggggatcaagcgacttaaagaaggt

SEQ ID NO: 332639 - DNA, 25 bp, Mus musculus
ggggatcaggaggttgagaacaaaa

SEQ ID NO: 332640 - DNA, 25 bp, Mus musculus
ggggatcatcaaggtggaaagagac

SEQ ID NO: 332641 - DNA, 25 bp, Mus musculus
ggggatcatgtcggtcacacagcaa

SEQ ID NO: 332642 - DNA, 25 bp, Mus musculus
ggggatccagccgagcccggtcttg

SEQ ID NO: 332643 - DNA, 25 bp, Mus musculus
ggggatccagccggttactctccag

SEQ ID NO: 332644 - DNA, 25 bp, Mus musculus
ggggatccaggtggcacattggaag

SEQ ID NO: 332645 - DNA, 25 bp, Mus musculus
ggggatcccccgcagcgtttggaaa

SEQ ID NO: 332646 - DNA, 25 bp, Mus musculus
ggggatcccttcagagggacagacc

SEQ ID NO: 332647 - DNA, 25 bp, Mus musculus
ggggatcgacaaccacagcaaaccc

SEQ ID NO: 332648 - DNA, 25 bp, Mus musculus
ggggatctcagactatggcgacaag

SEQ ID NO: 332649 - DNA, 25 bp, Mus musculus
ggggatctccaggggagttttgtgc

SEQ ID NO: 332650 - DNA, 25 bp, Mus musculus
ggggatgaagtcattgagaagtttg

SEQ ID NO: 332651 - DNA, 25 bp, Mus musculus
ggggatgacttcagggactcaccag

SEQ ID NO: 332652 - DNA, 25 bp, Mus musculus
ggggatgacttccgggactcaccag

SEQ ID NO: 332653 - DNA, 25 bp, Mus musculus
ggggatgagaaagttgatgaagatg

SEQ ID NO: 332654 - DNA, 25 bp, Mus musculus
ggggatgagaacaggatggacagtc

SEQ ID NO: 332655 - DNA, 25 bp, Mus musculus
ggggatgagaacagggtaggtgagc

SEQ ID NO: 332656 - DNA, 25 bp, Mus musculus
ggggatgcaggttctccgccatgag

SEQ ID NO: 332657 - DNA, 25 bp, Mus musculus
ggggatgccacacagaggacggctg

SEQ ID NO: 332658 - DNA, 25 bp, Mus musculus
ggggatgcctgcaggatctgccact

SEQ ID NO: 332659 - DNA, 25 bp, Mus musculus
ggggatggaggagggaagagtctga

SEQ ID NO: 332660 - DNA, 25 bp, Mus musculus
ggggatggcagattcctgtccatgc

SEQ ID NO: 332661 - DNA, 25 bp, Mus musculus
ggggatggtcgaggacttgcactaa

SEQ ID NO: 332662 - DNA, 25 bp, Mus musculus
ggggatggtgatgaacgagaccgtg

SEQ ID NO: 332663 - DNA, 25 bp, Mus musculus
ggggatgtagcaggcgccctggagg

SEQ ID NO: 332664 - DNA, 25 bp, Mus musculus
ggggatgtagcaggcgcgcggtgac

SEQ ID NO: 332665 - DNA, 25 bp, Mus musculus
ggggatgtgaagatcatcagaaact

SEQ ID NO: 332666 - DNA, 25 bp, Mus musculus
ggggattaaggcaggttgtcacaac

SEQ ID NO: 332667 - DNA, 25 bp, Mus musculus
ggggattacaggttaaaatgagctt

SEQ ID NO: 332668 - DNA, 25 bp, Mus musculus
ggggattatcgggctcagcgttgtt

SEQ ID NO: 332669 - DNA, 25 bp, Mus musculus
ggggattatcggggaagcgtttctc

SEQ ID NO: 332670 - DNA, 25 bp, Mus musculus
ggggattatttagcacaggtgatga

SEQ ID NO: 332671 - DNA, 25 bp, Mus musculus
ggggattccagagtgtgtgggtttc

SEQ ID NO: 332672 - DNA, 25 bp, Mus musculus
ggggattctacaaagctgggcatgg

SEQ ID NO: 332673 - DNA, 25 bp, Mus musculus
ggggattcttcagcacaggggatga

SEQ ID NO: 332674 - DNA, 25 bp, Mus musculus
ggggattgaacttcgtgggcatcga

SEQ ID NO: 332675 - DNA, 25 bp, Mus musculus
ggggattgattatgagaagatcttg

SEQ ID NO: 332676 - DNA, 25 bp, Mus musculus
ggggattgggaagagaacagacaag

SEQ ID NO: 332677 - DNA, 25 bp, Mus musculus
ggggatttaacacaggtgtgatcct

SEQ ID NO: 332678 - DNA, 25 bp, Mus musculus
ggggatttacagggctgcagaatgg

SEQ ID NO: 332679 - DNA, 25 bp, Mus musculus
ggggcaaaatggagctcgacgccat

SEQ ID NO: 332680 - DNA, 25 bp, Mus musculus
ggggcaacctaggtgttgactttaa

SEQ ID NO: 332681 - DNA, 25 bp, Mus musculus
ggggcaagaccaagatcaccgatgt

SEQ ID NO: 332682 - DNA, 25 bp, Mus musculus
ggggcaagcctgaacctgtcacagg

SEQ ID NO: 332683 - DNA, 25 bp, Mus musculus
ggggcaagcggttcagtacctctcg

SEQ ID NO: 332684 - DNA, 25 bp, Mus musculus
ggggcaaggaggagtcatctctcat

SEQ ID NO: 332685 - DNA, 25 bp, Mus musculus
ggggcaatacaatgaggagactgac

SEQ ID NO: 332686 - DNA, 25 bp, Mus musculus
ggggcaatacattgctatagctcaa

SEQ ID NO: 332687 - DNA, 25 bp, Mus musculus
ggggcaataccaatatagggggcta

SEQ ID NO: 332688 - DNA, 25 bp, Mus musculus
ggggcacaaaggtgacctcactgac

SEQ ID NO: 332689 - DNA, 25 bp, Mus musculus
ggggcacaagtgctgagagctaagt

SEQ ID NO: 332690 - DNA, 25 bp, Mus musculus
ggggcacaatctgcagctcagtggc

SEQ ID NO: 332691 - DNA, 25 bp, Mus musculus
ggggcaccgaggtctccagcagaag

SEQ ID NO: 332692 - DNA, 25 bp, Mus musculus
ggggcaccgagtcaaataatttagt

SEQ ID NO: 332693 - DNA, 25 bp, Mus musculus
ggggcaccgatcgtgtatgacggag

SEQ ID NO: 332694 - DNA, 25 bp, Mus musculus
ggggcacctggcgaggaggaagccc

SEQ ID NO: 332695 - DNA, 25 bp, Mus musculus
ggggcacctggtctcccttccatgc

SEQ ID NO: 332696 - DNA, 25 bp, Mus musculus
ggggcactatcgaagttgagaatac

SEQ ID NO: 332697 - DNA, 25 bp, Mus musculus
ggggcagaacctggccaagatcctg

SEQ ID NO: 332698 - DNA, 25 bp, Mus musculus
ggggcagaacgaggttgtgaaccat

SEQ ID NO: 332699 - DNA, 25 bp, Mus musculus
ggggcagaagagattgtggatggca

SEQ ID NO: 332700 - DNA, 25 bp, Mus musculus
ggggcagaagaggaggtggcttaca

SEQ ID NO: 332701 - DNA, 25 bp, Mus musculus
ggggcagaagattgctttggccttg

SEQ ID NO: 332702 - DNA, 25 bp, Mus musculus
ggggcagaagcgcattaaagaggaa

SEQ ID NO: 332703 - DNA, 25 bp, Mus musculus
ggggcagagcagggatcagtggtga

SEQ ID NO: 332704 - DNA, 25 bp, Mus musculus
ggggcagatcctccttatcccactc

SEQ ID NO: 332705 - DNA, 25 bp, Mus musculus
ggggcagatcctctgatggagccag

SEQ ID NO: 332706 - DNA, 25 bp, Mus musculus
ggggcagatgcgaatgaagaggcct

SEQ ID NO: 332707 - DNA, 25 bp, Mus musculus
ggggcagattcagcacagagctgat

SEQ ID NO: 332708 - DNA, 25 bp, Mus musculus
ggggcagattcaggtgattctcggg

SEQ ID NO: 332709 - DNA, 25 bp, Mus musculus
ggggcagcagcaccatggccagccc

SEQ ID NO: 332710 - DNA, 25 bp, Mus musculus
ggggcagcagcttcctggccccggg

SEQ ID NO: 332711 - DNA, 25 bp, Mus musculus
ggggcagcaggatcccagtgtgcgg

SEQ ID NO: 332712 - DNA, 25 bp, Mus musculus
ggggcagccaggctggggatgacaa

SEQ ID NO: 332713 - DNA, 25 bp, Mus musculus
ggggcagccagtcttcctgtcccag

SEQ ID NO: 332714 - DNA, 25 bp, Mus musculus
ggggcagcggaagaccagactctga

SEQ ID NO: 332715 - DNA, 25 bp, Mus musculus
ggggcagctccccaggcctcacacg

SEQ ID NO: 332716 - DNA, 25 bp, Mus musculus
ggggcagctccccagtgaggtggct

SEQ ID NO: 332717 - DNA, 25 bp, Mus musculus
ggggcagcttggagccggaagctgg

SEQ ID NO: 332718 - DNA, 25 bp, Mus musculus
ggggcaggaagtgtcgagtggctgg

SEQ ID NO: 332719 - DNA, 25 bp, Mus musculus
ggggcaggagccgaaatgtctcagg

SEQ ID NO: 332720 - DNA, 25 bp, Mus musculus
ggggcaggagccgagtctccttata

SEQ ID NO: 332721 - DNA, 25 bp, Mus musculus
ggggcaggagccgatcccttttcaa

SEQ ID NO: 332722 - DNA, 25 bp, Mus musculus
ggggcaggcagccactcccgagact

SEQ ID NO: 332723 - DNA, 25 bp, Mus musculus
ggggcaggcaggaggtggtggagtt

SEQ ID NO: 332724 - DNA, 25 bp, Mus musculus
ggggcaggcgggtgattatagagcg

SEQ ID NO: 332725 - DNA, 25 bp, Mus musculus
ggggcagggagacgatactgtatcc

SEQ ID NO: 332726 - DNA, 25 bp, Mus musculus
ggggcagggcgggagagtattgtct

SEQ ID NO: 332727 - DNA, 25 bp, Mus musculus
ggggcaggtcaatagccttcctggg

SEQ ID NO: 332728 - DNA, 25 bp, Mus musculus
ggggcaggtgcccatgttggaagat

SEQ ID NO: 332729 - DNA, 25 bp, Mus musculus
ggggcagtttagaaatgcacttagc

SEQ ID NO: 332730 - DNA, 25 bp, Mus musculus
ggggcatactgcagtgcttaaatgt

SEQ ID NO: 332731 - DNA, 25 bp, Mus musculus
ggggcatcatcgaagctcccatctc

SEQ ID NO: 332732 - DNA, 25 bp, Mus musculus
ggggcatcatcgaagtggaaaacat

SEQ ID NO: 332733 - DNA, 25 bp, Mus musculus
ggggcatccacggaggaggagctga

SEQ ID NO: 332734 - DNA, 25 bp, Mus musculus
ggggcatccacggaggccctgccca

SEQ ID NO: 332735 - DNA, 25 bp, Mus musculus
ggggcatccagataagatctgtgac

SEQ ID NO: 332736 - DNA, 25 bp, Mus musculus
ggggcatccgggactaggctctgta

SEQ ID NO: 332737 - DNA, 25 bp, Mus musculus
ggggcatcgtggaagccttgccatg

SEQ ID NO: 332738 - DNA, 25 bp, Mus musculus
ggggcatcgtggaagtggaaaaccc

SEQ ID NO: 332739 - DNA, 25 bp, Mus musculus
ggggcatctcacaagttagccctag

SEQ ID NO: 332740 - DNA, 25 bp, Mus musculus
ggggcatgagtgtaatgttcaagcc

SEQ ID NO: 332741 - DNA, 25 bp, Mus musculus
ggggcatgcaggcttcctgcttttt

SEQ ID NO: 332742 - DNA, 25 bp, Mus musculus
ggggcatgtagagtgatcgatggct

SEQ ID NO: 332743 - DNA, 25 bp, Mus musculus
ggggcatgtttacagtggccggcct

SEQ ID NO: 332744 - DNA, 25 bp, Mus musculus
ggggcatgtttacagttaggtgaca

SEQ ID NO: 332745 - DNA, 25 bp, Mus musculus
ggggccaagctcaagcaggtgttgc

SEQ ID NO: 332746 - DNA, 25 bp, Mus musculus
ggggccaaggcgtgattaaggttga

SEQ ID NO: 332747 - DNA, 25 bp, Mus musculus
ggggccacagaggcagaggagtcct

SEQ ID NO: 332748 - DNA, 25 bp, Mus musculus
ggggccacagcctgggtgcctatag

SEQ ID NO: 332749 - DNA, 25 bp, Mus musculus
ggggccacaggtgccccccactcgg

SEQ ID NO: 332750 - DNA, 25 bp, Mus musculus
ggggccactaccgacatctagagcc

SEQ ID NO: 332751 - DNA, 25 bp, Mus musculus
ggggccactaccgcacggactcccg

SEQ ID NO: 332752 - DNA, 25 bp, Mus musculus
ggggccactcaacccaccctcagcc

SEQ ID NO: 332753 - DNA, 25 bp, Mus musculus
ggggccagctccaggtcacaggatg

SEQ ID NO: 332754 - DNA, 25 bp, Mus musculus
ggggccagctcgcaagcaggctgac

SEQ ID NO: 332755 - DNA, 25 bp, Mus musculus
ggggccagctcgcttgaagctcctg

SEQ ID NO: 332756 - DNA, 25 bp, Mus musculus
ggggccagctgaaggctctgtgggt

SEQ ID NO: 332757 - DNA, 25 bp, Mus musculus
ggggccagctgagcaattgtgttcg

SEQ ID NO: 332758 - DNA, 25 bp, Mus musculus
ggggccagtagagtatagaaatatc

SEQ ID NO: 332759 - DNA, 25 bp, Mus musculus
ggggccagtaggtccaatcagcata

SEQ ID NO: 332760 - DNA, 25 bp, Mus musculus
ggggccatcgatgtgcagaagacca

SEQ ID NO: 332761 - DNA, 25 bp, Mus musculus
ggggccatcgtgattcgagtcatct

SEQ ID NO: 332762 - DNA, 25 bp, Mus musculus
ggggccatgatgagtacctatacca

SEQ ID NO: 332763 - DNA, 25 bp, Mus musculus
ggggccattaacaaggaccctgcag

SEQ ID NO: 332764 - DNA, 25 bp, Mus musculus
ggggccattaacaaggagacgactg

SEQ ID NO: 332765 - DNA, 25 bp, Mus musculus
ggggccattggaggagtctgcggtg

SEQ ID NO: 332766 - DNA, 25 bp, Mus musculus
ggggcccacagactgcagcaatggc

SEQ ID NO: 332767 - DNA, 25 bp, Mus musculus
ggggcccacaggtgcagttggtgaa

SEQ ID NO: 332768 - DNA, 25 bp, Mus musculus
ggggcccacagttggtgaacaactc

SEQ ID NO: 332769 - DNA, 25 bp, Mus musculus
ggggcccagaaccagggcaaaaagg

SEQ ID NO: 332770 - DNA, 25 bp, Mus musculus
ggggcccagaaccagggcaagaaag

SEQ ID NO: 332771 - DNA, 25 bp, Mus musculus
ggggcccagaaggctgagaccgctg

SEQ ID NO: 332772 - DNA, 25 bp, Mus musculus
ggggcccataacgtgtttcatcccc

SEQ ID NO: 332773 - DNA, 25 bp, Mus musculus
ggggccccacggatgctggtggact

SEQ ID NO: 332774 - DNA, 25 bp, Mus musculus
ggggccccacggctggggactcctt

SEQ ID NO: 332775 - DNA, 25 bp, Mus musculus
ggggccccagcccctctggtttcac

SEQ ID NO: 332776 - DNA, 25 bp, Mus musculus
ggggccccagctgtttcagccatgg

SEQ ID NO: 332777 - DNA, 25 bp, Mus musculus
ggggccccatcggaagctcagaacc

SEQ ID NO: 332778 - DNA, 25 bp, Mus musculus
ggggccccgcggcagactccggggt

SEQ ID NO: 332779 - DNA, 25 bp, Mus musculus
ggggcccgggcttccgtgacctcgt

SEQ ID NO: 332780 - DNA, 25 bp, Mus musculus
ggggcccgtggcaaaggtcttttgg

SEQ ID NO: 332781 - DNA, 25 bp, Mus musculus
ggggccctaaataaaagcctgacta

SEQ ID NO: 332782 - DNA, 25 bp, Mus musculus
ggggccctccctcagacctgggaag

SEQ ID NO: 332783 - DNA, 25 bp, Mus musculus
ggggccctcgatgagatgtgatctt

SEQ ID NO: 332784 - DNA, 25 bp, Mus musculus
ggggcccttggaagattggctcttt

SEQ ID NO: 332785 - DNA, 25 bp, Mus musculus
ggggccgaaggcctgggatgggaaa

SEQ ID NO: 332786 - DNA, 25 bp, Mus musculus
ggggccgcacggttggtacacgatg

SEQ ID NO: 332787 - DNA, 25 bp, Mus musculus
ggggccgcagcctggtaacgaaggc

SEQ ID NO: 332788 - DNA, 25 bp, Mus musculus
ggggccgcagcctgttgggcaaggc

SEQ ID NO: 332789 - DNA, 25 bp, Mus musculus
ggggccgcaggaggcccagcctcgt

SEQ ID NO: 332790 - DNA, 25 bp, Mus musculus
ggggccgccgctgagcgccggagta

SEQ ID NO: 332791 - DNA, 25 bp, Mus musculus
ggggccggccagatgggcaagagtt

SEQ ID NO: 332792 - DNA, 25 bp, Mus musculus
ggggccggctggcagaacacagatc

SEQ ID NO: 332793 - DNA, 25 bp, Mus musculus
ggggccgtgaggaggataaaagcag

SEQ ID NO: 332794 - DNA, 25 bp, Mus musculus
ggggccgtgaggtatccagctcata

SEQ ID NO: 332795 - DNA, 25 bp, Mus musculus
ggggccgtggaagagtgaagacacc

SEQ ID NO: 332796 - DNA, 25 bp, Mus musculus
ggggccgttgggcgtcgcggcttta

SEQ ID NO: 332797 - DNA, 25 bp, Mus musculus
ggggcctaactggtttgcatttcct

SEQ ID NO: 332798 - DNA, 25 bp, Mus musculus
ggggcctacagaagaggaggccact

SEQ ID NO: 332799 - DNA, 25 bp, Mus musculus
ggggcctatacgctgcctggctcac

SEQ ID NO: 332800 - DNA, 25 bp, Mus musculus
ggggcctattaagctgatccacacc

SEQ ID NO: 332801 - DNA, 25 bp, Mus musculus
ggggcctattaagggctcgctgctg

SEQ ID NO: 332802 - DNA, 25 bp, Mus musculus
ggggcctcaggtggatgaaactcag

SEQ ID NO: 332803 - DNA, 25 bp, Mus musculus
ggggcctccagcaggaacacagagg

SEQ ID NO: 332804 - DNA, 25 bp, Mus musculus
ggggcctccatacagtgctctgtga

SEQ ID NO: 332805 - DNA, 25 bp, Mus musculus
ggggcctccgagaggttggcctgct

SEQ ID NO: 332806 - DNA, 25 bp, Mus musculus
ggggcctcctggccaggtggccatt

SEQ ID NO: 332807 - DNA, 25 bp, Mus musculus
ggggcctcggaaccgtctggatctt

SEQ ID NO: 332808 - DNA, 25 bp, Mus musculus
ggggcctctcaaaggacagtgaact

SEQ ID NO: 332809 - DNA, 25 bp, Mus musculus
ggggcctctcaactggtgtggtgtg

SEQ ID NO: 332810 - DNA, 25 bp, Mus musculus
ggggcctctgctgtgctgaaatgga

SEQ ID NO: 332811 - DNA, 25 bp, Mus musculus
ggggcctgaccttccaatctgaaca

SEQ ID NO: 332812 - DNA, 25 bp, Mus musculus
ggggcctggaggacatcatgttcat

SEQ ID NO: 332813 - DNA, 25 bp, Mus musculus
ggggcctggctgggatgggtgctac

SEQ ID NO: 332814 - DNA, 25 bp, Mus musculus
ggggcctggtgcagctggtgctgct

SEQ ID NO: 332815 - DNA, 25 bp, Mus musculus
ggggccttcaaccgaaacaagctcc

SEQ ID NO: 332816 - DNA, 25 bp, Mus musculus
ggggccttcactggggcactcagaa

SEQ ID NO: 332817 - DNA, 25 bp, Mus musculus
ggggcctttagatgggaaagttgac

SEQ ID NO: 332818 - DNA, 25 bp, Mus musculus
ggggcgagaaactgatgaagtgact

SEQ ID NO: 332819 - DNA, 25 bp, Mus musculus
ggggcgagagtgggctgtaaaaaat

SEQ ID NO: 332820 - DNA, 25 bp, Mus musculus
ggggcgagcgaagtaagcggaggcc

SEQ ID NO: 332821 - DNA, 25 bp, Mus musculus
ggggcgaggccgatactccatgttt

SEQ ID NO: 332822 - DNA, 25 bp, Mus musculus
ggggcgatccggaacctggtggcca

SEQ ID NO: 332823 - DNA, 25 bp, Mus musculus
ggggcgatccgggaaggccatagcc

SEQ ID NO: 332824 - DNA, 25 bp, Mus musculus
ggggcgcacagccctgtgaagccag

SEQ ID NO: 332825 - DNA, 25 bp, Mus musculus
ggggcgcatcgcggcctcaaagcgg

SEQ ID NO: 332826 - DNA, 25 bp, Mus musculus
ggggcgccagacaggattatggaaa

SEQ ID NO: 332827 - DNA, 25 bp, Mus musculus
ggggcgccagggatcaacgttgtaa

SEQ ID NO: 332828 - DNA, 25 bp, Mus musculus
ggggcgccgtctctggcaggcactg

SEQ ID NO: 332829 - DNA, 25 bp, Mus musculus
ggggcgcgaggtgcagggaagggga

SEQ ID NO: 332830 - DNA, 25 bp, Mus musculus
ggggcgcgcaggtgtccacagaact

SEQ ID NO: 332831 - DNA, 25 bp, Mus musculus
ggggcgcgccctcaagaacagaagc

SEQ ID NO: 332832 - DNA, 25 bp, Mus musculus
ggggcgcgccctcacgtctgactct

SEQ ID NO: 332833 - DNA, 25 bp, Mus musculus
ggggcgcgcgcgtgacgagtgacca

SEQ ID NO: 332834 - DNA, 25 bp, Mus musculus
ggggcgcgcggtgtgaagaaaaagg

SEQ ID NO: 332835 - DNA, 25 bp, Mus musculus
ggggcgcggccagggcaaagtgcaa

SEQ ID NO: 332836 - DNA, 25 bp, Mus musculus
ggggcgctgacaggtactgggtttg

SEQ ID NO: 332837 - DNA, 25 bp, Mus musculus
ggggcgctgccacagcgctgtgtag

SEQ ID NO: 332838 - DNA, 25 bp, Mus musculus
ggggcgctggcaccttcaaacacct

SEQ ID NO: 332839 - DNA, 25 bp, Mus musculus
ggggcgctgggctacgatggaagca

SEQ ID NO: 332840 - DNA, 25 bp, Mus musculus
ggggcgctggtcgggctgtggcagt

SEQ ID NO: 332841 - DNA, 25 bp, Mus musculus
ggggcggacagacctacgcaatgat

SEQ ID NO: 332842 - DNA, 25 bp, Mus musculus
ggggcggacagatctgacacacatg

SEQ ID NO: 332843 - DNA, 25 bp, Mus musculus
ggggcggactaataggactgaggat

SEQ ID NO: 332844 - DNA, 25 bp, Mus musculus
ggggcggactaataggcagatacat

SEQ ID NO: 332845 - DNA, 25 bp, Mus musculus
ggggcggacttcaggtgactcggac

SEQ ID NO: 332846 - DNA, 25 bp, Mus musculus
ggggcggacttcaggtgattcacaa

SEQ ID NO: 332847 - DNA, 25 bp, Mus musculus
ggggcggacttccaggctcagtgtt

SEQ ID NO: 332848 - DNA, 25 bp, Mus musculus
ggggcggagctgtagatatggcata

SEQ ID NO: 332849 - DNA, 25 bp, Mus musculus
ggggcggagctgtagctggcccatg

SEQ ID NO: 332850 - DNA, 25 bp, Mus musculus
ggggcggagctgtaggcaagagata

SEQ ID NO: 332851 - DNA, 25 bp, Mus musculus
ggggcggccaggtccagcaccaagc

SEQ ID NO: 332852 - DNA, 25 bp, Mus musculus
ggggcgggacccagctgaccttaag

SEQ ID NO: 332853 - DNA, 25 bp, Mus musculus
ggggcgggaccgcagattattttta

SEQ ID NO: 332854 - DNA, 25 bp, Mus musculus
ggggcgggaccgcagggattctcct

SEQ ID NO: 332855 - DNA, 25 bp, Mus musculus
ggggcgggcttagggtggagcgacc

SEQ ID NO: 332856 - DNA, 25 bp, Mus musculus
ggggcggggcctcggaaccgtctgg

SEQ ID NO: 332857 - DNA, 25 bp, Mus musculus
ggggcggttgcctgtagtcagaaga

SEQ ID NO: 332858 - DNA, 25 bp, Mus musculus
ggggcgtagctctggtgcaccctct

SEQ ID NO: 332859 - DNA, 25 bp, Mus musculus
ggggcgtagctctgttcccacttca

SEQ ID NO: 332860 - DNA, 25 bp, Mus musculus
ggggcgtatgctgggtgaacttcga

SEQ ID NO: 332861 - DNA, 25 bp, Mus musculus
ggggcgtcctgaagcgctgtgcttt

SEQ ID NO: 332862 - DNA, 25 bp, Mus musculus
ggggcgtggaagaggtcagcagagc

SEQ ID NO: 332863 - DNA, 25 bp, Mus musculus
ggggcgtggaagaggtcagggccaa

SEQ ID NO: 332864 - DNA, 25 bp, Mus musculus
ggggcgtgggattgaagtgagtgaa

SEQ ID NO: 332865 - DNA, 25 bp, Mus musculus
ggggcgttcaacgctccagttataa

SEQ ID NO: 332866 - DNA, 25 bp, Mus musculus
ggggcgttcagtatgcctgtgtctt

SEQ ID NO: 332867 - DNA, 25 bp, Mus musculus
ggggctaagggacagatggctatga

SEQ ID NO: 332868 - DNA, 25 bp, Mus musculus
ggggctaagggacagggggctgaaa

SEQ ID NO: 332869 - DNA, 25 bp, Mus musculus
ggggctacagatagggtctctccac

SEQ ID NO: 332870 - DNA, 25 bp, Mus musculus
ggggctacagatttatgacattcaa

SEQ ID NO: 332871 - DNA, 25 bp, Mus musculus
ggggctacaggctcaccatcatgga

SEQ ID NO: 332872 - DNA, 25 bp, Mus musculus
ggggctacaggtggccttgcacgct

SEQ ID NO: 332873 - DNA, 25 bp, Mus musculus
ggggctagctgaggtgcggagctga

SEQ ID NO: 332874 - DNA, 25 bp, Mus musculus
ggggctataacacacgagtcatact

SEQ ID NO: 332875 - DNA, 25 bp, Mus musculus
ggggctataacacaggagtcatact

SEQ ID NO: 332876 - DNA, 25 bp, Mus musculus
ggggctatgcagatggctatgaacg

SEQ ID NO: 332877 - DNA, 25 bp, Mus musculus
ggggctatggaaaggtttttcaagt

SEQ ID NO: 332878 - DNA, 25 bp, Mus musculus
ggggctatggcaaggtgttccaggt

SEQ ID NO: 332879 - DNA, 25 bp, Mus musculus
ggggctcacaccgacctgagaaatg

SEQ ID NO: 332880 - DNA, 25 bp, Mus musculus
ggggctcacaccgactgcgtaattc

SEQ ID NO: 332881 - DNA, 25 bp, Mus musculus
ggggctcacaccgataaccctaaca

SEQ ID NO: 332882 - DNA, 25 bp, Mus musculus
ggggctcacgagaatcatcattcaa

SEQ ID NO: 332883 - DNA, 25 bp, Mus musculus
ggggctcacgtttcagatgagtgag

SEQ ID NO: 332884 - DNA, 25 bp, Mus musculus
ggggctcatcatacagaacagtacc

SEQ ID NO: 332885 - DNA, 25 bp, Mus musculus
ggggctccagagataaagctgctca

SEQ ID NO: 332886 - DNA, 25 bp, Mus musculus
ggggctccagagattatttgtcttt

SEQ ID NO: 332887 - DNA, 25 bp, Mus musculus
ggggctccaggcagaagcgatgctg

SEQ ID NO: 332888 - DNA, 25 bp, Mus musculus
ggggctccataaagcccatgcaggt

SEQ ID NO: 332889 - DNA, 25 bp, Mus musculus
ggggctccccgcctccgctgaagaa

SEQ ID NO: 332890 - DNA, 25 bp, Mus musculus
ggggctccctgcagggtcccacaaa

SEQ ID NO: 332891 - DNA, 25 bp, Mus musculus
ggggctcccttactcagttccctta

SEQ ID NO: 332892 - DNA, 25 bp, Mus musculus
ggggctcctgatgtcactggtctcc

SEQ ID NO: 332893 - DNA, 25 bp, Mus musculus
ggggctcctgcaggagggctgctgg

SEQ ID NO: 332894 - DNA, 25 bp, Mus musculus
ggggctcgaagggcaggtaaaccac

SEQ ID NO: 332895 - DNA, 25 bp, Mus musculus
ggggctcgcaggatccctgctgcct

SEQ ID NO: 332896 - DNA, 25 bp, Mus musculus
ggggctcggcaggttcgcttatctt

SEQ ID NO: 332897 - DNA, 25 bp, Mus musculus
ggggctcggggcggtaggaaatcag

SEQ ID NO: 332898 - DNA, 25 bp, Mus musculus
ggggctctctggtggttcatccctg

SEQ ID NO: 332899 - DNA, 25 bp, Mus musculus
ggggctctgacctgggacccctcat

SEQ ID NO: 332900 - DNA, 25 bp, Mus musculus
ggggctctgaggttgaactggagca

SEQ ID NO: 332901 - DNA, 25 bp, Mus musculus
ggggctctggcaaggactcacacac

SEQ ID NO: 332902 - DNA, 25 bp, Mus musculus
ggggctctggcaaggtaccctggct

SEQ ID NO: 332903 - DNA, 25 bp, Mus musculus
ggggctctgtgctcctggcacacac

SEQ ID NO: 332904 - DNA, 25 bp, Mus musculus
ggggctgaaaagacactacaagaag

SEQ ID NO: 332905 - DNA, 25 bp, Mus musculus
ggggctgaagtatatccatgcggct

SEQ ID NO: 332906 - DNA, 25 bp, Mus musculus
ggggctgacagatcaacttatgaga

SEQ ID NO: 332907 - DNA, 25 bp, Mus musculus
ggggctgacggacgagtccggctgc

SEQ ID NO: 332908 - DNA, 25 bp, Mus musculus
ggggctgacggagggtgaggagttc

SEQ ID NO: 332909 - DNA, 25 bp, Mus musculus
ggggctgacggtcgaagaaagcctg

SEQ ID NO: 332910 - DNA, 25 bp, Mus musculus
ggggctgagaaagacaggttgcagc

SEQ ID NO: 332911 - DNA, 25 bp, Mus musculus
ggggctgagcaccagggcttccagc

SEQ ID NO: 332912 - DNA, 25 bp, Mus musculus
ggggctgaggagagggaactagttc

SEQ ID NO: 332913 - DNA, 25 bp, Mus musculus
ggggctgaggccgggaccggagctg

SEQ ID NO: 332914 - DNA, 25 bp, Mus musculus
ggggctgatggcttccctaggattc

SEQ ID NO: 332915 - DNA, 25 bp, Mus musculus
ggggctgcagaccccacgtggctca

SEQ ID NO: 332916 - DNA, 25 bp, Mus musculus
ggggctgcaggggacacccgtcagc

SEQ ID NO: 332917 - DNA, 25 bp, Mus musculus
ggggctgcaggtcacagcggagtga

SEQ ID NO: 332918 - DNA, 25 bp, Mus musculus
ggggctgccacacaatcaggacttc

SEQ ID NO: 332919 - DNA, 25 bp, Mus musculus
ggggctgcccaaagagcatgccacc

SEQ ID NO: 332920 - DNA, 25 bp, Mus musculus
ggggctgcccaaagagccccctcag

SEQ ID NO: 332921 - DNA, 25 bp, Mus musculus
ggggctgcccaaagcctgagaccca

SEQ ID NO: 332922 - DNA, 25 bp, Mus musculus
ggggctgcccaaagggacactacat

SEQ ID NO: 332923 - DNA, 25 bp, Mus musculus
ggggctgccggggtagctcgcggcg

SEQ ID NO: 332924 - DNA, 25 bp, Mus musculus
ggggctgcctgcctacagactacaa

SEQ ID NO: 332925 - DNA, 25 bp, Mus musculus
ggggctgcgaggggcatgaaggatg

SEQ ID NO: 332926 - DNA, 25 bp, Mus musculus
ggggctgcgccctgggattcatcac

SEQ ID NO: 332927 - DNA, 25 bp, Mus musculus
ggggctgcggcagcaagaacagaag

SEQ ID NO: 332928 - DNA, 25 bp, Mus musculus
ggggctgcggcagcacgtctgactc

SEQ ID NO: 332929 - DNA, 25 bp, Mus musculus
ggggctgcggcagggcatcatgaag

SEQ ID NO: 332930 - DNA, 25 bp, Mus musculus
ggggctgctcaacaggacttggatg

SEQ ID NO: 332931 - DNA, 25 bp, Mus musculus
ggggctgctcaacaggctcacacca

SEQ ID NO: 332932 - DNA, 25 bp, Mus musculus
ggggctgctcccagcatggcggaca

SEQ ID NO: 332933 - DNA, 25 bp, Mus musculus
ggggctgctgagcaggtagataata

SEQ ID NO: 332934 - DNA, 25 bp, Mus musculus
ggggctgctgctctgtaaagaagaa

SEQ ID NO: 332935 - DNA, 25 bp, Mus musculus
ggggctgctggacctaccggcatgt

SEQ ID NO: 332936 - DNA, 25 bp, Mus musculus
ggggctgctggacggagcgggatga

SEQ ID NO: 332937 - DNA, 25 bp, Mus musculus
ggggctgctgttaaggaagaagagc

SEQ ID NO: 332938 - DNA, 25 bp, Mus musculus
ggggctggaccaggagcagccatgt

SEQ ID NO: 332939 - DNA, 25 bp, Mus musculus
ggggctggacgttgagatcaccacc

SEQ ID NO: 332940 - DNA, 25 bp, Mus musculus
ggggctggctcagctcccaagtgcc

SEQ ID NO: 332941 - DNA, 25 bp, Mus musculus
ggggctggctgaatcatgatgaaac

SEQ ID NO: 332942 - DNA, 25 bp, Mus musculus
ggggctggcttacagacaaagccta

SEQ ID NO: 332943 - DNA, 25 bp, Mus musculus
ggggctggcttacaggttcagaggt

SEQ ID NO: 332944 - DNA, 25 bp, Mus musculus
ggggctggggctactacggttgcaa

SEQ ID NO: 332945 - DNA, 25 bp, Mus musculus
ggggctgtcagattggtgacccaga

SEQ ID NO: 332946 - DNA, 25 bp, Mus musculus
ggggctgtcaggcacagaggatctt

SEQ ID NO: 332947 - DNA, 25 bp, Mus musculus
ggggctgtcctgctaaggaagagct

SEQ ID NO: 332948 - DNA, 25 bp, Mus musculus
ggggctgtgatggaatttcacgttt

SEQ ID NO: 332949 - DNA, 25 bp, Mus musculus
ggggctgtgatggtagcatcgcctg

SEQ ID NO: 332950 - DNA, 25 bp, Mus musculus
ggggctgtggatctttccagaacat

SEQ ID NO: 332951 - DNA, 25 bp, Mus musculus
ggggctgtggcagactaactccagt

SEQ ID NO: 332952 - DNA, 25 bp, Mus musculus
ggggctgtgggattatctgaacgat

SEQ ID NO: 332953 - DNA, 25 bp, Mus musculus
ggggctgttggacttcaagaaaaga

SEQ ID NO: 332954 - DNA, 25 bp, Mus musculus
ggggcttaaagagggcttggggcat

SEQ ID NO: 332955 - DNA, 25 bp, Mus musculus
ggggcttaactggttacaaaatgtc

SEQ ID NO: 332956 - DNA, 25 bp, Mus musculus
ggggcttactcaggatgtcaatggg

SEQ ID NO: 332957 - DNA, 25 bp, Mus musculus
ggggcttagacaggataaggaagcc

SEQ ID NO: 332958 - DNA, 25 bp, Mus musculus
ggggcttatggtgtctgatctggac

SEQ ID NO: 332959 - DNA, 25 bp, Mus musculus
ggggcttcagacaccaatgactgca

SEQ ID NO: 332960 - DNA, 25 bp, Mus musculus
ggggcttcagagatcatgtgtgccc

SEQ ID NO: 332961 - DNA, 25 bp, Mus musculus
ggggcttcccagaaaagatcaggca

SEQ ID NO: 332962 - DNA, 25 bp, Mus musculus
ggggcttctagccagagccatgcag

SEQ ID NO: 332963 - DNA, 25 bp, Mus musculus
ggggcttctgcgaaactgaagaaga

SEQ ID NO: 332964 - DNA, 25 bp, Mus musculus
ggggcttgataaagggaggtatgaa

SEQ ID NO: 332965 - DNA, 25 bp, Mus musculus
ggggcttgcagaggcctacgtgaag

SEQ ID NO: 332966 - DNA, 25 bp, Mus musculus
ggggcttgcccagctggctcctcca

SEQ ID NO: 332967 - DNA, 25 bp, Mus musculus
ggggcttggcaaatggaatctatag

SEQ ID NO: 332968 - DNA, 25 bp, Mus musculus
ggggcttgggagcatttagctcctc

SEQ ID NO: 332969 - DNA, 25 bp, Mus musculus
ggggcttgtgagggtgactacgggg

SEQ ID NO: 332970 - DNA, 25 bp, Mus musculus
ggggcttgtgcaggtctggtcactc

SEQ ID NO: 332971 - DNA, 25 bp, Mus musculus
ggggctttaggagggttggtggtcg

SEQ ID NO: 332972 - DNA, 25 bp, Mus musculus
ggggctttcagggggactgcaggcc

SEQ ID NO: 332973 - DNA, 25 bp, Mus musculus
ggggctttcctgaggagcggcggca

SEQ ID NO: 332974 - DNA, 25 bp, Mus musculus
ggggctttgggccggttgctgatga

SEQ ID NO: 332975 - DNA, 25 bp, Mus musculus
ggggcttttgcggctaagtaagaag

SEQ ID NO: 332976 - DNA, 25 bp, Mus musculus
gggggaaaccgaggactcagagagg

SEQ ID NO: 332977 - DNA, 25 bp, Mus musculus
gggggaaatctaagataccaagtgg

SEQ ID NO: 332978 - DNA, 25 bp, Mus musculus
gggggaacaggttgagtgatggtaa

SEQ ID NO: 332979 - DNA, 25 bp, Mus musculus
gggggaacagtttctctaatagcat

SEQ ID NO: 332980 - DNA, 25 bp, Mus musculus
gggggaacctggagctgcccatcga

SEQ ID NO: 332981 - DNA, 25 bp, Mus musculus
gggggaacctgggagccacccaaga

SEQ ID NO: 332982 - DNA, 25 bp, Mus musculus
gggggaactggttgggaagccagct

SEQ ID NO: 332983 - DNA, 25 bp, Mus musculus
gggggaagacgatcactttttaatt

SEQ ID NO: 332984 - DNA, 25 bp, Mus musculus
gggggaagacgatgtgtggtgtcga

SEQ ID NO: 332985 - DNA, 25 bp, Mus musculus
gggggaagtgggcacatacaatgtg

SEQ ID NO: 332986 - DNA, 25 bp, Mus musculus
gggggacaagaggttgcctgcagga

SEQ ID NO: 332987 - DNA, 25 bp, Mus musculus
gggggacaaggacccagcatggtat

SEQ ID NO: 332988 - DNA, 25 bp, Mus musculus
gggggacaagggtgccagtgatccg

SEQ ID NO: 332989 - DNA, 25 bp, Mus musculus
gggggacaaggttggggaggcgaga

SEQ ID NO: 332990 - DNA, 25 bp, Mus musculus
gggggacacatcagggggcgtcagt

SEQ ID NO: 332991 - DNA, 25 bp, Mus musculus
gggggacagtgaggggacgatccgg

SEQ ID NO: 332992 - DNA, 25 bp, Mus musculus
gggggacagttcagggagggaagga

SEQ ID NO: 332993 - DNA, 25 bp, Mus musculus
gggggacatgttcagcctggccaaa

SEQ ID NO: 332994 - DNA, 25 bp, Mus musculus
gggggacatgttcaggtttggcaaa

SEQ ID NO: 332995 - DNA, 25 bp, Mus musculus
gggggacctcagaaggtctatatgg

SEQ ID NO: 332996 - DNA, 25 bp, Mus musculus
gggggacctcgagacagccttccct

SEQ ID NO: 332997 - DNA, 25 bp, Mus musculus
gggggacgctgcaagtgtggaggca

SEQ ID NO: 332998 - DNA, 25 bp, Mus musculus
gggggacgctgggatttgaactgtc

SEQ ID NO: 332999 - DNA, 25 bp, Mus musculus
gggggactggcaggaccgtcacgac

SEQ ID NO: 333000 - DNA, 25 bp, Mus musculus
gggggactgtgcaggttgaaaacga

SEQ ID NO: 333001 - DNA, 25 bp, Mus musculus
gggggagaagggccacattgggcta

SEQ ID NO: 333002 - DNA, 25 bp, Mus musculus
gggggagactcgggggaactgatca

SEQ ID NO: 333003 - DNA, 25 bp, Mus musculus
gggggagatcttgacatcactgact

SEQ ID NO: 333004 - DNA, 25 bp, Mus musculus
gggggagatcttggtgatccgcagg

SEQ ID NO: 333005 - DNA, 25 bp, Mus musculus
gggggagatgacggcagaggagagg

SEQ ID NO: 333006 - DNA, 25 bp, Mus musculus
gggggagcacgagggttttttgcat

SEQ ID NO: 333007 - DNA, 25 bp, Mus musculus
gggggagccctggaggagtctcagc

SEQ ID NO: 333008 - DNA, 25 bp, Mus musculus
gggggagccctggaggattaccagg

SEQ ID NO: 333009 - DNA, 25 bp, Mus musculus
gggggagccgagcactccgccagag

SEQ ID NO: 333010 - DNA, 25 bp, Mus musculus
gggggagctgtggccatgttcatag

SEQ ID NO: 333011 - DNA, 25 bp, Mus musculus
gggggaggctaaggggaggcccagc

SEQ ID NO: 333012 - DNA, 25 bp, Mus musculus
gggggaggtcagatgtctctcttaa

SEQ ID NO: 333013 - DNA, 25 bp, Mus musculus
gggggaggtgaagcccctccaggcc

SEQ ID NO: 333014 - DNA, 25 bp, Mus musculus
gggggagtctcttgtacagaggaga

SEQ ID NO: 333015 - DNA, 25 bp, Mus musculus
gggggagtgcgggaacagaactcaa

SEQ ID NO: 333016 - DNA, 25 bp, Mus musculus
gggggatcatcaaggtggaaagaga

SEQ ID NO: 333017 - DNA, 25 bp, Mus musculus
gggggatctccaggggagttttgtg

SEQ ID NO: 333018 - DNA, 25 bp, Mus musculus
gggggatctgatggatacggaagtg

SEQ ID NO: 333019 - DNA, 25 bp, Mus musculus
gggggatgaagtcattgagaagttt

SEQ ID NO: 333020 - DNA, 25 bp, Mus musculus
gggggatgtagcaggcgccctggag

SEQ ID NO: 333021 - DNA, 25 bp, Mus musculus
gggggatgtagcaggcgcgcggtga

SEQ ID NO: 333022 - DNA, 25 bp, Mus musculus
gggggattccagagtgtgtgggttt

SEQ ID NO: 333023 - DNA, 25 bp, Mus musculus
gggggattgggaagagaacagacaa

SEQ ID NO: 333024 - DNA, 25 bp, Mus musculus
gggggcaaagccaggaggaagcctg

SEQ ID NO: 333025 - DNA, 25 bp, Mus musculus
gggggcaagcggttcagtacctctc

SEQ ID NO: 333026 - DNA, 25 bp, Mus musculus
gggggcaaggaggagtcatctctca

SEQ ID NO: 333027 - DNA, 25 bp, Mus musculus
gggggcaagggtggaccacttggat

SEQ ID NO: 333028 - DNA, 25 bp, Mus musculus
gggggcacaaaggtgacctcactga

SEQ ID NO: 333029 - DNA, 25 bp, Mus musculus
gggggcaccgaggtctccagcagaa

SEQ ID NO: 333030 - DNA, 25 bp, Mus musculus
gggggcaccgagtcaaataatttag

SEQ ID NO: 333031 - DNA, 25 bp, Mus musculus
gggggcagaagaggaggtggcttac

SEQ ID NO: 333032 - DNA, 25 bp, Mus musculus
gggggcagattcagcacagagctga

SEQ ID NO: 333033 - DNA, 25 bp, Mus musculus
gggggcagattcaggtgattctcgg

SEQ ID NO: 333034 - DNA, 25 bp, Mus musculus
gggggcagcagcaccatggccagcc

SEQ ID NO: 333035 - DNA, 25 bp, Mus musculus
gggggcagcagcttcctggccccgg

SEQ ID NO: 333036 - DNA, 25 bp, Mus musculus
gggggcagcaggatcccagtgtgcg

SEQ ID NO: 333037 - DNA, 25 bp, Mus musculus
gggggcagctccccaggcctcacac

SEQ ID NO: 333038 - DNA, 25 bp, Mus musculus
gggggcagctccccagtgaggtggc

SEQ ID NO: 333039 - DNA, 25 bp, Mus musculus
gggggcaggcagccactcccgagac

SEQ ID NO: 333040 - DNA, 25 bp, Mus musculus
gggggcaggcaggaggtggtggagt

SEQ ID NO: 333041 - DNA, 25 bp, Mus musculus
gggggcagggagacgatactgtatc

SEQ ID NO: 333042 - DNA, 25 bp, Mus musculus
gggggccaagctcaagcaggtgttg

SEQ ID NO: 333043 - DNA, 25 bp, Mus musculus
gggggccaagtgctcaccgagtctg

SEQ ID NO: 333044 - DNA, 25 bp, Mus musculus
gggggcccacagactgcagcaatgg

SEQ ID NO: 333045 - DNA, 25 bp, Mus musculus
gggggcccacaggtgcagttggtga

SEQ ID NO: 333046 - DNA, 25 bp, Mus musculus
gggggcccacagttggtgaacaact

SEQ ID NO: 333047 - DNA, 25 bp, Mus musculus
gggggcccagaaccagggcaagaaa

SEQ ID NO: 333048 - DNA, 25 bp, Mus musculus
gggggcccagaaggctgagaccgct

SEQ ID NO: 333049 - DNA, 25 bp, Mus musculus
gggggcccagattcacaacatcaga

SEQ ID NO: 333050 - DNA, 25 bp, Mus musculus
gggggcccgtggcaaaggtcttttg

SEQ ID NO: 333051 - DNA, 25 bp, Mus musculus
gggggccctcgatgagatgtgatct

SEQ ID NO: 333052 - DNA, 25 bp, Mus musculus
gggggccgtggaagagtgaagacac

SEQ ID NO: 333053 - DNA, 25 bp, Mus musculus
gggggccgttgggcgtcgcggcttt

SEQ ID NO: 333054 - DNA, 25 bp, Mus musculus
gggggcctatacgctgcctggctca

SEQ ID NO: 333055 - DNA, 25 bp, Mus musculus
gggggcctctcaaaggacagtgaac

SEQ ID NO: 333056 - DNA, 25 bp, Mus musculus
gggggcctgaccttccaatctgaac

SEQ ID NO: 333057 - DNA, 25 bp, Mus musculus
gggggcctggctgggatgggtgcta

SEQ ID NO: 333058 - DNA, 25 bp, Mus musculus
gggggcctggtccatcccgtggaaa

SEQ ID NO: 333059 - DNA, 25 bp, Mus musculus
gggggccttcaaccgaaacaagctc

SEQ ID NO: 333060 - DNA, 25 bp, Mus musculus
gggggcgcatcgcggcctcaaagcg

SEQ ID NO: 333061 - DNA, 25 bp, Mus musculus
gggggcgcgcaggtgtccacagaac

SEQ ID NO: 333062 - DNA, 25 bp, Mus musculus
gggggcgcgccctcaagaacagaag

SEQ ID NO: 333063 - DNA, 25 bp, Mus musculus
gggggcgcgccctcacgtctgactc

SEQ ID NO: 333064 - DNA, 25 bp, Mus musculus
gggggcgcgcgcgtgacgagtgacc

SEQ ID NO: 333065 - DNA, 25 bp, Mus musculus
gggggcgcggccagggcaaagtgca

SEQ ID NO: 333066 - DNA, 25 bp, Mus musculus
gggggcggacttcaggtgactcgga

SEQ ID NO: 333067 - DNA, 25 bp, Mus musculus
gggggcggacttcaggtgattcaca

SEQ ID NO: 333068 - DNA, 25 bp, Mus musculus
gggggcgtggaagaggtcagcagag

SEQ ID NO: 333069 - DNA, 25 bp, Mus musculus
gggggcgtggaagaggtcagggcca

SEQ ID NO: 333070 - DNA, 25 bp, Mus musculus
gggggctatggaaaggtttttcaag

SEQ ID NO: 333071 - DNA, 25 bp, Mus musculus
gggggctatggcaaggtgttccagg

SEQ ID NO: 333072 - DNA, 25 bp, Mus musculus
gggggctcctgcaggagggctgctg

SEQ ID NO: 333073 - DNA, 25 bp, Mus musculus
gggggctcgaagggcaggtaaacca

SEQ ID NO: 333074 - DNA, 25 bp, Mus musculus
gggggctcggggcggtaggaaatca

SEQ ID NO: 333075 - DNA, 25 bp, Mus musculus
gggggctctgacctgggacccctca

SEQ ID NO: 333076 - DNA, 25 bp, Mus musculus
gggggctctgaggttgaactggagc

SEQ ID NO: 333077 - DNA, 25 bp, Mus musculus
gggggctctgtgctcctggcacaca

SEQ ID NO: 333078 - DNA, 25 bp, Mus musculus
gggggctgacggacgagtccggctg

SEQ ID NO: 333079 - DNA, 25 bp, Mus musculus
gggggctgacggtcgaagaaagcct

SEQ ID NO: 333080 - DNA, 25 bp, Mus musculus
gggggctgcggcagggcatcatgaa

SEQ ID NO: 333081 - DNA, 25 bp, Mus musculus
gggggctgctggacctaccggcatg

SEQ ID NO: 333082 - DNA, 25 bp, Mus musculus
gggggctgctggacggagcgggatg

SEQ ID NO: 333083 - DNA, 25 bp, Mus musculus
gggggctggaccaggagcagccatg

SEQ ID NO: 333084 - DNA, 25 bp, Mus musculus
gggggctggctcagctcccaagtgc

SEQ ID NO: 333085 - DNA, 25 bp, Mus musculus
gggggctgggggggccaagatggga

SEQ ID NO: 333086 - DNA, 25 bp, Mus musculus
gggggctgtcagattggtgacccag

SEQ ID NO: 333087 - DNA, 25 bp, Mus musculus
gggggctgtcaggcacagaggatct

SEQ ID NO: 333088 - DNA, 25 bp, Mus musculus
gggggcttagacaggataaggaagc

SEQ ID NO: 333089 - DNA, 25 bp, Mus musculus
gggggcttcccagaaaagatcaggc

SEQ ID NO: 333090 - DNA, 25 bp, Mus musculus
gggggcttgcccagctggctcctcc

SEQ ID NO: 333091 - DNA, 25 bp, Mus musculus
gggggcttgtgagggtgactacggg

SEQ ID NO: 333092 - DNA, 25 bp, Mus musculus
gggggcttgtgcaggtctggtcact

SEQ ID NO: 333093 - DNA, 25 bp, Mus musculus
gggggctttgggccggttgctgatg

SEQ ID NO: 333094 - DNA, 25 bp, Mus musculus
ggggggaactggttgggaagccagc

SEQ ID NO: 333095 - DNA, 25 bp, Mus musculus
ggggggaagtgggcacatacaatgt

SEQ ID NO: 333096 - DNA, 25 bp, Mus musculus
ggggggacctcgagacagccttccc

SEQ ID NO: 333097 - DNA, 25 bp, Mus musculus
ggggggatcatcaaggtggaaagag

SEQ ID NO: 333098 - DNA, 25 bp, Mus musculus
ggggggatctgatggatacggaagt

SEQ ID NO: 333099 - DNA, 25 bp, Mus musculus
ggggggcacaaaggtgacctcactg

SEQ ID NO: 333100 - DNA, 25 bp, Mus musculus
ggggggcccacagactgcagcaatg

SEQ ID NO: 333101 - DNA, 25 bp, Mus musculus
ggggggcccagattcacaacatcag

SEQ ID NO: 333102 - DNA, 25 bp, Mus musculus
ggggggccgtggaagagtgaagaca

SEQ ID NO: 333103 - DNA, 25 bp, Mus musculus
ggggggccgttgggcgtcgcggctt

SEQ ID NO: 333104 - DNA, 25 bp, Mus musculus
ggggggctcctgcaggagggctgct

SEQ ID NO: 333105 - DNA, 25 bp, Mus musculus
ggggggctggaccaggagcagccat

SEQ ID NO: 333106 - DNA, 25 bp, Mus musculus
gggggggacctcgagacagccttcc

SEQ ID NO: 333107 - DNA, 25 bp, Mus musculus
gggggggatctgatggatacggaag

SEQ ID NO: 333108 - DNA, 25 bp, Mus musculus
gggggggcacaaaggtgacctcact

SEQ ID NO: 333109 - DNA, 25 bp, Mus musculus
gggggggcccacagactgcagcaat

SEQ ID NO: 333110 - DNA, 25 bp, Mus musculus
ggggggggacctcgagacagccttc

SEQ ID NO: 333111 - DNA, 25 bp, Mus musculus
ggggggggcacaaaggtgacctcac

SEQ ID NO: 333112 - DNA, 25 bp, Mus musculus
gggggggggacctcgagacagcctt

SEQ ID NO: 333113 - DNA, 25 bp, Mus musculus
ggggggtccctggtgtcgcggaaga

SEQ ID NO: 333114 - DNA, 25 bp, Mus musculus
gggggtaaatgtgattagtgttaag

SEQ ID NO: 333115 - DNA, 25 bp, Mus musculus
gggggtaagggaggccgctcacgat

SEQ ID NO: 333116 - DNA, 25 bp, Mus musculus
gggggtacagcagaggatgctttcg

SEQ ID NO: 333117 - DNA, 25 bp, Mus musculus
gggggtaccccgctggccctgtcca

SEQ ID NO: 333118 - DNA, 25 bp, Mus musculus
gggggtaccccgctggctggctttg

SEQ ID NO: 333119 - DNA, 25 bp, Mus musculus
gggggtagcaggtttggaccttatg

SEQ ID NO: 333120 - DNA, 25 bp, Mus musculus
gggggtagtgatcaggagaataatg

SEQ ID NO: 333121 - DNA, 25 bp, Mus musculus
gggggtatggagaggtgtcatcaat

SEQ ID NO: 333122 - DNA, 25 bp, Mus musculus
gggggtcactggagtcgctggggag

SEQ ID NO: 333123 - DNA, 25 bp, Mus musculus
gggggtccctggtgtcgcggaagat

SEQ ID NO: 333124 - DNA, 25 bp, Mus musculus
gggggtccggatcaaaagccccagg

SEQ ID NO: 333125 - DNA, 25 bp, Mus musculus
gggggtcgcggggctcggatggcgt

SEQ ID NO: 333126 - DNA, 25 bp, Mus musculus
gggggtctaaggaacgctggcagtg

SEQ ID NO: 333127 - DNA, 25 bp, Mus musculus
gggggtctaaggatcgagagctgag

SEQ ID NO: 333128 - DNA, 25 bp, Mus musculus
gggggtctgagagaatcgcacgtcc

SEQ ID NO: 333129 - DNA, 25 bp, Mus musculus
gggggtgaggatttctcccaggaaa

SEQ ID NO: 333130 - DNA, 25 bp, Mus musculus
gggggtgagttgtcagtggggctgg

SEQ ID NO: 333131 - DNA, 25 bp, Mus musculus
gggggtgcaggaaggtgtgaaacag

SEQ ID NO: 333132 - DNA, 25 bp, Mus musculus
gggggtgccacggacttgagcatcg

SEQ ID NO: 333133 - DNA, 25 bp, Mus musculus
gggggtgccacggtgaccatcgtca

SEQ ID NO: 333134 - DNA, 25 bp, Mus musculus
gggggtgggggagggcacatagaac

SEQ ID NO: 333135 - DNA, 25 bp, Mus musculus
gggggtgtcgagcccagccagtggt

SEQ ID NO: 333136 - DNA, 25 bp, Mus musculus
gggggttccgcgcgcttgggaccgc

SEQ ID NO: 333137 - DNA, 25 bp, Mus musculus
gggggttccgcgcggagaatgactc

SEQ ID NO: 333138 - DNA, 25 bp, Mus musculus
gggggttggtcactacactgcatat

SEQ ID NO: 333139 - DNA, 25 bp, Mus musculus
ggggtaaacatgctcatgaactaaa

SEQ ID NO: 333140 - DNA, 25 bp, Mus musculus
ggggtaagcacagctctgcccaccc

SEQ ID NO: 333141 - DNA, 25 bp, Mus musculus
ggggtaagcacaggatcacgtggcc

SEQ ID NO: 333142 - DNA, 25 bp, Mus musculus
ggggtacagcagaggatgctttcgc

SEQ ID NO: 333143 - DNA, 25 bp, Mus musculus
ggggtacagggtgaagtactggatc

SEQ ID NO: 333144 - DNA, 25 bp, Mus musculus
ggggtaccccgctggccctgtccac

SEQ ID NO: 333145 - DNA, 25 bp, Mus musculus
ggggtaccccgctggctggctttgg

SEQ ID NO: 333146 - DNA, 25 bp, Mus musculus
ggggtacgcccgagctccagcaaga

SEQ ID NO: 333147 - DNA, 25 bp, Mus musculus
ggggtactgccagggaatgaatttc

SEQ ID NO: 333148 - DNA, 25 bp, Mus musculus
ggggtactgccagtgctgcgcacag

SEQ ID NO: 333149 - DNA, 25 bp, Mus musculus
ggggtagcaggtttggaccttatga

SEQ ID NO: 333150 - DNA, 25 bp, Mus musculus
ggggtagccaagctgcttttagaag

SEQ ID NO: 333151 - DNA, 25 bp, Mus musculus
ggggtagtgatcaggagaataatgt

SEQ ID NO: 333152 - DNA, 25 bp, Mus musculus
ggggtagtgcaaggtggagtgtcat

SEQ ID NO: 333153 - DNA, 25 bp, Mus musculus
ggggtatcaattcaggaggaaacag

SEQ ID NO: 333154 - DNA, 25 bp, Mus musculus
ggggtatcagaaggttggaggctgc

SEQ ID NO: 333155 - DNA, 25 bp, Mus musculus
ggggtatggagaggtgtcatcaata

SEQ ID NO: 333156 - DNA, 25 bp, Mus musculus
ggggtattataatattattggcgtg

SEQ ID NO: 333157 - DNA, 25 bp, Mus musculus
ggggtatttcagggattctcctgat

SEQ ID NO: 333158 - DNA, 25 bp, Mus musculus
ggggtcaaaattgacaagactgact

SEQ ID NO: 333159 - DNA, 25 bp, Mus musculus
ggggtcacaatcaggttgactcttc

SEQ ID NO: 333160 - DNA, 25 bp, Mus musculus
ggggtcacctctaggtcattttacc

SEQ ID NO: 333161 - DNA, 25 bp, Mus musculus
ggggtcactggagtcgctggggagc

SEQ ID NO: 333162 - DNA, 25 bp, Mus musculus
ggggtcagccgaaagtttaagaggc

SEQ ID NO: 333163 - DNA, 25 bp, Mus musculus
ggggtcaggaagattgtcttagcaa

SEQ ID NO: 333164 - DNA, 25 bp, Mus musculus
ggggtcaggcaaggcagtccctcga

SEQ ID NO: 333165 - DNA, 25 bp, Mus musculus
ggggtcaggctccttccgatgagcc

SEQ ID NO: 333166 - DNA, 25 bp, Mus musculus
ggggtcatcccgtactcactggcct

SEQ ID NO: 333167 - DNA, 25 bp, Mus musculus
ggggtcattgaatacaaaggtgcca

SEQ ID NO: 333168 - DNA, 25 bp, Mus musculus
ggggtcatttgcaggtttaaggaga

SEQ ID NO: 333169 - DNA, 25 bp, Mus musculus
ggggtcccaggaggagtgggagcaa

SEQ ID NO: 333170 - DNA, 25 bp, Mus musculus
ggggtcccaggcaagcctggaagag

SEQ ID NO: 333171 - DNA, 25 bp, Mus musculus
ggggtcccaggcaagggcagtgtat

SEQ ID NO: 333172 - DNA, 25 bp, Mus musculus
ggggtcccagggatccgtttcattc

SEQ ID NO: 333173 - DNA, 25 bp, Mus musculus
ggggtcccatttcaggtgctggtgg

SEQ ID NO: 333174 - DNA, 25 bp, Mus musculus
ggggtccccagaatcactatcagtg

SEQ ID NO: 333175 - DNA, 25 bp, Mus musculus
ggggtccccagcaggaagggcccag

SEQ ID NO: 333176 - DNA, 25 bp, Mus musculus
ggggtccccagccgatcgggtcagg

SEQ ID NO: 333177 - DNA, 25 bp, Mus musculus
ggggtcccggacaagagtacatggg

SEQ ID NO: 333178 - DNA, 25 bp, Mus musculus
ggggtcccggatatttggaagatat

SEQ ID NO: 333179 - DNA, 25 bp, Mus musculus
ggggtccctggtgtcgcggaagatg

SEQ ID NO: 333180 - DNA, 25 bp, Mus musculus
ggggtccgccctgagaaatccagta

SEQ ID NO: 333181 - DNA, 25 bp, Mus musculus
ggggtccgccctgagaggtcccgta

SEQ ID NO: 333182 - DNA, 25 bp, Mus musculus
ggggtccgcggtactgtgaggaaag

SEQ ID NO: 333183 - DNA, 25 bp, Mus musculus
ggggtccgggagtgttacaggtggg

SEQ ID NO: 333184 - DNA, 25 bp, Mus musculus
ggggtcctggaaaggtgatgtacaa

SEQ ID NO: 333185 - DNA, 25 bp, Mus musculus
ggggtcctgtttaaccatcagcagt

SEQ ID NO: 333186 - DNA, 25 bp, Mus musculus
ggggtcctgtttaagagttcagatg

SEQ ID NO: 333187 - DNA, 25 bp, Mus musculus
ggggtcgagtaccagaaagctcagc

SEQ ID NO: 333188 - DNA, 25 bp, Mus musculus
ggggtcgagtaccaggttggagtgg

SEQ ID NO: 333189 - DNA, 25 bp, Mus musculus
ggggtcgcacagaggaagccgtgaa

SEQ ID NO: 333190 - DNA, 25 bp, Mus musculus
ggggtcgccctcggctatcccctct

SEQ ID NO: 333191 - DNA, 25 bp, Mus musculus
ggggtcgccctcgggttccagcaga

SEQ ID NO: 333192 - DNA, 25 bp, Mus musculus
ggggtcgcctctggaccaacggtcc

SEQ ID NO: 333193 - DNA, 25 bp, Mus musculus
ggggtcgcggggctcggatggcgtc

SEQ ID NO: 333194 - DNA, 25 bp, Mus musculus
ggggtcggctgacagacccgtggat

SEQ ID NO: 333195 - DNA, 25 bp, Mus musculus
ggggtcggctgacagggcaagagtt

SEQ ID NO: 333196 - DNA, 25 bp, Mus musculus
ggggtcggctgacaggtagaaaacc

SEQ ID NO: 333197 - DNA, 25 bp, Mus musculus
ggggtcgtgcctgagaactccgtgc

SEQ ID NO: 333198 - DNA, 25 bp, Mus musculus
ggggtctaaggaacgctggcagtgg

SEQ ID NO: 333199 - DNA, 25 bp, Mus musculus
ggggtctaaggatcgagagctgaga

SEQ ID NO: 333200 - DNA, 25 bp, Mus musculus
ggggtctacccagaagaaggaccag

SEQ ID NO: 333201 - DNA, 25 bp, Mus musculus
ggggtctgaagtcaaataccttcag

SEQ ID NO: 333202 - DNA, 25 bp, Mus musculus
ggggtcttttcctgccccacctcca

SEQ ID NO: 333203 - DNA, 25 bp, Mus musculus
ggggtgaaaatgctgacgtcctaca

SEQ ID NO: 333204 - DNA, 25 bp, Mus musculus
ggggtgaagactgaaccaataacgt

SEQ ID NO: 333205 - DNA, 25 bp, Mus musculus
ggggtgaagagggtcaacaggacaa

SEQ ID NO: 333206 - DNA, 25 bp, Mus musculus
ggggtgacgaggtggagtacatgtt

SEQ ID NO: 333207 - DNA, 25 bp, Mus musculus
ggggtgagaaagaggagacagagta

SEQ ID NO: 333208 - DNA, 25 bp, Mus musculus
ggggtgagaaaggggagacagagta

SEQ ID NO: 333209 - DNA, 25 bp, Mus musculus
ggggtgagaagggcgttctctccaa

SEQ ID NO: 333210 - DNA, 25 bp, Mus musculus
ggggtgagaaggtcatcctttttca

SEQ ID NO: 333211 - DNA, 25 bp, Mus musculus
ggggtgagccaggcctcgagcactg

SEQ ID NO: 333212 - DNA, 25 bp, Mus musculus
ggggtgagccagtgactccactggc

SEQ ID NO: 333213 - DNA, 25 bp, Mus musculus
ggggtgaggacacgagttgcattgt

SEQ ID NO: 333214 - DNA, 25 bp, Mus musculus
ggggtgaggatttctcccaggaaag

SEQ ID NO: 333215 - DNA, 25 bp, Mus musculus
ggggtgaggcggcagctgcagcagc

SEQ ID NO: 333216 - DNA, 25 bp, Mus musculus
ggggtgattgacaaggttttacttg

SEQ ID NO: 333217 - DNA, 25 bp, Mus musculus
ggggtgcaagaactgccccattgac

SEQ ID NO: 333218 - DNA, 25 bp, Mus musculus
ggggtgcaagggcttcttccgccgc

SEQ ID NO: 333219 - DNA, 25 bp, Mus musculus
ggggtgcacctcagctttgtgcgct

SEQ ID NO: 333220 - DNA, 25 bp, Mus musculus
ggggtgcactcagggtggcacaaga

SEQ ID NO: 333221 - DNA, 25 bp, Mus musculus
ggggtgcactcaggtcctcattcct

SEQ ID NO: 333222 - DNA, 25 bp, Mus musculus
ggggtgcagaggtctctgtgttggt

SEQ ID NO: 333223 - DNA, 25 bp, Mus musculus
ggggtgcagcaggatgctgggcagt

SEQ ID NO: 333224 - DNA, 25 bp, Mus musculus
ggggtgcagcaggatgcttcatctg

SEQ ID NO: 333225 - DNA, 25 bp, Mus musculus
ggggtgcaggaaggtgtgaaacaga

SEQ ID NO: 333226 - DNA, 25 bp, Mus musculus
ggggtgccacggacttgagcatcga

SEQ ID NO: 333227 - DNA, 25 bp, Mus musculus
ggggtgccacggtgaccatcgtcag

SEQ ID NO: 333228 - DNA, 25 bp, Mus musculus
ggggtgccctaagtatccagcatgc

SEQ ID NO: 333229 - DNA, 25 bp, Mus musculus
ggggtgccctgtggtaagcgagatc

SEQ ID NO: 333230 - DNA, 25 bp, Mus musculus
ggggtgcgacttggaccaattgctg

SEQ ID NO: 333231 - DNA, 25 bp, Mus musculus
ggggtgcgacttggactcggctctc

SEQ ID NO: 333232 - DNA, 25 bp, Mus musculus
ggggtgcggaggtcgctcatccgat

SEQ ID NO: 333233 - DNA, 25 bp, Mus musculus
ggggtgctatggggaagagacacag

SEQ ID NO: 333234 - DNA, 25 bp, Mus musculus
ggggtgctgatggggaaggaccgga

SEQ ID NO: 333235 - DNA, 25 bp, Mus musculus
ggggtgctgatgtttgagatgctga

SEQ ID NO: 333236 - DNA, 25 bp, Mus musculus
ggggtggaaaatgacattcccatgt

SEQ ID NO: 333237 - DNA, 25 bp, Mus musculus
ggggtggaagccaggaagcttcttg

SEQ ID NO: 333238 - DNA, 25 bp, Mus musculus
ggggtggaagccaggcctgtaggga

SEQ ID NO: 333239 - DNA, 25 bp, Mus musculus
ggggtggaagccccaggcctggtga

SEQ ID NO: 333240 - DNA, 25 bp, Mus musculus
ggggtggactgctggcctggtagag

SEQ ID NO: 333241 - DNA, 25 bp, Mus musculus
ggggtggcagactctcttctgcagc

SEQ ID NO: 333242 - DNA, 25 bp, Mus musculus
ggggtggcaggcgcaccaacccttt

SEQ ID NO: 333243 - DNA, 25 bp, Mus musculus
ggggtggccagggctctggctgaga

SEQ ID NO: 333244 - DNA, 25 bp, Mus musculus
ggggtggccgcgcagccagcgttcc

SEQ ID NO: 333245 - DNA, 25 bp, Mus musculus
ggggtggcgacagatgttgcattac

SEQ ID NO: 333246 - DNA, 25 bp, Mus musculus
ggggtggcgacaggtgtgactggag

SEQ ID NO: 333247 - DNA, 25 bp, Mus musculus
ggggtgggagatccgaattcgagac

SEQ ID NO: 333248 - DNA, 25 bp, Mus musculus
ggggtgggggagggcacatagaaca

SEQ ID NO: 333249 - DNA, 25 bp, Mus musculus
ggggtggtcgggctcagaaagtgct

SEQ ID NO: 333250 - DNA, 25 bp, Mus musculus
ggggtggtcggtggatggcttgcta

SEQ ID NO: 333251 - DNA, 25 bp, Mus musculus
ggggtggtgacgtgctgtgtgacgt

SEQ ID NO: 333252 - DNA, 25 bp, Mus musculus
ggggtggttcctttccttgggagcg

SEQ ID NO: 333253 - DNA, 25 bp, Mus musculus
ggggtgtcactctgggagttagcga

SEQ ID NO: 333254 - DNA, 25 bp, Mus musculus
ggggtgtccgtaaacttgggtgctg

SEQ ID NO: 333255 - DNA, 25 bp, Mus musculus
ggggtgtccgtaaagaagaacacaa

SEQ ID NO: 333256 - DNA, 25 bp, Mus musculus
ggggtgtcgagcccagccagtggtt

SEQ ID NO: 333257 - DNA, 25 bp, Mus musculus
ggggtgtgggccctcccaggcccaa

SEQ ID NO: 333258 - DNA, 25 bp, Mus musculus
ggggtgtggggatttcgctttatta

SEQ ID NO: 333259 - DNA, 25 bp, Mus musculus
ggggttacaaatagcacgctgaagc

SEQ ID NO: 333260 - DNA, 25 bp, Mus musculus
ggggttacaaatatgagctccccgc

SEQ ID NO: 333261 - DNA, 25 bp, Mus musculus
ggggttagcacttggtgtggagaag

SEQ ID NO: 333262 - DNA, 25 bp, Mus musculus
ggggttatatcaagttcaaaaggat

SEQ ID NO: 333263 - DNA, 25 bp, Mus musculus
ggggttatctggccgttcctcagtt

SEQ ID NO: 333264 - DNA, 25 bp, Mus musculus
ggggttcaattccagccatattgat

SEQ ID NO: 333265 - DNA, 25 bp, Mus musculus
ggggttcatcctgactatgcggcgc

SEQ ID NO: 333266 - DNA, 25 bp, Mus musculus
ggggttcatcctgccagagactatg

SEQ ID NO: 333267 - DNA, 25 bp, Mus musculus
ggggttcatgagaggccgaggccac

SEQ ID NO: 333268 - DNA, 25 bp, Mus musculus
ggggttcatttgcatccctggcacc

SEQ ID NO: 333269 - DNA, 25 bp, Mus musculus
ggggttccatgccggcaaagtgcaa

SEQ ID NO: 333270 - DNA, 25 bp, Mus musculus
ggggttccgcgcgcttgggaccgcg

SEQ ID NO: 333271 - DNA, 25 bp, Mus musculus
ggggttccgcgcggagaatgactca

SEQ ID NO: 333272 - DNA, 25 bp, Mus musculus
ggggttccgggtggacaagattgtg

SEQ ID NO: 333273 - DNA, 25 bp, Mus musculus
ggggttcgcctgaggattggatggt

SEQ ID NO: 333274 - DNA, 25 bp, Mus musculus
ggggttgaagacgttgatgtcagtg

SEQ ID NO: 333275 - DNA, 25 bp, Mus musculus
ggggttgcacaggatttccctagag

SEQ ID NO: 333276 - DNA, 25 bp, Mus musculus
ggggttgcacaggtgaagatcatga

SEQ ID NO: 333277 - DNA, 25 bp, Mus musculus
ggggttgccagccatgctgcaagct

SEQ ID NO: 333278 - DNA, 25 bp, Mus musculus
ggggttgcccttgaacatttatgaa

SEQ ID NO: 333279 - DNA, 25 bp, Mus musculus
ggggttgcccttggtgaggcatgca

SEQ ID NO: 333280 - DNA, 25 bp, Mus musculus
ggggttgctgtcgtgcctcgaggca

SEQ ID NO: 333281 - DNA, 25 bp, Mus musculus
ggggttggaggccaggaatggtacc

SEQ ID NO: 333282 - DNA, 25 bp, Mus musculus
ggggttggaggccagtgcctctctg

SEQ ID NO: 333283 - DNA, 25 bp, Mus musculus
ggggttggatcagaggagtccctgg

SEQ ID NO: 333284 - DNA, 25 bp, Mus musculus
ggggttgggcgacagagagagatgc

SEQ ID NO: 333285 - DNA, 25 bp, Mus musculus
ggggttggtcactacactgcatatg

SEQ ID NO: 333286 - DNA, 25 bp, Mus musculus
ggggttggtgatggattcatgggtg

SEQ ID NO: 333287 - DNA, 25 bp, Mus musculus
ggggttgtcaggtatgagcatgcga

SEQ ID NO: 333288 - DNA, 25 bp, Mus musculus
ggggtttcaggcagaaaatgtaact

SEQ ID NO: 333289 - DNA, 25 bp, Mus musculus
ggggtttcaggtctgcattacattt

SEQ ID NO: 333290 - DNA, 25 bp, Mus musculus
ggggtttctcggccgcgcgcggttc

SEQ ID NO: 333291 - DNA, 25 bp, Mus musculus
ggggtttgactcgcacatccttgtg

SEQ ID NO: 333292 - DNA, 25 bp, Mus musculus
ggggtttgcctgaagagaaggagga

SEQ ID NO: 333293 - DNA, 25 bp, Mus musculus
ggggttttcacagtctttcaggcat

SEQ ID NO: 333294 - DNA, 25 bp, Mus musculus
ggggtttttcaggatgccacagttg

SEQ ID NO: 333295 - DNA, 25 bp, Mus musculus
gggtaaacatgctcatgaactaaaa

SEQ ID NO: 333296 - DNA, 25 bp, Mus musculus
gggtaaactgaggctcctagaaggt

SEQ ID NO: 333297 - DNA, 25 bp, Mus musculus
gggtaaagaaagggttgctgttgca

SEQ ID NO: 333298 - DNA, 25 bp, Mus musculus
gggtaacacagaagccaccatgggg

SEQ ID NO: 333299 - DNA, 25 bp, Mus musculus
gggtaacactcctctacacttagcc

SEQ ID NO: 333300 - DNA, 25 bp, Mus musculus
gggtaacagaggaaccgatgatgtg

SEQ ID NO: 333301 - DNA, 25 bp, Mus musculus
gggtaactccaggccatccgaacca

SEQ ID NO: 333302 - DNA, 25 bp, Mus musculus
gggtaactgtcgaggaagttttctg

SEQ ID NO: 333303 - DNA, 25 bp, Mus musculus
gggtaactgtgtaggtgcaggcaac

SEQ ID NO: 333304 - DNA, 25 bp, Mus musculus
gggtaagagttgcagctaggacttc

SEQ ID NO: 333305 - DNA, 25 bp, Mus musculus
gggtaagcacagctctgcccacccc

SEQ ID NO: 333306 - DNA, 25 bp, Mus musculus
gggtaagcacaggatcacgtggcca

SEQ ID NO: 333307 - DNA, 25 bp, Mus musculus
gggtaaggatggagatcccccaggt

SEQ ID NO: 333308 - DNA, 25 bp, Mus musculus
gggtaatcagaaagggtccccagaa

SEQ ID NO: 333309 - DNA, 25 bp, Mus musculus
gggtaatggaaaaagcaggtttctg

SEQ ID NO: 333310 - DNA, 25 bp, Mus musculus
gggtaatggaaaaaggtgttcgaat

SEQ ID NO: 333311 - DNA, 25 bp, Mus musculus
gggtaatggcaaagggagttttgtg

SEQ ID NO: 333312 - DNA, 25 bp, Mus musculus
gggtacaagggcaagctccagaaag

SEQ ID NO: 333313 - DNA, 25 bp, Mus musculus
gggtacagaccaggacaaagagaaa

SEQ ID NO: 333314 - DNA, 25 bp, Mus musculus
gggtacagcagaggatgctttcgca

SEQ ID NO: 333315 - DNA, 25 bp, Mus musculus
gggtacattcctgagccagtcctag

SEQ ID NO: 333316 - DNA, 25 bp, Mus musculus
gggtacattcctgagccgggataac

SEQ ID NO: 333317 - DNA, 25 bp, Mus musculus
gggtaccacacaagattccgcaggg

SEQ ID NO: 333318 - DNA, 25 bp, Mus musculus
gggtaccacacaagggccatcaaaa

SEQ ID NO: 333319 - DNA, 25 bp, Mus musculus
gggtaccacgggcacagacttaaag

SEQ ID NO: 333320 - DNA, 25 bp, Mus musculus
gggtaccacgggcagagacttaaag

SEQ ID NO: 333321 - DNA, 25 bp, Mus musculus
gggtacccagttgcacaacctggtc

SEQ ID NO: 333322 - DNA, 25 bp, Mus musculus
gggtaccccaaaagagaatcgcacg

SEQ ID NO: 333323 - DNA, 25 bp, Mus musculus
gggtaccccgctggccctgtccacg

SEQ ID NO: 333324 - DNA, 25 bp, Mus musculus
gggtaccccgctggctggctttggg

SEQ ID NO: 333325 - DNA, 25 bp, Mus musculus
gggtaccttgatgccatcccgccca

SEQ ID NO: 333326 - DNA, 25 bp, Mus musculus
gggtacgatatatcacacagaaccc

SEQ ID NO: 333327 - DNA, 25 bp, Mus musculus
gggtacgcgactcagtaattggcaa

SEQ ID NO: 333328 - DNA, 25 bp, Mus musculus
gggtacggcctacgagttacaattt

SEQ ID NO: 333329 - DNA, 25 bp, Mus musculus
gggtactcaaaaaggtctatcctaa

SEQ ID NO: 333330 - DNA, 25 bp, Mus musculus
gggtactgccagggaatgaatttca

SEQ ID NO: 333331 - DNA, 25 bp, Mus musculus
gggtactgccagtgctgcgcacaga

SEQ ID NO: 333332 - DNA, 25 bp, Mus musculus
gggtacttaatgagttccgatctgg

SEQ ID NO: 333333 - DNA, 25 bp, Mus musculus
gggtacttaggtgctggaaagacaa

SEQ ID NO: 333334 - DNA, 25 bp, Mus musculus
gggtacttgggaaaaaattatgctt

SEQ ID NO: 333335 - DNA, 25 bp, Mus musculus
gggtagaaaaaagatgacctcaatg

SEQ ID NO: 333336 - DNA, 25 bp, Mus musculus
gggtagaccttgagtctagtgacaa

SEQ ID NO: 333337 - DNA, 25 bp, Mus musculus
gggtagaccttgtgtctagtgacaa

SEQ ID NO: 333338 - DNA, 25 bp, Mus musculus
gggtagagacacagagaacacactc

SEQ ID NO: 333339 - DNA, 25 bp, Mus musculus
gggtagagacacaggcaccatttta

SEQ ID NO: 333340 - DNA, 25 bp, Mus musculus
gggtagagacggggccctagctgct

SEQ ID NO: 333341 - DNA, 25 bp, Mus musculus
gggtagagagaaagggtacagattt

SEQ ID NO: 333342 - DNA, 25 bp, Mus musculus
gggtagcagacagattgatgacatt

SEQ ID NO: 333343 - DNA, 25 bp, Mus musculus
gggtagccaagctgcttttagaagg

SEQ ID NO: 333344 - DNA, 25 bp, Mus musculus
gggtagcccgtgtcccatcactggg

SEQ ID NO: 333345 - DNA, 25 bp, Mus musculus
gggtagcccgttacatcttcaaacg

SEQ ID NO: 333346 - DNA, 25 bp, Mus musculus
gggtagccggagtatgccgcctgtg

SEQ ID NO: 333347 - DNA, 25 bp, Mus musculus
gggtagcctctgaggaaagatataa

SEQ ID NO: 333348 - DNA, 25 bp, Mus musculus
gggtagcctctgagggaactacatg

SEQ ID NO: 333349 - DNA, 25 bp, Mus musculus
gggtaggagggtgggatggagattc

SEQ ID NO: 333350 - DNA, 25 bp, Mus musculus
gggtaggtggagtattggcttccct

SEQ ID NO: 333351 - DNA, 25 bp, Mus musculus
gggtagtcactgactgtatccaggt

SEQ ID NO: 333352 - DNA, 25 bp, Mus musculus
gggtagtgatcaggagaataatgtt

SEQ ID NO: 333353 - DNA, 25 bp, Mus musculus
gggtagtgcaaggtggagtgtcatc

SEQ ID NO: 333354 - DNA, 25 bp, Mus musculus
gggtagttaaagagggctgtcctgg

SEQ ID NO: 333355 - DNA, 25 bp, Mus musculus
gggtataacaagactacaatgcttc

SEQ ID NO: 333356 - DNA, 25 bp, Mus musculus
gggtatacaccaggcatccacatgg

SEQ ID NO: 333357 - DNA, 25 bp, Mus musculus
gggtatatagcttgaagtcaatggc

SEQ ID NO: 333358 - DNA, 25 bp, Mus musculus
gggtatcaattcaggaggaaacagt

SEQ ID NO: 333359 - DNA, 25 bp, Mus musculus
gggtatcagaaggttggaggctgct

SEQ ID NO: 333360 - DNA, 25 bp, Mus musculus
gggtatccaaagcggctggagaagg

SEQ ID NO: 333361 - DNA, 25 bp, Mus musculus
gggtatcgacaggtacaatcctgag

SEQ ID NO: 333362 - DNA, 25 bp, Mus musculus
gggtatcgacaggtaccagttcaac

SEQ ID NO: 333363 - DNA, 25 bp, Mus musculus
gggtatcgccccctggcaggtgatg

SEQ ID NO: 333364 - DNA, 25 bp, Mus musculus
gggtatctacggcagaaaggggagt

SEQ ID NO: 333365 - DNA, 25 bp, Mus musculus
gggtatctacggcagtacattttta

SEQ ID NO: 333366 - DNA, 25 bp, Mus musculus
gggtatgagtggcccaggatgggtg

SEQ ID NO: 333367 - DNA, 25 bp, Mus musculus
gggtatggagaggtgtcatcaataa

SEQ ID NO: 333368 - DNA, 25 bp, Mus musculus
gggtattcaaacacatagacatttt

SEQ ID NO: 333369 - DNA, 25 bp, Mus musculus
gggtattggtaagttccctgctatc

SEQ ID NO: 333370 - DNA, 25 bp, Mus musculus
gggtattggtccagaacacagcctg

SEQ ID NO: 333371 - DNA, 25 bp, Mus musculus
gggtatttcagggattctcctgatg

SEQ ID NO: 333372 - DNA, 25 bp, Mus musculus
gggtcaaagcactccactcatcagt

SEQ ID NO: 333373 - DNA, 25 bp, Mus musculus
gggtcaaagcattcctcaaccaccc

SEQ ID NO: 333374 - DNA, 25 bp, Mus musculus
gggtcaaagccatctgtccctcaat

SEQ ID NO: 333375 - DNA, 25 bp, Mus musculus
gggtcaaaggataattccttaaggc

SEQ ID NO: 333376 - DNA, 25 bp, Mus musculus
gggtcaaaggccacattgaatttgc

SEQ ID NO: 333377 - DNA, 25 bp, Mus musculus
gggtcaacgagcctggtgccttctg

SEQ ID NO: 333378 - DNA, 25 bp, Mus musculus
gggtcacaagaagccgtctcagtgc

SEQ ID NO: 333379 - DNA, 25 bp, Mus musculus
gggtcacaaggtcaaagcaagtagg

SEQ ID NO: 333380 - DNA, 25 bp, Mus musculus
gggtcacaatcaggttgactcttca

SEQ ID NO: 333381 - DNA, 25 bp, Mus musculus
gggtcacagaggttacccaggcctc

SEQ ID NO: 333382 - DNA, 25 bp, Mus musculus
gggtcacataccaggggctgcgatg

SEQ ID NO: 333383 - DNA, 25 bp, Mus musculus
gggtcacccacaaggtggagaaatg

SEQ ID NO: 333384 - DNA, 25 bp, Mus musculus
gggtcaccgcttcatgtttctctgc

SEQ ID NO: 333385 - DNA, 25 bp, Mus musculus
gggtcacctctaggtcattttacct

SEQ ID NO: 333386 - DNA, 25 bp, Mus musculus
gggtcacctctggaagcaaagctgc

SEQ ID NO: 333387 - DNA, 25 bp, Mus musculus
gggtcacctctggggcccaggatga

SEQ ID NO: 333388 - DNA, 25 bp, Mus musculus
gggtcacctctgttggcgaatgccc

SEQ ID NO: 333389 - DNA, 25 bp, Mus musculus
gggtcactacagtgacagagattgg

SEQ ID NO: 333390 - DNA, 25 bp, Mus musculus
gggtcactggacgagaggatggctg

SEQ ID NO: 333391 - DNA, 25 bp, Mus musculus
gggtcactggacgagtccgttagat

SEQ ID NO: 333392 - DNA, 25 bp, Mus musculus
gggtcactgtgactccagctccgtc

SEQ ID NO: 333393 - DNA, 25 bp, Mus musculus
gggtcagaagcatactgaggataga

SEQ ID NO: 333394 - DNA, 25 bp, Mus musculus
gggtcagaagcatacttagacgttt

SEQ ID NO: 333395 - DNA, 25 bp, Mus musculus
gggtcagacagcgtcatcatgacag

SEQ ID NO: 333396 - DNA, 25 bp, Mus musculus
gggtcagacaggcaagggctcatta

SEQ ID NO: 333397 - DNA, 25 bp, Mus musculus
gggtcagagggacctctgttctcct

SEQ ID NO: 333398 - DNA, 25 bp, Mus musculus
gggtcagccgaaagtttaagaggcg

SEQ ID NO: 333399 - DNA, 25 bp, Mus musculus
gggtcagccggatgtggagaaagag

SEQ ID NO: 333400 - DNA, 25 bp, Mus musculus
gggtcagccgggatcaactgcactt

SEQ ID NO: 333401 - DNA, 25 bp, Mus musculus
gggtcagccggttttttcattagga

SEQ ID NO: 333402 - DNA, 25 bp, Mus musculus
gggtcagcttcggtttgctgccaaa

SEQ ID NO: 333403 - DNA, 25 bp, Mus musculus
gggtcaggaagattgtcttagcaac

SEQ ID NO: 333404 - DNA, 25 bp, Mus musculus
gggtcaggagagaaggcattggaag

SEQ ID NO: 333405 - DNA, 25 bp, Mus musculus
gggtcaggcaaggcagtccctcgag

SEQ ID NO: 333406 - DNA, 25 bp, Mus musculus
gggtcaggctccttccgatgagccc

SEQ ID NO: 333407 - DNA, 25 bp, Mus musculus
gggtcaggtaaaacatcagagagag

SEQ ID NO: 333408 - DNA, 25 bp, Mus musculus
gggtcaggtgcaaaatggaacactg

SEQ ID NO: 333409 - DNA, 25 bp, Mus musculus
gggtcaggtgcaagtgcagaatgga

SEQ ID NO: 333410 - DNA, 25 bp, Mus musculus
gggtcataccaggtaatatccttgt

SEQ ID NO: 333411 - DNA, 25 bp, Mus musculus
gggtcatacggtaacatttcacttg

SEQ ID NO: 333412 - DNA, 25 bp, Mus musculus
gggtcatcaagggtcacgtgattac

SEQ ID NO: 333413 - DNA, 25 bp, Mus musculus
gggtcatcccgtactcactggccta

SEQ ID NO: 333414 - DNA, 25 bp, Mus musculus
gggtcatccctaaaggtgtcataag

SEQ ID NO: 333415 - DNA, 25 bp, Mus musculus
gggtcatctaagaatgaagccaaac

SEQ ID NO: 333416 - DNA, 25 bp, Mus musculus
gggtcatgacactgaacctgcagcc

SEQ ID NO: 333417 - DNA, 25 bp, Mus musculus
gggtcatgaccaatggctggaagct

SEQ ID NO: 333418 - DNA, 25 bp, Mus musculus
gggtcatgcagccctcaggaagaga

SEQ ID NO: 333419 - DNA, 25 bp, Mus musculus
gggtcatggaaatatgggcttaggt

SEQ ID NO: 333420 - DNA, 25 bp, Mus musculus
gggtcatgggatggctgcactgccc

SEQ ID NO: 333421 - DNA, 25 bp, Mus musculus
gggtcattcagtacctcagtagtaa

SEQ ID NO: 333422 - DNA, 25 bp, Mus musculus
gggtcattcagtagtaacagatgtg

SEQ ID NO: 333423 - DNA, 25 bp, Mus musculus
gggtcattgaatacaaaggtgccaa

SEQ ID NO: 333424 - DNA, 25 bp, Mus musculus
gggtcattgatcaaggtctgaagaa

SEQ ID NO: 333425 - DNA, 25 bp, Mus musculus
gggtcattggaggccttgagaagaa

SEQ ID NO: 333426 - DNA, 25 bp, Mus musculus
gggtcattggaggtgtccatcatac

SEQ ID NO: 333427 - DNA, 25 bp, Mus musculus
gggtcatttgcaggtttaaggagag

SEQ ID NO: 333428 - DNA, 25 bp, Mus musculus
gggtccacatggtgatatcatggga

SEQ ID NO: 333429 - DNA, 25 bp, Mus musculus
gggtccacctggtgctacagggttt

SEQ ID NO: 333430 - DNA, 25 bp, Mus musculus
gggtccagactcgctttgaattcat

SEQ ID NO: 333431 - DNA, 25 bp, Mus musculus
gggtccagagtgggtcatatcggat

SEQ ID NO: 333432 - DNA, 25 bp, Mus musculus
gggtccagcttgaaggtactaaaga

SEQ ID NO: 333433 - DNA, 25 bp, Mus musculus
gggtccaggaagatccactcctatg

SEQ ID NO: 333434 - DNA, 25 bp, Mus musculus
gggtccatgagccgggtgaacctga

SEQ ID NO: 333435 - DNA, 25 bp, Mus musculus
gggtcccaagagacaggggtccgaa

SEQ ID NO: 333436 - DNA, 25 bp, Mus musculus
gggtcccagaagggtcagaaagcat

SEQ ID NO: 333437 - DNA, 25 bp, Mus musculus
gggtcccagagagctgatggccagg

SEQ ID NO: 333438 - DNA, 25 bp, Mus musculus
gggtcccaggcaagcctggaagagt

SEQ ID NO: 333439 - DNA, 25 bp, Mus musculus
gggtcccaggcaagggcagtgtatg

SEQ ID NO: 333440 - DNA, 25 bp, Mus musculus
gggtcccagtgaagagacatcatgt

SEQ ID NO: 333441 - DNA, 25 bp, Mus musculus
gggtcccagtgaaggtcgcaggcat

SEQ ID NO: 333442 - DNA, 25 bp, Mus musculus
gggtcccatttcaggtgctggtggc

SEQ ID NO: 333443 - DNA, 25 bp, Mus musculus
gggtccccaccacagatctgcgatg

SEQ ID NO: 333444 - DNA, 25 bp, Mus musculus
gggtccccagaatcactatcagtga

SEQ ID NO: 333445 - DNA, 25 bp, Mus musculus
gggtccccagcaggaagggcccagc

SEQ ID NO: 333446 - DNA, 25 bp, Mus musculus
gggtccccagccgatcgggtcaggc

SEQ ID NO: 333447 - DNA, 25 bp, Mus musculus
gggtccccgcgaggtgtcgcggaag

SEQ ID NO: 333448 - DNA, 25 bp, Mus musculus
gggtcccgggagcccctgatgaccc

SEQ ID NO: 333449 - DNA, 25 bp, Mus musculus
gggtccctaagagctctcttccggc

SEQ ID NO: 333450 - DNA, 25 bp, Mus musculus
gggtccctccagacttcctctgccc

SEQ ID NO: 333451 - DNA, 25 bp, Mus musculus
gggtccctccaggtgggcacatgga

SEQ ID NO: 333452 - DNA, 25 bp, Mus musculus
gggtcccttgcagccatgcagtggt

SEQ ID NO: 333453 - DNA, 25 bp, Mus musculus
gggtccctttgcacttggaatctcc

SEQ ID NO: 333454 - DNA, 25 bp, Mus musculus
gggtccgccctgagaaatccagtaa

SEQ ID NO: 333455 - DNA, 25 bp, Mus musculus
gggtccgccctgagaggtcccgtaa

SEQ ID NO: 333456 - DNA, 25 bp, Mus musculus
gggtccgcggtactgtgaggaaagg

SEQ ID NO: 333457 - DNA, 25 bp, Mus musculus
gggtccgggagtgttacaggtggga

SEQ ID NO: 333458 - DNA, 25 bp, Mus musculus
gggtcctactgtattatggagattg

SEQ ID NO: 333459 - DNA, 25 bp, Mus musculus
gggtcctcactacaggcttccagcc

SEQ ID NO: 333460 - DNA, 25 bp, Mus musculus
gggtcctcggggcgagcgaggtttc

SEQ ID NO: 333461 - DNA, 25 bp, Mus musculus
gggtcctgcgttcttggcccagctg

SEQ ID NO: 333462 - DNA, 25 bp, Mus musculus
gggtcctggaaaggtgatgtacaaa

SEQ ID NO: 333463 - DNA, 25 bp, Mus musculus
gggtcctggagtagcctctccaggc

SEQ ID NO: 333464 - DNA, 25 bp, Mus musculus
gggtcctggagtagtcccaggcact

SEQ ID NO: 333465 - DNA, 25 bp, Mus musculus
gggtcctggcaggaagatttattgg

SEQ ID NO: 333466 - DNA, 25 bp, Mus musculus
gggtcctggcaggggcagtaattgg

SEQ ID NO: 333467 - DNA, 25 bp, Mus musculus
gggtcctgtgtgatctcagtaagtt

SEQ ID NO: 333468 - DNA, 25 bp, Mus musculus
gggtcctgttgaaactttagccact

SEQ ID NO: 333469 - DNA, 25 bp, Mus musculus
gggtcctgtttaaccatcagcagtg

SEQ ID NO: 333470 - DNA, 25 bp, Mus musculus
gggtcctgtttaagagttcagatgc

SEQ ID NO: 333471 - DNA, 25 bp, Mus musculus
gggtccttctcgagattttattccc

SEQ ID NO: 333472 - DNA, 25 bp, Mus musculus
gggtcgagcctaaagaacatcaaac

SEQ ID NO: 333473 - DNA, 25 bp, Mus musculus
gggtcgagctgtcagagaagcttca

SEQ ID NO: 333474 - DNA, 25 bp, Mus musculus
gggtcgagtaccagaaagctcagcc

SEQ ID NO: 333475 - DNA, 25 bp, Mus musculus
gggtcgagtaccaggttggagtggg

SEQ ID NO: 333476 - DNA, 25 bp, Mus musculus
gggtcgatatcaggtgtcctggagc

SEQ ID NO: 333477 - DNA, 25 bp, Mus musculus
gggtcgcaagcgggctgcctctgaa

SEQ ID NO: 333478 - DNA, 25 bp, Mus musculus
gggtcgcacagaggaagccgtgaag

SEQ ID NO: 333479 - DNA, 25 bp, Mus musculus
gggtcgcagcaaacgatcatcccag

SEQ ID NO: 333480 - DNA, 25 bp, Mus musculus
gggtcgccctcggctatcccctctg

SEQ ID NO: 333481 - DNA, 25 bp, Mus musculus
gggtcgccctcgggttccagcagaa

SEQ ID NO: 333482 - DNA, 25 bp, Mus musculus
gggtcgcctctggaccaacggtccc

SEQ ID NO: 333483 - DNA, 25 bp, Mus musculus
gggtcgcgaggtgcagacatggcca

SEQ ID NO: 333484 - DNA, 25 bp, Mus musculus
gggtcgcgcggcttggagctccttc

SEQ ID NO: 333485 - DNA, 25 bp, Mus musculus
gggtcggagcccgcgattctcattg

SEQ ID NO: 333486 - DNA, 25 bp, Mus musculus
gggtcggagcccgcgggtcttactg

SEQ ID NO: 333487 - DNA, 25 bp, Mus musculus
gggtcggctgacagacccgtggatt

SEQ ID NO: 333488 - DNA, 25 bp, Mus musculus
gggtcggctgacagggcaagagttc

SEQ ID NO: 333489 - DNA, 25 bp, Mus musculus
gggtcggctgacaggtagaaaacca

SEQ ID NO: 333490 - DNA, 25 bp, Mus musculus
gggtcgtgcctgagaactccgtgca

SEQ ID NO: 333491 - DNA, 25 bp, Mus musculus
gggtcgtttctgagtgagatcccat

SEQ ID NO: 333492 - DNA, 25 bp, Mus musculus
gggtctaccagcaatgtgtgtccgt

SEQ ID NO: 333493 - DNA, 25 bp, Mus musculus
gggtctacccagaagaaggaccagg

SEQ ID NO: 333494 - DNA, 25 bp, Mus musculus
gggtctacctctgtggaagctcgga

SEQ ID NO: 333495 - DNA, 25 bp, Mus musculus
gggtctatgataaggtacaaaatga

SEQ ID NO: 333496 - DNA, 25 bp, Mus musculus
gggtctcaaggagtcagagcaaccc

SEQ ID NO: 333497 - DNA, 25 bp, Mus musculus
gggtctcaataggtcttgtgtgatg

SEQ ID NO: 333498 - DNA, 25 bp, Mus musculus
gggtctcacgacaggtgatttccga

SEQ ID NO: 333499 - DNA, 25 bp, Mus musculus
gggtctcacgatctttggcatgata

SEQ ID NO: 333500 - DNA, 25 bp, Mus musculus
gggtctcacggaactctgatttcat

SEQ ID NO: 333501 - DNA, 25 bp, Mus musculus
gggtctcagcctcgaatgggtgaag

SEQ ID NO: 333502 - DNA, 25 bp, Mus musculus
gggtctccaatgcaggaggcccacc

SEQ ID NO: 333503 - DNA, 25 bp, Mus musculus
gggtctccaccgtgaaccacccatt

SEQ ID NO: 333504 - DNA, 25 bp, Mus musculus
gggtctccagacacagtttctctga

SEQ ID NO: 333505 - DNA, 25 bp, Mus musculus
gggtctccaggacacagcccagtcc

SEQ ID NO: 333506 - DNA, 25 bp, Mus musculus
gggtctccaggctcagcccgtgcca

SEQ ID NO: 333507 - DNA, 25 bp, Mus musculus
gggtctccaggtgtcctatctgact

SEQ ID NO: 333508 - DNA, 25 bp, Mus musculus
gggtctcccaggaccgtcagaaggg

SEQ ID NO: 333509 - DNA, 25 bp, Mus musculus
gggtctcccagtttgtcactcttta

SEQ ID NO: 333510 - DNA, 25 bp, Mus musculus
gggtctccgtgacaagattgtaagg

SEQ ID NO: 333511 - DNA, 25 bp, Mus musculus
gggtctctctcagcatacgaaggac

SEQ ID NO: 333512 - DNA, 25 bp, Mus musculus
gggtctctctcaggcgtggaggagg

SEQ ID NO: 333513 - DNA, 25 bp, Mus musculus
gggtctctgagtggaggtgaagccg

SEQ ID NO: 333514 - DNA, 25 bp, Mus musculus
gggtctctgcagtgctatggggcat

SEQ ID NO: 333515 - DNA, 25 bp, Mus musculus
gggtctgaagtcaaataccttcaga

SEQ ID NO: 333516 - DNA, 25 bp, Mus musculus
gggtctgacaggcacagtagactgg

SEQ ID NO: 333517 - DNA, 25 bp, Mus musculus
gggtctgacagtgttgtcatgactg

SEQ ID NO: 333518 - DNA, 25 bp, Mus musculus
gggtctgattcccagctgtttgggg

SEQ ID NO: 333519 - DNA, 25 bp, Mus musculus
gggtctgcaggtcttgtagaaattt

SEQ ID NO: 333520 - DNA, 25 bp, Mus musculus
gggtctgcaggtgagtacggctcca

SEQ ID NO: 333521 - DNA, 25 bp, Mus musculus
gggtctgctcaagagtgaagacaag

SEQ ID NO: 333522 - DNA, 25 bp, Mus musculus
gggtctgctgagtcctgcagcaggt

SEQ ID NO: 333523 - DNA, 25 bp, Mus musculus
gggtctggaggtttgaggctctgtg

SEQ ID NO: 333524 - DNA, 25 bp, Mus musculus
gggtctgtacaaggttttgaatcct

SEQ ID NO: 333525 - DNA, 25 bp, Mus musculus
gggtctgtggatgatgaccacaagc

SEQ ID NO: 333526 - DNA, 25 bp, Mus musculus
gggtcttaagaagattgaaaagcaa

SEQ ID NO: 333527 - DNA, 25 bp, Mus musculus
gggtcttaagaaggtcttgctgtgc

SEQ ID NO: 333528 - DNA, 25 bp, Mus musculus
gggtcttagagagagtgcagttctc

SEQ ID NO: 333529 - DNA, 25 bp, Mus musculus
gggtcttatctcgagttgggaacca

SEQ ID NO: 333530 - DNA, 25 bp, Mus musculus
gggtcttatctcgatgaggtctcaa

SEQ ID NO: 333531 - DNA, 25 bp, Mus musculus
gggtcttatctcggttacacctgta

SEQ ID NO: 333532 - DNA, 25 bp, Mus musculus
gggtcttcctggtgcagtggggact

SEQ ID NO: 333533 - DNA, 25 bp, Mus musculus
gggtcttgggaagaaagacgatgct

SEQ ID NO: 333534 - DNA, 25 bp, Mus musculus
gggtctttgagaggtatatctttgc

SEQ ID NO: 333535 - DNA, 25 bp, Mus musculus
gggtcttttcctgccccacctccag

SEQ ID NO: 333536 - DNA, 25 bp, Mus musculus
gggtgaaaaccaagaatccacctca

SEQ ID NO: 333537 - DNA, 25 bp, Mus musculus
gggtgaaaagccggctttctccttc

SEQ ID NO: 333538 - DNA, 25 bp, Mus musculus
gggtgaaaagggtgacataggacag

SEQ ID NO: 333539 - DNA, 25 bp, Mus musculus
gggtgaaaatgctgacgtcctacaa

SEQ ID NO: 333540 - DNA, 25 bp, Mus musculus
gggtgaaacacaggacttccatagt

SEQ ID NO: 333541 - DNA, 25 bp, Mus musculus
gggtgaaaggggaacatctcaagta

SEQ ID NO: 333542 - DNA, 25 bp, Mus musculus
gggtgaaagggtgggatgctatgga

SEQ ID NO: 333543 - DNA, 25 bp, Mus musculus
gggtgaacaaggtgttccaggaaga

SEQ ID NO: 333544 - DNA, 25 bp, Mus musculus
gggtgaacagggtgcctctggtgaa

SEQ ID NO: 333545 - DNA, 25 bp, Mus musculus
gggtgaagaagaagctgactgcgga

SEQ ID NO: 333546 - DNA, 25 bp, Mus musculus
gggtgaagcaggagcttctggaaga

SEQ ID NO: 333547 - DNA, 25 bp, Mus musculus
gggtgaaggagtattcatggctgct

SEQ ID NO: 333548 - DNA, 25 bp, Mus musculus
gggtgaattctcagatgccagcatg

SEQ ID NO: 333549 - DNA, 25 bp, Mus musculus
gggtgaattctcagttaaatttaaa

SEQ ID NO: 333550 - DNA, 25 bp, Mus musculus
gggtgaccgaggtggcataggagag

SEQ ID NO: 333551 - DNA, 25 bp, Mus musculus
gggtgacctatcagggtacttttga

SEQ ID NO: 333552 - DNA, 25 bp, Mus musculus
gggtgacctgggatggattcatggg

SEQ ID NO: 333553 - DNA, 25 bp, Mus musculus
gggtgacgaggtggagtacatgttg

SEQ ID NO: 333554 - DNA, 25 bp, Mus musculus
gggtgacgcgacagaaaccgcccag

SEQ ID NO: 333555 - DNA, 25 bp, Mus musculus
gggtgacgcgacagcacaccacatg

SEQ ID NO: 333556 - DNA, 25 bp, Mus musculus
gggtgactgctcccttccctggtct

SEQ ID NO: 333557 - DNA, 25 bp, Mus musculus
gggtgactgtacagtatgtgcagag

SEQ ID NO: 333558 - DNA, 25 bp, Mus musculus
gggtgactgtacagtgaaacagatg

SEQ ID NO: 333559 - DNA, 25 bp, Mus musculus
gggtgagaaagaggagacagagtat

SEQ ID NO: 333560 - DNA, 25 bp, Mus musculus
gggtgagaaaggggagacagagtat

SEQ ID NO: 333561 - DNA, 25 bp, Mus musculus
gggtgagaagggcgttctctccaac

SEQ ID NO: 333562 - DNA, 25 bp, Mus musculus
gggtgagaaggtcatcctttttcag

SEQ ID NO: 333563 - DNA, 25 bp, Mus musculus
gggtgagcaggtgcgggaggtgctg

SEQ ID NO: 333564 - DNA, 25 bp, Mus musculus
gggtgagccaggcctcgagcactgc

SEQ ID NO: 333565 - DNA, 25 bp, Mus musculus
gggtgagccagtgactccactggct

SEQ ID NO: 333566 - DNA, 25 bp, Mus musculus
gggtgaggacacgagttgcattgta

SEQ ID NO: 333567 - DNA, 25 bp, Mus musculus
gggtgaggaggaagaaatggtcctt

SEQ ID NO: 333568 - DNA, 25 bp, Mus musculus
gggtgaggaggttgtggcagcattg

SEQ ID NO: 333569 - DNA, 25 bp, Mus musculus
gggtgaggatttctcccaggaaagc

SEQ ID NO: 333570 - DNA, 25 bp, Mus musculus
gggtgaggcggcagctgcagcagcc

SEQ ID NO: 333571 - DNA, 25 bp, Mus musculus
gggtgagtttcacggagaaatccag

SEQ ID NO: 333572 - DNA, 25 bp, Mus musculus
gggtgagtttgaaaccaggaaaatg

SEQ ID NO: 333573 - DNA, 25 bp, Mus musculus
gggtgataataaggacaaccggatc

SEQ ID NO: 333574 - DNA, 25 bp, Mus musculus
gggtgataataagtttctgagggtc

SEQ ID NO: 333575 - DNA, 25 bp, Mus musculus
gggtgatccaggtcattgtggccac

SEQ ID NO: 333576 - DNA, 25 bp, Mus musculus
gggtgatcgaggggctgacatggac

SEQ ID NO: 333577 - DNA, 25 bp, Mus musculus
gggtgatgaaagggctgtgcctggc

SEQ ID NO: 333578 - DNA, 25 bp, Mus musculus
gggtgatgactcagcttctaaggag

SEQ ID NO: 333579 - DNA, 25 bp, Mus musculus
gggtgatgactgcccagtgtttcca

SEQ ID NO: 333580 - DNA, 25 bp, Mus musculus
gggtgatgactgttgctttcactac

SEQ ID NO: 333581 - DNA, 25 bp, Mus musculus
gggtgatgctggacaagtgggagaa

SEQ ID NO: 333582 - DNA, 25 bp, Mus musculus
gggtgatgctggggagatggtgcgc

SEQ ID NO: 333583 - DNA, 25 bp, Mus musculus
gggtgatggtgaggtctagtgacag

SEQ ID NO: 333584 - DNA, 25 bp, Mus musculus
gggtgattctcttgccattcattga

SEQ ID NO: 333585 - DNA, 25 bp, Mus musculus
gggtgattctcttggattgttcatc

SEQ ID NO: 333586 - DNA, 25 bp, Mus musculus
gggtgattgacaaggttttacttgt

SEQ ID NO: 333587 - DNA, 25 bp, Mus musculus
gggtgattgcgcaggccttcagaag

SEQ ID NO: 333588 - DNA, 25 bp, Mus musculus
gggtgcaaaaggtaccagcaaggtg

SEQ ID NO: 333589 - DNA, 25 bp, Mus musculus
gggtgcaatgggtgaaagagctggt

SEQ ID NO: 333590 - DNA, 25 bp, Mus musculus
gggtgcacctcagctttgtgcgctc

SEQ ID NO: 333591 - DNA, 25 bp, Mus musculus
gggtgcactcagggtggcacaagac

SEQ ID NO: 333592 - DNA, 25 bp, Mus musculus
gggtgcactcaggtcctcattccta

SEQ ID NO: 333593 - DNA, 25 bp, Mus musculus
gggtgcagaagttccctcaaccccg

SEQ ID NO: 333594 - DNA, 25 bp, Mus musculus
gggtgcagagagacatcccaatgcc

SEQ ID NO: 333595 - DNA, 25 bp, Mus musculus
gggtgcagaggtctctgtgttggtt

SEQ ID NO: 333596 - DNA, 25 bp, Mus musculus
gggtgcagcaggatgctgggcagtt

SEQ ID NO: 333597 - DNA, 25 bp, Mus musculus
gggtgcagcaggatgcttcatctgc

SEQ ID NO: 333598 - DNA, 25 bp, Mus musculus
gggtgcagcccagtggtatgacctg

SEQ ID NO: 333599 - DNA, 25 bp, Mus musculus
gggtgcagcggccagaagatgcatc

SEQ ID NO: 333600 - DNA, 25 bp, Mus musculus
gggtgcaggaaaacattgctgatag

SEQ ID NO: 333601 - DNA, 25 bp, Mus musculus
gggtgcaggaaggtgtgaaacagaa

SEQ ID NO: 333602 - DNA, 25 bp, Mus musculus
gggtgcagggggaacagctgtgcca

SEQ ID NO: 333603 - DNA, 25 bp, Mus musculus
gggtgcaggggtgtgccccagagaa

SEQ ID NO: 333604 - DNA, 25 bp, Mus musculus
gggtgcatgaaaggccgcaccatgt

SEQ ID NO: 333605 - DNA, 25 bp, Mus musculus
gggtgccacgcaggcttacagttcc

SEQ ID NO: 333606 - DNA, 25 bp, Mus musculus
gggtgccacggacttgagcatcgat

SEQ ID NO: 333607 - DNA, 25 bp, Mus musculus
gggtgccacggtgaccatcgtcagt

SEQ ID NO: 333608 - DNA, 25 bp, Mus musculus
gggtgccagccagtgtacgatccca

SEQ ID NO: 333609 - DNA, 25 bp, Mus musculus
gggtgcccagtgctaggagaccatc

SEQ ID NO: 333610 - DNA, 25 bp, Mus musculus
gggtgcccatggaggtcctgtccag

SEQ ID NO: 333611 - DNA, 25 bp, Mus musculus
gggtgcccgagaggttctgggagag

SEQ ID NO: 333612 - DNA, 25 bp, Mus musculus
gggtgcccgcagatgtgcctcatcc

SEQ ID NO: 333613 - DNA, 25 bp, Mus musculus
gggtgcccggcgccggttcagtcct

SEQ ID NO: 333614 - DNA, 25 bp, Mus musculus
gggtgcccgggatgaaagtgggatc

SEQ ID NO: 333615 - DNA, 25 bp, Mus musculus
gggtgcccgtgacaaatgaagagaa

SEQ ID NO: 333616 - DNA, 25 bp, Mus musculus
gggtgccctaagtatccagcatgct

SEQ ID NO: 333617 - DNA, 25 bp, Mus musculus
gggtgccctcaccactcaatccctg

SEQ ID NO: 333618 - DNA, 25 bp, Mus musculus
gggtgccctcaccagtcaatccctg

SEQ ID NO: 333619 - DNA, 25 bp, Mus musculus
gggtgcgacttggaccaattgctgg

SEQ ID NO: 333620 - DNA, 25 bp, Mus musculus
gggtgcgacttggactcggctctct

SEQ ID NO: 333621 - DNA, 25 bp, Mus musculus
gggtgcgagggaagctgtttacttt

SEQ ID NO: 333622 - DNA, 25 bp, Mus musculus
gggtgcgcacagaactcaggggcac

SEQ ID NO: 333623 - DNA, 25 bp, Mus musculus
gggtgcgcacagatgactggtttac

SEQ ID NO: 333624 - DNA, 25 bp, Mus musculus
gggtgcgcgcacagatgggctgtat

SEQ ID NO: 333625 - DNA, 25 bp, Mus musculus
gggtgcggaggtcgctcatccgatc

SEQ ID NO: 333626 - DNA, 25 bp, Mus musculus
gggtgctatggggaagagacacagg

SEQ ID NO: 333627 - DNA, 25 bp, Mus musculus
gggtgctcctggaaaacggggtgcc

SEQ ID NO: 333628 - DNA, 25 bp, Mus musculus
gggtgctgatggggaaggaccggaa

SEQ ID NO: 333629 - DNA, 25 bp, Mus musculus
gggtgctgatgtttgagatgctgac

SEQ ID NO: 333630 - DNA, 25 bp, Mus musculus
gggtgctgcagtggttttaagctat

SEQ ID NO: 333631 - DNA, 25 bp, Mus musculus
gggtgctgcccggcggtcccgcgac

SEQ ID NO: 333632 - DNA, 25 bp, Mus musculus
gggtgctggctggaggttggggttt

SEQ ID NO: 333633 - DNA, 25 bp, Mus musculus
gggtgctgtgcgcttctattccaag

SEQ ID NO: 333634 - DNA, 25 bp, Mus musculus
gggtgcttgtaggtggcgggacggg

SEQ ID NO: 333635 - DNA, 25 bp, Mus musculus
gggtggaagaaaggcttggggcata

SEQ ID NO: 333636 - DNA, 25 bp, Mus musculus
gggtggaagccaggaagcttcttga

SEQ ID NO: 333637 - DNA, 25 bp, Mus musculus
gggtggaagccaggcctgtagggac

SEQ ID NO: 333638 - DNA, 25 bp, Mus musculus
gggtggaagccccaggcctggtgat

SEQ ID NO: 333639 - DNA, 25 bp, Mus musculus
gggtggacaggtgagcaatgccagc

SEQ ID NO: 333640 - DNA, 25 bp, Mus musculus
gggtggacagtgaagatggagctgg

SEQ ID NO: 333641 - DNA, 25 bp, Mus musculus
gggtggacagtgaaggtgacccttg

SEQ ID NO: 333642 - DNA, 25 bp, Mus musculus
gggtggacggacgggcgcctctgaa

SEQ ID NO: 333643 - DNA, 25 bp, Mus musculus
gggtggactgctggcctggtagagg

SEQ ID NO: 333644 - DNA, 25 bp, Mus musculus
gggtggagagcatgggggggaaagt

SEQ ID NO: 333645 - DNA, 25 bp, Mus musculus
gggtggaggcagtgtgcaaatagtc

SEQ ID NO: 333646 - DNA, 25 bp, Mus musculus
gggtggaggcagttgtctgctacag

SEQ ID NO: 333647 - DNA, 25 bp, Mus musculus
gggtggagtgctctctgaaaactga

SEQ ID NO: 333648 - DNA, 25 bp, Mus musculus
gggtggagtggtccattcgtttgat

SEQ ID NO: 333649 - DNA, 25 bp, Mus musculus
gggtggagttctagtttggattaac

SEQ ID NO: 333650 - DNA, 25 bp, Mus musculus
gggtggatcgagaacactgtagctg

SEQ ID NO: 333651 - DNA, 25 bp, Mus musculus
gggtggatcgagatggttgtgagct

SEQ ID NO: 333652 - DNA, 25 bp, Mus musculus
gggtggcaaggctggagcagcagaa

SEQ ID NO: 333653 - DNA, 25 bp, Mus musculus
gggtggcagaggaggtccaactgag

SEQ ID NO: 333654 - DNA, 25 bp, Mus musculus
gggtggcagggggacacctggaaag

SEQ ID NO: 333655 - DNA, 25 bp, Mus musculus
gggtggccagggctctggctgagaa

SEQ ID NO: 333656 - DNA, 25 bp, Mus musculus
gggtggccatgggaaatggagcagt

SEQ ID NO: 333657 - DNA, 25 bp, Mus musculus
gggtggccatgtgcccagcccccga

SEQ ID NO: 333658 - DNA, 25 bp, Mus musculus
gggtggccgcgcagccagcgttcca

SEQ ID NO: 333659 - DNA, 25 bp, Mus musculus
gggtggccgggaagaccaaatacac

SEQ ID NO: 333660 - DNA, 25 bp, Mus musculus
gggtggcgacagatgttgcattacg

SEQ ID NO: 333661 - DNA, 25 bp, Mus musculus
gggtggcgacaggtgtgactggaga

SEQ ID NO: 333662 - DNA, 25 bp, Mus musculus
gggtggcgccagctagccggatcag

SEQ ID NO: 333663 - DNA, 25 bp, Mus musculus
gggtggcggccgggatctgggacga

SEQ ID NO: 333664 - DNA, 25 bp, Mus musculus
gggtggcggggccctccatgatgaa

SEQ ID NO: 333665 - DNA, 25 bp, Mus musculus
gggtggctctgaggtaggtgtcttc

SEQ ID NO: 333666 - DNA, 25 bp, Mus musculus
gggtggctggagatgaattcagtca

SEQ ID NO: 333667 - DNA, 25 bp, Mus musculus
gggtggctggagttgaattcagtca

SEQ ID NO: 333668 - DNA, 25 bp, Mus musculus
gggtgggaggaagctgtccatggct

SEQ ID NO: 333669 - DNA, 25 bp, Mus musculus
gggtgggattattagatttagagct

SEQ ID NO: 333670 - DNA, 25 bp, Mus musculus
gggtggggccacagaggcagaggag

SEQ ID NO: 333671 - DNA, 25 bp, Mus musculus
gggtggggccacaggtgccccccac

SEQ ID NO: 333672 - DNA, 25 bp, Mus musculus
gggtgggggtgggggagggcacata

SEQ ID NO: 333673 - DNA, 25 bp, Mus musculus
gggtggggttcagtacatcggcatc

SEQ ID NO: 333674 - DNA, 25 bp, Mus musculus
gggtggtcaggaaggtctatatgga

SEQ ID NO: 333675 - DNA, 25 bp, Mus musculus
gggtggtgtcctggctggtatctgc

SEQ ID NO: 333676 - DNA, 25 bp, Mus musculus
gggtggttcctttccttgggagcga

SEQ ID NO: 333677 - DNA, 25 bp, Mus musculus
gggtggttgacatgtgcgagtagtg

SEQ ID NO: 333678 - DNA, 25 bp, Mus musculus
gggtggttgtgctgggcctgcttcc

SEQ ID NO: 333679 - DNA, 25 bp, Mus musculus
gggtggttttcttgaccctgctttt

SEQ ID NO: 333680 - DNA, 25 bp, Mus musculus
gggtgtatggcgagatagaccatgc

SEQ ID NO: 333681 - DNA, 25 bp, Mus musculus
gggtgtatggcgagattttcagttt

SEQ ID NO: 333682 - DNA, 25 bp, Mus musculus
gggtgtcaaccaggaacctggctca

SEQ ID NO: 333683 - DNA, 25 bp, Mus musculus
gggtgtcactctgggagttagcgac

SEQ ID NO: 333684 - DNA, 25 bp, Mus musculus
gggtgtcagcgggaacagcagtggt

SEQ ID NO: 333685 - DNA, 25 bp, Mus musculus
gggtgtccagacgctgcggccaggc

SEQ ID NO: 333686 - DNA, 25 bp, Mus musculus
gggtgtccctcagctgcttccggtt

SEQ ID NO: 333687 - DNA, 25 bp, Mus musculus
gggtgtccctcaggtggccccttct

SEQ ID NO: 333688 - DNA, 25 bp, Mus musculus
gggtgtccctcagtcgagccccgtt

SEQ ID NO: 333689 - DNA, 25 bp, Mus musculus
gggtgtccgagccaggacgagggat

SEQ ID NO: 333690 - DNA, 25 bp, Mus musculus
gggtgtccgtaaacttgggtgctgg

SEQ ID NO: 333691 - DNA, 25 bp, Mus musculus
gggtgtccgtaaagaagaacacaac

SEQ ID NO: 333692 - DNA, 25 bp, Mus musculus
gggtgtcgagcccagccagtggttt

SEQ ID NO: 333693 - DNA, 25 bp, Mus musculus
gggtgtctgacggtgctgggaggat

SEQ ID NO: 333694 - DNA, 25 bp, Mus musculus
gggtgtctgtctatgaaaatgacac

SEQ ID NO: 333695 - DNA, 25 bp, Mus musculus
gggtgtctgtctatggtatcatcag

SEQ ID NO: 333696 - DNA, 25 bp, Mus musculus
gggtgtcttctaatgttctgatgga

SEQ ID NO: 333697 - DNA, 25 bp, Mus musculus
gggtgtgaagggtgagagtggttcc

SEQ ID NO: 333698 - DNA, 25 bp, Mus musculus
gggtgtgcaagggcgaccagggcgg

SEQ ID NO: 333699 - DNA, 25 bp, Mus musculus
gggtgtgccacggatgaataaaaac

SEQ ID NO: 333700 - DNA, 25 bp, Mus musculus
gggtgtgcctgaggagtccctgtgc

SEQ ID NO: 333701 - DNA, 25 bp, Mus musculus
gggtgtgcctgaggctgacctgtgc

SEQ ID NO: 333702 - DNA, 25 bp, Mus musculus
gggtgtggatggaggcattgcactc

SEQ ID NO: 333703 - DNA, 25 bp, Mus musculus
gggtgtggcaaggggaaactgtttg

SEQ ID NO: 333704 - DNA, 25 bp, Mus musculus
gggtgtggcaggaatgattaatatt

SEQ ID NO: 333705 - DNA, 25 bp, Mus musculus
gggtgtggccagatcagactccaac

SEQ ID NO: 333706 - DNA, 25 bp, Mus musculus
gggtgtggccagcgttttaccaacg

SEQ ID NO: 333707 - DNA, 25 bp, Mus musculus
gggtgtggtgggccgagccgccagt

SEQ ID NO: 333708 - DNA, 25 bp, Mus musculus
gggtgtgtgacttagcccaggagtt

SEQ ID NO: 333709 - DNA, 25 bp, Mus musculus
gggtgtgtgacttagctcaaagatt

SEQ ID NO: 333710 - DNA, 25 bp, Mus musculus
gggtgtgtgacttaggtaggtgagc

SEQ ID NO: 333711 - DNA, 25 bp, Mus musculus
gggtgttatatggttatatatttgg

SEQ ID NO: 333712 - DNA, 25 bp, Mus musculus
gggtgttgaatacaaggttctcagg

SEQ ID NO: 333713 - DNA, 25 bp, Mus musculus
gggtgttgatgaagagctggagtga

SEQ ID NO: 333714 - DNA, 25 bp, Mus musculus
gggtgttggcactgggatcagtaat

SEQ ID NO: 333715 - DNA, 25 bp, Mus musculus
gggtgttgtagcatcttggttgcca

SEQ ID NO: 333716 - DNA, 25 bp, Mus musculus
gggtgttgtagctgctcctcacaga

SEQ ID NO: 333717 - DNA, 25 bp, Mus musculus
gggtgtttggggcctacacgcccag

SEQ ID NO: 333718 - DNA, 25 bp, Mus musculus
gggtgtttttcagatttcaccgaga

SEQ ID NO: 333719 - DNA, 25 bp, Mus musculus
gggttaaatattgatgagaaggctc

SEQ ID NO: 333720 - DNA, 25 bp, Mus musculus
gggttacaaatagcacgctgaagca

SEQ ID NO: 333721 - DNA, 25 bp, Mus musculus
gggttacaaatatgagctccccgca

SEQ ID NO: 333722 - DNA, 25 bp, Mus musculus
gggttacaacatgggagaggcagag

SEQ ID NO: 333723 - DNA, 25 bp, Mus musculus
gggttagcacttggtgtggagaaga

SEQ ID NO: 333724 - DNA, 25 bp, Mus musculus
gggttatatcaagttcaaaaggatg

SEQ ID NO: 333725 - DNA, 25 bp, Mus musculus
gggttatctggccgttcctcagtta

SEQ ID NO: 333726 - DNA, 25 bp, Mus musculus
gggttatgataaggactatgtcaga

SEQ ID NO: 333727 - DNA, 25 bp, Mus musculus
gggttatgataagtacatggagagg

SEQ ID NO: 333728 - DNA, 25 bp, Mus musculus
gggttcaaagttcccctggcctggg

SEQ ID NO: 333729 - DNA, 25 bp, Mus musculus
gggttcaaggcgacaatgttctcaa

SEQ ID NO: 333730 - DNA, 25 bp, Mus musculus
gggttcaattccagccatattgatg

SEQ ID NO: 333731 - DNA, 25 bp, Mus musculus
gggttcacacaggagtgccaggagg

SEQ ID NO: 333732 - DNA, 25 bp, Mus musculus
gggttcacagcagcacatccctaca

SEQ ID NO: 333733 - DNA, 25 bp, Mus musculus
gggttcacagcaggtgcccagggaa

SEQ ID NO: 333734 - DNA, 25 bp, Mus musculus
gggttcacaggcacactggcaacct

SEQ ID NO: 333735 - DNA, 25 bp, Mus musculus
gggttcaccagataaatttaacaca

SEQ ID NO: 333736 - DNA, 25 bp, Mus musculus
gggttcaggaggggtgagtcagaat

SEQ ID NO: 333737 - DNA, 25 bp, Mus musculus
gggttcatcctgactatgcggcgca

SEQ ID NO: 333738 - DNA, 25 bp, Mus musculus
gggttcatcctgccagagactatgc

SEQ ID NO: 333739 - DNA, 25 bp, Mus musculus
gggttcatgagaggccgaggccact

SEQ ID NO: 333740 - DNA, 25 bp, Mus musculus
gggttcatttgcatccctggcacca

SEQ ID NO: 333741 - DNA, 25 bp, Mus musculus
gggttccatgccggcaaagtgcaaa

SEQ ID NO: 333742 - DNA, 25 bp, Mus musculus
gggttcccaagcagcagcaggctgt

SEQ ID NO: 333743 - DNA, 25 bp, Mus musculus
gggttcccagtgatagaaaacgagc

SEQ ID NO: 333744 - DNA, 25 bp, Mus musculus
gggttccctctcagggtgcgggtag

SEQ ID NO: 333745 - DNA, 25 bp, Mus musculus
gggttccctgatctatgaggactcc

SEQ ID NO: 333746 - DNA, 25 bp, Mus musculus
gggttccgcgcgcttgggaccgcgt

SEQ ID NO: 333747 - DNA, 25 bp, Mus musculus
gggttccgcgcggagaatgactcag

SEQ ID NO: 333748 - DNA, 25 bp, Mus musculus
gggttccggaaggttccatgatgga

SEQ ID NO: 333749 - DNA, 25 bp, Mus musculus
gggttcctagctggaggaaatccac

SEQ ID NO: 333750 - DNA, 25 bp, Mus musculus
gggttcctaggtccagctggaggaa

SEQ ID NO: 333751 - DNA, 25 bp, Mus musculus
gggttcctccagctctacccgatca

SEQ ID NO: 333752 - DNA, 25 bp, Mus musculus
gggttcctgcaggaggcagcgggcc

SEQ ID NO: 333753 - DNA, 25 bp, Mus musculus
gggttccttcaagagcatgctggga

SEQ ID NO: 333754 - DNA, 25 bp, Mus musculus
gggttccttcaagggacttcctcgc

SEQ ID NO: 333755 - DNA, 25 bp, Mus musculus
gggttccttctgcggagaacgtttt

SEQ ID NO: 333756 - DNA, 25 bp, Mus musculus
gggttcgcctgaggattggatggtg

SEQ ID NO: 333757 - DNA, 25 bp, Mus musculus
gggttcgtgggaagatagacccagt

SEQ ID NO: 333758 - DNA, 25 bp, Mus musculus
gggttctcaaggcggggacgatccg

SEQ ID NO: 333759 - DNA, 25 bp, Mus musculus
gggttctccaagtgttgaatcataa

SEQ ID NO: 333760 - DNA, 25 bp, Mus musculus
gggttctccagagaggtgcccttct

SEQ ID NO: 333761 - DNA, 25 bp, Mus musculus
gggttctccgccgagccggaccggg

SEQ ID NO: 333762 - DNA, 25 bp, Mus musculus
gggttctccgccgagcgcctcggtc

SEQ ID NO: 333763 - DNA, 25 bp, Mus musculus
gggttctcgggcaatgatggcagtg

SEQ ID NO: 333764 - DNA, 25 bp, Mus musculus
gggttctctgtaagttctccctgtt

SEQ ID NO: 333765 - DNA, 25 bp, Mus musculus
gggttctgacaggcctcaagaaagg

SEQ ID NO: 333766 - DNA, 25 bp, Mus musculus
gggttctgatgatgattcatgaaaa

SEQ ID NO: 333767 - DNA, 25 bp, Mus musculus
gggttctgcaggaggagtgatgggc

SEQ ID NO: 333768 - DNA, 25 bp, Mus musculus
gggttctgcatcccgttcacgcaaa

SEQ ID NO: 333769 - DNA, 25 bp, Mus musculus
gggttctgctcacagcctccctctt

SEQ ID NO: 333770 - DNA, 25 bp, Mus musculus
gggttctgctgcagagacagcacta

SEQ ID NO: 333771 - DNA, 25 bp, Mus musculus
gggttctgctgggccactgccggtg

SEQ ID NO: 333772 - DNA, 25 bp, Mus musculus
gggttctgctgtctcagtgccattt

SEQ ID NO: 333773 - DNA, 25 bp, Mus musculus
gggttctggtgatggccataaaatc

SEQ ID NO: 333774 - DNA, 25 bp, Mus musculus
gggttgagtaaattcacagatactg

SEQ ID NO: 333775 - DNA, 25 bp, Mus musculus
gggttgatcttaagatgtcagtaga

SEQ ID NO: 333776 - DNA, 25 bp, Mus musculus
gggttgatcttaaggatcgagagcg

SEQ ID NO: 333777 - DNA, 25 bp, Mus musculus
gggttgcacaggatttccctagaga

SEQ ID NO: 333778 - DNA, 25 bp, Mus musculus
gggttgcacaggtgaagatcatgac

SEQ ID NO: 333779 - DNA, 25 bp, Mus musculus
gggttgccagccatgctgcaagctg

SEQ ID NO: 333780 - DNA, 25 bp, Mus musculus
gggttgcccttgaacatttatgaac

SEQ ID NO: 333781 - DNA, 25 bp, Mus musculus
gggttgcccttggtgaggcatgcac

SEQ ID NO: 333782 - DNA, 25 bp, Mus musculus
gggttgctgaggacaggacccgagt

SEQ ID NO: 333783 - DNA, 25 bp, Mus musculus
gggttgctgtcgtgcctcgaggcag

SEQ ID NO: 333784 - DNA, 25 bp, Mus musculus
gggttggaggccaggaatggtacca

SEQ ID NO: 333785 - DNA, 25 bp, Mus musculus
gggttggaggccagtgcctctctgg

SEQ ID NO: 333786 - DNA, 25 bp, Mus musculus
gggttggaggctaggtcttggtttc

SEQ ID NO: 333787 - DNA, 25 bp, Mus musculus
gggttggatcagaggagtccctggt

SEQ ID NO: 333788 - DNA, 25 bp, Mus musculus
gggttgggaaggttctggctgccca

SEQ ID NO: 333789 - DNA, 25 bp, Mus musculus
gggttgggaatacaggagacagaaa

SEQ ID NO: 333790 - DNA, 25 bp, Mus musculus
gggttgggatttcagacaggtggag

SEQ ID NO: 333791 - DNA, 25 bp, Mus musculus
gggttgggatttcaggtctctggct

SEQ ID NO: 333792 - DNA, 25 bp, Mus musculus
gggttggggagtattactatgaata

SEQ ID NO: 333793 - DNA, 25 bp, Mus musculus
gggttggtcactacactgcatatgc

SEQ ID NO: 333794 - DNA, 25 bp, Mus musculus
gggttgtcaggtatgagcatgcgaa

SEQ ID NO: 333795 - DNA, 25 bp, Mus musculus
gggttgtgatgggaggctcctatga

SEQ ID NO: 333796 - DNA, 25 bp, Mus musculus
gggttgtgatgggcggctcctatga

SEQ ID NO: 333797 - DNA, 25 bp, Mus musculus
gggttgttacaagagggaagcctgt

SEQ ID NO: 333798 - DNA, 25 bp, Mus musculus
gggttgttgccgtaatctagctgcc

SEQ ID NO: 333799 - DNA, 25 bp, Mus musculus
gggtttaaagaatacttgaactatg

SEQ ID NO: 333800 - DNA, 25 bp, Mus musculus
gggtttaacggagagggcggcgaag

SEQ ID NO: 333801 - DNA, 25 bp, Mus musculus
gggtttaacggagatgagaaggcca

SEQ ID NO: 333802 - DNA, 25 bp, Mus musculus
gggtttacaaaggagcagccatgtc

SEQ ID NO: 333803 - DNA, 25 bp, Mus musculus
gggtttacaaggacatatggagatt

SEQ ID NO: 333804 - DNA, 25 bp, Mus musculus
gggtttactgcagctctgcattgag

SEQ ID NO: 333805 - DNA, 25 bp, Mus musculus
gggtttactgcaggacattaaggac

SEQ ID NO: 333806 - DNA, 25 bp, Mus musculus
gggtttactgcaggtaccgaatgtc

SEQ ID NO: 333807 - DNA, 25 bp, Mus musculus
gggtttcaagcctggggaaaaagat

SEQ ID NO: 333808 - DNA, 25 bp, Mus musculus
gggtttcaagtcttgtgatggatga

SEQ ID NO: 333809 - DNA, 25 bp, Mus musculus
gggtttcagaacagagggcaatgcg

SEQ ID NO: 333810 - DNA, 25 bp, Mus musculus
gggtttcctgttcagggagaggcgg

SEQ ID NO: 333811 - DNA, 25 bp, Mus musculus
gggtttccttgtcaaacccaacagt

SEQ ID NO: 333812 - DNA, 25 bp, Mus musculus
gggtttccttgtcaacaatcaagat

SEQ ID NO: 333813 - DNA, 25 bp, Mus musculus
gggtttcgcagagcttcctctctct

SEQ ID NO: 333814 - DNA, 25 bp, Mus musculus
gggtttcttccagggcttggctgag

SEQ ID NO: 333815 - DNA, 25 bp, Mus musculus
gggtttgaatgtatcgcaaacgctg

SEQ ID NO: 333816 - DNA, 25 bp, Mus musculus
gggtttgactcgcacatccttgtgg

SEQ ID NO: 333817 - DNA, 25 bp, Mus musculus
gggtttgcagtcttctggcagctca

SEQ ID NO: 333818 - DNA, 25 bp, Mus musculus
gggtttgccgattcccacccctggt

SEQ ID NO: 333819 - DNA, 25 bp, Mus musculus
gggtttgccggattatcacaaaatt

SEQ ID NO: 333820 - DNA, 25 bp, Mus musculus
gggtttgcttctcccttccagatat

SEQ ID NO: 333821 - DNA, 25 bp, Mus musculus
gggtttgggggaccagtagttgcag

SEQ ID NO: 333822 - DNA, 25 bp, Mus musculus
gggtttgttactaggattgaaattc

SEQ ID NO: 333823 - DNA, 25 bp, Mus musculus
gggtttgttcagtcgacctgataaa

SEQ ID NO: 333824 - DNA, 25 bp, Mus musculus
gggttttaaaactttgctgcgagac

SEQ ID NO: 333825 - DNA, 25 bp, Mus musculus
gggttttaagtgcggagatccaagg

SEQ ID NO: 333826 - DNA, 25 bp, Mus musculus
gggttttcacagtctttcaggcatg

SEQ ID NO: 333827 - DNA, 25 bp, Mus musculus
gggttttcagatccttaagctgttg

SEQ ID NO: 333828 - DNA, 25 bp, Mus musculus
gggttttcagcacactgccccattg

SEQ ID NO: 333829 - DNA, 25 bp, Mus musculus
gggttttcagcctgaataccaagga

SEQ ID NO: 333830 - DNA, 25 bp, Mus musculus
gggtttttcaggatgccacagttgg

SEQ ID NO: 333831 - DNA, 25 bp, Mus musculus
gggttttttctggcgagcggcgtgc

SEQ ID NO: 333832 - DNA, 25 bp, Mus musculus
ggtaaaaatggattagtcgtatcta

SEQ ID NO: 333833 - DNA, 25 bp, Mus musculus
ggtaaaactgattgactggggaaac

SEQ ID NO: 333834 - DNA, 25 bp, Mus musculus
ggtaaaatatcctgcccaaactcca

SEQ ID NO: 333835 - DNA, 25 bp, Mus musculus
ggtaaaatatcggatgcccgggtag

SEQ ID NO: 333836 - DNA, 25 bp, Mus musculus
ggtaaacatgctcatgaactaaaat

SEQ ID NO: 333837 - DNA, 25 bp, Mus musculus
ggtaaaccgtcaaggtcacggtctc

SEQ ID NO: 333838 - DNA, 25 bp, Mus musculus
ggtaaacctggagatgggtatcggc

SEQ ID NO: 333839 - DNA, 25 bp, Mus musculus
ggtaaactgaggctcctagaaggtg

SEQ ID NO: 333840 - DNA, 25 bp, Mus musculus
ggtaaactgcaggttgtcctggtgc

SEQ ID NO: 333841 - DNA, 25 bp, Mus musculus
ggtaaagaaagggttgctgttgcat

SEQ ID NO: 333842 - DNA, 25 bp, Mus musculus
ggtaaagaagattggatttaccttc

SEQ ID NO: 333843 - DNA, 25 bp, Mus musculus
ggtaaagaatgaaaggcgttgcagc

SEQ ID NO: 333844 - DNA, 25 bp, Mus musculus
ggtaaagacagagctctgaaagggg

SEQ ID NO: 333845 - DNA, 25 bp, Mus musculus
ggtaaagacagcacagccccccagc

SEQ ID NO: 333846 - DNA, 25 bp, Mus musculus
ggtaaagacagcctaaccatgccag

SEQ ID NO: 333847 - DNA, 25 bp, Mus musculus
ggtaaagacagtggattttgctgca

SEQ ID NO: 333848 - DNA, 25 bp, Mus musculus
ggtaaagggggagcacgagtgcttc

SEQ ID NO: 333849 - DNA, 25 bp, Mus musculus
ggtaaaggtgtattcagacttcaag

SEQ ID NO: 333850 - DNA, 25 bp, Mus musculus
ggtaaaggtgtattcgggttcctgg

SEQ ID NO: 333851 - DNA, 25 bp, Mus musculus
ggtaaagtcctgggaatcaacaagc

SEQ ID NO: 333852 - DNA, 25 bp, Mus musculus
ggtaaatgagatcatgattctggaa

SEQ ID NO: 333853 - DNA, 25 bp, Mus musculus
ggtaacacagaagccaccatggggc

SEQ ID NO: 333854 - DNA, 25 bp, Mus musculus
ggtaacactcctctacacttagcct

SEQ ID NO: 333855 - DNA, 25 bp, Mus musculus
ggtaacagaggaaccgatgatgtgg

SEQ ID NO: 333856 - DNA, 25 bp, Mus musculus
ggtaaccaaagctgttctgtgtcct

SEQ ID NO: 333857 - DNA, 25 bp, Mus musculus
ggtaaccacacagcttgttcggttt

SEQ ID NO: 333858 - DNA, 25 bp, Mus musculus
ggtaactacggagatcagcaggctc

SEQ ID NO: 333859 - DNA, 25 bp, Mus musculus
ggtaactccaggccatccgaaccat

SEQ ID NO: 333860 - DNA, 25 bp, Mus musculus
ggtaactgtcgaggaagttttctga

SEQ ID NO: 333861 - DNA, 25 bp, Mus musculus
ggtaactgtgtaggtgcaggcaacc

SEQ ID NO: 333862 - DNA, 25 bp, Mus musculus
ggtaagaaggcaatggcaagccggc

SEQ ID NO: 333863 - DNA, 25 bp, Mus musculus
ggtaagaaggctcagcggaacctgc

SEQ ID NO: 333864 - DNA, 25 bp, Mus musculus
ggtaagaccatcaccctggaggtcg

SEQ ID NO: 333865 - DNA, 25 bp, Mus musculus
ggtaagagagatctggagctgctat

SEQ ID NO: 333866 - DNA, 25 bp, Mus musculus
ggtaagagggggcccgtaagctggt

SEQ ID NO: 333867 - DNA, 25 bp, Mus musculus
ggtaagagttgcagctaggacttct

SEQ ID NO: 333868 - DNA, 25 bp, Mus musculus
ggtaagcacacccagaactgagcac

SEQ ID NO: 333869 - DNA, 25 bp, Mus musculus
ggtaagcacacccaggtgccagcct

SEQ ID NO: 333870 - DNA, 25 bp, Mus musculus
ggtaagcacagctctgcccacccca

SEQ ID NO: 333871 - DNA, 25 bp, Mus musculus
ggtaagcacaggatcacgtggccac

SEQ ID NO: 333872 - DNA, 25 bp, Mus musculus
ggtaagcagacagatgagcgttcgg

SEQ ID NO: 333873 - DNA, 25 bp, Mus musculus
ggtaagcgaagagaggaagcgggag

SEQ ID NO: 333874 - DNA, 25 bp, Mus musculus
ggtaaggaaagcagcccatacccag

SEQ ID NO: 333875 - DNA, 25 bp, Mus musculus
ggtaaggagaaggatggcctcaggc

SEQ ID NO: 333876 - DNA, 25 bp, Mus musculus
ggtaaggatggagatcccccaggtc

SEQ ID NO: 333877 - DNA, 25 bp, Mus musculus
ggtaaggtaagatctcaagcataca

SEQ ID NO: 333878 - DNA, 25 bp, Mus musculus
ggtaaggttcccaggatcaccgaca

SEQ ID NO: 333879 - DNA, 25 bp, Mus musculus
ggtaagttcccagcttcttctgtgt

SEQ ID NO: 333880 - DNA, 25 bp, Mus musculus
ggtaatagtcttttacccagtagag

SEQ ID NO: 333881 - DNA, 25 bp, Mus musculus
ggtaatcagaaagggtccccagaag

SEQ ID NO: 333882 - DNA, 25 bp, Mus musculus
ggtaatctgtctaagaatctcctgt

SEQ ID NO: 333883 - DNA, 25 bp, Mus musculus
ggtaatgatgaccattaattaaggc

SEQ ID NO: 333884 - DNA, 25 bp, Mus musculus
ggtaatgattcagagacctgcttct

SEQ ID NO: 333885 - DNA, 25 bp, Mus musculus
ggtaatgattcagatatcctgttag

SEQ ID NO: 333886 - DNA, 25 bp, Mus musculus
ggtaatggaaaaagcaggtttctgg

SEQ ID NO: 333887 - DNA, 25 bp, Mus musculus
ggtaatggaaaaaggtgttcgaatt

SEQ ID NO: 333888 - DNA, 25 bp, Mus musculus
ggtaatggagcccgagttcgtcaac

SEQ ID NO: 333889 - DNA, 25 bp, Mus musculus
ggtaatggaggtgcccctgtgctca

SEQ ID NO: 333890 - DNA, 25 bp, Mus musculus
ggtaatggcaaagggagttttgtgc

SEQ ID NO: 333891 - DNA, 25 bp, Mus musculus
ggtaattacgtggagaggtcaacag

SEQ ID NO: 333892 - DNA, 25 bp, Mus musculus
ggtaattgcgctccagatgaaaatg

SEQ ID NO: 333893 - DNA, 25 bp, Mus musculus
ggtaatttacagtagttgcagtaag

SEQ ID NO: 333894 - DNA, 25 bp, Mus musculus
ggtacaaacagaggatcaataccag

SEQ ID NO: 333895 - DNA, 25 bp, Mus musculus
ggtacaagacaacactgcttatctt

SEQ ID NO: 333896 - DNA, 25 bp, Mus musculus
ggtacaagacgcatgttaatgaaaa

SEQ ID NO: 333897 - DNA, 25 bp, Mus musculus
ggtacaagagggaagaagaagaccg

SEQ ID NO: 333898 - DNA, 25 bp, Mus musculus
ggtacaagcgggcaggtccatggag

SEQ ID NO: 333899 - DNA, 25 bp, Mus musculus
ggtacaaggaaggaaaagatggcat

SEQ ID NO: 333900 - DNA, 25 bp, Mus musculus
ggtacaagggcaagctccagaaagg

SEQ ID NO: 333901 - DNA, 25 bp, Mus musculus
ggtacaccacacagacagaggagtt

SEQ ID NO: 333902 - DNA, 25 bp, Mus musculus
ggtacacctacacaaatgtcccctt

SEQ ID NO: 333903 - DNA, 25 bp, Mus musculus
ggtacactgcagtgctggtgttggc

SEQ ID NO: 333904 - DNA, 25 bp, Mus musculus
ggtacactgtggcaggtgttcttct

SEQ ID NO: 333905 - DNA, 25 bp, Mus musculus
ggtacagaaaaagctcctgccaccc

SEQ ID NO: 333906 - DNA, 25 bp, Mus musculus
ggtacagaatgggataaagatgacc

SEQ ID NO: 333907 - DNA, 25 bp, Mus musculus
ggtacagaatgggatctttttaaag

SEQ ID NO: 333908 - DNA, 25 bp, Mus musculus
ggtacagaatgggctgaaccaataa

SEQ ID NO: 333909 - DNA, 25 bp, Mus musculus
ggtacagaatggggggtcaacagga

SEQ ID NO: 333910 - DNA, 25 bp, Mus musculus
ggtacagaccaggacaaagagaaaa

SEQ ID NO: 333911 - DNA, 25 bp, Mus musculus
ggtacagaccatattaaccagcttc

SEQ ID NO: 333912 - DNA, 25 bp, Mus musculus
ggtacagaccatattgatcagttga

SEQ ID NO: 333913 - DNA, 25 bp, Mus musculus
ggtacagagaccaggtctttggcca

SEQ ID NO: 333914 - DNA, 25 bp, Mus musculus
ggtacagatcatattgatcagtgga

SEQ ID NO: 333915 - DNA, 25 bp, Mus musculus
ggtacagcacaataaaacccaagca

SEQ ID NO: 333916 - DNA, 25 bp, Mus musculus
ggtacagcagaggatgctttcgcag

SEQ ID NO: 333917 - DNA, 25 bp, Mus musculus
ggtacaggagatatgagcaacaaaa

SEQ ID NO: 333918 - DNA, 25 bp, Mus musculus
ggtacaggcaggcaaaggctcgggg

SEQ ID NO: 333919 - DNA, 25 bp, Mus musculus
ggtacaggctcaggaggcctttccc

SEQ ID NO: 333920 - DNA, 25 bp, Mus musculus
ggtacatacctagggatgccctgga

SEQ ID NO: 333921 - DNA, 25 bp, Mus musculus
ggtacatcatcatggaaggcgtcac

SEQ ID NO: 333922 - DNA, 25 bp, Mus musculus
ggtacatctatcagccatggcgagt

SEQ ID NO: 333923 - DNA, 25 bp, Mus musculus
ggtacatgatgcaggtgaagacttt

SEQ ID NO: 333924 - DNA, 25 bp, Mus musculus
ggtacatgcaggtgcatattttcca

SEQ ID NO: 333925 - DNA, 25 bp, Mus musculus
ggtacatggacgacctgcaactttt

SEQ ID NO: 333926 - DNA, 25 bp, Mus musculus
ggtacattcctgagccagtcctaga

SEQ ID NO: 333927 - DNA, 25 bp, Mus musculus
ggtacattcctgagccgggataact

SEQ ID NO: 333928 - DNA, 25 bp, Mus musculus
ggtaccaacggaggtcctgggtggg

SEQ ID NO: 333929 - DNA, 25 bp, Mus musculus
ggtaccaactgtgtaaggagaagct

SEQ ID NO: 333930 - DNA, 25 bp, Mus musculus
ggtaccacacaagattccgcagggc

SEQ ID NO: 333931 - DNA, 25 bp, Mus musculus
ggtaccacacaagggccatcaaaag

SEQ ID NO: 333932 - DNA, 25 bp, Mus musculus
ggtaccacagaatgagagccacgtt

SEQ ID NO: 333933 - DNA, 25 bp, Mus musculus
ggtaccacagagcatttctgaagaa

SEQ ID NO: 333934 - DNA, 25 bp, Mus musculus
ggtaccacaggtaatctagctgcca

SEQ ID NO: 333935 - DNA, 25 bp, Mus musculus
ggtaccagatagaggctgatcttaa

SEQ ID NO: 333936 - DNA, 25 bp, Mus musculus
ggtaccagatagaggtctccctgtg

SEQ ID NO: 333937 - DNA, 25 bp, Mus musculus
ggtaccagttgcggatgagtacagc

SEQ ID NO: 333938 - DNA, 25 bp, Mus musculus
ggtaccataaacagtatggcggctc

SEQ ID NO: 333939 - DNA, 25 bp, Mus musculus
ggtaccatttccaaggccgtgcaga

SEQ ID NO: 333940 - DNA, 25 bp, Mus musculus
ggtacccatgaaactgcatttctag

SEQ ID NO: 333941 - DNA, 25 bp, Mus musculus
ggtaccccaaaagagaatcgcacgt

SEQ ID NO: 333942 - DNA, 25 bp, Mus musculus
ggtaccccacacaagtcaaaggagc

SEQ ID NO: 333943 - DNA, 25 bp, Mus musculus
ggtaccccacacaatgtttagttct

SEQ ID NO: 333944 - DNA, 25 bp, Mus musculus
ggtaccccgctggccctgtccacgg

SEQ ID NO: 333945 - DNA, 25 bp, Mus musculus
ggtaccccgctggctggctttgggt

SEQ ID NO: 333946 - DNA, 25 bp, Mus musculus
ggtaccccgtcggcaatgatggcag

SEQ ID NO: 333947 - DNA, 25 bp, Mus musculus
ggtacccgaggagaaactggaaaca

SEQ ID NO: 333948 - DNA, 25 bp, Mus musculus
ggtacccgaggagaccaaacagtct

SEQ ID NO: 333949 - DNA, 25 bp, Mus musculus
ggtacccgaggagaccaaagaagag

SEQ ID NO: 333950 - DNA, 25 bp, Mus musculus
ggtacccgatagaggtccaggtctg

SEQ ID NO: 333951 - DNA, 25 bp, Mus musculus
ggtaccgaggagggacttcaaaaca

SEQ ID NO: 333952 - DNA, 25 bp, Mus musculus
ggtaccgcaccaagtgtgaggagat

SEQ ID NO: 333953 - DNA, 25 bp, Mus musculus
ggtaccgcagaagttgcagaagctg

SEQ ID NO: 333954 - DNA, 25 bp, Mus musculus
ggtaccgctccgtagggaagacatc

SEQ ID NO: 333955 - DNA, 25 bp, Mus musculus
ggtacctaccaggtgaaacctttgt

SEQ ID NO: 333956 - DNA, 25 bp, Mus musculus
ggtacctacccagcgtccccatgga

SEQ ID NO: 333957 - DNA, 25 bp, Mus musculus
ggtacctgaagatgaaatgtggcaa

SEQ ID NO: 333958 - DNA, 25 bp, Mus musculus
ggtacctgcagcccatacctggatg

SEQ ID NO: 333959 - DNA, 25 bp, Mus musculus
ggtacctgcagtgcctgagacgtaa

SEQ ID NO: 333960 - DNA, 25 bp, Mus musculus
ggtacctgcggctgaaggtgaagac

SEQ ID NO: 333961 - DNA, 25 bp, Mus musculus
ggtacctgctgcccctctcctggga

SEQ ID NO: 333962 - DNA, 25 bp, Mus musculus
ggtacctgctggaaggagcagcggt

SEQ ID NO: 333963 - DNA, 25 bp, Mus musculus
ggtacctgctggaaggtgtgacccc

SEQ ID NO: 333964 - DNA, 25 bp, Mus musculus
ggtacctggatgcctatgctgaaca

SEQ ID NO: 333965 - DNA, 25 bp, Mus musculus
ggtacctgtgctcaggtcgcaggca

SEQ ID NO: 333966 - DNA, 25 bp, Mus musculus
ggtaccttagtataggtgattgaag

SEQ ID NO: 333967 - DNA, 25 bp, Mus musculus
ggtaccttagtataggtgtcctcag

SEQ ID NO: 333968 - DNA, 25 bp, Mus musculus
ggtacgaagcgccctttccgtcaga

SEQ ID NO: 333969 - DNA, 25 bp, Mus musculus
ggtacgatatatcacacagaacccc

SEQ ID NO: 333970 - DNA, 25 bp, Mus musculus
ggtacgcgactcagtaattggcaac

SEQ ID NO: 333971 - DNA, 25 bp, Mus musculus
ggtacgctgcgccaaattttcacct

SEQ ID NO: 333972 - DNA, 25 bp, Mus musculus
ggtacggagctggtgggaggagtga

SEQ ID NO: 333973 - DNA, 25 bp, Mus musculus
ggtacggcctacgagttacaattta

SEQ ID NO: 333974 - DNA, 25 bp, Mus musculus
ggtacgttcaggaggccccatcggt

SEQ ID NO: 333975 - DNA, 25 bp, Mus musculus
ggtacgttcaggggttgtgctgggc

SEQ ID NO: 333976 - DNA, 25 bp, Mus musculus
ggtactaatggatagatgcctgcaa

SEQ ID NO: 333977 - DNA, 25 bp, Mus musculus
ggtactaatgtgccagtattagcat

SEQ ID NO: 333978 - DNA, 25 bp, Mus musculus
ggtactacagtgtctaatgcactac

SEQ ID NO: 333979 - DNA, 25 bp, Mus musculus
ggtactcaaaaaggtctatcctaaa

SEQ ID NO: 333980 - DNA, 25 bp, Mus musculus
ggtactcaagcgagctgcagcgaaa

SEQ ID NO: 333981 - DNA, 25 bp, Mus musculus
ggtactcaaggtaggctgctttggg

SEQ ID NO: 333982 - DNA, 25 bp, Mus musculus
ggtactccaaagtctttggaagcat

SEQ ID NO: 333983 - DNA, 25 bp, Mus musculus
ggtactccaccgaacagtggccaca

SEQ ID NO: 333984 - DNA, 25 bp, Mus musculus
ggtactctcttggacctatatccag

SEQ ID NO: 333985 - DNA, 25 bp, Mus musculus
ggtactgaaggattctccagtgaca

SEQ ID NO: 333986 - DNA, 25 bp, Mus musculus
ggtactgaatcttcagtgagcatgt

SEQ ID NO: 333987 - DNA, 25 bp, Mus musculus
ggtactgccagggaatgaatttcat

SEQ ID NO: 333988 - DNA, 25 bp, Mus musculus
ggtactgccagtgctgcgcacagaa

SEQ ID NO: 333989 - DNA, 25 bp, Mus musculus
ggtactgctgcatgccctgaagcca

SEQ ID NO: 333990 - DNA, 25 bp, Mus musculus
ggtactgcttccggtgtggagaaga

SEQ ID NO: 333991 - DNA, 25 bp, Mus musculus
ggtactggagcagagggtccccagg

SEQ ID NO: 333992 - DNA, 25 bp, Mus musculus
ggtactggcaagagagtgctaacag

SEQ ID NO: 333993 - DNA, 25 bp, Mus musculus
ggtactgtaggtggatagtccaaca

SEQ ID NO: 333994 - DNA, 25 bp, Mus musculus
ggtactgtccgcatgagacactgcc

SEQ ID NO: 333995 - DNA, 25 bp, Mus musculus
ggtactgtcggaccagcagtgccgt

SEQ ID NO: 333996 - DNA, 25 bp, Mus musculus
ggtacttaatgagttccgatctgga

SEQ ID NO: 333997 - DNA, 25 bp, Mus musculus
ggtacttcaatcaagtttttgcagc

SEQ ID NO: 333998 - DNA, 25 bp, Mus musculus
ggtacttcggctgtcccagggctcc

SEQ ID NO: 333999 - DNA, 25 bp, Mus musculus
ggtacttgggaaaaaattatgcttc

SEQ ID NO: 334000 - DNA, 25 bp, Mus musculus
ggtagaaaaaagatgacctcaatgc

SEQ ID NO: 334001 - DNA, 25 bp, Mus musculus
ggtagaaaagagaagcccgtgcttc

SEQ ID NO: 334002 - DNA, 25 bp, Mus musculus
ggtagaaccagacgatggaggctct

SEQ ID NO: 334003 - DNA, 25 bp, Mus musculus
ggtagaacgagccatttattgaaac

SEQ ID NO: 334004 - DNA, 25 bp, Mus musculus
ggtagaagcaacaggcatgacttgc

SEQ ID NO: 334005 - DNA, 25 bp, Mus musculus
ggtagaccagtaacttccctctcac

SEQ ID NO: 334006 - DNA, 25 bp, Mus musculus
ggtagacggggtattgaagggcgtt

SEQ ID NO: 334007 - DNA, 25 bp, Mus musculus
ggtagactgataggactccagagga

SEQ ID NO: 334008 - DNA, 25 bp, Mus musculus
ggtagagaaagaaaccctggccctg

SEQ ID NO: 334009 - DNA, 25 bp, Mus musculus
ggtagagaaggcagaagaatgccag

SEQ ID NO: 334010 - DNA, 25 bp, Mus musculus
ggtagagaagggaccacagtatggg

SEQ ID NO: 334011 - DNA, 25 bp, Mus musculus
ggtagagacacagagaacacactct

SEQ ID NO: 334012 - DNA, 25 bp, Mus musculus
ggtagagacacaggcaccattttaa

SEQ ID NO: 334013 - DNA, 25 bp, Mus musculus
ggtagagacggggccctagctgctg

SEQ ID NO: 334014 - DNA, 25 bp, Mus musculus
ggtagagagaaagggtacagattta

SEQ ID NO: 334015 - DNA, 25 bp, Mus musculus
ggtagagccaaagaacaaattggaa

SEQ ID NO: 334016 - DNA, 25 bp, Mus musculus
ggtagagctgcgcttgtgcactttg

SEQ ID NO: 334017 - DNA, 25 bp, Mus musculus
ggtagagcttgggattttctttgag

SEQ ID NO: 334018 - DNA, 25 bp, Mus musculus
ggtagagcttggggttttatggcaa

SEQ ID NO: 334019 - DNA, 25 bp, Mus musculus
ggtagagcttgggtggtcgttgaag

SEQ ID NO: 334020 - DNA, 25 bp, Mus musculus
ggtagagtcacagaaatcactcaag

SEQ ID NO: 334021 - DNA, 25 bp, Mus musculus
ggtagagtgtgtgggaaagggccga

SEQ ID NO: 334022 - DNA, 25 bp, Mus musculus
ggtagatctagccttttctgattat

SEQ ID NO: 334023 - DNA, 25 bp, Mus musculus
ggtagatctagttacaacctgccat

SEQ ID NO: 334024 - DNA, 25 bp, Mus musculus
ggtagatgcaggagatcccccaaga

SEQ ID NO: 334025 - DNA, 25 bp, Mus musculus
ggtagatgctgagaggaaaaccaag

SEQ ID NO: 334026 - DNA, 25 bp, Mus musculus
ggtagattacgctcacaacaactac

SEQ ID NO: 334027 - DNA, 25 bp, Mus musculus
ggtagattctggtttacaatctagt

SEQ ID NO: 334028 - DNA, 25 bp, Mus musculus
ggtagattgccagagctccacgcag

SEQ ID NO: 334029 - DNA, 25 bp, Mus musculus
ggtagatttgttgaatgacaaagaa

SEQ ID NO: 334030 - DNA, 25 bp, Mus musculus
ggtagcaaagggtgtggaatattat

SEQ ID NO: 334031 - DNA, 25 bp, Mus musculus
ggtagcagacagattgatgacattg

SEQ ID NO: 334032 - DNA, 25 bp, Mus musculus
ggtagcagagcagagagatcaataa

SEQ ID NO: 334033 - DNA, 25 bp, Mus musculus
ggtagcagagcaggggaagcactgc

SEQ ID NO: 334034 - DNA, 25 bp, Mus musculus
ggtagcagatcagatgtggcaggca

SEQ ID NO: 334035 - DNA, 25 bp, Mus musculus
ggtagcagatcaggctcctggagtc

SEQ ID NO: 334036 - DNA, 25 bp, Mus musculus
ggtagccaagctgcttttagaagga

SEQ ID NO: 334037 - DNA, 25 bp, Mus musculus
ggtagccaagcttgaggcggccctg

SEQ ID NO: 334038 - DNA, 25 bp, Mus musculus
ggtagccaattctcccacacagatc

SEQ ID NO: 334039 - DNA, 25 bp, Mus musculus
ggtagcccaggcaagcgcttccagg

SEQ ID NO: 334040 - DNA, 25 bp, Mus musculus
ggtagcccaggccaccatggcagaa

SEQ ID NO: 334041 - DNA, 25 bp, Mus musculus
ggtagccccagaacccatgtgagta

SEQ ID NO: 334042 - DNA, 25 bp, Mus musculus
ggtagccccagaggccttcggacag

SEQ ID NO: 334043 - DNA, 25 bp, Mus musculus
ggtagccccagataaggaatatctt

SEQ ID NO: 334044 - DNA, 25 bp, Mus musculus
ggtagccggagcgatctttgggttc

SEQ ID NO: 334045 - DNA, 25 bp, Mus musculus
ggtagcctcggattccagaggggtg

SEQ ID NO: 334046 - DNA, 25 bp, Mus musculus
ggtagcctctgaggaaagatataaa

SEQ ID NO: 334047 - DNA, 25 bp, Mus musculus
ggtagcctctgagggaactacatga

SEQ ID NO: 334048 - DNA, 25 bp, Mus musculus
ggtagcgaaagaaggtaaaatttat

SEQ ID NO: 334049 - DNA, 25 bp, Mus musculus
ggtagcggtgaacgctgttgctcag

SEQ ID NO: 334050 - DNA, 25 bp, Mus musculus
ggtagcggtgccttctctccgtgga

SEQ ID NO: 334051 - DNA, 25 bp, Mus musculus
ggtagcggtgggtgtcaccgaaggc

SEQ ID NO: 334052 - DNA, 25 bp, Mus musculus
ggtagcggtgtatgtgggatccttt

SEQ ID NO: 334053 - DNA, 25 bp, Mus musculus
ggtagcgtacattgcaaacattaaa

SEQ ID NO: 334054 - DNA, 25 bp, Mus musculus
ggtagctcggtttcttctgggacca

SEQ ID NO: 334055 - DNA, 25 bp, Mus musculus
ggtagctgaagctgaacctgagcca

SEQ ID NO: 334056 - DNA, 25 bp, Mus musculus
ggtaggaaagagaaaatccctgaga

SEQ ID NO: 334057 - DNA, 25 bp, Mus musculus
ggtaggaaaggtccagcaagactag

SEQ ID NO: 334058 - DNA, 25 bp, Mus musculus
ggtaggaagaagccattgctcctgt

SEQ ID NO: 334059 - DNA, 25 bp, Mus musculus
ggtaggagacacaggtgacaaactt

SEQ ID NO: 334060 - DNA, 25 bp, Mus musculus
ggtaggagacacaggttttggctat

SEQ ID NO: 334061 - DNA, 25 bp, Mus musculus
ggtaggcaaaggtggaggaagagct

SEQ ID NO: 334062 - DNA, 25 bp, Mus musculus
ggtaggcctcgggacggcctcagga

SEQ ID NO: 334063 - DNA, 25 bp, Mus musculus
ggtaggctcagagtgcgatgcggtg

SEQ ID NO: 334064 - DNA, 25 bp, Mus musculus
ggtaggctcagagttcgaggaagcc

SEQ ID NO: 334065 - DNA, 25 bp, Mus musculus
ggtagggtggcggggccctccatga

SEQ ID NO: 334066 - DNA, 25 bp, Mus musculus
ggtaggtgcgcccaggccaaacagt

SEQ ID NO: 334067 - DNA, 25 bp, Mus musculus
ggtaggtggagtattggcttccctt

SEQ ID NO: 334068 - DNA, 25 bp, Mus musculus
ggtagtaaaatggaaggtgtcttgc

SEQ ID NO: 334069 - DNA, 25 bp, Mus musculus
ggtagtagatgtcccatattatgaa

SEQ ID NO: 334070 - DNA, 25 bp, Mus musculus
ggtagtagctcctggtttgcttact

SEQ ID NO: 334071 - DNA, 25 bp, Mus musculus
ggtagtcactgactgtatccaggtg

SEQ ID NO: 334072 - DNA, 25 bp, Mus musculus
ggtagtcctccatgatcgtcctgct

SEQ ID NO: 334073 - DNA, 25 bp, Mus musculus
ggtagtctctgcaagtggccctgcc

SEQ ID NO: 334074 - DNA, 25 bp, Mus musculus
ggtagtgatcaggagaataatgttt

SEQ ID NO: 334075 - DNA, 25 bp, Mus musculus
ggtagtgattgtaagaatgaagata

SEQ ID NO: 334076 - DNA, 25 bp, Mus musculus
ggtagtgattgtaatctactttttt

SEQ ID NO: 334077 - DNA, 25 bp, Mus musculus
ggtagtgcaaggtggagtgtcatct

SEQ ID NO: 334078 - DNA, 25 bp, Mus musculus
ggtagtgtactgtgaccgtgataca

SEQ ID NO: 334079 - DNA, 25 bp, Mus musculus
ggtagttaaagagggctgtcctggc

SEQ ID NO: 334080 - DNA, 25 bp, Mus musculus
ggtagttacagccaacggtaacgat

SEQ ID NO: 334081 - DNA, 25 bp, Mus musculus
ggtagttacaggtcataaaaggatg

SEQ ID NO: 334082 - DNA, 25 bp, Mus musculus
ggtataaaagcttatgcactggact

SEQ ID NO: 334083 - DNA, 25 bp, Mus musculus
ggtataaagtaactctaaatcttca

SEQ ID NO: 334084 - DNA, 25 bp, Mus musculus
ggtataacaagactacaatgcttct

SEQ ID NO: 334085 - DNA, 25 bp, Mus musculus
ggtataatggcctcggccctgcgaa

SEQ ID NO: 334086 - DNA, 25 bp, Mus musculus
ggtatacaccaggcatccacatggt

SEQ ID NO: 334087 - DNA, 25 bp, Mus musculus
ggtatacagatcagagaaaatatgg

SEQ ID NO: 334088 - DNA, 25 bp, Mus musculus
ggtatacaggaggataccagatgtt

SEQ ID NO: 334089 - DNA, 25 bp, Mus musculus
ggtatacaggagtacttatgtggta

SEQ ID NO: 334090 - DNA, 25 bp, Mus musculus
ggtatatgactcaattctacggtga

SEQ ID NO: 334091 - DNA, 25 bp, Mus musculus
ggtatcaactgtgtaaggagaagct

SEQ ID NO: 334092 - DNA, 25 bp, Mus musculus
ggtatcaagagtcagacgaaggaag

SEQ ID NO: 334093 - DNA, 25 bp, Mus musculus
ggtatcaattcaggaggaaacagtt

SEQ ID NO: 334094 - DNA, 25 bp, Mus musculus
ggtatcagaagaagattggagcata

SEQ ID NO: 334095 - DNA, 25 bp, Mus musculus
ggtatcagaagaagattggagccta

SEQ ID NO: 334096 - DNA, 25 bp, Mus musculus
ggtatcagaagaagggtttcaaaaa

SEQ ID NO: 334097 - DNA, 25 bp, Mus musculus
ggtatcagaagaaggtcaaagaagg

SEQ ID NO: 334098 - DNA, 25 bp, Mus musculus
ggtatcagaaggttggaggctgctg

SEQ ID NO: 334099 - DNA, 25 bp, Mus musculus
ggtatcatgggtataggtccagtcc

SEQ ID NO: 334100 - DNA, 25 bp, Mus musculus
ggtatccaaagcggctggagaagga

SEQ ID NO: 334101 - DNA, 25 bp, Mus musculus
ggtatccacatgggtctcctggaag

SEQ ID NO: 334102 - DNA, 25 bp, Mus musculus
ggtatccacgcctgaggtcctggtg

SEQ ID NO: 334103 - DNA, 25 bp, Mus musculus
ggtatccatgcggctgtgtggagat

SEQ ID NO: 334104 - DNA, 25 bp, Mus musculus
ggtatccttggggcactgcgtgact

SEQ ID NO: 334105 - DNA, 25 bp, Mus musculus
ggtatcgacaggtacaatcctgaga

SEQ ID NO: 334106 - DNA, 25 bp, Mus musculus
ggtatcgacaggtaccagttcaacc

SEQ ID NO: 334107 - DNA, 25 bp, Mus musculus
ggtatcgccccctggcaggtgatgc

SEQ ID NO: 334108 - DNA, 25 bp, Mus musculus
ggtatcggattcacaaataaagtgg

SEQ ID NO: 334109 - DNA, 25 bp, Mus musculus
ggtatcggggggagtacaaggacaa

SEQ ID NO: 334110 - DNA, 25 bp, Mus musculus
ggtatctacggcagaaaggggagtg

SEQ ID NO: 334111 - DNA, 25 bp, Mus musculus
ggtatctacggcagtacatttttat

SEQ ID NO: 334112 - DNA, 25 bp, Mus musculus
ggtatctctgaagcactgcgcaaga

SEQ ID NO: 334113 - DNA, 25 bp, Mus musculus
ggtatctgaagacgctcatgatccg

SEQ ID NO: 334114 - DNA, 25 bp, Mus musculus
ggtatctgtgaagcttcttaacccc

SEQ ID NO: 334115 - DNA, 25 bp, Mus musculus
ggtatcttcgaaccaagtatcaggg

SEQ ID NO: 334116 - DNA, 25 bp, Mus musculus
ggtatcttgatgtcagcccatcaca

SEQ ID NO: 334117 - DNA, 25 bp, Mus musculus
ggtatgagagggagcttcgttacga

SEQ ID NO: 334118 - DNA, 25 bp, Mus musculus
ggtatgagagggaggtctgggacat

SEQ ID NO: 334119 - DNA, 25 bp, Mus musculus
ggtatgagtggcccaggatgggtga

SEQ ID NO: 334120 - DNA, 25 bp, Mus musculus
ggtatgcagaggttaaggagctccg

SEQ ID NO: 334121 - DNA, 25 bp, Mus musculus
ggtatgcatgcggtctcccactgct

SEQ ID NO: 334122 - DNA, 25 bp, Mus musculus
ggtatgcatgcggtgtgagcatcta

SEQ ID NO: 334123 - DNA, 25 bp, Mus musculus
ggtatgccaaacagcagttattcaa

SEQ ID NO: 334124 - DNA, 25 bp, Mus musculus
ggtatgcctttccattggacacccc

SEQ ID NO: 334125 - DNA, 25 bp, Mus musculus
ggtatgctgtagtagtgactctctt

SEQ ID NO: 334126 - DNA, 25 bp, Mus musculus
ggtatggagaggtgtcatcaataaa

SEQ ID NO: 334127 - DNA, 25 bp, Mus musculus
ggtatggaggagaaaccaaggtata

SEQ ID NO: 334128 - DNA, 25 bp, Mus musculus
ggtatggctttttatttagaagaaa

SEQ ID NO: 334129 - DNA, 25 bp, Mus musculus
ggtatgggagaacagaacactgaaa

SEQ ID NO: 334130 - DNA, 25 bp, Mus musculus
ggtatgggattccaggagaaccaca

SEQ ID NO: 334131 - DNA, 25 bp, Mus musculus
ggtatgttccaggattgaaccagct

SEQ ID NO: 334132 - DNA, 25 bp, Mus musculus
ggtattactgactgcagcaccacag

SEQ ID NO: 334133 - DNA, 25 bp, Mus musculus
ggtattcaaacacatagacatttta

SEQ ID NO: 334134 - DNA, 25 bp, Mus musculus
ggtattcatgcaggtccacgcctca

SEQ ID NO: 334135 - DNA, 25 bp, Mus musculus
ggtattcatgccaggactactgttg

SEQ ID NO: 334136 - DNA, 25 bp, Mus musculus
ggtattccaggaatcatggcccaag

SEQ ID NO: 334137 - DNA, 25 bp, Mus musculus
ggtattcctcagacagtaaagactg

SEQ ID NO: 334138 - DNA, 25 bp, Mus musculus
ggtattcctcagcttatggctatta

SEQ ID NO: 334139 - DNA, 25 bp, Mus musculus
ggtattcctcaggttatggctatta

SEQ ID NO: 334140 - DNA, 25 bp, Mus musculus
ggtattgatgatgtgcctgatgaca

SEQ ID NO: 334141 - DNA, 25 bp, Mus musculus
ggtattggcgtgagcggaggctgct

SEQ ID NO: 334142 - DNA, 25 bp, Mus musculus
ggtattggtaagttccctgctatca

SEQ ID NO: 334143 - DNA, 25 bp, Mus musculus
ggtatttcagggattctcctgatga

SEQ ID NO: 334144 - DNA, 25 bp, Mus musculus
ggtatttccaatcccgctcaaggtc

SEQ ID NO: 334145 - DNA, 25 bp, Mus musculus
ggtatttgagaggtagtgatttaat

SEQ ID NO: 334146 - DNA, 25 bp, Mus musculus
ggtatttttaggctgttcatttaga

SEQ ID NO: 334147 - DNA, 25 bp, Mus musculus
ggtcaaaagaaagaattcctgagac

SEQ ID NO: 334148 - DNA, 25 bp, Mus musculus
ggtcaaacatttatggtgaagtatt

SEQ ID NO: 334149 - DNA, 25 bp, Mus musculus
ggtcaaagacagcggcattgactcg

SEQ ID NO: 334150 - DNA, 25 bp, Mus musculus
ggtcaaagcactccactcatcagtt

SEQ ID NO: 334151 - DNA, 25 bp, Mus musculus
ggtcaaagcattcctcaaccacccc

SEQ ID NO: 334152 - DNA, 25 bp, Mus musculus
ggtcaaagccatctgtccctcaatt

SEQ ID NO: 334153 - DNA, 25 bp, Mus musculus
ggtcaaatctcagagccccaaggac

SEQ ID NO: 334154 - DNA, 25 bp, Mus musculus
ggtcaacacaaaacacagatactga

SEQ ID NO: 334155 - DNA, 25 bp, Mus musculus
ggtcaacacaggtcttctgacgctt

SEQ ID NO: 334156 - DNA, 25 bp, Mus musculus
ggtcaacacataacacagatactga

SEQ ID NO: 334157 - DNA, 25 bp, Mus musculus
ggtcaaccagggaaaatgccaagtg

SEQ ID NO: 334158 - DNA, 25 bp, Mus musculus
ggtcaacgagcctggtgccttctgg

SEQ ID NO: 334159 - DNA, 25 bp, Mus musculus
ggtcaacggctggacctgtttacac

SEQ ID NO: 334160 - DNA, 25 bp, Mus musculus
ggtcaactgtgcaggctatgtggtg

SEQ ID NO: 334161 - DNA, 25 bp, Mus musculus
ggtcaactgtgcaggtgacagtaac

SEQ ID NO: 334162 - DNA, 25 bp, Mus musculus
ggtcaagaacagcatgggtacacaa

SEQ ID NO: 334163 - DNA, 25 bp, Mus musculus
ggtcaagaccagcaggctagatatg

SEQ ID NO: 334164 - DNA, 25 bp, Mus musculus
ggtcaagaccagcaggttacagtcg

SEQ ID NO: 334165 - DNA, 25 bp, Mus musculus
ggtcaagcaagtgcaaagaaacgat

SEQ ID NO: 334166 - DNA, 25 bp, Mus musculus
ggtcaagccacagagcccaagatga

SEQ ID NO: 334167 - DNA, 25 bp, Mus musculus
ggtcaaggaaaacaaattgatgatg

SEQ ID NO: 334168 - DNA, 25 bp, Mus musculus
ggtcaaggaaatggtggctgcgttg

SEQ ID NO: 334169 - DNA, 25 bp, Mus musculus
ggtcaaggcaccaatgaggaaacaa

SEQ ID NO: 334170 - DNA, 25 bp, Mus musculus
ggtcaaggcagcaatgaggaaacaa

SEQ ID NO: 334171 - DNA, 25 bp, Mus musculus
ggtcaaggcggagccagatgttaaa

SEQ ID NO: 334172 - DNA, 25 bp, Mus musculus
ggtcaagtcacaagctcctcaggat

SEQ ID NO: 334173 - DNA, 25 bp, Mus musculus
ggtcaagtcacaaggacaaagtata

SEQ ID NO: 334174 - DNA, 25 bp, Mus musculus
ggtcaagtcagtaggacaaagtata

SEQ ID NO: 334175 - DNA, 25 bp, Mus musculus
ggtcaagtttataagggtcgtcatg

SEQ ID NO: 334176 - DNA, 25 bp, Mus musculus
ggtcaataaggctgtggctctggat

SEQ ID NO: 334177 - DNA, 25 bp, Mus musculus
ggtcaatagggtacacctggtgagc

SEQ ID NO: 334178 - DNA, 25 bp, Mus musculus
ggtcaatgacaaatcaggacctttg

SEQ ID NO: 334179 - DNA, 25 bp, Mus musculus
ggtcaatgaggaagtaagtgcaaaa

SEQ ID NO: 334180 - DNA, 25 bp, Mus musculus
ggtcaatgaggtggacatggaaggc

SEQ ID NO: 334181 - DNA, 25 bp, Mus musculus
ggtcaatgggaagtcattcagctgg

SEQ ID NO: 334182 - DNA, 25 bp, Mus musculus
ggtcaattatgaagagtttgtacag

SEQ ID NO: 334183 - DNA, 25 bp, Mus musculus
ggtcacaaacttaatctagagaagc

SEQ ID NO: 334184 - DNA, 25 bp, Mus musculus
ggtcacaaccaaaaatactgaagca

SEQ ID NO: 334185 - DNA, 25 bp, Mus musculus
ggtcacaatcaggttgactcttcac

SEQ ID NO: 334186 - DNA, 25 bp, Mus musculus
ggtcacacaaagaaacaggtatgtg

SEQ ID NO: 334187 - DNA, 25 bp, Mus musculus
ggtcacacaaaggtatgtgatgata

SEQ ID NO: 334188 - DNA, 25 bp, Mus musculus
ggtcacacagggctcgcttgcctgt

SEQ ID NO: 334189 - DNA, 25 bp, Mus musculus
ggtcacaccgaggatgcgtccgaag

SEQ ID NO: 334190 - DNA, 25 bp, Mus musculus
ggtcacactcacgataaaagctggc

SEQ ID NO: 334191 - DNA, 25 bp, Mus musculus
ggtcacaggcaccagtcttggagga

SEQ ID NO: 334192 - DNA, 25 bp, Mus musculus
ggtcacataccaggggctgcgatgg

SEQ ID NO: 334193 - DNA, 25 bp, Mus musculus
ggtcaccaacagtcagcgtgggaga

SEQ ID NO: 334194 - DNA, 25 bp, Mus musculus
ggtcacccacaaggtggagaaatgg

SEQ ID NO: 334195 - DNA, 25 bp, Mus musculus
ggtcacccaggtcctgtccttggga

SEQ ID NO: 334196 - DNA, 25 bp, Mus musculus
ggtcacccctggccctgaaggcagc

SEQ ID NO: 334197 - DNA, 25 bp, Mus musculus
ggtcaccctcacagaacatctaact

SEQ ID NO: 334198 - DNA, 25 bp, Mus musculus
ggtcaccgcttcatgtttctctgcc

SEQ ID NO: 334199 - DNA, 25 bp, Mus musculus
ggtcaccgtcagtcagatcccattg

SEQ ID NO: 334200 - DNA, 25 bp, Mus musculus
ggtcacctctaggtcattttacctg

SEQ ID NO: 334201 - DNA, 25 bp, Mus musculus
ggtcacctctggaagcaaagctgct

SEQ ID NO: 334202 - DNA, 25 bp, Mus musculus
ggtcacctctggggcccaggatgat

SEQ ID NO: 334203 - DNA, 25 bp, Mus musculus
ggtcacctctgttggcgaatgccct

SEQ ID NO: 334204 - DNA, 25 bp, Mus musculus
ggtcacctgagcaagttgttgggct

SEQ ID NO: 334205 - DNA, 25 bp, Mus musculus
ggtcacctgcagatactttatgcat

SEQ ID NO: 334206 - DNA, 25 bp, Mus musculus
ggtcacgtaagcagagagtggctga

SEQ ID NO: 334207 - DNA, 25 bp, Mus musculus
ggtcacgtaagcagggtcttgacaa

SEQ ID NO: 334208 - DNA, 25 bp, Mus musculus
ggtcacgtaagcagggtcttggaga

SEQ ID NO: 334209 - DNA, 25 bp, Mus musculus
ggtcactacagtgacagagattggc

SEQ ID NO: 334210 - DNA, 25 bp, Mus musculus
ggtcactaggggcttcagaagagcg

SEQ ID NO: 334211 - DNA, 25 bp, Mus musculus
ggtcactatgagtgaaacatctttc

SEQ ID NO: 334212 - DNA, 25 bp, Mus musculus
ggtcactatggtgataaagttacaa

SEQ ID NO: 334213 - DNA, 25 bp, Mus musculus
ggtcactcagctcacagtggtacca

SEQ ID NO: 334214 - DNA, 25 bp, Mus musculus
ggtcactcgtgcagcgactgcagga

SEQ ID NO: 334215 - DNA, 25 bp, Mus musculus
ggtcactcgtgcagctcagagagcc

SEQ ID NO: 334216 - DNA, 25 bp, Mus musculus
ggtcactcgtgcagtgccaccgtgc

SEQ ID NO: 334217 - DNA, 25 bp, Mus musculus
ggtcactctaaccggtcatttggca

SEQ ID NO: 334218 - DNA, 25 bp, Mus musculus
ggtcactgaacaggttgctccagga

SEQ ID NO: 334219 - DNA, 25 bp, Mus musculus
ggtcactgagcctctgcaggtgtca

SEQ ID NO: 334220 - DNA, 25 bp, Mus musculus
ggtcactgaggtactggcggaggac

SEQ ID NO: 334221 - DNA, 25 bp, Mus musculus
ggtcactgcgacccccagcccagta

SEQ ID NO: 334222 - DNA, 25 bp, Mus musculus
ggtcactggacgagaggatggctgt

SEQ ID NO: 334223 - DNA, 25 bp, Mus musculus
ggtcactggacgagtccgttagatc

SEQ ID NO: 334224 - DNA, 25 bp, Mus musculus
ggtcactgtgactccagctccgtcc

SEQ ID NO: 334225 - DNA, 25 bp, Mus musculus
ggtcactgtgcagctcattctcttt

SEQ ID NO: 334226 - DNA, 25 bp, Mus musculus
ggtcactgtgcagttccgctcgctg

SEQ ID NO: 334227 - DNA, 25 bp, Mus musculus
ggtcacttgccagctcctgtgcggc

SEQ ID NO: 334228 - DNA, 25 bp, Mus musculus
ggtcacttggccttgatgaagaaca

SEQ ID NO: 334229 - DNA, 25 bp, Mus musculus
ggtcacttgggcatgatccagagca

SEQ ID NO: 334230 - DNA, 25 bp, Mus musculus
ggtcacttgggcatgctttggtggc

SEQ ID NO: 334231 - DNA, 25 bp, Mus musculus
ggtcacttttactgtataagtcttg

SEQ ID NO: 334232 - DNA, 25 bp, Mus musculus
ggtcagaaaccgtggatgatgaaaa

SEQ ID NO: 334233 - DNA, 25 bp, Mus musculus
ggtcagaaagataaggtgaccatag

SEQ ID NO: 334234 - DNA, 25 bp, Mus musculus
ggtcagaaagcctctccgaccagtc

SEQ ID NO: 334235 - DNA, 25 bp, Mus musculus
ggtcagaagagggggacctacacac

SEQ ID NO: 334236 - DNA, 25 bp, Mus musculus
ggtcagacagcgtcatcatgacagg

SEQ ID NO: 334237 - DNA, 25 bp, Mus musculus
ggtcagacaggcaagggctcattac

SEQ ID NO: 334238 - DNA, 25 bp, Mus musculus
ggtcagaccatacagtcgtttaccc

SEQ ID NO: 334239 - DNA, 25 bp, Mus musculus
ggtcagactgaggcaccaagtatag

SEQ ID NO: 334240 - DNA, 25 bp, Mus musculus
ggtcagagaaagatatgctggcatc

SEQ ID NO: 334241 - DNA, 25 bp, Mus musculus
ggtcagagaaagatatggcagtgaa

SEQ ID NO: 334242 - DNA, 25 bp, Mus musculus
ggtcagagaaagatgtgcactaggc

SEQ ID NO: 334243 - DNA, 25 bp, Mus musculus
ggtcagagaggtgctggtaactcaa

SEQ ID NO: 334244 - DNA, 25 bp, Mus musculus
ggtcagagcagcagattttccaccc

SEQ ID NO: 334245 - DNA, 25 bp, Mus musculus
ggtcagagcctcagaattgctcagc

SEQ ID NO: 334246 - DNA, 25 bp, Mus musculus
ggtcagagcctcagggggcctgtgg

SEQ ID NO: 334247 - DNA, 25 bp, Mus musculus
ggtcagagggacctctgttctcctc

SEQ ID NO: 334248 - DNA, 25 bp, Mus musculus
ggtcagagtccggggaaaacagtaa

SEQ ID NO: 334249 - DNA, 25 bp, Mus musculus
ggtcagagtcggagtcttattttag

SEQ ID NO: 334250 - DNA, 25 bp, Mus musculus
ggtcagatccatagggatttgaaag

SEQ ID NO: 334251 - DNA, 25 bp, Mus musculus
ggtcagatctggcactcgctcccac

SEQ ID NO: 334252 - DNA, 25 bp, Mus musculus
ggtcagatctgtcagtggtgcagtc

SEQ ID NO: 334253 - DNA, 25 bp, Mus musculus
ggtcagatgagggtacgggcgcttt

SEQ ID NO: 334254 - DNA, 25 bp, Mus musculus
ggtcagattgaaggtcagatgtacc

SEQ ID NO: 334255 - DNA, 25 bp, Mus musculus
ggtcagcaatggggctggagagatg

SEQ ID NO: 334256 - DNA, 25 bp, Mus musculus
ggtcagcaatgggttcagacctcga

SEQ ID NO: 334257 - DNA, 25 bp, Mus musculus
ggtcagcatgattcgattcttgaac

SEQ ID NO: 334258 - DNA, 25 bp, Mus musculus
ggtcagccaaatggtgttgtgtgaa

SEQ ID NO: 334259 - DNA, 25 bp, Mus musculus
ggtcagccaaatgtctttctgtaac

SEQ ID NO: 334260 - DNA, 25 bp, Mus musculus
ggtcagccaaattgaggatgccatg

SEQ ID NO: 334261 - DNA, 25 bp, Mus musculus
ggtcagccacagctgttctagctga

SEQ ID NO: 334262 - DNA, 25 bp, Mus musculus
ggtcagccgaaagtttaagaggcga

SEQ ID NO: 334263 - DNA, 25 bp, Mus musculus
ggtcagccgggatcaactgcacttg

SEQ ID NO: 334264 - DNA, 25 bp, Mus musculus
ggtcagccggttttttcattaggat

SEQ ID NO: 334265 - DNA, 25 bp, Mus musculus
ggtcagcgaggtattgaagcccctg

SEQ ID NO: 334266 - DNA, 25 bp, Mus musculus
ggtcagcggaggggtatctgctata

SEQ ID NO: 334267 - DNA, 25 bp, Mus musculus
ggtcagcgtctgggaaagaagaggt

SEQ ID NO: 334268 - DNA, 25 bp, Mus musculus
ggtcagctaaccaaggaagggatgc

SEQ ID NO: 334269 - DNA, 25 bp, Mus musculus
ggtcagctaaccaaggtttgcccac

SEQ ID NO: 334270 - DNA, 25 bp, Mus musculus
ggtcagcttcggtttgctgccaaac

SEQ ID NO: 334271 - DNA, 25 bp, Mus musculus
ggtcagctttgaacgctgtgtgaga

SEQ ID NO: 334272 - DNA, 25 bp, Mus musculus
ggtcaggaaaattggaacaatccac

SEQ ID NO: 334273 - DNA, 25 bp, Mus musculus
ggtcaggaaagaatccaccttgaca

SEQ ID NO: 334274 - DNA, 25 bp, Mus musculus
ggtcaggaaatgagtccacagatga

SEQ ID NO: 334275 - DNA, 25 bp, Mus musculus
ggtcaggaagattgtcttagcaaca

SEQ ID NO: 334276 - DNA, 25 bp, Mus musculus
ggtcaggacgatgagcgaggctgct

SEQ ID NO: 334277 - DNA, 25 bp, Mus musculus
ggtcaggagagaaggattggaagaa

SEQ ID NO: 334278 - DNA, 25 bp, Mus musculus
ggtcaggagagaaggcattggaaga

SEQ ID NO: 334279 - DNA, 25 bp, Mus musculus
ggtcaggagtttgggttaatatttg

SEQ ID NO: 334280 - DNA, 25 bp, Mus musculus
ggtcaggatccccaggctgcccttg

SEQ ID NO: 334281 - DNA, 25 bp, Mus musculus
ggtcaggatgccacgaaagcgctaa

SEQ ID NO: 334282 - DNA, 25 bp, Mus musculus
ggtcaggatgccacggatccttttg

SEQ ID NO: 334283 - DNA, 25 bp, Mus musculus
ggtcaggatggccaggtactgcagg

SEQ ID NO: 334284 - DNA, 25 bp, Mus musculus
ggtcaggatggccagtcgtggggcc

SEQ ID NO: 334285 - DNA, 25 bp, Mus musculus
ggtcaggcaaggcagtccctcgaga

SEQ ID NO: 334286 - DNA, 25 bp, Mus musculus
ggtcaggccaagacatgcccggaac

SEQ ID NO: 334287 - DNA, 25 bp, Mus musculus
ggtcaggccaagacgcccacagatt

SEQ ID NO: 334288 - DNA, 25 bp, Mus musculus
ggtcaggccaagactaaggggtccc

SEQ ID NO: 334289 - DNA, 25 bp, Mus musculus
ggtcaggctccttccgatgagcccc

SEQ ID NO: 334290 - DNA, 25 bp, Mus musculus
ggtcaggctcggaagaaattgataa

SEQ ID NO: 334291 - DNA, 25 bp, Mus musculus
ggtcagggcagggataatcttaagc

SEQ ID NO: 334292 - DNA, 25 bp, Mus musculus
ggtcagggccagggattctgggcac

SEQ ID NO: 334293 - DNA, 25 bp, Mus musculus
ggtcagggccaggtgtctccagtgc

SEQ ID NO: 334294 - DNA, 25 bp, Mus musculus
ggtcaggggattgattatgagaaga

SEQ ID NO: 334295 - DNA, 25 bp, Mus musculus
ggtcaggggggaggacctgtgtcat

SEQ ID NO: 334296 - DNA, 25 bp, Mus musculus
ggtcagggtgcacaggaaatactgg

SEQ ID NO: 334297 - DNA, 25 bp, Mus musculus
ggtcaggtaaaacatcagagagagg

SEQ ID NO: 334298 - DNA, 25 bp, Mus musculus
ggtcaggtgagcagattgatgatgt

SEQ ID NO: 334299 - DNA, 25 bp, Mus musculus
ggtcaggtgcaaaatggaacactgt

SEQ ID NO: 334300 - DNA, 25 bp, Mus musculus
ggtcaggtgcaagtgcagaatggaa

SEQ ID NO: 334301 - DNA, 25 bp, Mus musculus
ggtcagtaagggggtccaaggctgc

SEQ ID NO: 334302 - DNA, 25 bp, Mus musculus
ggtcagtcaacacagtgttcaagaa

SEQ ID NO: 334303 - DNA, 25 bp, Mus musculus
ggtcagtcaggacttgctagacctg

SEQ ID NO: 334304 - DNA, 25 bp, Mus musculus
ggtcagtcattgggaagactcttca

SEQ ID NO: 334305 - DNA, 25 bp, Mus musculus
ggtcagtcctgggctgggccgtcgg

SEQ ID NO: 334306 - DNA, 25 bp, Mus musculus
ggtcagtctctgcaggttcaggggc

SEQ ID NO: 334307 - DNA, 25 bp, Mus musculus
ggtcagtgtctccctccaagccaca

SEQ ID NO: 334308 - DNA, 25 bp, Mus musculus
ggtcagtgttggtttcaacctcttg

SEQ ID NO: 334309 - DNA, 25 bp, Mus musculus
ggtcagtttatcaaagtcatgtagg

SEQ ID NO: 334310 - DNA, 25 bp, Mus musculus
ggtcagtttttttgcattttgttcc

SEQ ID NO: 334311 - DNA, 25 bp, Mus musculus
ggtcataaaggttccagatgatgac

SEQ ID NO: 334312 - DNA, 25 bp, Mus musculus
ggtcataaatacaaaacctgggcat

SEQ ID NO: 334313 - DNA, 25 bp, Mus musculus
ggtcataaggaccaggatacaaatt

SEQ ID NO: 334314 - DNA, 25 bp, Mus musculus
ggtcataccaggtaatatccttgtt

SEQ ID NO: 334315 - DNA, 25 bp, Mus musculus
ggtcatagcagggtgttcttctgga

SEQ ID NO: 334316 - DNA, 25 bp, Mus musculus
ggtcatataagtgacattgaaactg

SEQ ID NO: 334317 - DNA, 25 bp, Mus musculus
ggtcatataatgtcatatttgaaga

SEQ ID NO: 334318 - DNA, 25 bp, Mus musculus
ggtcatcaacacagactttcctgcc

SEQ ID NO: 334319 - DNA, 25 bp, Mus musculus
ggtcatcaacaggctctccttttta

SEQ ID NO: 334320 - DNA, 25 bp, Mus musculus
ggtcatcaagatgaacaggatgtcc

SEQ ID NO: 334321 - DNA, 25 bp, Mus musculus
ggtcatcaagcagtgctatcaagat

SEQ ID NO: 334322 - DNA, 25 bp, Mus musculus
ggtcatcaaggacttcccatggatc

SEQ ID NO: 334323 - DNA, 25 bp, Mus musculus
ggtcatcaagggtcacgtgattacc

SEQ ID NO: 334324 - DNA, 25 bp, Mus musculus
ggtcatcaagtcaggctcagatgag

SEQ ID NO: 334325 - DNA, 25 bp, Mus musculus
ggtcatcaccaccggcgcctgtttt

SEQ ID NO: 334326 - DNA, 25 bp, Mus musculus
ggtcatcaccggggcttgcgacaag

SEQ ID NO: 334327 - DNA, 25 bp, Mus musculus
ggtcatcaccggggttccattttgg

SEQ ID NO: 334328 - DNA, 25 bp, Mus musculus
ggtcatcccccacgctgacagccct

SEQ ID NO: 334329 - DNA, 25 bp, Mus musculus
ggtcatcccgtactcactggcctac

SEQ ID NO: 334330 - DNA, 25 bp, Mus musculus
ggtcatccctaaaggtgtcataagc

SEQ ID NO: 334331 - DNA, 25 bp, Mus musculus
ggtcatcctcttctatgcggcaggc

SEQ ID NO: 334332 - DNA, 25 bp, Mus musculus
ggtcatcctcttctgagcattccgg

SEQ ID NO: 334333 - DNA, 25 bp, Mus musculus
ggtcatcctttgttgatggtattgc

SEQ ID NO: 334334 - DNA, 25 bp, Mus musculus
ggtcatcgacaatgagcaccggggg

SEQ ID NO: 334335 - DNA, 25 bp, Mus musculus
ggtcatcgacaatggttcaggggtg

SEQ ID NO: 334336 - DNA, 25 bp, Mus musculus
ggtcatcgaggtcttccagaaacgg

SEQ ID NO: 334337 - DNA, 25 bp, Mus musculus
ggtcatctgagggaaagccacccac

SEQ ID NO: 334338 - DNA, 25 bp, Mus musculus
ggtcatctgcaaacagaagcgatgt

SEQ ID NO: 334339 - DNA, 25 bp, Mus musculus
ggtcatcttaagaaagaggaagcag

SEQ ID NO: 334340 - DNA, 25 bp, Mus musculus
ggtcatgaagaagcagaattctaaa

SEQ ID NO: 334341 - DNA, 25 bp, Mus musculus
ggtcatgaagacatgtttaaaaagg

SEQ ID NO: 334342 - DNA, 25 bp, Mus musculus
ggtcatgaaggcatttgagcactta

SEQ ID NO: 334343 - DNA, 25 bp, Mus musculus
ggtcatgacactgaacctgcagcca

SEQ ID NO: 334344 - DNA, 25 bp, Mus musculus
ggtcatgaccaatggctggaagcta

SEQ ID NO: 334345 - DNA, 25 bp, Mus musculus
ggtcatgactgccatttgcttcaca

SEQ ID NO: 334346 - DNA, 25 bp, Mus musculus
ggtcatgactggggtgatctgcttt

SEQ ID NO: 334347 - DNA, 25 bp, Mus musculus
ggtcatgagaggagaaagagtcctg

SEQ ID NO: 334348 - DNA, 25 bp, Mus musculus
ggtcatgagaggagggcaggttttg

SEQ ID NO: 334349 - DNA, 25 bp, Mus musculus
ggtcatgcagccctcaggaagagac

SEQ ID NO: 334350 - DNA, 25 bp, Mus musculus
ggtcatgctcaaggacatggcagac

SEQ ID NO: 334351 - DNA, 25 bp, Mus musculus
ggtcatgctgaatgctaggtagaag

SEQ ID NO: 334352 - DNA, 25 bp, Mus musculus
ggtcatggaaatatgggcttaggtc

SEQ ID NO: 334353 - DNA, 25 bp, Mus musculus
ggtcatgggatggctgcactgccca

SEQ ID NO: 334354 - DNA, 25 bp, Mus musculus
ggtcatggtgtgaggggtcccacag

SEQ ID NO: 334355 - DNA, 25 bp, Mus musculus
ggtcatgtattccagcatccagaat

SEQ ID NO: 334356 - DNA, 25 bp, Mus musculus
ggtcatgtattccaggcgttacaat

SEQ ID NO: 334357 - DNA, 25 bp, Mus musculus
ggtcattaagggaaagatggagctc

SEQ ID NO: 334358 - DNA, 25 bp, Mus musculus
ggtcattcagtacctcagtagtaac

SEQ ID NO: 334359 - DNA, 25 bp, Mus musculus
ggtcattcagtagtaacagatgtgg

SEQ ID NO: 334360 - DNA, 25 bp, Mus musculus
ggtcattcataaagattgaggaaga

SEQ ID NO: 334361 - DNA, 25 bp, Mus musculus
ggtcattgaatacaaaggtgccaac

SEQ ID NO: 334362 - DNA, 25 bp, Mus musculus
ggtcattgaccagaccaccgctctt

SEQ ID NO: 334363 - DNA, 25 bp, Mus musculus
ggtcattgagagaagtgatattgtg

SEQ ID NO: 334364 - DNA, 25 bp, Mus musculus
ggtcattgatcaaggtctgaagaag

SEQ ID NO: 334365 - DNA, 25 bp, Mus musculus
ggtcattggaggccttgagaagaag

SEQ ID NO: 334366 - DNA, 25 bp, Mus musculus
ggtcattggaggtgtccatcatacc

SEQ ID NO: 334367 - DNA, 25 bp, Mus musculus
ggtcatttcaggggagcgtttgcct

SEQ ID NO: 334368 - DNA, 25 bp, Mus musculus
ggtcatttgcaggtttaaggagagt

SEQ ID NO: 334369 - DNA, 25 bp, Mus musculus
ggtccaaacagactgaaagtgtccc

SEQ ID NO: 334370 - DNA, 25 bp, Mus musculus
ggtccaagaaggtgaatgaatataa

SEQ ID NO: 334371 - DNA, 25 bp, Mus musculus
ggtccaagaggaaagacaaagtcag

SEQ ID NO: 334372 - DNA, 25 bp, Mus musculus
ggtccaagaggaaagacagctacaa

SEQ ID NO: 334373 - DNA, 25 bp, Mus musculus
ggtccaagaggaaaggtaccagcag

SEQ ID NO: 334374 - DNA, 25 bp, Mus musculus
ggtccaaggccatgaacacggctct

SEQ ID NO: 334375 - DNA, 25 bp, Mus musculus
ggtccacaagggggggctgttcaag

SEQ ID NO: 334376 - DNA, 25 bp, Mus musculus
ggtccacagagatccactgaggctt

SEQ ID NO: 334377 - DNA, 25 bp, Mus musculus
ggtccacagcaggattccccctctg

SEQ ID NO: 334378 - DNA, 25 bp, Mus musculus
ggtccacataaaaggaaattgtggg

SEQ ID NO: 334379 - DNA, 25 bp, Mus musculus
ggtccacatggtgatatcatgggac

SEQ ID NO: 334380 - DNA, 25 bp, Mus musculus
ggtccaccagatgctgagcaactac

SEQ ID NO: 334381 - DNA, 25 bp, Mus musculus
ggtccacccaagggtacagcatgtt

SEQ ID NO: 334382 - DNA, 25 bp, Mus musculus
ggtccaccgtgtcagactcagtcac

SEQ ID NO: 334383 - DNA, 25 bp, Mus musculus
ggtccacggtgggggacccctgtgc

SEQ ID NO: 334384 - DNA, 25 bp, Mus musculus
ggtccacggtgggggattgctgctg

SEQ ID NO: 334385 - DNA, 25 bp, Mus musculus
ggtccacgtgagacatggcacaaga

SEQ ID NO: 334386 - DNA, 25 bp, Mus musculus
ggtccacgtgagatccttcttacca

SEQ ID NO: 334387 - DNA, 25 bp, Mus musculus
ggtccactaacagctctatttcagt

SEQ ID NO: 334388 - DNA, 25 bp, Mus musculus
ggtccactaacagtgcttctctcct

SEQ ID NO: 334389 - DNA, 25 bp, Mus musculus
ggtccagaaaaacctccagcgtctc

SEQ ID NO: 334390 - DNA, 25 bp, Mus musculus
ggtccagaacagcctgcacttcgct

SEQ ID NO: 334391 - DNA, 25 bp, Mus musculus
ggtccagaacagctggaggtggctg

SEQ ID NO: 334392 - DNA, 25 bp, Mus musculus
ggtccagactcgctttgaattcatg

SEQ ID NO: 334393 - DNA, 25 bp, Mus musculus
ggtccagactgcatggaactacatg

SEQ ID NO: 334394 - DNA, 25 bp, Mus musculus
ggtccagagaggtgtggagaggatg

SEQ ID NO: 334395 - DNA, 25 bp, Mus musculus
ggtccagagtgggtcatatcggatg

SEQ ID NO: 334396 - DNA, 25 bp, Mus musculus
ggtccagcagatgcgtcgagccctt

SEQ ID NO: 334397 - DNA, 25 bp, Mus musculus
ggtccagccctgaagccgaacaaaa

SEQ ID NO: 334398 - DNA, 25 bp, Mus musculus
ggtccagcggcagccagcaccagct

SEQ ID NO: 334399 - DNA, 25 bp, Mus musculus
ggtccagcttacggacatgctccca

SEQ ID NO: 334400 - DNA, 25 bp, Mus musculus
ggtccagcttgaaggtactaaagaa

SEQ ID NO: 334401 - DNA, 25 bp, Mus musculus
ggtccaggaagatccactcctatgt

SEQ ID NO: 334402 - DNA, 25 bp, Mus musculus
ggtccaggactgaatctacccaaac

SEQ ID NO: 334403 - DNA, 25 bp, Mus musculus
ggtccaggagattgtgccttctgaa

SEQ ID NO: 334404 - DNA, 25 bp, Mus musculus
ggtccaggagccaggtggtgtccct

SEQ ID NO: 334405 - DNA, 25 bp, Mus musculus
ggtccaggcagaggacagctcctct

SEQ ID NO: 334406 - DNA, 25 bp, Mus musculus
ggtccaggtccaggtcccgttcaag

SEQ ID NO: 334407 - DNA, 25 bp, Mus musculus
ggtccagtgaggctgtcatctggga

SEQ ID NO: 334408 - DNA, 25 bp, Mus musculus
ggtccagtgaggggtgcactctcag

SEQ ID NO: 334409 - DNA, 25 bp, Mus musculus
ggtccagtggaacagattgttgtgg

SEQ ID NO: 334410 - DNA, 25 bp, Mus musculus
ggtccagtggaacgtgggatctcat

SEQ ID NO: 334411 - DNA, 25 bp, Mus musculus
ggtccagttggaaatgaaatgttcc

SEQ ID NO: 334412 - DNA, 25 bp, Mus musculus
ggtccagtttcccttgtgggtatga

SEQ ID NO: 334413 - DNA, 25 bp, Mus musculus
ggtccataaacatggacttgaattt

SEQ ID NO: 334414 - DNA, 25 bp, Mus musculus
ggtccatctgaagaaatcaaaggct

SEQ ID NO: 334415 - DNA, 25 bp, Mus musculus
ggtccatgaccgaaatgcgactgta

SEQ ID NO: 334416 - DNA, 25 bp, Mus musculus
ggtccatgactgaagggcatccgtc

SEQ ID NO: 334417 - DNA, 25 bp, Mus musculus
ggtccatgagcaatggcaacagtag

SEQ ID NO: 334418 - DNA, 25 bp, Mus musculus
ggtccatgagccgggtgaacctgaa

SEQ ID NO: 334419 - DNA, 25 bp, Mus musculus
ggtccatgagtgaattagtagaaga

SEQ ID NO: 334420 - DNA, 25 bp, Mus musculus
ggtccatggacaagatgcaatcact

SEQ ID NO: 334421 - DNA, 25 bp, Mus musculus
ggtccatggggtgcgccccgggatg

SEQ ID NO: 334422 - DNA, 25 bp, Mus musculus
ggtccattcaggagatggagttcta

SEQ ID NO: 334423 - DNA, 25 bp, Mus musculus
ggtcccaaccaagctgctggaagct

SEQ ID NO: 334424 - DNA, 25 bp, Mus musculus
ggtcccaaccaaggaatcactgaga

SEQ ID NO: 334425 - DNA, 25 bp, Mus musculus
ggtcccaactctcttccatgcgcca

SEQ ID NO: 334426 - DNA, 25 bp, Mus musculus
ggtcccaagagacaggggtccgaat

SEQ ID NO: 334427 - DNA, 25 bp, Mus musculus
ggtcccacacgcctctgtacaacca

SEQ ID NO: 334428 - DNA, 25 bp, Mus musculus
ggtcccacacggacgtggggctgct

SEQ ID NO: 334429 - DNA, 25 bp, Mus musculus
ggtcccacccagacaggcttcagga

SEQ ID NO: 334430 - DNA, 25 bp, Mus musculus
ggtcccagaagggtcagaaagcatg

SEQ ID NO: 334431 - DNA, 25 bp, Mus musculus
ggtcccagagagctgatggccagga

SEQ ID NO: 334432 - DNA, 25 bp, Mus musculus
ggtcccagagccagatgaagagcta

SEQ ID NO: 334433 - DNA, 25 bp, Mus musculus
ggtcccagagccaggctccccagca

SEQ ID NO: 334434 - DNA, 25 bp, Mus musculus
ggtcccagcccaagttccaaagaac

SEQ ID NO: 334435 - DNA, 25 bp, Mus musculus
ggtcccagcgcaagagcctgttatt

SEQ ID NO: 334436 - DNA, 25 bp, Mus musculus
ggtcccagctcaggaggaaaactcc

SEQ ID NO: 334437 - DNA, 25 bp, Mus musculus
ggtcccagctggggtcggagcttcc

SEQ ID NO: 334438 - DNA, 25 bp, Mus musculus
ggtcccaggcaagcctggaagagtt

SEQ ID NO: 334439 - DNA, 25 bp, Mus musculus
ggtcccaggcaagggcagtgtatgg

SEQ ID NO: 334440 - DNA, 25 bp, Mus musculus
ggtcccagtgaagagacatcatgtg

SEQ ID NO: 334441 - DNA, 25 bp, Mus musculus
ggtcccagtgaaggtcgcaggcatc

SEQ ID NO: 334442 - DNA, 25 bp, Mus musculus
ggtcccattgcaagataaataggat

SEQ ID NO: 334443 - DNA, 25 bp, Mus musculus
ggtcccatttcaggtgctggtggca

SEQ ID NO: 334444 - DNA, 25 bp, Mus musculus
ggtccccaaacccagacttacagct

SEQ ID NO: 334445 - DNA, 25 bp, Mus musculus
ggtccccaaacccagatcagtggac

SEQ ID NO: 334446 - DNA, 25 bp, Mus musculus
ggtccccaagagtgggccaagctgg

SEQ ID NO: 334447 - DNA, 25 bp, Mus musculus
ggtccccaaggtatttctctgagtc

SEQ ID NO: 334448 - DNA, 25 bp, Mus musculus
ggtccccaccacagatctgcgatgg

SEQ ID NO: 334449 - DNA, 25 bp, Mus musculus
ggtccccaggcctggctgctgccat

SEQ ID NO: 334450 - DNA, 25 bp, Mus musculus
ggtcccccaataccgtgactgtccg

SEQ ID NO: 334451 - DNA, 25 bp, Mus musculus
ggtcccccgctcctgggccgcaaac

SEQ ID NO: 334452 - DNA, 25 bp, Mus musculus
ggtcccccggtatagaacgtgtgac

SEQ ID NO: 334453 - DNA, 25 bp, Mus musculus
ggtccccgagtgttgggagcgggat

SEQ ID NO: 334454 - DNA, 25 bp, Mus musculus
ggtccccgcccgcaggtccattcag

SEQ ID NO: 334455 - DNA, 25 bp, Mus musculus
ggtccccgcgaggtgtcgcggaaga

SEQ ID NO: 334456 - DNA, 25 bp, Mus musculus
ggtccccgcgcggctaactcaacaa

SEQ ID NO: 334457 - DNA, 25 bp, Mus musculus
ggtccccgggacgaggcaaagatgc

SEQ ID NO: 334458 - DNA, 25 bp, Mus musculus
ggtcccctctggatcataaagacac

SEQ ID NO: 334459 - DNA, 25 bp, Mus musculus
ggtcccgagaaacattccagagtca

SEQ ID NO: 334460 - DNA, 25 bp, Mus musculus
ggtcccgagaaagattccagagtca

SEQ ID NO: 334461 - DNA, 25 bp, Mus musculus
ggtcccgagccagaggagtactttt

SEQ ID NO: 334462 - DNA, 25 bp, Mus musculus
ggtcccgggagcccctgatgacccc

SEQ ID NO: 334463 - DNA, 25 bp, Mus musculus
ggtcccgggcagcatccagcatgtg

SEQ ID NO: 334464 - DNA, 25 bp, Mus musculus
ggtcccgtacccacatcacagctcg

SEQ ID NO: 334465 - DNA, 25 bp, Mus musculus
ggtccctaagagctctcttccggct

SEQ ID NO: 334466 - DNA, 25 bp, Mus musculus
ggtccctacacgaatgaagtgtatc

SEQ ID NO: 334467 - DNA, 25 bp, Mus musculus
ggtccctacagtcaagctgtgcaag

SEQ ID NO: 334468 - DNA, 25 bp, Mus musculus
ggtccctcactaaaagcaccttcat

SEQ ID NO: 334469 - DNA, 25 bp, Mus musculus
ggtccctcagattgctgaagctaaa

SEQ ID NO: 334470 - DNA, 25 bp, Mus musculus
ggtccctcagggtctggagtatgga

SEQ ID NO: 334471 - DNA, 25 bp, Mus musculus
ggtccctccagacttcctctgccca

SEQ ID NO: 334472 - DNA, 25 bp, Mus musculus
ggtccctccaggtgggcacatggaa

SEQ ID NO: 334473 - DNA, 25 bp, Mus musculus
ggtccctcctaagactgtatcactt

SEQ ID NO: 334474 - DNA, 25 bp, Mus musculus
ggtccctctgtgccgaacatctcat

SEQ ID NO: 334475 - DNA, 25 bp, Mus musculus
ggtccctctgtgccgcccccagagg

SEQ ID NO: 334476 - DNA, 25 bp, Mus musculus
ggtccctgttctccaccctcccctg

SEQ ID NO: 334477 - DNA, 25 bp, Mus musculus
ggtccctgttgacaatatctttaat

SEQ ID NO: 334478 - DNA, 25 bp, Mus musculus
ggtccctgttgacgaacctaaaact

SEQ ID NO: 334479 - DNA, 25 bp, Mus musculus
ggtcccttaactgatgtgccggtga

SEQ ID NO: 334480 - DNA, 25 bp, Mus musculus
ggtcccttgcagccatgcagtggtg

SEQ ID NO: 334481 - DNA, 25 bp, Mus musculus
ggtccctttgcacttggaatctcct

SEQ ID NO: 334482 - DNA, 25 bp, Mus musculus
ggtccgaagcaggctcctggagtcc

SEQ ID NO: 334483 - DNA, 25 bp, Mus musculus
ggtccgagagcaggtctgcctgggc

SEQ ID NO: 334484 - DNA, 25 bp, Mus musculus
ggtccgagagcagtggccacagtta

SEQ ID NO: 334485 - DNA, 25 bp, Mus musculus
ggtccgagtcgctgatgagcgggac

SEQ ID NO: 334486 - DNA, 25 bp, Mus musculus
ggtccgcaaagagaaaagatgagag

SEQ ID NO: 334487 - DNA, 25 bp, Mus musculus
ggtccgcaaagctccttctggccgc

SEQ ID NO: 334488 - DNA, 25 bp, Mus musculus
ggtccgcaaagtggcatggatggtg

SEQ ID NO: 334489 - DNA, 25 bp, Mus musculus
ggtccgccctgagaaatccagtaaa

SEQ ID NO: 334490 - DNA, 25 bp, Mus musculus
ggtccgccctgagaggtcccgtaaa

SEQ ID NO: 334491 - DNA, 25 bp, Mus musculus
ggtccgcgtcggtgctggcctgcag

SEQ ID NO: 334492 - DNA, 25 bp, Mus musculus
ggtccgcttaaaggactggacagac

SEQ ID NO: 334493 - DNA, 25 bp, Mus musculus
ggtccggagccaggacaaagccaac

SEQ ID NO: 334494 - DNA, 25 bp, Mus musculus
ggtccggagccagggctcagattct

SEQ ID NO: 334495 - DNA, 25 bp, Mus musculus
ggtccggagttcgtgcctccggagc

SEQ ID NO: 334496 - DNA, 25 bp, Mus musculus
ggtccggcggctggtcacctttgta

SEQ ID NO: 334497 - DNA, 25 bp, Mus musculus
ggtccgggagacaggcctctctttc

SEQ ID NO: 334498 - DNA, 25 bp, Mus musculus
ggtccgggagtgttacaggtgggag

SEQ ID NO: 334499 - DNA, 25 bp, Mus musculus
ggtccggtttgcaagagtctttttg

SEQ ID NO: 334500 - DNA, 25 bp, Mus musculus
ggtccggtttgcaagggcaaatgga

SEQ ID NO: 334501 - DNA, 25 bp, Mus musculus
ggtccgtcaagcccttgaccacatc

SEQ ID NO: 334502 - DNA, 25 bp, Mus musculus
ggtccgtcagatgagccctaggacc

SEQ ID NO: 334503 - DNA, 25 bp, Mus musculus
ggtcctaaaaaagagaacgcaccag

SEQ ID NO: 334504 - DNA, 25 bp, Mus musculus
ggtcctaaaaggtgcaactacatta

SEQ ID NO: 334505 - DNA, 25 bp, Mus musculus
ggtcctacaagggcctgtggacctg

SEQ ID NO: 334506 - DNA, 25 bp, Mus musculus
ggtcctacagctataggccgtacag

SEQ ID NO: 334507 - DNA, 25 bp, Mus musculus
ggtcctacagttggggaatggcggt

SEQ ID NO: 334508 - DNA, 25 bp, Mus musculus
ggtcctactggaacaaatgcttccc

SEQ ID NO: 334509 - DNA, 25 bp, Mus musculus
ggtcctactgtattatggagattgc

SEQ ID NO: 334510 - DNA, 25 bp, Mus musculus
ggtcctcaacggagagtatgagagt

SEQ ID NO: 334511 - DNA, 25 bp, Mus musculus
ggtcctcactacaggcttccagcca

SEQ ID NO: 334512 - DNA, 25 bp, Mus musculus
ggtcctcactgccaaggcagcagcc

SEQ ID NO: 334513 - DNA, 25 bp, Mus musculus
ggtcctcactgtgatgatccgggag

SEQ ID NO: 334514 - DNA, 25 bp, Mus musculus
ggtcctccatgggcatggacatatc

SEQ ID NO: 334515 - DNA, 25 bp, Mus musculus
ggtcctcggggcagaaaatatctgc

SEQ ID NO: 334516 - DNA, 25 bp, Mus musculus
ggtcctcggggcagatcgtaatgta

SEQ ID NO: 334517 - DNA, 25 bp, Mus musculus
ggtcctctacaagacaatgttctat

SEQ ID NO: 334518 - DNA, 25 bp, Mus musculus
ggtcctctacaagactgtgtacagt

SEQ ID NO: 334519 - DNA, 25 bp, Mus musculus
ggtcctctgaggaggcccactgagt

SEQ ID NO: 334520 - DNA, 25 bp, Mus musculus
ggtcctcttggctcagctgaaggat

SEQ ID NO: 334521 - DNA, 25 bp, Mus musculus
ggtcctgaagacagcccaggaccca

SEQ ID NO: 334522 - DNA, 25 bp, Mus musculus
ggtcctgaagcactcggggataaat

SEQ ID NO: 334523 - DNA, 25 bp, Mus musculus
ggtcctgaagcgcctgtgagagaga

SEQ ID NO: 334524 - DNA, 25 bp, Mus musculus
ggtcctgaaggccgccggtgttaac

SEQ ID NO: 334525 - DNA, 25 bp, Mus musculus
ggtcctgacagaaatccatgcgaca

SEQ ID NO: 334526 - DNA, 25 bp, Mus musculus
ggtcctgacagctgggatctccatc

SEQ ID NO: 334527 - DNA, 25 bp, Mus musculus
ggtcctgagaaaggtataaatgggt

SEQ ID NO: 334528 - DNA, 25 bp, Mus musculus
ggtcctgcctctgggcggaaaaact

SEQ ID NO: 334529 - DNA, 25 bp, Mus musculus
ggtcctgcctctgggttaacaatca

SEQ ID NO: 334530 - DNA, 25 bp, Mus musculus
ggtcctggaaaggtgatgtacaaag

SEQ ID NO: 334531 - DNA, 25 bp, Mus musculus
ggtcctggagctgaacaaggagcaa

SEQ ID NO: 334532 - DNA, 25 bp, Mus musculus
ggtcctggagtagcctctccaggca

SEQ ID NO: 334533 - DNA, 25 bp, Mus musculus
ggtcctggagtagtcccaggcactc

SEQ ID NO: 334534 - DNA, 25 bp, Mus musculus
ggtcctggcaggaagatttattggt

SEQ ID NO: 334535 - DNA, 25 bp, Mus musculus
ggtcctggcaggagacctagaactt

SEQ ID NO: 334536 - DNA, 25 bp, Mus musculus
ggtcctggcaggggcagtaattgga

SEQ ID NO: 334537 - DNA, 25 bp, Mus musculus
ggtcctggcctggtgtgcatcggcc

SEQ ID NO: 334538 - DNA, 25 bp, Mus musculus
ggtcctgggctcttctctcacgtga

SEQ ID NO: 334539 - DNA, 25 bp, Mus musculus
ggtcctgggggaatggataagtatg

SEQ ID NO: 334540 - DNA, 25 bp, Mus musculus
ggtcctgggtctcagattatacaga

SEQ ID NO: 334541 - DNA, 25 bp, Mus musculus
ggtcctgtcagcttcagccaccttc

SEQ ID NO: 334542 - DNA, 25 bp, Mus musculus
ggtcctgtcagtggatgtgtcctct

SEQ ID NO: 334543 - DNA, 25 bp, Mus musculus
ggtcctgtgtgatctcagtaagttc

SEQ ID NO: 334544 - DNA, 25 bp, Mus musculus
ggtcctgttgaaactttagccactt

SEQ ID NO: 334545 - DNA, 25 bp, Mus musculus
ggtcctgtttaaccatcagcagtgt

SEQ ID NO: 334546 - DNA, 25 bp, Mus musculus
ggtcctgtttaagagttcagatgcc

SEQ ID NO: 334547 - DNA, 25 bp, Mus musculus
ggtccttagcaagcataaacagatt

SEQ ID NO: 334548 - DNA, 25 bp, Mus musculus
ggtccttctagcaggcctgcctact

SEQ ID NO: 334549 - DNA, 25 bp, Mus musculus
ggtccttctcgagattttattccct

SEQ ID NO: 334550 - DNA, 25 bp, Mus musculus
ggtccttgaaatcaagatgctgtca

SEQ ID NO: 334551 - DNA, 25 bp, Mus musculus
ggtccttgaaccgggcaccatccaa

SEQ ID NO: 334552 - DNA, 25 bp, Mus musculus
ggtccttgacaccagggtggaccca

SEQ ID NO: 334553 - DNA, 25 bp, Mus musculus
ggtccttgagtggggactgtcaggg

SEQ ID NO: 334554 - DNA, 25 bp, Mus musculus
ggtcctttcccagaaaaatatgccc

SEQ ID NO: 334555 - DNA, 25 bp, Mus musculus
ggtccttttcatggttaatttctaa

SEQ ID NO: 334556 - DNA, 25 bp, Mus musculus
ggtcgaacaaagtcagctttctctg

SEQ ID NO: 334557 - DNA, 25 bp, Mus musculus
ggtcgaactagaaaccagtgctgtt

SEQ ID NO: 334558 - DNA, 25 bp, Mus musculus
ggtcgaactagaacaccagcagtgc

SEQ ID NO: 334559 - DNA, 25 bp, Mus musculus
ggtcgaagctgggttgaaaactagc

SEQ ID NO: 334560 - DNA, 25 bp, Mus musculus
ggtcgaatcacgtggagtgaactca

SEQ ID NO: 334561 - DNA, 25 bp, Mus musculus
ggtcgaatcacgtggatggaatgaa

SEQ ID NO: 334562 - DNA, 25 bp, Mus musculus
ggtcgactgagagatcctgagcaag

SEQ ID NO: 334563 - DNA, 25 bp, Mus musculus
ggtcgagcagctggagaatcctggg

SEQ ID NO: 334564 - DNA, 25 bp, Mus musculus
ggtcgagcaggagcatagaagacat

SEQ ID NO: 334565 - DNA, 25 bp, Mus musculus
ggtcgagcccgtgacaccatagaga

SEQ ID NO: 334566 - DNA, 25 bp, Mus musculus
ggtcgagcctaaagaacatcaaact

SEQ ID NO: 334567 - DNA, 25 bp, Mus musculus
ggtcgagctgtcagagaagcttcaa

SEQ ID NO: 334568 - DNA, 25 bp, Mus musculus
ggtcgagggaagctaaagaagtaaa

SEQ ID NO: 334569 - DNA, 25 bp, Mus musculus
ggtcgagtaccagaaagctcagccc

SEQ ID NO: 334570 - DNA, 25 bp, Mus musculus
ggtcgagtaccaggttggagtgggt

SEQ ID NO: 334571 - DNA, 25 bp, Mus musculus
ggtcgatatcaggtgtcctggagcc

SEQ ID NO: 334572 - DNA, 25 bp, Mus musculus
ggtcgatgtgggcccagacccttcc

SEQ ID NO: 334573 - DNA, 25 bp, Mus musculus
ggtcgcaagcgggctgcctctgaag

SEQ ID NO: 334574 - DNA, 25 bp, Mus musculus
ggtcgcacagaggaagccgtgaagg

SEQ ID NO: 334575 - DNA, 25 bp, Mus musculus
ggtcgcacgcgtgagcatgcgctac

SEQ ID NO: 334576 - DNA, 25 bp, Mus musculus
ggtcgcagaagtacagcacgtggga

SEQ ID NO: 334577 - DNA, 25 bp, Mus musculus
ggtcgcagacgaagaaatggaagcc

SEQ ID NO: 334578 - DNA, 25 bp, Mus musculus
ggtcgcagcaaacgatcatcccagc

SEQ ID NO: 334579 - DNA, 25 bp, Mus musculus
ggtcgccatcccagggaacaggaag

SEQ ID NO: 334580 - DNA, 25 bp, Mus musculus
ggtcgcccaggctccgcccccacgc

SEQ ID NO: 334581 - DNA, 25 bp, Mus musculus
ggtcgcccagggactttgaatatgt

SEQ ID NO: 334582 - DNA, 25 bp, Mus musculus
ggtcgccctcggctatcccctctgc

SEQ ID NO: 334583 - DNA, 25 bp, Mus musculus
ggtcgccctcgggttccagcagaag

SEQ ID NO: 334584 - DNA, 25 bp, Mus musculus
ggtcgcctctggaccaacggtccca

SEQ ID NO: 334585 - DNA, 25 bp, Mus musculus
ggtcgcctggagccgaaatcatgtc

SEQ ID NO: 334586 - DNA, 25 bp, Mus musculus
ggtcgcgagactaagaccatggcca

SEQ ID NO: 334587 - DNA, 25 bp, Mus musculus
ggtcgcgagactaagagccccactg

SEQ ID NO: 334588 - DNA, 25 bp, Mus musculus
ggtcgcgcggaccatcggggctgct

SEQ ID NO: 334589 - DNA, 25 bp, Mus musculus
ggtcgcgcggcttggagctccttcc

SEQ ID NO: 334590 - DNA, 25 bp, Mus musculus
ggtcgcggcggtgacctacagcact

SEQ ID NO: 334591 - DNA, 25 bp, Mus musculus
ggtcgcggctcccgatggaaatcct

SEQ ID NO: 334592 - DNA, 25 bp, Mus musculus
ggtcgcggtcaatgggtgggtgagg

SEQ ID NO: 334593 - DNA, 25 bp, Mus musculus
ggtcgcggtcaatggtcagcaagat

SEQ ID NO: 334594 - DNA, 25 bp, Mus musculus
ggtcgctcaggacatcagcaacttc

SEQ ID NO: 334595 - DNA, 25 bp, Mus musculus
ggtcgctcaggcttgcagatgggtc

SEQ ID NO: 334596 - DNA, 25 bp, Mus musculus
ggtcgctcggagatcgcttttgtgg

SEQ ID NO: 334597 - DNA, 25 bp, Mus musculus
ggtcgctcggagatcgtatacttga

SEQ ID NO: 334598 - DNA, 25 bp, Mus musculus
ggtcgctggcttccaaatggaactc

SEQ ID NO: 334599 - DNA, 25 bp, Mus musculus
ggtcggacaagctctactccaggga

SEQ ID NO: 334600 - DNA, 25 bp, Mus musculus
ggtcggacaaggaaacacagagaga

SEQ ID NO: 334601 - DNA, 25 bp, Mus musculus
ggtcggagcccgcgattctcattga

SEQ ID NO: 334602 - DNA, 25 bp, Mus musculus
ggtcggagcccgcgggtcttactgt

SEQ ID NO: 334603 - DNA, 25 bp, Mus musculus
ggtcggaggaggtgggcgttgggct

SEQ ID NO: 334604 - DNA, 25 bp, Mus musculus
ggtcggaggaggttgctgaacgaaa

SEQ ID NO: 334605 - DNA, 25 bp, Mus musculus
ggtcggaggagtggtgtggaaggca

SEQ ID NO: 334606 - DNA, 25 bp, Mus musculus
ggtcggatggaaaagcacctggatg

SEQ ID NO: 334607 - DNA, 25 bp, Mus musculus
ggtcggcagaggtaaccatggagaa

SEQ ID NO: 334608 - DNA, 25 bp, Mus musculus
ggtcggcctcgatgtggaggccaca

SEQ ID NO: 334609 - DNA, 25 bp, Mus musculus
ggtcggcctcgcaatacttcgtgct

SEQ ID NO: 334610 - DNA, 25 bp, Mus musculus
ggtcggctgacagacccgtggattc

SEQ ID NO: 334611 - DNA, 25 bp, Mus musculus
ggtcggctgacagggcaagagttca

SEQ ID NO: 334612 - DNA, 25 bp, Mus musculus
ggtcggctgacaggtagaaaaccag

SEQ ID NO: 334613 - DNA, 25 bp, Mus musculus
ggtcgggagtcagaaagagcccagt

SEQ ID NO: 334614 - DNA, 25 bp, Mus musculus
ggtcggggctggtcaggacaaagag

SEQ ID NO: 334615 - DNA, 25 bp, Mus musculus
ggtcgtaaaaatgagcatctgtaac

SEQ ID NO: 334616 - DNA, 25 bp, Mus musculus
ggtcgtaaaaattgaaatctctcag

SEQ ID NO: 334617 - DNA, 25 bp, Mus musculus
ggtcgtaaggaggtgcctgcaggcc

SEQ ID NO: 334618 - DNA, 25 bp, Mus musculus
ggtcgtagtcaaggcacatcccagc

SEQ ID NO: 334619 - DNA, 25 bp, Mus musculus
ggtcgtcgtcatgatggagaggaga

SEQ ID NO: 334620 - DNA, 25 bp, Mus musculus
ggtcgtgaagctaggtactgggttt

SEQ ID NO: 334621 - DNA, 25 bp, Mus musculus
ggtcgtgaccgtgagcccattctgc

SEQ ID NO: 334622 - DNA, 25 bp, Mus musculus
ggtcgtgcctgagaactccgtgcaa

SEQ ID NO: 334623 - DNA, 25 bp, Mus musculus
ggtcgtggctcatacacactttgga

SEQ ID NO: 334624 - DNA, 25 bp, Mus musculus
ggtcgtggctcatagtatgatattt

SEQ ID NO: 334625 - DNA, 25 bp, Mus musculus
ggtcgtgtggagagattgctctctc

SEQ ID NO: 334626 - DNA, 25 bp, Mus musculus
ggtcgttcagccaggttgcattgaa

SEQ ID NO: 334627 - DNA, 25 bp, Mus musculus
ggtcgtttctgagtgagatcccatt

SEQ ID NO: 334628 - DNA, 25 bp, Mus musculus
ggtctaaagaatcagaagtactccc

SEQ ID NO: 334629 - DNA, 25 bp, Mus musculus
ggtctaacttcagccagaggctcca

SEQ ID NO: 334630 - DNA, 25 bp, Mus musculus
ggtctaagggaaggaaccaagtggt

SEQ ID NO: 334631 - DNA, 25 bp, Mus musculus
ggtctacaaagaaatgttctgcgaa

SEQ ID NO: 334632 - DNA, 25 bp, Mus musculus
ggtctacaaagtggatcccactgct

SEQ ID NO: 334633 - DNA, 25 bp, Mus musculus
ggtctacaagacagtagccaaccta

SEQ ID NO: 334634 - DNA, 25 bp, Mus musculus
ggtctacaagatcacagagcagcag

SEQ ID NO: 334635 - DNA, 25 bp, Mus musculus
ggtctacactgccaaccagaactgc

SEQ ID NO: 334636 - DNA, 25 bp, Mus musculus
ggtctacagaacctgacaggtatgt

SEQ ID NO: 334637 - DNA, 25 bp, Mus musculus
ggtctacagaatagacatgctaaca

SEQ ID NO: 334638 - DNA, 25 bp, Mus musculus
ggtctacagagctctcagacactgc

SEQ ID NO: 334639 - DNA, 25 bp, Mus musculus
ggtctacagatacaaatatagagat

SEQ ID NO: 334640 - DNA, 25 bp, Mus musculus
ggtctacatagggctccaacaccaa

SEQ ID NO: 334641 - DNA, 25 bp, Mus musculus
ggtctacatagtgtgagtcattctg

SEQ ID NO: 334642 - DNA, 25 bp, Mus musculus
ggtctaccagcaatgtgtgtccgtc

SEQ ID NO: 334643 - DNA, 25 bp, Mus musculus
ggtctacccagaagaaggaccaggt

SEQ ID NO: 334644 - DNA, 25 bp, Mus musculus
ggtctaccctttcactggggatcac

SEQ ID NO: 334645 - DNA, 25 bp, Mus musculus
ggtctacctctgtggaagctcggat

SEQ ID NO: 334646 - DNA, 25 bp, Mus musculus
ggtctagcaagccgggtatcccagc

SEQ ID NO: 334647 - DNA, 25 bp, Mus musculus
ggtctagcaagggcaatgacatcat

SEQ ID NO: 334648 - DNA, 25 bp, Mus musculus
ggtctatcctggccgcctgggaacc

SEQ ID NO: 334649 - DNA, 25 bp, Mus musculus
ggtctatcctggggacctaaaacag

SEQ ID NO: 334650 - DNA, 25 bp, Mus musculus
ggtctatcctggtgatccactgcgt

SEQ ID NO: 334651 - DNA, 25 bp, Mus musculus
ggtctatgataaggtacaaaatgaa

SEQ ID NO: 334652 - DNA, 25 bp, Mus musculus
ggtctattcagatacagccctgcag

SEQ ID NO: 334653 - DNA, 25 bp, Mus musculus
ggtctattcagctacagtgatcctt

SEQ ID NO: 334654 - DNA, 25 bp, Mus musculus
ggtctcaaacacaaagtgctgcagt

SEQ ID NO: 334655 - DNA, 25 bp, Mus musculus
ggtctcaaggagtcagagcaaccca

SEQ ID NO: 334656 - DNA, 25 bp, Mus musculus
ggtctcaataggtcttgtgtgatgc

SEQ ID NO: 334657 - DNA, 25 bp, Mus musculus
ggtctcacgacaggtgatttccgat

SEQ ID NO: 334658 - DNA, 25 bp, Mus musculus
ggtctcacgcggtcggatatgaaga

SEQ ID NO: 334659 - DNA, 25 bp, Mus musculus
ggtctcactgctaataaagacaaag

SEQ ID NO: 334660 - DNA, 25 bp, Mus musculus
ggtctcactgggcatacttctccgc

SEQ ID NO: 334661 - DNA, 25 bp, Mus musculus
ggtctcactggttggcgcatccttt

SEQ ID NO: 334662 - DNA, 25 bp, Mus musculus
ggtctcagaagtgccttcaagacaa

SEQ ID NO: 334663 - DNA, 25 bp, Mus musculus
ggtctcagcctcgaatgggtgaaga

SEQ ID NO: 334664 - DNA, 25 bp, Mus musculus
ggtctcatacaggtgagaaaccttt

SEQ ID NO: 334665 - DNA, 25 bp, Mus musculus
ggtctccaatgcaggaggcccacct

SEQ ID NO: 334666 - DNA, 25 bp, Mus musculus
ggtctccaccgtgaaccacccattc

SEQ ID NO: 334667 - DNA, 25 bp, Mus musculus
ggtctccacgccatggatgcagtga

SEQ ID NO: 334668 - DNA, 25 bp, Mus musculus
ggtctccagggcctggaatgtccta

SEQ ID NO: 334669 - DNA, 25 bp, Mus musculus
ggtctccattctgttgcaccaagta

SEQ ID NO: 334670 - DNA, 25 bp, Mus musculus
ggtctcccaggaccgtcagaagggg

SEQ ID NO: 334671 - DNA, 25 bp, Mus musculus
ggtctccctagtagatccactgtgg

SEQ ID NO: 334672 - DNA, 25 bp, Mus musculus
ggtctccctggggcatcagccgtcc

SEQ ID NO: 334673 - DNA, 25 bp, Mus musculus
ggtctccgaggagtatgtctccaaa

SEQ ID NO: 334674 - DNA, 25 bp, Mus musculus
ggtctccgtgacaagattgtaagga

SEQ ID NO: 334675 - DNA, 25 bp, Mus musculus
ggtctcctcagatgaggaaactgag

SEQ ID NO: 334676 - DNA, 25 bp, Mus musculus
ggtctcctccggcttgttggaggtg

SEQ ID NO: 334677 - DNA, 25 bp, Mus musculus
ggtctccttcaggctccatgttggc

SEQ ID NO: 334678 - DNA, 25 bp, Mus musculus
ggtctccttcagttaaagctagtcc

SEQ ID NO: 334679 - DNA, 25 bp, Mus musculus
ggtctccttccatggctgtgaccca

SEQ ID NO: 334680 - DNA, 25 bp, Mus musculus
ggtctccttcctcagctactgtgac

SEQ ID NO: 334681 - DNA, 25 bp, Mus musculus
ggtctccttcctgtgccccacagat

SEQ ID NO: 334682 - DNA, 25 bp, Mus musculus
ggtctcgcagcacccagcaggctca

SEQ ID NO: 334683 - DNA, 25 bp, Mus musculus
ggtctcgctctggcttcccatttcc

SEQ ID NO: 334684 - DNA, 25 bp, Mus musculus
ggtctctactgcctacaagaagact

SEQ ID NO: 334685 - DNA, 25 bp, Mus musculus
ggtctctactgcctatgtgaaaacg

SEQ ID NO: 334686 - DNA, 25 bp, Mus musculus
ggtctctcagaaaacatctcgggca

SEQ ID NO: 334687 - DNA, 25 bp, Mus musculus
ggtctctctcagcatacgaaggaca

SEQ ID NO: 334688 - DNA, 25 bp, Mus musculus
ggtctctctcaggcgtggaggaggt

SEQ ID NO: 334689 - DNA, 25 bp, Mus musculus
ggtctctgaaggaacagtctgagat

SEQ ID NO: 334690 - DNA, 25 bp, Mus musculus
ggtctctgagtggaggtgaagccgg

SEQ ID NO: 334691 - DNA, 25 bp, Mus musculus
ggtctctgcaagaaaaggcaagagc

SEQ ID NO: 334692 - DNA, 25 bp, Mus musculus
ggtctctgcaagaggtgttgtcgga

SEQ ID NO: 334693 - DNA, 25 bp, Mus musculus
ggtctctgcagtgctatggggcatg

SEQ ID NO: 334694 - DNA, 25 bp, Mus musculus
ggtctctgcgcggttgactcttcac

SEQ ID NO: 334695 - DNA, 25 bp, Mus musculus
ggtctctgtggagaactactgcata

SEQ ID NO: 334696 - DNA, 25 bp, Mus musculus
ggtctctgtgggagcttgcatttcc

SEQ ID NO: 334697 - DNA, 25 bp, Mus musculus
ggtctctgtgggtggtaaatctgta

SEQ ID NO: 334698 - DNA, 25 bp, Mus musculus
ggtctcttccttacacatgatgaag

SEQ ID NO: 334699 - DNA, 25 bp, Mus musculus
ggtctgaagctcagaactttgccaa

SEQ ID NO: 334700 - DNA, 25 bp, Mus musculus
ggtctgacacggaacaggaaggcaa

SEQ ID NO: 334701 - DNA, 25 bp, Mus musculus
ggtctgacaggcacagtagactgga

SEQ ID NO: 334702 - DNA, 25 bp, Mus musculus
ggtctgacagtgttgtcatgactgg

SEQ ID NO: 334703 - DNA, 25 bp, Mus musculus
ggtctgagagcccaacatgcaaatc

SEQ ID NO: 334704 - DNA, 25 bp, Mus musculus
ggtctgagcaggactcggaacccac

SEQ ID NO: 334705 - DNA, 25 bp, Mus musculus
ggtctgagtgaagattatttgtctt

SEQ ID NO: 334706 - DNA, 25 bp, Mus musculus
ggtctgatcaaaaagtttcagttcg

SEQ ID NO: 334707 - DNA, 25 bp, Mus musculus
ggtctgatccaggggcaggtgaggt

SEQ ID NO: 334708 - DNA, 25 bp, Mus musculus
ggtctgatccagtctgcctggagat

SEQ ID NO: 334709 - DNA, 25 bp, Mus musculus
ggtctgattaaacaaattggagaaa

SEQ ID NO: 334710 - DNA, 25 bp, Mus musculus
ggtctgattcccagctgtttggggc

SEQ ID NO: 334711 - DNA, 25 bp, Mus musculus
ggtctgcaaaggagaatcacactgg

SEQ ID NO: 334712 - DNA, 25 bp, Mus musculus
ggtctgcaggtgagtacggctccac

SEQ ID NO: 334713 - DNA, 25 bp, Mus musculus
ggtctgccaggatatagctcctctg

SEQ ID NO: 334714 - DNA, 25 bp, Mus musculus
ggtctgcccctgcctaagcctgaaa

SEQ ID NO: 334715 - DNA, 25 bp, Mus musculus
ggtctgccctgggagcctctgacct

SEQ ID NO: 334716 - DNA, 25 bp, Mus musculus
ggtctgcggaaagtacacaaacaag

SEQ ID NO: 334717 - DNA, 25 bp, Mus musculus
ggtctgcggaccgagaacctctcca

SEQ ID NO: 334718 - DNA, 25 bp, Mus musculus
ggtctgcggaccgagaagaaccgat

SEQ ID NO: 334719 - DNA, 25 bp, Mus musculus
ggtctgcggccgcaggcctgaagct

SEQ ID NO: 334720 - DNA, 25 bp, Mus musculus
ggtctgcgtctaaaggcttcgagta

SEQ ID NO: 334721 - DNA, 25 bp, Mus musculus
ggtctgctcaagagtgaagacaaga

SEQ ID NO: 334722 - DNA, 25 bp, Mus musculus
ggtctgctcagaaaaaactggccac

SEQ ID NO: 334723 - DNA, 25 bp, Mus musculus
ggtctgctgagtcctgcagcaggtg

SEQ ID NO: 334724 - DNA, 25 bp, Mus musculus
ggtctgctgcaacagcgaggcagag

SEQ ID NO: 334725 - DNA, 25 bp, Mus musculus
ggtctgctggacgcctttagaacag

SEQ ID NO: 334726 - DNA, 25 bp, Mus musculus
ggtctgctgggaagcggaacaggaa

SEQ ID NO: 334727 - DNA, 25 bp, Mus musculus
ggtctgcttacccgccgcagctccg

SEQ ID NO: 334728 - DNA, 25 bp, Mus musculus
ggtctgcttacccggtacctggcag

SEQ ID NO: 334729 - DNA, 25 bp, Mus musculus
ggtctggaaaagaactactgccgaa

SEQ ID NO: 334730 - DNA, 25 bp, Mus musculus
ggtctggacagccaggtgtggaggg

SEQ ID NO: 334731 - DNA, 25 bp, Mus musculus
ggtctggacagccagtttgtaggtg

SEQ ID NO: 334732 - DNA, 25 bp, Mus musculus
ggtctggagcaagcccacaccgcca

SEQ ID NO: 334733 - DNA, 25 bp, Mus musculus
ggtctggatcagaccttgtgaccgt

SEQ ID NO: 334734 - DNA, 25 bp, Mus musculus
ggtctggatcgagacaaagtgcaac

SEQ ID NO: 334735 - DNA, 25 bp, Mus musculus
ggtctggatcgagacggtctgtcct

SEQ ID NO: 334736 - DNA, 25 bp, Mus musculus
ggtctggatcgagagaaagtgcaac

SEQ ID NO: 334737 - DNA, 25 bp, Mus musculus
ggtctggatcgagagggtctgtcct

SEQ ID NO: 334738 - DNA, 25 bp, Mus musculus
ggtctggcaagcacgatctgcccat

SEQ ID NO: 334739 - DNA, 25 bp, Mus musculus
ggtctgggatttaagtctgtgcgag

SEQ ID NO: 334740 - DNA, 25 bp, Mus musculus
ggtctgggccagagcttcgagtgtg

SEQ ID NO: 334741 - DNA, 25 bp, Mus musculus
ggtctgggccaggtgcgtgctatta

SEQ ID NO: 334742 - DNA, 25 bp, Mus musculus
ggtctgggcgatggggcactggctc

SEQ ID NO: 334743 - DNA, 25 bp, Mus musculus
ggtctgggcttcccgatacgacatt

SEQ ID NO: 334744 - DNA, 25 bp, Mus musculus
ggtctgggcttcccgattctgttta

SEQ ID NO: 334745 - DNA, 25 bp, Mus musculus
ggtctgggcttcccggagccgagga

SEQ ID NO: 334746 - DNA, 25 bp, Mus musculus
ggtctgggtgaggaggttgtggcag

SEQ ID NO: 334747 - DNA, 25 bp, Mus musculus
ggtctgggttaaatggtttgtcttc

SEQ ID NO: 334748 - DNA, 25 bp, Mus musculus
ggtctggtcaaagctgttcctgagc

SEQ ID NO: 334749 - DNA, 25 bp, Mus musculus
ggtctgtaaaaaagcaacacgtttt

SEQ ID NO: 334750 - DNA, 25 bp, Mus musculus
ggtctgtacaaggttttgaatcctg

SEQ ID NO: 334751 - DNA, 25 bp, Mus musculus
ggtctgtcctgaaagccagagaccc

SEQ ID NO: 334752 - DNA, 25 bp, Mus musculus
ggtctgtcctgaaagtaggcttctt

SEQ ID NO: 334753 - DNA, 25 bp, Mus musculus
ggtctgtcctgaaagtctcagagga

SEQ ID NO: 334754 - DNA, 25 bp, Mus musculus
ggtctgtgagcagcgcggatgtcga

SEQ ID NO: 334755 - DNA, 25 bp, Mus musculus
ggtctgtgagcaggaatcccttcgc

SEQ ID NO: 334756 - DNA, 25 bp, Mus musculus
ggtctgtgagcagtggcagtggcac

SEQ ID NO: 334757 - DNA, 25 bp, Mus musculus
ggtctgtgcagagatattcacaacg

SEQ ID NO: 334758 - DNA, 25 bp, Mus musculus
ggtctgtggaatgtgacaaacggag

SEQ ID NO: 334759 - DNA, 25 bp, Mus musculus
ggtctgtggatgatgaccacaagcc

SEQ ID NO: 334760 - DNA, 25 bp, Mus musculus
ggtctgtgtgtgcagggaaatctgc

SEQ ID NO: 334761 - DNA, 25 bp, Mus musculus
ggtctgttctgactgctgcagctgg

SEQ ID NO: 334762 - DNA, 25 bp, Mus musculus
ggtcttaaatctggggaaggaagcc

SEQ ID NO: 334763 - DNA, 25 bp, Mus musculus
ggtcttaaatctggttaactatttg

SEQ ID NO: 334764 - DNA, 25 bp, Mus musculus
ggtcttaaatctgttcacacagaag

SEQ ID NO: 334765 - DNA, 25 bp, Mus musculus
ggtcttaagaagattgaaaagcaaa

SEQ ID NO: 334766 - DNA, 25 bp, Mus musculus
ggtcttaagaaggtcttgctgtgca

SEQ ID NO: 334767 - DNA, 25 bp, Mus musculus
ggtcttagagagagtgcagttctcc

SEQ ID NO: 334768 - DNA, 25 bp, Mus musculus
ggtcttatctcgagttgggaaccaa

SEQ ID NO: 334769 - DNA, 25 bp, Mus musculus
ggtcttatctcgatgaggtctcaat

SEQ ID NO: 334770 - DNA, 25 bp, Mus musculus
ggtcttatctcggttacacctgtaa

SEQ ID NO: 334771 - DNA, 25 bp, Mus musculus
ggtcttcaaggaaccagcacctgtt

SEQ ID NO: 334772 - DNA, 25 bp, Mus musculus
ggtcttcacaggcgtggagaccatg

SEQ ID NO: 334773 - DNA, 25 bp, Mus musculus
ggtcttcacagggacctgtgggatc

SEQ ID NO: 334774 - DNA, 25 bp, Mus musculus
ggtcttcaccacttccctgatgatc

SEQ ID NO: 334775 - DNA, 25 bp, Mus musculus
ggtcttcacctgcctctgcctcctg

SEQ ID NO: 334776 - DNA, 25 bp, Mus musculus
ggtcttcagagagaggtaccgaccc

SEQ ID NO: 334777 - DNA, 25 bp, Mus musculus
ggtcttcagagagagtctttctgca

SEQ ID NO: 334778 - DNA, 25 bp, Mus musculus
ggtcttcagagtggaattgggctta

SEQ ID NO: 334779 - DNA, 25 bp, Mus musculus
ggtcttcagtctgagattggccagg

SEQ ID NO: 334780 - DNA, 25 bp, Mus musculus
ggtcttcatctcaaggatccttgac

SEQ ID NO: 334781 - DNA, 25 bp, Mus musculus
ggtcttccagatcacagacctgtcc

SEQ ID NO: 334782 - DNA, 25 bp, Mus musculus
ggtcttccagatgagaaaatgatgt

SEQ ID NO: 334783 - DNA, 25 bp, Mus musculus
ggtcttccagatggggacttcagac

SEQ ID NO: 334784 - DNA, 25 bp, Mus musculus
ggtcttccaggcccaaagggtgagg

SEQ ID NO: 334785 - DNA, 25 bp, Mus musculus
ggtcttccaggggaatgcaggcaac

SEQ ID NO: 334786 - DNA, 25 bp, Mus musculus
ggtcttccctagagatggctttcct

SEQ ID NO: 334787 - DNA, 25 bp, Mus musculus
ggtcttcctgacagggagccaggct

SEQ ID NO: 334788 - DNA, 25 bp, Mus musculus
ggtcttcttgagctcggcttcatga

SEQ ID NO: 334789 - DNA, 25 bp, Mus musculus
ggtcttcttgaggtgagcgggatgg

SEQ ID NO: 334790 - DNA, 25 bp, Mus musculus
ggtcttcttttgccaggctgagctg

SEQ ID NO: 334791 - DNA, 25 bp, Mus musculus
ggtcttgacagaggatctccctcag

SEQ ID NO: 334792 - DNA, 25 bp, Mus musculus
ggtcttgcaaatttgatgcattctt

SEQ ID NO: 334793 - DNA, 25 bp, Mus musculus
ggtcttgccaaggtgattcctccta

SEQ ID NO: 334794 - DNA, 25 bp, Mus musculus
ggtcttgctgaggaacatggttggt

SEQ ID NO: 334795 - DNA, 25 bp, Mus musculus
ggtcttgctgttactataaagctct

SEQ ID NO: 334796 - DNA, 25 bp, Mus musculus
ggtcttgctgttactattgacaccg

SEQ ID NO: 334797 - DNA, 25 bp, Mus musculus
ggtcttgggaagaaagacgatgctc

SEQ ID NO: 334798 - DNA, 25 bp, Mus musculus
ggtcttgggaggaggcttgaagatg

SEQ ID NO: 334799 - DNA, 25 bp, Mus musculus
ggtcttgtgagtaacatttcacttg

SEQ ID NO: 334800 - DNA, 25 bp, Mus musculus
ggtctttaagaagggctctgctaag

SEQ ID NO: 334801 - DNA, 25 bp, Mus musculus
ggtctttgagaggtatatctttgca

SEQ ID NO: 334802 - DNA, 25 bp, Mus musculus
ggtctttggaacatagacaacatag

SEQ ID NO: 334803 - DNA, 25 bp, Mus musculus
ggtctttggagatatggaaggccag

SEQ ID NO: 334804 - DNA, 25 bp, Mus musculus
ggtcttttcctgccccacctccaga

SEQ ID NO: 334805 - DNA, 25 bp, Mus musculus
ggtgaaaaccaagaatccacctcat

SEQ ID NO: 334806 - DNA, 25 bp, Mus musculus
ggtgaaaagaagaccttgtcctggc

SEQ ID NO: 334807 - DNA, 25 bp, Mus musculus
ggtgaaaagccggctttctccttcc

SEQ ID NO: 334808 - DNA, 25 bp, Mus musculus
ggtgaaaatgctgacgtcctacaac

SEQ ID NO: 334809 - DNA, 25 bp, Mus musculus
ggtgaaaatgcttgggtcaccagtg

SEQ ID NO: 334810 - DNA, 25 bp, Mus musculus
ggtgaaacacaggacttccatagtt

SEQ ID NO: 334811 - DNA, 25 bp, Mus musculus
ggtgaaagaaaaagtggcccatcct

SEQ ID NO: 334812 - DNA, 25 bp, Mus musculus
ggtgaaagagactcggatgacgccc

SEQ ID NO: 334813 - DNA, 25 bp, Mus musculus
ggtgaaagaggtgacagctactaat

SEQ ID NO: 334814 - DNA, 25 bp, Mus musculus
ggtgaaatgaggaagaaaagcgagt

SEQ ID NO: 334815 - DNA, 25 bp, Mus musculus
ggtgaaattggaactcctggccctg

SEQ ID NO: 334816 - DNA, 25 bp, Mus musculus
ggtgaaatttatgattccatattaa

SEQ ID NO: 334817 - DNA, 25 bp, Mus musculus
ggtgaacaaaacagattgcctgcag

SEQ ID NO: 334818 - DNA, 25 bp, Mus musculus
ggtgaacaaggtgttccaggaagag

SEQ ID NO: 334819 - DNA, 25 bp, Mus musculus
ggtgaacaatgcagcagcaagtcct

SEQ ID NO: 334820 - DNA, 25 bp, Mus musculus
ggtgaacatcgaagacgccataaag

SEQ ID NO: 334821 - DNA, 25 bp, Mus musculus
ggtgaacatcggaaggaagagagag

SEQ ID NO: 334822 - DNA, 25 bp, Mus musculus
ggtgaacatttctgtattactatga

SEQ ID NO: 334823 - DNA, 25 bp, Mus musculus
ggtgaacccattggtcagtgacatc

SEQ ID NO: 334824 - DNA, 25 bp, Mus musculus
ggtgaactcagacaaggtctgggtg

SEQ ID NO: 334825 - DNA, 25 bp, Mus musculus
ggtgaactcaggttcttgctatgca

SEQ ID NO: 334826 - DNA, 25 bp, Mus musculus
ggtgaactggctgacagttgatgaa

SEQ ID NO: 334827 - DNA, 25 bp, Mus musculus
ggtgaactggctgactgccttgtgt

SEQ ID NO: 334828 - DNA, 25 bp, Mus musculus
ggtgaactggctgactgctgatctg

SEQ ID NO: 334829 - DNA, 25 bp, Mus musculus
ggtgaactggctgactgctgtagtg

SEQ ID NO: 334830 - DNA, 25 bp, Mus musculus
ggtgaactggctgagacttgctaag

SEQ ID NO: 334831 - DNA, 25 bp, Mus musculus
ggtgaagaagaagctgactgcggag

SEQ ID NO: 334832 - DNA, 25 bp, Mus musculus
ggtgaagaaggtgataaatgcacat

SEQ ID NO: 334833 - DNA, 25 bp, Mus musculus
ggtgaagaaggttcattatgatgga

SEQ ID NO: 334834 - DNA, 25 bp, Mus musculus
ggtgaagagcaaatttgacgccgag

SEQ ID NO: 334835 - DNA, 25 bp, Mus musculus
ggtgaagagcaggtatctcagacga

SEQ ID NO: 334836 - DNA, 25 bp, Mus musculus
ggtgaagagctgctatatccagagc

SEQ ID NO: 334837 - DNA, 25 bp, Mus musculus
ggtgaagagctggtatatccagagc

SEQ ID NO: 334838 - DNA, 25 bp, Mus musculus
ggtgaagcacctcctggacctcctg

SEQ ID NO: 334839 - DNA, 25 bp, Mus musculus
ggtgaagcagaatgatatggaacct

SEQ ID NO: 334840 - DNA, 25 bp, Mus musculus
ggtgaagcaggagcttctggaagag

SEQ ID NO: 334841 - DNA, 25 bp, Mus musculus
ggtgaagcatgatcagcaagtcgct

SEQ ID NO: 334842 - DNA, 25 bp, Mus musculus
ggtgaagcatggggccactgtcttc

SEQ ID NO: 334843 - DNA, 25 bp, Mus musculus
ggtgaagctcagaaacttgattgaa

SEQ ID NO: 334844 - DNA, 25 bp, Mus musculus
ggtgaagcttggctgctgtgaaggg

SEQ ID NO: 334845 - DNA, 25 bp, Mus musculus
ggtgaaggaaaagtatgatacagac

SEQ ID NO: 334846 - DNA, 25 bp, Mus musculus
ggtgaaggaagatgaggctcgcatc

SEQ ID NO: 334847 - DNA, 25 bp, Mus musculus
ggtgaaggaatacgtgctgcccagt

SEQ ID NO: 334848 - DNA, 25 bp, Mus musculus
ggtgaaggagaaaggcgccctggct

SEQ ID NO: 334849 - DNA, 25 bp, Mus musculus
ggtgaaggagaaaggcgctgacttc

SEQ ID NO: 334850 - DNA, 25 bp, Mus musculus
ggtgaaggagctcagaaggagtgaa

SEQ ID NO: 334851 - DNA, 25 bp, Mus musculus
ggtgaaggagtattcatggctgctc

SEQ ID NO: 334852 - DNA, 25 bp, Mus musculus
ggtgaaggcatgggtcttcggatca

SEQ ID NO: 334853 - DNA, 25 bp, Mus musculus
ggtgaaggtgctgaggcaccatcac

SEQ ID NO: 334854 - DNA, 25 bp, Mus musculus
ggtgaagtacttaaggctcaggccg

SEQ ID NO: 334855 - DNA, 25 bp, Mus musculus
ggtgaagtacttaagtcaggaggag

SEQ ID NO: 334856 - DNA, 25 bp, Mus musculus
ggtgaagtaggaaacacactggaga

SEQ ID NO: 334857 - DNA, 25 bp, Mus musculus
ggtgaagtggaggaggacttggtga

SEQ ID NO: 334858 - DNA, 25 bp, Mus musculus
ggtgaatagcaaaggatgcagtcat

SEQ ID NO: 334859 - DNA, 25 bp, Mus musculus
ggtgaatccagcctgaaactgttat

SEQ ID NO: 334860 - DNA, 25 bp, Mus musculus
ggtgaatccagcctggctgacgttg

SEQ ID NO: 334861 - DNA, 25 bp, Mus musculus
ggtgaatccaggtttgatctgtgga

SEQ ID NO: 334862 - DNA, 25 bp, Mus musculus
ggtgaatgcacagacgtggacgaat

SEQ ID NO: 334863 - DNA, 25 bp, Mus musculus
ggtgaatgctctggtgtccgccgat

SEQ ID NO: 334864 - DNA, 25 bp, Mus musculus
ggtgaatgtcacagatgccatctca

SEQ ID NO: 334865 - DNA, 25 bp, Mus musculus
ggtgaatgtgacaagatcgtgaacc

SEQ ID NO: 334866 - DNA, 25 bp, Mus musculus
ggtgaatgtgacaaggcatatctag

SEQ ID NO: 334867 - DNA, 25 bp, Mus musculus
ggtgaattctcagatgccagcatgt

SEQ ID NO: 334868 - DNA, 25 bp, Mus musculus
ggtgaattctcagttaaatttaaaa

SEQ ID NO: 334869 - DNA, 25 bp, Mus musculus
ggtgaattgggatgatgaggaatct

SEQ ID NO: 334870 - DNA, 25 bp, Mus musculus
ggtgacaaagcaggtaaacactggc

SEQ ID NO: 334871 - DNA, 25 bp, Mus musculus
ggtgacaaaggagaccctggcttca

SEQ ID NO: 334872 - DNA, 25 bp, Mus musculus
ggtgacaacgaaaatatctgcagaa

SEQ ID NO: 334873 - DNA, 25 bp, Mus musculus
ggtgacaagaaaaatatcgctgtag

SEQ ID NO: 334874 - DNA, 25 bp, Mus musculus
ggtgacaagggcaggctgctgtcac

SEQ ID NO: 334875 - DNA, 25 bp, Mus musculus
ggtgacaatatctggcaaaaaggat

SEQ ID NO: 334876 - DNA, 25 bp, Mus musculus
ggtgacaatgagttttcttggaggc

SEQ ID NO: 334877 - DNA, 25 bp, Mus musculus
ggtgacaatggtaaacctagccttt

SEQ ID NO: 334878 - DNA, 25 bp, Mus musculus
ggtgacacaagggacccgggaggcg

SEQ ID NO: 334879 - DNA, 25 bp, Mus musculus
ggtgacacaaggtgtggcctttgca

SEQ ID NO: 334880 - DNA, 25 bp, Mus musculus
ggtgacacagaagatctggaacttc

SEQ ID NO: 334881 - DNA, 25 bp, Mus musculus
ggtgacacagaaggaaggaattcag

SEQ ID NO: 334882 - DNA, 25 bp, Mus musculus
ggtgacacctgtgtacaggaaaact

SEQ ID NO: 334883 - DNA, 25 bp, Mus musculus
ggtgacagacagtcttcacacatct

SEQ ID NO: 334884 - DNA, 25 bp, Mus musculus
ggtgacagataagaactgagtcaaa

SEQ ID NO: 334885 - DNA, 25 bp, Mus musculus
ggtgacagataagtgtccagctgct

SEQ ID NO: 334886 - DNA, 25 bp, Mus musculus
ggtgacagataagttcggaataaat

SEQ ID NO: 334887 - DNA, 25 bp, Mus musculus
ggtgacaggatggctgggcacagag

SEQ ID NO: 334888 - DNA, 25 bp, Mus musculus
ggtgacaggatgttggtgttggtac

SEQ ID NO: 334889 - DNA, 25 bp, Mus musculus
ggtgacaggtattgagatgttccac

SEQ ID NO: 334890 - DNA, 25 bp, Mus musculus
ggtgacatttgaaaatgtcaaggag

SEQ ID NO: 334891 - DNA, 25 bp, Mus musculus
ggtgaccaaacgcagaagcttgcag

SEQ ID NO: 334892 - DNA, 25 bp, Mus musculus
ggtgaccaagactgcgcttcgccat

SEQ ID NO: 334893 - DNA, 25 bp, Mus musculus
ggtgaccagtgtgagaagaaacggg

SEQ ID NO: 334894 - DNA, 25 bp, Mus musculus
ggtgaccattgaagatgatgactat

SEQ ID NO: 334895 - DNA, 25 bp, Mus musculus
ggtgaccccatgcagaccagactct

SEQ ID NO: 334896 - DNA, 25 bp, Mus musculus
ggtgaccccatgcaggaatctgatg

SEQ ID NO: 334897 - DNA, 25 bp, Mus musculus
ggtgaccccatgcaggtttatggtg

SEQ ID NO: 334898 - DNA, 25 bp, Mus musculus
ggtgacccgccaggacaatggattt

SEQ ID NO: 334899 - DNA, 25 bp, Mus musculus
ggtgacctatcagggtacttttgat

SEQ ID NO: 334900 - DNA, 25 bp, Mus musculus
ggtgacctcctcagtgggaacacag

SEQ ID NO: 334901 - DNA, 25 bp, Mus musculus
ggtgacctgggatggattcatgggt

SEQ ID NO: 334902 - DNA, 25 bp, Mus musculus
ggtgacctgtgacatccggctccgg

SEQ ID NO: 334903 - DNA, 25 bp, Mus musculus
ggtgacctgtgatggggaaacaggc

SEQ ID NO: 334904 - DNA, 25 bp, Mus musculus
ggtgaccttggaggatttgaggcgc

SEQ ID NO: 334905 - DNA, 25 bp, Mus musculus
ggtgacctttgctttagggatcagt

SEQ ID NO: 334906 - DNA, 25 bp, Mus musculus
ggtgacctttgctttgattctttca

SEQ ID NO: 334907 - DNA, 25 bp, Mus musculus
ggtgacgcgacagaaaccgcccaga

SEQ ID NO: 334908 - DNA, 25 bp, Mus musculus
ggtgacgcgacagcacaccacatgt

SEQ ID NO: 334909 - DNA, 25 bp, Mus musculus
ggtgacgctgggttgccccggaggc

SEQ ID NO: 334910 - DNA, 25 bp, Mus musculus
ggtgactactggaataccagttgta

SEQ ID NO: 334911 - DNA, 25 bp, Mus musculus
ggtgactcacagctgaaggtggaga

SEQ ID NO: 334912 - DNA, 25 bp, Mus musculus
ggtgactcacagggaacaacccctt

SEQ ID NO: 334913 - DNA, 25 bp, Mus musculus
ggtgactcatgccagggttgtcgcc

SEQ ID NO: 334914 - DNA, 25 bp, Mus musculus
ggtgactccaaggacaagaccagtg

SEQ ID NO: 334915 - DNA, 25 bp, Mus musculus
ggtgactccaggagcagttcctcca

SEQ ID NO: 334916 - DNA, 25 bp, Mus musculus
ggtgactccaggaggagcgacagtt

SEQ ID NO: 334917 - DNA, 25 bp, Mus musculus
ggtgactccaggaggcttccagctt

SEQ ID NO: 334918 - DNA, 25 bp, Mus musculus
ggtgactctggggctgacaaaaagt

SEQ ID NO: 334919 - DNA, 25 bp, Mus musculus
ggtgactgatggtggaatgtacgtc

SEQ ID NO: 334920 - DNA, 25 bp, Mus musculus
ggtgactgcggcgcaaccatgaagg

SEQ ID NO: 334921 - DNA, 25 bp, Mus musculus
ggtgactgctcccttccctggtcta

SEQ ID NO: 334922 - DNA, 25 bp, Mus musculus
ggtgactggatctgggagcatcaag

SEQ ID NO: 334923 - DNA, 25 bp, Mus musculus
ggtgactggttgcaatcaggattca

SEQ ID NO: 334924 - DNA, 25 bp, Mus musculus
ggtgactggttgttaaatgaagctt

SEQ ID NO: 334925 - DNA, 25 bp, Mus musculus
ggtgactgtacagtatgtgcagagc

SEQ ID NO: 334926 - DNA, 25 bp, Mus musculus
ggtgactgtacagtgaaacagatgt

SEQ ID NO: 334927 - DNA, 25 bp, Mus musculus
ggtgactgtgtgtttgatcctgagt

SEQ ID NO: 334928 - DNA, 25 bp, Mus musculus
ggtgacttccgaggtcctggaggcc

SEQ ID NO: 334929 - DNA, 25 bp, Mus musculus
ggtgactttcattggtgctgtcccc

SEQ ID NO: 334930 - DNA, 25 bp, Mus musculus
ggtgagaaagaggagacagagtatg

SEQ ID NO: 334931 - DNA, 25 bp, Mus musculus
ggtgagaaaggggagacagagtatg

SEQ ID NO: 334932 - DNA, 25 bp, Mus musculus
ggtgagaacaagaaagcatctaaag

SEQ ID NO: 334933 - DNA, 25 bp, Mus musculus
ggtgagaaccgagttcctgttcctc

SEQ ID NO: 334934 - DNA, 25 bp, Mus musculus
ggtgagaactaggtgctcctgccat

SEQ ID NO: 334935 - DNA, 25 bp, Mus musculus
ggtgagacccaggttcaactggaga

SEQ ID NO: 334936 - DNA, 25 bp, Mus musculus
ggtgagagccagaggcactgagagt

SEQ ID NO: 334937 - DNA, 25 bp, Mus musculus
ggtgagagctcaaggcttctagctc

SEQ ID NO: 334938 - DNA, 25 bp, Mus musculus
ggtgagaggaagactctgcagcttc

SEQ ID NO: 334939 - DNA, 25 bp, Mus musculus
ggtgagaggtaagcttgtctcctct

SEQ ID NO: 334940 - DNA, 25 bp, Mus musculus
ggtgagatctgtgaggaaggtctac

SEQ ID NO: 334941 - DNA, 25 bp, Mus musculus
ggtgagatggacaggcagcgggcag

SEQ ID NO: 334942 - DNA, 25 bp, Mus musculus
ggtgagattccaggtggcagacatg

SEQ ID NO: 334943 - DNA, 25 bp, Mus musculus
ggtgagcaaggtaagctctgaggat

SEQ ID NO: 334944 - DNA, 25 bp, Mus musculus
ggtgagcaagttgagctctgaggat

SEQ ID NO: 334945 - DNA, 25 bp, Mus musculus
ggtgagcacgatgaaacggacagga

SEQ ID NO: 334946 - DNA, 25 bp, Mus musculus
ggtgagcatgcaggctctgctctga

SEQ ID NO: 334947 - DNA, 25 bp, Mus musculus
ggtgagccaggcaccttttgtgtcc

SEQ ID NO: 334948 - DNA, 25 bp, Mus musculus
ggtgagccaggcctcgagcactgcg

SEQ ID NO: 334949 - DNA, 25 bp, Mus musculus
ggtgagccagtgactccactggctc

SEQ ID NO: 334950 - DNA, 25 bp, Mus musculus
ggtgagccatcttttctggggactg

SEQ ID NO: 334951 - DNA, 25 bp, Mus musculus
ggtgagcctcccgagcaccatcaat

SEQ ID NO: 334952 - DNA, 25 bp, Mus musculus
ggtgagcggcctgagatccagagac

SEQ ID NO: 334953 - DNA, 25 bp, Mus musculus
ggtgagcggtgagcgacatgtcctt

SEQ ID NO: 334954 - DNA, 25 bp, Mus musculus
ggtgagcggtgagcgacgggccgca

SEQ ID NO: 334955 - DNA, 25 bp, Mus musculus
ggtgaggacacgagttgcattgtag

SEQ ID NO: 334956 - DNA, 25 bp, Mus musculus
ggtgaggacagaagatacaatggag

SEQ ID NO: 334957 - DNA, 25 bp, Mus musculus
ggtgaggactgcgggccttcatcaa

SEQ ID NO: 334958 - DNA, 25 bp, Mus musculus
ggtgaggaggaagaaatggtccttc

SEQ ID NO: 334959 - DNA, 25 bp, Mus musculus
ggtgaggatcaggttggtacacgat

SEQ ID NO: 334960 - DNA, 25 bp, Mus musculus
ggtgaggattcgaaagaatagactt

SEQ ID NO: 334961 - DNA, 25 bp, Mus musculus
ggtgaggattcggacttctagatct

SEQ ID NO: 334962 - DNA, 25 bp, Mus musculus
ggtgaggatttctcccaggaaagca

SEQ ID NO: 334963 - DNA, 25 bp, Mus musculus
ggtgaggcggcagctgcagcagcct

SEQ ID NO: 334964 - DNA, 25 bp, Mus musculus
ggtgaggctagaaagaaggatttcg

SEQ ID NO: 334965 - DNA, 25 bp, Mus musculus
ggtgaggctggtggagttcatgaca

SEQ ID NO: 334966 - DNA, 25 bp, Mus musculus
ggtgaggcttccagatggtcggcag

SEQ ID NO: 334967 - DNA, 25 bp, Mus musculus
ggtgagggggaggtccaacacaatc

SEQ ID NO: 334968 - DNA, 25 bp, Mus musculus
ggtgaggtacacaggcgcaggtctg

SEQ ID NO: 334969 - DNA, 25 bp, Mus musculus
ggtgaggtgcgacaggtaaatttaa

SEQ ID NO: 334970 - DNA, 25 bp, Mus musculus
ggtgagtacgcctgctaagccccag

SEQ ID NO: 334971 - DNA, 25 bp, Mus musculus
ggtgagtcagcagattcacaacatc

SEQ ID NO: 334972 - DNA, 25 bp, Mus musculus
ggtgagtgaagagctctgcagtttt

SEQ ID NO: 334973 - DNA, 25 bp, Mus musculus
ggtgagtgactccaggctgtccttg

SEQ ID NO: 334974 - DNA, 25 bp, Mus musculus
ggtgagtgatcagggcaccctcaga

SEQ ID NO: 334975 - DNA, 25 bp, Mus musculus
ggtgagtggatgatcacttgattga

SEQ ID NO: 334976 - DNA, 25 bp, Mus musculus
ggtgagttcaggtactcagttcgtg

SEQ ID NO: 334977 - DNA, 25 bp, Mus musculus
ggtgagttcaggtggttgtggaggc

SEQ ID NO: 334978 - DNA, 25 bp, Mus musculus
ggtgagtttgaaaccaggaaaatgg

SEQ ID NO: 334979 - DNA, 25 bp, Mus musculus
ggtgataaaaaggtgtcactctgca

SEQ ID NO: 334980 - DNA, 25 bp, Mus musculus
ggtgataaaaagtctttttatgaac

SEQ ID NO: 334981 - DNA, 25 bp, Mus musculus
ggtgataacggatagacaggaaaat

SEQ ID NO: 334982 - DNA, 25 bp, Mus musculus
ggtgataagtcagatgaatgagaac

SEQ ID NO: 334983 - DNA, 25 bp, Mus musculus
ggtgataataaggacaaccggatcc

SEQ ID NO: 334984 - DNA, 25 bp, Mus musculus
ggtgataataagtttctgagggtca

SEQ ID NO: 334985 - DNA, 25 bp, Mus musculus
ggtgatacagcaggtggggatgcgt

SEQ ID NO: 334986 - DNA, 25 bp, Mus musculus
ggtgatatcccagattttagaaagg

SEQ ID NO: 334987 - DNA, 25 bp, Mus musculus
ggtgatatcccaggtccaaatatca

SEQ ID NO: 334988 - DNA, 25 bp, Mus musculus
ggtgatatgcacagtggcttctatt

SEQ ID NO: 334989 - DNA, 25 bp, Mus musculus
ggtgatcaaaggcattcctttggac

SEQ ID NO: 334990 - DNA, 25 bp, Mus musculus
ggtgatcaaagggtgaagtcggtga

SEQ ID NO: 334991 - DNA, 25 bp, Mus musculus
ggtgatcaagaaatgcattgatatt

SEQ ID NO: 334992 - DNA, 25 bp, Mus musculus
ggtgatccagagaagagtttagcgg

SEQ ID NO: 334993 - DNA, 25 bp, Mus musculus
ggtgatccaggtcattgtggccaca

SEQ ID NO: 334994 - DNA, 25 bp, Mus musculus
ggtgatccctgcagacggctctgtg

SEQ ID NO: 334995 - DNA, 25 bp, Mus musculus
ggtgatccgagatcgcctttgtttt

SEQ ID NO: 334996 - DNA, 25 bp, Mus musculus
ggtgatcgaggggctgacatggacc

SEQ ID NO: 334997 - DNA, 25 bp, Mus musculus
ggtgatctcagacgggtcacccttg

SEQ ID NO: 334998 - DNA, 25 bp, Mus musculus
ggtgatctcagccttgccggagctt

SEQ ID NO: 334999 - DNA, 25 bp, Mus musculus
ggtgatgaaaactacatggaatttc

SEQ ID NO: 335000 - DNA, 25 bp, Mus musculus
ggtgatgaaagggctgtgcctggct

SEQ ID NO: 335001 - DNA, 25 bp, Mus musculus
ggtgatgaaagtggctcagctcaac

SEQ ID NO: 335002 - DNA, 25 bp, Mus musculus
ggtgatgacagaggacaaaggtgtg

SEQ ID NO: 335003 - DNA, 25 bp, Mus musculus
ggtgatgacagtcacctctcctctc

SEQ ID NO: 335004 - DNA, 25 bp, Mus musculus
ggtgatgactcagcttctaaggagc

SEQ ID NO: 335005 - DNA, 25 bp, Mus musculus
ggtgatgactgcccagtgtttccag

SEQ ID NO: 335006 - DNA, 25 bp, Mus musculus
ggtgatgactgttgctttcactacc

SEQ ID NO: 335007 - DNA, 25 bp, Mus musculus
ggtgatgagaggaagctttgtctcc

SEQ ID NO: 335008 - DNA, 25 bp, Mus musculus
ggtgatgcagagactgtgctgtatc

SEQ ID NO: 335009 - DNA, 25 bp, Mus musculus
ggtgatgcgcaagggctacgagggc

SEQ ID NO: 335010 - DNA, 25 bp, Mus musculus
ggtgatgcgcaaggtatgaatgctg

SEQ ID NO: 335011 - DNA, 25 bp, Mus musculus
ggtgatgctggacaagtgggagaaa

SEQ ID NO: 335012 - DNA, 25 bp, Mus musculus
ggtgatgctggggagatggtgcgcc

SEQ ID NO: 335013 - DNA, 25 bp, Mus musculus
ggtgatggaaagctgagcccaggaa

SEQ ID NO: 335014 - DNA, 25 bp, Mus musculus
ggtgatgggaagcaggtacccaccc

SEQ ID NO: 335015 - DNA, 25 bp, Mus musculus
ggtgatggtgaggtctagtgacagg

SEQ ID NO: 335016 - DNA, 25 bp, Mus musculus
ggtgatggtgcacgcctctgcctcc

SEQ ID NO: 335017 - DNA, 25 bp, Mus musculus
ggtgattactctgagagagtcagtc

SEQ ID NO: 335018 - DNA, 25 bp, Mus musculus
ggtgattatagcaatcagcagagtg

SEQ ID NO: 335019 - DNA, 25 bp, Mus musculus
ggtgattccaccagtggacagaggg

SEQ ID NO: 335020 - DNA, 25 bp, Mus musculus
ggtgattctcttgccattcattgac

SEQ ID NO: 335021 - DNA, 25 bp, Mus musculus
ggtgattctcttggattgttcatca

SEQ ID NO: 335022 - DNA, 25 bp, Mus musculus
ggtgattgacaaggttttacttgta

SEQ ID NO: 335023 - DNA, 25 bp, Mus musculus
ggtgattgaggacgcctcatgctct

SEQ ID NO: 335024 - DNA, 25 bp, Mus musculus
ggtgattgcgcaggccttcagaagt

SEQ ID NO: 335025 - DNA, 25 bp, Mus musculus
ggtgattggaggcctgggagctgcc

SEQ ID NO: 335026 - DNA, 25 bp, Mus musculus
ggtgcaaaaggtaccagcaaggtga

SEQ ID NO: 335027 - DNA, 25 bp, Mus musculus
ggtgcaaagaggaaaacaccataat

SEQ ID NO: 335028 - DNA, 25 bp, Mus musculus
ggtgcaaaggcctgaatcaggtctg

SEQ ID NO: 335029 - DNA, 25 bp, Mus musculus
ggtgcaaagttggtatatccaaagc

SEQ ID NO: 335030 - DNA, 25 bp, Mus musculus
ggtgcaagagagtgtccaagcacga

SEQ ID NO: 335031 - DNA, 25 bp, Mus musculus
ggtgcaagaggcaagacctggggat

SEQ ID NO: 335032 - DNA, 25 bp, Mus musculus
ggtgcaagcaggttatgaggtgacg

SEQ ID NO: 335033 - DNA, 25 bp, Mus musculus
ggtgcaatgggtgaaagagctggtc

SEQ ID NO: 335034 - DNA, 25 bp, Mus musculus
ggtgcacagaccaggtgattgtgca

SEQ ID NO: 335035 - DNA, 25 bp, Mus musculus
ggtgcacatgccaggggatgcccca

SEQ ID NO: 335036 - DNA, 25 bp, Mus musculus
ggtgcacatggaccagttggaggtg

SEQ ID NO: 335037 - DNA, 25 bp, Mus musculus
ggtgcaccaaacaggaccagagttt

SEQ ID NO: 335038 - DNA, 25 bp, Mus musculus
ggtgcaccaaacccagctgtgttcc

SEQ ID NO: 335039 - DNA, 25 bp, Mus musculus
ggtgcaccaaacggttgcagacccc

SEQ ID NO: 335040 - DNA, 25 bp, Mus musculus
ggtgcacctcagctttgtgcgctct

SEQ ID NO: 335041 - DNA, 25 bp, Mus musculus
ggtgcactcagggtggcacaagact

SEQ ID NO: 335042 - DNA, 25 bp, Mus musculus
ggtgcactcaggtcctcattcctag

SEQ ID NO: 335043 - DNA, 25 bp, Mus musculus
ggtgcactgagtaggcagaaaactt

SEQ ID NO: 335044 - DNA, 25 bp, Mus musculus
ggtgcactgcaaagctggaatgaag

SEQ ID NO: 335045 - DNA, 25 bp, Mus musculus
ggtgcagaaggtttttcaagacaga

SEQ ID NO: 335046 - DNA, 25 bp, Mus musculus
ggtgcagacatttatggtggttatg

SEQ ID NO: 335047 - DNA, 25 bp, Mus musculus
ggtgcagacctcaccgacacactgg

SEQ ID NO: 335048 - DNA, 25 bp, Mus musculus
ggtgcagacctcaccttcctcacag

SEQ ID NO: 335049 - DNA, 25 bp, Mus musculus
ggtgcagactggcccttcaaattgg

SEQ ID NO: 335050 - DNA, 25 bp, Mus musculus
ggtgcagaggagaacgcggtgtgtg

SEQ ID NO: 335051 - DNA, 25 bp, Mus musculus
ggtgcagagtggcatggaaggtgaa

SEQ ID NO: 335052 - DNA, 25 bp, Mus musculus
ggtgcagcaggatgctgggcagttt

SEQ ID NO: 335053 - DNA, 25 bp, Mus musculus
ggtgcagcaggatgcttcatctgca

SEQ ID NO: 335054 - DNA, 25 bp, Mus musculus
ggtgcagccagatggagtggccgga

SEQ ID NO: 335055 - DNA, 25 bp, Mus musculus
ggtgcagcccagtggtatgacctga

SEQ ID NO: 335056 - DNA, 25 bp, Mus musculus
ggtgcagcgaggagggctaccagtt

SEQ ID NO: 335057 - DNA, 25 bp, Mus musculus
ggtgcagcgatcaggtaatagtgca

SEQ ID NO: 335058 - DNA, 25 bp, Mus musculus
ggtgcagcgcggcgaaagaaagatc

SEQ ID NO: 335059 - DNA, 25 bp, Mus musculus
ggtgcagcgctccggtggaatgaac

SEQ ID NO: 335060 - DNA, 25 bp, Mus musculus
ggtgcagcggaagggcgtgtggaat

SEQ ID NO: 335061 - DNA, 25 bp, Mus musculus
ggtgcagcggccagaagatgcatct

SEQ ID NO: 335062 - DNA, 25 bp, Mus musculus
ggtgcagctctccagtgtggatgcc

SEQ ID NO: 335063 - DNA, 25 bp, Mus musculus
ggtgcaggaaaacattgctgatagc

SEQ ID NO: 335064 - DNA, 25 bp, Mus musculus
ggtgcaggaaggtgtgaaacagaag

SEQ ID NO: 335065 - DNA, 25 bp, Mus musculus
ggtgcaggacagctgtggagctggc

SEQ ID NO: 335066 - DNA, 25 bp, Mus musculus
ggtgcaggactgggctacacagaga

SEQ ID NO: 335067 - DNA, 25 bp, Mus musculus
ggtgcaggactgggctacgcagatc

SEQ ID NO: 335068 - DNA, 25 bp, Mus musculus
ggtgcaggagatcagggtctgatgt

SEQ ID NO: 335069 - DNA, 25 bp, Mus musculus
ggtgcaggctgactttttggggttt

SEQ ID NO: 335070 - DNA, 25 bp, Mus musculus
ggtgcaggctggttaccatggcatc

SEQ ID NO: 335071 - DNA, 25 bp, Mus musculus
ggtgcagggggaacagctgtgccaa

SEQ ID NO: 335072 - DNA, 25 bp, Mus musculus
ggtgcaggggtgtgccccagagaac

SEQ ID NO: 335073 - DNA, 25 bp, Mus musculus
ggtgcagggtgtggtgtgtcctctg

SEQ ID NO: 335074 - DNA, 25 bp, Mus musculus
ggtgcagtacaaagagtacttttga

SEQ ID NO: 335075 - DNA, 25 bp, Mus musculus
ggtgcagtatgatctgaagagtgca

SEQ ID NO: 335076 - DNA, 25 bp, Mus musculus
ggtgcagtcaccgccaccccgggac

SEQ ID NO: 335077 - DNA, 25 bp, Mus musculus
ggtgcagtcaccgccggcccagtgc

SEQ ID NO: 335078 - DNA, 25 bp, Mus musculus
ggtgcagtcaccgcctaatagggcc

SEQ ID NO: 335079 - DNA, 25 bp, Mus musculus
ggtgcagttaaagctccctcttgat

SEQ ID NO: 335080 - DNA, 25 bp, Mus musculus
ggtgcagttaaaggatggttcctat

SEQ ID NO: 335081 - DNA, 25 bp, Mus musculus
ggtgcatcaggtttgcaagtgagat

SEQ ID NO: 335082 - DNA, 25 bp, Mus musculus
ggtgcatccgtaagggcaccagcgt

SEQ ID NO: 335083 - DNA, 25 bp, Mus musculus
ggtgcatgaaaggccgcaccatgta

SEQ ID NO: 335084 - DNA, 25 bp, Mus musculus
ggtgcatgctagcttggccgacagg

SEQ ID NO: 335085 - DNA, 25 bp, Mus musculus
ggtgcattctgggtttctggttagc

SEQ ID NO: 335086 - DNA, 25 bp, Mus musculus
ggtgccaagagggagctccgctttg

SEQ ID NO: 335087 - DNA, 25 bp, Mus musculus
ggtgccaatgccatgctggtgccag

SEQ ID NO: 335088 - DNA, 25 bp, Mus musculus
ggtgccacagccaccatgccaatca

SEQ ID NO: 335089 - DNA, 25 bp, Mus musculus
ggtgccacgcaggcttacagttcct

SEQ ID NO: 335090 - DNA, 25 bp, Mus musculus
ggtgccacggacttgagcatcgatg

SEQ ID NO: 335091 - DNA, 25 bp, Mus musculus
ggtgccacggtgaccatcgtcagtg

SEQ ID NO: 335092 - DNA, 25 bp, Mus musculus
ggtgccagaagctgaacttcactgg

SEQ ID NO: 335093 - DNA, 25 bp, Mus musculus
ggtgccagagcagaagtcagcatcc

SEQ ID NO: 335094 - DNA, 25 bp, Mus musculus
ggtgccagcacccaagcaaacactt

SEQ ID NO: 335095 - DNA, 25 bp, Mus musculus
ggtgccagccagtgtacgatcccaa

SEQ ID NO: 335096 - DNA, 25 bp, Mus musculus
ggtgccagctcaaagctgtgtgtca

SEQ ID NO: 335097 - DNA, 25 bp, Mus musculus
ggtgccagctgcaggccacaggcag

SEQ ID NO: 335098 - DNA, 25 bp, Mus musculus
ggtgccaggaagtggtcatattcac

SEQ ID NO: 335099 - DNA, 25 bp, Mus musculus
ggtgccaggatgaacagcagtacgc

SEQ ID NO: 335100 - DNA, 25 bp, Mus musculus
ggtgccaggtatgcaaagtgcaccc

SEQ ID NO: 335101 - DNA, 25 bp, Mus musculus
ggtgccagtactgtggtggcttcag

SEQ ID NO: 335102 - DNA, 25 bp, Mus musculus
ggtgccatctagtgctcttcctcct

SEQ ID NO: 335103 - DNA, 25 bp, Mus musculus
ggtgcccagtgctaggagaccatct

SEQ ID NO: 335104 - DNA, 25 bp, Mus musculus
ggtgcccatcagattatctgcaatg

SEQ ID NO: 335105 - DNA, 25 bp, Mus musculus
ggtgcccatggaggtcctgtccaga

SEQ ID NO: 335106 - DNA, 25 bp, Mus musculus
ggtgccccaaaccagcgtgcctcat

SEQ ID NO: 335107 - DNA, 25 bp, Mus musculus
ggtgccccaagatgaggacgctcgc

SEQ ID NO: 335108 - DNA, 25 bp, Mus musculus
ggtgccccagataagccaaagagcc

SEQ ID NO: 335109 - DNA, 25 bp, Mus musculus
ggtgccccaggtgttccatgagcag

SEQ ID NO: 335110 - DNA, 25 bp, Mus musculus
ggtgccccaggtttcttgaactcca

SEQ ID NO: 335111 - DNA, 25 bp, Mus musculus
ggtgccccttccttcccagtggatc

SEQ ID NO: 335112 - DNA, 25 bp, Mus musculus
ggtgcccgagaggttctgggagagg

SEQ ID NO: 335113 - DNA, 25 bp, Mus musculus
ggtgcccgcagatgtgcctcatcca

SEQ ID NO: 335114 - DNA, 25 bp, Mus musculus
ggtgcccggcgccggttcagtcctc

SEQ ID NO: 335115 - DNA, 25 bp, Mus musculus
ggtgcccgtgacaaatgaagagaaa

SEQ ID NO: 335116 - DNA, 25 bp, Mus musculus
ggtgccctaagtatccagcatgctc

SEQ ID NO: 335117 - DNA, 25 bp, Mus musculus
ggtgccctcttctgcacatcgagtc

SEQ ID NO: 335118 - DNA, 25 bp, Mus musculus
ggtgccctgcgggcttcgagggtgc

SEQ ID NO: 335119 - DNA, 25 bp, Mus musculus
ggtgccctggccaaggtcctggaca

SEQ ID NO: 335120 - DNA, 25 bp, Mus musculus
ggtgccgaacaccggttttgcctca

SEQ ID NO: 335121 - DNA, 25 bp, Mus musculus
ggtgccgaacaccgtgcacttaatg

SEQ ID NO: 335122 - DNA, 25 bp, Mus musculus
ggtgccgagcaacaggtgtcgttga

SEQ ID NO: 335123 - DNA, 25 bp, Mus musculus
ggtgccgcagtctcaaaccatgaat

SEQ ID NO: 335124 - DNA, 25 bp, Mus musculus
ggtgccggccgagattgctaagaag

SEQ ID NO: 335125 - DNA, 25 bp, Mus musculus
ggtgccgtgttctcgaaaaggtgct

SEQ ID NO: 335126 - DNA, 25 bp, Mus musculus
ggtgcctatggagggaggagtgatg

SEQ ID NO: 335127 - DNA, 25 bp, Mus musculus
ggtgcctatggaggggtggacaaat

SEQ ID NO: 335128 - DNA, 25 bp, Mus musculus
ggtgcctccaagggttcccgtgaga

SEQ ID NO: 335129 - DNA, 25 bp, Mus musculus
ggtgcctcggagcagagcgatcagc

SEQ ID NO: 335130 - DNA, 25 bp, Mus musculus
ggtgcctcggcccagcacagccccc

SEQ ID NO: 335131 - DNA, 25 bp, Mus musculus
ggtgcctcggttccagggtccctgc

SEQ ID NO: 335132 - DNA, 25 bp, Mus musculus
ggtgcctcgtacgggtattcccagg

SEQ ID NO: 335133 - DNA, 25 bp, Mus musculus
ggtgcctcttaaagaaaaatcaaga

SEQ ID NO: 335134 - DNA, 25 bp, Mus musculus
ggtgcctcttgccatgctggccgag

SEQ ID NO: 335135 - DNA, 25 bp, Mus musculus
ggtgcctgaaaggttgcaggaatcc

SEQ ID NO: 335136 - DNA, 25 bp, Mus musculus
ggtgcctgactttaagcaagaagta

SEQ ID NO: 335137 - DNA, 25 bp, Mus musculus
ggtgcctgcagtgtgcaatggtgct

SEQ ID NO: 335138 - DNA, 25 bp, Mus musculus
ggtgcctggacagaaatatcttgag

SEQ ID NO: 335139 - DNA, 25 bp, Mus musculus
ggtgcctggagactcctccaccctg

SEQ ID NO: 335140 - DNA, 25 bp, Mus musculus
ggtgcctggagggtctcattatgca

SEQ ID NO: 335141 - DNA, 25 bp, Mus musculus
ggtgcctggggaagactcaagggca

SEQ ID NO: 335142 - DNA, 25 bp, Mus musculus
ggtgcctggggaaggtgactttcca

SEQ ID NO: 335143 - DNA, 25 bp, Mus musculus
ggtgccttcagaattgttttacttg

SEQ ID NO: 335144 - DNA, 25 bp, Mus musculus
ggtgccttgaaggaggggtcatctc

SEQ ID NO: 335145 - DNA, 25 bp, Mus musculus
ggtgcgacaggtaaatttaacacaa

SEQ ID NO: 335146 - DNA, 25 bp, Mus musculus
ggtgcgacttggaccaattgctgga

SEQ ID NO: 335147 - DNA, 25 bp, Mus musculus
ggtgcgacttggactcggctctctc

SEQ ID NO: 335148 - DNA, 25 bp, Mus musculus
ggtgcgagccgtaacacaaggcaca

SEQ ID NO: 335149 - DNA, 25 bp, Mus musculus
ggtgcgaggagcagatatggcctcc

SEQ ID NO: 335150 - DNA, 25 bp, Mus musculus
ggtgcgaggaggtggagcctactac

SEQ ID NO: 335151 - DNA, 25 bp, Mus musculus
ggtgcgagggaagctgtttactttg

SEQ ID NO: 335152 - DNA, 25 bp, Mus musculus
ggtgcgcacagaactcaggggcaca

SEQ ID NO: 335153 - DNA, 25 bp, Mus musculus
ggtgcgcacagatgactggtttaca

SEQ ID NO: 335154 - DNA, 25 bp, Mus musculus
ggtgcgcccaggccaaacagtgggg

SEQ ID NO: 335155 - DNA, 25 bp, Mus musculus
ggtgcgcgcacagatgggctgtatg

SEQ ID NO: 335156 - DNA, 25 bp, Mus musculus
ggtgcgcttccggtacggtggcacc

SEQ ID NO: 335157 - DNA, 25 bp, Mus musculus
ggtgcggccagagagtcgatatgcg

SEQ ID NO: 335158 - DNA, 25 bp, Mus musculus
ggtgcgggtagtttagtgaagctgt

SEQ ID NO: 335159 - DNA, 25 bp, Mus musculus
ggtgcgtaaaaaaatatttcttgga

SEQ ID NO: 335160 - DNA, 25 bp, Mus musculus
ggtgctactgaaccacaagaaccca

SEQ ID NO: 335161 - DNA, 25 bp, Mus musculus
ggtgctagcaggttttatgacccat

SEQ ID NO: 335162 - DNA, 25 bp, Mus musculus
ggtgctatgaagctacctacagcca

SEQ ID NO: 335163 - DNA, 25 bp, Mus musculus
ggtgctatgaagctctggccatggg

SEQ ID NO: 335164 - DNA, 25 bp, Mus musculus
ggtgctcacagcagagggtccccag

SEQ ID NO: 335165 - DNA, 25 bp, Mus musculus
ggtgctcatgcaggtccatgcctcc

SEQ ID NO: 335166 - DNA, 25 bp, Mus musculus
ggtgctccaaagagctttggcaatc

SEQ ID NO: 335167 - DNA, 25 bp, Mus musculus
ggtgctccaggacagcatcgcaaag

SEQ ID NO: 335168 - DNA, 25 bp, Mus musculus
ggtgctccagtccgttgtggggact

SEQ ID NO: 335169 - DNA, 25 bp, Mus musculus
ggtgctcccaggagaatttcaccca

SEQ ID NO: 335170 - DNA, 25 bp, Mus musculus
ggtgctccgcagctggctcctccaa

SEQ ID NO: 335171 - DNA, 25 bp, Mus musculus
ggtgctccgcaggtatctgaatccc

SEQ ID NO: 335172 - DNA, 25 bp, Mus musculus
ggtgctccgcaggttgaactggagc

SEQ ID NO: 335173 - DNA, 25 bp, Mus musculus
ggtgctcctggcatggtacttttct

SEQ ID NO: 335174 - DNA, 25 bp, Mus musculus
ggtgctcctgtgtagtgtgaaacag

SEQ ID NO: 335175 - DNA, 25 bp, Mus musculus
ggtgctcctgtgtatgctacaggag

SEQ ID NO: 335176 - DNA, 25 bp, Mus musculus
ggtgctctgaagggggtacttcgaa

SEQ ID NO: 335177 - DNA, 25 bp, Mus musculus
ggtgctctgaaggtcagcaagtcaa

SEQ ID NO: 335178 - DNA, 25 bp, Mus musculus
ggtgctctggaccgggtagcaaatg

SEQ ID NO: 335179 - DNA, 25 bp, Mus musculus
ggtgctctgggtttcctgtggccaa

SEQ ID NO: 335180 - DNA, 25 bp, Mus musculus
ggtgctgaaaggtattcccaagcca

SEQ ID NO: 335181 - DNA, 25 bp, Mus musculus
ggtgctgatgcagactttgtggtgc

SEQ ID NO: 335182 - DNA, 25 bp, Mus musculus
ggtgctgatgcagctcccccaccag

SEQ ID NO: 335183 - DNA, 25 bp, Mus musculus
ggtgctgatggggaaggaccggaag

SEQ ID NO: 335184 - DNA, 25 bp, Mus musculus
ggtgctgatgtcccgccgaacgcag

SEQ ID NO: 335185 - DNA, 25 bp, Mus musculus
ggtgctgatgtttgagatgctgacg

SEQ ID NO: 335186 - DNA, 25 bp, Mus musculus
ggtgctgattttgccaagtcatctc

SEQ ID NO: 335187 - DNA, 25 bp, Mus musculus
ggtgctgcaggttcttctgaatttt

SEQ ID NO: 335188 - DNA, 25 bp, Mus musculus
ggtgctgcagtctcaggactcaccg

SEQ ID NO: 335189 - DNA, 25 bp, Mus musculus
ggtgctgcagtggttttaagctata

SEQ ID NO: 335190 - DNA, 25 bp, Mus musculus
ggtgctgcccgagcacgcatgctgc

SEQ ID NO: 335191 - DNA, 25 bp, Mus musculus
ggtgctgcccggaataacagaagcc

SEQ ID NO: 335192 - DNA, 25 bp, Mus musculus
ggtgctgcccggcggtcccgcgacc

SEQ ID NO: 335193 - DNA, 25 bp, Mus musculus
ggtgctgctagacaggcttgtgttg

SEQ ID NO: 335194 - DNA, 25 bp, Mus musculus
ggtgctgctgccagcaggacggcca

SEQ ID NO: 335195 - DNA, 25 bp, Mus musculus
ggtgctgcttaatagatcacaactg

SEQ ID NO: 335196 - DNA, 25 bp, Mus musculus
ggtgctggacaaggcccgagtccgg

SEQ ID NO: 335197 - DNA, 25 bp, Mus musculus
ggtgctggagagcaaaaaaacactg

SEQ ID NO: 335198 - DNA, 25 bp, Mus musculus
ggtgctggaggtgtcctgtccatgg

SEQ ID NO: 335199 - DNA, 25 bp, Mus musculus
ggtgctggagtggagaaagcatgcg

SEQ ID NO: 335200 - DNA, 25 bp, Mus musculus
ggtgctggagttaaaggcagatgtc

SEQ ID NO: 335201 - DNA, 25 bp, Mus musculus
ggtgctggccgtggatattagcatt

SEQ ID NO: 335202 - DNA, 25 bp, Mus musculus
ggtgctggctggaggttggggtttc

SEQ ID NO: 335203 - DNA, 25 bp, Mus musculus
ggtgctgtgagcaagatcattgagc

SEQ ID NO: 335204 - DNA, 25 bp, Mus musculus
ggtgctgtgagcaaggctctacccc

SEQ ID NO: 335205 - DNA, 25 bp, Mus musculus
ggtgctgtgcgcttctattccaagg

SEQ ID NO: 335206 - DNA, 25 bp, Mus musculus
ggtgctgtggcagaattctcttttg

SEQ ID NO: 335207 - DNA, 25 bp, Mus musculus
ggtgctgtggcagatttgcaaacac

SEQ ID NO: 335208 - DNA, 25 bp, Mus musculus
ggtgctgtgtggatctctcagacat

SEQ ID NO: 335209 - DNA, 25 bp, Mus musculus
ggtgcttaaaaaggcaatgatagtg

SEQ ID NO: 335210 - DNA, 25 bp, Mus musculus
ggtgcttacgaacacagatatgtag

SEQ ID NO: 335211 - DNA, 25 bp, Mus musculus
ggtgcttcagaagatggttacggct

SEQ ID NO: 335212 - DNA, 25 bp, Mus musculus
ggtgcttcagaaggcacctcttccc

SEQ ID NO: 335213 - DNA, 25 bp, Mus musculus
ggtgcttcctcagtgtggcttgacc

SEQ ID NO: 335214 - DNA, 25 bp, Mus musculus
ggtgcttggctatggcatcttccac

SEQ ID NO: 335215 - DNA, 25 bp, Mus musculus
ggtgcttgtaggtggcgggacggga

SEQ ID NO: 335216 - DNA, 25 bp, Mus musculus
ggtgcttgtgaatcagcaatgcagg

SEQ ID NO: 335217 - DNA, 25 bp, Mus musculus
ggtggaaaagacatggagatacaga

SEQ ID NO: 335218 - DNA, 25 bp, Mus musculus
ggtggaaaagacatggaggaagcaa

SEQ ID NO: 335219 - DNA, 25 bp, Mus musculus
ggtggaaaagcaagaagcacatggc

SEQ ID NO: 335220 - DNA, 25 bp, Mus musculus
ggtggaaacaaaagataaaatattt

SEQ ID NO: 335221 - DNA, 25 bp, Mus musculus
ggtggaaacaagcgcccaggcgcgt

SEQ ID NO: 335222 - DNA, 25 bp, Mus musculus
ggtggaaacttggagcaggcaccgc

SEQ ID NO: 335223 - DNA, 25 bp, Mus musculus
ggtggaaagcaagcagaacacagaa

SEQ ID NO: 335224 - DNA, 25 bp, Mus musculus
ggtggaaagctgctaacgaggctgg

SEQ ID NO: 335225 - DNA, 25 bp, Mus musculus
ggtggaaatagacaacctgttggtg

SEQ ID NO: 335226 - DNA, 25 bp, Mus musculus
ggtggaaatagctgcagtacctcag

SEQ ID NO: 335227 - DNA, 25 bp, Mus musculus
ggtggaaatcctgtggtgggagcat

SEQ ID NO: 335228 - DNA, 25 bp, Mus musculus
ggtggaaatgaggcagctgcgatat

SEQ ID NO: 335229 - DNA, 25 bp, Mus musculus
ggtggaacgcttaagggaacaggaa

SEQ ID NO: 335230 - DNA, 25 bp, Mus musculus
ggtggaacggcagacccagtttcct

SEQ ID NO: 335231 - DNA, 25 bp, Mus musculus
ggtggaactaagggactttgaatat

SEQ ID NO: 335232 - DNA, 25 bp, Mus musculus
ggtggaactcagagtttgctattgc

SEQ ID NO: 335233 - DNA, 25 bp, Mus musculus
ggtggaactcaggtagcactttgta

SEQ ID NO: 335234 - DNA, 25 bp, Mus musculus
ggtggaactggaaggcacaatggag

SEQ ID NO: 335235 - DNA, 25 bp, Mus musculus
ggtggaagaaaggcttggggcatat

SEQ ID NO: 335236 - DNA, 25 bp, Mus musculus
ggtggaagaactatatcagtctctg

SEQ ID NO: 335237 - DNA, 25 bp, Mus musculus
ggtggaagaagaaaggatacaagac

SEQ ID NO: 335238 - DNA, 25 bp, Mus musculus
ggtggaagaagaaaggttcatcctc

SEQ ID NO: 335239 - DNA, 25 bp, Mus musculus
ggtggaagaggagacaagtttccta

SEQ ID NO: 335240 - DNA, 25 bp, Mus musculus
ggtggaagagggtcagggctgcatc

SEQ ID NO: 335241 - DNA, 25 bp, Mus musculus
ggtggaagatgtgctcgtagctcta

SEQ ID NO: 335242 - DNA, 25 bp, Mus musculus
ggtggaagccaggaagcttcttgac

SEQ ID NO: 335243 - DNA, 25 bp, Mus musculus
ggtggaagccaggcctgtagggact

SEQ ID NO: 335244 - DNA, 25 bp, Mus musculus
ggtggaagccccaggcctggtgatg

SEQ ID NO: 335245 - DNA, 25 bp, Mus musculus
ggtggaagccgaggaacgccgccac

SEQ ID NO: 335246 - DNA, 25 bp, Mus musculus
ggtggaagccgaggagctggaggag

SEQ ID NO: 335247 - DNA, 25 bp, Mus musculus
ggtggaaggggagcaaactggactg

SEQ ID NO: 335248 - DNA, 25 bp, Mus musculus
ggtggaagtgcaggagaaagacgaa

SEQ ID NO: 335249 - DNA, 25 bp, Mus musculus
ggtggaatcgcaggaaaccaacaga

SEQ ID NO: 335250 - DNA, 25 bp, Mus musculus
ggtggaatcgcaggactgtgcctgg

SEQ ID NO: 335251 - DNA, 25 bp, Mus musculus
ggtggaatttatgggatgaacaaga

SEQ ID NO: 335252 - DNA, 25 bp, Mus musculus
ggtggacaaatccaggtggctcctc

SEQ ID NO: 335253 - DNA, 25 bp, Mus musculus
ggtggacaaatcctcgtggctcctc

SEQ ID NO: 335254 - DNA, 25 bp, Mus musculus
ggtggacagtgaagatggagctgga

SEQ ID NO: 335255 - DNA, 25 bp, Mus musculus
ggtggacagtgaaggtgacccttgt

SEQ ID NO: 335256 - DNA, 25 bp, Mus musculus
ggtggacatcgtggccagacttcat

SEQ ID NO: 335257 - DNA, 25 bp, Mus musculus
ggtggacatcgtggctcctgcttcc

SEQ ID NO: 335258 - DNA, 25 bp, Mus musculus
ggtggacatgaaagtggccgaggtc

SEQ ID NO: 335259 - DNA, 25 bp, Mus musculus
ggtggacatgacagtggccgaggtc

SEQ ID NO: 335260 - DNA, 25 bp, Mus musculus
ggtggaccaaaaatgtggacatctt

SEQ ID NO: 335261 - DNA, 25 bp, Mus musculus
ggtggacccaggtttgccgaagatg

SEQ ID NO: 335262 - DNA, 25 bp, Mus musculus
ggtggacctcaggcatcctgcatcc

SEQ ID NO: 335263 - DNA, 25 bp, Mus musculus
ggtggacctcaggcatcctggatcc

SEQ ID NO: 335264 - DNA, 25 bp, Mus musculus
ggtggacgacagctttagccaggcc

SEQ ID NO: 335265 - DNA, 25 bp, Mus musculus
ggtggacggacgggcgcctctgaag

SEQ ID NO: 335266 - DNA, 25 bp, Mus musculus
ggtggacggggaggtgctgacggag

SEQ ID NO: 335267 - DNA, 25 bp, Mus musculus
ggtggactccggaggaacctggctc

SEQ ID NO: 335268 - DNA, 25 bp, Mus musculus
ggtggactgctggcctggtagagga

SEQ ID NO: 335269 - DNA, 25 bp, Mus musculus
ggtggactgggcgctggagagcgag

SEQ ID NO: 335270 - DNA, 25 bp, Mus musculus
ggtggactgtcagactgctgggctg

SEQ ID NO: 335271 - DNA, 25 bp, Mus musculus
ggtggactgtcaggattctctttca

SEQ ID NO: 335272 - DNA, 25 bp, Mus musculus
ggtggagaaacaggtcttgtccatg

SEQ ID NO: 335273 - DNA, 25 bp, Mus musculus
ggtggagaagctcaaggcaaggatg

SEQ ID NO: 335274 - DNA, 25 bp, Mus musculus
ggtggagaaggccaaggggaatcct

SEQ ID NO: 335275 - DNA, 25 bp, Mus musculus
ggtggagaaggccgagtacaacagg

SEQ ID NO: 335276 - DNA, 25 bp, Mus musculus
ggtggagaaggcttactgctcccac

SEQ ID NO: 335277 - DNA, 25 bp, Mus musculus
ggtggagaaggtgtaaccagccatg

SEQ ID NO: 335278 - DNA, 25 bp, Mus musculus
ggtggagaagtgcacgtaagttcat

SEQ ID NO: 335279 - DNA, 25 bp, Mus musculus
ggtggagaatttctcaaagtgcaac

SEQ ID NO: 335280 - DNA, 25 bp, Mus musculus
ggtggagaatttctgaaagtgcaac

SEQ ID NO: 335281 - DNA, 25 bp, Mus musculus
ggtggagacaacggaaagacgatgc

SEQ ID NO: 335282 - DNA, 25 bp, Mus musculus
ggtggagacaaggagtttttgggta

SEQ ID NO: 335283 - DNA, 25 bp, Mus musculus
ggtggagacacagacgctgttccgg

SEQ ID NO: 335284 - DNA, 25 bp, Mus musculus
ggtggagacagcccacaggatgact

SEQ ID NO: 335285 - DNA, 25 bp, Mus musculus
ggtggagaccagcagcccagagtat

SEQ ID NO: 335286 - DNA, 25 bp, Mus musculus
ggtggagaccagcatgattgggctg

SEQ ID NO: 335287 - DNA, 25 bp, Mus musculus
ggtggagagaggcaaactgctccac

SEQ ID NO: 335288 - DNA, 25 bp, Mus musculus
ggtggagagcgagctgcagcgactc

SEQ ID NO: 335289 - DNA, 25 bp, Mus musculus
ggtggagaggaaacgatcctggggc

SEQ ID NO: 335290 - DNA, 25 bp, Mus musculus
ggtggagatccagtgtcctgagcaa

SEQ ID NO: 335291 - DNA, 25 bp, Mus musculus
ggtggagatggacggaatgggcacc

SEQ ID NO: 335292 - DNA, 25 bp, Mus musculus
ggtggagcaaggtggccctgtctca

SEQ ID NO: 335293 - DNA, 25 bp, Mus musculus
ggtggagcagccctgttcccttccc

SEQ ID NO: 335294 - DNA, 25 bp, Mus musculus
ggtggagcaggacatgctggcctca

SEQ ID NO: 335295 - DNA, 25 bp, Mus musculus
ggtggagcaggacatgtttgcacac

SEQ ID NO: 335296 - DNA, 25 bp, Mus musculus
ggtggagcagggctcaaactcagaa

SEQ ID NO: 335297 - DNA, 25 bp, Mus musculus
ggtggagcaggtgaggggtcggggt

SEQ ID NO: 335298 - DNA, 25 bp, Mus musculus
ggtggagcccaagtttcagccatgg

SEQ ID NO: 335299 - DNA, 25 bp, Mus musculus
ggtggagcgacaaggtaaaagaaga

SEQ ID NO: 335300 - DNA, 25 bp, Mus musculus
ggtggagctctccgccggctgatta

SEQ ID NO: 335301 - DNA, 25 bp, Mus musculus
ggtggagctgagagttcttccagat

SEQ ID NO: 335302 - DNA, 25 bp, Mus musculus
ggtggagctgcagggatacaaactg

SEQ ID NO: 335303 - DNA, 25 bp, Mus musculus
ggtggagctgcctctgtacaaccag

SEQ ID NO: 335304 - DNA, 25 bp, Mus musculus
ggtggagctggatcgggcggtgctg

SEQ ID NO: 335305 - DNA, 25 bp, Mus musculus
ggtggaggaaaatctgaatgaggtg

SEQ ID NO: 335306 - DNA, 25 bp, Mus musculus
ggtggaggacctggaggaaattatg

SEQ ID NO: 335307 - DNA, 25 bp, Mus musculus
ggtggaggagaagatggagcgagat

SEQ ID NO: 335308 - DNA, 25 bp, Mus musculus
ggtggaggagatcctggtgctgctg

SEQ ID NO: 335309 - DNA, 25 bp, Mus musculus
ggtggaggagatgctgaccaacaat

SEQ ID NO: 335310 - DNA, 25 bp, Mus musculus
ggtggaggaggaaaaggcatgagga

SEQ ID NO: 335311 - DNA, 25 bp, Mus musculus
ggtggaggaggtggagtttgatgtt

SEQ ID NO: 335312 - DNA, 25 bp, Mus musculus
ggtggaggatgacaaaatccccatg

SEQ ID NO: 335313 - DNA, 25 bp, Mus musculus
ggtggaggcagtgtgcaaatagtct

SEQ ID NO: 335314 - DNA, 25 bp, Mus musculus
ggtggaggcagttgtctgctacaga

SEQ ID NO: 335315 - DNA, 25 bp, Mus musculus
ggtggaggccaagcaggtgcaggcc

SEQ ID NO: 335316 - DNA, 25 bp, Mus musculus
ggtggaggccaagggagaagcaagc

SEQ ID NO: 335317 - DNA, 25 bp, Mus musculus
ggtggaggccaaggggagtggagta

SEQ ID NO: 335318 - DNA, 25 bp, Mus musculus
ggtggaggcgggggccctagctgct

SEQ ID NO: 335319 - DNA, 25 bp, Mus musculus
ggtggagtacgaatatattgtggct

SEQ ID NO: 335320 - DNA, 25 bp, Mus musculus
ggtggagtgcaggccctgcaggtcg

SEQ ID NO: 335321 - DNA, 25 bp, Mus musculus
ggtggagttctaccccacaatcaag

SEQ ID NO: 335322 - DNA, 25 bp, Mus musculus
ggtggagttctagtttggattaacg

SEQ ID NO: 335323 - DNA, 25 bp, Mus musculus
ggtggagttctatgccccgtggtgt

SEQ ID NO: 335324 - DNA, 25 bp, Mus musculus
ggtggagttctatgccccttggtgt

SEQ ID NO: 335325 - DNA, 25 bp, Mus musculus
ggtggagttggccaaacagtggggc

SEQ ID NO: 335326 - DNA, 25 bp, Mus musculus
ggtggataacccaggctgcatgagt

SEQ ID NO: 335327 - DNA, 25 bp, Mus musculus
ggtggatatgcaggtgcttcacctt

SEQ ID NO: 335328 - DNA, 25 bp, Mus musculus
ggtggatcagctggaaaacaggctt

SEQ ID NO: 335329 - DNA, 25 bp, Mus musculus
ggtggatcgaagtctgcttccctgt

SEQ ID NO: 335330 - DNA, 25 bp, Mus musculus
ggtggatcgagaacactgtagctgt

SEQ ID NO: 335331 - DNA, 25 bp, Mus musculus
ggtggatcgagatggttgtgagcta

SEQ ID NO: 335332 - DNA, 25 bp, Mus musculus
ggtggatctgaataagtgcggacct

SEQ ID NO: 335333 - DNA, 25 bp, Mus musculus
ggtggatctgttacccacaggtccg

SEQ ID NO: 335334 - DNA, 25 bp, Mus musculus
ggtggatgatctggagggatccctg

SEQ ID NO: 335335 - DNA, 25 bp, Mus musculus
ggtggatgcactcagggtgactaca

SEQ ID NO: 335336 - DNA, 25 bp, Mus musculus
ggtggatgcactcaggttgaaggtg

SEQ ID NO: 335337 - DNA, 25 bp, Mus musculus
ggtggatgctgatgagttcttgacc

SEQ ID NO: 335338 - DNA, 25 bp, Mus musculus
ggtggatgctgatggcaatgggacc

SEQ ID NO: 335339 - DNA, 25 bp, Mus musculus
ggtggatgctggaggtcacatctgt

SEQ ID NO: 335340 - DNA, 25 bp, Mus musculus
ggtggatgctggaggtgagccttcc

SEQ ID NO: 335341 - DNA, 25 bp, Mus musculus
ggtggatgcttctcttcaggcctgg

SEQ ID NO: 335342 - DNA, 25 bp, Mus musculus
ggtggatggagtgggtaacttcaga

SEQ ID NO: 335343 - DNA, 25 bp, Mus musculus
ggtggatggagttcgacagaacaga

SEQ ID NO: 335344 - DNA, 25 bp, Mus musculus
ggtggatggctacggaatgtcactt

SEQ ID NO: 335345 - DNA, 25 bp, Mus musculus
ggtggatggctacggccatcttttt

SEQ ID NO: 335346 - DNA, 25 bp, Mus musculus
ggtggatggtgacctgctggcaggg

SEQ ID NO: 335347 - DNA, 25 bp, Mus musculus
ggtggattctgggaaggtgaaggag

SEQ ID NO: 335348 - DNA, 25 bp, Mus musculus
ggtggattgattcgttctccccgcc

SEQ ID NO: 335349 - DNA, 25 bp, Mus musculus
ggtggatttaggagaggatgaagat

SEQ ID NO: 335350 - DNA, 25 bp, Mus musculus
ggtggatttgaaagaaactgccagg

SEQ ID NO: 335351 - DNA, 25 bp, Mus musculus
ggtggatttggtggagctagagcgg

SEQ ID NO: 335352 - DNA, 25 bp, Mus musculus
ggtggcaaagaaccagcattttgac

SEQ ID NO: 335353 - DNA, 25 bp, Mus musculus
ggtggcaacgctgacagagcggctt

SEQ ID NO: 335354 - DNA, 25 bp, Mus musculus
ggtggcaacggggaggcacacggtc

SEQ ID NO: 335355 - DNA, 25 bp, Mus musculus
ggtggcaatgccccagttccttcct

SEQ ID NO: 335356 - DNA, 25 bp, Mus musculus
ggtggcaatggaaaaagatcttcca

SEQ ID NO: 335357 - DNA, 25 bp, Mus musculus
ggtggcacaatcaggcgacaggtga

SEQ ID NO: 335358 - DNA, 25 bp, Mus musculus
ggtggcacaatcaggttcttgagag

SEQ ID NO: 335359 - DNA, 25 bp, Mus musculus
ggtggcacagcaggacgcagagacc

SEQ ID NO: 335360 - DNA, 25 bp, Mus musculus
ggtggcacggaggcaagaaggagtt

SEQ ID NO: 335361 - DNA, 25 bp, Mus musculus
ggtggcactgaaaagaggacagaac

SEQ ID NO: 335362 - DNA, 25 bp, Mus musculus
ggtggcactgaaaagggttcccagc

SEQ ID NO: 335363 - DNA, 25 bp, Mus musculus
ggtggcagaggacctggtggctaac

SEQ ID NO: 335364 - DNA, 25 bp, Mus musculus
ggtggcagaggaggtccaactgagc

SEQ ID NO: 335365 - DNA, 25 bp, Mus musculus
ggtggcagaggtgctggctggagaa

SEQ ID NO: 335366 - DNA, 25 bp, Mus musculus
ggtggcagcagcccaaatgacccag

SEQ ID NO: 335367 - DNA, 25 bp, Mus musculus
ggtggcagctgagaaacttggaaaa

SEQ ID NO: 335368 - DNA, 25 bp, Mus musculus
ggtggcaggagaaggaggtggtgga

SEQ ID NO: 335369 - DNA, 25 bp, Mus musculus
ggtggcagggttaaggcagcttctg

SEQ ID NO: 335370 - DNA, 25 bp, Mus musculus
ggtggcaggtgactccagctccgtc

SEQ ID NO: 335371 - DNA, 25 bp, Mus musculus
ggtggcaggtgggacctgaccaagc

SEQ ID NO: 335372 - DNA, 25 bp, Mus musculus
ggtggcatcataggtggcatcatgg

SEQ ID NO: 335373 - DNA, 25 bp, Mus musculus
ggtggcatctcaagagttctatcca

SEQ ID NO: 335374 - DNA, 25 bp, Mus musculus
ggtggcatctcaagcctccagaggt

SEQ ID NO: 335375 - DNA, 25 bp, Mus musculus
ggtggcatctcaagcctccggtcag

SEQ ID NO: 335376 - DNA, 25 bp, Mus musculus
ggtggcatctcagatacgaacagaa

SEQ ID NO: 335377 - DNA, 25 bp, Mus musculus
ggtggcattccattgacaatttgcc

SEQ ID NO: 335378 - DNA, 25 bp, Mus musculus
ggtggcattgggctggaaagggtga

SEQ ID NO: 335379 - DNA, 25 bp, Mus musculus
ggtggccaaggttccctaccgcctc

SEQ ID NO: 335380 - DNA, 25 bp, Mus musculus
ggtggccacaggctcccataatgcc

SEQ ID NO: 335381 - DNA, 25 bp, Mus musculus
ggtggccacaggttggttttatcaa

SEQ ID NO: 335382 - DNA, 25 bp, Mus musculus
ggtggccacattctgattcaaagaa

SEQ ID NO: 335383 - DNA, 25 bp, Mus musculus
ggtggccacattctgtaccaaggaa

SEQ ID NO: 335384 - DNA, 25 bp, Mus musculus
ggtggccacctactcccagatggcc

SEQ ID NO: 335385 - DNA, 25 bp, Mus musculus
ggtggccagagagctgaagcgctgc

SEQ ID NO: 335386 - DNA, 25 bp, Mus musculus
ggtggccagcacgcaatcagcggag

SEQ ID NO: 335387 - DNA, 25 bp, Mus musculus
ggtggccagccaggcctgcagcatc

SEQ ID NO: 335388 - DNA, 25 bp, Mus musculus
ggtggccagtctcagatgatacaac

SEQ ID NO: 335389 - DNA, 25 bp, Mus musculus
ggtggccagtctcagattgttatag

SEQ ID NO: 335390 - DNA, 25 bp, Mus musculus
ggtggccatgggaaatggagcagtg

SEQ ID NO: 335391 - DNA, 25 bp, Mus musculus
ggtggccatggtctgggaaggcccc

SEQ ID NO: 335392 - DNA, 25 bp, Mus musculus
ggtggcccaggaggtcctgtccttg

SEQ ID NO: 335393 - DNA, 25 bp, Mus musculus
ggtggcccaggtccctgtccgcacc

SEQ ID NO: 335394 - DNA, 25 bp, Mus musculus
ggtggcccggcttctgcaggcacaa

SEQ ID NO: 335395 - DNA, 25 bp, Mus musculus
ggtggcccggtgaggagctgtggga

SEQ ID NO: 335396 - DNA, 25 bp, Mus musculus
ggtggccgacaaagttccacaggtg

SEQ ID NO: 335397 - DNA, 25 bp, Mus musculus
ggtggccgacagagtgcttgggatc

SEQ ID NO: 335398 - DNA, 25 bp, Mus musculus
ggtggccgagtgttgctgaacacaa

SEQ ID NO: 335399 - DNA, 25 bp, Mus musculus
ggtggccgccgacaacactggtagc

SEQ ID NO: 335400 - DNA, 25 bp, Mus musculus
ggtggccgccgatacatataccatt

SEQ ID NO: 335401 - DNA, 25 bp, Mus musculus
ggtggccgcgcagccagcgttccat

SEQ ID NO: 335402 - DNA, 25 bp, Mus musculus
ggtggccgctgaccagtgaagtcaa

SEQ ID NO: 335403 - DNA, 25 bp, Mus musculus
ggtggccgggaagaccaaatacaca

SEQ ID NO: 335404 - DNA, 25 bp, Mus musculus
ggtggccgtagagcatgcactcttg

SEQ ID NO: 335405 - DNA, 25 bp, Mus musculus
ggtggccgtagaggtgctgggatta

SEQ ID NO: 335406 - DNA, 25 bp, Mus musculus
ggtggccgtgaaggtggaggcaggg

SEQ ID NO: 335407 - DNA, 25 bp, Mus musculus
ggtggccgtgggaccgtggctaccg

SEQ ID NO: 335408 - DNA, 25 bp, Mus musculus
ggtggcctactactcttaaaaaaca

SEQ ID NO: 335409 - DNA, 25 bp, Mus musculus
ggtggcctactactgtcgtttatat

SEQ ID NO: 335410 - DNA, 25 bp, Mus musculus
ggtggcctcaagggttacagggaaa

SEQ ID NO: 335411 - DNA, 25 bp, Mus musculus
ggtggcctcctggactgtgctgggg

SEQ ID NO: 335412 - DNA, 25 bp, Mus musculus
ggtggcctcctgggtggtgcagact

SEQ ID NO: 335413 - DNA, 25 bp, Mus musculus
ggtggcctcgcgctataaccacttc

SEQ ID NO: 335414 - DNA, 25 bp, Mus musculus
ggtggcctctaagtgccatcacctg

SEQ ID NO: 335415 - DNA, 25 bp, Mus musculus
ggtggcctctaagttgctgactgtc

SEQ ID NO: 335416 - DNA, 25 bp, Mus musculus
ggtggcctgcaggtagctcgcggcg

SEQ ID NO: 335417 - DNA, 25 bp, Mus musculus
ggtggcctgtctgaggccctggcca

SEQ ID NO: 335418 - DNA, 25 bp, Mus musculus
ggtggcctgtgagacagtgtgcaag

SEQ ID NO: 335419 - DNA, 25 bp, Mus musculus
ggtggcctgtggtttatggtgtgct

SEQ ID NO: 335420 - DNA, 25 bp, Mus musculus
ggtggccttagagtttctgcgcccc

SEQ ID NO: 335421 - DNA, 25 bp, Mus musculus
ggtggccttggcaggggccagtccc

SEQ ID NO: 335422 - DNA, 25 bp, Mus musculus
ggtggcgaaccacagaaagcgtcca

SEQ ID NO: 335423 - DNA, 25 bp, Mus musculus
ggtggcgacagatgtgaaggcacca

SEQ ID NO: 335424 - DNA, 25 bp, Mus musculus
ggtggcgacagatgttgcattacga

SEQ ID NO: 335425 - DNA, 25 bp, Mus musculus
ggtggcgacaggtgtgactggagac

SEQ ID NO: 335426 - DNA, 25 bp, Mus musculus
ggtggcgcagtcttgagtaatccag

SEQ ID NO: 335427 - DNA, 25 bp, Mus musculus
ggtggcgccagctagccggatcagc

SEQ ID NO: 335428 - DNA, 25 bp, Mus musculus
ggtggcggagccgaatcctattcta

SEQ ID NO: 335429 - DNA, 25 bp, Mus musculus
ggtggcggccgggatctgggacgat

SEQ ID NO: 335430 - DNA, 25 bp, Mus musculus
ggtggcgtggaagggggaggcacac

SEQ ID NO: 335431 - DNA, 25 bp, Mus musculus
ggtggctacgacccgggagcccata

SEQ ID NO: 335432 - DNA, 25 bp, Mus musculus
ggtggctacgagataacagacaaaa

SEQ ID NO: 335433 - DNA, 25 bp, Mus musculus
ggtggctcaagttttcctgacttct

SEQ ID NO: 335434 - DNA, 25 bp, Mus musculus
ggtggctcaatgatccttccttcat

SEQ ID NO: 335435 - DNA, 25 bp, Mus musculus
ggtggctcacagctgtgatgagtgc

SEQ ID NO: 335436 - DNA, 25 bp, Mus musculus
ggtggctcagtttctacagttaaca

SEQ ID NO: 335437 - DNA, 25 bp, Mus musculus
ggtggctcagtttcttcggctgtcg

SEQ ID NO: 335438 - DNA, 25 bp, Mus musculus
ggtggctccatcctgttactgagct

SEQ ID NO: 335439 - DNA, 25 bp, Mus musculus
ggtggctcggtacaggttgtaagtt

SEQ ID NO: 335440 - DNA, 25 bp, Mus musculus
ggtggctctcagccaccaccttgtc

SEQ ID NO: 335441 - DNA, 25 bp, Mus musculus
ggtggctctcagcttgcagacaaaa

SEQ ID NO: 335442 - DNA, 25 bp, Mus musculus
ggtggctctcaggagcgcggccttc

SEQ ID NO: 335443 - DNA, 25 bp, Mus musculus
ggtggctctctgatgcaagctgttg

SEQ ID NO: 335444 - DNA, 25 bp, Mus musculus
ggtggctctgaggtaggtgtcttcc

SEQ ID NO: 335445 - DNA, 25 bp, Mus musculus
ggtggctgagaaccgggaccgcgtg

SEQ ID NO: 335446 - DNA, 25 bp, Mus musculus
ggtggctgagagccgagccagacag

SEQ ID NO: 335447 - DNA, 25 bp, Mus musculus
ggtggctgagagtaaatgtggggac

SEQ ID NO: 335448 - DNA, 25 bp, Mus musculus
ggtggctgaggtaccacgtacacag

SEQ ID NO: 335449 - DNA, 25 bp, Mus musculus
ggtggctgatgaaatgggtctagga

SEQ ID NO: 335450 - DNA, 25 bp, Mus musculus
ggtggctggagccctcagctgtggg

SEQ ID NO: 335451 - DNA, 25 bp, Mus musculus
ggtggctggtaccaattctatttat

SEQ ID NO: 335452 - DNA, 25 bp, Mus musculus
ggtggctgtgcaggtataatggccg

SEQ ID NO: 335453 - DNA, 25 bp, Mus musculus
ggtggctgtgtctttcagccctgca

SEQ ID NO: 335454 - DNA, 25 bp, Mus musculus
ggtggcttccgaggctccggcttcg

SEQ ID NO: 335455 - DNA, 25 bp, Mus musculus
ggtggctttgctcagccttctggcc

SEQ ID NO: 335456 - DNA, 25 bp, Mus musculus
ggtggctttggtggcatatccaatc

SEQ ID NO: 335457 - DNA, 25 bp, Mus musculus
ggtggctttgtgtgggcttgcaaaa

SEQ ID NO: 335458 - DNA, 25 bp, Mus musculus
ggtgggaatattgaagtacttggtt

SEQ ID NO: 335459 - DNA, 25 bp, Mus musculus
ggtgggaatcagtgggtatcacagg

SEQ ID NO: 335460 - DNA, 25 bp, Mus musculus
ggtgggacagaaactcatcatggag

SEQ ID NO: 335461 - DNA, 25 bp, Mus musculus
ggtgggacagccagctgaagtgagt

SEQ ID NO: 335462 - DNA, 25 bp, Mus musculus
ggtgggacagccaggtaacaatttc

SEQ ID NO: 335463 - DNA, 25 bp, Mus musculus
ggtgggacagctgggaacactccag

SEQ ID NO: 335464 - DNA, 25 bp, Mus musculus
ggtgggacagggcaagaccgtgatc

SEQ ID NO: 335465 - DNA, 25 bp, Mus musculus
ggtgggaccagtttaaaaggatgct

SEQ ID NO: 335466 - DNA, 25 bp, Mus musculus
ggtgggagagaaaagaaaaaacaag

SEQ ID NO: 335467 - DNA, 25 bp, Mus musculus
ggtgggagagaaaagccttaccaat

SEQ ID NO: 335468 - DNA, 25 bp, Mus musculus
ggtgggagagcgtggtcactgacaa

SEQ ID NO: 335469 - DNA, 25 bp, Mus musculus
ggtgggagatgaagcgggagatcgt

SEQ ID NO: 335470 - DNA, 25 bp, Mus musculus
ggtgggaggaagctgtccatggctg

SEQ ID NO: 335471 - DNA, 25 bp, Mus musculus
ggtgggatccaccaccacgggctca

SEQ ID NO: 335472 - DNA, 25 bp, Mus musculus
ggtgggattggaattgtacccattg

SEQ ID NO: 335473 - DNA, 25 bp, Mus musculus
ggtgggcaagtccagcctgctcctg

SEQ ID NO: 335474 - DNA, 25 bp, Mus musculus
ggtgggcacccaaggtgaaagcaga

SEQ ID NO: 335475 - DNA, 25 bp, Mus musculus
ggtgggcaccccaggtgaaagcaga

SEQ ID NO: 335476 - DNA, 25 bp, Mus musculus
ggtgggcagcctgtggggacaggtt

SEQ ID NO: 335477 - DNA, 25 bp, Mus musculus
ggtgggcagcctgtggttgcagctc

SEQ ID NO: 335478 - DNA, 25 bp, Mus musculus
ggtgggccaggtccacctccacctc

SEQ ID NO: 335479 - DNA, 25 bp, Mus musculus
ggtgggctaccagattttgttcgga

SEQ ID NO: 335480 - DNA, 25 bp, Mus musculus
ggtgggctaccagtggttgtcccca

SEQ ID NO: 335481 - DNA, 25 bp, Mus musculus
ggtgggctgagaagcggaggctgct

SEQ ID NO: 335482 - DNA, 25 bp, Mus musculus
ggtgggctgagaaggtgaggtggcc

SEQ ID NO: 335483 - DNA, 25 bp, Mus musculus
ggtggggaagcgcagcgagcaggac

SEQ ID NO: 335484 - DNA, 25 bp, Mus musculus
ggtggggaagcgcaggacacagaaa

SEQ ID NO: 335485 - DNA, 25 bp, Mus musculus
ggtggggaagttgcttcaggcagcc

SEQ ID NO: 335486 - DNA, 25 bp, Mus musculus
ggtggggatctcagactatggcgac

SEQ ID NO: 335487 - DNA, 25 bp, Mus musculus
ggtggggcagatgcgaatgaagagg

SEQ ID NO: 335488 - DNA, 25 bp, Mus musculus
ggtggggccacagaggcagaggagt

SEQ ID NO: 335489 - DNA, 25 bp, Mus musculus
ggtggggccacaggtgccccccact

SEQ ID NO: 335490 - DNA, 25 bp, Mus musculus
ggtggggccgagcaaccatgaaggt

SEQ ID NO: 335491 - DNA, 25 bp, Mus musculus
ggtggggctatgcagatggctatga

SEQ ID NO: 335492 - DNA, 25 bp, Mus musculus
ggtggggctcgcaggatccctgctg

SEQ ID NO: 335493 - DNA, 25 bp, Mus musculus
ggtgggggtagcaggtttggacctt

SEQ ID NO: 335494 - DNA, 25 bp, Mus musculus
ggtgggggtgggggagggcacatag

SEQ ID NO: 335495 - DNA, 25 bp, Mus musculus
ggtggggttcagtacatcggcatca

SEQ ID NO: 335496 - DNA, 25 bp, Mus musculus
ggtgggttagccaaccccaccagag

SEQ ID NO: 335497 - DNA, 25 bp, Mus musculus
ggtgggttctcgggcaatgatggca

SEQ ID NO: 335498 - DNA, 25 bp, Mus musculus
ggtggtacaagacgcatgttaatga

SEQ ID NO: 335499 - DNA, 25 bp, Mus musculus
ggtggtacactgcagtgctggtgtt

SEQ ID NO: 335500 - DNA, 25 bp, Mus musculus
ggtggtaccgaggagggacttcaaa

SEQ ID NO: 335501 - DNA, 25 bp, Mus musculus
ggtggtacctgaagatgaaatgtgg

SEQ ID NO: 335502 - DNA, 25 bp, Mus musculus
ggtggtaggcaggttgttcgtagtc

SEQ ID NO: 335503 - DNA, 25 bp, Mus musculus
ggtggtagtggaagcaattttggag

SEQ ID NO: 335504 - DNA, 25 bp, Mus musculus
ggtggtagtggtggctatggcggtt

SEQ ID NO: 335505 - DNA, 25 bp, Mus musculus
ggtggtataaagagggtgtattacc

SEQ ID NO: 335506 - DNA, 25 bp, Mus musculus
ggtggtatcatgatgacacttgttg

SEQ ID NO: 335507 - DNA, 25 bp, Mus musculus
ggtggtatcatggtggatacagtgc

SEQ ID NO: 335508 - DNA, 25 bp, Mus musculus
ggtggtatccacgcctgaggtcctg

SEQ ID NO: 335509 - DNA, 25 bp, Mus musculus
ggtggtatcttcgaaccaagtatca

SEQ ID NO: 335510 - DNA, 25 bp, Mus musculus
ggtggtatgttccaggattgaacca

SEQ ID NO: 335511 - DNA, 25 bp, Mus musculus
ggtggtcagggcagggataatctta

SEQ ID NO: 335512 - DNA, 25 bp, Mus musculus
ggtggtcatcaacggctcagaggtg

SEQ ID NO: 335513 - DNA, 25 bp, Mus musculus
ggtggtcatcccagcagaagttttc

SEQ ID NO: 335514 - DNA, 25 bp, Mus musculus
ggtggtccctgttctccaccctccc

SEQ ID NO: 335515 - DNA, 25 bp, Mus musculus
ggtggtccgagaggtgtgctctgaa

SEQ ID NO: 335516 - DNA, 25 bp, Mus musculus
ggtggtccgagttcccacgacagca

SEQ ID NO: 335517 - DNA, 25 bp, Mus musculus
ggtggtcctggggccatcagctcca

SEQ ID NO: 335518 - DNA, 25 bp, Mus musculus
ggtggtcctgggggaatggataagt

SEQ ID NO: 335519 - DNA, 25 bp, Mus musculus
ggtggtcctggggtacaatggtgct

SEQ ID NO: 335520 - DNA, 25 bp, Mus musculus
ggtggtccttgaaccgggcaccatc

SEQ ID NO: 335521 - DNA, 25 bp, Mus musculus
ggtggtctacaagacagtagccaac

SEQ ID NO: 335522 - DNA, 25 bp, Mus musculus
ggtggtctcacgcggtcggatatga

SEQ ID NO: 335523 - DNA, 25 bp, Mus musculus
ggtggtctccgggttctgcaggagc

SEQ ID NO: 335524 - DNA, 25 bp, Mus musculus
ggtggtcttccaggggaatgcaggc

SEQ ID NO: 335525 - DNA, 25 bp, Mus musculus
ggtggtgaagtaggaaacacactgg

SEQ ID NO: 335526 - DNA, 25 bp, Mus musculus
ggtggtgacacaagggacccgggag

SEQ ID NO: 335527 - DNA, 25 bp, Mus musculus
ggtggtgacacaaggtgtggccttt

SEQ ID NO: 335528 - DNA, 25 bp, Mus musculus
ggtggtgaccaagactgcgcttcgc

SEQ ID NO: 335529 - DNA, 25 bp, Mus musculus
ggtggtgaccggaactttctaagct

SEQ ID NO: 335530 - DNA, 25 bp, Mus musculus
ggtggtgatctgcgaccagtaccgg

SEQ ID NO: 335531 - DNA, 25 bp, Mus musculus
ggtggtgatgaaagtggctcagctc

SEQ ID NO: 335532 - DNA, 25 bp, Mus musculus
ggtggtgcaggagatcccccaagag

SEQ ID NO: 335533 - DNA, 25 bp, Mus musculus
ggtggtgccaattgctggtgccagt

SEQ ID NO: 335534 - DNA, 25 bp, Mus musculus
ggtggtgcttacgaacacagatatg

SEQ ID NO: 335535 - DNA, 25 bp, Mus musculus
ggtggtggaaggagctcaaggttct

SEQ ID NO: 335536 - DNA, 25 bp, Mus musculus
ggtggtggacagggaatgtacggca

SEQ ID NO: 335537 - DNA, 25 bp, Mus musculus
ggtggtggacagtgcctatgaagtc

SEQ ID NO: 335538 - DNA, 25 bp, Mus musculus
ggtggtggagaaggcttactgctcc

SEQ ID NO: 335539 - DNA, 25 bp, Mus musculus
ggtggtggaggaggggaatttgctc

SEQ ID NO: 335540 - DNA, 25 bp, Mus musculus
ggtggtggagggggacgatttggtc

SEQ ID NO: 335541 - DNA, 25 bp, Mus musculus
ggtggtggagtgcacctgtcaagcc

SEQ ID NO: 335542 - DNA, 25 bp, Mus musculus
ggtggtggcagcagcccaaatgacc

SEQ ID NO: 335543 - DNA, 25 bp, Mus musculus
ggtggtggcattgggctggaaaggg

SEQ ID NO: 335544 - DNA, 25 bp, Mus musculus
ggtggtggggaagttgcttcaggca

SEQ ID NO: 335545 - DNA, 25 bp, Mus musculus
ggtggtggtgttatgcttgcttcac

SEQ ID NO: 335546 - DNA, 25 bp, Mus musculus
ggtggtggttctgacagagcctcaa

SEQ ID NO: 335547 - DNA, 25 bp, Mus musculus
ggtggtgtcctggctggtatctgcc

SEQ ID NO: 335548 - DNA, 25 bp, Mus musculus
ggtggtgttatgcttgcttcactaa

SEQ ID NO: 335549 - DNA, 25 bp, Mus musculus
ggtggtgttcagtgtggacgaggag

SEQ ID NO: 335550 - DNA, 25 bp, Mus musculus
ggtggttcctttccttgggagcgag

SEQ ID NO: 335551 - DNA, 25 bp, Mus musculus
ggtggttctcgaggctgctgatgag

SEQ ID NO: 335552 - DNA, 25 bp, Mus musculus
ggtggttctgaaacgaagtgagaag

SEQ ID NO: 335553 - DNA, 25 bp, Mus musculus
ggtggttctgacagagcctcaaggt

SEQ ID NO: 335554 - DNA, 25 bp, Mus musculus
ggtggttctgtccagagcctcaagg

SEQ ID NO: 335555 - DNA, 25 bp, Mus musculus
ggtggttctgtccaggatcatttta

SEQ ID NO: 335556 - DNA, 25 bp, Mus musculus
ggtggttctttaagctacaaaaaat

SEQ ID NO: 335557 - DNA, 25 bp, Mus musculus
ggtggttgacatgtgcgagtagtgg

SEQ ID NO: 335558 - DNA, 25 bp, Mus musculus
ggtggttgcaggagcacccccaccg

SEQ ID NO: 335559 - DNA, 25 bp, Mus musculus
ggtggttgcaggagggtgaagggcc

SEQ ID NO: 335560 - DNA, 25 bp, Mus musculus
ggtggttgtgctgggcctgcttccg

SEQ ID NO: 335561 - DNA, 25 bp, Mus musculus
ggtggtttaacaggtgtcactctgc

SEQ ID NO: 335562 - DNA, 25 bp, Mus musculus
ggtggtttgaggtcctccagaggtg

SEQ ID NO: 335563 - DNA, 25 bp, Mus musculus
ggtggttttactgagttgcactcac

SEQ ID NO: 335564 - DNA, 25 bp, Mus musculus
ggtggttttcttgaccctgcttttt

SEQ ID NO: 335565 - DNA, 25 bp, Mus musculus
ggtgtaaaggtagatcgaggcccag

SEQ ID NO: 335566 - DNA, 25 bp, Mus musculus
ggtgtaatgctttgtcggatatgaa

SEQ ID NO: 335567 - DNA, 25 bp, Mus musculus
ggtgtaatgtgagacctctgggtga

SEQ ID NO: 335568 - DNA, 25 bp, Mus musculus
ggtgtaatgtgagagattggtgtcc

SEQ ID NO: 335569 - DNA, 25 bp, Mus musculus
ggtgtacaatgaaaatcttgttcat

SEQ ID NO: 335570 - DNA, 25 bp, Mus musculus
ggtgtacaatgagaaacatattcaa

SEQ ID NO: 335571 - DNA, 25 bp, Mus musculus
ggtgtacacacaggtggtgacagtg

SEQ ID NO: 335572 - DNA, 25 bp, Mus musculus
ggtgtacagtacaggcaaatttcca

SEQ ID NO: 335573 - DNA, 25 bp, Mus musculus
ggtgtacctgcagcctgcactggat

SEQ ID NO: 335574 - DNA, 25 bp, Mus musculus
ggtgtacggcgcaacctgcggcaga

SEQ ID NO: 335575 - DNA, 25 bp, Mus musculus
ggtgtactggagaaaatgttttcag

SEQ ID NO: 335576 - DNA, 25 bp, Mus musculus
ggtgtactggagagggtgtaacaaa

SEQ ID NO: 335577 - DNA, 25 bp, Mus musculus
ggtgtactgtggttcactacaacat

SEQ ID NO: 335578 - DNA, 25 bp, Mus musculus
ggtgtacttttcatcgtccaacttt

SEQ ID NO: 335579 - DNA, 25 bp, Mus musculus
ggtgtagagaaagacatggagatga

SEQ ID NO: 335580 - DNA, 25 bp, Mus musculus
ggtgtagcaggcagcaaagaagaat

SEQ ID NO: 335581 - DNA, 25 bp, Mus musculus
ggtgtaggatgtaggtgaattatac

SEQ ID NO: 335582 - DNA, 25 bp, Mus musculus
ggtgtaggcagtctcatcaagcaat

SEQ ID NO: 335583 - DNA, 25 bp, Mus musculus
ggtgtataatgaatttcagaaattc

SEQ ID NO: 335584 - DNA, 25 bp, Mus musculus
ggtgtataatggcatttgagcactt

SEQ ID NO: 335585 - DNA, 25 bp, Mus musculus
ggtgtatgaaagcctgtcagccgga

SEQ ID NO: 335586 - DNA, 25 bp, Mus musculus
ggtgtatgaaaggctgtcagccgga

SEQ ID NO: 335587 - DNA, 25 bp, Mus musculus
ggtgtatggcgagatagaccatgcc

SEQ ID NO: 335588 - DNA, 25 bp, Mus musculus
ggtgtatggcgagattttcagttta

SEQ ID NO: 335589 - DNA, 25 bp, Mus musculus
ggtgtcaacattgtggagatgctga

SEQ ID NO: 335590 - DNA, 25 bp, Mus musculus
ggtgtcaaccaggaacctggctcac

SEQ ID NO: 335591 - DNA, 25 bp, Mus musculus
ggtgtcacaagaaagaagagccaag

SEQ ID NO: 335592 - DNA, 25 bp, Mus musculus
ggtgtcacagcacggtctctctgct

SEQ ID NO: 335593 - DNA, 25 bp, Mus musculus
ggtgtcacaggcggcacgttttcta

SEQ ID NO: 335594 - DNA, 25 bp, Mus musculus
ggtgtcaccacaggccgacccgtgg

SEQ ID NO: 335595 - DNA, 25 bp, Mus musculus
ggtgtcacgacgaggaacaaggatg

SEQ ID NO: 335596 - DNA, 25 bp, Mus musculus
ggtgtcactctgggagttagcgacg

SEQ ID NO: 335597 - DNA, 25 bp, Mus musculus
ggtgtcactgcaagagcggccccgg

SEQ ID NO: 335598 - DNA, 25 bp, Mus musculus
ggtgtcagagaaggaagcagcggtg

SEQ ID NO: 335599 - DNA, 25 bp, Mus musculus
ggtgtcagagaagtatccctgggag

SEQ ID NO: 335600 - DNA, 25 bp, Mus musculus
ggtgtcagagccagttgtcactcag

SEQ ID NO: 335601 - DNA, 25 bp, Mus musculus
ggtgtcagcaggggtggatctggct

SEQ ID NO: 335602 - DNA, 25 bp, Mus musculus
ggtgtcagcgggaacagcagtggtg

SEQ ID NO: 335603 - DNA, 25 bp, Mus musculus
ggtgtcagctgccaacggacaaggc

SEQ ID NO: 335604 - DNA, 25 bp, Mus musculus
ggtgtcagctgccatcggacaaggc

SEQ ID NO: 335605 - DNA, 25 bp, Mus musculus
ggtgtcagctgcccagcctggtgag

SEQ ID NO: 335606 - DNA, 25 bp, Mus musculus
ggtgtcatccacagaatcctagact

SEQ ID NO: 335607 - DNA, 25 bp, Mus musculus
ggtgtcatccacagagacttgaagc

SEQ ID NO: 335608 - DNA, 25 bp, Mus musculus
ggtgtcatttacacaatgtactttc

SEQ ID NO: 335609 - DNA, 25 bp, Mus musculus
ggtgtcatttacacgggttatgcaa

SEQ ID NO: 335610 - DNA, 25 bp, Mus musculus
ggtgtccagagagttgtgtggccat

SEQ ID NO: 335611 - DNA, 25 bp, Mus musculus
ggtgtccagcacagggacctgaggt

SEQ ID NO: 335612 - DNA, 25 bp, Mus musculus
ggtgtccatttcgacttctctaccc

SEQ ID NO: 335613 - DNA, 25 bp, Mus musculus
ggtgtcccgggatgccaagcctttg

SEQ ID NO: 335614 - DNA, 25 bp, Mus musculus
ggtgtcccggggcggcctcttggga

SEQ ID NO: 335615 - DNA, 25 bp, Mus musculus
ggtgtcccggggcggtgatgtggcc

SEQ ID NO: 335616 - DNA, 25 bp, Mus musculus
ggtgtccctcagctgcttccggttg

SEQ ID NO: 335617 - DNA, 25 bp, Mus musculus
ggtgtccctcaggtggccccttctg

SEQ ID NO: 335618 - DNA, 25 bp, Mus musculus
ggtgtccctcagtcgagccccgttg

SEQ ID NO: 335619 - DNA, 25 bp, Mus musculus
ggtgtccgagatgcatgctgttctg

SEQ ID NO: 335620 - DNA, 25 bp, Mus musculus
ggtgtccgagccaggacgagggatc

SEQ ID NO: 335621 - DNA, 25 bp, Mus musculus
ggtgtccgaggtcttcagattacaa

SEQ ID NO: 335622 - DNA, 25 bp, Mus musculus
ggtgtccgagtgtcctgcaggtctt

SEQ ID NO: 335623 - DNA, 25 bp, Mus musculus
ggtgtccgtaaacttgggtgctgga

SEQ ID NO: 335624 - DNA, 25 bp, Mus musculus
ggtgtccgtaaagaagaacacaaca

SEQ ID NO: 335625 - DNA, 25 bp, Mus musculus
ggtgtcctaggccacagaaggaccc

SEQ ID NO: 335626 - DNA, 25 bp, Mus musculus
ggtgtcctcccaaagggtatgtgta

SEQ ID NO: 335627 - DNA, 25 bp, Mus musculus
ggtgtcctgctgaggcgagtaacaa

SEQ ID NO: 335628 - DNA, 25 bp, Mus musculus
ggtgtcctggctggtatctgccgag

SEQ ID NO: 335629 - DNA, 25 bp, Mus musculus
ggtgtccttcactctagcccatcca

SEQ ID NO: 335630 - DNA, 25 bp, Mus musculus
ggtgtcgatgggggccgttgactac

SEQ ID NO: 335631 - DNA, 25 bp, Mus musculus
ggtgtcgctcgagttcctgaggatc

SEQ ID NO: 335632 - DNA, 25 bp, Mus musculus
ggtgtcgctcgggtatcaagtctcc

SEQ ID NO: 335633 - DNA, 25 bp, Mus musculus
ggtgtcggaggatataaaattccgg

SEQ ID NO: 335634 - DNA, 25 bp, Mus musculus
ggtgtcggatcagctgcctgctgtc

SEQ ID NO: 335635 - DNA, 25 bp, Mus musculus
ggtgtcgtggaagggttttatggaa

SEQ ID NO: 335636 - DNA, 25 bp, Mus musculus
ggtgtctgacggtgctgggaggatc

SEQ ID NO: 335637 - DNA, 25 bp, Mus musculus
ggtgtctgggaaagagtgtgaggag

SEQ ID NO: 335638 - DNA, 25 bp, Mus musculus
ggtgtctgtctatgaaaatgacact

SEQ ID NO: 335639 - DNA, 25 bp, Mus musculus
ggtgtctgtctatggtatcatcaga

SEQ ID NO: 335640 - DNA, 25 bp, Mus musculus
ggtgtctgtgaggagttcaaggatg

SEQ ID NO: 335641 - DNA, 25 bp, Mus musculus
ggtgtctgtggggacctctgagctg

SEQ ID NO: 335642 - DNA, 25 bp, Mus musculus
ggtgtctttacagttgctagacctg

SEQ ID NO: 335643 - DNA, 25 bp, Mus musculus
ggtgtgaacaggttccacccgactc

SEQ ID NO: 335644 - DNA, 25 bp, Mus musculus
ggtgtgaagaatgtggcttcccaga

SEQ ID NO: 335645 - DNA, 25 bp, Mus musculus
ggtgtgaccttgggctggcatcccc

SEQ ID NO: 335646 - DNA, 25 bp, Mus musculus
ggtgtgaccttgggtgctggcctcg

SEQ ID NO: 335647 - DNA, 25 bp, Mus musculus
ggtgtgacgggaagcttatcaagta

SEQ ID NO: 335648 - DNA, 25 bp, Mus musculus
ggtgtgacgggaaggtgtgtgagtc

SEQ ID NO: 335649 - DNA, 25 bp, Mus musculus
ggtgtgactgagttggccgccccat

SEQ ID NO: 335650 - DNA, 25 bp, Mus musculus
ggtgtgacttgagaacacaagagag

SEQ ID NO: 335651 - DNA, 25 bp, Mus musculus
ggtgtgacttgagaagctgaatcac

SEQ ID NO: 335652 - DNA, 25 bp, Mus musculus
ggtgtgatcagcagctcgtgcctcc

SEQ ID NO: 335653 - DNA, 25 bp, Mus musculus
ggtgtgcaagaaactggtcttttgt

SEQ ID NO: 335654 - DNA, 25 bp, Mus musculus
ggtgtgcaagggcgaccagggcggc

SEQ ID NO: 335655 - DNA, 25 bp, Mus musculus
ggtgtgcaatggcaggtgctgacct

SEQ ID NO: 335656 - DNA, 25 bp, Mus musculus
ggtgtgcatgttgaccccaacaagg

SEQ ID NO: 335657 - DNA, 25 bp, Mus musculus
ggtgtgccaacgaggaatatcctcc

SEQ ID NO: 335658 - DNA, 25 bp, Mus musculus
ggtgtgccaacgccagcttttttaa

SEQ ID NO: 335659 - DNA, 25 bp, Mus musculus
ggtgtgccacggatgaataaaaacg

SEQ ID NO: 335660 - DNA, 25 bp, Mus musculus
ggtgtgccaggagagtactaaattt

SEQ ID NO: 335661 - DNA, 25 bp, Mus musculus
ggtgtgccccctctagtcctccctt

SEQ ID NO: 335662 - DNA, 25 bp, Mus musculus
ggtgtgcctgaggagtccctgtgcc

SEQ ID NO: 335663 - DNA, 25 bp, Mus musculus
ggtgtgcctgaggctgacctgtgct

SEQ ID NO: 335664 - DNA, 25 bp, Mus musculus
ggtgtgcgaccagatctgctgctta

SEQ ID NO: 335665 - DNA, 25 bp, Mus musculus
ggtgtgcgaccaggtgtctgcctgt

SEQ ID NO: 335666 - DNA, 25 bp, Mus musculus
ggtgtgcgcactcggaggccatgtc

SEQ ID NO: 335667 - DNA, 25 bp, Mus musculus
ggtgtgctcatgcccgacatcgtgc

SEQ ID NO: 335668 - DNA, 25 bp, Mus musculus
ggtgtgctcatgttcgagatgctca

SEQ ID NO: 335669 - DNA, 25 bp, Mus musculus
ggtgtgctccaggctggacagtatg

SEQ ID NO: 335670 - DNA, 25 bp, Mus musculus
ggtgtgctgaaatttcaaaaggaca

SEQ ID NO: 335671 - DNA, 25 bp, Mus musculus
ggtgtgctgaagagaactgcttcat

SEQ ID NO: 335672 - DNA, 25 bp, Mus musculus
ggtgtgctggaggacttcatcaaca

SEQ ID NO: 335673 - DNA, 25 bp, Mus musculus
ggtgtgcttggattacacagtgcgt

SEQ ID NO: 335674 - DNA, 25 bp, Mus musculus
ggtgtgcttgtgctcgccgtgggac

SEQ ID NO: 335675 - DNA, 25 bp, Mus musculus
ggtgtggaagagatgaaccggacaa

SEQ ID NO: 335676 - DNA, 25 bp, Mus musculus
ggtgtggacacgttggtcagactac

SEQ ID NO: 335677 - DNA, 25 bp, Mus musculus
ggtgtggacactcctggagccagaa

SEQ ID NO: 335678 - DNA, 25 bp, Mus musculus
ggtgtggaccaagtttgttgcatat

SEQ ID NO: 335679 - DNA, 25 bp, Mus musculus
ggtgtggagcccacgagcacccgga

SEQ ID NO: 335680 - DNA, 25 bp, Mus musculus
ggtgtggagcccacggtgacactgc

SEQ ID NO: 335681 - DNA, 25 bp, Mus musculus
ggtgtggatggaggcattgcactca

SEQ ID NO: 335682 - DNA, 25 bp, Mus musculus
ggtgtggatggtgcctgcaggccct

SEQ ID NO: 335683 - DNA, 25 bp, Mus musculus
ggtgtggcaaggggaaactgtttga

SEQ ID NO: 335684 - DNA, 25 bp, Mus musculus
ggtgtggcaggaatgattaatattt

SEQ ID NO: 335685 - DNA, 25 bp, Mus musculus
ggtgtggcagtggtggtgaccaacc

SEQ ID NO: 335686 - DNA, 25 bp, Mus musculus
ggtgtggccagatcagactccaacg

SEQ ID NO: 335687 - DNA, 25 bp, Mus musculus
ggtgtggccagcgttttaccaacga

SEQ ID NO: 335688 - DNA, 25 bp, Mus musculus
ggtgtggccttgcaaagctgttgct

SEQ ID NO: 335689 - DNA, 25 bp, Mus musculus
ggtgtgggacaaggttttgagcatt

SEQ ID NO: 335690 - DNA, 25 bp, Mus musculus
ggtgtgggactgagggtggttgctg

SEQ ID NO: 335691 - DNA, 25 bp, Mus musculus
ggtgtggggctcctctaaattggtt

SEQ ID NO: 335692 - DNA, 25 bp, Mus musculus
ggtgtggtggccagtgggtgcatcc

SEQ ID NO: 335693 - DNA, 25 bp, Mus musculus
ggtgtgtacaggccccgactctggc

SEQ ID NO: 335694 - DNA, 25 bp, Mus musculus
ggtgtgtacttgactgaagtgtgct

SEQ ID NO: 335695 - DNA, 25 bp, Mus musculus
ggtgtgtagaactgctccaggcttt

SEQ ID NO: 335696 - DNA, 25 bp, Mus musculus
ggtgtgtatgattccctgtcgtgat

SEQ ID NO: 335697 - DNA, 25 bp, Mus musculus
ggtgtgtatgctaatgggaatgaca

SEQ ID NO: 335698 - DNA, 25 bp, Mus musculus
ggtgtgtctagggtgtgcttatatc

SEQ ID NO: 335699 - DNA, 25 bp, Mus musculus
ggtgtgtgaaggatggcgaaacctg

SEQ ID NO: 335700 - DNA, 25 bp, Mus musculus
ggtgtgtgacttagcccaggagtta

SEQ ID NO: 335701 - DNA, 25 bp, Mus musculus
ggtgtgtgacttagctcaaagatta

SEQ ID NO: 335702 - DNA, 25 bp, Mus musculus
ggtgtgtgacttaggtaggtgagcc

SEQ ID NO: 335703 - DNA, 25 bp, Mus musculus
ggtgtgtgtgtgtaatagggatgga

SEQ ID NO: 335704 - DNA, 25 bp, Mus musculus
ggtgtgttagagtggattgaaatgc

SEQ ID NO: 335705 - DNA, 25 bp, Mus musculus
ggtgtgttaggtatggctttcccaa

SEQ ID NO: 335706 - DNA, 25 bp, Mus musculus
ggtgtgttaggtgcggtggctacta

SEQ ID NO: 335707 - DNA, 25 bp, Mus musculus
ggtgtgtttgaggagatttctaata

SEQ ID NO: 335708 - DNA, 25 bp, Mus musculus
ggtgtgttttatccttacaatgaca

SEQ ID NO: 335709 - DNA, 25 bp, Mus musculus
ggtgttaaaaagacatgtttttcag

SEQ ID NO: 335710 - DNA, 25 bp, Mus musculus
ggtgttaaaaagtttatgatcacag

SEQ ID NO: 335711 - DNA, 25 bp, Mus musculus
ggtgttaacatgaaggttcttccag

SEQ ID NO: 335712 - DNA, 25 bp, Mus musculus
ggtgttaacatgattgttcgttttg

SEQ ID NO: 335713 - DNA, 25 bp, Mus musculus
ggtgttacaggccgccctgctccat

SEQ ID NO: 335714 - DNA, 25 bp, Mus musculus
ggtgttacaggttagtgtcactggg

SEQ ID NO: 335715 - DNA, 25 bp, Mus musculus
ggtgttagaatgtgagcggacggac

SEQ ID NO: 335716 - DNA, 25 bp, Mus musculus
ggtgttagcgttaccctgggaatct

SEQ ID NO: 335717 - DNA, 25 bp, Mus musculus
ggtgttagctatttatgaagccaaa

SEQ ID NO: 335718 - DNA, 25 bp, Mus musculus
ggtgttagctatttatggttacacc

SEQ ID NO: 335719 - DNA, 25 bp, Mus musculus
ggtgttatatggttatatatttggg

SEQ ID NO: 335720 - DNA, 25 bp, Mus musculus
ggtgttatcaagctgaggattgaac

SEQ ID NO: 335721 - DNA, 25 bp, Mus musculus
ggtgttcagtgtggacgaggaggag

SEQ ID NO: 335722 - DNA, 25 bp, Mus musculus
ggtgttccaggagcgcatcaactgt

SEQ ID NO: 335723 - DNA, 25 bp, Mus musculus
ggtgttccaggtaggtgcatgagcc

SEQ ID NO: 335724 - DNA, 25 bp, Mus musculus
ggtgttcctactggagttaaaggga

SEQ ID NO: 335725 - DNA, 25 bp, Mus musculus
ggtgttcctcagcaacttgatttct

SEQ ID NO: 335726 - DNA, 25 bp, Mus musculus
ggtgttcgcggggctcgtgctcgtg

SEQ ID NO: 335727 - DNA, 25 bp, Mus musculus
ggtgttcgctccaggtgagaagtct

SEQ ID NO: 335728 - DNA, 25 bp, Mus musculus
ggtgttcgtgcggtcttttgatgga

SEQ ID NO: 335729 - DNA, 25 bp, Mus musculus
ggtgttcgtggcaggggatgatgag

SEQ ID NO: 335730 - DNA, 25 bp, Mus musculus
ggtgttcttatgactctgctgggat

SEQ ID NO: 335731 - DNA, 25 bp, Mus musculus
ggtgttcttatgactctgggctgat

SEQ ID NO: 335732 - DNA, 25 bp, Mus musculus
ggtgttcttatgactgcaccattcc

SEQ ID NO: 335733 - DNA, 25 bp, Mus musculus
ggtgttctttccggctgtgacttct

SEQ ID NO: 335734 - DNA, 25 bp, Mus musculus
ggtgttgaatacaaggttctcagga

SEQ ID NO: 335735 - DNA, 25 bp, Mus musculus
ggtgttgacggacttattgccaagg

SEQ ID NO: 335736 - DNA, 25 bp, Mus musculus
ggtgttgatgaagagctggagtgat

SEQ ID NO: 335737 - DNA, 25 bp, Mus musculus
ggtgttgattacaggtacagcgcag

SEQ ID NO: 335738 - DNA, 25 bp, Mus musculus
ggtgttgctgaagatcaaccgagaa

SEQ ID NO: 335739 - DNA, 25 bp, Mus musculus
ggtgttggagcccctgggaacaagc

SEQ ID NO: 335740 - DNA, 25 bp, Mus musculus
ggtgttggagctctgtgatacatgg

SEQ ID NO: 335741 - DNA, 25 bp, Mus musculus
ggtgttggaggaagtaaagctctac

SEQ ID NO: 335742 - DNA, 25 bp, Mus musculus
ggtgttggcactgggatcagtaatg

SEQ ID NO: 335743 - DNA, 25 bp, Mus musculus
ggtgttggcttgtggtctatgttca

SEQ ID NO: 335744 - DNA, 25 bp, Mus musculus
ggtgttgtagcatcttggttgccag

SEQ ID NO: 335745 - DNA, 25 bp, Mus musculus
ggtgttgtagctgctcctcacagaa

SEQ ID NO: 335746 - DNA, 25 bp, Mus musculus
ggtgtttaaggagatgaaaccctgt

SEQ ID NO: 335747 - DNA, 25 bp, Mus musculus
ggtgtttaaggccaagcatctggca

SEQ ID NO: 335748 - DNA, 25 bp, Mus musculus
ggtgtttcacagggtcaggtacctg

SEQ ID NO: 335749 - DNA, 25 bp, Mus musculus
ggtgtttccatagtctgagtgacag

SEQ ID NO: 335750 - DNA, 25 bp, Mus musculus
ggtgtttgcaggagtgtaccctata

SEQ ID NO: 335751 - DNA, 25 bp, Mus musculus
ggtgtttggggcctacacgcccaga

SEQ ID NO: 335752 - DNA, 25 bp, Mus musculus
ggtgtttgtgaatggctgcttattg

SEQ ID NO: 335753 - DNA, 25 bp, Mus musculus
ggtgttttcaggcctctgctcgatg

SEQ ID NO: 335754 - DNA, 25 bp, Mus musculus
ggtgttttgcataggtgcctctcct

SEQ ID NO: 335755 - DNA, 25 bp, Mus musculus
ggtgtttttcagatttcaccgagat

SEQ ID NO: 335756 - DNA, 25 bp, Mus musculus
ggttaaaatacctgagcatctgtaa

SEQ ID NO: 335757 - DNA, 25 bp, Mus musculus
ggttaaagaaggaagatgcaggttt

SEQ ID NO: 335758 - DNA, 25 bp, Mus musculus
ggttaaagaaggaaggatccaggcc

SEQ ID NO: 335759 - DNA, 25 bp, Mus musculus
ggttaaatattgatgagaaggctcc

SEQ ID NO: 335760 - DNA, 25 bp, Mus musculus
ggttaacagaatgagaacagacaag

SEQ ID NO: 335761 - DNA, 25 bp, Mus musculus
ggttaaccagagtcctggatgccca

SEQ ID NO: 335762 - DNA, 25 bp, Mus musculus
ggttaacctgattcctggtttggaa

SEQ ID NO: 335763 - DNA, 25 bp, Mus musculus
ggttaacctggatggggaggtgatt

SEQ ID NO: 335764 - DNA, 25 bp, Mus musculus
ggttaacctgggagtttctgcatcg

SEQ ID NO: 335765 - DNA, 25 bp, Mus musculus
ggttaactgccagatggttcttcgt

SEQ ID NO: 335766 - DNA, 25 bp, Mus musculus
ggttaactgtgagtggacatcatcg

SEQ ID NO: 335767 - DNA, 25 bp, Mus musculus
ggttaagaggggcagactgaagtca

SEQ ID NO: 335768 - DNA, 25 bp, Mus musculus
ggttaagagggggtctcactgtgta

SEQ ID NO: 335769 - DNA, 25 bp, Mus musculus
ggttaagcccaggtgttcatgaagc

SEQ ID NO: 335770 - DNA, 25 bp, Mus musculus
ggttaagtacagaagatctaaagcg

SEQ ID NO: 335771 - DNA, 25 bp, Mus musculus
ggttaataaaggaggctttggagga

SEQ ID NO: 335772 - DNA, 25 bp, Mus musculus
ggttaataatgatgctgtggttaga

SEQ ID NO: 335773 - DNA, 25 bp, Mus musculus
ggttaataatgcagctgtgtctgag

SEQ ID NO: 335774 - DNA, 25 bp, Mus musculus
ggttacaaatagcacgctgaagcag

SEQ ID NO: 335775 - DNA, 25 bp, Mus musculus
ggttacaaatatgagctccccgcac

SEQ ID NO: 335776 - DNA, 25 bp, Mus musculus
ggttacaacatgggagaggcagagt

SEQ ID NO: 335777 - DNA, 25 bp, Mus musculus
ggttacaatccggaaccagctattg

SEQ ID NO: 335778 - DNA, 25 bp, Mus musculus
ggttacaatccggtggcgtcccctt

SEQ ID NO: 335779 - DNA, 25 bp, Mus musculus
ggttacacagggctgttcaggtgtc

SEQ ID NO: 335780 - DNA, 25 bp, Mus musculus
ggttacaccaggcttgtgaagatcc

SEQ ID NO: 335781 - DNA, 25 bp, Mus musculus
ggttacactatacagtggtggaaga

SEQ ID NO: 335782 - DNA, 25 bp, Mus musculus
ggttaccgcacggataattgtgtgg

SEQ ID NO: 335783 - DNA, 25 bp, Mus musculus
ggttacctagaggtgggaggctttg

SEQ ID NO: 335784 - DNA, 25 bp, Mus musculus
ggttaccttcagaattggataacca

SEQ ID NO: 335785 - DNA, 25 bp, Mus musculus
ggttacctttcagcctcccagtaaa

SEQ ID NO: 335786 - DNA, 25 bp, Mus musculus
ggttacgatgaagactgccaaagtg

SEQ ID NO: 335787 - DNA, 25 bp, Mus musculus
ggttacgatgaaggctgtcatggta

SEQ ID NO: 335788 - DNA, 25 bp, Mus musculus
ggttactatctgggtgacaatagct

SEQ ID NO: 335789 - DNA, 25 bp, Mus musculus
ggttactcagggatgaacaagaagc

SEQ ID NO: 335790 - DNA, 25 bp, Mus musculus
ggttactttatctgcacaaacagcg

SEQ ID NO: 335791 - DNA, 25 bp, Mus musculus
ggttacttttgaggatgtcaagcaa

SEQ ID NO: 335792 - DNA, 25 bp, Mus musculus
ggttacttttggaaatacagttgga

SEQ ID NO: 335793 - DNA, 25 bp, Mus musculus
ggttagaacaggtccgagtaggtga

SEQ ID NO: 335794 - DNA, 25 bp, Mus musculus
ggttagaactggtgcaggtcctgcc

SEQ ID NO: 335795 - DNA, 25 bp, Mus musculus
ggttagagatgaatccgccagttcc

SEQ ID NO: 335796 - DNA, 25 bp, Mus musculus
ggttagagcagatggaagattcaga

SEQ ID NO: 335797 - DNA, 25 bp, Mus musculus
ggttagcaataggagaagatggagg

SEQ ID NO: 335798 - DNA, 25 bp, Mus musculus
ggttagcacttggtgtggagaagac

SEQ ID NO: 335799 - DNA, 25 bp, Mus musculus
ggttagccagggattacgcagccat

SEQ ID NO: 335800 - DNA, 25 bp, Mus musculus
ggttagcggtgagtgatcgtgagac

SEQ ID NO: 335801 - DNA, 25 bp, Mus musculus
ggttaggaagggaagttcttccatc

SEQ ID NO: 335802 - DNA, 25 bp, Mus musculus
ggttaggcctgaggctgcttccgcc

SEQ ID NO: 335803 - DNA, 25 bp, Mus musculus
ggttagtgctggattcgagttctga

SEQ ID NO: 335804 - DNA, 25 bp, Mus musculus
ggttagtggaagaaagcacattgta

SEQ ID NO: 335805 - DNA, 25 bp, Mus musculus
ggttataactgacaggtataaaaat

SEQ ID NO: 335806 - DNA, 25 bp, Mus musculus
ggttatacagacagagggtacccgg

SEQ ID NO: 335807 - DNA, 25 bp, Mus musculus
ggttatacaggacattgccctaaaa

SEQ ID NO: 335808 - DNA, 25 bp, Mus musculus
ggttatagcacacatccagaaccca

SEQ ID NO: 335809 - DNA, 25 bp, Mus musculus
ggttatataagaagcccctccaggc

SEQ ID NO: 335810 - DNA, 25 bp, Mus musculus
ggttatatcaagttcaaaaggatgc

SEQ ID NO: 335811 - DNA, 25 bp, Mus musculus
ggttatatttgcctaaagacgtcaa

SEQ ID NO: 335812 - DNA, 25 bp, Mus musculus
ggttatcacaagtgtgtgggataag

SEQ ID NO: 335813 - DNA, 25 bp, Mus musculus
ggttatctaaggaaggaaaaccata

SEQ ID NO: 335814 - DNA, 25 bp, Mus musculus
ggttatctccgggtctcactgttag

SEQ ID NO: 335815 - DNA, 25 bp, Mus musculus
ggttatgagcatcccgactttaagc

SEQ ID NO: 335816 - DNA, 25 bp, Mus musculus
ggttatgataaggactatgtcagat

SEQ ID NO: 335817 - DNA, 25 bp, Mus musculus
ggttatgataagtacatggagaggt

SEQ ID NO: 335818 - DNA, 25 bp, Mus musculus
ggttatgccagaaacccttcactga

SEQ ID NO: 335819 - DNA, 25 bp, Mus musculus
ggttattgagaaggagaacactgaa

SEQ ID NO: 335820 - DNA, 25 bp, Mus musculus
ggttattggtggttttggctcgtga

SEQ ID NO: 335821 - DNA, 25 bp, Mus musculus
ggttcaaaaggatccagaagcactg

SEQ ID NO: 335822 - DNA, 25 bp, Mus musculus
ggttcaaaaggcacagtgacctgaa

SEQ ID NO: 335823 - DNA, 25 bp, Mus musculus
ggttcaaaccagtaggtgcaaactc

SEQ ID NO: 335824 - DNA, 25 bp, Mus musculus
ggttcaaactgcctggaattacatg

SEQ ID NO: 335825 - DNA, 25 bp, Mus musculus
ggttcaaactgcctgggtagtccat

SEQ ID NO: 335826 - DNA, 25 bp, Mus musculus
ggttcaaagttcccctggcctgggg

SEQ ID NO: 335827 - DNA, 25 bp, Mus musculus
ggttcaacttctggtctcacccaaa

SEQ ID NO: 335828 - DNA, 25 bp, Mus musculus
ggttcaagacaagataagccgacaa

SEQ ID NO: 335829 - DNA, 25 bp, Mus musculus
ggttcaagacgatctggctgaaagt

SEQ ID NO: 335830 - DNA, 25 bp, Mus musculus
ggttcaaggcgacaatgttctcaaa

SEQ ID NO: 335831 - DNA, 25 bp, Mus musculus
ggttcaagtgggtgttccagtgatg

SEQ ID NO: 335832 - DNA, 25 bp, Mus musculus
ggttcaagtgttcctgtccacagaa

SEQ ID NO: 335833 - DNA, 25 bp, Mus musculus
ggttcaattccagccatattgatgg

SEQ ID NO: 335834 - DNA, 25 bp, Mus musculus
ggttcacacaggagtgccaggaggt

SEQ ID NO: 335835 - DNA, 25 bp, Mus musculus
ggttcacagagatcccagaaaccgg

SEQ ID NO: 335836 - DNA, 25 bp, Mus musculus
ggttcacagcagcacatccctacaa

SEQ ID NO: 335837 - DNA, 25 bp, Mus musculus
ggttcacagcaggtgcccagggaag

SEQ ID NO: 335838 - DNA, 25 bp, Mus musculus
ggttcaccacacagacagaggagct

SEQ ID NO: 335839 - DNA, 25 bp, Mus musculus
ggttcaccacacagacagaggagtt

SEQ ID NO: 335840 - DNA, 25 bp, Mus musculus
ggttcaccagataaatttaacacat

SEQ ID NO: 335841 - DNA, 25 bp, Mus musculus
ggttcactgctcttccgaatccagc

SEQ ID NO: 335842 - DNA, 25 bp, Mus musculus
ggttcactgtggaagtggtcccaac

SEQ ID NO: 335843 - DNA, 25 bp, Mus musculus
ggttcagaagggccagctgacgagt

SEQ ID NO: 335844 - DNA, 25 bp, Mus musculus
ggttcagcaaggtttacagtagcat

SEQ ID NO: 335845 - DNA, 25 bp, Mus musculus
ggttcagctcctacctccttcttca

SEQ ID NO: 335846 - DNA, 25 bp, Mus musculus
ggttcaggaggggtgagtcagaatt

SEQ ID NO: 335847 - DNA, 25 bp, Mus musculus
ggttcagggattacagtgctgtgct

SEQ ID NO: 335848 - DNA, 25 bp, Mus musculus
ggttcagggcagctctcagggcctg

SEQ ID NO: 335849 - DNA, 25 bp, Mus musculus
ggttcagggcctggacagccacttc

SEQ ID NO: 335850 - DNA, 25 bp, Mus musculus
ggttcagtttgataccggatggtgg

SEQ ID NO: 335851 - DNA, 25 bp, Mus musculus
ggttcataccaggttgtaagcatca

SEQ ID NO: 335852 - DNA, 25 bp, Mus musculus
ggttcatacctcgagaattatagtg

SEQ ID NO: 335853 - DNA, 25 bp, Mus musculus
ggttcatcagaggagattgaagggc

SEQ ID NO: 335854 - DNA, 25 bp, Mus musculus
ggttcatcatcccaggagtgttact

SEQ ID NO: 335855 - DNA, 25 bp, Mus musculus
ggttcatcatcccagtcttcatcag

SEQ ID NO: 335856 - DNA, 25 bp, Mus musculus
ggttcatccatacatccagaaccca

SEQ ID NO: 335857 - DNA, 25 bp, Mus musculus
ggttcatcctgactatgcggcgcag

SEQ ID NO: 335858 - DNA, 25 bp, Mus musculus
ggttcatcctgccagagactatgcg

SEQ ID NO: 335859 - DNA, 25 bp, Mus musculus
ggttcatgagaggccgaggccactc

SEQ ID NO: 335860 - DNA, 25 bp, Mus musculus
ggttcatgagttaaggcgtcgaggt

SEQ ID NO: 335861 - DNA, 25 bp, Mus musculus
ggttcatttgcatccctggcaccat

SEQ ID NO: 335862 - DNA, 25 bp, Mus musculus
ggttccaagagaagagcgcctccct

SEQ ID NO: 335863 - DNA, 25 bp, Mus musculus
ggttccaagagaagagtgcttccct

SEQ ID NO: 335864 - DNA, 25 bp, Mus musculus
ggttccaagagaagagtgcttcgct

SEQ ID NO: 335865 - DNA, 25 bp, Mus musculus
ggttccaagagcaggtcaccgacaa

SEQ ID NO: 335866 - DNA, 25 bp, Mus musculus
ggttccacgcctgattctggcaggt

SEQ ID NO: 335867 - DNA, 25 bp, Mus musculus
ggttccagcagaagtacgatggaat

SEQ ID NO: 335868 - DNA, 25 bp, Mus musculus
ggttccaggcggggtacatggcttc

SEQ ID NO: 335869 - DNA, 25 bp, Mus musculus
ggttccaggcggggttaaactcact

SEQ ID NO: 335870 - DNA, 25 bp, Mus musculus
ggttccataggtgcggctctggggc

SEQ ID NO: 335871 - DNA, 25 bp, Mus musculus
ggttccatcaagggaagaaggatgc

SEQ ID NO: 335872 - DNA, 25 bp, Mus musculus
ggttccatcacccagggcaccccac

SEQ ID NO: 335873 - DNA, 25 bp, Mus musculus
ggttccatgccggcaaagtgcaaac

SEQ ID NO: 335874 - DNA, 25 bp, Mus musculus
ggttccatgtggatgctgcctgggg

SEQ ID NO: 335875 - DNA, 25 bp, Mus musculus
ggttccatgtggatggctgactctg

SEQ ID NO: 335876 - DNA, 25 bp, Mus musculus
ggttccatttcccagggcacaccaa

SEQ ID NO: 335877 - DNA, 25 bp, Mus musculus
ggttcccaaagagatgcacgggaat

SEQ ID NO: 335878 - DNA, 25 bp, Mus musculus
ggttcccaagcagcagcaggctgtg

SEQ ID NO: 335879 - DNA, 25 bp, Mus musculus
ggttcccaaggacttgtactggttt

SEQ ID NO: 335880 - DNA, 25 bp, Mus musculus
ggttcccaatgatctgattggctgt

SEQ ID NO: 335881 - DNA, 25 bp, Mus musculus
ggttcccaatgatggcagcaagatc

SEQ ID NO: 335882 - DNA, 25 bp, Mus musculus
ggttcccagaaagccccgcagccct

SEQ ID NO: 335883 - DNA, 25 bp, Mus musculus
ggttccccagacacagaaagccatc

SEQ ID NO: 335884 - DNA, 25 bp, Mus musculus
ggttccccagcagagatgaactggc

SEQ ID NO: 335885 - DNA, 25 bp, Mus musculus
ggttccccagtcaatcgcaggccac

SEQ ID NO: 335886 - DNA, 25 bp, Mus musculus
ggttccccgcagaagacctccttcc

SEQ ID NO: 335887 - DNA, 25 bp, Mus musculus
ggttcccgacgctcctgcgttctat

SEQ ID NO: 335888 - DNA, 25 bp, Mus musculus
ggttcccgacggtgacaaacttgaa

SEQ ID NO: 335889 - DNA, 25 bp, Mus musculus
ggttcccgacggttttggctatgga

SEQ ID NO: 335890 - DNA, 25 bp, Mus musculus
ggttcccgcaacaggtgacccaatg

SEQ ID NO: 335891 - DNA, 25 bp, Mus musculus
ggttcccgctgacacgtaggcaatt

SEQ ID NO: 335892 - DNA, 25 bp, Mus musculus
ggttcccgctgacctcccgccatcc

SEQ ID NO: 335893 - DNA, 25 bp, Mus musculus
ggttcccgctgagacgtaggcaatt

SEQ ID NO: 335894 - DNA, 25 bp, Mus musculus
ggttcccgctgagctcccgccatcc

SEQ ID NO: 335895 - DNA, 25 bp, Mus musculus
ggttccctccactggttggaagagg

SEQ ID NO: 335896 - DNA, 25 bp, Mus musculus
ggttccctctcagggtgcgggtagc

SEQ ID NO: 335897 - DNA, 25 bp, Mus musculus
ggttcccttgagacaccagagaaga

SEQ ID NO: 335898 - DNA, 25 bp, Mus musculus
ggttccgcgcgcttgggaccgcgtt

SEQ ID NO: 335899 - DNA, 25 bp, Mus musculus
ggttccgcgcggagaatgactcagg

SEQ ID NO: 335900 - DNA, 25 bp, Mus musculus
ggttccggaaggttccatgatggag

SEQ ID NO: 335901 - DNA, 25 bp, Mus musculus
ggttccggttcggattctgtgtctt

SEQ ID NO: 335902 - DNA, 25 bp, Mus musculus
ggttcctcagaaaatgaagtcccag

SEQ ID NO: 335903 - DNA, 25 bp, Mus musculus
ggttcctcagaacctgggaggcagc

SEQ ID NO: 335904 - DNA, 25 bp, Mus musculus
ggttcctcagagccgagcaatggtg

SEQ ID NO: 335905 - DNA, 25 bp, Mus musculus
ggttcctccagctctacccgatcaa

SEQ ID NO: 335906 - DNA, 25 bp, Mus musculus
ggttcctctgtcagatgatgatcat

SEQ ID NO: 335907 - DNA, 25 bp, Mus musculus
ggttcctgatgatgatgaaccagct

SEQ ID NO: 335908 - DNA, 25 bp, Mus musculus
ggttcctgatggaaaaccaactcta

SEQ ID NO: 335909 - DNA, 25 bp, Mus musculus
ggttcctgatggtgttctccaaacc

SEQ ID NO: 335910 - DNA, 25 bp, Mus musculus
ggttcctgcaggaggcagcgggccg

SEQ ID NO: 335911 - DNA, 25 bp, Mus musculus
ggttcctgcctaccactgttccctt

SEQ ID NO: 335912 - DNA, 25 bp, Mus musculus
ggttcctgcctgtgacatggacaga

SEQ ID NO: 335913 - DNA, 25 bp, Mus musculus
ggttcctggagggatcaatgtgacc

SEQ ID NO: 335914 - DNA, 25 bp, Mus musculus
ggttcctggcttgcacaccggggcc

SEQ ID NO: 335915 - DNA, 25 bp, Mus musculus
ggttcctggcttgcagtgtgcctgc

SEQ ID NO: 335916 - DNA, 25 bp, Mus musculus
ggttcctgtatcagggtgcgcaggc

SEQ ID NO: 335917 - DNA, 25 bp, Mus musculus
ggttccttcaagagcatgctgggac

SEQ ID NO: 335918 - DNA, 25 bp, Mus musculus
ggttccttcaagggacttcctcgcc

SEQ ID NO: 335919 - DNA, 25 bp, Mus musculus
ggttccttctgcggagaacgtttta

SEQ ID NO: 335920 - DNA, 25 bp, Mus musculus
ggttccttgagatacgacatttcat

SEQ ID NO: 335921 - DNA, 25 bp, Mus musculus
ggttcctttccttgggagcgagcag

SEQ ID NO: 335922 - DNA, 25 bp, Mus musculus
ggttcgaaggccatgacagtagctg

SEQ ID NO: 335923 - DNA, 25 bp, Mus musculus
ggttcgaaggggctcatcctgttaa

SEQ ID NO: 335924 - DNA, 25 bp, Mus musculus
ggttcgcctgaggattggatggtga

SEQ ID NO: 335925 - DNA, 25 bp, Mus musculus
ggttcgcctgggtggcggctgacag

SEQ ID NO: 335926 - DNA, 25 bp, Mus musculus
ggttcgcgagaacagttcaagggca

SEQ ID NO: 335927 - DNA, 25 bp, Mus musculus
ggttcgcgcgcagtggtaactcata

SEQ ID NO: 335928 - DNA, 25 bp, Mus musculus
ggttcggagaagaagtctcagcgct

SEQ ID NO: 335929 - DNA, 25 bp, Mus musculus
ggttcggattcaggcttgtgtgtga

SEQ ID NO: 335930 - DNA, 25 bp, Mus musculus
ggttcggattcaggtaatcgccacg

SEQ ID NO: 335931 - DNA, 25 bp, Mus musculus
ggttcgtgggaagatagacccagtg

SEQ ID NO: 335932 - DNA, 25 bp, Mus musculus
ggttctaccagaattatatatgttg

SEQ ID NO: 335933 - DNA, 25 bp, Mus musculus
ggttctaccagaggctgtgtacagc

SEQ ID NO: 335934 - DNA, 25 bp, Mus musculus
ggttctacgccaagcatcatcagct

SEQ ID NO: 335935 - DNA, 25 bp, Mus musculus
ggttctagaacagttcttaggaagc

SEQ ID NO: 335936 - DNA, 25 bp, Mus musculus
ggttctataccattgacactggcca

SEQ ID NO: 335937 - DNA, 25 bp, Mus musculus
ggttctatctatgaatttggaaata

SEQ ID NO: 335938 - DNA, 25 bp, Mus musculus
ggttctcaactggctatggctcctg

SEQ ID NO: 335939 - DNA, 25 bp, Mus musculus
ggttctcaaggcggggacgatccgg

SEQ ID NO: 335940 - DNA, 25 bp, Mus musculus
ggttctccaagtgttgaatcataaa

SEQ ID NO: 335941 - DNA, 25 bp, Mus musculus
ggttctccagagaggtgcccttctc

SEQ ID NO: 335942 - DNA, 25 bp, Mus musculus
ggttctccagagggaaaaagcctac

SEQ ID NO: 335943 - DNA, 25 bp, Mus musculus
ggttctcccagagtggcttcatcac

SEQ ID NO: 335944 - DNA, 25 bp, Mus musculus
ggttctcccgaggaggcatgataag

SEQ ID NO: 335945 - DNA, 25 bp, Mus musculus
ggttctcccgagggctgggataagc

SEQ ID NO: 335946 - DNA, 25 bp, Mus musculus
ggttctccgccgagccggaccgggc

SEQ ID NO: 335947 - DNA, 25 bp, Mus musculus
ggttctccgccgagcgcctcggtcc

SEQ ID NO: 335948 - DNA, 25 bp, Mus musculus
ggttctcgagcaccctcagaatatg

SEQ ID NO: 335949 - DNA, 25 bp, Mus musculus
ggttctcgaggctgctgatgagacc

SEQ ID NO: 335950 - DNA, 25 bp, Mus musculus
ggttctctagggtgaagagatgaac

SEQ ID NO: 335951 - DNA, 25 bp, Mus musculus
ggttctctagtctgcccgagagcat

SEQ ID NO: 335952 - DNA, 25 bp, Mus musculus
ggttctctgtaagttctccctgttc

SEQ ID NO: 335953 - DNA, 25 bp, Mus musculus
ggttctgaaacaggaaatccggctc

SEQ ID NO: 335954 - DNA, 25 bp, Mus musculus
ggttctgacaggcctcaagaaagga

SEQ ID NO: 335955 - DNA, 25 bp, Mus musculus
ggttctgagtcacgtgctgtaatta

SEQ ID NO: 335956 - DNA, 25 bp, Mus musculus
ggttctgatatgtcacatgctgctg

SEQ ID NO: 335957 - DNA, 25 bp, Mus musculus
ggttctgatgatgattcatgaaaaa

SEQ ID NO: 335958 - DNA, 25 bp, Mus musculus
ggttctgcagaccatgccgtccatc

SEQ ID NO: 335959 - DNA, 25 bp, Mus musculus
ggttctgcagaggaacagctgtgcc

SEQ ID NO: 335960 - DNA, 25 bp, Mus musculus
ggttctgcaggagcagagcccgggt

SEQ ID NO: 335961 - DNA, 25 bp, Mus musculus
ggttctgcaggaggagtgatgggca

SEQ ID NO: 335962 - DNA, 25 bp, Mus musculus
ggttctgcatcccgttcacgcaaag

SEQ ID NO: 335963 - DNA, 25 bp, Mus musculus
ggttctgctcacagcctccctctta

SEQ ID NO: 335964 - DNA, 25 bp, Mus musculus
ggttctgctgcagagacagcactag

SEQ ID NO: 335965 - DNA, 25 bp, Mus musculus
ggttctgctgggccactgccggtgg

SEQ ID NO: 335966 - DNA, 25 bp, Mus musculus
ggttctgctgtctcagtgccatttc

SEQ ID NO: 335967 - DNA, 25 bp, Mus musculus
ggttctgcttcccaggctaaggaga

SEQ ID NO: 335968 - DNA, 25 bp, Mus musculus
ggttctggaaatcctgagaatatct

SEQ ID NO: 335969 - DNA, 25 bp, Mus musculus
ggttctggaaatggctgaccaaggt

SEQ ID NO: 335970 - DNA, 25 bp, Mus musculus
ggttctggaatgatctcaacttcct

SEQ ID NO: 335971 - DNA, 25 bp, Mus musculus
ggttctggcgctccggcactcagca

SEQ ID NO: 335972 - DNA, 25 bp, Mus musculus
ggttctggcgggattcctctgcgtg

SEQ ID NO: 335973 - DNA, 25 bp, Mus musculus
ggttctgggaagtgcgaaatcaaag

SEQ ID NO: 335974 - DNA, 25 bp, Mus musculus
ggttctgggggcaaactggaaggag

SEQ ID NO: 335975 - DNA, 25 bp, Mus musculus
ggttctggtgatggccataaaatca

SEQ ID NO: 335976 - DNA, 25 bp, Mus musculus
ggttctggtgccagcaactggccat

SEQ ID NO: 335977 - DNA, 25 bp, Mus musculus
ggttctggtgccagggtttctctgt

SEQ ID NO: 335978 - DNA, 25 bp, Mus musculus
ggttctggtgctgaaacccttcact

SEQ ID NO: 335979 - DNA, 25 bp, Mus musculus
ggttctgtccagagcctcaaggtcc

SEQ ID NO: 335980 - DNA, 25 bp, Mus musculus
ggttctgtccaggatcattttaacc

SEQ ID NO: 335981 - DNA, 25 bp, Mus musculus
ggttctgttcccatgagaacccctg

SEQ ID NO: 335982 - DNA, 25 bp, Mus musculus
ggttctgttcccatggaatcattgg

SEQ ID NO: 335983 - DNA, 25 bp, Mus musculus
ggttcttaagtcagagagcgaggag

SEQ ID NO: 335984 - DNA, 25 bp, Mus musculus
ggttcttcaagatctggagaccctg

SEQ ID NO: 335985 - DNA, 25 bp, Mus musculus
ggttcttcaaggccacgaaagacca

SEQ ID NO: 335986 - DNA, 25 bp, Mus musculus
ggttcttcagcaagacagaggagct

SEQ ID NO: 335987 - DNA, 25 bp, Mus musculus
ggttcttcaggcgtggctcccgcag

SEQ ID NO: 335988 - DNA, 25 bp, Mus musculus
ggttcttcaggtacatggcttcttc

SEQ ID NO: 335989 - DNA, 25 bp, Mus musculus
ggttcttcaggtcagaaggagacaa

SEQ ID NO: 335990 - DNA, 25 bp, Mus musculus
ggttcttcctcaaccccctagaatc

SEQ ID NO: 335991 - DNA, 25 bp, Mus musculus
ggttcttgagaggccacagacctcc

SEQ ID NO: 335992 - DNA, 25 bp, Mus musculus
ggttcttgtttgatactttatgcat

SEQ ID NO: 335993 - DNA, 25 bp, Mus musculus
ggttctttaagctacaaaaaattgc

SEQ ID NO: 335994 - DNA, 25 bp, Mus musculus
ggttctttccaaatggacctgaggt

SEQ ID NO: 335995 - DNA, 25 bp, Mus musculus
ggttgaaacaggctgttgtgcagac

SEQ ID NO: 335996 - DNA, 25 bp, Mus musculus
ggttgaaatagaattgatggaatcc

SEQ ID NO: 335997 - DNA, 25 bp, Mus musculus
ggttgaaatagagggaccagtcttg

SEQ ID NO: 335998 - DNA, 25 bp, Mus musculus
ggttgaactcctgagatatgaatct

SEQ ID NO: 335999 - DNA, 25 bp, Mus musculus
ggttgaacttgttggatttgaactt

SEQ ID NO: 336000 - DNA, 25 bp, Mus musculus
ggttgaagacacaggaggcagccag

SEQ ID NO: 336001 - DNA, 25 bp, Mus musculus
ggttgaagagaactctgataagaaa

SEQ ID NO: 336002 - DNA, 25 bp, Mus musculus
ggttgaagagatgaaaagaaaataa

SEQ ID NO: 336003 - DNA, 25 bp, Mus musculus
ggttgaagagatttgacatcctcaa

SEQ ID NO: 336004 - DNA, 25 bp, Mus musculus
ggttgaagagggtgctgatactttt

SEQ ID NO: 336005 - DNA, 25 bp, Mus musculus
ggttgaagaggtgcacactttatgg

SEQ ID NO: 336006 - DNA, 25 bp, Mus musculus
ggttgaatgatccagagtcctcccc

SEQ ID NO: 336007 - DNA, 25 bp, Mus musculus
ggttgaatgatgcagagtcctcccc

SEQ ID NO: 336008 - DNA, 25 bp, Mus musculus
ggttgaatttctggtaatctatgcc

SEQ ID NO: 336009 - DNA, 25 bp, Mus musculus
ggttgaatttctggtttgcggtgta

SEQ ID NO: 336010 - DNA, 25 bp, Mus musculus
ggttgacatcaaatacaagaggaat

SEQ ID NO: 336011 - DNA, 25 bp, Mus musculus
ggttgacatcaagactgaaggacaa

SEQ ID NO: 336012 - DNA, 25 bp, Mus musculus
ggttgacatgagtaacatacaagag

SEQ ID NO: 336013 - DNA, 25 bp, Mus musculus
ggttgacgtgattgtgaataccctt

SEQ ID NO: 336014 - DNA, 25 bp, Mus musculus
ggttgagaaaggaactcaacagagg

SEQ ID NO: 336015 - DNA, 25 bp, Mus musculus
ggttgagaactgggcgtggaaaaga

SEQ ID NO: 336016 - DNA, 25 bp, Mus musculus
ggttgagacagcaacggtggacaaa

SEQ ID NO: 336017 - DNA, 25 bp, Mus musculus
ggttgagagaattggaaaatgactc

SEQ ID NO: 336018 - DNA, 25 bp, Mus musculus
ggttgagcaacaaaatcttgctagt

SEQ ID NO: 336019 - DNA, 25 bp, Mus musculus
ggttgagcaagaaaatcttgctagt

SEQ ID NO: 336020 - DNA, 25 bp, Mus musculus
ggttgagtaaattcacagatactgc

SEQ ID NO: 336021 - DNA, 25 bp, Mus musculus
ggttgatccaaacatccagaaccca

SEQ ID NO: 336022 - DNA, 25 bp, Mus musculus
ggttgatcttaagatgtcagtagaa

SEQ ID NO: 336023 - DNA, 25 bp, Mus musculus
ggttgatcttaaggatcgagagcga

SEQ ID NO: 336024 - DNA, 25 bp, Mus musculus
ggttgattgagaaggagggagagtt

SEQ ID NO: 336025 - DNA, 25 bp, Mus musculus
ggttgcaaattagtttcgtggtttt

SEQ ID NO: 336026 - DNA, 25 bp, Mus musculus
ggttgcaacaagaaggtgacactgg

SEQ ID NO: 336027 - DNA, 25 bp, Mus musculus
ggttgcacaggatttccctagagat

SEQ ID NO: 336028 - DNA, 25 bp, Mus musculus
ggttgcacaggtgaagatcatgacg

SEQ ID NO: 336029 - DNA, 25 bp, Mus musculus
ggttgcaggaattggccaacggctc

SEQ ID NO: 336030 - DNA, 25 bp, Mus musculus
ggttgcaggagcacccccaccgctg

SEQ ID NO: 336031 - DNA, 25 bp, Mus musculus
ggttgcaggagggtgaagggcctgg

SEQ ID NO: 336032 - DNA, 25 bp, Mus musculus
ggttgccaagaaggggtagaggagc

SEQ ID NO: 336033 - DNA, 25 bp, Mus musculus
ggttgccaagcaacacgtgcaggac

SEQ ID NO: 336034 - DNA, 25 bp, Mus musculus
ggttgccaaggccttaatccaggac

SEQ ID NO: 336035 - DNA, 25 bp, Mus musculus
ggttgccaaggctacataaactgtt

SEQ ID NO: 336036 - DNA, 25 bp, Mus musculus
ggttgccaaggtccaaggaccttaa

SEQ ID NO: 336037 - DNA, 25 bp, Mus musculus
ggttgccaccaacacctgtacatgg

SEQ ID NO: 336038 - DNA, 25 bp, Mus musculus
ggttgccaccaagacctgtacatgg

SEQ ID NO: 336039 - DNA, 25 bp, Mus musculus
ggttgccaggctccacccgcggtca

SEQ ID NO: 336040 - DNA, 25 bp, Mus musculus
ggttgcccaggtgacagattatgtt

SEQ ID NO: 336041 - DNA, 25 bp, Mus musculus
ggttgcccaggtgctgggcttggag

SEQ ID NO: 336042 - DNA, 25 bp, Mus musculus
ggttgcccttgaacatttatgaaca

SEQ ID NO: 336043 - DNA, 25 bp, Mus musculus
ggttgcccttggtgaggcatgcacc

SEQ ID NO: 336044 - DNA, 25 bp, Mus musculus
ggttgccgccataggtttatggagc

SEQ ID NO: 336045 - DNA, 25 bp, Mus musculus
ggttgccgggcgagctggaaaccat

SEQ ID NO: 336046 - DNA, 25 bp, Mus musculus
ggttgccgggcgaggcctctgagaa

SEQ ID NO: 336047 - DNA, 25 bp, Mus musculus
ggttgcctttgcacctgagaaccca

SEQ ID NO: 336048 - DNA, 25 bp, Mus musculus
ggttgcgcgcacagatttgaagact

SEQ ID NO: 336049 - DNA, 25 bp, Mus musculus
ggttgcgcgcacaggcctcctctgt

SEQ ID NO: 336050 - DNA, 25 bp, Mus musculus
ggttgcggaaacaggcattgaagac

SEQ ID NO: 336051 - DNA, 25 bp, Mus musculus
ggttgcggcagatgccccacaggat

SEQ ID NO: 336052 - DNA, 25 bp, Mus musculus
ggttgcggcgccaagatccccagct

SEQ ID NO: 336053 - DNA, 25 bp, Mus musculus
ggttgcgtcaagagcctcagcttaa

SEQ ID NO: 336054 - DNA, 25 bp, Mus musculus
ggttgctatggaacatcattcatgg

SEQ ID NO: 336055 - DNA, 25 bp, Mus musculus
ggttgctatggtctgggagggtctg

SEQ ID NO: 336056 - DNA, 25 bp, Mus musculus
ggttgctcaaacatgtgaggaacta

SEQ ID NO: 336057 - DNA, 25 bp, Mus musculus
ggttgctcaatcatgtgaggaacta

SEQ ID NO: 336058 - DNA, 25 bp, Mus musculus
ggttgctgaagaagagcatcatggt

SEQ ID NO: 336059 - DNA, 25 bp, Mus musculus
ggttgctgacgagatctggccgccc

SEQ ID NO: 336060 - DNA, 25 bp, Mus musculus
ggttgctgaggacaggacccgagtt

SEQ ID NO: 336061 - DNA, 25 bp, Mus musculus
ggttgctgtcgtgcctcgaggcagc

SEQ ID NO: 336062 - DNA, 25 bp, Mus musculus
ggttgctgtggccctctgattgccc

SEQ ID NO: 336063 - DNA, 25 bp, Mus musculus
ggttgcttaatagattgtgcccacc

SEQ ID NO: 336064 - DNA, 25 bp, Mus musculus
ggttgcttctggggtcacaggatgc

SEQ ID NO: 336065 - DNA, 25 bp, Mus musculus
ggttggaacgaatgcctccaattcc

SEQ ID NO: 336066 - DNA, 25 bp, Mus musculus
ggttggaataaaggaaacaagctcc

SEQ ID NO: 336067 - DNA, 25 bp, Mus musculus
ggttggacaagggctgcaaacacaa

SEQ ID NO: 336068 - DNA, 25 bp, Mus musculus
ggttggacccaggagccgggtgtgg

SEQ ID NO: 336069 - DNA, 25 bp, Mus musculus
ggttggactggaaaggtggtctact

SEQ ID NO: 336070 - DNA, 25 bp, Mus musculus
ggttggactggaaaggttggtttct

SEQ ID NO: 336071 - DNA, 25 bp, Mus musculus
ggttggacttggtgtgagtcattct

SEQ ID NO: 336072 - DNA, 25 bp, Mus musculus
ggttggagaaatctctggtcgctta

SEQ ID NO: 336073 - DNA, 25 bp, Mus musculus
ggttggagagagtgtgaacatggct

SEQ ID NO: 336074 - DNA, 25 bp, Mus musculus
ggttggagcaggtactggccttatg

SEQ ID NO: 336075 - DNA, 25 bp, Mus musculus
ggttggagcaggtggcaaagcaaca

SEQ ID NO: 336076 - DNA, 25 bp, Mus musculus
ggttggagccagctatgtggcccta

SEQ ID NO: 336077 - DNA, 25 bp, Mus musculus
ggttggagccagctcctgctgctga

SEQ ID NO: 336078 - DNA, 25 bp, Mus musculus
ggttggagctgcagggcctgttgct

SEQ ID NO: 336079 - DNA, 25 bp, Mus musculus
ggttggagctgcaggggctctgaga

SEQ ID NO: 336080 - DNA, 25 bp, Mus musculus
ggttggaggccaggaatggtaccag

SEQ ID NO: 336081 - DNA, 25 bp, Mus musculus
ggttggaggccagtgcctctctggg

SEQ ID NO: 336082 - DNA, 25 bp, Mus musculus
ggttggaggctaggtcttggtttcc

SEQ ID NO: 336083 - DNA, 25 bp, Mus musculus
ggttggatcagaggagtccctggtg

SEQ ID NO: 336084 - DNA, 25 bp, Mus musculus
ggttggatgcaagctatgccccctc

SEQ ID NO: 336085 - DNA, 25 bp, Mus musculus
ggttggatgggcacacgctgccacc

SEQ ID NO: 336086 - DNA, 25 bp, Mus musculus
ggttggcaacctctgaagtcttgaa

SEQ ID NO: 336087 - DNA, 25 bp, Mus musculus
ggttggccctcagggtcccacagga

SEQ ID NO: 336088 - DNA, 25 bp, Mus musculus
ggttggcggagagagtacccagtat

SEQ ID NO: 336089 - DNA, 25 bp, Mus musculus
ggttggctaccagggacctcctggc

SEQ ID NO: 336090 - DNA, 25 bp, Mus musculus
ggttggctggcgtgccctacgttgg

SEQ ID NO: 336091 - DNA, 25 bp, Mus musculus
ggttgggaaggaaaagggctatgct

SEQ ID NO: 336092 - DNA, 25 bp, Mus musculus
ggttgggaaggttctggctgcccat

SEQ ID NO: 336093 - DNA, 25 bp, Mus musculus
ggttgggaatacaggagacagaaaa

SEQ ID NO: 336094 - DNA, 25 bp, Mus musculus
ggttgggataaactcgcatgtgtgg

SEQ ID NO: 336095 - DNA, 25 bp, Mus musculus
ggttgggatttcagacaggtggagt

SEQ ID NO: 336096 - DNA, 25 bp, Mus musculus
ggttgggatttcaggtctctggctt

SEQ ID NO: 336097 - DNA, 25 bp, Mus musculus
ggttgggcagtgaatccaaaactac

SEQ ID NO: 336098 - DNA, 25 bp, Mus musculus
ggttggggagtattactatgaatat

SEQ ID NO: 336099 - DNA, 25 bp, Mus musculus
ggttgggttttaagtgcggagatcc

SEQ ID NO: 336100 - DNA, 25 bp, Mus musculus
ggttggtcactacactgcatatgcg

SEQ ID NO: 336101 - DNA, 25 bp, Mus musculus
ggttggtggaagatgtgctcgtagc

SEQ ID NO: 336102 - DNA, 25 bp, Mus musculus
ggttgtaaaacgagccctcagggat

SEQ ID NO: 336103 - DNA, 25 bp, Mus musculus
ggttgtcagcgctgatagaagtgga

SEQ ID NO: 336104 - DNA, 25 bp, Mus musculus
ggttgtcagcgggtgactttgcagt

SEQ ID NO: 336105 - DNA, 25 bp, Mus musculus
ggttgtcaggagatataacagactt

SEQ ID NO: 336106 - DNA, 25 bp, Mus musculus
ggttgtcagggttacagccactcac

SEQ ID NO: 336107 - DNA, 25 bp, Mus musculus
ggttgtcatgtatcacggtgatcgt

SEQ ID NO: 336108 - DNA, 25 bp, Mus musculus
ggttgtcgtcgtcagcttgacaaaa

SEQ ID NO: 336109 - DNA, 25 bp, Mus musculus
ggttgtctcaacagcctgacagagc

SEQ ID NO: 336110 - DNA, 25 bp, Mus musculus
ggttgtcttccaaaaggctcaaaga

SEQ ID NO: 336111 - DNA, 25 bp, Mus musculus
ggttgtgatgggaggctcctatgat

SEQ ID NO: 336112 - DNA, 25 bp, Mus musculus
ggttgtgatgggcggctcctatgat

SEQ ID NO: 336113 - DNA, 25 bp, Mus musculus
ggttgtgattcagatacaaacagga

SEQ ID NO: 336114 - DNA, 25 bp, Mus musculus
ggttgtgattcagatcaactgccac

SEQ ID NO: 336115 - DNA, 25 bp, Mus musculus
ggttgtgctgggcctgcttccgaga

SEQ ID NO: 336116 - DNA, 25 bp, Mus musculus
ggttgtggatcacagctgcgaccga

SEQ ID NO: 336117 - DNA, 25 bp, Mus musculus
ggttgtggcggttcccgaggagact

SEQ ID NO: 336118 - DNA, 25 bp, Mus musculus
ggttgtggtcaaccacactgtcctg

SEQ ID NO: 336119 - DNA, 25 bp, Mus musculus
ggttgtggtgggacaaccctccata

SEQ ID NO: 336120 - DNA, 25 bp, Mus musculus
ggttgtgtctcttactggggccttc

SEQ ID NO: 336121 - DNA, 25 bp, Mus musculus
ggttgttaagactactgggaatcag

SEQ ID NO: 336122 - DNA, 25 bp, Mus musculus
ggttgttaagatcctggaccgctgg

SEQ ID NO: 336123 - DNA, 25 bp, Mus musculus
ggttgttaaggacaaagcaggacct

SEQ ID NO: 336124 - DNA, 25 bp, Mus musculus
ggttgttaaggacctcataaggaaa

SEQ ID NO: 336125 - DNA, 25 bp, Mus musculus
ggttgttacaagagggaagcctgtc

SEQ ID NO: 336126 - DNA, 25 bp, Mus musculus
ggttgttactaacagcaagttcaat

SEQ ID NO: 336127 - DNA, 25 bp, Mus musculus
ggttgttcaagttataggtaaaagc

SEQ ID NO: 336128 - DNA, 25 bp, Mus musculus
ggttgttccggaggaatttgaagcc

SEQ ID NO: 336129 - DNA, 25 bp, Mus musculus
ggttgttgaaggactcgggacaccc

SEQ ID NO: 336130 - DNA, 25 bp, Mus musculus
ggttgttgccgtaatctagctgcca

SEQ ID NO: 336131 - DNA, 25 bp, Mus musculus
ggttgttgttcaagatgaggagact

SEQ ID NO: 336132 - DNA, 25 bp, Mus musculus
ggttgttgttcaagcatttatatct

SEQ ID NO: 336133 - DNA, 25 bp, Mus musculus
ggttgtttttggtgccttcaagaca

SEQ ID NO: 336134 - DNA, 25 bp, Mus musculus
ggtttaaaaaactacatatggtcaa

SEQ ID NO: 336135 - DNA, 25 bp, Mus musculus
ggtttaaaaactctgtgcaccgagg

SEQ ID NO: 336136 - DNA, 25 bp, Mus musculus
ggtttaacaggtgtcactctgcaaa

SEQ ID NO: 336137 - DNA, 25 bp, Mus musculus
ggtttaacggagagggcggcgaaga

SEQ ID NO: 336138 - DNA, 25 bp, Mus musculus
ggtttaacggagatgagaaggccac

SEQ ID NO: 336139 - DNA, 25 bp, Mus musculus
ggtttaatatttcagcagtgtgata

SEQ ID NO: 336140 - DNA, 25 bp, Mus musculus
ggtttaatgaaatgatgaaagttgt

SEQ ID NO: 336141 - DNA, 25 bp, Mus musculus
ggtttaatgaaggtgattcagaagt

SEQ ID NO: 336142 - DNA, 25 bp, Mus musculus
ggtttacaaaggagcagccatgtct

SEQ ID NO: 336143 - DNA, 25 bp, Mus musculus
ggtttacaaggacatatggagatta

SEQ ID NO: 336144 - DNA, 25 bp, Mus musculus
ggtttacacagtattactatgaata

SEQ ID NO: 336145 - DNA, 25 bp, Mus musculus
ggtttacagcagatacagttggtgc

SEQ ID NO: 336146 - DNA, 25 bp, Mus musculus
ggtttacattccacactcccgtatg

SEQ ID NO: 336147 - DNA, 25 bp, Mus musculus
ggtttactgcagctctgcattgagt

SEQ ID NO: 336148 - DNA, 25 bp, Mus musculus
ggtttactgcaggacattaaggacg

SEQ ID NO: 336149 - DNA, 25 bp, Mus musculus
ggtttactgcaggtaccgaatgtct

SEQ ID NO: 336150 - DNA, 25 bp, Mus musculus
ggtttagaagacagcgtggaagatg

SEQ ID NO: 336151 - DNA, 25 bp, Mus musculus
ggtttagcaactccagctatcaccc

SEQ ID NO: 336152 - DNA, 25 bp, Mus musculus
ggtttaggtctggatcccacgcaat

SEQ ID NO: 336153 - DNA, 25 bp, Mus musculus
ggtttataagaacgagctgcaccgc

SEQ ID NO: 336154 - DNA, 25 bp, Mus musculus
ggtttatatgcattcacatcattgg

SEQ ID NO: 336155 - DNA, 25 bp, Mus musculus
ggtttatatgcttgtgggctttttg

SEQ ID NO: 336156 - DNA, 25 bp, Mus musculus
ggtttatcaaaagacttccaactga

SEQ ID NO: 336157 - DNA, 25 bp, Mus musculus
ggtttatcaagattactcgggacaa

SEQ ID NO: 336158 - DNA, 25 bp, Mus musculus
ggtttatcaagggatccacaaatgc

SEQ ID NO: 336159 - DNA, 25 bp, Mus musculus
ggtttatcagagatttgaagttcac

SEQ ID NO: 336160 - DNA, 25 bp, Mus musculus
ggtttatcaggacccagcatgaact

SEQ ID NO: 336161 - DNA, 25 bp, Mus musculus
ggtttatcatgacaccaagctggat

SEQ ID NO: 336162 - DNA, 25 bp, Mus musculus
ggtttatgcctgagcgcttcttaga

SEQ ID NO: 336163 - DNA, 25 bp, Mus musculus
ggtttatgcctgatccaacaggaag

SEQ ID NO: 336164 - DNA, 25 bp, Mus musculus
ggtttatgctgcgtccctgaccctt

SEQ ID NO: 336165 - DNA, 25 bp, Mus musculus
ggtttcacagagatgctgatgaaac

SEQ ID NO: 336166 - DNA, 25 bp, Mus musculus
ggtttcacaggtcaactttgtgagg

SEQ ID NO: 336167 - DNA, 25 bp, Mus musculus
ggtttcagaacagagggcaatgcga

SEQ ID NO: 336168 - DNA, 25 bp, Mus musculus
ggtttcagaaggtttgaagactccc

SEQ ID NO: 336169 - DNA, 25 bp, Mus musculus
ggtttcagaggaggcctttcccagg

SEQ ID NO: 336170 - DNA, 25 bp, Mus musculus
ggtttcagataattggaggatagac

SEQ ID NO: 336171 - DNA, 25 bp, Mus musculus
ggtttcagataattgggccattgac

SEQ ID NO: 336172 - DNA, 25 bp, Mus musculus
ggtttcatcagccaggagccagtcc

SEQ ID NO: 336173 - DNA, 25 bp, Mus musculus
ggtttcatctcaaagcatacagctg

SEQ ID NO: 336174 - DNA, 25 bp, Mus musculus
ggtttccaaggtggcgacagacaag

SEQ ID NO: 336175 - DNA, 25 bp, Mus musculus
ggtttccactgagtccttagccagg

SEQ ID NO: 336176 - DNA, 25 bp, Mus musculus
ggtttccactgcacctcctggcctt

SEQ ID NO: 336177 - DNA, 25 bp, Mus musculus
ggtttcccagagaagggggaactga

SEQ ID NO: 336178 - DNA, 25 bp, Mus musculus
ggtttcccattgaaggtttcaggac

SEQ ID NO: 336179 - DNA, 25 bp, Mus musculus
ggtttcccattgagtacccagactc

SEQ ID NO: 336180 - DNA, 25 bp, Mus musculus
ggtttcccctttggagtcccatggt

SEQ ID NO: 336181 - DNA, 25 bp, Mus musculus
ggtttcccgggtatgcatggaccat

SEQ ID NO: 336182 - DNA, 25 bp, Mus musculus
ggtttccctggatcaggacatgcag

SEQ ID NO: 336183 - DNA, 25 bp, Mus musculus
ggtttccgaggtctctgtgttggtt

SEQ ID NO: 336184 - DNA, 25 bp, Mus musculus
ggtttcctccgcaccaccaccacca

SEQ ID NO: 336185 - DNA, 25 bp, Mus musculus
ggtttcctgttcagggagaggcggt

SEQ ID NO: 336186 - DNA, 25 bp, Mus musculus
ggtttccttgtcaaacccaacagtt

SEQ ID NO: 336187 - DNA, 25 bp, Mus musculus
ggtttccttgtcaacaatcaagatg

SEQ ID NO: 336188 - DNA, 25 bp, Mus musculus
ggtttcctttcaggatggcctcagg

SEQ ID NO: 336189 - DNA, 25 bp, Mus musculus
ggtttcgcagagcttcctctctctg

SEQ ID NO: 336190 - DNA, 25 bp, Mus musculus
ggtttcgcctacaggcatataccag

SEQ ID NO: 336191 - DNA, 25 bp, Mus musculus
ggtttcggatccaggacctgctgtc

SEQ ID NO: 336192 - DNA, 25 bp, Mus musculus
ggtttctccaccaggacatggattt

SEQ ID NO: 336193 - DNA, 25 bp, Mus musculus
ggtttctcctacaaattgctaataa

SEQ ID NO: 336194 - DNA, 25 bp, Mus musculus
ggtttctcctgggctgcaagcccag

SEQ ID NO: 336195 - DNA, 25 bp, Mus musculus
ggtttctctagatctcacactcctc

SEQ ID NO: 336196 - DNA, 25 bp, Mus musculus
ggtttctctaggtattctcatggga

SEQ ID NO: 336197 - DNA, 25 bp, Mus musculus
ggtttctctaggtgtgagcatcttt

SEQ ID NO: 336198 - DNA, 25 bp, Mus musculus
ggtttctcttgtccatctcagtcca

SEQ ID NO: 336199 - DNA, 25 bp, Mus musculus
ggtttctgacaggtaaccaatggag

SEQ ID NO: 336200 - DNA, 25 bp, Mus musculus
ggtttctgaggccatgagttccgac

SEQ ID NO: 336201 - DNA, 25 bp, Mus musculus
ggtttctgaggtggagtctttcatt

SEQ ID NO: 336202 - DNA, 25 bp, Mus musculus
ggtttctgattatagggtcctgctg

SEQ ID NO: 336203 - DNA, 25 bp, Mus musculus
ggtttctggtttgccagctccggaa

SEQ ID NO: 336204 - DNA, 25 bp, Mus musculus
ggtttctggtttgtcaaagacatag

SEQ ID NO: 336205 - DNA, 25 bp, Mus musculus
ggtttctgtttgttttcttctgctt

SEQ ID NO: 336206 - DNA, 25 bp, Mus musculus
ggtttcttcaaggacgtagagtcag

SEQ ID NO: 336207 - DNA, 25 bp, Mus musculus
ggtttcttccagggcttggctgagt

SEQ ID NO: 336208 - DNA, 25 bp, Mus musculus
ggtttcttctgatgaaagagaagat

SEQ ID NO: 336209 - DNA, 25 bp, Mus musculus
ggtttcttggtcagaagaagcgcac

SEQ ID NO: 336210 - DNA, 25 bp, Mus musculus
ggtttctttcagccttttatgtcac

SEQ ID NO: 336211 - DNA, 25 bp, Mus musculus
ggtttgaaagtatccctggaagaca

SEQ ID NO: 336212 - DNA, 25 bp, Mus musculus
ggtttgactcgcacatccttgtggc

SEQ ID NO: 336213 - DNA, 25 bp, Mus musculus
ggtttgagaatttgacttcggagga

SEQ ID NO: 336214 - DNA, 25 bp, Mus musculus
ggtttgcaagagtctttttggtgta

SEQ ID NO: 336215 - DNA, 25 bp, Mus musculus
ggtttgcaagggcaaatggaaaaat

SEQ ID NO: 336216 - DNA, 25 bp, Mus musculus
ggtttgcactggtccaacccagact

SEQ ID NO: 336217 - DNA, 25 bp, Mus musculus
ggtttgcagactgcggtgaggggag

SEQ ID NO: 336218 - DNA, 25 bp, Mus musculus
ggtttgcagtcttctggcagctcag

SEQ ID NO: 336219 - DNA, 25 bp, Mus musculus
ggtttgccaagggtatgtcggagac

SEQ ID NO: 336220 - DNA, 25 bp, Mus musculus
ggtttgccagaaggaacctgaatga

SEQ ID NO: 336221 - DNA, 25 bp, Mus musculus
ggtttgccagggaaaatcatagtga

SEQ ID NO: 336222 - DNA, 25 bp, Mus musculus
ggtttgccagggcgacggaacaaga

SEQ ID NO: 336223 - DNA, 25 bp, Mus musculus
ggtttgccaggtcggatgatgagca

SEQ ID NO: 336224 - DNA, 25 bp, Mus musculus
ggtttgccctcaggttcattctgaa

SEQ ID NO: 336225 - DNA, 25 bp, Mus musculus
ggtttgccctgagagtgggccatgg

SEQ ID NO: 336226 - DNA, 25 bp, Mus musculus
ggtttgcgaggctggagcaaaacat

SEQ ID NO: 336227 - DNA, 25 bp, Mus musculus
ggtttgctcgccgcacctgcctcag

SEQ ID NO: 336228 - DNA, 25 bp, Mus musculus
ggtttgctctgaagattgtgcccac

SEQ ID NO: 336229 - DNA, 25 bp, Mus musculus
ggtttgctctgaaggtttcttttga

SEQ ID NO: 336230 - DNA, 25 bp, Mus musculus
ggtttgcttctcccttccagatatg

SEQ ID NO: 336231 - DNA, 25 bp, Mus musculus
ggtttggaagaaatacaagaaaaat

SEQ ID NO: 336232 - DNA, 25 bp, Mus musculus
ggtttggacaagatgtttaagacaa

SEQ ID NO: 336233 - DNA, 25 bp, Mus musculus
ggtttggccccagaagtcggtgacc

SEQ ID NO: 336234 - DNA, 25 bp, Mus musculus
ggtttggccccagggcctgagccat

SEQ ID NO: 336235 - DNA, 25 bp, Mus musculus
ggtttgggaagggctgtcatgggga

SEQ ID NO: 336236 - DNA, 25 bp, Mus musculus
ggtttgggggaccagtagttgcagt

SEQ ID NO: 336237 - DNA, 25 bp, Mus musculus
ggtttggtaaaagccatggccatgc

SEQ ID NO: 336238 - DNA, 25 bp, Mus musculus
ggtttggtctgaaggacagggtttc

SEQ ID NO: 336239 - DNA, 25 bp, Mus musculus
ggtttggtggaatgcatgcagatgt

SEQ ID NO: 336240 - DNA, 25 bp, Mus musculus
ggtttgtatgaactccagttctcat

SEQ ID NO: 336241 - DNA, 25 bp, Mus musculus
ggtttgtcaaaaataaggccagcag

SEQ ID NO: 336242 - DNA, 25 bp, Mus musculus
ggtttgtgagagaggctgtccgtac

SEQ ID NO: 336243 - DNA, 25 bp, Mus musculus
ggtttgtgagagagttataaaagat

SEQ ID NO: 336244 - DNA, 25 bp, Mus musculus
ggtttgtgagcctgccgctcatgct

SEQ ID NO: 336245 - DNA, 25 bp, Mus musculus
ggtttgtgagcctgtttgtgggctg

SEQ ID NO: 336246 - DNA, 25 bp, Mus musculus
ggtttgtgtggggttcactgatcac

SEQ ID NO: 336247 - DNA, 25 bp, Mus musculus
ggtttgtgttaaggcctcacacctt

SEQ ID NO: 336248 - DNA, 25 bp, Mus musculus
ggtttgtgtttaaggaatcaaaagt

SEQ ID NO: 336249 - DNA, 25 bp, Mus musculus
ggtttgttactaggattgaaattcc

SEQ ID NO: 336250 - DNA, 25 bp, Mus musculus
ggtttgttcagtcgacctgataaaa

SEQ ID NO: 336251 - DNA, 25 bp, Mus musculus
ggtttgttcgtggaggtggagccta

SEQ ID NO: 336252 - DNA, 25 bp, Mus musculus
ggtttgttttacagcatgtacattg

SEQ ID NO: 336253 - DNA, 25 bp, Mus musculus
ggtttgttttacagcctttcccatg

SEQ ID NO: 336254 - DNA, 25 bp, Mus musculus
ggttttaaaactttgctgcgagaca

SEQ ID NO: 336255 - DNA, 25 bp, Mus musculus
ggttttaaggctgtctgatcccaca

SEQ ID NO: 336256 - DNA, 25 bp, Mus musculus
ggttttacggagtaagccatgagaa

SEQ ID NO: 336257 - DNA, 25 bp, Mus musculus
ggttttactgagttgcactcactgt

SEQ ID NO: 336258 - DNA, 25 bp, Mus musculus
ggttttagggcaagtctgatgagcg

SEQ ID NO: 336259 - DNA, 25 bp, Mus musculus
ggttttagttaaaggtctctgtgtt

SEQ ID NO: 336260 - DNA, 25 bp, Mus musculus
ggttttatggactacagatttggga

SEQ ID NO: 336261 - DNA, 25 bp, Mus musculus
ggttttcacagtctttcaggcatgc

SEQ ID NO: 336262 - DNA, 25 bp, Mus musculus
ggttttcatccaggtggatcgcact

SEQ ID NO: 336263 - DNA, 25 bp, Mus musculus
ggttttcatgatcatccagtcctcg

SEQ ID NO: 336264 - DNA, 25 bp, Mus musculus
ggttttccctcagaatgggtcagcc

SEQ ID NO: 336265 - DNA, 25 bp, Mus musculus
ggttttctgaagagatacaagggga

SEQ ID NO: 336266 - DNA, 25 bp, Mus musculus
ggttttcttgaccctgctttttgca

SEQ ID NO: 336267 - DNA, 25 bp, Mus musculus
ggttttgacaggactggaggaccga

SEQ ID NO: 336268 - DNA, 25 bp, Mus musculus
ggttttgcccacctggctggtttgg

SEQ ID NO: 336269 - DNA, 25 bp, Mus musculus
ggttttgcccacctggtacccagga

SEQ ID NO: 336270 - DNA, 25 bp, Mus musculus
ggttttgccctgcactcctgggcat

SEQ ID NO: 336271 - DNA, 25 bp, Mus musculus
ggttttgccctgggctacggcgtgt

SEQ ID NO: 336272 - DNA, 25 bp, Mus musculus
ggttttgctggccagcagtgacgcg

SEQ ID NO: 336273 - DNA, 25 bp, Mus musculus
ggttttgctggtggtggcatcgttt

SEQ ID NO: 336274 - DNA, 25 bp, Mus musculus
ggttttgctggtggtgttcagacag

SEQ ID NO: 336275 - DNA, 25 bp, Mus musculus
ggttttggaggctgataagctggca

SEQ ID NO: 336276 - DNA, 25 bp, Mus musculus
ggttttggtgaaaagtgaagatgcc

SEQ ID NO: 336277 - DNA, 25 bp, Mus musculus
ggttttgttggtgtgcaacagaaga

SEQ ID NO: 336278 - DNA, 25 bp, Mus musculus
ggtttttaatgatgaggtccttctg

SEQ ID NO: 336279 - DNA, 25 bp, Mus musculus
ggtttttcaggatgccacagttgga

SEQ ID NO: 336280 - DNA, 25 bp, Mus musculus
ggtttttctaagagaacggtcatca

SEQ ID NO: 336281 - DNA, 25 bp, Mus musculus
ggtttttgacagaccagccacacca

SEQ ID NO: 336282 - DNA, 25 bp, Mus musculus
ggtttttgacagcctcattaacttc

SEQ ID NO: 336283 - DNA, 25 bp, Mus musculus
ggttttttctggcgagcggcgtgct

SEQ ID NO: 336284 - DNA, 25 bp, Mus musculus
gtaaaaacatcgagatcaagaagtt

SEQ ID NO: 336285 - DNA, 25 bp, Mus musculus
gtaaaaaccagaatgacccattgcc

SEQ ID NO: 336286 - DNA, 25 bp, Mus musculus
gtaaaaaccagaccgacgtgacaaa

SEQ ID NO: 336287 - DNA, 25 bp, Mus musculus
gtaaaaactggcattgcttcacgag

SEQ ID NO: 336288 - DNA, 25 bp, Mus musculus
gtaaaaagatggatcagtttgacaa

SEQ ID NO: 336289 - DNA, 25 bp, Mus musculus
gtaaaaagattcaagaacttgggga

SEQ ID NO: 336290 - DNA, 25 bp, Mus musculus
gtaaaaatgacttcgcactgaaaat

SEQ ID NO: 336291 - DNA, 25 bp, Mus musculus
gtaaaaatgacttcggagatgatag

SEQ ID NO: 336292 - DNA, 25 bp, Mus musculus
gtaaaaattaatggtatcctaaagt

SEQ ID NO: 336293 - DNA, 25 bp, Mus musculus
gtaaaaattaatggttggctgcagg

SEQ ID NO: 336294 - DNA, 25 bp, Mus musculus
gtaaaacgagccctcagggattcat

SEQ ID NO: 336295 - DNA, 25 bp, Mus musculus
gtaaaactactgagaaggtcctttt

SEQ ID NO: 336296 - DNA, 25 bp, Mus musculus
gtaaaactactgtcctcggcccagg

SEQ ID NO: 336297 - DNA, 25 bp, Mus musculus
gtaaaactactgttttggtgaaaat

SEQ ID NO: 336298 - DNA, 25 bp, Mus musculus
gtaaaactgattgactggggaaaca

SEQ ID NO: 336299 - DNA, 25 bp, Mus musculus
gtaaaagaccctgtgtcacgaaccc

SEQ ID NO: 336300 - DNA, 25 bp, Mus musculus
gtaaaatatcctgcccaaactccaa

SEQ ID NO: 336301 - DNA, 25 bp, Mus musculus
gtaaaatatcggatgcccgggtagt

SEQ ID NO: 336302 - DNA, 25 bp, Mus musculus
gtaaaatcagaggtccggaccgctg

SEQ ID NO: 336303 - DNA, 25 bp, Mus musculus
gtaaaatccccagatcccagcctcc

SEQ ID NO: 336304 - DNA, 25 bp, Mus musculus
gtaaaatccccagctattgcagatc

SEQ ID NO: 336305 - DNA, 25 bp, Mus musculus
gtaaaatccccaggtgtgactgcac

SEQ ID NO: 336306 - DNA, 25 bp, Mus musculus
gtaaaatcgaggttaataatgcgac

SEQ ID NO: 336307 - DNA, 25 bp, Mus musculus
gtaaaatctgggggttacaactaag

SEQ ID NO: 336308 - DNA, 25 bp, Mus musculus
gtaaaatctgtgcactgaggccaaa

SEQ ID NO: 336309 - DNA, 25 bp, Mus musculus
gtaaaatgtttgaagcgacagcagt

SEQ ID NO: 336310 - DNA, 25 bp, Mus musculus
gtaaacactccaggtcgcagacact

SEQ ID NO: 336311 - DNA, 25 bp, Mus musculus
gtaaacagagactcacttctgctga

SEQ ID NO: 336312 - DNA, 25 bp, Mus musculus
gtaaacagataggtaccctactcgc

SEQ ID NO: 336313 - DNA, 25 bp, Mus musculus
gtaaacatgctcatgaactaaaatt

SEQ ID NO: 336314 - DNA, 25 bp, Mus musculus
gtaaacatgtcccagcttacataat

SEQ ID NO: 336315 - DNA, 25 bp, Mus musculus
gtaaacatgtcccagtttgacccat

SEQ ID NO: 336316 - DNA, 25 bp, Mus musculus
gtaaaccatgaaggggactcctctc

SEQ ID NO: 336317 - DNA, 25 bp, Mus musculus
gtaaaccatgaagtttctctgtgct

SEQ ID NO: 336318 - DNA, 25 bp, Mus musculus
gtaaaccggaagaagttcagagttt

SEQ ID NO: 336319 - DNA, 25 bp, Mus musculus
gtaaaccgtcaaggtcacggtctcg

SEQ ID NO: 336320 - DNA, 25 bp, Mus musculus
gtaaacgcaggtgacctggcctcag

SEQ ID NO: 336321 - DNA, 25 bp, Mus musculus
gtaaactatggcatggttacagtac

SEQ ID NO: 336322 - DNA, 25 bp, Mus musculus
gtaaactgaggctcctagaaggtga

SEQ ID NO: 336323 - DNA, 25 bp, Mus musculus
gtaaactgcaggttgtcctggtgcc

SEQ ID NO: 336324 - DNA, 25 bp, Mus musculus
gtaaactttgttatggctgaatcag

SEQ ID NO: 336325 - DNA, 25 bp, Mus musculus
gtaaagaaagatcaggaaaagactg

SEQ ID NO: 336326 - DNA, 25 bp, Mus musculus
gtaaagaaagatcaggcgagtacta

SEQ ID NO: 336327 - DNA, 25 bp, Mus musculus
gtaaagaaagggttgctgttgcatg

SEQ ID NO: 336328 - DNA, 25 bp, Mus musculus
gtaaagaagattggatttaccttca

SEQ ID NO: 336329 - DNA, 25 bp, Mus musculus
gtaaagaatccagaaacttggaaaa

SEQ ID NO: 336330 - DNA, 25 bp, Mus musculus
gtaaagaatgaaaggcgttgcagct

SEQ ID NO: 336331 - DNA, 25 bp, Mus musculus
gtaaagaatgaaggaataacagcct

SEQ ID NO: 336332 - DNA, 25 bp, Mus musculus
gtaaagacagagctctgaaaggggt

SEQ ID NO: 336333 - DNA, 25 bp, Mus musculus
gtaaagacagcacagccccccagcg

SEQ ID NO: 336334 - DNA, 25 bp, Mus musculus
gtaaagacagcctaaccatgccagg

SEQ ID NO: 336335 - DNA, 25 bp, Mus musculus
gtaaagacagtggattttgctgcag

SEQ ID NO: 336336 - DNA, 25 bp, Mus musculus
gtaaagagaaagtgtttatgggacc

SEQ ID NO: 336337 - DNA, 25 bp, Mus musculus
gtaaagatcatgagacagaacttct

SEQ ID NO: 336338 - DNA, 25 bp, Mus musculus
gtaaagattgctgctagagcatgga

SEQ ID NO: 336339 - DNA, 25 bp, Mus musculus
gtaaagcaagagcaccagaagtgcc

SEQ ID NO: 336340 - DNA, 25 bp, Mus musculus
gtaaagcaaggctgtggctctggat

SEQ ID NO: 336341 - DNA, 25 bp, Mus musculus
gtaaagcgatgattcccccgactcc

SEQ ID NO: 336342 - DNA, 25 bp, Mus musculus
gtaaagctcaaaagctttgcagcca

SEQ ID NO: 336343 - DNA, 25 bp, Mus musculus
gtaaagctcaaaaggcactaagcaa

SEQ ID NO: 336344 - DNA, 25 bp, Mus musculus
gtaaagcttgtgaaggcgctggttg

SEQ ID NO: 336345 - DNA, 25 bp, Mus musculus
gtaaagggacttcaggccttctccc

SEQ ID NO: 336346 - DNA, 25 bp, Mus musculus
gtaaaggtctcctggtcttatatcc

SEQ ID NO: 336347 - DNA, 25 bp, Mus musculus
gtaaaggtgtattcagacttcaaga

SEQ ID NO: 336348 - DNA, 25 bp, Mus musculus
gtaaaggtgtattcgggttcctgga

SEQ ID NO: 336349 - DNA, 25 bp, Mus musculus
gtaaagtatgtgggctggaaaaagg

SEQ ID NO: 336350 - DNA, 25 bp, Mus musculus
gtaaagtatgtggttctgctcatta

SEQ ID NO: 336351 - DNA, 25 bp, Mus musculus
gtaaagtcccacacctacttcatta

SEQ ID NO: 336352 - DNA, 25 bp, Mus musculus
gtaaagtcctgggaatcaacaagca

SEQ ID NO: 336353 - DNA, 25 bp, Mus musculus
gtaaagttcgaggtcacgttcatga

SEQ ID NO: 336354 - DNA, 25 bp, Mus musculus
gtaaagttgacagtcccacagtcaa

SEQ ID NO: 336355 - DNA, 25 bp, Mus musculus
gtaaagtttcggaacaaggagccca

SEQ ID NO: 336356 - DNA, 25 bp, Mus musculus
gtaaataaaggaatgtgtttctgat

SEQ ID NO: 336357 - DNA, 25 bp, Mus musculus
gtaaataatcaaagatcttgttttt

SEQ ID NO: 336358 - DNA, 25 bp, Mus musculus
gtaaatacataaatatgtaaagaac

SEQ ID NO: 336359 - DNA, 25 bp, Mus musculus
gtaaatatgcccttgaaagcagacc

SEQ ID NO: 336360 - DNA, 25 bp, Mus musculus
gtaaatatttgggcccagcaacctc

SEQ ID NO: 336361 - DNA, 25 bp, Mus musculus
gtaaatatttggtgctggtaactca

SEQ ID NO: 336362 - DNA, 25 bp, Mus musculus
gtaaatccaaactttatgatggtta

SEQ ID NO: 336363 - DNA, 25 bp, Mus musculus
gtaaatctaagatcaactatggggg

SEQ ID NO: 336364 - DNA, 25 bp, Mus musculus
gtaaatgaaggaatatgctcagagc

SEQ ID NO: 336365 - DNA, 25 bp, Mus musculus
gtaaatgaaggctggagccagttag

SEQ ID NO: 336366 - DNA, 25 bp, Mus musculus
gtaaatgcagggtctcgtggttcct

SEQ ID NO: 336367 - DNA, 25 bp, Mus musculus
gtaaatgcagtgattgatgatgcaa

SEQ ID NO: 336368 - DNA, 25 bp, Mus musculus
gtaaatggaaggcatacgatgcgac

SEQ ID NO: 336369 - DNA, 25 bp, Mus musculus
gtaaatggaaggttgcttttaactt

SEQ ID NO: 336370 - DNA, 25 bp, Mus musculus
gtaaatgtaagtatgccatttgtca

SEQ ID NO: 336371 - DNA, 25 bp, Mus musculus
gtaaatgttagtgacagctagaata

SEQ ID NO: 336372 - DNA, 25 bp, Mus musculus
gtaaattatgaacagattgatgaca

SEQ ID NO: 336373 - DNA, 25 bp, Mus musculus
gtaaattcagatgggtggcctaacg

SEQ ID NO: 336374 - DNA, 25 bp, Mus musculus
gtaaattgtcagatactgctcatca

SEQ ID NO: 336375 - DNA, 25 bp, Mus musculus
gtaacaaaatcaaggatcatgggct

SEQ ID NO: 336376 - DNA, 25 bp, Mus musculus
gtaacaacaggaggcccagcctcgt

SEQ ID NO: 336377 - DNA, 25 bp, Mus musculus
gtaacaacggcctcagcatcctcct

SEQ ID NO: 336378 - DNA, 25 bp, Mus musculus
gtaacaagaggcttcccgaggaggt

SEQ ID NO: 336379 - DNA, 25 bp, Mus musculus
gtaacaagcaaggaatccaagtgaa

SEQ ID NO: 336380 - DNA, 25 bp, Mus musculus
gtaacaaggaggcttacagtgggtc

SEQ ID NO: 336381 - DNA, 25 bp, Mus musculus
gtaacacagtccaaggtcacacggt

SEQ ID NO: 336382 - DNA, 25 bp, Mus musculus
gtaacaccaaaggcgacctggcgag

SEQ ID NO: 336383 - DNA, 25 bp, Mus musculus
gtaacacctctgcagttacggacga

SEQ ID NO: 336384 - DNA, 25 bp, Mus musculus
gtaacactcctctacacttagcctg

SEQ ID NO: 336385 - DNA, 25 bp, Mus musculus
gtaacagactttgcatgaagttgcc

SEQ ID NO: 336386 - DNA, 25 bp, Mus musculus
gtaacagagggaaaacagttggagt

SEQ ID NO: 336387 - DNA, 25 bp, Mus musculus
gtaacagagggttcccatctcctgc

SEQ ID NO: 336388 - DNA, 25 bp, Mus musculus
gtaacagagggtttgaagatcaagg

SEQ ID NO: 336389 - DNA, 25 bp, Mus musculus
gtaacagctgcaggaatagtgattg

SEQ ID NO: 336390 - DNA, 25 bp, Mus musculus
gtaacatcacccccgccactggctt

SEQ ID NO: 336391 - DNA, 25 bp, Mus musculus
gtaacatcacccccggtggtgaagg

SEQ ID NO: 336392 - DNA, 25 bp, Mus musculus
gtaacatcacccccgtgctccccct

SEQ ID NO: 336393 - DNA, 25 bp, Mus musculus
gtaacatccagctgttgcacaaaca

SEQ ID NO: 336394 - DNA, 25 bp, Mus musculus
gtaaccaaagatgtcgcactggctg

SEQ ID NO: 336395 - DNA, 25 bp, Mus musculus
gtaaccaaagctgttctgtgtcctg

SEQ ID NO: 336396 - DNA, 25 bp, Mus musculus
gtaaccacaattatgcctctgatga

SEQ ID NO: 336397 - DNA, 25 bp, Mus musculus
gtaaccacaattatggaatccccct

SEQ ID NO: 336398 - DNA, 25 bp, Mus musculus
gtaaccacacagcttgttcggtttg

SEQ ID NO: 336399 - DNA, 25 bp, Mus musculus
gtaaccacatccctccctccaaagc

SEQ ID NO: 336400 - DNA, 25 bp, Mus musculus
gtaaccagtacttgacaggttcttg

SEQ ID NO: 336401 - DNA, 25 bp, Mus musculus
gtaaccatagatcgcaagccatgat

SEQ ID NO: 336402 - DNA, 25 bp, Mus musculus
gtaaccatagctcaccgtgtctctt

SEQ ID NO: 336403 - DNA, 25 bp, Mus musculus
gtaaccatagctcatcgggttcaca

SEQ ID NO: 336404 - DNA, 25 bp, Mus musculus
gtaaccataggcccgaggacggtga

SEQ ID NO: 336405 - DNA, 25 bp, Mus musculus
gtaaccatccttcttgctttgtaag

SEQ ID NO: 336406 - DNA, 25 bp, Mus musculus
gtaaccatgagaaagagccactggc

SEQ ID NO: 336407 - DNA, 25 bp, Mus musculus
gtaaccccaggttctgccttagatc

SEQ ID NO: 336408 - DNA, 25 bp, Mus musculus
gtaaccgacctgagacttcattgaa

SEQ ID NO: 336409 - DNA, 25 bp, Mus musculus
gtaaccgacctgagcaagaaattat

SEQ ID NO: 336410 - DNA, 25 bp, Mus musculus
gtaaccgctcaggtagtagtctgga

SEQ ID NO: 336411 - DNA, 25 bp, Mus musculus
gtaaccgctcagttcatctcaaaga

SEQ ID NO: 336412 - DNA, 25 bp, Mus musculus
gtaaccgtccagttggttctgacca

SEQ ID NO: 336413 - DNA, 25 bp, Mus musculus
gtaaccgtgggactcgatctgccca

SEQ ID NO: 336414 - DNA, 25 bp, Mus musculus
gtaacctcttcaggcccgcactttg

SEQ ID NO: 336415 - DNA, 25 bp, Mus musculus
gtaacctggagtttctgacatgaag

SEQ ID NO: 336416 - DNA, 25 bp, Mus musculus
gtaacctttaggtcttgctaggtag

SEQ ID NO: 336417 - DNA, 25 bp, Mus musculus
gtaacgaccaagacgcaaatggaac

SEQ ID NO: 336418 - DNA, 25 bp, Mus musculus
gtaacgtaaggacaagatggcaacc

SEQ ID NO: 336419 - DNA, 25 bp, Mus musculus
gtaactaactggtccagctgctgct

SEQ ID NO: 336420 - DNA, 25 bp, Mus musculus
gtaactacagaggcctccaggtgtg

SEQ ID NO: 336421 - DNA, 25 bp, Mus musculus
gtaactacagttgtgcccctgtctc

SEQ ID NO: 336422 - DNA, 25 bp, Mus musculus
gtaactcaaaaagcagcctttactt

SEQ ID NO: 336423 - DNA, 25 bp, Mus musculus
gtaactcacaacggacgcctccttg

SEQ ID NO: 336424 - DNA, 25 bp, Mus musculus
gtaactcacaacgggattgtcttgg

SEQ ID NO: 336425 - DNA, 25 bp, Mus musculus
gtaactccaggccatccgaaccatt

SEQ ID NO: 336426 - DNA, 25 bp, Mus musculus
gtaactccaggggcactatgaacga

SEQ ID NO: 336427 - DNA, 25 bp, Mus musculus
gtaactcccgtgagcacttcattca

SEQ ID NO: 336428 - DNA, 25 bp, Mus musculus
gtaactcccgtgaggttcttgtagt

SEQ ID NO: 336429 - DNA, 25 bp, Mus musculus
gtaactctgagataaagtgcaggat

SEQ ID NO: 336430 - DNA, 25 bp, Mus musculus
gtaactctgagtcacaggaatgtga

SEQ ID NO: 336431 - DNA, 25 bp, Mus musculus
gtaactgaaggtgtccactcccagg

SEQ ID NO: 336432 - DNA, 25 bp, Mus musculus
gtaactggccagagagcaatggaag

SEQ ID NO: 336433 - DNA, 25 bp, Mus musculus
gtaactggccagaggacacggatgc

SEQ ID NO: 336434 - DNA, 25 bp, Mus musculus
gtaactgtcgaggaagttttctgaa

SEQ ID NO: 336435 - DNA, 25 bp, Mus musculus
gtaactgtgtaggtgcaggcaacca

SEQ ID NO: 336436 - DNA, 25 bp, Mus musculus
gtaactgttacgaaatctcataagc

SEQ ID NO: 336437 - DNA, 25 bp, Mus musculus
gtaactgttacgatccatctttttt

SEQ ID NO: 336438 - DNA, 25 bp, Mus musculus
gtaacttcaaggttatccaggccgt

SEQ ID NO: 336439 - DNA, 25 bp, Mus musculus
gtaactttctgcagcctccatctca

SEQ ID NO: 336440 - DNA, 25 bp, Mus musculus
gtaagaaaagtgatgctgcatcaaa

SEQ ID NO: 336441 - DNA, 25 bp, Mus musculus
gtaagaaaatcatatgtgacaaata

SEQ ID NO: 336442 - DNA, 25 bp, Mus musculus
gtaagaaagagcccagtaagagaat

SEQ ID NO: 336443 - DNA, 25 bp, Mus musculus
gtaagaaccgggacactcttctcca

SEQ ID NO: 336444 - DNA, 25 bp, Mus musculus
gtaagaacttgaaaactcctcctta

SEQ ID NO: 336445 - DNA, 25 bp, Mus musculus
gtaagaactttcttttgcatggttc

SEQ ID NO: 336446 - DNA, 25 bp, Mus musculus
gtaagaagctgacatgccatatgaa

SEQ ID NO: 336447 - DNA, 25 bp, Mus musculus
gtaagaaggctcagcggaacctgcc

SEQ ID NO: 336448 - DNA, 25 bp, Mus musculus
gtaagaataaaagatgcctcaggaa

SEQ ID NO: 336449 - DNA, 25 bp, Mus musculus
gtaagaatattgagacggccagagc

SEQ ID NO: 336450 - DNA, 25 bp, Mus musculus
gtaagaccatcaccctggaggtcga

SEQ ID NO: 336451 - DNA, 25 bp, Mus musculus
gtaagaccgtggtaaatgtttcaac

SEQ ID NO: 336452 - DNA, 25 bp, Mus musculus
gtaagagaacaaattgaaatggatg

SEQ ID NO: 336453 - DNA, 25 bp, Mus musculus
gtaagagaaccagcattggattgca

SEQ ID NO: 336454 - DNA, 25 bp, Mus musculus
gtaagagccagctggctcgcataca

SEQ ID NO: 336455 - DNA, 25 bp, Mus musculus
gtaagagccagttgctatgtccacc

SEQ ID NO: 336456 - DNA, 25 bp, Mus musculus
gtaagagcttgtgccattcctgcca

SEQ ID NO: 336457 - DNA, 25 bp, Mus musculus
gtaagagcttgtgttattggatttt

SEQ ID NO: 336458 - DNA, 25 bp, Mus musculus
gtaagaggaattctggctgaaagtg

SEQ ID NO: 336459 - DNA, 25 bp, Mus musculus
gtaagagggggcccgtaagctggtc

SEQ ID NO: 336460 - DNA, 25 bp, Mus musculus
gtaagagtgactcaggaagccataa

SEQ ID NO: 336461 - DNA, 25 bp, Mus musculus
gtaagagttgcagctaggacttctc

SEQ ID NO: 336462 - DNA, 25 bp, Mus musculus
gtaagagtttgatacgaacagaaca

SEQ ID NO: 336463 - DNA, 25 bp, Mus musculus
gtaagatgaaaccttccgacttgtc

SEQ ID NO: 336464 - DNA, 25 bp, Mus musculus
gtaagattcccacctgttgcccatc

SEQ ID NO: 336465 - DNA, 25 bp, Mus musculus
gtaagcacacccagaactgagcaca

SEQ ID NO: 336466 - DNA, 25 bp, Mus musculus
gtaagcacacccaggtgccagcctc

SEQ ID NO: 336467 - DNA, 25 bp, Mus musculus
gtaagcacagctctgcccaccccac

SEQ ID NO: 336468 - DNA, 25 bp, Mus musculus
gtaagcacaggatcacgtggccact

SEQ ID NO: 336469 - DNA, 25 bp, Mus musculus
gtaagcactggggaaagcctttgct

SEQ ID NO: 336470 - DNA, 25 bp, Mus musculus
gtaagcagacagatgagcgttcggc

SEQ ID NO: 336471 - DNA, 25 bp, Mus musculus
gtaagcagaggagacctgccaggcc

SEQ ID NO: 336472 - DNA, 25 bp, Mus musculus
gtaagcatcagggaaacctcaccga

SEQ ID NO: 336473 - DNA, 25 bp, Mus musculus
gtaagcatcagttcagaaaccaact

SEQ ID NO: 336474 - DNA, 25 bp, Mus musculus
gtaagcatgtgtcatggctccgaac

SEQ ID NO: 336475 - DNA, 25 bp, Mus musculus
gtaagccgagttctctagcctccaa

SEQ ID NO: 336476 - DNA, 25 bp, Mus musculus
gtaagcctcagaaggatgcgggctc

SEQ ID NO: 336477 - DNA, 25 bp, Mus musculus
gtaagcctgagtgaggatcatggct

SEQ ID NO: 336478 - DNA, 25 bp, Mus musculus
gtaagcctgcatcaggtcctagacc

SEQ ID NO: 336479 - DNA, 25 bp, Mus musculus
gtaagccttgcatagtcccagaagt

SEQ ID NO: 336480 - DNA, 25 bp, Mus musculus
gtaagcgaagagaggaagcgggaga

SEQ ID NO: 336481 - DNA, 25 bp, Mus musculus
gtaagcggtgggtacagtcctcagg

SEQ ID NO: 336482 - DNA, 25 bp, Mus musculus
gtaagctattcccagctccaccaga

SEQ ID NO: 336483 - DNA, 25 bp, Mus musculus
gtaagctgcagagaagctagaaact

SEQ ID NO: 336484 - DNA, 25 bp, Mus musculus
gtaagcttggtatttggaatgcaga

SEQ ID NO: 336485 - DNA, 25 bp, Mus musculus
gtaaggaaacacagatacctctgaa

SEQ ID NO: 336486 - DNA, 25 bp, Mus musculus
gtaaggaaactctcggtgccatggg

SEQ ID NO: 336487 - DNA, 25 bp, Mus musculus
gtaaggaaagcagcccatacccagc

SEQ ID NO: 336488 - DNA, 25 bp, Mus musculus
gtaaggacaagggagttgtatttgt

SEQ ID NO: 336489 - DNA, 25 bp, Mus musculus
gtaaggacaaggtagactgggtaca

SEQ ID NO: 336490 - DNA, 25 bp, Mus musculus
gtaaggagaaggatggcctcaggca

SEQ ID NO: 336491 - DNA, 25 bp, Mus musculus
gtaaggagagatgcctctggatgtt

SEQ ID NO: 336492 - DNA, 25 bp, Mus musculus
gtaaggagagttttagatgcctctg

SEQ ID NO: 336493 - DNA, 25 bp, Mus musculus
gtaaggagccttagctgccagcggc

SEQ ID NO: 336494 - DNA, 25 bp, Mus musculus
gtaaggagccttgccctgtgtgtca

SEQ ID NO: 336495 - DNA, 25 bp, Mus musculus
gtaaggatggagatcccccaggtcc

SEQ ID NO: 336496 - DNA, 25 bp, Mus musculus
gtaaggctggctcagagttctcagt

SEQ ID NO: 336497 - DNA, 25 bp, Mus musculus
gtaagggacaagcctacacaggtgc

SEQ ID NO: 336498 - DNA, 25 bp, Mus musculus
gtaaggtaagatctcaagcatacac

SEQ ID NO: 336499 - DNA, 25 bp, Mus musculus
gtaaggtccaagaaggtgaatgaat

SEQ ID NO: 336500 - DNA, 25 bp, Mus musculus
gtaaggttcccaggatcaccgacaa

SEQ ID NO: 336501 - DNA, 25 bp, Mus musculus
gtaagtacagttgatacactaaaga

SEQ ID NO: 336502 - DNA, 25 bp, Mus musculus
gtaagtaccgagtgctgcttttgat

SEQ ID NO: 336503 - DNA, 25 bp, Mus musculus
gtaagtactgacaaggggtgtgatt

SEQ ID NO: 336504 - DNA, 25 bp, Mus musculus
gtaagtacttgaagcatgcctcatg

SEQ ID NO: 336505 - DNA, 25 bp, Mus musculus
gtaagtcaggaggatcgcaagtcct

SEQ ID NO: 336506 - DNA, 25 bp, Mus musculus
gtaagtccagatctgatttgtactc

SEQ ID NO: 336507 - DNA, 25 bp, Mus musculus
gtaagtccctcttagagtttcaaga

SEQ ID NO: 336508 - DNA, 25 bp, Mus musculus
gtaagtctatatggagacaccaaga

SEQ ID NO: 336509 - DNA, 25 bp, Mus musculus
gtaagtgattctgcaaaaaatactt

SEQ ID NO: 336510 - DNA, 25 bp, Mus musculus
gtaagttaccatgcctgtctcctcc

SEQ ID NO: 336511 - DNA, 25 bp, Mus musculus
gtaagttatggttatcaccattcct

SEQ ID NO: 336512 - DNA, 25 bp, Mus musculus
gtaagttcccagcttcttctgtgtg

SEQ ID NO: 336513 - DNA, 25 bp, Mus musculus
gtaagtttttcagaatttcttaatg

SEQ ID NO: 336514 - DNA, 25 bp, Mus musculus
gtaataaaaagaagctgaagtcatt

SEQ ID NO: 336515 - DNA, 25 bp, Mus musculus
gtaataaaaagatgccagcagaggg

SEQ ID NO: 336516 - DNA, 25 bp, Mus musculus
gtaataaaatagagaatcatcattc

SEQ ID NO: 336517 - DNA, 25 bp, Mus musculus
gtaataagtgcgtgaagactctaca

SEQ ID NO: 336518 - DNA, 25 bp, Mus musculus
gtaataattgcaaagataactggga

SEQ ID NO: 336519 - DNA, 25 bp, Mus musculus
gtaataattgcaaaggaaggaaggt

SEQ ID NO: 336520 - DNA, 25 bp, Mus musculus
gtaatagctgccactgaagctgggg

SEQ ID NO: 336521 - DNA, 25 bp, Mus musculus
gtaatagctgccactgacaaagcaa

SEQ ID NO: 336522 - DNA, 25 bp, Mus musculus
gtaatagtcttttacccagtagaga

SEQ ID NO: 336523 - DNA, 25 bp, Mus musculus
gtaatagtgaagcagagccatgaag

SEQ ID NO: 336524 - DNA, 25 bp, Mus musculus
gtaatataccaagtgtcctggttgc

SEQ ID NO: 336525 - DNA, 25 bp, Mus musculus
gtaatataccaatgtctcttggacc

SEQ ID NO: 336526 - DNA, 25 bp, Mus musculus
gtaatatgcctaaagggtatgtgta

SEQ ID NO: 336527 - DNA, 25 bp, Mus musculus
gtaatcaagagaacttctcggacct

SEQ ID NO: 336528 - DNA, 25 bp, Mus musculus
gtaatcaagagatcttctcggacct

SEQ ID NO: 336529 - DNA, 25 bp, Mus musculus
gtaatcactgcttgcccaagtgtgc

SEQ ID NO: 336530 - DNA, 25 bp, Mus musculus
gtaatcagaaagggtccccagaagc

SEQ ID NO: 336531 - DNA, 25 bp, Mus musculus
gtaatcagagagtgtcacgatgtct

SEQ ID NO: 336532 - DNA, 25 bp, Mus musculus
gtaatcagcagctgttctcatatgc

SEQ ID NO: 336533 - DNA, 25 bp, Mus musculus
gtaatcattgacagattctttctaa

SEQ ID NO: 336534 - DNA, 25 bp, Mus musculus
gtaatcattgacagtcctgatgctt

SEQ ID NO: 336535 - DNA, 25 bp, Mus musculus
gtaatcattgagaatgaaaagaagc

SEQ ID NO: 336536 - DNA, 25 bp, Mus musculus
gtaatccaccccaagaaaaagctcc

SEQ ID NO: 336537 - DNA, 25 bp, Mus musculus
gtaatcctagctggggatttgtata

SEQ ID NO: 336538 - DNA, 25 bp, Mus musculus
gtaatcctccaatcactgttaagaa

SEQ ID NO: 336539 - DNA, 25 bp, Mus musculus
gtaatcgatatctaatttttaagac

SEQ ID NO: 336540 - DNA, 25 bp, Mus musculus
gtaatctcggattgtaagggccaag

SEQ ID NO: 336541 - DNA, 25 bp, Mus musculus
gtaatctgtctaagaatctcctgta

SEQ ID NO: 336542 - DNA, 25 bp, Mus musculus
gtaatcttatgtcaaggcaccgaga

SEQ ID NO: 336543 - DNA, 25 bp, Mus musculus
gtaatcttgagaaaatgaaaatcac

SEQ ID NO: 336544 - DNA, 25 bp, Mus musculus
gtaatgaaggaaaatatctgcagaa

SEQ ID NO: 336545 - DNA, 25 bp, Mus musculus
gtaatgacagacattgagatatcta

SEQ ID NO: 336546 - DNA, 25 bp, Mus musculus
gtaatgacagctcagttcctaggaa

SEQ ID NO: 336547 - DNA, 25 bp, Mus musculus
gtaatgacagctccttcctctacaa

SEQ ID NO: 336548 - DNA, 25 bp, Mus musculus
gtaatgattcagagacctgcttctg

SEQ ID NO: 336549 - DNA, 25 bp, Mus musculus
gtaatgattcagatatcctgttaga

SEQ ID NO: 336550 - DNA, 25 bp, Mus musculus
gtaatgcaacgtttcagtctacaga

SEQ ID NO: 336551 - DNA, 25 bp, Mus musculus
gtaatgcaacgtttcagtctgaacg

SEQ ID NO: 336552 - DNA, 25 bp, Mus musculus
gtaatgccaatcccatcttcatgcg

SEQ ID NO: 336553 - DNA, 25 bp, Mus musculus
gtaatgcctggcacttctgtgatgc

SEQ ID NO: 336554 - DNA, 25 bp, Mus musculus
gtaatgcttatgaggaagaattctt

SEQ ID NO: 336555 - DNA, 25 bp, Mus musculus
gtaatgctttgtcggatatgaagag

SEQ ID NO: 336556 - DNA, 25 bp, Mus musculus
gtaatggaaaaagcaggtttctgga

SEQ ID NO: 336557 - DNA, 25 bp, Mus musculus
gtaatggaaaaaggtgttcgaattt

SEQ ID NO: 336558 - DNA, 25 bp, Mus musculus
gtaatggacagaaagaatgtcactg

SEQ ID NO: 336559 - DNA, 25 bp, Mus musculus
gtaatggacgggcattttgttccca

SEQ ID NO: 336560 - DNA, 25 bp, Mus musculus
gtaatggaggccaggctgtaattca

SEQ ID NO: 336561 - DNA, 25 bp, Mus musculus
gtaatggaggccaggtgacataccg

SEQ ID NO: 336562 - DNA, 25 bp, Mus musculus
gtaatggaggtgcccctgtgctcaa

SEQ ID NO: 336563 - DNA, 25 bp, Mus musculus
gtaatggcaaagggagttttgtgct

SEQ ID NO: 336564 - DNA, 25 bp, Mus musculus
gtaatggcagtttgagatggtatca

SEQ ID NO: 336565 - DNA, 25 bp, Mus musculus
gtaatgtcatggaattggggaattc

SEQ ID NO: 336566 - DNA, 25 bp, Mus musculus
gtaatgtcttccaggccaagttcct

SEQ ID NO: 336567 - DNA, 25 bp, Mus musculus
gtaatgtgaagctgcagcctgtcaa

SEQ ID NO: 336568 - DNA, 25 bp, Mus musculus
gtaatgtgaaggcaaagcccatggt

SEQ ID NO: 336569 - DNA, 25 bp, Mus musculus
gtaatgtgagacctctgggtgaggc

SEQ ID NO: 336570 - DNA, 25 bp, Mus musculus
gtaatgtgagagattggtgtccttt

SEQ ID NO: 336571 - DNA, 25 bp, Mus musculus
gtaattacgtggagaggtcaacagt

SEQ ID NO: 336572 - DNA, 25 bp, Mus musculus
gtaattactttctggatgagcagaa

SEQ ID NO: 336573 - DNA, 25 bp, Mus musculus
gtaattccaactctggttgacccta

SEQ ID NO: 336574 - DNA, 25 bp, Mus musculus
gtaattccctctgacaaaaggcttg

SEQ ID NO: 336575 - DNA, 25 bp, Mus musculus
gtaattctatcacagagctgtttgg

SEQ ID NO: 336576 - DNA, 25 bp, Mus musculus
gtaattgtagctgatgaagagtttg

SEQ ID NO: 336577 - DNA, 25 bp, Mus musculus
gtaattgtaggtgccgcaccagttt

SEQ ID NO: 336578 - DNA, 25 bp, Mus musculus
gtaattgtgctaaagaaatgctcta

SEQ ID NO: 336579 - DNA, 25 bp, Mus musculus
gtaattgtgctaaagaaattgccaa

SEQ ID NO: 336580 - DNA, 25 bp, Mus musculus
gtaatttaaccgcttggctgaagag

SEQ ID NO: 336581 - DNA, 25 bp, Mus musculus
gtaatttacagtagttgcagtaagg

SEQ ID NO: 336582 - DNA, 25 bp, Mus musculus
gtacaaaaagctgtgagtaccagag

SEQ ID NO: 336583 - DNA, 25 bp, Mus musculus
gtacaaaaaggtgcatccaagcaga

SEQ ID NO: 336584 - DNA, 25 bp, Mus musculus
gtacaaaacgcccattttcctgaat

SEQ ID NO: 336585 - DNA, 25 bp, Mus musculus
gtacaaaactgtgggaacctggata

SEQ ID NO: 336586 - DNA, 25 bp, Mus musculus
gtacaaaatatttggtgacttcacc

SEQ ID NO: 336587 - DNA, 25 bp, Mus musculus
gtacaaacagaggatcaataccagt

SEQ ID NO: 336588 - DNA, 25 bp, Mus musculus
gtacaaagaaatggcaaccagataa

SEQ ID NO: 336589 - DNA, 25 bp, Mus musculus
gtacaaagagccagttccaagaatt

SEQ ID NO: 336590 - DNA, 25 bp, Mus musculus
gtacaaagcaacaggtggaccgtac

SEQ ID NO: 336591 - DNA, 25 bp, Mus musculus
gtacaaaggggaagttccaggatcc

SEQ ID NO: 336592 - DNA, 25 bp, Mus musculus
gtacaaataaaagtcttactcctaa

SEQ ID NO: 336593 - DNA, 25 bp, Mus musculus
gtacaaataatctgcaggacagctt

SEQ ID NO: 336594 - DNA, 25 bp, Mus musculus
gtacaaatagcagattttggagtaa

SEQ ID NO: 336595 - DNA, 25 bp, Mus musculus
gtacaacaaagaagctcttagcccc

SEQ ID NO: 336596 - DNA, 25 bp, Mus musculus
gtacaaccagcacgaagccccccag

SEQ ID NO: 336597 - DNA, 25 bp, Mus musculus
gtacaagacaacactgcttatcttt

SEQ ID NO: 336598 - DNA, 25 bp, Mus musculus
gtacaagacagtgacagccctggag

SEQ ID NO: 336599 - DNA, 25 bp, Mus musculus
gtacaagacgcatgttaatgaaaag

SEQ ID NO: 336600 - DNA, 25 bp, Mus musculus
gtacaagagcgaggaagaggaagta

SEQ ID NO: 336601 - DNA, 25 bp, Mus musculus
gtacaagagcgagggtccagattat

SEQ ID NO: 336602 - DNA, 25 bp, Mus musculus
gtacaagattgggcagcccagacac

SEQ ID NO: 336603 - DNA, 25 bp, Mus musculus
gtacaagattggtcaactcagatca

SEQ ID NO: 336604 - DNA, 25 bp, Mus musculus
gtacaagcacacagggttttggtaa

SEQ ID NO: 336605 - DNA, 25 bp, Mus musculus
gtacaagcagtgagcttatgggggc

SEQ ID NO: 336606 - DNA, 25 bp, Mus musculus
gtacaagcgggcaggtccatggaga

SEQ ID NO: 336607 - DNA, 25 bp, Mus musculus
gtacaagctgaaccctcacctgtgc

SEQ ID NO: 336608 - DNA, 25 bp, Mus musculus
gtacaaggaaggaaaagatggcatc

SEQ ID NO: 336609 - DNA, 25 bp, Mus musculus
gtacaaggagcttcctccaatgcac

SEQ ID NO: 336610 - DNA, 25 bp, Mus musculus
gtacaaggagggtgacaatagcttt

SEQ ID NO: 336611 - DNA, 25 bp, Mus musculus
gtacaagggccagatgctgcatatt

SEQ ID NO: 336612 - DNA, 25 bp, Mus musculus
gtacaataacaaagctgcagtgttg

SEQ ID NO: 336613 - DNA, 25 bp, Mus musculus
gtacaatcaggcctggctgctgcca

SEQ ID NO: 336614 - DNA, 25 bp, Mus musculus
gtacaatcctgatttgtactgtgtt

SEQ ID NO: 336615 - DNA, 25 bp, Mus musculus
gtacaatgagaaaaaaagacatgaa

SEQ ID NO: 336616 - DNA, 25 bp, Mus musculus
gtacaatgagattctgatatctgca

SEQ ID NO: 336617 - DNA, 25 bp, Mus musculus
gtacaatgagattctgcacacttcc

SEQ ID NO: 336618 - DNA, 25 bp, Mus musculus
gtacaatgcgtacagaaaagcggca

SEQ ID NO: 336619 - DNA, 25 bp, Mus musculus
gtacaatgcgtacagccaggagtag

SEQ ID NO: 336620 - DNA, 25 bp, Mus musculus
gtacaatggtggtccatgagaaaca

SEQ ID NO: 336621 - DNA, 25 bp, Mus musculus
gtacacaagaaactaacactaagca

SEQ ID NO: 336622 - DNA, 25 bp, Mus musculus
gtacacaagaagcagtcgttcccca

SEQ ID NO: 336623 - DNA, 25 bp, Mus musculus
gtacacacaaaacaggctggccttg

SEQ ID NO: 336624 - DNA, 25 bp, Mus musculus
gtacacacaggtggtgacagtggca

SEQ ID NO: 336625 - DNA, 25 bp, Mus musculus
gtacacacctgaacctgatatctgt

SEQ ID NO: 336626 - DNA, 25 bp, Mus musculus
gtacacacgagttgggccattccag

SEQ ID NO: 336627 - DNA, 25 bp, Mus musculus
gtacacagtgagagttcgatgccca

SEQ ID NO: 336628 - DNA, 25 bp, Mus musculus
gtacacatcgataaggctcctgagg

SEQ ID NO: 336629 - DNA, 25 bp, Mus musculus
gtacacatcgataaggttgaagaac

SEQ ID NO: 336630 - DNA, 25 bp, Mus musculus
gtacaccaagtcaaaagtgagacca

SEQ ID NO: 336631 - DNA, 25 bp, Mus musculus
gtacaccaagtcggacttacggtta

SEQ ID NO: 336632 - DNA, 25 bp, Mus musculus
gtacaccacacagacagaggagttg

SEQ ID NO: 336633 - DNA, 25 bp, Mus musculus
gtacaccacggacaaggagcccagg

SEQ ID NO: 336634 - DNA, 25 bp, Mus musculus
gtacaccagctccaacatagtttgt

SEQ ID NO: 336635 - DNA, 25 bp, Mus musculus
gtacaccagctccaatttttcaaga

SEQ ID NO: 336636 - DNA, 25 bp, Mus musculus
gtacacccaaaagatttttgaatgt

SEQ ID NO: 336637 - DNA, 25 bp, Mus musculus
gtacacccaaaaggtcactccattc

SEQ ID NO: 336638 - DNA, 25 bp, Mus musculus
gtacacccagagaacctgtctctgg

SEQ ID NO: 336639 - DNA, 25 bp, Mus musculus
gtacacccagcttccggaataacaa

SEQ ID NO: 336640 - DNA, 25 bp, Mus musculus
gtacacctacacaaatgtccccttt

SEQ ID NO: 336641 - DNA, 25 bp, Mus musculus
gtacacgatgtgctggatttccact

SEQ ID NO: 336642 - DNA, 25 bp, Mus musculus
gtacacggtccagcagcaaccctat

SEQ ID NO: 336643 - DNA, 25 bp, Mus musculus
gtacacggtccaggatgagagtcat

SEQ ID NO: 336644 - DNA, 25 bp, Mus musculus
gtacactaaagtagagactcagggt

SEQ ID NO: 336645 - DNA, 25 bp, Mus musculus
gtacactaaggtaagaaatccagtc

SEQ ID NO: 336646 - DNA, 25 bp, Mus musculus
gtacactcaggctgaagctctaccc

SEQ ID NO: 336647 - DNA, 25 bp, Mus musculus
gtacactcaggctgagggtaaaaag

SEQ ID NO: 336648 - DNA, 25 bp, Mus musculus
gtacactccaggagctgcagcccca

SEQ ID NO: 336649 - DNA, 25 bp, Mus musculus
gtacactgacgaggatagtgccatg

SEQ ID NO: 336650 - DNA, 25 bp, Mus musculus
gtacactgacgtccagaaacgctga

SEQ ID NO: 336651 - DNA, 25 bp, Mus musculus
gtacactgcagtgctggtgttggca

SEQ ID NO: 336652 - DNA, 25 bp, Mus musculus
gtacactgtggcaggtgttcttctg

SEQ ID NO: 336653 - DNA, 25 bp, Mus musculus
gtacactttcaaacttccaaaggaa

SEQ ID NO: 336654 - DNA, 25 bp, Mus musculus
gtacagaaaaagctcctgccaccct

SEQ ID NO: 336655 - DNA, 25 bp, Mus musculus
gtacagaaagagtatgaaaagacac

SEQ ID NO: 336656 - DNA, 25 bp, Mus musculus
gtacagaaagcaagatttgtcttcg

SEQ ID NO: 336657 - DNA, 25 bp, Mus musculus
gtacagaacagctaggactcagatt

SEQ ID NO: 336658 - DNA, 25 bp, Mus musculus
gtacagaacaggcaaagacaagaaa

SEQ ID NO: 336659 - DNA, 25 bp, Mus musculus
gtacagaagagacaggtgagaactc

SEQ ID NO: 336660 - DNA, 25 bp, Mus musculus
gtacagaagcaagggaaaatacaga

SEQ ID NO: 336661 - DNA, 25 bp, Mus musculus
gtacagaagcaagggaacctgcaac

SEQ ID NO: 336662 - DNA, 25 bp, Mus musculus
gtacagaagcagattaagcacatga

SEQ ID NO: 336663 - DNA, 25 bp, Mus musculus
gtacagaatactgtaataccagaag

SEQ ID NO: 336664 - DNA, 25 bp, Mus musculus
gtacagaatgggataaagatgacct

SEQ ID NO: 336665 - DNA, 25 bp, Mus musculus
gtacagaatgggatctttttaaagc

SEQ ID NO: 336666 - DNA, 25 bp, Mus musculus
gtacagaatgggctgaaccaataac

SEQ ID NO: 336667 - DNA, 25 bp, Mus musculus
gtacagaatggggggtcaacaggac

SEQ ID NO: 336668 - DNA, 25 bp, Mus musculus
gtacagaattggacaaaatccccat

SEQ ID NO: 336669 - DNA, 25 bp, Mus musculus
gtacagaccaggacaaagagaaaaa

SEQ ID NO: 336670 - DNA, 25 bp, Mus musculus
gtacagagacaggttgcttttaact

SEQ ID NO: 336671 - DNA, 25 bp, Mus musculus
gtacagagaccaggtctttggccag

SEQ ID NO: 336672 - DNA, 25 bp, Mus musculus
gtacagaggatggctccccttccaa

SEQ ID NO: 336673 - DNA, 25 bp, Mus musculus
gtacagaggatggctgttttaaaat

SEQ ID NO: 336674 - DNA, 25 bp, Mus musculus
gtacagatatggagaaagagaaaaa

SEQ ID NO: 336675 - DNA, 25 bp, Mus musculus
gtacagatgatggcgagtcattcga

SEQ ID NO: 336676 - DNA, 25 bp, Mus musculus
gtacagatttacaaagttgcttcag

SEQ ID NO: 336677 - DNA, 25 bp, Mus musculus
gtacagcaaacagatgcgtgtacat

SEQ ID NO: 336678 - DNA, 25 bp, Mus musculus
gtacagcaaacagccatttcgtaga

SEQ ID NO: 336679 - DNA, 25 bp, Mus musculus
gtacagcacaataaaacccaagcaa

SEQ ID NO: 336680 - DNA, 25 bp, Mus musculus
gtacagcacaggctaaataaaacgg

SEQ ID NO: 336681 - DNA, 25 bp, Mus musculus
gtacagcacaggttaccagtgcaga

SEQ ID NO: 336682 - DNA, 25 bp, Mus musculus
gtacagcacaggttgctggttgttg

SEQ ID NO: 336683 - DNA, 25 bp, Mus musculus
gtacagcagaggatgctttcgcagc

SEQ ID NO: 336684 - DNA, 25 bp, Mus musculus
gtacagcagggcttcctgaaagagg

SEQ ID NO: 336685 - DNA, 25 bp, Mus musculus
gtacagcatggggcaaggagaggga

SEQ ID NO: 336686 - DNA, 25 bp, Mus musculus
gtacagcatgggtatcaccagcctc

SEQ ID NO: 336687 - DNA, 25 bp, Mus musculus
gtacagccaggtgaccgagctgaac

SEQ ID NO: 336688 - DNA, 25 bp, Mus musculus
gtacagctcagccctgcccacctca

SEQ ID NO: 336689 - DNA, 25 bp, Mus musculus
gtacaggaaaaccaggttgctggtg

SEQ ID NO: 336690 - DNA, 25 bp, Mus musculus
gtacaggagatatgagcaacaaaag

SEQ ID NO: 336691 - DNA, 25 bp, Mus musculus
gtacaggattagtttccttttagac

SEQ ID NO: 336692 - DNA, 25 bp, Mus musculus
gtacaggcaggcaaaggctcggggt

SEQ ID NO: 336693 - DNA, 25 bp, Mus musculus
gtacaggctcaggaggcctttccca

SEQ ID NO: 336694 - DNA, 25 bp, Mus musculus
gtacagggatggctaccagagacca

SEQ ID NO: 336695 - DNA, 25 bp, Mus musculus
gtacaggtagggtttcgatgagact

SEQ ID NO: 336696 - DNA, 25 bp, Mus musculus
gtacaggtggggtttaggtcacaat

SEQ ID NO: 336697 - DNA, 25 bp, Mus musculus
gtacagtaagggatgttctgatatc

SEQ ID NO: 336698 - DNA, 25 bp, Mus musculus
gtacagtaagtactggctctggaac

SEQ ID NO: 336699 - DNA, 25 bp, Mus musculus
gtacagtaagttcatagacagagga

SEQ ID NO: 336700 - DNA, 25 bp, Mus musculus
gtacagtacaggcaaatttccaggg

SEQ ID NO: 336701 - DNA, 25 bp, Mus musculus
gtacagtctatcttggaaaagatga

SEQ ID NO: 336702 - DNA, 25 bp, Mus musculus
gtacagtgacaggtatatctttgca

SEQ ID NO: 336703 - DNA, 25 bp, Mus musculus
gtacagtgcaaaggtaatgctgatg

SEQ ID NO: 336704 - DNA, 25 bp, Mus musculus
gtacagtgcttctcagacacaaatc

SEQ ID NO: 336705 - DNA, 25 bp, Mus musculus
gtacagttccagaggcagcagtggt

SEQ ID NO: 336706 - DNA, 25 bp, Mus musculus
gtacagttccagattcagcacttag

SEQ ID NO: 336707 - DNA, 25 bp, Mus musculus
gtacatacctagggatgccctggac

SEQ ID NO: 336708 - DNA, 25 bp, Mus musculus
gtacatacttccatgaaacaatccc

SEQ ID NO: 336709 - DNA, 25 bp, Mus musculus
gtacatacttccatggccgtaatta

SEQ ID NO: 336710 - DNA, 25 bp, Mus musculus
gtacatatgagtcgaacaccaaaca

SEQ ID NO: 336711 - DNA, 25 bp, Mus musculus
gtacatatggaagtgctccttccgc

SEQ ID NO: 336712 - DNA, 25 bp, Mus musculus
gtacatcaagcgcgccaacagcctc

SEQ ID NO: 336713 - DNA, 25 bp, Mus musculus
gtacatcaatatcacagaaaagtgt

SEQ ID NO: 336714 - DNA, 25 bp, Mus musculus
gtacatcatcatggaaggcgtcacc

SEQ ID NO: 336715 - DNA, 25 bp, Mus musculus
gtacatcatgccaagacaactcctg

SEQ ID NO: 336716 - DNA, 25 bp, Mus musculus
gtacatcatgccaagcctgttcatt

SEQ ID NO: 336717 - DNA, 25 bp, Mus musculus
gtacatcatgccaaggactctggag

SEQ ID NO: 336718 - DNA, 25 bp, Mus musculus
gtacatccaccctgaaacgatcagc

SEQ ID NO: 336719 - DNA, 25 bp, Mus musculus
gtacatccccaccgtctttgacaac

SEQ ID NO: 336720 - DNA, 25 bp, Mus musculus
gtacatccccaccgtgacgtgttct

SEQ ID NO: 336721 - DNA, 25 bp, Mus musculus
gtacatccggccaggacctagggaa

SEQ ID NO: 336722 - DNA, 25 bp, Mus musculus
gtacatcgaccctgagactggtatg

SEQ ID NO: 336723 - DNA, 25 bp, Mus musculus
gtacatctatcagccatggcgagtg

SEQ ID NO: 336724 - DNA, 25 bp, Mus musculus
gtacatctggcacagaagctgattg

SEQ ID NO: 336725 - DNA, 25 bp, Mus musculus
gtacatctttgaaggtctgggacac

SEQ ID NO: 336726 - DNA, 25 bp, Mus musculus
gtacatgatccagagaggtgctcgg

SEQ ID NO: 336727 - DNA, 25 bp, Mus musculus
gtacatgatgcaggtgaagactttt

SEQ ID NO: 336728 - DNA, 25 bp, Mus musculus
gtacatgcagcagattcaagtcaat

SEQ ID NO: 336729 - DNA, 25 bp, Mus musculus
gtacatgcaggtgcatattttccac

SEQ ID NO: 336730 - DNA, 25 bp, Mus musculus
gtacatgctgacagatcgggagaat

SEQ ID NO: 336731 - DNA, 25 bp, Mus musculus
gtacatggacgacctgcaacttttt

SEQ ID NO: 336732 - DNA, 25 bp, Mus musculus
gtacatggaggaatgtctataacaa

SEQ ID NO: 336733 - DNA, 25 bp, Mus musculus
gtacatggaggaggtgcggcggcag

SEQ ID NO: 336734 - DNA, 25 bp, Mus musculus
gtacatgggatgctagccaacgacc

SEQ ID NO: 336735 - DNA, 25 bp, Mus musculus
gtacatggggagatcctttctctgc

SEQ ID NO: 336736 - DNA, 25 bp, Mus musculus
gtacatggggaggattcagtccttc

SEQ ID NO: 336737 - DNA, 25 bp, Mus musculus
gtacatgtatatcagacactgtcct

SEQ ID NO: 336738 - DNA, 25 bp, Mus musculus
gtacatgtgcgcagacaaacccgga

SEQ ID NO: 336739 - DNA, 25 bp, Mus musculus
gtacatgtgcgcagccgcctgggaa

SEQ ID NO: 336740 - DNA, 25 bp, Mus musculus
gtacattacgatgagactgaggctg

SEQ ID NO: 336741 - DNA, 25 bp, Mus musculus
gtacattacggctgagcgggagcag

SEQ ID NO: 336742 - DNA, 25 bp, Mus musculus
gtacattattgagatgacacagaga

SEQ ID NO: 336743 - DNA, 25 bp, Mus musculus
gtacattattgaggccactgcagat

SEQ ID NO: 336744 - DNA, 25 bp, Mus musculus
gtacattcctgagccagtcctagag

SEQ ID NO: 336745 - DNA, 25 bp, Mus musculus
gtacattcctgagccgggataactg

SEQ ID NO: 336746 - DNA, 25 bp, Mus musculus
gtacattctcttaaggttgtgtgga

SEQ ID NO: 336747 - DNA, 25 bp, Mus musculus
gtaccaaagtgatcctatcccatca

SEQ ID NO: 336748 - DNA, 25 bp, Mus musculus
gtaccaacaccatggacaaaagctt

SEQ ID NO: 336749 - DNA, 25 bp, Mus musculus
gtaccaacaccatggtgtttcctgg

SEQ ID NO: 336750 - DNA, 25 bp, Mus musculus
gtaccaacatgtggagtgaaaaatc

SEQ ID NO: 336751 - DNA, 25 bp, Mus musculus
gtaccaacggaggtcctgggtggga

SEQ ID NO: 336752 - DNA, 25 bp, Mus musculus
gtaccaactgtgtaaggagaagctg

SEQ ID NO: 336753 - DNA, 25 bp, Mus musculus
gtaccaaggtgagactctgctgcta

SEQ ID NO: 336754 - DNA, 25 bp, Mus musculus
gtaccaatgaaaagggtgccttctc

SEQ ID NO: 336755 - DNA, 25 bp, Mus musculus
gtaccaatgtcctgatttcagagtg

SEQ ID NO: 336756 - DNA, 25 bp, Mus musculus
gtaccacacaagattccgcagggcc

SEQ ID NO: 336757 - DNA, 25 bp, Mus musculus
gtaccacacaagggccatcaaaagt

SEQ ID NO: 336758 - DNA, 25 bp, Mus musculus
gtaccaccttcccaggaccagtcag

SEQ ID NO: 336759 - DNA, 25 bp, Mus musculus
gtaccacgagcagcccgaggagctc

SEQ ID NO: 336760 - DNA, 25 bp, Mus musculus
gtaccacgggcacagacttaaagtt

SEQ ID NO: 336761 - DNA, 25 bp, Mus musculus
gtaccacgggcagagacttaaagtt

SEQ ID NO: 336762 - DNA, 25 bp, Mus musculus
gtaccactaaacgattggtgaccca

SEQ ID NO: 336763 - DNA, 25 bp, Mus musculus
gtaccacttagatagttgaagtatt

SEQ ID NO: 336764 - DNA, 25 bp, Mus musculus
gtaccacttgcagacaaatgaattc

SEQ ID NO: 336765 - DNA, 25 bp, Mus musculus
gtaccagaaataggagcagttgacc

SEQ ID NO: 336766 - DNA, 25 bp, Mus musculus
gtaccagaagacctcatcgggaacc

SEQ ID NO: 336767 - DNA, 25 bp, Mus musculus
gtaccagaccagtatcacagagcag

SEQ ID NO: 336768 - DNA, 25 bp, Mus musculus
gtaccagaccagtcgtgttgaggag

SEQ ID NO: 336769 - DNA, 25 bp, Mus musculus
gtaccagatagaggctgatcttaaa

SEQ ID NO: 336770 - DNA, 25 bp, Mus musculus
gtaccagatagaggtctccctgtgt

SEQ ID NO: 336771 - DNA, 25 bp, Mus musculus
gtaccagatcaaggtggttgaagat

SEQ ID NO: 336772 - DNA, 25 bp, Mus musculus
gtaccagatcagctcaaggcaagga

SEQ ID NO: 336773 - DNA, 25 bp, Mus musculus
gtaccagcctctggggccctggccc

SEQ ID NO: 336774 - DNA, 25 bp, Mus musculus
gtaccaggagaaggtgaggtacacc

SEQ ID NO: 336775 - DNA, 25 bp, Mus musculus
gtaccagttgcggatgagtacagca

SEQ ID NO: 336776 - DNA, 25 bp, Mus musculus
gtaccagttgtcgccctttaaccat

SEQ ID NO: 336777 - DNA, 25 bp, Mus musculus
gtaccataaacagtatggcggctct

SEQ ID NO: 336778 - DNA, 25 bp, Mus musculus
gtaccatatcaagtttagagacgtg

SEQ ID NO: 336779 - DNA, 25 bp, Mus musculus
gtaccatatggaagactcggagatc

SEQ ID NO: 336780 - DNA, 25 bp, Mus musculus
gtaccatcagctgactacccaggcg

SEQ ID NO: 336781 - DNA, 25 bp, Mus musculus
gtaccatcagctgagtgactgtgga

SEQ ID NO: 336782 - DNA, 25 bp, Mus musculus
gtaccatgcaggcgagacttcagca

SEQ ID NO: 336783 - DNA, 25 bp, Mus musculus
gtaccatgcagggttctgaggagga

SEQ ID NO: 336784 - DNA, 25 bp, Mus musculus
gtaccatgccatcaagaatgaggag

SEQ ID NO: 336785 - DNA, 25 bp, Mus musculus
gtaccatgtgcaggacccaaggctg

SEQ ID NO: 336786 - DNA, 25 bp, Mus musculus
gtaccatttccaaggccgtgcagaa

SEQ ID NO: 336787 - DNA, 25 bp, Mus musculus
gtacccacacacccaaaccaggtgg

SEQ ID NO: 336788 - DNA, 25 bp, Mus musculus
gtacccagcaaccaggagctggagc

SEQ ID NO: 336789 - DNA, 25 bp, Mus musculus
gtacccaggcccaggtgttatctgc

SEQ ID NO: 336790 - DNA, 25 bp, Mus musculus
gtacccatcaactaattgtcaacag

SEQ ID NO: 336791 - DNA, 25 bp, Mus musculus
gtacccatcaagccaccctgtattc

SEQ ID NO: 336792 - DNA, 25 bp, Mus musculus
gtacccatgaaactgcatttctagg

SEQ ID NO: 336793 - DNA, 25 bp, Mus musculus
gtacccattcaggctgcaacaggtg

SEQ ID NO: 336794 - DNA, 25 bp, Mus musculus
gtaccccaaaagagaatcgcacgtc

SEQ ID NO: 336795 - DNA, 25 bp, Mus musculus
gtaccccaacaagaatcagcacaca

SEQ ID NO: 336796 - DNA, 25 bp, Mus musculus
gtaccccaacaagacccgtctaaat

SEQ ID NO: 336797 - DNA, 25 bp, Mus musculus
gtaccccaaggacagtttagagacg

SEQ ID NO: 336798 - DNA, 25 bp, Mus musculus
gtaccccaatcggatctgtgtaaga

SEQ ID NO: 336799 - DNA, 25 bp, Mus musculus
gtaccccaatcggggcaccacctgt

SEQ ID NO: 336800 - DNA, 25 bp, Mus musculus
gtaccccacacaagtcaaaggagcc

SEQ ID NO: 336801 - DNA, 25 bp, Mus musculus
gtaccccacacaatgtttagttctg

SEQ ID NO: 336802 - DNA, 25 bp, Mus musculus
gtaccccgaaagagctcctgggctc

SEQ ID NO: 336803 - DNA, 25 bp, Mus musculus
gtaccccgctggccctgtccacgga

SEQ ID NO: 336804 - DNA, 25 bp, Mus musculus
gtaccccgctggctggctttgggta

SEQ ID NO: 336805 - DNA, 25 bp, Mus musculus
gtaccccggcctagatgcagcttca

SEQ ID NO: 336806 - DNA, 25 bp, Mus musculus
gtaccccgtcggcaatgatggcagt

SEQ ID NO: 336807 - DNA, 25 bp, Mus musculus
gtacccgaggagaaactggaaacaa

SEQ ID NO: 336808 - DNA, 25 bp, Mus musculus
gtacccgaggagaccaaacagtctt

SEQ ID NO: 336809 - DNA, 25 bp, Mus musculus
gtacccgaggagaccaaagaagaga

SEQ ID NO: 336810 - DNA, 25 bp, Mus musculus
gtacccgatagaggtccaggtctgt

SEQ ID NO: 336811 - DNA, 25 bp, Mus musculus
gtaccctacagaaacactcaaggct

SEQ ID NO: 336812 - DNA, 25 bp, Mus musculus
gtaccctatgataaaaactacagtg

SEQ ID NO: 336813 - DNA, 25 bp, Mus musculus
gtaccctatgcatctgcctctataa

SEQ ID NO: 336814 - DNA, 25 bp, Mus musculus
gtaccctccagctggaccctggagg

SEQ ID NO: 336815 - DNA, 25 bp, Mus musculus
gtaccctgaaagagttaaacatctt

SEQ ID NO: 336816 - DNA, 25 bp, Mus musculus
gtaccctgcctgatgagctgggaga

SEQ ID NO: 336817 - DNA, 25 bp, Mus musculus
gtacccttgccaaaagcggggagcc

SEQ ID NO: 336818 - DNA, 25 bp, Mus musculus
gtacccttgccaaggttcccagaag

SEQ ID NO: 336819 - DNA, 25 bp, Mus musculus
gtacccttgctgcaatgaagctgat

SEQ ID NO: 336820 - DNA, 25 bp, Mus musculus
gtacccttgtggaccagcagagaac

SEQ ID NO: 336821 - DNA, 25 bp, Mus musculus
gtaccctttattcaggagatgattt

SEQ ID NO: 336822 - DNA, 25 bp, Mus musculus
gtaccctttcatagattaccaagga

SEQ ID NO: 336823 - DNA, 25 bp, Mus musculus
gtaccctttcatagctatgataagt

SEQ ID NO: 336824 - DNA, 25 bp, Mus musculus
gtaccgaaagctggacgatggtagt

SEQ ID NO: 336825 - DNA, 25 bp, Mus musculus
gtaccgactttcacgatatgtgacc

SEQ ID NO: 336826 - DNA, 25 bp, Mus musculus
gtaccgaggagggacttcaaaacat

SEQ ID NO: 336827 - DNA, 25 bp, Mus musculus
gtaccgcaccaagtgtgaggagata

SEQ ID NO: 336828 - DNA, 25 bp, Mus musculus
gtaccgcaccaagtgtgaggagatg

SEQ ID NO: 336829 - DNA, 25 bp, Mus musculus
gtaccgcagaagttgcagaagctgg

SEQ ID NO: 336830 - DNA, 25 bp, Mus musculus
gtaccgcatggttcctgctctgcac

SEQ ID NO: 336831 - DNA, 25 bp, Mus musculus
gtaccgctccgtagggaagacatct

SEQ ID NO: 336832 - DNA, 25 bp, Mus musculus
gtaccggcaaatggttgaaactgag

SEQ ID NO: 336833 - DNA, 25 bp, Mus musculus
gtaccgggtcggagactgcaagtgg

SEQ ID NO: 336834 - DNA, 25 bp, Mus musculus
gtaccgggtgcagagagacatccca

SEQ ID NO: 336835 - DNA, 25 bp, Mus musculus
gtaccgtaaacccaaggcagtgggc

SEQ ID NO: 336836 - DNA, 25 bp, Mus musculus
gtaccgttgtgagctgctggggcca

SEQ ID NO: 336837 - DNA, 25 bp, Mus musculus
gtacctaccaggtgaaacctttgtc

SEQ ID NO: 336838 - DNA, 25 bp, Mus musculus
gtacctagaagatcttggtaatgtt

SEQ ID NO: 336839 - DNA, 25 bp, Mus musculus
gtacctagaaggaagagaaaagaga

SEQ ID NO: 336840 - DNA, 25 bp, Mus musculus
gtacctataaccagacacgcagtgc

SEQ ID NO: 336841 - DNA, 25 bp, Mus musculus
gtacctataaccaggtgcagacacg

SEQ ID NO: 336842 - DNA, 25 bp, Mus musculus
gtacctatggagtaatggttcctga

SEQ ID NO: 336843 - DNA, 25 bp, Mus musculus
gtacctatggatgtgctgggccagg

SEQ ID NO: 336844 - DNA, 25 bp, Mus musculus
gtacctatggcagggccaccaaagc

SEQ ID NO: 336845 - DNA, 25 bp, Mus musculus
gtacctcaatcaaggacagtcttat

SEQ ID NO: 336846 - DNA, 25 bp, Mus musculus
gtacctccacgaggcgagcctgtca

SEQ ID NO: 336847 - DNA, 25 bp, Mus musculus
gtacctccaggtgatcaagctcggc

SEQ ID NO: 336848 - DNA, 25 bp, Mus musculus
gtacctcccaagccggccgttgaaa

SEQ ID NO: 336849 - DNA, 25 bp, Mus musculus
gtacctcccacccttggactctcct

SEQ ID NO: 336850 - DNA, 25 bp, Mus musculus
gtacctcccagtactgggtacagag

SEQ ID NO: 336851 - DNA, 25 bp, Mus musculus
gtacctgaagatgaaatgtggcaac

SEQ ID NO: 336852 - DNA, 25 bp, Mus musculus
gtacctgaagggaaccccaatatac

SEQ ID NO: 336853 - DNA, 25 bp, Mus musculus
gtacctgaaggtggagagctgtgag

SEQ ID NO: 336854 - DNA, 25 bp, Mus musculus
gtacctgattggactgcccgtggtt

SEQ ID NO: 336855 - DNA, 25 bp, Mus musculus
gtacctgcaactcaatcgtttacta

SEQ ID NO: 336856 - DNA, 25 bp, Mus musculus
gtacctgcaagaagaaagtcctctg

SEQ ID NO: 336857 - DNA, 25 bp, Mus musculus
gtacctgcagaccagaggctgcctg

SEQ ID NO: 336858 - DNA, 25 bp, Mus musculus
gtacctgcagcccatacctggatgt

SEQ ID NO: 336859 - DNA, 25 bp, Mus musculus
gtacctgcagcctgcactggatggc

SEQ ID NO: 336860 - DNA, 25 bp, Mus musculus
gtacctgcagtgcctgagacgtaaa

SEQ ID NO: 336861 - DNA, 25 bp, Mus musculus
gtacctgcataaagacagacccctg

SEQ ID NO: 336862 - DNA, 25 bp, Mus musculus
gtacctgcataagaattgaattaga

SEQ ID NO: 336863 - DNA, 25 bp, Mus musculus
gtacctgcatgattgccacaatctc

SEQ ID NO: 336864 - DNA, 25 bp, Mus musculus
gtacctgcatgggtgaaagaattga

SEQ ID NO: 336865 - DNA, 25 bp, Mus musculus
gtacctgctgcccctctcctgggaa

SEQ ID NO: 336866 - DNA, 25 bp, Mus musculus
gtacctgctggaaggagcagcggtc

SEQ ID NO: 336867 - DNA, 25 bp, Mus musculus
gtacctgctggaaggtgtgacccca

SEQ ID NO: 336868 - DNA, 25 bp, Mus musculus
gtacctggaccagaggagccccagg

SEQ ID NO: 336869 - DNA, 25 bp, Mus musculus
gtacctggaccagcaacagtatcaa

SEQ ID NO: 336870 - DNA, 25 bp, Mus musculus
gtacctggagcaatcaaagtatcgt

SEQ ID NO: 336871 - DNA, 25 bp, Mus musculus
gtacctggagggcctgttcttcttg

SEQ ID NO: 336872 - DNA, 25 bp, Mus musculus
gtacctggatgcctatgctgaacac

SEQ ID NO: 336873 - DNA, 25 bp, Mus musculus
gtacctggtccaggataaataggat

SEQ ID NO: 336874 - DNA, 25 bp, Mus musculus
gtacctgtatacaggccgcttggac

SEQ ID NO: 336875 - DNA, 25 bp, Mus musculus
gtacctgtgctcaggtcgcaggcat

SEQ ID NO: 336876 - DNA, 25 bp, Mus musculus
gtaccttagtataggtgattgaagc

SEQ ID NO: 336877 - DNA, 25 bp, Mus musculus
gtaccttagtataggtgtcctcaga

SEQ ID NO: 336878 - DNA, 25 bp, Mus musculus
gtaccttcaagggatttaaacgagt

SEQ ID NO: 336879 - DNA, 25 bp, Mus musculus
gtaccttcattacgtgcgaccctgg

SEQ ID NO: 336880 - DNA, 25 bp, Mus musculus
gtaccttcattgaactccaagattc

SEQ ID NO: 336881 - DNA, 25 bp, Mus musculus
gtaccttcgctaggtatatatggtc

SEQ ID NO: 336882 - DNA, 25 bp, Mus musculus
gtaccttggcaggagccaacagaga

SEQ ID NO: 336883 - DNA, 25 bp, Mus musculus
gtaccttgggatcagagggctccta

SEQ ID NO: 336884 - DNA, 25 bp, Mus musculus
gtaccttgggggccggcacatgggt

SEQ ID NO: 336885 - DNA, 25 bp, Mus musculus
gtacctttccaataccaaatatgaa

SEQ ID NO: 336886 - DNA, 25 bp, Mus musculus
gtacctttccagagctgccttacag

SEQ ID NO: 336887 - DNA, 25 bp, Mus musculus
gtaccttttgagcaggtagaagaga

SEQ ID NO: 336888 - DNA, 25 bp, Mus musculus
gtacgaagcagctccttaattgatg

SEQ ID NO: 336889 - DNA, 25 bp, Mus musculus
gtacgaagcgccctttccgtcagaa

SEQ ID NO: 336890 - DNA, 25 bp, Mus musculus
gtacgaaggcaaggcgacccctctg

SEQ ID NO: 336891 - DNA, 25 bp, Mus musculus
gtacgaatttcagcgaggagagtgg

SEQ ID NO: 336892 - DNA, 25 bp, Mus musculus
gtacgacatggctgccagaaaatgc

SEQ ID NO: 336893 - DNA, 25 bp, Mus musculus
gtacgacgatgacgtggcgcagtgg

SEQ ID NO: 336894 - DNA, 25 bp, Mus musculus
gtacgactgaaggagaaaattttga

SEQ ID NO: 336895 - DNA, 25 bp, Mus musculus
gtacgaggagagagcaagaggaggc

SEQ ID NO: 336896 - DNA, 25 bp, Mus musculus
gtacgaggcagaaatgctgagcttc

SEQ ID NO: 336897 - DNA, 25 bp, Mus musculus
gtacgatacagacaggttaactgag

SEQ ID NO: 336898 - DNA, 25 bp, Mus musculus
gtacgatatatcacacagaacccct

SEQ ID NO: 336899 - DNA, 25 bp, Mus musculus
gtacgatccaccaggtttgaggagt

SEQ ID NO: 336900 - DNA, 25 bp, Mus musculus
gtacgatgagtccaaattttatatt

SEQ ID NO: 336901 - DNA, 25 bp, Mus musculus
gtacgatgagtccaagttctatatt

SEQ ID NO: 336902 - DNA, 25 bp, Mus musculus
gtacgcaaaataataggaagaaggg

SEQ ID NO: 336903 - DNA, 25 bp, Mus musculus
gtacgcaaaatagttgaaaaacatt

SEQ ID NO: 336904 - DNA, 25 bp, Mus musculus
gtacgccaagaaatccaggaagtaa

SEQ ID NO: 336905 - DNA, 25 bp, Mus musculus
gtacgcccgaggacttcaggaacca

SEQ ID NO: 336906 - DNA, 25 bp, Mus musculus
gtacgcctgcagagcccacatggtg

SEQ ID NO: 336907 - DNA, 25 bp, Mus musculus
gtacgcctgcagtgctgtgaagagc

SEQ ID NO: 336908 - DNA, 25 bp, Mus musculus
gtacgcgactcagtaattggcaact

SEQ ID NO: 336909 - DNA, 25 bp, Mus musculus
gtacgctgcgccaaattttcacctg

SEQ ID NO: 336910 - DNA, 25 bp, Mus musculus
gtacggacaggaggcgttgtctgtc

SEQ ID NO: 336911 - DNA, 25 bp, Mus musculus
gtacggacaggaggggagaagagac

SEQ ID NO: 336912 - DNA, 25 bp, Mus musculus
gtacggaccaaatggaatgaataaa

SEQ ID NO: 336913 - DNA, 25 bp, Mus musculus
gtacggagctggtgggaggagtgaa

SEQ ID NO: 336914 - DNA, 25 bp, Mus musculus
gtacggcgagccaggatgtccacct

SEQ ID NO: 336915 - DNA, 25 bp, Mus musculus
gtacggcgagccagggcaaaggagc

SEQ ID NO: 336916 - DNA, 25 bp, Mus musculus
gtacggcggagatgaagttggcgct

SEQ ID NO: 336917 - DNA, 25 bp, Mus musculus
gtacggcgtggccttttacaactac

SEQ ID NO: 336918 - DNA, 25 bp, Mus musculus
gtacggctgcgaggaagaagaaatg

SEQ ID NO: 336919 - DNA, 25 bp, Mus musculus
gtacggctgcgaggaattcatcaga

SEQ ID NO: 336920 - DNA, 25 bp, Mus musculus
gtacgggatttgctggacaggacgc

SEQ ID NO: 336921 - DNA, 25 bp, Mus musculus
gtacgggcatggcagccaaagctta

SEQ ID NO: 336922 - DNA, 25 bp, Mus musculus
gtacggtgttcagggactgctgacc

SEQ ID NO: 336923 - DNA, 25 bp, Mus musculus
gtacggtgttcaggtcactgcaaga

SEQ ID NO: 336924 - DNA, 25 bp, Mus musculus
gtacgtacacaggttttcctttgga

SEQ ID NO: 336925 - DNA, 25 bp, Mus musculus
gtacgtgagcctggacagaccctct

SEQ ID NO: 336926 - DNA, 25 bp, Mus musculus
gtacgtgggaaggcactttccggat

SEQ ID NO: 336927 - DNA, 25 bp, Mus musculus
gtacgtgtactcctggaccatgatg

SEQ ID NO: 336928 - DNA, 25 bp, Mus musculus
gtacgtgttcaatgggcatgttcat

SEQ ID NO: 336929 - DNA, 25 bp, Mus musculus
gtacgttcaggaggccccatcggtt

SEQ ID NO: 336930 - DNA, 25 bp, Mus musculus
gtacgttcaggggttgtgctgggcc

SEQ ID NO: 336931 - DNA, 25 bp, Mus musculus
gtacgtttactgtgagttccttcgg

SEQ ID NO: 336932 - DNA, 25 bp, Mus musculus
gtactaaaaatagcccagaagagat

SEQ ID NO: 336933 - DNA, 25 bp, Mus musculus
gtactacaaggacatcaatgcaagc

SEQ ID NO: 336934 - DNA, 25 bp, Mus musculus
gtactacacagttcaacgggaaggg

SEQ ID NO: 336935 - DNA, 25 bp, Mus musculus
gtactacaccacagattatcagctg

SEQ ID NO: 336936 - DNA, 25 bp, Mus musculus
gtactacagtgtctaatgcactacc

SEQ ID NO: 336937 - DNA, 25 bp, Mus musculus
gtactacgtgtcctatgctgtcttc

SEQ ID NO: 336938 - DNA, 25 bp, Mus musculus
gtactactcgtccagctcaagtctc

SEQ ID NO: 336939 - DNA, 25 bp, Mus musculus
gtactagaaaagttcctgtggaaga

SEQ ID NO: 336940 - DNA, 25 bp, Mus musculus
gtactaggaagaggaacacgcagca

SEQ ID NO: 336941 - DNA, 25 bp, Mus musculus
gtactagtgaggccacaggcaggat

SEQ ID NO: 336942 - DNA, 25 bp, Mus musculus
gtactagttaagtgcctgaagacct

SEQ ID NO: 336943 - DNA, 25 bp, Mus musculus
gtactatctgacaagcacaaacggg

SEQ ID NO: 336944 - DNA, 25 bp, Mus musculus
gtactatctgacaagcacctatagt

SEQ ID NO: 336945 - DNA, 25 bp, Mus musculus
gtactatctgacagaagtggtcctt

SEQ ID NO: 336946 - DNA, 25 bp, Mus musculus
gtactatggggatgtctgtgttaga

SEQ ID NO: 336947 - DNA, 25 bp, Mus musculus
gtactattggggagagagaaaaaac

SEQ ID NO: 336948 - DNA, 25 bp, Mus musculus
gtactcaaaaaggtctatcctaaag

SEQ ID NO: 336949 - DNA, 25 bp, Mus musculus
gtactcaagctccgccctcagtcat

SEQ ID NO: 336950 - DNA, 25 bp, Mus musculus
gtactcaagctcctgtcttctaatt

SEQ ID NO: 336951 - DNA, 25 bp, Mus musculus
gtactcaaggagaatctgggagcag

SEQ ID NO: 336952 - DNA, 25 bp, Mus musculus
gtactcacagagcggtccaacctta

SEQ ID NO: 336953 - DNA, 25 bp, Mus musculus
gtactcacagcgcatgactacatca

SEQ ID NO: 336954 - DNA, 25 bp, Mus musculus
gtactcacagggcatgactacatca

SEQ ID NO: 336955 - DNA, 25 bp, Mus musculus
gtactcacagtgcggtccaacctta

SEQ ID NO: 336956 - DNA, 25 bp, Mus musculus
gtactcacccaagattgatgaccag

SEQ ID NO: 336957 - DNA, 25 bp, Mus musculus
gtactcacccaagctatgagcttgg

SEQ ID NO: 336958 - DNA, 25 bp, Mus musculus
gtactcacccaaggagctgctagca

SEQ ID NO: 336959 - DNA, 25 bp, Mus musculus
gtactcacctagagtggaccagatt

SEQ ID NO: 336960 - DNA, 25 bp, Mus musculus
gtactcagagacatggagttctttt

SEQ ID NO: 336961 - DNA, 25 bp, Mus musculus
gtactcagagacatgtatgcactga

SEQ ID NO: 336962 - DNA, 25 bp, Mus musculus
gtactcagttaggatgaccattgat

SEQ ID NO: 336963 - DNA, 25 bp, Mus musculus
gtactcagttagtttcctatgatga

SEQ ID NO: 336964 - DNA, 25 bp, Mus musculus
gtactcatacaccagcaactctgat

SEQ ID NO: 336965 - DNA, 25 bp, Mus musculus
gtactcatgatgcaagttactgtaa

SEQ ID NO: 336966 - DNA, 25 bp, Mus musculus
gtactcattctgaatctagtaagag

SEQ ID NO: 336967 - DNA, 25 bp, Mus musculus
gtactcattcttcttttagctctac

SEQ ID NO: 336968 - DNA, 25 bp, Mus musculus
gtactccaaagtctttggaagcata

SEQ ID NO: 336969 - DNA, 25 bp, Mus musculus
gtactccaagaggctcgggtcttta

SEQ ID NO: 336970 - DNA, 25 bp, Mus musculus
gtactccaccgaacagtggccacag

SEQ ID NO: 336971 - DNA, 25 bp, Mus musculus
gtactccacgtgatccgaggaccca

SEQ ID NO: 336972 - DNA, 25 bp, Mus musculus
gtactccacgttgcaggatctgtgg

SEQ ID NO: 336973 - DNA, 25 bp, Mus musculus
gtactccctccagacatggacccta

SEQ ID NO: 336974 - DNA, 25 bp, Mus musculus
gtactccctgagtggctatggagtt

SEQ ID NO: 336975 - DNA, 25 bp, Mus musculus
gtactcctattacttgaagctggct

SEQ ID NO: 336976 - DNA, 25 bp, Mus musculus
gtactcctattacttgtcccaaagg

SEQ ID NO: 336977 - DNA, 25 bp, Mus musculus
gtactcgatggcggagaggtgtctg

SEQ ID NO: 336978 - DNA, 25 bp, Mus musculus
gtactcgatggcggagagtgagggg

SEQ ID NO: 336979 - DNA, 25 bp, Mus musculus
gtactctcaaactagatttcctctg

SEQ ID NO: 336980 - DNA, 25 bp, Mus musculus
gtactctcgggaggtgttcctgctc

SEQ ID NO: 336981 - DNA, 25 bp, Mus musculus
gtactctcttaggaaaagaagacca

SEQ ID NO: 336982 - DNA, 25 bp, Mus musculus
gtactctcttggacctatatccaga

SEQ ID NO: 336983 - DNA, 25 bp, Mus musculus
gtactctgaaactagactctacagg

SEQ ID NO: 336984 - DNA, 25 bp, Mus musculus
gtactctgaaactctgccgagtgtt

SEQ ID NO: 336985 - DNA, 25 bp, Mus musculus
gtactctgctgccggcttttctcct

SEQ ID NO: 336986 - DNA, 25 bp, Mus musculus
gtactctgctgccgggtcagcacct

SEQ ID NO: 336987 - DNA, 25 bp, Mus musculus
gtactctgtttcagtggaaacaagt

SEQ ID NO: 336988 - DNA, 25 bp, Mus musculus
gtactcttcagaggaatgatattgc

SEQ ID NO: 336989 - DNA, 25 bp, Mus musculus
gtactgaatcttcagtgagcatgtt

SEQ ID NO: 336990 - DNA, 25 bp, Mus musculus
gtactgaatcttcattgagcatgtt

SEQ ID NO: 336991 - DNA, 25 bp, Mus musculus
gtactgacaaggggtgtgattttgc

SEQ ID NO: 336992 - DNA, 25 bp, Mus musculus
gtactgactcaggctctgggggacc

SEQ ID NO: 336993 - DNA, 25 bp, Mus musculus
gtactgactcagtatgaagagcgca

SEQ ID NO: 336994 - DNA, 25 bp, Mus musculus
gtactgagaggtagccagaaatgga

SEQ ID NO: 336995 - DNA, 25 bp, Mus musculus
gtactgagattacaggaatggaaga

SEQ ID NO: 336996 - DNA, 25 bp, Mus musculus
gtactgatgctggggagaatcccgt

SEQ ID NO: 336997 - DNA, 25 bp, Mus musculus
gtactgcaagattggcaaagagacc

SEQ ID NO: 336998 - DNA, 25 bp, Mus musculus
gtactgcatcagcagtgatgatctt

SEQ ID NO: 336999 - DNA, 25 bp, Mus musculus
gtactgcatcgcccttgactacaag

SEQ ID NO: 337000 - DNA, 25 bp, Mus musculus
gtactgccaaggtcaaggctggttc

SEQ ID NO: 337001 - DNA, 25 bp, Mus musculus
gtactgccagggaatgaatttcata

SEQ ID NO: 337002 - DNA, 25 bp, Mus musculus
gtactgccagtgctgcgcacagaaa

SEQ ID NO: 337003 - DNA, 25 bp, Mus musculus
gtactgcgaagatgtcaatgaatgt

SEQ ID NO: 337004 - DNA, 25 bp, Mus musculus
gtactgctgactggttgcccattgg

SEQ ID NO: 337005 - DNA, 25 bp, Mus musculus
gtactgctgcatgccctgaagccag

SEQ ID NO: 337006 - DNA, 25 bp, Mus musculus
gtactgctgtacggtagcagatatc

SEQ ID NO: 337007 - DNA, 25 bp, Mus musculus
gtactgctgtacgtgagtcagccgg

SEQ ID NO: 337008 - DNA, 25 bp, Mus musculus
gtactgcttccggtgtggagaagac

SEQ ID NO: 337009 - DNA, 25 bp, Mus musculus
gtactggaaggaaggtgcacacttt

SEQ ID NO: 337010 - DNA, 25 bp, Mus musculus
gtactggagaagttatttccgagag

SEQ ID NO: 337011 - DNA, 25 bp, Mus musculus
gtactggagacaccaacaggtggaa

SEQ ID NO: 337012 - DNA, 25 bp, Mus musculus
gtactggagacaggccgggtgacca

SEQ ID NO: 337013 - DNA, 25 bp, Mus musculus
gtactggcaagagagtgctaacagc

SEQ ID NO: 337014 - DNA, 25 bp, Mus musculus
gtactggctattgagctcttcctca

SEQ ID NO: 337015 - DNA, 25 bp, Mus musculus
gtactgggagtacagctgactcaag

SEQ ID NO: 337016 - DNA, 25 bp, Mus musculus
gtactgggattaaagatggcagact

SEQ ID NO: 337017 - DNA, 25 bp, Mus musculus
gtactgggattaaaggatgaaaatg

SEQ ID NO: 337018 - DNA, 25 bp, Mus musculus
gtactgggattaaaggtatagtcca

SEQ ID NO: 337019 - DNA, 25 bp, Mus musculus
gtactgggattacaggggctgagat

SEQ ID NO: 337020 - DNA, 25 bp, Mus musculus
gtactggtcaatagggtacacctgg

SEQ ID NO: 337021 - DNA, 25 bp, Mus musculus
gtactgtaagaggcttctcaggatg

SEQ ID NO: 337022 - DNA, 25 bp, Mus musculus
gtactgtcacagatgcaggagacaa

SEQ ID NO: 337023 - DNA, 25 bp, Mus musculus
gtactgtcacaggtctggggctttc

SEQ ID NO: 337024 - DNA, 25 bp, Mus musculus
gtactgtcggaccagcagtgccgtg

SEQ ID NO: 337025 - DNA, 25 bp, Mus musculus
gtactgtgaaagagttgttatttct

SEQ ID NO: 337026 - DNA, 25 bp, Mus musculus
gtactgtgaaagatatgaatttgga

SEQ ID NO: 337027 - DNA, 25 bp, Mus musculus
gtactgtgcccccaagtctgtcttc

SEQ ID NO: 337028 - DNA, 25 bp, Mus musculus
gtactgttcgagaggcctccaacat

SEQ ID NO: 337029 - DNA, 25 bp, Mus musculus
gtacttaatgagttccgatctggaa

SEQ ID NO: 337030 - DNA, 25 bp, Mus musculus
gtacttacatatataaataaataaa

SEQ ID NO: 337031 - DNA, 25 bp, Mus musculus
gtacttagcactcctacagcagact

SEQ ID NO: 337032 - DNA, 25 bp, Mus musculus
gtacttagcactttatttgcagctc

SEQ ID NO: 337033 - DNA, 25 bp, Mus musculus
gtacttcaagagcctgcacaggttt

SEQ ID NO: 337034 - DNA, 25 bp, Mus musculus
gtacttcaatcaagtttttgcagcc

SEQ ID NO: 337035 - DNA, 25 bp, Mus musculus
gtacttcattgtacgatctttgcgg

SEQ ID NO: 337036 - DNA, 25 bp, Mus musculus
gtacttcctctggactctgtgaagg

SEQ ID NO: 337037 - DNA, 25 bp, Mus musculus
gtacttcctctgtggaaggactctg

SEQ ID NO: 337038 - DNA, 25 bp, Mus musculus
gtacttcctggtgggtgcaggggcc

SEQ ID NO: 337039 - DNA, 25 bp, Mus musculus
gtacttcctgtccagagagaacatt

SEQ ID NO: 337040 - DNA, 25 bp, Mus musculus
gtacttcctgtccaggagagaacac

SEQ ID NO: 337041 - DNA, 25 bp, Mus musculus
gtacttcggctgtcccagggctccc

SEQ ID NO: 337042 - DNA, 25 bp, Mus musculus
gtacttcgggaggaattatgcttca

SEQ ID NO: 337043 - DNA, 25 bp, Mus musculus
gtacttcgggagggatgtactgagc

SEQ ID NO: 337044 - DNA, 25 bp, Mus musculus
gtacttctacagttacccagctgtg

SEQ ID NO: 337045 - DNA, 25 bp, Mus musculus
gtacttcttcctcatcggaccccca

SEQ ID NO: 337046 - DNA, 25 bp, Mus musculus
gtacttcttgcacgatgacagagat

SEQ ID NO: 337047 - DNA, 25 bp, Mus musculus
gtacttgactgaagtgtgcttttgt

SEQ ID NO: 337048 - DNA, 25 bp, Mus musculus
gtacttggagaggctccggctcact

SEQ ID NO: 337049 - DNA, 25 bp, Mus musculus
gtacttggccgagcagcctgcgcca

SEQ ID NO: 337050 - DNA, 25 bp, Mus musculus
gtacttgggaaaaaattatgcttca

SEQ ID NO: 337051 - DNA, 25 bp, Mus musculus
gtacttgggaatcatgaccaacact

SEQ ID NO: 337052 - DNA, 25 bp, Mus musculus
gtacttgggagctaggagaccatct

SEQ ID NO: 337053 - DNA, 25 bp, Mus musculus
gtacttgtgttccagaatggggagg

SEQ ID NO: 337054 - DNA, 25 bp, Mus musculus
gtacttgtgttccagggagatgcta

SEQ ID NO: 337055 - DNA, 25 bp, Mus musculus
gtactttgactcggtccctaccacc

SEQ ID NO: 337056 - DNA, 25 bp, Mus musculus
gtactttgactcgtgaagtcatcag

SEQ ID NO: 337057 - DNA, 25 bp, Mus musculus
gtactttgcccgagggctccgggga

SEQ ID NO: 337058 - DNA, 25 bp, Mus musculus
gtactttgtgcaggtcccagccagc

SEQ ID NO: 337059 - DNA, 25 bp, Mus musculus
gtactttgtgcagtggctcgtgggt

SEQ ID NO: 337060 - DNA, 25 bp, Mus musculus
gtacttttcatcgtccaactttaac

SEQ ID NO: 337061 - DNA, 25 bp, Mus musculus
gtacttttgaattaggacgagtctt

SEQ ID NO: 337062 - DNA, 25 bp, Mus musculus
gtacttttgaattgttcctgtgaag

SEQ ID NO: 337063 - DNA, 25 bp, Mus musculus
gtacttttgggggagctgaagaaga

SEQ ID NO: 337064 - DNA, 25 bp, Mus musculus
gtacttttttggttatgggcaaagc

SEQ ID NO: 337065 - DNA, 25 bp, Mus musculus
gtagaaaaaacagacagtgatgtga

SEQ ID NO: 337066 - DNA, 25 bp, Mus musculus
gtagaaaaaagatgacctcaatgcc

SEQ ID NO: 337067 - DNA, 25 bp, Mus musculus
gtagaaaaagggcttttcctagatg

SEQ ID NO: 337068 - DNA, 25 bp, Mus musculus
gtagaaaactgtggtgtcatggata

SEQ ID NO: 337069 - DNA, 25 bp, Mus musculus
gtagaaaagatggcagcctttactt

SEQ ID NO: 337070 - DNA, 25 bp, Mus musculus
gtagaaaaggggcatcgtctgcctt

SEQ ID NO: 337071 - DNA, 25 bp, Mus musculus
gtagaaacaaggtgctctgttgccg

SEQ ID NO: 337072 - DNA, 25 bp, Mus musculus
gtagaaacgaaacgttgacaaacaa

SEQ ID NO: 337073 - DNA, 25 bp, Mus musculus
gtagaaataaagatgatcagtcagt

SEQ ID NO: 337074 - DNA, 25 bp, Mus musculus
gtagaaatcggaagatcttagatga

SEQ ID NO: 337075 - DNA, 25 bp, Mus musculus
gtagaacaagagactaagtctggct

SEQ ID NO: 337076 - DNA, 25 bp, Mus musculus
gtagaacaagtatcatctcagagtt

SEQ ID NO: 337077 - DNA, 25 bp, Mus musculus
gtagaaccagacgatggaggctctg

SEQ ID NO: 337078 - DNA, 25 bp, Mus musculus
gtagaaccaggggaaagcgcagcca

SEQ ID NO: 337079 - DNA, 25 bp, Mus musculus
gtagaacctgccctctgaccgtgct

SEQ ID NO: 337080 - DNA, 25 bp, Mus musculus
gtagaacgagccatttattgaaact

SEQ ID NO: 337081 - DNA, 25 bp, Mus musculus
gtagaactgccgggttcatcgtggc

SEQ ID NO: 337082 - DNA, 25 bp, Mus musculus
gtagaagaacagaaactacataaag

SEQ ID NO: 337083 - DNA, 25 bp, Mus musculus
gtagaagaagctggtcccgtccatg

SEQ ID NO: 337084 - DNA, 25 bp, Mus musculus
gtagaagagatggagttttttggac

SEQ ID NO: 337085 - DNA, 25 bp, Mus musculus
gtagaagagctgccctctgaagcca

SEQ ID NO: 337086 - DNA, 25 bp, Mus musculus
gtagaagagcttagcctatcttcag

SEQ ID NO: 337087 - DNA, 25 bp, Mus musculus
gtagaagcaacaggcatgacttgcc

SEQ ID NO: 337088 - DNA, 25 bp, Mus musculus
gtagaagccatccgttctcgtgctg

SEQ ID NO: 337089 - DNA, 25 bp, Mus musculus
gtagaagctggtgggatgcaggcac

SEQ ID NO: 337090 - DNA, 25 bp, Mus musculus
gtagaaggcagaggtggcacggcga

SEQ ID NO: 337091 - DNA, 25 bp, Mus musculus
gtagaagtgagtcaggtgttaaatg

SEQ ID NO: 337092 - DNA, 25 bp, Mus musculus
gtagaagtggtgattgaaggtgatg

SEQ ID NO: 337093 - DNA, 25 bp, Mus musculus
gtagaagttgtcctagaatcgaatc

SEQ ID NO: 337094 - DNA, 25 bp, Mus musculus
gtagaattcctccaggagtacatca

SEQ ID NO: 337095 - DNA, 25 bp, Mus musculus
gtagacaaggaaagggatcttgctg

SEQ ID NO: 337096 - DNA, 25 bp, Mus musculus
gtagacaaggaaaggtacgacatga

SEQ ID NO: 337097 - DNA, 25 bp, Mus musculus
gtagacaagggagcatatgcaggaa

SEQ ID NO: 337098 - DNA, 25 bp, Mus musculus
gtagacaccacgggtgctggtgaca

SEQ ID NO: 337099 - DNA, 25 bp, Mus musculus
gtagacacttgtggaaggaatctgc

SEQ ID NO: 337100 - DNA, 25 bp, Mus musculus
gtagacattgagcaggcatacaaat

SEQ ID NO: 337101 - DNA, 25 bp, Mus musculus
gtagaccacgaggagctgaaggacc

SEQ ID NO: 337102 - DNA, 25 bp, Mus musculus
gtagaccagtaacttccctctcact

SEQ ID NO: 337103 - DNA, 25 bp, Mus musculus
gtagaccccattgagctcatgtttg

SEQ ID NO: 337104 - DNA, 25 bp, Mus musculus
gtagaccccattgagctggtggttt

SEQ ID NO: 337105 - DNA, 25 bp, Mus musculus
gtagacctgaaggtgtcccccttgt

SEQ ID NO: 337106 - DNA, 25 bp, Mus musculus
gtagaccttaacctagcttaccatc

SEQ ID NO: 337107 - DNA, 25 bp, Mus musculus
gtagaccttgagtctagtgacaatg

SEQ ID NO: 337108 - DNA, 25 bp, Mus musculus
gtagaccttgtgtctagtgacaatg

SEQ ID NO: 337109 - DNA, 25 bp, Mus musculus
gtagacgctcttttcagacccaagt

SEQ ID NO: 337110 - DNA, 25 bp, Mus musculus
gtagactccatagaactttccaaag

SEQ ID NO: 337111 - DNA, 25 bp, Mus musculus
gtagactccataggaccttctgtct

SEQ ID NO: 337112 - DNA, 25 bp, Mus musculus
gtagactccgagggacatctctaca

SEQ ID NO: 337113 - DNA, 25 bp, Mus musculus
gtagactgataggactccagaggac

SEQ ID NO: 337114 - DNA, 25 bp, Mus musculus
gtagacttattaaggtcacagtaat

SEQ ID NO: 337115 - DNA, 25 bp, Mus musculus
gtagacttgaacagcattgaggatc

SEQ ID NO: 337116 - DNA, 25 bp, Mus musculus
gtagagaaaaggttttctgtccaca

SEQ ID NO: 337117 - DNA, 25 bp, Mus musculus
gtagagaaagaaaccctggccctgg

SEQ ID NO: 337118 - DNA, 25 bp, Mus musculus
gtagagaaagacatggagatgactt

SEQ ID NO: 337119 - DNA, 25 bp, Mus musculus
gtagagaaccccaggcacggccacc

SEQ ID NO: 337120 - DNA, 25 bp, Mus musculus
gtagagaagggaccacagtatggga

SEQ ID NO: 337121 - DNA, 25 bp, Mus musculus
gtagagaagtgattgtgaagccaga

SEQ ID NO: 337122 - DNA, 25 bp, Mus musculus
gtagagaagtgcctagacaagtatt

SEQ ID NO: 337123 - DNA, 25 bp, Mus musculus
gtagagaataataaggagaatctgt

SEQ ID NO: 337124 - DNA, 25 bp, Mus musculus
gtagagaatgcgggtttccgcttcc

SEQ ID NO: 337125 - DNA, 25 bp, Mus musculus
gtagagacacagagaacacactcta

SEQ ID NO: 337126 - DNA, 25 bp, Mus musculus
gtagagacacaggcaccattttaac

SEQ ID NO: 337127 - DNA, 25 bp, Mus musculus
gtagagaccaagaaaatccagcctc

SEQ ID NO: 337128 - DNA, 25 bp, Mus musculus
gtagagaccaagatgaagaaccacc

SEQ ID NO: 337129 - DNA, 25 bp, Mus musculus
gtagagacgccagttctacctccag

SEQ ID NO: 337130 - DNA, 25 bp, Mus musculus
gtagagagaaagggtacagatttat

SEQ ID NO: 337131 - DNA, 25 bp, Mus musculus
gtagagagccggaacaggtacttaa

SEQ ID NO: 337132 - DNA, 25 bp, Mus musculus
gtagagagccggaaggataaagaaa

SEQ ID NO: 337133 - DNA, 25 bp, Mus musculus
gtagagaggcgagggttgtgagccc

SEQ ID NO: 337134 - DNA, 25 bp, Mus musculus
gtagagagggtcctgagtgatgttc

SEQ ID NO: 337135 - DNA, 25 bp, Mus musculus
gtagagatctcagtgcccttatgca

SEQ ID NO: 337136 - DNA, 25 bp, Mus musculus
gtagagcaaggaaagaccgtagagg

SEQ ID NO: 337137 - DNA, 25 bp, Mus musculus
gtagagcagccaggacaatcccaga

SEQ ID NO: 337138 - DNA, 25 bp, Mus musculus
gtagagcagtagtggcttcacggaa

SEQ ID NO: 337139 - DNA, 25 bp, Mus musculus
gtagagccaaacatccagaacccag

SEQ ID NO: 337140 - DNA, 25 bp, Mus musculus
gtagagccaaagaacaaattggaag

SEQ ID NO: 337141 - DNA, 25 bp, Mus musculus
gtagagccacagaactgtcctggct

SEQ ID NO: 337142 - DNA, 25 bp, Mus musculus
gtagagccacagagacagtgtttca

SEQ ID NO: 337143 - DNA, 25 bp, Mus musculus
gtagagccacaggatctcaattcac

SEQ ID NO: 337144 - DNA, 25 bp, Mus musculus
gtagagccagcaagtccacatgcga

SEQ ID NO: 337145 - DNA, 25 bp, Mus musculus
gtagagccaggaagtgactgtggac

SEQ ID NO: 337146 - DNA, 25 bp, Mus musculus
gtagagccaggcttgccatctccaa

SEQ ID NO: 337147 - DNA, 25 bp, Mus musculus
gtagagcccatcaggtggttgaaga

SEQ ID NO: 337148 - DNA, 25 bp, Mus musculus
gtagagcctagccccgtgtctgaag

SEQ ID NO: 337149 - DNA, 25 bp, Mus musculus
gtagagctatcttataatctggagg

SEQ ID NO: 337150 - DNA, 25 bp, Mus musculus
gtagagctgcgcttgtgcactttgg

SEQ ID NO: 337151 - DNA, 25 bp, Mus musculus
gtagagcttgggattttctttgagg

SEQ ID NO: 337152 - DNA, 25 bp, Mus musculus
gtagagcttggggttttatggcaat

SEQ ID NO: 337153 - DNA, 25 bp, Mus musculus
gtagagcttgggtggtcgttgaagt

SEQ ID NO: 337154 - DNA, 25 bp, Mus musculus
gtagaggaacattgtaaattcaaga

SEQ ID NO: 337155 - DNA, 25 bp, Mus musculus
gtagaggactgttatgaaagagaag

SEQ ID NO: 337156 - DNA, 25 bp, Mus musculus
gtagaggaggagctggagcgctcgg

SEQ ID NO: 337157 - DNA, 25 bp, Mus musculus
gtagaggcagagccccactccacag

SEQ ID NO: 337158 - DNA, 25 bp, Mus musculus
gtagaggcctttgtgaaaatgtcca

SEQ ID NO: 337159 - DNA, 25 bp, Mus musculus
gtagaggcggatcacattccagctc

SEQ ID NO: 337160 - DNA, 25 bp, Mus musculus
gtagaggcggggctctgccacgtcc

SEQ ID NO: 337161 - DNA, 25 bp, Mus musculus
gtagagggctaggcctgcctgcccc

SEQ ID NO: 337162 - DNA, 25 bp, Mus musculus
gtagagtcacagaaatcactcaagg

SEQ ID NO: 337163 - DNA, 25 bp, Mus musculus
gtagagtggaatgggatgagaaaga

SEQ ID NO: 337164 - DNA, 25 bp, Mus musculus
gtagagtggaatggggatggcactg

SEQ ID NO: 337165 - DNA, 25 bp, Mus musculus
gtagagtggaatggggcctagccgc

SEQ ID NO: 337166 - DNA, 25 bp, Mus musculus
gtagagtgtaaattccccttttatg

SEQ ID NO: 337167 - DNA, 25 bp, Mus musculus
gtagagtgtgtgggaaagggccgat

SEQ ID NO: 337168 - DNA, 25 bp, Mus musculus
gtagatactattgttgcaatcatgg

SEQ ID NO: 337169 - DNA, 25 bp, Mus musculus
gtagatcagatccgtgccatcgctg

SEQ ID NO: 337170 - DNA, 25 bp, Mus musculus
gtagatgaagtgccagaaccagctc

SEQ ID NO: 337171 - DNA, 25 bp, Mus musculus
gtagatgatgcaagggttctggaat

SEQ ID NO: 337172 - DNA, 25 bp, Mus musculus
gtagatgcaggagatcccccaagag

SEQ ID NO: 337173 - DNA, 25 bp, Mus musculus
gtagatggagaatggtaccgcgccc

SEQ ID NO: 337174 - DNA, 25 bp, Mus musculus
gtagatgttgtgaggctggtggagg

SEQ ID NO: 337175 - DNA, 25 bp, Mus musculus
gtagattacgctcacaacaactacc

SEQ ID NO: 337176 - DNA, 25 bp, Mus musculus
gtagattctggtggctttgatgaac

SEQ ID NO: 337177 - DNA, 25 bp, Mus musculus
gtagattctggtggtggacttctca

SEQ ID NO: 337178 - DNA, 25 bp, Mus musculus
gtagattctggtttacaatctagta

SEQ ID NO: 337179 - DNA, 25 bp, Mus musculus
gtagattgccagagctccacgcagg

SEQ ID NO: 337180 - DNA, 25 bp, Mus musculus
gtagatttagatgccagcacctgga

SEQ ID NO: 337181 - DNA, 25 bp, Mus musculus
gtagcaaattcccaggtgaagcctt

SEQ ID NO: 337182 - DNA, 25 bp, Mus musculus
gtagcaacaaaacgctgccgtccag

SEQ ID NO: 337183 - DNA, 25 bp, Mus musculus
gtagcaacaaagagcagcggtcagc

SEQ ID NO: 337184 - DNA, 25 bp, Mus musculus
gtagcaacaagctgcgcaaaccatg

SEQ ID NO: 337185 - DNA, 25 bp, Mus musculus
gtagcaacagaggaacatgtgtatg

SEQ ID NO: 337186 - DNA, 25 bp, Mus musculus
gtagcaagcccgtcctggacaatac

SEQ ID NO: 337187 - DNA, 25 bp, Mus musculus
gtagcacaaacagaggcaaatattg

SEQ ID NO: 337188 - DNA, 25 bp, Mus musculus
gtagcaccccaggtgttgactgtct

SEQ ID NO: 337189 - DNA, 25 bp, Mus musculus
gtagcaccccagttcttgcaggtgt

SEQ ID NO: 337190 - DNA, 25 bp, Mus musculus
gtagcacctgagggatatgatgctg

SEQ ID NO: 337191 - DNA, 25 bp, Mus musculus
gtagcacctgagttctcactcaaca

SEQ ID NO: 337192 - DNA, 25 bp, Mus musculus
gtagcagaagcagatataatttcta

SEQ ID NO: 337193 - DNA, 25 bp, Mus musculus
gtagcagaagggttcactgcagtcc

SEQ ID NO: 337194 - DNA, 25 bp, Mus musculus
gtagcagacagattgatgacattgc

SEQ ID NO: 337195 - DNA, 25 bp, Mus musculus
gtagcagagcagagagatcaataag

SEQ ID NO: 337196 - DNA, 25 bp, Mus musculus
gtagcagagcaggggaagcactgca

SEQ ID NO: 337197 - DNA, 25 bp, Mus musculus
gtagcagatcagatgtggcaggcag

SEQ ID NO: 337198 - DNA, 25 bp, Mus musculus
gtagcagatcaggctcctggagtcc

SEQ ID NO: 337199 - DNA, 25 bp, Mus musculus
gtagcagcccatacaatcctcctga

SEQ ID NO: 337200 - DNA, 25 bp, Mus musculus
gtagcaggcagcaaagaagaatgga

SEQ ID NO: 337201 - DNA, 25 bp, Mus musculus
gtagcagtaatacgaaagccgcaaa

SEQ ID NO: 337202 - DNA, 25 bp, Mus musculus
gtagcagtaataggaaagccgcaaa

SEQ ID NO: 337203 - DNA, 25 bp, Mus musculus
gtagcagtggcgaggccatggtggc

SEQ ID NO: 337204 - DNA, 25 bp, Mus musculus
gtagcagttccagtcagctgcgggc

SEQ ID NO: 337205 - DNA, 25 bp, Mus musculus
gtagcagttcgcagaacagaaactg

SEQ ID NO: 337206 - DNA, 25 bp, Mus musculus
gtagcatctgttgaattgtggaaca

SEQ ID NO: 337207 - DNA, 25 bp, Mus musculus
gtagcatctgttgacttgactgaaa

SEQ ID NO: 337208 - DNA, 25 bp, Mus musculus
gtagcatctgttgggccagagggca

SEQ ID NO: 337209 - DNA, 25 bp, Mus musculus
gtagccaaaaccctgaggccacaag

SEQ ID NO: 337210 - DNA, 25 bp, Mus musculus
gtagccaaaaccctgctatcttcca

SEQ ID NO: 337211 - DNA, 25 bp, Mus musculus
gtagccaacatcaaagtgtgctccc

SEQ ID NO: 337212 - DNA, 25 bp, Mus musculus
gtagccaacatcaatgtgtgctccc

SEQ ID NO: 337213 - DNA, 25 bp, Mus musculus
gtagccaatgatcatgaagaagatt

SEQ ID NO: 337214 - DNA, 25 bp, Mus musculus
gtagccaatgatttatctgttttct

SEQ ID NO: 337215 - DNA, 25 bp, Mus musculus
gtagccaattacagaatctgggagc

SEQ ID NO: 337216 - DNA, 25 bp, Mus musculus
gtagccaattctcccacacagatct

SEQ ID NO: 337217 - DNA, 25 bp, Mus musculus
gtagccaccttcggcactgcagtaa

SEQ ID NO: 337218 - DNA, 25 bp, Mus musculus
gtagccagctgctgagaacccaata

SEQ ID NO: 337219 - DNA, 25 bp, Mus musculus
gtagccatgatggttactaactttc

SEQ ID NO: 337220 - DNA, 25 bp, Mus musculus
gtagcccaattccaagagatatgtc

SEQ ID NO: 337221 - DNA, 25 bp, Mus musculus
gtagccccagaacccatgtgagtag

SEQ ID NO: 337222 - DNA, 25 bp, Mus musculus
gtagccccagaggccttcggacagt

SEQ ID NO: 337223 - DNA, 25 bp, Mus musculus
gtagccccagataaggaatatcttc

SEQ ID NO: 337224 - DNA, 25 bp, Mus musculus
gtagccccagctgagaaaaaacgca

SEQ ID NO: 337225 - DNA, 25 bp, Mus musculus
gtagccctagatcctttacaagcga

SEQ ID NO: 337226 - DNA, 25 bp, Mus musculus
gtagccgaagcgatctgctaatgcc

SEQ ID NO: 337227 - DNA, 25 bp, Mus musculus
gtagccggagcgatctttgggttcc

SEQ ID NO: 337228 - DNA, 25 bp, Mus musculus
gtagcctacagatgaaaaacgactg

SEQ ID NO: 337229 - DNA, 25 bp, Mus musculus
gtagcctacaggtggcggaggacga

SEQ ID NO: 337230 - DNA, 25 bp, Mus musculus
gtagcctcagagatgctggagtgtc

SEQ ID NO: 337231 - DNA, 25 bp, Mus musculus
gtagcctcaggatgcctggtgtgca

SEQ ID NO: 337232 - DNA, 25 bp, Mus musculus
gtagcctccggctatgcatatggag

SEQ ID NO: 337233 - DNA, 25 bp, Mus musculus
gtagcctcggattccagaggggtga

SEQ ID NO: 337234 - DNA, 25 bp, Mus musculus
gtagcctctgaggaaagatataaaa

SEQ ID NO: 337235 - DNA, 25 bp, Mus musculus
gtagcctctgagggaactacatgaa

SEQ ID NO: 337236 - DNA, 25 bp, Mus musculus
gtagcctggaaggagctttggttaa

SEQ ID NO: 337237 - DNA, 25 bp, Mus musculus
gtagcctggaagggcatactttgag

SEQ ID NO: 337238 - DNA, 25 bp, Mus musculus
gtagcctggatgttgccaaggcacc

SEQ ID NO: 337239 - DNA, 25 bp, Mus musculus
gtagcctggggagaggccgacccgt

SEQ ID NO: 337240 - DNA, 25 bp, Mus musculus
gtagcctggggcaggtcacctagca

SEQ ID NO: 337241 - DNA, 25 bp, Mus musculus
gtagcctttgagaggaacaaatgtg

SEQ ID NO: 337242 - DNA, 25 bp, Mus musculus
gtagcgaaagaaggtaaaatttatg

SEQ ID NO: 337243 - DNA, 25 bp, Mus musculus
gtagcgctgcccgggatctccatct

SEQ ID NO: 337244 - DNA, 25 bp, Mus musculus
gtagcggaaagctgagcagcaagtc

SEQ ID NO: 337245 - DNA, 25 bp, Mus musculus
gtagcggcagccaggacatagtcac

SEQ ID NO: 337246 - DNA, 25 bp, Mus musculus
gtagcggcagccagggaacatctca

SEQ ID NO: 337247 - DNA, 25 bp, Mus musculus
gtagcggcagccaggtgcagggcag

SEQ ID NO: 337248 - DNA, 25 bp, Mus musculus
gtagcggcagccaggtgggatgcta

SEQ ID NO: 337249 - DNA, 25 bp, Mus musculus
gtagcggcggccccggagaagatgg

SEQ ID NO: 337250 - DNA, 25 bp, Mus musculus
gtagcgtgaaggttcttcatgagaa

SEQ ID NO: 337251 - DNA, 25 bp, Mus musculus
gtagcgttggggagtatccgcctcc

SEQ ID NO: 337252 - DNA, 25 bp, Mus musculus
gtagctaaaacattctcatacaaga

SEQ ID NO: 337253 - DNA, 25 bp, Mus musculus
gtagctatgaaggagatgaagagga

SEQ ID NO: 337254 - DNA, 25 bp, Mus musculus
gtagctcagcagacaagaaaaatct

SEQ ID NO: 337255 - DNA, 25 bp, Mus musculus
gtagctcccacctgcaccttatagc

SEQ ID NO: 337256 - DNA, 25 bp, Mus musculus
gtagctcccacctggttttctctgt

SEQ ID NO: 337257 - DNA, 25 bp, Mus musculus
gtagctccttgaaagacctgcctgg

SEQ ID NO: 337258 - DNA, 25 bp, Mus musculus
gtagctgaagctgaacctgagccag

SEQ ID NO: 337259 - DNA, 25 bp, Mus musculus
gtagctgagagtaagatttatgaca

SEQ ID NO: 337260 - DNA, 25 bp, Mus musculus
gtagctgaggagctcttccaggaat

SEQ ID NO: 337261 - DNA, 25 bp, Mus musculus
gtagctgctgctaactgtgtggttt

SEQ ID NO: 337262 - DNA, 25 bp, Mus musculus
gtagctggaagagtatctgtgggag

SEQ ID NO: 337263 - DNA, 25 bp, Mus musculus
gtagctggaatgttacagaattttg

SEQ ID NO: 337264 - DNA, 25 bp, Mus musculus
gtagcttaatagttgaaccaagact

SEQ ID NO: 337265 - DNA, 25 bp, Mus musculus
gtagcttcaggtgacctcactgacc

SEQ ID NO: 337266 - DNA, 25 bp, Mus musculus
gtagcttcataatcctcagcccatg

SEQ ID NO: 337267 - DNA, 25 bp, Mus musculus
gtagcttcatgctctctatctccgc

SEQ ID NO: 337268 - DNA, 25 bp, Mus musculus
gtagcttccaggtggtggtcctcac

SEQ ID NO: 337269 - DNA, 25 bp, Mus musculus
gtagctttgaagaatgaagaggaat

SEQ ID NO: 337270 - DNA, 25 bp, Mus musculus
gtagctttggctcttttacagacct

SEQ ID NO: 337271 - DNA, 25 bp, Mus musculus
gtagcttttccaacgccgagatgac

SEQ ID NO: 337272 - DNA, 25 bp, Mus musculus
gtaggaactgcaggacagtaatgat

SEQ ID NO: 337273 - DNA, 25 bp, Mus musculus
gtaggaagaagccattgctcctgtg

SEQ ID NO: 337274 - DNA, 25 bp, Mus musculus
gtaggaagaagtccctctcgtgacc

SEQ ID NO: 337275 - DNA, 25 bp, Mus musculus
gtaggaagggtggtgctgatcggcg

SEQ ID NO: 337276 - DNA, 25 bp, Mus musculus
gtaggacaaaggtatggctttgtgg

SEQ ID NO: 337277 - DNA, 25 bp, Mus musculus
gtaggacagaaaggaagcagaggcc

SEQ ID NO: 337278 - DNA, 25 bp, Mus musculus
gtaggacttaggagtacagagactc

SEQ ID NO: 337279 - DNA, 25 bp, Mus musculus
gtaggactttgagctgaggctgcag

SEQ ID NO: 337280 - DNA, 25 bp, Mus musculus
gtaggagaacagggcgtggtaccca

SEQ ID NO: 337281 - DNA, 25 bp, Mus musculus
gtaggagaaggtccaacgggcgctc

SEQ ID NO: 337282 - DNA, 25 bp, Mus musculus
gtaggagacacaggtgacaaacttg

SEQ ID NO: 337283 - DNA, 25 bp, Mus musculus
gtaggagacacaggttttggctatg

SEQ ID NO: 337284 - DNA, 25 bp, Mus musculus
gtaggagctttgttttttgccatct

SEQ ID NO: 337285 - DNA, 25 bp, Mus musculus
gtaggagggcagaaggaagaaaacg

SEQ ID NO: 337286 - DNA, 25 bp, Mus musculus
gtaggaggggctgaggaaaggaaac

SEQ ID NO: 337287 - DNA, 25 bp, Mus musculus
gtaggatacaggtgccctagctgtg

SEQ ID NO: 337288 - DNA, 25 bp, Mus musculus
gtaggatcatggggtactcaatgca

SEQ ID NO: 337289 - DNA, 25 bp, Mus musculus
gtaggatcatgggttcctcggcctc

SEQ ID NO: 337290 - DNA, 25 bp, Mus musculus
gtaggatgcagggcattttcccgac

SEQ ID NO: 337291 - DNA, 25 bp, Mus musculus
gtaggatgcaggggtctcactgtgt

SEQ ID NO: 337292 - DNA, 25 bp, Mus musculus
gtaggatgtaggtgaattatacttc

SEQ ID NO: 337293 - DNA, 25 bp, Mus musculus
gtaggcaaaggtggaggaagagcta

SEQ ID NO: 337294 - DNA, 25 bp, Mus musculus
gtaggcacgtgtgggatctttctca

SEQ ID NO: 337295 - DNA, 25 bp, Mus musculus
gtaggcactgatattcgagactcac

SEQ ID NO: 337296 - DNA, 25 bp, Mus musculus
gtaggcatcgagggcttcttcggct

SEQ ID NO: 337297 - DNA, 25 bp, Mus musculus
gtaggcatgccgggtggctttgctg

SEQ ID NO: 337298 - DNA, 25 bp, Mus musculus
gtaggccctattggagaccctggga

SEQ ID NO: 337299 - DNA, 25 bp, Mus musculus
gtaggcctcaactataagtcttgct

SEQ ID NO: 337300 - DNA, 25 bp, Mus musculus
gtaggcctcgggacggcctcaggat

SEQ ID NO: 337301 - DNA, 25 bp, Mus musculus
gtaggcggatcaaccccccttaaga

SEQ ID NO: 337302 - DNA, 25 bp, Mus musculus
gtaggcggatcaagatcagtataac

SEQ ID NO: 337303 - DNA, 25 bp, Mus musculus
gtaggctaacgaggacgtctgcctg

SEQ ID NO: 337304 - DNA, 25 bp, Mus musculus
gtaggctaccggtgatggtgtggat

SEQ ID NO: 337305 - DNA, 25 bp, Mus musculus
gtaggctcagagtgcgatgcggtga

SEQ ID NO: 337306 - DNA, 25 bp, Mus musculus
gtaggctcagagttcgaggaagcca

SEQ ID NO: 337307 - DNA, 25 bp, Mus musculus
gtaggctccgaggtggcgaaatgga

SEQ ID NO: 337308 - DNA, 25 bp, Mus musculus
gtaggctgaagctcggaaacaagct

SEQ ID NO: 337309 - DNA, 25 bp, Mus musculus
gtagggaatgaaaggtgatgaagtc

SEQ ID NO: 337310 - DNA, 25 bp, Mus musculus
gtagggaccaaggaagctcgaagcg

SEQ ID NO: 337311 - DNA, 25 bp, Mus musculus
gtagggcagatctggtattcttttg

SEQ ID NO: 337312 - DNA, 25 bp, Mus musculus
gtaggggcgaggcacccaagcagtg

SEQ ID NO: 337313 - DNA, 25 bp, Mus musculus
gtagggggcaagcggttcagtacct

SEQ ID NO: 337314 - DNA, 25 bp, Mus musculus
gtaggggtaaagatctaagctggaa

SEQ ID NO: 337315 - DNA, 25 bp, Mus musculus
gtaggggtgggagatccgaattcga

SEQ ID NO: 337316 - DNA, 25 bp, Mus musculus
gtagggtggcggggccctccatgat

SEQ ID NO: 337317 - DNA, 25 bp, Mus musculus
gtaggtatcagggtggactcagtac

SEQ ID NO: 337318 - DNA, 25 bp, Mus musculus
gtaggtcccgtacccacatcacagc

SEQ ID NO: 337319 - DNA, 25 bp, Mus musculus
gtaggtccgccggtttcaacctctt

SEQ ID NO: 337320 - DNA, 25 bp, Mus musculus
gtaggtgccctgcgggcttcgaggg

SEQ ID NO: 337321 - DNA, 25 bp, Mus musculus
gtaggtgcgcccaggccaaacagtg

SEQ ID NO: 337322 - DNA, 25 bp, Mus musculus
gtaggtggaagtcttctatgagtgc

SEQ ID NO: 337323 - DNA, 25 bp, Mus musculus
gtaggtggagtattggcttccctta

SEQ ID NO: 337324 - DNA, 25 bp, Mus musculus
gtaggtgtggctatttcaatggaag

SEQ ID NO: 337325 - DNA, 25 bp, Mus musculus
gtaggttcccttgagacaccagaga

SEQ ID NO: 337326 - DNA, 25 bp, Mus musculus
gtaggtttgtagtgagcttagccta

SEQ ID NO: 337327 - DNA, 25 bp, Mus musculus
gtagtaaaatggaaggtgtcttgct

SEQ ID NO: 337328 - DNA, 25 bp, Mus musculus
gtagtaactcaaaaagcagccttta

SEQ ID NO: 337329 - DNA, 25 bp, Mus musculus
gtagtactagatgccaaatccgagt

SEQ ID NO: 337330 - DNA, 25 bp, Mus musculus
gtagtactagtgaggccacaggcag

SEQ ID NO: 337331 - DNA, 25 bp, Mus musculus
gtagtactagttgccaaatccgagt

SEQ ID NO: 337332 - DNA, 25 bp, Mus musculus
gtagtactcattctgaatctagtaa

SEQ ID NO: 337333 - DNA, 25 bp, Mus musculus
gtagtactcattcttcttttagctc

SEQ ID NO: 337334 - DNA, 25 bp, Mus musculus
gtagtatttaagaaaagtgagaggc

SEQ ID NO: 337335 - DNA, 25 bp, Mus musculus
gtagtcaaggccaacaaagtattat

SEQ ID NO: 337336 - DNA, 25 bp, Mus musculus
gtagtcaaggccaagaaagtattat

SEQ ID NO: 337337 - DNA, 25 bp, Mus musculus
gtagtcactgactgtatccaggtgg

SEQ ID NO: 337338 - DNA, 25 bp, Mus musculus
gtagtcagactcaagcaagacctgc

SEQ ID NO: 337339 - DNA, 25 bp, Mus musculus
gtagtcagtaagctgtggtgtacct

SEQ ID NO: 337340 - DNA, 25 bp, Mus musculus
gtagtccaacagagaatgaagcact

SEQ ID NO: 337341 - DNA, 25 bp, Mus musculus
gtagtccaagagattagaattttag

SEQ ID NO: 337342 - DNA, 25 bp, Mus musculus
gtagtccaagatgcctttgagtgtg

SEQ ID NO: 337343 - DNA, 25 bp, Mus musculus
gtagtccaagtgattagaattttag

SEQ ID NO: 337344 - DNA, 25 bp, Mus musculus
gtagtccaagttgcctttgagtgtg

SEQ ID NO: 337345 - DNA, 25 bp, Mus musculus
gtagtcccagcgagatggagttgct

SEQ ID NO: 337346 - DNA, 25 bp, Mus musculus
gtagtcctccatgatcgtcctgctt

SEQ ID NO: 337347 - DNA, 25 bp, Mus musculus
gtagtcgcagaactgcactggcgtc

SEQ ID NO: 337348 - DNA, 25 bp, Mus musculus
gtagtctctgcaagtggccctgccg

SEQ ID NO: 337349 - DNA, 25 bp, Mus musculus
gtagtctggggggtcagcagcctta

SEQ ID NO: 337350 - DNA, 25 bp, Mus musculus
gtagtctggtcagatagttttgaga

SEQ ID NO: 337351 - DNA, 25 bp, Mus musculus
gtagtctttcagatcctgcctcaga

SEQ ID NO: 337352 - DNA, 25 bp, Mus musculus
gtagtgaaaagctgcagcaataccc

SEQ ID NO: 337353 - DNA, 25 bp, Mus musculus
gtagtgaagctatgccattgtgcgg

SEQ ID NO: 337354 - DNA, 25 bp, Mus musculus
gtagtgaagctccttggcgagcaat

SEQ ID NO: 337355 - DNA, 25 bp, Mus musculus
gtagtgacaggacactactggacac

SEQ ID NO: 337356 - DNA, 25 bp, Mus musculus
gtagtgagacctgcgacaacaacgg

SEQ ID NO: 337357 - DNA, 25 bp, Mus musculus
gtagtgatcaggagaataatgtttt

SEQ ID NO: 337358 - DNA, 25 bp, Mus musculus
gtagtgattgtaagaatgaagatat

SEQ ID NO: 337359 - DNA, 25 bp, Mus musculus
gtagtgattgtaatctactttttta

SEQ ID NO: 337360 - DNA, 25 bp, Mus musculus
gtagtgcaaggtggagtgtcatctt

SEQ ID NO: 337361 - DNA, 25 bp, Mus musculus
gtagtgcatgagtttccagatccag

SEQ ID NO: 337362 - DNA, 25 bp, Mus musculus
gtagtgctgaagatgatcaaaaagc

SEQ ID NO: 337363 - DNA, 25 bp, Mus musculus
gtagtgctgaagatgtttccacagt

SEQ ID NO: 337364 - DNA, 25 bp, Mus musculus
gtagtggaagaagaatgactgtcac

SEQ ID NO: 337365 - DNA, 25 bp, Mus musculus
gtagtggaagagaaatcactgtcac

SEQ ID NO: 337366 - DNA, 25 bp, Mus musculus
gtagtggatcaggcactggcccagt

SEQ ID NO: 337367 - DNA, 25 bp, Mus musculus
gtagtggatcaggtactggcccttg

SEQ ID NO: 337368 - DNA, 25 bp, Mus musculus
gtagtggatccctgctgacaaggac

SEQ ID NO: 337369 - DNA, 25 bp, Mus musculus
gtagtggctctggcatgctgagccg

SEQ ID NO: 337370 - DNA, 25 bp, Mus musculus
gtagtgggaacgcagagcagtggga

SEQ ID NO: 337371 - DNA, 25 bp, Mus musculus
gtagtggtgctcaggcaagatgggc

SEQ ID NO: 337372 - DNA, 25 bp, Mus musculus
gtagtggtgctcagtggcagcatgg

SEQ ID NO: 337373 - DNA, 25 bp, Mus musculus
gtagtgtactgtgaccgtgatacac

SEQ ID NO: 337374 - DNA, 25 bp, Mus musculus
gtagtgttactcaggtaccagcgct

SEQ ID NO: 337375 - DNA, 25 bp, Mus musculus
gtagtgttccctgacgctgccggcg

SEQ ID NO: 337376 - DNA, 25 bp, Mus musculus
gtagtgttccctgggttctgcagct

SEQ ID NO: 337377 - DNA, 25 bp, Mus musculus
gtagttaaagagggctgtcctggct

SEQ ID NO: 337378 - DNA, 25 bp, Mus musculus
gtagttacagccaacggtaacgata

SEQ ID NO: 337379 - DNA, 25 bp, Mus musculus
gtagttacaggtcataaaaggatgg

SEQ ID NO: 337380 - DNA, 25 bp, Mus musculus
gtagttcagagtgtcaaaaccgctt

SEQ ID NO: 337381 - DNA, 25 bp, Mus musculus
gtagttctaaagtgtcatatttgaa

SEQ ID NO: 337382 - DNA, 25 bp, Mus musculus
gtagttctgtgcatctgggtggtct

SEQ ID NO: 337383 - DNA, 25 bp, Mus musculus
gtagttctttatttgagtgcagcag

SEQ ID NO: 337384 - DNA, 25 bp, Mus musculus
gtagttgatctggtgtgttatcgac

SEQ ID NO: 337385 - DNA, 25 bp, Mus musculus
gtagttgattgggaatttggcagct

SEQ ID NO: 337386 - DNA, 25 bp, Mus musculus
gtagtttagagccaggttcaatata

SEQ ID NO: 337387 - DNA, 25 bp, Mus musculus
gtagtttccttgcagatatactgct

SEQ ID NO: 337388 - DNA, 25 bp, Mus musculus
gtagtttccttgcaggtccattcac

SEQ ID NO: 337389 - DNA, 25 bp, Mus musculus
gtagtttgatgagtcttgattggag

SEQ ID NO: 337390 - DNA, 25 bp, Mus musculus
gtataaaaaacgcaataccacagat

SEQ ID NO: 337391 - DNA, 25 bp, Mus musculus
gtataaaacccatacaatttgttta

SEQ ID NO: 337392 - DNA, 25 bp, Mus musculus
gtataaaacccatccagaatgaaga

SEQ ID NO: 337393 - DNA, 25 bp, Mus musculus
gtataaaatgctatgtgctgagcca

SEQ ID NO: 337394 - DNA, 25 bp, Mus musculus
gtataaacactggaacttagcagga

SEQ ID NO: 337395 - DNA, 25 bp, Mus musculus
gtataaacactgtaaaggatctccc

SEQ ID NO: 337396 - DNA, 25 bp, Mus musculus
gtataaagacagggaggtggacatc

SEQ ID NO: 337397 - DNA, 25 bp, Mus musculus
gtataaagtaactctaaatcttcaa

SEQ ID NO: 337398 - DNA, 25 bp, Mus musculus
gtataaatactgaagtgtattcctt

SEQ ID NO: 337399 - DNA, 25 bp, Mus musculus
gtataaatgagtctgctattgatag

SEQ ID NO: 337400 - DNA, 25 bp, Mus musculus
gtataacaagactacaatgcttctc

SEQ ID NO: 337401 - DNA, 25 bp, Mus musculus
gtataacaaggattctcaaagctgg

SEQ ID NO: 337402 - DNA, 25 bp, Mus musculus
gtataacattcaaggaagccatcac

SEQ ID NO: 337403 - DNA, 25 bp, Mus musculus
gtataacattcaaggcccttctgaa

SEQ ID NO: 337404 - DNA, 25 bp, Mus musculus
gtataactcaaggctccagaatggg

SEQ ID NO: 337405 - DNA, 25 bp, Mus musculus
gtataagaaagaaagatggttgtcc

SEQ ID NO: 337406 - DNA, 25 bp, Mus musculus
gtataagacagatttcttctgcccg

SEQ ID NO: 337407 - DNA, 25 bp, Mus musculus
gtataagacagtaagcgtcaccctg

SEQ ID NO: 337408 - DNA, 25 bp, Mus musculus
gtataagactgtcatcaggaatttt

SEQ ID NO: 337409 - DNA, 25 bp, Mus musculus
gtataatcccaatgacagttctgcc

SEQ ID NO: 337410 - DNA, 25 bp, Mus musculus
gtataatgaaagcccagttcggaaa

SEQ ID NO: 337411 - DNA, 25 bp, Mus musculus
gtataatgagaaatgttgtcagaga

SEQ ID NO: 337412 - DNA, 25 bp, Mus musculus
gtataattcacagaactgggaagca

SEQ ID NO: 337413 - DNA, 25 bp, Mus musculus
gtatacaaaagcacaaaaggcaacc

SEQ ID NO: 337414 - DNA, 25 bp, Mus musculus
gtatacaaaaggatttactaggtca

SEQ ID NO: 337415 - DNA, 25 bp, Mus musculus
gtatacaaaagtcaggttttcagct

SEQ ID NO: 337416 - DNA, 25 bp, Mus musculus
gtatacaccaggcatccacatggtg

SEQ ID NO: 337417 - DNA, 25 bp, Mus musculus
gtatacagaggagcattccggctgg

SEQ ID NO: 337418 - DNA, 25 bp, Mus musculus
gtatacagatcagagaaaatatggc

SEQ ID NO: 337419 - DNA, 25 bp, Mus musculus
gtatacaggaggataccagatgttt

SEQ ID NO: 337420 - DNA, 25 bp, Mus musculus
gtatacaggagtacttatgtggtag

SEQ ID NO: 337421 - DNA, 25 bp, Mus musculus
gtataccaaggaggccaaattggga

SEQ ID NO: 337422 - DNA, 25 bp, Mus musculus
gtataccaaggagtttctatgattg

SEQ ID NO: 337423 - DNA, 25 bp, Mus musculus
gtataccagcacctgaggagaggtg

SEQ ID NO: 337424 - DNA, 25 bp, Mus musculus
gtataccaggaatttccacagtgcc

SEQ ID NO: 337425 - DNA, 25 bp, Mus musculus
gtatacccacacacaagtctggcca

SEQ ID NO: 337426 - DNA, 25 bp, Mus musculus
gtatacgacaaacctgaggtctgga

SEQ ID NO: 337427 - DNA, 25 bp, Mus musculus
gtatacgacacgggccggactggaa

SEQ ID NO: 337428 - DNA, 25 bp, Mus musculus
gtatacgacgacccgtctcgatact

SEQ ID NO: 337429 - DNA, 25 bp, Mus musculus
gtatacgacgactcgtccgtctcgg

SEQ ID NO: 337430 - DNA, 25 bp, Mus musculus
gtatacgacgatgttgagactgtgc

SEQ ID NO: 337431 - DNA, 25 bp, Mus musculus
gtatactcagccccagagcagctct

SEQ ID NO: 337432 - DNA, 25 bp, Mus musculus
gtatactcatcctgggtcactgaca

SEQ ID NO: 337433 - DNA, 25 bp, Mus musculus
gtatacttagacaaaagtcctcagt

SEQ ID NO: 337434 - DNA, 25 bp, Mus musculus
gtatactttgtgaagctctgaaaac

SEQ ID NO: 337435 - DNA, 25 bp, Mus musculus
gtatagaacctggcctcatctgtat

SEQ ID NO: 337436 - DNA, 25 bp, Mus musculus
gtatagacctgaagagtacagtcgc

SEQ ID NO: 337437 - DNA, 25 bp, Mus musculus
gtatagagaaaacgtgaaaaaggtc

SEQ ID NO: 337438 - DNA, 25 bp, Mus musculus
gtatagagacacagccagctcagga

SEQ ID NO: 337439 - DNA, 25 bp, Mus musculus
gtatagagacacagcctgagtgcat

SEQ ID NO: 337440 - DNA, 25 bp, Mus musculus
gtatagataaatagatatgttttct

SEQ ID NO: 337441 - DNA, 25 bp, Mus musculus
gtatagataaggtgaagaaactgct

SEQ ID NO: 337442 - DNA, 25 bp, Mus musculus
gtatagataagtgtcatatttgaag

SEQ ID NO: 337443 - DNA, 25 bp, Mus musculus
gtatagatgtaggcaaaagaaagaa

SEQ ID NO: 337444 - DNA, 25 bp, Mus musculus
gtatagatgttggcaaaagaaagaa

SEQ ID NO: 337445 - DNA, 25 bp, Mus musculus
gtatagcagagggctcctgctgaag

SEQ ID NO: 337446 - DNA, 25 bp, Mus musculus
gtatagccaggtcatccacaggttg

SEQ ID NO: 337447 - DNA, 25 bp, Mus musculus
gtatagccaggtggtgaccgttata

SEQ ID NO: 337448 - DNA, 25 bp, Mus musculus
gtatagctccccgaaagaaaagttt

SEQ ID NO: 337449 - DNA, 25 bp, Mus musculus
gtatataacacttgacatctcaata

SEQ ID NO: 337450 - DNA, 25 bp, Mus musculus
gtatataacacttgattctcattga

SEQ ID NO: 337451 - DNA, 25 bp, Mus musculus
gtatataagaagaccctatctaact

SEQ ID NO: 337452 - DNA, 25 bp, Mus musculus
gtatataagaaggcactaaccctat

SEQ ID NO: 337453 - DNA, 25 bp, Mus musculus
gtatatacaggaaaactcctcctta

SEQ ID NO: 337454 - DNA, 25 bp, Mus musculus
gtatatactcaaggtatcgcagggt

SEQ ID NO: 337455 - DNA, 25 bp, Mus musculus
gtatatattaggctatgtggtggtt

SEQ ID NO: 337456 - DNA, 25 bp, Mus musculus
gtatatcatgcatccatttttgttt

SEQ ID NO: 337457 - DNA, 25 bp, Mus musculus
gtatatccacagtcaagccctgctt

SEQ ID NO: 337458 - DNA, 25 bp, Mus musculus
gtatatctacaggtctgacaagaca

SEQ ID NO: 337459 - DNA, 25 bp, Mus musculus
gtatatctttaagcaacctcacttt

SEQ ID NO: 337460 - DNA, 25 bp, Mus musculus
gtatatgactcaattctacggtgag

SEQ ID NO: 337461 - DNA, 25 bp, Mus musculus
gtatatgatggagagggataaagtg

SEQ ID NO: 337462 - DNA, 25 bp, Mus musculus
gtatatgatgggcaggatagcatgt

SEQ ID NO: 337463 - DNA, 25 bp, Mus musculus
gtatatgatgggttttaaagatgcg

SEQ ID NO: 337464 - DNA, 25 bp, Mus musculus
gtatatgccagggggctctgtaaaa

SEQ ID NO: 337465 - DNA, 25 bp, Mus musculus
gtatattcagggtcacagcttccca

SEQ ID NO: 337466 - DNA, 25 bp, Mus musculus
gtatattcttggggaacttagcata

SEQ ID NO: 337467 - DNA, 25 bp, Mus musculus
gtatattcttggggttgaatctcca

SEQ ID NO: 337468 - DNA, 25 bp, Mus musculus
gtatattgcaggattcactagcaaa

SEQ ID NO: 337469 - DNA, 25 bp, Mus musculus
gtatcaaaatttctatgaggagaga

SEQ ID NO: 337470 - DNA, 25 bp, Mus musculus
gtatcaactgtgtaaggagaagctg

SEQ ID NO: 337471 - DNA, 25 bp, Mus musculus
gtatcaagagtcagacgaaggaaga

SEQ ID NO: 337472 - DNA, 25 bp, Mus musculus
gtatcaattcaggaggaaacagttg

SEQ ID NO: 337473 - DNA, 25 bp, Mus musculus
gtatcacaacaagattgaggaagac

SEQ ID NO: 337474 - DNA, 25 bp, Mus musculus
gtatcacaacaaggcccatctgctc

SEQ ID NO: 337475 - DNA, 25 bp, Mus musculus
gtatcacaccatagatgaccactgt

SEQ ID NO: 337476 - DNA, 25 bp, Mus musculus
gtatcaccgactcagacagagtctt

SEQ ID NO: 337477 - DNA, 25 bp, Mus musculus
gtatcaccgactcagctgactcaag

SEQ ID NO: 337478 - DNA, 25 bp, Mus musculus
gtatcaccgtccagatccccaccct

SEQ ID NO: 337479 - DNA, 25 bp, Mus musculus
gtatcaccgtccaggtctgggtggc

SEQ ID NO: 337480 - DNA, 25 bp, Mus musculus
gtatcacgtgcagcacctggccaca

SEQ ID NO: 337481 - DNA, 25 bp, Mus musculus
gtatcacgtgcagggtctttcaggt

SEQ ID NO: 337482 - DNA, 25 bp, Mus musculus
gtatcactgtggaatatcgttcaga

SEQ ID NO: 337483 - DNA, 25 bp, Mus musculus
gtatcactgtggcaatagtaattgt

SEQ ID NO: 337484 - DNA, 25 bp, Mus musculus
gtatcacttgatattaaactaacca

SEQ ID NO: 337485 - DNA, 25 bp, Mus musculus
gtatcacttgggtgagaatgcctgg

SEQ ID NO: 337486 - DNA, 25 bp, Mus musculus
gtatcagaagaagattggagcatat

SEQ ID NO: 337487 - DNA, 25 bp, Mus musculus
gtatcagaagaagattggagcctat

SEQ ID NO: 337488 - DNA, 25 bp, Mus musculus
gtatcagaagaagggtttcaaaaac

SEQ ID NO: 337489 - DNA, 25 bp, Mus musculus
gtatcagaagaaggtcaaagaaggc

SEQ ID NO: 337490 - DNA, 25 bp, Mus musculus
gtatcagaaggttggaggctgctgt

SEQ ID NO: 337491 - DNA, 25 bp, Mus musculus
gtatcagagagacaagattgaggat

SEQ ID NO: 337492 - DNA, 25 bp, Mus musculus
gtatcagaggacctcagaatacatt

SEQ ID NO: 337493 - DNA, 25 bp, Mus musculus
gtatcagatgcaggttgcgttacag

SEQ ID NO: 337494 - DNA, 25 bp, Mus musculus
gtatcagcaactgacaggggagcaa

SEQ ID NO: 337495 - DNA, 25 bp, Mus musculus
gtatcagcagtgtagtgattttgac

SEQ ID NO: 337496 - DNA, 25 bp, Mus musculus
gtatcagctgcgaatccctcgtggg

SEQ ID NO: 337497 - DNA, 25 bp, Mus musculus
gtatcatgggtataggtccagtccc

SEQ ID NO: 337498 - DNA, 25 bp, Mus musculus
gtatccaaaagaaatccagagagag

SEQ ID NO: 337499 - DNA, 25 bp, Mus musculus
gtatccaaaagcaaatttcgcagaa

SEQ ID NO: 337500 - DNA, 25 bp, Mus musculus
gtatccaaagcggctggagaaggaa

SEQ ID NO: 337501 - DNA, 25 bp, Mus musculus
gtatccaaaggagtgtgcagcaaac

SEQ ID NO: 337502 - DNA, 25 bp, Mus musculus
gtatccaaagttcaattttgtgggg

SEQ ID NO: 337503 - DNA, 25 bp, Mus musculus
gtatccacaacaggtgtgagcaggt

SEQ ID NO: 337504 - DNA, 25 bp, Mus musculus
gtatccacaacaggttccacccgac

SEQ ID NO: 337505 - DNA, 25 bp, Mus musculus
gtatccacatgggtctcctggaaga

SEQ ID NO: 337506 - DNA, 25 bp, Mus musculus
gtatccacgcctgaggtcctggtgt

SEQ ID NO: 337507 - DNA, 25 bp, Mus musculus
gtatccagagaaacatgactttggg

SEQ ID NO: 337508 - DNA, 25 bp, Mus musculus
gtatccagaggaagttgtcctggtc

SEQ ID NO: 337509 - DNA, 25 bp, Mus musculus
gtatccataggagttttaaagccag

SEQ ID NO: 337510 - DNA, 25 bp, Mus musculus
gtatccataggatttacatggatat

SEQ ID NO: 337511 - DNA, 25 bp, Mus musculus
gtatccatgcggctgtgtggagatg

SEQ ID NO: 337512 - DNA, 25 bp, Mus musculus
gtatccctcaagtgaccacacactg

SEQ ID NO: 337513 - DNA, 25 bp, Mus musculus
gtatccgcccaacaggcgctgtgag

SEQ ID NO: 337514 - DNA, 25 bp, Mus musculus
gtatccgcccaacatgccaccttac

SEQ ID NO: 337515 - DNA, 25 bp, Mus musculus
gtatcctcagttcatgttccatctg

SEQ ID NO: 337516 - DNA, 25 bp, Mus musculus
gtatcctgaaggaaagaccgtagag

SEQ ID NO: 337517 - DNA, 25 bp, Mus musculus
gtatcctgagagacaggcaataccg

SEQ ID NO: 337518 - DNA, 25 bp, Mus musculus
gtatcctggtgttgggtatgagatg

SEQ ID NO: 337519 - DNA, 25 bp, Mus musculus
gtatccttggggcactgcgtgacta

SEQ ID NO: 337520 - DNA, 25 bp, Mus musculus
gtatcgacaggtacaatcctgagaa

SEQ ID NO: 337521 - DNA, 25 bp, Mus musculus
gtatcgacaggtaccagttcaaccc

SEQ ID NO: 337522 - DNA, 25 bp, Mus musculus
gtatcgacagttctgtaagcatcag

SEQ ID NO: 337523 - DNA, 25 bp, Mus musculus
gtatcgccccctggcaggtgatgct

SEQ ID NO: 337524 - DNA, 25 bp, Mus musculus
gtatcggaagcttgtgtcggcagtt

SEQ ID NO: 337525 - DNA, 25 bp, Mus musculus
gtatcggattcacaaataaagtggt

SEQ ID NO: 337526 - DNA, 25 bp, Mus musculus
gtatcgggcttcagggggctgaggc

SEQ ID NO: 337527 - DNA, 25 bp, Mus musculus
gtatcgtgggtggagctgaagaaag

SEQ ID NO: 337528 - DNA, 25 bp, Mus musculus
gtatctaagagtgcttggctgtctg

SEQ ID NO: 337529 - DNA, 25 bp, Mus musculus
gtatctaatatcagcgctcatgctc

SEQ ID NO: 337530 - DNA, 25 bp, Mus musculus
gtatctacggcagaaaggggagtgt

SEQ ID NO: 337531 - DNA, 25 bp, Mus musculus
gtatctacggcagtacatttttata

SEQ ID NO: 337532 - DNA, 25 bp, Mus musculus
gtatctacgggcaggctcccggacc

SEQ ID NO: 337533 - DNA, 25 bp, Mus musculus
gtatctatgcagggtgacaagggag

SEQ ID NO: 337534 - DNA, 25 bp, Mus musculus
gtatctcaacagcaagctgcctagt

SEQ ID NO: 337535 - DNA, 25 bp, Mus musculus
gtatctcaccattgttataataaag

SEQ ID NO: 337536 - DNA, 25 bp, Mus musculus
gtatctcactgaaagatttgtatac

SEQ ID NO: 337537 - DNA, 25 bp, Mus musculus
gtatctcagccatgatggtaacaaa

SEQ ID NO: 337538 - DNA, 25 bp, Mus musculus
gtatctcagtggaggagaactattt

SEQ ID NO: 337539 - DNA, 25 bp, Mus musculus
gtatctccaaaccccattcaacctc

SEQ ID NO: 337540 - DNA, 25 bp, Mus musculus
gtatctccaaacccctgagggagag

SEQ ID NO: 337541 - DNA, 25 bp, Mus musculus
gtatctcctcgacgggtcctgcatg

SEQ ID NO: 337542 - DNA, 25 bp, Mus musculus
gtatctcctcgctcttcgaacggac

SEQ ID NO: 337543 - DNA, 25 bp, Mus musculus
gtatctctctctgtggaggtgaagc

SEQ ID NO: 337544 - DNA, 25 bp, Mus musculus
gtatctctgaagcactgcgcaagat

SEQ ID NO: 337545 - DNA, 25 bp, Mus musculus
gtatctctttcaggtagagcttgag

SEQ ID NO: 337546 - DNA, 25 bp, Mus musculus
gtatctctttcagtatcctgtgcgt

SEQ ID NO: 337547 - DNA, 25 bp, Mus musculus
gtatctgaagacgctcatgatccgt

SEQ ID NO: 337548 - DNA, 25 bp, Mus musculus
gtatctgcctaccaggtgcagagcc

SEQ ID NO: 337549 - DNA, 25 bp, Mus musculus
gtatctgcctaccaggtggcaaagg

SEQ ID NO: 337550 - DNA, 25 bp, Mus musculus
gtatctgctgcccctcctgggccct

SEQ ID NO: 337551 - DNA, 25 bp, Mus musculus
gtatctggaggagctggaccagatc

SEQ ID NO: 337552 - DNA, 25 bp, Mus musculus
gtatctggggattctacagcacagg

SEQ ID NO: 337553 - DNA, 25 bp, Mus musculus
gtatctggtgctctaccttagcaga

SEQ ID NO: 337554 - DNA, 25 bp, Mus musculus
gtatctggtgctctaccttcaggcc

SEQ ID NO: 337555 - DNA, 25 bp, Mus musculus
gtatctgtctgcaggtgttatttcc

SEQ ID NO: 337556 - DNA, 25 bp, Mus musculus
gtatctgtgaagcttcttaacccca

SEQ ID NO: 337557 - DNA, 25 bp, Mus musculus
gtatcttcagtcaagacctttggag

SEQ ID NO: 337558 - DNA, 25 bp, Mus musculus
gtatcttctacatggtgccatcagc

SEQ ID NO: 337559 - DNA, 25 bp, Mus musculus
gtatcttctgggcggaacgaagagc

SEQ ID NO: 337560 - DNA, 25 bp, Mus musculus
gtatcttgagttgaactacagggaa

SEQ ID NO: 337561 - DNA, 25 bp, Mus musculus
gtatcttgatcccacctaaaccaac

SEQ ID NO: 337562 - DNA, 25 bp, Mus musculus
gtatcttgatgtcagcccatcacag

SEQ ID NO: 337563 - DNA, 25 bp, Mus musculus
gtatctttaccttctacttccagaa

SEQ ID NO: 337564 - DNA, 25 bp, Mus musculus
gtatctttccaagagctggagaagc

SEQ ID NO: 337565 - DNA, 25 bp, Mus musculus
gtatgaaaaccgacctatgtcacct

SEQ ID NO: 337566 - DNA, 25 bp, Mus musculus
gtatgaaaaccgacttccagattac

SEQ ID NO: 337567 - DNA, 25 bp, Mus musculus
gtatgaaaatagattagcattcttg

SEQ ID NO: 337568 - DNA, 25 bp, Mus musculus
gtatgaaacctgggactttactgga

SEQ ID NO: 337569 - DNA, 25 bp, Mus musculus
gtatgaaagcaaggccagaagtcaa

SEQ ID NO: 337570 - DNA, 25 bp, Mus musculus
gtatgaaagtacagggttgtttcaa

SEQ ID NO: 337571 - DNA, 25 bp, Mus musculus
gtatgaaatcagccacaccttcaac

SEQ ID NO: 337572 - DNA, 25 bp, Mus musculus
gtatgaacaggcctgtcgtgagttc

SEQ ID NO: 337573 - DNA, 25 bp, Mus musculus
gtatgaacatttaagagtgaatgcc

SEQ ID NO: 337574 - DNA, 25 bp, Mus musculus
gtatgaacatttaaggcaattctgc

SEQ ID NO: 337575 - DNA, 25 bp, Mus musculus
gtatgaagaggtggcccgtaagctg

SEQ ID NO: 337576 - DNA, 25 bp, Mus musculus
gtatgaagaggtggctcgtaagttg

SEQ ID NO: 337577 - DNA, 25 bp, Mus musculus
gtatgaagttttcaggggctctctg

SEQ ID NO: 337578 - DNA, 25 bp, Mus musculus
gtatgaattggagctactgctttct

SEQ ID NO: 337579 - DNA, 25 bp, Mus musculus
gtatgacatccagtcaccagatttc

SEQ ID NO: 337580 - DNA, 25 bp, Mus musculus
gtatgaccagaattatcccatccat

SEQ ID NO: 337581 - DNA, 25 bp, Mus musculus
gtatgaccaggtcacaatcattacc

SEQ ID NO: 337582 - DNA, 25 bp, Mus musculus
gtatgacctcaagggctctctagtg

SEQ ID NO: 337583 - DNA, 25 bp, Mus musculus
gtatgacctggacaagatcatagaa

SEQ ID NO: 337584 - DNA, 25 bp, Mus musculus
gtatgacgaggagacccgcatcctc

SEQ ID NO: 337585 - DNA, 25 bp, Mus musculus
gtatgacgccagctgtgactccagt

SEQ ID NO: 337586 - DNA, 25 bp, Mus musculus
gtatgacgttgctgatcactggaga

SEQ ID NO: 337587 - DNA, 25 bp, Mus musculus
gtatgactcagactggttgatcccc

SEQ ID NO: 337588 - DNA, 25 bp, Mus musculus
gtatgagaagctgaagcagtcgcag

SEQ ID NO: 337589 - DNA, 25 bp, Mus musculus
gtatgagaaggatgttgctgactat

SEQ ID NO: 337590 - DNA, 25 bp, Mus musculus
gtatgagagggagcttcgttacgac

SEQ ID NO: 337591 - DNA, 25 bp, Mus musculus
gtatgagagggaggtctgggacatg

SEQ ID NO: 337592 - DNA, 25 bp, Mus musculus
gtatgagatggaagctgccactgac

SEQ ID NO: 337593 - DNA, 25 bp, Mus musculus
gtatgagatgggggaatgcacccga

SEQ ID NO: 337594 - DNA, 25 bp, Mus musculus
gtatgagatggggtcacctccaagg

SEQ ID NO: 337595 - DNA, 25 bp, Mus musculus
gtatgagcaagatccagtatgtacc

SEQ ID NO: 337596 - DNA, 25 bp, Mus musculus
gtatgagctggatagagagatgaat

SEQ ID NO: 337597 - DNA, 25 bp, Mus musculus
gtatgaggcagccatctccattcta

SEQ ID NO: 337598 - DNA, 25 bp, Mus musculus
gtatgaggcagggctcattttcact

SEQ ID NO: 337599 - DNA, 25 bp, Mus musculus
gtatgagtctcttcagcgtcaagaa

SEQ ID NO: 337600 - DNA, 25 bp, Mus musculus
gtatgatacatccaggtgcatggag

SEQ ID NO: 337601 - DNA, 25 bp, Mus musculus
gtatgatccacaggccctttggaga

SEQ ID NO: 337602 - DNA, 25 bp, Mus musculus
gtatgatgacatcgactatggcaaa

SEQ ID NO: 337603 - DNA, 25 bp, Mus musculus
gtatgatgacgagctaaccttcttt

SEQ ID NO: 337604 - DNA, 25 bp, Mus musculus
gtatgatgacgagctctcttctctt

SEQ ID NO: 337605 - DNA, 25 bp, Mus musculus
gtatgatgaggagacccgcatcctc

SEQ ID NO: 337606 - DNA, 25 bp, Mus musculus
gtatgatgcccaggacttagaagag

SEQ ID NO: 337607 - DNA, 25 bp, Mus musculus
gtatgatgcccagtcttaccatgag

SEQ ID NO: 337608 - DNA, 25 bp, Mus musculus
gtatgatttgaggacccagttccgc

SEQ ID NO: 337609 - DNA, 25 bp, Mus musculus
gtatgcacacagtggatgaagaaga

SEQ ID NO: 337610 - DNA, 25 bp, Mus musculus
gtatgcacacagtggtaccgttttg

SEQ ID NO: 337611 - DNA, 25 bp, Mus musculus
gtatgcacagggtatccagaagttg

SEQ ID NO: 337612 - DNA, 25 bp, Mus musculus
gtatgcactcctcccagcagttatg

SEQ ID NO: 337613 - DNA, 25 bp, Mus musculus
gtatgcactcctggatatccggcgc

SEQ ID NO: 337614 - DNA, 25 bp, Mus musculus
gtatgcagaggttaaggagctccga

SEQ ID NO: 337615 - DNA, 25 bp, Mus musculus
gtatgcatgcggtctcccactgctc

SEQ ID NO: 337616 - DNA, 25 bp, Mus musculus
gtatgcatgcggtgtgagcatctat

SEQ ID NO: 337617 - DNA, 25 bp, Mus musculus
gtatgccaaacagcagttattcaaa

SEQ ID NO: 337618 - DNA, 25 bp, Mus musculus
gtatgccaagagcaagaaagtatga

SEQ ID NO: 337619 - DNA, 25 bp, Mus musculus
gtatgccaagaggaataaaaggaaa

SEQ ID NO: 337620 - DNA, 25 bp, Mus musculus
gtatgccacatcctgtgccaataac

SEQ ID NO: 337621 - DNA, 25 bp, Mus musculus
gtatgccagcatgtctgattgcctc

SEQ ID NO: 337622 - DNA, 25 bp, Mus musculus
gtatgcctttccattggacaccccc

SEQ ID NO: 337623 - DNA, 25 bp, Mus musculus
gtatgcgcaaggcttcattctcatt

SEQ ID NO: 337624 - DNA, 25 bp, Mus musculus
gtatgctaagttctttgaaaccatc

SEQ ID NO: 337625 - DNA, 25 bp, Mus musculus
gtatgctacaaaggaaagaattgaa

SEQ ID NO: 337626 - DNA, 25 bp, Mus musculus
gtatgctcgggagcatggcttggac

SEQ ID NO: 337627 - DNA, 25 bp, Mus musculus
gtatgctgagctgacacttatgcct

SEQ ID NO: 337628 - DNA, 25 bp, Mus musculus
gtatgctgagctgctggaagagcat

SEQ ID NO: 337629 - DNA, 25 bp, Mus musculus
gtatgctgggtgaacttcgaggcct

SEQ ID NO: 337630 - DNA, 25 bp, Mus musculus
gtatgctgtagtagtgactctcttt

SEQ ID NO: 337631 - DNA, 25 bp, Mus musculus
gtatggaaagatggcctctgcacaa

SEQ ID NO: 337632 - DNA, 25 bp, Mus musculus
gtatggaaatagtttcttggatctg

SEQ ID NO: 337633 - DNA, 25 bp, Mus musculus
gtatggaaatgtcctaccctaggca

SEQ ID NO: 337634 - DNA, 25 bp, Mus musculus
gtatggaagagttactttggagtac

SEQ ID NO: 337635 - DNA, 25 bp, Mus musculus
gtatggaagatctctgcgatatgac

SEQ ID NO: 337636 - DNA, 25 bp, Mus musculus
gtatggaagtggcttggctgagtag

SEQ ID NO: 337637 - DNA, 25 bp, Mus musculus
gtatggaagtgtttgccgaagatgc

SEQ ID NO: 337638 - DNA, 25 bp, Mus musculus
gtatggaagttcccagaaatcctgg

SEQ ID NO: 337639 - DNA, 25 bp, Mus musculus
gtatggaattcttcctttgcagctc

SEQ ID NO: 337640 - DNA, 25 bp, Mus musculus
gtatggaccgatgggtcccacccaa

SEQ ID NO: 337641 - DNA, 25 bp, Mus musculus
gtatggaccggtgtgttcctctttc

SEQ ID NO: 337642 - DNA, 25 bp, Mus musculus
gtatggagaacaggtgagtgaaatc

SEQ ID NO: 337643 - DNA, 25 bp, Mus musculus
gtatggagagcatcgagattgacca

SEQ ID NO: 337644 - DNA, 25 bp, Mus musculus
gtatggagaggtgtcatcaataaac

SEQ ID NO: 337645 - DNA, 25 bp, Mus musculus
gtatggaggagaaaccaaggtatat

SEQ ID NO: 337646 - DNA, 25 bp, Mus musculus
gtatggatgggtacctggaatggaa

SEQ ID NO: 337647 - DNA, 25 bp, Mus musculus
gtatggcaaggatttaattaaagat

SEQ ID NO: 337648 - DNA, 25 bp, Mus musculus
gtatggcaaggctggccttctaagc

SEQ ID NO: 337649 - DNA, 25 bp, Mus musculus
gtatggcaatggcagaaagaactca

SEQ ID NO: 337650 - DNA, 25 bp, Mus musculus
gtatggcaatggcagtgagcaccac

SEQ ID NO: 337651 - DNA, 25 bp, Mus musculus
gtatggcacacagaaaggggagtgt

SEQ ID NO: 337652 - DNA, 25 bp, Mus musculus
gtatggcacgaatgaggaagagtgg

SEQ ID NO: 337653 - DNA, 25 bp, Mus musculus
gtatggcatcacgggagacaatgtc

SEQ ID NO: 337654 - DNA, 25 bp, Mus musculus
gtatggccagccctgctctcggaga

SEQ ID NO: 337655 - DNA, 25 bp, Mus musculus
gtatggcgagatagaccatgccttc

SEQ ID NO: 337656 - DNA, 25 bp, Mus musculus
gtatggcgagattttcagtttagat

SEQ ID NO: 337657 - DNA, 25 bp, Mus musculus
gtatggctactatactctgtattct

SEQ ID NO: 337658 - DNA, 25 bp, Mus musculus
gtatggctgcaaaaaagcactggaa

SEQ ID NO: 337659 - DNA, 25 bp, Mus musculus
gtatggctgcaaacactcagagtga

SEQ ID NO: 337660 - DNA, 25 bp, Mus musculus
gtatggctgcaaagttgcagatatc

SEQ ID NO: 337661 - DNA, 25 bp, Mus musculus
gtatggctttttatttagaagaaag

SEQ ID NO: 337662 - DNA, 25 bp, Mus musculus
gtatgggattccaggagaaccacaa

SEQ ID NO: 337663 - DNA, 25 bp, Mus musculus
gtatgggcgggctgacgcttcccaa

SEQ ID NO: 337664 - DNA, 25 bp, Mus musculus
gtatgggcgggctgctgagaagacg

SEQ ID NO: 337665 - DNA, 25 bp, Mus musculus
gtatgggcgggctggtatgcgtctt

SEQ ID NO: 337666 - DNA, 25 bp, Mus musculus
gtatgggcgggtaatctatgccagc

SEQ ID NO: 337667 - DNA, 25 bp, Mus musculus
gtatgggctgaagagatttgaaagt

SEQ ID NO: 337668 - DNA, 25 bp, Mus musculus
gtatgggggcaggtggctttgtggc

SEQ ID NO: 337669 - DNA, 25 bp, Mus musculus
gtatggtctcgagatgaagatatca

SEQ ID NO: 337670 - DNA, 25 bp, Mus musculus
gtatggtctcgagcagcagtgaagg

SEQ ID NO: 337671 - DNA, 25 bp, Mus musculus
gtatggtgccgtgttctcgaaaagg

SEQ ID NO: 337672 - DNA, 25 bp, Mus musculus
gtatgtaccccaactgtgccatcct

SEQ ID NO: 337673 - DNA, 25 bp, Mus musculus
gtatgtatacaggtttgttaactga

SEQ ID NO: 337674 - DNA, 25 bp, Mus musculus
gtatgtatacgacaccacggcgacg

SEQ ID NO: 337675 - DNA, 25 bp, Mus musculus
gtatgtatacgatccccccacaact

SEQ ID NO: 337676 - DNA, 25 bp, Mus musculus
gtatgtatacgcaccaccaccacca

SEQ ID NO: 337677 - DNA, 25 bp, Mus musculus
gtatgtattacagagtgatggcgtg

SEQ ID NO: 337678 - DNA, 25 bp, Mus musculus
gtatgtattggatatgatggttacc

SEQ ID NO: 337679 - DNA, 25 bp, Mus musculus
gtatgtcagcagatcaacttctgag

SEQ ID NO: 337680 - DNA, 25 bp, Mus musculus
gtatgtcatcctcagacaacattgt

SEQ ID NO: 337681 - DNA, 25 bp, Mus musculus
gtatgtcatcctcagctgggagggc

SEQ ID NO: 337682 - DNA, 25 bp, Mus musculus
gtatgtcatcctcaggcacaccaag

SEQ ID NO: 337683 - DNA, 25 bp, Mus musculus
gtatgtcatcctcaggcagtgccct

SEQ ID NO: 337684 - DNA, 25 bp, Mus musculus
gtatgtctcaggctgaatttgacaa

SEQ ID NO: 337685 - DNA, 25 bp, Mus musculus
gtatgtcttggtggtcactaactgc

SEQ ID NO: 337686 - DNA, 25 bp, Mus musculus
gtatgtgaagagctggttttggggt

SEQ ID NO: 337687 - DNA, 25 bp, Mus musculus
gtatgtgaagaggtttgttgtctca

SEQ ID NO: 337688 - DNA, 25 bp, Mus musculus
gtatgtgaatacatacacaaaggca

SEQ ID NO: 337689 - DNA, 25 bp, Mus musculus
gtatgtgcaccaggttggcagagtt

SEQ ID NO: 337690 - DNA, 25 bp, Mus musculus
gtatgtggagaacgttgacaaacaa

SEQ ID NO: 337691 - DNA, 25 bp, Mus musculus
gtatgtggaggaacatgtgtatgtg

SEQ ID NO: 337692 - DNA, 25 bp, Mus musculus
gtatgtggaggccatgggaagtgtt

SEQ ID NO: 337693 - DNA, 25 bp, Mus musculus
gtatgtgttgaggaggagagaacat

SEQ ID NO: 337694 - DNA, 25 bp, Mus musculus
gtatgttccaggattgaaccagctg

SEQ ID NO: 337695 - DNA, 25 bp, Mus musculus
gtattaaaccaggtgctgtggaaag

SEQ ID NO: 337696 - DNA, 25 bp, Mus musculus
gtattaacaagtaagtgtggacatt

SEQ ID NO: 337697 - DNA, 25 bp, Mus musculus
gtattaagaggagtgtctccaatct

SEQ ID NO: 337698 - DNA, 25 bp, Mus musculus
gtattaagagttccgaggtgataag

SEQ ID NO: 337699 - DNA, 25 bp, Mus musculus
gtattaattacagttctccaagcca

SEQ ID NO: 337700 - DNA, 25 bp, Mus musculus
gtattaattagaggaggttcgcctt

SEQ ID NO: 337701 - DNA, 25 bp, Mus musculus
gtattacaagcatccgatatcaaga

SEQ ID NO: 337702 - DNA, 25 bp, Mus musculus
gtattacagcagcaatattcacaac

SEQ ID NO: 337703 - DNA, 25 bp, Mus musculus
gtattactatgaagtttctctgccc

SEQ ID NO: 337704 - DNA, 25 bp, Mus musculus
gtattactatgaatacctctctgac

SEQ ID NO: 337705 - DNA, 25 bp, Mus musculus
gtattactgaagcttaaaaagcaag

SEQ ID NO: 337706 - DNA, 25 bp, Mus musculus
gtattactgactgcagcaccacagc

SEQ ID NO: 337707 - DNA, 25 bp, Mus musculus
gtattactggcccggctgtgaagtt

SEQ ID NO: 337708 - DNA, 25 bp, Mus musculus
gtattagaaaaggaaactgcattca

SEQ ID NO: 337709 - DNA, 25 bp, Mus musculus
gtattagaaaagtctctccagaggc

SEQ ID NO: 337710 - DNA, 25 bp, Mus musculus
gtattagagggaattctgcctttgg

SEQ ID NO: 337711 - DNA, 25 bp, Mus musculus
gtattagaggttcataagccagaaa

SEQ ID NO: 337712 - DNA, 25 bp, Mus musculus
gtattagaggttggcaggaaggtaa

SEQ ID NO: 337713 - DNA, 25 bp, Mus musculus
gtattagtattaaagataatcaaat

SEQ ID NO: 337714 - DNA, 25 bp, Mus musculus
gtattataaccacagtggaagacca

SEQ ID NO: 337715 - DNA, 25 bp, Mus musculus
gtattataacctcatcgtgttgtaa

SEQ ID NO: 337716 - DNA, 25 bp, Mus musculus
gtattatcgttatgagtattggaga

SEQ ID NO: 337717 - DNA, 25 bp, Mus musculus
gtattattaaagtggttggctatga

SEQ ID NO: 337718 - DNA, 25 bp, Mus musculus
gtattattaatatggaaatgaaagt

SEQ ID NO: 337719 - DNA, 25 bp, Mus musculus
gtattatttccaactatgaaaagaa

SEQ ID NO: 337720 - DNA, 25 bp, Mus musculus
gtattattttatggatattcattag

SEQ ID NO: 337721 - DNA, 25 bp, Mus musculus
gtattatttttttggccatattccc

SEQ ID NO: 337722 - DNA, 25 bp, Mus musculus
gtattcaaacaaggcaagcttctag

SEQ ID NO: 337723 - DNA, 25 bp, Mus musculus
gtattcaaagaacttagtagtcagc

SEQ ID NO: 337724 - DNA, 25 bp, Mus musculus
gtattcacgtagggtgatatgggac

SEQ ID NO: 337725 - DNA, 25 bp, Mus musculus
gtattcagatggaaaactacagact

SEQ ID NO: 337726 - DNA, 25 bp, Mus musculus
gtattcatccaaagatgactggttt

SEQ ID NO: 337727 - DNA, 25 bp, Mus musculus
gtattcatgcaggtccacgcctcaa

SEQ ID NO: 337728 - DNA, 25 bp, Mus musculus
gtattcatgccaggactactgttga

SEQ ID NO: 337729 - DNA, 25 bp, Mus musculus
gtattccatagggatccaagcctat

SEQ ID NO: 337730 - DNA, 25 bp, Mus musculus
gtattccatagggcatgccttcagg

SEQ ID NO: 337731 - DNA, 25 bp, Mus musculus
gtattcccaggacccacattgtgga

SEQ ID NO: 337732 - DNA, 25 bp, Mus musculus
gtattccctacagaactcttgagcc

SEQ ID NO: 337733 - DNA, 25 bp, Mus musculus
gtattccctacagcctgcccactga

SEQ ID NO: 337734 - DNA, 25 bp, Mus musculus
gtattcctcagaagcaaatggagac

SEQ ID NO: 337735 - DNA, 25 bp, Mus musculus
gtattcctcagaagttgtggagttt

SEQ ID NO: 337736 - DNA, 25 bp, Mus musculus
gtattcctcagacagtaaagactgt

SEQ ID NO: 337737 - DNA, 25 bp, Mus musculus
gtattcctgggggttcggcagactc

SEQ ID NO: 337738 - DNA, 25 bp, Mus musculus
gtattctacagcccaggagtgttcg

SEQ ID NO: 337739 - DNA, 25 bp, Mus musculus
gtattctacagctcaagactgcagt

SEQ ID NO: 337740 - DNA, 25 bp, Mus musculus
gtattctacagctgaggaatgtgct

SEQ ID NO: 337741 - DNA, 25 bp, Mus musculus
gtattctcagttcctgtagttgctg

SEQ ID NO: 337742 - DNA, 25 bp, Mus musculus
gtattctgagccaggtatcatacag

SEQ ID NO: 337743 - DNA, 25 bp, Mus musculus
gtattctgatgatgttgctttcccc

SEQ ID NO: 337744 - DNA, 25 bp, Mus musculus
gtattctgcaaaaccttatgcacac

SEQ ID NO: 337745 - DNA, 25 bp, Mus musculus
gtattctgcaaacttcaagcacaaa

SEQ ID NO: 337746 - DNA, 25 bp, Mus musculus
gtattgaatatgtggtgctgctgtt

SEQ ID NO: 337747 - DNA, 25 bp, Mus musculus
gtattgatgatgtgcctgatgacat

SEQ ID NO: 337748 - DNA, 25 bp, Mus musculus
gtattgcatatagtcctgatgggaa

SEQ ID NO: 337749 - DNA, 25 bp, Mus musculus
gtattggaagcatagaaggcctact

SEQ ID NO: 337750 - DNA, 25 bp, Mus musculus
gtattggataagaccaccgctcttg

SEQ ID NO: 337751 - DNA, 25 bp, Mus musculus
gtattggcaagaaccgagctcaagc

SEQ ID NO: 337752 - DNA, 25 bp, Mus musculus
gtattggcaagagtccagaaaacct

SEQ ID NO: 337753 - DNA, 25 bp, Mus musculus
gtattggcgtgagcggaggctgctg

SEQ ID NO: 337754 - DNA, 25 bp, Mus musculus
gtattggctggatcccaagtcttcc

SEQ ID NO: 337755 - DNA, 25 bp, Mus musculus
gtattgggagctccagtggcagtgg

SEQ ID NO: 337756 - DNA, 25 bp, Mus musculus
gtattggtaagttccctgctatcaa

SEQ ID NO: 337757 - DNA, 25 bp, Mus musculus
gtattggtagcagatttcttagatt

SEQ ID NO: 337758 - DNA, 25 bp, Mus musculus
gtattgtgcaggcatccagggtatc

SEQ ID NO: 337759 - DNA, 25 bp, Mus musculus
gtattgtggaggaattaattcgaga

SEQ ID NO: 337760 - DNA, 25 bp, Mus musculus
gtattgtttaaactacagaactttg

SEQ ID NO: 337761 - DNA, 25 bp, Mus musculus
gtatttaaagaacttgtgtagcttg

SEQ ID NO: 337762 - DNA, 25 bp, Mus musculus
gtatttaacagacaaatggtggccc

SEQ ID NO: 337763 - DNA, 25 bp, Mus musculus
gtatttaacagacaatcatggccct

SEQ ID NO: 337764 - DNA, 25 bp, Mus musculus
gtatttaagcagagatgacgtcagt

SEQ ID NO: 337765 - DNA, 25 bp, Mus musculus
gtatttaataaaggcctgtgatact

SEQ ID NO: 337766 - DNA, 25 bp, Mus musculus
gtatttacagatttatgacattcaa

SEQ ID NO: 337767 - DNA, 25 bp, Mus musculus
gtatttacaggatcttgctgcatag

SEQ ID NO: 337768 - DNA, 25 bp, Mus musculus
gtatttaccaagcgctgatcctgac

SEQ ID NO: 337769 - DNA, 25 bp, Mus musculus
gtatttaccaaggaggcatcctcat

SEQ ID NO: 337770 - DNA, 25 bp, Mus musculus
gtatttatcagataaccacatttta

SEQ ID NO: 337771 - DNA, 25 bp, Mus musculus
gtatttatccaaaggtgttttacat

SEQ ID NO: 337772 - DNA, 25 bp, Mus musculus
gtatttcaagaaaagagaaaattgg

SEQ ID NO: 337773 - DNA, 25 bp, Mus musculus
gtatttcaagaaaaggaaaatgtcc

SEQ ID NO: 337774 - DNA, 25 bp, Mus musculus
gtatttcatggagagacgtgacact

SEQ ID NO: 337775 - DNA, 25 bp, Mus musculus
gtatttcatggagagggaggggcgg

SEQ ID NO: 337776 - DNA, 25 bp, Mus musculus
gtatttcccactgaggccaatgtgc

SEQ ID NO: 337777 - DNA, 25 bp, Mus musculus
gtatttcccaggtgcggggtcctcc

SEQ ID NO: 337778 - DNA, 25 bp, Mus musculus
gtatttctcccagagcctggcaccc

SEQ ID NO: 337779 - DNA, 25 bp, Mus musculus
gtatttctcccagaggcaaaatctc

SEQ ID NO: 337780 - DNA, 25 bp, Mus musculus
gtatttgagaggtagtgatttaata

SEQ ID NO: 337781 - DNA, 25 bp, Mus musculus
gtatttgctggtgctgtagcccgga

SEQ ID NO: 337782 - DNA, 25 bp, Mus musculus
gtatttgtggggtaatcaggaagca

SEQ ID NO: 337783 - DNA, 25 bp, Mus musculus
gtatttgtggtgataatgagtctac

SEQ ID NO: 337784 - DNA, 25 bp, Mus musculus
gtattttctcaggtgtgcatgtagc

SEQ ID NO: 337785 - DNA, 25 bp, Mus musculus
gtattttgaccttggacttcctgga

SEQ ID NO: 337786 - DNA, 25 bp, Mus musculus
gtatttttaggctgttcatttagaa

SEQ ID NO: 337787 - DNA, 25 bp, Mus musculus
gtcaaaaagtatcaggaatacatcc

SEQ ID NO: 337788 - DNA, 25 bp, Mus musculus
gtcaaaaatctggtagtgcaacttc

SEQ ID NO: 337789 - DNA, 25 bp, Mus musculus
gtcaaaactgcaagttgcacccagc

SEQ ID NO: 337790 - DNA, 25 bp, Mus musculus
gtcaaaagaaagaattcctgagaca

SEQ ID NO: 337791 - DNA, 25 bp, Mus musculus
gtcaaaatgtcaggttctggcaccc

SEQ ID NO: 337792 - DNA, 25 bp, Mus musculus
gtcaaacagtggcttgcattgttca

SEQ ID NO: 337793 - DNA, 25 bp, Mus musculus
gtcaaacagtggtattttaacagta

SEQ ID NO: 337794 - DNA, 25 bp, Mus musculus
gtcaaacatttatggtgaagtattt

SEQ ID NO: 337795 - DNA, 25 bp, Mus musculus
gtcaaaccagggttctctaaatgcc

SEQ ID NO: 337796 - DNA, 25 bp, Mus musculus
gtcaaaccaggttaaggagctccga

SEQ ID NO: 337797 - DNA, 25 bp, Mus musculus
gtcaaacccaaggtatggaagactt

SEQ ID NO: 337798 - DNA, 25 bp, Mus musculus
gtcaaactggagcaggcagactgtt

SEQ ID NO: 337799 - DNA, 25 bp, Mus musculus
gtcaaactggaggaaagcacagaca

SEQ ID NO: 337800 - DNA, 25 bp, Mus musculus
gtcaaacttcagagtgaatgccatc

SEQ ID NO: 337801 - DNA, 25 bp, Mus musculus
gtcaaagaagctcagagtctacagt

SEQ ID NO: 337802 - DNA, 25 bp, Mus musculus
gtcaaagaaggggaggaagtttgtc

SEQ ID NO: 337803 - DNA, 25 bp, Mus musculus
gtcaaagacagcggcattgactcgg

SEQ ID NO: 337804 - DNA, 25 bp, Mus musculus
gtcaaagacagcggccctggcccag

SEQ ID NO: 337805 - DNA, 25 bp, Mus musculus
gtcaaagacctgatctccaagctgc

SEQ ID NO: 337806 - DNA, 25 bp, Mus musculus
gtcaaagacctgtttctctagatct

SEQ ID NO: 337807 - DNA, 25 bp, Mus musculus
gtcaaagactgccttactaaagatc

SEQ ID NO: 337808 - DNA, 25 bp, Mus musculus
gtcaaagagctgggtctctccagtg

SEQ ID NO: 337809 - DNA, 25 bp, Mus musculus
gtcaaagatcaaatatcatgtagaa

SEQ ID NO: 337810 - DNA, 25 bp, Mus musculus
gtcaaagatcaattatcatgtagaa

SEQ ID NO: 337811 - DNA, 25 bp, Mus musculus
gtcaaagatgagattccatattaat

SEQ ID NO: 337812 - DNA, 25 bp, Mus musculus
gtcaaagcagacagaatttcagcat

SEQ ID NO: 337813 - DNA, 25 bp, Mus musculus
gtcaaagcagacaggttcagctcct

SEQ ID NO: 337814 - DNA, 25 bp, Mus musculus
gtcaaagccagggtctcttgtggta

SEQ ID NO: 337815 - DNA, 25 bp, Mus musculus
gtcaaagccaggtgccagctgggac

SEQ ID NO: 337816 - DNA, 25 bp, Mus musculus
gtcaaagccatctgtccctcaattc

SEQ ID NO: 337817 - DNA, 25 bp, Mus musculus
gtcaaagcccaagaaatagcagaca

SEQ ID NO: 337818 - DNA, 25 bp, Mus musculus
gtcaaagcccaaggacatgggagaa

SEQ ID NO: 337819 - DNA, 25 bp, Mus musculus
gtcaaagctgaggtacggcatccag

SEQ ID NO: 337820 - DNA, 25 bp, Mus musculus
gtcaaaggatggctccggtgaggac

SEQ ID NO: 337821 - DNA, 25 bp, Mus musculus
gtcaaaggatggtggtgtgcgaatc

SEQ ID NO: 337822 - DNA, 25 bp, Mus musculus
gtcaaagtcattcttgatattccag

SEQ ID NO: 337823 - DNA, 25 bp, Mus musculus
gtcaaagtcattgttgatattccag

SEQ ID NO: 337824 - DNA, 25 bp, Mus musculus
gtcaaagtcgccaaggtgaccccag

SEQ ID NO: 337825 - DNA, 25 bp, Mus musculus
gtcaaagttcagccctgaaaagtcc

SEQ ID NO: 337826 - DNA, 25 bp, Mus musculus
gtcaaagttcagccctgagaagagc

SEQ ID NO: 337827 - DNA, 25 bp, Mus musculus
gtcaaataaaaatccatggagctta

SEQ ID NO: 337828 - DNA, 25 bp, Mus musculus
gtcaaatatggacctgggtcgctta

SEQ ID NO: 337829 - DNA, 25 bp, Mus musculus
gtcaaatatggccaccaggccttgc

SEQ ID NO: 337830 - DNA, 25 bp, Mus musculus
gtcaaatcaagatgtcattaaagcg

SEQ ID NO: 337831 - DNA, 25 bp, Mus musculus
gtcaaatcagatgcccccacgactc

SEQ ID NO: 337832 - DNA, 25 bp, Mus musculus
gtcaaatctcagagccccaaggacg

SEQ ID NO: 337833 - DNA, 25 bp, Mus musculus
gtcaaatgaaggaggaattttattg

SEQ ID NO: 337834 - DNA, 25 bp, Mus musculus
gtcaaatgaaggaggcaagtcttct

SEQ ID NO: 337835 - DNA, 25 bp, Mus musculus
gtcaacaacagggaaagaaggcaat

SEQ ID NO: 337836 - DNA, 25 bp, Mus musculus
gtcaacaaggtcccagtgaagaaga

SEQ ID NO: 337837 - DNA, 25 bp, Mus musculus
gtcaacaatgaaaaacttcagaagc

SEQ ID NO: 337838 - DNA, 25 bp, Mus musculus
gtcaacaatgaaaatcttcagaagc

SEQ ID NO: 337839 - DNA, 25 bp, Mus musculus
gtcaacacaggtcttctgacgcttc

SEQ ID NO: 337840 - DNA, 25 bp, Mus musculus
gtcaacagcccgaaaagcgactcaa

SEQ ID NO: 337841 - DNA, 25 bp, Mus musculus
gtcaacagcccgacgtatgtttcct

SEQ ID NO: 337842 - DNA, 25 bp, Mus musculus
gtcaacagccctggaaatgtggact

SEQ ID NO: 337843 - DNA, 25 bp, Mus musculus
gtcaacagccctggcactgaagatc

SEQ ID NO: 337844 - DNA, 25 bp, Mus musculus
gtcaacagccgcctggtttaccatg

SEQ ID NO: 337845 - DNA, 25 bp, Mus musculus
gtcaacagccggtgataactcccta

SEQ ID NO: 337846 - DNA, 25 bp, Mus musculus
gtcaacagcgtgagcaccactctgt

SEQ ID NO: 337847 - DNA, 25 bp, Mus musculus
gtcaacataatagcctgctttttct

SEQ ID NO: 337848 - DNA, 25 bp, Mus musculus
gtcaacataataggtgagcacatag

SEQ ID NO: 337849 - DNA, 25 bp, Mus musculus
gtcaacatcacactcaatgacgagg

SEQ ID NO: 337850 - DNA, 25 bp, Mus musculus
gtcaacatgaatgtgaccgagataa

SEQ ID NO: 337851 - DNA, 25 bp, Mus musculus
gtcaacattcaggagcagagcccag

SEQ ID NO: 337852 - DNA, 25 bp, Mus musculus
gtcaacattcagtacacactgcgct

SEQ ID NO: 337853 - DNA, 25 bp, Mus musculus
gtcaaccccatggagacatatgagg

SEQ ID NO: 337854 - DNA, 25 bp, Mus musculus
gtcaaccctccagaaagccatcgat

SEQ ID NO: 337855 - DNA, 25 bp, Mus musculus
gtcaaccctccggagatggcgtcag

SEQ ID NO: 337856 - DNA, 25 bp, Mus musculus
gtcaaccctgaagatattgtgaaca

SEQ ID NO: 337857 - DNA, 25 bp, Mus musculus
gtcaacccttcaagatcccgattcg

SEQ ID NO: 337858 - DNA, 25 bp, Mus musculus
gtcaaccgacccccaggctcaacag

SEQ ID NO: 337859 - DNA, 25 bp, Mus musculus
gtcaacctgaaaaggacaagaagat

SEQ ID NO: 337860 - DNA, 25 bp, Mus musculus
gtcaacctggctgtgggtggtgaga

SEQ ID NO: 337861 - DNA, 25 bp, Mus musculus
gtcaacctgtaagtgctgtgaccca

SEQ ID NO: 337862 - DNA, 25 bp, Mus musculus
gtcaacctgtaagttcacttgttca

SEQ ID NO: 337863 - DNA, 25 bp, Mus musculus
gtcaacctgtcaggtgactcaagtg

SEQ ID NO: 337864 - DNA, 25 bp, Mus musculus
gtcaacctgtcaggtgactccaatg

SEQ ID NO: 337865 - DNA, 25 bp, Mus musculus
gtcaacgagcctggtgccttctggg

SEQ ID NO: 337866 - DNA, 25 bp, Mus musculus
gtcaacggctggacctgtttacact

SEQ ID NO: 337867 - DNA, 25 bp, Mus musculus
gtcaacggcttgtctgtgccaccaa

SEQ ID NO: 337868 - DNA, 25 bp, Mus musculus
gtcaacgggctgagatctcttgatg

SEQ ID NO: 337869 - DNA, 25 bp, Mus musculus
gtcaacgggctgaggtctgtgcaga

SEQ ID NO: 337870 - DNA, 25 bp, Mus musculus
gtcaacgtccacaagcttgtgacac

SEQ ID NO: 337871 - DNA, 25 bp, Mus musculus
gtcaactctccatcctacctcacga

SEQ ID NO: 337872 - DNA, 25 bp, Mus musculus
gtcaactctcccagggctttctgag

SEQ ID NO: 337873 - DNA, 25 bp, Mus musculus
gtcaactgacaggccataaaatcag

SEQ ID NO: 337874 - DNA, 25 bp, Mus musculus
gtcaactgtgcaggctatgtggtgg

SEQ ID NO: 337875 - DNA, 25 bp, Mus musculus
gtcaactgtgcaggtgacagtaacc

SEQ ID NO: 337876 - DNA, 25 bp, Mus musculus
gtcaacttacagaactatgtagaag

SEQ ID NO: 337877 - DNA, 25 bp, Mus musculus
gtcaacttacagcatctgctggtga

SEQ ID NO: 337878 - DNA, 25 bp, Mus musculus
gtcaagaaagcctgtaccccagtag

SEQ ID NO: 337879 - DNA, 25 bp, Mus musculus
gtcaagaaaggacatctgatttgaa

SEQ ID NO: 337880 - DNA, 25 bp, Mus musculus
gtcaagaaagtcatcagcaggaaga

SEQ ID NO: 337881 - DNA, 25 bp, Mus musculus
gtcaagaacaaggcccagtctgtgc

SEQ ID NO: 337882 - DNA, 25 bp, Mus musculus
gtcaagaacagcatgggtacacaat

SEQ ID NO: 337883 - DNA, 25 bp, Mus musculus
gtcaagaacagctggggaagtgaat

SEQ ID NO: 337884 - DNA, 25 bp, Mus musculus
gtcaagaagaagatgtgttacagca

SEQ ID NO: 337885 - DNA, 25 bp, Mus musculus
gtcaagaccaaacggcccccttgag

SEQ ID NO: 337886 - DNA, 25 bp, Mus musculus
gtcaagaccagcaggctagatatgg

SEQ ID NO: 337887 - DNA, 25 bp, Mus musculus
gtcaagaccagcaggttacagtcgg

SEQ ID NO: 337888 - DNA, 25 bp, Mus musculus
gtcaagaccatcaaggcactagatg

SEQ ID NO: 337889 - DNA, 25 bp, Mus musculus
gtcaagacttgccgggtggagacag

SEQ ID NO: 337890 - DNA, 25 bp, Mus musculus
gtcaagagcaagaagaagcagacca

SEQ ID NO: 337891 - DNA, 25 bp, Mus musculus
gtcaagagcaagtttggcgccgagt

SEQ ID NO: 337892 - DNA, 25 bp, Mus musculus
gtcaagagctccggctctgaagtgt

SEQ ID NO: 337893 - DNA, 25 bp, Mus musculus
gtcaagagctccgggtctgaagtgt

SEQ ID NO: 337894 - DNA, 25 bp, Mus musculus
gtcaagatgcagggttccaagcgtg

SEQ ID NO: 337895 - DNA, 25 bp, Mus musculus
gtcaagatgcagtacccccacttcc

SEQ ID NO: 337896 - DNA, 25 bp, Mus musculus
gtcaagattgagattcccctcttcc

SEQ ID NO: 337897 - DNA, 25 bp, Mus musculus
gtcaagcaagtgcaaagaaacgatg

SEQ ID NO: 337898 - DNA, 25 bp, Mus musculus
gtcaagcacggggcgggggcagaga

SEQ ID NO: 337899 - DNA, 25 bp, Mus musculus
gtcaagcagatgaagatcatccatg

SEQ ID NO: 337900 - DNA, 25 bp, Mus musculus
gtcaagcagtggcatcagaaatttc

SEQ ID NO: 337901 - DNA, 25 bp, Mus musculus
gtcaagcagtgggtatatgcttgtc

SEQ ID NO: 337902 - DNA, 25 bp, Mus musculus
gtcaagccaaacatccagaacccag

SEQ ID NO: 337903 - DNA, 25 bp, Mus musculus
gtcaagccacagagcccaagatgat

SEQ ID NO: 337904 - DNA, 25 bp, Mus musculus
gtcaagcccatcagaaaatcaccgt

SEQ ID NO: 337905 - DNA, 25 bp, Mus musculus
gtcaagccggtgtcctgggtcatga

SEQ ID NO: 337906 - DNA, 25 bp, Mus musculus
gtcaagcgcaagtattttccgccaa

SEQ ID NO: 337907 - DNA, 25 bp, Mus musculus
gtcaagctcgaaccagcccctccga

SEQ ID NO: 337908 - DNA, 25 bp, Mus musculus
gtcaagctgagactgttggtgaaat

SEQ ID NO: 337909 - DNA, 25 bp, Mus musculus
gtcaaggaaaacaaattgatgatgc

SEQ ID NO: 337910 - DNA, 25 bp, Mus musculus
gtcaaggaaaagagttaccgtcaag

SEQ ID NO: 337911 - DNA, 25 bp, Mus musculus
gtcaaggaaatggtggctgcgttga

SEQ ID NO: 337912 - DNA, 25 bp, Mus musculus
gtcaaggactccaggcatgtcatgt

SEQ ID NO: 337913 - DNA, 25 bp, Mus musculus
gtcaaggaggacagattaattgtgg

SEQ ID NO: 337914 - DNA, 25 bp, Mus musculus
gtcaaggaggacaggacaaaagagg

SEQ ID NO: 337915 - DNA, 25 bp, Mus musculus
gtcaaggccaagaaagtattatgag

SEQ ID NO: 337916 - DNA, 25 bp, Mus musculus
gtcaaggccaagtaagtattatgag

SEQ ID NO: 337917 - DNA, 25 bp, Mus musculus
gtcaaggcggcccagaccagtgact

SEQ ID NO: 337918 - DNA, 25 bp, Mus musculus
gtcaagggtcacagaggttacccag

SEQ ID NO: 337919 - DNA, 25 bp, Mus musculus
gtcaaggttcaggtcttatatccag

SEQ ID NO: 337920 - DNA, 25 bp, Mus musculus
gtcaaggttccaggagagacatgct

SEQ ID NO: 337921 - DNA, 25 bp, Mus musculus
gtcaagtacaatcaggcctggctgc

SEQ ID NO: 337922 - DNA, 25 bp, Mus musculus
gtcaagtacgagctttatggccacg

SEQ ID NO: 337923 - DNA, 25 bp, Mus musculus
gtcaagtactggttgggtggtccgg

SEQ ID NO: 337924 - DNA, 25 bp, Mus musculus
gtcaagtactggtttacaggaacag

SEQ ID NO: 337925 - DNA, 25 bp, Mus musculus
gtcaagtatgtaccccaactgtgcc

SEQ ID NO: 337926 - DNA, 25 bp, Mus musculus
gtcaagtcacaagctcctcaggatc

SEQ ID NO: 337927 - DNA, 25 bp, Mus musculus
gtcaagtcacaaggacaaagtatag

SEQ ID NO: 337928 - DNA, 25 bp, Mus musculus
gtcaagtcatttcctgtagaagacc

SEQ ID NO: 337929 - DNA, 25 bp, Mus musculus
gtcaagtcctttccgggtggcaagg

SEQ ID NO: 337930 - DNA, 25 bp, Mus musculus
gtcaagtggttgcgaacaatttcga

SEQ ID NO: 337931 - DNA, 25 bp, Mus musculus
gtcaagtggttgcggagaggtttgc

SEQ ID NO: 337932 - DNA, 25 bp, Mus musculus
gtcaagtggttgcggagcgagcccg

SEQ ID NO: 337933 - DNA, 25 bp, Mus musculus
gtcaagttcaccaagatatttatca

SEQ ID NO: 337934 - DNA, 25 bp, Mus musculus
gtcaagttctgcaaggatgaattgt

SEQ ID NO: 337935 - DNA, 25 bp, Mus musculus
gtcaagtttataagggtcgtcatgt

SEQ ID NO: 337936 - DNA, 25 bp, Mus musculus
gtcaagtttcagcctcttagcaagt

SEQ ID NO: 337937 - DNA, 25 bp, Mus musculus
gtcaagtttcaggacacacaggacc

SEQ ID NO: 337938 - DNA, 25 bp, Mus musculus
gtcaagtttgtgggtgaatccgtgg

SEQ ID NO: 337939 - DNA, 25 bp, Mus musculus
gtcaatactacatttatgatctgca

SEQ ID NO: 337940 - DNA, 25 bp, Mus musculus
gtcaatataatgctagataaatggg

SEQ ID NO: 337941 - DNA, 25 bp, Mus musculus
gtcaatatgaagagtaaagatggga

SEQ ID NO: 337942 - DNA, 25 bp, Mus musculus
gtcaatcaatggtgtcccagatgac

SEQ ID NO: 337943 - DNA, 25 bp, Mus musculus
gtcaatcacaacttgaaagatgcca

SEQ ID NO: 337944 - DNA, 25 bp, Mus musculus
gtcaatcataaggatgagaacaagt

SEQ ID NO: 337945 - DNA, 25 bp, Mus musculus
gtcaatcataagggcgagatgtgtg

SEQ ID NO: 337946 - DNA, 25 bp, Mus musculus
gtcaatctgaaagagttcttgcctc

SEQ ID NO: 337947 - DNA, 25 bp, Mus musculus
gtcaatctgaaaggtacccagaact

SEQ ID NO: 337948 - DNA, 25 bp, Mus musculus
gtcaatgcaattgtttacatgatag

SEQ ID NO: 337949 - DNA, 25 bp, Mus musculus
gtcaatgcacaggatgcagaaggga

SEQ ID NO: 337950 - DNA, 25 bp, Mus musculus
gtcaatgcagcccagatggagctcg

SEQ ID NO: 337951 - DNA, 25 bp, Mus musculus
gtcaatgcagcttgttttagcccag

SEQ ID NO: 337952 - DNA, 25 bp, Mus musculus
gtcaatgcaggcgacctggcattca

SEQ ID NO: 337953 - DNA, 25 bp, Mus musculus
gtcaatgcccccaaccccatccaac

SEQ ID NO: 337954 - DNA, 25 bp, Mus musculus
gtcaatgctcaggtgcagtgtcttg

SEQ ID NO: 337955 - DNA, 25 bp, Mus musculus
gtcaatgggaagtcattcagctggt

SEQ ID NO: 337956 - DNA, 25 bp, Mus musculus
gtcaatgggccacgtctaaagagcc

SEQ ID NO: 337957 - DNA, 25 bp, Mus musculus
gtcaatgtctcagatgcactcccat

SEQ ID NO: 337958 - DNA, 25 bp, Mus musculus
gtcaatgtgaacaagcttgtgacac

SEQ ID NO: 337959 - DNA, 25 bp, Mus musculus
gtcaattatgaagagtttgtacaga

SEQ ID NO: 337960 - DNA, 25 bp, Mus musculus
gtcaattcacaccgaaactatgttc

SEQ ID NO: 337961 - DNA, 25 bp, Mus musculus
gtcaatttcaggaaaatctgggttt

SEQ ID NO: 337962 - DNA, 25 bp, Mus musculus
gtcaatttcaggatactggctcgaa

SEQ ID NO: 337963 - DNA, 25 bp, Mus musculus
gtcaatttcaggggctctctaaata

SEQ ID NO: 337964 - DNA, 25 bp, Mus musculus
gtcaatttggagaaggtacattatt

SEQ ID NO: 337965 - DNA, 25 bp, Mus musculus
gtcaattttaagatgaaaatacttg

SEQ ID NO: 337966 - DNA, 25 bp, Mus musculus
gtcacaaaaaaagattttggagtaa

SEQ ID NO: 337967 - DNA, 25 bp, Mus musculus
gtcacaaaagtaggagttaccattg

SEQ ID NO: 337968 - DNA, 25 bp, Mus musculus
gtcacaaaccacttccattgaagat

SEQ ID NO: 337969 - DNA, 25 bp, Mus musculus
gtcacaaactcttacgacatgatgg

SEQ ID NO: 337970 - DNA, 25 bp, Mus musculus
gtcacaaacttaatctagagaagca

SEQ ID NO: 337971 - DNA, 25 bp, Mus musculus
gtcacaaatgcccagctcctaacct

SEQ ID NO: 337972 - DNA, 25 bp, Mus musculus
gtcacaacagctcgcaatgccctgg

SEQ ID NO: 337973 - DNA, 25 bp, Mus musculus
gtcacaaccaaaaatactgaagcag

SEQ ID NO: 337974 - DNA, 25 bp, Mus musculus
gtcacaacttagtcttgacttcttt

SEQ ID NO: 337975 - DNA, 25 bp, Mus musculus
gtcacaacttagtgtcttcaagagg

SEQ ID NO: 337976 - DNA, 25 bp, Mus musculus
gtcacaagaaagaagagccaagtgg

SEQ ID NO: 337977 - DNA, 25 bp, Mus musculus
gtcacaagagaatgcaggcatgttc

SEQ ID NO: 337978 - DNA, 25 bp, Mus musculus
gtcacaagaggaactttgtggtgtc

SEQ ID NO: 337979 - DNA, 25 bp, Mus musculus
gtcacaagcagtcatgaaagtccac

SEQ ID NO: 337980 - DNA, 25 bp, Mus musculus
gtcacaagcagtctgaccaaggaca

SEQ ID NO: 337981 - DNA, 25 bp, Mus musculus
gtcacaaggcagccatggaatttca

SEQ ID NO: 337982 - DNA, 25 bp, Mus musculus
gtcacaaggcaggggcaagcggatc

SEQ ID NO: 337983 - DNA, 25 bp, Mus musculus
gtcacaataaagatctgggacatag

SEQ ID NO: 337984 - DNA, 25 bp, Mus musculus
gtcacaataaaggtactagtacttg

SEQ ID NO: 337985 - DNA, 25 bp, Mus musculus
gtcacaatcaggttgactcttcacc

SEQ ID NO: 337986 - DNA, 25 bp, Mus musculus
gtcacacaaagaaacaggtatgtga

SEQ ID NO: 337987 - DNA, 25 bp, Mus musculus
gtcacacaaaggtatgtgatgatat

SEQ ID NO: 337988 - DNA, 25 bp, Mus musculus
gtcacacaactatgttcagcaggac

SEQ ID NO: 337989 - DNA, 25 bp, Mus musculus
gtcacacaaggaggatacatctcta

SEQ ID NO: 337990 - DNA, 25 bp, Mus musculus
gtcacacagcgacatgtgagggagc

SEQ ID NO: 337991 - DNA, 25 bp, Mus musculus
gtcacacagggctcgcttgcctgtt

SEQ ID NO: 337992 - DNA, 25 bp, Mus musculus
gtcacaccaagattgtttatttagt

SEQ ID NO: 337993 - DNA, 25 bp, Mus musculus
gtcacaccaagcaaaacaattgcag

SEQ ID NO: 337994 - DNA, 25 bp, Mus musculus
gtcacacctaaagagcaatgcaagt

SEQ ID NO: 337995 - DNA, 25 bp, Mus musculus
gtcacacctaaagagtctgacacgt

SEQ ID NO: 337996 - DNA, 25 bp, Mus musculus
gtcacactcacgataaaagctggca

SEQ ID NO: 337997 - DNA, 25 bp, Mus musculus
gtcacactcttcaaggtaaagtgga

SEQ ID NO: 337998 - DNA, 25 bp, Mus musculus
gtcacactgaagctcgcactggaca

SEQ ID NO: 337999 - DNA, 25 bp, Mus musculus
gtcacactgaaggccgttcctcagt

SEQ ID NO: 338000 - DNA, 25 bp, Mus musculus
gtcacactgcgagttacacttccaa

SEQ ID NO: 338001 - DNA, 25 bp, Mus musculus
gtcacactgcgggagaaagcaagac

SEQ ID NO: 338002 - DNA, 25 bp, Mus musculus
gtcacagaaaataatacaatggatt

SEQ ID NO: 338003 - DNA, 25 bp, Mus musculus
gtcacagaagagaagagttgataca

SEQ ID NO: 338004 - DNA, 25 bp, Mus musculus
gtcacagaatagttgatctttataa

SEQ ID NO: 338005 - DNA, 25 bp, Mus musculus
gtcacagaatagttggtcaaaagaa

SEQ ID NO: 338006 - DNA, 25 bp, Mus musculus
gtcacagaatgatgtgagccctgtc

SEQ ID NO: 338007 - DNA, 25 bp, Mus musculus
gtcacagagcacttttaataaccca

SEQ ID NO: 338008 - DNA, 25 bp, Mus musculus
gtcacagagcagaatgattggcagc

SEQ ID NO: 338009 - DNA, 25 bp, Mus musculus
gtcacagagcagttttaataaccca

SEQ ID NO: 338010 - DNA, 25 bp, Mus musculus
gtcacagcacggtctctctgctcct

SEQ ID NO: 338011 - DNA, 25 bp, Mus musculus
gtcacagccccaggtggtgatgaag

SEQ ID NO: 338012 - DNA, 25 bp, Mus musculus
gtcacagctgtctagtccccatgga

SEQ ID NO: 338013 - DNA, 25 bp, Mus musculus
gtcacaggaacatcgtgactttata

SEQ ID NO: 338014 - DNA, 25 bp, Mus musculus
gtcacaggattcagctctgtttcct

SEQ ID NO: 338015 - DNA, 25 bp, Mus musculus
gtcacaggattcaggccactaaacc

SEQ ID NO: 338016 - DNA, 25 bp, Mus musculus
gtcacaggcaccagtcttggaggag

SEQ ID NO: 338017 - DNA, 25 bp, Mus musculus
gtcacaggggcaggtggcagtgcag

SEQ ID NO: 338018 - DNA, 25 bp, Mus musculus
gtcacaggggcgggacaggaaagcc

SEQ ID NO: 338019 - DNA, 25 bp, Mus musculus
gtcacagggggtgagaaccctgctc

SEQ ID NO: 338020 - DNA, 25 bp, Mus musculus
gtcacagggggtggaaagctttcgt

SEQ ID NO: 338021 - DNA, 25 bp, Mus musculus
gtcacaggtgacaggttttactgca

SEQ ID NO: 338022 - DNA, 25 bp, Mus musculus
gtcacaggtgtagcttactaccagc

SEQ ID NO: 338023 - DNA, 25 bp, Mus musculus
gtcacaggtgtagggcagaggagac

SEQ ID NO: 338024 - DNA, 25 bp, Mus musculus
gtcacaggtgtaggggttgtgctgg

SEQ ID NO: 338025 - DNA, 25 bp, Mus musculus
gtcacagtaccgtcacctccaagta

SEQ ID NO: 338026 - DNA, 25 bp, Mus musculus
gtcacagtgaatcagcctcaccttc

SEQ ID NO: 338027 - DNA, 25 bp, Mus musculus
gtcacagtgtggttgatgacattaa

SEQ ID NO: 338028 - DNA, 25 bp, Mus musculus
gtcacataccaggggctgcgatgga

SEQ ID NO: 338029 - DNA, 25 bp, Mus musculus
gtcacatccatggaaagaaaggaga

SEQ ID NO: 338030 - DNA, 25 bp, Mus musculus
gtcacatccatggtcctattaaact

SEQ ID NO: 338031 - DNA, 25 bp, Mus musculus
gtcacatgagttgtgcctgccgaca

SEQ ID NO: 338032 - DNA, 25 bp, Mus musculus
gtcacatgcagatgacctagagctc

SEQ ID NO: 338033 - DNA, 25 bp, Mus musculus
gtcacatgcagatgagctcggattt

SEQ ID NO: 338034 - DNA, 25 bp, Mus musculus
gtcacatgcagatgatcgagtgctt

SEQ ID NO: 338035 - DNA, 25 bp, Mus musculus
gtcacatggctgctgccacaggtga

SEQ ID NO: 338036 - DNA, 25 bp, Mus musculus
gtcacatgttcttggcattgggaga

SEQ ID NO: 338037 - DNA, 25 bp, Mus musculus
gtcacattagcctttggagctgaca

SEQ ID NO: 338038 - DNA, 25 bp, Mus musculus
gtcacattagggtccgcaagcaggt

SEQ ID NO: 338039 - DNA, 25 bp, Mus musculus
gtcaccaactcagctctctgctctc

SEQ ID NO: 338040 - DNA, 25 bp, Mus musculus
gtcaccaactccgcggatgtggtgg

SEQ ID NO: 338041 - DNA, 25 bp, Mus musculus
gtcaccaactccgcgggctcaggga

SEQ ID NO: 338042 - DNA, 25 bp, Mus musculus
gtcaccaactccgcgtctcttacat

SEQ ID NO: 338043 - DNA, 25 bp, Mus musculus
gtcaccaagccaggatcctgtcccc

SEQ ID NO: 338044 - DNA, 25 bp, Mus musculus
gtcaccaagccaggtggacttgttt

SEQ ID NO: 338045 - DNA, 25 bp, Mus musculus
gtcaccaaggcccacgtttttgcag

SEQ ID NO: 338046 - DNA, 25 bp, Mus musculus
gtcaccaatcttgatcgcagtaaga

SEQ ID NO: 338047 - DNA, 25 bp, Mus musculus
gtcaccacacaggtatcagtgagca

SEQ ID NO: 338048 - DNA, 25 bp, Mus musculus
gtcaccacacagtcttaggcaaccc

SEQ ID NO: 338049 - DNA, 25 bp, Mus musculus
gtcaccacactgctccgcaggaggc

SEQ ID NO: 338050 - DNA, 25 bp, Mus musculus
gtcaccacaggccgacccgtggaag

SEQ ID NO: 338051 - DNA, 25 bp, Mus musculus
gtcaccaccaccagagagtcggctc

SEQ ID NO: 338052 - DNA, 25 bp, Mus musculus
gtcaccacccagaaggaatacacag

SEQ ID NO: 338053 - DNA, 25 bp, Mus musculus
gtcaccacccaggcctcccaagacc

SEQ ID NO: 338054 - DNA, 25 bp, Mus musculus
gtcaccagaaccaggttatgtagta

SEQ ID NO: 338055 - DNA, 25 bp, Mus musculus
gtcaccagagaatagccatgatgct

SEQ ID NO: 338056 - DNA, 25 bp, Mus musculus
gtcaccagagaatgtgcccacagac

SEQ ID NO: 338057 - DNA, 25 bp, Mus musculus
gtcaccagcttcagtaaagagggct

SEQ ID NO: 338058 - DNA, 25 bp, Mus musculus
gtcaccagcttcagtgaatggaact

SEQ ID NO: 338059 - DNA, 25 bp, Mus musculus
gtcaccagctttttgctgcccctta

SEQ ID NO: 338060 - DNA, 25 bp, Mus musculus
gtcaccaggactcaaatattctcct

SEQ ID NO: 338061 - DNA, 25 bp, Mus musculus
gtcaccagttcgagggggctgaaga

SEQ ID NO: 338062 - DNA, 25 bp, Mus musculus
gtcaccatgatgcatatcttcctcc

SEQ ID NO: 338063 - DNA, 25 bp, Mus musculus
gtcaccatgcccctggctagagatc

SEQ ID NO: 338064 - DNA, 25 bp, Mus musculus
gtcaccatgggaaggatcatgcgtc

SEQ ID NO: 338065 - DNA, 25 bp, Mus musculus
gtcacccaaggtccagtttgatgtg

SEQ ID NO: 338066 - DNA, 25 bp, Mus musculus
gtcacccaataggcaactccgaaga

SEQ ID NO: 338067 - DNA, 25 bp, Mus musculus
gtcacccacaaggtggagaaatggg

SEQ ID NO: 338068 - DNA, 25 bp, Mus musculus
gtcacccacagcaatgagaggtatg

SEQ ID NO: 338069 - DNA, 25 bp, Mus musculus
gtcacccagacctggagcctgttct

SEQ ID NO: 338070 - DNA, 25 bp, Mus musculus
gtcaccccaatagagataatgcagg

SEQ ID NO: 338071 - DNA, 25 bp, Mus musculus
gtcaccccaatagagatggcttgcc

SEQ ID NO: 338072 - DNA, 25 bp, Mus musculus
gtcaccccggtccctccgagccatc

SEQ ID NO: 338073 - DNA, 25 bp, Mus musculus
gtcaccccgtgacgctgcggattta

SEQ ID NO: 338074 - DNA, 25 bp, Mus musculus
gtcacccctggccctgaaggcagcc

SEQ ID NO: 338075 - DNA, 25 bp, Mus musculus
gtcacccctgtatatcaacctgaat

SEQ ID NO: 338076 - DNA, 25 bp, Mus musculus
gtcacccgcggttcctgagactgac

SEQ ID NO: 338077 - DNA, 25 bp, Mus musculus
gtcaccctcacagaacatctaacta

SEQ ID NO: 338078 - DNA, 25 bp, Mus musculus
gtcaccctcagaagacccccgtcag

SEQ ID NO: 338079 - DNA, 25 bp, Mus musculus
gtcaccctccgcaagtgtccattgt

SEQ ID NO: 338080 - DNA, 25 bp, Mus musculus
gtcaccctggacagccccggcagcc

SEQ ID NO: 338081 - DNA, 25 bp, Mus musculus
gtcaccctggatctggtcttctagg

SEQ ID NO: 338082 - DNA, 25 bp, Mus musculus
gtcaccctgtaaaagatttctaacg

SEQ ID NO: 338083 - DNA, 25 bp, Mus musculus
gtcaccctgtctggaaagaaatgat

SEQ ID NO: 338084 - DNA, 25 bp, Mus musculus
gtcaccgacatgtgagccactgctt

SEQ ID NO: 338085 - DNA, 25 bp, Mus musculus
gtcaccgagaggcttcattaacaaa

SEQ ID NO: 338086 - DNA, 25 bp, Mus musculus
gtcaccgcttcatgtttctctgccg

SEQ ID NO: 338087 - DNA, 25 bp, Mus musculus
gtcaccgtcagtcagatcccattgt

SEQ ID NO: 338088 - DNA, 25 bp, Mus musculus
gtcaccgtggccagaggcggaggca

SEQ ID NO: 338089 - DNA, 25 bp, Mus musculus
gtcacctatgatgaggactaccagc

SEQ ID NO: 338090 - DNA, 25 bp, Mus musculus
gtcacctatgatggacaagaagctg

SEQ ID NO: 338091 - DNA, 25 bp, Mus musculus
gtcacctcggaggtcccacccagga

SEQ ID NO: 338092 - DNA, 25 bp, Mus musculus
gtcacctcggctaaggatggggatt

SEQ ID NO: 338093 - DNA, 25 bp, Mus musculus
gtcacctctacagatttcctccctc

SEQ ID NO: 338094 - DNA, 25 bp, Mus musculus
gtcacctctaggtcattttacctgg

SEQ ID NO: 338095 - DNA, 25 bp, Mus musculus
gtcacctctggaagcaaagctgctg

SEQ ID NO: 338096 - DNA, 25 bp, Mus musculus
gtcacctctggggcccaggatgatt

SEQ ID NO: 338097 - DNA, 25 bp, Mus musculus
gtcacctctgtccaccattccaagg

SEQ ID NO: 338098 - DNA, 25 bp, Mus musculus
gtcacctctgttggcgaatgccctt

SEQ ID NO: 338099 - DNA, 25 bp, Mus musculus
gtcacctgagcaagttgttgggctg

SEQ ID NO: 338100 - DNA, 25 bp, Mus musculus
gtcacctgatctaaggagattacct

SEQ ID NO: 338101 - DNA, 25 bp, Mus musculus
gtcacctgcagatactttatgcatg

SEQ ID NO: 338102 - DNA, 25 bp, Mus musculus
gtcacctgctgtaattggcaactgg

SEQ ID NO: 338103 - DNA, 25 bp, Mus musculus
gtcacctggagacaatacgcatgga

SEQ ID NO: 338104 - DNA, 25 bp, Mus musculus
gtcacctgtaaggtagaaatttaca

SEQ ID NO: 338105 - DNA, 25 bp, Mus musculus
gtcacctgtaaggtctctagcatca

SEQ ID NO: 338106 - DNA, 25 bp, Mus musculus
gtcaccttcagctacccctgcagac

SEQ ID NO: 338107 - DNA, 25 bp, Mus musculus
gtcaccttccgagaactccgtgcaa

SEQ ID NO: 338108 - DNA, 25 bp, Mus musculus
gtcacctttcgggcaggtgatatta

SEQ ID NO: 338109 - DNA, 25 bp, Mus musculus
gtcacctttcgggtcatctagtagc

SEQ ID NO: 338110 - DNA, 25 bp, Mus musculus
gtcaccttttaaaggctgctggcac

SEQ ID NO: 338111 - DNA, 25 bp, Mus musculus
gtcacgaaacaccagctgcgatact

SEQ ID NO: 338112 - DNA, 25 bp, Mus musculus
gtcacgcagcatgcttccctagcgt

SEQ ID NO: 338113 - DNA, 25 bp, Mus musculus
gtcacgcagcatgggctccggctgg

SEQ ID NO: 338114 - DNA, 25 bp, Mus musculus
gtcacgctacggaatgaagctaccc

SEQ ID NO: 338115 - DNA, 25 bp, Mus musculus
gtcacgctcaatgagaagccctttg

SEQ ID NO: 338116 - DNA, 25 bp, Mus musculus
gtcacgcttctataaacctgactct

SEQ ID NO: 338117 - DNA, 25 bp, Mus musculus
gtcacgcttctattaaaccgggagg

SEQ ID NO: 338118 - DNA, 25 bp, Mus musculus
gtcacggcccaaggggtttcctgag

SEQ ID NO: 338119 - DNA, 25 bp, Mus musculus
gtcacgggggctggcacaggtgatg

SEQ ID NO: 338120 - DNA, 25 bp, Mus musculus
gtcacgtaagcagagagtggctgaa

SEQ ID NO: 338121 - DNA, 25 bp, Mus musculus
gtcacgtaagcagggtcttgacaat

SEQ ID NO: 338122 - DNA, 25 bp, Mus musculus
gtcacgtaagcagggtcttggagag

SEQ ID NO: 338123 - DNA, 25 bp, Mus musculus
gtcacgtcaaggtagccatcccttg

SEQ ID NO: 338124 - DNA, 25 bp, Mus musculus
gtcacgtccggaaggtgaatcggtt

SEQ ID NO: 338125 - DNA, 25 bp, Mus musculus
gtcacgtggcttaggattgtctaaa

SEQ ID NO: 338126 - DNA, 25 bp, Mus musculus
gtcacgttggttggcttttgtttgt

SEQ ID NO: 338127 - DNA, 25 bp, Mus musculus
gtcactaacaaggataagaagcatt

SEQ ID NO: 338128 - DNA, 25 bp, Mus musculus
gtcactaacaccaaggtcacaaagc

SEQ ID NO: 338129 - DNA, 25 bp, Mus musculus
gtcactaagaagacccagagtgata

SEQ ID NO: 338130 - DNA, 25 bp, Mus musculus
gtcactaagttgaaacactaattac

SEQ ID NO: 338131 - DNA, 25 bp, Mus musculus
gtcactaagttgtcccgagtttatg

SEQ ID NO: 338132 - DNA, 25 bp, Mus musculus
gtcactaccaggtgcagacccacct

SEQ ID NO: 338133 - DNA, 25 bp, Mus musculus
gtcactatcagttggtttacctgct

SEQ ID NO: 338134 - DNA, 25 bp, Mus musculus
gtcactcaagagcctcatccccgac

SEQ ID NO: 338135 - DNA, 25 bp, Mus musculus
gtcactcaaggaggctgttgtggat

SEQ ID NO: 338136 - DNA, 25 bp, Mus musculus
gtcactcacatctgtgtctgataac

SEQ ID NO: 338137 - DNA, 25 bp, Mus musculus
gtcactcacatcttcttccctttca

SEQ ID NO: 338138 - DNA, 25 bp, Mus musculus
gtcactcagctcacagtggtaccag

SEQ ID NO: 338139 - DNA, 25 bp, Mus musculus
gtcactcagtggaagttctggatga

SEQ ID NO: 338140 - DNA, 25 bp, Mus musculus
gtcactccagagaaattcccaacat

SEQ ID NO: 338141 - DNA, 25 bp, Mus musculus
gtcactccagaggccacaaaagaag

SEQ ID NO: 338142 - DNA, 25 bp, Mus musculus
gtcactcgaagtgagattgaccttg

SEQ ID NO: 338143 - DNA, 25 bp, Mus musculus
gtcactcgtgcagcgactgcaggac

SEQ ID NO: 338144 - DNA, 25 bp, Mus musculus
gtcactcgtgcagctcagagagccg

SEQ ID NO: 338145 - DNA, 25 bp, Mus musculus
gtcactcgtgcagtgccaccgtgcc

SEQ ID NO: 338146 - DNA, 25 bp, Mus musculus
gtcactctaaccggtcatttggcag

SEQ ID NO: 338147 - DNA, 25 bp, Mus musculus
gtcactctgggagttagcgacgccg

SEQ ID NO: 338148 - DNA, 25 bp, Mus musculus
gtcactgaacaggttgctccaggac

SEQ ID NO: 338149 - DNA, 25 bp, Mus musculus
gtcactgaccggaggaacaaggatg

SEQ ID NO: 338150 - DNA, 25 bp, Mus musculus
gtcactgagaaggtgtccttggtgc

SEQ ID NO: 338151 - DNA, 25 bp, Mus musculus
gtcactgcacagcccatcgtttctg

SEQ ID NO: 338152 - DNA, 25 bp, Mus musculus
gtcactgcagaggaggagggtggac

SEQ ID NO: 338153 - DNA, 25 bp, Mus musculus
gtcactgcagcgacggctccgggtg

SEQ ID NO: 338154 - DNA, 25 bp, Mus musculus
gtcactgcagcgctgctgtggctgg

SEQ ID NO: 338155 - DNA, 25 bp, Mus musculus
gtcactgcaggaagtatttgtagag

SEQ ID NO: 338156 - DNA, 25 bp, Mus musculus
gtcactgccaggtatgtgaagggga

SEQ ID NO: 338157 - DNA, 25 bp, Mus musculus
gtcactgcgacccccagcccagtag

SEQ ID NO: 338158 - DNA, 25 bp, Mus musculus
gtcactgcgccacaggaaagcactg

SEQ ID NO: 338159 - DNA, 25 bp, Mus musculus
gtcactgcggaaactgaaacctttg

SEQ ID NO: 338160 - DNA, 25 bp, Mus musculus
gtcactgctaggtatggcactgcaa

SEQ ID NO: 338161 - DNA, 25 bp, Mus musculus
gtcactggacgagaggatggctgtg

SEQ ID NO: 338162 - DNA, 25 bp, Mus musculus
gtcactggacgagtccgttagatcg

SEQ ID NO: 338163 - DNA, 25 bp, Mus musculus
gtcactgggaggtgtccctgtataa

SEQ ID NO: 338164 - DNA, 25 bp, Mus musculus
gtcactggtttgtacagtgtctacc

SEQ ID NO: 338165 - DNA, 25 bp, Mus musculus
gtcactgtactcaagactgcaggcg

SEQ ID NO: 338166 - DNA, 25 bp, Mus musculus
gtcactgtactcaagtcctggatca

SEQ ID NO: 338167 - DNA, 25 bp, Mus musculus
gtcactgtccttcgggacctgctag

SEQ ID NO: 338168 - DNA, 25 bp, Mus musculus
gtcactgtgcagctcattctctttg

SEQ ID NO: 338169 - DNA, 25 bp, Mus musculus
gtcactgtgcagttccgctcgctgt

SEQ ID NO: 338170 - DNA, 25 bp, Mus musculus
gtcactgtggacgatgctcagacca

SEQ ID NO: 338171 - DNA, 25 bp, Mus musculus
gtcacttgccagctcctgtgcggca

SEQ ID NO: 338172 - DNA, 25 bp, Mus musculus
gtcacttgctacaagtgtggtgaga

SEQ ID NO: 338173 - DNA, 25 bp, Mus musculus
gtcacttgctacaagtgtggtgggc

SEQ ID NO: 338174 - DNA, 25 bp, Mus musculus
gtcacttggccttgatgaagaacaa

SEQ ID NO: 338175 - DNA, 25 bp, Mus musculus
gtcacttgggcatgatccagagcaa

SEQ ID NO: 338176 - DNA, 25 bp, Mus musculus
gtcacttgggcatgctttggtggcc

SEQ ID NO: 338177 - DNA, 25 bp, Mus musculus
gtcacttgtacatggaggctttgct

SEQ ID NO: 338178 - DNA, 25 bp, Mus musculus
gtcacttgtacatggtgctctagac

SEQ ID NO: 338179 - DNA, 25 bp, Mus musculus
gtcacttgtgactgaggctccacgg

SEQ ID NO: 338180 - DNA, 25 bp, Mus musculus
gtcacttgtgctgcttctcaggatg

SEQ ID NO: 338181 - DNA, 25 bp, Mus musculus
gtcactttccaaggaatttgaagcc

SEQ ID NO: 338182 - DNA, 25 bp, Mus musculus
gtcactttcctaaccgcacagacca

SEQ ID NO: 338183 - DNA, 25 bp, Mus musculus
gtcactttcctaccagcaatgccag

SEQ ID NO: 338184 - DNA, 25 bp, Mus musculus
gtcactttcggctggggaactgaca

SEQ ID NO: 338185 - DNA, 25 bp, Mus musculus
gtcactttcgtgggagccacatata

SEQ ID NO: 338186 - DNA, 25 bp, Mus musculus
gtcactttctacaagactatggcga

SEQ ID NO: 338187 - DNA, 25 bp, Mus musculus
gtcactttctacaaggtcatggagg

SEQ ID NO: 338188 - DNA, 25 bp, Mus musculus
gtcactttctacaaggtcattccca

SEQ ID NO: 338189 - DNA, 25 bp, Mus musculus
gtcactttctacaagtctcgcctgc

SEQ ID NO: 338190 - DNA, 25 bp, Mus musculus
gtcactttgcagtgccctgctctgc

SEQ ID NO: 338191 - DNA, 25 bp, Mus musculus
gtcacttttactgtataagtcttgc

SEQ ID NO: 338192 - DNA, 25 bp, Mus musculus
gtcagaaaagttgtcctctctaaca

SEQ ID NO: 338193 - DNA, 25 bp, Mus musculus
gtcagaaaatgagcttggtgttggt

SEQ ID NO: 338194 - DNA, 25 bp, Mus musculus
gtcagaaaccaaaccatatggagaa

SEQ ID NO: 338195 - DNA, 25 bp, Mus musculus
gtcagaaaccaaaccggataagctg

SEQ ID NO: 338196 - DNA, 25 bp, Mus musculus
gtcagaaaccccaggtttcccagga

SEQ ID NO: 338197 - DNA, 25 bp, Mus musculus
gtcagaaaccgtggatgatgaaaac

SEQ ID NO: 338198 - DNA, 25 bp, Mus musculus
gtcagaaacgcttcctcagactgct

SEQ ID NO: 338199 - DNA, 25 bp, Mus musculus
gtcagaaagactctactgtatactc

SEQ ID NO: 338200 - DNA, 25 bp, Mus musculus
gtcagaaagagtctactgtatactc

SEQ ID NO: 338201 - DNA, 25 bp, Mus musculus
gtcagaaagataaggtgaccatagc

SEQ ID NO: 338202 - DNA, 25 bp, Mus musculus
gtcagaaatatgatatcaccaccct

SEQ ID NO: 338203 - DNA, 25 bp, Mus musculus
gtcagaaatatgatatcatgactgt

SEQ ID NO: 338204 - DNA, 25 bp, Mus musculus
gtcagaaatatgatcagcaagaagg

SEQ ID NO: 338205 - DNA, 25 bp, Mus musculus
gtcagaacagaaatgctgccaagaa

SEQ ID NO: 338206 - DNA, 25 bp, Mus musculus
gtcagaacagatcattgtgacagaa

SEQ ID NO: 338207 - DNA, 25 bp, Mus musculus
gtcagaactcaaataattttgcact

SEQ ID NO: 338208 - DNA, 25 bp, Mus musculus
gtcagaactcagcatcttatggaag

SEQ ID NO: 338209 - DNA, 25 bp, Mus musculus
gtcagaactcagtcaggctgttcct

SEQ ID NO: 338210 - DNA, 25 bp, Mus musculus
gtcagaactgagtacacaaacaagt

SEQ ID NO: 338211 - DNA, 25 bp, Mus musculus
gtcagaactgcagttggagctgcac

SEQ ID NO: 338212 - DNA, 25 bp, Mus musculus
gtcagaagaaagagtgcagcagctg

SEQ ID NO: 338213 - DNA, 25 bp, Mus musculus
gtcagaagacatcaagtgctgtaac

SEQ ID NO: 338214 - DNA, 25 bp, Mus musculus
gtcagaagagaagacgccagcaaaa

SEQ ID NO: 338215 - DNA, 25 bp, Mus musculus
gtcagaagaggagtccaaaatcgac

SEQ ID NO: 338216 - DNA, 25 bp, Mus musculus
gtcagaagagggggacctacacact

SEQ ID NO: 338217 - DNA, 25 bp, Mus musculus
gtcagaagatgattcagctaaattt

SEQ ID NO: 338218 - DNA, 25 bp, Mus musculus
gtcagaagcacggtactacaagaag

SEQ ID NO: 338219 - DNA, 25 bp, Mus musculus
gtcagaaggctcggggaacctccgc

SEQ ID NO: 338220 - DNA, 25 bp, Mus musculus
gtcagaagtctgagaactcagatga

SEQ ID NO: 338221 - DNA, 25 bp, Mus musculus
gtcagaagtctgagatgattgggag

SEQ ID NO: 338222 - DNA, 25 bp, Mus musculus
gtcagaattggggaccctctgacta

SEQ ID NO: 338223 - DNA, 25 bp, Mus musculus
gtcagacaagaaagggatctgtgtg

SEQ ID NO: 338224 - DNA, 25 bp, Mus musculus
gtcagacaaggaggaaggctcaaca

SEQ ID NO: 338225 - DNA, 25 bp, Mus musculus
gtcagacaaggtaaggaattacatt

SEQ ID NO: 338226 - DNA, 25 bp, Mus musculus
gtcagaccagggagcccccgggcca

SEQ ID NO: 338227 - DNA, 25 bp, Mus musculus
gtcagaccatacagtcgtttaccct

SEQ ID NO: 338228 - DNA, 25 bp, Mus musculus
gtcagacgatgaaggtgaagatgcc

SEQ ID NO: 338229 - DNA, 25 bp, Mus musculus
gtcagacgatgaagtaaggaaagcc

SEQ ID NO: 338230 - DNA, 25 bp, Mus musculus
gtcagacgatgagatggaactggag

SEQ ID NO: 338231 - DNA, 25 bp, Mus musculus
gtcagactacatggaatatgctcag

SEQ ID NO: 338232 - DNA, 25 bp, Mus musculus
gtcagactcaagcaagacctgcagg

SEQ ID NO: 338233 - DNA, 25 bp, Mus musculus
gtcagactgaggcaccaagtataga

SEQ ID NO: 338234 - DNA, 25 bp, Mus musculus
gtcagacttctcaaggctcagaaat

SEQ ID NO: 338235 - DNA, 25 bp, Mus musculus
gtcagagaaaaacggctcttgcttc

SEQ ID NO: 338236 - DNA, 25 bp, Mus musculus
gtcagagaaagatatgctggcatcg

SEQ ID NO: 338237 - DNA, 25 bp, Mus musculus
gtcagagaaagatatggcagtgaaa

SEQ ID NO: 338238 - DNA, 25 bp, Mus musculus
gtcagagaaagatgtgcactaggcc

SEQ ID NO: 338239 - DNA, 25 bp, Mus musculus
gtcagagaaggaagcagcggtggcg

SEQ ID NO: 338240 - DNA, 25 bp, Mus musculus
gtcagagaaggtctcccatgttctg

SEQ ID NO: 338241 - DNA, 25 bp, Mus musculus
gtcagagaagtatccctgggaggaa

SEQ ID NO: 338242 - DNA, 25 bp, Mus musculus
gtcagagaatgctgactttgcagaa

SEQ ID NO: 338243 - DNA, 25 bp, Mus musculus
gtcagagagaagaatgaaagtaaca

SEQ ID NO: 338244 - DNA, 25 bp, Mus musculus
gtcagagagatgcaggtaacccctc

SEQ ID NO: 338245 - DNA, 25 bp, Mus musculus
gtcagagagatgcagtatgacttct

SEQ ID NO: 338246 - DNA, 25 bp, Mus musculus
gtcagagaggaagattacaacaacc

SEQ ID NO: 338247 - DNA, 25 bp, Mus musculus
gtcagagaggagggccaaggaggct

SEQ ID NO: 338248 - DNA, 25 bp, Mus musculus
gtcagagcaagcatcgctgccatga

SEQ ID NO: 338249 - DNA, 25 bp, Mus musculus
gtcagagcaagcctggctgttttga

SEQ ID NO: 338250 - DNA, 25 bp, Mus musculus
gtcagagcacaggctcagaaatcct

SEQ ID NO: 338251 - DNA, 25 bp, Mus musculus
gtcagagcagcagaaactagacacc

SEQ ID NO: 338252 - DNA, 25 bp, Mus musculus
gtcagagcagcagacaccatgtgcg

SEQ ID NO: 338253 - DNA, 25 bp, Mus musculus
gtcagagcagcagactcctccctcc

SEQ ID NO: 338254 - DNA, 25 bp, Mus musculus
gtcagagcagcagattttccacccc

SEQ ID NO: 338255 - DNA, 25 bp, Mus musculus
gtcagagccacgaaggagattctgg

SEQ ID NO: 338256 - DNA, 25 bp, Mus musculus
gtcagagccagttgtcactcagccc

SEQ ID NO: 338257 - DNA, 25 bp, Mus musculus
gtcagagcccagtctcagatctcgg

SEQ ID NO: 338258 - DNA, 25 bp, Mus musculus
gtcagagccggcttcggagttgggc

SEQ ID NO: 338259 - DNA, 25 bp, Mus musculus
gtcagagcctcagaattgctcagcc

SEQ ID NO: 338260 - DNA, 25 bp, Mus musculus
gtcagagcctcagggggcctgtggc

SEQ ID NO: 338261 - DNA, 25 bp, Mus musculus
gtcagagctctcgtgacagccttga

SEQ ID NO: 338262 - DNA, 25 bp, Mus musculus
gtcagaggaggatacgggaagccag

SEQ ID NO: 338263 - DNA, 25 bp, Mus musculus
gtcagaggaggtggagcctactacc

SEQ ID NO: 338264 - DNA, 25 bp, Mus musculus
gtcagaggcccaggcctctctttct

SEQ ID NO: 338265 - DNA, 25 bp, Mus musculus
gtcagaggccttgctcctaaatgaa

SEQ ID NO: 338266 - DNA, 25 bp, Mus musculus
gtcagagggacctctgttctcctcg

SEQ ID NO: 338267 - DNA, 25 bp, Mus musculus
gtcagaggtaaacagaaagaattta

SEQ ID NO: 338268 - DNA, 25 bp, Mus musculus
gtcagaggtttgagatggaagctct

SEQ ID NO: 338269 - DNA, 25 bp, Mus musculus
gtcagagtatgagaaaataaaggac

SEQ ID NO: 338270 - DNA, 25 bp, Mus musculus
gtcagagtatgagaggctgttatgt

SEQ ID NO: 338271 - DNA, 25 bp, Mus musculus
gtcagagtatgaggaagaagattcc

SEQ ID NO: 338272 - DNA, 25 bp, Mus musculus
gtcagagtatgagtttctcctcatc

SEQ ID NO: 338273 - DNA, 25 bp, Mus musculus
gtcagagtatgtgtcttcaccctgc

SEQ ID NO: 338274 - DNA, 25 bp, Mus musculus
gtcagagtcatgtatcgagtggccc

SEQ ID NO: 338275 - DNA, 25 bp, Mus musculus
gtcagagtccggggaaaacagtaag

SEQ ID NO: 338276 - DNA, 25 bp, Mus musculus
gtcagagtcggagtcttattttagt

SEQ ID NO: 338277 - DNA, 25 bp, Mus musculus
gtcagatattgttgttgttacagat

SEQ ID NO: 338278 - DNA, 25 bp, Mus musculus
gtcagatccatagggatttgaaagc

SEQ ID NO: 338279 - DNA, 25 bp, Mus musculus
gtcagatcccagacttggagagaga

SEQ ID NO: 338280 - DNA, 25 bp, Mus musculus
gtcagatcccaggaagccatgacat

SEQ ID NO: 338281 - DNA, 25 bp, Mus musculus
gtcagatcccagtatatttgtgtct

SEQ ID NO: 338282 - DNA, 25 bp, Mus musculus
gtcagatcgtccaaccttctgtgtt

SEQ ID NO: 338283 - DNA, 25 bp, Mus musculus
gtcagatcgtccaagttgaaaggcc

SEQ ID NO: 338284 - DNA, 25 bp, Mus musculus
gtcagatctggcactcgctcccact

SEQ ID NO: 338285 - DNA, 25 bp, Mus musculus
gtcagatctgtcagtggtgcagtcc

SEQ ID NO: 338286 - DNA, 25 bp, Mus musculus
gtcagatgagccctaggaccatgaa

SEQ ID NO: 338287 - DNA, 25 bp, Mus musculus
gtcagatgagggtacgggcgcttta

SEQ ID NO: 338288 - DNA, 25 bp, Mus musculus
gtcagatgcaggatgccaggcagat

SEQ ID NO: 338289 - DNA, 25 bp, Mus musculus
gtcagatggcagagagtgcagcagc

SEQ ID NO: 338290 - DNA, 25 bp, Mus musculus
gtcagatgtccaagcccccaccttc

SEQ ID NO: 338291 - DNA, 25 bp, Mus musculus
gtcagatgtccaaggtcagagtaca

SEQ ID NO: 338292 - DNA, 25 bp, Mus musculus
gtcagatgtccaagtttggcaatga

SEQ ID NO: 338293 - DNA, 25 bp, Mus musculus
gtcagatgtctccagaacacttcag

SEQ ID NO: 338294 - DNA, 25 bp, Mus musculus
gtcagattacagatcccaggcaggc

SEQ ID NO: 338295 - DNA, 25 bp, Mus musculus
gtcagattcctcagttccaccagag

SEQ ID NO: 338296 - DNA, 25 bp, Mus musculus
gtcagattgaaggtcagatgtacca

SEQ ID NO: 338297 - DNA, 25 bp, Mus musculus
gtcagattggttgtcgccatctttt

SEQ ID NO: 338298 - DNA, 25 bp, Mus musculus
gtcagattggttgtggccatctttt

SEQ ID NO: 338299 - DNA, 25 bp, Mus musculus
gtcagcaagaaagatgttattcttc

SEQ ID NO: 338300 - DNA, 25 bp, Mus musculus
gtcagcaagaaagctgcaggaatga

SEQ ID NO: 338301 - DNA, 25 bp, Mus musculus
gtcagcaagggtattcttcagtatg

SEQ ID NO: 338302 - DNA, 25 bp, Mus musculus
gtcagcaatggggctggagagatgg

SEQ ID NO: 338303 - DNA, 25 bp, Mus musculus
gtcagcaatgggttcagacctcgaa

SEQ ID NO: 338304 - DNA, 25 bp, Mus musculus
gtcagcacaaactacagctgtggag

SEQ ID NO: 338305 - DNA, 25 bp, Mus musculus
gtcagcacaactcctccagtgccaa

SEQ ID NO: 338306 - DNA, 25 bp, Mus musculus
gtcagcacagctgtctgggattcct

SEQ ID NO: 338307 - DNA, 25 bp, Mus musculus
gtcagcacagtgaaggcagtcggag

SEQ ID NO: 338308 - DNA, 25 bp, Mus musculus
gtcagcaccagctcgcagtggtcct

SEQ ID NO: 338309 - DNA, 25 bp, Mus musculus
gtcagcaccagggattctgggcaca

SEQ ID NO: 338310 - DNA, 25 bp, Mus musculus
gtcagcacttatgtgatccgtgatg

SEQ ID NO: 338311 - DNA, 25 bp, Mus musculus
gtcagcacttggcagaatcgtatgg

SEQ ID NO: 338312 - DNA, 25 bp, Mus musculus
gtcagcagagggaaggcctggcctt

SEQ ID NO: 338313 - DNA, 25 bp, Mus musculus
gtcagcagagggaaggtgaccaacc

SEQ ID NO: 338314 - DNA, 25 bp, Mus musculus
gtcagcagcagcggcaggaaaagcc

SEQ ID NO: 338315 - DNA, 25 bp, Mus musculus
gtcagcagcgagcagatgtctcatt

SEQ ID NO: 338316 - DNA, 25 bp, Mus musculus
gtcagcaggaagcgcatccagtatg

SEQ ID NO: 338317 - DNA, 25 bp, Mus musculus
gtcagcaggaagtatggaagcttct

SEQ ID NO: 338318 - DNA, 25 bp, Mus musculus
gtcagcaggacgtggtgacagagtt

SEQ ID NO: 338319 - DNA, 25 bp, Mus musculus
gtcagcaggggtggatctggcttct

SEQ ID NO: 338320 - DNA, 25 bp, Mus musculus
gtcagcatgagagctggattgtcat

SEQ ID NO: 338321 - DNA, 25 bp, Mus musculus
gtcagcatgagaggaaccatttgta

SEQ ID NO: 338322 - DNA, 25 bp, Mus musculus
gtcagcatggctcaggaattttatt

SEQ ID NO: 338323 - DNA, 25 bp, Mus musculus
gtcagcatggctcaggcaagtcttc

SEQ ID NO: 338324 - DNA, 25 bp, Mus musculus
gtcagccaaatggtgttgtgtgaag

SEQ ID NO: 338325 - DNA, 25 bp, Mus musculus
gtcagccaaatgtctttctgtaact

SEQ ID NO: 338326 - DNA, 25 bp, Mus musculus
gtcagccaaattgaggatgccatga

SEQ ID NO: 338327 - DNA, 25 bp, Mus musculus
gtcagccaagaagaccaccaagttt

SEQ ID NO: 338328 - DNA, 25 bp, Mus musculus
gtcagccaagaaggccagcaccctg

SEQ ID NO: 338329 - DNA, 25 bp, Mus musculus
gtcagccaagaaggtgaaggaagag

SEQ ID NO: 338330 - DNA, 25 bp, Mus musculus
gtcagccacagctgttctagctgac

SEQ ID NO: 338331 - DNA, 25 bp, Mus musculus
gtcagccactagacggttcttcatg

SEQ ID NO: 338332 - DNA, 25 bp, Mus musculus
gtcagccagctacagatgcagactc

SEQ ID NO: 338333 - DNA, 25 bp, Mus musculus
gtcagccatacggacacatgtgctg

SEQ ID NO: 338334 - DNA, 25 bp, Mus musculus
gtcagccatacggagtgagcctgtg

SEQ ID NO: 338335 - DNA, 25 bp, Mus musculus
gtcagcccagagctgatttatccag

SEQ ID NO: 338336 - DNA, 25 bp, Mus musculus
gtcagcccaggtgctgtgagtggct

SEQ ID NO: 338337 - DNA, 25 bp, Mus musculus
gtcagccccaacatccagaacccag

SEQ ID NO: 338338 - DNA, 25 bp, Mus musculus
gtcagccccacaccaaggagatcca

SEQ ID NO: 338339 - DNA, 25 bp, Mus musculus
gtcagccccagcctggtagggatgc

SEQ ID NO: 338340 - DNA, 25 bp, Mus musculus
gtcagccgaaagtttaagaggcgag

SEQ ID NO: 338341 - DNA, 25 bp, Mus musculus
gtcagcctttagttcctctttccac

SEQ ID NO: 338342 - DNA, 25 bp, Mus musculus
gtcagcgaaaccaggtccacaggat

SEQ ID NO: 338343 - DNA, 25 bp, Mus musculus
gtcagcgactgggtgccattgtggc

SEQ ID NO: 338344 - DNA, 25 bp, Mus musculus
gtcagcgagaaaggagacaccgtgg

SEQ ID NO: 338345 - DNA, 25 bp, Mus musculus
gtcagcgcaaactgggcaaacgcta

SEQ ID NO: 338346 - DNA, 25 bp, Mus musculus
gtcagcggaggggtatctgctatag

SEQ ID NO: 338347 - DNA, 25 bp, Mus musculus
gtcagcgtctgggaaagaagaggtt

SEQ ID NO: 338348 - DNA, 25 bp, Mus musculus
gtcagctaaccaaggaagggatgct

SEQ ID NO: 338349 - DNA, 25 bp, Mus musculus
gtcagctaaccaaggtttgcccaca

SEQ ID NO: 338350 - DNA, 25 bp, Mus musculus
gtcagctacgcaggaagggcccagc

SEQ ID NO: 338351 - DNA, 25 bp, Mus musculus
gtcagctacgccgatcgggtcaggc

SEQ ID NO: 338352 - DNA, 25 bp, Mus musculus
gtcagctatctccggtccaaatatc

SEQ ID NO: 338353 - DNA, 25 bp, Mus musculus
gtcagctcagaccctgctggacatg

SEQ ID NO: 338354 - DNA, 25 bp, Mus musculus
gtcagctcagctttgcggagcctgg

SEQ ID NO: 338355 - DNA, 25 bp, Mus musculus
gtcagctgacactgtagctcagtgg

SEQ ID NO: 338356 - DNA, 25 bp, Mus musculus
gtcagctgccatcggacaaggctgt

SEQ ID NO: 338357 - DNA, 25 bp, Mus musculus
gtcagctgccatgggacaaggctgt

SEQ ID NO: 338358 - DNA, 25 bp, Mus musculus
gtcagctgcccagcctggtgaggag

SEQ ID NO: 338359 - DNA, 25 bp, Mus musculus
gtcagctgtaccagataacatgttt

SEQ ID NO: 338360 - DNA, 25 bp, Mus musculus
gtcagctgtatccttcaggagccca

SEQ ID NO: 338361 - DNA, 25 bp, Mus musculus
gtcagcttcaaggtggacagcagca

SEQ ID NO: 338362 - DNA, 25 bp, Mus musculus
gtcagcttcggtttgctgccaaact

SEQ ID NO: 338363 - DNA, 25 bp, Mus musculus
gtcagcttgtctggaacctctcagg

SEQ ID NO: 338364 - DNA, 25 bp, Mus musculus
gtcagctttgaacgctgtgtgagaa

SEQ ID NO: 338365 - DNA, 25 bp, Mus musculus
gtcagctttgacgttaccaccaggt

SEQ ID NO: 338366 - DNA, 25 bp, Mus musculus
gtcagctttgagtcggtctatgtgc

SEQ ID NO: 338367 - DNA, 25 bp, Mus musculus
gtcaggaaaagaggaccccaggact

SEQ ID NO: 338368 - DNA, 25 bp, Mus musculus
gtcaggaaaagaggagtgggagctc

SEQ ID NO: 338369 - DNA, 25 bp, Mus musculus
gtcaggaaaattggaacaatccact

SEQ ID NO: 338370 - DNA, 25 bp, Mus musculus
gtcaggaaacagcagattcctcaga

SEQ ID NO: 338371 - DNA, 25 bp, Mus musculus
gtcaggaaacagcagggaaggatct

SEQ ID NO: 338372 - DNA, 25 bp, Mus musculus
gtcaggaaagaatccaccttgacac

SEQ ID NO: 338373 - DNA, 25 bp, Mus musculus
gtcaggaaaggaatcccaatcttaa

SEQ ID NO: 338374 - DNA, 25 bp, Mus musculus
gtcaggaaaggcacatgaatgctca

SEQ ID NO: 338375 - DNA, 25 bp, Mus musculus
gtcaggaaaggtgccctgggacaac

SEQ ID NO: 338376 - DNA, 25 bp, Mus musculus
gtcaggaaatgagtccacagatgat

SEQ ID NO: 338377 - DNA, 25 bp, Mus musculus
gtcaggaactggcggtcttctgttc

SEQ ID NO: 338378 - DNA, 25 bp, Mus musculus
gtcaggaagaggagctttggctgtg

SEQ ID NO: 338379 - DNA, 25 bp, Mus musculus
gtcaggaagaggctgtcaacaggaa

SEQ ID NO: 338380 - DNA, 25 bp, Mus musculus
gtcaggaagagggagtcccagcagg

SEQ ID NO: 338381 - DNA, 25 bp, Mus musculus
gtcaggaagggactggaatacgcta

SEQ ID NO: 338382 - DNA, 25 bp, Mus musculus
gtcaggaatgcttgggaattgaatc

SEQ ID NO: 338383 - DNA, 25 bp, Mus musculus
gtcaggaatgcttgggagagttaac

SEQ ID NO: 338384 - DNA, 25 bp, Mus musculus
gtcaggaattccttaactccattct

SEQ ID NO: 338385 - DNA, 25 bp, Mus musculus
gtcaggacacccctcatgtttctgc

SEQ ID NO: 338386 - DNA, 25 bp, Mus musculus
gtcaggacgatgagcgaggctgctg

SEQ ID NO: 338387 - DNA, 25 bp, Mus musculus
gtcaggagaagagtctgttcaagat

SEQ ID NO: 338388 - DNA, 25 bp, Mus musculus
gtcaggagaagtggctggtgaggtg

SEQ ID NO: 338389 - DNA, 25 bp, Mus musculus
gtcaggagagaaggattggaagaaa

SEQ ID NO: 338390 - DNA, 25 bp, Mus musculus
gtcaggagagaaggcattggaagaa

SEQ ID NO: 338391 - DNA, 25 bp, Mus musculus
gtcaggagcagattgccagggcaac

SEQ ID NO: 338392 - DNA, 25 bp, Mus musculus
gtcaggagtttgggttaatatttgc

SEQ ID NO: 338393 - DNA, 25 bp, Mus musculus
gtcaggatatgacataatgaaatct

SEQ ID NO: 338394 - DNA, 25 bp, Mus musculus
gtcaggatccccaggctgcccttgg

SEQ ID NO: 338395 - DNA, 25 bp, Mus musculus
gtcaggatgccacgaaagcgctaac

SEQ ID NO: 338396 - DNA, 25 bp, Mus musculus
gtcaggatgccacggatccttttgt

SEQ ID NO: 338397 - DNA, 25 bp, Mus musculus
gtcaggatggccaggtactgcaggg

SEQ ID NO: 338398 - DNA, 25 bp, Mus musculus
gtcaggatggccagtcgtggggcct

SEQ ID NO: 338399 - DNA, 25 bp, Mus musculus
gtcaggattctcgatccagagacaa

SEQ ID NO: 338400 - DNA, 25 bp, Mus musculus
gtcaggattctgaagtgagtaatag

SEQ ID NO: 338401 - DNA, 25 bp, Mus musculus
gtcaggatttggagtctgtctccaa

SEQ ID NO: 338402 - DNA, 25 bp, Mus musculus
gtcaggcaaggcagtccctcgagag

SEQ ID NO: 338403 - DNA, 25 bp, Mus musculus
gtcaggcagatgatgtgtgttaaag

SEQ ID NO: 338404 - DNA, 25 bp, Mus musculus
gtcaggcatgaactatgaagatgac

SEQ ID NO: 338405 - DNA, 25 bp, Mus musculus
gtcaggccaagacatgcccggaacc

SEQ ID NO: 338406 - DNA, 25 bp, Mus musculus
gtcaggccaagacgcccacagatta

SEQ ID NO: 338407 - DNA, 25 bp, Mus musculus
gtcaggccaagactaaggggtcccc

SEQ ID NO: 338408 - DNA, 25 bp, Mus musculus
gtcaggccagttgggctgtgactcg

SEQ ID NO: 338409 - DNA, 25 bp, Mus musculus
gtcaggccggaggctcctgtagttt

SEQ ID NO: 338410 - DNA, 25 bp, Mus musculus
gtcaggcgcgaggagctccagaaat

SEQ ID NO: 338411 - DNA, 25 bp, Mus musculus
gtcaggctccttccgatgagcccct

SEQ ID NO: 338412 - DNA, 25 bp, Mus musculus
gtcaggctcgcgctgacgcagtatg

SEQ ID NO: 338413 - DNA, 25 bp, Mus musculus
gtcaggctcgcgctgggtgcatgta

SEQ ID NO: 338414 - DNA, 25 bp, Mus musculus
gtcaggctcgcgctgtatttcaggg

SEQ ID NO: 338415 - DNA, 25 bp, Mus musculus
gtcaggctcggaagaaattgataat

SEQ ID NO: 338416 - DNA, 25 bp, Mus musculus
gtcaggctggagtgacgagtatctg

SEQ ID NO: 338417 - DNA, 25 bp, Mus musculus
gtcaggcttctctgcaagagctgtg

SEQ ID NO: 338418 - DNA, 25 bp, Mus musculus
gtcagggaaggttttggtcgtgtgg

SEQ ID NO: 338419 - DNA, 25 bp, Mus musculus
gtcagggcagggataatcttaagct

SEQ ID NO: 338420 - DNA, 25 bp, Mus musculus
gtcagggccagggattctgggcaca

SEQ ID NO: 338421 - DNA, 25 bp, Mus musculus
gtcagggccaggtgtctccagtgcc

SEQ ID NO: 338422 - DNA, 25 bp, Mus musculus
gtcagggccatgtcttccctctcat

SEQ ID NO: 338423 - DNA, 25 bp, Mus musculus
gtcagggcccagtgggaggagtgaa

SEQ ID NO: 338424 - DNA, 25 bp, Mus musculus
gtcagggccctgaagagcatgacgt

SEQ ID NO: 338425 - DNA, 25 bp, Mus musculus
gtcagggccgtaagagtgcagacca

SEQ ID NO: 338426 - DNA, 25 bp, Mus musculus
gtcaggggattgattatgagaagat

SEQ ID NO: 338427 - DNA, 25 bp, Mus musculus
gtcaggggctttcagggggactgca

SEQ ID NO: 338428 - DNA, 25 bp, Mus musculus
gtcagggggcaaagccaggaggaag

SEQ ID NO: 338429 - DNA, 25 bp, Mus musculus
gtcaggggggaggacctgtgtcatg

SEQ ID NO: 338430 - DNA, 25 bp, Mus musculus
gtcaggggggcccagattcacaaca

SEQ ID NO: 338431 - DNA, 25 bp, Mus musculus
gtcagggtaagagatggctgtgaat

SEQ ID NO: 338432 - DNA, 25 bp, Mus musculus
gtcagggtgcacaggaaatactggg

SEQ ID NO: 338433 - DNA, 25 bp, Mus musculus
gtcagggttctccaagtgttgaatc

SEQ ID NO: 338434 - DNA, 25 bp, Mus musculus
gtcaggtgcaaaatggaacactgtg

SEQ ID NO: 338435 - DNA, 25 bp, Mus musculus
gtcaggtgcaagtgcagaatggaac

SEQ ID NO: 338436 - DNA, 25 bp, Mus musculus
gtcaggtgctgatttcaacgttgaa

SEQ ID NO: 338437 - DNA, 25 bp, Mus musculus
gtcaggtggaggctgcctccacttc

SEQ ID NO: 338438 - DNA, 25 bp, Mus musculus
gtcaggttgccaagcaacacgtgca

SEQ ID NO: 338439 - DNA, 25 bp, Mus musculus
gtcaggttgccaaggccttaatcca

SEQ ID NO: 338440 - DNA, 25 bp, Mus musculus
gtcaggttgtaggttatcttgacga

SEQ ID NO: 338441 - DNA, 25 bp, Mus musculus
gtcaggttttatggactacagattt

SEQ ID NO: 338442 - DNA, 25 bp, Mus musculus
gtcagtaactgaaggtgtccactcc

SEQ ID NO: 338443 - DNA, 25 bp, Mus musculus
gtcagtaagccagaccactgagcaa

SEQ ID NO: 338444 - DNA, 25 bp, Mus musculus
gtcagtaagggggtccaaggctgca

SEQ ID NO: 338445 - DNA, 25 bp, Mus musculus
gtcagtacagcaaacaattgggaaa

SEQ ID NO: 338446 - DNA, 25 bp, Mus musculus
gtcagtacaggttcatcgtttttaa

SEQ ID NO: 338447 - DNA, 25 bp, Mus musculus
gtcagtacctaccgtgctgtgcgga

SEQ ID NO: 338448 - DNA, 25 bp, Mus musculus
gtcagtacctagatcgacagctgaa

SEQ ID NO: 338449 - DNA, 25 bp, Mus musculus
gtcagtagcaacaagctgcgcaaac

SEQ ID NO: 338450 - DNA, 25 bp, Mus musculus
gtcagtatcactgtggaatatcgtt

SEQ ID NO: 338451 - DNA, 25 bp, Mus musculus
gtcagtatcactgtggcaatagtaa

SEQ ID NO: 338452 - DNA, 25 bp, Mus musculus
gtcagtattacccttctagctgggg

SEQ ID NO: 338453 - DNA, 25 bp, Mus musculus
gtcagtcactgctaggtatggcact

SEQ ID NO: 338454 - DNA, 25 bp, Mus musculus
gtcagtcaggacttgctagacctga

SEQ ID NO: 338455 - DNA, 25 bp, Mus musculus
gtcagtcattgggaagactcttcaa

SEQ ID NO: 338456 - DNA, 25 bp, Mus musculus
gtcagtccaggaccacttggtcata

SEQ ID NO: 338457 - DNA, 25 bp, Mus musculus
gtcagtcctatggcagtaccagtga

SEQ ID NO: 338458 - DNA, 25 bp, Mus musculus
gtcagtcctgggctgggccgtcgga

SEQ ID NO: 338459 - DNA, 25 bp, Mus musculus
gtcagtcggatgaggaagggcccgg

SEQ ID NO: 338460 - DNA, 25 bp, Mus musculus
gtcagtctcggcgtggaaaggagac

SEQ ID NO: 338461 - DNA, 25 bp, Mus musculus
gtcagtctctgcaggttcaggggca

SEQ ID NO: 338462 - DNA, 25 bp, Mus musculus
gtcagtcttacaatacggactctga

SEQ ID NO: 338463 - DNA, 25 bp, Mus musculus
gtcagtgaaggcaggagctgggagg

SEQ ID NO: 338464 - DNA, 25 bp, Mus musculus
gtcagtgaggacttacagaagctca

SEQ ID NO: 338465 - DNA, 25 bp, Mus musculus
gtcagtgcacagaacctcgttgcca

SEQ ID NO: 338466 - DNA, 25 bp, Mus musculus
gtcagtggagcagcttacagatgtc

SEQ ID NO: 338467 - DNA, 25 bp, Mus musculus
gtcagtgggcagatgcacatgcaga

SEQ ID NO: 338468 - DNA, 25 bp, Mus musculus
gtcagtgtctccctccaagccacac

SEQ ID NO: 338469 - DNA, 25 bp, Mus musculus
gtcagtgtggaagagctcccgccag

SEQ ID NO: 338470 - DNA, 25 bp, Mus musculus
gtcagtgtgtcaaatctctcatgga

SEQ ID NO: 338471 - DNA, 25 bp, Mus musculus
gtcagtgttggtttcaacctcttgg

SEQ ID NO: 338472 - DNA, 25 bp, Mus musculus
gtcagttaaaagaaggtaccaggtg

SEQ ID NO: 338473 - DNA, 25 bp, Mus musculus
gtcagttcagcttcaattagtgggg

SEQ ID NO: 338474 - DNA, 25 bp, Mus musculus
gtcagttctgggaagcttccagctt

SEQ ID NO: 338475 - DNA, 25 bp, Mus musculus
gtcagttctgggaagtctccaggct

SEQ ID NO: 338476 - DNA, 25 bp, Mus musculus
gtcagttgctttctgtgaggccagg

SEQ ID NO: 338477 - DNA, 25 bp, Mus musculus
gtcagttgctttctgtttctaatcc

SEQ ID NO: 338478 - DNA, 25 bp, Mus musculus
gtcagttgggaaattcctaaatgca

SEQ ID NO: 338479 - DNA, 25 bp, Mus musculus
gtcagttgggagaccgtaccaccac

SEQ ID NO: 338480 - DNA, 25 bp, Mus musculus
gtcagttgggagcttgcactagcac

SEQ ID NO: 338481 - DNA, 25 bp, Mus musculus
gtcagttgtagagggcatctcctcc

SEQ ID NO: 338482 - DNA, 25 bp, Mus musculus
gtcagtttaattatgatggagaaga

SEQ ID NO: 338483 - DNA, 25 bp, Mus musculus
gtcagtttaattatggtatgcagcc

SEQ ID NO: 338484 - DNA, 25 bp, Mus musculus
gtcagtttatcaaagtcatgtagga

SEQ ID NO: 338485 - DNA, 25 bp, Mus musculus
gtcagtttttttgcattttgttccc

SEQ ID NO: 338486 - DNA, 25 bp, Mus musculus
gtcataaaagaaatgtaccccaagc

SEQ ID NO: 338487 - DNA, 25 bp, Mus musculus
gtcataaaagatgggcgaaccaagg

SEQ ID NO: 338488 - DNA, 25 bp, Mus musculus
gtcataaatacaaaacctgggcatt

SEQ ID NO: 338489 - DNA, 25 bp, Mus musculus
gtcataagaagacacacacaggaga

SEQ ID NO: 338490 - DNA, 25 bp, Mus musculus
gtcataaggaccaggatacaaattg

SEQ ID NO: 338491 - DNA, 25 bp, Mus musculus
gtcatacagaaccatgaccatccac

SEQ ID NO: 338492 - DNA, 25 bp, Mus musculus
gtcatacagaggtaccttccttgcg

SEQ ID NO: 338493 - DNA, 25 bp, Mus musculus
gtcatacagaggttaaattaaaaat

SEQ ID NO: 338494 - DNA, 25 bp, Mus musculus
gtcatacagccaaggccaggtagct

SEQ ID NO: 338495 - DNA, 25 bp, Mus musculus
gtcataccaggtaatatccttgttc

SEQ ID NO: 338496 - DNA, 25 bp, Mus musculus
gtcatactctgagtgacagcttcct

SEQ ID NO: 338497 - DNA, 25 bp, Mus musculus
gtcatactgtagaggaatgcctcca

SEQ ID NO: 338498 - DNA, 25 bp, Mus musculus
gtcatactgtagaggagaatccttc

SEQ ID NO: 338499 - DNA, 25 bp, Mus musculus
gtcatagcagggtgttcttctggac

SEQ ID NO: 338500 - DNA, 25 bp, Mus musculus
gtcatagcatcaggcactgttgtag

SEQ ID NO: 338501 - DNA, 25 bp, Mus musculus
gtcataggaacaaagacaggaaatc

SEQ ID NO: 338502 - DNA, 25 bp, Mus musculus
gtcataggaacagattgagaaatgg

SEQ ID NO: 338503 - DNA, 25 bp, Mus musculus
gtcatagtactagattcatcccagg

SEQ ID NO: 338504 - DNA, 25 bp, Mus musculus
gtcatagtgcatttctcatctacat

SEQ ID NO: 338505 - DNA, 25 bp, Mus musculus
gtcatatcaggtaacgggcaaccaa

SEQ ID NO: 338506 - DNA, 25 bp, Mus musculus
gtcatatctgctaaggctttggagt

SEQ ID NO: 338507 - DNA, 25 bp, Mus musculus
gtcatatgtagcagctgtggcagac

SEQ ID NO: 338508 - DNA, 25 bp, Mus musculus
gtcatattcagagcctcagcttaag

SEQ ID NO: 338509 - DNA, 25 bp, Mus musculus
gtcatattcggtggatttctttatt

SEQ ID NO: 338510 - DNA, 25 bp, Mus musculus
gtcatattttggtttttgggaataa

SEQ ID NO: 338511 - DNA, 25 bp, Mus musculus
gtcatcaaaggcctctccctggaac

SEQ ID NO: 338512 - DNA, 25 bp, Mus musculus
gtcatcaaagggaatgatgaaaggc

SEQ ID NO: 338513 - DNA, 25 bp, Mus musculus
gtcatcaaagggtctgagtggcaaa

SEQ ID NO: 338514 - DNA, 25 bp, Mus musculus
gtcatcaaaggtccagatgttcctt

SEQ ID NO: 338515 - DNA, 25 bp, Mus musculus
gtcatcaacacagactttcctgccc

SEQ ID NO: 338516 - DNA, 25 bp, Mus musculus
gtcatcaacaggctctcctttttac

SEQ ID NO: 338517 - DNA, 25 bp, Mus musculus
gtcatcaacagggctgatatccctg

SEQ ID NO: 338518 - DNA, 25 bp, Mus musculus
gtcatcaaccaaaagctggcatctg

SEQ ID NO: 338519 - DNA, 25 bp, Mus musculus
gtcatcaaccagcatggcgaggaga

SEQ ID NO: 338520 - DNA, 25 bp, Mus musculus
gtcatcaaccaggatggcgaggaga

SEQ ID NO: 338521 - DNA, 25 bp, Mus musculus
gtcatcaagcagtgctatcaagatc

SEQ ID NO: 338522 - DNA, 25 bp, Mus musculus
gtcatcaagtcaggctcagatgagg

SEQ ID NO: 338523 - DNA, 25 bp, Mus musculus
gtcatcacaccggtgttttggccag

SEQ ID NO: 338524 - DNA, 25 bp, Mus musculus
gtcatcacagacaccctctctccag

SEQ ID NO: 338525 - DNA, 25 bp, Mus musculus
gtcatcacagattctttaagatttc

SEQ ID NO: 338526 - DNA, 25 bp, Mus musculus
gtcatcacagcttagcgctctgtgg

SEQ ID NO: 338527 - DNA, 25 bp, Mus musculus
gtcatcaccaccggcgcctgttttt

SEQ ID NO: 338528 - DNA, 25 bp, Mus musculus
gtcatcaccatgatctgtgccattg

SEQ ID NO: 338529 - DNA, 25 bp, Mus musculus
gtcatcaccggggcttgcgacaagg

SEQ ID NO: 338530 - DNA, 25 bp, Mus musculus
gtcatcaccggggttccattttggg

SEQ ID NO: 338531 - DNA, 25 bp, Mus musculus
gtcatcacctacatccgcaggctgc

SEQ ID NO: 338532 - DNA, 25 bp, Mus musculus
gtcatcactgtcatccaggacatgg

SEQ ID NO: 338533 - DNA, 25 bp, Mus musculus
gtcatcagcgatgagatggtacaga

SEQ ID NO: 338534 - DNA, 25 bp, Mus musculus
gtcatcagcgatgaggtagttttga

SEQ ID NO: 338535 - DNA, 25 bp, Mus musculus
gtcatcatcacccaagatcatcatg

SEQ ID NO: 338536 - DNA, 25 bp, Mus musculus
gtcatcatcgggaagttctgattca

SEQ ID NO: 338537 - DNA, 25 bp, Mus musculus
gtcatcatgaatgtgaaagagtttc

SEQ ID NO: 338538 - DNA, 25 bp, Mus musculus
gtcatcattgcaaaggatgaagtcg

SEQ ID NO: 338539 - DNA, 25 bp, Mus musculus
gtcatccacacctccatcccactct

SEQ ID NO: 338540 - DNA, 25 bp, Mus musculus
gtcatccacagaatcctagactttg

SEQ ID NO: 338541 - DNA, 25 bp, Mus musculus
gtcatccacagagacttgaagcctg

SEQ ID NO: 338542 - DNA, 25 bp, Mus musculus
gtcatccacattgagagcaccaaga

SEQ ID NO: 338543 - DNA, 25 bp, Mus musculus
gtcatccacggtgtggcctcttcct

SEQ ID NO: 338544 - DNA, 25 bp, Mus musculus
gtcatccaggacacgtttctgtgtt

SEQ ID NO: 338545 - DNA, 25 bp, Mus musculus
gtcatccaggaccccatgcctgcgg

SEQ ID NO: 338546 - DNA, 25 bp, Mus musculus
gtcatcccagccggagtgttctttt

SEQ ID NO: 338547 - DNA, 25 bp, Mus musculus
gtcatcccccacgctgacagccctg

SEQ ID NO: 338548 - DNA, 25 bp, Mus musculus
gtcatccccgatgatcatcccctct

SEQ ID NO: 338549 - DNA, 25 bp, Mus musculus
gtcatccccgtggccctgttgcatc

SEQ ID NO: 338550 - DNA, 25 bp, Mus musculus
gtcatccctaaaggtgtcataagcc

SEQ ID NO: 338551 - DNA, 25 bp, Mus musculus
gtcatccctggaaaagcctgaaaat

SEQ ID NO: 338552 - DNA, 25 bp, Mus musculus
gtcatccggaagctggcaaaaacgc

SEQ ID NO: 338553 - DNA, 25 bp, Mus musculus
gtcatcctcagacaacattgtgcac

SEQ ID NO: 338554 - DNA, 25 bp, Mus musculus
gtcatcctcagctgggagggcattg

SEQ ID NO: 338555 - DNA, 25 bp, Mus musculus
gtcatcctcaggcacaccaagatga

SEQ ID NO: 338556 - DNA, 25 bp, Mus musculus
gtcatcctcaggcagtgccctgaaa

SEQ ID NO: 338557 - DNA, 25 bp, Mus musculus
gtcatcctcattgagacccccgatg

SEQ ID NO: 338558 - DNA, 25 bp, Mus musculus
gtcatcctcgaagccaagctggata

SEQ ID NO: 338559 - DNA, 25 bp, Mus musculus
gtcatcctcgtgcctggctgcttgg

SEQ ID NO: 338560 - DNA, 25 bp, Mus musculus
gtcatcctcttctatgcggcaggcc

SEQ ID NO: 338561 - DNA, 25 bp, Mus musculus
gtcatcctcttctgagcattccggc

SEQ ID NO: 338562 - DNA, 25 bp, Mus musculus
gtcatcctgacagaaacacataaac

SEQ ID NO: 338563 - DNA, 25 bp, Mus musculus
gtcatcctgacagaagatgattctg

SEQ ID NO: 338564 - DNA, 25 bp, Mus musculus
gtcatcctgccacaggtactactgg

SEQ ID NO: 338565 - DNA, 25 bp, Mus musculus
gtcatcctggacatggcccgtgtgg

SEQ ID NO: 338566 - DNA, 25 bp, Mus musculus
gtcatcctgtgagttgggtgcaaag

SEQ ID NO: 338567 - DNA, 25 bp, Mus musculus
gtcatccttcgaggatgtctcggaa

SEQ ID NO: 338568 - DNA, 25 bp, Mus musculus
gtcatccttcgaggcttgctttgct

SEQ ID NO: 338569 - DNA, 25 bp, Mus musculus
gtcatcctttgttgatggtattgcg

SEQ ID NO: 338570 - DNA, 25 bp, Mus musculus
gtcatcgaaagcaagtctcgttaca

SEQ ID NO: 338571 - DNA, 25 bp, Mus musculus
gtcatcgaaggagctgtgcggtctg

SEQ ID NO: 338572 - DNA, 25 bp, Mus musculus
gtcatcgacaatgagcaccgggggc

SEQ ID NO: 338573 - DNA, 25 bp, Mus musculus
gtcatcgacaatggttcaggggtga

SEQ ID NO: 338574 - DNA, 25 bp, Mus musculus
gtcatcgacagaggatgagggtgag

SEQ ID NO: 338575 - DNA, 25 bp, Mus musculus
gtcatcgagcaatggctaggagacc

SEQ ID NO: 338576 - DNA, 25 bp, Mus musculus
gtcatcgccacctgcggccccgact

SEQ ID NO: 338577 - DNA, 25 bp, Mus musculus
gtcatcgggctgcagatgggcacca

SEQ ID NO: 338578 - DNA, 25 bp, Mus musculus
gtcatcggttcgatttggggatatt

SEQ ID NO: 338579 - DNA, 25 bp, Mus musculus
gtcatcggttcggcgtaatagcttg

SEQ ID NO: 338580 - DNA, 25 bp, Mus musculus
gtcatcgtcatacgtccctggaggc

SEQ ID NO: 338581 - DNA, 25 bp, Mus musculus
gtcatcgttagaagcaaaatctaca

SEQ ID NO: 338582 - DNA, 25 bp, Mus musculus
gtcatcgttagaagctgaaggaaga

SEQ ID NO: 338583 - DNA, 25 bp, Mus musculus
gtcatctaggctaaaggacacagct

SEQ ID NO: 338584 - DNA, 25 bp, Mus musculus
gtcatctatctgaaggccctgtcca

SEQ ID NO: 338585 - DNA, 25 bp, Mus musculus
gtcatctattttcaggatgtcagtg

SEQ ID NO: 338586 - DNA, 25 bp, Mus musculus
gtcatctattttcaggggtttcgtg

SEQ ID NO: 338587 - DNA, 25 bp, Mus musculus
gtcatctcccagggactgcgcagct

SEQ ID NO: 338588 - DNA, 25 bp, Mus musculus
gtcatctctgaaagttctcctgtct

SEQ ID NO: 338589 - DNA, 25 bp, Mus musculus
gtcatctctgtatgtgactgtccta

SEQ ID NO: 338590 - DNA, 25 bp, Mus musculus
gtcatctgacaacagccaagagaaa

SEQ ID NO: 338591 - DNA, 25 bp, Mus musculus
gtcatctgacaacaggtcaccttcg

SEQ ID NO: 338592 - DNA, 25 bp, Mus musculus
gtcatctgagggaaagccacccacc

SEQ ID NO: 338593 - DNA, 25 bp, Mus musculus
gtcatctgcaaacagaagcgatgtc

SEQ ID NO: 338594 - DNA, 25 bp, Mus musculus
gtcatctgcgaacacgactccttct

SEQ ID NO: 338595 - DNA, 25 bp, Mus musculus
gtcatctgtaccagccgtgactgtc

SEQ ID NO: 338596 - DNA, 25 bp, Mus musculus
gtcatctgtaccaggtgcgcaagga

SEQ ID NO: 338597 - DNA, 25 bp, Mus musculus
gtcatcttaagaaagaggaagcaga

SEQ ID NO: 338598 - DNA, 25 bp, Mus musculus
gtcatcttaccgatcaagaagctac

SEQ ID NO: 338599 - DNA, 25 bp, Mus musculus
gtcatgaaactgcagatccaggtgg

SEQ ID NO: 338600 - DNA, 25 bp, Mus musculus
gtcatgaaactgcagtgctggcaga

SEQ ID NO: 338601 - DNA, 25 bp, Mus musculus
gtcatgaaagaggctaccttaaggg

SEQ ID NO: 338602 - DNA, 25 bp, Mus musculus
gtcatgacactgaacctgcagccag

SEQ ID NO: 338603 - DNA, 25 bp, Mus musculus
gtcatgaccaatggctggaagctaa

SEQ ID NO: 338604 - DNA, 25 bp, Mus musculus
gtcatgactgccatttgcttcacac

SEQ ID NO: 338605 - DNA, 25 bp, Mus musculus
gtcatgactggggtgatctgctttg

SEQ ID NO: 338606 - DNA, 25 bp, Mus musculus
gtcatgagaacacaaattgaagtga

SEQ ID NO: 338607 - DNA, 25 bp, Mus musculus
gtcatgagaggagaaagagtcctga

SEQ ID NO: 338608 - DNA, 25 bp, Mus musculus
gtcatgagaggagggcaggttttgt

SEQ ID NO: 338609 - DNA, 25 bp, Mus musculus
gtcatgagaggccagatcctaaatt

SEQ ID NO: 338610 - DNA, 25 bp, Mus musculus
gtcatgagtccaaggagtctctcgc

SEQ ID NO: 338611 - DNA, 25 bp, Mus musculus
gtcatgagtcgaaggagtctctcgc

SEQ ID NO: 338612 - DNA, 25 bp, Mus musculus
gtcatgagtgagattgataacaaca

SEQ ID NO: 338613 - DNA, 25 bp, Mus musculus
gtcatgagtgagggtacaagaaggt

SEQ ID NO: 338614 - DNA, 25 bp, Mus musculus
gtcatgagtgcagaggggaacctgc

SEQ ID NO: 338615 - DNA, 25 bp, Mus musculus
gtcatgataggagacgattgcaggg

SEQ ID NO: 338616 - DNA, 25 bp, Mus musculus
gtcatgatcacaggacacctatatc

SEQ ID NO: 338617 - DNA, 25 bp, Mus musculus
gtcatgatcacaggtgacaatcttc

SEQ ID NO: 338618 - DNA, 25 bp, Mus musculus
gtcatgatgaaaacggaacaccaga

SEQ ID NO: 338619 - DNA, 25 bp, Mus musculus
gtcatgattccgaagcacctttggg

SEQ ID NO: 338620 - DNA, 25 bp, Mus musculus
gtcatgcaagcatttgacatgctct

SEQ ID NO: 338621 - DNA, 25 bp, Mus musculus
gtcatgcaaggttcaaagggatcca

SEQ ID NO: 338622 - DNA, 25 bp, Mus musculus
gtcatgcaagtttgtatgccggaag

SEQ ID NO: 338623 - DNA, 25 bp, Mus musculus
gtcatgccagatgtctctccgagct

SEQ ID NO: 338624 - DNA, 25 bp, Mus musculus
gtcatgcccagcttcccatcatcat

SEQ ID NO: 338625 - DNA, 25 bp, Mus musculus
gtcatgcccagggagtccccccatc

SEQ ID NO: 338626 - DNA, 25 bp, Mus musculus
gtcatgcccagtgcctatgcttgtg

SEQ ID NO: 338627 - DNA, 25 bp, Mus musculus
gtcatgcccttagatttctacacga

SEQ ID NO: 338628 - DNA, 25 bp, Mus musculus
gtcatgcctctgcagacgtggagaa

SEQ ID NO: 338629 - DNA, 25 bp, Mus musculus
gtcatgctcaaggacatggcagact

SEQ ID NO: 338630 - DNA, 25 bp, Mus musculus
gtcatgctgaatgctaggtagaagc

SEQ ID NO: 338631 - DNA, 25 bp, Mus musculus
gtcatgctgtgtgcaggagagatgg

SEQ ID NO: 338632 - DNA, 25 bp, Mus musculus
gtcatggaaacccagcgctaactgt

SEQ ID NO: 338633 - DNA, 25 bp, Mus musculus
gtcatggaaagttacttcaatgaga

SEQ ID NO: 338634 - DNA, 25 bp, Mus musculus
gtcatggaaatatgggcttaggtca

SEQ ID NO: 338635 - DNA, 25 bp, Mus musculus
gtcatggaacaggtgagaggctatg

SEQ ID NO: 338636 - DNA, 25 bp, Mus musculus
gtcatggaatcaggcggcccccttt

SEQ ID NO: 338637 - DNA, 25 bp, Mus musculus
gtcatggaatcagggtgcgactgga

SEQ ID NO: 338638 - DNA, 25 bp, Mus musculus
gtcatggacggtttgaagatcaact

SEQ ID NO: 338639 - DNA, 25 bp, Mus musculus
gtcatggacgttcggggatgaggtc

SEQ ID NO: 338640 - DNA, 25 bp, Mus musculus
gtcatggagtatacaaaaaagcctg

SEQ ID NO: 338641 - DNA, 25 bp, Mus musculus
gtcatggattaccatctagatgttg

SEQ ID NO: 338642 - DNA, 25 bp, Mus musculus
gtcatggcaacagactccaagcccc

SEQ ID NO: 338643 - DNA, 25 bp, Mus musculus
gtcatggctattgagcatgcaccat

SEQ ID NO: 338644 - DNA, 25 bp, Mus musculus
gtcatgggatggctgcactgcccag

SEQ ID NO: 338645 - DNA, 25 bp, Mus musculus
gtcatgggcccgattgacgacagtg

SEQ ID NO: 338646 - DNA, 25 bp, Mus musculus
gtcatggggtgtgtgagtgttatga

SEQ ID NO: 338647 - DNA, 25 bp, Mus musculus
gtcatggtcccgggtgaacagagta

SEQ ID NO: 338648 - DNA, 25 bp, Mus musculus
gtcatggtgtgaggggtcccacaga

SEQ ID NO: 338649 - DNA, 25 bp, Mus musculus
gtcatgtattccagcatccagaatt

SEQ ID NO: 338650 - DNA, 25 bp, Mus musculus
gtcatgtattccaggcgttacaata

SEQ ID NO: 338651 - DNA, 25 bp, Mus musculus
gtcatgtgcagagacaggctttgat

SEQ ID NO: 338652 - DNA, 25 bp, Mus musculus
gtcatgtgcaggctttgatatgtca

SEQ ID NO: 338653 - DNA, 25 bp, Mus musculus
gtcatgttcttcttcagaaacaaac

SEQ ID NO: 338654 - DNA, 25 bp, Mus musculus
gtcatgttgtcgcaggacagtaatg

SEQ ID NO: 338655 - DNA, 25 bp, Mus musculus
gtcatgttgtgtgcaggagagatgg

SEQ ID NO: 338656 - DNA, 25 bp, Mus musculus
gtcattaactacgtggaaaaggcag

SEQ ID NO: 338657 - DNA, 25 bp, Mus musculus
gtcattaactccatgtaatcgtgtt

SEQ ID NO: 338658 - DNA, 25 bp, Mus musculus
gtcattaatccaggatccacagggt

SEQ ID NO: 338659 - DNA, 25 bp, Mus musculus
gtcattataacaggtgagacgacaa

SEQ ID NO: 338660 - DNA, 25 bp, Mus musculus
gtcattcaaacctgaacgctggaaa

SEQ ID NO: 338661 - DNA, 25 bp, Mus musculus
gtcattcaaacctgtggtttgctct

SEQ ID NO: 338662 - DNA, 25 bp, Mus musculus
gtcattcaagtttatctccggcatc

SEQ ID NO: 338663 - DNA, 25 bp, Mus musculus
gtcattcacgagcaccctgaaacat

SEQ ID NO: 338664 - DNA, 25 bp, Mus musculus
gtcattcacggtgaaggcagcttcc

SEQ ID NO: 338665 - DNA, 25 bp, Mus musculus
gtcattcactgtataagcatgatcc

SEQ ID NO: 338666 - DNA, 25 bp, Mus musculus
gtcattcagaaggcctctctcttgt

SEQ ID NO: 338667 - DNA, 25 bp, Mus musculus
gtcattcataaagattgaggaagac

SEQ ID NO: 338668 - DNA, 25 bp, Mus musculus
gtcattccaccccagactctgcaga

SEQ ID NO: 338669 - DNA, 25 bp, Mus musculus
gtcattccagggatcttcattgcct

SEQ ID NO: 338670 - DNA, 25 bp, Mus musculus
gtcattgaagacccaactccgaagt

SEQ ID NO: 338671 - DNA, 25 bp, Mus musculus
gtcattgaccagaccaccgctcttg

SEQ ID NO: 338672 - DNA, 25 bp, Mus musculus
gtcattgagaagtgccccaagccag

SEQ ID NO: 338673 - DNA, 25 bp, Mus musculus
gtcattgagaagtgcctgtgacatt

SEQ ID NO: 338674 - DNA, 25 bp, Mus musculus
gtcattgagagaagtgatattgtgg

SEQ ID NO: 338675 - DNA, 25 bp, Mus musculus
gtcattgagtaggtggacccatgct

SEQ ID NO: 338676 - DNA, 25 bp, Mus musculus
gtcattgatcaaggtctgaagaaga

SEQ ID NO: 338677 - DNA, 25 bp, Mus musculus
gtcattgctcagaagaaacctgctc

SEQ ID NO: 338678 - DNA, 25 bp, Mus musculus
gtcattggagccaggcaggtgcagt

SEQ ID NO: 338679 - DNA, 25 bp, Mus musculus
gtcattggagccaggtacgtacaga

SEQ ID NO: 338680 - DNA, 25 bp, Mus musculus
gtcattggaggccttgagaagaaga

SEQ ID NO: 338681 - DNA, 25 bp, Mus musculus
gtcattggaggtgtccatcatacct

SEQ ID NO: 338682 - DNA, 25 bp, Mus musculus
gtcattggcttgaaggatgctcaga

SEQ ID NO: 338683 - DNA, 25 bp, Mus musculus
gtcattgggagagtccttatcggac

SEQ ID NO: 338684 - DNA, 25 bp, Mus musculus
gtcattgtcagctggattgtcattg

SEQ ID NO: 338685 - DNA, 25 bp, Mus musculus
gtcattgtcgatgaggtccatgaga

SEQ ID NO: 338686 - DNA, 25 bp, Mus musculus
gtcattgtgcttcatgttcaaatag

SEQ ID NO: 338687 - DNA, 25 bp, Mus musculus
gtcattgtgcttcgtgcctttattg

SEQ ID NO: 338688 - DNA, 25 bp, Mus musculus
gtcattgtgcttgatgttcaaatag

SEQ ID NO: 338689 - DNA, 25 bp, Mus musculus
gtcattgtgcttggtgcctttattg

SEQ ID NO: 338690 - DNA, 25 bp, Mus musculus
gtcattgtggctgatcagactccaa

SEQ ID NO: 338691 - DNA, 25 bp, Mus musculus
gtcatttacacaatgtactttcctt

SEQ ID NO: 338692 - DNA, 25 bp, Mus musculus
gtcatttacacgggttatgcaacaa

SEQ ID NO: 338693 - DNA, 25 bp, Mus musculus
gtcatttactatttccatgatggcc

SEQ ID NO: 338694 - DNA, 25 bp, Mus musculus
gtcatttatagggttatacagggga

SEQ ID NO: 338695 - DNA, 25 bp, Mus musculus
gtcatttcagccgtgtttgaccggg

SEQ ID NO: 338696 - DNA, 25 bp, Mus musculus
gtcatttcaggggagcgtttgccta

SEQ ID NO: 338697 - DNA, 25 bp, Mus musculus
gtcatttctcacggaaacctaggca

SEQ ID NO: 338698 - DNA, 25 bp, Mus musculus
gtcatttctcacgggcacatctcat

SEQ ID NO: 338699 - DNA, 25 bp, Mus musculus
gtcatttgcaggtttaaggagagta

SEQ ID NO: 338700 - DNA, 25 bp, Mus musculus
gtcatttgttcgggaacctttgctc

SEQ ID NO: 338701 - DNA, 25 bp, Mus musculus
gtcatttgttcgggcttacggtgaa

SEQ ID NO: 338702 - DNA, 25 bp, Mus musculus
gtcattttcagaatggtcgatgtag

SEQ ID NO: 338703 - DNA, 25 bp, Mus musculus
gtcattttcatgatcacaaaatttg

SEQ ID NO: 338704 - DNA, 25 bp, Mus musculus
gtcattttgaaagatgtccttcaag

SEQ ID NO: 338705 - DNA, 25 bp, Mus musculus
gtcattttgtgcagcttacctgtgg

SEQ ID NO: 338706 - DNA, 25 bp, Mus musculus
gtcattttgtgcaggatctgctgat

SEQ ID NO: 338707 - DNA, 25 bp, Mus musculus
gtcattttgttaaaggctgatgaac

SEQ ID NO: 338708 - DNA, 25 bp, Mus musculus
gtcatttttagctccgcctgctccc

SEQ ID NO: 338709 - DNA, 25 bp, Mus musculus
gtcatttttaggatttggtgtcatt

SEQ ID NO: 338710 - DNA, 25 bp, Mus musculus
gtccaaaaaacagatcaaaaggtcc

SEQ ID NO: 338711 - DNA, 25 bp, Mus musculus
gtccaaacaaccaagagaagcaatt

SEQ ID NO: 338712 - DNA, 25 bp, Mus musculus
gtccaaacaaccaagcacttgtttc

SEQ ID NO: 338713 - DNA, 25 bp, Mus musculus
gtccaaacagactgaaagtgtccca

SEQ ID NO: 338714 - DNA, 25 bp, Mus musculus
gtccaaacagttcagatttcaacta

SEQ ID NO: 338715 - DNA, 25 bp, Mus musculus
gtccaaacagttcagtcattgttct

SEQ ID NO: 338716 - DNA, 25 bp, Mus musculus
gtccaaacagttcagtcttcctgta

SEQ ID NO: 338717 - DNA, 25 bp, Mus musculus
gtccaaacataggaattccaggcag

SEQ ID NO: 338718 - DNA, 25 bp, Mus musculus
gtccaaacatgactttctgggacaa

SEQ ID NO: 338719 - DNA, 25 bp, Mus musculus
gtccaaatcacaggcatatgctatg

SEQ ID NO: 338720 - DNA, 25 bp, Mus musculus
gtccaaccagaaagagtccaaagct

SEQ ID NO: 338721 - DNA, 25 bp, Mus musculus
gtccaaccctaaagatcctgttgtc

SEQ ID NO: 338722 - DNA, 25 bp, Mus musculus
gtccaacctcgggctcaaaaaattg

SEQ ID NO: 338723 - DNA, 25 bp, Mus musculus
gtccaacctggggtttaagaggcga

SEQ ID NO: 338724 - DNA, 25 bp, Mus musculus
gtccaacgaaaggtaacatttcact

SEQ ID NO: 338725 - DNA, 25 bp, Mus musculus
gtccaagaaaatatttcagatacac

SEQ ID NO: 338726 - DNA, 25 bp, Mus musculus
gtccaagaagaggagaaaccaagac

SEQ ID NO: 338727 - DNA, 25 bp, Mus musculus
gtccaagaagatgctgtcgccgagg

SEQ ID NO: 338728 - DNA, 25 bp, Mus musculus
gtccaagaaggtgaatgaatataaa

SEQ ID NO: 338729 - DNA, 25 bp, Mus musculus
gtccaagaggaaagacaaagtcagc

SEQ ID NO: 338730 - DNA, 25 bp, Mus musculus
gtccaagaggaaagacagctacaac

SEQ ID NO: 338731 - DNA, 25 bp, Mus musculus
gtccaagaggaaaggtaccagcagt

SEQ ID NO: 338732 - DNA, 25 bp, Mus musculus
gtccaagcacgccgcagcagcctgc

SEQ ID NO: 338733 - DNA, 25 bp, Mus musculus
gtccaagcacggggacagcttcgtg

SEQ ID NO: 338734 - DNA, 25 bp, Mus musculus
gtccaagccagcctggagccatcgt

SEQ ID NO: 338735 - DNA, 25 bp, Mus musculus
gtccaagctgaaggaccaagtctcc

SEQ ID NO: 338736 - DNA, 25 bp, Mus musculus
gtccaaggcactagagccccagatc

SEQ ID NO: 338737 - DNA, 25 bp, Mus musculus
gtccaaggcactagggtgccaccta

SEQ ID NO: 338738 - DNA, 25 bp, Mus musculus
gtccaaggccatgaacacggctcta

SEQ ID NO: 338739 - DNA, 25 bp, Mus musculus
gtccaaggcccaggtggtgaccata

SEQ ID NO: 338740 - DNA, 25 bp, Mus musculus
gtccaaggcccaggttgaccaaaga

SEQ ID NO: 338741 - DNA, 25 bp, Mus musculus
gtccaagtataaggtggctctcgag

SEQ ID NO: 338742 - DNA, 25 bp, Mus musculus
gtccaagtcactggaatttcttgat

SEQ ID NO: 338743 - DNA, 25 bp, Mus musculus
gtccaagtcactgggaatctgtcct

SEQ ID NO: 338744 - DNA, 25 bp, Mus musculus
gtccaagtcagtttctgatgacctg

SEQ ID NO: 338745 - DNA, 25 bp, Mus musculus
gtccaagtccggtcagagcagcagg

SEQ ID NO: 338746 - DNA, 25 bp, Mus musculus
gtccaagtgcgatatgatgaatgga

SEQ ID NO: 338747 - DNA, 25 bp, Mus musculus
gtccaatatcatggggggatatccc

SEQ ID NO: 338748 - DNA, 25 bp, Mus musculus
gtccaatggttggctcaacttgatt

SEQ ID NO: 338749 - DNA, 25 bp, Mus musculus
gtccaatgtcccatcaccatctcag

SEQ ID NO: 338750 - DNA, 25 bp, Mus musculus
gtccaatgtgaaggctccagcctgg

SEQ ID NO: 338751 - DNA, 25 bp, Mus musculus
gtccaatgtggctagctataaaacc

SEQ ID NO: 338752 - DNA, 25 bp, Mus musculus
gtccaattcagccaccagcacagct

SEQ ID NO: 338753 - DNA, 25 bp, Mus musculus
gtccaattcaggcatggtccaggta

SEQ ID NO: 338754 - DNA, 25 bp, Mus musculus
gtccacaaccagaaaagccagctca

SEQ ID NO: 338755 - DNA, 25 bp, Mus musculus
gtccacaaccagccctcagcggcat

SEQ ID NO: 338756 - DNA, 25 bp, Mus musculus
gtccacaaccaggctcccaccacct

SEQ ID NO: 338757 - DNA, 25 bp, Mus musculus
gtccacaagatatgtgagatagatg

SEQ ID NO: 338758 - DNA, 25 bp, Mus musculus
gtccacaagatattggttctgaaga

SEQ ID NO: 338759 - DNA, 25 bp, Mus musculus
gtccacaagggggggctgttcaaga

SEQ ID NO: 338760 - DNA, 25 bp, Mus musculus
gtccacacaagctttgaaccactgg

SEQ ID NO: 338761 - DNA, 25 bp, Mus musculus
gtccacacaaggtttcacgacttca

SEQ ID NO: 338762 - DNA, 25 bp, Mus musculus
gtccacacaggtttatgaagctgat

SEQ ID NO: 338763 - DNA, 25 bp, Mus musculus
gtccacacagtggaggattaccagg

SEQ ID NO: 338764 - DNA, 25 bp, Mus musculus
gtccacacccaccaccccagtctac

SEQ ID NO: 338765 - DNA, 25 bp, Mus musculus
gtccacacccagatgaagttgctgc

SEQ ID NO: 338766 - DNA, 25 bp, Mus musculus
gtccacacccagcacaggtccctgt

SEQ ID NO: 338767 - DNA, 25 bp, Mus musculus
gtccacaccgggacaaccatcatgg

SEQ ID NO: 338768 - DNA, 25 bp, Mus musculus
gtccacaccggtgatcctaagagaa

SEQ ID NO: 338769 - DNA, 25 bp, Mus musculus
gtccacactacaggctccttcctga

SEQ ID NO: 338770 - DNA, 25 bp, Mus musculus
gtccacactacaggtctgtaactgg

SEQ ID NO: 338771 - DNA, 25 bp, Mus musculus
gtccacagagatccactgaggcttt

SEQ ID NO: 338772 - DNA, 25 bp, Mus musculus
gtccacagcaggattccccctctgt

SEQ ID NO: 338773 - DNA, 25 bp, Mus musculus
gtccacaggcagatgaacacaatga

SEQ ID NO: 338774 - DNA, 25 bp, Mus musculus
gtccacagtcgagagctaagatgcg

SEQ ID NO: 338775 - DNA, 25 bp, Mus musculus
gtccacataaaaggaaattgtggga

SEQ ID NO: 338776 - DNA, 25 bp, Mus musculus
gtccacatgcccctgtgatgccagt

SEQ ID NO: 338777 - DNA, 25 bp, Mus musculus
gtccacatgcgtttgatatcgttgg

SEQ ID NO: 338778 - DNA, 25 bp, Mus musculus
gtccacatttgagaacggccggttt

SEQ ID NO: 338779 - DNA, 25 bp, Mus musculus
gtccacatttgagtgtgaagtgagg

SEQ ID NO: 338780 - DNA, 25 bp, Mus musculus
gtccaccagatgctgagcaactaca

SEQ ID NO: 338781 - DNA, 25 bp, Mus musculus
gtccaccagggtttgacctgccacc

SEQ ID NO: 338782 - DNA, 25 bp, Mus musculus
gtccaccatattcttttgaatatgt

SEQ ID NO: 338783 - DNA, 25 bp, Mus musculus
gtccaccatgctgatggggattgga

SEQ ID NO: 338784 - DNA, 25 bp, Mus musculus
gtccaccatggtaggtgagctccag

SEQ ID NO: 338785 - DNA, 25 bp, Mus musculus
gtccacccaagggtacagcatgttt

SEQ ID NO: 338786 - DNA, 25 bp, Mus musculus
gtccacccagagaagatgtgagccc

SEQ ID NO: 338787 - DNA, 25 bp, Mus musculus
gtccacccgagtggcccatcctcag

SEQ ID NO: 338788 - DNA, 25 bp, Mus musculus
gtccaccctgcacctggtccttcgc

SEQ ID NO: 338789 - DNA, 25 bp, Mus musculus
gtccaccgtgggaggttctccagtg

SEQ ID NO: 338790 - DNA, 25 bp, Mus musculus
gtccaccgtgggagtggattttgct

SEQ ID NO: 338791 - DNA, 25 bp, Mus musculus
gtccaccgtgtcagactcagtcacc

SEQ ID NO: 338792 - DNA, 25 bp, Mus musculus
gtccacctcacagaatagcattcct

SEQ ID NO: 338793 - DNA, 25 bp, Mus musculus
gtccacctcacagaggagcagggac

SEQ ID NO: 338794 - DNA, 25 bp, Mus musculus
gtccacctcacagattcccggtcgg

SEQ ID NO: 338795 - DNA, 25 bp, Mus musculus
gtccacctgggatcatgggctctat

SEQ ID NO: 338796 - DNA, 25 bp, Mus musculus
gtccacgcgccagggaatggacctg

SEQ ID NO: 338797 - DNA, 25 bp, Mus musculus
gtccacggtattgagttggtcacaa

SEQ ID NO: 338798 - DNA, 25 bp, Mus musculus
gtccacggtgggggacccctgtgca

SEQ ID NO: 338799 - DNA, 25 bp, Mus musculus
gtccacggtgggggattgctgctgg

SEQ ID NO: 338800 - DNA, 25 bp, Mus musculus
gtccacgtgagacatggcacaagaa

SEQ ID NO: 338801 - DNA, 25 bp, Mus musculus
gtccacgtgagatccttcttaccag

SEQ ID NO: 338802 - DNA, 25 bp, Mus musculus
gtccacgtgtgagattccctgctcc

SEQ ID NO: 338803 - DNA, 25 bp, Mus musculus
gtccactaacagctctatttcagtg

SEQ ID NO: 338804 - DNA, 25 bp, Mus musculus
gtccactaacagtgcttctctcctc

SEQ ID NO: 338805 - DNA, 25 bp, Mus musculus
gtccactccagggctctctaagtac

SEQ ID NO: 338806 - DNA, 25 bp, Mus musculus
gtccactctgtcaaggcccgagacc

SEQ ID NO: 338807 - DNA, 25 bp, Mus musculus
gtccactgactttaactggtacacc

SEQ ID NO: 338808 - DNA, 25 bp, Mus musculus
gtccactgcattgaacagcgtctgt

SEQ ID NO: 338809 - DNA, 25 bp, Mus musculus
gtccactgtgccactcctgcctgga

SEQ ID NO: 338810 - DNA, 25 bp, Mus musculus
gtccactgtgccagcaccagaccct

SEQ ID NO: 338811 - DNA, 25 bp, Mus musculus
gtccacttgtttggttgtggcctac

SEQ ID NO: 338812 - DNA, 25 bp, Mus musculus
gtccagaaaaacctccagcgtctcc

SEQ ID NO: 338813 - DNA, 25 bp, Mus musculus
gtccagaaagcgaccataacctgta

SEQ ID NO: 338814 - DNA, 25 bp, Mus musculus
gtccagaaagtcaacgcctcaagac

SEQ ID NO: 338815 - DNA, 25 bp, Mus musculus
gtccagaacagcctgcacttcgctg

SEQ ID NO: 338816 - DNA, 25 bp, Mus musculus
gtccagaacagctggaggtggctga

SEQ ID NO: 338817 - DNA, 25 bp, Mus musculus
gtccagaacagtgtccccgatgaag

SEQ ID NO: 338818 - DNA, 25 bp, Mus musculus
gtccagacaccatgccagcccactc

SEQ ID NO: 338819 - DNA, 25 bp, Mus musculus
gtccagactcgctttgaattcatga

SEQ ID NO: 338820 - DNA, 25 bp, Mus musculus
gtccagactcggggccctgttctcc

SEQ ID NO: 338821 - DNA, 25 bp, Mus musculus
gtccagactgcatggaactacatga

SEQ ID NO: 338822 - DNA, 25 bp, Mus musculus
gtccagagaaggtgatcatctgtct

SEQ ID NO: 338823 - DNA, 25 bp, Mus musculus
gtccagagagagaaccttcacacct

SEQ ID NO: 338824 - DNA, 25 bp, Mus musculus
gtccagagaggcagagacagggcag

SEQ ID NO: 338825 - DNA, 25 bp, Mus musculus
gtccagagaggtgtggagaggatgc

SEQ ID NO: 338826 - DNA, 25 bp, Mus musculus
gtccagagagttgtgtggccatcat

SEQ ID NO: 338827 - DNA, 25 bp, Mus musculus
gtccagagcaaggttgctcttctgg

SEQ ID NO: 338828 - DNA, 25 bp, Mus musculus
gtccagagcaatgagtccagatccg

SEQ ID NO: 338829 - DNA, 25 bp, Mus musculus
gtccagagcaccctgctgctgaata

SEQ ID NO: 338830 - DNA, 25 bp, Mus musculus
gtccagagcctgtgcttgaggcgag

SEQ ID NO: 338831 - DNA, 25 bp, Mus musculus
gtccagaggtgccgagtaacttgtc

SEQ ID NO: 338832 - DNA, 25 bp, Mus musculus
gtccagaggtgccgcaccatggcca

SEQ ID NO: 338833 - DNA, 25 bp, Mus musculus
gtccagagtgggtcatatcggatgt

SEQ ID NO: 338834 - DNA, 25 bp, Mus musculus
gtccagatcacagaatacagatatg

SEQ ID NO: 338835 - DNA, 25 bp, Mus musculus
gtccagatcacagcctctgcagaat

SEQ ID NO: 338836 - DNA, 25 bp, Mus musculus
gtccagatcacggaccaggagggaa

SEQ ID NO: 338837 - DNA, 25 bp, Mus musculus
gtccagatcaggatgactctttaga

SEQ ID NO: 338838 - DNA, 25 bp, Mus musculus
gtccagatcagtaggtgcaaactca

SEQ ID NO: 338839 - DNA, 25 bp, Mus musculus
gtccagatcctgaagactgctggag

SEQ ID NO: 338840 - DNA, 25 bp, Mus musculus
gtccagatcctgaagcattcgggaa

SEQ ID NO: 338841 - DNA, 25 bp, Mus musculus
gtccagatctgatgaacacaatgat

SEQ ID NO: 338842 - DNA, 25 bp, Mus musculus
gtccagatgtccagatctgctggaa

SEQ ID NO: 338843 - DNA, 25 bp, Mus musculus
gtccagatgtccaggtgtggtgcac

SEQ ID NO: 338844 - DNA, 25 bp, Mus musculus
gtccagcaagaggaccagagttcaa

SEQ ID NO: 338845 - DNA, 25 bp, Mus musculus
gtccagcaaggagattcttccaaga

SEQ ID NO: 338846 - DNA, 25 bp, Mus musculus
gtccagcacagaatcgtccttggaa

SEQ ID NO: 338847 - DNA, 25 bp, Mus musculus
gtccagcacagccagccatatggaa

SEQ ID NO: 338848 - DNA, 25 bp, Mus musculus
gtccagcacagggacctgaggtgca

SEQ ID NO: 338849 - DNA, 25 bp, Mus musculus
gtccagcactagggctccttctcct

SEQ ID NO: 338850 - DNA, 25 bp, Mus musculus
gtccagcaggtcccagttgtactgc

SEQ ID NO: 338851 - DNA, 25 bp, Mus musculus
gtccagcagtagggagtgccgcgtc

SEQ ID NO: 338852 - DNA, 25 bp, Mus musculus
gtccagcagtaggggaacaaagatg

SEQ ID NO: 338853 - DNA, 25 bp, Mus musculus
gtccagccaaggctgtcttcatgct

SEQ ID NO: 338854 - DNA, 25 bp, Mus musculus
gtccagccctgaagccgaacaaaaa

SEQ ID NO: 338855 - DNA, 25 bp, Mus musculus
gtccagcgagtgtgctagaggctgt

SEQ ID NO: 338856 - DNA, 25 bp, Mus musculus
gtccagcgctgagcttcacctggtt

SEQ ID NO: 338857 - DNA, 25 bp, Mus musculus
gtccagcggcagccagcaccagctg

SEQ ID NO: 338858 - DNA, 25 bp, Mus musculus
gtccagcgtgcgcccctccagcagc

SEQ ID NO: 338859 - DNA, 25 bp, Mus musculus
gtccagctccaagaaaagcaccttc

SEQ ID NO: 338860 - DNA, 25 bp, Mus musculus
gtccagctccaagttatctccagag

SEQ ID NO: 338861 - DNA, 25 bp, Mus musculus
gtccagctcctgggatacgtattat

SEQ ID NO: 338862 - DNA, 25 bp, Mus musculus
gtccagctgatcaagaggcctgcca

SEQ ID NO: 338863 - DNA, 25 bp, Mus musculus
gtccagctgatcaagccagccatct

SEQ ID NO: 338864 - DNA, 25 bp, Mus musculus
gtccagcttacggacatgctcccaa

SEQ ID NO: 338865 - DNA, 25 bp, Mus musculus
gtccagcttgaaggtactaaagaaa

SEQ ID NO: 338866 - DNA, 25 bp, Mus musculus
gtccaggaagatccactcctatgtg

SEQ ID NO: 338867 - DNA, 25 bp, Mus musculus
gtccaggacctgcagctcttatgct

SEQ ID NO: 338868 - DNA, 25 bp, Mus musculus
gtccaggacctgcaggccccccagg

SEQ ID NO: 338869 - DNA, 25 bp, Mus musculus
gtccaggactgaatctacccaaacg

SEQ ID NO: 338870 - DNA, 25 bp, Mus musculus
gtccaggagcagacacggatcatcc

SEQ ID NO: 338871 - DNA, 25 bp, Mus musculus
gtccaggagcaggggggactcccca

SEQ ID NO: 338872 - DNA, 25 bp, Mus musculus
gtccaggagccaggtggtgtccctc

SEQ ID NO: 338873 - DNA, 25 bp, Mus musculus
gtccaggaggaagaggaagtccaag

SEQ ID NO: 338874 - DNA, 25 bp, Mus musculus
gtccaggaggaagatgctgtcgccg

SEQ ID NO: 338875 - DNA, 25 bp, Mus musculus
gtccaggatttaaccctgagatacc

SEQ ID NO: 338876 - DNA, 25 bp, Mus musculus
gtccaggcaagatcagctctgaatg

SEQ ID NO: 338877 - DNA, 25 bp, Mus musculus
gtccaggcagaggacagctcctctg

SEQ ID NO: 338878 - DNA, 25 bp, Mus musculus
gtccagggagtgaagccaagaagaa

SEQ ID NO: 338879 - DNA, 25 bp, Mus musculus
gtccaggtcactaggggcttcagaa

SEQ ID NO: 338880 - DNA, 25 bp, Mus musculus
gtccaggtccaggtcccgttcaaga

SEQ ID NO: 338881 - DNA, 25 bp, Mus musculus
gtccaggtggctgagctcccgccag

SEQ ID NO: 338882 - DNA, 25 bp, Mus musculus
gtccaggtggctgccccagtgcggg

SEQ ID NO: 338883 - DNA, 25 bp, Mus musculus
gtccagtaacgtgtgctgccatgct

SEQ ID NO: 338884 - DNA, 25 bp, Mus musculus
gtccagtaagcagataaggatgaat

SEQ ID NO: 338885 - DNA, 25 bp, Mus musculus
gtccagtacagccaggtgaccgagc

SEQ ID NO: 338886 - DNA, 25 bp, Mus musculus
gtccagtatagggagaagctgggca

SEQ ID NO: 338887 - DNA, 25 bp, Mus musculus
gtccagtgaggctgtcatctgggag

SEQ ID NO: 338888 - DNA, 25 bp, Mus musculus
gtccagtgaggggtgcactctcaga

SEQ ID NO: 338889 - DNA, 25 bp, Mus musculus
gtccagtgcggctgctcctggcaca

SEQ ID NO: 338890 - DNA, 25 bp, Mus musculus
gtccagtgcgggctgatgcatgggc

SEQ ID NO: 338891 - DNA, 25 bp, Mus musculus
gtccagtggaacagattgttgtggt

SEQ ID NO: 338892 - DNA, 25 bp, Mus musculus
gtccagtggaacgtgggatctcatc

SEQ ID NO: 338893 - DNA, 25 bp, Mus musculus
gtccagttcgataccgttcctgtgt

SEQ ID NO: 338894 - DNA, 25 bp, Mus musculus
gtccagttcgatttgatatcctttt

SEQ ID NO: 338895 - DNA, 25 bp, Mus musculus
gtccagttggaaatgaaatgttcct

SEQ ID NO: 338896 - DNA, 25 bp, Mus musculus
gtccagtttcccttgtgggtatgaa

SEQ ID NO: 338897 - DNA, 25 bp, Mus musculus
gtccagtttgggaagaaaggtggca

SEQ ID NO: 338898 - DNA, 25 bp, Mus musculus
gtccagtttgggtgtctggagacat

SEQ ID NO: 338899 - DNA, 25 bp, Mus musculus
gtccataaacatggacttgaatttt

SEQ ID NO: 338900 - DNA, 25 bp, Mus musculus
gtccatacggctggctcggatggcg

SEQ ID NO: 338901 - DNA, 25 bp, Mus musculus
gtccatattcccagcttctccagtt

SEQ ID NO: 338902 - DNA, 25 bp, Mus musculus
gtccatcaaagccccagaagaccct

SEQ ID NO: 338903 - DNA, 25 bp, Mus musculus
gtccatcaaagccctgtgcccacga

SEQ ID NO: 338904 - DNA, 25 bp, Mus musculus
gtccatcaaagctgacttctctacc

SEQ ID NO: 338905 - DNA, 25 bp, Mus musculus
gtccatcaaagggtcgtcttctgcc

SEQ ID NO: 338906 - DNA, 25 bp, Mus musculus
gtccatcaacatcctaatcctggag

SEQ ID NO: 338907 - DNA, 25 bp, Mus musculus
gtccatcacattaaagtttcactag

SEQ ID NO: 338908 - DNA, 25 bp, Mus musculus
gtccatcaccaagaacaagaaaaca

SEQ ID NO: 338909 - DNA, 25 bp, Mus musculus
gtccatcacgattcaggctctttct

SEQ ID NO: 338910 - DNA, 25 bp, Mus musculus
gtccatccctggcctatctccctgg

SEQ ID NO: 338911 - DNA, 25 bp, Mus musculus
gtccatcctcatcaccggagaatcc

SEQ ID NO: 338912 - DNA, 25 bp, Mus musculus
gtccatctgaagaaatcaaaggctc

SEQ ID NO: 338913 - DNA, 25 bp, Mus musculus
gtccatcttggccaaatgtaccgtc

SEQ ID NO: 338914 - DNA, 25 bp, Mus musculus
gtccatgaaagtgagatgagcatca

SEQ ID NO: 338915 - DNA, 25 bp, Mus musculus
gtccatgaacatatcccgtactctt

SEQ ID NO: 338916 - DNA, 25 bp, Mus musculus
gtccatgaacatgggtccaggagtg

SEQ ID NO: 338917 - DNA, 25 bp, Mus musculus
gtccatgaccgaaatgcgactgtag

SEQ ID NO: 338918 - DNA, 25 bp, Mus musculus
gtccatgaccggaatccatgcccag

SEQ ID NO: 338919 - DNA, 25 bp, Mus musculus
gtccatgactgaagggcatccgtct

SEQ ID NO: 338920 - DNA, 25 bp, Mus musculus
gtccatgagaagaggaagcttcttg

SEQ ID NO: 338921 - DNA, 25 bp, Mus musculus
gtccatgagatggattctgacgttg

SEQ ID NO: 338922 - DNA, 25 bp, Mus musculus
gtccatgagccgggtgaacctgaat

SEQ ID NO: 338923 - DNA, 25 bp, Mus musculus
gtccatgagtagcgaaagcaaatca

SEQ ID NO: 338924 - DNA, 25 bp, Mus musculus
gtccatgatgtacgcaccagttgaa

SEQ ID NO: 338925 - DNA, 25 bp, Mus musculus
gtccatgatgtacgccagtgaattc

SEQ ID NO: 338926 - DNA, 25 bp, Mus musculus
gtccatgattgacaatgagacgctg

SEQ ID NO: 338927 - DNA, 25 bp, Mus musculus
gtccatgcaaacggtgttcaatatg

SEQ ID NO: 338928 - DNA, 25 bp, Mus musculus
gtccatgcaggaatatttaaggctg

SEQ ID NO: 338929 - DNA, 25 bp, Mus musculus
gtccatgcagtatgctgcctggctg

SEQ ID NO: 338930 - DNA, 25 bp, Mus musculus
gtccatgcagtcccccagcctgcag

SEQ ID NO: 338931 - DNA, 25 bp, Mus musculus
gtccatgccataaggaaatcctacc

SEQ ID NO: 338932 - DNA, 25 bp, Mus musculus
gtccatggaagacagcagtgacagt

SEQ ID NO: 338933 - DNA, 25 bp, Mus musculus
gtccatggacaagatgcaatcactg

SEQ ID NO: 338934 - DNA, 25 bp, Mus musculus
gtccatggagagattgatcctgtta

SEQ ID NO: 338935 - DNA, 25 bp, Mus musculus
gtccatggggtgcgccccgggatgc

SEQ ID NO: 338936 - DNA, 25 bp, Mus musculus
gtccatggtaacaggcctgatggaa

SEQ ID NO: 338937 - DNA, 25 bp, Mus musculus
gtccatggtaacagtcaacaaatgc

SEQ ID NO: 338938 - DNA, 25 bp, Mus musculus
gtccatgtcgggtgtgaagattgct

SEQ ID NO: 338939 - DNA, 25 bp, Mus musculus
gtccatgtgccagggaaaccgtgac

SEQ ID NO: 338940 - DNA, 25 bp, Mus musculus
gtccatgttggagtttggattcgag

SEQ ID NO: 338941 - DNA, 25 bp, Mus musculus
gtccattcaggagatggagttctac

SEQ ID NO: 338942 - DNA, 25 bp, Mus musculus
gtccattcatcaactggccttgaca

SEQ ID NO: 338943 - DNA, 25 bp, Mus musculus
gtccattcatcaggaagcaggtgtg

SEQ ID NO: 338944 - DNA, 25 bp, Mus musculus
gtccattccagaggcattaaaagct

SEQ ID NO: 338945 - DNA, 25 bp, Mus musculus
gtccattctcacatccatgaagaaa

SEQ ID NO: 338946 - DNA, 25 bp, Mus musculus
gtccattctcagcgctgtgtagttc

SEQ ID NO: 338947 - DNA, 25 bp, Mus musculus
gtccattgaggcgcccttgacagcc

SEQ ID NO: 338948 - DNA, 25 bp, Mus musculus
gtccattgcaaaggctgggatcatc

SEQ ID NO: 338949 - DNA, 25 bp, Mus musculus
gtccatttagcatggctgttggaaa

SEQ ID NO: 338950 - DNA, 25 bp, Mus musculus
gtccatttcgacttctctacccagg

SEQ ID NO: 338951 - DNA, 25 bp, Mus musculus
gtccatttgaaaatgatgccagaat

SEQ ID NO: 338952 - DNA, 25 bp, Mus musculus
gtcccaaaagaccatgtgacccatc

SEQ ID NO: 338953 - DNA, 25 bp, Mus musculus
gtcccaaacacaaggcgaaggagat

SEQ ID NO: 338954 - DNA, 25 bp, Mus musculus
gtcccaaagaacagaaaatcaatct

SEQ ID NO: 338955 - DNA, 25 bp, Mus musculus
gtcccaaagaacaggtcctcagaat

SEQ ID NO: 338956 - DNA, 25 bp, Mus musculus
gtcccaaagacgcaggaaaaggaag

SEQ ID NO: 338957 - DNA, 25 bp, Mus musculus
gtcccaaaggatgcatgctgttctg

SEQ ID NO: 338958 - DNA, 25 bp, Mus musculus
gtcccaaagggtcttcagattacaa

SEQ ID NO: 338959 - DNA, 25 bp, Mus musculus
gtcccaaaggtgtcctgcaggtctt

SEQ ID NO: 338960 - DNA, 25 bp, Mus musculus
gtcccaaatcagatcgacatcagga

SEQ ID NO: 338961 - DNA, 25 bp, Mus musculus
gtcccaacaggccatccgctgcaca

SEQ ID NO: 338962 - DNA, 25 bp, Mus musculus
gtcccaaccaagctgctggaagctc

SEQ ID NO: 338963 - DNA, 25 bp, Mus musculus
gtcccaaccaaggaatcactgagat

SEQ ID NO: 338964 - DNA, 25 bp, Mus musculus
gtcccaacgaaaattgaacagatcg

SEQ ID NO: 338965 - DNA, 25 bp, Mus musculus
gtcccaactcaaggtctgatccgga

SEQ ID NO: 338966 - DNA, 25 bp, Mus musculus
gtcccaactcaaggtgctgtcccac

SEQ ID NO: 338967 - DNA, 25 bp, Mus musculus
gtcccaactctcttccatgcgccaa

SEQ ID NO: 338968 - DNA, 25 bp, Mus musculus
gtcccaagaaacatgcactgataaa

SEQ ID NO: 338969 - DNA, 25 bp, Mus musculus
gtcccaagaaacatgggattactgc

SEQ ID NO: 338970 - DNA, 25 bp, Mus musculus
gtcccaagagggggaatacctccac

SEQ ID NO: 338971 - DNA, 25 bp, Mus musculus
gtcccaagccaggctttcttgatca

SEQ ID NO: 338972 - DNA, 25 bp, Mus musculus
gtcccaatccgggctgtggaaacca

SEQ ID NO: 338973 - DNA, 25 bp, Mus musculus
gtcccacaaggcatgctagtcccac

SEQ ID NO: 338974 - DNA, 25 bp, Mus musculus
gtcccacacgcctctgtacaaccag

SEQ ID NO: 338975 - DNA, 25 bp, Mus musculus
gtcccacacggacgtggggctgctt

SEQ ID NO: 338976 - DNA, 25 bp, Mus musculus
gtcccacattggcaagacattgctt

SEQ ID NO: 338977 - DNA, 25 bp, Mus musculus
gtcccacccagacaggcttcaggac

SEQ ID NO: 338978 - DNA, 25 bp, Mus musculus
gtcccagaacaatattgctgccttc

SEQ ID NO: 338979 - DNA, 25 bp, Mus musculus
gtcccagaacagatcgggaagctgc

SEQ ID NO: 338980 - DNA, 25 bp, Mus musculus
gtcccagaagaggacactacatgaa

SEQ ID NO: 338981 - DNA, 25 bp, Mus musculus
gtcccagaagggtcagaaagcatgg

SEQ ID NO: 338982 - DNA, 25 bp, Mus musculus
gtcccagaatatgaccccagcagcg

SEQ ID NO: 338983 - DNA, 25 bp, Mus musculus
gtcccagaatatgcgatgatccctc

SEQ ID NO: 338984 - DNA, 25 bp, Mus musculus
gtcccagacagcagctgcagtatct

SEQ ID NO: 338985 - DNA, 25 bp, Mus musculus
gtcccagacagcttgcttgcctttt

SEQ ID NO: 338986 - DNA, 25 bp, Mus musculus
gtcccagagaaaaggtggagctttt

SEQ ID NO: 338987 - DNA, 25 bp, Mus musculus
gtcccagagagctgatggccaggag

SEQ ID NO: 338988 - DNA, 25 bp, Mus musculus
gtcccagagccagatgaagagctag

SEQ ID NO: 338989 - DNA, 25 bp, Mus musculus
gtcccagagccaggctccccagcac

SEQ ID NO: 338990 - DNA, 25 bp, Mus musculus
gtcccagcagactgagcaagagcca

SEQ ID NO: 338991 - DNA, 25 bp, Mus musculus
gtcccagcagagtgatggttgccca

SEQ ID NO: 338992 - DNA, 25 bp, Mus musculus
gtcccagcaggacatggatttgatt

SEQ ID NO: 338993 - DNA, 25 bp, Mus musculus
gtcccagcccaagttccaaagaaca

SEQ ID NO: 338994 - DNA, 25 bp, Mus musculus
gtcccagccgctcatgtgggatatg

SEQ ID NO: 338995 - DNA, 25 bp, Mus musculus
gtcccagcgagatggagttgctatg

SEQ ID NO: 338996 - DNA, 25 bp, Mus musculus
gtcccagcgagcagccctgcaactc

SEQ ID NO: 338997 - DNA, 25 bp, Mus musculus
gtcccagcgcaagagcctgttattc

SEQ ID NO: 338998 - DNA, 25 bp, Mus musculus
gtcccagcgcagggacagtcacgag

SEQ ID NO: 338999 - DNA, 25 bp, Mus musculus
gtcccagctcaggaggaaaactccc

SEQ ID NO: 339000 - DNA, 25 bp, Mus musculus
gtcccagctgagactggctggtgga

SEQ ID NO: 339001 - DNA, 25 bp, Mus musculus
gtcccagctggggtcggagcttcca

SEQ ID NO: 339002 - DNA, 25 bp, Mus musculus
gtcccaggaggatctcccagaagct

SEQ ID NO: 339003 - DNA, 25 bp, Mus musculus
gtcccaggcaagcctggaagagttg

SEQ ID NO: 339004 - DNA, 25 bp, Mus musculus
gtcccaggcaagggcagtgtatggg

SEQ ID NO: 339005 - DNA, 25 bp, Mus musculus
gtcccaggctgatagagacatcggc

SEQ ID NO: 339006 - DNA, 25 bp, Mus musculus
gtcccaggctggacagagatttcct

SEQ ID NO: 339007 - DNA, 25 bp, Mus musculus
gtcccaggctggagaaagctgtggc

SEQ ID NO: 339008 - DNA, 25 bp, Mus musculus
gtcccagtagcaagatggactgtaa

SEQ ID NO: 339009 - DNA, 25 bp, Mus musculus
gtcccagtccccacgggcactatga

SEQ ID NO: 339010 - DNA, 25 bp, Mus musculus
gtcccagtgaagagacatcatgtga

SEQ ID NO: 339011 - DNA, 25 bp, Mus musculus
gtcccagtgaaggtcgcaggcatcc

SEQ ID NO: 339012 - DNA, 25 bp, Mus musculus
gtcccagtgcaggatttactaggtc

SEQ ID NO: 339013 - DNA, 25 bp, Mus musculus
gtcccagtgcagggataacaacacc

SEQ ID NO: 339014 - DNA, 25 bp, Mus musculus
gtcccatgacttttgtacaaacaaa

SEQ ID NO: 339015 - DNA, 25 bp, Mus musculus
gtcccatgcgtcaggaaatgtgttt

SEQ ID NO: 339016 - DNA, 25 bp, Mus musculus
gtcccatggtcaagacgtccgtcct

SEQ ID NO: 339017 - DNA, 25 bp, Mus musculus
gtcccattagcaaaggtggattgca

SEQ ID NO: 339018 - DNA, 25 bp, Mus musculus
gtcccattctctggtgccctgcctt

SEQ ID NO: 339019 - DNA, 25 bp, Mus musculus
gtcccattgcaagataaataggatt

SEQ ID NO: 339020 - DNA, 25 bp, Mus musculus
gtcccatttcaggtgctggtggcaa

SEQ ID NO: 339021 - DNA, 25 bp, Mus musculus
gtccccaaaacctgacgtccacgtc

SEQ ID NO: 339022 - DNA, 25 bp, Mus musculus
gtccccaaacccagacttacagctc

SEQ ID NO: 339023 - DNA, 25 bp, Mus musculus
gtccccaaacccagatcagtggacc

SEQ ID NO: 339024 - DNA, 25 bp, Mus musculus
gtccccaaagaaaggtcaaatggtt

SEQ ID NO: 339025 - DNA, 25 bp, Mus musculus
gtccccaaataatgacctagccctc

SEQ ID NO: 339026 - DNA, 25 bp, Mus musculus
gtccccaaataatgatgtctatact

SEQ ID NO: 339027 - DNA, 25 bp, Mus musculus
gtccccaagaggtacttttctcact

SEQ ID NO: 339028 - DNA, 25 bp, Mus musculus
gtccccaagccagccccgcagccct

SEQ ID NO: 339029 - DNA, 25 bp, Mus musculus
gtccccacaggggcaggtgctgagt

SEQ ID NO: 339030 - DNA, 25 bp, Mus musculus
gtccccaccacagatctgcgatggc

SEQ ID NO: 339031 - DNA, 25 bp, Mus musculus
gtccccaccgccatgcctgtctcct

SEQ ID NO: 339032 - DNA, 25 bp, Mus musculus
gtccccacctactgggaccagcggg

SEQ ID NO: 339033 - DNA, 25 bp, Mus musculus
gtccccacctccagggtgaagttga

SEQ ID NO: 339034 - DNA, 25 bp, Mus musculus
gtccccagacgcttgtcggagctcc

SEQ ID NO: 339035 - DNA, 25 bp, Mus musculus
gtccccagcaagcaagaggaggcag

SEQ ID NO: 339036 - DNA, 25 bp, Mus musculus
gtccccaggaggcccccaaggtggt

SEQ ID NO: 339037 - DNA, 25 bp, Mus musculus
gtccccaggcctggctgctgccatt

SEQ ID NO: 339038 - DNA, 25 bp, Mus musculus
gtccccagtcaggtagcctttccag

SEQ ID NO: 339039 - DNA, 25 bp, Mus musculus
gtccccagtgaaagcagaagatacc

SEQ ID NO: 339040 - DNA, 25 bp, Mus musculus
gtccccatatgagcataaatcaaaa

SEQ ID NO: 339041 - DNA, 25 bp, Mus musculus
gtccccatatgatgggaaataagtt

SEQ ID NO: 339042 - DNA, 25 bp, Mus musculus
gtccccatctcagagctctcttccg

SEQ ID NO: 339043 - DNA, 25 bp, Mus musculus
gtccccatctcagccagcagaggcc

SEQ ID NO: 339044 - DNA, 25 bp, Mus musculus
gtccccatctcagctccggaaaggc

SEQ ID NO: 339045 - DNA, 25 bp, Mus musculus
gtccccatgtacagactcatcccac

SEQ ID NO: 339046 - DNA, 25 bp, Mus musculus
gtccccatgtacagctcacaaactc

SEQ ID NO: 339047 - DNA, 25 bp, Mus musculus
gtccccattagaaacaagccacgga

SEQ ID NO: 339048 - DNA, 25 bp, Mus musculus
gtccccattagaaaccacctaccct

SEQ ID NO: 339049 - DNA, 25 bp, Mus musculus
gtcccccaaactgaagaagtagcta

SEQ ID NO: 339050 - DNA, 25 bp, Mus musculus
gtcccccaaggaggtaagcctggac

SEQ ID NO: 339051 - DNA, 25 bp, Mus musculus
gtcccccagaggttgagaacaaaaa

SEQ ID NO: 339052 - DNA, 25 bp, Mus musculus
gtcccccagccccagcagcctggta

SEQ ID NO: 339053 - DNA, 25 bp, Mus musculus
gtcccccagccccagtccttcaggc

SEQ ID NO: 339054 - DNA, 25 bp, Mus musculus
gtcccccatgcgcagctccagacct

SEQ ID NO: 339055 - DNA, 25 bp, Mus musculus
gtcccccgcaagcctcctggaggac

SEQ ID NO: 339056 - DNA, 25 bp, Mus musculus
gtcccccgcagccgacatgcgctac

SEQ ID NO: 339057 - DNA, 25 bp, Mus musculus
gtcccccgctcctgggccgcaaaca

SEQ ID NO: 339058 - DNA, 25 bp, Mus musculus
gtccccctggtcctgctggcttccc

SEQ ID NO: 339059 - DNA, 25 bp, Mus musculus
gtccccgagccgcagggccagttcc

SEQ ID NO: 339060 - DNA, 25 bp, Mus musculus
gtccccgaggagatctcccctctgg

SEQ ID NO: 339061 - DNA, 25 bp, Mus musculus
gtccccgaggagctacagttttatt

SEQ ID NO: 339062 - DNA, 25 bp, Mus musculus
gtccccgagtgttgggagcgggatg

SEQ ID NO: 339063 - DNA, 25 bp, Mus musculus
gtccccgcccgcaggtccattcaga

SEQ ID NO: 339064 - DNA, 25 bp, Mus musculus
gtccccgcgaggtgtcgcggaagat

SEQ ID NO: 339065 - DNA, 25 bp, Mus musculus
gtccccgcgcggctaactcaacaaa

SEQ ID NO: 339066 - DNA, 25 bp, Mus musculus
gtccccgcggacggcactgagagta

SEQ ID NO: 339067 - DNA, 25 bp, Mus musculus
gtccccgctagacatccgttacaaa

SEQ ID NO: 339068 - DNA, 25 bp, Mus musculus
gtccccgctagacatgaaggatggc

SEQ ID NO: 339069 - DNA, 25 bp, Mus musculus
gtccccgctgtacttgtccagctct

SEQ ID NO: 339070 - DNA, 25 bp, Mus musculus
gtccccggacggagctgaagaagaa

SEQ ID NO: 339071 - DNA, 25 bp, Mus musculus
gtccccgggacgaggcaaagatgct

SEQ ID NO: 339072 - DNA, 25 bp, Mus musculus
gtccccgggaggtttcatgggatca

SEQ ID NO: 339073 - DNA, 25 bp, Mus musculus
gtccccggtgaggcatatgctatga

SEQ ID NO: 339074 - DNA, 25 bp, Mus musculus
gtccccggtgaggtataaagaggaa

SEQ ID NO: 339075 - DNA, 25 bp, Mus musculus
gtccccggtggaatgcaagacttca

SEQ ID NO: 339076 - DNA, 25 bp, Mus musculus
gtcccctagaaggaagagtcactcc

SEQ ID NO: 339077 - DNA, 25 bp, Mus musculus
gtcccctcaggatcgccacgactcg

SEQ ID NO: 339078 - DNA, 25 bp, Mus musculus
gtcccctcagttccccagtgaagaa

SEQ ID NO: 339079 - DNA, 25 bp, Mus musculus
gtcccctccaagagcaaagctgcag

SEQ ID NO: 339080 - DNA, 25 bp, Mus musculus
gtcccctctactcagttcctcattt

SEQ ID NO: 339081 - DNA, 25 bp, Mus musculus
gtcccctctggatcataaagacaca

SEQ ID NO: 339082 - DNA, 25 bp, Mus musculus
gtcccctgcccggaattctgatcaa

SEQ ID NO: 339083 - DNA, 25 bp, Mus musculus
gtcccctgggagtgcttacttttct

SEQ ID NO: 339084 - DNA, 25 bp, Mus musculus
gtccccttcacggcatatggatcag

SEQ ID NO: 339085 - DNA, 25 bp, Mus musculus
gtccccttcacggttgcagcttcat

SEQ ID NO: 339086 - DNA, 25 bp, Mus musculus
gtccccttcgcggccgtcagaatgt

SEQ ID NO: 339087 - DNA, 25 bp, Mus musculus
gtccccttcggatgaattgtctgga

SEQ ID NO: 339088 - DNA, 25 bp, Mus musculus
gtcccctttaaggctccaggatgac

SEQ ID NO: 339089 - DNA, 25 bp, Mus musculus
gtcccgaaactccagtgacacgtgc

SEQ ID NO: 339090 - DNA, 25 bp, Mus musculus
gtcccgaaatggggttggtgtcatt

SEQ ID NO: 339091 - DNA, 25 bp, Mus musculus
gtcccgacgccttggtctgtgtgtg

SEQ ID NO: 339092 - DNA, 25 bp, Mus musculus
gtcccgactgtaccgggctgtcagg

SEQ ID NO: 339093 - DNA, 25 bp, Mus musculus
gtcccgagaaagattccagagtcag

SEQ ID NO: 339094 - DNA, 25 bp, Mus musculus
gtcccgagaaagtttccagagtcag

SEQ ID NO: 339095 - DNA, 25 bp, Mus musculus
gtcccgagccagaggagtacttttg

SEQ ID NO: 339096 - DNA, 25 bp, Mus musculus
gtcccgagggaccggacactggcca

SEQ ID NO: 339097 - DNA, 25 bp, Mus musculus
gtcccgatcaagatcaacaacccct

SEQ ID NO: 339098 - DNA, 25 bp, Mus musculus
gtcccgatgaagaactaagtggaaa

SEQ ID NO: 339099 - DNA, 25 bp, Mus musculus
gtcccgatgaagaatggataacgac

SEQ ID NO: 339100 - DNA, 25 bp, Mus musculus
gtcccgattctgtggacaggccaaa

SEQ ID NO: 339101 - DNA, 25 bp, Mus musculus
gtcccgctagaccggtggaacctag

SEQ ID NO: 339102 - DNA, 25 bp, Mus musculus
gtcccggacacccggaaaccctgat

SEQ ID NO: 339103 - DNA, 25 bp, Mus musculus
gtcccggatggagtgtcgaggggga

SEQ ID NO: 339104 - DNA, 25 bp, Mus musculus
gtcccggcagcagaggtggtttgtg

SEQ ID NO: 339105 - DNA, 25 bp, Mus musculus
gtcccgggagcccctgatgacccct

SEQ ID NO: 339106 - DNA, 25 bp, Mus musculus
gtcccgggcagcatccagcatgtgt

SEQ ID NO: 339107 - DNA, 25 bp, Mus musculus
gtcccggggcggagtttgatggtga

SEQ ID NO: 339108 - DNA, 25 bp, Mus musculus
gtcccggggcggcctcttgggagac

SEQ ID NO: 339109 - DNA, 25 bp, Mus musculus
gtcccggggcggtgatgtggccgtg

SEQ ID NO: 339110 - DNA, 25 bp, Mus musculus
gtcccggtgatcaagaaatgcattg

SEQ ID NO: 339111 - DNA, 25 bp, Mus musculus
gtcccgtacccacatcacagctcga

SEQ ID NO: 339112 - DNA, 25 bp, Mus musculus
gtcccgtatccttgaattacatcca

SEQ ID NO: 339113 - DNA, 25 bp, Mus musculus
gtcccgtatccttgtgttatccaag

SEQ ID NO: 339114 - DNA, 25 bp, Mus musculus
gtcccgtcatctcccccagatctcc

SEQ ID NO: 339115 - DNA, 25 bp, Mus musculus
gtcccgtggccaggaaggacaggag

SEQ ID NO: 339116 - DNA, 25 bp, Mus musculus
gtcccgtgtcatgggtctcagcctg

SEQ ID NO: 339117 - DNA, 25 bp, Mus musculus
gtccctaaagcaagggagccgagta

SEQ ID NO: 339118 - DNA, 25 bp, Mus musculus
gtccctacagtcaagctgtgcaagt

SEQ ID NO: 339119 - DNA, 25 bp, Mus musculus
gtccctaccctcgagtctgtagctc

SEQ ID NO: 339120 - DNA, 25 bp, Mus musculus
gtccctacgcctggactaacggtta

SEQ ID NO: 339121 - DNA, 25 bp, Mus musculus
gtccctagaggtgttggtggaatga

SEQ ID NO: 339122 - DNA, 25 bp, Mus musculus
gtccctataaccgatgagaaccaca

SEQ ID NO: 339123 - DNA, 25 bp, Mus musculus
gtccctatggagcagcccaggcctc

SEQ ID NO: 339124 - DNA, 25 bp, Mus musculus
gtccctcaagagtttacaaacctga

SEQ ID NO: 339125 - DNA, 25 bp, Mus musculus
gtccctcaatgcaaaaaggccagat

SEQ ID NO: 339126 - DNA, 25 bp, Mus musculus
gtccctcacacacctgcacgttctc

SEQ ID NO: 339127 - DNA, 25 bp, Mus musculus
gtccctcacccccaggagttcaact

SEQ ID NO: 339128 - DNA, 25 bp, Mus musculus
gtccctcaccttggcagccatcatg

SEQ ID NO: 339129 - DNA, 25 bp, Mus musculus
gtccctcaccttgggaatcccaatg

SEQ ID NO: 339130 - DNA, 25 bp, Mus musculus
gtccctcactaaaagcaccttcatc

SEQ ID NO: 339131 - DNA, 25 bp, Mus musculus
gtccctcagggtctggagtatggac

SEQ ID NO: 339132 - DNA, 25 bp, Mus musculus
gtccctccagacttcctctgcccac

SEQ ID NO: 339133 - DNA, 25 bp, Mus musculus
gtccctccaggtgggcacatggaac

SEQ ID NO: 339134 - DNA, 25 bp, Mus musculus
gtccctccccagcaatctactctcc

SEQ ID NO: 339135 - DNA, 25 bp, Mus musculus
gtccctccccaggaacattgaccat

SEQ ID NO: 339136 - DNA, 25 bp, Mus musculus
gtccctccgggctgtgagcacctcc

SEQ ID NO: 339137 - DNA, 25 bp, Mus musculus
gtccctcctaagactgtatcacttt

SEQ ID NO: 339138 - DNA, 25 bp, Mus musculus
gtccctcctgcaagcgttctgtcaa

SEQ ID NO: 339139 - DNA, 25 bp, Mus musculus
gtccctctatgccaaaaggccagat

SEQ ID NO: 339140 - DNA, 25 bp, Mus musculus
gtccctctcaaccctggctgcactg

SEQ ID NO: 339141 - DNA, 25 bp, Mus musculus
gtccctctgatttagatcttgaacc

SEQ ID NO: 339142 - DNA, 25 bp, Mus musculus
gtccctctgtgccgaacatctcatc

SEQ ID NO: 339143 - DNA, 25 bp, Mus musculus
gtccctctgtgccgcccccagagga

SEQ ID NO: 339144 - DNA, 25 bp, Mus musculus
gtccctgaaaggaagtcagagaagc

SEQ ID NO: 339145 - DNA, 25 bp, Mus musculus
gtccctgaggagcagggcattttcc

SEQ ID NO: 339146 - DNA, 25 bp, Mus musculus
gtccctgcaggtgaagaagactcat

SEQ ID NO: 339147 - DNA, 25 bp, Mus musculus
gtccctgccagatgaggatcatgcg

SEQ ID NO: 339148 - DNA, 25 bp, Mus musculus
gtccctgctggagaatgagagagaa

SEQ ID NO: 339149 - DNA, 25 bp, Mus musculus
gtccctgctggaggagctgatgcac

SEQ ID NO: 339150 - DNA, 25 bp, Mus musculus
gtccctggactggaaggaaatctac

SEQ ID NO: 339151 - DNA, 25 bp, Mus musculus
gtccctggagaaggatatgaatcag

SEQ ID NO: 339152 - DNA, 25 bp, Mus musculus
gtccctggagaaggcgtgggtgact

SEQ ID NO: 339153 - DNA, 25 bp, Mus musculus
gtccctggagaagtcaaacaggtga

SEQ ID NO: 339154 - DNA, 25 bp, Mus musculus
gtccctggcggttcacaagagcaag

SEQ ID NO: 339155 - DNA, 25 bp, Mus musculus
gtccctggctgagtatgagcccaga

SEQ ID NO: 339156 - DNA, 25 bp, Mus musculus
gtccctggggatccgagagactcgg

SEQ ID NO: 339157 - DNA, 25 bp, Mus musculus
gtccctggtccaggtgaaatcgccc

SEQ ID NO: 339158 - DNA, 25 bp, Mus musculus
gtccctgtaacaagcttaaatccag

SEQ ID NO: 339159 - DNA, 25 bp, Mus musculus
gtccctgtcatcagattgatctttt

SEQ ID NO: 339160 - DNA, 25 bp, Mus musculus
gtccctgtctgaaggatctcacata

SEQ ID NO: 339161 - DNA, 25 bp, Mus musculus
gtccctgtctgaaggcacttctgga

SEQ ID NO: 339162 - DNA, 25 bp, Mus musculus
gtccctgtctgtggccaggagggcc

SEQ ID NO: 339163 - DNA, 25 bp, Mus musculus
gtccctgtggctgatcgcgtggctg

SEQ ID NO: 339164 - DNA, 25 bp, Mus musculus
gtccctgtggctgatctcttcattg

SEQ ID NO: 339165 - DNA, 25 bp, Mus musculus
gtccctgtggctgatgtatgtgtaa

SEQ ID NO: 339166 - DNA, 25 bp, Mus musculus
gtccctgtgggaagcccccggcagc

SEQ ID NO: 339167 - DNA, 25 bp, Mus musculus
gtccctgttcagagggagagccgag

SEQ ID NO: 339168 - DNA, 25 bp, Mus musculus
gtccctgttcagaggtcctgatagc

SEQ ID NO: 339169 - DNA, 25 bp, Mus musculus
gtccctgttctccaccctcccctga

SEQ ID NO: 339170 - DNA, 25 bp, Mus musculus
gtccctgttgacaatatctttaatg

SEQ ID NO: 339171 - DNA, 25 bp, Mus musculus
gtccctgttgacgaacctaaaacta

SEQ ID NO: 339172 - DNA, 25 bp, Mus musculus
gtcccttaactgatgtgccggtgaa

SEQ ID NO: 339173 - DNA, 25 bp, Mus musculus
gtcccttaagttcaggtcagaggaa

SEQ ID NO: 339174 - DNA, 25 bp, Mus musculus
gtcccttaggtttgatcagacctac

SEQ ID NO: 339175 - DNA, 25 bp, Mus musculus
gtcccttcactggctcccactactg

SEQ ID NO: 339176 - DNA, 25 bp, Mus musculus
gtcccttcagcctggggctgacatg

SEQ ID NO: 339177 - DNA, 25 bp, Mus musculus
gtcccttgcagccactgcaagaaaa

SEQ ID NO: 339178 - DNA, 25 bp, Mus musculus
gtcccttgcagccagacgttagggg

SEQ ID NO: 339179 - DNA, 25 bp, Mus musculus
gtcccttgcagccatgcagtggtgc

SEQ ID NO: 339180 - DNA, 25 bp, Mus musculus
gtccctttaggagagaagatagagg

SEQ ID NO: 339181 - DNA, 25 bp, Mus musculus
gtcccttttctgagtggtccaagcc

SEQ ID NO: 339182 - DNA, 25 bp, Mus musculus
gtccgaaacactcagccctggcacc

SEQ ID NO: 339183 - DNA, 25 bp, Mus musculus
gtccgaaatctgcttcttgcaggag

SEQ ID NO: 339184 - DNA, 25 bp, Mus musculus
gtccgaagcaggctcctggagtcca

SEQ ID NO: 339185 - DNA, 25 bp, Mus musculus
gtccgaatttcaagcccatctctca

SEQ ID NO: 339186 - DNA, 25 bp, Mus musculus
gtccgaatttcaaggggacgatttg

SEQ ID NO: 339187 - DNA, 25 bp, Mus musculus
gtccgaatttcaaggtctttaagtg

SEQ ID NO: 339188 - DNA, 25 bp, Mus musculus
gtccgaccggcctctctggaggaaa

SEQ ID NO: 339189 - DNA, 25 bp, Mus musculus
gtccgacgctgacatggactgggct

SEQ ID NO: 339190 - DNA, 25 bp, Mus musculus
gtccgagaaggaaaagtggtcattg

SEQ ID NO: 339191 - DNA, 25 bp, Mus musculus
gtccgagaaggcctgtgtgggcagc

SEQ ID NO: 339192 - DNA, 25 bp, Mus musculus
gtccgagacatgatagaagcgatgg

SEQ ID NO: 339193 - DNA, 25 bp, Mus musculus
gtccgagacatggagatcgagggcg

SEQ ID NO: 339194 - DNA, 25 bp, Mus musculus
gtccgagagaagacacagctggtat

SEQ ID NO: 339195 - DNA, 25 bp, Mus musculus
gtccgagagaagaccaccaaggcct

SEQ ID NO: 339196 - DNA, 25 bp, Mus musculus
gtccgagagaaggtgggtgacatca

SEQ ID NO: 339197 - DNA, 25 bp, Mus musculus
gtccgagagcaggtctgcctgggct

SEQ ID NO: 339198 - DNA, 25 bp, Mus musculus
gtccgagagcagtggccacagttaa

SEQ ID NO: 339199 - DNA, 25 bp, Mus musculus
gtccgagagttcaaaggtgaagaga

SEQ ID NO: 339200 - DNA, 25 bp, Mus musculus
gtccgagatctgctgcccaccaatt

SEQ ID NO: 339201 - DNA, 25 bp, Mus musculus
gtccgagccaggacgagggatctga

SEQ ID NO: 339202 - DNA, 25 bp, Mus musculus
gtccgaggactatgagaccaccatc

SEQ ID NO: 339203 - DNA, 25 bp, Mus musculus
gtccgaggcctacctcccttttgct

SEQ ID NO: 339204 - DNA, 25 bp, Mus musculus
gtccgaggcctatgttgatctaacc

SEQ ID NO: 339205 - DNA, 25 bp, Mus musculus
gtccgaggggcggagctacagagac

SEQ ID NO: 339206 - DNA, 25 bp, Mus musculus
gtccgaggggcggatacagagactg

SEQ ID NO: 339207 - DNA, 25 bp, Mus musculus
gtccgaggtgcacagaggcataatc

SEQ ID NO: 339208 - DNA, 25 bp, Mus musculus
gtccgaggttctgccgcaggagatg

SEQ ID NO: 339209 - DNA, 25 bp, Mus musculus
gtccgagtccccaagaacacagcca

SEQ ID NO: 339210 - DNA, 25 bp, Mus musculus
gtccgagtccccaagcacggctgga

SEQ ID NO: 339211 - DNA, 25 bp, Mus musculus
gtccgagtcgctgatgagcgggacc

SEQ ID NO: 339212 - DNA, 25 bp, Mus musculus
gtccgcaaagagaaaagatgagagc

SEQ ID NO: 339213 - DNA, 25 bp, Mus musculus
gtccgcaaagctccttctggccgca

SEQ ID NO: 339214 - DNA, 25 bp, Mus musculus
gtccgcaaagtggcatggatggtga

SEQ ID NO: 339215 - DNA, 25 bp, Mus musculus
gtccgcactgtgagaaggaggggat

SEQ ID NO: 339216 - DNA, 25 bp, Mus musculus
gtccgcagacccccaggaaacacca

SEQ ID NO: 339217 - DNA, 25 bp, Mus musculus
gtccgcagagacgagaacagagctg

SEQ ID NO: 339218 - DNA, 25 bp, Mus musculus
gtccgcagagacgagctgacatccg

SEQ ID NO: 339219 - DNA, 25 bp, Mus musculus
gtccgcaggcggctcaaagacttgg

SEQ ID NO: 339220 - DNA, 25 bp, Mus musculus
gtccgcataggcttcagttgtgttt

SEQ ID NO: 339221 - DNA, 25 bp, Mus musculus
gtccgcatcagaggaaggagatgac

SEQ ID NO: 339222 - DNA, 25 bp, Mus musculus
gtccgccatgctctgcgttgctgct

SEQ ID NO: 339223 - DNA, 25 bp, Mus musculus
gtccgcccgaagccctattctgaaa

SEQ ID NO: 339224 - DNA, 25 bp, Mus musculus
gtccgcccgaagcttggtgaggtct

SEQ ID NO: 339225 - DNA, 25 bp, Mus musculus
gtccgcccgaaggttaacaagcctg

SEQ ID NO: 339226 - DNA, 25 bp, Mus musculus
gtccgcccgagatcatcagaaacta

SEQ ID NO: 339227 - DNA, 25 bp, Mus musculus
gtccgccctgagaaatccagtaaac

SEQ ID NO: 339228 - DNA, 25 bp, Mus musculus
gtccgccctgagaggtcccgtaaac

SEQ ID NO: 339229 - DNA, 25 bp, Mus musculus
gtccgccgccgcaaccatcagcctg

SEQ ID NO: 339230 - DNA, 25 bp, Mus musculus
gtccgcctcacaggaacaaaaagtt

SEQ ID NO: 339231 - DNA, 25 bp, Mus musculus
gtccgcgatggagaaaactttagaa

SEQ ID NO: 339232 - DNA, 25 bp, Mus musculus
gtccgcgatggagagagaaaaggaa

SEQ ID NO: 339233 - DNA, 25 bp, Mus musculus
gtccgcgccaggttcatcatttgga

SEQ ID NO: 339234 - DNA, 25 bp, Mus musculus
gtccgcgtcccgcaggtcctgcatg

SEQ ID NO: 339235 - DNA, 25 bp, Mus musculus
gtccgcgtcggtgctggcctgcagc

SEQ ID NO: 339236 - DNA, 25 bp, Mus musculus
gtccgcgtgggtgtcccagaaattt

SEQ ID NO: 339237 - DNA, 25 bp, Mus musculus
gtccgctcagaccagcagtgccgtg

SEQ ID NO: 339238 - DNA, 25 bp, Mus musculus
gtccgctcagggatggtctgtaggc

SEQ ID NO: 339239 - DNA, 25 bp, Mus musculus
gtccgctcagggcttctgaccccat

SEQ ID NO: 339240 - DNA, 25 bp, Mus musculus
gtccgctccagtgcgactttactgg

SEQ ID NO: 339241 - DNA, 25 bp, Mus musculus
gtccgctgctgccatccctcaggcc

SEQ ID NO: 339242 - DNA, 25 bp, Mus musculus
gtccgcttaaaggactggacagact

SEQ ID NO: 339243 - DNA, 25 bp, Mus musculus
gtccgcttcgggcagctgctgattc

SEQ ID NO: 339244 - DNA, 25 bp, Mus musculus
gtccggaacctcaaagtcagtggct

SEQ ID NO: 339245 - DNA, 25 bp, Mus musculus
gtccggagccaggacaaagccaact

SEQ ID NO: 339246 - DNA, 25 bp, Mus musculus
gtccggagccagggctcagattctt

SEQ ID NO: 339247 - DNA, 25 bp, Mus musculus
gtccggagctgtgaggaatgagttc

SEQ ID NO: 339248 - DNA, 25 bp, Mus musculus
gtccggagctgtgaggacagaaaat

SEQ ID NO: 339249 - DNA, 25 bp, Mus musculus
gtccggagtcccaagtctccaggtg

SEQ ID NO: 339250 - DNA, 25 bp, Mus musculus
gtccggagttcgtgcctccggagcc

SEQ ID NO: 339251 - DNA, 25 bp, Mus musculus
gtccggatgtggacgcctctgccca

SEQ ID NO: 339252 - DNA, 25 bp, Mus musculus
gtccggatgtggacgcttctgccag

SEQ ID NO: 339253 - DNA, 25 bp, Mus musculus
gtccggatgtggacggccgagctct

SEQ ID NO: 339254 - DNA, 25 bp, Mus musculus
gtccggcacgccgttcggggtctaa

SEQ ID NO: 339255 - DNA, 25 bp, Mus musculus
gtccggcaggctcagctgcaggctg

SEQ ID NO: 339256 - DNA, 25 bp, Mus musculus
gtccggcgcgcacagccgttgacta

SEQ ID NO: 339257 - DNA, 25 bp, Mus musculus
gtccggcggctggtcacctttgtat

SEQ ID NO: 339258 - DNA, 25 bp, Mus musculus
gtccggctctggttggtcatgctgc

SEQ ID NO: 339259 - DNA, 25 bp, Mus musculus
gtccgggaaaacaatatggctcctt

SEQ ID NO: 339260 - DNA, 25 bp, Mus musculus
gtccgggaaaggattcagatattaa

SEQ ID NO: 339261 - DNA, 25 bp, Mus musculus
gtccgggaccgcctgatccggacac

SEQ ID NO: 339262 - DNA, 25 bp, Mus musculus
gtccgggaccgcctggaggaggaca

SEQ ID NO: 339263 - DNA, 25 bp, Mus musculus
gtccgggagacaggcctctctttct

SEQ ID NO: 339264 - DNA, 25 bp, Mus musculus
gtccggggaccgaaagtctcctgct

SEQ ID NO: 339265 - DNA, 25 bp, Mus musculus
gtccggggacgagatgatttttgat

SEQ ID NO: 339266 - DNA, 25 bp, Mus musculus
gtccgggggcctcgcctgctcctgc

SEQ ID NO: 339267 - DNA, 25 bp, Mus musculus
gtccggtttgcaagagtctttttgg

SEQ ID NO: 339268 - DNA, 25 bp, Mus musculus
gtccggtttgcaagggcaaatggaa

SEQ ID NO: 339269 - DNA, 25 bp, Mus musculus
gtccgtatgtggagaacgttgacaa

SEQ ID NO: 339270 - DNA, 25 bp, Mus musculus
gtccgtcagagaatgctgactttgc

SEQ ID NO: 339271 - DNA, 25 bp, Mus musculus
gtccgtcagatgagccctaggacca

SEQ ID NO: 339272 - DNA, 25 bp, Mus musculus
gtccgtccagagcctgtgcttgagg

SEQ ID NO: 339273 - DNA, 25 bp, Mus musculus
gtccgtcccttcactggctcccact

SEQ ID NO: 339274 - DNA, 25 bp, Mus musculus
gtccgtcctgccgggagctcttacc

SEQ ID NO: 339275 - DNA, 25 bp, Mus musculus
gtccgtgatcagaattgcatttgta

SEQ ID NO: 339276 - DNA, 25 bp, Mus musculus
gtccgtgatcagttccgtatctact

SEQ ID NO: 339277 - DNA, 25 bp, Mus musculus
gtccgtgccagacctcgcagtaact

SEQ ID NO: 339278 - DNA, 25 bp, Mus musculus
gtccgtgccagtaaccctgacctca

SEQ ID NO: 339279 - DNA, 25 bp, Mus musculus
gtccgtgcccacagcccaggctata

SEQ ID NO: 339280 - DNA, 25 bp, Mus musculus
gtccgtgcccgttctgtacttcacc

SEQ ID NO: 339281 - DNA, 25 bp, Mus musculus
gtccgtgctcaaatgagaaaagttg

SEQ ID NO: 339282 - DNA, 25 bp, Mus musculus
gtccgtgctcaagatcaaagaagaa

SEQ ID NO: 339283 - DNA, 25 bp, Mus musculus
gtccgtggaggttgtcagagaattc

SEQ ID NO: 339284 - DNA, 25 bp, Mus musculus
gtcctaaaaaagagaacgcaccagg

SEQ ID NO: 339285 - DNA, 25 bp, Mus musculus
gtcctaaaaggtgcaactacattac

SEQ ID NO: 339286 - DNA, 25 bp, Mus musculus
gtcctaaacatctgtggatggatgg

SEQ ID NO: 339287 - DNA, 25 bp, Mus musculus
gtcctaacacttccagaaactcatc

SEQ ID NO: 339288 - DNA, 25 bp, Mus musculus
gtcctaacccagaacatgtttggga

SEQ ID NO: 339289 - DNA, 25 bp, Mus musculus
gtcctaacgagaatgtcatacccag

SEQ ID NO: 339290 - DNA, 25 bp, Mus musculus
gtcctaagaaaccatcaagaagcgt

SEQ ID NO: 339291 - DNA, 25 bp, Mus musculus
gtcctaagaaacgcaggctccagct

SEQ ID NO: 339292 - DNA, 25 bp, Mus musculus
gtcctaagtcgaaagagttataccc

SEQ ID NO: 339293 - DNA, 25 bp, Mus musculus
gtcctaatggagccatctttaaatc

SEQ ID NO: 339294 - DNA, 25 bp, Mus musculus
gtcctaatggaggtaattttgggag

SEQ ID NO: 339295 - DNA, 25 bp, Mus musculus
gtcctacaagcctggacaaactact

SEQ ID NO: 339296 - DNA, 25 bp, Mus musculus
gtcctacaaggccctcgttgccctg

SEQ ID NO: 339297 - DNA, 25 bp, Mus musculus
gtcctacaagggcctgtggacctgg

SEQ ID NO: 339298 - DNA, 25 bp, Mus musculus
gtcctacaatgatgatgtgctgact

SEQ ID NO: 339299 - DNA, 25 bp, Mus musculus
gtcctacagtgtctacagctacctg

SEQ ID NO: 339300 - DNA, 25 bp, Mus musculus
gtcctacagttgcaggcatcccaca

SEQ ID NO: 339301 - DNA, 25 bp, Mus musculus
gtcctacgaagattatacagacacg

SEQ ID NO: 339302 - DNA, 25 bp, Mus musculus
gtcctacgtgggctcgccatacgac

SEQ ID NO: 339303 - DNA, 25 bp, Mus musculus
gtcctactggaacaaatgcttcccc

SEQ ID NO: 339304 - DNA, 25 bp, Mus musculus
gtcctactgtattatggagattgcc

SEQ ID NO: 339305 - DNA, 25 bp, Mus musculus
gtcctagaaaaccaaactgcagctg

SEQ ID NO: 339306 - DNA, 25 bp, Mus musculus
gtcctagaaatatagctcccgttac

SEQ ID NO: 339307 - DNA, 25 bp, Mus musculus
gtcctagaagcctggcaaaatgaag

SEQ ID NO: 339308 - DNA, 25 bp, Mus musculus
gtcctagcagattgtccttctgaag

SEQ ID NO: 339309 - DNA, 25 bp, Mus musculus
gtcctataacaggataacataaatg

SEQ ID NO: 339310 - DNA, 25 bp, Mus musculus
gtcctatataggtgacagtggaaga

SEQ ID NO: 339311 - DNA, 25 bp, Mus musculus
gtcctatgcagaagaagtactacaa

SEQ ID NO: 339312 - DNA, 25 bp, Mus musculus
gtcctcaaatcggggaaaaactctc

SEQ ID NO: 339313 - DNA, 25 bp, Mus musculus
gtcctcaacaaggacctgatgcaac

SEQ ID NO: 339314 - DNA, 25 bp, Mus musculus
gtcctcaacggagagtatgagagtt

SEQ ID NO: 339315 - DNA, 25 bp, Mus musculus
gtcctcaacgtgtattttgttaaat

SEQ ID NO: 339316 - DNA, 25 bp, Mus musculus
gtcctcaactaggagcttcgatatg

SEQ ID NO: 339317 - DNA, 25 bp, Mus musculus
gtcctcaactccaccccagcctgct

SEQ ID NO: 339318 - DNA, 25 bp, Mus musculus
gtcctcaactccaccctgaagagct

SEQ ID NO: 339319 - DNA, 25 bp, Mus musculus
gtcctcaagaggaaggcagtagagt

SEQ ID NO: 339320 - DNA, 25 bp, Mus musculus
gtcctcaagaggaaggccgaggatg

SEQ ID NO: 339321 - DNA, 25 bp, Mus musculus
gtcctcacacagtgtccaacctgtc

SEQ ID NO: 339322 - DNA, 25 bp, Mus musculus
gtcctcacagtgagtgatagctgct

SEQ ID NO: 339323 - DNA, 25 bp, Mus musculus
gtcctcacatgaaggggcctctgct

SEQ ID NO: 339324 - DNA, 25 bp, Mus musculus
gtcctcacatgcaggatccaaacca

SEQ ID NO: 339325 - DNA, 25 bp, Mus musculus
gtcctcacatgctaggtggagagag

SEQ ID NO: 339326 - DNA, 25 bp, Mus musculus
gtcctcaccaagatcctccaattct

SEQ ID NO: 339327 - DNA, 25 bp, Mus musculus
gtcctcaccaaggtttctctggact

SEQ ID NO: 339328 - DNA, 25 bp, Mus musculus
gtcctcaccacttgagctcctggcc

SEQ ID NO: 339329 - DNA, 25 bp, Mus musculus
gtcctcaccacttggtgaacagtga

SEQ ID NO: 339330 - DNA, 25 bp, Mus musculus
gtcctcactacaggcttccagccag

SEQ ID NO: 339331 - DNA, 25 bp, Mus musculus
gtcctcactgccaaggcagcagccg

SEQ ID NO: 339332 - DNA, 25 bp, Mus musculus
gtcctcagaagagcatggcagaaga

SEQ ID NO: 339333 - DNA, 25 bp, Mus musculus
gtcctcagaagcatggtgtgctcct

SEQ ID NO: 339334 - DNA, 25 bp, Mus musculus
gtcctcagaggccagttgttgctgt

SEQ ID NO: 339335 - DNA, 25 bp, Mus musculus
gtcctcagaggtgtgctcctgcaat

SEQ ID NO: 339336 - DNA, 25 bp, Mus musculus
gtcctcagattccagagacactgta

SEQ ID NO: 339337 - DNA, 25 bp, Mus musculus
gtcctcagccagcaaacaggccctg

SEQ ID NO: 339338 - DNA, 25 bp, Mus musculus
gtcctcagggagtgcctgcacttct

SEQ ID NO: 339339 - DNA, 25 bp, Mus musculus
gtcctcagtcaggaggtctccccag

SEQ ID NO: 339340 - DNA, 25 bp, Mus musculus
gtcctcagtcagtgctggggactga

SEQ ID NO: 339341 - DNA, 25 bp, Mus musculus
gtcctcagtgccaacctttttgccc

SEQ ID NO: 339342 - DNA, 25 bp, Mus musculus
gtcctcatacacagcgtgcagggtc

SEQ ID NO: 339343 - DNA, 25 bp, Mus musculus
gtcctcatagcagaatctggtcaac

SEQ ID NO: 339344 - DNA, 25 bp, Mus musculus
gtcctcatttatgatcccataaaaa

SEQ ID NO: 339345 - DNA, 25 bp, Mus musculus
gtcctccagttttccagagcccctt

SEQ ID NO: 339346 - DNA, 25 bp, Mus musculus
gtcctccatgatcgtcctgcttctc

SEQ ID NO: 339347 - DNA, 25 bp, Mus musculus
gtcctccatgggcatggacatatct

SEQ ID NO: 339348 - DNA, 25 bp, Mus musculus
gtcctcccaaagggtatgtgtattt

SEQ ID NO: 339349 - DNA, 25 bp, Mus musculus
gtcctccccagaaatagatgaagac

SEQ ID NO: 339350 - DNA, 25 bp, Mus musculus
gtcctccccgttctgatacccgatt

SEQ ID NO: 339351 - DNA, 25 bp, Mus musculus
gtcctccctcactgcactaaccttt

SEQ ID NO: 339352 - DNA, 25 bp, Mus musculus
gtcctccctcactggtgagaatgtc

SEQ ID NO: 339353 - DNA, 25 bp, Mus musculus
gtcctccgaatttatgttgaaaaac

SEQ ID NO: 339354 - DNA, 25 bp, Mus musculus
gtcctccgcagcctctactcaatag

SEQ ID NO: 339355 - DNA, 25 bp, Mus musculus
gtcctccgcaggttcgtggtacgaa

SEQ ID NO: 339356 - DNA, 25 bp, Mus musculus
gtcctccgccgggagggttgatttc

SEQ ID NO: 339357 - DNA, 25 bp, Mus musculus
gtcctccgccgggaggtcatggctg

SEQ ID NO: 339358 - DNA, 25 bp, Mus musculus
gtcctcctaaggtgatcttagtgga

SEQ ID NO: 339359 - DNA, 25 bp, Mus musculus
gtcctcctaagtggagggcagcaag

SEQ ID NO: 339360 - DNA, 25 bp, Mus musculus
gtcctcctccacctaaggtggtaaa

SEQ ID NO: 339361 - DNA, 25 bp, Mus musculus
gtcctcctgctgatgctttcattgg

SEQ ID NO: 339362 - DNA, 25 bp, Mus musculus
gtcctcctggaggagttctcagagt

SEQ ID NO: 339363 - DNA, 25 bp, Mus musculus
gtcctcgaagctagggtcccaaagg

SEQ ID NO: 339364 - DNA, 25 bp, Mus musculus
gtcctcgaccagctgcttaaaggat

SEQ ID NO: 339365 - DNA, 25 bp, Mus musculus
gtcctcgctttgtactggttccgcc

SEQ ID NO: 339366 - DNA, 25 bp, Mus musculus
gtcctcggaaaccatcgagcgtttg

SEQ ID NO: 339367 - DNA, 25 bp, Mus musculus
gtcctcggaggagtatatatcctgg

SEQ ID NO: 339368 - DNA, 25 bp, Mus musculus
gtcctcggggcagaaaatatctgca

SEQ ID NO: 339369 - DNA, 25 bp, Mus musculus
gtcctcggggcagatcgtaatgtaa

SEQ ID NO: 339370 - DNA, 25 bp, Mus musculus
gtcctcgtaggaatcagagaagctg

SEQ ID NO: 339371 - DNA, 25 bp, Mus musculus
gtcctcgtcctcctcttcttctaat

SEQ ID NO: 339372 - DNA, 25 bp, Mus musculus
gtcctcgttggagtgacatcgtctt

SEQ ID NO: 339373 - DNA, 25 bp, Mus musculus
gtcctctacaagacaatgttctatt

SEQ ID NO: 339374 - DNA, 25 bp, Mus musculus
gtcctctacaagactgtgtacagtg

SEQ ID NO: 339375 - DNA, 25 bp, Mus musculus
gtcctctataattagcacagagaat

SEQ ID NO: 339376 - DNA, 25 bp, Mus musculus
gtcctctcaaggctcaaactcagaa

SEQ ID NO: 339377 - DNA, 25 bp, Mus musculus
gtcctctcagtggccccagggcccg

SEQ ID NO: 339378 - DNA, 25 bp, Mus musculus
gtcctctgacccactcttggaactg

SEQ ID NO: 339379 - DNA, 25 bp, Mus musculus
gtcctctgaggaggcccactgagtg

SEQ ID NO: 339380 - DNA, 25 bp, Mus musculus
gtcctctgcctgctccggctcctgc

SEQ ID NO: 339381 - DNA, 25 bp, Mus musculus
gtcctctggccctggggatgtgaca

SEQ ID NO: 339382 - DNA, 25 bp, Mus musculus
gtcctctgtggaaagcagatgagaa

SEQ ID NO: 339383 - DNA, 25 bp, Mus musculus
gtcctcttcagaaaggccggagcct

SEQ ID NO: 339384 - DNA, 25 bp, Mus musculus
gtcctcttgcaaggagtcagcattg

SEQ ID NO: 339385 - DNA, 25 bp, Mus musculus
gtcctcttggctcagctgaaggatg

SEQ ID NO: 339386 - DNA, 25 bp, Mus musculus
gtcctctttaagaagtttgatgaag

SEQ ID NO: 339387 - DNA, 25 bp, Mus musculus
gtcctgaaactgtaccagttcaacc

SEQ ID NO: 339388 - DNA, 25 bp, Mus musculus
gtcctgaaagccagagacccgccca

SEQ ID NO: 339389 - DNA, 25 bp, Mus musculus
gtcctgaaagtaggcttctttggct

SEQ ID NO: 339390 - DNA, 25 bp, Mus musculus
gtcctgaaagtctcagaggagcagt

SEQ ID NO: 339391 - DNA, 25 bp, Mus musculus
gtcctgaacacgacccgagcaacgt

SEQ ID NO: 339392 - DNA, 25 bp, Mus musculus
gtcctgaaccctggcggaggctgct

SEQ ID NO: 339393 - DNA, 25 bp, Mus musculus
gtcctgaacttggatcctttctcta

SEQ ID NO: 339394 - DNA, 25 bp, Mus musculus
gtcctgaagacagcccaggacccag

SEQ ID NO: 339395 - DNA, 25 bp, Mus musculus
gtcctgaatgtgagaagattacagt

SEQ ID NO: 339396 - DNA, 25 bp, Mus musculus
gtcctgacagaaatccatgcgacag

SEQ ID NO: 339397 - DNA, 25 bp, Mus musculus
gtcctgacagctgggatctccatct

SEQ ID NO: 339398 - DNA, 25 bp, Mus musculus
gtcctgactatatgatggggctgtg

SEQ ID NO: 339399 - DNA, 25 bp, Mus musculus
gtcctgacttgagaggcccaggatg

SEQ ID NO: 339400 - DNA, 25 bp, Mus musculus
gtcctgagaaaggtataaatgggtc

SEQ ID NO: 339401 - DNA, 25 bp, Mus musculus
gtcctgagattaaagcattggatac

SEQ ID NO: 339402 - DNA, 25 bp, Mus musculus
gtcctgaggacagagaaagagctaa

SEQ ID NO: 339403 - DNA, 25 bp, Mus musculus
gtcctgataggcaggagatgagccg

SEQ ID NO: 339404 - DNA, 25 bp, Mus musculus
gtcctgatgaggtttatcagcttat

SEQ ID NO: 339405 - DNA, 25 bp, Mus musculus
gtcctgattccgggactgcaggcta

SEQ ID NO: 339406 - DNA, 25 bp, Mus musculus
gtcctgcacaaggttctgaaccagc

SEQ ID NO: 339407 - DNA, 25 bp, Mus musculus
gtcctgcccagctcaatggtggctc

SEQ ID NO: 339408 - DNA, 25 bp, Mus musculus
gtcctgcccaggatggcagtacctg

SEQ ID NO: 339409 - DNA, 25 bp, Mus musculus
gtcctgccccacgggcttcagcagc

SEQ ID NO: 339410 - DNA, 25 bp, Mus musculus
gtcctgccctcactcggccgccgcg

SEQ ID NO: 339411 - DNA, 25 bp, Mus musculus
gtcctgccctgcagccagacagtga

SEQ ID NO: 339412 - DNA, 25 bp, Mus musculus
gtcctgccgggagctcttaccaaag

SEQ ID NO: 339413 - DNA, 25 bp, Mus musculus
gtcctgcctctgggcggaaaaactg

SEQ ID NO: 339414 - DNA, 25 bp, Mus musculus
gtcctgcctctgggttaacaatcaa

SEQ ID NO: 339415 - DNA, 25 bp, Mus musculus
gtcctgccttgagagcttacccctc

SEQ ID NO: 339416 - DNA, 25 bp, Mus musculus
gtcctgccttgaggatgacaagatc

SEQ ID NO: 339417 - DNA, 25 bp, Mus musculus
gtcctgccttgaggttcctagacaa

SEQ ID NO: 339418 - DNA, 25 bp, Mus musculus
gtcctgcgctctttgagcgctgccg

SEQ ID NO: 339419 - DNA, 25 bp, Mus musculus
gtcctgctaaggctagagcgcagaa

SEQ ID NO: 339420 - DNA, 25 bp, Mus musculus
gtcctgctaagtgttcttgagtgga

SEQ ID NO: 339421 - DNA, 25 bp, Mus musculus
gtcctgctagagcgcatcccagcct

SEQ ID NO: 339422 - DNA, 25 bp, Mus musculus
gtcctgctcaggtgactcagaagaa

SEQ ID NO: 339423 - DNA, 25 bp, Mus musculus
gtcctgctgaggcgagtaacaagaa

SEQ ID NO: 339424 - DNA, 25 bp, Mus musculus
gtcctgctgcaggctgccaacagct

SEQ ID NO: 339425 - DNA, 25 bp, Mus musculus
gtcctgctgtaaaggctggctactg

SEQ ID NO: 339426 - DNA, 25 bp, Mus musculus
gtcctgctgtcccaggtgctcctgg

SEQ ID NO: 339427 - DNA, 25 bp, Mus musculus
gtcctgctgtctcaggtgctcctgg

SEQ ID NO: 339428 - DNA, 25 bp, Mus musculus
gtcctggaaaggtgatgtacaaagc

SEQ ID NO: 339429 - DNA, 25 bp, Mus musculus
gtcctggaaccaaggtgatgaatct

SEQ ID NO: 339430 - DNA, 25 bp, Mus musculus
gtcctggaactgtgttacatcctga

SEQ ID NO: 339431 - DNA, 25 bp, Mus musculus
gtcctggaaggtggtttgctctctt

SEQ ID NO: 339432 - DNA, 25 bp, Mus musculus
gtcctggaatgtcatggccttatca

SEQ ID NO: 339433 - DNA, 25 bp, Mus musculus
gtcctggagaagacaagtccatcta

SEQ ID NO: 339434 - DNA, 25 bp, Mus musculus
gtcctggagataggacgagtgacca

SEQ ID NO: 339435 - DNA, 25 bp, Mus musculus
gtcctggagcagacaggattatgga

SEQ ID NO: 339436 - DNA, 25 bp, Mus musculus
gtcctggagctgaacaaggagcaag

SEQ ID NO: 339437 - DNA, 25 bp, Mus musculus
gtcctggagctgtgcatccttttat

SEQ ID NO: 339438 - DNA, 25 bp, Mus musculus
gtcctggagctgtggttcgttctcc

SEQ ID NO: 339439 - DNA, 25 bp, Mus musculus
gtcctggaggccagcatattcagga

SEQ ID NO: 339440 - DNA, 25 bp, Mus musculus
gtcctggagtagcctctccaggcag

SEQ ID NO: 339441 - DNA, 25 bp, Mus musculus
gtcctggagtagtcccaggcactct

SEQ ID NO: 339442 - DNA, 25 bp, Mus musculus
gtcctggagtcaagctggaaccacc

SEQ ID NO: 339443 - DNA, 25 bp, Mus musculus
gtcctggatttggggaatacacatg

SEQ ID NO: 339444 - DNA, 25 bp, Mus musculus
gtcctggatttgggggtcctgttac

SEQ ID NO: 339445 - DNA, 25 bp, Mus musculus
gtcctggcacagagaacctgtgctc

SEQ ID NO: 339446 - DNA, 25 bp, Mus musculus
gtcctggcacaggtacaaagtgaaa

SEQ ID NO: 339447 - DNA, 25 bp, Mus musculus
gtcctggcagactgtaccatcaagc

SEQ ID NO: 339448 - DNA, 25 bp, Mus musculus
gtcctggcagagacagagatgggca

SEQ ID NO: 339449 - DNA, 25 bp, Mus musculus
gtcctggcaggaagatttattggtg

SEQ ID NO: 339450 - DNA, 25 bp, Mus musculus
gtcctggcaggactttcctggaacg

SEQ ID NO: 339451 - DNA, 25 bp, Mus musculus
gtcctggcaggagacctagaacttc

SEQ ID NO: 339452 - DNA, 25 bp, Mus musculus
gtcctggcaggggcagtaattggag

SEQ ID NO: 339453 - DNA, 25 bp, Mus musculus
gtcctggccgccaagttgaagttca

SEQ ID NO: 339454 - DNA, 25 bp, Mus musculus
gtcctggcctcagacctcacagtgg

SEQ ID NO: 339455 - DNA, 25 bp, Mus musculus
gtcctggcctggtgtgcatcggcca

SEQ ID NO: 339456 - DNA, 25 bp, Mus musculus
gtcctgggaaaggtgtggtatctct

SEQ ID NO: 339457 - DNA, 25 bp, Mus musculus
gtcctgggcctaagttatgaggagt

SEQ ID NO: 339458 - DNA, 25 bp, Mus musculus
gtcctggggagtgaggacagaactt

SEQ ID NO: 339459 - DNA, 25 bp, Mus musculus
gtcctggggatgcaggttctccgcc

SEQ ID NO: 339460 - DNA, 25 bp, Mus musculus
gtcctgggggaatggataagtatgt

SEQ ID NO: 339461 - DNA, 25 bp, Mus musculus
gtcctgggtctcagattatacagac

SEQ ID NO: 339462 - DNA, 25 bp, Mus musculus
gtcctgggtggctctcccagggtgg

SEQ ID NO: 339463 - DNA, 25 bp, Mus musculus
gtcctgggttaaggagagcacacag

SEQ ID NO: 339464 - DNA, 25 bp, Mus musculus
gtcctgggttcaggcatcagaaaca

SEQ ID NO: 339465 - DNA, 25 bp, Mus musculus
gtcctgggttcaggtgtttccagga

SEQ ID NO: 339466 - DNA, 25 bp, Mus musculus
gtcctggtatgatcccaggctccgg

SEQ ID NO: 339467 - DNA, 25 bp, Mus musculus
gtcctggtttcacaggtcaactttg

SEQ ID NO: 339468 - DNA, 25 bp, Mus musculus
gtcctgtaaggtggtctgtgatgag

SEQ ID NO: 339469 - DNA, 25 bp, Mus musculus
gtcctgtcagcttcagccaccttcg

SEQ ID NO: 339470 - DNA, 25 bp, Mus musculus
gtcctgtcagtggatgtgtcctctc

SEQ ID NO: 339471 - DNA, 25 bp, Mus musculus
gtcctgtccacacaggtttatgaag

SEQ ID NO: 339472 - DNA, 25 bp, Mus musculus
gtcctgtcctcagggaccgcagcag

SEQ ID NO: 339473 - DNA, 25 bp, Mus musculus
gtcctgtcctcagggccttcaggga

SEQ ID NO: 339474 - DNA, 25 bp, Mus musculus
gtcctgtctgcaagagaccgggctc

SEQ ID NO: 339475 - DNA, 25 bp, Mus musculus
gtcctgtctttgggcagctcaaaga

SEQ ID NO: 339476 - DNA, 25 bp, Mus musculus
gtcctgtgaacactgagcctacaca

SEQ ID NO: 339477 - DNA, 25 bp, Mus musculus
gtcctgtgaacactgcgaaattgcc

SEQ ID NO: 339478 - DNA, 25 bp, Mus musculus
gtcctgtgaacaggttgatcgtgtc

SEQ ID NO: 339479 - DNA, 25 bp, Mus musculus
gtcctgtgaagacatcaacgaatgc

SEQ ID NO: 339480 - DNA, 25 bp, Mus musculus
gtcctgtgaagacatcaatgagtgt

SEQ ID NO: 339481 - DNA, 25 bp, Mus musculus
gtcctgtgaagaccaagacgagtgt

SEQ ID NO: 339482 - DNA, 25 bp, Mus musculus
gtcctgtgagacagtgtttcttggt

SEQ ID NO: 339483 - DNA, 25 bp, Mus musculus
gtcctgtgagagagattccccctcc

SEQ ID NO: 339484 - DNA, 25 bp, Mus musculus
gtcctgtgagagatggatgtccttt

SEQ ID NO: 339485 - DNA, 25 bp, Mus musculus
gtcctgtgagatctatgtaagagca

SEQ ID NO: 339486 - DNA, 25 bp, Mus musculus
gtcctgtgcagaagattgataagta

SEQ ID NO: 339487 - DNA, 25 bp, Mus musculus
gtcctgtgccaggaaagcactgcca

SEQ ID NO: 339488 - DNA, 25 bp, Mus musculus
gtcctgtgccaggcaaggtgaccca

SEQ ID NO: 339489 - DNA, 25 bp, Mus musculus
gtcctgtgcctatgcttataccatc

SEQ ID NO: 339490 - DNA, 25 bp, Mus musculus
gtcctgtggagagcctccaacgtgt

SEQ ID NO: 339491 - DNA, 25 bp, Mus musculus
gtcctgtggaggaaattgtgtcaga

SEQ ID NO: 339492 - DNA, 25 bp, Mus musculus
gtcctgtgtgatctcagtaagttct

SEQ ID NO: 339493 - DNA, 25 bp, Mus musculus
gtcctgttcagcaccaacaccacct

SEQ ID NO: 339494 - DNA, 25 bp, Mus musculus
gtcctgttcagcaccatcagcacca

SEQ ID NO: 339495 - DNA, 25 bp, Mus musculus
gtcctgttccaccatagccatcata

SEQ ID NO: 339496 - DNA, 25 bp, Mus musculus
gtcctgttgaaactttagccactta

SEQ ID NO: 339497 - DNA, 25 bp, Mus musculus
gtcctgttgcagggccacaataccc

SEQ ID NO: 339498 - DNA, 25 bp, Mus musculus
gtcctgtttaaccatcagcagtgtt

SEQ ID NO: 339499 - DNA, 25 bp, Mus musculus
gtcctgtttaagagttcagatgcct

SEQ ID NO: 339500 - DNA, 25 bp, Mus musculus
gtcctgtttggtcaggtggtacgtg

SEQ ID NO: 339501 - DNA, 25 bp, Mus musculus
gtccttaaaaggttatggctttcag

SEQ ID NO: 339502 - DNA, 25 bp, Mus musculus
gtccttaaaggtttatgggactgtc

SEQ ID NO: 339503 - DNA, 25 bp, Mus musculus
gtccttaatgaacctcccactgagg

SEQ ID NO: 339504 - DNA, 25 bp, Mus musculus
gtccttacagggaatttaatgaaga

SEQ ID NO: 339505 - DNA, 25 bp, Mus musculus
gtccttactgtcccgagaaggtgta

SEQ ID NO: 339506 - DNA, 25 bp, Mus musculus
gtccttagcaagcataaacagattc

SEQ ID NO: 339507 - DNA, 25 bp, Mus musculus
gtccttatattaaaaggtgtccagt

SEQ ID NO: 339508 - DNA, 25 bp, Mus musculus
gtccttcactctagcccatccagtc

SEQ ID NO: 339509 - DNA, 25 bp, Mus musculus
gtccttcagacctctcctgagatgg

SEQ ID NO: 339510 - DNA, 25 bp, Mus musculus
gtccttcagagaaacagcagcacca

SEQ ID NO: 339511 - DNA, 25 bp, Mus musculus
gtccttcaggaaggtggtcagcgcg

SEQ ID NO: 339512 - DNA, 25 bp, Mus musculus
gtccttcagggcaatctctgtggta

SEQ ID NO: 339513 - DNA, 25 bp, Mus musculus
gtccttcccaggagtacacggtcat

SEQ ID NO: 339514 - DNA, 25 bp, Mus musculus
gtccttcctccaggagccggccacc

SEQ ID NO: 339515 - DNA, 25 bp, Mus musculus
gtccttcctgccccttccatcaaga

SEQ ID NO: 339516 - DNA, 25 bp, Mus musculus
gtccttcctgtcagggattgtgcca

SEQ ID NO: 339517 - DNA, 25 bp, Mus musculus
gtccttctagcaggcctgcctactt

SEQ ID NO: 339518 - DNA, 25 bp, Mus musculus
gtccttctagccagctgcagacgga

SEQ ID NO: 339519 - DNA, 25 bp, Mus musculus
gtccttctccagcagcaagagccag

SEQ ID NO: 339520 - DNA, 25 bp, Mus musculus
gtccttctccagcaggacccaacct

SEQ ID NO: 339521 - DNA, 25 bp, Mus musculus
gtccttctcgagattttattccctc

SEQ ID NO: 339522 - DNA, 25 bp, Mus musculus
gtccttgaaagccctctgggcgtgg

SEQ ID NO: 339523 - DNA, 25 bp, Mus musculus
gtccttgaaccgggcaccatccaaa

SEQ ID NO: 339524 - DNA, 25 bp, Mus musculus
gtccttgaagagcccacctgaatga

SEQ ID NO: 339525 - DNA, 25 bp, Mus musculus
gtccttgacaccagggtggacccag

SEQ ID NO: 339526 - DNA, 25 bp, Mus musculus
gtccttgagtcgatgtgcctgagac

SEQ ID NO: 339527 - DNA, 25 bp, Mus musculus
gtccttgagtggggactgtcagggc

SEQ ID NO: 339528 - DNA, 25 bp, Mus musculus
gtccttgatgtcggtggcgcccagg

SEQ ID NO: 339529 - DNA, 25 bp, Mus musculus
gtccttgcggggcctgtgctctcta

SEQ ID NO: 339530 - DNA, 25 bp, Mus musculus
gtccttggcagcaggaggagccatc

SEQ ID NO: 339531 - DNA, 25 bp, Mus musculus
gtccttggctggcgtatgaggagtg

SEQ ID NO: 339532 - DNA, 25 bp, Mus musculus
gtccttggctggcgtgaggccaaag

SEQ ID NO: 339533 - DNA, 25 bp, Mus musculus
gtccttgggaggttctggctgccca

SEQ ID NO: 339534 - DNA, 25 bp, Mus musculus
gtccttggggcgcagacatgtcttt

SEQ ID NO: 339535 - DNA, 25 bp, Mus musculus
gtccttggggcgcaggacccaagtt

SEQ ID NO: 339536 - DNA, 25 bp, Mus musculus
gtccttgtaacaagcttaaatccag

SEQ ID NO: 339537 - DNA, 25 bp, Mus musculus
gtccttgtcctctgcgagtggcagt

SEQ ID NO: 339538 - DNA, 25 bp, Mus musculus
gtccttgtgtattggcattggaggt

SEQ ID NO: 339539 - DNA, 25 bp, Mus musculus
gtcctttcagggcttcttcgtgtct

SEQ ID NO: 339540 - DNA, 25 bp, Mus musculus
gtcctttcatgtaaatttacatatg

SEQ ID NO: 339541 - DNA, 25 bp, Mus musculus
gtcctttcccagaaaaatatgccca

SEQ ID NO: 339542 - DNA, 25 bp, Mus musculus
gtcctttccgggtggcaaggagtac

SEQ ID NO: 339543 - DNA, 25 bp, Mus musculus
gtcctttctggaaagaatatccagt

SEQ ID NO: 339544 - DNA, 25 bp, Mus musculus
gtcctttctggtgtccgccgatgcc

SEQ ID NO: 339545 - DNA, 25 bp, Mus musculus
gtcctttgagattgagcgtcacgac

SEQ ID NO: 339546 - DNA, 25 bp, Mus musculus
gtcctttgctagggaaagagaaatg

SEQ ID NO: 339547 - DNA, 25 bp, Mus musculus
gtcctttgtatcagtcctggaaaga

SEQ ID NO: 339548 - DNA, 25 bp, Mus musculus
gtcctttgtatctgtcctggaaaga

SEQ ID NO: 339549 - DNA, 25 bp, Mus musculus
gtccttttcagacccgggtcggtga

SEQ ID NO: 339550 - DNA, 25 bp, Mus musculus
gtccttttcatggttaatttctaat

SEQ ID NO: 339551 - DNA, 25 bp, Mus musculus
gtcgaaataaaaaaggggcctgctg

SEQ ID NO: 339552 - DNA, 25 bp, Mus musculus
gtcgaaatgaaacttccagcaatga

SEQ ID NO: 339553 - DNA, 25 bp, Mus musculus
gtcgaaatgaaagttccagcaatga

SEQ ID NO: 339554 - DNA, 25 bp, Mus musculus
gtcgaacaaagtcagctttctctgg

SEQ ID NO: 339555 - DNA, 25 bp, Mus musculus
gtcgaacccctggaattgtggaggc

SEQ ID NO: 339556 - DNA, 25 bp, Mus musculus
gtcgaactagaaaccagtgctgttg

SEQ ID NO: 339557 - DNA, 25 bp, Mus musculus
gtcgaactagaacaccagcagtgct

SEQ ID NO: 339558 - DNA, 25 bp, Mus musculus
gtcgaagaaacatggatgtaaacag

SEQ ID NO: 339559 - DNA, 25 bp, Mus musculus
gtcgaagacacagtgaagcatgact

SEQ ID NO: 339560 - DNA, 25 bp, Mus musculus
gtcgaagacggggacattacactta

SEQ ID NO: 339561 - DNA, 25 bp, Mus musculus
gtcgaagactaagtggactaaagag

SEQ ID NO: 339562 - DNA, 25 bp, Mus musculus
gtcgaagctgggttgaaaactagct

SEQ ID NO: 339563 - DNA, 25 bp, Mus musculus
gtcgaaggagacgaagagatgagac

SEQ ID NO: 339564 - DNA, 25 bp, Mus musculus
gtcgaagtcgctgacatcaatgcaa

SEQ ID NO: 339565 - DNA, 25 bp, Mus musculus
gtcgaatcacgtggagtgaactcag

SEQ ID NO: 339566 - DNA, 25 bp, Mus musculus
gtcgaatcacgtggatggaatgaaa

SEQ ID NO: 339567 - DNA, 25 bp, Mus musculus
gtcgaatgaaaacaagatgagcgat

SEQ ID NO: 339568 - DNA, 25 bp, Mus musculus
gtcgaatgaaactatccagcaagag

SEQ ID NO: 339569 - DNA, 25 bp, Mus musculus
gtcgacaaggagatggacagtacag

SEQ ID NO: 339570 - DNA, 25 bp, Mus musculus
gtcgacacgccagataacacaactg

SEQ ID NO: 339571 - DNA, 25 bp, Mus musculus
gtcgacgacagggaacgaatggagc

SEQ ID NO: 339572 - DNA, 25 bp, Mus musculus
gtcgactatgtgtacaagaccgagc

SEQ ID NO: 339573 - DNA, 25 bp, Mus musculus
gtcgactgagagatcctgagcaagc

SEQ ID NO: 339574 - DNA, 25 bp, Mus musculus
gtcgactggaaaaaggacaggtgca

SEQ ID NO: 339575 - DNA, 25 bp, Mus musculus
gtcgactggaaaaaggataggtgcg

SEQ ID NO: 339576 - DNA, 25 bp, Mus musculus
gtcgactggaaggataggtgcggtc

SEQ ID NO: 339577 - DNA, 25 bp, Mus musculus
gtcgacttcaggtacaggtcccaga

SEQ ID NO: 339578 - DNA, 25 bp, Mus musculus
gtcgacttcaggtggtaagagaagc

SEQ ID NO: 339579 - DNA, 25 bp, Mus musculus
gtcgactttggaggtctcccagtgg

SEQ ID NO: 339580 - DNA, 25 bp, Mus musculus
gtcgagaaatcgagaacactgttat

SEQ ID NO: 339581 - DNA, 25 bp, Mus musculus
gtcgagaaatcgagaacttgattct

SEQ ID NO: 339582 - DNA, 25 bp, Mus musculus
gtcgagactcagggtgaaatggtca

SEQ ID NO: 339583 - DNA, 25 bp, Mus musculus
gtcgagcagctggagaatcctgggg

SEQ ID NO: 339584 - DNA, 25 bp, Mus musculus
gtcgagcatctacttacggctggcc

SEQ ID NO: 339585 - DNA, 25 bp, Mus musculus
gtcgagcatctacttcagctgcgtg

SEQ ID NO: 339586 - DNA, 25 bp, Mus musculus
gtcgagcccaggaggaagaaggcat

SEQ ID NO: 339587 - DNA, 25 bp, Mus musculus
gtcgagcctaaagaacatcaaactg

SEQ ID NO: 339588 - DNA, 25 bp, Mus musculus
gtcgaggatgatcggggaatcatca

SEQ ID NO: 339589 - DNA, 25 bp, Mus musculus
gtcgagggaagctaaagaagtaaac

SEQ ID NO: 339590 - DNA, 25 bp, Mus musculus
gtcgagtaccagaaagctcagccca

SEQ ID NO: 339591 - DNA, 25 bp, Mus musculus
gtcgagtaccaggttggagtgggtg

SEQ ID NO: 339592 - DNA, 25 bp, Mus musculus
gtcgagtgaccagtggagtgaagcc

SEQ ID NO: 339593 - DNA, 25 bp, Mus musculus
gtcgagtggcctcggatgtggaagg

SEQ ID NO: 339594 - DNA, 25 bp, Mus musculus
gtcgatacctgaggacacgagagga

SEQ ID NO: 339595 - DNA, 25 bp, Mus musculus
gtcgatatcaggtgtcctggagcct

SEQ ID NO: 339596 - DNA, 25 bp, Mus musculus
gtcgatcccagatgtagaactctca

SEQ ID NO: 339597 - DNA, 25 bp, Mus musculus
gtcgatcccaggtgcacctccgctc

SEQ ID NO: 339598 - DNA, 25 bp, Mus musculus
gtcgatcccaggtgcttgtcctggc

SEQ ID NO: 339599 - DNA, 25 bp, Mus musculus
gtcgatgggggccgttgactacttt

SEQ ID NO: 339600 - DNA, 25 bp, Mus musculus
gtcgatggtagccgctgccgtgact

SEQ ID NO: 339601 - DNA, 25 bp, Mus musculus
gtcgatggtagccggaagctgtgct

SEQ ID NO: 339602 - DNA, 25 bp, Mus musculus
gtcgattattcagaagcagaacaga

SEQ ID NO: 339603 - DNA, 25 bp, Mus musculus
gtcgatttttaatagatggagagca

SEQ ID NO: 339604 - DNA, 25 bp, Mus musculus
gtcgcaaagagctcaccgagctctt

SEQ ID NO: 339605 - DNA, 25 bp, Mus musculus
gtcgcaaagagggtttctctgtgta

SEQ ID NO: 339606 - DNA, 25 bp, Mus musculus
gtcgcaaagagtgtggggagacctg

SEQ ID NO: 339607 - DNA, 25 bp, Mus musculus
gtcgcaactcaaggtaggtgtacat

SEQ ID NO: 339608 - DNA, 25 bp, Mus musculus
gtcgcaactcaaggtcctttcccat

SEQ ID NO: 339609 - DNA, 25 bp, Mus musculus
gtcgcaagcgggctgcctctgaaga

SEQ ID NO: 339610 - DNA, 25 bp, Mus musculus
gtcgcacagaggaagccgtgaaggc

SEQ ID NO: 339611 - DNA, 25 bp, Mus musculus
gtcgcacagtgcccctgcttgttct

SEQ ID NO: 339612 - DNA, 25 bp, Mus musculus
gtcgcacgagagctgcctgtagctg

SEQ ID NO: 339613 - DNA, 25 bp, Mus musculus
gtcgcacgaggtggactcacattat

SEQ ID NO: 339614 - DNA, 25 bp, Mus musculus
gtcgcacgcgtgagcatgcgctacg

SEQ ID NO: 339615 - DNA, 25 bp, Mus musculus
gtcgcagacggttcccagcagtggc

SEQ ID NO: 339616 - DNA, 25 bp, Mus musculus
gtcgcagagctgtcagtgacccacc

SEQ ID NO: 339617 - DNA, 25 bp, Mus musculus
gtcgcagcaaacgatcatcccagca

SEQ ID NO: 339618 - DNA, 25 bp, Mus musculus
gtcgcagcagaaactggaggtactg

SEQ ID NO: 339619 - DNA, 25 bp, Mus musculus
gtcgcagcagctaacagagaagtcc

SEQ ID NO: 339620 - DNA, 25 bp, Mus musculus
gtcgcaggcaaaggttcagaactta

SEQ ID NO: 339621 - DNA, 25 bp, Mus musculus
gtcgcagtcaggcctcagctgcacc

SEQ ID NO: 339622 - DNA, 25 bp, Mus musculus
gtcgcagtcagtactgttacataaa

SEQ ID NO: 339623 - DNA, 25 bp, Mus musculus
gtcgcagtggtgcaggcagtgcagg

SEQ ID NO: 339624 - DNA, 25 bp, Mus musculus
gtcgcatccatgtcattgaccacag

SEQ ID NO: 339625 - DNA, 25 bp, Mus musculus
gtcgcattcgaagagccaccgaagg

SEQ ID NO: 339626 - DNA, 25 bp, Mus musculus
gtcgcattcgatgaaatcgtggaca

SEQ ID NO: 339627 - DNA, 25 bp, Mus musculus
gtcgccaaagcaaggacgtccacgt

SEQ ID NO: 339628 - DNA, 25 bp, Mus musculus
gtcgccaaagcccatgaaatgattg

SEQ ID NO: 339629 - DNA, 25 bp, Mus musculus
gtcgccaaataagaacaactaggct

SEQ ID NO: 339630 - DNA, 25 bp, Mus musculus
gtcgccaaataagacagtgaaatcg

SEQ ID NO: 339631 - DNA, 25 bp, Mus musculus
gtcgccaagcaggtagggccttcct

SEQ ID NO: 339632 - DNA, 25 bp, Mus musculus
gtcgccacgcgagcaagctctcacg

SEQ ID NO: 339633 - DNA, 25 bp, Mus musculus
gtcgccagcccgtcccaggtaaatc

SEQ ID NO: 339634 - DNA, 25 bp, Mus musculus
gtcgccatcccagggaacaggaaga

SEQ ID NO: 339635 - DNA, 25 bp, Mus musculus
gtcgccatccttgaaattttctgaa

SEQ ID NO: 339636 - DNA, 25 bp, Mus musculus
gtcgccatccttgaatgtccagttt

SEQ ID NO: 339637 - DNA, 25 bp, Mus musculus
gtcgccatggctccagcacccgagc

SEQ ID NO: 339638 - DNA, 25 bp, Mus musculus
gtcgccattggatcatctgtcccta

SEQ ID NO: 339639 - DNA, 25 bp, Mus musculus
gtcgcccaaaagacctagtggttta

SEQ ID NO: 339640 - DNA, 25 bp, Mus musculus
gtcgcccaggagcaggtgtagctac

SEQ ID NO: 339641 - DNA, 25 bp, Mus musculus
gtcgccccgagagaagtcaatgaaa

SEQ ID NO: 339642 - DNA, 25 bp, Mus musculus
gtcgcccctgaagatggagagaaga

SEQ ID NO: 339643 - DNA, 25 bp, Mus musculus
gtcgcccctgagaaaaatgttttac

SEQ ID NO: 339644 - DNA, 25 bp, Mus musculus
gtcgcccgggaggcgctggcggtgg

SEQ ID NO: 339645 - DNA, 25 bp, Mus musculus
gtcgccctagagttgaggccggcgc

SEQ ID NO: 339646 - DNA, 25 bp, Mus musculus
gtcgccctcggctatcccctctgcc

SEQ ID NO: 339647 - DNA, 25 bp, Mus musculus
gtcgccctcgggttccagcagaaga

SEQ ID NO: 339648 - DNA, 25 bp, Mus musculus
gtcgccgacaggagctacgagaggt

SEQ ID NO: 339649 - DNA, 25 bp, Mus musculus
gtcgccgacaggaggcgacccagtg

SEQ ID NO: 339650 - DNA, 25 bp, Mus musculus
gtcgccgccacagagttctgtcctt

SEQ ID NO: 339651 - DNA, 25 bp, Mus musculus
gtcgccggaggacacagagctgcag

SEQ ID NO: 339652 - DNA, 25 bp, Mus musculus
gtcgccggcttccaggtaccaatgg

SEQ ID NO: 339653 - DNA, 25 bp, Mus musculus
gtcgccgtgccgcgggagaggaaaa

SEQ ID NO: 339654 - DNA, 25 bp, Mus musculus
gtcgccgtgccgcgggtgtgccagg

SEQ ID NO: 339655 - DNA, 25 bp, Mus musculus
gtcgcctatttcaagataaacaagc

SEQ ID NO: 339656 - DNA, 25 bp, Mus musculus
gtcgcctcagaaaatgtatctcgtg

SEQ ID NO: 339657 - DNA, 25 bp, Mus musculus
gtcgcctcgagaaccctgcacctgc

SEQ ID NO: 339658 - DNA, 25 bp, Mus musculus
gtcgcctcgaggaagaaggcattgt

SEQ ID NO: 339659 - DNA, 25 bp, Mus musculus
gtcgcctctggaccaacggtcccat

SEQ ID NO: 339660 - DNA, 25 bp, Mus musculus
gtcgcctgaagctaagctcccttcg

SEQ ID NO: 339661 - DNA, 25 bp, Mus musculus
gtcgcctgcaggatactttggaaca

SEQ ID NO: 339662 - DNA, 25 bp, Mus musculus
gtcgcctgcaggtgattttcgatat

SEQ ID NO: 339663 - DNA, 25 bp, Mus musculus
gtcgcctgcaggtgtctaagcactg

SEQ ID NO: 339664 - DNA, 25 bp, Mus musculus
gtcgcctggagccgaaatcatgtcc

SEQ ID NO: 339665 - DNA, 25 bp, Mus musculus
gtcgcctgtagttgcagccccaccc

SEQ ID NO: 339666 - DNA, 25 bp, Mus musculus
gtcgcctttgaaaagctttctccag

SEQ ID NO: 339667 - DNA, 25 bp, Mus musculus
gtcgcctttgtctggaagcggcctc

SEQ ID NO: 339668 - DNA, 25 bp, Mus musculus
gtcgcctttgtctggtcccccttcc

SEQ ID NO: 339669 - DNA, 25 bp, Mus musculus
gtcgcgagactaagaccatggccaa

SEQ ID NO: 339670 - DNA, 25 bp, Mus musculus
gtcgcgagactaagagccccactgc

SEQ ID NO: 339671 - DNA, 25 bp, Mus musculus
gtcgcgcacaggattacatcttcta

SEQ ID NO: 339672 - DNA, 25 bp, Mus musculus
gtcgcgcacaggccctaccgtggac

SEQ ID NO: 339673 - DNA, 25 bp, Mus musculus
gtcgcgcggcttggagctccttcct

SEQ ID NO: 339674 - DNA, 25 bp, Mus musculus
gtcgcgctgcgctcggtgagtgcag

SEQ ID NO: 339675 - DNA, 25 bp, Mus musculus
gtcgcggccatgaagcatgtctgct

SEQ ID NO: 339676 - DNA, 25 bp, Mus musculus
gtcgcggccatgaaggcgggtgcta

SEQ ID NO: 339677 - DNA, 25 bp, Mus musculus
gtcgcggccgcatggcggacaagga

SEQ ID NO: 339678 - DNA, 25 bp, Mus musculus
gtcgcggcggtgacctacagcactg

SEQ ID NO: 339679 - DNA, 25 bp, Mus musculus
gtcgcggctcccgatggaaatccta

SEQ ID NO: 339680 - DNA, 25 bp, Mus musculus
gtcgcggtcaatgggtgggtgaggt

SEQ ID NO: 339681 - DNA, 25 bp, Mus musculus
gtcgcggtcaatggtcagcaagatc

SEQ ID NO: 339682 - DNA, 25 bp, Mus musculus
gtcgcgtggatcggaactccagcga

SEQ ID NO: 339683 - DNA, 25 bp, Mus musculus
gtcgcgtggatcggttcgccttgcg

SEQ ID NO: 339684 - DNA, 25 bp, Mus musculus
gtcgctagagttttcaggaagagct

SEQ ID NO: 339685 - DNA, 25 bp, Mus musculus
gtcgctcaacaagagagaaggcttt

SEQ ID NO: 339686 - DNA, 25 bp, Mus musculus
gtcgctcctatggcatgtgggcaca

SEQ ID NO: 339687 - DNA, 25 bp, Mus musculus
gtcgctcggagatcgcttttgtggc

SEQ ID NO: 339688 - DNA, 25 bp, Mus musculus
gtcgctcggagatcgtatacttgaa

SEQ ID NO: 339689 - DNA, 25 bp, Mus musculus
gtcgctgaaccgagcctgttcctgc

SEQ ID NO: 339690 - DNA, 25 bp, Mus musculus
gtcgctgaagccagagagtcatgga

SEQ ID NO: 339691 - DNA, 25 bp, Mus musculus
gtcgctgagttctggaatacagtga

SEQ ID NO: 339692 - DNA, 25 bp, Mus musculus
gtcgctgcacagtgatgactcttcc

SEQ ID NO: 339693 - DNA, 25 bp, Mus musculus
gtcgctgctcggtgtcgcaacatcc

SEQ ID NO: 339694 - DNA, 25 bp, Mus musculus
gtcgctggcttccaaatggaactct

SEQ ID NO: 339695 - DNA, 25 bp, Mus musculus
gtcgctgttacggaggcgaagagga

SEQ ID NO: 339696 - DNA, 25 bp, Mus musculus
gtcgctgttacgggctgtgacaatc

SEQ ID NO: 339697 - DNA, 25 bp, Mus musculus
gtcgcttaccggtggaagcttggag

SEQ ID NO: 339698 - DNA, 25 bp, Mus musculus
gtcgcttaccgttaccgcaggtgga

SEQ ID NO: 339699 - DNA, 25 bp, Mus musculus
gtcgcttcagcctttaccctccggt

SEQ ID NO: 339700 - DNA, 25 bp, Mus musculus
gtcgcttcctcaagctgagtcctga

SEQ ID NO: 339701 - DNA, 25 bp, Mus musculus
gtcgcttgcaaggttcctgtcccac

SEQ ID NO: 339702 - DNA, 25 bp, Mus musculus
gtcgcttgcaagtgtgacttggaag

SEQ ID NO: 339703 - DNA, 25 bp, Mus musculus
gtcgcttgtagaaatgccaaagccc

SEQ ID NO: 339704 - DNA, 25 bp, Mus musculus
gtcgcttgtaggaatgccaaagccc

SEQ ID NO: 339705 - DNA, 25 bp, Mus musculus
gtcgcttttttatcaggtcgcatca

SEQ ID NO: 339706 - DNA, 25 bp, Mus musculus
gtcggaaactcagatgaatgaagaa

SEQ ID NO: 339707 - DNA, 25 bp, Mus musculus
gtcggaacagccgtgaagcacctaa

SEQ ID NO: 339708 - DNA, 25 bp, Mus musculus
gtcggaaccatggcttccctttccc

SEQ ID NO: 339709 - DNA, 25 bp, Mus musculus
gtcggaagcaaggtctggtccatcg

SEQ ID NO: 339710 - DNA, 25 bp, Mus musculus
gtcggaattcctaccctcagaagga

SEQ ID NO: 339711 - DNA, 25 bp, Mus musculus
gtcggacatgcagtggaaagttcga

SEQ ID NO: 339712 - DNA, 25 bp, Mus musculus
gtcggaccagatggtgacttgccgt

SEQ ID NO: 339713 - DNA, 25 bp, Mus musculus
gtcggaccggaacggatgtatacat

SEQ ID NO: 339714 - DNA, 25 bp, Mus musculus
gtcggacggctgccgggttgtgagc

SEQ ID NO: 339715 - DNA, 25 bp, Mus musculus
gtcggagaaaagggagaacctggtg

SEQ ID NO: 339716 - DNA, 25 bp, Mus musculus
gtcggagaagtcccgttgtatcaga

SEQ ID NO: 339717 - DNA, 25 bp, Mus musculus
gtcggagacccggatttcccagcct

SEQ ID NO: 339718 - DNA, 25 bp, Mus musculus
gtcggagatgaagattcaatgagag

SEQ ID NO: 339719 - DNA, 25 bp, Mus musculus
gtcggagccatgcctcttcgacttg

SEQ ID NO: 339720 - DNA, 25 bp, Mus musculus
gtcggagccatggagcatttcactg

SEQ ID NO: 339721 - DNA, 25 bp, Mus musculus
gtcggagcccgcgattctcattgaa

SEQ ID NO: 339722 - DNA, 25 bp, Mus musculus
gtcggagcccgcgggtcttactgtt

SEQ ID NO: 339723 - DNA, 25 bp, Mus musculus
gtcggaggaggtgggcgttgggctc

SEQ ID NO: 339724 - DNA, 25 bp, Mus musculus
gtcggaggaggttgctgaacgaaag

SEQ ID NO: 339725 - DNA, 25 bp, Mus musculus
gtcggaggagtggtgtggaaggcag

SEQ ID NO: 339726 - DNA, 25 bp, Mus musculus
gtcggaggccagttctggtccgcat

SEQ ID NO: 339727 - DNA, 25 bp, Mus musculus
gtcggaggctccgtggaacactcgg

SEQ ID NO: 339728 - DNA, 25 bp, Mus musculus
gtcggagttgctgggagacattggg

SEQ ID NO: 339729 - DNA, 25 bp, Mus musculus
gtcggataaccagtggcatcctttg

SEQ ID NO: 339730 - DNA, 25 bp, Mus musculus
gtcggatgaggaagggcccggggag

SEQ ID NO: 339731 - DNA, 25 bp, Mus musculus
gtcggatggaaaagcacctggatgc

SEQ ID NO: 339732 - DNA, 25 bp, Mus musculus
gtcggcaatggctatgacattgcct

SEQ ID NO: 339733 - DNA, 25 bp, Mus musculus
gtcggcacaactcctggtcatctag

SEQ ID NO: 339734 - DNA, 25 bp, Mus musculus
gtcggcacaatcagagccttggctg

SEQ ID NO: 339735 - DNA, 25 bp, Mus musculus
gtcggcagaggtaaccatggagaag

SEQ ID NO: 339736 - DNA, 25 bp, Mus musculus
gtcggcaggtcccaggtatgaatac

SEQ ID NO: 339737 - DNA, 25 bp, Mus musculus
gtcggcatcagaacggccggtttgt

SEQ ID NO: 339738 - DNA, 25 bp, Mus musculus
gtcggcattgcccgcccatgtgcct

SEQ ID NO: 339739 - DNA, 25 bp, Mus musculus
gtcggcctcgatgtggaggccacat

SEQ ID NO: 339740 - DNA, 25 bp, Mus musculus
gtcggcctcgcaatacttcgtgctg

SEQ ID NO: 339741 - DNA, 25 bp, Mus musculus
gtcggcctgcaggcctgtcgagggg

SEQ ID NO: 339742 - DNA, 25 bp, Mus musculus
gtcggcctgcaggtgcggacctatg

SEQ ID NO: 339743 - DNA, 25 bp, Mus musculus
gtcggcctgcagtttcaggcctgtc

SEQ ID NO: 339744 - DNA, 25 bp, Mus musculus
gtcggcggaacaggtaattgctggc

SEQ ID NO: 339745 - DNA, 25 bp, Mus musculus
gtcggcggccagcagatcgtgtcca

SEQ ID NO: 339746 - DNA, 25 bp, Mus musculus
gtcggcggccagcaggtactcctga

SEQ ID NO: 339747 - DNA, 25 bp, Mus musculus
gtcggcggggacagatctcaagacc

SEQ ID NO: 339748 - DNA, 25 bp, Mus musculus
gtcggcgtaggaatgtgtttctgat

SEQ ID NO: 339749 - DNA, 25 bp, Mus musculus
gtcggctcagctggacagaggggat

SEQ ID NO: 339750 - DNA, 25 bp, Mus musculus
gtcggctgacagacccgtggattcc

SEQ ID NO: 339751 - DNA, 25 bp, Mus musculus
gtcggctgacagggcaagagttcaa

SEQ ID NO: 339752 - DNA, 25 bp, Mus musculus
gtcggctgacaggtagaaaaccagt

SEQ ID NO: 339753 - DNA, 25 bp, Mus musculus
gtcggctgagaggcaggctgcaagg

SEQ ID NO: 339754 - DNA, 25 bp, Mus musculus
gtcggctgagaggcaggctgtcaat

SEQ ID NO: 339755 - DNA, 25 bp, Mus musculus
gtcggctgctcatggaaacgtgtgc

SEQ ID NO: 339756 - DNA, 25 bp, Mus musculus
gtcggcttaggagccacatatagac

SEQ ID NO: 339757 - DNA, 25 bp, Mus musculus
gtcggcttccttaagacagatggga

SEQ ID NO: 339758 - DNA, 25 bp, Mus musculus
gtcgggaccaggatgaggctgtaga

SEQ ID NO: 339759 - DNA, 25 bp, Mus musculus
gtcgggacccttgcacaagcagttc

SEQ ID NO: 339760 - DNA, 25 bp, Mus musculus
gtcgggaccgtgaagtggatgggag

SEQ ID NO: 339761 - DNA, 25 bp, Mus musculus
gtcgggagatattggcaaaatatcc

SEQ ID NO: 339762 - DNA, 25 bp, Mus musculus
gtcgggagatgagaatcagctgttc

SEQ ID NO: 339763 - DNA, 25 bp, Mus musculus
gtcgggagatgagcattcgcagccg

SEQ ID NO: 339764 - DNA, 25 bp, Mus musculus
gtcgggagatggatccttaaattta

SEQ ID NO: 339765 - DNA, 25 bp, Mus musculus
gtcgggagtcagaaagagcccagtg

SEQ ID NO: 339766 - DNA, 25 bp, Mus musculus
gtcgggccctcagccctaccagcag

SEQ ID NO: 339767 - DNA, 25 bp, Mus musculus
gtcgggccctcagtgagttgcagac

SEQ ID NO: 339768 - DNA, 25 bp, Mus musculus
gtcgggccgccagatagaaggacaa

SEQ ID NO: 339769 - DNA, 25 bp, Mus musculus
gtcgggctgatcgaaaaggactcta

SEQ ID NO: 339770 - DNA, 25 bp, Mus musculus
gtcgggctgatcgtgaccatctttc

SEQ ID NO: 339771 - DNA, 25 bp, Mus musculus
gtcggggacagagtctcggccacca

SEQ ID NO: 339772 - DNA, 25 bp, Mus musculus
gtcggggctccccgcctccgctgaa

SEQ ID NO: 339773 - DNA, 25 bp, Mus musculus
gtcggggctggtcaggacaaagagg

SEQ ID NO: 339774 - DNA, 25 bp, Mus musculus
gtcgggtgactgctcccttccctgg

SEQ ID NO: 339775 - DNA, 25 bp, Mus musculus
gtcgggtgttatatggttatatatt

SEQ ID NO: 339776 - DNA, 25 bp, Mus musculus
gtcggtattttcaggaaatcagcct

SEQ ID NO: 339777 - DNA, 25 bp, Mus musculus
gtcggtcttcttgagctcggcttca

SEQ ID NO: 339778 - DNA, 25 bp, Mus musculus
gtcggtcttcttgaggtgagcggga

SEQ ID NO: 339779 - DNA, 25 bp, Mus musculus
gtcggtgcgcttccggtacggtggc

SEQ ID NO: 339780 - DNA, 25 bp, Mus musculus
gtcggtgctatgagtgctctgggga

SEQ ID NO: 339781 - DNA, 25 bp, Mus musculus
gtcggtgctatggcctgtgctgctt

SEQ ID NO: 339782 - DNA, 25 bp, Mus musculus
gtcggtgctgcgatccggaggaagg

SEQ ID NO: 339783 - DNA, 25 bp, Mus musculus
gtcggtgctggccttcccagaacgc

SEQ ID NO: 339784 - DNA, 25 bp, Mus musculus
gtcggtgcttggctctggctgagaa

SEQ ID NO: 339785 - DNA, 25 bp, Mus musculus
gtcggtgtgtatgattccctgtcgt

SEQ ID NO: 339786 - DNA, 25 bp, Mus musculus
gtcggtttaaagcggggatctgatg

SEQ ID NO: 339787 - DNA, 25 bp, Mus musculus
gtcggtttatcatgacaccaagctg

SEQ ID NO: 339788 - DNA, 25 bp, Mus musculus
gtcgtaaaaatgagcatctgtaaca

SEQ ID NO: 339789 - DNA, 25 bp, Mus musculus
gtcgtaaaaattgaaatctctcaga

SEQ ID NO: 339790 - DNA, 25 bp, Mus musculus
gtcgtaaccatagctcaccgtgtct

SEQ ID NO: 339791 - DNA, 25 bp, Mus musculus
gtcgtaaccatagctcatcgggttc

SEQ ID NO: 339792 - DNA, 25 bp, Mus musculus
gtcgtaaggaggtgcctgcaggccc

SEQ ID NO: 339793 - DNA, 25 bp, Mus musculus
gtcgtacacaaatgaagagagactt

SEQ ID NO: 339794 - DNA, 25 bp, Mus musculus
gtcgtactcttcagaggaatgatat

SEQ ID NO: 339795 - DNA, 25 bp, Mus musculus
gtcgtaggacagaaaggaagcagag

SEQ ID NO: 339796 - DNA, 25 bp, Mus musculus
gtcgtagtcaaggcacatcccagcc

SEQ ID NO: 339797 - DNA, 25 bp, Mus musculus
gtcgtagtcagcattttcttgagat

SEQ ID NO: 339798 - DNA, 25 bp, Mus musculus
gtcgtattaggcttaactccggccg

SEQ ID NO: 339799 - DNA, 25 bp, Mus musculus
gtcgtcacctgtaaggtagaaattt

SEQ ID NO: 339800 - DNA, 25 bp, Mus musculus
gtcgtcacctgtaaggtctctagca

SEQ ID NO: 339801 - DNA, 25 bp, Mus musculus
gtcgtcatactctgagtgacagctt

SEQ ID NO: 339802 - DNA, 25 bp, Mus musculus
gtcgtcatggcaacagactccaagc

SEQ ID NO: 339803 - DNA, 25 bp, Mus musculus
gtcgtccagtatagggagaagctgg

SEQ ID NO: 339804 - DNA, 25 bp, Mus musculus
gtcgtccgagtctccaggaacacag

SEQ ID NO: 339805 - DNA, 25 bp, Mus musculus
gtcgtcgccgagaagacctccttcc

SEQ ID NO: 339806 - DNA, 25 bp, Mus musculus
gtcgtcgtcagcttgacaaaagtaa

SEQ ID NO: 339807 - DNA, 25 bp, Mus musculus
gtcgtcgtcatgatggagaggagaa

SEQ ID NO: 339808 - DNA, 25 bp, Mus musculus
gtcgtcgtccgctccagaaatcttg

SEQ ID NO: 339809 - DNA, 25 bp, Mus musculus
gtcgtctcctggccagagttccaaa

SEQ ID NO: 339810 - DNA, 25 bp, Mus musculus
gtcgtctcctgggacagaagatgca

SEQ ID NO: 339811 - DNA, 25 bp, Mus musculus
gtcgtctctccaaagtacttgggag

SEQ ID NO: 339812 - DNA, 25 bp, Mus musculus
gtcgtctgcctctgtccagttgtcc

SEQ ID NO: 339813 - DNA, 25 bp, Mus musculus
gtcgtgaaacaccattgctggggtt

SEQ ID NO: 339814 - DNA, 25 bp, Mus musculus
gtcgtgaagcgactccggccctcga

SEQ ID NO: 339815 - DNA, 25 bp, Mus musculus
gtcgtgaagctaggtactgggtttg

SEQ ID NO: 339816 - DNA, 25 bp, Mus musculus
gtcgtgaccgtgagcccattctgca

SEQ ID NO: 339817 - DNA, 25 bp, Mus musculus
gtcgtgacctctaaatgtggtcaac

SEQ ID NO: 339818 - DNA, 25 bp, Mus musculus
gtcgtgactggacaggttttatacg

SEQ ID NO: 339819 - DNA, 25 bp, Mus musculus
gtcgtgagaagcatggtgaagaaac

SEQ ID NO: 339820 - DNA, 25 bp, Mus musculus
gtcgtgagaaggtatagcagtgttt

SEQ ID NO: 339821 - DNA, 25 bp, Mus musculus
gtcgtgaggagagacgtggagaaat

SEQ ID NO: 339822 - DNA, 25 bp, Mus musculus
gtcgtgcctgagaactccgtgcaag

SEQ ID NO: 339823 - DNA, 25 bp, Mus musculus
gtcgtgcgttgcaggtctccgggac

SEQ ID NO: 339824 - DNA, 25 bp, Mus musculus
gtcgtggaagggttttatggaagac

SEQ ID NO: 339825 - DNA, 25 bp, Mus musculus
gtcgtggctcatacacactttggag

SEQ ID NO: 339826 - DNA, 25 bp, Mus musculus
gtcgtggctcatagtatgatatttg

SEQ ID NO: 339827 - DNA, 25 bp, Mus musculus
gtcgtggtcagaatttcaaaggcca

SEQ ID NO: 339828 - DNA, 25 bp, Mus musculus
gtcgtggtgccgatctctgagaaga

SEQ ID NO: 339829 - DNA, 25 bp, Mus musculus
gtcgtgtacagtgacaccatctgtg

SEQ ID NO: 339830 - DNA, 25 bp, Mus musculus
gtcgtgtcttgggtcttctccatcg

SEQ ID NO: 339831 - DNA, 25 bp, Mus musculus
gtcgtgtggagagattgctctctca

SEQ ID NO: 339832 - DNA, 25 bp, Mus musculus
gtcgtgttggaaggtggcattgacc

SEQ ID NO: 339833 - DNA, 25 bp, Mus musculus
gtcgttcagccaggttgcattgaag

SEQ ID NO: 339834 - DNA, 25 bp, Mus musculus
gtcgttcgaggtaaaaagagaaaag

SEQ ID NO: 339835 - DNA, 25 bp, Mus musculus
gtcgttgaagagagttgtggttata

SEQ ID NO: 339836 - DNA, 25 bp, Mus musculus
gtcgttgaaggtactagcaagatga

SEQ ID NO: 339837 - DNA, 25 bp, Mus musculus
gtcgttgacaggaaagagtaggaaa

SEQ ID NO: 339838 - DNA, 25 bp, Mus musculus
gtcgttgactctggtagagcagatc

SEQ ID NO: 339839 - DNA, 25 bp, Mus musculus
gtcgttggaggcagacgatttacat

SEQ ID NO: 339840 - DNA, 25 bp, Mus musculus
gtcgttgttacagtttgccaggcag

SEQ ID NO: 339841 - DNA, 25 bp, Mus musculus
gtcgtttctgagtgagatcccattt

SEQ ID NO: 339842 - DNA, 25 bp, Mus musculus
gtctaaaaaccagtcggcagaccac

SEQ ID NO: 339843 - DNA, 25 bp, Mus musculus
gtctaaagggaagcgattatagaga

SEQ ID NO: 339844 - DNA, 25 bp, Mus musculus
gtctaacaccctgatgcttcctttg

SEQ ID NO: 339845 - DNA, 25 bp, Mus musculus
gtctaacagaaaccagattcatcca

SEQ ID NO: 339846 - DNA, 25 bp, Mus musculus
gtctaacctggttggtttgggatgc

SEQ ID NO: 339847 - DNA, 25 bp, Mus musculus
gtctaacttcagccagaggctccag

SEQ ID NO: 339848 - DNA, 25 bp, Mus musculus
gtctaagaatgctgttttgaatcag

SEQ ID NO: 339849 - DNA, 25 bp, Mus musculus
gtctaagactgcagatgcccccgaa

SEQ ID NO: 339850 - DNA, 25 bp, Mus musculus
gtctaagattctccttccacgaccc

SEQ ID NO: 339851 - DNA, 25 bp, Mus musculus
gtctaaggaggacaacatttcagag

SEQ ID NO: 339852 - DNA, 25 bp, Mus musculus
gtctaaggaggagaacatttcagag

SEQ ID NO: 339853 - DNA, 25 bp, Mus musculus
gtctaagggaaggaaccaagtggtt

SEQ ID NO: 339854 - DNA, 25 bp, Mus musculus
gtctaagtcctgacaagccgcccct

SEQ ID NO: 339855 - DNA, 25 bp, Mus musculus
gtctaagtcctgacacaagcgaccg

SEQ ID NO: 339856 - DNA, 25 bp, Mus musculus
gtctaatagtgtccatgtcaatata

SEQ ID NO: 339857 - DNA, 25 bp, Mus musculus
gtctaatcattcttgtgaatctctt

SEQ ID NO: 339858 - DNA, 25 bp, Mus musculus
gtctaatcattctttctgagcagaa

SEQ ID NO: 339859 - DNA, 25 bp, Mus musculus
gtctacaaaagctcttcagagaagt

SEQ ID NO: 339860 - DNA, 25 bp, Mus musculus
gtctacaaaaggtgaagtatttgac

SEQ ID NO: 339861 - DNA, 25 bp, Mus musculus
gtctacaaccgctcccaccaacagt

SEQ ID NO: 339862 - DNA, 25 bp, Mus musculus
gtctacaaccggtggcaggatccaa

SEQ ID NO: 339863 - DNA, 25 bp, Mus musculus
gtctacaccacgactggtggaaaaa

SEQ ID NO: 339864 - DNA, 25 bp, Mus musculus
gtctacacctgcaaggaatattgaa

SEQ ID NO: 339865 - DNA, 25 bp, Mus musculus
gtctacactgccaaccagaactgcg

SEQ ID NO: 339866 - DNA, 25 bp, Mus musculus
gtctacacttcccaaaaagaagatt

SEQ ID NO: 339867 - DNA, 25 bp, Mus musculus
gtctacacttgcaaggccatacctt

SEQ ID NO: 339868 - DNA, 25 bp, Mus musculus
gtctacagaacctgacaggtatgtc

SEQ ID NO: 339869 - DNA, 25 bp, Mus musculus
gtctacagaggacaggctcacaact

SEQ ID NO: 339870 - DNA, 25 bp, Mus musculus
gtctacaggaacagcgctcatccac

SEQ ID NO: 339871 - DNA, 25 bp, Mus musculus
gtctacaggaacagcggaaaataca

SEQ ID NO: 339872 - DNA, 25 bp, Mus musculus
gtctacagtaagaaggtggaggagc

SEQ ID NO: 339873 - DNA, 25 bp, Mus musculus
gtctacagtaagaaggtggagtacc

SEQ ID NO: 339874 - DNA, 25 bp, Mus musculus
gtctaccaacgataaaacaataaaa

SEQ ID NO: 339875 - DNA, 25 bp, Mus musculus
gtctaccaagctgttccacgcacca

SEQ ID NO: 339876 - DNA, 25 bp, Mus musculus
gtctaccaaggagaggaacgtcccg

SEQ ID NO: 339877 - DNA, 25 bp, Mus musculus
gtctaccagcaatgtgtgtccgtcc

SEQ ID NO: 339878 - DNA, 25 bp, Mus musculus
gtctacccaaagtgatcaacttttg

SEQ ID NO: 339879 - DNA, 25 bp, Mus musculus
gtctacccagaagaaggaccaggtg

SEQ ID NO: 339880 - DNA, 25 bp, Mus musculus
gtctaccccaggtggcagccttggc

SEQ ID NO: 339881 - DNA, 25 bp, Mus musculus
gtctacccctttcagattgtaagct

SEQ ID NO: 339882 - DNA, 25 bp, Mus musculus
gtctacccctttcaggactccttct

SEQ ID NO: 339883 - DNA, 25 bp, Mus musculus
gtctaccctttcactggggatcaca

SEQ ID NO: 339884 - DNA, 25 bp, Mus musculus
gtctacctctgtggaagctcggatt

SEQ ID NO: 339885 - DNA, 25 bp, Mus musculus
gtctacctgatgccgaatgatcacc

SEQ ID NO: 339886 - DNA, 25 bp, Mus musculus
gtctacctgatgcctggcctggtct

SEQ ID NO: 339887 - DNA, 25 bp, Mus musculus
gtctacctgatgcgcctggagctgt

SEQ ID NO: 339888 - DNA, 25 bp, Mus musculus
gtctacctgcagcatcgaatcctgg

SEQ ID NO: 339889 - DNA, 25 bp, Mus musculus
gtctacctgcaggagaccccatgtt

SEQ ID NO: 339890 - DNA, 25 bp, Mus musculus
gtctacctgtacagggctggtactt

SEQ ID NO: 339891 - DNA, 25 bp, Mus musculus
gtctacctgtacagttttgtggcgg

SEQ ID NO: 339892 - DNA, 25 bp, Mus musculus
gtctacgaacacggccaaagtgaaa

SEQ ID NO: 339893 - DNA, 25 bp, Mus musculus
gtctacgagaagatctcaagaaagc

SEQ ID NO: 339894 - DNA, 25 bp, Mus musculus
gtctacgccatgggctggcgccacc

SEQ ID NO: 339895 - DNA, 25 bp, Mus musculus
gtctacgccttcccgaactacgctg

SEQ ID NO: 339896 - DNA, 25 bp, Mus musculus
gtctacggcggagtggaacactcgg

SEQ ID NO: 339897 - DNA, 25 bp, Mus musculus
gtctacggtgccaggctgtactgcc

SEQ ID NO: 339898 - DNA, 25 bp, Mus musculus
gtctacgttaaggtcacctccaagg

SEQ ID NO: 339899 - DNA, 25 bp, Mus musculus
gtctacgttaagttccggcgggagg

SEQ ID NO: 339900 - DNA, 25 bp, Mus musculus
gtctactcaataagctgagagtgct

SEQ ID NO: 339901 - DNA, 25 bp, Mus musculus
gtctactcacagagagaaaaaacca

SEQ ID NO: 339902 - DNA, 25 bp, Mus musculus
gtctactcacagagccccgtggctt

SEQ ID NO: 339903 - DNA, 25 bp, Mus musculus
gtctactcacaggagaaaatgctgg

SEQ ID NO: 339904 - DNA, 25 bp, Mus musculus
gtctactccagtaaatcctgtcata

SEQ ID NO: 339905 - DNA, 25 bp, Mus musculus
gtctactggtgcattgaagatcggc

SEQ ID NO: 339906 - DNA, 25 bp, Mus musculus
gtctacttcattgaccataacacaa

SEQ ID NO: 339907 - DNA, 25 bp, Mus musculus
gtctagaaaacataggagacagctt

SEQ ID NO: 339908 - DNA, 25 bp, Mus musculus
gtctagaaaacgctaatctttctgc

SEQ ID NO: 339909 - DNA, 25 bp, Mus musculus
gtctagaatacgcgtctgatggcta

SEQ ID NO: 339910 - DNA, 25 bp, Mus musculus
gtctagactggctgttcctgtgttt

SEQ ID NO: 339911 - DNA, 25 bp, Mus musculus
gtctagcaagccgggtatcccagcc

SEQ ID NO: 339912 - DNA, 25 bp, Mus musculus
gtctagcaagggcaatgacatcatt

SEQ ID NO: 339913 - DNA, 25 bp, Mus musculus
gtctagccccaggctcaatttgaga

SEQ ID NO: 339914 - DNA, 25 bp, Mus musculus
gtctaggaaggtccttttgatagga

SEQ ID NO: 339915 - DNA, 25 bp, Mus musculus
gtctaggatgctggacgctggatcg

SEQ ID NO: 339916 - DNA, 25 bp, Mus musculus
gtctaggccagcctggtctccgtta

SEQ ID NO: 339917 - DNA, 25 bp, Mus musculus
gtctagggagtagaacagaggcgtg

SEQ ID NO: 339918 - DNA, 25 bp, Mus musculus
gtctaggtaccacaggtaatctagc

SEQ ID NO: 339919 - DNA, 25 bp, Mus musculus
gtctagttcaggccagctgctgctc

SEQ ID NO: 339920 - DNA, 25 bp, Mus musculus
gtctataaatttgcaagagccagag

SEQ ID NO: 339921 - DNA, 25 bp, Mus musculus
gtctataatcctgtggctgaccata

SEQ ID NO: 339922 - DNA, 25 bp, Mus musculus
gtctatacagaggctctccctacgg

SEQ ID NO: 339923 - DNA, 25 bp, Mus musculus
gtctatagcacgaccccttatccct

SEQ ID NO: 339924 - DNA, 25 bp, Mus musculus
gtctatagcacggtaacacaagtag

SEQ ID NO: 339925 - DNA, 25 bp, Mus musculus
gtctatagccaaggacattaaggac

SEQ ID NO: 339926 - DNA, 25 bp, Mus musculus
gtctatattactcaacaacatcccc

SEQ ID NO: 339927 - DNA, 25 bp, Mus musculus
gtctatcacatatacgcagtactcc

SEQ ID NO: 339928 - DNA, 25 bp, Mus musculus
gtctatccagaacagggcgtgccta

SEQ ID NO: 339929 - DNA, 25 bp, Mus musculus
gtctatccagaacaggtgaccttgg

SEQ ID NO: 339930 - DNA, 25 bp, Mus musculus
gtctatcctggccgcctgggaacca

SEQ ID NO: 339931 - DNA, 25 bp, Mus musculus
gtctatcctggggacctaaaacagg

SEQ ID NO: 339932 - DNA, 25 bp, Mus musculus
gtctatcctggtgatccactgcgtt

SEQ ID NO: 339933 - DNA, 25 bp, Mus musculus
gtctatctgagatgccttattggag

SEQ ID NO: 339934 - DNA, 25 bp, Mus musculus
gtctatctgccagcagaatggcatt

SEQ ID NO: 339935 - DNA, 25 bp, Mus musculus
gtctatcttggaaaagatgacgagt

SEQ ID NO: 339936 - DNA, 25 bp, Mus musculus
gtctatgaacaccagaagcctaaga

SEQ ID NO: 339937 - DNA, 25 bp, Mus musculus
gtctatgaacaccaggtttggacgt

SEQ ID NO: 339938 - DNA, 25 bp, Mus musculus
gtctatgataaggtacaaaatgaag

SEQ ID NO: 339939 - DNA, 25 bp, Mus musculus
gtctatgcaaaacgtataaatcctc

SEQ ID NO: 339940 - DNA, 25 bp, Mus musculus
gtctatgcaaaactgcttcaccgat

SEQ ID NO: 339941 - DNA, 25 bp, Mus musculus
gtctatggaagaaggatattacaaa

SEQ ID NO: 339942 - DNA, 25 bp, Mus musculus
gtctatggaggaagaagacagcatg

SEQ ID NO: 339943 - DNA, 25 bp, Mus musculus
gtctatggcagtcctgacttcctgg

SEQ ID NO: 339944 - DNA, 25 bp, Mus musculus
gtctatgtcagacagggaacaacac

SEQ ID NO: 339945 - DNA, 25 bp, Mus musculus
gtctattaaaatgaagcattggatg

SEQ ID NO: 339946 - DNA, 25 bp, Mus musculus
gtctattcagatacagccctgcagg

SEQ ID NO: 339947 - DNA, 25 bp, Mus musculus
gtctattcagctacagtgatccttg

SEQ ID NO: 339948 - DNA, 25 bp, Mus musculus
gtctattcgtaatgatttcattatg

SEQ ID NO: 339949 - DNA, 25 bp, Mus musculus
gtctattctgactggagccctttca

SEQ ID NO: 339950 - DNA, 25 bp, Mus musculus
gtctattgagataaaagccagagtt

SEQ ID NO: 339951 - DNA, 25 bp, Mus musculus
gtctcaaaactggcttggagtcaaa

SEQ ID NO: 339952 - DNA, 25 bp, Mus musculus
gtctcaaaactgggattattggccc

SEQ ID NO: 339953 - DNA, 25 bp, Mus musculus
gtctcaaacaataggtgaccagtgt

SEQ ID NO: 339954 - DNA, 25 bp, Mus musculus
gtctcaaacacaaagtgctgcagtc

SEQ ID NO: 339955 - DNA, 25 bp, Mus musculus
gtctcaaagcgcaaatttcccagct

SEQ ID NO: 339956 - DNA, 25 bp, Mus musculus
gtctcaacaaaagggctctactaca

SEQ ID NO: 339957 - DNA, 25 bp, Mus musculus
gtctcaacagcctgacagagcagca

SEQ ID NO: 339958 - DNA, 25 bp, Mus musculus
gtctcaaccctcgtctcttctgtcg

SEQ ID NO: 339959 - DNA, 25 bp, Mus musculus
gtctcaagaatatgttgttgatcac

SEQ ID NO: 339960 - DNA, 25 bp, Mus musculus
gtctcaaggagtcagagcaacccag

SEQ ID NO: 339961 - DNA, 25 bp, Mus musculus
gtctcaagtaccggcagtcctttac

SEQ ID NO: 339962 - DNA, 25 bp, Mus musculus
gtctcaataggtcttgtgtgatgcc

SEQ ID NO: 339963 - DNA, 25 bp, Mus musculus
gtctcacaatgccatcaggtttggg

SEQ ID NO: 339964 - DNA, 25 bp, Mus musculus
gtctcacaatggagatcagaaccag

SEQ ID NO: 339965 - DNA, 25 bp, Mus musculus
gtctcacatccagggtaaagcccca

SEQ ID NO: 339966 - DNA, 25 bp, Mus musculus
gtctcacatccaggtaaccgagaag

SEQ ID NO: 339967 - DNA, 25 bp, Mus musculus
gtctcacccaggagatcttcagaac

SEQ ID NO: 339968 - DNA, 25 bp, Mus musculus
gtctcacccaggagatggagttcca

SEQ ID NO: 339969 - DNA, 25 bp, Mus musculus
gtctcacccaggatgagtttcatcc

SEQ ID NO: 339970 - DNA, 25 bp, Mus musculus
gtctcacccgggtgctggggacatt

SEQ ID NO: 339971 - DNA, 25 bp, Mus musculus
gtctcacctggcaagatgaatatga

SEQ ID NO: 339972 - DNA, 25 bp, Mus musculus
gtctcaccttgtctgtctgcaggtt

SEQ ID NO: 339973 - DNA, 25 bp, Mus musculus
gtctcacgacaggtgatttccgatt

SEQ ID NO: 339974 - DNA, 25 bp, Mus musculus
gtctcacgcggtcggatatgaagag

SEQ ID NO: 339975 - DNA, 25 bp, Mus musculus
gtctcactcacatagctaacccaag

SEQ ID NO: 339976 - DNA, 25 bp, Mus musculus
gtctcactcacatgtgctggagagt

SEQ ID NO: 339977 - DNA, 25 bp, Mus musculus
gtctcactgggcatacttctccgcc

SEQ ID NO: 339978 - DNA, 25 bp, Mus musculus
gtctcagaagcttttccaaggctgt

SEQ ID NO: 339979 - DNA, 25 bp, Mus musculus
gtctcagaaggttttccaaggctgt

SEQ ID NO: 339980 - DNA, 25 bp, Mus musculus
gtctcagaagtcagcggctgcgtag

SEQ ID NO: 339981 - DNA, 25 bp, Mus musculus
gtctcagaggatagctctctacagg

SEQ ID NO: 339982 - DNA, 25 bp, Mus musculus
gtctcagattggctatgtagtcagt

SEQ ID NO: 339983 - DNA, 25 bp, Mus musculus
gtctcagcagaggtggaaagtacgc

SEQ ID NO: 339984 - DNA, 25 bp, Mus musculus
gtctcagcatagaaagtcctcgcgt

SEQ ID NO: 339985 - DNA, 25 bp, Mus musculus
gtctcagcatagaagtttaccgaca

SEQ ID NO: 339986 - DNA, 25 bp, Mus musculus
gtctcagcctcgaatgggtgaagac

SEQ ID NO: 339987 - DNA, 25 bp, Mus musculus
gtctcagcgcggattaccttatgct

SEQ ID NO: 339988 - DNA, 25 bp, Mus musculus
gtctcagctggacaaaccatctttc

SEQ ID NO: 339989 - DNA, 25 bp, Mus musculus
gtctcagctgggtactctcaagttc

SEQ ID NO: 339990 - DNA, 25 bp, Mus musculus
gtctcaggaaaggtaaacctagcct

SEQ ID NO: 339991 - DNA, 25 bp, Mus musculus
gtctcaggattggaagatcgaagcc

SEQ ID NO: 339992 - DNA, 25 bp, Mus musculus
gtctcagtcgaaaggcaagaagcga

SEQ ID NO: 339993 - DNA, 25 bp, Mus musculus
gtctcagtttctcagaatcccctgg

SEQ ID NO: 339994 - DNA, 25 bp, Mus musculus
gtctcatacaggtgagaaacctttt

SEQ ID NO: 339995 - DNA, 25 bp, Mus musculus
gtctcatccctgctcctgtctccaa

SEQ ID NO: 339996 - DNA, 25 bp, Mus musculus
gtctcatgtgcatgtccatgctgtg

SEQ ID NO: 339997 - DNA, 25 bp, Mus musculus
gtctcatgtgcatgttcatgacttg

SEQ ID NO: 339998 - DNA, 25 bp, Mus musculus
gtctcattcctccagctacactcct

SEQ ID NO: 339999 - DNA, 25 bp, Mus musculus
gtctcattctctgcatcgggttcac

SEQ ID NO: 340000 - DNA, 25 bp, Mus musculus
gtctcattgtgtggaatcacaggcc

SEQ ID NO: 340001 - DNA, 25 bp, Mus musculus
gtctcatttggatggcaccacccct

SEQ ID NO: 340002 - DNA, 25 bp, Mus musculus
gtctcattttaaggccctgtggttc

SEQ ID NO: 340003 - DNA, 25 bp, Mus musculus
gtctccaaaccggagtcctgttgaa

SEQ ID NO: 340004 - DNA, 25 bp, Mus musculus
gtctccaagaatggtcctggcactg

SEQ ID NO: 340005 - DNA, 25 bp, Mus musculus
gtctccaatgcaggaggcccacctg

SEQ ID NO: 340006 - DNA, 25 bp, Mus musculus
gtctccacagattgacggcggggct

SEQ ID NO: 340007 - DNA, 25 bp, Mus musculus
gtctccacagccagagaacctgaaa

SEQ ID NO: 340008 - DNA, 25 bp, Mus musculus
gtctccacccttgagtcaagtccat

SEQ ID NO: 340009 - DNA, 25 bp, Mus musculus
gtctccaccgtgaaccacccattcc

SEQ ID NO: 340010 - DNA, 25 bp, Mus musculus
gtctccacgccatggatgcagtgac

SEQ ID NO: 340011 - DNA, 25 bp, Mus musculus
gtctccagaaagaggcgccctgtgc

SEQ ID NO: 340012 - DNA, 25 bp, Mus musculus
gtctccagaaagaggtgggtcttct

SEQ ID NO: 340013 - DNA, 25 bp, Mus musculus
gtctccagaaagtgctttgcatggg

SEQ ID NO: 340014 - DNA, 25 bp, Mus musculus
gtctccagaaagtggtatcccataa

SEQ ID NO: 340015 - DNA, 25 bp, Mus musculus
gtctccagacatggagacaacagct

SEQ ID NO: 340016 - DNA, 25 bp, Mus musculus
gtctccagggagacgaaggaggcgt

SEQ ID NO: 340017 - DNA, 25 bp, Mus musculus
gtctccagtgcaagcagcccagcca

SEQ ID NO: 340018 - DNA, 25 bp, Mus musculus
gtctccatcctgggttggctgatgt

SEQ ID NO: 340019 - DNA, 25 bp, Mus musculus
gtctccatctatagatcttaccaat

SEQ ID NO: 340020 - DNA, 25 bp, Mus musculus
gtctccatctataggattcatgaat

SEQ ID NO: 340021 - DNA, 25 bp, Mus musculus
gtctccattcaggagacattccaaa

SEQ ID NO: 340022 - DNA, 25 bp, Mus musculus
gtctccattcagggttcccgggccc

SEQ ID NO: 340023 - DNA, 25 bp, Mus musculus
gtctccattctgttgcaccaagtat

SEQ ID NO: 340024 - DNA, 25 bp, Mus musculus
gtctcccagctccttcactcactcg

SEQ ID NO: 340025 - DNA, 25 bp, Mus musculus
gtctcccaggaccgtcagaaggggc

SEQ ID NO: 340026 - DNA, 25 bp, Mus musculus
gtctcccgagtgccttagtcctggg

SEQ ID NO: 340027 - DNA, 25 bp, Mus musculus
gtctccctacagagatgggagaccg

SEQ ID NO: 340028 - DNA, 25 bp, Mus musculus
gtctccctacagaggagaatttaga

SEQ ID NO: 340029 - DNA, 25 bp, Mus musculus
gtctccctacagaggtgtgtcagag

SEQ ID NO: 340030 - DNA, 25 bp, Mus musculus
gtctccctagtagatccactgtggg

SEQ ID NO: 340031 - DNA, 25 bp, Mus musculus
gtctccctcttcacctcgctgaggt

SEQ ID NO: 340032 - DNA, 25 bp, Mus musculus
gtctccctggggcatcagccgtcca

SEQ ID NO: 340033 - DNA, 25 bp, Mus musculus
gtctccgcaggggaacagtacattg

SEQ ID NO: 340034 - DNA, 25 bp, Mus musculus
gtctccgccagaggatccgtgaaga

SEQ ID NO: 340035 - DNA, 25 bp, Mus musculus
gtctccgccagagggtgcactattc

SEQ ID NO: 340036 - DNA, 25 bp, Mus musculus
gtctccgccggcgctggagaatctg

SEQ ID NO: 340037 - DNA, 25 bp, Mus musculus
gtctccgctggcgagcctccctgtg

SEQ ID NO: 340038 - DNA, 25 bp, Mus musculus
gtctccggatctgatcgtctgccgt

SEQ ID NO: 340039 - DNA, 25 bp, Mus musculus
gtctccggcaatctctgagtttgga

SEQ ID NO: 340040 - DNA, 25 bp, Mus musculus
gtctccggcagacagacagctggtg

SEQ ID NO: 340041 - DNA, 25 bp, Mus musculus
gtctccggcagacagtgaagccagt

SEQ ID NO: 340042 - DNA, 25 bp, Mus musculus
gtctccggcaggaatttaatgaaga

SEQ ID NO: 340043 - DNA, 25 bp, Mus musculus
gtctccgggtgagtttgccaggcag

SEQ ID NO: 340044 - DNA, 25 bp, Mus musculus
gtctccgtccccagaacccgagcca

SEQ ID NO: 340045 - DNA, 25 bp, Mus musculus
gtctccgttatcatgaacacggctc

SEQ ID NO: 340046 - DNA, 25 bp, Mus musculus
gtctccgttatcatgtttgatttga

SEQ ID NO: 340047 - DNA, 25 bp, Mus musculus
gtctcctagtgagcttgtccaggtg

SEQ ID NO: 340048 - DNA, 25 bp, Mus musculus
gtctcctatagcagggtctacctgc

SEQ ID NO: 340049 - DNA, 25 bp, Mus musculus
gtctcctcaaggcaccttgttgtga

SEQ ID NO: 340050 - DNA, 25 bp, Mus musculus
gtctcctcagagagtcagtccttcc

SEQ ID NO: 340051 - DNA, 25 bp, Mus musculus
gtctcctcagagtctgcgagaaatc

SEQ ID NO: 340052 - DNA, 25 bp, Mus musculus
gtctcctcagatgaggaaactgagg

SEQ ID NO: 340053 - DNA, 25 bp, Mus musculus
gtctcctcagccaaaacaacacccc

SEQ ID NO: 340054 - DNA, 25 bp, Mus musculus
gtctcctcagccaaaacaacagccc

SEQ ID NO: 340055 - DNA, 25 bp, Mus musculus
gtctcctcagccaaaacgacacccc

SEQ ID NO: 340056 - DNA, 25 bp, Mus musculus
gtctcctcagcctctatcaggaacc

SEQ ID NO: 340057 - DNA, 25 bp, Mus musculus
gtctcctcagctacaacaacagccc

SEQ ID NO: 340058 - DNA, 25 bp, Mus musculus
gtctcctccaaaacctcaggctggc

SEQ ID NO: 340059 - DNA, 25 bp, Mus musculus
gtctcctcccagtgccctggggggc

SEQ ID NO: 340060 - DNA, 25 bp, Mus musculus
gtctcctccggcttgttggaggtga

SEQ ID NO: 340061 - DNA, 25 bp, Mus musculus
gtctcctctcagcaaagctgttgct

SEQ ID NO: 340062 - DNA, 25 bp, Mus musculus
gtctcctgagagaaattttcctcgg

SEQ ID NO: 340063 - DNA, 25 bp, Mus musculus
gtctcctgaggttcaggacctgcag

SEQ ID NO: 340064 - DNA, 25 bp, Mus musculus
gtctcctgcacgtgaggagcatgtc

SEQ ID NO: 340065 - DNA, 25 bp, Mus musculus
gtctcctgcttggctcctgtagttt

SEQ ID NO: 340066 - DNA, 25 bp, Mus musculus
gtctcctggcagccaaccaatggaa

SEQ ID NO: 340067 - DNA, 25 bp, Mus musculus
gtctcctgtcagatgggattgatga

SEQ ID NO: 340068 - DNA, 25 bp, Mus musculus
gtctccttcaggctccatgttggct

SEQ ID NO: 340069 - DNA, 25 bp, Mus musculus
gtctccttcagttaaagctagtcct

SEQ ID NO: 340070 - DNA, 25 bp, Mus musculus
gtctccttccacaagaagaacgaga

SEQ ID NO: 340071 - DNA, 25 bp, Mus musculus
gtctccttccacaagtttcctctta

SEQ ID NO: 340072 - DNA, 25 bp, Mus musculus
gtctccttccatggctgtgacccaa

SEQ ID NO: 340073 - DNA, 25 bp, Mus musculus
gtctccttcctcagctactgtgact

SEQ ID NO: 340074 - DNA, 25 bp, Mus musculus
gtctccttcctgtgccccacagatt

SEQ ID NO: 340075 - DNA, 25 bp, Mus musculus
gtctccttgcagagcaggcaaggag

SEQ ID NO: 340076 - DNA, 25 bp, Mus musculus
gtctccttgtccaagatcgagcggt

SEQ ID NO: 340077 - DNA, 25 bp, Mus musculus
gtctcgaaccagtggcaacactggc

SEQ ID NO: 340078 - DNA, 25 bp, Mus musculus
gtctcgaacgtgccacggtcaggga

SEQ ID NO: 340079 - DNA, 25 bp, Mus musculus
gtctcgacaacatgcattcattcag

SEQ ID NO: 340080 - DNA, 25 bp, Mus musculus
gtctcgagagctgaagacaccagcc

SEQ ID NO: 340081 - DNA, 25 bp, Mus musculus
gtctcgataataagatcagcaccag

SEQ ID NO: 340082 - DNA, 25 bp, Mus musculus
gtctcgcatgaaggagatcttggac

SEQ ID NO: 340083 - DNA, 25 bp, Mus musculus
gtctcgctctggcttcccatttcca

SEQ ID NO: 340084 - DNA, 25 bp, Mus musculus
gtctcggataggagatgtttgagac

SEQ ID NO: 340085 - DNA, 25 bp, Mus musculus
gtctcggcttccaaggttcctactt

SEQ ID NO: 340086 - DNA, 25 bp, Mus musculus
gtctcggcttccaagtctgttcttc

SEQ ID NO: 340087 - DNA, 25 bp, Mus musculus
gtctcggtgaaagggattgaaattc

SEQ ID NO: 340088 - DNA, 25 bp, Mus musculus
gtctcggtggatcgaagtctgcttc

SEQ ID NO: 340089 - DNA, 25 bp, Mus musculus
gtctcgtcacagataacatctggtt

SEQ ID NO: 340090 - DNA, 25 bp, Mus musculus
gtctcgtcacaggaatggcggccct

SEQ ID NO: 340091 - DNA, 25 bp, Mus musculus
gtctctaaaacaagagatttgaagt

SEQ ID NO: 340092 - DNA, 25 bp, Mus musculus
gtctctacacatccttgctgaggat

SEQ ID NO: 340093 - DNA, 25 bp, Mus musculus
gtctctacacatcctttaaaaagta

SEQ ID NO: 340094 - DNA, 25 bp, Mus musculus
gtctctactgcctacaagaagactc

SEQ ID NO: 340095 - DNA, 25 bp, Mus musculus
gtctctactgcctatgtgaaaacgt

SEQ ID NO: 340096 - DNA, 25 bp, Mus musculus
gtctctatcaaaggttgccgaggct

SEQ ID NO: 340097 - DNA, 25 bp, Mus musculus
gtctctattaaaagatgacttacag

SEQ ID NO: 340098 - DNA, 25 bp, Mus musculus
gtctctattaaaagctcttttggaa

SEQ ID NO: 340099 - DNA, 25 bp, Mus musculus
gtctctcaaagtcaagctgaacagg

SEQ ID NO: 340100 - DNA, 25 bp, Mus musculus
gtctctcaagagtcaccatgtagac

SEQ ID NO: 340101 - DNA, 25 bp, Mus musculus
gtctctcaagcgtcaagaactggag

SEQ ID NO: 340102 - DNA, 25 bp, Mus musculus
gtctctcaagtatctcagcaataac

SEQ ID NO: 340103 - DNA, 25 bp, Mus musculus
gtctctcaggaccaggtagattcca

SEQ ID NO: 340104 - DNA, 25 bp, Mus musculus
gtctctcataaagccctttctgaca

SEQ ID NO: 340105 - DNA, 25 bp, Mus musculus
gtctctcatagccagggttcagccg

SEQ ID NO: 340106 - DNA, 25 bp, Mus musculus
gtctctccaaagtacttgggagaca

SEQ ID NO: 340107 - DNA, 25 bp, Mus musculus
gtctctccatcaggtttctttcttg

SEQ ID NO: 340108 - DNA, 25 bp, Mus musculus
gtctctccggatggacctgatcgac

SEQ ID NO: 340109 - DNA, 25 bp, Mus musculus
gtctctccggcccccgcgcgccggg

SEQ ID NO: 340110 - DNA, 25 bp, Mus musculus
gtctctcgaagattccccccagctg

SEQ ID NO: 340111 - DNA, 25 bp, Mus musculus
gtctctctagaaaagttgaaatact

SEQ ID NO: 340112 - DNA, 25 bp, Mus musculus
gtctctctcagcatacgaaggacaa

SEQ ID NO: 340113 - DNA, 25 bp, Mus musculus
gtctctctcaggcgtggaggaggtg

SEQ ID NO: 340114 - DNA, 25 bp, Mus musculus
gtctctctgcaagatcatgctggga

SEQ ID NO: 340115 - DNA, 25 bp, Mus musculus
gtctctcttccatgtctcccatcag

SEQ ID NO: 340116 - DNA, 25 bp, Mus musculus
gtctctctttgtagggactacaaga

SEQ ID NO: 340117 - DNA, 25 bp, Mus musculus
gtctctgaagaatgcaccaccaaaa

SEQ ID NO: 340118 - DNA, 25 bp, Mus musculus
gtctctgaaggaacagtctgagatc

SEQ ID NO: 340119 - DNA, 25 bp, Mus musculus
gtctctgacaaatcgccagtaccta

SEQ ID NO: 340120 - DNA, 25 bp, Mus musculus
gtctctgacaaattctctccagagg

SEQ ID NO: 340121 - DNA, 25 bp, Mus musculus
gtctctgacaagaaggaaatgttgt

SEQ ID NO: 340122 - DNA, 25 bp, Mus musculus
gtctctgagaaactgatctctcacc

SEQ ID NO: 340123 - DNA, 25 bp, Mus musculus
gtctctgcaagaaaaggcaagagct

SEQ ID NO: 340124 - DNA, 25 bp, Mus musculus
gtctctgcaagaggtgttgtcggaa

SEQ ID NO: 340125 - DNA, 25 bp, Mus musculus
gtctctgcaagtggccctgccgcct

SEQ ID NO: 340126 - DNA, 25 bp, Mus musculus
gtctctgcagaacaacactgaagtc

SEQ ID NO: 340127 - DNA, 25 bp, Mus musculus
gtctctgcagaagtttgatggtgac

SEQ ID NO: 340128 - DNA, 25 bp, Mus musculus
gtctctgcagaccgctcgggaatgg

SEQ ID NO: 340129 - DNA, 25 bp, Mus musculus
gtctctgcagagagtcagtccttcc

SEQ ID NO: 340130 - DNA, 25 bp, Mus musculus
gtctctgcagagtctgcgagaaatc

SEQ ID NO: 340131 - DNA, 25 bp, Mus musculus
gtctctgcagccaaaacaacacccc

SEQ ID NO: 340132 - DNA, 25 bp, Mus musculus
gtctctgcagccaaaacaacagccc

SEQ ID NO: 340133 - DNA, 25 bp, Mus musculus
gtctctgcaggggaggacatagtcg

SEQ ID NO: 340134 - DNA, 25 bp, Mus musculus
gtctctgcaggggaggctttgctac

SEQ ID NO: 340135 - DNA, 25 bp, Mus musculus
gtctctgcaggtaatgaaaagggac

SEQ ID NO: 340136 - DNA, 25 bp, Mus musculus
gtctctgcaggtgcccaaaactgaa

SEQ ID NO: 340137 - DNA, 25 bp, Mus musculus
gtctctgcagtgctatggggcatgg

SEQ ID NO: 340138 - DNA, 25 bp, Mus musculus
gtctctgccaaacacaccagaaggg

SEQ ID NO: 340139 - DNA, 25 bp, Mus musculus
gtctctgccaacattgtcctcgtaa

SEQ ID NO: 340140 - DNA, 25 bp, Mus musculus
gtctctgcccttcaggatgagcttt

SEQ ID NO: 340141 - DNA, 25 bp, Mus musculus
gtctctgcctgaaggtttgacttca

SEQ ID NO: 340142 - DNA, 25 bp, Mus musculus
gtctctgcgcggttgactcttcacc

SEQ ID NO: 340143 - DNA, 25 bp, Mus musculus
gtctctgctgacctgggcacacatg

SEQ ID NO: 340144 - DNA, 25 bp, Mus musculus
gtctctggcgctgatcccactgcag

SEQ ID NO: 340145 - DNA, 25 bp, Mus musculus
gtctctggcggccccactgaagaca

SEQ ID NO: 340146 - DNA, 25 bp, Mus musculus
gtctctgtccttgtcttatctcctc

SEQ ID NO: 340147 - DNA, 25 bp, Mus musculus
gtctctgtccttttgcctttatcat

SEQ ID NO: 340148 - DNA, 25 bp, Mus musculus
gtctctgtggacacagaagccatgg

SEQ ID NO: 340149 - DNA, 25 bp, Mus musculus
gtctctgtggagaactactgcataa

SEQ ID NO: 340150 - DNA, 25 bp, Mus musculus
gtctctgtggcccaggttgctacag

SEQ ID NO: 340151 - DNA, 25 bp, Mus musculus
gtctctgtggcccagtcactggccg

SEQ ID NO: 340152 - DNA, 25 bp, Mus musculus
gtctctgtgggagcttgcatttcca

SEQ ID NO: 340153 - DNA, 25 bp, Mus musculus
gtctctgtgggtggtaaatctgtac

SEQ ID NO: 340154 - DNA, 25 bp, Mus musculus
gtctctgttccgaggagaagcctac

SEQ ID NO: 340155 - DNA, 25 bp, Mus musculus
gtctctgttccgtcacagtcacgcc

SEQ ID NO: 340156 - DNA, 25 bp, Mus musculus
gtctcttaaaggagagcttgaactt

SEQ ID NO: 340157 - DNA, 25 bp, Mus musculus
gtctcttcaggagggggaacagaca

SEQ ID NO: 340158 - DNA, 25 bp, Mus musculus
gtctcttcccgatttgcccatgaag

SEQ ID NO: 340159 - DNA, 25 bp, Mus musculus
gtctcttcctctgctctgccttctg

SEQ ID NO: 340160 - DNA, 25 bp, Mus musculus
gtctcttccttacacatgatgaaga

SEQ ID NO: 340161 - DNA, 25 bp, Mus musculus
gtctcttgcacaagttgatgggcag

SEQ ID NO: 340162 - DNA, 25 bp, Mus musculus
gtctcttggctcagaaatcctacga

SEQ ID NO: 340163 - DNA, 25 bp, Mus musculus
gtctcttggtgcagggtttgtggta

SEQ ID NO: 340164 - DNA, 25 bp, Mus musculus
gtctctttcaaattaattgtggtga

SEQ ID NO: 340165 - DNA, 25 bp, Mus musculus
gtctcttttagaaagggggagctgg

SEQ ID NO: 340166 - DNA, 25 bp, Mus musculus
gtctgaaaacgatgatggagctggt

SEQ ID NO: 340167 - DNA, 25 bp, Mus musculus
gtctgaaaaggctcccccaccgaaa

SEQ ID NO: 340168 - DNA, 25 bp, Mus musculus
gtctgaaaagggccggcaggaggac

SEQ ID NO: 340169 - DNA, 25 bp, Mus musculus
gtctgaaaccacagaggaagcattc

SEQ ID NO: 340170 - DNA, 25 bp, Mus musculus
gtctgaaaccacagcattctcatct

SEQ ID NO: 340171 - DNA, 25 bp, Mus musculus
gtctgaaaccacagctctagccaag

SEQ ID NO: 340172 - DNA, 25 bp, Mus musculus
gtctgaagaggaggtgctgggcccc

SEQ ID NO: 340173 - DNA, 25 bp, Mus musculus
gtctgaagcaggaaggaacagctcg

SEQ ID NO: 340174 - DNA, 25 bp, Mus musculus
gtctgaagcaggatctgaagaagaa

SEQ ID NO: 340175 - DNA, 25 bp, Mus musculus
gtctgaagctcagaactttgccaat

SEQ ID NO: 340176 - DNA, 25 bp, Mus musculus
gtctgaagggattggagatagcaac

SEQ ID NO: 340177 - DNA, 25 bp, Mus musculus
gtctgaagtgcaggaactctgcaaa

SEQ ID NO: 340178 - DNA, 25 bp, Mus musculus
gtctgaagtgcaggtatcagggtgg

SEQ ID NO: 340179 - DNA, 25 bp, Mus musculus
gtctgaatggtgggtgcaagtccca

SEQ ID NO: 340180 - DNA, 25 bp, Mus musculus
gtctgacaatgagctgtgtgtccga

SEQ ID NO: 340181 - DNA, 25 bp, Mus musculus
gtctgacacagcaattaccaaggac

SEQ ID NO: 340182 - DNA, 25 bp, Mus musculus
gtctgacacggaacaggaaggcaaa

SEQ ID NO: 340183 - DNA, 25 bp, Mus musculus
gtctgacagccctgtgtggggctgc

SEQ ID NO: 340184 - DNA, 25 bp, Mus musculus
gtctgaccagcatgcccgctgcctg

SEQ ID NO: 340185 - DNA, 25 bp, Mus musculus
gtctgaccaggaaaagaaagatgtg

SEQ ID NO: 340186 - DNA, 25 bp, Mus musculus
gtctgaccgagtcagcaggaccaag

SEQ ID NO: 340187 - DNA, 25 bp, Mus musculus
gtctgacctgggagagtttgtgaga

SEQ ID NO: 340188 - DNA, 25 bp, Mus musculus
gtctgacgaggtgttccacgacatc

SEQ ID NO: 340189 - DNA, 25 bp, Mus musculus
gtctgacggtgctgggaggatctgg

SEQ ID NO: 340190 - DNA, 25 bp, Mus musculus
gtctgacttcggtcagccatgtcat

SEQ ID NO: 340191 - DNA, 25 bp, Mus musculus
gtctgagaaatgcaggaatctccgg

SEQ ID NO: 340192 - DNA, 25 bp, Mus musculus
gtctgagaatgaagacactcagccg

SEQ ID NO: 340193 - DNA, 25 bp, Mus musculus
gtctgagaatgaaggctctggaatg

SEQ ID NO: 340194 - DNA, 25 bp, Mus musculus
gtctgagagaaagtgatgtatcgcc

SEQ ID NO: 340195 - DNA, 25 bp, Mus musculus
gtctgagagacaggacggggcgctg

SEQ ID NO: 340196 - DNA, 25 bp, Mus musculus
gtctgagagacaggccttctgtata

SEQ ID NO: 340197 - DNA, 25 bp, Mus musculus
gtctgagaggaaccattctctgagg

SEQ ID NO: 340198 - DNA, 25 bp, Mus musculus
gtctgagaggaacccttctctgagg

SEQ ID NO: 340199 - DNA, 25 bp, Mus musculus
gtctgagaggaagttttatctgtgc

SEQ ID NO: 340200 - DNA, 25 bp, Mus musculus
gtctgagatcgacaggaagcccgca

SEQ ID NO: 340201 - DNA, 25 bp, Mus musculus
gtctgagcaggactcggaacccact

SEQ ID NO: 340202 - DNA, 25 bp, Mus musculus
gtctgagcaggagaatctggagaag

SEQ ID NO: 340203 - DNA, 25 bp, Mus musculus
gtctgagcaggtgctcctgtgtgcg

SEQ ID NO: 340204 - DNA, 25 bp, Mus musculus
gtctgagccgaatccaccttgacac

SEQ ID NO: 340205 - DNA, 25 bp, Mus musculus
gtctgaggcgcggcccagcactatg

SEQ ID NO: 340206 - DNA, 25 bp, Mus musculus
gtctgagggagccagaatcacttct

SEQ ID NO: 340207 - DNA, 25 bp, Mus musculus
gtctgaggggaagagatgcaattcg

SEQ ID NO: 340208 - DNA, 25 bp, Mus musculus
gtctgagtaaggagagtccttcttg

SEQ ID NO: 340209 - DNA, 25 bp, Mus musculus
gtctgagtctgaagaagacaaaggc

SEQ ID NO: 340210 - DNA, 25 bp, Mus musculus
gtctgagtctttaaggagaaagcat

SEQ ID NO: 340211 - DNA, 25 bp, Mus musculus
gtctgagtctttaagtggttctgtg

SEQ ID NO: 340212 - DNA, 25 bp, Mus musculus
gtctgagtgaagattatttgtcttt

SEQ ID NO: 340213 - DNA, 25 bp, Mus musculus
gtctgagtgtcaggatggtggtgcg

SEQ ID NO: 340214 - DNA, 25 bp, Mus musculus
gtctgagtgtcaggctgtgagtcct

SEQ ID NO: 340215 - DNA, 25 bp, Mus musculus
gtctgataaataagagggcaatgcg

SEQ ID NO: 340216 - DNA, 25 bp, Mus musculus
gtctgatcaaaaagtttcagttcgt

SEQ ID NO: 340217 - DNA, 25 bp, Mus musculus
gtctgatccaggggcaggtgaggtg

SEQ ID NO: 340218 - DNA, 25 bp, Mus musculus
gtctgatccagtctgcctggagatt

SEQ ID NO: 340219 - DNA, 25 bp, Mus musculus
gtctgatgaaagggaggctacagac

SEQ ID NO: 340220 - DNA, 25 bp, Mus musculus
gtctgatgaaaggggagggcactga

SEQ ID NO: 340221 - DNA, 25 bp, Mus musculus
gtctgatgattcacagtggtaagat

SEQ ID NO: 340222 - DNA, 25 bp, Mus musculus
gtctgatggaggtaaaagtaactcg

SEQ ID NO: 340223 - DNA, 25 bp, Mus musculus
gtctgattaaacaaattggagaaaa

SEQ ID NO: 340224 - DNA, 25 bp, Mus musculus
gtctgattcccagctgtttggggca

SEQ ID NO: 340225 - DNA, 25 bp, Mus musculus
gtctgattctgaggtgtggcttgac

SEQ ID NO: 340226 - DNA, 25 bp, Mus musculus
gtctgattggggagggttttgaatc

SEQ ID NO: 340227 - DNA, 25 bp, Mus musculus
gtctgatttaaacgtcatccactgg

SEQ ID NO: 340228 - DNA, 25 bp, Mus musculus
gtctgatttaaaggtcatccactgg

SEQ ID NO: 340229 - DNA, 25 bp, Mus musculus
gtctgcaaaaagaaatacgaagaaa

SEQ ID NO: 340230 - DNA, 25 bp, Mus musculus
gtctgcaaaccatgatctcaagacc

SEQ ID NO: 340231 - DNA, 25 bp, Mus musculus
gtctgcaaaccatgcctcaatctag

SEQ ID NO: 340232 - DNA, 25 bp, Mus musculus
gtctgcaaagataaaagctttgatg

SEQ ID NO: 340233 - DNA, 25 bp, Mus musculus
gtctgcaaaggagaatcacactggg

SEQ ID NO: 340234 - DNA, 25 bp, Mus musculus
gtctgcaacagttgtttaatgaact

SEQ ID NO: 340235 - DNA, 25 bp, Mus musculus
gtctgcaagagaccgggctcatcat

SEQ ID NO: 340236 - DNA, 25 bp, Mus musculus
gtctgcaaggaatggaccgggttca

SEQ ID NO: 340237 - DNA, 25 bp, Mus musculus
gtctgcaaggatctctcctcaccat

SEQ ID NO: 340238 - DNA, 25 bp, Mus musculus
gtctgcaatcccaaaccttgtcact

SEQ ID NO: 340239 - DNA, 25 bp, Mus musculus
gtctgcacaggaaatgaaagcttgg

SEQ ID NO: 340240 - DNA, 25 bp, Mus musculus
gtctgcactacacaggacaccaagg

SEQ ID NO: 340241 - DNA, 25 bp, Mus musculus
gtctgcactacgcgggtgacttcac

SEQ ID NO: 340242 - DNA, 25 bp, Mus musculus
gtctgcactatcggtctgtgcactg

SEQ ID NO: 340243 - DNA, 25 bp, Mus musculus
gtctgcactatcggtttggaggtac

SEQ ID NO: 340244 - DNA, 25 bp, Mus musculus
gtctgcacttaacaggacaagctct

SEQ ID NO: 340245 - DNA, 25 bp, Mus musculus
gtctgcagaagcaacctcttacctc

SEQ ID NO: 340246 - DNA, 25 bp, Mus musculus
gtctgcagaaggccaagatggacaa

SEQ ID NO: 340247 - DNA, 25 bp, Mus musculus
gtctgcagactcggtcaccactcaa

SEQ ID NO: 340248 - DNA, 25 bp, Mus musculus
gtctgcagagataaagccactcttg

SEQ ID NO: 340249 - DNA, 25 bp, Mus musculus
gtctgcagcaagatcttggccaact

SEQ ID NO: 340250 - DNA, 25 bp, Mus musculus
gtctgcagcaagcacatgcatcccc

SEQ ID NO: 340251 - DNA, 25 bp, Mus musculus
gtctgcaggaagggtccccctgtgg

SEQ ID NO: 340252 - DNA, 25 bp, Mus musculus
gtctgcaggaaggtgtggggcggag

SEQ ID NO: 340253 - DNA, 25 bp, Mus musculus
gtctgcaggccgagatcaagatgct

SEQ ID NO: 340254 - DNA, 25 bp, Mus musculus
gtctgcaggccgagcaggtccttga

SEQ ID NO: 340255 - DNA, 25 bp, Mus musculus
gtctgcaggtgagtacggctccaca

SEQ ID NO: 340256 - DNA, 25 bp, Mus musculus
gtctgcagtaggggctgctgaataa

SEQ ID NO: 340257 - DNA, 25 bp, Mus musculus
gtctgcataaggctgcggagaaggg

SEQ ID NO: 340258 - DNA, 25 bp, Mus musculus
gtctgcatcgaggtggacaacatca

SEQ ID NO: 340259 - DNA, 25 bp, Mus musculus
gtctgcccctgcctaagcctgaaaa

SEQ ID NO: 340260 - DNA, 25 bp, Mus musculus
gtctgccctggatgacttgaaagta

SEQ ID NO: 340261 - DNA, 25 bp, Mus musculus
gtctgccctgggagcctctgacctc

SEQ ID NO: 340262 - DNA, 25 bp, Mus musculus
gtctgccgtgtgtctgcccatcgtg

SEQ ID NO: 340263 - DNA, 25 bp, Mus musculus
gtctgcctcaaagctcattggctaa

SEQ ID NO: 340264 - DNA, 25 bp, Mus musculus
gtctgcctctgtccagttgtccctt

SEQ ID NO: 340265 - DNA, 25 bp, Mus musculus
gtctgcctgtccagacatcttcttc

SEQ ID NO: 340266 - DNA, 25 bp, Mus musculus
gtctgcctgtccagggatttggaca

SEQ ID NO: 340267 - DNA, 25 bp, Mus musculus
gtctgcctttggaaaggagcaccga

SEQ ID NO: 340268 - DNA, 25 bp, Mus musculus
gtctgcgaatggaaggagagtccag

SEQ ID NO: 340269 - DNA, 25 bp, Mus musculus
gtctgcgactctgagagcagagggg

SEQ ID NO: 340270 - DNA, 25 bp, Mus musculus
gtctgcgatttagctgctgtgtgga

SEQ ID NO: 340271 - DNA, 25 bp, Mus musculus
gtctgcgccctcaggatgactgagt

SEQ ID NO: 340272 - DNA, 25 bp, Mus musculus
gtctgcgcctaggggaggatcatgc

SEQ ID NO: 340273 - DNA, 25 bp, Mus musculus
gtctgcggaaagtacacaaacaagt

SEQ ID NO: 340274 - DNA, 25 bp, Mus musculus
gtctgcggaccgagaacctctccat

SEQ ID NO: 340275 - DNA, 25 bp, Mus musculus
gtctgcggaccgagaagaaccgatc

SEQ ID NO: 340276 - DNA, 25 bp, Mus musculus
gtctgcggagcggggttgaaagaca

SEQ ID NO: 340277 - DNA, 25 bp, Mus musculus
gtctgcggagcgggtttatggtcgg

SEQ ID NO: 340278 - DNA, 25 bp, Mus musculus
gtctgcggccgcaggcctgaagctc

SEQ ID NO: 340279 - DNA, 25 bp, Mus musculus
gtctgcggggcggttgccgctggtg

SEQ ID NO: 340280 - DNA, 25 bp, Mus musculus
gtctgcgtctaaaggcttcgagtac

SEQ ID NO: 340281 - DNA, 25 bp, Mus musculus
gtctgcgtctcgagacaagaccata

SEQ ID NO: 340282 - DNA, 25 bp, Mus musculus
gtctgcgtctcgagacaagaccatc

SEQ ID NO: 340283 - DNA, 25 bp, Mus musculus
gtctgctattaagatcgagttctct

SEQ ID NO: 340284 - DNA, 25 bp, Mus musculus
gtctgctcaagagtgaagacaagat

SEQ ID NO: 340285 - DNA, 25 bp, Mus musculus
gtctgctcactgggggaatgcgggg

SEQ ID NO: 340286 - DNA, 25 bp, Mus musculus
gtctgctcagaaaaaactggccacg

SEQ ID NO: 340287 - DNA, 25 bp, Mus musculus
gtctgctcagggcggcttcatttgg

SEQ ID NO: 340288 - DNA, 25 bp, Mus musculus
gtctgctcctggccttcccagaggc

SEQ ID NO: 340289 - DNA, 25 bp, Mus musculus
gtctgctgagtcctgcagcaggtgc

SEQ ID NO: 340290 - DNA, 25 bp, Mus musculus
gtctgctgcaacagcaaggtggcca

SEQ ID NO: 340291 - DNA, 25 bp, Mus musculus
gtctgctgcaacagcgaggcagagg

SEQ ID NO: 340292 - DNA, 25 bp, Mus musculus
gtctgctgggaagatgagccagata

SEQ ID NO: 340293 - DNA, 25 bp, Mus musculus
gtctgcttacccgccgcagctccgg

SEQ ID NO: 340294 - DNA, 25 bp, Mus musculus
gtctgcttacccggtacctggcagc

SEQ ID NO: 340295 - DNA, 25 bp, Mus musculus
gtctgcttggagccctgcactattg

SEQ ID NO: 340296 - DNA, 25 bp, Mus musculus
gtctgctttcaagaaaggcgacagg

SEQ ID NO: 340297 - DNA, 25 bp, Mus musculus
gtctggaaaagaactactgccgaaa

SEQ ID NO: 340298 - DNA, 25 bp, Mus musculus
gtctggaaagagaaaacatcgctct

SEQ ID NO: 340299 - DNA, 25 bp, Mus musculus
gtctggaatcacaggccaactactg

SEQ ID NO: 340300 - DNA, 25 bp, Mus musculus
gtctggaatcccaggccaactactg

SEQ ID NO: 340301 - DNA, 25 bp, Mus musculus
gtctggacagagtttgatgagtggt

SEQ ID NO: 340302 - DNA, 25 bp, Mus musculus
gtctggacagccaggtgtggagggc

SEQ ID NO: 340303 - DNA, 25 bp, Mus musculus
gtctggacagccagtttgtaggtgt

SEQ ID NO: 340304 - DNA, 25 bp, Mus musculus
gtctggacaggtcacgctggagttc

SEQ ID NO: 340305 - DNA, 25 bp, Mus musculus
gtctggacggcctgtatgccctgat

SEQ ID NO: 340306 - DNA, 25 bp, Mus musculus
gtctggagaagattgaagaaatgct

SEQ ID NO: 340307 - DNA, 25 bp, Mus musculus
gtctggagaaggtggactatagtgg

SEQ ID NO: 340308 - DNA, 25 bp, Mus musculus
gtctggagacacagcatcttgcagc

SEQ ID NO: 340309 - DNA, 25 bp, Mus musculus
gtctggagatgaagctataaaagca

SEQ ID NO: 340310 - DNA, 25 bp, Mus musculus
gtctggagcaagcccacaccgccaa

SEQ ID NO: 340311 - DNA, 25 bp, Mus musculus
gtctggagcaggtgtgccacagatc

SEQ ID NO: 340312 - DNA, 25 bp, Mus musculus
gtctggagccggtgagcctggaggc

SEQ ID NO: 340313 - DNA, 25 bp, Mus musculus
gtctggaggagattggcatccagaa

SEQ ID NO: 340314 - DNA, 25 bp, Mus musculus
gtctggaggaggttcttcgtgatct

SEQ ID NO: 340315 - DNA, 25 bp, Mus musculus
gtctggatacccagtttgcagatgg

SEQ ID NO: 340316 - DNA, 25 bp, Mus musculus
gtctggatcagaccttgtgaccgtg

SEQ ID NO: 340317 - DNA, 25 bp, Mus musculus
gtctggatgacagctctgaccaggc

SEQ ID NO: 340318 - DNA, 25 bp, Mus musculus
gtctggcaaaatgaacactaccacc

SEQ ID NO: 340319 - DNA, 25 bp, Mus musculus
gtctggcaaaggccaaggaagtagc

SEQ ID NO: 340320 - DNA, 25 bp, Mus musculus
gtctggcaagcacgatctgcccatg

SEQ ID NO: 340321 - DNA, 25 bp, Mus musculus
gtctggcacaagggtgactgtggcc

SEQ ID NO: 340322 - DNA, 25 bp, Mus musculus
gtctggcacagctgctgaaccaggt

SEQ ID NO: 340323 - DNA, 25 bp, Mus musculus
gtctggcacaggcttctgccctcac

SEQ ID NO: 340324 - DNA, 25 bp, Mus musculus
gtctggcccacaagacccgccctag

SEQ ID NO: 340325 - DNA, 25 bp, Mus musculus
gtctggcccacaagcccccactgtg

SEQ ID NO: 340326 - DNA, 25 bp, Mus musculus
gtctggccgccacggatgggtgcta

SEQ ID NO: 340327 - DNA, 25 bp, Mus musculus
gtctggcgagtctgtgaaggcccca

SEQ ID NO: 340328 - DNA, 25 bp, Mus musculus
gtctggctacaaaaggtgcttccac

SEQ ID NO: 340329 - DNA, 25 bp, Mus musculus
gtctggctatcatactgctgataaa

SEQ ID NO: 340330 - DNA, 25 bp, Mus musculus
gtctggctggcgaaggatgatgccc

SEQ ID NO: 340331 - DNA, 25 bp, Mus musculus
gtctgggaaagagtgtgaggagatc

SEQ ID NO: 340332 - DNA, 25 bp, Mus musculus
gtctgggaggagccacccgcggtca

SEQ ID NO: 340333 - DNA, 25 bp, Mus musculus
gtctgggatctaagtaaaattggag

SEQ ID NO: 340334 - DNA, 25 bp, Mus musculus
gtctgggatttaagtctgtgcgagg

SEQ ID NO: 340335 - DNA, 25 bp, Mus musculus
gtctgggccagagcttcgagtgtgt

SEQ ID NO: 340336 - DNA, 25 bp, Mus musculus
gtctgggccagcagactggaagctc

SEQ ID NO: 340337 - DNA, 25 bp, Mus musculus
gtctgggccagcaggtggcccgagg

SEQ ID NO: 340338 - DNA, 25 bp, Mus musculus
gtctgggccaggtgcgtgctattat

SEQ ID NO: 340339 - DNA, 25 bp, Mus musculus
gtctgggcgatggggcactggctcc

SEQ ID NO: 340340 - DNA, 25 bp, Mus musculus
gtctgggcttcccgatacgacattt

SEQ ID NO: 340341 - DNA, 25 bp, Mus musculus
gtctgggcttcccgattctgtttag

SEQ ID NO: 340342 - DNA, 25 bp, Mus musculus
gtctgggcttcccggagccgaggac

SEQ ID NO: 340343 - DNA, 25 bp, Mus musculus
gtctggggatggcagattcctgtcc

SEQ ID NO: 340344 - DNA, 25 bp, Mus musculus
gtctgggggaggaaagaccacagtt

SEQ ID NO: 340345 - DNA, 25 bp, Mus musculus
gtctgggtgaggaggttgtggcagc

SEQ ID NO: 340346 - DNA, 25 bp, Mus musculus
gtctgggttaaatggtttgtcttct

SEQ ID NO: 340347 - DNA, 25 bp, Mus musculus
gtctggtagcagttggaacaagagg

SEQ ID NO: 340348 - DNA, 25 bp, Mus musculus
gtctggtcaaagctgttcctgagca

SEQ ID NO: 340349 - DNA, 25 bp, Mus musculus
gtctggtcagatagttttgagatag

SEQ ID NO: 340350 - DNA, 25 bp, Mus musculus
gtctggtctacatagtgtgagtcat

SEQ ID NO: 340351 - DNA, 25 bp, Mus musculus
gtctggtttctctagatctcacact

SEQ ID NO: 340352 - DNA, 25 bp, Mus musculus
gtctggtttctctaggtgtgagcat

SEQ ID NO: 340353 - DNA, 25 bp, Mus musculus
gtctggtttctcttgtccatctcag

SEQ ID NO: 340354 - DNA, 25 bp, Mus musculus
gtctgtaaaaaagcaacacgtttta

SEQ ID NO: 340355 - DNA, 25 bp, Mus musculus
gtctgtaactgggatcatggcagga

SEQ ID NO: 340356 - DNA, 25 bp, Mus musculus
gtctgtaactgtcatcagagatcac

SEQ ID NO: 340357 - DNA, 25 bp, Mus musculus
gtctgtacaaggttttgaatcctgt

SEQ ID NO: 340358 - DNA, 25 bp, Mus musculus
gtctgtacaggttcctgcagacagc

SEQ ID NO: 340359 - DNA, 25 bp, Mus musculus
gtctgtagtgatgctgcatgccatg

SEQ ID NO: 340360 - DNA, 25 bp, Mus musculus
gtctgtatcacagctgcctcatata

SEQ ID NO: 340361 - DNA, 25 bp, Mus musculus
gtctgtatccagcgagacggtcatc

SEQ ID NO: 340362 - DNA, 25 bp, Mus musculus
gtctgtatgagaacaaagccagtca

SEQ ID NO: 340363 - DNA, 25 bp, Mus musculus
gtctgtatgagtggctgagagggtt

SEQ ID NO: 340364 - DNA, 25 bp, Mus musculus
gtctgtattgagaaacctgaaaaat

SEQ ID NO: 340365 - DNA, 25 bp, Mus musculus
gtctgtcaagggggtggcaccgaaa

SEQ ID NO: 340366 - DNA, 25 bp, Mus musculus
gtctgtcccgtcatctcccccagat

SEQ ID NO: 340367 - DNA, 25 bp, Mus musculus
gtctgtcctcaagtgagccccaggc

SEQ ID NO: 340368 - DNA, 25 bp, Mus musculus
gtctgtcctgaaagccagagacccg

SEQ ID NO: 340369 - DNA, 25 bp, Mus musculus
gtctgtcctgaaagtaggcttcttt

SEQ ID NO: 340370 - DNA, 25 bp, Mus musculus
gtctgtcctgaaagtctcagaggag

SEQ ID NO: 340371 - DNA, 25 bp, Mus musculus
gtctgtcgtagagacactctgcaca

SEQ ID NO: 340372 - DNA, 25 bp, Mus musculus
gtctgtctatgaaaatgacactgtg

SEQ ID NO: 340373 - DNA, 25 bp, Mus musculus
gtctgtctatggtatcatcagagat

SEQ ID NO: 340374 - DNA, 25 bp, Mus musculus
gtctgtctctttgacaggagaagga

SEQ ID NO: 340375 - DNA, 25 bp, Mus musculus
gtctgtgaagagccacaatcatgtc

SEQ ID NO: 340376 - DNA, 25 bp, Mus musculus
gtctgtgaagatcactgttaagaat

SEQ ID NO: 340377 - DNA, 25 bp, Mus musculus
gtctgtgaaggagaagtttgagatg

SEQ ID NO: 340378 - DNA, 25 bp, Mus musculus
gtctgtgacaggtgacacggctcag

SEQ ID NO: 340379 - DNA, 25 bp, Mus musculus
gtctgtgacagtggagatctcagac

SEQ ID NO: 340380 - DNA, 25 bp, Mus musculus
gtctgtgaccacagaatcagacaca

SEQ ID NO: 340381 - DNA, 25 bp, Mus musculus
gtctgtgaccacagatcttaccttc

SEQ ID NO: 340382 - DNA, 25 bp, Mus musculus
gtctgtgactggattggccgcagac

SEQ ID NO: 340383 - DNA, 25 bp, Mus musculus
gtctgtgagcacaggacataataag

SEQ ID NO: 340384 - DNA, 25 bp, Mus musculus
gtctgtgagcagcgcggatgtcgaa

SEQ ID NO: 340385 - DNA, 25 bp, Mus musculus
gtctgtgagcaggaatcccttcgcc

SEQ ID NO: 340386 - DNA, 25 bp, Mus musculus
gtctgtgagcagtggcagtggcacg

SEQ ID NO: 340387 - DNA, 25 bp, Mus musculus
gtctgtgaggagttcaaggatgtgg

SEQ ID NO: 340388 - DNA, 25 bp, Mus musculus
gtctgtgcacttagtagaaaatgag

SEQ ID NO: 340389 - DNA, 25 bp, Mus musculus
gtctgtgcagagatattcacaacgt

SEQ ID NO: 340390 - DNA, 25 bp, Mus musculus
gtctgtgctgctgccttccctcctc

SEQ ID NO: 340391 - DNA, 25 bp, Mus musculus
gtctgtgctgctgcgcggtgaccac

SEQ ID NO: 340392 - DNA, 25 bp, Mus musculus
gtctgtggaatgtgacaaacggagg

SEQ ID NO: 340393 - DNA, 25 bp, Mus musculus
gtctgtggatgatgaccacaagccg

SEQ ID NO: 340394 - DNA, 25 bp, Mus musculus
gtctgtggcatgcagctccatgact

SEQ ID NO: 340395 - DNA, 25 bp, Mus musculus
gtctgtggcatgcaggtgtaccagc

SEQ ID NO: 340396 - DNA, 25 bp, Mus musculus
gtctgtggcggcacagtggttgaag

SEQ ID NO: 340397 - DNA, 25 bp, Mus musculus
gtctgtggcggtcattgtcatgaga

SEQ ID NO: 340398 - DNA, 25 bp, Mus musculus
gtctgtggctcagctatcttccaga

SEQ ID NO: 340399 - DNA, 25 bp, Mus musculus
gtctgtggctgtcctccaggaggac

SEQ ID NO: 340400 - DNA, 25 bp, Mus musculus
gtctgtggtcctgaatccttcacac

SEQ ID NO: 340401 - DNA, 25 bp, Mus musculus
gtctgtgtccaggcttcagaagagc

SEQ ID NO: 340402 - DNA, 25 bp, Mus musculus
gtctgtgtggaggtacattcgctca

SEQ ID NO: 340403 - DNA, 25 bp, Mus musculus
gtctgtgtgtgcagggaaatctgct

SEQ ID NO: 340404 - DNA, 25 bp, Mus musculus
gtctgttagcgagttccagaatacc

SEQ ID NO: 340405 - DNA, 25 bp, Mus musculus
gtctgttcagactgtactccctccc

SEQ ID NO: 340406 - DNA, 25 bp, Mus musculus
gtctgttctgactgctgcagctggc

SEQ ID NO: 340407 - DNA, 25 bp, Mus musculus
gtctgttgcggtggcactgcttcga

SEQ ID NO: 340408 - DNA, 25 bp, Mus musculus
gtctgttttatgagatgtccagctc

SEQ ID NO: 340409 - DNA, 25 bp, Mus musculus
gtcttaaaaatgcaccaacaattct

SEQ ID NO: 340410 - DNA, 25 bp, Mus musculus
gtcttaaacaagcaataccttctga

SEQ ID NO: 340411 - DNA, 25 bp, Mus musculus
gtcttaaatctggggaaggaagcca

SEQ ID NO: 340412 - DNA, 25 bp, Mus musculus
gtcttaaatctggttaactatttgt

SEQ ID NO: 340413 - DNA, 25 bp, Mus musculus
gtcttaaatctgttcacacagaaga

SEQ ID NO: 340414 - DNA, 25 bp, Mus musculus
gtcttaactttcatagatcctgaag

SEQ ID NO: 340415 - DNA, 25 bp, Mus musculus
gtcttaagaagattgaaaagcaaat

SEQ ID NO: 340416 - DNA, 25 bp, Mus musculus
gtcttaagaaggtcttgctgtgcag

SEQ ID NO: 340417 - DNA, 25 bp, Mus musculus
gtcttaaggagctaagggaacaatt

SEQ ID NO: 340418 - DNA, 25 bp, Mus musculus
gtcttaagtatttgatgctggagaa

SEQ ID NO: 340419 - DNA, 25 bp, Mus musculus
gtcttaagtatttggctcagtgttt

SEQ ID NO: 340420 - DNA, 25 bp, Mus musculus
gtcttaatcagtggatggagaccaa

SEQ ID NO: 340421 - DNA, 25 bp, Mus musculus
gtcttacatggaaggaggcatggag

SEQ ID NO: 340422 - DNA, 25 bp, Mus musculus
gtcttacatggaagggcgtggagct

SEQ ID NO: 340423 - DNA, 25 bp, Mus musculus
gtcttactgcagcagcttcaaactg

SEQ ID NO: 340424 - DNA, 25 bp, Mus musculus
gtcttactgcagcaggagtgtgata

SEQ ID NO: 340425 - DNA, 25 bp, Mus musculus
gtcttagaagcagaatggaatgacc

SEQ ID NO: 340426 - DNA, 25 bp, Mus musculus
gtcttagagagagtgcagttctccg

SEQ ID NO: 340427 - DNA, 25 bp, Mus musculus
gtcttagatcagaaaagattcggca

SEQ ID NO: 340428 - DNA, 25 bp, Mus musculus
gtcttagatcagaggcggcagaccc

SEQ ID NO: 340429 - DNA, 25 bp, Mus musculus
gtcttagcagaacaggtgtttggat

SEQ ID NO: 340430 - DNA, 25 bp, Mus musculus
gtcttagctggcggtgtggcaccca

SEQ ID NO: 340431 - DNA, 25 bp, Mus musculus
gtcttagtgcaggccaaaagtcaca

SEQ ID NO: 340432 - DNA, 25 bp, Mus musculus
gtcttagtgcaggctttggcagctc

SEQ ID NO: 340433 - DNA, 25 bp, Mus musculus
gtcttatcaccagggagctaagaag

SEQ ID NO: 340434 - DNA, 25 bp, Mus musculus
gtcttatctcgagttgggaaccaaa

SEQ ID NO: 340435 - DNA, 25 bp, Mus musculus
gtcttatctcgatgaggtctcaata

SEQ ID NO: 340436 - DNA, 25 bp, Mus musculus
gtcttatctcggttacacctgtaat

SEQ ID NO: 340437 - DNA, 25 bp, Mus musculus
gtcttattcctcctatgaggcgtct

SEQ ID NO: 340438 - DNA, 25 bp, Mus musculus
gtcttatttaaagctgagtgcaata

SEQ ID NO: 340439 - DNA, 25 bp, Mus musculus
gtcttatttaagacttcattgaacc

SEQ ID NO: 340440 - DNA, 25 bp, Mus musculus
gtcttatttattggcacagacacag

SEQ ID NO: 340441 - DNA, 25 bp, Mus musculus
gtcttcaaaagagtgttgaagtcct

SEQ ID NO: 340442 - DNA, 25 bp, Mus musculus
gtcttcaaaagtgaggaagaaaaac

SEQ ID NO: 340443 - DNA, 25 bp, Mus musculus
gtcttcaacattgaggatcataaag

SEQ ID NO: 340444 - DNA, 25 bp, Mus musculus
gtcttcaagaggaccctggcccagt

SEQ ID NO: 340445 - DNA, 25 bp, Mus musculus
gtcttcaagaggacgtccttcattt

SEQ ID NO: 340446 - DNA, 25 bp, Mus musculus
gtcttcacaggcgtggagaccatgg

SEQ ID NO: 340447 - DNA, 25 bp, Mus musculus
gtcttcacagggacctgtgggatcc

SEQ ID NO: 340448 - DNA, 25 bp, Mus musculus
gtcttcacatcatgaagtgtgatct

SEQ ID NO: 340449 - DNA, 25 bp, Mus musculus
gtcttcaccacttccctgatgatct

SEQ ID NO: 340450 - DNA, 25 bp, Mus musculus
gtcttcaccccacaggtgcgactgg

SEQ ID NO: 340451 - DNA, 25 bp, Mus musculus
gtcttcacctgcctctgcctcctga

SEQ ID NO: 340452 - DNA, 25 bp, Mus musculus
gtcttcagagagaggtaccgaccct

SEQ ID NO: 340453 - DNA, 25 bp, Mus musculus
gtcttcagagagagtctttctgcag

SEQ ID NO: 340454 - DNA, 25 bp, Mus musculus
gtcttcagagattttcacagctgag

SEQ ID NO: 340455 - DNA, 25 bp, Mus musculus
gtcttcagattggagattttatttc

SEQ ID NO: 340456 - DNA, 25 bp, Mus musculus
gtcttcagattggttctgtaagcgg

SEQ ID NO: 340457 - DNA, 25 bp, Mus musculus
gtcttcagtctgagattggccaggt

SEQ ID NO: 340458 - DNA, 25 bp, Mus musculus
gtcttcatagagacacaccagagga

SEQ ID NO: 340459 - DNA, 25 bp, Mus musculus
gtcttcatagagatctccttgtcag

SEQ ID NO: 340460 - DNA, 25 bp, Mus musculus
gtcttcatcgcgcccttgctgaccg

SEQ ID NO: 340461 - DNA, 25 bp, Mus musculus
gtcttcatcgtggacctgctgcaga

SEQ ID NO: 340462 - DNA, 25 bp, Mus musculus
gtcttcatctcaaggatccttgaca

SEQ ID NO: 340463 - DNA, 25 bp, Mus musculus
gtcttcatctgactctggctcctct

SEQ ID NO: 340464 - DNA, 25 bp, Mus musculus
gtcttcatgttcgtgattgtgctgt

SEQ ID NO: 340465 - DNA, 25 bp, Mus musculus
gtcttcattaggtgctgacctctcg

SEQ ID NO: 340466 - DNA, 25 bp, Mus musculus
gtcttcattgtcagtcagggatcaa

SEQ ID NO: 340467 - DNA, 25 bp, Mus musculus
gtcttcatttagggacaagaagacc

SEQ ID NO: 340468 - DNA, 25 bp, Mus musculus
gtcttcatttgtgtaattttgtgcc

SEQ ID NO: 340469 - DNA, 25 bp, Mus musculus
gtcttccaaaaggctcaaagacttg

SEQ ID NO: 340470 - DNA, 25 bp, Mus musculus
gtcttccaagagaggaggctgtgaa

SEQ ID NO: 340471 - DNA, 25 bp, Mus musculus
gtcttccagatgagaaaatgatgta

SEQ ID NO: 340472 - DNA, 25 bp, Mus musculus
gtcttccagatggggacttcagacg

SEQ ID NO: 340473 - DNA, 25 bp, Mus musculus
gtcttcccacgaacaagatgccatt

SEQ ID NO: 340474 - DNA, 25 bp, Mus musculus
gtcttcccacggatgtgatcttcgt

SEQ ID NO: 340475 - DNA, 25 bp, Mus musculus
gtcttcccactcatgttactgggcc

SEQ ID NO: 340476 - DNA, 25 bp, Mus musculus
gtcttcccagagtttccagagtctg

SEQ ID NO: 340477 - DNA, 25 bp, Mus musculus
gtcttcccaggatgagtctgactat

SEQ ID NO: 340478 - DNA, 25 bp, Mus musculus
gtcttccccccaggattcttcctac

SEQ ID NO: 340479 - DNA, 25 bp, Mus musculus
gtcttccccccaggcttaagatact

SEQ ID NO: 340480 - DNA, 25 bp, Mus musculus
gtcttccctagagatggctttcctg

SEQ ID NO: 340481 - DNA, 25 bp, Mus musculus
gtcttccgggaaagggctctcttgt

SEQ ID NO: 340482 - DNA, 25 bp, Mus musculus
gtcttccggggtctggacagcattc

SEQ ID NO: 340483 - DNA, 25 bp, Mus musculus
gtcttccggggtctggtggtacttg

SEQ ID NO: 340484 - DNA, 25 bp, Mus musculus
gtcttccgtgcaggcgcctaaaaga

SEQ ID NO: 340485 - DNA, 25 bp, Mus musculus
gtcttcctagccacgagtctagcag

SEQ ID NO: 340486 - DNA, 25 bp, Mus musculus
gtcttcctatcagagagtgactcag

SEQ ID NO: 340487 - DNA, 25 bp, Mus musculus
gtcttcctatcagggctcagttctg

SEQ ID NO: 340488 - DNA, 25 bp, Mus musculus
gtcttcctcagaattatctgggaat

SEQ ID NO: 340489 - DNA, 25 bp, Mus musculus
gtcttcctctggaatcaacataaag

SEQ ID NO: 340490 - DNA, 25 bp, Mus musculus
gtcttcctgaaggttgagaacaaaa

SEQ ID NO: 340491 - DNA, 25 bp, Mus musculus
gtcttcctgacagggagccaggctt

SEQ ID NO: 340492 - DNA, 25 bp, Mus musculus
gtcttcgaataaggactgcatcaaa

SEQ ID NO: 340493 - DNA, 25 bp, Mus musculus
gtcttcgaataagtaataaaagagc

SEQ ID NO: 340494 - DNA, 25 bp, Mus musculus
gtcttcgtctgaagacaaacctgag

SEQ ID NO: 340495 - DNA, 25 bp, Mus musculus
gtcttcgtctgaagatgggtcagag

SEQ ID NO: 340496 - DNA, 25 bp, Mus musculus
gtcttctactagagttatctgggaa

SEQ ID NO: 340497 - DNA, 25 bp, Mus musculus
gtcttctactgcggctggtgtcagt

SEQ ID NO: 340498 - DNA, 25 bp, Mus musculus
gtcttctactgcgggatggccatcg

SEQ ID NO: 340499 - DNA, 25 bp, Mus musculus
gtcttctactgcgggcatggtgaag

SEQ ID NO: 340500 - DNA, 25 bp, Mus musculus
gtcttctatctttggtatagttgga

SEQ ID NO: 340501 - DNA, 25 bp, Mus musculus
gtcttctatgcccaatatctctgta

SEQ ID NO: 340502 - DNA, 25 bp, Mus musculus
gtcttctatggccaatatctctgta

SEQ ID NO: 340503 - DNA, 25 bp, Mus musculus
gtcttctcagtcaggtaccaagcgc

SEQ ID NO: 340504 - DNA, 25 bp, Mus musculus
gtcttctcagtcaggtcgcagacat

SEQ ID NO: 340505 - DNA, 25 bp, Mus musculus
gtcttctcgatctttgggaccatct

SEQ ID NO: 340506 - DNA, 25 bp, Mus musculus
gtcttctctggcttttctcatgtcg

SEQ ID NO: 340507 - DNA, 25 bp, Mus musculus
gtcttctctggggtctatgtttctt

SEQ ID NO: 340508 - DNA, 25 bp, Mus musculus
gtcttctctgtcacttgcctcggat

SEQ ID NO: 340509 - DNA, 25 bp, Mus musculus
gtcttctgctgtggaacgacatcgc

SEQ ID NO: 340510 - DNA, 25 bp, Mus musculus
gtcttctgggagaagatgctcagac

SEQ ID NO: 340511 - DNA, 25 bp, Mus musculus
gtcttctgtgacaagggagcagaaa

SEQ ID NO: 340512 - DNA, 25 bp, Mus musculus
gtcttctgtgacaaggtcatagtcc

SEQ ID NO: 340513 - DNA, 25 bp, Mus musculus
gtcttctgtgatggactgcagtaat

SEQ ID NO: 340514 - DNA, 25 bp, Mus musculus
gtcttctgtgatggccaaagatctc

SEQ ID NO: 340515 - DNA, 25 bp, Mus musculus
gtcttcttacagaagtaccctcctc

SEQ ID NO: 340516 - DNA, 25 bp, Mus musculus
gtcttcttacagaagttactggaca

SEQ ID NO: 340517 - DNA, 25 bp, Mus musculus
gtcttcttatctctgttgaactctt

SEQ ID NO: 340518 - DNA, 25 bp, Mus musculus
gtcttcttatctgtgttgaactctt

SEQ ID NO: 340519 - DNA, 25 bp, Mus musculus
gtcttcttgagctcggcttcatgac

SEQ ID NO: 340520 - DNA, 25 bp, Mus musculus
gtcttcttgaggtgagcgggatggc

SEQ ID NO: 340521 - DNA, 25 bp, Mus musculus
gtcttctttgtcagtttgtccctgc

SEQ ID NO: 340522 - DNA, 25 bp, Mus musculus
gtcttcttttgccaggctgagctgg

SEQ ID NO: 340523 - DNA, 25 bp, Mus musculus
gtcttgaactttaagaaaagatgtg

SEQ ID NO: 340524 - DNA, 25 bp, Mus musculus
gtcttgaactttgcaaattgaagaa

SEQ ID NO: 340525 - DNA, 25 bp, Mus musculus
gtcttgacaccaggaacctatgggc

SEQ ID NO: 340526 - DNA, 25 bp, Mus musculus
gtcttgacaccaggctgaccttctt

SEQ ID NO: 340527 - DNA, 25 bp, Mus musculus
gtcttgacagaggatctccctcagc

SEQ ID NO: 340528 - DNA, 25 bp, Mus musculus
gtcttgacataagtgaacctagtaa

SEQ ID NO: 340529 - DNA, 25 bp, Mus musculus
gtcttgacctgactggcaccctcag

SEQ ID NO: 340530 - DNA, 25 bp, Mus musculus
gtcttgacctgactggtcacagtaa

SEQ ID NO: 340531 - DNA, 25 bp, Mus musculus
gtcttgacctgactggtcttaagtt

SEQ ID NO: 340532 - DNA, 25 bp, Mus musculus
gtcttgagctggaagccggttcctg

SEQ ID NO: 340533 - DNA, 25 bp, Mus musculus
gtcttgagctggcccatcatggctg

SEQ ID NO: 340534 - DNA, 25 bp, Mus musculus
gtcttgattgttgaagatataattg

SEQ ID NO: 340535 - DNA, 25 bp, Mus musculus
gtcttgcaaatttgatgcattcttc

SEQ ID NO: 340536 - DNA, 25 bp, Mus musculus
gtcttgcagggtcagtcatatcatt

SEQ ID NO: 340537 - DNA, 25 bp, Mus musculus
gtcttgccaaggtgattcctcctaa

SEQ ID NO: 340538 - DNA, 25 bp, Mus musculus
gtcttgctagcagcaatcatctggg

SEQ ID NO: 340539 - DNA, 25 bp, Mus musculus
gtcttgctgaggaacatggttggtg

SEQ ID NO: 340540 - DNA, 25 bp, Mus musculus
gtcttgctgttactataaagctctg

SEQ ID NO: 340541 - DNA, 25 bp, Mus musculus
gtcttgctgttactattgacaccga

SEQ ID NO: 340542 - DNA, 25 bp, Mus musculus
gtcttggaagaatggcatctagtgc

SEQ ID NO: 340543 - DNA, 25 bp, Mus musculus
gtcttggacagtgagcctcgaggtc

SEQ ID NO: 340544 - DNA, 25 bp, Mus musculus
gtcttggacctcagagatgaggagt

SEQ ID NO: 340545 - DNA, 25 bp, Mus musculus
gtcttggcagagttttgcctgttcc

SEQ ID NO: 340546 - DNA, 25 bp, Mus musculus
gtcttggctctgaagattgccctct

SEQ ID NO: 340547 - DNA, 25 bp, Mus musculus
gtcttggctgttccttcttggaggg

SEQ ID NO: 340548 - DNA, 25 bp, Mus musculus
gtcttgggaaaagactgtaatgaaa

SEQ ID NO: 340549 - DNA, 25 bp, Mus musculus
gtcttgggaacttcagacccagcca

SEQ ID NO: 340550 - DNA, 25 bp, Mus musculus
gtcttgggaagaaagacgatgctca

SEQ ID NO: 340551 - DNA, 25 bp, Mus musculus
gtcttgggaggaggcttgaagatgc

SEQ ID NO: 340552 - DNA, 25 bp, Mus musculus
gtcttgggcctgggcccatacccac

SEQ ID NO: 340553 - DNA, 25 bp, Mus musculus
gtcttggtcgatgggatgctttatt

SEQ ID NO: 340554 - DNA, 25 bp, Mus musculus
gtcttggtcggaggtggctattgcc

SEQ ID NO: 340555 - DNA, 25 bp, Mus musculus
gtcttggtctccgaggagtatgtct

SEQ ID NO: 340556 - DNA, 25 bp, Mus musculus
gtcttggtggtgtgtcggagctcca

SEQ ID NO: 340557 - DNA, 25 bp, Mus musculus
gtcttggtgtggatggtgcctgcag

SEQ ID NO: 340558 - DNA, 25 bp, Mus musculus
gtcttgtggaaacagcactcatgaa

SEQ ID NO: 340559 - DNA, 25 bp, Mus musculus
gtcttgtggtgctagacctgaacta

SEQ ID NO: 340560 - DNA, 25 bp, Mus musculus
gtcttgtggtgctgcatctacataa

SEQ ID NO: 340561 - DNA, 25 bp, Mus musculus
gtcttgttacaggaagaacccccag

SEQ ID NO: 340562 - DNA, 25 bp, Mus musculus
gtcttgttcaaaggaaatgccacca

SEQ ID NO: 340563 - DNA, 25 bp, Mus musculus
gtcttgttcaaagggaagtggctga

SEQ ID NO: 340564 - DNA, 25 bp, Mus musculus
gtctttaagaacaaggacaacatcc

SEQ ID NO: 340565 - DNA, 25 bp, Mus musculus
gtctttaagaacaagtactgaaagt

SEQ ID NO: 340566 - DNA, 25 bp, Mus musculus
gtctttaagaagggctctgctaagg

SEQ ID NO: 340567 - DNA, 25 bp, Mus musculus
gtctttaaggtctctaatagatgct

SEQ ID NO: 340568 - DNA, 25 bp, Mus musculus
gtctttaaggtggtgctgatcggcg

SEQ ID NO: 340569 - DNA, 25 bp, Mus musculus
gtctttacagtatgtaggccatgga

SEQ ID NO: 340570 - DNA, 25 bp, Mus musculus
gtctttacagttgctagacctgatg

SEQ ID NO: 340571 - DNA, 25 bp, Mus musculus
gtctttacccagcctccatagactc

SEQ ID NO: 340572 - DNA, 25 bp, Mus musculus
gtctttacgttactggttgcttcta

SEQ ID NO: 340573 - DNA, 25 bp, Mus musculus
gtctttagaaagaagcatgtctgct

SEQ ID NO: 340574 - DNA, 25 bp, Mus musculus
gtctttatctgcatcccctgtgagg

SEQ ID NO: 340575 - DNA, 25 bp, Mus musculus
gtctttattagatgatgcagtccct

SEQ ID NO: 340576 - DNA, 25 bp, Mus musculus
gtctttcacaagaggctccatagga

SEQ ID NO: 340577 - DNA, 25 bp, Mus musculus
gtctttcagaagttctatgcaagaa

SEQ ID NO: 340578 - DNA, 25 bp, Mus musculus
gtctttcagcatagtctccattcag

SEQ ID NO: 340579 - DNA, 25 bp, Mus musculus
gtctttccaacagagcttaccaaat

SEQ ID NO: 340580 - DNA, 25 bp, Mus musculus
gtctttccagcccctgctggctctg

SEQ ID NO: 340581 - DNA, 25 bp, Mus musculus
gtctttccagcttctcctggtctcc

SEQ ID NO: 340582 - DNA, 25 bp, Mus musculus
gtctttccagggagctcccgtccag

SEQ ID NO: 340583 - DNA, 25 bp, Mus musculus
gtctttccaggtcatcctgttcagt

SEQ ID NO: 340584 - DNA, 25 bp, Mus musculus
gtctttccattgagttcctccgcaa

SEQ ID NO: 340585 - DNA, 25 bp, Mus musculus
gtctttccgaagtctggggctatgg

SEQ ID NO: 340586 - DNA, 25 bp, Mus musculus
gtctttcctaaattctctgcccttc

SEQ ID NO: 340587 - DNA, 25 bp, Mus musculus
gtctttcgatttgcgatcttctgcc

SEQ ID NO: 340588 - DNA, 25 bp, Mus musculus
gtctttcgatttgctttgtccatac

SEQ ID NO: 340589 - DNA, 25 bp, Mus musculus
gtctttctaacagagaagaatatca

SEQ ID NO: 340590 - DNA, 25 bp, Mus musculus
gtctttctctagcttttcctatgat

SEQ ID NO: 340591 - DNA, 25 bp, Mus musculus
gtctttctctggccctgtatccctg

SEQ ID NO: 340592 - DNA, 25 bp, Mus musculus
gtctttctgccagcgggtccggagt

SEQ ID NO: 340593 - DNA, 25 bp, Mus musculus
gtctttgaccttgggtgccttccaa

SEQ ID NO: 340594 - DNA, 25 bp, Mus musculus
gtctttgacttgctgaacattgttc

SEQ ID NO: 340595 - DNA, 25 bp, Mus musculus
gtctttgagaggtatatctttgcaa

SEQ ID NO: 340596 - DNA, 25 bp, Mus musculus
gtctttgcaaggtattgtcgccttc

SEQ ID NO: 340597 - DNA, 25 bp, Mus musculus
gtctttgcagtatggtggaacccag

SEQ ID NO: 340598 - DNA, 25 bp, Mus musculus
gtctttgcccggaacacacgccggg

SEQ ID NO: 340599 - DNA, 25 bp, Mus musculus
gtctttgcctaggttgagaacaaaa

SEQ ID NO: 340600 - DNA, 25 bp, Mus musculus
gtctttgcgggcgtgctggtcacca

SEQ ID NO: 340601 - DNA, 25 bp, Mus musculus
gtctttgcgggtgcctggctgagga

SEQ ID NO: 340602 - DNA, 25 bp, Mus musculus
gtctttggaaagggacatcatcgaa

SEQ ID NO: 340603 - DNA, 25 bp, Mus musculus
gtctttggaacatagacaacataga

SEQ ID NO: 340604 - DNA, 25 bp, Mus musculus
gtctttggacctccctccaactctt

SEQ ID NO: 340605 - DNA, 25 bp, Mus musculus
gtctttggagagctcaaagagaagc

SEQ ID NO: 340606 - DNA, 25 bp, Mus musculus
gtctttggagatatggaaggccaga

SEQ ID NO: 340607 - DNA, 25 bp, Mus musculus
gtctttggagatctctgacatctac

SEQ ID NO: 340608 - DNA, 25 bp, Mus musculus
gtctttggagggtggaagagcagag

SEQ ID NO: 340609 - DNA, 25 bp, Mus musculus
gtctttgtaccaggatcttgaaaca

SEQ ID NO: 340610 - DNA, 25 bp, Mus musculus
gtctttgtaccagggggctggtggc

SEQ ID NO: 340611 - DNA, 25 bp, Mus musculus
gtctttgtctgccagactgtcattg

SEQ ID NO: 340612 - DNA, 25 bp, Mus musculus
gtcttttactatagccccagcggga

SEQ ID NO: 340613 - DNA, 25 bp, Mus musculus
gtcttttatctcaggtgacataaat

SEQ ID NO: 340614 - DNA, 25 bp, Mus musculus
gtcttttcaaggtatttcctggtgg

SEQ ID NO: 340615 - DNA, 25 bp, Mus musculus
gtcttttcctgccccacctccagat

SEQ ID NO: 340616 - DNA, 25 bp, Mus musculus
gtcttttctgcccccagctatttta

SEQ ID NO: 340617 - DNA, 25 bp, Mus musculus
gtcttttcttcggtgggtctcggaa

SEQ ID NO: 340618 - DNA, 25 bp, Mus musculus
gtcttttcttgccaatgaggcgagc

SEQ ID NO: 340619 - DNA, 25 bp, Mus musculus
gtcttttgcaatcaaagttctattt

SEQ ID NO: 340620 - DNA, 25 bp, Mus musculus
gtcttttgcaattagaagatggagg

SEQ ID NO: 340621 - DNA, 25 bp, Mus musculus
gtcttttgcagcagtcctatgcacc

SEQ ID NO: 340622 - DNA, 25 bp, Mus musculus
gtcttttttgaaattggcaccgacc

SEQ ID NO: 340623 - DNA, 25 bp, Mus musculus
gtcttttttgctgagaaagtgatgt

SEQ ID NO: 340624 - DNA, 25 bp, Mus musculus
gtgaaaaaccaggtggaggatcttc

SEQ ID NO: 340625 - DNA, 25 bp, Mus musculus
gtgaaaaagctggaggcaagaaagg

SEQ ID NO: 340626 - DNA, 25 bp, Mus musculus
gtgaaaaatcagggggcctgtggca

SEQ ID NO: 340627 - DNA, 25 bp, Mus musculus
gtgaaaaatgactggcatggaggtg

SEQ ID NO: 340628 - DNA, 25 bp, Mus musculus
gtgaaaaatgactgggaaggattta

SEQ ID NO: 340629 - DNA, 25 bp, Mus musculus
gtgaaaaatgagtttggcaaaggtg

SEQ ID NO: 340630 - DNA, 25 bp, Mus musculus
gtgaaaaccaagaatccacctcatt

SEQ ID NO: 340631 - DNA, 25 bp, Mus musculus
gtgaaaacctgcttgtttctggggc

SEQ ID NO: 340632 - DNA, 25 bp, Mus musculus
gtgaaaactatggattccaaaatgc

SEQ ID NO: 340633 - DNA, 25 bp, Mus musculus
gtgaaaactatggtgacctgctgga

SEQ ID NO: 340634 - DNA, 25 bp, Mus musculus
gtgaaaagaagaccttgtcctggcc

SEQ ID NO: 340635 - DNA, 25 bp, Mus musculus
gtgaaaagagtgtcccagcagatga

SEQ ID NO: 340636 - DNA, 25 bp, Mus musculus
gtgaaaagccggctttctccttcca

SEQ ID NO: 340637 - DNA, 25 bp, Mus musculus
gtgaaaagccgggtactggaaattg

SEQ ID NO: 340638 - DNA, 25 bp, Mus musculus
gtgaaaaggagctgggagactccct

SEQ ID NO: 340639 - DNA, 25 bp, Mus musculus
gtgaaaaggagtgttaagcaaaagg

SEQ ID NO: 340640 - DNA, 25 bp, Mus musculus
gtgaaaaggcacaaagtaagcgcaa

SEQ ID NO: 340641 - DNA, 25 bp, Mus musculus
gtgaaaatcagatgggatcagtcag

SEQ ID NO: 340642 - DNA, 25 bp, Mus musculus
gtgaaaatgcaaaggcaggaaggag

SEQ ID NO: 340643 - DNA, 25 bp, Mus musculus
gtgaaaatgcaaaggtttcatcact

SEQ ID NO: 340644 - DNA, 25 bp, Mus musculus
gtgaaaatgctgacgtcctacaacc

SEQ ID NO: 340645 - DNA, 25 bp, Mus musculus
gtgaaaatgcttgggtcaccagtgg

SEQ ID NO: 340646 - DNA, 25 bp, Mus musculus
gtgaaacacaggacttccatagttt

SEQ ID NO: 340647 - DNA, 25 bp, Mus musculus
gtgaaacacatcccaggcaccccac

SEQ ID NO: 340648 - DNA, 25 bp, Mus musculus
gtgaaacaccattgctggggttcga

SEQ ID NO: 340649 - DNA, 25 bp, Mus musculus
gtgaaactagaaatgatggaagaac

SEQ ID NO: 340650 - DNA, 25 bp, Mus musculus
gtgaaactcaaagagcgtcaggaag

SEQ ID NO: 340651 - DNA, 25 bp, Mus musculus
gtgaaactcaaattttaatccaggt

SEQ ID NO: 340652 - DNA, 25 bp, Mus musculus
gtgaaagaaaaagtggcccatcctc

SEQ ID NO: 340653 - DNA, 25 bp, Mus musculus
gtgaaagaaacagaggtcaacagtc

SEQ ID NO: 340654 - DNA, 25 bp, Mus musculus
gtgaaagaaacagcttttaaagaca

SEQ ID NO: 340655 - DNA, 25 bp, Mus musculus
gtgaaagaattgcagagggtaattt

SEQ ID NO: 340656 - DNA, 25 bp, Mus musculus
gtgaaagaattgcagttgcctcttt

SEQ ID NO: 340657 - DNA, 25 bp, Mus musculus
gtgaaagactaggccaatcccttta

SEQ ID NO: 340658 - DNA, 25 bp, Mus musculus
gtgaaagagaagcagtgaacttatt

SEQ ID NO: 340659 - DNA, 25 bp, Mus musculus
gtgaaagagaataaatggcttgttg

SEQ ID NO: 340660 - DNA, 25 bp, Mus musculus
gtgaaagagaggaggcgcaggcagg

SEQ ID NO: 340661 - DNA, 25 bp, Mus musculus
gtgaaagatcagtttggctttatta

SEQ ID NO: 340662 - DNA, 25 bp, Mus musculus
gtgaaagatgagaatgcacctgtct

SEQ ID NO: 340663 - DNA, 25 bp, Mus musculus
gtgaaagcgacagctctacaacaga

SEQ ID NO: 340664 - DNA, 25 bp, Mus musculus
gtgaaaggcaaagccatgtcatatc

SEQ ID NO: 340665 - DNA, 25 bp, Mus musculus
gtgaaagggtcacggacctcttcac

SEQ ID NO: 340666 - DNA, 25 bp, Mus musculus
gtgaaagggtcacggttgcatctga

SEQ ID NO: 340667 - DNA, 25 bp, Mus musculus
gtgaaaggtgtgctggtgcgatgca

SEQ ID NO: 340668 - DNA, 25 bp, Mus musculus
gtgaaagtagttaccgtggtcaaga

SEQ ID NO: 340669 - DNA, 25 bp, Mus musculus
gtgaaagtgtgtggtgcaacagaat

SEQ ID NO: 340670 - DNA, 25 bp, Mus musculus
gtgaaagttagaaatttcaacgttg

SEQ ID NO: 340671 - DNA, 25 bp, Mus musculus
gtgaaatcaaggttacagaatgtct

SEQ ID NO: 340672 - DNA, 25 bp, Mus musculus
gtgaaatcttcagctgctgacctca

SEQ ID NO: 340673 - DNA, 25 bp, Mus musculus
gtgaaatgaggaagaaaagcgagtc

SEQ ID NO: 340674 - DNA, 25 bp, Mus musculus
gtgaaatgcacgatgaggaaactga

SEQ ID NO: 340675 - DNA, 25 bp, Mus musculus
gtgaaatgggccaaggaaaatgatg

SEQ ID NO: 340676 - DNA, 25 bp, Mus musculus
gtgaaatgtcagaaaatcaagagaa

SEQ ID NO: 340677 - DNA, 25 bp, Mus musculus
gtgaaatgtgcagattgtgggttga

SEQ ID NO: 340678 - DNA, 25 bp, Mus musculus
gtgaaattcccaatgagttgccata

SEQ ID NO: 340679 - DNA, 25 bp, Mus musculus
gtgaaattggcttccctgagatcct

SEQ ID NO: 340680 - DNA, 25 bp, Mus musculus
gtgaaattgtgaaagaggtcctgta

SEQ ID NO: 340681 - DNA, 25 bp, Mus musculus
gtgaaatttatgattccatattaat

SEQ ID NO: 340682 - DNA, 25 bp, Mus musculus
gtgaacaaaacagattgcctgcagt

SEQ ID NO: 340683 - DNA, 25 bp, Mus musculus
gtgaacaaagtgaattccaaggctg

SEQ ID NO: 340684 - DNA, 25 bp, Mus musculus
gtgaacaagatgacggtcagcgtca

SEQ ID NO: 340685 - DNA, 25 bp, Mus musculus
gtgaacaagttgaggaacaatacga

SEQ ID NO: 340686 - DNA, 25 bp, Mus musculus
gtgaacaagttgaggaggaggccca

SEQ ID NO: 340687 - DNA, 25 bp, Mus musculus
gtgaacaatgcagcagcaagtcctc

SEQ ID NO: 340688 - DNA, 25 bp, Mus musculus
gtgaacacaagggtcatccaaacgc

SEQ ID NO: 340689 - DNA, 25 bp, Mus musculus
gtgaacacagaaatcccttcactcc

SEQ ID NO: 340690 - DNA, 25 bp, Mus musculus
gtgaacacagggggcttccgaagtc

SEQ ID NO: 340691 - DNA, 25 bp, Mus musculus
gtgaacacagtaacctcagtcacct

SEQ ID NO: 340692 - DNA, 25 bp, Mus musculus
gtgaacacattgaagcaataccttc

SEQ ID NO: 340693 - DNA, 25 bp, Mus musculus
gtgaacaccccgggcttgcccaggt

SEQ ID NO: 340694 - DNA, 25 bp, Mus musculus
gtgaacactgacgcttttgtcaatc

SEQ ID NO: 340695 - DNA, 25 bp, Mus musculus
gtgaacactgagcctacacaggtgc

SEQ ID NO: 340696 - DNA, 25 bp, Mus musculus
gtgaacactgcgaaattgcccattc

SEQ ID NO: 340697 - DNA, 25 bp, Mus musculus
gtgaacagaggcagaaactttgtca

SEQ ID NO: 340698 - DNA, 25 bp, Mus musculus
gtgaacagtaggtgagcttagccta

SEQ ID NO: 340699 - DNA, 25 bp, Mus musculus
gtgaacagttcaaattccatcaagc

SEQ ID NO: 340700 - DNA, 25 bp, Mus musculus
gtgaacagtttaaagcatgctagtg

SEQ ID NO: 340701 - DNA, 25 bp, Mus musculus
gtgaacatcatgcatgctaagtggc

SEQ ID NO: 340702 - DNA, 25 bp, Mus musculus
gtgaacatccagatcatccacacgg

SEQ ID NO: 340703 - DNA, 25 bp, Mus musculus
gtgaacatcgaagacgccataaagg

SEQ ID NO: 340704 - DNA, 25 bp, Mus musculus
gtgaacatcggaaggaagagagagt

SEQ ID NO: 340705 - DNA, 25 bp, Mus musculus
gtgaacatttctgtattactatgaa

SEQ ID NO: 340706 - DNA, 25 bp, Mus musculus
gtgaacattttcaagacatttgaga

SEQ ID NO: 340707 - DNA, 25 bp, Mus musculus
gtgaaccaaggaattcatcctacaa

SEQ ID NO: 340708 - DNA, 25 bp, Mus musculus
gtgaaccagacagctgtgccaccgc

SEQ ID NO: 340709 - DNA, 25 bp, Mus musculus
gtgaaccagacaggcacctgtgctc

SEQ ID NO: 340710 - DNA, 25 bp, Mus musculus
gtgaacccaagagacttctctaccc

SEQ ID NO: 340711 - DNA, 25 bp, Mus musculus
gtgaacccatcaggaaggatcatcg

SEQ ID NO: 340712 - DNA, 25 bp, Mus musculus
gtgaacccatcaggctgacatcaaa

SEQ ID NO: 340713 - DNA, 25 bp, Mus musculus
gtgaacccattggtcagtgacatca

SEQ ID NO: 340714 - DNA, 25 bp, Mus musculus
gtgaaccctaggttctgctgcctta

SEQ ID NO: 340715 - DNA, 25 bp, Mus musculus
gtgaacctcaccagcatgtccaaaa

SEQ ID NO: 340716 - DNA, 25 bp, Mus musculus
gtgaacctgcagtggaccccgaagg

SEQ ID NO: 340717 - DNA, 25 bp, Mus musculus
gtgaacgaagggaacaagtcataca

SEQ ID NO: 340718 - DNA, 25 bp, Mus musculus
gtgaacgccatagaaaagtttcact

SEQ ID NO: 340719 - DNA, 25 bp, Mus musculus
gtgaacgccatagaagtttcactca

SEQ ID NO: 340720 - DNA, 25 bp, Mus musculus
gtgaacgccatagcatcaaaagacg

SEQ ID NO: 340721 - DNA, 25 bp, Mus musculus
gtgaacgccatagtggcattgaacc

SEQ ID NO: 340722 - DNA, 25 bp, Mus musculus
gtgaacgtcacaggcatatatcgag

SEQ ID NO: 340723 - DNA, 25 bp, Mus musculus
gtgaacgtggattccctccatccat

SEQ ID NO: 340724 - DNA, 25 bp, Mus musculus
gtgaacgtgttagactcccatttcc

SEQ ID NO: 340725 - DNA, 25 bp, Mus musculus
gtgaactagagcttctggaatttct

SEQ ID NO: 340726 - DNA, 25 bp, Mus musculus
gtgaactcagacaaggtctgggtgt

SEQ ID NO: 340727 - DNA, 25 bp, Mus musculus
gtgaactcaggttcttgctatgcag

SEQ ID NO: 340728 - DNA, 25 bp, Mus musculus
gtgaactccagggaggttagaagga

SEQ ID NO: 340729 - DNA, 25 bp, Mus musculus
gtgaactccctgcagcttgacgtgg

SEQ ID NO: 340730 - DNA, 25 bp, Mus musculus
gtgaactctgaaaaagtcctaatca

SEQ ID NO: 340731 - DNA, 25 bp, Mus musculus
gtgaactgaatgtgtttcctttgcc

SEQ ID NO: 340732 - DNA, 25 bp, Mus musculus
gtgaactgcattcaggacaggggtc

SEQ ID NO: 340733 - DNA, 25 bp, Mus musculus
gtgaactgcgggacatctatgacct

SEQ ID NO: 340734 - DNA, 25 bp, Mus musculus
gtgaactgcgggagtctttgtctga

SEQ ID NO: 340735 - DNA, 25 bp, Mus musculus
gtgaactggctgactgccttgtgtg

SEQ ID NO: 340736 - DNA, 25 bp, Mus musculus
gtgaactggctgactgctgatctgc

SEQ ID NO: 340737 - DNA, 25 bp, Mus musculus
gtgaactggctgactgctgtagtgg

SEQ ID NO: 340738 - DNA, 25 bp, Mus musculus
gtgaactgggccgctctctgcctct

SEQ ID NO: 340739 - DNA, 25 bp, Mus musculus
gtgaactgttcagacgcctccttgg

SEQ ID NO: 340740 - DNA, 25 bp, Mus musculus
gtgaacttcagcagagactccaaga

SEQ ID NO: 340741 - DNA, 25 bp, Mus musculus
gtgaagaaaattattgatattttca

SEQ ID NO: 340742 - DNA, 25 bp, Mus musculus
gtgaagaaccagggccagtgcgggt

SEQ ID NO: 340743 - DNA, 25 bp, Mus musculus
gtgaagaacctaatatcaggacaag

SEQ ID NO: 340744 - DNA, 25 bp, Mus musculus
gtgaagaacctgcaactggacaata

SEQ ID NO: 340745 - DNA, 25 bp, Mus musculus
gtgaagaacgaaaagggaactgtga

SEQ ID NO: 340746 - DNA, 25 bp, Mus musculus
gtgaagaactggagaaaccatggaa

SEQ ID NO: 340747 - DNA, 25 bp, Mus musculus
gtgaagaactggagtattttaacca

SEQ ID NO: 340748 - DNA, 25 bp, Mus musculus
gtgaagaagcttctggaggctcttt

SEQ ID NO: 340749 - DNA, 25 bp, Mus musculus
gtgaagaagtggggtgccgccatgc

SEQ ID NO: 340750 - DNA, 25 bp, Mus musculus
gtgaagaatgtggcttcccagacac

SEQ ID NO: 340751 - DNA, 25 bp, Mus musculus
gtgaagaattccatcaatggaaaaa

SEQ ID NO: 340752 - DNA, 25 bp, Mus musculus
gtgaagaccctgacagcaagaccat

SEQ ID NO: 340753 - DNA, 25 bp, Mus musculus
gtgaagacctgctgccgacaacctc

SEQ ID NO: 340754 - DNA, 25 bp, Mus musculus
gtgaagacgaagaaaggctacttcg

SEQ ID NO: 340755 - DNA, 25 bp, Mus musculus
gtgaagacggacaccatgatatctt

SEQ ID NO: 340756 - DNA, 25 bp, Mus musculus
gtgaagacggacagtgttacgaagc

SEQ ID NO: 340757 - DNA, 25 bp, Mus musculus
gtgaagacgtgagcaagatggggct

SEQ ID NO: 340758 - DNA, 25 bp, Mus musculus
gtgaagacgtggaggcatccaggct

SEQ ID NO: 340759 - DNA, 25 bp, Mus musculus
gtgaagactgacaagcactgcccca

SEQ ID NO: 340760 - DNA, 25 bp, Mus musculus
gtgaagagcaaatttgacgccgagt

SEQ ID NO: 340761 - DNA, 25 bp, Mus musculus
gtgaagagcaggtatctcagacgag

SEQ ID NO: 340762 - DNA, 25 bp, Mus musculus
gtgaagagcgagatgttgaacttgc

SEQ ID NO: 340763 - DNA, 25 bp, Mus musculus
gtgaagagcgtgggtgtggtggctt

SEQ ID NO: 340764 - DNA, 25 bp, Mus musculus
gtgaagagctgctggagcaggcaca

SEQ ID NO: 340765 - DNA, 25 bp, Mus musculus
gtgaagagctggtggaaggatcatc

SEQ ID NO: 340766 - DNA, 25 bp, Mus musculus
gtgaagaggaggtcccccagaggtg

SEQ ID NO: 340767 - DNA, 25 bp, Mus musculus
gtgaagatcatgtgagcatcgtgga

SEQ ID NO: 340768 - DNA, 25 bp, Mus musculus
gtgaagatctgctttcccaggctaa

SEQ ID NO: 340769 - DNA, 25 bp, Mus musculus
gtgaagatgcgcatgggaggctttg

SEQ ID NO: 340770 - DNA, 25 bp, Mus musculus
gtgaagatggagagcttccctatgg

SEQ ID NO: 340771 - DNA, 25 bp, Mus musculus
gtgaagattcaggcttgttccccct

SEQ ID NO: 340772 - DNA, 25 bp, Mus musculus
gtgaagattgtcaagatgaaatgtc

SEQ ID NO: 340773 - DNA, 25 bp, Mus musculus
gtgaagcaacctccagctctcttcc

SEQ ID NO: 340774 - DNA, 25 bp, Mus musculus
gtgaagcaactaagattcctctcgt

SEQ ID NO: 340775 - DNA, 25 bp, Mus musculus
gtgaagcaactaaggttcagagaaa

SEQ ID NO: 340776 - DNA, 25 bp, Mus musculus
gtgaagcaccaggtttggaaacaga

SEQ ID NO: 340777 - DNA, 25 bp, Mus musculus
gtgaagcagaagtacctggactatg

SEQ ID NO: 340778 - DNA, 25 bp, Mus musculus
gtgaagcagggaagcctggaccccc

SEQ ID NO: 340779 - DNA, 25 bp, Mus musculus
gtgaagcatgatcagcaagtcgctc

SEQ ID NO: 340780 - DNA, 25 bp, Mus musculus
gtgaagcatggggccactgtcttct

SEQ ID NO: 340781 - DNA, 25 bp, Mus musculus
gtgaagccacgcttgcctctccacc

SEQ ID NO: 340782 - DNA, 25 bp, Mus musculus
gtgaagccacgttgtgggacctaag

SEQ ID NO: 340783 - DNA, 25 bp, Mus musculus
gtgaagccagacagccccaggatcc

SEQ ID NO: 340784 - DNA, 25 bp, Mus musculus
gtgaagccagacagggttgccatac

SEQ ID NO: 340785 - DNA, 25 bp, Mus musculus
gtgaagccagtaaacaaggccaggg

SEQ ID NO: 340786 - DNA, 25 bp, Mus musculus
gtgaagcccggagggatccttttgt

SEQ ID NO: 340787 - DNA, 25 bp, Mus musculus
gtgaagccgactcagatccgtgatg

SEQ ID NO: 340788 - DNA, 25 bp, Mus musculus
gtgaagcctcgcaaactatttcaat

SEQ ID NO: 340789 - DNA, 25 bp, Mus musculus
gtgaagcctgctggtcctacagtgg

SEQ ID NO: 340790 - DNA, 25 bp, Mus musculus
gtgaagcgaggtctaagccgactcg

SEQ ID NO: 340791 - DNA, 25 bp, Mus musculus
gtgaagcgagtttcagggacacgtg

SEQ ID NO: 340792 - DNA, 25 bp, Mus musculus
gtgaagcggtcttaagaatcaacat

SEQ ID NO: 340793 - DNA, 25 bp, Mus musculus
gtgaagctaggtactgggtttggat

SEQ ID NO: 340794 - DNA, 25 bp, Mus musculus
gtgaagctcaagatggagaaatgga

SEQ ID NO: 340795 - DNA, 25 bp, Mus musculus
gtgaagctcaaggttgattctttca

SEQ ID NO: 340796 - DNA, 25 bp, Mus musculus
gtgaagctcagaaacttgattgaac

SEQ ID NO: 340797 - DNA, 25 bp, Mus musculus
gtgaagctcgcaaaggctggcaaaa

SEQ ID NO: 340798 - DNA, 25 bp, Mus musculus
gtgaagcttggctgctgtgaaggga

SEQ ID NO: 340799 - DNA, 25 bp, Mus musculus
gtgaaggaaaagtatgatacagact

SEQ ID NO: 340800 - DNA, 25 bp, Mus musculus
gtgaaggaaataaaatggttatgtc

SEQ ID NO: 340801 - DNA, 25 bp, Mus musculus
gtgaaggaagaggctgtggccctga

SEQ ID NO: 340802 - DNA, 25 bp, Mus musculus
gtgaaggaaggactccaccgctaac

SEQ ID NO: 340803 - DNA, 25 bp, Mus musculus
gtgaaggaatacgtgctgcccagtt

SEQ ID NO: 340804 - DNA, 25 bp, Mus musculus
gtgaaggagaaaggcgccctggctc

SEQ ID NO: 340805 - DNA, 25 bp, Mus musculus
gtgaaggagaaaggcgctgacttcc

SEQ ID NO: 340806 - DNA, 25 bp, Mus musculus
gtgaaggagcatcagaatttcagat

SEQ ID NO: 340807 - DNA, 25 bp, Mus musculus
gtgaaggagcatcagattccagaat

SEQ ID NO: 340808 - DNA, 25 bp, Mus musculus
gtgaaggagctcagaaggagtgaaa

SEQ ID NO: 340809 - DNA, 25 bp, Mus musculus
gtgaaggagtattcatggctgctcg

SEQ ID NO: 340810 - DNA, 25 bp, Mus musculus
gtgaaggagtttctggtgtgatccc

SEQ ID NO: 340811 - DNA, 25 bp, Mus musculus
gtgaaggatgccagcccaaaccagg

SEQ ID NO: 340812 - DNA, 25 bp, Mus musculus
gtgaaggatgccagccctccagggc

SEQ ID NO: 340813 - DNA, 25 bp, Mus musculus
gtgaaggatggcgaaacctgaccaa

SEQ ID NO: 340814 - DNA, 25 bp, Mus musculus
gtgaaggcaaaaaggccaaagcctc

SEQ ID NO: 340815 - DNA, 25 bp, Mus musculus
gtgaaggcatgggtcttcggatcag

SEQ ID NO: 340816 - DNA, 25 bp, Mus musculus
gtgaaggccggaggatggaaccaaa

SEQ ID NO: 340817 - DNA, 25 bp, Mus musculus
gtgaaggccggagttccctcacaac

SEQ ID NO: 340818 - DNA, 25 bp, Mus musculus
gtgaaggctggctgcctttgcgggg

SEQ ID NO: 340819 - DNA, 25 bp, Mus musculus
gtgaagggaggggatcaaactcttc

SEQ ID NO: 340820 - DNA, 25 bp, Mus musculus
gtgaaggggcagtctgtccatcagt

SEQ ID NO: 340821 - DNA, 25 bp, Mus musculus
gtgaagggtcagatttctcagctga

SEQ ID NO: 340822 - DNA, 25 bp, Mus musculus
gtgaaggtgacaggtctattttccg

SEQ ID NO: 340823 - DNA, 25 bp, Mus musculus
gtgaaggtgctgaggcaccatcaca

SEQ ID NO: 340824 - DNA, 25 bp, Mus musculus
gtgaagtaaccccaggttctgcctt

SEQ ID NO: 340825 - DNA, 25 bp, Mus musculus
gtgaagtaccgaaagctggacgatg

SEQ ID NO: 340826 - DNA, 25 bp, Mus musculus
gtgaagtacctggttaactttgtgg

SEQ ID NO: 340827 - DNA, 25 bp, Mus musculus
gtgaagtacttaaggctcaggccgt

SEQ ID NO: 340828 - DNA, 25 bp, Mus musculus
gtgaagtacttaagtcaggaggagg

SEQ ID NO: 340829 - DNA, 25 bp, Mus musculus
gtgaagtcattcaattctggaacaa

SEQ ID NO: 340830 - DNA, 25 bp, Mus musculus
gtgaagtcatttcagccgtgtttga

SEQ ID NO: 340831 - DNA, 25 bp, Mus musculus
gtgaagtccaagctggaggcattcc

SEQ ID NO: 340832 - DNA, 25 bp, Mus musculus
gtgaagtctcgacaacatgcattca

SEQ ID NO: 340833 - DNA, 25 bp, Mus musculus
gtgaagtgctctggtcctccttgtc

SEQ ID NO: 340834 - DNA, 25 bp, Mus musculus
gtgaagtggaacactgactgtcaca

SEQ ID NO: 340835 - DNA, 25 bp, Mus musculus
gtgaagtggaggaggacttggtgaa

SEQ ID NO: 340836 - DNA, 25 bp, Mus musculus
gtgaagtgtctactaatttcccagc

SEQ ID NO: 340837 - DNA, 25 bp, Mus musculus
gtgaagtgtttggattcacaacact

SEQ ID NO: 340838 - DNA, 25 bp, Mus musculus
gtgaagttattcagaagagagccaa

SEQ ID NO: 340839 - DNA, 25 bp, Mus musculus
gtgaagttattcatgctcgatttat

SEQ ID NO: 340840 - DNA, 25 bp, Mus musculus
gtgaataaagaaaaggctggaagtt

SEQ ID NO: 340841 - DNA, 25 bp, Mus musculus
gtgaataaatgtctcattaagaacc

SEQ ID NO: 340842 - DNA, 25 bp, Mus musculus
gtgaatacatacacaaaggcattag

SEQ ID NO: 340843 - DNA, 25 bp, Mus musculus
gtgaatacgaagctgttgccgcaca

SEQ ID NO: 340844 - DNA, 25 bp, Mus musculus
gtgaatagcaaaggatgcagtcatg

SEQ ID NO: 340845 - DNA, 25 bp, Mus musculus
gtgaatatcagacatgtacatggag

SEQ ID NO: 340846 - DNA, 25 bp, Mus musculus
gtgaatatcaggacaatgggctgga

SEQ ID NO: 340847 - DNA, 25 bp, Mus musculus
gtgaatattccaggaacattagaat

SEQ ID NO: 340848 - DNA, 25 bp, Mus musculus
gtgaatcagaaaaatttgctcagga

SEQ ID NO: 340849 - DNA, 25 bp, Mus musculus
gtgaatccagcctgaaactgttatt

SEQ ID NO: 340850 - DNA, 25 bp, Mus musculus
gtgaatccagcctggctgacgttgg

SEQ ID NO: 340851 - DNA, 25 bp, Mus musculus
gtgaatccaggtggcacaagacttg

SEQ ID NO: 340852 - DNA, 25 bp, Mus musculus
gtgaatccaggtttgatctgtggat

SEQ ID NO: 340853 - DNA, 25 bp, Mus musculus
gtgaatcctcttggttcagacaatg

SEQ ID NO: 340854 - DNA, 25 bp, Mus musculus
gtgaatctaggtgtagaagccacag

SEQ ID NO: 340855 - DNA, 25 bp, Mus musculus
gtgaatctgtttcccatgctgagag

SEQ ID NO: 340856 - DNA, 25 bp, Mus musculus
gtgaatcttctggacatgttgacca

SEQ ID NO: 340857 - DNA, 25 bp, Mus musculus
gtgaatgaaggctttaacagaaaat

SEQ ID NO: 340858 - DNA, 25 bp, Mus musculus
gtgaatgacgagccccacaggatcg

SEQ ID NO: 340859 - DNA, 25 bp, Mus musculus
gtgaatgacgagtgtggagagcaaa

SEQ ID NO: 340860 - DNA, 25 bp, Mus musculus
gtgaatgcacagacgtggacgaatg

SEQ ID NO: 340861 - DNA, 25 bp, Mus musculus
gtgaatgctctggtgtccgccgatg

SEQ ID NO: 340862 - DNA, 25 bp, Mus musculus
gtgaatggaggttggagacctagga

SEQ ID NO: 340863 - DNA, 25 bp, Mus musculus
gtgaatggcaaaaaggtggtggaga

SEQ ID NO: 340864 - DNA, 25 bp, Mus musculus
gtgaatgtcacagatgccatctcat

SEQ ID NO: 340865 - DNA, 25 bp, Mus musculus
gtgaatgtctgtgtcagcagctccc

SEQ ID NO: 340866 - DNA, 25 bp, Mus musculus
gtgaatgtgacaagatcgtgaacct

SEQ ID NO: 340867 - DNA, 25 bp, Mus musculus
gtgaatgtgacaaggcatatctaga

SEQ ID NO: 340868 - DNA, 25 bp, Mus musculus
gtgaatgtgagagacctctcagtag

SEQ ID NO: 340869 - DNA, 25 bp, Mus musculus
gtgaatgtgaggcctcagtgagctt

SEQ ID NO: 340870 - DNA, 25 bp, Mus musculus
gtgaattagatataatgtttaattt

SEQ ID NO: 340871 - DNA, 25 bp, Mus musculus
gtgaattctcagatgccagcatgtc

SEQ ID NO: 340872 - DNA, 25 bp, Mus musculus
gtgaattctcagttaaatttaaaaa

SEQ ID NO: 340873 - DNA, 25 bp, Mus musculus
gtgaattctgccagataaaacacgg

SEQ ID NO: 340874 - DNA, 25 bp, Mus musculus
gtgaattctgccagatactggattt

SEQ ID NO: 340875 - DNA, 25 bp, Mus musculus
gtgaattgggatgatgaggaatctg

SEQ ID NO: 340876 - DNA, 25 bp, Mus musculus
gtgaattgtagcaccatcccgattg

SEQ ID NO: 340877 - DNA, 25 bp, Mus musculus
gtgaatttccagatgcaggtgtccc

SEQ ID NO: 340878 - DNA, 25 bp, Mus musculus
gtgaatttgcaagtggattgtcttg

SEQ ID NO: 340879 - DNA, 25 bp, Mus musculus
gtgaatttgggaggtcataagtggt

SEQ ID NO: 340880 - DNA, 25 bp, Mus musculus
gtgaatttgggcacctccgcacctg

SEQ ID NO: 340881 - DNA, 25 bp, Mus musculus
gtgaattttgaggtggcccgggaga

SEQ ID NO: 340882 - DNA, 25 bp, Mus musculus
gtgaattttgagtctttccttctga

SEQ ID NO: 340883 - DNA, 25 bp, Mus musculus
gtgacaaaggagaccctggcttcaa

SEQ ID NO: 340884 - DNA, 25 bp, Mus musculus
gtgacaaataccggggtgaacctgg

SEQ ID NO: 340885 - DNA, 25 bp, Mus musculus
gtgacaaatactttgctgccttctg

SEQ ID NO: 340886 - DNA, 25 bp, Mus musculus
gtgacaaatactttgttgaaccaag

SEQ ID NO: 340887 - DNA, 25 bp, Mus musculus
gtgacaactccacagagtcattctc

SEQ ID NO: 340888 - DNA, 25 bp, Mus musculus
gtgacaagaaaaatatcgctgtagt

SEQ ID NO: 340889 - DNA, 25 bp, Mus musculus
gtgacaagcagcctgacaaaagaca

SEQ ID NO: 340890 - DNA, 25 bp, Mus musculus
gtgacaagcaggctgagtaatttag

SEQ ID NO: 340891 - DNA, 25 bp, Mus musculus
gtgacaaggccaggtgtggaggcat

SEQ ID NO: 340892 - DNA, 25 bp, Mus musculus
gtgacaagggagaattcggtggctt

SEQ ID NO: 340893 - DNA, 25 bp, Mus musculus
gtgacaagggagggaaaattgaatg

SEQ ID NO: 340894 - DNA, 25 bp, Mus musculus
gtgacaagggcaggctgctgtcacc

SEQ ID NO: 340895 - DNA, 25 bp, Mus musculus
gtgacaagtccagtagaggaagcca

SEQ ID NO: 340896 - DNA, 25 bp, Mus musculus
gtgacaagtgcgagaacatgtttgg

SEQ ID NO: 340897 - DNA, 25 bp, Mus musculus
gtgacaagtgcgagatcaaagaact

SEQ ID NO: 340898 - DNA, 25 bp, Mus musculus
gtgacaagttctcgcacacaagaag

SEQ ID NO: 340899 - DNA, 25 bp, Mus musculus
gtgacaagttctcggcctatggctg

SEQ ID NO: 340900 - DNA, 25 bp, Mus musculus
gtgacaataaggacgggccaaggtg

SEQ ID NO: 340901 - DNA, 25 bp, Mus musculus
gtgacaatatctggcaaaaaggata

SEQ ID NO: 340902 - DNA, 25 bp, Mus musculus
gtgacacaagggacccgggaggcgg

SEQ ID NO: 340903 - DNA, 25 bp, Mus musculus
gtgacacaaggtgtggcctttgcag

SEQ ID NO: 340904 - DNA, 25 bp, Mus musculus
gtgacacagaagatctggaacttcc

SEQ ID NO: 340905 - DNA, 25 bp, Mus musculus
gtgacacagaaggaaggaattcagg

SEQ ID NO: 340906 - DNA, 25 bp, Mus musculus
gtgacaccagagaccttaaccgaag

SEQ ID NO: 340907 - DNA, 25 bp, Mus musculus
gtgacaccagcacacatagactgcc

SEQ ID NO: 340908 - DNA, 25 bp, Mus musculus
gtgacaccagcagacatagactgcc

SEQ ID NO: 340909 - DNA, 25 bp, Mus musculus
gtgacacccattgagaatcctataa

SEQ ID NO: 340910 - DNA, 25 bp, Mus musculus
gtgacacccattgaggcccaaacac

SEQ ID NO: 340911 - DNA, 25 bp, Mus musculus
gtgacacctaaggtgaaggcgataa

SEQ ID NO: 340912 - DNA, 25 bp, Mus musculus
gtgacacctgtgtacaggaaaactc

SEQ ID NO: 340913 - DNA, 25 bp, Mus musculus
gtgacactccacacttggatgctca

SEQ ID NO: 340914 - DNA, 25 bp, Mus musculus
gtgacactccacagaagtgtacagt

SEQ ID NO: 340915 - DNA, 25 bp, Mus musculus
gtgacactgtcagagtatttttcta

SEQ ID NO: 340916 - DNA, 25 bp, Mus musculus
gtgacacttggtccctccagctata

SEQ ID NO: 340917 - DNA, 25 bp, Mus musculus
gtgacagaaaggcgatctctttcca

SEQ ID NO: 340918 - DNA, 25 bp, Mus musculus
gtgacagaaagggaacgcatcatca

SEQ ID NO: 340919 - DNA, 25 bp, Mus musculus
gtgacagacaagatttgaaagaagc

SEQ ID NO: 340920 - DNA, 25 bp, Mus musculus
gtgacagacagtcttcacacatctc

SEQ ID NO: 340921 - DNA, 25 bp, Mus musculus
gtgacagagctgaagagccagatga

SEQ ID NO: 340922 - DNA, 25 bp, Mus musculus
gtgacagataagaactgagtcaaac

SEQ ID NO: 340923 - DNA, 25 bp, Mus musculus
gtgacagataagtgtccagctgctc

SEQ ID NO: 340924 - DNA, 25 bp, Mus musculus
gtgacagataagttcggaataaatt

SEQ ID NO: 340925 - DNA, 25 bp, Mus musculus
gtgacagatgtcatgctgtgtgcag

SEQ ID NO: 340926 - DNA, 25 bp, Mus musculus
gtgacaggatggctgggcacagagt

SEQ ID NO: 340927 - DNA, 25 bp, Mus musculus
gtgacaggatgttggtgttggtact

SEQ ID NO: 340928 - DNA, 25 bp, Mus musculus
gtgacaggcatgagtaaagacattt

SEQ ID NO: 340929 - DNA, 25 bp, Mus musculus
gtgacagggatgagtgggatgtacc

SEQ ID NO: 340930 - DNA, 25 bp, Mus musculus
gtgacaggtattgagatgttccaca

SEQ ID NO: 340931 - DNA, 25 bp, Mus musculus
gtgacagtatcgaggagaaagaaaa

SEQ ID NO: 340932 - DNA, 25 bp, Mus musculus
gtgacagtcaaagaacactggtgaa

SEQ ID NO: 340933 - DNA, 25 bp, Mus musculus
gtgacagtgacccggctaagcatgg

SEQ ID NO: 340934 - DNA, 25 bp, Mus musculus
gtgacagtgacccggtgaagacttt

SEQ ID NO: 340935 - DNA, 25 bp, Mus musculus
gtgacagtgacctggctgaagaatt

SEQ ID NO: 340936 - DNA, 25 bp, Mus musculus
gtgacagtgatactagtcgacaatt

SEQ ID NO: 340937 - DNA, 25 bp, Mus musculus
gtgacagtgatactagtttaaaagc

SEQ ID NO: 340938 - DNA, 25 bp, Mus musculus
gtgacatactggggtgagcatgcca

SEQ ID NO: 340939 - DNA, 25 bp, Mus musculus
gtgacatagagtgtgctgctctggt

SEQ ID NO: 340940 - DNA, 25 bp, Mus musculus
gtgacatatgcccccaaggtctctg

SEQ ID NO: 340941 - DNA, 25 bp, Mus musculus
gtgacatcaagctggaaaaccttat

SEQ ID NO: 340942 - DNA, 25 bp, Mus musculus
gtgacatcacagctggtgaatgagc

SEQ ID NO: 340943 - DNA, 25 bp, Mus musculus
gtgacatcattcagaatctgtccgt

SEQ ID NO: 340944 - DNA, 25 bp, Mus musculus
gtgacatccccctggttggttttat

SEQ ID NO: 340945 - DNA, 25 bp, Mus musculus
gtgacatcctagacaacaacgggac

SEQ ID NO: 340946 - DNA, 25 bp, Mus musculus
gtgacatctacagctataacccaga

SEQ ID NO: 340947 - DNA, 25 bp, Mus musculus
gtgacattgccctcccctttttttg

SEQ ID NO: 340948 - DNA, 25 bp, Mus musculus
gtgacatttgaaaatgtcaaggaga

SEQ ID NO: 340949 - DNA, 25 bp, Mus musculus
gtgaccaaacgcagaagcttgcagg

SEQ ID NO: 340950 - DNA, 25 bp, Mus musculus
gtgaccaaccagattgagagccacc

SEQ ID NO: 340951 - DNA, 25 bp, Mus musculus
gtgaccaaccaggtcgagtgtcacc

SEQ ID NO: 340952 - DNA, 25 bp, Mus musculus
gtgaccaagactgcgcttcgccatg

SEQ ID NO: 340953 - DNA, 25 bp, Mus musculus
gtgaccaagctgtagatcaagtctc

SEQ ID NO: 340954 - DNA, 25 bp, Mus musculus
gtgaccaagctgtagcatagttttg

SEQ ID NO: 340955 - DNA, 25 bp, Mus musculus
gtgaccacagaatcagacacaagtt

SEQ ID NO: 340956 - DNA, 25 bp, Mus musculus
gtgaccacagagagttctccagatt

SEQ ID NO: 340957 - DNA, 25 bp, Mus musculus
gtgaccacagatcttaccttctcta

SEQ ID NO: 340958 - DNA, 25 bp, Mus musculus
gtgaccacaggacaggattatggaa

SEQ ID NO: 340959 - DNA, 25 bp, Mus musculus
gtgaccaccacacaggccagaccca

SEQ ID NO: 340960 - DNA, 25 bp, Mus musculus
gtgaccacccagatgttgccgcact

SEQ ID NO: 340961 - DNA, 25 bp, Mus musculus
gtgaccactcaagcccatcgtttct

SEQ ID NO: 340962 - DNA, 25 bp, Mus musculus
gtgaccactcaaggcaccacaatgg

SEQ ID NO: 340963 - DNA, 25 bp, Mus musculus
gtgaccagacctacgataaccactt

SEQ ID NO: 340964 - DNA, 25 bp, Mus musculus
gtgaccagtgtgagaagaaacgggg

SEQ ID NO: 340965 - DNA, 25 bp, Mus musculus
gtgaccatactcccgagatgttaga

SEQ ID NO: 340966 - DNA, 25 bp, Mus musculus
gtgaccatcacagggtttgtggatg

SEQ ID NO: 340967 - DNA, 25 bp, Mus musculus
gtgaccatcacaggtctattctgga

SEQ ID NO: 340968 - DNA, 25 bp, Mus musculus
gtgaccatcaggtactgcagggttg

SEQ ID NO: 340969 - DNA, 25 bp, Mus musculus
gtgaccatccagaaaaaacactgaa

SEQ ID NO: 340970 - DNA, 25 bp, Mus musculus
gtgaccatggaagcgtatttgatag

SEQ ID NO: 340971 - DNA, 25 bp, Mus musculus
gtgaccatggtagcgtatttgatag

SEQ ID NO: 340972 - DNA, 25 bp, Mus musculus
gtgaccattgaagatgatgactatt

SEQ ID NO: 340973 - DNA, 25 bp, Mus musculus
gtgaccattgagcaagaactatgtc

SEQ ID NO: 340974 - DNA, 25 bp, Mus musculus
gtgaccattgaggttatctggctgt

SEQ ID NO: 340975 - DNA, 25 bp, Mus musculus
gtgaccccatgcagaccagactctg

SEQ ID NO: 340976 - DNA, 25 bp, Mus musculus
gtgaccccatgcaggaatctgatgc

SEQ ID NO: 340977 - DNA, 25 bp, Mus musculus
gtgaccccatgcaggtttatggtgt

SEQ ID NO: 340978 - DNA, 25 bp, Mus musculus
gtgaccccatgtggccacagtacac

SEQ ID NO: 340979 - DNA, 25 bp, Mus musculus
gtgacccccagcagtctaaggtggt

SEQ ID NO: 340980 - DNA, 25 bp, Mus musculus
gtgaccccctggcaggacactactg

SEQ ID NO: 340981 - DNA, 25 bp, Mus musculus
gtgacccgccaggacaatggatttt

SEQ ID NO: 340982 - DNA, 25 bp, Mus musculus
gtgaccctgacccagcttctcgtgt

SEQ ID NO: 340983 - DNA, 25 bp, Mus musculus
gtgaccctgacccaggaacacagtg

SEQ ID NO: 340984 - DNA, 25 bp, Mus musculus
gtgaccctgacccaggtcaacagct

SEQ ID NO: 340985 - DNA, 25 bp, Mus musculus
gtgaccgaatgagaaaggtttaact

SEQ ID NO: 340986 - DNA, 25 bp, Mus musculus
gtgaccgaatgagagactctacagg

SEQ ID NO: 340987 - DNA, 25 bp, Mus musculus
gtgaccgaatgagctgccgagtgtt

SEQ ID NO: 340988 - DNA, 25 bp, Mus musculus
gtgaccggagctgagcatttcagat

SEQ ID NO: 340989 - DNA, 25 bp, Mus musculus
gtgaccgtgagcccattctgcactc

SEQ ID NO: 340990 - DNA, 25 bp, Mus musculus
gtgacctaacaggtgtgaaagatgt

SEQ ID NO: 340991 - DNA, 25 bp, Mus musculus
gtgacctatcagggtacttttgatg

SEQ ID NO: 340992 - DNA, 25 bp, Mus musculus
gtgacctcaggggagctgctgcagt

SEQ ID NO: 340993 - DNA, 25 bp, Mus musculus
gtgacctcctcagtgggaacacagg

SEQ ID NO: 340994 - DNA, 25 bp, Mus musculus
gtgacctcgcgagtttcctgacagg

SEQ ID NO: 340995 - DNA, 25 bp, Mus musculus
gtgacctgcttggttcaactggaga

SEQ ID NO: 340996 - DNA, 25 bp, Mus musculus
gtgacctggaaagtgtctttgccat

SEQ ID NO: 340997 - DNA, 25 bp, Mus musculus
gtgacctgggatggattcatgggtg

SEQ ID NO: 340998 - DNA, 25 bp, Mus musculus
gtgacctgtgacatccggctccggg

SEQ ID NO: 340999 - DNA, 25 bp, Mus musculus
gtgacctgtgatggggaaacaggct

SEQ ID NO: 341000 - DNA, 25 bp, Mus musculus
gtgaccttagaatcagctgcccgag

SEQ ID NO: 341001 - DNA, 25 bp, Mus musculus
gtgaccttggaggatttgaggcgcc

SEQ ID NO: 341002 - DNA, 25 bp, Mus musculus
gtgaccttgggctggcatccccacc

SEQ ID NO: 341003 - DNA, 25 bp, Mus musculus
gtgaccttggggaaagatggagctc

SEQ ID NO: 341004 - DNA, 25 bp, Mus musculus
gtgaccttgggtgctggcctcgcgc

SEQ ID NO: 341005 - DNA, 25 bp, Mus musculus
gtgaccttggtgcagacaacatcgc

SEQ ID NO: 341006 - DNA, 25 bp, Mus musculus
gtgaccttggttcttccatcagtgt

SEQ ID NO: 341007 - DNA, 25 bp, Mus musculus
gtgacctttgctttagggatcagtc

SEQ ID NO: 341008 - DNA, 25 bp, Mus musculus
gtgacctttgctttgattctttcag

SEQ ID NO: 341009 - DNA, 25 bp, Mus musculus
gtgacgaaaggtctgtcacctaaag

SEQ ID NO: 341010 - DNA, 25 bp, Mus musculus
gtgacgacaagatttgaaagaagcg

SEQ ID NO: 341011 - DNA, 25 bp, Mus musculus
gtgacgacagcagagaaacatggct

SEQ ID NO: 341012 - DNA, 25 bp, Mus musculus
gtgacgagtcctatggtgaaggctg

SEQ ID NO: 341013 - DNA, 25 bp, Mus musculus
gtgacgcgacagaaaccgcccagaa

SEQ ID NO: 341014 - DNA, 25 bp, Mus musculus
gtgacgcgacagcacaccacatgta

SEQ ID NO: 341015 - DNA, 25 bp, Mus musculus
gtgacgcgggatggtcactcggacg

SEQ ID NO: 341016 - DNA, 25 bp, Mus musculus
gtgacgcgggtctgcaccggtgagt

SEQ ID NO: 341017 - DNA, 25 bp, Mus musculus
gtgacgctgggttgccccggaggcc

SEQ ID NO: 341018 - DNA, 25 bp, Mus musculus
gtgacggaggctgagatcactggag

SEQ ID NO: 341019 - DNA, 25 bp, Mus musculus
gtgacggccacattgattttcctcg

SEQ ID NO: 341020 - DNA, 25 bp, Mus musculus
gtgacggccacattgccctgtcagc

SEQ ID NO: 341021 - DNA, 25 bp, Mus musculus
gtgacgggaagcttatcaagtacgg

SEQ ID NO: 341022 - DNA, 25 bp, Mus musculus
gtgacgggaaggtgtgtgagtctcc

SEQ ID NO: 341023 - DNA, 25 bp, Mus musculus
gtgacgtcagtccaggaccacttgg

SEQ ID NO: 341024 - DNA, 25 bp, Mus musculus
gtgacgtcgggaactgaagagccga

SEQ ID NO: 341025 - DNA, 25 bp, Mus musculus
gtgacgtcgggaagttccgtgtacc

SEQ ID NO: 341026 - DNA, 25 bp, Mus musculus
gtgacgtgaaagccagagacgcccc

SEQ ID NO: 341027 - DNA, 25 bp, Mus musculus
gtgacgtggatgagtacgctccaga

SEQ ID NO: 341028 - DNA, 25 bp, Mus musculus
gtgacgtggtaaaagactacgcgtt

SEQ ID NO: 341029 - DNA, 25 bp, Mus musculus
gtgacgtggtgggaagaggtgccag

SEQ ID NO: 341030 - DNA, 25 bp, Mus musculus
gtgactaaaagtagtagaaggagga

SEQ ID NO: 341031 - DNA, 25 bp, Mus musculus
gtgactacatgaagtgccctccgtt

SEQ ID NO: 341032 - DNA, 25 bp, Mus musculus
gtgactacgagacggtggtgaaagt

SEQ ID NO: 341033 - DNA, 25 bp, Mus musculus
gtgactactggaataccagttgtaa

SEQ ID NO: 341034 - DNA, 25 bp, Mus musculus
gtgactactttagggccatgttcac

SEQ ID NO: 341035 - DNA, 25 bp, Mus musculus
gtgactactttagtgctgaggtgac

SEQ ID NO: 341036 - DNA, 25 bp, Mus musculus
gtgactcaagctcgtgtggccagca

SEQ ID NO: 341037 - DNA, 25 bp, Mus musculus
gtgactcacagctgaaggtggagat

SEQ ID NO: 341038 - DNA, 25 bp, Mus musculus
gtgactcacagggaacaaccccttt

SEQ ID NO: 341039 - DNA, 25 bp, Mus musculus
gtgactcatgagaaaagagaagcag

SEQ ID NO: 341040 - DNA, 25 bp, Mus musculus
gtgactcatgaggctcatccagagc

SEQ ID NO: 341041 - DNA, 25 bp, Mus musculus
gtgactcatgccagggttgtcgccc

SEQ ID NO: 341042 - DNA, 25 bp, Mus musculus
gtgactccaaacatccagaacccag

SEQ ID NO: 341043 - DNA, 25 bp, Mus musculus
gtgactccaaggacaagaccagtgc

SEQ ID NO: 341044 - DNA, 25 bp, Mus musculus
gtgactccaggagcagttcctccag

SEQ ID NO: 341045 - DNA, 25 bp, Mus musculus
gtgactccaggaggagcgacagttt

SEQ ID NO: 341046 - DNA, 25 bp, Mus musculus
gtgactccaggaggcttccagcttg

SEQ ID NO: 341047 - DNA, 25 bp, Mus musculus
gtgactccaggctgtccttgttgga

SEQ ID NO: 341048 - DNA, 25 bp, Mus musculus
gtgactcctccatgctggacagtgc

SEQ ID NO: 341049 - DNA, 25 bp, Mus musculus
gtgactcctttcccaacactatgac

SEQ ID NO: 341050 - DNA, 25 bp, Mus musculus
gtgactctggggctgacaaaaagtt

SEQ ID NO: 341051 - DNA, 25 bp, Mus musculus
gtgactgaaaaagttccaccaggtg

SEQ ID NO: 341052 - DNA, 25 bp, Mus musculus
gtgactgagagcgagctgaccaatg

SEQ ID NO: 341053 - DNA, 25 bp, Mus musculus
gtgactgagagtgagaaagcgctgc

SEQ ID NO: 341054 - DNA, 25 bp, Mus musculus
gtgactgagagtggaatgcagtggc

SEQ ID NO: 341055 - DNA, 25 bp, Mus musculus
gtgactgcagaaccaagggccagga

SEQ ID NO: 341056 - DNA, 25 bp, Mus musculus
gtgactgcaggctcatgagcagcgt

SEQ ID NO: 341057 - DNA, 25 bp, Mus musculus
gtgactgcggcgcaaccatgaaggt

SEQ ID NO: 341058 - DNA, 25 bp, Mus musculus
gtgactgctcccttccctggtctat

SEQ ID NO: 341059 - DNA, 25 bp, Mus musculus
gtgactggaacaggaaggttcatat

SEQ ID NO: 341060 - DNA, 25 bp, Mus musculus
gtgactggacaggttttatacgttc

SEQ ID NO: 341061 - DNA, 25 bp, Mus musculus
gtgactggacccatgtccttcagga

SEQ ID NO: 341062 - DNA, 25 bp, Mus musculus
gtgactggaggattctgtacccaga

SEQ ID NO: 341063 - DNA, 25 bp, Mus musculus
gtgactggatctgggagcatcaagg

SEQ ID NO: 341064 - DNA, 25 bp, Mus musculus
gtgactggctggtgtgcaggatttt

SEQ ID NO: 341065 - DNA, 25 bp, Mus musculus
gtgactgggataaaggattccagca

SEQ ID NO: 341066 - DNA, 25 bp, Mus musculus
gtgactggtgtcaagcctgagggat

SEQ ID NO: 341067 - DNA, 25 bp, Mus musculus
gtgactggtgtcaagctcccagact

SEQ ID NO: 341068 - DNA, 25 bp, Mus musculus
gtgactggttgcaatcaggattcag

SEQ ID NO: 341069 - DNA, 25 bp, Mus musculus
gtgactggttgttaaatgaagcttc

SEQ ID NO: 341070 - DNA, 25 bp, Mus musculus
gtgactgtaagttgtctgacatctc

SEQ ID NO: 341071 - DNA, 25 bp, Mus musculus
gtgactgtacagtatgtgcagagca

SEQ ID NO: 341072 - DNA, 25 bp, Mus musculus
gtgactgtacagtgaaacagatgtg

SEQ ID NO: 341073 - DNA, 25 bp, Mus musculus
gtgactgtagcccggacatcacctt

SEQ ID NO: 341074 - DNA, 25 bp, Mus musculus
gtgactgtgtaacggagcacctccc

SEQ ID NO: 341075 - DNA, 25 bp, Mus musculus
gtgactgtgtgtttgatcctgagtt

SEQ ID NO: 341076 - DNA, 25 bp, Mus musculus
gtgactgtgttagatgctcctgaag

SEQ ID NO: 341077 - DNA, 25 bp, Mus musculus
gtgactgtgttagttgaacccacag

SEQ ID NO: 341078 - DNA, 25 bp, Mus musculus
gtgactgtgttctagactcaagaat

SEQ ID NO: 341079 - DNA, 25 bp, Mus musculus
gtgactgttatatgcagcagaagat

SEQ ID NO: 341080 - DNA, 25 bp, Mus musculus
gtgactgtttggtgctgcagagctt

SEQ ID NO: 341081 - DNA, 25 bp, Mus musculus
gtgacttacacacaggctgagggta

SEQ ID NO: 341082 - DNA, 25 bp, Mus musculus
gtgacttacagtaaggggctccacg

SEQ ID NO: 341083 - DNA, 25 bp, Mus musculus
gtgacttcaataatgatttccaggg

SEQ ID NO: 341084 - DNA, 25 bp, Mus musculus
gtgacttcaataatgtggtgaaaac

SEQ ID NO: 341085 - DNA, 25 bp, Mus musculus
gtgacttcagtggggcgtctccgct

SEQ ID NO: 341086 - DNA, 25 bp, Mus musculus
gtgacttccacaggacctataagaa

SEQ ID NO: 341087 - DNA, 25 bp, Mus musculus
gtgacttccacatcctgactccgtt

SEQ ID NO: 341088 - DNA, 25 bp, Mus musculus
gtgacttccgaggtcctggaggcca

SEQ ID NO: 341089 - DNA, 25 bp, Mus musculus
gtgacttccgtggtgggattttcct

SEQ ID NO: 341090 - DNA, 25 bp, Mus musculus
gtgacttgagaacacaagagagcag

SEQ ID NO: 341091 - DNA, 25 bp, Mus musculus
gtgacttgagaagctgaatcacttt

SEQ ID NO: 341092 - DNA, 25 bp, Mus musculus
gtgacttgctgctgcgatactatga

SEQ ID NO: 341093 - DNA, 25 bp, Mus musculus
gtgacttgtcctacctgctgatttt

SEQ ID NO: 341094 - DNA, 25 bp, Mus musculus
gtgactttaaggacagttatctgct

SEQ ID NO: 341095 - DNA, 25 bp, Mus musculus
gtgactttacaggaaaaccaccaaa

SEQ ID NO: 341096 - DNA, 25 bp, Mus musculus
gtgactttcattggtgctgtccccg

SEQ ID NO: 341097 - DNA, 25 bp, Mus musculus
gtgactttcttcagttgtttcctct

SEQ ID NO: 341098 - DNA, 25 bp, Mus musculus
gtgactttgcagtttcaccaaacct

SEQ ID NO: 341099 - DNA, 25 bp, Mus musculus
gtgagaaaaatttagaatatgacat

SEQ ID NO: 341100 - DNA, 25 bp, Mus musculus
gtgagaaaaggatgattgagatagc

SEQ ID NO: 341101 - DNA, 25 bp, Mus musculus
gtgagaaaaggccctcaacttcctc

SEQ ID NO: 341102 - DNA, 25 bp, Mus musculus
gtgagaaagataggttgcagctgtc

SEQ ID NO: 341103 - DNA, 25 bp, Mus musculus
gtgagaaaggggagacagagtatga

SEQ ID NO: 341104 - DNA, 25 bp, Mus musculus
gtgagaacaagaaagcatctaaaga

SEQ ID NO: 341105 - DNA, 25 bp, Mus musculus
gtgagaacaggtcctatgagggcat

SEQ ID NO: 341106 - DNA, 25 bp, Mus musculus
gtgagaaccagagcatcgtgctgga

SEQ ID NO: 341107 - DNA, 25 bp, Mus musculus
gtgagaaccagagggacagcatcgt

SEQ ID NO: 341108 - DNA, 25 bp, Mus musculus
gtgagaaccgagaaatggcaaaatg

SEQ ID NO: 341109 - DNA, 25 bp, Mus musculus
gtgagaaccgagttcctgttcctct

SEQ ID NO: 341110 - DNA, 25 bp, Mus musculus
gtgagaaccttacccacaggtccgc

SEQ ID NO: 341111 - DNA, 25 bp, Mus musculus
gtgagaactaggtgctcctgccatg

SEQ ID NO: 341112 - DNA, 25 bp, Mus musculus
gtgagaagagagagaagctcggacc

SEQ ID NO: 341113 - DNA, 25 bp, Mus musculus
gtgagaagattacgacgggcagaac

SEQ ID NO: 341114 - DNA, 25 bp, Mus musculus
gtgagaataagttcaaggtgcttat

SEQ ID NO: 341115 - DNA, 25 bp, Mus musculus
gtgagaatgagacgtccagcgtgct

SEQ ID NO: 341116 - DNA, 25 bp, Mus musculus
gtgagaatgaggaaggcaagcgcag

SEQ ID NO: 341117 - DNA, 25 bp, Mus musculus
gtgagaatgtccactgttccccatt

SEQ ID NO: 341118 - DNA, 25 bp, Mus musculus
gtgagacaattccagcacaaggaat

SEQ ID NO: 341119 - DNA, 25 bp, Mus musculus
gtgagaccaacaaatagctgtatga

SEQ ID NO: 341120 - DNA, 25 bp, Mus musculus
gtgagaccaacaaatgacaccgtac

SEQ ID NO: 341121 - DNA, 25 bp, Mus musculus
gtgagaccatcctagtcatgggaga

SEQ ID NO: 341122 - DNA, 25 bp, Mus musculus
gtgagacccaggttcaactggagag

SEQ ID NO: 341123 - DNA, 25 bp, Mus musculus
gtgagaccggaccagctccccatat

SEQ ID NO: 341124 - DNA, 25 bp, Mus musculus
gtgagaccggatcagctccccatat

SEQ ID NO: 341125 - DNA, 25 bp, Mus musculus
gtgagacctgcgacaacaacgggac

SEQ ID NO: 341126 - DNA, 25 bp, Mus musculus
gtgagacgtgggactccagtgattt

SEQ ID NO: 341127 - DNA, 25 bp, Mus musculus
gtgagactaatagtgcagaggagaa

SEQ ID NO: 341128 - DNA, 25 bp, Mus musculus
gtgagactaatccagctgaacatac

SEQ ID NO: 341129 - DNA, 25 bp, Mus musculus
gtgagactctctgtggaccccgttc

SEQ ID NO: 341130 - DNA, 25 bp, Mus musculus
gtgagagaattaaggcaccaaggag

SEQ ID NO: 341131 - DNA, 25 bp, Mus musculus
gtgagagatcccaagttctttcaga

SEQ ID NO: 341132 - DNA, 25 bp, Mus musculus
gtgagagatctgaagcagataaaga

SEQ ID NO: 341133 - DNA, 25 bp, Mus musculus
gtgagagcaagagatacttcaagcg

SEQ ID NO: 341134 - DNA, 25 bp, Mus musculus
gtgagagccagaggcactgagagta

SEQ ID NO: 341135 - DNA, 25 bp, Mus musculus
gtgagagccagtcgtttcagctctg

SEQ ID NO: 341136 - DNA, 25 bp, Mus musculus
gtgagaggaagactctgcagcttca

SEQ ID NO: 341137 - DNA, 25 bp, Mus musculus
gtgagaggaatcagaatcagactgg

SEQ ID NO: 341138 - DNA, 25 bp, Mus musculus
gtgagaggaatcagttcacagcgct

SEQ ID NO: 341139 - DNA, 25 bp, Mus musculus
gtgagaggcagggcttgtcaatgag

SEQ ID NO: 341140 - DNA, 25 bp, Mus musculus
gtgagaggctcaggcagaagatcct

SEQ ID NO: 341141 - DNA, 25 bp, Mus musculus
gtgagaggtaagcttgtctcctctc

SEQ ID NO: 341142 - DNA, 25 bp, Mus musculus
gtgagagtatgcagtccttcagctc

SEQ ID NO: 341143 - DNA, 25 bp, Mus musculus
gtgagagttaagggcacagagaact

SEQ ID NO: 341144 - DNA, 25 bp, Mus musculus
gtgagagttgacggcgtccaacacg

SEQ ID NO: 341145 - DNA, 25 bp, Mus musculus
gtgagagttgagtcctacctgctcc

SEQ ID NO: 341146 - DNA, 25 bp, Mus musculus
gtgagatacaagcgggctttgctgc

SEQ ID NO: 341147 - DNA, 25 bp, Mus musculus
gtgagatacagattgctaataatca

SEQ ID NO: 341148 - DNA, 25 bp, Mus musculus
gtgagatctgtgaggaaggtctacg

SEQ ID NO: 341149 - DNA, 25 bp, Mus musculus
gtgagatgacttcagatggaggctg

SEQ ID NO: 341150 - DNA, 25 bp, Mus musculus
gtgagatggacaggcagcgggcagg

SEQ ID NO: 341151 - DNA, 25 bp, Mus musculus
gtgagattccaggtggcagacatgg

SEQ ID NO: 341152 - DNA, 25 bp, Mus musculus
gtgagatttttgtggacagcacatg

SEQ ID NO: 341153 - DNA, 25 bp, Mus musculus
gtgagcaacttgtcttcactctgcc

SEQ ID NO: 341154 - DNA, 25 bp, Mus musculus
gtgagcaagaggaagcttttcttct

SEQ ID NO: 341155 - DNA, 25 bp, Mus musculus
gtgagcaaggtaagctctgaggatg

SEQ ID NO: 341156 - DNA, 25 bp, Mus musculus
gtgagcacaggacataataagaaaa

SEQ ID NO: 341157 - DNA, 25 bp, Mus musculus
gtgagcacatccgtctcaggtgaaa

SEQ ID NO: 341158 - DNA, 25 bp, Mus musculus
gtgagcaccaagcagccttctctcc

SEQ ID NO: 341159 - DNA, 25 bp, Mus musculus
gtgagcacggatgaaaatttttcct

SEQ ID NO: 341160 - DNA, 25 bp, Mus musculus
gtgagcactggccctctctgggggg

SEQ ID NO: 341161 - DNA, 25 bp, Mus musculus
gtgagcagctctgtgctgtattttc

SEQ ID NO: 341162 - DNA, 25 bp, Mus musculus
gtgagcagctctgtggtttgggctc

SEQ ID NO: 341163 - DNA, 25 bp, Mus musculus
gtgagcaggaggagctgagcaagcg

SEQ ID NO: 341164 - DNA, 25 bp, Mus musculus
gtgagcaggggtgactactttggga

SEQ ID NO: 341165 - DNA, 25 bp, Mus musculus
gtgagcatcctctaccacacccgtg

SEQ ID NO: 341166 - DNA, 25 bp, Mus musculus
gtgagcatgaggttgtctattacac

SEQ ID NO: 341167 - DNA, 25 bp, Mus musculus
gtgagcatgagttggatatacaacc

SEQ ID NO: 341168 - DNA, 25 bp, Mus musculus
gtgagcatgcaggctctgctctgac

SEQ ID NO: 341169 - DNA, 25 bp, Mus musculus
gtgagccaaggacaggctgagggta

SEQ ID NO: 341170 - DNA, 25 bp, Mus musculus
gtgagccaccagagagctgtgcctg

SEQ ID NO: 341171 - DNA, 25 bp, Mus musculus
gtgagccaccaggagaggaaacgag

SEQ ID NO: 341172 - DNA, 25 bp, Mus musculus
gtgagccacctaaggtgacaaaaga

SEQ ID NO: 341173 - DNA, 25 bp, Mus musculus
gtgagccaccttgtgtgtggaatgt

SEQ ID NO: 341174 - DNA, 25 bp, Mus musculus
gtgagccaggcatctatgttctgcg

SEQ ID NO: 341175 - DNA, 25 bp, Mus musculus
gtgagcccacagcaacctcaagccc

SEQ ID NO: 341176 - DNA, 25 bp, Mus musculus
gtgagcccacagccttctcatcatt

SEQ ID NO: 341177 - DNA, 25 bp, Mus musculus
gtgagccccagaccacctcatcctc

SEQ ID NO: 341178 - DNA, 25 bp, Mus musculus
gtgagccccaggtctgtctccgtgc

SEQ ID NO: 341179 - DNA, 25 bp, Mus musculus
gtgagccccgggaaggaaaagcgca

SEQ ID NO: 341180 - DNA, 25 bp, Mus musculus
gtgagccgagctcagccaaccccac

SEQ ID NO: 341181 - DNA, 25 bp, Mus musculus
gtgagcctagtactgccaaccccac

SEQ ID NO: 341182 - DNA, 25 bp, Mus musculus
gtgagcctagtactggaggagagtt

SEQ ID NO: 341183 - DNA, 25 bp, Mus musculus
gtgagcctcccgagcaccatcaatc

SEQ ID NO: 341184 - DNA, 25 bp, Mus musculus
gtgagcctggtcaggcagtccctcg

SEQ ID NO: 341185 - DNA, 25 bp, Mus musculus
gtgagcctggtcaggtgaaagcagc

SEQ ID NO: 341186 - DNA, 25 bp, Mus musculus
gtgagcgaaagactttactggaaag

SEQ ID NO: 341187 - DNA, 25 bp, Mus musculus
gtgagcgacgtggaggaggtattca

SEQ ID NO: 341188 - DNA, 25 bp, Mus musculus
gtgagcgactgcatcgtcaacgtgt

SEQ ID NO: 341189 - DNA, 25 bp, Mus musculus
gtgagcggagagtgaagtgtgtcag

SEQ ID NO: 341190 - DNA, 25 bp, Mus musculus
gtgagcggcctgagatccagagaca

SEQ ID NO: 341191 - DNA, 25 bp, Mus musculus
gtgagcgggggctgagtgtcagtgg

SEQ ID NO: 341192 - DNA, 25 bp, Mus musculus
gtgagcggtgagcgacatgtccttc

SEQ ID NO: 341193 - DNA, 25 bp, Mus musculus
gtgagcggtgagcgacgggccgcat

SEQ ID NO: 341194 - DNA, 25 bp, Mus musculus
gtgagctcagaccagatggccaagc

SEQ ID NO: 341195 - DNA, 25 bp, Mus musculus
gtgagctcatccaaggaggcgagta

SEQ ID NO: 341196 - DNA, 25 bp, Mus musculus
gtgagctcatccaagtcctaccagg

SEQ ID NO: 341197 - DNA, 25 bp, Mus musculus
gtgagctccagcacgatggagaata

SEQ ID NO: 341198 - DNA, 25 bp, Mus musculus
gtgagctgaagatcctagactttgg

SEQ ID NO: 341199 - DNA, 25 bp, Mus musculus
gtgagctgaaggacgagggccttgg

SEQ ID NO: 341200 - DNA, 25 bp, Mus musculus
gtgagctgcctgagcttcatgccct

SEQ ID NO: 341201 - DNA, 25 bp, Mus musculus
gtgagctggacgagaactacaatat

SEQ ID NO: 341202 - DNA, 25 bp, Mus musculus
gtgagctggaggcccctggcgaagg

SEQ ID NO: 341203 - DNA, 25 bp, Mus musculus
gtgagcttcaggaaaaacataaaca

SEQ ID NO: 341204 - DNA, 25 bp, Mus musculus
gtgagcttcaggttcatggacactt

SEQ ID NO: 341205 - DNA, 25 bp, Mus musculus
gtgagcttggcagactgtataacaa

SEQ ID NO: 341206 - DNA, 25 bp, Mus musculus
gtgagctttggagctgttggttttg

SEQ ID NO: 341207 - DNA, 25 bp, Mus musculus
gtgaggaacaaagacaaagccagtg

SEQ ID NO: 341208 - DNA, 25 bp, Mus musculus
gtgaggaaccccggaagcacaaata

SEQ ID NO: 341209 - DNA, 25 bp, Mus musculus
gtgaggaagttcgtggaagggtggc

SEQ ID NO: 341210 - DNA, 25 bp, Mus musculus
gtgaggacaagagtgtggaaaatgc

SEQ ID NO: 341211 - DNA, 25 bp, Mus musculus
gtgaggacacagagaagctcattgc

SEQ ID NO: 341212 - DNA, 25 bp, Mus musculus
gtgaggacacgagttgcattgtagt

SEQ ID NO: 341213 - DNA, 25 bp, Mus musculus
gtgaggacagaagatacaatggaga

SEQ ID NO: 341214 - DNA, 25 bp, Mus musculus
gtgaggacagcatccctggcaccat

SEQ ID NO: 341215 - DNA, 25 bp, Mus musculus
gtgaggacaggcttttgattgcagg

SEQ ID NO: 341216 - DNA, 25 bp, Mus musculus
gtgaggaccgcgaagaggatgaacc

SEQ ID NO: 341217 - DNA, 25 bp, Mus musculus
gtgaggaccgcgaaggtcatctaac

SEQ ID NO: 341218 - DNA, 25 bp, Mus musculus
gtgaggactatggcaggttcaccgg

SEQ ID NO: 341219 - DNA, 25 bp, Mus musculus
gtgaggactgcgggccttcatcaag

SEQ ID NO: 341220 - DNA, 25 bp, Mus musculus
gtgaggactgggttgactgtgggtt

SEQ ID NO: 341221 - DNA, 25 bp, Mus musculus
gtgaggagaatgtcccagaaatcct

SEQ ID NO: 341222 - DNA, 25 bp, Mus musculus
gtgaggagagacgtggagaaatggg

SEQ ID NO: 341223 - DNA, 25 bp, Mus musculus
gtgaggagagatcagtgttgaagat

SEQ ID NO: 341224 - DNA, 25 bp, Mus musculus
gtgaggagccggtccagattatctc

SEQ ID NO: 341225 - DNA, 25 bp, Mus musculus
gtgaggaggaagaaatggtccttct

SEQ ID NO: 341226 - DNA, 25 bp, Mus musculus
gtgaggaggatgaggatggtgggca

SEQ ID NO: 341227 - DNA, 25 bp, Mus musculus
gtgaggaggatgaggattttgattg

SEQ ID NO: 341228 - DNA, 25 bp, Mus musculus
gtgaggaggcctcagattttacatg

SEQ ID NO: 341229 - DNA, 25 bp, Mus musculus
gtgaggaggcctcagttcctggccc

SEQ ID NO: 341230 - DNA, 25 bp, Mus musculus
gtgaggagggagctgaggttttatc

SEQ ID NO: 341231 - DNA, 25 bp, Mus musculus
gtgaggagtaccaggagaccctgag

SEQ ID NO: 341232 - DNA, 25 bp, Mus musculus
gtgaggagtaccaggaggagctgga

SEQ ID NO: 341233 - DNA, 25 bp, Mus musculus
gtgaggatcaggttggtacacgatg

SEQ ID NO: 341234 - DNA, 25 bp, Mus musculus
gtgaggatgacactggacccccctt

SEQ ID NO: 341235 - DNA, 25 bp, Mus musculus
gtgaggattcgaaagaatagacttt

SEQ ID NO: 341236 - DNA, 25 bp, Mus musculus
gtgaggattcggacttctagatctg

SEQ ID NO: 341237 - DNA, 25 bp, Mus musculus
gtgaggattttaaagtggacatccc

SEQ ID NO: 341238 - DNA, 25 bp, Mus musculus
gtgaggcagaggtcccgtcaggaag

SEQ ID NO: 341239 - DNA, 25 bp, Mus musculus
gtgaggccacagtgtgtcagaaatc

SEQ ID NO: 341240 - DNA, 25 bp, Mus musculus
gtgaggccccagggcaactgggtga

SEQ ID NO: 341241 - DNA, 25 bp, Mus musculus
gtgaggcgcccaaagtctcaggggc

SEQ ID NO: 341242 - DNA, 25 bp, Mus musculus
gtgaggcggcagctgcagcagcctc

SEQ ID NO: 341243 - DNA, 25 bp, Mus musculus
gtgaggctagaaagaaggatttcgg

SEQ ID NO: 341244 - DNA, 25 bp, Mus musculus
gtgaggctgaagaggaagaagagct

SEQ ID NO: 341245 - DNA, 25 bp, Mus musculus
gtgaggctgctggaggtctctcctg

SEQ ID NO: 341246 - DNA, 25 bp, Mus musculus
gtgaggcttatcggaagaaatggaa

SEQ ID NO: 341247 - DNA, 25 bp, Mus musculus
gtgaggcttccagatggtcggcagt

SEQ ID NO: 341248 - DNA, 25 bp, Mus musculus
gtgagggatggcaggctcaaagact

SEQ ID NO: 341249 - DNA, 25 bp, Mus musculus
gtgagggcggcagcgtgcctgaaga

SEQ ID NO: 341250 - DNA, 25 bp, Mus musculus
gtgagggggaggtccaacacaatcc

SEQ ID NO: 341251 - DNA, 25 bp, Mus musculus
gtgaggggtgcaagaactgccccat

SEQ ID NO: 341252 - DNA, 25 bp, Mus musculus
gtgaggggtgcaagggcttcttccg

SEQ ID NO: 341253 - DNA, 25 bp, Mus musculus
gtgagggtgggattattagatttag

SEQ ID NO: 341254 - DNA, 25 bp, Mus musculus
gtgaggtacacaggcgcaggtctga

SEQ ID NO: 341255 - DNA, 25 bp, Mus musculus
gtgaggtacaggtgtcggctctgtc

SEQ ID NO: 341256 - DNA, 25 bp, Mus musculus
gtgaggtgcgacaggtaaatttaac

SEQ ID NO: 341257 - DNA, 25 bp, Mus musculus
gtgaggtgtgttgaggtcattgcaa

SEQ ID NO: 341258 - DNA, 25 bp, Mus musculus
gtgagtaaacaagaattcctcagag

SEQ ID NO: 341259 - DNA, 25 bp, Mus musculus
gtgagtaaacaagatctcgccctcc

SEQ ID NO: 341260 - DNA, 25 bp, Mus musculus
gtgagtacgccaggagtgagagaga

SEQ ID NO: 341261 - DNA, 25 bp, Mus musculus
gtgagtactccacgttgcaggatct

SEQ ID NO: 341262 - DNA, 25 bp, Mus musculus
gtgagtagagagggtcctgagtgat

SEQ ID NO: 341263 - DNA, 25 bp, Mus musculus
gtgagtagcaccaatgggcataggt

SEQ ID NO: 341264 - DNA, 25 bp, Mus musculus
gtgagtaggcaaggaccccatgact

SEQ ID NO: 341265 - DNA, 25 bp, Mus musculus
gtgagtcaaaggtcacatgctgctg

SEQ ID NO: 341266 - DNA, 25 bp, Mus musculus
gtgagtcctccccttcaaagctgtg

SEQ ID NO: 341267 - DNA, 25 bp, Mus musculus
gtgagtcgaaacattgtggatttca

SEQ ID NO: 341268 - DNA, 25 bp, Mus musculus
gtgagtcggcagggctctgagtcag

SEQ ID NO: 341269 - DNA, 25 bp, Mus musculus
gtgagtcggcagttgaaagtggggg

SEQ ID NO: 341270 - DNA, 25 bp, Mus musculus
gtgagtctggacaggtcacgctgga

SEQ ID NO: 341271 - DNA, 25 bp, Mus musculus
gtgagtgaagagctctgcagttttg

SEQ ID NO: 341272 - DNA, 25 bp, Mus musculus
gtgagtgaagatagtttaggtcaac

SEQ ID NO: 341273 - DNA, 25 bp, Mus musculus
gtgagtgaagatgatcgtaatactt

SEQ ID NO: 341274 - DNA, 25 bp, Mus musculus
gtgagtgacagagcctccaggtgag

SEQ ID NO: 341275 - DNA, 25 bp, Mus musculus
gtgagtgactccaggctgtccttgt

SEQ ID NO: 341276 - DNA, 25 bp, Mus musculus
gtgagtgagaaaggagacatggagt

SEQ ID NO: 341277 - DNA, 25 bp, Mus musculus
gtgagtgagaaaggggacagtcaaa

SEQ ID NO: 341278 - DNA, 25 bp, Mus musculus
gtgagtgagagccagtcgtttcagc

SEQ ID NO: 341279 - DNA, 25 bp, Mus musculus
gtgagtgagattccctgttctgcag

SEQ ID NO: 341280 - DNA, 25 bp, Mus musculus
gtgagtgatcagggcaccctcagat

SEQ ID NO: 341281 - DNA, 25 bp, Mus musculus
gtgagtgatggaggacttctgtgtg

SEQ ID NO: 341282 - DNA, 25 bp, Mus musculus
gtgagtgccaaggttcatatgggaa

SEQ ID NO: 341283 - DNA, 25 bp, Mus musculus
gtgagtgccagcgaatggctattca

SEQ ID NO: 341284 - DNA, 25 bp, Mus musculus
gtgagtgccaggtgatacttaaata

SEQ ID NO: 341285 - DNA, 25 bp, Mus musculus
gtgagtggaagaatcctcggctcct

SEQ ID NO: 341286 - DNA, 25 bp, Mus musculus
gtgagtggaaggcgagaactccact

SEQ ID NO: 341287 - DNA, 25 bp, Mus musculus
gtgagtggaaggggattttacagtt

SEQ ID NO: 341288 - DNA, 25 bp, Mus musculus
gtgagtggaggcgccactgcccaca

SEQ ID NO: 341289 - DNA, 25 bp, Mus musculus
gtgagtggcgttatatgaatactcg

SEQ ID NO: 341290 - DNA, 25 bp, Mus musculus
gtgagtggctggattcctatctact

SEQ ID NO: 341291 - DNA, 25 bp, Mus musculus
gtgagtgggggtaagggtggaatgt

SEQ ID NO: 341292 - DNA, 25 bp, Mus musculus
gtgagtgtgagagcccgctgtgagg

SEQ ID NO: 341293 - DNA, 25 bp, Mus musculus
gtgagtgtgtgtgtcagcggtctga

SEQ ID NO: 341294 - DNA, 25 bp, Mus musculus
gtgagttagagttccagttactatg

SEQ ID NO: 341295 - DNA, 25 bp, Mus musculus
gtgagttcagcgacattaaggcccg

SEQ ID NO: 341296 - DNA, 25 bp, Mus musculus
gtgagttcaggtactcagttcgtgt

SEQ ID NO: 341297 - DNA, 25 bp, Mus musculus
gtgagttcaggtggttgtggaggca

SEQ ID NO: 341298 - DNA, 25 bp, Mus musculus
gtgagttgcacggatgttctgagcc

SEQ ID NO: 341299 - DNA, 25 bp, Mus musculus
gtgagttgtcaggtaaagatgagcc

SEQ ID NO: 341300 - DNA, 25 bp, Mus musculus
gtgagtttcacaagtggatagagag

SEQ ID NO: 341301 - DNA, 25 bp, Mus musculus
gtgagtttcccccacttacagactg

SEQ ID NO: 341302 - DNA, 25 bp, Mus musculus
gtgagtttctatgccgatcaaaagg

SEQ ID NO: 341303 - DNA, 25 bp, Mus musculus
gtgagtttcttgtaatagggcccag

SEQ ID NO: 341304 - DNA, 25 bp, Mus musculus
gtgagtttttggagttagaacaaat

SEQ ID NO: 341305 - DNA, 25 bp, Mus musculus
gtgataaaaaataaggctcatccta

SEQ ID NO: 341306 - DNA, 25 bp, Mus musculus
gtgataaaaaggtgtcactctgcaa

SEQ ID NO: 341307 - DNA, 25 bp, Mus musculus
gtgataaaaagtctttttatgaact

SEQ ID NO: 341308 - DNA, 25 bp, Mus musculus
gtgataaaactggggttcgcaacgt

SEQ ID NO: 341309 - DNA, 25 bp, Mus musculus
gtgataaaactgggtggtcatatgc

SEQ ID NO: 341310 - DNA, 25 bp, Mus musculus
gtgataaaggagattgaggacggct

SEQ ID NO: 341311 - DNA, 25 bp, Mus musculus
gtgataaaggaggccttggaaatac

SEQ ID NO: 341312 - DNA, 25 bp, Mus musculus
gtgataacgaacggtaccatggttg

SEQ ID NO: 341313 - DNA, 25 bp, Mus musculus
gtgataacggatagacaggaaaatc

SEQ ID NO: 341314 - DNA, 25 bp, Mus musculus
gtgataagtcagatgaatgagaaca

SEQ ID NO: 341315 - DNA, 25 bp, Mus musculus
gtgataataaggacaaccggatcca

SEQ ID NO: 341316 - DNA, 25 bp, Mus musculus
gtgataataagtttctgagggtcag

SEQ ID NO: 341317 - DNA, 25 bp, Mus musculus
gtgatacacaagacatttcgacttt

SEQ ID NO: 341318 - DNA, 25 bp, Mus musculus
gtgatacagcaggtggggatgcgtc

SEQ ID NO: 341319 - DNA, 25 bp, Mus musculus
gtgataccagaccctgaagaagaaa

SEQ ID NO: 341320 - DNA, 25 bp, Mus musculus
gtgatacgcacagatcttgatatgg

SEQ ID NO: 341321 - DNA, 25 bp, Mus musculus
gtgatagaaaagcttggctttccca

SEQ ID NO: 341322 - DNA, 25 bp, Mus musculus
gtgatagggagttctgaggctctaa

SEQ ID NO: 341323 - DNA, 25 bp, Mus musculus
gtgatatacaggtggaatgacattg

SEQ ID NO: 341324 - DNA, 25 bp, Mus musculus
gtgatatcccagattttagaaagga

SEQ ID NO: 341325 - DNA, 25 bp, Mus musculus
gtgatatcccaggtccaaatatcac

SEQ ID NO: 341326 - DNA, 25 bp, Mus musculus
gtgatatgcacagtggcttctattt

SEQ ID NO: 341327 - DNA, 25 bp, Mus musculus
gtgatatttgctccgctttttgcaa

SEQ ID NO: 341328 - DNA, 25 bp, Mus musculus
gtgatcaaaggcattcctttggacc

SEQ ID NO: 341329 - DNA, 25 bp, Mus musculus
gtgatcaaagggtgaagtcggtgat

SEQ ID NO: 341330 - DNA, 25 bp, Mus musculus
gtgatcaaaggtatgagggtgctgg

SEQ ID NO: 341331 - DNA, 25 bp, Mus musculus
gtgatcaagcgagactccctccaac

SEQ ID NO: 341332 - DNA, 25 bp, Mus musculus
gtgatcaagcgagatggccgccaag

SEQ ID NO: 341333 - DNA, 25 bp, Mus musculus
gtgatcacaggattgctgctggaca

SEQ ID NO: 341334 - DNA, 25 bp, Mus musculus
gtgatcacaggcctgggcatgtgtt

SEQ ID NO: 341335 - DNA, 25 bp, Mus musculus
gtgatcacagggccaaaggcgacag

SEQ ID NO: 341336 - DNA, 25 bp, Mus musculus
gtgatcacgaagcacagctgtgacg

SEQ ID NO: 341337 - DNA, 25 bp, Mus musculus
gtgatcagcagctcgtgcctcctac

SEQ ID NO: 341338 - DNA, 25 bp, Mus musculus
gtgatcatcagccacttccacctgg

SEQ ID NO: 341339 - DNA, 25 bp, Mus musculus
gtgatcatcaggccatctgccccat

SEQ ID NO: 341340 - DNA, 25 bp, Mus musculus
gtgatcatctcattgctaagaatgt

SEQ ID NO: 341341 - DNA, 25 bp, Mus musculus
gtgatccacagagatgtgaagccat

SEQ ID NO: 341342 - DNA, 25 bp, Mus musculus
gtgatccagtgaggcctcaggtcca

SEQ ID NO: 341343 - DNA, 25 bp, Mus musculus
gtgatccccaagggtgtgctggctg

SEQ ID NO: 341344 - DNA, 25 bp, Mus musculus
gtgatccccaagtgcctggctgagc

SEQ ID NO: 341345 - DNA, 25 bp, Mus musculus
gtgatccgagatcgcctttgttttg

SEQ ID NO: 341346 - DNA, 25 bp, Mus musculus
gtgatccgcccagtgggggcaggag

SEQ ID NO: 341347 - DNA, 25 bp, Mus musculus
gtgatcctccgcaatgcacggctgt

SEQ ID NO: 341348 - DNA, 25 bp, Mus musculus
gtgatcgaggcatggccagtaatgt

SEQ ID NO: 341349 - DNA, 25 bp, Mus musculus
gtgatcgaggcatgggtgaacggcc

SEQ ID NO: 341350 - DNA, 25 bp, Mus musculus
gtgatcgatgccagaaagaagagct

SEQ ID NO: 341351 - DNA, 25 bp, Mus musculus
gtgatcgatgccagattttgcctca

SEQ ID NO: 341352 - DNA, 25 bp, Mus musculus
gtgatcgatgccaggtttcactttt

SEQ ID NO: 341353 - DNA, 25 bp, Mus musculus
gtgatcgctgggttcctgagactga

SEQ ID NO: 341354 - DNA, 25 bp, Mus musculus
gtgatcgctttctgaatggtttggc

SEQ ID NO: 341355 - DNA, 25 bp, Mus musculus
gtgatctactgctgagaagaggaga

SEQ ID NO: 341356 - DNA, 25 bp, Mus musculus
gtgatctactgtacagagctatcgt

SEQ ID NO: 341357 - DNA, 25 bp, Mus musculus
gtgatctcaagttggagaatttgat

SEQ ID NO: 341358 - DNA, 25 bp, Mus musculus
gtgatctcactcaggctcccatgtg

SEQ ID NO: 341359 - DNA, 25 bp, Mus musculus
gtgatctcagacgggtcacccttgt

SEQ ID NO: 341360 - DNA, 25 bp, Mus musculus
gtgatctcagccttgccggagcttg

SEQ ID NO: 341361 - DNA, 25 bp, Mus musculus
gtgatctccaatggactaaattcgg

SEQ ID NO: 341362 - DNA, 25 bp, Mus musculus
gtgatctctcaggtgccaacaggat

SEQ ID NO: 341363 - DNA, 25 bp, Mus musculus
gtgatctgaagcctggttccctcaa

SEQ ID NO: 341364 - DNA, 25 bp, Mus musculus
gtgatctgcaggaccagtccatgat

SEQ ID NO: 341365 - DNA, 25 bp, Mus musculus
gtgatctgtagcacccagttcttgc

SEQ ID NO: 341366 - DNA, 25 bp, Mus musculus
gtgatcttcagggggtgattagtgt

SEQ ID NO: 341367 - DNA, 25 bp, Mus musculus
gtgatcttctaaagttgattgaatc

SEQ ID NO: 341368 - DNA, 25 bp, Mus musculus
gtgatcttgataggatctgcttaaa

SEQ ID NO: 341369 - DNA, 25 bp, Mus musculus
gtgatcttggaggctggtccaggag

SEQ ID NO: 341370 - DNA, 25 bp, Mus musculus
gtgatgaaaactacatggaatttct

SEQ ID NO: 341371 - DNA, 25 bp, Mus musculus
gtgatgaaaagcttgttcggccagt

SEQ ID NO: 341372 - DNA, 25 bp, Mus musculus
gtgatgaaaaggaagtaccattggc

SEQ ID NO: 341373 - DNA, 25 bp, Mus musculus
gtgatgaaagggctgtgcctggctc

SEQ ID NO: 341374 - DNA, 25 bp, Mus musculus
gtgatgaaagtggctcagctcaaca

SEQ ID NO: 341375 - DNA, 25 bp, Mus musculus
gtgatgacaactacgaaagagcctg

SEQ ID NO: 341376 - DNA, 25 bp, Mus musculus
gtgatgacagaggacaaaggtgtgg

SEQ ID NO: 341377 - DNA, 25 bp, Mus musculus
gtgatgacaggaaattgtttactac

SEQ ID NO: 341378 - DNA, 25 bp, Mus musculus
gtgatgacagggtccaaggctgcag

SEQ ID NO: 341379 - DNA, 25 bp, Mus musculus
gtgatgacagtcacctctcctctct

SEQ ID NO: 341380 - DNA, 25 bp, Mus musculus
gtgatgaccaaggaggagcccctgc

SEQ ID NO: 341381 - DNA, 25 bp, Mus musculus
gtgatgactgataaacaagctggag

SEQ ID NO: 341382 - DNA, 25 bp, Mus musculus
gtgatgactgcccagtgtttccagg

SEQ ID NO: 341383 - DNA, 25 bp, Mus musculus
gtgatgagaggaagctttgtctcct

SEQ ID NO: 341384 - DNA, 25 bp, Mus musculus
gtgatgaggataaagaatgacagcc

SEQ ID NO: 341385 - DNA, 25 bp, Mus musculus
gtgatgaggatgaagatgatgagga

SEQ ID NO: 341386 - DNA, 25 bp, Mus musculus
gtgatgataagaacaaattggaaga

SEQ ID NO: 341387 - DNA, 25 bp, Mus musculus
gtgatgatccagaagcaacatggct

SEQ ID NO: 341388 - DNA, 25 bp, Mus musculus
gtgatgatgagcaggaaaagaagcc

SEQ ID NO: 341389 - DNA, 25 bp, Mus musculus
gtgatgatgtttttccctaggcagt

SEQ ID NO: 341390 - DNA, 25 bp, Mus musculus
gtgatgcactgaccctgcagttggg

SEQ ID NO: 341391 - DNA, 25 bp, Mus musculus
gtgatgcagagactgtgctgtatct

SEQ ID NO: 341392 - DNA, 25 bp, Mus musculus
gtgatgcaggagactgacggttctg

SEQ ID NO: 341393 - DNA, 25 bp, Mus musculus
gtgatgccatgaagccattttcagt

SEQ ID NO: 341394 - DNA, 25 bp, Mus musculus
gtgatgcgcaagggctacgagggcc

SEQ ID NO: 341395 - DNA, 25 bp, Mus musculus
gtgatgcgcaaggtatgaatgctgc

SEQ ID NO: 341396 - DNA, 25 bp, Mus musculus
gtgatgctacaggtaaagtcctttt

SEQ ID NO: 341397 - DNA, 25 bp, Mus musculus
gtgatgctcacagagaacagtacac

SEQ ID NO: 341398 - DNA, 25 bp, Mus musculus
gtgatgctcacaggaagttcattca

SEQ ID NO: 341399 - DNA, 25 bp, Mus musculus
gtgatgctgaccagcacgtaacttc

SEQ ID NO: 341400 - DNA, 25 bp, Mus musculus
gtgatgctgaccgagatccctgacg

SEQ ID NO: 341401 - DNA, 25 bp, Mus musculus
gtgatgctgcagaatatgtgtacat

SEQ ID NO: 341402 - DNA, 25 bp, Mus musculus
gtgatgctgcgaagctgatggtgcc

SEQ ID NO: 341403 - DNA, 25 bp, Mus musculus
gtgatgctgtccactttgatcttca

SEQ ID NO: 341404 - DNA, 25 bp, Mus musculus
gtgatgcttgcggaatgcagcccgc

SEQ ID NO: 341405 - DNA, 25 bp, Mus musculus
gtgatgcttgcgtgcaatgctcacc

SEQ ID NO: 341406 - DNA, 25 bp, Mus musculus
gtgatggaaagctgagcccaggaag

SEQ ID NO: 341407 - DNA, 25 bp, Mus musculus
gtgatggacaggtttttggtgcatt

SEQ ID NO: 341408 - DNA, 25 bp, Mus musculus
gtgatggagatgagaagaagccggg

SEQ ID NO: 341409 - DNA, 25 bp, Mus musculus
gtgatggagatgcgctccctccttt

SEQ ID NO: 341410 - DNA, 25 bp, Mus musculus
gtgatggagatggggtcctaaagga

SEQ ID NO: 341411 - DNA, 25 bp, Mus musculus
gtgatggagtcggctcttaaccggc

SEQ ID NO: 341412 - DNA, 25 bp, Mus musculus
gtgatggccaggcctagccaggtgt

SEQ ID NO: 341413 - DNA, 25 bp, Mus musculus
gtgatggcgactgttgccctctata

SEQ ID NO: 341414 - DNA, 25 bp, Mus musculus
gtgatgggaagcaggtacccacccg

SEQ ID NO: 341415 - DNA, 25 bp, Mus musculus
gtgatgggaaggtatggatgtattg

SEQ ID NO: 341416 - DNA, 25 bp, Mus musculus
gtgatggggcagaagaaactcttgg

SEQ ID NO: 341417 - DNA, 25 bp, Mus musculus
gtgatgggtagtgatgtaagcggta

SEQ ID NO: 341418 - DNA, 25 bp, Mus musculus
gtgatggtaaaaatactggctcgaa

SEQ ID NO: 341419 - DNA, 25 bp, Mus musculus
gtgatggtaagcttctctctaacag

SEQ ID NO: 341420 - DNA, 25 bp, Mus musculus
gtgatggtagacggggtattgaagg

SEQ ID NO: 341421 - DNA, 25 bp, Mus musculus
gtgatggtcaaggttgttcctacat

SEQ ID NO: 341422 - DNA, 25 bp, Mus musculus
gtgatggtcaggaagcctgctgcgt

SEQ ID NO: 341423 - DNA, 25 bp, Mus musculus
gtgatggtgaggtctagtgacagga

SEQ ID NO: 341424 - DNA, 25 bp, Mus musculus
gtgatggtgcacgcctctgcctccc

SEQ ID NO: 341425 - DNA, 25 bp, Mus musculus
gtgatggtgctcagggtacagcatg

SEQ ID NO: 341426 - DNA, 25 bp, Mus musculus
gtgatggttcctcagaaaatgaagt

SEQ ID NO: 341427 - DNA, 25 bp, Mus musculus
gtgatggttcctcagagccgagcaa

SEQ ID NO: 341428 - DNA, 25 bp, Mus musculus
gtgatgtacaagaaagggaagatga

SEQ ID NO: 341429 - DNA, 25 bp, Mus musculus
gtgatgtatcagggtaagacataca

SEQ ID NO: 341430 - DNA, 25 bp, Mus musculus
gtgatgtccatgaggcctgtcccag

SEQ ID NO: 341431 - DNA, 25 bp, Mus musculus
gtgatgtctatttggagtgtctaaa

SEQ ID NO: 341432 - DNA, 25 bp, Mus musculus
gtgatgtgtttggactcacacacga

SEQ ID NO: 341433 - DNA, 25 bp, Mus musculus
gtgatgtgtttggggaggcagatgc

SEQ ID NO: 341434 - DNA, 25 bp, Mus musculus
gtgattaaagccatcatgttaagga

SEQ ID NO: 341435 - DNA, 25 bp, Mus musculus
gtgattaataaccagctggttgatc

SEQ ID NO: 341436 - DNA, 25 bp, Mus musculus
gtgattacagagaattgtatttctt

SEQ ID NO: 341437 - DNA, 25 bp, Mus musculus
gtgattacagaggctttggtatagg

SEQ ID NO: 341438 - DNA, 25 bp, Mus musculus
gtgattacagaggttgccatgaagt

SEQ ID NO: 341439 - DNA, 25 bp, Mus musculus
gtgattactctgagagagtcagtcc

SEQ ID NO: 341440 - DNA, 25 bp, Mus musculus
gtgattactggataagaaaacttcc

SEQ ID NO: 341441 - DNA, 25 bp, Mus musculus
gtgattactttgagcgtcgagcaga

SEQ ID NO: 341442 - DNA, 25 bp, Mus musculus
gtgattactttgagtttgctggggg

SEQ ID NO: 341443 - DNA, 25 bp, Mus musculus
gtgattatagcaatcagcagagtgg

SEQ ID NO: 341444 - DNA, 25 bp, Mus musculus
gtgattatagtttcagagccatctg

SEQ ID NO: 341445 - DNA, 25 bp, Mus musculus
gtgattatcaggactagcggacatg

SEQ ID NO: 341446 - DNA, 25 bp, Mus musculus
gtgattatgtctgtcagaatctcca

SEQ ID NO: 341447 - DNA, 25 bp, Mus musculus
gtgattccaccagtggacagagggg

SEQ ID NO: 341448 - DNA, 25 bp, Mus musculus
gtgattccaggttcagtacctctcg

SEQ ID NO: 341449 - DNA, 25 bp, Mus musculus
gtgattctcaagctgggaagtcatc

SEQ ID NO: 341450 - DNA, 25 bp, Mus musculus
gtgattctcttgccattcattgaca

SEQ ID NO: 341451 - DNA, 25 bp, Mus musculus
gtgattctcttggattgttcatcac

SEQ ID NO: 341452 - DNA, 25 bp, Mus musculus
gtgattgacaaggttttacttgtaa

SEQ ID NO: 341453 - DNA, 25 bp, Mus musculus
gtgattgacagagactctttcaagc

SEQ ID NO: 341454 - DNA, 25 bp, Mus musculus
gtgattgacagagagccccttccaa

SEQ ID NO: 341455 - DNA, 25 bp, Mus musculus
gtgattgcgcaggccttcagaagta

SEQ ID NO: 341456 - DNA, 25 bp, Mus musculus
gtgattgctctaagaagctgatggt

SEQ ID NO: 341457 - DNA, 25 bp, Mus musculus
gtgattggaggcctgggagctgccc

SEQ ID NO: 341458 - DNA, 25 bp, Mus musculus
gtgattggtgcaggagaatttggag

SEQ ID NO: 341459 - DNA, 25 bp, Mus musculus
gtgattgtaagaatgaagatatcct

SEQ ID NO: 341460 - DNA, 25 bp, Mus musculus
gtgattgtaagcggacatcagaaaa

SEQ ID NO: 341461 - DNA, 25 bp, Mus musculus
gtgattgtaatctacttttttactt

SEQ ID NO: 341462 - DNA, 25 bp, Mus musculus
gtgattgtagctgaggttcgttcca

SEQ ID NO: 341463 - DNA, 25 bp, Mus musculus
gtgattgtcgagacgtgcgaccgca

SEQ ID NO: 341464 - DNA, 25 bp, Mus musculus
gtgattgtggtgacactgcaaatgg

SEQ ID NO: 341465 - DNA, 25 bp, Mus musculus
gtgatttaaaggatgacgagaaggt

SEQ ID NO: 341466 - DNA, 25 bp, Mus musculus
gtgatttacaggtggaaagctttcg

SEQ ID NO: 341467 - DNA, 25 bp, Mus musculus
gtgatttaggaatgttcttgggagt

SEQ ID NO: 341468 - DNA, 25 bp, Mus musculus
gtgatttatgacaaagatcagttca

SEQ ID NO: 341469 - DNA, 25 bp, Mus musculus
gtgatttcaattaaggtattaagtc

SEQ ID NO: 341470 - DNA, 25 bp, Mus musculus
gtgatttccagtccctgcagggctc

SEQ ID NO: 341471 - DNA, 25 bp, Mus musculus
gtgatttcctggattctcaggactc

SEQ ID NO: 341472 - DNA, 25 bp, Mus musculus
gtgatttgaaaatcgaatctctagg

SEQ ID NO: 341473 - DNA, 25 bp, Mus musculus
gtgatttgaaaatcgatcttctttc

SEQ ID NO: 341474 - DNA, 25 bp, Mus musculus
gtgatttgaaaatcggttagtcctt

SEQ ID NO: 341475 - DNA, 25 bp, Mus musculus
gtgatttgctgtcagaagctatccc

SEQ ID NO: 341476 - DNA, 25 bp, Mus musculus
gtgatttggagaggtacaactgatg

SEQ ID NO: 341477 - DNA, 25 bp, Mus musculus
gtgattttatgccagagatttcaga

SEQ ID NO: 341478 - DNA, 25 bp, Mus musculus
gtgattttcaggaaaagtgcaagaa

SEQ ID NO: 341479 - DNA, 25 bp, Mus musculus
gtgcaaaacagatggagaatagggc

SEQ ID NO: 341480 - DNA, 25 bp, Mus musculus
gtgcaaaacaggatatcctgtacct

SEQ ID NO: 341481 - DNA, 25 bp, Mus musculus
gtgcaaaattcagaatgggctgtat

SEQ ID NO: 341482 - DNA, 25 bp, Mus musculus
gtgcaaagaagtttacaattcctgg

SEQ ID NO: 341483 - DNA, 25 bp, Mus musculus
gtgcaaagaatggggtaaccataga

SEQ ID NO: 341484 - DNA, 25 bp, Mus musculus
gtgcaaagaggaaaacaccataatt

SEQ ID NO: 341485 - DNA, 25 bp, Mus musculus
gtgcaaagcagagacggtaacacgg

SEQ ID NO: 341486 - DNA, 25 bp, Mus musculus
gtgcaaagccacaagtgcctccaaa

SEQ ID NO: 341487 - DNA, 25 bp, Mus musculus
gtgcaaaggaggtgttttagctcac

SEQ ID NO: 341488 - DNA, 25 bp, Mus musculus
gtgcaaaggcctgaatcaggtctgc

SEQ ID NO: 341489 - DNA, 25 bp, Mus musculus
gtgcaaagttggtatatccaaagcc

SEQ ID NO: 341490 - DNA, 25 bp, Mus musculus
gtgcaaatcggggcggtgtgaatga

SEQ ID NO: 341491 - DNA, 25 bp, Mus musculus
gtgcaacacaagatttccacccaga

SEQ ID NO: 341492 - DNA, 25 bp, Mus musculus
gtgcaacacaaggctgtgtctctcc

SEQ ID NO: 341493 - DNA, 25 bp, Mus musculus
gtgcaacatcccagccaaagcaaaa

SEQ ID NO: 341494 - DNA, 25 bp, Mus musculus
gtgcaaccacagaaggttatagaag

SEQ ID NO: 341495 - DNA, 25 bp, Mus musculus
gtgcaaccacagggactggaaatgg

SEQ ID NO: 341496 - DNA, 25 bp, Mus musculus
gtgcaaccagacatccagaacccag

SEQ ID NO: 341497 - DNA, 25 bp, Mus musculus
gtgcaacccgtggcagtcaagctct

SEQ ID NO: 341498 - DNA, 25 bp, Mus musculus
gtgcaacctgcaccatgggcttggc

SEQ ID NO: 341499 - DNA, 25 bp, Mus musculus
gtgcaacggacaggagacctgaact

SEQ ID NO: 341500 - DNA, 25 bp, Mus musculus
gtgcaactacagccttgatgaccac

SEQ ID NO: 341501 - DNA, 25 bp, Mus musculus
gtgcaacttaccagacttggtggtt

SEQ ID NO: 341502 - DNA, 25 bp, Mus musculus
gtgcaacttaccaggtggatcccac

SEQ ID NO: 341503 - DNA, 25 bp, Mus musculus
gtgcaacttctagccctgctgtcct

SEQ ID NO: 341504 - DNA, 25 bp, Mus musculus
gtgcaagaaactggtcttttgtgtg

SEQ ID NO: 341505 - DNA, 25 bp, Mus musculus
gtgcaagagagaaagaatctggagg

SEQ ID NO: 341506 - DNA, 25 bp, Mus musculus
gtgcaagaggatgagatcgactggg

SEQ ID NO: 341507 - DNA, 25 bp, Mus musculus
gtgcaagaggcaagacctggggatc

SEQ ID NO: 341508 - DNA, 25 bp, Mus musculus
gtgcaagagtgagggtgatctgcaa

SEQ ID NO: 341509 - DNA, 25 bp, Mus musculus
gtgcaagcagagagagaagacgacg

SEQ ID NO: 341510 - DNA, 25 bp, Mus musculus
gtgcaagcaggttatgaggtgacgg

SEQ ID NO: 341511 - DNA, 25 bp, Mus musculus
gtgcaagcagttgcacgtttgtgat

SEQ ID NO: 341512 - DNA, 25 bp, Mus musculus
gtgcaagcattcagctccctgcccc

SEQ ID NO: 341513 - DNA, 25 bp, Mus musculus
gtgcaagccaaggtgaaacttcagc

SEQ ID NO: 341514 - DNA, 25 bp, Mus musculus
gtgcaagccaaggttacctctggaa

SEQ ID NO: 341515 - DNA, 25 bp, Mus musculus
gtgcaagccagccccaggtatggct

SEQ ID NO: 341516 - DNA, 25 bp, Mus musculus
gtgcaagccccaagaggatgattat

SEQ ID NO: 341517 - DNA, 25 bp, Mus musculus
gtgcaagccccatgtcactgccttc

SEQ ID NO: 341518 - DNA, 25 bp, Mus musculus
gtgcaaggaaatccggacatctatg

SEQ ID NO: 341519 - DNA, 25 bp, Mus musculus
gtgcaaggcctcgaaccgccgtccc

SEQ ID NO: 341520 - DNA, 25 bp, Mus musculus
gtgcaaggcctcgtcattgtgacag

SEQ ID NO: 341521 - DNA, 25 bp, Mus musculus
gtgcaagtctccaggtgctgctggg

SEQ ID NO: 341522 - DNA, 25 bp, Mus musculus
gtgcaagttcctatgtcacctccaa

SEQ ID NO: 341523 - DNA, 25 bp, Mus musculus
gtgcaatcacaggtggatacccttc

SEQ ID NO: 341524 - DNA, 25 bp, Mus musculus
gtgcaatccagcccttacagaggaa

SEQ ID NO: 341525 - DNA, 25 bp, Mus musculus
gtgcaatccaggtcctggaatcctg

SEQ ID NO: 341526 - DNA, 25 bp, Mus musculus
gtgcaatgagggctggagtggcaaa

SEQ ID NO: 341527 - DNA, 25 bp, Mus musculus
gtgcaatgcaggacagtggtgacta

SEQ ID NO: 341528 - DNA, 25 bp, Mus musculus
gtgcaatgcagtccgtggtggatga

SEQ ID NO: 341529 - DNA, 25 bp, Mus musculus
gtgcaatggcaggtgctgacctgag

SEQ ID NO: 341530 - DNA, 25 bp, Mus musculus
gtgcaattagagaaagataagggcc

SEQ ID NO: 341531 - DNA, 25 bp, Mus musculus
gtgcaattaggcgtgcagccggcag

SEQ ID NO: 341532 - DNA, 25 bp, Mus musculus
gtgcacaaagatagttttgagatag

SEQ ID NO: 341533 - DNA, 25 bp, Mus musculus
gtgcacaaagcactgtgtgaagaga

SEQ ID NO: 341534 - DNA, 25 bp, Mus musculus
gtgcacaagccagggcccatcactc

SEQ ID NO: 341535 - DNA, 25 bp, Mus musculus
gtgcacaaggtgggccgagacatct

SEQ ID NO: 341536 - DNA, 25 bp, Mus musculus
gtgcacaatcctgagaggaagatcc

SEQ ID NO: 341537 - DNA, 25 bp, Mus musculus
gtgcacaatcctgaggtgaagagga

SEQ ID NO: 341538 - DNA, 25 bp, Mus musculus
gtgcacacaaaagcaaatcactgaa

SEQ ID NO: 341539 - DNA, 25 bp, Mus musculus
gtgcacagaacctcgttgccattcc

SEQ ID NO: 341540 - DNA, 25 bp, Mus musculus
gtgcacagaccaggtgattgtgcag

SEQ ID NO: 341541 - DNA, 25 bp, Mus musculus
gtgcacagatgtcaggagccctgtc

SEQ ID NO: 341542 - DNA, 25 bp, Mus musculus
gtgcacagatgtcagggttgtacct

SEQ ID NO: 341543 - DNA, 25 bp, Mus musculus
gtgcacagatgtcaggtttatgcgc

SEQ ID NO: 341544 - DNA, 25 bp, Mus musculus
gtgcacagatgtcagtcatcttcct

SEQ ID NO: 341545 - DNA, 25 bp, Mus musculus
gtgcacagcagaggcagacaggcac

SEQ ID NO: 341546 - DNA, 25 bp, Mus musculus
gtgcacagctggtatgcatggacca

SEQ ID NO: 341547 - DNA, 25 bp, Mus musculus
gtgcacagtggatgttcctccattt

SEQ ID NO: 341548 - DNA, 25 bp, Mus musculus
gtgcacatccgagatgatgggcgtc

SEQ ID NO: 341549 - DNA, 25 bp, Mus musculus
gtgcacatcctccggactctaatga

SEQ ID NO: 341550 - DNA, 25 bp, Mus musculus
gtgcacatgccaggggatgccccat

SEQ ID NO: 341551 - DNA, 25 bp, Mus musculus
gtgcacatggaccagttggaggtgg

SEQ ID NO: 341552 - DNA, 25 bp, Mus musculus
gtgcacattcaggagtgtgttccag

SEQ ID NO: 341553 - DNA, 25 bp, Mus musculus
gtgcaccaaacaggaccagagtttg

SEQ ID NO: 341554 - DNA, 25 bp, Mus musculus
gtgcaccaaacccagctgtgttccg

SEQ ID NO: 341555 - DNA, 25 bp, Mus musculus
gtgcaccaaacggttgcagacccct

SEQ ID NO: 341556 - DNA, 25 bp, Mus musculus
gtgcaccaaagaccgtggggcagtt

SEQ ID NO: 341557 - DNA, 25 bp, Mus musculus
gtgcaccaagaagctgcagcaatac

SEQ ID NO: 341558 - DNA, 25 bp, Mus musculus
gtgcaccacgagatgtgtgttaaag

SEQ ID NO: 341559 - DNA, 25 bp, Mus musculus
gtgcaccacgaggatcagaacttat

SEQ ID NO: 341560 - DNA, 25 bp, Mus musculus
gtgcaccagcaagctgagttcctac

SEQ ID NO: 341561 - DNA, 25 bp, Mus musculus
gtgcaccagcatttggtataggagg

SEQ ID NO: 341562 - DNA, 25 bp, Mus musculus
gtgcacccagaaaacgaagagatgg

SEQ ID NO: 341563 - DNA, 25 bp, Mus musculus
gtgcacccagaaatgtatgagcttt

SEQ ID NO: 341564 - DNA, 25 bp, Mus musculus
gtgcacccaggggggaagccctata

SEQ ID NO: 341565 - DNA, 25 bp, Mus musculus
gtgcaccctggaacagcttcagaga

SEQ ID NO: 341566 - DNA, 25 bp, Mus musculus
gtgcacctaatgccacagagcaaca

SEQ ID NO: 341567 - DNA, 25 bp, Mus musculus
gtgcacctcagctttgtgcgctctg

SEQ ID NO: 341568 - DNA, 25 bp, Mus musculus
gtgcacgcggtcagaactgtgccgg

SEQ ID NO: 341569 - DNA, 25 bp, Mus musculus
gtgcacggcaacagatttctttctt

SEQ ID NO: 341570 - DNA, 25 bp, Mus musculus
gtgcacggcaacaggcctgatggga

SEQ ID NO: 341571 - DNA, 25 bp, Mus musculus
gtgcacggcactgccactgattcca

SEQ ID NO: 341572 - DNA, 25 bp, Mus musculus
gtgcactagcgggacttggtgagta

SEQ ID NO: 341573 - DNA, 25 bp, Mus musculus
gtgcactagcggtctcaaaagattc

SEQ ID NO: 341574 - DNA, 25 bp, Mus musculus
gtgcactatgagtctacctgaagga

SEQ ID NO: 341575 - DNA, 25 bp, Mus musculus
gtgcactcagacagatggtgcagag

SEQ ID NO: 341576 - DNA, 25 bp, Mus musculus
gtgcactcagccatagattgtaagc

SEQ ID NO: 341577 - DNA, 25 bp, Mus musculus
gtgcactcagggtggcacaagactt

SEQ ID NO: 341578 - DNA, 25 bp, Mus musculus
gtgcactcaggtcctcattcctagg

SEQ ID NO: 341579 - DNA, 25 bp, Mus musculus
gtgcactctcagctgagcagcaaga

SEQ ID NO: 341580 - DNA, 25 bp, Mus musculus
gtgcactctcagctgctttgctgct

SEQ ID NO: 341581 - DNA, 25 bp, Mus musculus
gtgcactgagtaggcagaaaacttc

SEQ ID NO: 341582 - DNA, 25 bp, Mus musculus
gtgcactgcaaagctggaatgaagt

SEQ ID NO: 341583 - DNA, 25 bp, Mus musculus
gtgcactggagatggcagtgctgga

SEQ ID NO: 341584 - DNA, 25 bp, Mus musculus
gtgcactggaggttccaataccaac

SEQ ID NO: 341585 - DNA, 25 bp, Mus musculus
gtgcacttagcatgatgacttgctc

SEQ ID NO: 341586 - DNA, 25 bp, Mus musculus
gtgcagaaagagctcagggactgca

SEQ ID NO: 341587 - DNA, 25 bp, Mus musculus
gtgcagaaattgaagagagagaagc

SEQ ID NO: 341588 - DNA, 25 bp, Mus musculus
gtgcagaacagagcctacttccagc

SEQ ID NO: 341589 - DNA, 25 bp, Mus musculus
gtgcagaagcagaaagaagaagaag

SEQ ID NO: 341590 - DNA, 25 bp, Mus musculus
gtgcagaaggagctcaggggctgga

SEQ ID NO: 341591 - DNA, 25 bp, Mus musculus
gtgcagaatgtctcacagatctttg

SEQ ID NO: 341592 - DNA, 25 bp, Mus musculus
gtgcagacacagatgacgctcctgt

SEQ ID NO: 341593 - DNA, 25 bp, Mus musculus
gtgcagacagaacggtcattgatta

SEQ ID NO: 341594 - DNA, 25 bp, Mus musculus
gtgcagacagcccctgcaggaacaa

SEQ ID NO: 341595 - DNA, 25 bp, Mus musculus
gtgcagacatttatggtggttatgc

SEQ ID NO: 341596 - DNA, 25 bp, Mus musculus
gtgcagacctcaccgacacactgga

SEQ ID NO: 341597 - DNA, 25 bp, Mus musculus
gtgcagacctcaccttcctcacagg

SEQ ID NO: 341598 - DNA, 25 bp, Mus musculus
gtgcagacgtagagggatttaaaga

SEQ ID NO: 341599 - DNA, 25 bp, Mus musculus
gtgcagactctgtccagccagctgg

SEQ ID NO: 341600 - DNA, 25 bp, Mus musculus
gtgcagactggcccttcaaattggc

SEQ ID NO: 341601 - DNA, 25 bp, Mus musculus
gtgcagagactgtgagcaaagaaaa

SEQ ID NO: 341602 - DNA, 25 bp, Mus musculus
gtgcagagacttcttccctaggaaa

SEQ ID NO: 341603 - DNA, 25 bp, Mus musculus
gtgcagagcagatctggtggccctc

SEQ ID NO: 341604 - DNA, 25 bp, Mus musculus
gtgcagagctgtaaggccgtggcag

SEQ ID NO: 341605 - DNA, 25 bp, Mus musculus
gtgcagaggagaacgcggtgtgtga

SEQ ID NO: 341606 - DNA, 25 bp, Mus musculus
gtgcagaggctgacaggcggaactt

SEQ ID NO: 341607 - DNA, 25 bp, Mus musculus
gtgcagagtctgtgcggtgaccaca

SEQ ID NO: 341608 - DNA, 25 bp, Mus musculus
gtgcagagtgctgatcagggcactg

SEQ ID NO: 341609 - DNA, 25 bp, Mus musculus
gtgcagagtggcatggaaggtgaag

SEQ ID NO: 341610 - DNA, 25 bp, Mus musculus
gtgcagagtgtacaccgaccctagg

SEQ ID NO: 341611 - DNA, 25 bp, Mus musculus
gtgcagagtgtacagcgaccctagg

SEQ ID NO: 341612 - DNA, 25 bp, Mus musculus
gtgcagcaacaaggcgggaggaagc

SEQ ID NO: 341613 - DNA, 25 bp, Mus musculus
gtgcagcacagggggcagtgcccaa

SEQ ID NO: 341614 - DNA, 25 bp, Mus musculus
gtgcagcagcaggaggtgtatggtg

SEQ ID NO: 341615 - DNA, 25 bp, Mus musculus
gtgcagcagcagttgcaacaacctc

SEQ ID NO: 341616 - DNA, 25 bp, Mus musculus
gtgcagcaggctctattcccaactt

SEQ ID NO: 341617 - DNA, 25 bp, Mus musculus
gtgcagcaggctcttgcatcccctc

SEQ ID NO: 341618 - DNA, 25 bp, Mus musculus
gtgcagcatgagaatggctatgcaa

SEQ ID NO: 341619 - DNA, 25 bp, Mus musculus
gtgcagcatgcttttcccagtcatt

SEQ ID NO: 341620 - DNA, 25 bp, Mus musculus
gtgcagccaagaagtccaggaagaa

SEQ ID NO: 341621 - DNA, 25 bp, Mus musculus
gtgcagccagatggagtggccggac

SEQ ID NO: 341622 - DNA, 25 bp, Mus musculus
gtgcagccagcagcatgtgtttcag

SEQ ID NO: 341623 - DNA, 25 bp, Mus musculus
gtgcagcccagagaagagtttagcg

SEQ ID NO: 341624 - DNA, 25 bp, Mus musculus
gtgcagcccagtggtatgacctgat

SEQ ID NO: 341625 - DNA, 25 bp, Mus musculus
gtgcagcccgagggatgagtttgtg

SEQ ID NO: 341626 - DNA, 25 bp, Mus musculus
gtgcagccgctaccccggaagacca

SEQ ID NO: 341627 - DNA, 25 bp, Mus musculus
gtgcagccgctacgaccccatccct

SEQ ID NO: 341628 - DNA, 25 bp, Mus musculus
gtgcagcctcagccaagttgaagtt

SEQ ID NO: 341629 - DNA, 25 bp, Mus musculus
gtgcagcctgtaagcccagcactat

SEQ ID NO: 341630 - DNA, 25 bp, Mus musculus
gtgcagcctgtaagcccagcatgtg

SEQ ID NO: 341631 - DNA, 25 bp, Mus musculus
gtgcagcctgtaagttcttgcagat

SEQ ID NO: 341632 - DNA, 25 bp, Mus musculus
gtgcagcgacggatcgaagcctgtt

SEQ ID NO: 341633 - DNA, 25 bp, Mus musculus
gtgcagcgaggagggctaccagttc

SEQ ID NO: 341634 - DNA, 25 bp, Mus musculus
gtgcagcgatcaggtaatagtgcag

SEQ ID NO: 341635 - DNA, 25 bp, Mus musculus
gtgcagcgcctggagcatgcagcca

SEQ ID NO: 341636 - DNA, 25 bp, Mus musculus
gtgcagcgcggcgaaagaaagatca

SEQ ID NO: 341637 - DNA, 25 bp, Mus musculus
gtgcagcgctccggtggaatgaacc

SEQ ID NO: 341638 - DNA, 25 bp, Mus musculus
gtgcagcggaagggcgtgtggaatg

SEQ ID NO: 341639 - DNA, 25 bp, Mus musculus
gtgcagcgggagggcagcagagctt

SEQ ID NO: 341640 - DNA, 25 bp, Mus musculus
gtgcagctagaagggaagtctcagc

SEQ ID NO: 341641 - DNA, 25 bp, Mus musculus
gtgcagctcagtcactcagctgcag

SEQ ID NO: 341642 - DNA, 25 bp, Mus musculus
gtgcagctctccagtgtggatgcca

SEQ ID NO: 341643 - DNA, 25 bp, Mus musculus
gtgcagctgaggagcagctgccttc

SEQ ID NO: 341644 - DNA, 25 bp, Mus musculus
gtgcagctgcgaggctctacacaga

SEQ ID NO: 341645 - DNA, 25 bp, Mus musculus
gtgcagcttcaggaccacagccact

SEQ ID NO: 341646 - DNA, 25 bp, Mus musculus
gtgcagcttgagtagcttatctaca

SEQ ID NO: 341647 - DNA, 25 bp, Mus musculus
gtgcagcttggagtggatttgtcta

SEQ ID NO: 341648 - DNA, 25 bp, Mus musculus
gtgcagctttgttgagaaggagcgc

SEQ ID NO: 341649 - DNA, 25 bp, Mus musculus
gtgcaggaaaacattgctgatagcc

SEQ ID NO: 341650 - DNA, 25 bp, Mus musculus
gtgcaggaaagacatggaaggcctc

SEQ ID NO: 341651 - DNA, 25 bp, Mus musculus
gtgcaggaaagatggccctgcatgc

SEQ ID NO: 341652 - DNA, 25 bp, Mus musculus
gtgcaggaagaacagaggcgtgaga

SEQ ID NO: 341653 - DNA, 25 bp, Mus musculus
gtgcaggaaggtgtgaaacagaaga

SEQ ID NO: 341654 - DNA, 25 bp, Mus musculus
gtgcaggacagctgtggagctggcc

SEQ ID NO: 341655 - DNA, 25 bp, Mus musculus
gtgcaggactgaggaagccagcttt

SEQ ID NO: 341656 - DNA, 25 bp, Mus musculus
gtgcaggactgaggtcctctttcag

SEQ ID NO: 341657 - DNA, 25 bp, Mus musculus
gtgcaggactgggctacacagagaa

SEQ ID NO: 341658 - DNA, 25 bp, Mus musculus
gtgcaggactgggctacgcagatca

SEQ ID NO: 341659 - DNA, 25 bp, Mus musculus
gtgcaggagatcagggtctgatgtt

SEQ ID NO: 341660 - DNA, 25 bp, Mus musculus
gtgcaggagcagcctgagagggact

SEQ ID NO: 341661 - DNA, 25 bp, Mus musculus
gtgcaggaggctcaggattcagact

SEQ ID NO: 341662 - DNA, 25 bp, Mus musculus
gtgcaggagtacaagagccagatga

SEQ ID NO: 341663 - DNA, 25 bp, Mus musculus
gtgcaggagtacaaggccaagctac

SEQ ID NO: 341664 - DNA, 25 bp, Mus musculus
gtgcaggatgcaggtcaactgaagc

SEQ ID NO: 341665 - DNA, 25 bp, Mus musculus
gtgcaggcatgacaggagctggaga

SEQ ID NO: 341666 - DNA, 25 bp, Mus musculus
gtgcaggctccagaatggagctgcg

SEQ ID NO: 341667 - DNA, 25 bp, Mus musculus
gtgcaggctccaggtacacctggtg

SEQ ID NO: 341668 - DNA, 25 bp, Mus musculus
gtgcaggctgactttttggggtttg

SEQ ID NO: 341669 - DNA, 25 bp, Mus musculus
gtgcaggctggttaccatggcatct

SEQ ID NO: 341670 - DNA, 25 bp, Mus musculus
gtgcagggctggaagccattcagtt

SEQ ID NO: 341671 - DNA, 25 bp, Mus musculus
gtgcaggggcaagctggacccccaa

SEQ ID NO: 341672 - DNA, 25 bp, Mus musculus
gtgcagggtgtggtgtgtcctctgg

SEQ ID NO: 341673 - DNA, 25 bp, Mus musculus
gtgcaggtgagccaggcaccttttg

SEQ ID NO: 341674 - DNA, 25 bp, Mus musculus
gtgcagtaagaaggaattagaaagt

SEQ ID NO: 341675 - DNA, 25 bp, Mus musculus
gtgcagtaagaaggaggataaaatt

SEQ ID NO: 341676 - DNA, 25 bp, Mus musculus
gtgcagtaagtctggagccaattaa

SEQ ID NO: 341677 - DNA, 25 bp, Mus musculus
gtgcagtacaaagagtacttttgag

SEQ ID NO: 341678 - DNA, 25 bp, Mus musculus
gtgcagtatgatctgaagagtgcaa

SEQ ID NO: 341679 - DNA, 25 bp, Mus musculus
gtgcagtcacaggtggataccctcc

SEQ ID NO: 341680 - DNA, 25 bp, Mus musculus
gtgcagtcaccgccaccccgggacc

SEQ ID NO: 341681 - DNA, 25 bp, Mus musculus
gtgcagtcaccgccggcccagtgct

SEQ ID NO: 341682 - DNA, 25 bp, Mus musculus
gtgcagtcaccgcctaatagggccc

SEQ ID NO: 341683 - DNA, 25 bp, Mus musculus
gtgcagtcgcagcagaaactggagg

SEQ ID NO: 341684 - DNA, 25 bp, Mus musculus
gtgcagtcgcagcagctaacagaga

SEQ ID NO: 341685 - DNA, 25 bp, Mus musculus
gtgcagtgaccagaacatcaaactg

SEQ ID NO: 341686 - DNA, 25 bp, Mus musculus
gtgcagtgaccagggtgccacaact

SEQ ID NO: 341687 - DNA, 25 bp, Mus musculus
gtgcagtgactcagacatggaaacc

SEQ ID NO: 341688 - DNA, 25 bp, Mus musculus
gtgcagtgactcagctattcgtctt

SEQ ID NO: 341689 - DNA, 25 bp, Mus musculus
gtgcagtggagctccgcgtgagtcg

SEQ ID NO: 341690 - DNA, 25 bp, Mus musculus
gtgcagtggcccagctgctgtcaac

SEQ ID NO: 341691 - DNA, 25 bp, Mus musculus
gtgcagttaaagctccctcttgatg

SEQ ID NO: 341692 - DNA, 25 bp, Mus musculus
gtgcagttaaaggatggttcctatc

SEQ ID NO: 341693 - DNA, 25 bp, Mus musculus
gtgcagttatatggtggtgacgtat

SEQ ID NO: 341694 - DNA, 25 bp, Mus musculus
gtgcagttcaagcaaatggtattca

SEQ ID NO: 341695 - DNA, 25 bp, Mus musculus
gtgcatagtttagggtgtctagccc

SEQ ID NO: 341696 - DNA, 25 bp, Mus musculus
gtgcatatgtggcaaagtttataaa

SEQ ID NO: 341697 - DNA, 25 bp, Mus musculus
gtgcatattcagggtgacggcctct

SEQ ID NO: 341698 - DNA, 25 bp, Mus musculus
gtgcatcaaacaagttgatcaagag

SEQ ID NO: 341699 - DNA, 25 bp, Mus musculus
gtgcatcaaacagtatgaagaagaa

SEQ ID NO: 341700 - DNA, 25 bp, Mus musculus
gtgcatcacacgatttgtgaaaaca

SEQ ID NO: 341701 - DNA, 25 bp, Mus musculus
gtgcatcacacggctcattcaccta

SEQ ID NO: 341702 - DNA, 25 bp, Mus musculus
gtgcatcatcaatccaaacatctgt

SEQ ID NO: 341703 - DNA, 25 bp, Mus musculus
gtgcatcattcaggtttttcctgat

SEQ ID NO: 341704 - DNA, 25 bp, Mus musculus
gtgcatccacaccgccgtgacgtct

SEQ ID NO: 341705 - DNA, 25 bp, Mus musculus
gtgcatccacaccgcttgcttgggt

SEQ ID NO: 341706 - DNA, 25 bp, Mus musculus
gtgcatccatgcagtattcaagaga

SEQ ID NO: 341707 - DNA, 25 bp, Mus musculus
gtgcatccgtaagggcaccagcgtc

SEQ ID NO: 341708 - DNA, 25 bp, Mus musculus
gtgcatcggaggtcaccttcgtctc

SEQ ID NO: 341709 - DNA, 25 bp, Mus musculus
gtgcatctccaggtcccacctgctc

SEQ ID NO: 341710 - DNA, 25 bp, Mus musculus
gtgcatctggagaccaggttctctg

SEQ ID NO: 341711 - DNA, 25 bp, Mus musculus
gtgcatgaaaggccgcaccatgtat

SEQ ID NO: 341712 - DNA, 25 bp, Mus musculus
gtgcatgaaaggcctgacaagatca

SEQ ID NO: 341713 - DNA, 25 bp, Mus musculus
gtgcatgaagacataccgacgcttg

SEQ ID NO: 341714 - DNA, 25 bp, Mus musculus
gtgcatgccatgacccccgaggctg

SEQ ID NO: 341715 - DNA, 25 bp, Mus musculus
gtgcatgctagatgtgaaacatttt

SEQ ID NO: 341716 - DNA, 25 bp, Mus musculus
gtgcatgctagcttggccgacagga

SEQ ID NO: 341717 - DNA, 25 bp, Mus musculus
gtgcatgctggatctctcgtctgct

SEQ ID NO: 341718 - DNA, 25 bp, Mus musculus
gtgcatgctgggatagctcaggttt

SEQ ID NO: 341719 - DNA, 25 bp, Mus musculus
gtgcatgtctcagagcttggatctg

SEQ ID NO: 341720 - DNA, 25 bp, Mus musculus
gtgcatgtgacagacctcactcaca

SEQ ID NO: 341721 - DNA, 25 bp, Mus musculus
gtgcatgtgacagataattcacaga

SEQ ID NO: 341722 - DNA, 25 bp, Mus musculus
gtgcatgttcttggaaacctgatat

SEQ ID NO: 341723 - DNA, 25 bp, Mus musculus
gtgcattagaaaagaatctaaaggg

SEQ ID NO: 341724 - DNA, 25 bp, Mus musculus
gtgcattagtgggtttgatgaccct

SEQ ID NO: 341725 - DNA, 25 bp, Mus musculus
gtgcattctgggtttctggttagct

SEQ ID NO: 341726 - DNA, 25 bp, Mus musculus
gtgcattgagaaagaagtcaacaaa

SEQ ID NO: 341727 - DNA, 25 bp, Mus musculus
gtgcattgagagctgtctgtctagg

SEQ ID NO: 341728 - DNA, 25 bp, Mus musculus
gtgcattgccaaggcgttcgtgcct

SEQ ID NO: 341729 - DNA, 25 bp, Mus musculus
gtgcattgccatggaccgctccttt

SEQ ID NO: 341730 - DNA, 25 bp, Mus musculus
gtgcattggacagattgtccttctg

SEQ ID NO: 341731 - DNA, 25 bp, Mus musculus
gtgccaaaagaattcagaaggagct

SEQ ID NO: 341732 - DNA, 25 bp, Mus musculus
gtgccaaaagtgctggacccaaagg

SEQ ID NO: 341733 - DNA, 25 bp, Mus musculus
gtgccaaaataatgacaccattcta

SEQ ID NO: 341734 - DNA, 25 bp, Mus musculus
gtgccaaatggcccagcaaggaccc

SEQ ID NO: 341735 - DNA, 25 bp, Mus musculus
gtgccaacaaggcagagatggagtt

SEQ ID NO: 341736 - DNA, 25 bp, Mus musculus
gtgccaacatggccatcctggacat

SEQ ID NO: 341737 - DNA, 25 bp, Mus musculus
gtgccaactgcgggaaggagctaac

SEQ ID NO: 341738 - DNA, 25 bp, Mus musculus
gtgccaagaagggttgagattgaga

SEQ ID NO: 341739 - DNA, 25 bp, Mus musculus
gtgccaagagggagctccgctttgg

SEQ ID NO: 341740 - DNA, 25 bp, Mus musculus
gtgccaagcaggcagctgtgttaat

SEQ ID NO: 341741 - DNA, 25 bp, Mus musculus
gtgccaagcgaagagacagggcagg

SEQ ID NO: 341742 - DNA, 25 bp, Mus musculus
gtgccaagctcatggccagggcatt

SEQ ID NO: 341743 - DNA, 25 bp, Mus musculus
gtgccaagctcatgggccctgcacc

SEQ ID NO: 341744 - DNA, 25 bp, Mus musculus
gtgccaagctcatgggtacttccgc

SEQ ID NO: 341745 - DNA, 25 bp, Mus musculus
gtgccaaggctgccgctctggccca

SEQ ID NO: 341746 - DNA, 25 bp, Mus musculus
gtgccaatattttcgagcattactg

SEQ ID NO: 341747 - DNA, 25 bp, Mus musculus
gtgccaatgaagaatctggtccagg

SEQ ID NO: 341748 - DNA, 25 bp, Mus musculus
gtgccaatgaagaccctggtctttt

SEQ ID NO: 341749 - DNA, 25 bp, Mus musculus
gtgccaatgccatgctggtgccagt

SEQ ID NO: 341750 - DNA, 25 bp, Mus musculus
gtgccaatgcgcttaagaaaatcag

SEQ ID NO: 341751 - DNA, 25 bp, Mus musculus
gtgccaatgcgtgcatgtcctgcag

SEQ ID NO: 341752 - DNA, 25 bp, Mus musculus
gtgccaattcccttggatttcagtt

SEQ ID NO: 341753 - DNA, 25 bp, Mus musculus
gtgccaatttgggcaccctaagatg

SEQ ID NO: 341754 - DNA, 25 bp, Mus musculus
gtgccaatttgggcactgcagcctg

SEQ ID NO: 341755 - DNA, 25 bp, Mus musculus
gtgccacaaacaaaagtgtttacaa

SEQ ID NO: 341756 - DNA, 25 bp, Mus musculus
gtgccacaaaggaacctacttggtg

SEQ ID NO: 341757 - DNA, 25 bp, Mus musculus
gtgccacaaaggtagctacttggtg

SEQ ID NO: 341758 - DNA, 25 bp, Mus musculus
gtgccacaaatgaaggagcccattg

SEQ ID NO: 341759 - DNA, 25 bp, Mus musculus
gtgccacaaggagagaactgcccag

SEQ ID NO: 341760 - DNA, 25 bp, Mus musculus
gtgccacacagatgctggagagcat

SEQ ID NO: 341761 - DNA, 25 bp, Mus musculus
gtgccacacgagaccctggctgggc

SEQ ID NO: 341762 - DNA, 25 bp, Mus musculus
gtgccacagctcctccctggcccat

SEQ ID NO: 341763 - DNA, 25 bp, Mus musculus
gtgccacagtgaaaaaagcaactat

SEQ ID NO: 341764 - DNA, 25 bp, Mus musculus
gtgccacagtgaaggagcagattat

SEQ ID NO: 341765 - DNA, 25 bp, Mus musculus
gtgccaccacacccgagcagtatat

SEQ ID NO: 341766 - DNA, 25 bp, Mus musculus
gtgccaccaggatccaagcctattg

SEQ ID NO: 341767 - DNA, 25 bp, Mus musculus
gtgccacccatgctttctggatcat

SEQ ID NO: 341768 - DNA, 25 bp, Mus musculus
gtgccacccgacagggccgcagcct

SEQ ID NO: 341769 - DNA, 25 bp, Mus musculus
gtgccacgcaggcttacagttcctc

SEQ ID NO: 341770 - DNA, 25 bp, Mus musculus
gtgccacgccccctgattgaacctc

SEQ ID NO: 341771 - DNA, 25 bp, Mus musculus
gtgccacggaggatctagataaaac

SEQ ID NO: 341772 - DNA, 25 bp, Mus musculus
gtgccacggagtcggaccaggagga

SEQ ID NO: 341773 - DNA, 25 bp, Mus musculus
gtgccacggctgagttaagaatcat

SEQ ID NO: 341774 - DNA, 25 bp, Mus musculus
gtgccactaccccacagcggcagaa

SEQ ID NO: 341775 - DNA, 25 bp, Mus musculus
gtgccactattgagcatgacctcct

SEQ ID NO: 341776 - DNA, 25 bp, Mus musculus
gtgccacttttgaacgggacagctt

SEQ ID NO: 341777 - DNA, 25 bp, Mus musculus
gtgccagaaagctgccccacgagct

SEQ ID NO: 341778 - DNA, 25 bp, Mus musculus
gtgccagaagctgaacttcactgga

SEQ ID NO: 341779 - DNA, 25 bp, Mus musculus
gtgccagagaggaccccggagctgc

SEQ ID NO: 341780 - DNA, 25 bp, Mus musculus
gtgccagagcagaagtcagcatcca

SEQ ID NO: 341781 - DNA, 25 bp, Mus musculus
gtgccagataccaggttgctggtga

SEQ ID NO: 341782 - DNA, 25 bp, Mus musculus
gtgccagatgctaggcatgaggtga

SEQ ID NO: 341783 - DNA, 25 bp, Mus musculus
gtgccagatgtcaagaaagcgtgta

SEQ ID NO: 341784 - DNA, 25 bp, Mus musculus
gtgccagatgtcaagatatctgttt

SEQ ID NO: 341785 - DNA, 25 bp, Mus musculus
gtgccagatgttttaatggctgtta

SEQ ID NO: 341786 - DNA, 25 bp, Mus musculus
gtgccagcacccaagcaaacacttt

SEQ ID NO: 341787 - DNA, 25 bp, Mus musculus
gtgccagcacccaggccctgtccag

SEQ ID NO: 341788 - DNA, 25 bp, Mus musculus
gtgccagcagaagatgatgactatt

SEQ ID NO: 341789 - DNA, 25 bp, Mus musculus
gtgccagcagaagattctactcaac

SEQ ID NO: 341790 - DNA, 25 bp, Mus musculus
gtgccagcagacagctcccaacccc

SEQ ID NO: 341791 - DNA, 25 bp, Mus musculus
gtgccagccagtgtacgatcccaag

SEQ ID NO: 341792 - DNA, 25 bp, Mus musculus
gtgccagccccacgggtctcagagg

SEQ ID NO: 341793 - DNA, 25 bp, Mus musculus
gtgccagccggactcctccaccctg

SEQ ID NO: 341794 - DNA, 25 bp, Mus musculus
gtgccagctcaaagctgtgtgtcaa

SEQ ID NO: 341795 - DNA, 25 bp, Mus musculus
gtgccagctgacagatggcgttgac

SEQ ID NO: 341796 - DNA, 25 bp, Mus musculus
gtgccagctgcaggccacaggcagg

SEQ ID NO: 341797 - DNA, 25 bp, Mus musculus
gtgccagctgccggactgccctcca

SEQ ID NO: 341798 - DNA, 25 bp, Mus musculus
gtgccagcttggaggcgaatgaagt

SEQ ID NO: 341799 - DNA, 25 bp, Mus musculus
gtgccaggaagtggtcatattcacg

SEQ ID NO: 341800 - DNA, 25 bp, Mus musculus
gtgccaggaccccacctggattccg

SEQ ID NO: 341801 - DNA, 25 bp, Mus musculus
gtgccaggatgaacagcagtacgca

SEQ ID NO: 341802 - DNA, 25 bp, Mus musculus
gtgccagggaggtgtgaatgaggca

SEQ ID NO: 341803 - DNA, 25 bp, Mus musculus
gtgccaggtatgcaaagtgcaccct

SEQ ID NO: 341804 - DNA, 25 bp, Mus musculus
gtgccagtaaagcatatgggtgatt

SEQ ID NO: 341805 - DNA, 25 bp, Mus musculus
gtgccagtactgtggtggcttcagt

SEQ ID NO: 341806 - DNA, 25 bp, Mus musculus
gtgccagtgacacccgtgccggcat

SEQ ID NO: 341807 - DNA, 25 bp, Mus musculus
gtgccagtgtctcaggtgactcaag

SEQ ID NO: 341808 - DNA, 25 bp, Mus musculus
gtgccatagaaggttaatggagtgt

SEQ ID NO: 341809 - DNA, 25 bp, Mus musculus
gtgccatcacacacacttccttccc

SEQ ID NO: 341810 - DNA, 25 bp, Mus musculus
gtgccatcacacacagatctcagta

SEQ ID NO: 341811 - DNA, 25 bp, Mus musculus
gtgccatcatggacatcgataaggg

SEQ ID NO: 341812 - DNA, 25 bp, Mus musculus
gtgccatcccatcacctggaacaac

SEQ ID NO: 341813 - DNA, 25 bp, Mus musculus
gtgccatccttgtcgctgcggatgg

SEQ ID NO: 341814 - DNA, 25 bp, Mus musculus
gtgccatctagtgctcttcctcctg

SEQ ID NO: 341815 - DNA, 25 bp, Mus musculus
gtgccatgaccccagtgaccgtctg

SEQ ID NO: 341816 - DNA, 25 bp, Mus musculus
gtgccatgagagttgactctgtgca

SEQ ID NO: 341817 - DNA, 25 bp, Mus musculus
gtgccatgagagttgggcacttgct

SEQ ID NO: 341818 - DNA, 25 bp, Mus musculus
gtgccattaggttttcttaaagaac

SEQ ID NO: 341819 - DNA, 25 bp, Mus musculus
gtgcccaaccccaggcacagctgac

SEQ ID NO: 341820 - DNA, 25 bp, Mus musculus
gtgcccacaaggttcttgttcattc

SEQ ID NO: 341821 - DNA, 25 bp, Mus musculus
gtgcccacagacaggtggtggctgg

SEQ ID NO: 341822 - DNA, 25 bp, Mus musculus
gtgcccacagcccaggctatatcag

SEQ ID NO: 341823 - DNA, 25 bp, Mus musculus
gtgcccacattccagggccctctgc

SEQ ID NO: 341824 - DNA, 25 bp, Mus musculus
gtgcccacccatcactcagcactca

SEQ ID NO: 341825 - DNA, 25 bp, Mus musculus
gtgcccacccgagtcattcgacgtg

SEQ ID NO: 341826 - DNA, 25 bp, Mus musculus
gtgcccacgagacttttctttgagt

SEQ ID NO: 341827 - DNA, 25 bp, Mus musculus
gtgcccacgagttcccacttggact

SEQ ID NO: 341828 - DNA, 25 bp, Mus musculus
gtgcccagaggagtaccctcacctg

SEQ ID NO: 341829 - DNA, 25 bp, Mus musculus
gtgcccagatcaaatcgtgtccagc

SEQ ID NO: 341830 - DNA, 25 bp, Mus musculus
gtgcccagatcaactattagacatg

SEQ ID NO: 341831 - DNA, 25 bp, Mus musculus
gtgcccagcctacggttgtctaccg

SEQ ID NO: 341832 - DNA, 25 bp, Mus musculus
gtgcccagcctacgtggtgaagatg

SEQ ID NO: 341833 - DNA, 25 bp, Mus musculus
gtgcccagctcacgagacagggcag

SEQ ID NO: 341834 - DNA, 25 bp, Mus musculus
gtgcccaggacagaggcttccccac

SEQ ID NO: 341835 - DNA, 25 bp, Mus musculus
gtgcccaggctgtgggtcctcccag

SEQ ID NO: 341836 - DNA, 25 bp, Mus musculus
gtgcccaggggcaggatggtgttgc

SEQ ID NO: 341837 - DNA, 25 bp, Mus musculus
gtgcccataggttacaaccatccgg

SEQ ID NO: 341838 - DNA, 25 bp, Mus musculus
gtgcccatcagattatctgcaatgc

SEQ ID NO: 341839 - DNA, 25 bp, Mus musculus
gtgcccatgaaaaacccgtctcgat

SEQ ID NO: 341840 - DNA, 25 bp, Mus musculus
gtgcccatgaaaaatttggaaatcg

SEQ ID NO: 341841 - DNA, 25 bp, Mus musculus
gtgcccatggaggtcctgtccagag

SEQ ID NO: 341842 - DNA, 25 bp, Mus musculus
gtgcccattccagctgtcgcagaga

SEQ ID NO: 341843 - DNA, 25 bp, Mus musculus
gtgccccaaaccagcgtgcctcatg

SEQ ID NO: 341844 - DNA, 25 bp, Mus musculus
gtgccccaagatgaggacgctcgca

SEQ ID NO: 341845 - DNA, 25 bp, Mus musculus
gtgcccccagaagagttctcttcct

SEQ ID NO: 341846 - DNA, 25 bp, Mus musculus
gtgcccccagagagctctcatggta

SEQ ID NO: 341847 - DNA, 25 bp, Mus musculus
gtgcccccagagaggcagagcccct

SEQ ID NO: 341848 - DNA, 25 bp, Mus musculus
gtgcccccagcttcggcttgtttta

SEQ ID NO: 341849 - DNA, 25 bp, Mus musculus
gtgcccccagcttcgggtcttttca

SEQ ID NO: 341850 - DNA, 25 bp, Mus musculus
gtgcccccaggcttccccccaatgc

SEQ ID NO: 341851 - DNA, 25 bp, Mus musculus
gtgccccgcaacagcaatccaaact

SEQ ID NO: 341852 - DNA, 25 bp, Mus musculus
gtgccccgccgcaggcccggacaca

SEQ ID NO: 341853 - DNA, 25 bp, Mus musculus
gtgccccgggagagacggagatttc

SEQ ID NO: 341854 - DNA, 25 bp, Mus musculus
gtgccccgttccaaggactccttta

SEQ ID NO: 341855 - DNA, 25 bp, Mus musculus
gtgccccgttccaaggcaagtcctt

SEQ ID NO: 341856 - DNA, 25 bp, Mus musculus
gtgcccctcaggcggtgctatacaa

SEQ ID NO: 341857 - DNA, 25 bp, Mus musculus
gtgcccctgcctaagccaaggaagt

SEQ ID NO: 341858 - DNA, 25 bp, Mus musculus
gtgccccttccttcccagtggatct

SEQ ID NO: 341859 - DNA, 25 bp, Mus musculus
gtgcccgagaggttctgggagaggt

SEQ ID NO: 341860 - DNA, 25 bp, Mus musculus
gtgcccgcagatgtgcctcatccag

SEQ ID NO: 341861 - DNA, 25 bp, Mus musculus
gtgcccgcccacaagtatgtcttgg

SEQ ID NO: 341862 - DNA, 25 bp, Mus musculus
gtgcccgcccaggttgtcttgacac

SEQ ID NO: 341863 - DNA, 25 bp, Mus musculus
gtgcccggaaagccccggcagccca

SEQ ID NO: 341864 - DNA, 25 bp, Mus musculus
gtgcccggacccgagatgagcaata

SEQ ID NO: 341865 - DNA, 25 bp, Mus musculus
gtgcccggcgccggttcagtcctcg

SEQ ID NO: 341866 - DNA, 25 bp, Mus musculus
gtgcccgggaagagttcagccggcg

SEQ ID NO: 341867 - DNA, 25 bp, Mus musculus
gtgcccgtatagattacatctcgct

SEQ ID NO: 341868 - DNA, 25 bp, Mus musculus
gtgcccgtataggcacgtcagcttt

SEQ ID NO: 341869 - DNA, 25 bp, Mus musculus
gtgcccgtgaagagtgtttcccgag

SEQ ID NO: 341870 - DNA, 25 bp, Mus musculus
gtgccctaagtatccagcatgctcc

SEQ ID NO: 341871 - DNA, 25 bp, Mus musculus
gtgccctatgggaatattcagagca

SEQ ID NO: 341872 - DNA, 25 bp, Mus musculus
gtgccctcaccactcaatccctgtt

SEQ ID NO: 341873 - DNA, 25 bp, Mus musculus
gtgccctcaccagtcaatccctgtt

SEQ ID NO: 341874 - DNA, 25 bp, Mus musculus
gtgccctcagccccccagcacttgt

SEQ ID NO: 341875 - DNA, 25 bp, Mus musculus
gtgccctcttctgcacatcgagtca

SEQ ID NO: 341876 - DNA, 25 bp, Mus musculus
gtgccctgaagctcctgtatgacag

SEQ ID NO: 341877 - DNA, 25 bp, Mus musculus
gtgccctgaaggtcagaaacccaag

SEQ ID NO: 341878 - DNA, 25 bp, Mus musculus
gtgccctgcgggcttcgagggtgcc

SEQ ID NO: 341879 - DNA, 25 bp, Mus musculus
gtgccctgctggacattcaggagct

SEQ ID NO: 341880 - DNA, 25 bp, Mus musculus
gtgccctgctggacctgttcagccc

SEQ ID NO: 341881 - DNA, 25 bp, Mus musculus
gtgccctgctgggtggggagacagc

SEQ ID NO: 341882 - DNA, 25 bp, Mus musculus
gtgccctggccaaggtcctggacaa

SEQ ID NO: 341883 - DNA, 25 bp, Mus musculus
gtgccctggtaaatgctactgagtg

SEQ ID NO: 341884 - DNA, 25 bp, Mus musculus
gtgccctgtgtgaaggagcttctgc

SEQ ID NO: 341885 - DNA, 25 bp, Mus musculus
gtgcccttaatgaaaacattaacca

SEQ ID NO: 341886 - DNA, 25 bp, Mus musculus
gtgccgaacaccggttttgcctcaa

SEQ ID NO: 341887 - DNA, 25 bp, Mus musculus
gtgccgaacaccgtgcacttaatgc

SEQ ID NO: 341888 - DNA, 25 bp, Mus musculus
gtgccgacagactaacctaacatgg

SEQ ID NO: 341889 - DNA, 25 bp, Mus musculus
gtgccgacaggagatgatttctccg

SEQ ID NO: 341890 - DNA, 25 bp, Mus musculus
gtgccgactacgtggaggagcccaa

SEQ ID NO: 341891 - DNA, 25 bp, Mus musculus
gtgccgagcaacaggtgtcgttgac

SEQ ID NO: 341892 - DNA, 25 bp, Mus musculus
gtgccgaggaggggcgtgctggtca

SEQ ID NO: 341893 - DNA, 25 bp, Mus musculus
gtgccgagtccgacggatcgctact

SEQ ID NO: 341894 - DNA, 25 bp, Mus musculus
gtgccgcacagtctggaataaaagc

SEQ ID NO: 341895 - DNA, 25 bp, Mus musculus
gtgccgcatgcaggtggaccctcag

SEQ ID NO: 341896 - DNA, 25 bp, Mus musculus
gtgccgccacagccagaagttgaaa

SEQ ID NO: 341897 - DNA, 25 bp, Mus musculus
gtgccgcctacaggattcctgtcta

SEQ ID NO: 341898 - DNA, 25 bp, Mus musculus
gtgccgcctacagtgcagggagact

SEQ ID NO: 341899 - DNA, 25 bp, Mus musculus
gtgccgctcttggtttccatcgtgt

SEQ ID NO: 341900 - DNA, 25 bp, Mus musculus
gtgccgctgcttgcaaggagaagtt

SEQ ID NO: 341901 - DNA, 25 bp, Mus musculus
gtgccggcagaggtggtttgtgcac

SEQ ID NO: 341902 - DNA, 25 bp, Mus musculus
gtgccggcagcagagacttgctgaa

SEQ ID NO: 341903 - DNA, 25 bp, Mus musculus
gtgccggccgagattgctaagaagc

SEQ ID NO: 341904 - DNA, 25 bp, Mus musculus
gtgccggcttgatgcccccaagcct

SEQ ID NO: 341905 - DNA, 25 bp, Mus musculus
gtgccgggattaaagagcaaaagag

SEQ ID NO: 341906 - DNA, 25 bp, Mus musculus
gtgccgggattaaagagtctatttt

SEQ ID NO: 341907 - DNA, 25 bp, Mus musculus
gtgccggttagggactgcatgagaa

SEQ ID NO: 341908 - DNA, 25 bp, Mus musculus
gtgccggttaggggcgaatggaccc

SEQ ID NO: 341909 - DNA, 25 bp, Mus musculus
gtgccggttgagagggggcacaata

SEQ ID NO: 341910 - DNA, 25 bp, Mus musculus
gtgccgtaagaacttgaaaactcct

SEQ ID NO: 341911 - DNA, 25 bp, Mus musculus
gtgccgtaagaactttcttttgcat

SEQ ID NO: 341912 - DNA, 25 bp, Mus musculus
gtgccgtagcggggatgatgagcaa

SEQ ID NO: 341913 - DNA, 25 bp, Mus musculus
gtgccgtgtgacgcagtgggccatg

SEQ ID NO: 341914 - DNA, 25 bp, Mus musculus
gtgccgtgtggtgtggattcgcagg

SEQ ID NO: 341915 - DNA, 25 bp, Mus musculus
gtgccgttttgagaagattgctgca

SEQ ID NO: 341916 - DNA, 25 bp, Mus musculus
gtgccgttttgaggctttggagaag

SEQ ID NO: 341917 - DNA, 25 bp, Mus musculus
gtgcctaagccagatctcaaagcca

SEQ ID NO: 341918 - DNA, 25 bp, Mus musculus
gtgcctacattaatgattccattgg

SEQ ID NO: 341919 - DNA, 25 bp, Mus musculus
gtgcctacattaatgctaccgtctt

SEQ ID NO: 341920 - DNA, 25 bp, Mus musculus
gtgcctaccaggtgctgaggatcaa

SEQ ID NO: 341921 - DNA, 25 bp, Mus musculus
gtgcctaccaggtgtccgtaaatgg

SEQ ID NO: 341922 - DNA, 25 bp, Mus musculus
gtgcctaccgtgccagcccccatgc

SEQ ID NO: 341923 - DNA, 25 bp, Mus musculus
gtgcctaccgtgcttgccattcccc

SEQ ID NO: 341924 - DNA, 25 bp, Mus musculus
gtgcctagtcgaagcccagagaaga

SEQ ID NO: 341925 - DNA, 25 bp, Mus musculus
gtgcctagtcgaagtgcccccctcc

SEQ ID NO: 341926 - DNA, 25 bp, Mus musculus
gtgcctatactagtgagcatcagat

SEQ ID NO: 341927 - DNA, 25 bp, Mus musculus
gtgcctatcaatcccaggctccggc

SEQ ID NO: 341928 - DNA, 25 bp, Mus musculus
gtgcctatcaggaaaggactcagct

SEQ ID NO: 341929 - DNA, 25 bp, Mus musculus
gtgcctatccagaccctcctcccag

SEQ ID NO: 341930 - DNA, 25 bp, Mus musculus
gtgcctatgatgtgagagaacaaga

SEQ ID NO: 341931 - DNA, 25 bp, Mus musculus
gtgcctatggagggaggagtgatgg

SEQ ID NO: 341932 - DNA, 25 bp, Mus musculus
gtgcctatggaggggtggacaaatc

SEQ ID NO: 341933 - DNA, 25 bp, Mus musculus
gtgcctatggatgccctcttggctt

SEQ ID NO: 341934 - DNA, 25 bp, Mus musculus
gtgcctattgtgaggaactaatgac

SEQ ID NO: 341935 - DNA, 25 bp, Mus musculus
gtgcctcagtgaagaaactgacgct

SEQ ID NO: 341936 - DNA, 25 bp, Mus musculus
gtgcctcagtgcttctacctggcag

SEQ ID NO: 341937 - DNA, 25 bp, Mus musculus
gtgcctcagtggtggtgagctcttc

SEQ ID NO: 341938 - DNA, 25 bp, Mus musculus
gtgcctcagtgtggcctcccctggt

SEQ ID NO: 341939 - DNA, 25 bp, Mus musculus
gtgcctcagttgccgattgctgttc

SEQ ID NO: 341940 - DNA, 25 bp, Mus musculus
gtgcctcatcttttgctggaattta

SEQ ID NO: 341941 - DNA, 25 bp, Mus musculus
gtgcctccaagggttcccgtgagaa

SEQ ID NO: 341942 - DNA, 25 bp, Mus musculus
gtgcctccactcaggtctgggaacg

SEQ ID NO: 341943 - DNA, 25 bp, Mus musculus
gtgcctccaggaataacaggcaatg

SEQ ID NO: 341944 - DNA, 25 bp, Mus musculus
gtgcctccaggagacacaaagcagt

SEQ ID NO: 341945 - DNA, 25 bp, Mus musculus
gtgcctcccacgtcagaaccgttac

SEQ ID NO: 341946 - DNA, 25 bp, Mus musculus
gtgcctcctagatgccctttgaagc

SEQ ID NO: 341947 - DNA, 25 bp, Mus musculus
gtgcctcgatgccctggtcgtgtgc

SEQ ID NO: 341948 - DNA, 25 bp, Mus musculus
gtgcctcggagcagagcgatcagca

SEQ ID NO: 341949 - DNA, 25 bp, Mus musculus
gtgcctcggcccagcacagcccccc

SEQ ID NO: 341950 - DNA, 25 bp, Mus musculus
gtgcctcgtacgggtattcccaggg

SEQ ID NO: 341951 - DNA, 25 bp, Mus musculus
gtgcctctctgtgagcaaagaaaat

SEQ ID NO: 341952 - DNA, 25 bp, Mus musculus
gtgcctctgactaggtctgcgaatg

SEQ ID NO: 341953 - DNA, 25 bp, Mus musculus
gtgcctctgagaaggtctgcgaatg

SEQ ID NO: 341954 - DNA, 25 bp, Mus musculus
gtgcctctgatgctggctggggaca

SEQ ID NO: 341955 - DNA, 25 bp, Mus musculus
gtgcctctgtgtctcactaatgctc

SEQ ID NO: 341956 - DNA, 25 bp, Mus musculus
gtgcctctgtgtctcgtttaaaaag

SEQ ID NO: 341957 - DNA, 25 bp, Mus musculus
gtgcctcttaaagaaaaatcaagaa

SEQ ID NO: 341958 - DNA, 25 bp, Mus musculus
gtgcctcttccaaggaatttgaaat

SEQ ID NO: 341959 - DNA, 25 bp, Mus musculus
gtgcctcttccaaggagtgccggtg

SEQ ID NO: 341960 - DNA, 25 bp, Mus musculus
gtgcctcttgccatgctggccgagg

SEQ ID NO: 341961 - DNA, 25 bp, Mus musculus
gtgcctgaaaggttgcaggaatcct

SEQ ID NO: 341962 - DNA, 25 bp, Mus musculus
gtgcctgacaccgatggcagacttt

SEQ ID NO: 341963 - DNA, 25 bp, Mus musculus
gtgcctgagaggcgtccccattcct

SEQ ID NO: 341964 - DNA, 25 bp, Mus musculus
gtgcctgagcggaggactggctacc

SEQ ID NO: 341965 - DNA, 25 bp, Mus musculus
gtgcctgagcgggctagctgtggag

SEQ ID NO: 341966 - DNA, 25 bp, Mus musculus
gtgcctgcaggatcggaacgtcaat

SEQ ID NO: 341967 - DNA, 25 bp, Mus musculus
gtgcctgcagtgtgcaatggtgctc

SEQ ID NO: 341968 - DNA, 25 bp, Mus musculus
gtgcctgcagttccacaggctcagg

SEQ ID NO: 341969 - DNA, 25 bp, Mus musculus
gtgcctgctataaagaaactacata

SEQ ID NO: 341970 - DNA, 25 bp, Mus musculus
gtgcctgctataaaggacttagaag

SEQ ID NO: 341971 - DNA, 25 bp, Mus musculus
gtgcctgctgcaaagcctgcctggg

SEQ ID NO: 341972 - DNA, 25 bp, Mus musculus
gtgcctgctgctcacacacacacac

SEQ ID NO: 341973 - DNA, 25 bp, Mus musculus
gtgcctggaacccatcagatcttcc

SEQ ID NO: 341974 - DNA, 25 bp, Mus musculus
gtgcctggacagaaatatcttgagc

SEQ ID NO: 341975 - DNA, 25 bp, Mus musculus
gtgcctggagactcctccaccctgc

SEQ ID NO: 341976 - DNA, 25 bp, Mus musculus
gtgcctggaggaccagctctctcct

SEQ ID NO: 341977 - DNA, 25 bp, Mus musculus
gtgcctggagggtctcattatgcag

SEQ ID NO: 341978 - DNA, 25 bp, Mus musculus
gtgcctggccccatgggtccttctg

SEQ ID NO: 341979 - DNA, 25 bp, Mus musculus
gtgcctggcggcttaaaaggcagta

SEQ ID NO: 341980 - DNA, 25 bp, Mus musculus
gtgcctgggcaaaggggggctcctg

SEQ ID NO: 341981 - DNA, 25 bp, Mus musculus
gtgcctggggaagactcaagggcaa

SEQ ID NO: 341982 - DNA, 25 bp, Mus musculus
gtgcctggggaaggtgactttccag

SEQ ID NO: 341983 - DNA, 25 bp, Mus musculus
gtgcctggtatatgctcccggcaac

SEQ ID NO: 341984 - DNA, 25 bp, Mus musculus
gtgcctgtcctggttgttcctcaaa

SEQ ID NO: 341985 - DNA, 25 bp, Mus musculus
gtgcctgtctcagagagcctgggca

SEQ ID NO: 341986 - DNA, 25 bp, Mus musculus
gtgcctgtctgcactggtgaccatg

SEQ ID NO: 341987 - DNA, 25 bp, Mus musculus
gtgcctgtgccagggtgtgagggta

SEQ ID NO: 341988 - DNA, 25 bp, Mus musculus
gtgcctgtgccagtgttctttccag

SEQ ID NO: 341989 - DNA, 25 bp, Mus musculus
gtgcctgtgtgtctcagcctcagct

SEQ ID NO: 341990 - DNA, 25 bp, Mus musculus
gtgccttaaaagaaaccatggaatg

SEQ ID NO: 341991 - DNA, 25 bp, Mus musculus
gtgccttattcaaggcctggtgtgt

SEQ ID NO: 341992 - DNA, 25 bp, Mus musculus
gtgccttattcaaggggtgtggaat

SEQ ID NO: 341993 - DNA, 25 bp, Mus musculus
gtgccttcagaattgttttacttgt

SEQ ID NO: 341994 - DNA, 25 bp, Mus musculus
gtgccttcagagtgatccaccttga

SEQ ID NO: 341995 - DNA, 25 bp, Mus musculus
gtgccttcaggctcacccaggaatg

SEQ ID NO: 341996 - DNA, 25 bp, Mus musculus
gtgccttcaggtgccttggagcact

SEQ ID NO: 341997 - DNA, 25 bp, Mus musculus
gtgccttctcaggaagtaaaccagg

SEQ ID NO: 341998 - DNA, 25 bp, Mus musculus
gtgccttctcaggaagttctgatcc

SEQ ID NO: 341999 - DNA, 25 bp, Mus musculus
gtgccttctgggcattgaagatcgg

SEQ ID NO: 342000 - DNA, 25 bp, Mus musculus
gtgccttgaaggaggggtcatctcc

SEQ ID NO: 342001 - DNA, 25 bp, Mus musculus
gtgcctttaacccaggtgactcata

SEQ ID NO: 342002 - DNA, 25 bp, Mus musculus
gtgcctttactccagacaaatcgcc

SEQ ID NO: 342003 - DNA, 25 bp, Mus musculus
gtgcctttactccagtgcctatgac

SEQ ID NO: 342004 - DNA, 25 bp, Mus musculus
gtgcctttgaggtcaatcttggaaa

SEQ ID NO: 342005 - DNA, 25 bp, Mus musculus
gtgcgaaagaagactttaagaaaca

SEQ ID NO: 342006 - DNA, 25 bp, Mus musculus
gtgcgaaagagaacctgctcctccg

SEQ ID NO: 342007 - DNA, 25 bp, Mus musculus
gtgcgaaagagattacaggacaggc

SEQ ID NO: 342008 - DNA, 25 bp, Mus musculus
gtgcgacaaggaaacttatggaacg

SEQ ID NO: 342009 - DNA, 25 bp, Mus musculus
gtgcgacaagggtgactattatatg

SEQ ID NO: 342010 - DNA, 25 bp, Mus musculus
gtgcgacaaggtccgcagatgcact

SEQ ID NO: 342011 - DNA, 25 bp, Mus musculus
gtgcgaccaacagaaaacaagcacg

SEQ ID NO: 342012 - DNA, 25 bp, Mus musculus
gtgcgaccaacagattcctgttgcg

SEQ ID NO: 342013 - DNA, 25 bp, Mus musculus
gtgcgaccaatgagggagagcccat

SEQ ID NO: 342014 - DNA, 25 bp, Mus musculus
gtgcgaccagatctgctgcttactc

SEQ ID NO: 342015 - DNA, 25 bp, Mus musculus
gtgcgaccaggtgtctgcctgtatc

SEQ ID NO: 342016 - DNA, 25 bp, Mus musculus
gtgcgaccgtgatggtaacaaatca

SEQ ID NO: 342017 - DNA, 25 bp, Mus musculus
gtgcgacttggaccaattgctggag

SEQ ID NO: 342018 - DNA, 25 bp, Mus musculus
gtgcgacttggactcggctctctcc

SEQ ID NO: 342019 - DNA, 25 bp, Mus musculus
gtgcgagagtccacgagaaatggaa

SEQ ID NO: 342020 - DNA, 25 bp, Mus musculus
gtgcgagagtccacgatatgttttc

SEQ ID NO: 342021 - DNA, 25 bp, Mus musculus
gtgcgagagtccacggttttctctg

SEQ ID NO: 342022 - DNA, 25 bp, Mus musculus
gtgcgagcagatgagggcgctgtgt

SEQ ID NO: 342023 - DNA, 25 bp, Mus musculus
gtgcgagcaggtagtcaatacccat

SEQ ID NO: 342024 - DNA, 25 bp, Mus musculus
gtgcgagccagcagctctgaactcc

SEQ ID NO: 342025 - DNA, 25 bp, Mus musculus
gtgcgagccgtaacacaaggcacat

SEQ ID NO: 342026 - DNA, 25 bp, Mus musculus
gtgcgagcgggttgctgttctggct

SEQ ID NO: 342027 - DNA, 25 bp, Mus musculus
gtgcgaggagcagatatggcctcca

SEQ ID NO: 342028 - DNA, 25 bp, Mus musculus
gtgcgaggaggtggagcctactacc

SEQ ID NO: 342029 - DNA, 25 bp, Mus musculus
gtgcgagggaagctgtttactttgt

SEQ ID NO: 342030 - DNA, 25 bp, Mus musculus
gtgcgaggtgcctgggtccaagccg

SEQ ID NO: 342031 - DNA, 25 bp, Mus musculus
gtgcgaggtgcctgttaaagtccgc

SEQ ID NO: 342032 - DNA, 25 bp, Mus musculus
gtgcgcaaactgactgatgatgctt

SEQ ID NO: 342033 - DNA, 25 bp, Mus musculus
gtgcgcaaactggcgccccttgtct

SEQ ID NO: 342034 - DNA, 25 bp, Mus musculus
gtgcgcaaatgaagaagccggcatg

SEQ ID NO: 342035 - DNA, 25 bp, Mus musculus
gtgcgcaaatgggagaagaaatggg

SEQ ID NO: 342036 - DNA, 25 bp, Mus musculus
gtgcgcacagaactcaggggcacac

SEQ ID NO: 342037 - DNA, 25 bp, Mus musculus
gtgcgcacagatgactggtttacaa

SEQ ID NO: 342038 - DNA, 25 bp, Mus musculus
gtgcgcacgccggaccctgagccgt

SEQ ID NO: 342039 - DNA, 25 bp, Mus musculus
gtgcgcactcggaggccatgtcagg

SEQ ID NO: 342040 - DNA, 25 bp, Mus musculus
gtgcgcagagcagattttctgcatt

SEQ ID NO: 342041 - DNA, 25 bp, Mus musculus
gtgcgcagcaggctgcctgctgtct

SEQ ID NO: 342042 - DNA, 25 bp, Mus musculus
gtgcgcatccctgagaacacaccag

SEQ ID NO: 342043 - DNA, 25 bp, Mus musculus
gtgcgcatccctgaggtcttccaca

SEQ ID NO: 342044 - DNA, 25 bp, Mus musculus
gtgcgccacctgagaaaagaaaaga

SEQ ID NO: 342045 - DNA, 25 bp, Mus musculus
gtgcgccacctgagaagagaagaga

SEQ ID NO: 342046 - DNA, 25 bp, Mus musculus
gtgcgccacctgagagatctcaggt

SEQ ID NO: 342047 - DNA, 25 bp, Mus musculus
gtgcgccacctgaggcctcccagca

SEQ ID NO: 342048 - DNA, 25 bp, Mus musculus
gtgcgcccaggccaaacagtggggc

SEQ ID NO: 342049 - DNA, 25 bp, Mus musculus
gtgcgccctgggtccaactgagccc

SEQ ID NO: 342050 - DNA, 25 bp, Mus musculus
gtgcgcctccgccggtgagctcctc

SEQ ID NO: 342051 - DNA, 25 bp, Mus musculus
gtgcgcctgcaggtctctgcaagaa

SEQ ID NO: 342052 - DNA, 25 bp, Mus musculus
gtgcgcctgcaggtggtggtggaag

SEQ ID NO: 342053 - DNA, 25 bp, Mus musculus
gtgcgcctgcaggttcacattgaga

SEQ ID NO: 342054 - DNA, 25 bp, Mus musculus
gtgcgcctggccaggatccattttc

SEQ ID NO: 342055 - DNA, 25 bp, Mus musculus
gtgcgcctggccaggtctggcatat

SEQ ID NO: 342056 - DNA, 25 bp, Mus musculus
gtgcgcctttggaagagatggagag

SEQ ID NO: 342057 - DNA, 25 bp, Mus musculus
gtgcgcgacaagccgaactgctttg

SEQ ID NO: 342058 - DNA, 25 bp, Mus musculus
gtgcgcgacaggctgtttggtctcg

SEQ ID NO: 342059 - DNA, 25 bp, Mus musculus
gtgcgcgacaggttctggatggtgg

SEQ ID NO: 342060 - DNA, 25 bp, Mus musculus
gtgcgcgcacagatgggctgtatgg

SEQ ID NO: 342061 - DNA, 25 bp, Mus musculus
gtgcgcgcagggtttcacttagcag

SEQ ID NO: 342062 - DNA, 25 bp, Mus musculus
gtgcgcgcaggtacagcgcagcaga

SEQ ID NO: 342063 - DNA, 25 bp, Mus musculus
gtgcgcgcggcccaggggatccaaa

SEQ ID NO: 342064 - DNA, 25 bp, Mus musculus
gtgcgcgcggcccaggtttggatct

SEQ ID NO: 342065 - DNA, 25 bp, Mus musculus
gtgcgcgctctcaggaggaggcaaa

SEQ ID NO: 342066 - DNA, 25 bp, Mus musculus
gtgcgcgctctcaggctagagttca

SEQ ID NO: 342067 - DNA, 25 bp, Mus musculus
gtgcgcggccgaggtacaatgtcac

SEQ ID NO: 342068 - DNA, 25 bp, Mus musculus
gtgcgcgggtggtgtaagaataaac

SEQ ID NO: 342069 - DNA, 25 bp, Mus musculus
gtgcgctccgctagccaacatgagt

SEQ ID NO: 342070 - DNA, 25 bp, Mus musculus
gtgcgctcggaactgtgtcgtgatt

SEQ ID NO: 342071 - DNA, 25 bp, Mus musculus
gtgcgctgaccgacaaaaagatcag

SEQ ID NO: 342072 - DNA, 25 bp, Mus musculus
gtgcgctggaggtctaagccgactc

SEQ ID NO: 342073 - DNA, 25 bp, Mus musculus
gtgcgcttcattcaagtgcgcaaac

SEQ ID NO: 342074 - DNA, 25 bp, Mus musculus
gtgcgcttcattcaatttgatcaag

SEQ ID NO: 342075 - DNA, 25 bp, Mus musculus
gtgcgcttccggtacggtggcaccg

SEQ ID NO: 342076 - DNA, 25 bp, Mus musculus
gtgcggaaatgggagaagaaatggg

SEQ ID NO: 342077 - DNA, 25 bp, Mus musculus
gtgcggaactaaagcaaatggttat

SEQ ID NO: 342078 - DNA, 25 bp, Mus musculus
gtgcggacctaaataacgagcctta

SEQ ID NO: 342079 - DNA, 25 bp, Mus musculus
gtgcggaccttcactacttcgatga

SEQ ID NO: 342080 - DNA, 25 bp, Mus musculus
gtgcggacgggaatctggtcggctg

SEQ ID NO: 342081 - DNA, 25 bp, Mus musculus
gtgcggagggccaaaaaagtgtgcg

SEQ ID NO: 342082 - DNA, 25 bp, Mus musculus
gtgcggcagccgtggtcatagtcag

SEQ ID NO: 342083 - DNA, 25 bp, Mus musculus
gtgcggccagagagtcgatatgcgt

SEQ ID NO: 342084 - DNA, 25 bp, Mus musculus
gtgcggccaggtgaggctccatcaa

SEQ ID NO: 342085 - DNA, 25 bp, Mus musculus
gtgcggccagtgtgtgtgtatggag

SEQ ID NO: 342086 - DNA, 25 bp, Mus musculus
gtgcggccggagggattcatcagtg

SEQ ID NO: 342087 - DNA, 25 bp, Mus musculus
gtgcggccggagggattcgaggacg

SEQ ID NO: 342088 - DNA, 25 bp, Mus musculus
gtgcggccggatgagattatgcggg

SEQ ID NO: 342089 - DNA, 25 bp, Mus musculus
gtgcggccggatgccactacgaagg

SEQ ID NO: 342090 - DNA, 25 bp, Mus musculus
gtgcggcgagaaggactccatgaaa

SEQ ID NO: 342091 - DNA, 25 bp, Mus musculus
gtgcggcgagacacaccagaagagg

SEQ ID NO: 342092 - DNA, 25 bp, Mus musculus
gtgcggcgagatcccacgggttcct

SEQ ID NO: 342093 - DNA, 25 bp, Mus musculus
gtgcggcgcgccgagggtgtgtggg

SEQ ID NO: 342094 - DNA, 25 bp, Mus musculus
gtgcggcgcgccgagttgaactttc

SEQ ID NO: 342095 - DNA, 25 bp, Mus musculus
gtgcggcgggatcctataagttgca

SEQ ID NO: 342096 - DNA, 25 bp, Mus musculus
gtgcggcgggatcctatgcatattt

SEQ ID NO: 342097 - DNA, 25 bp, Mus musculus
gtgcggcggtcaaggccctcagcct

SEQ ID NO: 342098 - DNA, 25 bp, Mus musculus
gtgcggcggtcaaggtcacggtctc

SEQ ID NO: 342099 - DNA, 25 bp, Mus musculus
gtgcggctcggtccgacgcacagcc

SEQ ID NO: 342100 - DNA, 25 bp, Mus musculus
gtgcggctttggaggggctgtgggt

SEQ ID NO: 342101 - DNA, 25 bp, Mus musculus
gtgcgggaactgctggtgtgatcct

SEQ ID NO: 342102 - DNA, 25 bp, Mus musculus
gtgcgggaccagctgatccgagcac

SEQ ID NO: 342103 - DNA, 25 bp, Mus musculus
gtgcgggaccaggcctttaagacca

SEQ ID NO: 342104 - DNA, 25 bp, Mus musculus
gtgcggggcaaaatggagctcgacg

SEQ ID NO: 342105 - DNA, 25 bp, Mus musculus
gtgcgggtagtttagtgaagctgtg

SEQ ID NO: 342106 - DNA, 25 bp, Mus musculus
gtgcgggtgagatctgattttctgg

SEQ ID NO: 342107 - DNA, 25 bp, Mus musculus
gtgcggtactgaaggattctccagt

SEQ ID NO: 342108 - DNA, 25 bp, Mus musculus
gtgcggtatcggggggagtacaagg

SEQ ID NO: 342109 - DNA, 25 bp, Mus musculus
gtgcggtccaggagattgtgccttc

SEQ ID NO: 342110 - DNA, 25 bp, Mus musculus
gtgcggtccattcaggagatggagt

SEQ ID NO: 342111 - DNA, 25 bp, Mus musculus
gtgcggtccctcagattgctgaagc

SEQ ID NO: 342112 - DNA, 25 bp, Mus musculus
gtgcggtttgcactggtccaaccca

SEQ ID NO: 342113 - DNA, 25 bp, Mus musculus
gtgcgtaatgacttccctgctggga

SEQ ID NO: 342114 - DNA, 25 bp, Mus musculus
gtgcgtacagaagaactcctggcca

SEQ ID NO: 342115 - DNA, 25 bp, Mus musculus
gtgcgtacagagaacttaccgatct

SEQ ID NO: 342116 - DNA, 25 bp, Mus musculus
gtgcgtcctgctgtctcaggtgctc

SEQ ID NO: 342117 - DNA, 25 bp, Mus musculus
gtgcgtggaagagtccccaagagct

SEQ ID NO: 342118 - DNA, 25 bp, Mus musculus
gtgcgtggaaggcagaaaccaggtg

SEQ ID NO: 342119 - DNA, 25 bp, Mus musculus
gtgcgtggacccagctgtcctggaa

SEQ ID NO: 342120 - DNA, 25 bp, Mus musculus
gtgcgtgtaacagatgctccatcct

SEQ ID NO: 342121 - DNA, 25 bp, Mus musculus
gtgcgtgtaacaggggctccttatt

SEQ ID NO: 342122 - DNA, 25 bp, Mus musculus
gtgcgtgttggtcgcctctctgcct

SEQ ID NO: 342123 - DNA, 25 bp, Mus musculus
gtgcgtgttggtcgcgggggttcta

SEQ ID NO: 342124 - DNA, 25 bp, Mus musculus
gtgcgttatcagagtgaagccatag

SEQ ID NO: 342125 - DNA, 25 bp, Mus musculus
gtgcgttatcgagcctactagttca

SEQ ID NO: 342126 - DNA, 25 bp, Mus musculus
gtgcgttatcgaggaaagcatgtgg

SEQ ID NO: 342127 - DNA, 25 bp, Mus musculus
gtgcgttatcgaggtaatatatata

SEQ ID NO: 342128 - DNA, 25 bp, Mus musculus
gtgcgttcaggaggcagactccggg

SEQ ID NO: 342129 - DNA, 25 bp, Mus musculus
gtgcgttcccggctgtcactgagca

SEQ ID NO: 342130 - DNA, 25 bp, Mus musculus
gtgcgttgcaggtctccgggactca

SEQ ID NO: 342131 - DNA, 25 bp, Mus musculus
gtgctaaagcatgaccccgtggccc

SEQ ID NO: 342132 - DNA, 25 bp, Mus musculus
gtgctaacacagttgctcctgaatt

SEQ ID NO: 342133 - DNA, 25 bp, Mus musculus
gtgctaagtacacaaatgatgactt

SEQ ID NO: 342134 - DNA, 25 bp, Mus musculus
gtgctaataagattgagtctgtttc

SEQ ID NO: 342135 - DNA, 25 bp, Mus musculus
gtgctaataaggggttgatagtcct

SEQ ID NO: 342136 - DNA, 25 bp, Mus musculus
gtgctaatctaggtcttgccgtgga

SEQ ID NO: 342137 - DNA, 25 bp, Mus musculus
gtgctaatgatcaaagcgctgcagg

SEQ ID NO: 342138 - DNA, 25 bp, Mus musculus
gtgctaatgatcaacggttccagtt

SEQ ID NO: 342139 - DNA, 25 bp, Mus musculus
gtgctacaccccctcacgcctcaca

SEQ ID NO: 342140 - DNA, 25 bp, Mus musculus
gtgctacagcttggggaagggaaca

SEQ ID NO: 342141 - DNA, 25 bp, Mus musculus
gtgctacatcggaggaaatgaggcc

SEQ ID NO: 342142 - DNA, 25 bp, Mus musculus
gtgctacattggctggggctccaac

SEQ ID NO: 342143 - DNA, 25 bp, Mus musculus
gtgctacattggctggtgtcccttc

SEQ ID NO: 342144 - DNA, 25 bp, Mus musculus
gtgctaccttaggatcgagcggtcc

SEQ ID NO: 342145 - DNA, 25 bp, Mus musculus
gtgctactgaaccacaagaacccat

SEQ ID NO: 342146 - DNA, 25 bp, Mus musculus
gtgctagaacagaaactgcagttgg

SEQ ID NO: 342147 - DNA, 25 bp, Mus musculus
gtgctagacaagtgctacgttgaag

SEQ ID NO: 342148 - DNA, 25 bp, Mus musculus
gtgctagaggaaccagcagatagac

SEQ ID NO: 342149 - DNA, 25 bp, Mus musculus
gtgctagcagagcaggatccaagtg

SEQ ID NO: 342150 - DNA, 25 bp, Mus musculus
gtgctagcaggttttatgacccatg

SEQ ID NO: 342151 - DNA, 25 bp, Mus musculus
gtgctaggatttcagtttacccatc

SEQ ID NO: 342152 - DNA, 25 bp, Mus musculus
gtgctagggttaaaggagacattcc

SEQ ID NO: 342153 - DNA, 25 bp, Mus musculus
gtgctagtggacactagactacatc

SEQ ID NO: 342154 - DNA, 25 bp, Mus musculus
gtgctatgaagctacctacagccag

SEQ ID NO: 342155 - DNA, 25 bp, Mus musculus
gtgctatgaagctctggccatgggc

SEQ ID NO: 342156 - DNA, 25 bp, Mus musculus
gtgctatgaaggtgaagcttccctc

SEQ ID NO: 342157 - DNA, 25 bp, Mus musculus
gtgctatgcccagaacatcccaacc

SEQ ID NO: 342158 - DNA, 25 bp, Mus musculus
gtgctatggagtgcctttctttctg

SEQ ID NO: 342159 - DNA, 25 bp, Mus musculus
gtgctatttgaccatctgttctgtg

SEQ ID NO: 342160 - DNA, 25 bp, Mus musculus
gtgctcaaacaggctctggaaaaac

SEQ ID NO: 342161 - DNA, 25 bp, Mus musculus
gtgctcaacctgctggttggtgggg

SEQ ID NO: 342162 - DNA, 25 bp, Mus musculus
gtgctcaactatgcttaactgcgga

SEQ ID NO: 342163 - DNA, 25 bp, Mus musculus
gtgctcaactggctgttggaaagcc

SEQ ID NO: 342164 - DNA, 25 bp, Mus musculus
gtgctcaagctgcaggaggaggcaa

SEQ ID NO: 342165 - DNA, 25 bp, Mus musculus
gtgctcacagcagagggtccccagg

SEQ ID NO: 342166 - DNA, 25 bp, Mus musculus
gtgctcaccaagagctttgtaaatg

SEQ ID NO: 342167 - DNA, 25 bp, Mus musculus
gtgctcaccagtttgacttcggagg

SEQ ID NO: 342168 - DNA, 25 bp, Mus musculus
gtgctcactgccaaggggacaatga

SEQ ID NO: 342169 - DNA, 25 bp, Mus musculus
gtgctcactgccaaggtgaaagcag

SEQ ID NO: 342170 - DNA, 25 bp, Mus musculus
gtgctcagaagtttgcagggacatg

SEQ ID NO: 342171 - DNA, 25 bp, Mus musculus
gtgctcagcaggtttgggaaaaatt

SEQ ID NO: 342172 - DNA, 25 bp, Mus musculus
gtgctcaggaatgcaacttctcggt

SEQ ID NO: 342173 - DNA, 25 bp, Mus musculus
gtgctcataggaattcactgtgaag

SEQ ID NO: 342174 - DNA, 25 bp, Mus musculus
gtgctcatccagatctgcaacgggc

SEQ ID NO: 342175 - DNA, 25 bp, Mus musculus
gtgctcatccagctcagcacattgc

SEQ ID NO: 342176 - DNA, 25 bp, Mus musculus
gtgctcatccaggaacaacttccac

SEQ ID NO: 342177 - DNA, 25 bp, Mus musculus
gtgctcatccaggtgggatatgagc

SEQ ID NO: 342178 - DNA, 25 bp, Mus musculus
gtgctcatgcaggtccatgcctccc

SEQ ID NO: 342179 - DNA, 25 bp, Mus musculus
gtgctcatggaaacttcgggtggaa

SEQ ID NO: 342180 - DNA, 25 bp, Mus musculus
gtgctcatggggtacgtgtgtgctc

SEQ ID NO: 342181 - DNA, 25 bp, Mus musculus
gtgctcattataggggtgatcctgt

SEQ ID NO: 342182 - DNA, 25 bp, Mus musculus
gtgctccaaagagctttggcaatcc

SEQ ID NO: 342183 - DNA, 25 bp, Mus musculus
gtgctccaacggcttcctgcttttt

SEQ ID NO: 342184 - DNA, 25 bp, Mus musculus
gtgctccaaggatcgtggagttgat

SEQ ID NO: 342185 - DNA, 25 bp, Mus musculus
gtgctccaaggggagcctcctttcc

SEQ ID NO: 342186 - DNA, 25 bp, Mus musculus
gtgctccacggggaggcacacggtc

SEQ ID NO: 342187 - DNA, 25 bp, Mus musculus
gtgctccagaaccagaaccggagtg

SEQ ID NO: 342188 - DNA, 25 bp, Mus musculus
gtgctccagaaccagtgtctgacag

SEQ ID NO: 342189 - DNA, 25 bp, Mus musculus
gtgctccagtatgcagattaagaaa

SEQ ID NO: 342190 - DNA, 25 bp, Mus musculus
gtgctccagtccgttgtggggactg

SEQ ID NO: 342191 - DNA, 25 bp, Mus musculus
gtgctcccaaagcattagcagagac

SEQ ID NO: 342192 - DNA, 25 bp, Mus musculus
gtgctcccactgcaatttgaagagc

SEQ ID NO: 342193 - DNA, 25 bp, Mus musculus
gtgctcccagatggtgtcataagcc

SEQ ID NO: 342194 - DNA, 25 bp, Mus musculus
gtgctcccaggagaatttcacccac

SEQ ID NO: 342195 - DNA, 25 bp, Mus musculus
gtgctcccaggggtgatctgctttg

SEQ ID NO: 342196 - DNA, 25 bp, Mus musculus
gtgctccccaaagaccctctatggg

SEQ ID NO: 342197 - DNA, 25 bp, Mus musculus
gtgctcccgaaactgaccactgcgg

SEQ ID NO: 342198 - DNA, 25 bp, Mus musculus
gtgctcccgtattaggagacacaga

SEQ ID NO: 342199 - DNA, 25 bp, Mus musculus
gtgctccctaaagttgcagaattaa

SEQ ID NO: 342200 - DNA, 25 bp, Mus musculus
gtgctccctcagctgctcctggact

SEQ ID NO: 342201 - DNA, 25 bp, Mus musculus
gtgctccgagggaagctctacaaag

SEQ ID NO: 342202 - DNA, 25 bp, Mus musculus
gtgctccgcagctggctcctccaag

SEQ ID NO: 342203 - DNA, 25 bp, Mus musculus
gtgctccgcaggtatctgaatccca

SEQ ID NO: 342204 - DNA, 25 bp, Mus musculus
gtgctccgcaggttgaactggagca

SEQ ID NO: 342205 - DNA, 25 bp, Mus musculus
gtgctccggagatcacagctgcacg

SEQ ID NO: 342206 - DNA, 25 bp, Mus musculus
gtgctccggagatcattataggtaa

SEQ ID NO: 342207 - DNA, 25 bp, Mus musculus
gtgctcctaaccgcgttggctctcc

SEQ ID NO: 342208 - DNA, 25 bp, Mus musculus
gtgctcctctagaggctgtggggtg

SEQ ID NO: 342209 - DNA, 25 bp, Mus musculus
gtgctcctctcttggtcaaactaca

SEQ ID NO: 342210 - DNA, 25 bp, Mus musculus
gtgctcctgcgggcggcatcgctgt

SEQ ID NO: 342211 - DNA, 25 bp, Mus musculus
gtgctcctggcatggtacttttctc

SEQ ID NO: 342212 - DNA, 25 bp, Mus musculus
gtgctcctgtgtagtgtgaaacaga

SEQ ID NO: 342213 - DNA, 25 bp, Mus musculus
gtgctcctgtgtatgctacaggagg

SEQ ID NO: 342214 - DNA, 25 bp, Mus musculus
gtgctccttgcagatttctaacgag

SEQ ID NO: 342215 - DNA, 25 bp, Mus musculus
gtgctcgacaaagcatagtaacatt

SEQ ID NO: 342216 - DNA, 25 bp, Mus musculus
gtgctctactcgtcctcttccactt

SEQ ID NO: 342217 - DNA, 25 bp, Mus musculus
gtgctctagccgagatgtggtgacc

SEQ ID NO: 342218 - DNA, 25 bp, Mus musculus
gtgctctagccgaggccatgtggag

SEQ ID NO: 342219 - DNA, 25 bp, Mus musculus
gtgctctcaggggactcctctcgaa

SEQ ID NO: 342220 - DNA, 25 bp, Mus musculus
gtgctctccagcaggttacagtacc

SEQ ID NO: 342221 - DNA, 25 bp, Mus musculus
gtgctctctaagggccatgcagctc

SEQ ID NO: 342222 - DNA, 25 bp, Mus musculus
gtgctctgaaaaatagtcacaaagc

SEQ ID NO: 342223 - DNA, 25 bp, Mus musculus
gtgctctgaagggggtacttcgaag

SEQ ID NO: 342224 - DNA, 25 bp, Mus musculus
gtgctctgaaggtcagcaagtcaag

SEQ ID NO: 342225 - DNA, 25 bp, Mus musculus
gtgctctggaccgggtagcaaatgc

SEQ ID NO: 342226 - DNA, 25 bp, Mus musculus
gtgctctgttgcatatgacatggaa

SEQ ID NO: 342227 - DNA, 25 bp, Mus musculus
gtgctctgttgcgctgacccctgcc

SEQ ID NO: 342228 - DNA, 25 bp, Mus musculus
gtgctcttcagaatgtgaagagact

SEQ ID NO: 342229 - DNA, 25 bp, Mus musculus
gtgctctttcctatggatttggcca

SEQ ID NO: 342230 - DNA, 25 bp, Mus musculus
gtgctctttgaggacctttactctt

SEQ ID NO: 342231 - DNA, 25 bp, Mus musculus
gtgctctttggcagatcagtaatgg

SEQ ID NO: 342232 - DNA, 25 bp, Mus musculus
gtgctgaaaggaagcaggtcccaga

SEQ ID NO: 342233 - DNA, 25 bp, Mus musculus
gtgctgaaaggtattcccaagccag

SEQ ID NO: 342234 - DNA, 25 bp, Mus musculus
gtgctgaaagtgtctgatgccattc

SEQ ID NO: 342235 - DNA, 25 bp, Mus musculus
gtgctgaaatttcaaaaggacatag

SEQ ID NO: 342236 - DNA, 25 bp, Mus musculus
gtgctgaagatgatcaaaaagccga

SEQ ID NO: 342237 - DNA, 25 bp, Mus musculus
gtgctgaagatgtttccacagtgcc

SEQ ID NO: 342238 - DNA, 25 bp, Mus musculus
gtgctgaagccgagagaaatgtctt

SEQ ID NO: 342239 - DNA, 25 bp, Mus musculus
gtgctgaagccgggaggggcttttt

SEQ ID NO: 342240 - DNA, 25 bp, Mus musculus
gtgctgaagccgtaagggttggagc

SEQ ID NO: 342241 - DNA, 25 bp, Mus musculus
gtgctgaagctacagggttgaaaaa

SEQ ID NO: 342242 - DNA, 25 bp, Mus musculus
gtgctgaagttacagtcaccggaag

SEQ ID NO: 342243 - DNA, 25 bp, Mus musculus
gtgctgaatgatgctgggatccaga

SEQ ID NO: 342244 - DNA, 25 bp, Mus musculus
gtgctgaatggggctttcccgctca

SEQ ID NO: 342245 - DNA, 25 bp, Mus musculus
gtgctgacagaacaggtcctgctgc

SEQ ID NO: 342246 - DNA, 25 bp, Mus musculus
gtgctgaccgttgaatcttttgagc

SEQ ID NO: 342247 - DNA, 25 bp, Mus musculus
gtgctgactgagctcggattgggaa

SEQ ID NO: 342248 - DNA, 25 bp, Mus musculus
gtgctgactgcctgtttctggacca

SEQ ID NO: 342249 - DNA, 25 bp, Mus musculus
gtgctgagaagctgagttcctaccc

SEQ ID NO: 342250 - DNA, 25 bp, Mus musculus
gtgctgagagagaggatgagaccgg

SEQ ID NO: 342251 - DNA, 25 bp, Mus musculus
gtgctgagagcgaaccccgactgca

SEQ ID NO: 342252 - DNA, 25 bp, Mus musculus
gtgctgagagtcgggccctgtctcc

SEQ ID NO: 342253 - DNA, 25 bp, Mus musculus
gtgctgagagtcgggggcctggtgt

SEQ ID NO: 342254 - DNA, 25 bp, Mus musculus
gtgctgagattacagagaaaacaga

SEQ ID NO: 342255 - DNA, 25 bp, Mus musculus
gtgctgagattacagaggcctcatt

SEQ ID NO: 342256 - DNA, 25 bp, Mus musculus
gtgctgagattacaggtgtggttga

SEQ ID NO: 342257 - DNA, 25 bp, Mus musculus
gtgctgagattgaagaaaccgggct

SEQ ID NO: 342258 - DNA, 25 bp, Mus musculus
gtgctgagcagtaacttgaatccca

SEQ ID NO: 342259 - DNA, 25 bp, Mus musculus
gtgctgataggatccacgcacattc

SEQ ID NO: 342260 - DNA, 25 bp, Mus musculus
gtgctgatccctagagatgtcttcc

SEQ ID NO: 342261 - DNA, 25 bp, Mus musculus
gtgctgatccctaggtcagacggga

SEQ ID NO: 342262 - DNA, 25 bp, Mus musculus
gtgctgatgatcaggaccagtgtcc

SEQ ID NO: 342263 - DNA, 25 bp, Mus musculus
gtgctgatgcagactttgtggtgct

SEQ ID NO: 342264 - DNA, 25 bp, Mus musculus
gtgctgatgcagctcccccaccagt

SEQ ID NO: 342265 - DNA, 25 bp, Mus musculus
gtgctgatggacagccctgggatcg

SEQ ID NO: 342266 - DNA, 25 bp, Mus musculus
gtgctgatggccatggtcaagaaaa

SEQ ID NO: 342267 - DNA, 25 bp, Mus musculus
gtgctgatgtcccgccgaacgcagt

SEQ ID NO: 342268 - DNA, 25 bp, Mus musculus
gtgctgattttgccaagtcatctca

SEQ ID NO: 342269 - DNA, 25 bp, Mus musculus
gtgctgcaaaagcgggcctcctgct

SEQ ID NO: 342270 - DNA, 25 bp, Mus musculus
gtgctgcaaaagcgggtggaggaga

SEQ ID NO: 342271 - DNA, 25 bp, Mus musculus
gtgctgcaagaccaaggacgagtct

SEQ ID NO: 342272 - DNA, 25 bp, Mus musculus
gtgctgcaaggtgatgaagtctcga

SEQ ID NO: 342273 - DNA, 25 bp, Mus musculus
gtgctgcacaatgccttaggattct

SEQ ID NO: 342274 - DNA, 25 bp, Mus musculus
gtgctgcagaaaaagacggcctgtc

SEQ ID NO: 342275 - DNA, 25 bp, Mus musculus
gtgctgcagaaaaaggagcaggtag

SEQ ID NO: 342276 - DNA, 25 bp, Mus musculus
gtgctgcagactggtcttctcagta

SEQ ID NO: 342277 - DNA, 25 bp, Mus musculus
gtgctgcagcgagaggtggaggtag

SEQ ID NO: 342278 - DNA, 25 bp, Mus musculus
gtgctgcagtggttttaagctataa

SEQ ID NO: 342279 - DNA, 25 bp, Mus musculus
gtgctgcccagatcttggtgaccaa

SEQ ID NO: 342280 - DNA, 25 bp, Mus musculus
gtgctgcccgaaaggctgagaccgc

SEQ ID NO: 342281 - DNA, 25 bp, Mus musculus
gtgctgcccgagcacgcatgctgcc

SEQ ID NO: 342282 - DNA, 25 bp, Mus musculus
gtgctgcccggaataacagaagccc

SEQ ID NO: 342283 - DNA, 25 bp, Mus musculus
gtgctgcccggcggtcccgcgaccc

SEQ ID NO: 342284 - DNA, 25 bp, Mus musculus
gtgctgccgtttagctcgatgagag

SEQ ID NO: 342285 - DNA, 25 bp, Mus musculus
gtgctgcctgagccctaggaccatg

SEQ ID NO: 342286 - DNA, 25 bp, Mus musculus
gtgctgcctgaggtagtgactgtgc

SEQ ID NO: 342287 - DNA, 25 bp, Mus musculus
gtgctgcgacaaggcccttggactg

SEQ ID NO: 342288 - DNA, 25 bp, Mus musculus
gtgctgcgcaaggtttctctgtgta

SEQ ID NO: 342289 - DNA, 25 bp, Mus musculus
gtgctgcgcaaggtttctgacatga

SEQ ID NO: 342290 - DNA, 25 bp, Mus musculus
gtgctgcgtccctctggggctgtgg

SEQ ID NO: 342291 - DNA, 25 bp, Mus musculus
gtgctgctaatgtcagcagaccgct

SEQ ID NO: 342292 - DNA, 25 bp, Mus musculus
gtgctgctagacaggcttgtgttgc

SEQ ID NO: 342293 - DNA, 25 bp, Mus musculus
gtgctgctcaaagaggtcctccggg

SEQ ID NO: 342294 - DNA, 25 bp, Mus musculus
gtgctgctgaagaggcagaggagtc

SEQ ID NO: 342295 - DNA, 25 bp, Mus musculus
gtgctgctgagagcggcccctttgt

SEQ ID NO: 342296 - DNA, 25 bp, Mus musculus
gtgctgctgagaggttcatgtactg

SEQ ID NO: 342297 - DNA, 25 bp, Mus musculus
gtgctgctgcaccagattataagtg

SEQ ID NO: 342298 - DNA, 25 bp, Mus musculus
gtgctgctgcaccagattgatgtcc

SEQ ID NO: 342299 - DNA, 25 bp, Mus musculus
gtgctgctgcaggtactagaagaca

SEQ ID NO: 342300 - DNA, 25 bp, Mus musculus
gtgctgctgccagcaggacggccag

SEQ ID NO: 342301 - DNA, 25 bp, Mus musculus
gtgctgctgccttccctcctctagg

SEQ ID NO: 342302 - DNA, 25 bp, Mus musculus
gtgctgctgcgcggtgaccacacac

SEQ ID NO: 342303 - DNA, 25 bp, Mus musculus
gtgctgctggaaaagccacacctgc

SEQ ID NO: 342304 - DNA, 25 bp, Mus musculus
gtgctgctggaaaaggtacctgaga

SEQ ID NO: 342305 - DNA, 25 bp, Mus musculus
gtgctgcttaatagatcacaactgg

SEQ ID NO: 342306 - DNA, 25 bp, Mus musculus
gtgctgcttccgggtgttggaagga

SEQ ID NO: 342307 - DNA, 25 bp, Mus musculus
gtgctggaattaaagctctaagaac

SEQ ID NO: 342308 - DNA, 25 bp, Mus musculus
gtgctggaattacaggatgagcctg

SEQ ID NO: 342309 - DNA, 25 bp, Mus musculus
gtgctggacaaggcccgagtccgga

SEQ ID NO: 342310 - DNA, 25 bp, Mus musculus
gtgctggacaggccggggcccgccg

SEQ ID NO: 342311 - DNA, 25 bp, Mus musculus
gtgctggagcagaagatctatccct

SEQ ID NO: 342312 - DNA, 25 bp, Mus musculus
gtgctggagctgagatgacgttgca

SEQ ID NO: 342313 - DNA, 25 bp, Mus musculus
gtgctggagtgagagagcctgtgct

SEQ ID NO: 342314 - DNA, 25 bp, Mus musculus
gtgctggagtgagagaggaggagcg

SEQ ID NO: 342315 - DNA, 25 bp, Mus musculus
gtgctggagtgagagctgggaagtc

SEQ ID NO: 342316 - DNA, 25 bp, Mus musculus
gtgctggccacagagttcctggagt

SEQ ID NO: 342317 - DNA, 25 bp, Mus musculus
gtgctggccacaggcctgcccaagg

SEQ ID NO: 342318 - DNA, 25 bp, Mus musculus
gtgctggccgtggatattagcattt

SEQ ID NO: 342319 - DNA, 25 bp, Mus musculus
gtgctggcgattcacttcagcacat

SEQ ID NO: 342320 - DNA, 25 bp, Mus musculus
gtgctggctggaggttggggtttct

SEQ ID NO: 342321 - DNA, 25 bp, Mus musculus
gtgctgggactaaagagatggatgt

SEQ ID NO: 342322 - DNA, 25 bp, Mus musculus
gtgctgggactaaaggggacagctg

SEQ ID NO: 342323 - DNA, 25 bp, Mus musculus
gtgctgggagccgacagggagttca

SEQ ID NO: 342324 - DNA, 25 bp, Mus musculus
gtgctgggagcctcttagctgcttg

SEQ ID NO: 342325 - DNA, 25 bp, Mus musculus
gtgctgggatggggaacatgacatc

SEQ ID NO: 342326 - DNA, 25 bp, Mus musculus
gtgctgggattaaagagacttcctt

SEQ ID NO: 342327 - DNA, 25 bp, Mus musculus
gtgctgggattaaagatccagctga

SEQ ID NO: 342328 - DNA, 25 bp, Mus musculus
gtgctgggattaaagcagatataat

SEQ ID NO: 342329 - DNA, 25 bp, Mus musculus
gtgctgggattaaagcgtgagggtc

SEQ ID NO: 342330 - DNA, 25 bp, Mus musculus
gtgctgggattaaaggggtccctcc

SEQ ID NO: 342331 - DNA, 25 bp, Mus musculus
gtgctgggattaaaggttgtaagca

SEQ ID NO: 342332 - DNA, 25 bp, Mus musculus
gtgctgggattaaagtgctctgtga

SEQ ID NO: 342333 - DNA, 25 bp, Mus musculus
gtgctgggattacagactcctccac

SEQ ID NO: 342334 - DNA, 25 bp, Mus musculus
gtgctgggattacaggttccacagc

SEQ ID NO: 342335 - DNA, 25 bp, Mus musculus
gtgctgggattacaggttggcttcc

SEQ ID NO: 342336 - DNA, 25 bp, Mus musculus
gtgctgggattacagtcttgaaata

SEQ ID NO: 342337 - DNA, 25 bp, Mus musculus
gtgctgggattagaggagttggaac

SEQ ID NO: 342338 - DNA, 25 bp, Mus musculus
gtgctgggattccaggatggcagct

SEQ ID NO: 342339 - DNA, 25 bp, Mus musculus
gtgctgggattccaggtgacagagt

SEQ ID NO: 342340 - DNA, 25 bp, Mus musculus
gtgctgggattgcagttttcaaaga

SEQ ID NO: 342341 - DNA, 25 bp, Mus musculus
gtgctgggcaggtacctggacaatg

SEQ ID NO: 342342 - DNA, 25 bp, Mus musculus
gtgctggggtacgcccgagctccag

SEQ ID NO: 342343 - DNA, 25 bp, Mus musculus
gtgctgggtttaaagaatacttgaa

SEQ ID NO: 342344 - DNA, 25 bp, Mus musculus
gtgctggtaaaagctgatgaagaga

SEQ ID NO: 342345 - DNA, 25 bp, Mus musculus
gtgctggtaggcccacagaacatga

SEQ ID NO: 342346 - DNA, 25 bp, Mus musculus
gtgctggtggatattcattagctta

SEQ ID NO: 342347 - DNA, 25 bp, Mus musculus
gtgctggtgtcctaggccacagaag

SEQ ID NO: 342348 - DNA, 25 bp, Mus musculus
gtgctgtacagagatggcccacacg

SEQ ID NO: 342349 - DNA, 25 bp, Mus musculus
gtgctgtactggatgcaagacgcta

SEQ ID NO: 342350 - DNA, 25 bp, Mus musculus
gtgctgtactgggtcaatgatgccg

SEQ ID NO: 342351 - DNA, 25 bp, Mus musculus
gtgctgtatccacgagaggcacgcc

SEQ ID NO: 342352 - DNA, 25 bp, Mus musculus
gtgctgtccttacagggaatttaat

SEQ ID NO: 342353 - DNA, 25 bp, Mus musculus
gtgctgtgacccaggagctgcctta

SEQ ID NO: 342354 - DNA, 25 bp, Mus musculus
gtgctgtgagcaagatcattgagcg

SEQ ID NO: 342355 - DNA, 25 bp, Mus musculus
gtgctgtgagcaaggctctacccct

SEQ ID NO: 342356 - DNA, 25 bp, Mus musculus
gtgctgtgcccctggctgggtttgg

SEQ ID NO: 342357 - DNA, 25 bp, Mus musculus
gtgctgtgcccctgttcacctgctg

SEQ ID NO: 342358 - DNA, 25 bp, Mus musculus
gtgctgtgcgcttctattccaagga

SEQ ID NO: 342359 - DNA, 25 bp, Mus musculus
gtgctgtggcagaattctcttttgt

SEQ ID NO: 342360 - DNA, 25 bp, Mus musculus
gtgctgtggcagatttgcaaacacg

SEQ ID NO: 342361 - DNA, 25 bp, Mus musculus
gtgctgtgtgcctcagtgctaggtt

SEQ ID NO: 342362 - DNA, 25 bp, Mus musculus
gtgctgtgtgcctctgtgctaggtt

SEQ ID NO: 342363 - DNA, 25 bp, Mus musculus
gtgctgtgtggatatctatgataga

SEQ ID NO: 342364 - DNA, 25 bp, Mus musculus
gtgctgtgtggatatgtttctgaac

SEQ ID NO: 342365 - DNA, 25 bp, Mus musculus
gtgctgtgtggatattgtgattcgt

SEQ ID NO: 342366 - DNA, 25 bp, Mus musculus
gtgctgtgtggatctctcagacatt

SEQ ID NO: 342367 - DNA, 25 bp, Mus musculus
gtgctgtgttggtccggaccgctgt

SEQ ID NO: 342368 - DNA, 25 bp, Mus musculus
gtgctgttcagggtgactcatattc

SEQ ID NO: 342369 - DNA, 25 bp, Mus musculus
gtgctgttcccgatccgtacttcgg

SEQ ID NO: 342370 - DNA, 25 bp, Mus musculus
gtgctgttggaggaactgtactgag

SEQ ID NO: 342371 - DNA, 25 bp, Mus musculus
gtgctgtttggaagtgaaatggaag

SEQ ID NO: 342372 - DNA, 25 bp, Mus musculus
gtgctgttttgatgattccaagagc

SEQ ID NO: 342373 - DNA, 25 bp, Mus musculus
gtgcttaaaaaggcaatgatagtga

SEQ ID NO: 342374 - DNA, 25 bp, Mus musculus
gtgcttaatgaaacccacagcactg

SEQ ID NO: 342375 - DNA, 25 bp, Mus musculus
gtgcttagaaagagcaactgtcctg

SEQ ID NO: 342376 - DNA, 25 bp, Mus musculus
gtgcttagagctcctcctcccatct

SEQ ID NO: 342377 - DNA, 25 bp, Mus musculus
gtgcttagtgtggatctgttaagat

SEQ ID NO: 342378 - DNA, 25 bp, Mus musculus
gtgcttatcatcagcaacagcaaca

SEQ ID NO: 342379 - DNA, 25 bp, Mus musculus
gtgcttatccaggttatcttctctg

SEQ ID NO: 342380 - DNA, 25 bp, Mus musculus
gtgcttatgacaggattgtggttgc

SEQ ID NO: 342381 - DNA, 25 bp, Mus musculus
gtgcttatgacaggctgaagccatc

SEQ ID NO: 342382 - DNA, 25 bp, Mus musculus
gtgcttattatgctggataataaga

SEQ ID NO: 342383 - DNA, 25 bp, Mus musculus
gtgcttcagaagatggttacggctc

SEQ ID NO: 342384 - DNA, 25 bp, Mus musculus
gtgcttcagaaggcacctcttccct

SEQ ID NO: 342385 - DNA, 25 bp, Mus musculus
gtgcttcagagtctgaaagggtggc

SEQ ID NO: 342386 - DNA, 25 bp, Mus musculus
gtgcttccaaagcacaggctggctc

SEQ ID NO: 342387 - DNA, 25 bp, Mus musculus
gtgcttccaaagccaggtgtcagat

SEQ ID NO: 342388 - DNA, 25 bp, Mus musculus
gtgcttcctcagtgtggcttgacct

SEQ ID NO: 342389 - DNA, 25 bp, Mus musculus
gtgcttcctccaggatggattcatg

SEQ ID NO: 342390 - DNA, 25 bp, Mus musculus
gtgcttcctcgagaagccaacagag

SEQ ID NO: 342391 - DNA, 25 bp, Mus musculus
gtgcttcctcgatgagatcgtgggg

SEQ ID NO: 342392 - DNA, 25 bp, Mus musculus
gtgcttctgtgaaagaattgaatac

SEQ ID NO: 342393 - DNA, 25 bp, Mus musculus
gtgcttgaatctgctttttaccttt

SEQ ID NO: 342394 - DNA, 25 bp, Mus musculus
gtgcttgagtttccgatgagacaga

SEQ ID NO: 342395 - DNA, 25 bp, Mus musculus
gtgcttgccagataaagtgcaggat

SEQ ID NO: 342396 - DNA, 25 bp, Mus musculus
gtgcttgccaggggctgacaagtta

SEQ ID NO: 342397 - DNA, 25 bp, Mus musculus
gtgcttgcctccaggctgaagaagg

SEQ ID NO: 342398 - DNA, 25 bp, Mus musculus
gtgcttgctaggggtcatgatatac

SEQ ID NO: 342399 - DNA, 25 bp, Mus musculus
gtgcttggagagactgggcagtttg

SEQ ID NO: 342400 - DNA, 25 bp, Mus musculus
gtgcttggagaggaggtcttcttct

SEQ ID NO: 342401 - DNA, 25 bp, Mus musculus
gtgcttggcgcgaaaaggtggacaa

SEQ ID NO: 342402 - DNA, 25 bp, Mus musculus
gtgcttggcgcgatatgctaatgaa

SEQ ID NO: 342403 - DNA, 25 bp, Mus musculus
gtgcttggcgcggtgaaggcgataa

SEQ ID NO: 342404 - DNA, 25 bp, Mus musculus
gtgcttggcggcgcctgtgagagag

SEQ ID NO: 342405 - DNA, 25 bp, Mus musculus
gtgcttggctatggcatcttccact

SEQ ID NO: 342406 - DNA, 25 bp, Mus musculus
gtgcttgggggagccatgacagtag

SEQ ID NO: 342407 - DNA, 25 bp, Mus musculus
gtgcttgtaggtggcgggacgggat

SEQ ID NO: 342408 - DNA, 25 bp, Mus musculus
gtgcttgtcaggaacaatccacttt

SEQ ID NO: 342409 - DNA, 25 bp, Mus musculus
gtgcttgtgaatcagcaatgcaggg

SEQ ID NO: 342410 - DNA, 25 bp, Mus musculus
gtgcttgttcaggtgtcctatgcca

SEQ ID NO: 342411 - DNA, 25 bp, Mus musculus
gtgctttccggaagattcatcgcag

SEQ ID NO: 342412 - DNA, 25 bp, Mus musculus
gtgctttcttcaagcaccagattgt

SEQ ID NO: 342413 - DNA, 25 bp, Mus musculus
gtgctttggagaagaaccatcagtc

SEQ ID NO: 342414 - DNA, 25 bp, Mus musculus
gtgctttggagaaggagcttcagtg

SEQ ID NO: 342415 - DNA, 25 bp, Mus musculus
gtgcttttcctggaagagtatctac

SEQ ID NO: 342416 - DNA, 25 bp, Mus musculus
gtggaaaaaggggagagcatcactg

SEQ ID NO: 342417 - DNA, 25 bp, Mus musculus
gtggaaaacatggggcttctcacca

SEQ ID NO: 342418 - DNA, 25 bp, Mus musculus
gtggaaaactgatgagaaatgaatt

SEQ ID NO: 342419 - DNA, 25 bp, Mus musculus
gtggaaaagaaacctcttcggtgat

SEQ ID NO: 342420 - DNA, 25 bp, Mus musculus
gtggaaaagacatggagatacagaa

SEQ ID NO: 342421 - DNA, 25 bp, Mus musculus
gtggaaaagacatggaggaagcaag

SEQ ID NO: 342422 - DNA, 25 bp, Mus musculus
gtggaaaagcaagaagcacatggca

SEQ ID NO: 342423 - DNA, 25 bp, Mus musculus
gtggaaaagtgtgacaccatccatg

SEQ ID NO: 342424 - DNA, 25 bp, Mus musculus
gtggaaaagtgtgagaccatccatg

SEQ ID NO: 342425 - DNA, 25 bp, Mus musculus
gtggaaacaaaagataaaatatttt

SEQ ID NO: 342426 - DNA, 25 bp, Mus musculus
gtggaaacaagcgcccaggcgcgtt

SEQ ID NO: 342427 - DNA, 25 bp, Mus musculus
gtggaaacagaccacaggatggctc

SEQ ID NO: 342428 - DNA, 25 bp, Mus musculus
gtggaaacagcactcatgaacacta

SEQ ID NO: 342429 - DNA, 25 bp, Mus musculus
gtggaaaccagtaagggcaaagatg

SEQ ID NO: 342430 - DNA, 25 bp, Mus musculus
gtggaaacctttccatattgtattt

SEQ ID NO: 342431 - DNA, 25 bp, Mus musculus
gtggaaactggcggtgttttcagct

SEQ ID NO: 342432 - DNA, 25 bp, Mus musculus
gtggaaactggcgttgttgacaaga

SEQ ID NO: 342433 - DNA, 25 bp, Mus musculus
gtggaaacttggagcaggcaccgct

SEQ ID NO: 342434 - DNA, 25 bp, Mus musculus
gtggaaactttgatctgctgttgtg

SEQ ID NO: 342435 - DNA, 25 bp, Mus musculus
gtggaaactttgatgaaactttttt

SEQ ID NO: 342436 - DNA, 25 bp, Mus musculus
gtggaaagaaaacagccccttcgag

SEQ ID NO: 342437 - DNA, 25 bp, Mus musculus
gtggaaagaaaacagctttgtttac

SEQ ID NO: 342438 - DNA, 25 bp, Mus musculus
gtggaaagaaaacagtgacaacata

SEQ ID NO: 342439 - DNA, 25 bp, Mus musculus
gtggaaagaggagaaccatcaagcc

SEQ ID NO: 342440 - DNA, 25 bp, Mus musculus
gtggaaagaggtggcagtgggagac

SEQ ID NO: 342441 - DNA, 25 bp, Mus musculus
gtggaaagattgagttcaggagggg

SEQ ID NO: 342442 - DNA, 25 bp, Mus musculus
gtggaaagcaagatatattttgcac

SEQ ID NO: 342443 - DNA, 25 bp, Mus musculus
gtggaaagcaagcagaacacagaac

SEQ ID NO: 342444 - DNA, 25 bp, Mus musculus
gtggaaagccgaaggtcctggttat

SEQ ID NO: 342445 - DNA, 25 bp, Mus musculus
gtggaaagctgctaacgaggctggc

SEQ ID NO: 342446 - DNA, 25 bp, Mus musculus
gtggaaaggcaggtgtccacagcca

SEQ ID NO: 342447 - DNA, 25 bp, Mus musculus
gtggaaatagacaacctgttggtgt

SEQ ID NO: 342448 - DNA, 25 bp, Mus musculus
gtggaaatagcaaaaccagcaagta

SEQ ID NO: 342449 - DNA, 25 bp, Mus musculus
gtggaaatagctgcagtacctcaga

SEQ ID NO: 342450 - DNA, 25 bp, Mus musculus
gtggaaataggaaaaccagcaagta

SEQ ID NO: 342451 - DNA, 25 bp, Mus musculus
gtggaaatattgcatactcctatga

SEQ ID NO: 342452 - DNA, 25 bp, Mus musculus
gtggaaatccaggctgttcatcagc

SEQ ID NO: 342453 - DNA, 25 bp, Mus musculus
gtggaaatccagggcagagatgacc

SEQ ID NO: 342454 - DNA, 25 bp, Mus musculus
gtggaaatcctgtggtgggagcatg

SEQ ID NO: 342455 - DNA, 25 bp, Mus musculus
gtggaaatgaggcagctgcgatatt

SEQ ID NO: 342456 - DNA, 25 bp, Mus musculus
gtggaaatgcagtccctgcagatag

SEQ ID NO: 342457 - DNA, 25 bp, Mus musculus
gtggaaatggggaacttctgtggcc

SEQ ID NO: 342458 - DNA, 25 bp, Mus musculus
gtggaaatggggcactttctgcatc

SEQ ID NO: 342459 - DNA, 25 bp, Mus musculus
gtggaaatggggggtcttcttgtgt

SEQ ID NO: 342460 - DNA, 25 bp, Mus musculus
gtggaacaagtgcgcatctgtagcc

SEQ ID NO: 342461 - DNA, 25 bp, Mus musculus
gtggaacaagtgctagccattgagc

SEQ ID NO: 342462 - DNA, 25 bp, Mus musculus
gtggaacacgaagccctgcagaggc

SEQ ID NO: 342463 - DNA, 25 bp, Mus musculus
gtggaacacgctgtcttcagacacc

SEQ ID NO: 342464 - DNA, 25 bp, Mus musculus
gtggaacaggaatatgtggcatcag

SEQ ID NO: 342465 - DNA, 25 bp, Mus musculus
gtggaacatcagaggatctgagaaa

SEQ ID NO: 342466 - DNA, 25 bp, Mus musculus
gtggaacatggagggccctgctcag

SEQ ID NO: 342467 - DNA, 25 bp, Mus musculus
gtggaacattcttctgccttggctg

SEQ ID NO: 342468 - DNA, 25 bp, Mus musculus
gtggaaccgggtgccatgtttcctg

SEQ ID NO: 342469 - DNA, 25 bp, Mus musculus
gtggaacgcagggatgccctgctgg

SEQ ID NO: 342470 - DNA, 25 bp, Mus musculus
gtggaacgcatcaactgtccagcag

SEQ ID NO: 342471 - DNA, 25 bp, Mus musculus
gtggaacgcttaagggaacaggaag

SEQ ID NO: 342472 - DNA, 25 bp, Mus musculus
gtggaacggcagacccagtttccta

SEQ ID NO: 342473 - DNA, 25 bp, Mus musculus
gtggaacgggcagtgtggtgagcac

SEQ ID NO: 342474 - DNA, 25 bp, Mus musculus
gtggaacgtatgatggaaatttcta

SEQ ID NO: 342475 - DNA, 25 bp, Mus musculus
gtggaactaagggactttgaatatg

SEQ ID NO: 342476 - DNA, 25 bp, Mus musculus
gtggaactacaggtgaccccaaagg

SEQ ID NO: 342477 - DNA, 25 bp, Mus musculus
gtggaactatcgcaggattgggttt

SEQ ID NO: 342478 - DNA, 25 bp, Mus musculus
gtggaactatcgcagggatcccagg

SEQ ID NO: 342479 - DNA, 25 bp, Mus musculus
gtggaactcagagtttgctattgcg

SEQ ID NO: 342480 - DNA, 25 bp, Mus musculus
gtggaactcaggtagcactttgtat

SEQ ID NO: 342481 - DNA, 25 bp, Mus musculus
gtggaactggaaggcacaatggaga

SEQ ID NO: 342482 - DNA, 25 bp, Mus musculus
gtggaactggcagccagcgctcctg

SEQ ID NO: 342483 - DNA, 25 bp, Mus musculus
gtggaactgtctttatccgtctacc

SEQ ID NO: 342484 - DNA, 25 bp, Mus musculus
gtggaacttgtaaagtcccacgagt

SEQ ID NO: 342485 - DNA, 25 bp, Mus musculus
gtggaagaaagcacattgtagtctg

SEQ ID NO: 342486 - DNA, 25 bp, Mus musculus
gtggaagaaaggcttggggcatatc

SEQ ID NO: 342487 - DNA, 25 bp, Mus musculus
gtggaagaaatggaggtgacagcta

SEQ ID NO: 342488 - DNA, 25 bp, Mus musculus
gtggaagaactatatcagtctctgc

SEQ ID NO: 342489 - DNA, 25 bp, Mus musculus
gtggaagaagaaaggatacaagacc

SEQ ID NO: 342490 - DNA, 25 bp, Mus musculus
gtggaagaagaaaggttcatcctca

SEQ ID NO: 342491 - DNA, 25 bp, Mus musculus
gtggaagaagggagcagcatccacg

SEQ ID NO: 342492 - DNA, 25 bp, Mus musculus
gtggaagaaggtgctccttcagcaa

SEQ ID NO: 342493 - DNA, 25 bp, Mus musculus
gtggaagacagagaatttcatcttc

SEQ ID NO: 342494 - DNA, 25 bp, Mus musculus
gtggaagacagagttcctctgctaa

SEQ ID NO: 342495 - DNA, 25 bp, Mus musculus
gtggaagacctgatcctgtggaaga

SEQ ID NO: 342496 - DNA, 25 bp, Mus musculus
gtggaagactatctgtctgcaatcc

SEQ ID NO: 342497 - DNA, 25 bp, Mus musculus
gtggaagagcggagactactggatt

SEQ ID NO: 342498 - DNA, 25 bp, Mus musculus
gtggaagaggaggaaactttggttt

SEQ ID NO: 342499 - DNA, 25 bp, Mus musculus
gtggaagaggaggaactatggtcct

SEQ ID NO: 342500 - DNA, 25 bp, Mus musculus
gtggaagaggaggaccatatggtgg

SEQ ID NO: 342501 - DNA, 25 bp, Mus musculus
gtggaagagggtcagggctgcatca

SEQ ID NO: 342502 - DNA, 25 bp, Mus musculus
gtggaagcacatccagaaggagctt

SEQ ID NO: 342503 - DNA, 25 bp, Mus musculus
gtggaagcaccagctggaggaagag

SEQ ID NO: 342504 - DNA, 25 bp, Mus musculus
gtggaagcaccttggtgaccagaat

SEQ ID NO: 342505 - DNA, 25 bp, Mus musculus
gtggaagcagagcgttggtcagact

SEQ ID NO: 342506 - DNA, 25 bp, Mus musculus
gtggaagcagagtcggagcagaagt

SEQ ID NO: 342507 - DNA, 25 bp, Mus musculus
gtggaagccagctttttgatcacgt

SEQ ID NO: 342508 - DNA, 25 bp, Mus musculus
gtggaagccaggaagcttcttgact

SEQ ID NO: 342509 - DNA, 25 bp, Mus musculus
gtggaagccaggcctgtagggactt

SEQ ID NO: 342510 - DNA, 25 bp, Mus musculus
gtggaagcccaccaggccatcatga

SEQ ID NO: 342511 - DNA, 25 bp, Mus musculus
gtggaagccgaggaacgccgccact

SEQ ID NO: 342512 - DNA, 25 bp, Mus musculus
gtggaagccgaggagctggaggaga

SEQ ID NO: 342513 - DNA, 25 bp, Mus musculus
gtggaagccgtgccccggcagccca

SEQ ID NO: 342514 - DNA, 25 bp, Mus musculus
gtggaagcgaaggcaaacttaaaca

SEQ ID NO: 342515 - DNA, 25 bp, Mus musculus
gtggaagcgatggtgaatgagaatg

SEQ ID NO: 342516 - DNA, 25 bp, Mus musculus
gtggaagctaaaagagcatgaagga

SEQ ID NO: 342517 - DNA, 25 bp, Mus musculus
gtggaaggcaacaagatgaagaaca

SEQ ID NO: 342518 - DNA, 25 bp, Mus musculus
gtggaaggcaacaaggatgctacag

SEQ ID NO: 342519 - DNA, 25 bp, Mus musculus
gtggaaggcagaaaccaggtggcct

SEQ ID NO: 342520 - DNA, 25 bp, Mus musculus
gtggaagggcataggcagccaccta

SEQ ID NO: 342521 - DNA, 25 bp, Mus musculus
gtggaagtcccaggctctgtgtgag

SEQ ID NO: 342522 - DNA, 25 bp, Mus musculus
gtggaagtcggtgatggcatgcaga

SEQ ID NO: 342523 - DNA, 25 bp, Mus musculus
gtggaagtgcaggagaaagacgaaa

SEQ ID NO: 342524 - DNA, 25 bp, Mus musculus
gtggaagtgctgaaggcagggaagc

SEQ ID NO: 342525 - DNA, 25 bp, Mus musculus
gtggaagtgggcaggcacccagcgg

SEQ ID NO: 342526 - DNA, 25 bp, Mus musculus
gtggaagtgggcagggtgaagtgtg

SEQ ID NO: 342527 - DNA, 25 bp, Mus musculus
gtggaagttcaaggactcccttact

SEQ ID NO: 342528 - DNA, 25 bp, Mus musculus
gtggaataaagtatcaggagtgcga

SEQ ID NO: 342529 - DNA, 25 bp, Mus musculus
gtggaataagagctcagtaagttct

SEQ ID NO: 342530 - DNA, 25 bp, Mus musculus
gtggaatacgcatgggatgccaatg

SEQ ID NO: 342531 - DNA, 25 bp, Mus musculus
gtggaatatcagaagtgacagacag

SEQ ID NO: 342532 - DNA, 25 bp, Mus musculus
gtggaatcactccgacacctcctgc

SEQ ID NO: 342533 - DNA, 25 bp, Mus musculus
gtggaatcgcaggaaaccaacagaa

SEQ ID NO: 342534 - DNA, 25 bp, Mus musculus
gtggaatcgcaggactgtgcctgga

SEQ ID NO: 342535 - DNA, 25 bp, Mus musculus
gtggaatctcaaaaaggttactgca

SEQ ID NO: 342536 - DNA, 25 bp, Mus musculus
gtggaatgaagaagcttctcttcag

SEQ ID NO: 342537 - DNA, 25 bp, Mus musculus
gtggaatgaagaaggaggtgaagat

SEQ ID NO: 342538 - DNA, 25 bp, Mus musculus
gtggaatgggatgagaaagatgaag

SEQ ID NO: 342539 - DNA, 25 bp, Mus musculus
gtggaatggggatggcactggatct

SEQ ID NO: 342540 - DNA, 25 bp, Mus musculus
gtggaatggggcctagccgcccgcc

SEQ ID NO: 342541 - DNA, 25 bp, Mus musculus
gtggaatgtcaagatgaagatgaat

SEQ ID NO: 342542 - DNA, 25 bp, Mus musculus
gtggaatgtcaagatgttaacgaat

SEQ ID NO: 342543 - DNA, 25 bp, Mus musculus
gtggaattaaggaagttacaatgat

SEQ ID NO: 342544 - DNA, 25 bp, Mus musculus
gtggaattatagccacaatcacaag

SEQ ID NO: 342545 - DNA, 25 bp, Mus musculus
gtggaattatgtctgaggaagatgg

SEQ ID NO: 342546 - DNA, 25 bp, Mus musculus
gtggaattcaacaagaatttggatg

SEQ ID NO: 342547 - DNA, 25 bp, Mus musculus
gtggaattcaacaaggtgtcggtgc

SEQ ID NO: 342548 - DNA, 25 bp, Mus musculus
gtggaatttatgggatgaacaagaa

SEQ ID NO: 342549 - DNA, 25 bp, Mus musculus
gtggaattttgtaagaggacaatgc

SEQ ID NO: 342550 - DNA, 25 bp, Mus musculus
gtggaattttgtaagtacaaacagg

SEQ ID NO: 342551 - DNA, 25 bp, Mus musculus
gtggacaaagacggttatattaaga

SEQ ID NO: 342552 - DNA, 25 bp, Mus musculus
gtggacaaagatgagtggataagtg

SEQ ID NO: 342553 - DNA, 25 bp, Mus musculus
gtggacaaatccaggtggctcctcc

SEQ ID NO: 342554 - DNA, 25 bp, Mus musculus
gtggacaaatcctcgtggctcctcc

SEQ ID NO: 342555 - DNA, 25 bp, Mus musculus
gtggacaaggaagactttctctgtg

SEQ ID NO: 342556 - DNA, 25 bp, Mus musculus
gtggacaaggaaggttctgagcctg

SEQ ID NO: 342557 - DNA, 25 bp, Mus musculus
gtggacaatcatggctgtcatggta

SEQ ID NO: 342558 - DNA, 25 bp, Mus musculus
gtggacacctatgaacttgcgatgt

SEQ ID NO: 342559 - DNA, 25 bp, Mus musculus
gtggacacctatgttttcaaagata

SEQ ID NO: 342560 - DNA, 25 bp, Mus musculus
gtggacacttaacaggtccccaggc

SEQ ID NO: 342561 - DNA, 25 bp, Mus musculus
gtggacacttaccaggtctttgaca

SEQ ID NO: 342562 - DNA, 25 bp, Mus musculus
gtggacacttgagaggctacagaca

SEQ ID NO: 342563 - DNA, 25 bp, Mus musculus
gtggacagcagtcccagcgcttccc

SEQ ID NO: 342564 - DNA, 25 bp, Mus musculus
gtggacaggccaaagcttcctgaaa

SEQ ID NO: 342565 - DNA, 25 bp, Mus musculus
gtggacagtgaagatggagctggag

SEQ ID NO: 342566 - DNA, 25 bp, Mus musculus
gtggacagtgaaggtgacccttgta

SEQ ID NO: 342567 - DNA, 25 bp, Mus musculus
gtggacatcaggatgtgatggtggc

SEQ ID NO: 342568 - DNA, 25 bp, Mus musculus
gtggacatcgtggccagacttcatg

SEQ ID NO: 342569 - DNA, 25 bp, Mus musculus
gtggacatcgtggctcctgcttcct

SEQ ID NO: 342570 - DNA, 25 bp, Mus musculus
gtggacatcgttaaccagaatggag

SEQ ID NO: 342571 - DNA, 25 bp, Mus musculus
gtggacatctccaagatgcacatga

SEQ ID NO: 342572 - DNA, 25 bp, Mus musculus
gtggacatgaaagtggccgaggtcc

SEQ ID NO: 342573 - DNA, 25 bp, Mus musculus
gtggacatgaagctgtttgtatggc

SEQ ID NO: 342574 - DNA, 25 bp, Mus musculus
gtggacatgaaggtgcctcagccag

SEQ ID NO: 342575 - DNA, 25 bp, Mus musculus
gtggaccaaaaatgtggacatcttc

SEQ ID NO: 342576 - DNA, 25 bp, Mus musculus
gtggaccaagtttgttgcatattct

SEQ ID NO: 342577 - DNA, 25 bp, Mus musculus
gtggaccacagtcaccgagagtgag

SEQ ID NO: 342578 - DNA, 25 bp, Mus musculus
gtggaccacattaggactctgttgg

SEQ ID NO: 342579 - DNA, 25 bp, Mus musculus
gtggaccacattaggatctgaagtg

SEQ ID NO: 342580 - DNA, 25 bp, Mus musculus
gtggaccacgaatgtgccgcttcat

SEQ ID NO: 342581 - DNA, 25 bp, Mus musculus
gtggaccatcaaacagacctttggc

SEQ ID NO: 342582 - DNA, 25 bp, Mus musculus
gtggaccatcggggtacctggaatg

SEQ ID NO: 342583 - DNA, 25 bp, Mus musculus
gtggaccatggccttatgttgactt

SEQ ID NO: 342584 - DNA, 25 bp, Mus musculus
gtggacccagaggagacttgtgcac

SEQ ID NO: 342585 - DNA, 25 bp, Mus musculus
gtggacccagccccgggaacaccgc

SEQ ID NO: 342586 - DNA, 25 bp, Mus musculus
gtggacccagctgtcctggaagatg

SEQ ID NO: 342587 - DNA, 25 bp, Mus musculus
gtggacccagggctgttgggagaaa

SEQ ID NO: 342588 - DNA, 25 bp, Mus musculus
gtggacccaggtttgccgaagatgc

SEQ ID NO: 342589 - DNA, 25 bp, Mus musculus
gtggaccccaaaggccatgaagaag

SEQ ID NO: 342590 - DNA, 25 bp, Mus musculus
gtggaccccagacatcacgagcatt

SEQ ID NO: 342591 - DNA, 25 bp, Mus musculus
gtggaccccagcggcagctccggct

SEQ ID NO: 342592 - DNA, 25 bp, Mus musculus
gtggaccccgtggatggtgtggtcc

SEQ ID NO: 342593 - DNA, 25 bp, Mus musculus
gtggaccccgtggtctacgtgacac

SEQ ID NO: 342594 - DNA, 25 bp, Mus musculus
gtggaccctaaggagaaggagcgcc

SEQ ID NO: 342595 - DNA, 25 bp, Mus musculus
gtggaccctaagtgcagctttgttg

SEQ ID NO: 342596 - DNA, 25 bp, Mus musculus
gtggaccctcagattgatgacattg

SEQ ID NO: 342597 - DNA, 25 bp, Mus musculus
gtggaccctgagttccaccaggtga

SEQ ID NO: 342598 - DNA, 25 bp, Mus musculus
gtggaccgtgggagaactactatcc

SEQ ID NO: 342599 - DNA, 25 bp, Mus musculus
gtggacctagaatggtgtgccagga

SEQ ID NO: 342600 - DNA, 25 bp, Mus musculus
gtggacctagaatggtttgcaatag

SEQ ID NO: 342601 - DNA, 25 bp, Mus musculus
gtggacctagaatgtgggcacaatg

SEQ ID NO: 342602 - DNA, 25 bp, Mus musculus
gtggacctagattcatcagccagat

SEQ ID NO: 342603 - DNA, 25 bp, Mus musculus
gtggacctagggtttctctgtagag

SEQ ID NO: 342604 - DNA, 25 bp, Mus musculus
gtggacctcaggcatcctgcatcct

SEQ ID NO: 342605 - DNA, 25 bp, Mus musculus
gtggacctcaggcatcctggatcct

SEQ ID NO: 342606 - DNA, 25 bp, Mus musculus
gtggacctccactccaggcagcaga

SEQ ID NO: 342607 - DNA, 25 bp, Mus musculus
gtggacctgcttgtgatatatgttg

SEQ ID NO: 342608 - DNA, 25 bp, Mus musculus
gtggacgaagaaaatattcccgaga

SEQ ID NO: 342609 - DNA, 25 bp, Mus musculus
gtggacgaagcaatggcaagccggc

SEQ ID NO: 342610 - DNA, 25 bp, Mus musculus
gtggacgacagctttagccaggccc

SEQ ID NO: 342611 - DNA, 25 bp, Mus musculus
gtggacgagagtttcggggccagga

SEQ ID NO: 342612 - DNA, 25 bp, Mus musculus
gtggacgagtctgatagctgctgct

SEQ ID NO: 342613 - DNA, 25 bp, Mus musculus
gtggacgcgaggtacaacgcctacc

SEQ ID NO: 342614 - DNA, 25 bp, Mus musculus
gtggacgcgagtttcggacccagta

SEQ ID NO: 342615 - DNA, 25 bp, Mus musculus
gtggacgctcaggggaggggcgaca

SEQ ID NO: 342616 - DNA, 25 bp, Mus musculus
gtggacgctctgctcatttgggagg

SEQ ID NO: 342617 - DNA, 25 bp, Mus musculus
gtggacgctctggtcatccaacttg

SEQ ID NO: 342618 - DNA, 25 bp, Mus musculus
gtggacggacgggcgcctctgaagc

SEQ ID NO: 342619 - DNA, 25 bp, Mus musculus
gtggacggctgcacgagtcacaccg

SEQ ID NO: 342620 - DNA, 25 bp, Mus musculus
gtggacgggattaaggaatcttccg

SEQ ID NO: 342621 - DNA, 25 bp, Mus musculus
gtggacggggaggtgctgacggaga

SEQ ID NO: 342622 - DNA, 25 bp, Mus musculus
gtggacgtggaaggcattttgtgac

SEQ ID NO: 342623 - DNA, 25 bp, Mus musculus
gtggacgtggaaggccttgatcctg

SEQ ID NO: 342624 - DNA, 25 bp, Mus musculus
gtggactacaagatgtcccactttg

SEQ ID NO: 342625 - DNA, 25 bp, Mus musculus
gtggactcaatgcgatctggttcta

SEQ ID NO: 342626 - DNA, 25 bp, Mus musculus
gtggactcatctaaggaattagctg

SEQ ID NO: 342627 - DNA, 25 bp, Mus musculus
gtggactccggaggaacctggctca

SEQ ID NO: 342628 - DNA, 25 bp, Mus musculus
gtggactcgacagtgttagcaacaa

SEQ ID NO: 342629 - DNA, 25 bp, Mus musculus
gtggactctacaggagagtattgtc

SEQ ID NO: 342630 - DNA, 25 bp, Mus musculus
gtggactctactgtgaggtctacat

SEQ ID NO: 342631 - DNA, 25 bp, Mus musculus
gtggactctctgaagagcactctgg

SEQ ID NO: 342632 - DNA, 25 bp, Mus musculus
gtggactgaggtgctgcactgtgct

SEQ ID NO: 342633 - DNA, 25 bp, Mus musculus
gtggactgctggcctggtagaggag

SEQ ID NO: 342634 - DNA, 25 bp, Mus musculus
gtggactggagtgagtcagcagtgt

SEQ ID NO: 342635 - DNA, 25 bp, Mus musculus
gtggactgggcgctggagagcgagg

SEQ ID NO: 342636 - DNA, 25 bp, Mus musculus
gtggactgtcagactgctgggctga

SEQ ID NO: 342637 - DNA, 25 bp, Mus musculus
gtggactgtcaggattctctttcaa

SEQ ID NO: 342638 - DNA, 25 bp, Mus musculus
gtggactgtgatgggtgtacaatag

SEQ ID NO: 342639 - DNA, 25 bp, Mus musculus
gtggacttagagcatcactcttaca

SEQ ID NO: 342640 - DNA, 25 bp, Mus musculus
gtggacttagggctgaccagtttga

SEQ ID NO: 342641 - DNA, 25 bp, Mus musculus
gtggacttaggtgacaagttccggt

SEQ ID NO: 342642 - DNA, 25 bp, Mus musculus
gtggactttctcagatcgtttagga

SEQ ID NO: 342643 - DNA, 25 bp, Mus musculus
gtggactttctcaggagtctcatga

SEQ ID NO: 342644 - DNA, 25 bp, Mus musculus
gtggactttgaagctgttaagaaga

SEQ ID NO: 342645 - DNA, 25 bp, Mus musculus
gtggagaaaaacgaaaatcttcaag

SEQ ID NO: 342646 - DNA, 25 bp, Mus musculus
gtggagaaaagagaatattttccag

SEQ ID NO: 342647 - DNA, 25 bp, Mus musculus
gtggagaaaagaggaatattagtta

SEQ ID NO: 342648 - DNA, 25 bp, Mus musculus
gtggagaaacaggtcttgtccatgg

SEQ ID NO: 342649 - DNA, 25 bp, Mus musculus
gtggagaaaggtttccttctcttat

SEQ ID NO: 342650 - DNA, 25 bp, Mus musculus
gtggagaactccagggaggtcctga

SEQ ID NO: 342651 - DNA, 25 bp, Mus musculus
gtggagaactccaggtctttccagc

SEQ ID NO: 342652 - DNA, 25 bp, Mus musculus
gtggagaagagatgctggtcccttt

SEQ ID NO: 342653 - DNA, 25 bp, Mus musculus
gtggagaagaggatgcccctgtgga

SEQ ID NO: 342654 - DNA, 25 bp, Mus musculus
gtggagaagatggttccatatctgc

SEQ ID NO: 342655 - DNA, 25 bp, Mus musculus
gtggagaagggtcaactgctgctac

SEQ ID NO: 342656 - DNA, 25 bp, Mus musculus
gtggagaagggtttcaaagctgaat

SEQ ID NO: 342657 - DNA, 25 bp, Mus musculus
gtggagaagtgcacgtaagttcata

SEQ ID NO: 342658 - DNA, 25 bp, Mus musculus
gtggagaataagcgtgaagtgcagc

SEQ ID NO: 342659 - DNA, 25 bp, Mus musculus
gtggagaataagtggtacagggtac

SEQ ID NO: 342660 - DNA, 25 bp, Mus musculus
gtggagaatccgaggccacaggcct

SEQ ID NO: 342661 - DNA, 25 bp, Mus musculus
gtggagaatgaagatgctgggtttt

SEQ ID NO: 342662 - DNA, 25 bp, Mus musculus
gtggagaatgtgggctcatggcaga

SEQ ID NO: 342663 - DNA, 25 bp, Mus musculus
gtggagacaacggaaagacgatgct

SEQ ID NO: 342664 - DNA, 25 bp, Mus musculus
gtggagacaaggagtttttgggtaa

SEQ ID NO: 342665 - DNA, 25 bp, Mus musculus
gtggagacacagacgctgttccggc

SEQ ID NO: 342666 - DNA, 25 bp, Mus musculus
gtggagacagagcagacgatttaca

SEQ ID NO: 342667 - DNA, 25 bp, Mus musculus
gtggagacagaggaggtggtcctgg

SEQ ID NO: 342668 - DNA, 25 bp, Mus musculus
gtggagacagcccacaggatgactc

SEQ ID NO: 342669 - DNA, 25 bp, Mus musculus
gtggagacaggacctcacgcatccg

SEQ ID NO: 342670 - DNA, 25 bp, Mus musculus
gtggagacagtttgaagaggacatc

SEQ ID NO: 342671 - DNA, 25 bp, Mus musculus
gtggagaccaacagacctgatagca

SEQ ID NO: 342672 - DNA, 25 bp, Mus musculus
gtggagaccaacagcaagaactggc

SEQ ID NO: 342673 - DNA, 25 bp, Mus musculus
gtggagaccagcagcccagagtatg

SEQ ID NO: 342674 - DNA, 25 bp, Mus musculus
gtggagaccagcatgattgggctga

SEQ ID NO: 342675 - DNA, 25 bp, Mus musculus
gtggagactcaaactgaagtgagta

SEQ ID NO: 342676 - DNA, 25 bp, Mus musculus
gtggagactgagcaaatcggccaag

SEQ ID NO: 342677 - DNA, 25 bp, Mus musculus
gtggagactggcacccagctggaaa

SEQ ID NO: 342678 - DNA, 25 bp, Mus musculus
gtggagactggtcttgctttgtgcc

SEQ ID NO: 342679 - DNA, 25 bp, Mus musculus
gtggagagaaagtttgctcttcaaa

SEQ ID NO: 342680 - DNA, 25 bp, Mus musculus
gtggagagagatggtatggtgtatg

SEQ ID NO: 342681 - DNA, 25 bp, Mus musculus
gtggagagaggcaaactgctccaca

SEQ ID NO: 342682 - DNA, 25 bp, Mus musculus
gtggagagatacagaatgaatgaag

SEQ ID NO: 342683 - DNA, 25 bp, Mus musculus
gtggagagatacagagcactggtga

SEQ ID NO: 342684 - DNA, 25 bp, Mus musculus
gtggagagcaagctcgaagaggatg

SEQ ID NO: 342685 - DNA, 25 bp, Mus musculus
gtggagagcaaggtcgaagaggatg

SEQ ID NO: 342686 - DNA, 25 bp, Mus musculus
gtggagagcgagctgcagcgactcc

SEQ ID NO: 342687 - DNA, 25 bp, Mus musculus
gtggagagcgtgaaagagtttctag

SEQ ID NO: 342688 - DNA, 25 bp, Mus musculus
gtggagaggaaacgatcctggggca

SEQ ID NO: 342689 - DNA, 25 bp, Mus musculus
gtggagaggagctctcctatgtgga

SEQ ID NO: 342690 - DNA, 25 bp, Mus musculus
gtggagaggcagagatggacttcct

SEQ ID NO: 342691 - DNA, 25 bp, Mus musculus
gtggagagggaccttcttcacctgg

SEQ ID NO: 342692 - DNA, 25 bp, Mus musculus
gtggagagggcagcggccgtctggg

SEQ ID NO: 342693 - DNA, 25 bp, Mus musculus
gtggagagggcagcggttccttcct

SEQ ID NO: 342694 - DNA, 25 bp, Mus musculus
gtggagataccaggcacaatcactt

SEQ ID NO: 342695 - DNA, 25 bp, Mus musculus
gtggagatagccaatgagatagatg

SEQ ID NO: 342696 - DNA, 25 bp, Mus musculus
gtggagatccagctgatggtagaag

SEQ ID NO: 342697 - DNA, 25 bp, Mus musculus
gtggagatccagtgtcctgagcaag

SEQ ID NO: 342698 - DNA, 25 bp, Mus musculus
gtggagatcgatgagctatgtgcca

SEQ ID NO: 342699 - DNA, 25 bp, Mus musculus
gtggagatcgatgaggaagggaacc

SEQ ID NO: 342700 - DNA, 25 bp, Mus musculus
gtggagatctcaaagggggaaaaac

SEQ ID NO: 342701 - DNA, 25 bp, Mus musculus
gtggagatgcaaggagagtctcttc

SEQ ID NO: 342702 - DNA, 25 bp, Mus musculus
gtggagatggacggaatgggcacca

SEQ ID NO: 342703 - DNA, 25 bp, Mus musculus
gtggagatggagacattgatggaca

SEQ ID NO: 342704 - DNA, 25 bp, Mus musculus
gtggagattccagcaattcctggag

SEQ ID NO: 342705 - DNA, 25 bp, Mus musculus
gtggagattccaggaagcccctgag

SEQ ID NO: 342706 - DNA, 25 bp, Mus musculus
gtggagcaaggtggccctgtctcaa

SEQ ID NO: 342707 - DNA, 25 bp, Mus musculus
gtggagcaagtgtttgccaagaatt

SEQ ID NO: 342708 - DNA, 25 bp, Mus musculus
gtggagcacatatcgacttggagag

SEQ ID NO: 342709 - DNA, 25 bp, Mus musculus
gtggagcagatgtagttcatcctat

SEQ ID NO: 342710 - DNA, 25 bp, Mus musculus
gtggagcaggacatgctggcctcaa

SEQ ID NO: 342711 - DNA, 25 bp, Mus musculus
gtggagcaggacatgtttgcacacc

SEQ ID NO: 342712 - DNA, 25 bp, Mus musculus
gtggagcagggccgactgatctttg

SEQ ID NO: 342713 - DNA, 25 bp, Mus musculus
gtggagcagggctcaaactcagaaa

SEQ ID NO: 342714 - DNA, 25 bp, Mus musculus
gtggagcaggtgagggggtcggggt

SEQ ID NO: 342715 - DNA, 25 bp, Mus musculus
gtggagcatcccgagatgacacgaa

SEQ ID NO: 342716 - DNA, 25 bp, Mus musculus
gtggagcatcccgaggtgtttacaa

SEQ ID NO: 342717 - DNA, 25 bp, Mus musculus
gtggagcccaagtttcagccatggc

SEQ ID NO: 342718 - DNA, 25 bp, Mus musculus
gtggagcccacgagcacccggagga

SEQ ID NO: 342719 - DNA, 25 bp, Mus musculus
gtggagcccacggtgacactgctga

SEQ ID NO: 342720 - DNA, 25 bp, Mus musculus
gtggagcccttgacgcctccttggc

SEQ ID NO: 342721 - DNA, 25 bp, Mus musculus
gtggagccgcgtagactttaagaaa

SEQ ID NO: 342722 - DNA, 25 bp, Mus musculus
gtggagcgacaaggtaaaagaagaa

SEQ ID NO: 342723 - DNA, 25 bp, Mus musculus
gtggagcgagcggatttgataatgg

SEQ ID NO: 342724 - DNA, 25 bp, Mus musculus
gtggagcgatcagaggaacaaggag

SEQ ID NO: 342725 - DNA, 25 bp, Mus musculus
gtggagcgtggagaccatcttcaac

SEQ ID NO: 342726 - DNA, 25 bp, Mus musculus
gtggagctaagaacggaaagaccaa

SEQ ID NO: 342727 - DNA, 25 bp, Mus musculus
gtggagctctccgccggctgattat

SEQ ID NO: 342728 - DNA, 25 bp, Mus musculus
gtggagctgagaaccagtcttctgg

SEQ ID NO: 342729 - DNA, 25 bp, Mus musculus
gtggagctgagagttcttccagatg

SEQ ID NO: 342730 - DNA, 25 bp, Mus musculus
gtggagctgagctcactccgtgtct

SEQ ID NO: 342731 - DNA, 25 bp, Mus musculus
gtggagctgcagggatacaaactgc

SEQ ID NO: 342732 - DNA, 25 bp, Mus musculus
gtggagctgctgggaagatgctacc

SEQ ID NO: 342733 - DNA, 25 bp, Mus musculus
gtggagctggaaggtcttgttgcag

SEQ ID NO: 342734 - DNA, 25 bp, Mus musculus
gtggagctggagggctaaaaccgac

SEQ ID NO: 342735 - DNA, 25 bp, Mus musculus
gtggagctggatcgggcggtgctgc

SEQ ID NO: 342736 - DNA, 25 bp, Mus musculus
gtggagctgggacaggtggccctaa

SEQ ID NO: 342737 - DNA, 25 bp, Mus musculus
gtggagctggtctgggactgtgccc

SEQ ID NO: 342738 - DNA, 25 bp, Mus musculus
gtggagctgtacaaggtgctgagtt

SEQ ID NO: 342739 - DNA, 25 bp, Mus musculus
gtggagctttgaatcgggaggaagc

SEQ ID NO: 342740 - DNA, 25 bp, Mus musculus
gtggaggaaaatctgaatgaggtgt

SEQ ID NO: 342741 - DNA, 25 bp, Mus musculus
gtggaggaaatcaatcgcaagcagg

SEQ ID NO: 342742 - DNA, 25 bp, Mus musculus
gtggaggaacagagaagctcccgtc

SEQ ID NO: 342743 - DNA, 25 bp, Mus musculus
gtggaggaagcacctcccactaatc

SEQ ID NO: 342744 - DNA, 25 bp, Mus musculus
gtggaggaagctcatctacggaccc

SEQ ID NO: 342745 - DNA, 25 bp, Mus musculus
gtggaggacctggaggaaattatgg

SEQ ID NO: 342746 - DNA, 25 bp, Mus musculus
gtggaggagaagatggagcgagatg

SEQ ID NO: 342747 - DNA, 25 bp, Mus musculus
gtggaggagaatggggagacctgtc

SEQ ID NO: 342748 - DNA, 25 bp, Mus musculus
gtggaggagcagtgccctcagccag

SEQ ID NO: 342749 - DNA, 25 bp, Mus musculus
gtggaggaggaaaaggcatgaggat

SEQ ID NO: 342750 - DNA, 25 bp, Mus musculus
gtggaggagggggatatgaaaggtg

SEQ ID NO: 342751 - DNA, 25 bp, Mus musculus
gtggaggatctggaaagagaacttg

SEQ ID NO: 342752 - DNA, 25 bp, Mus musculus
gtggaggcaaatatctgaaagattt

SEQ ID NO: 342753 - DNA, 25 bp, Mus musculus
gtggaggcaagatgcctttgcgggg

SEQ ID NO: 342754 - DNA, 25 bp, Mus musculus
gtggaggcaaggaagacatacatgg

SEQ ID NO: 342755 - DNA, 25 bp, Mus musculus
gtggaggcagaggaggtagaggagg

SEQ ID NO: 342756 - DNA, 25 bp, Mus musculus
gtggaggcagtgtgcaaatagtcta

SEQ ID NO: 342757 - DNA, 25 bp, Mus musculus
gtggaggcagttgtctgctacagag

SEQ ID NO: 342758 - DNA, 25 bp, Mus musculus
gtggaggccaagcaggtgcaggccc

SEQ ID NO: 342759 - DNA, 25 bp, Mus musculus
gtggaggccaagggagaagcaagcc

SEQ ID NO: 342760 - DNA, 25 bp, Mus musculus
gtggaggccaaggggagtggagtaa

SEQ ID NO: 342761 - DNA, 25 bp, Mus musculus
gtggaggcctcatgatgcctggaat

SEQ ID NO: 342762 - DNA, 25 bp, Mus musculus
gtggaggcctcatgatggggcatcc

SEQ ID NO: 342763 - DNA, 25 bp, Mus musculus
gtggaggcgccactgcccacactta

SEQ ID NO: 342764 - DNA, 25 bp, Mus musculus
gtggaggcggccaagggagcagccg

SEQ ID NO: 342765 - DNA, 25 bp, Mus musculus
gtggaggcgggggccctagctgctg

SEQ ID NO: 342766 - DNA, 25 bp, Mus musculus
gtggaggctgggctgtacgggagcc

SEQ ID NO: 342767 - DNA, 25 bp, Mus musculus
gtggagggacagcaactgctttgct

SEQ ID NO: 342768 - DNA, 25 bp, Mus musculus
gtggagggacagtgacaggtttctg

SEQ ID NO: 342769 - DNA, 25 bp, Mus musculus
gtggagggtgccaaaaaggccaaca

SEQ ID NO: 342770 - DNA, 25 bp, Mus musculus
gtggaggtagagggtggagtttacc

SEQ ID NO: 342771 - DNA, 25 bp, Mus musculus
gtggaggtccgagggtgacttcacc

SEQ ID NO: 342772 - DNA, 25 bp, Mus musculus
gtggaggtcttcaaggaaccagcac

SEQ ID NO: 342773 - DNA, 25 bp, Mus musculus
gtggaggtgaaggccaatacatatg

SEQ ID NO: 342774 - DNA, 25 bp, Mus musculus
gtggaggtggcccaggtccctgtcc

SEQ ID NO: 342775 - DNA, 25 bp, Mus musculus
gtggaggtggctgtgtctttcagcc

SEQ ID NO: 342776 - DNA, 25 bp, Mus musculus
gtggaggtggggtgctgtgagtggc

SEQ ID NO: 342777 - DNA, 25 bp, Mus musculus
gtggaggttgcatcagatgaagaaa

SEQ ID NO: 342778 - DNA, 25 bp, Mus musculus
gtggaggttggtccctgcatcccta

SEQ ID NO: 342779 - DNA, 25 bp, Mus musculus
gtggaggttttgttggtgtgcaaca

SEQ ID NO: 342780 - DNA, 25 bp, Mus musculus
gtggagtacgaatatattgtggctt

SEQ ID NO: 342781 - DNA, 25 bp, Mus musculus
gtggagtactgagaggtagccagaa

SEQ ID NO: 342782 - DNA, 25 bp, Mus musculus
gtggagtcaaagagtggcttcaccc

SEQ ID NO: 342783 - DNA, 25 bp, Mus musculus
gtggagtcattcaagtttatctccg

SEQ ID NO: 342784 - DNA, 25 bp, Mus musculus
gtggagtccacgtacaagtatgaat

SEQ ID NO: 342785 - DNA, 25 bp, Mus musculus
gtggagtccgtcacgctggcggtgg

SEQ ID NO: 342786 - DNA, 25 bp, Mus musculus
gtggagtgcaggccctgcaggtcgg

SEQ ID NO: 342787 - DNA, 25 bp, Mus musculus
gtggagtggggacggcagcggctct

SEQ ID NO: 342788 - DNA, 25 bp, Mus musculus
gtggagtgtggattttatggatacg

SEQ ID NO: 342789 - DNA, 25 bp, Mus musculus
gtggagttacagctgccttgccttg

SEQ ID NO: 342790 - DNA, 25 bp, Mus musculus
gtggagttcagagacctcaacgaat

SEQ ID NO: 342791 - DNA, 25 bp, Mus musculus
gtggagttcagcagcacttggaaca

SEQ ID NO: 342792 - DNA, 25 bp, Mus musculus
gtggagttctaccccacaatcaagt

SEQ ID NO: 342793 - DNA, 25 bp, Mus musculus
gtggagttctagtttggattaacgc

SEQ ID NO: 342794 - DNA, 25 bp, Mus musculus
gtggagttctatgccccgtggtgtg

SEQ ID NO: 342795 - DNA, 25 bp, Mus musculus
gtggagttctatgccccttggtgtg

SEQ ID NO: 342796 - DNA, 25 bp, Mus musculus
gtggataaatagatgcccgtgtggt

SEQ ID NO: 342797 - DNA, 25 bp, Mus musculus
gtggataacaaaaaggccctaggcc

SEQ ID NO: 342798 - DNA, 25 bp, Mus musculus
gtggataacaaaaaggtgatgaagg

SEQ ID NO: 342799 - DNA, 25 bp, Mus musculus
gtggataacatgagcatcatcagct

SEQ ID NO: 342800 - DNA, 25 bp, Mus musculus
gtggataacccaggctgcatgagtg

SEQ ID NO: 342801 - DNA, 25 bp, Mus musculus
gtggataaggactgaatcttggtac

SEQ ID NO: 342802 - DNA, 25 bp, Mus musculus
gtggataatgtagagggtcctgtta

SEQ ID NO: 342803 - DNA, 25 bp, Mus musculus
gtggatactttaaagagaatgtggt

SEQ ID NO: 342804 - DNA, 25 bp, Mus musculus
gtggatactttaaagatgaaaactt

SEQ ID NO: 342805 - DNA, 25 bp, Mus musculus
gtggatagtgtggaaacctgctgcc

SEQ ID NO: 342806 - DNA, 25 bp, Mus musculus
gtggatagtgtgggcctgccagctc

SEQ ID NO: 342807 - DNA, 25 bp, Mus musculus
gtggatatatccgaaatggctacca

SEQ ID NO: 342808 - DNA, 25 bp, Mus musculus
gtggatatgcaggtgcttcaccttt

SEQ ID NO: 342809 - DNA, 25 bp, Mus musculus
gtggatcaagtgtttgcaaaaaatt

SEQ ID NO: 342810 - DNA, 25 bp, Mus musculus
gtggatcacagctgcgaccgagggc

SEQ ID NO: 342811 - DNA, 25 bp, Mus musculus
gtggatcacgaaggtaacttcatgg

SEQ ID NO: 342812 - DNA, 25 bp, Mus musculus
gtggatcacgaattgggccggtgta

SEQ ID NO: 342813 - DNA, 25 bp, Mus musculus
gtggatcaggtactggcccttggga

SEQ ID NO: 342814 - DNA, 25 bp, Mus musculus
gtggatccagaccaaaaccaacaaa

SEQ ID NO: 342815 - DNA, 25 bp, Mus musculus
gtggatccagatctcggacgctgtg

SEQ ID NO: 342816 - DNA, 25 bp, Mus musculus
gtggatccctgctgacaaggacacc

SEQ ID NO: 342817 - DNA, 25 bp, Mus musculus
gtggatccttacatgcgctgtaaga

SEQ ID NO: 342818 - DNA, 25 bp, Mus musculus
gtggatccttacatgctcctgacca

SEQ ID NO: 342819 - DNA, 25 bp, Mus musculus
gtggatccttgatcttagaatcttt

SEQ ID NO: 342820 - DNA, 25 bp, Mus musculus
gtggatccttgggggcaggtcctaa

SEQ ID NO: 342821 - DNA, 25 bp, Mus musculus
gtggatcgagaacactgtagctgtc

SEQ ID NO: 342822 - DNA, 25 bp, Mus musculus
gtggatcgagatggttgtgagctac

SEQ ID NO: 342823 - DNA, 25 bp, Mus musculus
gtggatcgcggggtcccagctcctg

SEQ ID NO: 342824 - DNA, 25 bp, Mus musculus
gtggatcggccagtgagcccatcat

SEQ ID NO: 342825 - DNA, 25 bp, Mus musculus
gtggatcggccagtgccaaggcctg

SEQ ID NO: 342826 - DNA, 25 bp, Mus musculus
gtggatcggcggttcattacagcat

SEQ ID NO: 342827 - DNA, 25 bp, Mus musculus
gtggatctctcagcaccatatcctc

SEQ ID NO: 342828 - DNA, 25 bp, Mus musculus
gtggatctgaataagtgcggaccta

SEQ ID NO: 342829 - DNA, 25 bp, Mus musculus
gtggatctgcagccatgtcatatcc

SEQ ID NO: 342830 - DNA, 25 bp, Mus musculus
gtggatctggcccagaggccaagtg

SEQ ID NO: 342831 - DNA, 25 bp, Mus musculus
gtggatctgttacccacaggtccgc

SEQ ID NO: 342832 - DNA, 25 bp, Mus musculus
gtggatcttcttaaggagagcgatt

SEQ ID NO: 342833 - DNA, 25 bp, Mus musculus
gtggatgaagacaaggtgctggtct

SEQ ID NO: 342834 - DNA, 25 bp, Mus musculus
gtggatgacaaggcatctgtgggct

SEQ ID NO: 342835 - DNA, 25 bp, Mus musculus
gtggatgacagacacccctgcactg

SEQ ID NO: 342836 - DNA, 25 bp, Mus musculus
gtggatgacagagcagagcctgcta

SEQ ID NO: 342837 - DNA, 25 bp, Mus musculus
gtggatgactgaagctggccccgtt

SEQ ID NO: 342838 - DNA, 25 bp, Mus musculus
gtggatgactgggcagccacgcccc

SEQ ID NO: 342839 - DNA, 25 bp, Mus musculus
gtggatgagttttgaagtgaggaga

SEQ ID NO: 342840 - DNA, 25 bp, Mus musculus
gtggatgatattggtgatgtaacca

SEQ ID NO: 342841 - DNA, 25 bp, Mus musculus
gtggatgatcaaaaccaggggctgt

SEQ ID NO: 342842 - DNA, 25 bp, Mus musculus
gtggatgcactcagggtgactacaa

SEQ ID NO: 342843 - DNA, 25 bp, Mus musculus
gtggatgcactcaggttgaaggtgg

SEQ ID NO: 342844 - DNA, 25 bp, Mus musculus
gtggatgcagctgccatcaaacttc

SEQ ID NO: 342845 - DNA, 25 bp, Mus musculus
gtggatgcaggccctgcttctctaa

SEQ ID NO: 342846 - DNA, 25 bp, Mus musculus
gtggatgcagggagcccccgggcca

SEQ ID NO: 342847 - DNA, 25 bp, Mus musculus
gtggatgccctagtcctgcgcttct

SEQ ID NO: 342848 - DNA, 25 bp, Mus musculus
gtggatgccgtggaggaccccagca

SEQ ID NO: 342849 - DNA, 25 bp, Mus musculus
gtggatgctgatgagttcttgacca

SEQ ID NO: 342850 - DNA, 25 bp, Mus musculus
gtggatgctgatggcaatggcacca

SEQ ID NO: 342851 - DNA, 25 bp, Mus musculus
gtggatgctgatggcaatgggacca

SEQ ID NO: 342852 - DNA, 25 bp, Mus musculus
gtggatgctggaggtcacatctgtc

SEQ ID NO: 342853 - DNA, 25 bp, Mus musculus
gtggatgctggaggtgagccttccc

SEQ ID NO: 342854 - DNA, 25 bp, Mus musculus
gtggatgctgtggtggaatgcaatt

SEQ ID NO: 342855 - DNA, 25 bp, Mus musculus
gtggatgcttctcttcaggcctggg

SEQ ID NO: 342856 - DNA, 25 bp, Mus musculus
gtggatggaggcattgcactcagcg

SEQ ID NO: 342857 - DNA, 25 bp, Mus musculus
gtggatggagtgggtaacttcagaa

SEQ ID NO: 342858 - DNA, 25 bp, Mus musculus
gtggatggagttcgacagaacagaa

SEQ ID NO: 342859 - DNA, 25 bp, Mus musculus
gtggatggcgagaaataccagaggg

SEQ ID NO: 342860 - DNA, 25 bp, Mus musculus
gtggatggctacggaatgtcacttg

SEQ ID NO: 342861 - DNA, 25 bp, Mus musculus
gtggatggctacggccatctttttt

SEQ ID NO: 342862 - DNA, 25 bp, Mus musculus
gtggatgggtcagggaaagagttgt

SEQ ID NO: 342863 - DNA, 25 bp, Mus musculus
gtggatgggtgaacgagcgtcagtg

SEQ ID NO: 342864 - DNA, 25 bp, Mus musculus
gtggatggtgacctgctggcagggg

SEQ ID NO: 342865 - DNA, 25 bp, Mus musculus
gtggatgtagagaaggccatcgccc

SEQ ID NO: 342866 - DNA, 25 bp, Mus musculus
gtggatgtgatgctttagatgagca

SEQ ID NO: 342867 - DNA, 25 bp, Mus musculus
gtggatgttcaattggcttcgtgag

SEQ ID NO: 342868 - DNA, 25 bp, Mus musculus
gtggatgtttccaagtttggtgtga

SEQ ID NO: 342869 - DNA, 25 bp, Mus musculus
gtggattaaagctttctccttatgt

SEQ ID NO: 342870 - DNA, 25 bp, Mus musculus
gtggattatctgaagagcccagagc

SEQ ID NO: 342871 - DNA, 25 bp, Mus musculus
gtggattatctgaaggcctgggagc

SEQ ID NO: 342872 - DNA, 25 bp, Mus musculus
gtggattcaatcgaagatgctggtg

SEQ ID NO: 342873 - DNA, 25 bp, Mus musculus
gtggattcagcatttaagcaaaact

SEQ ID NO: 342874 - DNA, 25 bp, Mus musculus
gtggattcaggctcggtcttttccg

SEQ ID NO: 342875 - DNA, 25 bp, Mus musculus
gtggattcatgactcaggcccacaa

SEQ ID NO: 342876 - DNA, 25 bp, Mus musculus
gtggattctgaccacctcatcctcc

SEQ ID NO: 342877 - DNA, 25 bp, Mus musculus
gtggattctgggaaggtgaaggaga

SEQ ID NO: 342878 - DNA, 25 bp, Mus musculus
gtggattgattcgttctccccgcca

SEQ ID NO: 342879 - DNA, 25 bp, Mus musculus
gtggattgccgggagccaccatgtt

SEQ ID NO: 342880 - DNA, 25 bp, Mus musculus
gtggattgccgggagctgaccggaa

SEQ ID NO: 342881 - DNA, 25 bp, Mus musculus
gtggattggccggctatggggcatg

SEQ ID NO: 342882 - DNA, 25 bp, Mus musculus
gtggatttaggagaggatgaagatc

SEQ ID NO: 342883 - DNA, 25 bp, Mus musculus
gtggatttccaggcagtagaggccc

SEQ ID NO: 342884 - DNA, 25 bp, Mus musculus
gtggatttccaggccgtggtattcc

SEQ ID NO: 342885 - DNA, 25 bp, Mus musculus
gtggatttgaaagagctgaatgata

SEQ ID NO: 342886 - DNA, 25 bp, Mus musculus
gtggattttcggcctggccgagtgg

SEQ ID NO: 342887 - DNA, 25 bp, Mus musculus
gtggcaaaagactgctggagttaat

SEQ ID NO: 342888 - DNA, 25 bp, Mus musculus
gtggcaaaagccctggaagagagac

SEQ ID NO: 342889 - DNA, 25 bp, Mus musculus
gtggcaaaccgggaataattctcca

SEQ ID NO: 342890 - DNA, 25 bp, Mus musculus
gtggcaaacttgcagtatgatgatg

SEQ ID NO: 342891 - DNA, 25 bp, Mus musculus
gtggcaaagtaggagttggcatcca

SEQ ID NO: 342892 - DNA, 25 bp, Mus musculus
gtggcaaagttagagaacgtggaga

SEQ ID NO: 342893 - DNA, 25 bp, Mus musculus
gtggcaaatgtgagaatgaaacttt

SEQ ID NO: 342894 - DNA, 25 bp, Mus musculus
gtggcaaatgtgagttgtctgttga

SEQ ID NO: 342895 - DNA, 25 bp, Mus musculus
gtggcaaatttccagaaatcaacac

SEQ ID NO: 342896 - DNA, 25 bp, Mus musculus
gtggcaaatttccagggctatgtgc

SEQ ID NO: 342897 - DNA, 25 bp, Mus musculus
gtggcaaccagaatggggaatgcat

SEQ ID NO: 342898 - DNA, 25 bp, Mus musculus
gtggcaaccaggctgacaggggctg

SEQ ID NO: 342899 - DNA, 25 bp, Mus musculus
gtggcaagagagatctccagtcctg

SEQ ID NO: 342900 - DNA, 25 bp, Mus musculus
gtggcaagagccagcagcagcagca

SEQ ID NO: 342901 - DNA, 25 bp, Mus musculus
gtggcaaggacagtctcatgcttgc

SEQ ID NO: 342902 - DNA, 25 bp, Mus musculus
gtggcaatcctggttctcgtggtga

SEQ ID NO: 342903 - DNA, 25 bp, Mus musculus
gtggcaatgactggtgtccactccc

SEQ ID NO: 342904 - DNA, 25 bp, Mus musculus
gtggcaatgactgtcattttagtga

SEQ ID NO: 342905 - DNA, 25 bp, Mus musculus
gtggcaattcaggttcattttgctg

SEQ ID NO: 342906 - DNA, 25 bp, Mus musculus
gtggcaattcaggttcccaggtggt

SEQ ID NO: 342907 - DNA, 25 bp, Mus musculus
gtggcaattcaggttctcttgccac

SEQ ID NO: 342908 - DNA, 25 bp, Mus musculus
gtggcacaactctagagaagtttat

SEQ ID NO: 342909 - DNA, 25 bp, Mus musculus
gtggcacaagacgatacagcacggg

SEQ ID NO: 342910 - DNA, 25 bp, Mus musculus
gtggcacaagacggatcttgaaaca

SEQ ID NO: 342911 - DNA, 25 bp, Mus musculus
gtggcacaaggcaaagacatcaggg

SEQ ID NO: 342912 - DNA, 25 bp, Mus musculus
gtggcacaatcaggcgacaggtgaa

SEQ ID NO: 342913 - DNA, 25 bp, Mus musculus
gtggcacaatcaggttcttgagagg

SEQ ID NO: 342914 - DNA, 25 bp, Mus musculus
gtggcacagcaggacgcagagacca

SEQ ID NO: 342915 - DNA, 25 bp, Mus musculus
gtggcaccacacgctacaggtacat

SEQ ID NO: 342916 - DNA, 25 bp, Mus musculus
gtggcaccagtgggaggtctggact

SEQ ID NO: 342917 - DNA, 25 bp, Mus musculus
gtggcaccttcagaggcagagagag

SEQ ID NO: 342918 - DNA, 25 bp, Mus musculus
gtggcaccttcagctacatcaggta

SEQ ID NO: 342919 - DNA, 25 bp, Mus musculus
gtggcacggaggcaagaaggagtta

SEQ ID NO: 342920 - DNA, 25 bp, Mus musculus
gtggcacggcaggattcacagatgg

SEQ ID NO: 342921 - DNA, 25 bp, Mus musculus
gtggcacgtctgcagctggtgagcc

SEQ ID NO: 342922 - DNA, 25 bp, Mus musculus
gtggcactaaggctggtgttcccgg

SEQ ID NO: 342923 - DNA, 25 bp, Mus musculus
gtggcactgaaaagaggacagaact

SEQ ID NO: 342924 - DNA, 25 bp, Mus musculus
gtggcactgaaaagggttcccagcc

SEQ ID NO: 342925 - DNA, 25 bp, Mus musculus
gtggcactgtcctcccagtggcaca

SEQ ID NO: 342926 - DNA, 25 bp, Mus musculus
gtggcacttccattatcggaatgtg

SEQ ID NO: 342927 - DNA, 25 bp, Mus musculus
gtggcagaaagcagtgagtacggct

SEQ ID NO: 342928 - DNA, 25 bp, Mus musculus
gtggcagaagactcagaggcctggg

SEQ ID NO: 342929 - DNA, 25 bp, Mus musculus
gtggcagagaagggcaaacattgta

SEQ ID NO: 342930 - DNA, 25 bp, Mus musculus
gtggcagagctaaagggtttggatc

SEQ ID NO: 342931 - DNA, 25 bp, Mus musculus
gtggcagaggaggtccaactgagcc

SEQ ID NO: 342932 - DNA, 25 bp, Mus musculus
gtggcagatgccccaaatattctta

SEQ ID NO: 342933 - DNA, 25 bp, Mus musculus
gtggcagcaatggaagcccctaaga

SEQ ID NO: 342934 - DNA, 25 bp, Mus musculus
gtggcagcacagatacctttatcaa

SEQ ID NO: 342935 - DNA, 25 bp, Mus musculus
gtggcagcaccgggctaaagaagcc

SEQ ID NO: 342936 - DNA, 25 bp, Mus musculus
gtggcagcagcccaaatgacccagt

SEQ ID NO: 342937 - DNA, 25 bp, Mus musculus
gtggcagcgaagatcacaaggttta

SEQ ID NO: 342938 - DNA, 25 bp, Mus musculus
gtggcagcgaaggcctccttgaaca

SEQ ID NO: 342939 - DNA, 25 bp, Mus musculus
gtggcagcgtgtcaacccaaagttt

SEQ ID NO: 342940 - DNA, 25 bp, Mus musculus
gtggcagcgtgtttcccacgacagc

SEQ ID NO: 342941 - DNA, 25 bp, Mus musculus
gtggcagctatgggaaagagatacc

SEQ ID NO: 342942 - DNA, 25 bp, Mus musculus
gtggcagctgagaaacttggaaaag

SEQ ID NO: 342943 - DNA, 25 bp, Mus musculus
gtggcaggaacacacagtggggagg

SEQ ID NO: 342944 - DNA, 25 bp, Mus musculus
gtggcaggaagccagatatctcaca

SEQ ID NO: 342945 - DNA, 25 bp, Mus musculus
gtggcaggagaaacccaagcctgca

SEQ ID NO: 342946 - DNA, 25 bp, Mus musculus
gtggcaggagaagcgtagacccttc

SEQ ID NO: 342947 - DNA, 25 bp, Mus musculus
gtggcaggagaaggaggtggtggag

SEQ ID NO: 342948 - DNA, 25 bp, Mus musculus
gtggcaggagccctggcctgagaga

SEQ ID NO: 342949 - DNA, 25 bp, Mus musculus
gtggcaggaggcctatgtgaaccag

SEQ ID NO: 342950 - DNA, 25 bp, Mus musculus
gtggcaggaggtccggagttcaaat

SEQ ID NO: 342951 - DNA, 25 bp, Mus musculus
gtggcagggccgaggcccgatttcc

SEQ ID NO: 342952 - DNA, 25 bp, Mus musculus
gtggcagggctgagagatgggaaag

SEQ ID NO: 342953 - DNA, 25 bp, Mus musculus
gtggcaggtgactccagctccgtcc

SEQ ID NO: 342954 - DNA, 25 bp, Mus musculus
gtggcaggtgggacctgaccaagct

SEQ ID NO: 342955 - DNA, 25 bp, Mus musculus
gtggcagtagatgaagaacaacgag

SEQ ID NO: 342956 - DNA, 25 bp, Mus musculus
gtggcagtgaaacagctgggtgtta

SEQ ID NO: 342957 - DNA, 25 bp, Mus musculus
gtggcagtggtggtgaccaaccact

SEQ ID NO: 342958 - DNA, 25 bp, Mus musculus
gtggcataaggtgatgttccctgtt

SEQ ID NO: 342959 - DNA, 25 bp, Mus musculus
gtggcatcagagccaaggctaaact

SEQ ID NO: 342960 - DNA, 25 bp, Mus musculus
gtggcatcataggtggcatcatggc

SEQ ID NO: 342961 - DNA, 25 bp, Mus musculus
gtggcatctcaagagttctatccag

SEQ ID NO: 342962 - DNA, 25 bp, Mus musculus
gtggcatctcaagcctccagaggtg

SEQ ID NO: 342963 - DNA, 25 bp, Mus musculus
gtggcatctcaagcctccggtcagc

SEQ ID NO: 342964 - DNA, 25 bp, Mus musculus
gtggcatctcagatacgaacagaac

SEQ ID NO: 342965 - DNA, 25 bp, Mus musculus
gtggcatgaaaaggcccttgctgct

SEQ ID NO: 342966 - DNA, 25 bp, Mus musculus
gtggcatgcagctccatgactggaa

SEQ ID NO: 342967 - DNA, 25 bp, Mus musculus
gtggcatgcaggtgtaccagctgga

SEQ ID NO: 342968 - DNA, 25 bp, Mus musculus
gtggcatgccaggtactgctggaga

SEQ ID NO: 342969 - DNA, 25 bp, Mus musculus
gtggcatgccagtgaagagagagct

SEQ ID NO: 342970 - DNA, 25 bp, Mus musculus
gtggcatgtgggcatcatcgcagaa

SEQ ID NO: 342971 - DNA, 25 bp, Mus musculus
gtggcatgtggttcttcccgaaaag

SEQ ID NO: 342972 - DNA, 25 bp, Mus musculus
gtggcatgttcccaaatagctttct

SEQ ID NO: 342973 - DNA, 25 bp, Mus musculus
gtggcattaagcactgaatgcacag

SEQ ID NO: 342974 - DNA, 25 bp, Mus musculus
gtggcatttctgatgggcagcccca

SEQ ID NO: 342975 - DNA, 25 bp, Mus musculus
gtggcatttctgtggctaacttcga

SEQ ID NO: 342976 - DNA, 25 bp, Mus musculus
gtggccaaagaccctatcgtcaacg

SEQ ID NO: 342977 - DNA, 25 bp, Mus musculus
gtggccaaagacccttctggagagg

SEQ ID NO: 342978 - DNA, 25 bp, Mus musculus
gtggccaaagcctacagacacagag

SEQ ID NO: 342979 - DNA, 25 bp, Mus musculus
gtggccaagcagggactggaatacg

SEQ ID NO: 342980 - DNA, 25 bp, Mus musculus
gtggccaagcaggggtttgatttcc

SEQ ID NO: 342981 - DNA, 25 bp, Mus musculus
gtggccaagctgaacatccagagtc

SEQ ID NO: 342982 - DNA, 25 bp, Mus musculus
gtggccaaggacgaggaacctagta

SEQ ID NO: 342983 - DNA, 25 bp, Mus musculus
gtggccaaggagggggctgagaaaa

SEQ ID NO: 342984 - DNA, 25 bp, Mus musculus
gtggccaatggcatgccttggactc

SEQ ID NO: 342985 - DNA, 25 bp, Mus musculus
gtggccaatggctgtcgatattcaa

SEQ ID NO: 342986 - DNA, 25 bp, Mus musculus
gtggccacacaggatcagaacttat

SEQ ID NO: 342987 - DNA, 25 bp, Mus musculus
gtggccacagagacactggagctcc

SEQ ID NO: 342988 - DNA, 25 bp, Mus musculus
gtggccacaggctcccataatgccc

SEQ ID NO: 342989 - DNA, 25 bp, Mus musculus
gtggccacaggttggttttatcaac

SEQ ID NO: 342990 - DNA, 25 bp, Mus musculus
gtggccacattctgattcaaagaat

SEQ ID NO: 342991 - DNA, 25 bp, Mus musculus
gtggccacattctgtaccaaggaag

SEQ ID NO: 342992 - DNA, 25 bp, Mus musculus
gtggccacctactcccagatggccg

SEQ ID NO: 342993 - DNA, 25 bp, Mus musculus
gtggccacgtgttctgccgatcttg

SEQ ID NO: 342994 - DNA, 25 bp, Mus musculus
gtggccagagagctgaagcgctgca

SEQ ID NO: 342995 - DNA, 25 bp, Mus musculus
gtggccagagatacccaggggccat

SEQ ID NO: 342996 - DNA, 25 bp, Mus musculus
gtggccagcacccggctacctgagg

SEQ ID NO: 342997 - DNA, 25 bp, Mus musculus
gtggccagcacccgggctgtggctg

SEQ ID NO: 342998 - DNA, 25 bp, Mus musculus
gtggccagcacgcaatcagcggagt

SEQ ID NO: 342999 - DNA, 25 bp, Mus musculus
gtggccagccaggcctgcagcatca

SEQ ID NO: 343000 - DNA, 25 bp, Mus musculus
gtggccaggatcgaaagccagcctg

SEQ ID NO: 343001 - DNA, 25 bp, Mus musculus
gtggccaggcttgtagaaaatgatg

SEQ ID NO: 343002 - DNA, 25 bp, Mus musculus
gtggccaggtattgagacaatgatg

SEQ ID NO: 343003 - DNA, 25 bp, Mus musculus
gtggccagtctcagatgatacaact

SEQ ID NO: 343004 - DNA, 25 bp, Mus musculus
gtggccagtctcagattgttataga

SEQ ID NO: 343005 - DNA, 25 bp, Mus musculus
gtggccatacaggtcctgtccagag

SEQ ID NO: 343006 - DNA, 25 bp, Mus musculus
gtggccatcataggtacccaggata

SEQ ID NO: 343007 - DNA, 25 bp, Mus musculus
gtggccatggctgagactctgaaga

SEQ ID NO: 343008 - DNA, 25 bp, Mus musculus
gtggccattgaggtgaggcacagag

SEQ ID NO: 343009 - DNA, 25 bp, Mus musculus
gtggcccaagataaagactgagttc

SEQ ID NO: 343010 - DNA, 25 bp, Mus musculus
gtggcccaaggacactcctcctctg

SEQ ID NO: 343011 - DNA, 25 bp, Mus musculus
gtggcccacgcgcagcaacacctcc

SEQ ID NO: 343012 - DNA, 25 bp, Mus musculus
gtggcccacgcgcagcgctgtgtag

SEQ ID NO: 343013 - DNA, 25 bp, Mus musculus
gtggcccagaaggagatccttaagc

SEQ ID NO: 343014 - DNA, 25 bp, Mus musculus
gtggcccagaatcctgggccaccaa

SEQ ID NO: 343015 - DNA, 25 bp, Mus musculus
gtggcccagacagtgactcaggtgc

SEQ ID NO: 343016 - DNA, 25 bp, Mus musculus
gtggcccagattaagtctcctgaaa

SEQ ID NO: 343017 - DNA, 25 bp, Mus musculus
gtggcccaggaggtcctgtccttgg

SEQ ID NO: 343018 - DNA, 25 bp, Mus musculus
gtggcccaggatgacaacgagtgta

SEQ ID NO: 343019 - DNA, 25 bp, Mus musculus
gtggcccaggttgacaacgagtgta

SEQ ID NO: 343020 - DNA, 25 bp, Mus musculus
gtggccccagggttgtgagccccgg

SEQ ID NO: 343021 - DNA, 25 bp, Mus musculus
gtggcccccgaggatgtcagtgctc

SEQ ID NO: 343022 - DNA, 25 bp, Mus musculus
gtggccccgaggtctcagatctgac

SEQ ID NO: 343023 - DNA, 25 bp, Mus musculus
gtggccccgagtgccagttgccagc

SEQ ID NO: 343024 - DNA, 25 bp, Mus musculus
gtggcccggcttctgcaggcacaag

SEQ ID NO: 343025 - DNA, 25 bp, Mus musculus
gtggcccggtgaggagctgtgggaa

SEQ ID NO: 343026 - DNA, 25 bp, Mus musculus
gtggccctggcagagaacacagcag

SEQ ID NO: 343027 - DNA, 25 bp, Mus musculus
gtggccctgtcctgccatcatgaag

SEQ ID NO: 343028 - DNA, 25 bp, Mus musculus
gtggcccttctcatcaaggtgattc

SEQ ID NO: 343029 - DNA, 25 bp, Mus musculus
gtggccgacaaagttccacaggtgt

SEQ ID NO: 343030 - DNA, 25 bp, Mus musculus
gtggccgacagagtgcttgggatcc

SEQ ID NO: 343031 - DNA, 25 bp, Mus musculus
gtggccgagctagcaacctttcccc

SEQ ID NO: 343032 - DNA, 25 bp, Mus musculus
gtggccgagctagctgctgcctgtt

SEQ ID NO: 343033 - DNA, 25 bp, Mus musculus
gtggccgaggaggtccagattatct

SEQ ID NO: 343034 - DNA, 25 bp, Mus musculus
gtggccgagtgttgctgaacacaac

SEQ ID NO: 343035 - DNA, 25 bp, Mus musculus
gtggccgataaagattactctgtga

SEQ ID NO: 343036 - DNA, 25 bp, Mus musculus
gtggccgcacagaactgactgtccc

SEQ ID NO: 343037 - DNA, 25 bp, Mus musculus
gtggccgccgacaacactggtagcc

SEQ ID NO: 343038 - DNA, 25 bp, Mus musculus
gtggccgccgatacatataccattt

SEQ ID NO: 343039 - DNA, 25 bp, Mus musculus
gtggccgcgcagccagcgttccatg

SEQ ID NO: 343040 - DNA, 25 bp, Mus musculus
gtggccgcgtccgggtgatctctgg

SEQ ID NO: 343041 - DNA, 25 bp, Mus musculus
gtggccgctgaccagtgaagtcaag

SEQ ID NO: 343042 - DNA, 25 bp, Mus musculus
gtggccgctttcaggtagcactttg

SEQ ID NO: 343043 - DNA, 25 bp, Mus musculus
gtggccggaaataagactgcagctt

SEQ ID NO: 343044 - DNA, 25 bp, Mus musculus
gtggccgggaagaccaaatacacac

SEQ ID NO: 343045 - DNA, 25 bp, Mus musculus
gtggccgggatcaggtggatcaact

SEQ ID NO: 343046 - DNA, 25 bp, Mus musculus
gtggccgtagagcatgcactcttgg

SEQ ID NO: 343047 - DNA, 25 bp, Mus musculus
gtggccgtagaggtgctgggattac

SEQ ID NO: 343048 - DNA, 25 bp, Mus musculus
gtggccgtccaagaacatgtaccct

SEQ ID NO: 343049 - DNA, 25 bp, Mus musculus
gtggccgtcgtcaggtgggtccgag

SEQ ID NO: 343050 - DNA, 25 bp, Mus musculus
gtggccgtgaaggtggaggcaggga

SEQ ID NO: 343051 - DNA, 25 bp, Mus musculus
gtggccgtgcagcaagacccagaag

SEQ ID NO: 343052 - DNA, 25 bp, Mus musculus
gtggccgtggcagaggtagttctgg

SEQ ID NO: 343053 - DNA, 25 bp, Mus musculus
gtggccgtgggaccgtggctaccga

SEQ ID NO: 343054 - DNA, 25 bp, Mus musculus
gtggccgttgttggagccactggca

SEQ ID NO: 343055 - DNA, 25 bp, Mus musculus
gtggcctacagggctggctgtggac

SEQ ID NO: 343056 - DNA, 25 bp, Mus musculus
gtggcctactactcttaaaaaacag

SEQ ID NO: 343057 - DNA, 25 bp, Mus musculus
gtggcctactactgtcgtttatatg

SEQ ID NO: 343058 - DNA, 25 bp, Mus musculus
gtggcctatcagcgggcttatccgc

SEQ ID NO: 343059 - DNA, 25 bp, Mus musculus
gtggcctatcagcgggtcatagaag

SEQ ID NO: 343060 - DNA, 25 bp, Mus musculus
gtggcctcagataatgatttttcca

SEQ ID NO: 343061 - DNA, 25 bp, Mus musculus
gtggcctcaggtgcgttcattcctg

SEQ ID NO: 343062 - DNA, 25 bp, Mus musculus
gtggcctccaacacccgctgcctca

SEQ ID NO: 343063 - DNA, 25 bp, Mus musculus
gtggcctccagaagccaccatgggg

SEQ ID NO: 343064 - DNA, 25 bp, Mus musculus
gtggcctcctggactgtgctggggg

SEQ ID NO: 343065 - DNA, 25 bp, Mus musculus
gtggcctcctgggtggtgcagactg

SEQ ID NO: 343066 - DNA, 25 bp, Mus musculus
gtggcctcgcatggtcatggtcacg

SEQ ID NO: 343067 - DNA, 25 bp, Mus musculus
gtggcctcgcgctataaccacttcc

SEQ ID NO: 343068 - DNA, 25 bp, Mus musculus
gtggcctcgctaggatgcttcattt

SEQ ID NO: 343069 - DNA, 25 bp, Mus musculus
gtggcctcggtgattgaagtgagtg

SEQ ID NO: 343070 - DNA, 25 bp, Mus musculus
gtggcctctaagtgccatcacctgt

SEQ ID NO: 343071 - DNA, 25 bp, Mus musculus
gtggcctctaagttgctgactgtcc

SEQ ID NO: 343072 - DNA, 25 bp, Mus musculus
gtggcctcttcacaattacgctcga

SEQ ID NO: 343073 - DNA, 25 bp, Mus musculus
gtggcctgcaagttataccacatca

SEQ ID NO: 343074 - DNA, 25 bp, Mus musculus
gtggcctgcaggtagctcgcggcgt

SEQ ID NO: 343075 - DNA, 25 bp, Mus musculus
gtggcctggagcttaccagcccttc

SEQ ID NO: 343076 - DNA, 25 bp, Mus musculus
gtggcctggagtgttgaagatgaag

SEQ ID NO: 343077 - DNA, 25 bp, Mus musculus
gtggcctgtctgaggccctggccag

SEQ ID NO: 343078 - DNA, 25 bp, Mus musculus
gtggcctgtgagacagtgtgcaaga

SEQ ID NO: 343079 - DNA, 25 bp, Mus musculus
gtggcctgtggagggttgtctaccg

SEQ ID NO: 343080 - DNA, 25 bp, Mus musculus
gtggcctgtggtttatggtgtgctg

SEQ ID NO: 343081 - DNA, 25 bp, Mus musculus
gtggccttaaagtctttaagaaata

SEQ ID NO: 343082 - DNA, 25 bp, Mus musculus
gtggccttaccatgtgccctggggg

SEQ ID NO: 343083 - DNA, 25 bp, Mus musculus
gtggccttagagtttctgcgccccc

SEQ ID NO: 343084 - DNA, 25 bp, Mus musculus
gtggccttcaaggttgtagccctcg

SEQ ID NO: 343085 - DNA, 25 bp, Mus musculus
gtggccttgaacaggacaggccgaa

SEQ ID NO: 343086 - DNA, 25 bp, Mus musculus
gtggccttggcaggggccagtccct

SEQ ID NO: 343087 - DNA, 25 bp, Mus musculus
gtggcctttgatgccgtcctgcttg

SEQ ID NO: 343088 - DNA, 25 bp, Mus musculus
gtggcctttgttcaggaatatcgtt

SEQ ID NO: 343089 - DNA, 25 bp, Mus musculus
gtggccttttcagaactcaagctct

SEQ ID NO: 343090 - DNA, 25 bp, Mus musculus
gtggccttttcagggctacagtgca

SEQ ID NO: 343091 - DNA, 25 bp, Mus musculus
gtggcgaaccacagaaagcgtccat

SEQ ID NO: 343092 - DNA, 25 bp, Mus musculus
gtggcgaatcagaataatttaaaaa

SEQ ID NO: 343093 - DNA, 25 bp, Mus musculus
gtggcgacagatgtgaaggcaccat

SEQ ID NO: 343094 - DNA, 25 bp, Mus musculus
gtggcgacagatgttgcattacgat

SEQ ID NO: 343095 - DNA, 25 bp, Mus musculus
gtggcgacaggtgtgactggagaca

SEQ ID NO: 343096 - DNA, 25 bp, Mus musculus
gtggcgactgcagcctattccaagc

SEQ ID NO: 343097 - DNA, 25 bp, Mus musculus
gtggcgactgcaggtaacgggcaac

SEQ ID NO: 343098 - DNA, 25 bp, Mus musculus
gtggcgagaccggggcatggaacaa

SEQ ID NO: 343099 - DNA, 25 bp, Mus musculus
gtggcgagcccctcggtcttcaaag

SEQ ID NO: 343100 - DNA, 25 bp, Mus musculus
gtggcgaggagaaagcggtggagaa

SEQ ID NO: 343101 - DNA, 25 bp, Mus musculus
gtggcgcagatgggatacagatttc

SEQ ID NO: 343102 - DNA, 25 bp, Mus musculus
gtggcgcagatggtcaccctgctga

SEQ ID NO: 343103 - DNA, 25 bp, Mus musculus
gtggcgcagtcttgagtaatccaga

SEQ ID NO: 343104 - DNA, 25 bp, Mus musculus
gtggcgccagctagccggatcagcc

SEQ ID NO: 343105 - DNA, 25 bp, Mus musculus
gtggcgcccgaccctaggtacccag

SEQ ID NO: 343106 - DNA, 25 bp, Mus musculus
gtggcgccgagcggggcgaggtggc

SEQ ID NO: 343107 - DNA, 25 bp, Mus musculus
gtggcgccgagcgggtcctcaggac

SEQ ID NO: 343108 - DNA, 25 bp, Mus musculus
gtggcgcgcctgcaggactttaagc

SEQ ID NO: 343109 - DNA, 25 bp, Mus musculus
gtggcgcgcctgcaggcaagaagga

SEQ ID NO: 343110 - DNA, 25 bp, Mus musculus
gtggcgcgcggccaggtcttggttt

SEQ ID NO: 343111 - DNA, 25 bp, Mus musculus
gtggcgcgcgtccgaaatgctgagc

SEQ ID NO: 343112 - DNA, 25 bp, Mus musculus
gtggcgcggcaaccaaccgtctgga

SEQ ID NO: 343113 - DNA, 25 bp, Mus musculus
gtggcgctcaccctgattgactcgt

SEQ ID NO: 343114 - DNA, 25 bp, Mus musculus
gtggcgctcaccctgcgactactgt

SEQ ID NO: 343115 - DNA, 25 bp, Mus musculus
gtggcgctgtacaagcttggcttct

SEQ ID NO: 343116 - DNA, 25 bp, Mus musculus
gtggcgctgtacaaggttcactcta

SEQ ID NO: 343117 - DNA, 25 bp, Mus musculus
gtggcgctgtatactccatgtttcc

SEQ ID NO: 343118 - DNA, 25 bp, Mus musculus
gtggcggaagaagagaagaaagatg

SEQ ID NO: 343119 - DNA, 25 bp, Mus musculus
gtggcggagcaggggaagagacaca

SEQ ID NO: 343120 - DNA, 25 bp, Mus musculus
gtggcggagccgaatcctattctaa

SEQ ID NO: 343121 - DNA, 25 bp, Mus musculus
gtggcggagttcgagactaccaggt

SEQ ID NO: 343122 - DNA, 25 bp, Mus musculus
gtggcggccgggatctgggacgatg

SEQ ID NO: 343123 - DNA, 25 bp, Mus musculus
gtggcggcggcggaccggcggcggc

SEQ ID NO: 343124 - DNA, 25 bp, Mus musculus
gtggcgggcgctaggtccgtctccc

SEQ ID NO: 343125 - DNA, 25 bp, Mus musculus
gtggcggggaggctggggaaggaag

SEQ ID NO: 343126 - DNA, 25 bp, Mus musculus
gtggcggggaggctggtgcaaacag

SEQ ID NO: 343127 - DNA, 25 bp, Mus musculus
gtggcggggttgggaatggctttgc

SEQ ID NO: 343128 - DNA, 25 bp, Mus musculus
gtggcggggttggggggcttctgct

SEQ ID NO: 343129 - DNA, 25 bp, Mus musculus
gtggcggggttggggtcgatactga

SEQ ID NO: 343130 - DNA, 25 bp, Mus musculus
gtggcggtgctccaggacagcatcg

SEQ ID NO: 343131 - DNA, 25 bp, Mus musculus
gtggcgtcggggtgacatggacaga

SEQ ID NO: 343132 - DNA, 25 bp, Mus musculus
gtggcgtggaagggggaggcacacg

SEQ ID NO: 343133 - DNA, 25 bp, Mus musculus
gtggcgttaaactttctccagacca

SEQ ID NO: 343134 - DNA, 25 bp, Mus musculus
gtggctaattagcatctgaagttga

SEQ ID NO: 343135 - DNA, 25 bp, Mus musculus
gtggctacgacccgggagcccataa

SEQ ID NO: 343136 - DNA, 25 bp, Mus musculus
gtggctacgagataacagacaaaag

SEQ ID NO: 343137 - DNA, 25 bp, Mus musculus
gtggctactctgagataaagccact

SEQ ID NO: 343138 - DNA, 25 bp, Mus musculus
gtggctactctgagtgttataggct

SEQ ID NO: 343139 - DNA, 25 bp, Mus musculus
gtggctagagaggctgccctgggag

SEQ ID NO: 343140 - DNA, 25 bp, Mus musculus
gtggctatggagaggtgggaaaggg

SEQ ID NO: 343141 - DNA, 25 bp, Mus musculus
gtggctcaagaccctgaaggctatc

SEQ ID NO: 343142 - DNA, 25 bp, Mus musculus
gtggctcaaggctatcgaggagggc

SEQ ID NO: 343143 - DNA, 25 bp, Mus musculus
gtggctcaagttttcctgacttctc

SEQ ID NO: 343144 - DNA, 25 bp, Mus musculus
gtggctcaatgatccttccttcata

SEQ ID NO: 343145 - DNA, 25 bp, Mus musculus
gtggctcacagctgtgatgagtgca

SEQ ID NO: 343146 - DNA, 25 bp, Mus musculus
gtggctcacttgggtgctggtctcc

SEQ ID NO: 343147 - DNA, 25 bp, Mus musculus
gtggctcatacacactttggaggta

SEQ ID NO: 343148 - DNA, 25 bp, Mus musculus
gtggctcatagtatgatatttgctc

SEQ ID NO: 343149 - DNA, 25 bp, Mus musculus
gtggctccatcctgttactgagctg

SEQ ID NO: 343150 - DNA, 25 bp, Mus musculus
gtggctcccttgggaagccggagga

SEQ ID NO: 343151 - DNA, 25 bp, Mus musculus
gtggctcccttgggaatttagaagc

SEQ ID NO: 343152 - DNA, 25 bp, Mus musculus
gtggctcccttggggttctcacgcg

SEQ ID NO: 343153 - DNA, 25 bp, Mus musculus
gtggctccggacagaccatggcaac

SEQ ID NO: 343154 - DNA, 25 bp, Mus musculus
gtggctccggacaggatgcatttgc

SEQ ID NO: 343155 - DNA, 25 bp, Mus musculus
gtggctccggacagtttccttttag

SEQ ID NO: 343156 - DNA, 25 bp, Mus musculus
gtggctccggcagggaagcccagcc

SEQ ID NO: 343157 - DNA, 25 bp, Mus musculus
gtggctcctggcactttgaattgct

SEQ ID NO: 343158 - DNA, 25 bp, Mus musculus
gtggctcggtacaggttgtaagttc

SEQ ID NO: 343159 - DNA, 25 bp, Mus musculus
gtggctctaaagaaggatgtggact

SEQ ID NO: 343160 - DNA, 25 bp, Mus musculus
gtggctctagagaaggagctagaag

SEQ ID NO: 343161 - DNA, 25 bp, Mus musculus
gtggctctcagccaccaccttgtcg

SEQ ID NO: 343162 - DNA, 25 bp, Mus musculus
gtggctctcagcttgcagacaaaag

SEQ ID NO: 343163 - DNA, 25 bp, Mus musculus
gtggctctcaggagcgcggccttct

SEQ ID NO: 343164 - DNA, 25 bp, Mus musculus
gtggctctctgatgcaagctgttgc

SEQ ID NO: 343165 - DNA, 25 bp, Mus musculus
gtggctctgaagaaggatgtggact

SEQ ID NO: 343166 - DNA, 25 bp, Mus musculus
gtggctctgagataggtgtcttcca

SEQ ID NO: 343167 - DNA, 25 bp, Mus musculus
gtggctctgaggtaggtgtcttcca

SEQ ID NO: 343168 - DNA, 25 bp, Mus musculus
gtggctcttccacaggtctgttggt

SEQ ID NO: 343169 - DNA, 25 bp, Mus musculus
gtggctgaagaggtcccaggtaaat

SEQ ID NO: 343170 - DNA, 25 bp, Mus musculus
gtggctgaagcaggaatggacagac

SEQ ID NO: 343171 - DNA, 25 bp, Mus musculus
gtggctgaaggagaacttgagagag

SEQ ID NO: 343172 - DNA, 25 bp, Mus musculus
gtggctgaaggaggtctctctgctc

SEQ ID NO: 343173 - DNA, 25 bp, Mus musculus
gtggctgagaaccgggaccgcgtgg

SEQ ID NO: 343174 - DNA, 25 bp, Mus musculus
gtggctgagacaggcacataagact

SEQ ID NO: 343175 - DNA, 25 bp, Mus musculus
gtggctgagagccgagccagacagg

SEQ ID NO: 343176 - DNA, 25 bp, Mus musculus
gtggctgagagtaaatgtggggacc

SEQ ID NO: 343177 - DNA, 25 bp, Mus musculus
gtggctgaggaggcagctgacctag

SEQ ID NO: 343178 - DNA, 25 bp, Mus musculus
gtggctgatcaaaggaaaggactca

SEQ ID NO: 343179 - DNA, 25 bp, Mus musculus
gtggctgatgaaatgggtctaggaa

SEQ ID NO: 343180 - DNA, 25 bp, Mus musculus
gtggctgcaaaaacttgagaattac

SEQ ID NO: 343181 - DNA, 25 bp, Mus musculus
gtggctgcaaaaaggtcctggtctc

SEQ ID NO: 343182 - DNA, 25 bp, Mus musculus
gtggctgcaaaggccactttgccaa

SEQ ID NO: 343183 - DNA, 25 bp, Mus musculus
gtggctgcagagaatgatgtcactg

SEQ ID NO: 343184 - DNA, 25 bp, Mus musculus
gtggctgcaggcggcccaagatgtc

SEQ ID NO: 343185 - DNA, 25 bp, Mus musculus
gtggctgcaggcggcttgaagatga

SEQ ID NO: 343186 - DNA, 25 bp, Mus musculus
gtggctgccgtgacgcatgatcttt

SEQ ID NO: 343187 - DNA, 25 bp, Mus musculus
gtggctgccgtgacggttgcaggcc

SEQ ID NO: 343188 - DNA, 25 bp, Mus musculus
gtggctgcggctgttaagaagaaag

SEQ ID NO: 343189 - DNA, 25 bp, Mus musculus
gtggctgcgggtattcccaggttga

SEQ ID NO: 343190 - DNA, 25 bp, Mus musculus
gtggctgctgactctgctctccctg

SEQ ID NO: 343191 - DNA, 25 bp, Mus musculus
gtggctgctgatgccatactccaac

SEQ ID NO: 343192 - DNA, 25 bp, Mus musculus
gtggctgctgtctccccattcagaa

SEQ ID NO: 343193 - DNA, 25 bp, Mus musculus
gtggctgcttccaggcttttatttg

SEQ ID NO: 343194 - DNA, 25 bp, Mus musculus
gtggctggaagcagatgttttgggt

SEQ ID NO: 343195 - DNA, 25 bp, Mus musculus
gtggctggagagaaggataaagggg

SEQ ID NO: 343196 - DNA, 25 bp, Mus musculus
gtggctggagagaaggcctgcctgc

SEQ ID NO: 343197 - DNA, 25 bp, Mus musculus
gtggctggagagaagggctattggc

SEQ ID NO: 343198 - DNA, 25 bp, Mus musculus
gtggctggagagaaggtcatttgag

SEQ ID NO: 343199 - DNA, 25 bp, Mus musculus
gtggctggagatgaattcagtcagc

SEQ ID NO: 343200 - DNA, 25 bp, Mus musculus
gtggctggagccctcagctgtgggt

SEQ ID NO: 343201 - DNA, 25 bp, Mus musculus
gtggctggaggggagtggggccggc

SEQ ID NO: 343202 - DNA, 25 bp, Mus musculus
gtggctggagttgaattcagtcagc

SEQ ID NO: 343203 - DNA, 25 bp, Mus musculus
gtggctggatccggtggacacacca

SEQ ID NO: 343204 - DNA, 25 bp, Mus musculus
gtggctggatccgtaccccaagtac

SEQ ID NO: 343205 - DNA, 25 bp, Mus musculus
gtggctggatccgtattcttgttcc

SEQ ID NO: 343206 - DNA, 25 bp, Mus musculus
gtggctggctcaaggaaccatctgg

SEQ ID NO: 343207 - DNA, 25 bp, Mus musculus
gtggctgggaaccaccgtcacttcc

SEQ ID NO: 343208 - DNA, 25 bp, Mus musculus
gtggctgggaccaggagctgacaga

SEQ ID NO: 343209 - DNA, 25 bp, Mus musculus
gtggctggtaccaattctatttatt

SEQ ID NO: 343210 - DNA, 25 bp, Mus musculus
gtggctgtatggcgatgagaatgaa

SEQ ID NO: 343211 - DNA, 25 bp, Mus musculus
gtggctgtatggcggcccgtgggac

SEQ ID NO: 343212 - DNA, 25 bp, Mus musculus
gtggctgtcacaaagatcatagccc

SEQ ID NO: 343213 - DNA, 25 bp, Mus musculus
gtggctgtcaccaaggaccccaact

SEQ ID NO: 343214 - DNA, 25 bp, Mus musculus
gtggctgtgcaggtataatggccgg

SEQ ID NO: 343215 - DNA, 25 bp, Mus musculus
gtggctgttggcagttctggcaggt

SEQ ID NO: 343216 - DNA, 25 bp, Mus musculus
gtggcttaagagaagagccatggag

SEQ ID NO: 343217 - DNA, 25 bp, Mus musculus
gtggcttacagtggaatgggcctgc

SEQ ID NO: 343218 - DNA, 25 bp, Mus musculus
gtggcttacagtgggaagacatggg

SEQ ID NO: 343219 - DNA, 25 bp, Mus musculus
gtggcttaggattgtctaaagccac

SEQ ID NO: 343220 - DNA, 25 bp, Mus musculus
gtggcttcaagttttggaaacatga

SEQ ID NO: 343221 - DNA, 25 bp, Mus musculus
gtggcttcagatcagagttggtgtg

SEQ ID NO: 343222 - DNA, 25 bp, Mus musculus
gtggcttcccagatgaatgcactga

SEQ ID NO: 343223 - DNA, 25 bp, Mus musculus
gtggcttccctgagctgggaacact

SEQ ID NO: 343224 - DNA, 25 bp, Mus musculus
gtggcttccgaggctccggcttcgt

SEQ ID NO: 343225 - DNA, 25 bp, Mus musculus
gtggcttccggaaggaactggtgag

SEQ ID NO: 343226 - DNA, 25 bp, Mus musculus
gtggcttccggaaggcctctggatt

SEQ ID NO: 343227 - DNA, 25 bp, Mus musculus
gtggcttccggagacagaaaagagc

SEQ ID NO: 343228 - DNA, 25 bp, Mus musculus
gtggcttccggatcctttgtgtata

SEQ ID NO: 343229 - DNA, 25 bp, Mus musculus
gtggcttcctgagaggctggcctcc

SEQ ID NO: 343230 - DNA, 25 bp, Mus musculus
gtggcttgccaggtgaatattggct

SEQ ID NO: 343231 - DNA, 25 bp, Mus musculus
gtggctttaataaaccacgtttacg

SEQ ID NO: 343232 - DNA, 25 bp, Mus musculus
gtggctttaatatgggcggcaacga

SEQ ID NO: 343233 - DNA, 25 bp, Mus musculus
gtggctttgaccatccacgaaaatg

SEQ ID NO: 343234 - DNA, 25 bp, Mus musculus
gtggctttgagtctgacaagatgta

SEQ ID NO: 343235 - DNA, 25 bp, Mus musculus
gtggctttgctcagccttctggccg

SEQ ID NO: 343236 - DNA, 25 bp, Mus musculus
gtggctttgctggagtatattgaaa

SEQ ID NO: 343237 - DNA, 25 bp, Mus musculus
gtggctttgctgggttgctatgata

SEQ ID NO: 343238 - DNA, 25 bp, Mus musculus
gtggctttgtgtgggcttgcaaaat

SEQ ID NO: 343239 - DNA, 25 bp, Mus musculus
gtggcttttgcagaggtttcctggc

SEQ ID NO: 343240 - DNA, 25 bp, Mus musculus
gtgggaaaaagaccaaagattcaag

SEQ ID NO: 343241 - DNA, 25 bp, Mus musculus
gtgggaaaagaactaaatggcagca

SEQ ID NO: 343242 - DNA, 25 bp, Mus musculus
gtgggaaaagaactaatttcagcat

SEQ ID NO: 343243 - DNA, 25 bp, Mus musculus
gtgggaaaagaactgttcagctcct

SEQ ID NO: 343244 - DNA, 25 bp, Mus musculus
gtgggaaacccaagcttatggcaaa

SEQ ID NO: 343245 - DNA, 25 bp, Mus musculus
gtgggaaaccttggtcttgccacct

SEQ ID NO: 343246 - DNA, 25 bp, Mus musculus
gtgggaaactatgatctcttcactg

SEQ ID NO: 343247 - DNA, 25 bp, Mus musculus
gtgggaaactgctctcctatgtgga

SEQ ID NO: 343248 - DNA, 25 bp, Mus musculus
gtgggaaagaaggttaacctctgct

SEQ ID NO: 343249 - DNA, 25 bp, Mus musculus
gtgggaaagctgatgaatgcaccct

SEQ ID NO: 343250 - DNA, 25 bp, Mus musculus
gtgggaaagggagtcatgtggctgg

SEQ ID NO: 343251 - DNA, 25 bp, Mus musculus
gtgggaaatacggtatcaccagcct

SEQ ID NO: 343252 - DNA, 25 bp, Mus musculus
gtgggaaattattagggatgccagt

SEQ ID NO: 343253 - DNA, 25 bp, Mus musculus
gtgggaacagagccctttgggagaa

SEQ ID NO: 343254 - DNA, 25 bp, Mus musculus
gtgggaacagctggaaggtaggccc

SEQ ID NO: 343255 - DNA, 25 bp, Mus musculus
gtgggaacaggaacagaatggaagc

SEQ ID NO: 343256 - DNA, 25 bp, Mus musculus
gtgggaacaggtattgaagcccctg

SEQ ID NO: 343257 - DNA, 25 bp, Mus musculus
gtgggaacaggtgtcacagcacggt

SEQ ID NO: 343258 - DNA, 25 bp, Mus musculus
gtgggaacctaaatggggggatcgc

SEQ ID NO: 343259 - DNA, 25 bp, Mus musculus
gtgggaacctaaatggtggagccac

SEQ ID NO: 343260 - DNA, 25 bp, Mus musculus
gtgggaacctgtgaggtcatgcact

SEQ ID NO: 343261 - DNA, 25 bp, Mus musculus
gtgggaacgcagagcagtgggaaga

SEQ ID NO: 343262 - DNA, 25 bp, Mus musculus
gtgggaagaaagaaggatagatata

SEQ ID NO: 343263 - DNA, 25 bp, Mus musculus
gtgggaagaacactgctgtgctggg

SEQ ID NO: 343264 - DNA, 25 bp, Mus musculus
gtgggaagcaaaggctcaagtcatt

SEQ ID NO: 343265 - DNA, 25 bp, Mus musculus
gtgggaaggcactttccggatgatc

SEQ ID NO: 343266 - DNA, 25 bp, Mus musculus
gtgggaaggcagaaggtgatgtggg

SEQ ID NO: 343267 - DNA, 25 bp, Mus musculus
gtgggaagttggtacagagcatcat

SEQ ID NO: 343268 - DNA, 25 bp, Mus musculus
gtgggaatattgaagtacttggttt

SEQ ID NO: 343269 - DNA, 25 bp, Mus musculus
gtgggaatcagtgggtatcacaggc

SEQ ID NO: 343270 - DNA, 25 bp, Mus musculus
gtgggaatcatacatgacgcctttg

SEQ ID NO: 343271 - DNA, 25 bp, Mus musculus
gtgggaattgcaaagatgtgtccag

SEQ ID NO: 343272 - DNA, 25 bp, Mus musculus
gtgggaattgcaaagtgtactggga

SEQ ID NO: 343273 - DNA, 25 bp, Mus musculus
gtgggaattttatgtaagaccagct

SEQ ID NO: 343274 - DNA, 25 bp, Mus musculus
gtgggacaaggttttgagcattaat

SEQ ID NO: 343275 - DNA, 25 bp, Mus musculus
gtgggacacctgcctgcagtacaag

SEQ ID NO: 343276 - DNA, 25 bp, Mus musculus
gtgggacagaacggttgatttaggg

SEQ ID NO: 343277 - DNA, 25 bp, Mus musculus
gtgggacagagccagctgcgcaaac

SEQ ID NO: 343278 - DNA, 25 bp, Mus musculus
gtgggacagattggatctggccgcc

SEQ ID NO: 343279 - DNA, 25 bp, Mus musculus
gtgggacagccagaggaacagatgg

SEQ ID NO: 343280 - DNA, 25 bp, Mus musculus
gtgggacagccagctgaagtgagta

SEQ ID NO: 343281 - DNA, 25 bp, Mus musculus
gtgggacagccaggtaacaatttca

SEQ ID NO: 343282 - DNA, 25 bp, Mus musculus
gtgggacaggagaacgagaagaact

SEQ ID NO: 343283 - DNA, 25 bp, Mus musculus
gtgggacataagttctacggcccca

SEQ ID NO: 343284 - DNA, 25 bp, Mus musculus
gtgggacatgaatttggacctcact

SEQ ID NO: 343285 - DNA, 25 bp, Mus musculus
gtgggaccaagaacacggtacaacc

SEQ ID NO: 343286 - DNA, 25 bp, Mus musculus
gtgggaccagtttaaaaggatgctg

SEQ ID NO: 343287 - DNA, 25 bp, Mus musculus
gtgggacccacatggttactgggaa

SEQ ID NO: 343288 - DNA, 25 bp, Mus musculus
gtgggacccagcatgctggcgactt

SEQ ID NO: 343289 - DNA, 25 bp, Mus musculus
gtgggacccgaacaatttcgaagag

SEQ ID NO: 343290 - DNA, 25 bp, Mus musculus
gtgggaccggcccttggtgctgaca

SEQ ID NO: 343291 - DNA, 25 bp, Mus musculus
gtgggaccggggtgttgtgctacgg

SEQ ID NO: 343292 - DNA, 25 bp, Mus musculus
gtgggacctcaggctgactgctgtc

SEQ ID NO: 343293 - DNA, 25 bp, Mus musculus
gtgggacctccgggcctagctgggg

SEQ ID NO: 343294 - DNA, 25 bp, Mus musculus
gtgggactctctgcgccctttgtgg

SEQ ID NO: 343295 - DNA, 25 bp, Mus musculus
gtgggactgagggtggttgctgtat

SEQ ID NO: 343296 - DNA, 25 bp, Mus musculus
gtgggagaaagtgagagcaccactt

SEQ ID NO: 343297 - DNA, 25 bp, Mus musculus
gtgggagaactcgcaccagggtcca

SEQ ID NO: 343298 - DNA, 25 bp, Mus musculus
gtgggagaaggtgcagcagctggtg

SEQ ID NO: 343299 - DNA, 25 bp, Mus musculus
gtgggagaccactgggacaccaacc

SEQ ID NO: 343300 - DNA, 25 bp, Mus musculus
gtgggagacggccccgactctggcc

SEQ ID NO: 343301 - DNA, 25 bp, Mus musculus
gtgggagagaaaagaaaaaacaaga

SEQ ID NO: 343302 - DNA, 25 bp, Mus musculus
gtgggagagaaaagccttaccaata

SEQ ID NO: 343303 - DNA, 25 bp, Mus musculus
gtgggagagaggcaccatgacaacc

SEQ ID NO: 343304 - DNA, 25 bp, Mus musculus
gtgggagagcgtggtcactgacaat

SEQ ID NO: 343305 - DNA, 25 bp, Mus musculus
gtgggagatgaagcgggagatcgtt

SEQ ID NO: 343306 - DNA, 25 bp, Mus musculus
gtgggagattgtgaccttggagtgc

SEQ ID NO: 343307 - DNA, 25 bp, Mus musculus
gtgggagcaaggaggctcatctgcg

SEQ ID NO: 343308 - DNA, 25 bp, Mus musculus
gtgggagcactggctcacccatgac

SEQ ID NO: 343309 - DNA, 25 bp, Mus musculus
gtgggagcagaggtggagcgaccct

SEQ ID NO: 343310 - DNA, 25 bp, Mus musculus
gtgggagcagctgttgctttcccct

SEQ ID NO: 343311 - DNA, 25 bp, Mus musculus
gtgggagctaagaataatagggccc

SEQ ID NO: 343312 - DNA, 25 bp, Mus musculus
gtgggagctgctgttgctttcccct

SEQ ID NO: 343313 - DNA, 25 bp, Mus musculus
gtgggagctgtgtacatgtcaatga

SEQ ID NO: 343314 - DNA, 25 bp, Mus musculus
gtgggagctgtgtagatgtcaatga

SEQ ID NO: 343315 - DNA, 25 bp, Mus musculus
gtgggaggaagctgtccatggctgg

SEQ ID NO: 343316 - DNA, 25 bp, Mus musculus
gtgggaggaggaatttgacaagatt

SEQ ID NO: 343317 - DNA, 25 bp, Mus musculus
gtgggaggcaggctgccccagcagt

SEQ ID NO: 343318 - DNA, 25 bp, Mus musculus
gtgggaggggcaaaggagcatggct

SEQ ID NO: 343319 - DNA, 25 bp, Mus musculus
gtgggagtcgagagactgaccaacc

SEQ ID NO: 343320 - DNA, 25 bp, Mus musculus
gtgggagtcgagttctaaaacaaca

SEQ ID NO: 343321 - DNA, 25 bp, Mus musculus
gtgggagtgcagattgaaaaatgca

SEQ ID NO: 343322 - DNA, 25 bp, Mus musculus
gtgggatatcgcggcccaatggaag

SEQ ID NO: 343323 - DNA, 25 bp, Mus musculus
gtgggatatcgcgggacaggaacgg

SEQ ID NO: 343324 - DNA, 25 bp, Mus musculus
gtgggatccaccaccacgggctcac

SEQ ID NO: 343325 - DNA, 25 bp, Mus musculus
gtgggatctagacgaggacctatta

SEQ ID NO: 343326 - DNA, 25 bp, Mus musculus
gtgggatctaggacgctgcattggg

SEQ ID NO: 343327 - DNA, 25 bp, Mus musculus
gtgggatgacgaggaagaggaacag

SEQ ID NO: 343328 - DNA, 25 bp, Mus musculus
gtgggatggagctcctggtgaacaa

SEQ ID NO: 343329 - DNA, 25 bp, Mus musculus
gtgggattgcaggccctcaaggccc

SEQ ID NO: 343330 - DNA, 25 bp, Mus musculus
gtgggattggaattgtacccattgt

SEQ ID NO: 343331 - DNA, 25 bp, Mus musculus
gtgggcaacgctgaatggtgccatg

SEQ ID NO: 343332 - DNA, 25 bp, Mus musculus
gtgggcaacgctgtcagcgaaggcc

SEQ ID NO: 343333 - DNA, 25 bp, Mus musculus
gtgggcaaggagatggaatccaagt

SEQ ID NO: 343334 - DNA, 25 bp, Mus musculus
gtgggcaagtcagaatcaacctacc

SEQ ID NO: 343335 - DNA, 25 bp, Mus musculus
gtgggcaagtcagacagtatctcac

SEQ ID NO: 343336 - DNA, 25 bp, Mus musculus
gtgggcaagtcagcgattgtagtga

SEQ ID NO: 343337 - DNA, 25 bp, Mus musculus
gtgggcaagtccagcctgctcctga

SEQ ID NO: 343338 - DNA, 25 bp, Mus musculus
gtgggcacaagacagacaaggaact

SEQ ID NO: 343339 - DNA, 25 bp, Mus musculus
gtgggcacaagagtcagctctggtg

SEQ ID NO: 343340 - DNA, 25 bp, Mus musculus
gtgggcacccaaggtgaaagcagaa

SEQ ID NO: 343341 - DNA, 25 bp, Mus musculus
gtgggcacctgaatccaccttgaca

SEQ ID NO: 343342 - DNA, 25 bp, Mus musculus
gtgggcacctgagagagaagacaca

SEQ ID NO: 343343 - DNA, 25 bp, Mus musculus
gtgggcacctgctggggttgggact

SEQ ID NO: 343344 - DNA, 25 bp, Mus musculus
gtgggcacttttgaaatggccatga

SEQ ID NO: 343345 - DNA, 25 bp, Mus musculus
gtgggcagatgcacatgcagaacat

SEQ ID NO: 343346 - DNA, 25 bp, Mus musculus
gtgggcagcctgtggggacaggttg

SEQ ID NO: 343347 - DNA, 25 bp, Mus musculus
gtgggcagcctgtggttgcagctcc

SEQ ID NO: 343348 - DNA, 25 bp, Mus musculus
gtgggcagtacactgcctcaggcga

SEQ ID NO: 343349 - DNA, 25 bp, Mus musculus
gtgggcagtacattgccattaccca

SEQ ID NO: 343350 - DNA, 25 bp, Mus musculus
gtgggcatgagcaagcacgtcgcgt

SEQ ID NO: 343351 - DNA, 25 bp, Mus musculus
gtgggccacaagccctagcatccct

SEQ ID NO: 343352 - DNA, 25 bp, Mus musculus
gtgggccacttgcccatgttaccag

SEQ ID NO: 343353 - DNA, 25 bp, Mus musculus
gtgggccagaggcttcatgtggaag

SEQ ID NO: 343354 - DNA, 25 bp, Mus musculus
gtgggccagagggtccaggtggagt

SEQ ID NO: 343355 - DNA, 25 bp, Mus musculus
gtgggccagatgggccctcctggtc

SEQ ID NO: 343356 - DNA, 25 bp, Mus musculus
gtgggcccagaccattccccttgtg

SEQ ID NO: 343357 - DNA, 25 bp, Mus musculus
gtgggcccccaagccttggaaatac

SEQ ID NO: 343358 - DNA, 25 bp, Mus musculus
gtgggccgtttctgcttccctcaag

SEQ ID NO: 343359 - DNA, 25 bp, Mus musculus
gtgggcctgcggtagaaaaagcaga

SEQ ID NO: 343360 - DNA, 25 bp, Mus musculus
gtgggccttaaatcagtgtcggtga

SEQ ID NO: 343361 - DNA, 25 bp, Mus musculus
gtgggcgaggaatcttatggcaagg

SEQ ID NO: 343362 - DNA, 25 bp, Mus musculus
gtgggcgcccggcgcagcaagcaca

SEQ ID NO: 343363 - DNA, 25 bp, Mus musculus
gtgggcgcgcgccagttggacattt

SEQ ID NO: 343364 - DNA, 25 bp, Mus musculus
gtgggcgctgtggagataaagaagc

SEQ ID NO: 343365 - DNA, 25 bp, Mus musculus
gtgggcggccggaggtttgccaaag

SEQ ID NO: 343366 - DNA, 25 bp, Mus musculus
gtgggctaccagattttgttcggat

SEQ ID NO: 343367 - DNA, 25 bp, Mus musculus
gtgggctaccagtggttgtccccat

SEQ ID NO: 343368 - DNA, 25 bp, Mus musculus
gtgggctcacacgaggtagctcgcg

SEQ ID NO: 343369 - DNA, 25 bp, Mus musculus
gtgggctccaaatctgaggttatgc

SEQ ID NO: 343370 - DNA, 25 bp, Mus musculus
gtgggctccagcagcccaagcccag

SEQ ID NO: 343371 - DNA, 25 bp, Mus musculus
gtgggctctcacttccagaggaact

SEQ ID NO: 343372 - DNA, 25 bp, Mus musculus
gtgggctctgagaggcccctgcccg

SEQ ID NO: 343373 - DNA, 25 bp, Mus musculus
gtgggctgagaagcggaggctgctg

SEQ ID NO: 343374 - DNA, 25 bp, Mus musculus
gtgggctgagaaggtgaggtggcct

SEQ ID NO: 343375 - DNA, 25 bp, Mus musculus
gtgggctgcggtatcagcctagcag

SEQ ID NO: 343376 - DNA, 25 bp, Mus musculus
gtgggctgcttgctctctaactgat

SEQ ID NO: 343377 - DNA, 25 bp, Mus musculus
gtgggctgcttggcttacttctttg

SEQ ID NO: 343378 - DNA, 25 bp, Mus musculus
gtgggcttcctcaatattgatgaaa

SEQ ID NO: 343379 - DNA, 25 bp, Mus musculus
gtggggaaaccaaggacacactgaa

SEQ ID NO: 343380 - DNA, 25 bp, Mus musculus
gtggggaacagaagccggatggtgt

SEQ ID NO: 343381 - DNA, 25 bp, Mus musculus
gtggggaacaggtctttcatagtac

SEQ ID NO: 343382 - DNA, 25 bp, Mus musculus
gtggggaagcgcagcgagcaggaca

SEQ ID NO: 343383 - DNA, 25 bp, Mus musculus
gtggggaagcgcaggacacagaaaa

SEQ ID NO: 343384 - DNA, 25 bp, Mus musculus
gtggggaatgggagaagagttagaa

SEQ ID NO: 343385 - DNA, 25 bp, Mus musculus
gtggggaatgggagaagatgctgtg

SEQ ID NO: 343386 - DNA, 25 bp, Mus musculus
gtggggacaccattaccatgcagct

SEQ ID NO: 343387 - DNA, 25 bp, Mus musculus
gtggggacagagcagaatttgatac

SEQ ID NO: 343388 - DNA, 25 bp, Mus musculus
gtggggacagagcaggggtgctctt

SEQ ID NO: 343389 - DNA, 25 bp, Mus musculus
gtggggacaggttctggaaatacgc

SEQ ID NO: 343390 - DNA, 25 bp, Mus musculus
gtggggaccataaagtctaaggttg

SEQ ID NO: 343391 - DNA, 25 bp, Mus musculus
gtggggagaaacagccctgacggcc

SEQ ID NO: 343392 - DNA, 25 bp, Mus musculus
gtggggagaccggtactttgatccg

SEQ ID NO: 343393 - DNA, 25 bp, Mus musculus
gtggggagagactgatgagacatcg

SEQ ID NO: 343394 - DNA, 25 bp, Mus musculus
gtggggagctctcgaagtgccctgg

SEQ ID NO: 343395 - DNA, 25 bp, Mus musculus
gtggggagctctcggtctcaactca

SEQ ID NO: 343396 - DNA, 25 bp, Mus musculus
gtggggagctttgaggacctcatgg

SEQ ID NO: 343397 - DNA, 25 bp, Mus musculus
gtggggagggcgaggtgctcctaat

SEQ ID NO: 343398 - DNA, 25 bp, Mus musculus
gtggggagtactttggtcggtgtgg

SEQ ID NO: 343399 - DNA, 25 bp, Mus musculus
gtggggatctcagactatggcgaca

SEQ ID NO: 343400 - DNA, 25 bp, Mus musculus
gtggggattaaggcaggttgtcaca

SEQ ID NO: 343401 - DNA, 25 bp, Mus musculus
gtggggcagaacgaggttgtgaacc

SEQ ID NO: 343402 - DNA, 25 bp, Mus musculus
gtggggcagatgcgaatgaagaggc

SEQ ID NO: 343403 - DNA, 25 bp, Mus musculus
gtggggcatgagtgtaatgttcaag

SEQ ID NO: 343404 - DNA, 25 bp, Mus musculus
gtggggccacagaggcagaggagtc

SEQ ID NO: 343405 - DNA, 25 bp, Mus musculus
gtggggccacaggtgccccccactc

SEQ ID NO: 343406 - DNA, 25 bp, Mus musculus
gtggggccaggcctcttaggtaagg

SEQ ID NO: 343407 - DNA, 25 bp, Mus musculus
gtggggccaggtgtcctgtccatgg

SEQ ID NO: 343408 - DNA, 25 bp, Mus musculus
gtggggccgagcaaccatgaaggtg

SEQ ID NO: 343409 - DNA, 25 bp, Mus musculus
gtggggccgcacggttggtacacga

SEQ ID NO: 343410 - DNA, 25 bp, Mus musculus
gtggggcctggaggacatcatgttc

SEQ ID NO: 343411 - DNA, 25 bp, Mus musculus
gtggggcgcacagccctgtgaagcc

SEQ ID NO: 343412 - DNA, 25 bp, Mus musculus
gtggggctatgcagatggctatgaa

SEQ ID NO: 343413 - DNA, 25 bp, Mus musculus
gtggggctccacagaattgtggcta

SEQ ID NO: 343414 - DNA, 25 bp, Mus musculus
gtggggctccctccatgtgctgtca

SEQ ID NO: 343415 - DNA, 25 bp, Mus musculus
gtggggctcctctaaattggttcca

SEQ ID NO: 343416 - DNA, 25 bp, Mus musculus
gtggggctcgcaggatccctgctgc

SEQ ID NO: 343417 - DNA, 25 bp, Mus musculus
gtggggctgcagaccccacgtggct

SEQ ID NO: 343418 - DNA, 25 bp, Mus musculus
gtggggcttatggtgtctgatctgg

SEQ ID NO: 343419 - DNA, 25 bp, Mus musculus
gtggggctttaggagggttggtggt

SEQ ID NO: 343420 - DNA, 25 bp, Mus musculus
gtgggggaacaggttgagtgatggt

SEQ ID NO: 343421 - DNA, 25 bp, Mus musculus
gtgggggaacagtttctctaatagc

SEQ ID NO: 343422 - DNA, 25 bp, Mus musculus
gtgggggaacctggagctgcccatc

SEQ ID NO: 343423 - DNA, 25 bp, Mus musculus
gtgggggaacctgggagccacccaa

SEQ ID NO: 343424 - DNA, 25 bp, Mus musculus
gtgggggcagtaaatgatgctggag

SEQ ID NO: 343425 - DNA, 25 bp, Mus musculus
gtgggggcctgcatggcctgattgt

SEQ ID NO: 343426 - DNA, 25 bp, Mus musculus
gtgggggcttgtgagggtgactacg

SEQ ID NO: 343427 - DNA, 25 bp, Mus musculus
gtgggggtaagggtggaatgtacgt

SEQ ID NO: 343428 - DNA, 25 bp, Mus musculus
gtgggggtagcaggtttggacctta

SEQ ID NO: 343429 - DNA, 25 bp, Mus musculus
gtgggggtgggggagggcacataga

SEQ ID NO: 343430 - DNA, 25 bp, Mus musculus
gtggggtactgccagggaatgaatt

SEQ ID NO: 343431 - DNA, 25 bp, Mus musculus
gtggggtactgccagtgctgcgcac

SEQ ID NO: 343432 - DNA, 25 bp, Mus musculus
gtggggtcaggcaaggcagtccctc

SEQ ID NO: 343433 - DNA, 25 bp, Mus musculus
gtggggtcagggggactatgtatgg

SEQ ID NO: 343434 - DNA, 25 bp, Mus musculus
gtggggtcccgggctactcttccgt

SEQ ID NO: 343435 - DNA, 25 bp, Mus musculus
gtggggtccgggagtgttacaggtg

SEQ ID NO: 343436 - DNA, 25 bp, Mus musculus
gtggggtgacgaggtggagtacatg

SEQ ID NO: 343437 - DNA, 25 bp, Mus musculus
gtggggtggcgacagatgttgcatt

SEQ ID NO: 343438 - DNA, 25 bp, Mus musculus
gtggggtggcgacaggtgtgactgg

SEQ ID NO: 343439 - DNA, 25 bp, Mus musculus
gtggggttcagtacatcggcatcat

SEQ ID NO: 343440 - DNA, 25 bp, Mus musculus
gtgggtaacacagaagccaccatgg

SEQ ID NO: 343441 - DNA, 25 bp, Mus musculus
gtgggtacagagtataaaggagggg

SEQ ID NO: 343442 - DNA, 25 bp, Mus musculus
gtgggtaccaggcacaggctaccct

SEQ ID NO: 343443 - DNA, 25 bp, Mus musculus
gtgggtaccttgatgccatcccgcc

SEQ ID NO: 343444 - DNA, 25 bp, Mus musculus
gtgggtagcagacagattgatgaca

SEQ ID NO: 343445 - DNA, 25 bp, Mus musculus
gtgggtatacaccaggcatccacat

SEQ ID NO: 343446 - DNA, 25 bp, Mus musculus
gtgggtcacaagaagccgtctcagt

SEQ ID NO: 343447 - DNA, 25 bp, Mus musculus
gtgggtcacaaggtcaaagcaagta

SEQ ID NO: 343448 - DNA, 25 bp, Mus musculus
gtgggtccaggctctggacctgatc

SEQ ID NO: 343449 - DNA, 25 bp, Mus musculus
gtgggtccctccagacttcctctgc

SEQ ID NO: 343450 - DNA, 25 bp, Mus musculus
gtgggtccctccaggtgggcacatg

SEQ ID NO: 343451 - DNA, 25 bp, Mus musculus
gtgggtcccttgcagccatgcagtg

SEQ ID NO: 343452 - DNA, 25 bp, Mus musculus
gtgggtcctcggggcgagcgaggtt

SEQ ID NO: 343453 - DNA, 25 bp, Mus musculus
gtgggtcgatatcaggtgtcctgga

SEQ ID NO: 343454 - DNA, 25 bp, Mus musculus
gtgggtcgggcacattgcctcttta

SEQ ID NO: 343455 - DNA, 25 bp, Mus musculus
gtgggtcggggaagagttgggctgt

SEQ ID NO: 343456 - DNA, 25 bp, Mus musculus
gtgggtctccaggctcagcccgtgc

SEQ ID NO: 343457 - DNA, 25 bp, Mus musculus
gtgggtgacctatcagggtactttt

SEQ ID NO: 343458 - DNA, 25 bp, Mus musculus
gtgggtgagcaggtgcgggaggtgc

SEQ ID NO: 343459 - DNA, 25 bp, Mus musculus
gtgggtgatccaggtcattgtggcc

SEQ ID NO: 343460 - DNA, 25 bp, Mus musculus
gtgggtgatgactcagcttctaagg

SEQ ID NO: 343461 - DNA, 25 bp, Mus musculus
gtgggtgatgactgcccagtgtttc

SEQ ID NO: 343462 - DNA, 25 bp, Mus musculus
gtgggtgatgactgttgctttcact

SEQ ID NO: 343463 - DNA, 25 bp, Mus musculus
gtgggtgcaggtctcaggagctatg

SEQ ID NO: 343464 - DNA, 25 bp, Mus musculus
gtgggtgccacgcaggcttacagtt

SEQ ID NO: 343465 - DNA, 25 bp, Mus musculus
gtgggtggagagcatgggggggaaa

SEQ ID NO: 343466 - DNA, 25 bp, Mus musculus
gtgggtggagctgaagaaagcaatt

SEQ ID NO: 343467 - DNA, 25 bp, Mus musculus
gtgggtggagctgaagaaagccatt

SEQ ID NO: 343468 - DNA, 25 bp, Mus musculus
gtgggtggagtgctctctgaaaact

SEQ ID NO: 343469 - DNA, 25 bp, Mus musculus
gtgggtggagtggtccattcgtttg

SEQ ID NO: 343470 - DNA, 25 bp, Mus musculus
gtgggtggggttcagtacatcggca

SEQ ID NO: 343471 - DNA, 25 bp, Mus musculus
gtgggtgtgtgaaatgcacttagcg

SEQ ID NO: 343472 - DNA, 25 bp, Mus musculus
gtgggtgtgtggactgtgcagcatg

SEQ ID NO: 343473 - DNA, 25 bp, Mus musculus
gtgggttctcgggcaatgatggcag

SEQ ID NO: 343474 - DNA, 25 bp, Mus musculus
gtgggttctgcaggaggagtgatgg

SEQ ID NO: 343475 - DNA, 25 bp, Mus musculus
gtgggtttcaggatccagccgcagc

SEQ ID NO: 343476 - DNA, 25 bp, Mus musculus
gtggtaaaaagagctgtaatagact

SEQ ID NO: 343477 - DNA, 25 bp, Mus musculus
gtggtaaaagactacgcgtttgttc

SEQ ID NO: 343478 - DNA, 25 bp, Mus musculus
gtggtaaagggggagcacgagtgct

SEQ ID NO: 343479 - DNA, 25 bp, Mus musculus
gtggtaatcagggtaacacgcagtc

SEQ ID NO: 343480 - DNA, 25 bp, Mus musculus
gtggtacaaccacttccagctgccc

SEQ ID NO: 343481 - DNA, 25 bp, Mus musculus
gtggtacaacccaagtaatgaaaat

SEQ ID NO: 343482 - DNA, 25 bp, Mus musculus
gtggtacaagacgcatgttaatgaa

SEQ ID NO: 343483 - DNA, 25 bp, Mus musculus
gtggtacactgcagtgctggtgttg

SEQ ID NO: 343484 - DNA, 25 bp, Mus musculus
gtggtacagaaaaagctcctgccac

SEQ ID NO: 343485 - DNA, 25 bp, Mus musculus
gtggtacccttgtgaatacatcaag

SEQ ID NO: 343486 - DNA, 25 bp, Mus musculus
gtggtaccgaggagggacttcaaaa

SEQ ID NO: 343487 - DNA, 25 bp, Mus musculus
gtggtaccggagtaaggaacgaggg

SEQ ID NO: 343488 - DNA, 25 bp, Mus musculus
gtggtacctgaagatgaaatgtggc

SEQ ID NO: 343489 - DNA, 25 bp, Mus musculus
gtggtacgttcaggaggccccatcg

SEQ ID NO: 343490 - DNA, 25 bp, Mus musculus
gtggtacgttcaggggttgtgctgg

SEQ ID NO: 343491 - DNA, 25 bp, Mus musculus
gtggtacttcggctgtcccagggct

SEQ ID NO: 343492 - DNA, 25 bp, Mus musculus
gtggtagagaaagaaaccctggccc

SEQ ID NO: 343493 - DNA, 25 bp, Mus musculus
gtggtagagaaggcagaagaatgcc

SEQ ID NO: 343494 - DNA, 25 bp, Mus musculus
gtggtagcagacccaacagttccca

SEQ ID NO: 343495 - DNA, 25 bp, Mus musculus
gtggtagccccagaggccttcggac

SEQ ID NO: 343496 - DNA, 25 bp, Mus musculus
gtggtaggcaggttgttcgtagtct

SEQ ID NO: 343497 - DNA, 25 bp, Mus musculus
gtggtagtgtactgtgaccgtgata

SEQ ID NO: 343498 - DNA, 25 bp, Mus musculus
gtggtataaagagggtgtattacct

SEQ ID NO: 343499 - DNA, 25 bp, Mus musculus
gtggtatcatgatgacacttgttga

SEQ ID NO: 343500 - DNA, 25 bp, Mus musculus
gtggtatcatggtggatacagtgcc

SEQ ID NO: 343501 - DNA, 25 bp, Mus musculus
gtggtatccacgcctgaggtcctgg

SEQ ID NO: 343502 - DNA, 25 bp, Mus musculus
gtggtatcttcgaaccaagtatcag

SEQ ID NO: 343503 - DNA, 25 bp, Mus musculus
gtggtatgaggttgaacggacagaa

SEQ ID NO: 343504 - DNA, 25 bp, Mus musculus
gtggtatgagtggttcagaaattga

SEQ ID NO: 343505 - DNA, 25 bp, Mus musculus
gtggtatgcagaggttaaggagctc

SEQ ID NO: 343506 - DNA, 25 bp, Mus musculus
gtggtatgttccaggattgaaccag

SEQ ID NO: 343507 - DNA, 25 bp, Mus musculus
gtggtcaccaacagtcagcgtggga

SEQ ID NO: 343508 - DNA, 25 bp, Mus musculus
gtggtcactctaaccggtcatttgg

SEQ ID NO: 343509 - DNA, 25 bp, Mus musculus
gtggtcactgtgcagctcattctct

SEQ ID NO: 343510 - DNA, 25 bp, Mus musculus
gtggtcactgtgcagttccgctcgc

SEQ ID NO: 343511 - DNA, 25 bp, Mus musculus
gtggtcagagcagcagattttccac

SEQ ID NO: 343512 - DNA, 25 bp, Mus musculus
gtggtcagcatgattcgattcttga

SEQ ID NO: 343513 - DNA, 25 bp, Mus musculus
gtggtcagcgtctgggaaagaagag

SEQ ID NO: 343514 - DNA, 25 bp, Mus musculus
gtggtcagggcagggataatcttaa

SEQ ID NO: 343515 - DNA, 25 bp, Mus musculus
gtggtcagtctctgcaggttcaggg

SEQ ID NO: 343516 - DNA, 25 bp, Mus musculus
gtggtcatcaacggctcagaggtgg

SEQ ID NO: 343517 - DNA, 25 bp, Mus musculus
gtggtcatcccagcagaagttttca

SEQ ID NO: 343518 - DNA, 25 bp, Mus musculus
gtggtcatcgacaatgagcaccggg

SEQ ID NO: 343519 - DNA, 25 bp, Mus musculus
gtggtcatcgacaatggttcagggg

SEQ ID NO: 343520 - DNA, 25 bp, Mus musculus
gtggtcatgaaggcatttgagcact

SEQ ID NO: 343521 - DNA, 25 bp, Mus musculus
gtggtccacaagggggggctgttca

SEQ ID NO: 343522 - DNA, 25 bp, Mus musculus
gtggtccagaaccctctgattgccc

SEQ ID NO: 343523 - DNA, 25 bp, Mus musculus
gtggtccagtggaacagattgttgt

SEQ ID NO: 343524 - DNA, 25 bp, Mus musculus
gtggtccagtggaacgtgggatctc

SEQ ID NO: 343525 - DNA, 25 bp, Mus musculus
gtggtcccagaatggaagcccagag

SEQ ID NO: 343526 - DNA, 25 bp, Mus musculus
gtggtcccagctcaggaggaaaact

SEQ ID NO: 343527 - DNA, 25 bp, Mus musculus
gtggtcccagggccagaaaaagctg

SEQ ID NO: 343528 - DNA, 25 bp, Mus musculus
gtggtcccctggagcaccaaggaaa

SEQ ID NO: 343529 - DNA, 25 bp, Mus musculus
gtggtccctacacgaatgaagtgta

SEQ ID NO: 343530 - DNA, 25 bp, Mus musculus
gtggtccctgagttcgtcaatgcat

SEQ ID NO: 343531 - DNA, 25 bp, Mus musculus
gtggtccctgttctccaccctcccc

SEQ ID NO: 343532 - DNA, 25 bp, Mus musculus
gtggtccgagaggtgtgctctgaac

SEQ ID NO: 343533 - DNA, 25 bp, Mus musculus
gtggtccgagggctgctggacctgg

SEQ ID NO: 343534 - DNA, 25 bp, Mus musculus
gtggtccgagttcccacgacagcag

SEQ ID NO: 343535 - DNA, 25 bp, Mus musculus
gtggtccgcgtcggtgctggcctgc

SEQ ID NO: 343536 - DNA, 25 bp, Mus musculus
gtggtccgcttaaaggactggacag

SEQ ID NO: 343537 - DNA, 25 bp, Mus musculus
gtggtccgtcaagcccttgaccaca

SEQ ID NO: 343538 - DNA, 25 bp, Mus musculus
gtggtcctagggttctccacatacg

SEQ ID NO: 343539 - DNA, 25 bp, Mus musculus
gtggtcctggcctggtgtgcatcgg

SEQ ID NO: 343540 - DNA, 25 bp, Mus musculus
gtggtcctggggccatcagctccag

SEQ ID NO: 343541 - DNA, 25 bp, Mus musculus
gtggtcctgggggaatggataagta

SEQ ID NO: 343542 - DNA, 25 bp, Mus musculus
gtggtcctggggtacaatggtgctt

SEQ ID NO: 343543 - DNA, 25 bp, Mus musculus
gtggtcctgtcagcttcagccacct

SEQ ID NO: 343544 - DNA, 25 bp, Mus musculus
gtggtcctgtcagtggatgtgtcct

SEQ ID NO: 343545 - DNA, 25 bp, Mus musculus
gtggtccttgaaccgggcaccatcc

SEQ ID NO: 343546 - DNA, 25 bp, Mus musculus
gtggtcgcagacgaagaaatggaag

SEQ ID NO: 343547 - DNA, 25 bp, Mus musculus
gtggtcggaggagtggtgtggaagg

SEQ ID NO: 343548 - DNA, 25 bp, Mus musculus
gtggtcgtcgtcatgatggagagga

SEQ ID NO: 343549 - DNA, 25 bp, Mus musculus
gtggtctacaagacagtagccaacc

SEQ ID NO: 343550 - DNA, 25 bp, Mus musculus
gtggtctattcagatacagccctgc

SEQ ID NO: 343551 - DNA, 25 bp, Mus musculus
gtggtctattcagctacagtgatcc

SEQ ID NO: 343552 - DNA, 25 bp, Mus musculus
gtggtctcacgcggtcggatatgaa

SEQ ID NO: 343553 - DNA, 25 bp, Mus musculus
gtggtctcactgggcatacttctcc

SEQ ID NO: 343554 - DNA, 25 bp, Mus musculus
gtggtctcagaagtgccttcaagac

SEQ ID NO: 343555 - DNA, 25 bp, Mus musculus
gtggtctccgggttctgcaggagcc

SEQ ID NO: 343556 - DNA, 25 bp, Mus musculus
gtggtctctgcgcggttgactcttc

SEQ ID NO: 343557 - DNA, 25 bp, Mus musculus
gtggtctgagtgaagattatttgtc

SEQ ID NO: 343558 - DNA, 25 bp, Mus musculus
gtggtctgcaaaggagaatcacact

SEQ ID NO: 343559 - DNA, 25 bp, Mus musculus
gtggtctgcggaaagtacacaaaca

SEQ ID NO: 343560 - DNA, 25 bp, Mus musculus
gtggtcttcacaggcgtggagacca

SEQ ID NO: 343561 - DNA, 25 bp, Mus musculus
gtggtcttccagatgagaaaatgat

SEQ ID NO: 343562 - DNA, 25 bp, Mus musculus
gtggtcttccagatggggacttcag

SEQ ID NO: 343563 - DNA, 25 bp, Mus musculus
gtggtcttccaggggaatgcaggca

SEQ ID NO: 343564 - DNA, 25 bp, Mus musculus
gtggtcttgctgaggaacatggttg

SEQ ID NO: 343565 - DNA, 25 bp, Mus musculus
gtggtgaacattagcaacaagacgg

SEQ ID NO: 343566 - DNA, 25 bp, Mus musculus
gtggtgaagaaggttcattatgatg

SEQ ID NO: 343567 - DNA, 25 bp, Mus musculus
gtggtgaaggacctcagtgcagaag

SEQ ID NO: 343568 - DNA, 25 bp, Mus musculus
gtggtgaagtaggaaacacactgga

SEQ ID NO: 343569 - DNA, 25 bp, Mus musculus
gtggtgacaagggcaacagcaggtt

SEQ ID NO: 343570 - DNA, 25 bp, Mus musculus
gtggtgacacaagggacccgggagg

SEQ ID NO: 343571 - DNA, 25 bp, Mus musculus
gtggtgacacaaggtgtggcctttg

SEQ ID NO: 343572 - DNA, 25 bp, Mus musculus
gtggtgacacagaagatctggaact

SEQ ID NO: 343573 - DNA, 25 bp, Mus musculus
gtggtgacacagaaggaaggaattc

SEQ ID NO: 343574 - DNA, 25 bp, Mus musculus
gtggtgacacctgtgtacaggaaaa

SEQ ID NO: 343575 - DNA, 25 bp, Mus musculus
gtggtgacaggcattgagatgttcc

SEQ ID NO: 343576 - DNA, 25 bp, Mus musculus
gtggtgacaggctccatccaacccc

SEQ ID NO: 343577 - DNA, 25 bp, Mus musculus
gtggtgacaggtattgagatgttcc

SEQ ID NO: 343578 - DNA, 25 bp, Mus musculus
gtggtgaccaagactgcgcttcgcc

SEQ ID NO: 343579 - DNA, 25 bp, Mus musculus
gtggtgaccggaactttctaagctg

SEQ ID NO: 343580 - DNA, 25 bp, Mus musculus
gtggtgactgacctatccgcttctc

SEQ ID NO: 343581 - DNA, 25 bp, Mus musculus
gtggtgagtgaagagctctgcagtt

SEQ ID NO: 343582 - DNA, 25 bp, Mus musculus
gtggtgagttcaggtactcagttcg

SEQ ID NO: 343583 - DNA, 25 bp, Mus musculus
gtggtgagttcaggtggttgtggag

SEQ ID NO: 343584 - DNA, 25 bp, Mus musculus
gtggtgatatcccagattttagaaa

SEQ ID NO: 343585 - DNA, 25 bp, Mus musculus
gtggtgatatcccaggtccaaatat

SEQ ID NO: 343586 - DNA, 25 bp, Mus musculus
gtggtgatcaggatctgcacctggg

SEQ ID NO: 343587 - DNA, 25 bp, Mus musculus
gtggtgatgaaagtggctcagctca

SEQ ID NO: 343588 - DNA, 25 bp, Mus musculus
gtggtgcacaggacacaaaaaagaa

SEQ ID NO: 343589 - DNA, 25 bp, Mus musculus
gtggtgcacagtttccctcaggaca

SEQ ID NO: 343590 - DNA, 25 bp, Mus musculus
gtggtgcatgctagcttggccgaca

SEQ ID NO: 343591 - DNA, 25 bp, Mus musculus
gtggtgccaatgccatgctggtgcc

SEQ ID NO: 343592 - DNA, 25 bp, Mus musculus
gtggtgccaattgctggtgccagtg

SEQ ID NO: 343593 - DNA, 25 bp, Mus musculus
gtggtgccagcacccaagcaaacac

SEQ ID NO: 343594 - DNA, 25 bp, Mus musculus
gtggtgccggccgagattgctaaga

SEQ ID NO: 343595 - DNA, 25 bp, Mus musculus
gtggtgcgaggaggtggagcctact

SEQ ID NO: 343596 - DNA, 25 bp, Mus musculus
gtggtgctaagaggcttcctggatg

SEQ ID NO: 343597 - DNA, 25 bp, Mus musculus
gtggtgctaaggcaacatctgcaac

SEQ ID NO: 343598 - DNA, 25 bp, Mus musculus
gtggtgctaaggtggtggagaaagc

SEQ ID NO: 343599 - DNA, 25 bp, Mus musculus
gtggtgctcaggcaagatgggcata

SEQ ID NO: 343600 - DNA, 25 bp, Mus musculus
gtggtgctcagtggcagcatggagc

SEQ ID NO: 343601 - DNA, 25 bp, Mus musculus
gtggtgctgctgccagcaggacggc

SEQ ID NO: 343602 - DNA, 25 bp, Mus musculus
gtggtgctggaggtgtcctgtccat

SEQ ID NO: 343603 - DNA, 25 bp, Mus musculus
gtggtgctggagttaaaggcagatg

SEQ ID NO: 343604 - DNA, 25 bp, Mus musculus
gtggtgctggggcctgtgctctcta

SEQ ID NO: 343605 - DNA, 25 bp, Mus musculus
gtggtgcttacgaacacagatatgt

SEQ ID NO: 343606 - DNA, 25 bp, Mus musculus
gtggtgcttgtgaatcagcaatgca

SEQ ID NO: 343607 - DNA, 25 bp, Mus musculus
gtggtggaaagataaggaattggaa

SEQ ID NO: 343608 - DNA, 25 bp, Mus musculus
gtggtggaaatagacaacctgttgg

SEQ ID NO: 343609 - DNA, 25 bp, Mus musculus
gtggtggaaatagctgcagtacctc

SEQ ID NO: 343610 - DNA, 25 bp, Mus musculus
gtggtggaagaggagaactttgact

SEQ ID NO: 343611 - DNA, 25 bp, Mus musculus
gtggtggaagaggagacaagtttcc

SEQ ID NO: 343612 - DNA, 25 bp, Mus musculus
gtggtggaaggagctcaaggttctc

SEQ ID NO: 343613 - DNA, 25 bp, Mus musculus
gtggtggaagtcgtgttcaaggaca

SEQ ID NO: 343614 - DNA, 25 bp, Mus musculus
gtggtggaagtgcaggagaaagacg

SEQ ID NO: 343615 - DNA, 25 bp, Mus musculus
gtggtggaatttatgggatgaacaa

SEQ ID NO: 343616 - DNA, 25 bp, Mus musculus
gtggtggacagggaatgtacggcat

SEQ ID NO: 343617 - DNA, 25 bp, Mus musculus
gtggtggacagtgcctatgaagtca

SEQ ID NO: 343618 - DNA, 25 bp, Mus musculus
gtggtggacctcaggcatcctgcat

SEQ ID NO: 343619 - DNA, 25 bp, Mus musculus
gtggtggacctcaggcatcctggat

SEQ ID NO: 343620 - DNA, 25 bp, Mus musculus
gtggtggagaaggcttactgctccc

SEQ ID NO: 343621 - DNA, 25 bp, Mus musculus
gtggtggagacacagacgctgttcc

SEQ ID NO: 343622 - DNA, 25 bp, Mus musculus
gtggtggagccttcccatcagggac

SEQ ID NO: 343623 - DNA, 25 bp, Mus musculus
gtggtggaggaggggaatttgctct

SEQ ID NO: 343624 - DNA, 25 bp, Mus musculus
gtggtggaggggatcctggacaccc

SEQ ID NO: 343625 - DNA, 25 bp, Mus musculus
gtggtggagggggacgatttggtct

SEQ ID NO: 343626 - DNA, 25 bp, Mus musculus
gtggtggagtacgaatatattgtgg

SEQ ID NO: 343627 - DNA, 25 bp, Mus musculus
gtggtggagtgcacctgtcaagccc

SEQ ID NO: 343628 - DNA, 25 bp, Mus musculus
gtggtggattctgggaaggtgaagg

SEQ ID NO: 343629 - DNA, 25 bp, Mus musculus
gtggtggcagcagcccaaatgaccc

SEQ ID NO: 343630 - DNA, 25 bp, Mus musculus
gtggtggcatctcagatacgaacag

SEQ ID NO: 343631 - DNA, 25 bp, Mus musculus
gtggtggcattgggctggaaagggt

SEQ ID NO: 343632 - DNA, 25 bp, Mus musculus
gtggtggccaggacagcaaccatct

SEQ ID NO: 343633 - DNA, 25 bp, Mus musculus
gtggtggccagtgggtgcatccttg

SEQ ID NO: 343634 - DNA, 25 bp, Mus musculus
gtggtggccatggtctgggaaggcc

SEQ ID NO: 343635 - DNA, 25 bp, Mus musculus
gtggtggcccgagctgtgggaacct

SEQ ID NO: 343636 - DNA, 25 bp, Mus musculus
gtggtggccctgtctctctggactt

SEQ ID NO: 343637 - DNA, 25 bp, Mus musculus
gtggtggccgtagagcatgcactct

SEQ ID NO: 343638 - DNA, 25 bp, Mus musculus
gtggtggccgtagaggtgctgggat

SEQ ID NO: 343639 - DNA, 25 bp, Mus musculus
gtggtggcctgtggtttatggtgtg

SEQ ID NO: 343640 - DNA, 25 bp, Mus musculus
gtggtggctcgattcctgtctctga

SEQ ID NO: 343641 - DNA, 25 bp, Mus musculus
gtggtggctttggtggcatatccaa

SEQ ID NO: 343642 - DNA, 25 bp, Mus musculus
gtggtgggagagcgtggtcactgac

SEQ ID NO: 343643 - DNA, 25 bp, Mus musculus
gtggtgggagatgaagcgggagatc

SEQ ID NO: 343644 - DNA, 25 bp, Mus musculus
gtggtgggagccctatgctgctgtt

SEQ ID NO: 343645 - DNA, 25 bp, Mus musculus
gtggtgggctaccagattttgttcg

SEQ ID NO: 343646 - DNA, 25 bp, Mus musculus
gtggtgggctaccagtggttgtccc

SEQ ID NO: 343647 - DNA, 25 bp, Mus musculus
gtggtggggaagttgcttcaggcag

SEQ ID NO: 343648 - DNA, 25 bp, Mus musculus
gtggtggtataaagagggtgtatta

SEQ ID NO: 343649 - DNA, 25 bp, Mus musculus
gtggtggtcatcccagcagaagttt

SEQ ID NO: 343650 - DNA, 25 bp, Mus musculus
gtggtggtgaccggaactttctaag

SEQ ID NO: 343651 - DNA, 25 bp, Mus musculus
gtggtggtgccaattgctggtgcca

SEQ ID NO: 343652 - DNA, 25 bp, Mus musculus
gtggtggtggggaagttgcttcagg

SEQ ID NO: 343653 - DNA, 25 bp, Mus musculus
gtggtggtgttatgcttgcttcact

SEQ ID NO: 343654 - DNA, 25 bp, Mus musculus
gtggtggtgttcagtgtggacgagg

SEQ ID NO: 343655 - DNA, 25 bp, Mus musculus
gtggtggttctgacagagcctcaag

SEQ ID NO: 343656 - DNA, 25 bp, Mus musculus
gtggtgtcaccacaggccgacccgt

SEQ ID NO: 343657 - DNA, 25 bp, Mus musculus
gtggtgtcctggctggtatctgccg

SEQ ID NO: 343658 - DNA, 25 bp, Mus musculus
gtggtgtgacttgagaacacaagag

SEQ ID NO: 343659 - DNA, 25 bp, Mus musculus
gtggtgtgacttgagaagctgaatc

SEQ ID NO: 343660 - DNA, 25 bp, Mus musculus
gtggtgtgccccctctagtcctccc

SEQ ID NO: 343661 - DNA, 25 bp, Mus musculus
gtggtgtgcgaccagatctgctgct

SEQ ID NO: 343662 - DNA, 25 bp, Mus musculus
gtggtgtgcgaccaggtgtctgcct

SEQ ID NO: 343663 - DNA, 25 bp, Mus musculus
gtggtgtggacactcctggagccag

SEQ ID NO: 343664 - DNA, 25 bp, Mus musculus
gtggtgtgttagagtggattgaaat

SEQ ID NO: 343665 - DNA, 25 bp, Mus musculus
gtggtgtgttaggtatggctttccc

SEQ ID NO: 343666 - DNA, 25 bp, Mus musculus
gtggtgtgttaggtgcggtggctac

SEQ ID NO: 343667 - DNA, 25 bp, Mus musculus
gtggtgttaacatgattgttcgttt

SEQ ID NO: 343668 - DNA, 25 bp, Mus musculus
gtggtgttacaggccgccctgctcc

SEQ ID NO: 343669 - DNA, 25 bp, Mus musculus
gtggtgttacaggttagtgtcactg

SEQ ID NO: 343670 - DNA, 25 bp, Mus musculus
gtggtgttatgcttgcttcactaaa

SEQ ID NO: 343671 - DNA, 25 bp, Mus musculus
gtggtgttcagtgtggacgaggagg

SEQ ID NO: 343672 - DNA, 25 bp, Mus musculus
gtggtgttcttatgactctgggctg

SEQ ID NO: 343673 - DNA, 25 bp, Mus musculus
gtggtgttgctgaagatcaaccgag

SEQ ID NO: 343674 - DNA, 25 bp, Mus musculus
gtggttaacagaatgagaacagaca

SEQ ID NO: 343675 - DNA, 25 bp, Mus musculus
gtggttaataaaggaggctttggag

SEQ ID NO: 343676 - DNA, 25 bp, Mus musculus
gtggttaataatgcagctgtgtctg

SEQ ID NO: 343677 - DNA, 25 bp, Mus musculus
gtggttacagagccgagcagttggc

SEQ ID NO: 343678 - DNA, 25 bp, Mus musculus
gtggttacaggaaataatgaagaca

SEQ ID NO: 343679 - DNA, 25 bp, Mus musculus
gtggttcatccatacatccagaacc

SEQ ID NO: 343680 - DNA, 25 bp, Mus musculus
gtggttccatcaagggaagaaggat

SEQ ID NO: 343681 - DNA, 25 bp, Mus musculus
gtggttcccgacgctcctgcgttct

SEQ ID NO: 343682 - DNA, 25 bp, Mus musculus
gtggttcccgacggtgacaaacttg

SEQ ID NO: 343683 - DNA, 25 bp, Mus musculus
gtggttcccgacggttttggctatg

SEQ ID NO: 343684 - DNA, 25 bp, Mus musculus
gtggttcctttccttgggagcgagc

SEQ ID NO: 343685 - DNA, 25 bp, Mus musculus
gtggttctagctttaaggaccatcc

SEQ ID NO: 343686 - DNA, 25 bp, Mus musculus
gtggttctaggagctcagactgaag

SEQ ID NO: 343687 - DNA, 25 bp, Mus musculus
gtggttctccagagggaaaaagcct

SEQ ID NO: 343688 - DNA, 25 bp, Mus musculus
gtggttctcgagcaccctcagaata

SEQ ID NO: 343689 - DNA, 25 bp, Mus musculus
gtggttctcgaggctgctgatgaga

SEQ ID NO: 343690 - DNA, 25 bp, Mus musculus
gtggttctgtccagagcctcaaggt

SEQ ID NO: 343691 - DNA, 25 bp, Mus musculus
gtggttctgtccaggatcattttaa

SEQ ID NO: 343692 - DNA, 25 bp, Mus musculus
gtggttcttcaggcgtggctcccgc

SEQ ID NO: 343693 - DNA, 25 bp, Mus musculus
gtggttcttcaggtacatggcttct

SEQ ID NO: 343694 - DNA, 25 bp, Mus musculus
gtggttcttcaggtcagaaggagac

SEQ ID NO: 343695 - DNA, 25 bp, Mus musculus
gtggttctttaagctacaaaaaatt

SEQ ID NO: 343696 - DNA, 25 bp, Mus musculus
gtggttgaatgatccagagtcctcc

SEQ ID NO: 343697 - DNA, 25 bp, Mus musculus
gtggttgacatcaaatacaagagga

SEQ ID NO: 343698 - DNA, 25 bp, Mus musculus
gtggttgacatcaagactgaaggac

SEQ ID NO: 343699 - DNA, 25 bp, Mus musculus
gtggttgacatgtgcgagtagtggg

SEQ ID NO: 343700 - DNA, 25 bp, Mus musculus
gtggttgattgagaaggagggagag

SEQ ID NO: 343701 - DNA, 25 bp, Mus musculus
gtggttgcaggagcacccccaccgc

SEQ ID NO: 343702 - DNA, 25 bp, Mus musculus
gtggttgcaggagggtgaagggcct

SEQ ID NO: 343703 - DNA, 25 bp, Mus musculus
gtggttgccggacctacaacctggg

SEQ ID NO: 343704 - DNA, 25 bp, Mus musculus
gtggttgctatggaacatcattcat

SEQ ID NO: 343705 - DNA, 25 bp, Mus musculus
gtggttgctatggtctgggagggtc

SEQ ID NO: 343706 - DNA, 25 bp, Mus musculus
gtggttggcaacctctgaagtcttg

SEQ ID NO: 343707 - DNA, 25 bp, Mus musculus
gtggttggccctcagggtcccacag

SEQ ID NO: 343708 - DNA, 25 bp, Mus musculus
gtggttgtcagcgctgatagaagtg

SEQ ID NO: 343709 - DNA, 25 bp, Mus musculus
gtggttgtgctgggcctgcttccga

SEQ ID NO: 343710 - DNA, 25 bp, Mus musculus
gtggttgtggtcaaccacactgtcc

SEQ ID NO: 343711 - DNA, 25 bp, Mus musculus
gtggttgttccggaggaatttgaag

SEQ ID NO: 343712 - DNA, 25 bp, Mus musculus
gtggtttaaaaaactacatatggtc

SEQ ID NO: 343713 - DNA, 25 bp, Mus musculus
gtggtttaaaaactctgtgcaccga

SEQ ID NO: 343714 - DNA, 25 bp, Mus musculus
gtggtttaacaggtgtcactctgca

SEQ ID NO: 343715 - DNA, 25 bp, Mus musculus
gtggtttacacagtattactatgaa

SEQ ID NO: 343716 - DNA, 25 bp, Mus musculus
gtggtttatatgcattcacatcatt

SEQ ID NO: 343717 - DNA, 25 bp, Mus musculus
gtggtttatatgcttgtgggctttt

SEQ ID NO: 343718 - DNA, 25 bp, Mus musculus
gtggtttatcaagattactcgggac

SEQ ID NO: 343719 - DNA, 25 bp, Mus musculus
gtggtttatcaagggatccacaaat

SEQ ID NO: 343720 - DNA, 25 bp, Mus musculus
gtggtttctctaggtattctcatgg

SEQ ID NO: 343721 - DNA, 25 bp, Mus musculus
gtggtttgaaagtatccctggaaga

SEQ ID NO: 343722 - DNA, 25 bp, Mus musculus
gtggtttgaggtcctccagaggtgg

SEQ ID NO: 343723 - DNA, 25 bp, Mus musculus
gtggtttgcagcttcatggtttcag

SEQ ID NO: 343724 - DNA, 25 bp, Mus musculus
gtggtttgcagggatgcggtaaaaa

SEQ ID NO: 343725 - DNA, 25 bp, Mus musculus
gtggttttactgagttgcactcact

SEQ ID NO: 343726 - DNA, 25 bp, Mus musculus
gtggttttcttgaccctgctttttg

SEQ ID NO: 343727 - DNA, 25 bp, Mus musculus
gtggtttttgacagaccagccacac

SEQ ID NO: 343728 - DNA, 25 bp, Mus musculus
gtggtttttgacagcctcattaact

SEQ ID NO: 343729 - DNA, 25 bp, Mus musculus
gtgtaaaaagagtattacaacaaca

SEQ ID NO: 343730 - DNA, 25 bp, Mus musculus
gtgtaaaaaggaagtgttaaacatg

SEQ ID NO: 343731 - DNA, 25 bp, Mus musculus
gtgtaaaaattaatggtatcctaaa

SEQ ID NO: 343732 - DNA, 25 bp, Mus musculus
gtgtaaaaattaatggttggctgca

SEQ ID NO: 343733 - DNA, 25 bp, Mus musculus
gtgtaaaatccccagatcccagcct

SEQ ID NO: 343734 - DNA, 25 bp, Mus musculus
gtgtaaaatccccagctattgcaga

SEQ ID NO: 343735 - DNA, 25 bp, Mus musculus
gtgtaaaatccccaggtgtgactgc

SEQ ID NO: 343736 - DNA, 25 bp, Mus musculus
gtgtaaaatctgggggttacaacta

SEQ ID NO: 343737 - DNA, 25 bp, Mus musculus
gtgtaaaatctgtgcactgaggcca

SEQ ID NO: 343738 - DNA, 25 bp, Mus musculus
gtgtaaagcgatgattcccccgact

SEQ ID NO: 343739 - DNA, 25 bp, Mus musculus
gtgtaaaggtagatcgaggcccagc

SEQ ID NO: 343740 - DNA, 25 bp, Mus musculus
gtgtaaatctaagatcaactatggg

SEQ ID NO: 343741 - DNA, 25 bp, Mus musculus
gtgtaacaaggaggcttacagtggg

SEQ ID NO: 343742 - DNA, 25 bp, Mus musculus
gtgtaaccaaagatgtcgcactggc

SEQ ID NO: 343743 - DNA, 25 bp, Mus musculus
gtgtaacccagagatttattttatg

SEQ ID NO: 343744 - DNA, 25 bp, Mus musculus
gtgtaactcagaaagaagattataa

SEQ ID NO: 343745 - DNA, 25 bp, Mus musculus
gtgtaactgttacgaaatctcataa

SEQ ID NO: 343746 - DNA, 25 bp, Mus musculus
gtgtaactgttacgatccatctttt

SEQ ID NO: 343747 - DNA, 25 bp, Mus musculus
gtgtaagcactggggaaagcctttg

SEQ ID NO: 343748 - DNA, 25 bp, Mus musculus
gtgtaagcagaatattcaagggcat

SEQ ID NO: 343749 - DNA, 25 bp, Mus musculus
gtgtaagcccggccgaattcgagga

SEQ ID NO: 343750 - DNA, 25 bp, Mus musculus
gtgtaaggacaagggagttgtattt

SEQ ID NO: 343751 - DNA, 25 bp, Mus musculus
gtgtaaggacaaggtagactgggta

SEQ ID NO: 343752 - DNA, 25 bp, Mus musculus
gtgtaagtttttcagaatttcttaa

SEQ ID NO: 343753 - DNA, 25 bp, Mus musculus
gtgtaatcagcagctgttctcatat

SEQ ID NO: 343754 - DNA, 25 bp, Mus musculus
gtgtaatgaagaaaagtccatcata

SEQ ID NO: 343755 - DNA, 25 bp, Mus musculus
gtgtaatgaagacttgtgacacctg

SEQ ID NO: 343756 - DNA, 25 bp, Mus musculus
gtgtaatgctttgtcggatatgaag

SEQ ID NO: 343757 - DNA, 25 bp, Mus musculus
gtgtaatgtgagacctctgggtgag

SEQ ID NO: 343758 - DNA, 25 bp, Mus musculus
gtgtaatgtgagagattggtgtcct

SEQ ID NO: 343759 - DNA, 25 bp, Mus musculus
gtgtacaatgaaaatcttgttcata

SEQ ID NO: 343760 - DNA, 25 bp, Mus musculus
gtgtacaatgagaaacatattcaag

SEQ ID NO: 343761 - DNA, 25 bp, Mus musculus
gtgtacacacaggtggtgacagtgg

SEQ ID NO: 343762 - DNA, 25 bp, Mus musculus
gtgtacactccaggagctgcagccc

SEQ ID NO: 343763 - DNA, 25 bp, Mus musculus
gtgtacagtacaggcaaatttccag

SEQ ID NO: 343764 - DNA, 25 bp, Mus musculus
gtgtacagtgacaggtatatctttg

SEQ ID NO: 343765 - DNA, 25 bp, Mus musculus
gtgtacagtgcttctcagacacaaa

SEQ ID NO: 343766 - DNA, 25 bp, Mus musculus
gtgtacccaggaataaaacccaatg

SEQ ID NO: 343767 - DNA, 25 bp, Mus musculus
gtgtacccaggttgtgactacacta

SEQ ID NO: 343768 - DNA, 25 bp, Mus musculus
gtgtacctgcagcctgcactggatg

SEQ ID NO: 343769 - DNA, 25 bp, Mus musculus
gtgtacgaagcagctccttaattga

SEQ ID NO: 343770 - DNA, 25 bp, Mus musculus
gtgtacgaaggtatggcctcacatg

SEQ ID NO: 343771 - DNA, 25 bp, Mus musculus
gtgtacggcgcaacctgcggcagat

SEQ ID NO: 343772 - DNA, 25 bp, Mus musculus
gtgtacggcggagatgaagttggcg

SEQ ID NO: 343773 - DNA, 25 bp, Mus musculus
gtgtacgtgagcctggacagaccct

SEQ ID NO: 343774 - DNA, 25 bp, Mus musculus
gtgtactaaaaatagcccagaagag

SEQ ID NO: 343775 - DNA, 25 bp, Mus musculus
gtgtactcctggaccatgatgtgcc

SEQ ID NO: 343776 - DNA, 25 bp, Mus musculus
gtgtactgaggaaagcagaggagtt

SEQ ID NO: 343777 - DNA, 25 bp, Mus musculus
gtgtactgaggcatatttaattagg

SEQ ID NO: 343778 - DNA, 25 bp, Mus musculus
gtgtactggagaaaatgttttcaga

SEQ ID NO: 343779 - DNA, 25 bp, Mus musculus
gtgtactggagagggtgtaacaaaa

SEQ ID NO: 343780 - DNA, 25 bp, Mus musculus
gtgtactgtggttcactacaacatt

SEQ ID NO: 343781 - DNA, 25 bp, Mus musculus
gtgtacttacatatataaataaata

SEQ ID NO: 343782 - DNA, 25 bp, Mus musculus
gtgtacttgactgaagtgtgctttt

SEQ ID NO: 343783 - DNA, 25 bp, Mus musculus
gtgtacttttcatcgtccaacttta

SEQ ID NO: 343784 - DNA, 25 bp, Mus musculus
gtgtagaactgctccaggctttctt

SEQ ID NO: 343785 - DNA, 25 bp, Mus musculus
gtgtagaagccatccgttctcgtgc

SEQ ID NO: 343786 - DNA, 25 bp, Mus musculus
gtgtagaattctcactggccggggc

SEQ ID NO: 343787 - DNA, 25 bp, Mus musculus
gtgtagagaaagacatggagatgac

SEQ ID NO: 343788 - DNA, 25 bp, Mus musculus
gtgtagagccacagaactgtcctgg

SEQ ID NO: 343789 - DNA, 25 bp, Mus musculus
gtgtagagccacagagacagtgttt

SEQ ID NO: 343790 - DNA, 25 bp, Mus musculus
gtgtagagccacaggatctcaattc

SEQ ID NO: 343791 - DNA, 25 bp, Mus musculus
gtgtagcaggcagcaaagaagaatg

SEQ ID NO: 343792 - DNA, 25 bp, Mus musculus
gtgtagcagttccagtcagctgcgg

SEQ ID NO: 343793 - DNA, 25 bp, Mus musculus
gtgtagcctcaggatgcctggtgtg

SEQ ID NO: 343794 - DNA, 25 bp, Mus musculus
gtgtagctggaatgttacagaattt

SEQ ID NO: 343795 - DNA, 25 bp, Mus musculus
gtgtaggagaaggtccaacgggcgc

SEQ ID NO: 343796 - DNA, 25 bp, Mus musculus
gtgtaggatacaggtgccctagctg

SEQ ID NO: 343797 - DNA, 25 bp, Mus musculus
gtgtaggatgtaggtgaattatact

SEQ ID NO: 343798 - DNA, 25 bp, Mus musculus
gtgtaggcagtctcatcaagcaatc

SEQ ID NO: 343799 - DNA, 25 bp, Mus musculus
gtgtaggccaggttgactcttcacc

SEQ ID NO: 343800 - DNA, 25 bp, Mus musculus
gtgtaggcggatcaaccccccttaa

SEQ ID NO: 343801 - DNA, 25 bp, Mus musculus
gtgtaggcggatcaagatcagtata

SEQ ID NO: 343802 - DNA, 25 bp, Mus musculus
gtgtaggggtaaagatctaagctgg

SEQ ID NO: 343803 - DNA, 25 bp, Mus musculus
gtgtagtcgcagaactgcactggcg

SEQ ID NO: 343804 - DNA, 25 bp, Mus musculus
gtgtagtgaaaagctgcagcaatac

SEQ ID NO: 343805 - DNA, 25 bp, Mus musculus
gtgtagtggatcaggcactggccca

SEQ ID NO: 343806 - DNA, 25 bp, Mus musculus
gtgtataaatgagtctgctattgat

SEQ ID NO: 343807 - DNA, 25 bp, Mus musculus
gtgtataactaagaatgtcttccaa

SEQ ID NO: 343808 - DNA, 25 bp, Mus musculus
gtgtataagactgtcatcaggaatt

SEQ ID NO: 343809 - DNA, 25 bp, Mus musculus
gtgtataatgaatttcagaaattca

SEQ ID NO: 343810 - DNA, 25 bp, Mus musculus
gtgtataatggcatttgagcactta

SEQ ID NO: 343811 - DNA, 25 bp, Mus musculus
gtgtatacagtggcccatcatggct

SEQ ID NO: 343812 - DNA, 25 bp, Mus musculus
gtgtataccaaggaggccaaattgg

SEQ ID NO: 343813 - DNA, 25 bp, Mus musculus
gtgtataccaaggagtttctatgat

SEQ ID NO: 343814 - DNA, 25 bp, Mus musculus
gtgtatagagaaaacgtgaaaaagg

SEQ ID NO: 343815 - DNA, 25 bp, Mus musculus
gtgtatatctacaggtctgacaaga

SEQ ID NO: 343816 - DNA, 25 bp, Mus musculus
gtgtatatggacatctggattatgc

SEQ ID NO: 343817 - DNA, 25 bp, Mus musculus
gtgtatcagaggacctcagaataca

SEQ ID NO: 343818 - DNA, 25 bp, Mus musculus
gtgtatccaggctttaagcactgga

SEQ ID NO: 343819 - DNA, 25 bp, Mus musculus
gtgtatccagggaccaccacaccaa

SEQ ID NO: 343820 - DNA, 25 bp, Mus musculus
gtgtatccagggataatcttgggga

SEQ ID NO: 343821 - DNA, 25 bp, Mus musculus
gtgtatctcaacagcaagctgccta

SEQ ID NO: 343822 - DNA, 25 bp, Mus musculus
gtgtatgaaatcagccacaccttca

SEQ ID NO: 343823 - DNA, 25 bp, Mus musculus
gtgtatgacatccagtcaccagatt

SEQ ID NO: 343824 - DNA, 25 bp, Mus musculus
gtgtatgaggcagccatctccattc

SEQ ID NO: 343825 - DNA, 25 bp, Mus musculus
gtgtatgaggcagggctcattttca

SEQ ID NO: 343826 - DNA, 25 bp, Mus musculus
gtgtatgccacatgagtctttcaat

SEQ ID NO: 343827 - DNA, 25 bp, Mus musculus
gtgtatggcgagatagaccatgcct

SEQ ID NO: 343828 - DNA, 25 bp, Mus musculus
gtgtatggcgagattttcagtttag

SEQ ID NO: 343829 - DNA, 25 bp, Mus musculus
gtgtatggtctcgagatgaagatat

SEQ ID NO: 343830 - DNA, 25 bp, Mus musculus
gtgtatggtctcgagcagcagtgaa

SEQ ID NO: 343831 - DNA, 25 bp, Mus musculus
gtgtatgtcttggtggtcactaact

SEQ ID NO: 343832 - DNA, 25 bp, Mus musculus
gtgtattaagaggagtgtctccaat

SEQ ID NO: 343833 - DNA, 25 bp, Mus musculus
gtgtattaagagttccgaggtgata

SEQ ID NO: 343834 - DNA, 25 bp, Mus musculus
gtgtattaattagaggaggttcgcc

SEQ ID NO: 343835 - DNA, 25 bp, Mus musculus
gtgtattcaaagaacttagtagtca

SEQ ID NO: 343836 - DNA, 25 bp, Mus musculus
gtgtattcagggggagatgactgcc

SEQ ID NO: 343837 - DNA, 25 bp, Mus musculus
gtgtattcccaggacccacattgtg

SEQ ID NO: 343838 - DNA, 25 bp, Mus musculus
gtgtattttggggtgagcgtggaca

SEQ ID NO: 343839 - DNA, 25 bp, Mus musculus
gtgtcaaaagcctatgtccccacag

SEQ ID NO: 343840 - DNA, 25 bp, Mus musculus
gtgtcaaaagggaagatggaagact

SEQ ID NO: 343841 - DNA, 25 bp, Mus musculus
gtgtcaaatatggacctgggtcgct

SEQ ID NO: 343842 - DNA, 25 bp, Mus musculus
gtgtcaaatatggccaccaggcctt

SEQ ID NO: 343843 - DNA, 25 bp, Mus musculus
gtgtcaaccaggaacctggctcacc

SEQ ID NO: 343844 - DNA, 25 bp, Mus musculus
gtgtcaaccagtgctcagagttctg

SEQ ID NO: 343845 - DNA, 25 bp, Mus musculus
gtgtcaaccatcttgctctacaaat

SEQ ID NO: 343846 - DNA, 25 bp, Mus musculus
gtgtcaacctgtcaggtgactcaag

SEQ ID NO: 343847 - DNA, 25 bp, Mus musculus
gtgtcaacctgtcaggtgactccaa

SEQ ID NO: 343848 - DNA, 25 bp, Mus musculus
gtgtcaacgaggaaatgttgtcctt

SEQ ID NO: 343849 - DNA, 25 bp, Mus musculus
gtgtcaacgaggtccccggacctcc

SEQ ID NO: 343850 - DNA, 25 bp, Mus musculus
gtgtcaagtttcagcctcttagcaa

SEQ ID NO: 343851 - DNA, 25 bp, Mus musculus
gtgtcaagtttcaggacacacagga

SEQ ID NO: 343852 - DNA, 25 bp, Mus musculus
gtgtcaatcaatggtgtcccagatg

SEQ ID NO: 343853 - DNA, 25 bp, Mus musculus
gtgtcaatccctgatactgtagaag

SEQ ID NO: 343854 - DNA, 25 bp, Mus musculus
gtgtcacaagaaagaagagccaagt

SEQ ID NO: 343855 - DNA, 25 bp, Mus musculus
gtgtcacaagatggagcaggaaatg

SEQ ID NO: 343856 - DNA, 25 bp, Mus musculus
gtgtcacacagatccagctgagctc

SEQ ID NO: 343857 - DNA, 25 bp, Mus musculus
gtgtcacacagatttttggagacag

SEQ ID NO: 343858 - DNA, 25 bp, Mus musculus
gtgtcacacgtgtggggctgccttc

SEQ ID NO: 343859 - DNA, 25 bp, Mus musculus
gtgtcacagcacggtctctctgctc

SEQ ID NO: 343860 - DNA, 25 bp, Mus musculus
gtgtcacagtgtggttgatgacatt

SEQ ID NO: 343861 - DNA, 25 bp, Mus musculus
gtgtcaccacaggccgacccgtgga

SEQ ID NO: 343862 - DNA, 25 bp, Mus musculus
gtgtcaccacccagaaggaatacac

SEQ ID NO: 343863 - DNA, 25 bp, Mus musculus
gtgtcaccacccaggcctcccaaga

SEQ ID NO: 343864 - DNA, 25 bp, Mus musculus
gtgtcacccaaggtccagtttgatg

SEQ ID NO: 343865 - DNA, 25 bp, Mus musculus
gtgtcacccattctaacggcaagtc

SEQ ID NO: 343866 - DNA, 25 bp, Mus musculus
gtgtcaccccggtccctccgagcca

SEQ ID NO: 343867 - DNA, 25 bp, Mus musculus
gtgtcacccgcggttcctgagactg

SEQ ID NO: 343868 - DNA, 25 bp, Mus musculus
gtgtcacgacgaggaacaaggatga

SEQ ID NO: 343869 - DNA, 25 bp, Mus musculus
gtgtcacgctacggaatgaagctac

SEQ ID NO: 343870 - DNA, 25 bp, Mus musculus
gtgtcacgcttctataaacctgact

SEQ ID NO: 343871 - DNA, 25 bp, Mus musculus
gtgtcacgcttctattaaaccggga

SEQ ID NO: 343872 - DNA, 25 bp, Mus musculus
gtgtcacgggggctggcacaggtga

SEQ ID NO: 343873 - DNA, 25 bp, Mus musculus
gtgtcactaacaaggataagaagca

SEQ ID NO: 343874 - DNA, 25 bp, Mus musculus
gtgtcactctgggagttagcgacgc

SEQ ID NO: 343875 - DNA, 25 bp, Mus musculus
gtgtcactgcaagagcggccccggt

SEQ ID NO: 343876 - DNA, 25 bp, Mus musculus
gtgtcactggtttgtacagtgtcta

SEQ ID NO: 343877 - DNA, 25 bp, Mus musculus
gtgtcactttcggctggggaactga

SEQ ID NO: 343878 - DNA, 25 bp, Mus musculus
gtgtcagaaaatgagcttggtgttg

SEQ ID NO: 343879 - DNA, 25 bp, Mus musculus
gtgtcagaactgcagttggagctgc

SEQ ID NO: 343880 - DNA, 25 bp, Mus musculus
gtgtcagaagcacggtactacaaga

SEQ ID NO: 343881 - DNA, 25 bp, Mus musculus
gtgtcagaattggggaccctctgac

SEQ ID NO: 343882 - DNA, 25 bp, Mus musculus
gtgtcagagaaggaagcagcggtgg

SEQ ID NO: 343883 - DNA, 25 bp, Mus musculus
gtgtcagagaaggtctcccatgttc

SEQ ID NO: 343884 - DNA, 25 bp, Mus musculus
gtgtcagagaagtatccctgggagg

SEQ ID NO: 343885 - DNA, 25 bp, Mus musculus
gtgtcagagccagttgtcactcagc

SEQ ID NO: 343886 - DNA, 25 bp, Mus musculus
gtgtcagatcgaaccttgttcagca

SEQ ID NO: 343887 - DNA, 25 bp, Mus musculus
gtgtcagcaggggtggatctggctt

SEQ ID NO: 343888 - DNA, 25 bp, Mus musculus
gtgtcagcatgagagctggattgtc

SEQ ID NO: 343889 - DNA, 25 bp, Mus musculus
gtgtcagcatgagaggaaccatttg

SEQ ID NO: 343890 - DNA, 25 bp, Mus musculus
gtgtcagccagggcggagctacacg

SEQ ID NO: 343891 - DNA, 25 bp, Mus musculus
gtgtcagcgggaacagcagtggtga

SEQ ID NO: 343892 - DNA, 25 bp, Mus musculus
gtgtcagctacgcaggaagggccca

SEQ ID NO: 343893 - DNA, 25 bp, Mus musculus
gtgtcagctacgccgatcgggtcag

SEQ ID NO: 343894 - DNA, 25 bp, Mus musculus
gtgtcagctgcccagcctggtgagg

SEQ ID NO: 343895 - DNA, 25 bp, Mus musculus
gtgtcagctgtatccttcaggagcc

SEQ ID NO: 343896 - DNA, 25 bp, Mus musculus
gtgtcaggagcagattgccagggca

SEQ ID NO: 343897 - DNA, 25 bp, Mus musculus
gtgtcaggatatgacataatgaaat

SEQ ID NO: 343898 - DNA, 25 bp, Mus musculus
gtgtcagtatgtggtccagtgtgag

SEQ ID NO: 343899 - DNA, 25 bp, Mus musculus
gtgtcagtgggttatttcgctgcag

SEQ ID NO: 343900 - DNA, 25 bp, Mus musculus
gtgtcatcaaggtctttccggactt

SEQ ID NO: 343901 - DNA, 25 bp, Mus musculus
gtgtcatccacagaatcctagactt

SEQ ID NO: 343902 - DNA, 25 bp, Mus musculus
gtgtcatccacagagacttgaagcc

SEQ ID NO: 343903 - DNA, 25 bp, Mus musculus
gtgtcatcgtcatacgtccctggag

SEQ ID NO: 343904 - DNA, 25 bp, Mus musculus
gtgtcattaactacgtggaaaaggc

SEQ ID NO: 343905 - DNA, 25 bp, Mus musculus
gtgtcattaagcccacaaggcccga

SEQ ID NO: 343906 - DNA, 25 bp, Mus musculus
gtgtcattcagaaggcctctctctt

SEQ ID NO: 343907 - DNA, 25 bp, Mus musculus
gtgtcattgtggctgatcagactcc

SEQ ID NO: 343908 - DNA, 25 bp, Mus musculus
gtgtcatttacacaatgtactttcc

SEQ ID NO: 343909 - DNA, 25 bp, Mus musculus
gtgtcatttacacgggttatgcaac

SEQ ID NO: 343910 - DNA, 25 bp, Mus musculus
gtgtcattttcagaatggtcgatgt

SEQ ID NO: 343911 - DNA, 25 bp, Mus musculus
gtgtcatttttagctccgcctgctc

SEQ ID NO: 343912 - DNA, 25 bp, Mus musculus
gtgtcatttttaggatttggtgtca

SEQ ID NO: 343913 - DNA, 25 bp, Mus musculus
gtgtccacaagatatgtgagataga

SEQ ID NO: 343914 - DNA, 25 bp, Mus musculus
gtgtccacagtcgagagctaagatg

SEQ ID NO: 343915 - DNA, 25 bp, Mus musculus
gtgtccaccagggtttgacctgcca

SEQ ID NO: 343916 - DNA, 25 bp, Mus musculus
gtgtccagactcggggccctgttct

SEQ ID NO: 343917 - DNA, 25 bp, Mus musculus
gtgtccagagagttgtgtggccatc

SEQ ID NO: 343918 - DNA, 25 bp, Mus musculus
gtgtccagcacagaatcgtccttgg

SEQ ID NO: 343919 - DNA, 25 bp, Mus musculus
gtgtccagcacagccagccatatgg

SEQ ID NO: 343920 - DNA, 25 bp, Mus musculus
gtgtccagcacagggacctgaggtg

SEQ ID NO: 343921 - DNA, 25 bp, Mus musculus
gtgtccagcagtagggagtgccgcg

SEQ ID NO: 343922 - DNA, 25 bp, Mus musculus
gtgtccagcagtaggggaacaaaga

SEQ ID NO: 343923 - DNA, 25 bp, Mus musculus
gtgtccatgagatggattctgacgt

SEQ ID NO: 343924 - DNA, 25 bp, Mus musculus
gtgtccatgaggttttggggcgaga

SEQ ID NO: 343925 - DNA, 25 bp, Mus musculus
gtgtccatgtgccagggaaaccgtg

SEQ ID NO: 343926 - DNA, 25 bp, Mus musculus
gtgtccatttcgacttctctaccca

SEQ ID NO: 343927 - DNA, 25 bp, Mus musculus
gtgtcccaagagggtgtattacctc

SEQ ID NO: 343928 - DNA, 25 bp, Mus musculus
gtgtcccaatccgggctgtggaaac

SEQ ID NO: 343929 - DNA, 25 bp, Mus musculus
gtgtccccagaaccaaggagagcat

SEQ ID NO: 343930 - DNA, 25 bp, Mus musculus
gtgtcccggggcggcctcttgggag

SEQ ID NO: 343931 - DNA, 25 bp, Mus musculus
gtgtcccggggcggtgatgtggccg

SEQ ID NO: 343932 - DNA, 25 bp, Mus musculus
gtgtccctcagctgcttccggttgt

SEQ ID NO: 343933 - DNA, 25 bp, Mus musculus
gtgtccctcaggtggccccttctgc

SEQ ID NO: 343934 - DNA, 25 bp, Mus musculus
gtgtccctcagtcgagccccgttga

SEQ ID NO: 343935 - DNA, 25 bp, Mus musculus
gtgtccctgtaacaagcttaaatcc

SEQ ID NO: 343936 - DNA, 25 bp, Mus musculus
gtgtccctgtctgtggccaggaggg

SEQ ID NO: 343937 - DNA, 25 bp, Mus musculus
gtgtccgagccaggacgagggatct

SEQ ID NO: 343938 - DNA, 25 bp, Mus musculus
gtgtccgcagagacgagaacagagc

SEQ ID NO: 343939 - DNA, 25 bp, Mus musculus
gtgtccgcagagacgagctgacatc

SEQ ID NO: 343940 - DNA, 25 bp, Mus musculus
gtgtccgcctcacaggaacaaaaag

SEQ ID NO: 343941 - DNA, 25 bp, Mus musculus
gtgtccggctctggttggtcatgct

SEQ ID NO: 343942 - DNA, 25 bp, Mus musculus
gtgtccgtaaacttgggtgctggaa

SEQ ID NO: 343943 - DNA, 25 bp, Mus musculus
gtgtccgtaaagaagaacacaacaa

SEQ ID NO: 343944 - DNA, 25 bp, Mus musculus
gtgtcctaacgagaatgtcataccc

SEQ ID NO: 343945 - DNA, 25 bp, Mus musculus
gtgtcctagcagattgtccttctga

SEQ ID NO: 343946 - DNA, 25 bp, Mus musculus
gtgtcctatgactggccactgactc

SEQ ID NO: 343947 - DNA, 25 bp, Mus musculus
gtgtcctatgactggctgatccttc

SEQ ID NO: 343948 - DNA, 25 bp, Mus musculus
gtgtcctcagagtctcccattagaa

SEQ ID NO: 343949 - DNA, 25 bp, Mus musculus
gtgtcctcaggtggcagtttatgtc

SEQ ID NO: 343950 - DNA, 25 bp, Mus musculus
gtgtcctcccaaagggtatgtgtat

SEQ ID NO: 343951 - DNA, 25 bp, Mus musculus
gtgtcctcgagagacccagccattc

SEQ ID NO: 343952 - DNA, 25 bp, Mus musculus
gtgtcctcgagttttactacagaga

SEQ ID NO: 343953 - DNA, 25 bp, Mus musculus
gtgtcctctgatgctgaggaatacc

SEQ ID NO: 343954 - DNA, 25 bp, Mus musculus
gtgtcctctgcctgttccagttgat

SEQ ID NO: 343955 - DNA, 25 bp, Mus musculus
gtgtcctcttctagttctttgtatg

SEQ ID NO: 343956 - DNA, 25 bp, Mus musculus
gtgtcctgaacttggatcctttctc

SEQ ID NO: 343957 - DNA, 25 bp, Mus musculus
gtgtcctgaggatctttccaacctc

SEQ ID NO: 343958 - DNA, 25 bp, Mus musculus
gtgtcctgagtatcccaggcgcggt

SEQ ID NO: 343959 - DNA, 25 bp, Mus musculus
gtgtcctgctaaggctagagcgcag

SEQ ID NO: 343960 - DNA, 25 bp, Mus musculus
gtgtcctgctaagtgttcttgagtg

SEQ ID NO: 343961 - DNA, 25 bp, Mus musculus
gtgtcctgctcaggtgactcagaag

SEQ ID NO: 343962 - DNA, 25 bp, Mus musculus
gtgtcctgctgaggcgagtaacaag

SEQ ID NO: 343963 - DNA, 25 bp, Mus musculus
gtgtcctgcttagtcttgctgtttc

SEQ ID NO: 343964 - DNA, 25 bp, Mus musculus
gtgtcctgcttttttcacttccctt

SEQ ID NO: 343965 - DNA, 25 bp, Mus musculus
gtgtcctggaaggtggtttgctctc

SEQ ID NO: 343966 - DNA, 25 bp, Mus musculus
gtgtcctggagcagacaggattatg

SEQ ID NO: 343967 - DNA, 25 bp, Mus musculus
gtgtcctggcagcccaaacgatgag

SEQ ID NO: 343968 - DNA, 25 bp, Mus musculus
gtgtcctgtgaagacatcaacgaat

SEQ ID NO: 343969 - DNA, 25 bp, Mus musculus
gtgtcctgtgaagacatcaatgagt

SEQ ID NO: 343970 - DNA, 25 bp, Mus musculus
gtgtcctgtgaagaccaagacgagt

SEQ ID NO: 343971 - DNA, 25 bp, Mus musculus
gtgtccttcactctagcccatccag

SEQ ID NO: 343972 - DNA, 25 bp, Mus musculus
gtgtccttgaggcccatctgaacag

SEQ ID NO: 343973 - DNA, 25 bp, Mus musculus
gtgtcctttgtatcagtcctggaaa

SEQ ID NO: 343974 - DNA, 25 bp, Mus musculus
gtgtcctttgtatctgtcctggaaa

SEQ ID NO: 343975 - DNA, 25 bp, Mus musculus
gtgtcgaaggagacgaagagatgag

SEQ ID NO: 343976 - DNA, 25 bp, Mus musculus
gtgtcgatgggggccgttgactact

SEQ ID NO: 343977 - DNA, 25 bp, Mus musculus
gtgtcgcacgagagctgcctgtagc

SEQ ID NO: 343978 - DNA, 25 bp, Mus musculus
gtgtcgcacgaggtggactcacatt

SEQ ID NO: 343979 - DNA, 25 bp, Mus musculus
gtgtcgcaggcaaaggttcagaact

SEQ ID NO: 343980 - DNA, 25 bp, Mus musculus
gtgtcgccaggtcagccatgtcatc

SEQ ID NO: 343981 - DNA, 25 bp, Mus musculus
gtgtcgccagtgtggaaggggagta

SEQ ID NO: 343982 - DNA, 25 bp, Mus musculus
gtgtcgccgccacagagttctgtcc

SEQ ID NO: 343983 - DNA, 25 bp, Mus musculus
gtgtcgctcctgggaccatttactc

SEQ ID NO: 343984 - DNA, 25 bp, Mus musculus
gtgtcgctcgagttcctgaggatca

SEQ ID NO: 343985 - DNA, 25 bp, Mus musculus
gtgtcgctcgggtatcaagtctcca

SEQ ID NO: 343986 - DNA, 25 bp, Mus musculus
gtgtcgctgctcggtgtcgcaacat

SEQ ID NO: 343987 - DNA, 25 bp, Mus musculus
gtgtcgcttgtagaaatgccaaagc

SEQ ID NO: 343988 - DNA, 25 bp, Mus musculus
gtgtcgcttgtaggaatgccaaagc

SEQ ID NO: 343989 - DNA, 25 bp, Mus musculus
gtgtcggaagtgatgggaccagtgg

SEQ ID NO: 343990 - DNA, 25 bp, Mus musculus
gtgtcggatcagctgcctgctgtct

SEQ ID NO: 343991 - DNA, 25 bp, Mus musculus
gtgtcggcggaacaggtaattgctg

SEQ ID NO: 343992 - DNA, 25 bp, Mus musculus
gtgtcgtggaagggttttatggaag

SEQ ID NO: 343993 - DNA, 25 bp, Mus musculus
gtgtctaaagggcttctctgcctag

SEQ ID NO: 343994 - DNA, 25 bp, Mus musculus
gtgtctaaaggtaaaacagactagc

SEQ ID NO: 343995 - DNA, 25 bp, Mus musculus
gtgtctaagattctccttccacgac

SEQ ID NO: 343996 - DNA, 25 bp, Mus musculus
gtgtctacctgatgccgaatgatca

SEQ ID NO: 343997 - DNA, 25 bp, Mus musculus
gtgtctacctgatgcctggcctggt

SEQ ID NO: 343998 - DNA, 25 bp, Mus musculus
gtgtctacctgatgcgcctggagct

SEQ ID NO: 343999 - DNA, 25 bp, Mus musculus
gtgtctatcggccgctcaccccagg

SEQ ID NO: 344000 - DNA, 25 bp, Mus musculus
gtgtctcagaagcttttccaaggct

SEQ ID NO: 344001 - DNA, 25 bp, Mus musculus
gtgtctcagaaggttttccaaggct

SEQ ID NO: 344002 - DNA, 25 bp, Mus musculus
gtgtctcattctctgcatcgggttc

SEQ ID NO: 344003 - DNA, 25 bp, Mus musculus
gtgtctccagacatggagacaacag

SEQ ID NO: 344004 - DNA, 25 bp, Mus musculus
gtgtctcccaggctttgaagggcca

SEQ ID NO: 344005 - DNA, 25 bp, Mus musculus
gtgtctcgcatgaaggagatcttgg

SEQ ID NO: 344006 - DNA, 25 bp, Mus musculus
gtgtctcggctttccagtctgttct

SEQ ID NO: 344007 - DNA, 25 bp, Mus musculus
gtgtctctgtccttgtcttatctcc

SEQ ID NO: 344008 - DNA, 25 bp, Mus musculus
gtgtctctgtccttttgcctttatc

SEQ ID NO: 344009 - DNA, 25 bp, Mus musculus
gtgtctgaaaaggctcccccaccga

SEQ ID NO: 344010 - DNA, 25 bp, Mus musculus
gtgtctgaaatgacacggagagcca

SEQ ID NO: 344011 - DNA, 25 bp, Mus musculus
gtgtctgaagaggaggtgctgggcc

SEQ ID NO: 344012 - DNA, 25 bp, Mus musculus
gtgtctgaccagcatgcccgctgcc

SEQ ID NO: 344013 - DNA, 25 bp, Mus musculus
gtgtctgacgcactgtatcactttc

SEQ ID NO: 344014 - DNA, 25 bp, Mus musculus
gtgtctgacggtgctgggaggatct

SEQ ID NO: 344015 - DNA, 25 bp, Mus musculus
gtgtctgaggcgcggcccagcacta

SEQ ID NO: 344016 - DNA, 25 bp, Mus musculus
gtgtctgatttaaacgtcatccact

SEQ ID NO: 344017 - DNA, 25 bp, Mus musculus
gtgtctgatttaaaggtcatccact

SEQ ID NO: 344018 - DNA, 25 bp, Mus musculus
gtgtctgcaggtatatccgaatagt

SEQ ID NO: 344019 - DNA, 25 bp, Mus musculus
gtgtctgccagaatggggaggtaga

SEQ ID NO: 344020 - DNA, 25 bp, Mus musculus
gtgtctgccagatctgtggccagct

SEQ ID NO: 344021 - DNA, 25 bp, Mus musculus
gtgtctgccattgcaggatctgtgg

SEQ ID NO: 344022 - DNA, 25 bp, Mus musculus
gtgtctgccgtgcgtctcttcctgc

SEQ ID NO: 344023 - DNA, 25 bp, Mus musculus
gtgtctgccgtgtgtctgcccatcg

SEQ ID NO: 344024 - DNA, 25 bp, Mus musculus
gtgtctgctttcaagaaaggcgaca

SEQ ID NO: 344025 - DNA, 25 bp, Mus musculus
gtgtctggaaagagaaaacatcgct

SEQ ID NO: 344026 - DNA, 25 bp, Mus musculus
gtgtctggaatcccaggccaactac

SEQ ID NO: 344027 - DNA, 25 bp, Mus musculus
gtgtctggagataacaatcgaaaga

SEQ ID NO: 344028 - DNA, 25 bp, Mus musculus
gtgtctggaggaggtaaatgaaaaa

SEQ ID NO: 344029 - DNA, 25 bp, Mus musculus
gtgtctggatgccagccactgctgt

SEQ ID NO: 344030 - DNA, 25 bp, Mus musculus
gtgtctgggaaagagtgtgaggaga

SEQ ID NO: 344031 - DNA, 25 bp, Mus musculus
gtgtctgtatcacagctgcctcata

SEQ ID NO: 344032 - DNA, 25 bp, Mus musculus
gtgtctgtctatgaaaatgacactg

SEQ ID NO: 344033 - DNA, 25 bp, Mus musculus
gtgtctgtctatggtatcatcagag

SEQ ID NO: 344034 - DNA, 25 bp, Mus musculus
gtgtctgtctggctggaaatgtttc

SEQ ID NO: 344035 - DNA, 25 bp, Mus musculus
gtgtctgtctgggagatgctatttc

SEQ ID NO: 344036 - DNA, 25 bp, Mus musculus
gtgtctgtgaggagttcaaggatgt

SEQ ID NO: 344037 - DNA, 25 bp, Mus musculus
gtgtctgtggggacctctgagctgc

SEQ ID NO: 344038 - DNA, 25 bp, Mus musculus
gtgtctgtgtggaggtacattcgct

SEQ ID NO: 344039 - DNA, 25 bp, Mus musculus
gtgtcttatttaagacttcattgaa

SEQ ID NO: 344040 - DNA, 25 bp, Mus musculus
gtgtcttcagcctcagctttatgag

SEQ ID NO: 344041 - DNA, 25 bp, Mus musculus
gtgtcttcagtaaatgaagcatttg

SEQ ID NO: 344042 - DNA, 25 bp, Mus musculus
gtgtcttcattaggtgctgacctct

SEQ ID NO: 344043 - DNA, 25 bp, Mus musculus
gtgtcttcctatcagagagtgactc

SEQ ID NO: 344044 - DNA, 25 bp, Mus musculus
gtgtcttcctatcagggctcagttc

SEQ ID NO: 344045 - DNA, 25 bp, Mus musculus
gtgtcttctcgcatgcacgcctacc

SEQ ID NO: 344046 - DNA, 25 bp, Mus musculus
gtgtcttcttatctctgttgaactc

SEQ ID NO: 344047 - DNA, 25 bp, Mus musculus
gtgtcttcttatctgtgttgaactc

SEQ ID NO: 344048 - DNA, 25 bp, Mus musculus
gtgtctttacagttgctagacctga

SEQ ID NO: 344049 - DNA, 25 bp, Mus musculus
gtgtctttatctgcatcccctgtga

SEQ ID NO: 344050 - DNA, 25 bp, Mus musculus
gtgtctttgcgggcgtgctggtcac

SEQ ID NO: 344051 - DNA, 25 bp, Mus musculus
gtgtctttgcgggtgcctggctgag

SEQ ID NO: 344052 - DNA, 25 bp, Mus musculus
gtgtcttttctatagatgcccaaca

SEQ ID NO: 344053 - DNA, 25 bp, Mus musculus
gtgtgaaaaagctggaggcaagaaa

SEQ ID NO: 344054 - DNA, 25 bp, Mus musculus
gtgtgaaaaccttgtcactagatgc

SEQ ID NO: 344055 - DNA, 25 bp, Mus musculus
gtgtgaaagatcagtttggctttat

SEQ ID NO: 344056 - DNA, 25 bp, Mus musculus
gtgtgaacaccccgggcttgcccag

SEQ ID NO: 344057 - DNA, 25 bp, Mus musculus
gtgtgaacagaggcagaaactttgt

SEQ ID NO: 344058 - DNA, 25 bp, Mus musculus
gtgtgaacaggttccacccgactcc

SEQ ID NO: 344059 - DNA, 25 bp, Mus musculus
gtgtgaacccaagagacttctctac

SEQ ID NO: 344060 - DNA, 25 bp, Mus musculus
gtgtgaactccagggaggttagaag

SEQ ID NO: 344061 - DNA, 25 bp, Mus musculus
gtgtgaagaatgtggcttcccagac

SEQ ID NO: 344062 - DNA, 25 bp, Mus musculus
gtgtgaagacgtgagcaagatgggg

SEQ ID NO: 344063 - DNA, 25 bp, Mus musculus
gtgtgaagacgtggaggcatccagg

SEQ ID NO: 344064 - DNA, 25 bp, Mus musculus
gtgtgaagagatccaggcttacaat

SEQ ID NO: 344065 - DNA, 25 bp, Mus musculus
gtgtgaagatctgctttcccaggct

SEQ ID NO: 344066 - DNA, 25 bp, Mus musculus
gtgtgaaggatggcgaaacctgacc

SEQ ID NO: 344067 - DNA, 25 bp, Mus musculus
gtgtgaagtacctggttaactttgt

SEQ ID NO: 344068 - DNA, 25 bp, Mus musculus
gtgtgacaaggtggtacaggatcta

SEQ ID NO: 344069 - DNA, 25 bp, Mus musculus
gtgtgacaccaacgacctgcagcaa

SEQ ID NO: 344070 - DNA, 25 bp, Mus musculus
gtgtgacaccattcattgatgcagt

SEQ ID NO: 344071 - DNA, 25 bp, Mus musculus
gtgtgacagacaagatttgaaagaa

SEQ ID NO: 344072 - DNA, 25 bp, Mus musculus
gtgtgacatctacagctataaccca

SEQ ID NO: 344073 - DNA, 25 bp, Mus musculus
gtgtgaccatcacagggtttgtgga

SEQ ID NO: 344074 - DNA, 25 bp, Mus musculus
gtgtgaccatcacaggtctattctg

SEQ ID NO: 344075 - DNA, 25 bp, Mus musculus
gtgtgacctcaggggagctgctgca

SEQ ID NO: 344076 - DNA, 25 bp, Mus musculus
gtgtgaccttgggctggcatcccca

SEQ ID NO: 344077 - DNA, 25 bp, Mus musculus
gtgtgaccttggggaaagatggagc

SEQ ID NO: 344078 - DNA, 25 bp, Mus musculus
gtgtgaccttgggtgctggcctcgc

SEQ ID NO: 344079 - DNA, 25 bp, Mus musculus
gtgtgaccttggttcttccatcagt

SEQ ID NO: 344080 - DNA, 25 bp, Mus musculus
gtgtgacgaaaggtctgtcacctaa

SEQ ID NO: 344081 - DNA, 25 bp, Mus musculus
gtgtgacgacaagatttgaaagaag

SEQ ID NO: 344082 - DNA, 25 bp, Mus musculus
gtgtgacgggaagcttatcaagtac

SEQ ID NO: 344083 - DNA, 25 bp, Mus musculus
gtgtgacgggaaggtgtgtgagtct

SEQ ID NO: 344084 - DNA, 25 bp, Mus musculus
gtgtgactgagttggccgccccatc

SEQ ID NO: 344085 - DNA, 25 bp, Mus musculus
gtgtgacttagcccaggagttaaag

SEQ ID NO: 344086 - DNA, 25 bp, Mus musculus
gtgtgacttagctcaaagattagaa

SEQ ID NO: 344087 - DNA, 25 bp, Mus musculus
gtgtgacttaggtaggtgagcctgt

SEQ ID NO: 344088 - DNA, 25 bp, Mus musculus
gtgtgacttgagaacacaagagagc

SEQ ID NO: 344089 - DNA, 25 bp, Mus musculus
gtgtgacttgagaagctgaatcact

SEQ ID NO: 344090 - DNA, 25 bp, Mus musculus
gtgtgagagaaaccttataagtgta

SEQ ID NO: 344091 - DNA, 25 bp, Mus musculus
gtgtgagagtatgcagtccttcagc

SEQ ID NO: 344092 - DNA, 25 bp, Mus musculus
gtgtgagagttgacggcgtccaaca

SEQ ID NO: 344093 - DNA, 25 bp, Mus musculus
gtgtgagagttgagtcctacctgct

SEQ ID NO: 344094 - DNA, 25 bp, Mus musculus
gtgtgagcaaagaagatagaggaga

SEQ ID NO: 344095 - DNA, 25 bp, Mus musculus
gtgtgagcaacttggcatcagcatg

SEQ ID NO: 344096 - DNA, 25 bp, Mus musculus
gtgtgagccagagaagccatcctgg

SEQ ID NO: 344097 - DNA, 25 bp, Mus musculus
gtgtgagccaggtacattctttgtg

SEQ ID NO: 344098 - DNA, 25 bp, Mus musculus
gtgtgagcctatccgcctccgactc

SEQ ID NO: 344099 - DNA, 25 bp, Mus musculus
gtgtgaggacaagagtgtggaaaat

SEQ ID NO: 344100 - DNA, 25 bp, Mus musculus
gtgtgaggtacaggtgtcggctctg

SEQ ID NO: 344101 - DNA, 25 bp, Mus musculus
gtgtgagtgagaaaggagacatgga

SEQ ID NO: 344102 - DNA, 25 bp, Mus musculus
gtgtgagtgagaaaggggacagtca

SEQ ID NO: 344103 - DNA, 25 bp, Mus musculus
gtgtgagttgtcaggtaaagatgag

SEQ ID NO: 344104 - DNA, 25 bp, Mus musculus
gtgtgataaagttggagtcattcga

SEQ ID NO: 344105 - DNA, 25 bp, Mus musculus
gtgtgatcagcagctcgtgcctcct

SEQ ID NO: 344106 - DNA, 25 bp, Mus musculus
gtgtgatcaggagttcctctgtgac

SEQ ID NO: 344107 - DNA, 25 bp, Mus musculus
gtgtgatcatcagccacttccacct

SEQ ID NO: 344108 - DNA, 25 bp, Mus musculus
gtgtgatcatcaggccatctgcccc

SEQ ID NO: 344109 - DNA, 25 bp, Mus musculus
gtgtgatccagtgaggcctcaggtc

SEQ ID NO: 344110 - DNA, 25 bp, Mus musculus
gtgtgatgaccaaggaggagcccct

SEQ ID NO: 344111 - DNA, 25 bp, Mus musculus
gtgtgatgcgggtgcctggctacgg

SEQ ID NO: 344112 - DNA, 25 bp, Mus musculus
gtgtgatggggccaaactgagcctt

SEQ ID NO: 344113 - DNA, 25 bp, Mus musculus
gtgtgatggtcaggaagcctgctgc

SEQ ID NO: 344114 - DNA, 25 bp, Mus musculus
gtgtgattactggataagaaaactt

SEQ ID NO: 344115 - DNA, 25 bp, Mus musculus
gtgtgattgggagaaaccactggta

SEQ ID NO: 344116 - DNA, 25 bp, Mus musculus
gtgtgattggtgcaggagaatttgg

SEQ ID NO: 344117 - DNA, 25 bp, Mus musculus
gtgtgcaaagctgtgccaccgcatg

SEQ ID NO: 344118 - DNA, 25 bp, Mus musculus
gtgtgcaaatgacccaggatgtaca

SEQ ID NO: 344119 - DNA, 25 bp, Mus musculus
gtgtgcaagaaactggtcttttgtg

SEQ ID NO: 344120 - DNA, 25 bp, Mus musculus
gtgtgcaaggcctcgaaccgccgtc

SEQ ID NO: 344121 - DNA, 25 bp, Mus musculus
gtgtgcaaggcctcgtcattgtgac

SEQ ID NO: 344122 - DNA, 25 bp, Mus musculus
gtgtgcaatggcaggtgctgacctg

SEQ ID NO: 344123 - DNA, 25 bp, Mus musculus
gtgtgcacatcctccggactctaat

SEQ ID NO: 344124 - DNA, 25 bp, Mus musculus
gtgtgcaccaggagcacctgagcct

SEQ ID NO: 344125 - DNA, 25 bp, Mus musculus
gtgtgcactggagatggcagtgctg

SEQ ID NO: 344126 - DNA, 25 bp, Mus musculus
gtgtgcagaaagagctcagggactg

SEQ ID NO: 344127 - DNA, 25 bp, Mus musculus
gtgtgcagaaggagctcaggggctg

SEQ ID NO: 344128 - DNA, 25 bp, Mus musculus
gtgtgcagaatgtctcacagatctt

SEQ ID NO: 344129 - DNA, 25 bp, Mus musculus
gtgtgcagcagcagttgcaacaacc

SEQ ID NO: 344130 - DNA, 25 bp, Mus musculus
gtgtgcagcggggagagttagattt

SEQ ID NO: 344131 - DNA, 25 bp, Mus musculus
gtgtgcaggggcaagctggaccccc

SEQ ID NO: 344132 - DNA, 25 bp, Mus musculus
gtgtgcatagagtgttattgtaacc

SEQ ID NO: 344133 - DNA, 25 bp, Mus musculus
gtgtgcatagctaatgtctgcgaca

SEQ ID NO: 344134 - DNA, 25 bp, Mus musculus
gtgtgcatgaaaggcctgacaagat

SEQ ID NO: 344135 - DNA, 25 bp, Mus musculus
gtgtgcattggacagattgtccttc

SEQ ID NO: 344136 - DNA, 25 bp, Mus musculus
gtgtgccaacgaggaatatcctccc

SEQ ID NO: 344137 - DNA, 25 bp, Mus musculus
gtgtgccaacgccagcttttttaaa

SEQ ID NO: 344138 - DNA, 25 bp, Mus musculus
gtgtgccaagatattgatgagtgca

SEQ ID NO: 344139 - DNA, 25 bp, Mus musculus
gtgtgccaaggcgaaagcccatggg

SEQ ID NO: 344140 - DNA, 25 bp, Mus musculus
gtgtgccaaggtttgacctgccacc

SEQ ID NO: 344141 - DNA, 25 bp, Mus musculus
gtgtgccacaaggagagaactgccc

SEQ ID NO: 344142 - DNA, 25 bp, Mus musculus
gtgtgccaccaggatccaagcctat

SEQ ID NO: 344143 - DNA, 25 bp, Mus musculus
gtgtgccacggatgaataaaaacga

SEQ ID NO: 344144 - DNA, 25 bp, Mus musculus
gtgtgccagccaggtgggcatgaca

SEQ ID NO: 344145 - DNA, 25 bp, Mus musculus
gtgtgccagctgccggactgccctc

SEQ ID NO: 344146 - DNA, 25 bp, Mus musculus
gtgtgcccgtggtatcgatgttgaa

SEQ ID NO: 344147 - DNA, 25 bp, Mus musculus
gtgtgccctgaagctcctgtatgac

SEQ ID NO: 344148 - DNA, 25 bp, Mus musculus
gtgtgccctgaaggtcagaaaccca

SEQ ID NO: 344149 - DNA, 25 bp, Mus musculus
gtgtgccgaggaggggcgtgctggt

SEQ ID NO: 344150 - DNA, 25 bp, Mus musculus
gtgtgccggcttgatgcccccaagc

SEQ ID NO: 344151 - DNA, 25 bp, Mus musculus
gtgtgcctctctgctaggtttattc

SEQ ID NO: 344152 - DNA, 25 bp, Mus musculus
gtgtgcctctgtgctaggtttattc

SEQ ID NO: 344153 - DNA, 25 bp, Mus musculus
gtgtgcctgagcggaggactggcta

SEQ ID NO: 344154 - DNA, 25 bp, Mus musculus
gtgtgcctgagcgggctagctgtgg

SEQ ID NO: 344155 - DNA, 25 bp, Mus musculus
gtgtgcctgaggagtccctgtgcca

SEQ ID NO: 344156 - DNA, 25 bp, Mus musculus
gtgtgcctgaggctgacctgtgctc

SEQ ID NO: 344157 - DNA, 25 bp, Mus musculus
gtgtgcctgtaatgaatggtatggt

SEQ ID NO: 344158 - DNA, 25 bp, Mus musculus
gtgtgcctgtgccagggtgtgaggg

SEQ ID NO: 344159 - DNA, 25 bp, Mus musculus
gtgtgcctgtgccagtgttctttcc

SEQ ID NO: 344160 - DNA, 25 bp, Mus musculus
gtgtgccttctgggcattgaagatc

SEQ ID NO: 344161 - DNA, 25 bp, Mus musculus
gtgtgcgaagatgtggatgagtgca

SEQ ID NO: 344162 - DNA, 25 bp, Mus musculus
gtgtgcgaccagatctgctgcttac

SEQ ID NO: 344163 - DNA, 25 bp, Mus musculus
gtgtgcgaccaggtgtctgcctgta

SEQ ID NO: 344164 - DNA, 25 bp, Mus musculus
gtgtgcgagcaggtagtcaataccc

SEQ ID NO: 344165 - DNA, 25 bp, Mus musculus
gtgtgcgcactcggaggccatgtca

SEQ ID NO: 344166 - DNA, 25 bp, Mus musculus
gtgtgcgcagcctggaagggcgttt

SEQ ID NO: 344167 - DNA, 25 bp, Mus musculus
gtgtgcgcagcttgcttctccagaa

SEQ ID NO: 344168 - DNA, 25 bp, Mus musculus
gtgtgcgccctgggtccaactgagc

SEQ ID NO: 344169 - DNA, 25 bp, Mus musculus
gtgtgcgcctgccccgcgagaaagg

SEQ ID NO: 344170 - DNA, 25 bp, Mus musculus
gtgtgcgctggaggtctaagccgac

SEQ ID NO: 344171 - DNA, 25 bp, Mus musculus
gtgtgcgggtgagatctgattttct

SEQ ID NO: 344172 - DNA, 25 bp, Mus musculus
gtgtgcgtgtaacagatgctccatc

SEQ ID NO: 344173 - DNA, 25 bp, Mus musculus
gtgtgcgtgtaacaggggctcctta

SEQ ID NO: 344174 - DNA, 25 bp, Mus musculus
gtgtgctaggtctcctcctgcctga

SEQ ID NO: 344175 - DNA, 25 bp, Mus musculus
gtgtgctagtggacactagactaca

SEQ ID NO: 344176 - DNA, 25 bp, Mus musculus
gtgtgctcatgcccgacatcgtgca

SEQ ID NO: 344177 - DNA, 25 bp, Mus musculus
gtgtgctcatgttcgagatgctcac

SEQ ID NO: 344178 - DNA, 25 bp, Mus musculus
gtgtgctccaacggcttcctgcttt

SEQ ID NO: 344179 - DNA, 25 bp, Mus musculus
gtgtgctccaggctggacagtatgg

SEQ ID NO: 344180 - DNA, 25 bp, Mus musculus
gtgtgctcgacaaagcatagtaaca

SEQ ID NO: 344181 - DNA, 25 bp, Mus musculus
gtgtgctcgtggcacggaggtgcca

SEQ ID NO: 344182 - DNA, 25 bp, Mus musculus
gtgtgctgaaatttcaaaaggacat

SEQ ID NO: 344183 - DNA, 25 bp, Mus musculus
gtgtgctgaagagaactgcttcatg

SEQ ID NO: 344184 - DNA, 25 bp, Mus musculus
gtgtgctgactgcctgtttctggac

SEQ ID NO: 344185 - DNA, 25 bp, Mus musculus
gtgtgctgagaagctgagttcctac

SEQ ID NO: 344186 - DNA, 25 bp, Mus musculus
gtgtgctgctcaaagaggtcctccg

SEQ ID NO: 344187 - DNA, 25 bp, Mus musculus
gtgtgctggaggacttcatcaacaa

SEQ ID NO: 344188 - DNA, 25 bp, Mus musculus
gtgtgctggcgattcacttcagcac

SEQ ID NO: 344189 - DNA, 25 bp, Mus musculus
gtgtgctgttggaggaactgtactg

SEQ ID NO: 344190 - DNA, 25 bp, Mus musculus
gtgtgcttgccagataaagtgcagg

SEQ ID NO: 344191 - DNA, 25 bp, Mus musculus
gtgtgcttggagagactgggcagtt

SEQ ID NO: 344192 - DNA, 25 bp, Mus musculus
gtgtggaaacagaccacaggatggc

SEQ ID NO: 344193 - DNA, 25 bp, Mus musculus
gtgtggaagaacccctcagcagccc

SEQ ID NO: 344194 - DNA, 25 bp, Mus musculus
gtgtggaagactatctgtctgcaat

SEQ ID NO: 344195 - DNA, 25 bp, Mus musculus
gtgtggaagagatgaaccggacaaa

SEQ ID NO: 344196 - DNA, 25 bp, Mus musculus
gtgtggaagtctggtcatctgactt

SEQ ID NO: 344197 - DNA, 25 bp, Mus musculus
gtgtggaagttctgcaactgtgtct

SEQ ID NO: 344198 - DNA, 25 bp, Mus musculus
gtgtggaattatgtctgaggaagat

SEQ ID NO: 344199 - DNA, 25 bp, Mus musculus
gtgtggacaaggaagactttctctg

SEQ ID NO: 344200 - DNA, 25 bp, Mus musculus
gtgtggacaaggaaggttctgagcc

SEQ ID NO: 344201 - DNA, 25 bp, Mus musculus
gtgtggacactcctggagccagaat

SEQ ID NO: 344202 - DNA, 25 bp, Mus musculus
gtgtggacatcaggatgtgatggtg

SEQ ID NO: 344203 - DNA, 25 bp, Mus musculus
gtgtggaccaagtttgttgcatatt

SEQ ID NO: 344204 - DNA, 25 bp, Mus musculus
gtgtggaccatcggggtacctggaa

SEQ ID NO: 344205 - DNA, 25 bp, Mus musculus
gtgtggaccctaaggagaaggagcg

SEQ ID NO: 344206 - DNA, 25 bp, Mus musculus
gtgtggaccctaagtgcagctttgt

SEQ ID NO: 344207 - DNA, 25 bp, Mus musculus
gtgtggaccctgagttccaccaggt

SEQ ID NO: 344208 - DNA, 25 bp, Mus musculus
gtgtggacgagagagactcgggaaa

SEQ ID NO: 344209 - DNA, 25 bp, Mus musculus
gtgtggagatgcaaggagagtctct

SEQ ID NO: 344210 - DNA, 25 bp, Mus musculus
gtgtggagcccacgagcacccggag

SEQ ID NO: 344211 - DNA, 25 bp, Mus musculus
gtgtggagcccacggtgacactgct

SEQ ID NO: 344212 - DNA, 25 bp, Mus musculus
gtgtggaggtccgagggtgacttca

SEQ ID NO: 344213 - DNA, 25 bp, Mus musculus
gtgtggatatctatgatagagaatt

SEQ ID NO: 344214 - DNA, 25 bp, Mus musculus
gtgtggatatgtttctgaacaaagc

SEQ ID NO: 344215 - DNA, 25 bp, Mus musculus
gtgtggatattgtgattcgtcatag

SEQ ID NO: 344216 - DNA, 25 bp, Mus musculus
gtgtggatggaggcattgcactcag

SEQ ID NO: 344217 - DNA, 25 bp, Mus musculus
gtgtggcaaggggaaactgtttgat

SEQ ID NO: 344218 - DNA, 25 bp, Mus musculus
gtgtggcaatgactggtgtccactc

SEQ ID NO: 344219 - DNA, 25 bp, Mus musculus
gtgtggcaatgactgtcattttagt

SEQ ID NO: 344220 - DNA, 25 bp, Mus musculus
gtgtggcacaagacgatacagcacg

SEQ ID NO: 344221 - DNA, 25 bp, Mus musculus
gtgtggcacaagacggatcttgaaa

SEQ ID NO: 344222 - DNA, 25 bp, Mus musculus
gtgtggcagcgtgtcaacccaaagt

SEQ ID NO: 344223 - DNA, 25 bp, Mus musculus
gtgtggcagcgtgtttcccacgaca

SEQ ID NO: 344224 - DNA, 25 bp, Mus musculus
gtgtggcagtagatgaagaacaacg

SEQ ID NO: 344225 - DNA, 25 bp, Mus musculus
gtgtggcagtggtggtgaccaacca

SEQ ID NO: 344226 - DNA, 25 bp, Mus musculus
gtgtggccaaagccaaacttgccaa

SEQ ID NO: 344227 - DNA, 25 bp, Mus musculus
gtgtggccaaagggacagtacttat

SEQ ID NO: 344228 - DNA, 25 bp, Mus musculus
gtgtggccaatggcatgccttggac

SEQ ID NO: 344229 - DNA, 25 bp, Mus musculus
gtgtggccaatggctgtcgatattc

SEQ ID NO: 344230 - DNA, 25 bp, Mus musculus
gtgtggccagatcagactccaacgc

SEQ ID NO: 344231 - DNA, 25 bp, Mus musculus
gtgtggccagcgttttaccaacgag

SEQ ID NO: 344232 - DNA, 25 bp, Mus musculus
gtgtggcctggtggatgactacagc

SEQ ID NO: 344233 - DNA, 25 bp, Mus musculus
gtgtggccttgcaaagctgttgctg

SEQ ID NO: 344234 - DNA, 25 bp, Mus musculus
gtgtggcgtcggggtgacatggaca

SEQ ID NO: 344235 - DNA, 25 bp, Mus musculus
gtgtggctagcaagctgcctcgtac

SEQ ID NO: 344236 - DNA, 25 bp, Mus musculus
gtgtggctgaagcaggaatggacag

SEQ ID NO: 344237 - DNA, 25 bp, Mus musculus
gtgtggctgcaaaggccactttgcc

SEQ ID NO: 344238 - DNA, 25 bp, Mus musculus
gtgtggcttggtacctggaatggaa

SEQ ID NO: 344239 - DNA, 25 bp, Mus musculus
gtgtgggaaaccttggtcttgccac

SEQ ID NO: 344240 - DNA, 25 bp, Mus musculus
gtgtgggaaatacggtatcaccagc

SEQ ID NO: 344241 - DNA, 25 bp, Mus musculus
gtgtgggaacagctggaaggtaggc

SEQ ID NO: 344242 - DNA, 25 bp, Mus musculus
gtgtgggacaaggttttgagcatta

SEQ ID NO: 344243 - DNA, 25 bp, Mus musculus
gtgtgggactgagggtggttgctgt

SEQ ID NO: 344244 - DNA, 25 bp, Mus musculus
gtgtgggagacggccccgactctgg

SEQ ID NO: 344245 - DNA, 25 bp, Mus musculus
gtgtgggagagaggcaccatgacaa

SEQ ID NO: 344246 - DNA, 25 bp, Mus musculus
gtgtggggattaaggcaggttgtca

SEQ ID NO: 344247 - DNA, 25 bp, Mus musculus
gtgtggggctcctctaaattggttc

SEQ ID NO: 344248 - DNA, 25 bp, Mus musculus
gtgtgggtctccaggctcagcccgt

SEQ ID NO: 344249 - DNA, 25 bp, Mus musculus
gtgtgggtgagcaggtgcgggaggt

SEQ ID NO: 344250 - DNA, 25 bp, Mus musculus
gtgtggtccgtcaagcccttgacca

SEQ ID NO: 344251 - DNA, 25 bp, Mus musculus
gtgtggtctattcagatacagccct

SEQ ID NO: 344252 - DNA, 25 bp, Mus musculus
gtgtggtctattcagctacagtgat

SEQ ID NO: 344253 - DNA, 25 bp, Mus musculus
gtgtggtcttcacaggcgtggagac

SEQ ID NO: 344254 - DNA, 25 bp, Mus musculus
gtgtggtgactgttggtcctgtgga

SEQ ID NO: 344255 - DNA, 25 bp, Mus musculus
gtgtggtggccagtgggtgcatcct

SEQ ID NO: 344256 - DNA, 25 bp, Mus musculus
gtgtggttgcaccctcaggatcacc

SEQ ID NO: 344257 - DNA, 25 bp, Mus musculus
gtgtggtttacacagtattactatg

SEQ ID NO: 344258 - DNA, 25 bp, Mus musculus
gtgtggtttgcagcttcatggtttc

SEQ ID NO: 344259 - DNA, 25 bp, Mus musculus
gtgtggtttgcagggatgcggtaaa

SEQ ID NO: 344260 - DNA, 25 bp, Mus musculus
gtgtgtaagcactggggaaagcctt

SEQ ID NO: 344261 - DNA, 25 bp, Mus musculus
gtgtgtacaggccccgactctggcc

SEQ ID NO: 344262 - DNA, 25 bp, Mus musculus
gtgtgtacttgactgaagtgtgctt

SEQ ID NO: 344263 - DNA, 25 bp, Mus musculus
gtgtgtagaactgctccaggctttc

SEQ ID NO: 344264 - DNA, 25 bp, Mus musculus
gtgtgtataaagtacaacctgagaa

SEQ ID NO: 344265 - DNA, 25 bp, Mus musculus
gtgtgtataagactgtcatcaggaa

SEQ ID NO: 344266 - DNA, 25 bp, Mus musculus
gtgtgtcaaatctctcatggaactt

SEQ ID NO: 344267 - DNA, 25 bp, Mus musculus
gtgtgtcacacagatccagctgagc

SEQ ID NO: 344268 - DNA, 25 bp, Mus musculus
gtgtgtcacacagatttttggagac

SEQ ID NO: 344269 - DNA, 25 bp, Mus musculus
gtgtgtcacacgtgtggggctgcct

SEQ ID NO: 344270 - DNA, 25 bp, Mus musculus
gtgtgtcatttttagctccgcctgc

SEQ ID NO: 344271 - DNA, 25 bp, Mus musculus
gtgtgtcatttttaggatttggtgt

SEQ ID NO: 344272 - DNA, 25 bp, Mus musculus
gtgtgtcctgtgaagacatcaacga

SEQ ID NO: 344273 - DNA, 25 bp, Mus musculus
gtgtgtcctgtgaagacatcaatga

SEQ ID NO: 344274 - DNA, 25 bp, Mus musculus
gtgtgtcctgtgaagaccaagacga

SEQ ID NO: 344275 - DNA, 25 bp, Mus musculus
gtgtgtcgcacgagagctgcctgta

SEQ ID NO: 344276 - DNA, 25 bp, Mus musculus
gtgtgtcgcacgaggtggactcaca

SEQ ID NO: 344277 - DNA, 25 bp, Mus musculus
gtgtgtcggagaggctggtccagga

SEQ ID NO: 344278 - DNA, 25 bp, Mus musculus
gtgtgtcggagcctccgaagtagct

SEQ ID NO: 344279 - DNA, 25 bp, Mus musculus
gtgtgtctagggtgtgcttatatcc

SEQ ID NO: 344280 - DNA, 25 bp, Mus musculus
gtgtgtctcaggtggtccacaaggc

SEQ ID NO: 344281 - DNA, 25 bp, Mus musculus
gtgtgtctgaccagcatgcccgctg

SEQ ID NO: 344282 - DNA, 25 bp, Mus musculus
gtgtgtctgacgcactgtatcactt

SEQ ID NO: 344283 - DNA, 25 bp, Mus musculus
gtgtgtctgtctggctggaaatgtt

SEQ ID NO: 344284 - DNA, 25 bp, Mus musculus
gtgtgtctgtctgggagatgctatt

SEQ ID NO: 344285 - DNA, 25 bp, Mus musculus
gtgtgtcttcagcctcagctttatg

SEQ ID NO: 344286 - DNA, 25 bp, Mus musculus
gtgtgtgaagcaaggagaactcatg

SEQ ID NO: 344287 - DNA, 25 bp, Mus musculus
gtgtgtgaaggatggcgaaacctga

SEQ ID NO: 344288 - DNA, 25 bp, Mus musculus
gtgtgtgacgaaaggtctgtcacct

SEQ ID NO: 344289 - DNA, 25 bp, Mus musculus
gtgtgtgacttagcccaggagttaa

SEQ ID NO: 344290 - DNA, 25 bp, Mus musculus
gtgtgtgacttagctcaaagattag

SEQ ID NO: 344291 - DNA, 25 bp, Mus musculus
gtgtgtgacttaggtaggtgagcct

SEQ ID NO: 344292 - DNA, 25 bp, Mus musculus
gtgtgtgcaaatgacccaggatgta

SEQ ID NO: 344293 - DNA, 25 bp, Mus musculus
gtgtgtgcagcggggagagttagat

SEQ ID NO: 344294 - DNA, 25 bp, Mus musculus
gtgtgtgcagggaaatctgctccat

SEQ ID NO: 344295 - DNA, 25 bp, Mus musculus
gtgtgtgccaagtctatatttgaac

SEQ ID NO: 344296 - DNA, 25 bp, Mus musculus
gtgtgtgccaagttccatatctgca

SEQ ID NO: 344297 - DNA, 25 bp, Mus musculus
gtgtgtgcccgtggtatcgatgttg

SEQ ID NO: 344298 - DNA, 25 bp, Mus musculus
gtgtgtggcctggtggatgactaca

SEQ ID NO: 344299 - DNA, 25 bp, Mus musculus
gtgtgtgtcgtgctggtctgtgcgc

SEQ ID NO: 344300 - DNA, 25 bp, Mus musculus
gtgtgtgtctgctgctgacaaggac

SEQ ID NO: 344301 - DNA, 25 bp, Mus musculus
gtgtgtgtctgtctggctggaaatg

SEQ ID NO: 344302 - DNA, 25 bp, Mus musculus
gtgtgtgtctgtctgggagatgcta

SEQ ID NO: 344303 - DNA, 25 bp, Mus musculus
gtgtgtgtgcaacgatactgtatcc

SEQ ID NO: 344304 - DNA, 25 bp, Mus musculus
gtgtgtgtgtggggagatggtggcc

SEQ ID NO: 344305 - DNA, 25 bp, Mus musculus
gtgtgtgtgtgtaatagggatggag

SEQ ID NO: 344306 - DNA, 25 bp, Mus musculus
gtgtgtgtgtgtggggagatggtgg

SEQ ID NO: 344307 - DNA, 25 bp, Mus musculus
gtgtgtgtgtgtgtggggagatggt

SEQ ID NO: 344308 - DNA, 25 bp, Mus musculus
gtgtgtgttattggactctgggctt

SEQ ID NO: 344309 - DNA, 25 bp, Mus musculus
gtgtgtgtttggagaacccagattc

SEQ ID NO: 344310 - DNA, 25 bp, Mus musculus
gtgtgttaagccatcaaacaatgaa

SEQ ID NO: 344311 - DNA, 25 bp, Mus musculus
gtgtgttaaggtctcattttttttc

SEQ ID NO: 344312 - DNA, 25 bp, Mus musculus
gtgtgttaaggttaccaacatatcc

SEQ ID NO: 344313 - DNA, 25 bp, Mus musculus
gtgtgttattggactctgggcttgt

SEQ ID NO: 344314 - DNA, 25 bp, Mus musculus
gtgtgttcatcacgctcctgcccaa

SEQ ID NO: 344315 - DNA, 25 bp, Mus musculus
gtgtgttcatcgtcgctgcaaaata

SEQ ID NO: 344316 - DNA, 25 bp, Mus musculus
gtgtgttcctgccagactgggtttg

SEQ ID NO: 344317 - DNA, 25 bp, Mus musculus
gtgtgttctctgtttgacacgttta

SEQ ID NO: 344318 - DNA, 25 bp, Mus musculus
gtgtgttctggcagggacgaaactt

SEQ ID NO: 344319 - DNA, 25 bp, Mus musculus
gtgtgttctgtagattcgagtaaga

SEQ ID NO: 344320 - DNA, 25 bp, Mus musculus
gtgtgttgaggagcccaccgcaacg

SEQ ID NO: 344321 - DNA, 25 bp, Mus musculus
gtgtgttgccgatgagtctgcaatc

SEQ ID NO: 344322 - DNA, 25 bp, Mus musculus
gtgtgttggagcaggcggacagaga

SEQ ID NO: 344323 - DNA, 25 bp, Mus musculus
gtgtgtttgaggagatttctaatag

SEQ ID NO: 344324 - DNA, 25 bp, Mus musculus
gtgtgtttggagaacccagattcca

SEQ ID NO: 344325 - DNA, 25 bp, Mus musculus
gtgtgttttatccttacaatgacac

SEQ ID NO: 344326 - DNA, 25 bp, Mus musculus
gtgttaaaaagacatgtttttcagt

SEQ ID NO: 344327 - DNA, 25 bp, Mus musculus
gtgttaaaaagtttatgatcacagg

SEQ ID NO: 344328 - DNA, 25 bp, Mus musculus
gtgttaacatgaaggttcttccagc

SEQ ID NO: 344329 - DNA, 25 bp, Mus musculus
gtgttaacatgattgttcgttttga

SEQ ID NO: 344330 - DNA, 25 bp, Mus musculus
gtgttaatgagaagggagccttctg

SEQ ID NO: 344331 - DNA, 25 bp, Mus musculus
gtgttaatgatgttgcttttctctt

SEQ ID NO: 344332 - DNA, 25 bp, Mus musculus
gtgttacaagctaatggcactgact

SEQ ID NO: 344333 - DNA, 25 bp, Mus musculus
gtgttacaagggactgagtggggtc

SEQ ID NO: 344334 - DNA, 25 bp, Mus musculus
gtgttaccagcaccaccaaaaaagg

SEQ ID NO: 344335 - DNA, 25 bp, Mus musculus
gtgttactcaggtaccagcgctgaa

SEQ ID NO: 344336 - DNA, 25 bp, Mus musculus
gtgttactgaggcaacgtttcatac

SEQ ID NO: 344337 - DNA, 25 bp, Mus musculus
gtgttactgagggactttgtaaaca

SEQ ID NO: 344338 - DNA, 25 bp, Mus musculus
gtgttagaatgtgagcggacggaca

SEQ ID NO: 344339 - DNA, 25 bp, Mus musculus
gtgttagagaacagggaccgtgtgg

SEQ ID NO: 344340 - DNA, 25 bp, Mus musculus
gtgttagaggagatttaccttcaag

SEQ ID NO: 344341 - DNA, 25 bp, Mus musculus
gtgttagcgttaccctgggaatctg

SEQ ID NO: 344342 - DNA, 25 bp, Mus musculus
gtgttagctatttatgaagccaaag

SEQ ID NO: 344343 - DNA, 25 bp, Mus musculus
gtgttagctatttatggttacacct

SEQ ID NO: 344344 - DNA, 25 bp, Mus musculus
gtgttatatggttatatatttgggg

SEQ ID NO: 344345 - DNA, 25 bp, Mus musculus
gtgttatcaaccgaacacagaagaa

SEQ ID NO: 344346 - DNA, 25 bp, Mus musculus
gtgttatcagaacccccaacttgaa

SEQ ID NO: 344347 - DNA, 25 bp, Mus musculus
gtgttatcagaagccccaacttgaa

SEQ ID NO: 344348 - DNA, 25 bp, Mus musculus
gtgttatcgctgcaggaacgtttgg

SEQ ID NO: 344349 - DNA, 25 bp, Mus musculus
gtgttatgagtttgtgatgtctggc

SEQ ID NO: 344350 - DNA, 25 bp, Mus musculus
gtgttatgcacaatcagagtcctca

SEQ ID NO: 344351 - DNA, 25 bp, Mus musculus
gtgttattgagctgggaggcaccat

SEQ ID NO: 344352 - DNA, 25 bp, Mus musculus
gtgttcaaacatgcccagttgcaga

SEQ ID NO: 344353 - DNA, 25 bp, Mus musculus
gtgttcaaagggctgaacgacaaag

SEQ ID NO: 344354 - DNA, 25 bp, Mus musculus
gtgttcaaggagaagaagaaaaagt

SEQ ID NO: 344355 - DNA, 25 bp, Mus musculus
gtgttcaatgggcatgttcatcaca

SEQ ID NO: 344356 - DNA, 25 bp, Mus musculus
gtgttcaattcccggacggcctatg

SEQ ID NO: 344357 - DNA, 25 bp, Mus musculus
gtgttcacatcaacaggaacgtcat

SEQ ID NO: 344358 - DNA, 25 bp, Mus musculus
gtgttcactgatgaggcatcaatac

SEQ ID NO: 344359 - DNA, 25 bp, Mus musculus
gtgttcagaaagcgctcctgttatc

SEQ ID NO: 344360 - DNA, 25 bp, Mus musculus
gtgttcagtgatgtgatggaggatc

SEQ ID NO: 344361 - DNA, 25 bp, Mus musculus
gtgttcatcaaactttcatggatcg

SEQ ID NO: 344362 - DNA, 25 bp, Mus musculus
gtgttcatcacgctcctgcccaatg

SEQ ID NO: 344363 - DNA, 25 bp, Mus musculus
gtgttcatcgtcgctgcaaaataca

SEQ ID NO: 344364 - DNA, 25 bp, Mus musculus
gtgttcatttgtgattcatggcagg

SEQ ID NO: 344365 - DNA, 25 bp, Mus musculus
gtgttccaaggagaccccctcctgc

SEQ ID NO: 344366 - DNA, 25 bp, Mus musculus
gtgttccaaggtttggtgccgtgaa

SEQ ID NO: 344367 - DNA, 25 bp, Mus musculus
gtgttccctgacgctgccggcgaaa

SEQ ID NO: 344368 - DNA, 25 bp, Mus musculus
gtgttccctgggttctgcagcttcc

SEQ ID NO: 344369 - DNA, 25 bp, Mus musculus
gtgttccgttggcagaagccatccc

SEQ ID NO: 344370 - DNA, 25 bp, Mus musculus
gtgttcctactggagttaaagggaa

SEQ ID NO: 344371 - DNA, 25 bp, Mus musculus
gtgttcctcagcaacttgatttctt

SEQ ID NO: 344372 - DNA, 25 bp, Mus musculus
gtgttcctgccagactgggtttgtc

SEQ ID NO: 344373 - DNA, 25 bp, Mus musculus
gtgttcctgggtcttgctgtctcta

SEQ ID NO: 344374 - DNA, 25 bp, Mus musculus
gtgttccttctccactacctcctcc

SEQ ID NO: 344375 - DNA, 25 bp, Mus musculus
gtgttccttctgcttctaccaggcc

SEQ ID NO: 344376 - DNA, 25 bp, Mus musculus
gtgttcgcggggctcgtgctcgtgg

SEQ ID NO: 344377 - DNA, 25 bp, Mus musculus
gtgttcgctccaggtgagaagtctg

SEQ ID NO: 344378 - DNA, 25 bp, Mus musculus
gtgttcgctgtgcgggtgtctccac

SEQ ID NO: 344379 - DNA, 25 bp, Mus musculus
gtgttcgctgtgcgggtgtgggcac

SEQ ID NO: 344380 - DNA, 25 bp, Mus musculus
gtgttcggcaggttcgcagaccagt

SEQ ID NO: 344381 - DNA, 25 bp, Mus musculus
gtgttcggtgcagagccaccatgcc

SEQ ID NO: 344382 - DNA, 25 bp, Mus musculus
gtgttcgtgcggtcttttgatggat

SEQ ID NO: 344383 - DNA, 25 bp, Mus musculus
gtgttcgtggcaggggatgatgagc

SEQ ID NO: 344384 - DNA, 25 bp, Mus musculus
gtgttctatgatgattcggctcctt

SEQ ID NO: 344385 - DNA, 25 bp, Mus musculus
gtgttctcccggacgagggatctga

SEQ ID NO: 344386 - DNA, 25 bp, Mus musculus
gtgttctctgtttgacacgtttagg

SEQ ID NO: 344387 - DNA, 25 bp, Mus musculus
gtgttctgagatgacagtcatgtcc

SEQ ID NO: 344388 - DNA, 25 bp, Mus musculus
gtgttctgagctggcttgctgccca

SEQ ID NO: 344389 - DNA, 25 bp, Mus musculus
gtgttctgaggatcctggaaagctg

SEQ ID NO: 344390 - DNA, 25 bp, Mus musculus
gtgttctggatacagacaggatctt

SEQ ID NO: 344391 - DNA, 25 bp, Mus musculus
gtgttctggatacagccaaggtctc

SEQ ID NO: 344392 - DNA, 25 bp, Mus musculus
gtgttctggcagggacgaaacttag

SEQ ID NO: 344393 - DNA, 25 bp, Mus musculus
gtgttctgtagattcgagtaagagt

SEQ ID NO: 344394 - DNA, 25 bp, Mus musculus
gtgttctgtgcaggtgcagacctga

SEQ ID NO: 344395 - DNA, 25 bp, Mus musculus
gtgttctgttgttattttccttcac

SEQ ID NO: 344396 - DNA, 25 bp, Mus musculus
gtgttcttatgactctgctgggatt

SEQ ID NO: 344397 - DNA, 25 bp, Mus musculus
gtgttcttatgactctgggctgatg

SEQ ID NO: 344398 - DNA, 25 bp, Mus musculus
gtgttcttatgactgcaccattcct

SEQ ID NO: 344399 - DNA, 25 bp, Mus musculus
gtgttcttggattcgctggttggtg

SEQ ID NO: 344400 - DNA, 25 bp, Mus musculus
gtgttctttcagagtgcttctactt

SEQ ID NO: 344401 - DNA, 25 bp, Mus musculus
gtgttctttccggctgtgacttctt

SEQ ID NO: 344402 - DNA, 25 bp, Mus musculus
gtgttgaaagtggagcaaaatgcca

SEQ ID NO: 344403 - DNA, 25 bp, Mus musculus
gtgttgaacagagaaattagccgag

SEQ ID NO: 344404 - DNA, 25 bp, Mus musculus
gtgttgaatacaaggttctcaggac

SEQ ID NO: 344405 - DNA, 25 bp, Mus musculus
gtgttgaccctgcagaaaacttctt

SEQ ID NO: 344406 - DNA, 25 bp, Mus musculus
gtgttgaccgaaagcacagccatct

SEQ ID NO: 344407 - DNA, 25 bp, Mus musculus
gtgttgacggacttattgccaagga

SEQ ID NO: 344408 - DNA, 25 bp, Mus musculus
gtgttgatgaagagctggagtgatt

SEQ ID NO: 344409 - DNA, 25 bp, Mus musculus
gtgttgattacaggtacagcgcagc

SEQ ID NO: 344410 - DNA, 25 bp, Mus musculus
gtgttgccgatgagtctgcaatcct

SEQ ID NO: 344411 - DNA, 25 bp, Mus musculus
gtgttgccgatgagtctgccaccat

SEQ ID NO: 344412 - DNA, 25 bp, Mus musculus
gtgttgccgatgagtctgcctgcca

SEQ ID NO: 344413 - DNA, 25 bp, Mus musculus
gtgttgctgaagatcaaccgagaaa

SEQ ID NO: 344414 - DNA, 25 bp, Mus musculus
gtgttgctgagattgccaaaatgct

SEQ ID NO: 344415 - DNA, 25 bp, Mus musculus
gtgttgctgctccagggtggggcac

SEQ ID NO: 344416 - DNA, 25 bp, Mus musculus
gtgttgctggatgagtattggagaa

SEQ ID NO: 344417 - DNA, 25 bp, Mus musculus
gtgttgctggctgccatgcctatga

SEQ ID NO: 344418 - DNA, 25 bp, Mus musculus
gtgttgctggctggattgccttttg

SEQ ID NO: 344419 - DNA, 25 bp, Mus musculus
gtgttgcttgctgtgcctcagatca

SEQ ID NO: 344420 - DNA, 25 bp, Mus musculus
gtgttgcttgttttgctggtaactg

SEQ ID NO: 344421 - DNA, 25 bp, Mus musculus
gtgttggaaggtggcattgacccca

SEQ ID NO: 344422 - DNA, 25 bp, Mus musculus
gtgttggaatggtcagcctctcagc

SEQ ID NO: 344423 - DNA, 25 bp, Mus musculus
gtgttggacagattgtaggtgaagt

SEQ ID NO: 344424 - DNA, 25 bp, Mus musculus
gtgttggactcatgagagcaaagac

SEQ ID NO: 344425 - DNA, 25 bp, Mus musculus
gtgttggagcaggcggacagagaag

SEQ ID NO: 344426 - DNA, 25 bp, Mus musculus
gtgttggcaagagagatgaagatgc

SEQ ID NO: 344427 - DNA, 25 bp, Mus musculus
gtgttggcaagaggccacagcacta

SEQ ID NO: 344428 - DNA, 25 bp, Mus musculus
gtgttggcactgcaggaagaagagg

SEQ ID NO: 344429 - DNA, 25 bp, Mus musculus
gtgttggcactgggatcagtaatgg

SEQ ID NO: 344430 - DNA, 25 bp, Mus musculus
gtgttggcctttgagtagagtatca

SEQ ID NO: 344431 - DNA, 25 bp, Mus musculus
gtgttggctcaggagggtgtgaaga

SEQ ID NO: 344432 - DNA, 25 bp, Mus musculus
gtgttggcttgtggtctatgttcag

SEQ ID NO: 344433 - DNA, 25 bp, Mus musculus
gtgttgggattccaggacgcccctg

SEQ ID NO: 344434 - DNA, 25 bp, Mus musculus
gtgttgggctaaagaatatgacaga

SEQ ID NO: 344435 - DNA, 25 bp, Mus musculus
gtgttgggggtctgagagaatcgca

SEQ ID NO: 344436 - DNA, 25 bp, Mus musculus
gtgttggtcgcctctctgcctttca

SEQ ID NO: 344437 - DNA, 25 bp, Mus musculus
gtgttggtcgcgggggttctactgt

SEQ ID NO: 344438 - DNA, 25 bp, Mus musculus
gtgttggtgccatggtggcttcagt

SEQ ID NO: 344439 - DNA, 25 bp, Mus musculus
gtgttgtgaaagtggaacccagtga

SEQ ID NO: 344440 - DNA, 25 bp, Mus musculus
gtgttgtgaaagtgttacaggttta

SEQ ID NO: 344441 - DNA, 25 bp, Mus musculus
gtgttgtgaggagtccatgaagatt

SEQ ID NO: 344442 - DNA, 25 bp, Mus musculus
gtgttgtgcagagactgccttgtgt

SEQ ID NO: 344443 - DNA, 25 bp, Mus musculus
gtgttgtgcagaggcggccatgctt

SEQ ID NO: 344444 - DNA, 25 bp, Mus musculus
gtgttgtggaggttgcatcagatga

SEQ ID NO: 344445 - DNA, 25 bp, Mus musculus
gtgttgtggaggttggtccctgcat

SEQ ID NO: 344446 - DNA, 25 bp, Mus musculus
gtgttgtgtccggtataagtgctac

SEQ ID NO: 344447 - DNA, 25 bp, Mus musculus
gtgttgtgtctcggctttccagtct

SEQ ID NO: 344448 - DNA, 25 bp, Mus musculus
gtgttgttactgaggaacttcctga

SEQ ID NO: 344449 - DNA, 25 bp, Mus musculus
gtgttgttcggagatgggtatcggc

SEQ ID NO: 344450 - DNA, 25 bp, Mus musculus
gtgtttaaggagatgaaaccctgtt

SEQ ID NO: 344451 - DNA, 25 bp, Mus musculus
gtgtttaagttccgatacttcgctg

SEQ ID NO: 344452 - DNA, 25 bp, Mus musculus
gtgtttacatcagtggttggagact

SEQ ID NO: 344453 - DNA, 25 bp, Mus musculus
gtgtttaccacgcatgcagctggtc

SEQ ID NO: 344454 - DNA, 25 bp, Mus musculus
gtgtttactcactttcaaaacttaa

SEQ ID NO: 344455 - DNA, 25 bp, Mus musculus
gtgtttactcactttgaaaaagaga

SEQ ID NO: 344456 - DNA, 25 bp, Mus musculus
gtgtttattcaggtgcactgcatca

SEQ ID NO: 344457 - DNA, 25 bp, Mus musculus
gtgtttcaaaagctctcttctccct

SEQ ID NO: 344458 - DNA, 25 bp, Mus musculus
gtgtttcaaaaggcattgcgctccc

SEQ ID NO: 344459 - DNA, 25 bp, Mus musculus
gtgtttcacagggtcaggtacctgg

SEQ ID NO: 344460 - DNA, 25 bp, Mus musculus
gtgtttccaggacagatggcgctgc

SEQ ID NO: 344461 - DNA, 25 bp, Mus musculus
gtgtttccatagtctgagtgacagc

SEQ ID NO: 344462 - DNA, 25 bp, Mus musculus
gtgtttccctacatccagaacccag

SEQ ID NO: 344463 - DNA, 25 bp, Mus musculus
gtgtttcctgtgaaccgatttaaag

SEQ ID NO: 344464 - DNA, 25 bp, Mus musculus
gtgtttcggaggccgatggcaccac

SEQ ID NO: 344465 - DNA, 25 bp, Mus musculus
gtgtttcgtcatgagatcaaggaca

SEQ ID NO: 344466 - DNA, 25 bp, Mus musculus
gtgtttctagaggcctcaaacagcg

SEQ ID NO: 344467 - DNA, 25 bp, Mus musculus
gtgtttctcagctcagaggctgaga

SEQ ID NO: 344468 - DNA, 25 bp, Mus musculus
gtgtttctgcaagatgaacgagacc

SEQ ID NO: 344469 - DNA, 25 bp, Mus musculus
gtgtttctggtgaagattatgggac

SEQ ID NO: 344470 - DNA, 25 bp, Mus musculus
gtgtttcttaccatctatggagttg

SEQ ID NO: 344471 - DNA, 25 bp, Mus musculus
gtgtttgaatgaccttcttttggag

SEQ ID NO: 344472 - DNA, 25 bp, Mus musculus
gtgtttgacatggcaacagaagttg

SEQ ID NO: 344473 - DNA, 25 bp, Mus musculus
gtgtttgaccttgttaccggagggg

SEQ ID NO: 344474 - DNA, 25 bp, Mus musculus
gtgtttgagaggaaacttcgagtca

SEQ ID NO: 344475 - DNA, 25 bp, Mus musculus
gtgtttgaggaggtagggtctgacc

SEQ ID NO: 344476 - DNA, 25 bp, Mus musculus
gtgtttgaggaggtgtacaggaatg

SEQ ID NO: 344477 - DNA, 25 bp, Mus musculus
gtgtttgcaggagtgtaccctatag

SEQ ID NO: 344478 - DNA, 25 bp, Mus musculus
gtgtttgcatgctaggagatgtacg

SEQ ID NO: 344479 - DNA, 25 bp, Mus musculus
gtgtttgccgggtgtaatggatagg

SEQ ID NO: 344480 - DNA, 25 bp, Mus musculus
gtgtttgctagagggcaatgcgagc

SEQ ID NO: 344481 - DNA, 25 bp, Mus musculus
gtgtttgctattgggcacaaatatg

SEQ ID NO: 344482 - DNA, 25 bp, Mus musculus
gtgtttgctcagtgctggcctttgc

SEQ ID NO: 344483 - DNA, 25 bp, Mus musculus
gtgtttggaaaggcgaccgtgctgt

SEQ ID NO: 344484 - DNA, 25 bp, Mus musculus
gtgtttggaaaggctggcaagtttg

SEQ ID NO: 344485 - DNA, 25 bp, Mus musculus
gtgtttggacggtgtgccggactcc

SEQ ID NO: 344486 - DNA, 25 bp, Mus musculus
gtgtttggagaacccagattccaaa

SEQ ID NO: 344487 - DNA, 25 bp, Mus musculus
gtgtttggcaggatgctcgggacac

SEQ ID NO: 344488 - DNA, 25 bp, Mus musculus
gtgtttggcagtctccaaaacccca

SEQ ID NO: 344489 - DNA, 25 bp, Mus musculus
gtgtttgtagacccatccctgacgg

SEQ ID NO: 344490 - DNA, 25 bp, Mus musculus
gtgtttgtcctcaaatcgtcctgct

SEQ ID NO: 344491 - DNA, 25 bp, Mus musculus
gtgtttgtgaatggctgcttattgg

SEQ ID NO: 344492 - DNA, 25 bp, Mus musculus
gtgtttgttagtgagctgctggaag

SEQ ID NO: 344493 - DNA, 25 bp, Mus musculus
gtgttttatccttacaatgacactg

SEQ ID NO: 344494 - DNA, 25 bp, Mus musculus
gtgttttattggatcgtggagttga

SEQ ID NO: 344495 - DNA, 25 bp, Mus musculus
gtgttttcaaaaaagaatatgatgc

SEQ ID NO: 344496 - DNA, 25 bp, Mus musculus
gtgttttcagaatggcttcctttgg

SEQ ID NO: 344497 - DNA, 25 bp, Mus musculus
gtgttttcagatgtccctggtagat

SEQ ID NO: 344498 - DNA, 25 bp, Mus musculus
gtgttttcaggcctctgctcgatga

SEQ ID NO: 344499 - DNA, 25 bp, Mus musculus
gtgttttcagggccctcagccgatg

SEQ ID NO: 344500 - DNA, 25 bp, Mus musculus
gtgttttcagtggataatgaaacac

SEQ ID NO: 344501 - DNA, 25 bp, Mus musculus
gtgttttctcacagcatggtctgag

SEQ ID NO: 344502 - DNA, 25 bp, Mus musculus
gtgttttgcataggtgcctctcctt

SEQ ID NO: 344503 - DNA, 25 bp, Mus musculus
gtgttttgtgaagagtacccagtat

SEQ ID NO: 344504 - DNA, 25 bp, Mus musculus
gtgttttgtgaagcctggatggtgg

SEQ ID NO: 344505 - DNA, 25 bp, Mus musculus
gtgtttttaaactaggtcgatcctt

SEQ ID NO: 344506 - DNA, 25 bp, Mus musculus
gtgtttttcagatttcaccgagatg

SEQ ID NO: 344507 - DNA, 25 bp, Mus musculus
gtgtttttgcagaatgtgtgctgtg

SEQ ID NO: 344508 - DNA, 25 bp, Mus musculus
gttaaaaaatcttgcccagtcccag

SEQ ID NO: 344509 - DNA, 25 bp, Mus musculus
gttaaaaatattagcatcaaaaatc

SEQ ID NO: 344510 - DNA, 25 bp, Mus musculus
gttaaaaatattgagactggaagtg

SEQ ID NO: 344511 - DNA, 25 bp, Mus musculus
gttaaaaatattgggtatgaaagtg

SEQ ID NO: 344512 - DNA, 25 bp, Mus musculus
gttaaaaatcgcctcaccattgagc

SEQ ID NO: 344513 - DNA, 25 bp, Mus musculus
gttaaaagttcaaggagtctcatga

SEQ ID NO: 344514 - DNA, 25 bp, Mus musculus
gttaaaatacctgagcatctgtaac

SEQ ID NO: 344515 - DNA, 25 bp, Mus musculus
gttaaaatatcagaaatcatgaggt

SEQ ID NO: 344516 - DNA, 25 bp, Mus musculus
gttaaaatatcagaggctaaagaag

SEQ ID NO: 344517 - DNA, 25 bp, Mus musculus
gttaaaatcaagatctctgctcctc

SEQ ID NO: 344518 - DNA, 25 bp, Mus musculus
gttaaaatcacagactcaccacctc

SEQ ID NO: 344519 - DNA, 25 bp, Mus musculus
gttaaaattctcaagccagtaaaaa

SEQ ID NO: 344520 - DNA, 25 bp, Mus musculus
gttaaaattctcaagtcacgaaccc

SEQ ID NO: 344521 - DNA, 25 bp, Mus musculus
gttaaagaaggaagatgcaggtttt

SEQ ID NO: 344522 - DNA, 25 bp, Mus musculus
gttaaagaaggaaggatccaggcca

SEQ ID NO: 344523 - DNA, 25 bp, Mus musculus
gttaaagaccacaaagaaacatggt

SEQ ID NO: 344524 - DNA, 25 bp, Mus musculus
gttaaagtttcagcaacccagcatg

SEQ ID NO: 344525 - DNA, 25 bp, Mus musculus
gttaaatattgatgagaaggctcca

SEQ ID NO: 344526 - DNA, 25 bp, Mus musculus
gttaacaaaatatagtgtcatcatg

SEQ ID NO: 344527 - DNA, 25 bp, Mus musculus
gttaacaagcaagaaagaagacatc

SEQ ID NO: 344528 - DNA, 25 bp, Mus musculus
gttaacaagcaagatccgctgatct

SEQ ID NO: 344529 - DNA, 25 bp, Mus musculus
gttaacaataaggacctccagtcag

SEQ ID NO: 344530 - DNA, 25 bp, Mus musculus
gttaacagaaacttcagaaaagtag

SEQ ID NO: 344531 - DNA, 25 bp, Mus musculus
gttaacagaatgagaacagacaagg

SEQ ID NO: 344532 - DNA, 25 bp, Mus musculus
gttaacagataggttctgcctcatg

SEQ ID NO: 344533 - DNA, 25 bp, Mus musculus
gttaacagcacagattctaccagtg

SEQ ID NO: 344534 - DNA, 25 bp, Mus musculus
gttaacaggccatggatgcccgggt

SEQ ID NO: 344535 - DNA, 25 bp, Mus musculus
gttaacatgaaggttcttccagcac

SEQ ID NO: 344536 - DNA, 25 bp, Mus musculus
gttaacatgagctttctgctcaaca

SEQ ID NO: 344537 - DNA, 25 bp, Mus musculus
gttaacatgaggtctatccaggaaa

SEQ ID NO: 344538 - DNA, 25 bp, Mus musculus
gttaacatgattgttcgttttgaga

SEQ ID NO: 344539 - DNA, 25 bp, Mus musculus
gttaacccacagacaaggaatatgt

SEQ ID NO: 344540 - DNA, 25 bp, Mus musculus
gttaactaatggcagttggatcctc

SEQ ID NO: 344541 - DNA, 25 bp, Mus musculus
gttaactgacacgagtgcgcaaact

SEQ ID NO: 344542 - DNA, 25 bp, Mus musculus
gttaactgacacgcaacagatagta

SEQ ID NO: 344543 - DNA, 25 bp, Mus musculus
gttaactgacacggtaagtcttctt

SEQ ID NO: 344544 - DNA, 25 bp, Mus musculus
gttaactgccagatggttcttcgtg

SEQ ID NO: 344545 - DNA, 25 bp, Mus musculus
gttaactgtgagtggacatcatcga

SEQ ID NO: 344546 - DNA, 25 bp, Mus musculus
gttaagaaagaaacgctgcatccac

SEQ ID NO: 344547 - DNA, 25 bp, Mus musculus
gttaagaaagattaaagatgaacca

SEQ ID NO: 344548 - DNA, 25 bp, Mus musculus
gttaagaaaggacaaagatgttgcc

SEQ ID NO: 344549 - DNA, 25 bp, Mus musculus
gttaagacaatcagggcaagaaaat

SEQ ID NO: 344550 - DNA, 25 bp, Mus musculus
gttaagacagtgggttgtatcccct

SEQ ID NO: 344551 - DNA, 25 bp, Mus musculus
gttaagagaggtaatagaattgcct

SEQ ID NO: 344552 - DNA, 25 bp, Mus musculus
gttaagaggaaaaagcgaccagcta

SEQ ID NO: 344553 - DNA, 25 bp, Mus musculus
gttaagaggggcagactgaagtcag

SEQ ID NO: 344554 - DNA, 25 bp, Mus musculus
gttaagagggggtctcactgtgtag

SEQ ID NO: 344555 - DNA, 25 bp, Mus musculus
gttaagatttggaagatggagaact

SEQ ID NO: 344556 - DNA, 25 bp, Mus musculus
gttaagatttggaagggtggatgtc

SEQ ID NO: 344557 - DNA, 25 bp, Mus musculus
gttaagatttggaagtcaagaagtt

SEQ ID NO: 344558 - DNA, 25 bp, Mus musculus
gttaagccagaggcaatgggctctg

SEQ ID NO: 344559 - DNA, 25 bp, Mus musculus
gttaagcccaggtgttcatgaagcc

SEQ ID NO: 344560 - DNA, 25 bp, Mus musculus
gttaagccccaggagccctcccagg

SEQ ID NO: 344561 - DNA, 25 bp, Mus musculus
gttaagctgagtgtcctggttgcct

SEQ ID NO: 344562 - DNA, 25 bp, Mus musculus
gttaaggaacaggctttcatgctgc

SEQ ID NO: 344563 - DNA, 25 bp, Mus musculus
gttaaggtctggctcagtttatgaa

SEQ ID NO: 344564 - DNA, 25 bp, Mus musculus
gttaagtacagaagatctaaagcgg

SEQ ID NO: 344565 - DNA, 25 bp, Mus musculus
gttaagtcaggaaaccaagcgcctg

SEQ ID NO: 344566 - DNA, 25 bp, Mus musculus
gttaataacgtaacgcccggccaca

SEQ ID NO: 344567 - DNA, 25 bp, Mus musculus
gttaataatgatgctgtggttagaa

SEQ ID NO: 344568 - DNA, 25 bp, Mus musculus
gttaatacaaaagaagttattttag

SEQ ID NO: 344569 - DNA, 25 bp, Mus musculus
gttaatagcagagggctaccgtgtg

SEQ ID NO: 344570 - DNA, 25 bp, Mus musculus
gttaatagctctcaggtcaactcct

SEQ ID NO: 344571 - DNA, 25 bp, Mus musculus
gttaatatcaaggtactgtctgatg

SEQ ID NO: 344572 - DNA, 25 bp, Mus musculus
gttaatcacaaaaatataattggcc

SEQ ID NO: 344573 - DNA, 25 bp, Mus musculus
gttaatcatgctcggatcaagcaaa

SEQ ID NO: 344574 - DNA, 25 bp, Mus musculus
gttaatcatgctcggctatctgcac

SEQ ID NO: 344575 - DNA, 25 bp, Mus musculus
gttaatccacaacagtgagaggact

SEQ ID NO: 344576 - DNA, 25 bp, Mus musculus
gttaatgagaagggagccttctggg

SEQ ID NO: 344577 - DNA, 25 bp, Mus musculus
gttaatgaggggtattcagagtggg

SEQ ID NO: 344578 - DNA, 25 bp, Mus musculus
gttaatgatgttgcttttctcttat

SEQ ID NO: 344579 - DNA, 25 bp, Mus musculus
gttaatggagcaaggtgtccatgtt

SEQ ID NO: 344580 - DNA, 25 bp, Mus musculus
gttaatggcggagaggtattagaag

SEQ ID NO: 344581 - DNA, 25 bp, Mus musculus
gttaatggcggagaggtgttctctg

SEQ ID NO: 344582 - DNA, 25 bp, Mus musculus
gttaatgtccaagccatgtacatag

SEQ ID NO: 344583 - DNA, 25 bp, Mus musculus
gttaatgttagagagaatggactgc

SEQ ID NO: 344584 - DNA, 25 bp, Mus musculus
gttaattaccaacgattgaaaaatg

SEQ ID NO: 344585 - DNA, 25 bp, Mus musculus
gttaattctagaaggttttctgtcc

SEQ ID NO: 344586 - DNA, 25 bp, Mus musculus
gttaattctccattgaaatgttgtc

SEQ ID NO: 344587 - DNA, 25 bp, Mus musculus
gttaattgaacactgttaatttatc

SEQ ID NO: 344588 - DNA, 25 bp, Mus musculus
gttaattgagtgtgttctcagggga

SEQ ID NO: 344589 - DNA, 25 bp, Mus musculus
gttaattgctggccttcgttttcac

SEQ ID NO: 344590 - DNA, 25 bp, Mus musculus
gttacaaactaaaggctatggtcat

SEQ ID NO: 344591 - DNA, 25 bp, Mus musculus
gttacaaatgaacagctctggagtg

SEQ ID NO: 344592 - DNA, 25 bp, Mus musculus
gttacaaatgaacaggcctattcct

SEQ ID NO: 344593 - DNA, 25 bp, Mus musculus
gttacaaatgaacaggtgtgcggac

SEQ ID NO: 344594 - DNA, 25 bp, Mus musculus
gttacaacatgggagaggcagagtt

SEQ ID NO: 344595 - DNA, 25 bp, Mus musculus
gttacaagagggaagcctgtcatga

SEQ ID NO: 344596 - DNA, 25 bp, Mus musculus
gttacaagataaagctcacttcaat

SEQ ID NO: 344597 - DNA, 25 bp, Mus musculus
gttacaagtgggatgcctggaacag

SEQ ID NO: 344598 - DNA, 25 bp, Mus musculus
gttacaagtgtgaggactgtgggaa

SEQ ID NO: 344599 - DNA, 25 bp, Mus musculus
gttacaatccggaaccagctattgc

SEQ ID NO: 344600 - DNA, 25 bp, Mus musculus
gttacaatccggtggcgtccccttg

SEQ ID NO: 344601 - DNA, 25 bp, Mus musculus
gttacacagggctgttcaggtgtct

SEQ ID NO: 344602 - DNA, 25 bp, Mus musculus
gttacacatgagagcagcatggccc

SEQ ID NO: 344603 - DNA, 25 bp, Mus musculus
gttacacatgctatacctgctctgc

SEQ ID NO: 344604 - DNA, 25 bp, Mus musculus
gttacaccaggcttgtgaagatcct

SEQ ID NO: 344605 - DNA, 25 bp, Mus musculus
gttacactatacagtggtggaagat

SEQ ID NO: 344606 - DNA, 25 bp, Mus musculus
gttacactgacagacagatggggct

SEQ ID NO: 344607 - DNA, 25 bp, Mus musculus
gttacagaaatcgagctgaggaaac

SEQ ID NO: 344608 - DNA, 25 bp, Mus musculus
gttacagaaggtttggaggtaccaa

SEQ ID NO: 344609 - DNA, 25 bp, Mus musculus
gttacagcaaggtggctcaggagtt

SEQ ID NO: 344610 - DNA, 25 bp, Mus musculus
gttacagcagcccagtgtcacgagc

SEQ ID NO: 344611 - DNA, 25 bp, Mus musculus
gttacagcagtcactgctggggttc

SEQ ID NO: 344612 - DNA, 25 bp, Mus musculus
gttacagccaggcatgctgagccgg

SEQ ID NO: 344613 - DNA, 25 bp, Mus musculus
gttacagctaaagagaatggactcg

SEQ ID NO: 344614 - DNA, 25 bp, Mus musculus
gttacaggacatgagctactataga

SEQ ID NO: 344615 - DNA, 25 bp, Mus musculus
gttacagtcagaagccggagcctgg

SEQ ID NO: 344616 - DNA, 25 bp, Mus musculus
gttacagttaagtagtcttttcaca

SEQ ID NO: 344617 - DNA, 25 bp, Mus musculus
gttacagtttgccccggctgaggat

SEQ ID NO: 344618 - DNA, 25 bp, Mus musculus
gttacatccctctggatcggttaag

SEQ ID NO: 344619 - DNA, 25 bp, Mus musculus
gttacatccctctggtgaattccaa

SEQ ID NO: 344620 - DNA, 25 bp, Mus musculus
gttacatcgacagacatctgcaact

SEQ ID NO: 344621 - DNA, 25 bp, Mus musculus
gttacatgcaggtcataaatgaagg

SEQ ID NO: 344622 - DNA, 25 bp, Mus musculus
gttacatgtatgatttctgtacact

SEQ ID NO: 344623 - DNA, 25 bp, Mus musculus
gttaccaagagtaaggacgagtctt

SEQ ID NO: 344624 - DNA, 25 bp, Mus musculus
gttaccagtgtaagattaatgtggc

SEQ ID NO: 344625 - DNA, 25 bp, Mus musculus
gttaccatatcccaagtgtctgata

SEQ ID NO: 344626 - DNA, 25 bp, Mus musculus
gttacccaaaggtggctctgcgggt

SEQ ID NO: 344627 - DNA, 25 bp, Mus musculus
gttaccctgttgaggtttttcatct

SEQ ID NO: 344628 - DNA, 25 bp, Mus musculus
gttaccgcacggataattgtgtgga

SEQ ID NO: 344629 - DNA, 25 bp, Mus musculus
gttaccggaacagaaatcatcgtga

SEQ ID NO: 344630 - DNA, 25 bp, Mus musculus
gttaccggaacggcacgacgcgact

SEQ ID NO: 344631 - DNA, 25 bp, Mus musculus
gttaccgtaatggacggatctttgc

SEQ ID NO: 344632 - DNA, 25 bp, Mus musculus
gttacctagaggtgggaggctttgt

SEQ ID NO: 344633 - DNA, 25 bp, Mus musculus
gttacctatgaccatctgtgtaaga

SEQ ID NO: 344634 - DNA, 25 bp, Mus musculus
gttacctatgaccgaatataccatg

SEQ ID NO: 344635 - DNA, 25 bp, Mus musculus
gttacctccttggatttccataaga

SEQ ID NO: 344636 - DNA, 25 bp, Mus musculus
gttacctccttgggcatccccaaag

SEQ ID NO: 344637 - DNA, 25 bp, Mus musculus
gttacctcttatgccctgctgtgaa

SEQ ID NO: 344638 - DNA, 25 bp, Mus musculus
gttacctcttctggctcatcgccat

SEQ ID NO: 344639 - DNA, 25 bp, Mus musculus
gttacctgctggcaggtcgcttctc

SEQ ID NO: 344640 - DNA, 25 bp, Mus musculus
gttaccttcagaattggataaccac

SEQ ID NO: 344641 - DNA, 25 bp, Mus musculus
gttaccttgttgtctctgcttcctg

SEQ ID NO: 344642 - DNA, 25 bp, Mus musculus
gttacctttcagcctcccagtaaag

SEQ ID NO: 344643 - DNA, 25 bp, Mus musculus
gttacgatgaagactgccaaagtgg

SEQ ID NO: 344644 - DNA, 25 bp, Mus musculus
gttacgatgaaggctgtcatggtat

SEQ ID NO: 344645 - DNA, 25 bp, Mus musculus
gttacgcttgtacttcatcctgctc

SEQ ID NO: 344646 - DNA, 25 bp, Mus musculus
gttacggaggacccgagtcagaact

SEQ ID NO: 344647 - DNA, 25 bp, Mus musculus
gttacggagggcagtaaatcgtcct

SEQ ID NO: 344648 - DNA, 25 bp, Mus musculus
gttacggagggctgtaaatcgtcct

SEQ ID NO: 344649 - DNA, 25 bp, Mus musculus
gttacggggcttgggagcatttagc

SEQ ID NO: 344650 - DNA, 25 bp, Mus musculus
gttactaacagcaagttcaatgtcg

SEQ ID NO: 344651 - DNA, 25 bp, Mus musculus
gttactaacattagaaatccacagg

SEQ ID NO: 344652 - DNA, 25 bp, Mus musculus
gttactaaggccaagcttctggggt

SEQ ID NO: 344653 - DNA, 25 bp, Mus musculus
gttactaattactgaaaaagaagtt

SEQ ID NO: 344654 - DNA, 25 bp, Mus musculus
gttactaattactggattctgctct

SEQ ID NO: 344655 - DNA, 25 bp, Mus musculus
gttactagcacaaggtgactacgag

SEQ ID NO: 344656 - DNA, 25 bp, Mus musculus
gttactatcaaagtattctgcagat

SEQ ID NO: 344657 - DNA, 25 bp, Mus musculus
gttactatctgggtgacaatagctt

SEQ ID NO: 344658 - DNA, 25 bp, Mus musculus
gttactcacttgaagcccatctctg

SEQ ID NO: 344659 - DNA, 25 bp, Mus musculus
gttactcatgaaaacttgctagaaa

SEQ ID NO: 344660 - DNA, 25 bp, Mus musculus
gttactctgggcacgctaataattt

SEQ ID NO: 344661 - DNA, 25 bp, Mus musculus
gttactggcattggaccatctgctg

SEQ ID NO: 344662 - DNA, 25 bp, Mus musculus
gttactggcattggatctcaggaaa

SEQ ID NO: 344663 - DNA, 25 bp, Mus musculus
gttacttagtggagagaacagatac

SEQ ID NO: 344664 - DNA, 25 bp, Mus musculus
gttacttagtggtgagacgtggaat

SEQ ID NO: 344665 - DNA, 25 bp, Mus musculus
gttacttctgatggcctcgaactca

SEQ ID NO: 344666 - DNA, 25 bp, Mus musculus
gttacttgtgccagtctaatgcact

SEQ ID NO: 344667 - DNA, 25 bp, Mus musculus
gttactttatctgcacaaacagcgc

SEQ ID NO: 344668 - DNA, 25 bp, Mus musculus
gttactttgtaaagcaatccgaagg

SEQ ID NO: 344669 - DNA, 25 bp, Mus musculus
gttactttgttctcgagcaggttag

SEQ ID NO: 344670 - DNA, 25 bp, Mus musculus
gttacttttgaggatgtcaagcaaa

SEQ ID NO: 344671 - DNA, 25 bp, Mus musculus
gttacttttggaaatacagttggag

SEQ ID NO: 344672 - DNA, 25 bp, Mus musculus
gttagaaaagagtatgctgtcaagg

SEQ ID NO: 344673 - DNA, 25 bp, Mus musculus
gttagaaaagcatccgcagacatcc

SEQ ID NO: 344674 - DNA, 25 bp, Mus musculus
gttagaaaagccatagattgtaagc

SEQ ID NO: 344675 - DNA, 25 bp, Mus musculus
gttagaaaagctatagagaagtctg

SEQ ID NO: 344676 - DNA, 25 bp, Mus musculus
gttagaaaaggcatctgtggcaagg

SEQ ID NO: 344677 - DNA, 25 bp, Mus musculus
gttagaaacaaatgggatggaagac

SEQ ID NO: 344678 - DNA, 25 bp, Mus musculus
gttagaaacaaatggtgaagaagat

SEQ ID NO: 344679 - DNA, 25 bp, Mus musculus
gttagaacaggtccgagtaggtgaa

SEQ ID NO: 344680 - DNA, 25 bp, Mus musculus
gttagaactcaggcaggaagaggaa

SEQ ID NO: 344681 - DNA, 25 bp, Mus musculus
gttagaactggtgcaggtcctgcca

SEQ ID NO: 344682 - DNA, 25 bp, Mus musculus
gttagaagctctgaatgacaaaaag

SEQ ID NO: 344683 - DNA, 25 bp, Mus musculus
gttagaagctcttaaaaaacagttg

SEQ ID NO: 344684 - DNA, 25 bp, Mus musculus
gttagaaggaggattgcttcctgag

SEQ ID NO: 344685 - DNA, 25 bp, Mus musculus
gttagaaggaggccattaggaaacc

SEQ ID NO: 344686 - DNA, 25 bp, Mus musculus
gttagaaggaggggctaaggagaag

SEQ ID NO: 344687 - DNA, 25 bp, Mus musculus
gttagaagtccctccgctccaaggt

SEQ ID NO: 344688 - DNA, 25 bp, Mus musculus
gttagaatgtgagcggacggacaat

SEQ ID NO: 344689 - DNA, 25 bp, Mus musculus
gttagacattggatgccgccttgga

SEQ ID NO: 344690 - DNA, 25 bp, Mus musculus
gttagacattggctgcggttctggg

SEQ ID NO: 344691 - DNA, 25 bp, Mus musculus
gttagaccatggcacccgatggcct

SEQ ID NO: 344692 - DNA, 25 bp, Mus musculus
gttagaccatgtggtgaccatcatc

SEQ ID NO: 344693 - DNA, 25 bp, Mus musculus
gttagacctgtcttgtaaccctgag

SEQ ID NO: 344694 - DNA, 25 bp, Mus musculus
gttagacgaggaggtggagttgtta

SEQ ID NO: 344695 - DNA, 25 bp, Mus musculus
gttagactcagaggagctgtgattg

SEQ ID NO: 344696 - DNA, 25 bp, Mus musculus
gttagactcagagtcataaggtcac

SEQ ID NO: 344697 - DNA, 25 bp, Mus musculus
gttagacttgcaagcacctttcttc

SEQ ID NO: 344698 - DNA, 25 bp, Mus musculus
gttagagaaacatggtggcgacaga

SEQ ID NO: 344699 - DNA, 25 bp, Mus musculus
gttagagaacagggaccgtgtgggc

SEQ ID NO: 344700 - DNA, 25 bp, Mus musculus
gttagagaaggctcatacaacactg

SEQ ID NO: 344701 - DNA, 25 bp, Mus musculus
gttagagacaaaggttctaatcaga

SEQ ID NO: 344702 - DNA, 25 bp, Mus musculus
gttagagatgaatccgccagttcct

SEQ ID NO: 344703 - DNA, 25 bp, Mus musculus
gttagagcagatggaagattcagaa

SEQ ID NO: 344704 - DNA, 25 bp, Mus musculus
gttagaggagatttaccttcaagac

SEQ ID NO: 344705 - DNA, 25 bp, Mus musculus
gttagaggtcacaacttctcacaca

SEQ ID NO: 344706 - DNA, 25 bp, Mus musculus
gttagatatcgaaggatgttttatt

SEQ ID NO: 344707 - DNA, 25 bp, Mus musculus
gttagatcaggctgctttctcccac

SEQ ID NO: 344708 - DNA, 25 bp, Mus musculus
gttagatcaggggggctttgcccca

SEQ ID NO: 344709 - DNA, 25 bp, Mus musculus
gttagatctagtgagcagcacctcc

SEQ ID NO: 344710 - DNA, 25 bp, Mus musculus
gttagatctagtttttagagaaatc

SEQ ID NO: 344711 - DNA, 25 bp, Mus musculus
gttagatctggctctgttgctgtag

SEQ ID NO: 344712 - DNA, 25 bp, Mus musculus
gttagcaaccgctatggaattgcca

SEQ ID NO: 344713 - DNA, 25 bp, Mus musculus
gttagcaataggagaagatggaggg

SEQ ID NO: 344714 - DNA, 25 bp, Mus musculus
gttagcaccgtggtgagtaatagtt

SEQ ID NO: 344715 - DNA, 25 bp, Mus musculus
gttagcacttggtgtggagaagaca

SEQ ID NO: 344716 - DNA, 25 bp, Mus musculus
gttagcagtcaaactcagcaacagc

SEQ ID NO: 344717 - DNA, 25 bp, Mus musculus
gttagcagtcaatatatggactaat

SEQ ID NO: 344718 - DNA, 25 bp, Mus musculus
gttagccccgtggacccagcagctg

SEQ ID NO: 344719 - DNA, 25 bp, Mus musculus
gttagccccgtgggtgctcgtgtgc

SEQ ID NO: 344720 - DNA, 25 bp, Mus musculus
gttagccttcaaaccatgaagtgac

SEQ ID NO: 344721 - DNA, 25 bp, Mus musculus
gttagccttcggttgtttgtctgtg

SEQ ID NO: 344722 - DNA, 25 bp, Mus musculus
gttagcggtgagtgatcgtgagaca

SEQ ID NO: 344723 - DNA, 25 bp, Mus musculus
gttagcgttaccctgggaatctgag

SEQ ID NO: 344724 - DNA, 25 bp, Mus musculus
gttagctatttatgaagccaaagct

SEQ ID NO: 344725 - DNA, 25 bp, Mus musculus
gttagctatttatggttacaccttc

SEQ ID NO: 344726 - DNA, 25 bp, Mus musculus
gttagctgagacacttgtgagcctg

SEQ ID NO: 344727 - DNA, 25 bp, Mus musculus
gttagctgaggtgccgacaatggcc

SEQ ID NO: 344728 - DNA, 25 bp, Mus musculus
gttagctgagtcggctgcacggctc

SEQ ID NO: 344729 - DNA, 25 bp, Mus musculus
gttagctggcaaagattttctttga

SEQ ID NO: 344730 - DNA, 25 bp, Mus musculus
gttaggaaacagctatataaaagaa

SEQ ID NO: 344731 - DNA, 25 bp, Mus musculus
gttaggaaacagggtggactctccc

SEQ ID NO: 344732 - DNA, 25 bp, Mus musculus
gttaggaaaggaaagcactgccacc

SEQ ID NO: 344733 - DNA, 25 bp, Mus musculus
gttaggaagggaagttcttccatca

SEQ ID NO: 344734 - DNA, 25 bp, Mus musculus
gttaggaccacgagtattgttacag

SEQ ID NO: 344735 - DNA, 25 bp, Mus musculus
gttaggagtaaagcagtcagtggaa

SEQ ID NO: 344736 - DNA, 25 bp, Mus musculus
gttaggagtaaagctgcttctaaac

SEQ ID NO: 344737 - DNA, 25 bp, Mus musculus
gttaggatcgcaccagagtatatgc

SEQ ID NO: 344738 - DNA, 25 bp, Mus musculus
gttaggattgcagcacctaccctca

SEQ ID NO: 344739 - DNA, 25 bp, Mus musculus
gttaggcctgaggctgcttccgccc

SEQ ID NO: 344740 - DNA, 25 bp, Mus musculus
gttagggaaataattgttgcttgtg

SEQ ID NO: 344741 - DNA, 25 bp, Mus musculus
gttaggtgagaaagcagaagatacc

SEQ ID NO: 344742 - DNA, 25 bp, Mus musculus
gttagtacagatgcagacagccttt

SEQ ID NO: 344743 - DNA, 25 bp, Mus musculus
gttagtcctggcaggactttcctgg

SEQ ID NO: 344744 - DNA, 25 bp, Mus musculus
gttagtctcagaggatagctctcta

SEQ ID NO: 344745 - DNA, 25 bp, Mus musculus
gttagtgaccagatggttcagaact

SEQ ID NO: 344746 - DNA, 25 bp, Mus musculus
gttagtgaccagtaaaaggtacttt

SEQ ID NO: 344747 - DNA, 25 bp, Mus musculus
gttagtgacctgacgttgatgtcag

SEQ ID NO: 344748 - DNA, 25 bp, Mus musculus
gttagtgacctgactcctgggtgcc

SEQ ID NO: 344749 - DNA, 25 bp, Mus musculus
gttagtggaagaaagcacattgtag

SEQ ID NO: 344750 - DNA, 25 bp, Mus musculus
gttagtggccagggttgaagacaat

SEQ ID NO: 344751 - DNA, 25 bp, Mus musculus
gttagtggcggcttgacatctaggg

SEQ ID NO: 344752 - DNA, 25 bp, Mus musculus
gttagtgtcaatccctgatactgta

SEQ ID NO: 344753 - DNA, 25 bp, Mus musculus
gttataactgacaggtataaaaatc

SEQ ID NO: 344754 - DNA, 25 bp, Mus musculus
gttataccaaattcttctggaataa

SEQ ID NO: 344755 - DNA, 25 bp, Mus musculus
gttataccaaattgaaaagatatga

SEQ ID NO: 344756 - DNA, 25 bp, Mus musculus
gttatacctccggcttatacaactg

SEQ ID NO: 344757 - DNA, 25 bp, Mus musculus
gttatagactggcctcatctgttcc

SEQ ID NO: 344758 - DNA, 25 bp, Mus musculus
gttatagcacacatccagaacccag

SEQ ID NO: 344759 - DNA, 25 bp, Mus musculus
gttatagccagagaatgtattcttc

SEQ ID NO: 344760 - DNA, 25 bp, Mus musculus
gttatagccagataactggggtgag

SEQ ID NO: 344761 - DNA, 25 bp, Mus musculus
gttatagccaggatttcccagcctg

SEQ ID NO: 344762 - DNA, 25 bp, Mus musculus
gttatagccaggtctccagcagaag

SEQ ID NO: 344763 - DNA, 25 bp, Mus musculus
gttatataagaagcccctccaggcc

SEQ ID NO: 344764 - DNA, 25 bp, Mus musculus
gttatatatatggacatacatgttt

SEQ ID NO: 344765 - DNA, 25 bp, Mus musculus
gttatatatatggatttgttgctgt

SEQ ID NO: 344766 - DNA, 25 bp, Mus musculus
gttatatcaagttcaaaaggatgct

SEQ ID NO: 344767 - DNA, 25 bp, Mus musculus
gttatatcaggggtcggcacaagaa

SEQ ID NO: 344768 - DNA, 25 bp, Mus musculus
gttatatgaaagttacgagaagcag

SEQ ID NO: 344769 - DNA, 25 bp, Mus musculus
gttatatttgcctaaagacgtcaat

SEQ ID NO: 344770 - DNA, 25 bp, Mus musculus
gttatcaaagaggatgtctcggaac

SEQ ID NO: 344771 - DNA, 25 bp, Mus musculus
gttatcaaccgaacacagaagaatc

SEQ ID NO: 344772 - DNA, 25 bp, Mus musculus
gttatcacaagtgtgtgggataaga

SEQ ID NO: 344773 - DNA, 25 bp, Mus musculus
gttatcgctgcaggaacgtttggat

SEQ ID NO: 344774 - DNA, 25 bp, Mus musculus
gttatctaaggaaggaaaaccataa

SEQ ID NO: 344775 - DNA, 25 bp, Mus musculus
gttatctagtgccaggaaaatacta

SEQ ID NO: 344776 - DNA, 25 bp, Mus musculus
gttatctcacggcgaactttctgac

SEQ ID NO: 344777 - DNA, 25 bp, Mus musculus
gttatctcactatcctttgtgagat

SEQ ID NO: 344778 - DNA, 25 bp, Mus musculus
gttatctccagaagtgacagacagg

SEQ ID NO: 344779 - DNA, 25 bp, Mus musculus
gttatctccgggtctcactgttaga

SEQ ID NO: 344780 - DNA, 25 bp, Mus musculus
gttatctgaagaaagaatctgtgga

SEQ ID NO: 344781 - DNA, 25 bp, Mus musculus
gttatctgaaggttttctctgtata

SEQ ID NO: 344782 - DNA, 25 bp, Mus musculus
gttatctgcagaatgtgtatgcacc

SEQ ID NO: 344783 - DNA, 25 bp, Mus musculus
gttatgaaagacctgtgttgcgtgg

SEQ ID NO: 344784 - DNA, 25 bp, Mus musculus
gttatgaaatggcctcaaaccccct

SEQ ID NO: 344785 - DNA, 25 bp, Mus musculus
gttatgaagccagacaagttggcat

SEQ ID NO: 344786 - DNA, 25 bp, Mus musculus
gttatgaagccaggtccctcaaagt

SEQ ID NO: 344787 - DNA, 25 bp, Mus musculus
gttatgacaagcccgtctcgatact

SEQ ID NO: 344788 - DNA, 25 bp, Mus musculus
gttatgagcatcccgactttaagct

SEQ ID NO: 344789 - DNA, 25 bp, Mus musculus
gttatgataaggactatgtcagata

SEQ ID NO: 344790 - DNA, 25 bp, Mus musculus
gttatgataagtacatggagaggtt

SEQ ID NO: 344791 - DNA, 25 bp, Mus musculus
gttatgatgaggccaagcacgtgag

SEQ ID NO: 344792 - DNA, 25 bp, Mus musculus
gttatgcacaatcagagtcctcatt

SEQ ID NO: 344793 - DNA, 25 bp, Mus musculus
gttatgcattgagacgtccgagata

SEQ ID NO: 344794 - DNA, 25 bp, Mus musculus
gttatgccagaaacccttcactgaa

SEQ ID NO: 344795 - DNA, 25 bp, Mus musculus
gttatgccagtcaggatttgcacaa

SEQ ID NO: 344796 - DNA, 25 bp, Mus musculus
gttatgctccagagtgagagacttg

SEQ ID NO: 344797 - DNA, 25 bp, Mus musculus
gttatgctccagagtttcagttcct

SEQ ID NO: 344798 - DNA, 25 bp, Mus musculus
gttatgctccagccactctgctgat

SEQ ID NO: 344799 - DNA, 25 bp, Mus musculus
gttatgctgggaaagaatctgcatg

SEQ ID NO: 344800 - DNA, 25 bp, Mus musculus
gttatgctgggaaagggaattttaa

SEQ ID NO: 344801 - DNA, 25 bp, Mus musculus
gttatgggacctcaggtctgttgtg

SEQ ID NO: 344802 - DNA, 25 bp, Mus musculus
gttatgtcaggagttcaccttttcc

SEQ ID NO: 344803 - DNA, 25 bp, Mus musculus
gttatgtcagtatatgactgctgct

SEQ ID NO: 344804 - DNA, 25 bp, Mus musculus
gttatgtgaaataggtgagaagcca

SEQ ID NO: 344805 - DNA, 25 bp, Mus musculus
gttatgtgaaatagttttgggattt

SEQ ID NO: 344806 - DNA, 25 bp, Mus musculus
gttatgtttttgtgctgttgcttcc

SEQ ID NO: 344807 - DNA, 25 bp, Mus musculus
gttattccagcccaggaggaagaag

SEQ ID NO: 344808 - DNA, 25 bp, Mus musculus
gttattctcgatgaaacggacagga

SEQ ID NO: 344809 - DNA, 25 bp, Mus musculus
gttattctgcagaagataccgggac

SEQ ID NO: 344810 - DNA, 25 bp, Mus musculus
gttattctgcagaagggggactatg

SEQ ID NO: 344811 - DNA, 25 bp, Mus musculus
gttattgaaaggtgacattcccact

SEQ ID NO: 344812 - DNA, 25 bp, Mus musculus
gttattgaaggacctctcttgcctg

SEQ ID NO: 344813 - DNA, 25 bp, Mus musculus
gttattgagaaggagaacactgaag

SEQ ID NO: 344814 - DNA, 25 bp, Mus musculus
gttattgatgctgtaagaactaaaa

SEQ ID NO: 344815 - DNA, 25 bp, Mus musculus
gttattgctactgggggctacgggc

SEQ ID NO: 344816 - DNA, 25 bp, Mus musculus
gttattgctcggggtgacaaagact

SEQ ID NO: 344817 - DNA, 25 bp, Mus musculus
gttattggtggttttggctcgtgat

SEQ ID NO: 344818 - DNA, 25 bp, Mus musculus
gttattgtagacaggtactggcata

SEQ ID NO: 344819 - DNA, 25 bp, Mus musculus
gttattgtcagcaagcttcaggagc

SEQ ID NO: 344820 - DNA, 25 bp, Mus musculus
gttatttctccagagcgtgcccctg

SEQ ID NO: 344821 - DNA, 25 bp, Mus musculus
gttatttctccaggcttcacagaga

SEQ ID NO: 344822 - DNA, 25 bp, Mus musculus
gttattttggggaaggatattcagt

SEQ ID NO: 344823 - DNA, 25 bp, Mus musculus
gttcaaaacacacgaattgtcacaa

SEQ ID NO: 344824 - DNA, 25 bp, Mus musculus
gttcaaaaccaagattaattgcctg

SEQ ID NO: 344825 - DNA, 25 bp, Mus musculus
gttcaaaaggaggccacctatgaaa

SEQ ID NO: 344826 - DNA, 25 bp, Mus musculus
gttcaaaaggagtatgaaggcttag

SEQ ID NO: 344827 - DNA, 25 bp, Mus musculus
gttcaaaaggagtttgttgaaggat

SEQ ID NO: 344828 - DNA, 25 bp, Mus musculus
gttcaaacacaagttggaaatctac

SEQ ID NO: 344829 - DNA, 25 bp, Mus musculus
gttcaaacatacagctttgtaccct

SEQ ID NO: 344830 - DNA, 25 bp, Mus musculus
gttcaaacatccaggtggctctggt

SEQ ID NO: 344831 - DNA, 25 bp, Mus musculus
gttcaaacatgcccagttgcagaag

SEQ ID NO: 344832 - DNA, 25 bp, Mus musculus
gttcaaaccagtaggtgcaaactca

SEQ ID NO: 344833 - DNA, 25 bp, Mus musculus
gttcaaactgcctggaattacatga

SEQ ID NO: 344834 - DNA, 25 bp, Mus musculus
gttcaaactgcctgggtagtccatg

SEQ ID NO: 344835 - DNA, 25 bp, Mus musculus
gttcaaagatctaaatgcaaatgtg

SEQ ID NO: 344836 - DNA, 25 bp, Mus musculus
gttcaaagcatgattggagagagag

SEQ ID NO: 344837 - DNA, 25 bp, Mus musculus
gttcaaagcatgtcttttgctgatc

SEQ ID NO: 344838 - DNA, 25 bp, Mus musculus
gttcaaaggcaaaattcttccaaga

SEQ ID NO: 344839 - DNA, 25 bp, Mus musculus
gttcaaaggcaaagcttccctggtt

SEQ ID NO: 344840 - DNA, 25 bp, Mus musculus
gttcaaaggctaaaggtctgtacac

SEQ ID NO: 344841 - DNA, 25 bp, Mus musculus
gttcaaagttcccctggcctgggga

SEQ ID NO: 344842 - DNA, 25 bp, Mus musculus
gttcaaatcccaagttccgtgagga

SEQ ID NO: 344843 - DNA, 25 bp, Mus musculus
gttcaaatgcgcttaaaggatagca

SEQ ID NO: 344844 - DNA, 25 bp, Mus musculus
gttcaacaaacggtgtttgcctgca

SEQ ID NO: 344845 - DNA, 25 bp, Mus musculus
gttcaacaaacgttgacttgctggt

SEQ ID NO: 344846 - DNA, 25 bp, Mus musculus
gttcaacatcgtagagggagattca

SEQ ID NO: 344847 - DNA, 25 bp, Mus musculus
gttcaaccctgactctaaggggctc

SEQ ID NO: 344848 - DNA, 25 bp, Mus musculus
gttcaaccgggagaggtctgctctg

SEQ ID NO: 344849 - DNA, 25 bp, Mus musculus
gttcaaccgggagcaggaggacagg

SEQ ID NO: 344850 - DNA, 25 bp, Mus musculus
gttcaaccgggagcattctcagagc

SEQ ID NO: 344851 - DNA, 25 bp, Mus musculus
gttcaactgcgagatgaaatggaag

SEQ ID NO: 344852 - DNA, 25 bp, Mus musculus
gttcaacttcgctagttgatttatg

SEQ ID NO: 344853 - DNA, 25 bp, Mus musculus
gttcaacttctggtctcacccaaaa

SEQ ID NO: 344854 - DNA, 25 bp, Mus musculus
gttcaagaagcgaccttcctatgaa

SEQ ID NO: 344855 - DNA, 25 bp, Mus musculus
gttcaagacaagataagccgacaac

SEQ ID NO: 344856 - DNA, 25 bp, Mus musculus
gttcaagacgatctggctgaaagtg

SEQ ID NO: 344857 - DNA, 25 bp, Mus musculus
gttcaagcaaatggtattcatgcag

SEQ ID NO: 344858 - DNA, 25 bp, Mus musculus
gttcaagcaagaaggcacttgctat

SEQ ID NO: 344859 - DNA, 25 bp, Mus musculus
gttcaagcaagactgtacatttgca

SEQ ID NO: 344860 - DNA, 25 bp, Mus musculus
gttcaagcaagtaaaccggcctcag

SEQ ID NO: 344861 - DNA, 25 bp, Mus musculus
gttcaagccattgctgcatgcctgt

SEQ ID NO: 344862 - DNA, 25 bp, Mus musculus
gttcaagccattgcttttgggactc

SEQ ID NO: 344863 - DNA, 25 bp, Mus musculus
gttcaaggagaagaagaaaaagtca

SEQ ID NO: 344864 - DNA, 25 bp, Mus musculus
gttcaaggccaagatccgggacttg

SEQ ID NO: 344865 - DNA, 25 bp, Mus musculus
gttcaaggccaagggtctactatac

SEQ ID NO: 344866 - DNA, 25 bp, Mus musculus
gttcaaggcgacaatgttctcaaac

SEQ ID NO: 344867 - DNA, 25 bp, Mus musculus
gttcaagggcagtgggtgctggtct

SEQ ID NO: 344868 - DNA, 25 bp, Mus musculus
gttcaagggctcttgctgttccggg

SEQ ID NO: 344869 - DNA, 25 bp, Mus musculus
gttcaagggctcttgggcagcgctc

SEQ ID NO: 344870 - DNA, 25 bp, Mus musculus
gttcaaggtcgaacacatgggtcgg

SEQ ID NO: 344871 - DNA, 25 bp, Mus musculus
gttcaagtccttggaaattagaagg

SEQ ID NO: 344872 - DNA, 25 bp, Mus musculus
gttcaagtccttggaccatggtatc

SEQ ID NO: 344873 - DNA, 25 bp, Mus musculus
gttcaagtgaaagaggtcaaccgga

SEQ ID NO: 344874 - DNA, 25 bp, Mus musculus
gttcaagtttgagctgggaagatgc

SEQ ID NO: 344875 - DNA, 25 bp, Mus musculus
gttcaatgagcggtttgagtgggat

SEQ ID NO: 344876 - DNA, 25 bp, Mus musculus
gttcaatggccagaagcaccaagaa

SEQ ID NO: 344877 - DNA, 25 bp, Mus musculus
gttcaatggccaggtcaggagttta

SEQ ID NO: 344878 - DNA, 25 bp, Mus musculus
gttcaattccagccatattgatgga

SEQ ID NO: 344879 - DNA, 25 bp, Mus musculus
gttcaattcccggacggcctatgca

SEQ ID NO: 344880 - DNA, 25 bp, Mus musculus
gttcacacagcagaaagtgtcaccg

SEQ ID NO: 344881 - DNA, 25 bp, Mus musculus
gttcacacaggagtgccaggaggta

SEQ ID NO: 344882 - DNA, 25 bp, Mus musculus
gttcacacctaagatggaacagcta

SEQ ID NO: 344883 - DNA, 25 bp, Mus musculus
gttcacacctaagattgagcagcta

SEQ ID NO: 344884 - DNA, 25 bp, Mus musculus
gttcacagagatcccagaaaccggc

SEQ ID NO: 344885 - DNA, 25 bp, Mus musculus
gttcacagcagatgtaaagaacatg

SEQ ID NO: 344886 - DNA, 25 bp, Mus musculus
gttcacagcagcacatccctacaaa

SEQ ID NO: 344887 - DNA, 25 bp, Mus musculus
gttcacagcaggtgcccagggaagc

SEQ ID NO: 344888 - DNA, 25 bp, Mus musculus
gttcacagcaggtttaaaaaataca

SEQ ID NO: 344889 - DNA, 25 bp, Mus musculus
gttcacatcaacaggaacgtcatcc

SEQ ID NO: 344890 - DNA, 25 bp, Mus musculus
gttcacatcagcaggaacgtcatcc

SEQ ID NO: 344891 - DNA, 25 bp, Mus musculus
gttcacatcagcagtgcctgcagaa

SEQ ID NO: 344892 - DNA, 25 bp, Mus musculus
gttcaccaagatatttatcaacaac

SEQ ID NO: 344893 - DNA, 25 bp, Mus musculus
gttcaccacacagacagaggagctg

SEQ ID NO: 344894 - DNA, 25 bp, Mus musculus
gttcaccacacagacagaggagttg

SEQ ID NO: 344895 - DNA, 25 bp, Mus musculus
gttcaccacagtgactccataccaa

SEQ ID NO: 344896 - DNA, 25 bp, Mus musculus
gttcaccagacagaacttctgtggg

SEQ ID NO: 344897 - DNA, 25 bp, Mus musculus
gttcaccagacagggcacgttctca

SEQ ID NO: 344898 - DNA, 25 bp, Mus musculus
gttcaccaggagctggaatttggag

SEQ ID NO: 344899 - DNA, 25 bp, Mus musculus
gttcaccaggcaggcagtacaggcc

SEQ ID NO: 344900 - DNA, 25 bp, Mus musculus
gttcaccaggcaggtaagcttcaag

SEQ ID NO: 344901 - DNA, 25 bp, Mus musculus
gttcaccatgagagggtgtggaccg

SEQ ID NO: 344902 - DNA, 25 bp, Mus musculus
gttcacccgagtcccctgagggatc

SEQ ID NO: 344903 - DNA, 25 bp, Mus musculus
gttcacccggaaggccctcaatgac

SEQ ID NO: 344904 - DNA, 25 bp, Mus musculus
gttcacggtcaccaggccattccaa

SEQ ID NO: 344905 - DNA, 25 bp, Mus musculus
gttcactaccctcccaaactggcct

SEQ ID NO: 344906 - DNA, 25 bp, Mus musculus
gttcactagctgggtacctcttgtg

SEQ ID NO: 344907 - DNA, 25 bp, Mus musculus
gttcactatgaagattcacagacac

SEQ ID NO: 344908 - DNA, 25 bp, Mus musculus
gttcactcaagagttcacaagccag

SEQ ID NO: 344909 - DNA, 25 bp, Mus musculus
gttcactcaaggagctctgtgaatc

SEQ ID NO: 344910 - DNA, 25 bp, Mus musculus
gttcactcagaggcagccatggaac

SEQ ID NO: 344911 - DNA, 25 bp, Mus musculus
gttcactccaatgatggcactcaga

SEQ ID NO: 344912 - DNA, 25 bp, Mus musculus
gttcactctagagtcttttattcaa

SEQ ID NO: 344913 - DNA, 25 bp, Mus musculus
gttcactgaacagacagctccgaag

SEQ ID NO: 344914 - DNA, 25 bp, Mus musculus
gttcactgaggcagttgcacctgaa

SEQ ID NO: 344915 - DNA, 25 bp, Mus musculus
gttcactgatgaggcatcaatactt

SEQ ID NO: 344916 - DNA, 25 bp, Mus musculus
gttcactgggaaaaggtaaatgttg

SEQ ID NO: 344917 - DNA, 25 bp, Mus musculus
gttcactgggaaaaggtggcagtgg

SEQ ID NO: 344918 - DNA, 25 bp, Mus musculus
gttcactgggaaaagtgagccccag

SEQ ID NO: 344919 - DNA, 25 bp, Mus musculus
gttcactgtcaagtcaagactgttg

SEQ ID NO: 344920 - DNA, 25 bp, Mus musculus
gttcactgtcattagaccatttcca

SEQ ID NO: 344921 - DNA, 25 bp, Mus musculus
gttcactgtggaagtggtcccaacc

SEQ ID NO: 344922 - DNA, 25 bp, Mus musculus
gttcacttcaggtattgacctcatg

SEQ ID NO: 344923 - DNA, 25 bp, Mus musculus
gttcacttcaggtgtggacctcgtt

SEQ ID NO: 344924 - DNA, 25 bp, Mus musculus
gttcacttgcaggtgttgtttgtgg

SEQ ID NO: 344925 - DNA, 25 bp, Mus musculus
gttcacttgcagtcgagcaaaagac

SEQ ID NO: 344926 - DNA, 25 bp, Mus musculus
gttcactttggaagagctcattgcc

SEQ ID NO: 344927 - DNA, 25 bp, Mus musculus
gttcactttggaggaatgggagggc

SEQ ID NO: 344928 - DNA, 25 bp, Mus musculus
gttcactttgtgctggaaggcgctt

SEQ ID NO: 344929 - DNA, 25 bp, Mus musculus
gttcactttgtgctgggaaagagta

SEQ ID NO: 344930 - DNA, 25 bp, Mus musculus
gttcacttttcagtatatatggtct

SEQ ID NO: 344931 - DNA, 25 bp, Mus musculus
gttcagaaaacagcatcaaggatga

SEQ ID NO: 344932 - DNA, 25 bp, Mus musculus
gttcagaaaacaggtaaaggctatt

SEQ ID NO: 344933 - DNA, 25 bp, Mus musculus
gttcagaaaagttggactacatctg

SEQ ID NO: 344934 - DNA, 25 bp, Mus musculus
gttcagaaaccatggtcgcttatac

SEQ ID NO: 344935 - DNA, 25 bp, Mus musculus
gttcagaaaccatgtctcgaagata

SEQ ID NO: 344936 - DNA, 25 bp, Mus musculus
gttcagaaagcgctcctgttatctc

SEQ ID NO: 344937 - DNA, 25 bp, Mus musculus
gttcagaaaggagctcttaccaaag

SEQ ID NO: 344938 - DNA, 25 bp, Mus musculus
gttcagaaccgcgtgttgatcgtgt

SEQ ID NO: 344939 - DNA, 25 bp, Mus musculus
gttcagaacgatcatccagcccctc

SEQ ID NO: 344940 - DNA, 25 bp, Mus musculus
gttcagaagaggatgactgagtggg

SEQ ID NO: 344941 - DNA, 25 bp, Mus musculus
gttcagaagggccagctgacgagtt

SEQ ID NO: 344942 - DNA, 25 bp, Mus musculus
gttcagagacctcaacgaatccgtg

SEQ ID NO: 344943 - DNA, 25 bp, Mus musculus
gttcagagatggtggagactgagaa

SEQ ID NO: 344944 - DNA, 25 bp, Mus musculus
gttcagagctggcttccatggagat

SEQ ID NO: 344945 - DNA, 25 bp, Mus musculus
gttcagatactgaatgaatctgagc

SEQ ID NO: 344946 - DNA, 25 bp, Mus musculus
gttcagatttcacagagacagccat

SEQ ID NO: 344947 - DNA, 25 bp, Mus musculus
gttcagcaagctttgcagccagctg

SEQ ID NO: 344948 - DNA, 25 bp, Mus musculus
gttcagcaaggtttacagtagcatg

SEQ ID NO: 344949 - DNA, 25 bp, Mus musculus
gttcagcagaggagacagcagtggt

SEQ ID NO: 344950 - DNA, 25 bp, Mus musculus
gttcagcaggataaaggcataatca

SEQ ID NO: 344951 - DNA, 25 bp, Mus musculus
gttcagccaggagggagcggacatg

SEQ ID NO: 344952 - DNA, 25 bp, Mus musculus
gttcagccaggttgcattgaaggcc

SEQ ID NO: 344953 - DNA, 25 bp, Mus musculus
gttcagcgggtcaggtatatgcacc

SEQ ID NO: 344954 - DNA, 25 bp, Mus musculus
gttcagcgggtcaggtatggatgag

SEQ ID NO: 344955 - DNA, 25 bp, Mus musculus
gttcagcggttacaggatgagctga

SEQ ID NO: 344956 - DNA, 25 bp, Mus musculus
gttcagcggttacagggtcttactt

SEQ ID NO: 344957 - DNA, 25 bp, Mus musculus
gttcagctcctacctccttcttcag

SEQ ID NO: 344958 - DNA, 25 bp, Mus musculus
gttcaggaagctgatttcacaatat

SEQ ID NO: 344959 - DNA, 25 bp, Mus musculus
gttcaggaaggtgcagacacaagtc

SEQ ID NO: 344960 - DNA, 25 bp, Mus musculus
gttcaggagatggtaaccaagtcaa

SEQ ID NO: 344961 - DNA, 25 bp, Mus musculus
gttcaggatgaagaactacaaagca

SEQ ID NO: 344962 - DNA, 25 bp, Mus musculus
gttcaggatgaagaggagaagacac

SEQ ID NO: 344963 - DNA, 25 bp, Mus musculus
gttcaggatgtcgagatgcagatct

SEQ ID NO: 344964 - DNA, 25 bp, Mus musculus
gttcaggatgtcgaggtacggtcag

SEQ ID NO: 344965 - DNA, 25 bp, Mus musculus
gttcaggcagctgtgctcactgctc

SEQ ID NO: 344966 - DNA, 25 bp, Mus musculus
gttcaggcaggtaatgccatcatgg

SEQ ID NO: 344967 - DNA, 25 bp, Mus musculus
gttcaggcctttcagagacgaagag

SEQ ID NO: 344968 - DNA, 25 bp, Mus musculus
gttcaggcttcaggtgcaggtcctg

SEQ ID NO: 344969 - DNA, 25 bp, Mus musculus
gttcagggaagaatcggtttctggt

SEQ ID NO: 344970 - DNA, 25 bp, Mus musculus
gttcagggattacagtgctgtgctc

SEQ ID NO: 344971 - DNA, 25 bp, Mus musculus
gttcagggcagctctcagggcctgt

SEQ ID NO: 344972 - DNA, 25 bp, Mus musculus
gttcagggcctggacagccacttcc

SEQ ID NO: 344973 - DNA, 25 bp, Mus musculus
gttcagggtgatgctctcccagtgt

SEQ ID NO: 344974 - DNA, 25 bp, Mus musculus
gttcaggtacaagattgagaaatgg

SEQ ID NO: 344975 - DNA, 25 bp, Mus musculus
gttcaggtgttaggggatgctggca

SEQ ID NO: 344976 - DNA, 25 bp, Mus musculus
gttcaggttctgagaaaacctatcc

SEQ ID NO: 344977 - DNA, 25 bp, Mus musculus
gttcagtcaaggacagtggccttag

SEQ ID NO: 344978 - DNA, 25 bp, Mus musculus
gttcagtctcaccggctggggagag

SEQ ID NO: 344979 - DNA, 25 bp, Mus musculus
gttcagtgacagattgctgttcttc

SEQ ID NO: 344980 - DNA, 25 bp, Mus musculus
gttcagtgaccacgctgtgttgaca

SEQ ID NO: 344981 - DNA, 25 bp, Mus musculus
gttcagtgaccacggggtaaaggcc

SEQ ID NO: 344982 - DNA, 25 bp, Mus musculus
gttcagtgatgacttggatgttgtg

SEQ ID NO: 344983 - DNA, 25 bp, Mus musculus
gttcagtgcccacccgagtcattcg

SEQ ID NO: 344984 - DNA, 25 bp, Mus musculus
gttcagttaatggaatcttctgaga

SEQ ID NO: 344985 - DNA, 25 bp, Mus musculus
gttcagttcaaagatctaaatgcaa

SEQ ID NO: 344986 - DNA, 25 bp, Mus musculus
gttcagttggatgaaaattccaagt

SEQ ID NO: 344987 - DNA, 25 bp, Mus musculus
gttcagtttgataccggatggtgga

SEQ ID NO: 344988 - DNA, 25 bp, Mus musculus
gttcataaacaagatgaaattatag

SEQ ID NO: 344989 - DNA, 25 bp, Mus musculus
gttcataaacaaggtcgctggtcat

SEQ ID NO: 344990 - DNA, 25 bp, Mus musculus
gttcataaacttgttcaagccatat

SEQ ID NO: 344991 - DNA, 25 bp, Mus musculus
gttcataatcaaggcgtatgggcaa

SEQ ID NO: 344992 - DNA, 25 bp, Mus musculus
gttcataccaggttgtaagcatcaa

SEQ ID NO: 344993 - DNA, 25 bp, Mus musculus
gttcatacctcgagaattatagtga

SEQ ID NO: 344994 - DNA, 25 bp, Mus musculus
gttcatatcagatgttttccagcaa

SEQ ID NO: 344995 - DNA, 25 bp, Mus musculus
gttcatatcagtggaacacatttcc

SEQ ID NO: 344996 - DNA, 25 bp, Mus musculus
gttcatcaaactttcatggatcgct

SEQ ID NO: 344997 - DNA, 25 bp, Mus musculus
gttcatcacgactgtgcaacagcgt

SEQ ID NO: 344998 - DNA, 25 bp, Mus musculus
gttcatcacgctcctgcccaatgag

SEQ ID NO: 344999 - DNA, 25 bp, Mus musculus
gttcatcagaggagattgaagggcg

SEQ ID NO: 345000 - DNA, 25 bp, Mus musculus
gttcatcagcacagaccggggagct

SEQ ID NO: 345001 - DNA, 25 bp, Mus musculus
gttcatcatcccaggagtgttacta

SEQ ID NO: 345002 - DNA, 25 bp, Mus musculus
gttcatcatcccagtcttcatcagc

SEQ ID NO: 345003 - DNA, 25 bp, Mus musculus
gttcatccagtgagaaaattgtaca

SEQ ID NO: 345004 - DNA, 25 bp, Mus musculus
gttcatccagtgaggaatcttccga

SEQ ID NO: 345005 - DNA, 25 bp, Mus musculus
gttcatccatacatccagaacccag

SEQ ID NO: 345006 - DNA, 25 bp, Mus musculus
gttcatccccacagataattctgaa

SEQ ID NO: 345007 - DNA, 25 bp, Mus musculus
gttcatccccacagggtcagttttg

SEQ ID NO: 345008 - DNA, 25 bp, Mus musculus
gttcatccccacagtacccatgatg

SEQ ID NO: 345009 - DNA, 25 bp, Mus musculus
gttcatcctgactatgcggcgcagg

SEQ ID NO: 345010 - DNA, 25 bp, Mus musculus
gttcatcctgccagagactatgcgg

SEQ ID NO: 345011 - DNA, 25 bp, Mus musculus
gttcatcgagccgagatgaaaccag

SEQ ID NO: 345012 - DNA, 25 bp, Mus musculus
gttcatcgataccgtgatgcaattg

SEQ ID NO: 345013 - DNA, 25 bp, Mus musculus
gttcatcgtcgctgcaaaatacaac

SEQ ID NO: 345014 - DNA, 25 bp, Mus musculus
gttcatctgtttcaaatcccagaaa

SEQ ID NO: 345015 - DNA, 25 bp, Mus musculus
gttcatctgtttcaagaagatctgc

SEQ ID NO: 345016 - DNA, 25 bp, Mus musculus
gttcatgaaagatcgattatatttt

SEQ ID NO: 345017 - DNA, 25 bp, Mus musculus
gttcatgaacacccagtattttgga

SEQ ID NO: 345018 - DNA, 25 bp, Mus musculus
gttcatgaaggaagcgggtgcagct

SEQ ID NO: 345019 - DNA, 25 bp, Mus musculus
gttcatgaaggaggatttcgatgtg

SEQ ID NO: 345020 - DNA, 25 bp, Mus musculus
gttcatgacaagtgggccaatccga

SEQ ID NO: 345021 - DNA, 25 bp, Mus musculus
gttcatgacgccaggatcccatttt

SEQ ID NO: 345022 - DNA, 25 bp, Mus musculus
gttcatgacggagcgaaatacttaa

SEQ ID NO: 345023 - DNA, 25 bp, Mus musculus
gttcatgagttaaggcgtcgaggtg

SEQ ID NO: 345024 - DNA, 25 bp, Mus musculus
gttcatgataagtgcacaaagaaga

SEQ ID NO: 345025 - DNA, 25 bp, Mus musculus
gttcatgatggattgggtcgaaaag

SEQ ID NO: 345026 - DNA, 25 bp, Mus musculus
gttcatgatgtgaccctggacaaac

SEQ ID NO: 345027 - DNA, 25 bp, Mus musculus
gttcatgcactttgccacaggcatg

SEQ ID NO: 345028 - DNA, 25 bp, Mus musculus
gttcatgggagaagggcaggtttat

SEQ ID NO: 345029 - DNA, 25 bp, Mus musculus
gttcatgggagaggggtaactatcc

SEQ ID NO: 345030 - DNA, 25 bp, Mus musculus
gttcattccggctagccctgctcct

SEQ ID NO: 345031 - DNA, 25 bp, Mus musculus
gttcattcgaattgggcggcggcca

SEQ ID NO: 345032 - DNA, 25 bp, Mus musculus
gttcattctaataaggagtggagtc

SEQ ID NO: 345033 - DNA, 25 bp, Mus musculus
gttcattgagtgcaggaatttgacg

SEQ ID NO: 345034 - DNA, 25 bp, Mus musculus
gttcattgagtgcaggcttggctgt

SEQ ID NO: 345035 - DNA, 25 bp, Mus musculus
gttcattttcaaaagaaacagcaac

SEQ ID NO: 345036 - DNA, 25 bp, Mus musculus
gttcattttgaaacacgagaagccc

SEQ ID NO: 345037 - DNA, 25 bp, Mus musculus
gttccaaaagctgccgcagtggcaa

SEQ ID NO: 345038 - DNA, 25 bp, Mus musculus
gttccaacagactggattttgggac

SEQ ID NO: 345039 - DNA, 25 bp, Mus musculus
gttccaacagtctgatgatttgaag

SEQ ID NO: 345040 - DNA, 25 bp, Mus musculus
gttccaaccccgatgctctgaaccc

SEQ ID NO: 345041 - DNA, 25 bp, Mus musculus
gttccaactggggcacttccccact

SEQ ID NO: 345042 - DNA, 25 bp, Mus musculus
gttccaactgtctaaattgatcagg

SEQ ID NO: 345043 - DNA, 25 bp, Mus musculus
gttccaagaaaggtgcttacagaca

SEQ ID NO: 345044 - DNA, 25 bp, Mus musculus
gttccaagagaagagcgcctccctg

SEQ ID NO: 345045 - DNA, 25 bp, Mus musculus
gttccaagagaagagtgcttccctg

SEQ ID NO: 345046 - DNA, 25 bp, Mus musculus
gttccaagagaagagtgcttcgctg

SEQ ID NO: 345047 - DNA, 25 bp, Mus musculus
gttccaagagcaggtcaccgacaat

SEQ ID NO: 345048 - DNA, 25 bp, Mus musculus
gttccaagaggtgggatgctatgga

SEQ ID NO: 345049 - DNA, 25 bp, Mus musculus
gttccaagcagcatgggtcggagcc

SEQ ID NO: 345050 - DNA, 25 bp, Mus musculus
gttccacacccaggttctgattgga

SEQ ID NO: 345051 - DNA, 25 bp, Mus musculus
gttccacagaggttctatggtacag

SEQ ID NO: 345052 - DNA, 25 bp, Mus musculus
gttccaccaggcagcatctgaggac

SEQ ID NO: 345053 - DNA, 25 bp, Mus musculus
gttccaccaggctgggccggtaata

SEQ ID NO: 345054 - DNA, 25 bp, Mus musculus
gttccaccagtatttgaggcagaga

SEQ ID NO: 345055 - DNA, 25 bp, Mus musculus
gttccaccccacaggtatatacggt

SEQ ID NO: 345056 - DNA, 25 bp, Mus musculus
gttccacgccccatggtgtggacat

SEQ ID NO: 345057 - DNA, 25 bp, Mus musculus
gttccacgcctgattctggcaggtg

SEQ ID NO: 345058 - DNA, 25 bp, Mus musculus
gttccactcctagctccaccccccg

SEQ ID NO: 345059 - DNA, 25 bp, Mus musculus
gttccactgtagtcacagtaatgaa

SEQ ID NO: 345060 - DNA, 25 bp, Mus musculus
gttccagaaagtgatcacagaatac

SEQ ID NO: 345061 - DNA, 25 bp, Mus musculus
gttccagaagaagaaataaagtgga

SEQ ID NO: 345062 - DNA, 25 bp, Mus musculus
gttccagaggaggtactacaagcct

SEQ ID NO: 345063 - DNA, 25 bp, Mus musculus
gttccagataactgcctttgtacct

SEQ ID NO: 345064 - DNA, 25 bp, Mus musculus
gttccagcaaccagaatttcagctt

SEQ ID NO: 345065 - DNA, 25 bp, Mus musculus
gttccagcagaagtacgatggaatc

SEQ ID NO: 345066 - DNA, 25 bp, Mus musculus
gttccaggaggaagaagactcagaa

SEQ ID NO: 345067 - DNA, 25 bp, Mus musculus
gttccaggcggggtacatggcttct

SEQ ID NO: 345068 - DNA, 25 bp, Mus musculus
gttccaggcggggttaaactcactt

SEQ ID NO: 345069 - DNA, 25 bp, Mus musculus
gttccaggggatccaggaccagatg

SEQ ID NO: 345070 - DNA, 25 bp, Mus musculus
gttccagtactttgtgacaggtgtg

SEQ ID NO: 345071 - DNA, 25 bp, Mus musculus
gttccagttgcagattgaacttcat

SEQ ID NO: 345072 - DNA, 25 bp, Mus musculus
gttccagttgcagcaggtactctga

SEQ ID NO: 345073 - DNA, 25 bp, Mus musculus
gttccagttgcaggtacaacataag

SEQ ID NO: 345074 - DNA, 25 bp, Mus musculus
gttccagtttgctaagaactttgtt

SEQ ID NO: 345075 - DNA, 25 bp, Mus musculus
gttccataagtttggatgatttacc

SEQ ID NO: 345076 - DNA, 25 bp, Mus musculus
gttccataatgcagggcacaccaag

SEQ ID NO: 345077 - DNA, 25 bp, Mus musculus
gttccatacacaggctcatcagcag

SEQ ID NO: 345078 - DNA, 25 bp, Mus musculus
gttccatcaagggaagaaggatgca

SEQ ID NO: 345079 - DNA, 25 bp, Mus musculus
gttccatcacccagggcaccccact

SEQ ID NO: 345080 - DNA, 25 bp, Mus musculus
gttccatgccggcaaagtgcaaaca

SEQ ID NO: 345081 - DNA, 25 bp, Mus musculus
gttccatgtggatgctgcctggggt

SEQ ID NO: 345082 - DNA, 25 bp, Mus musculus
gttccatgtggatggctgactctgt

SEQ ID NO: 345083 - DNA, 25 bp, Mus musculus
gttccattacaagaccgaccagggc

SEQ ID NO: 345084 - DNA, 25 bp, Mus musculus
gttccattgactaggccagggtcac

SEQ ID NO: 345085 - DNA, 25 bp, Mus musculus
gttccatttcccagggcacaccaat

SEQ ID NO: 345086 - DNA, 25 bp, Mus musculus
gttcccaaaccaaaagttgatgtag

SEQ ID NO: 345087 - DNA, 25 bp, Mus musculus
gttcccaaagagatgcacgggaata

SEQ ID NO: 345088 - DNA, 25 bp, Mus musculus
gttcccaacggggttaagcctgatc

SEQ ID NO: 345089 - DNA, 25 bp, Mus musculus
gttcccaagcagcagcaggctgtgg

SEQ ID NO: 345090 - DNA, 25 bp, Mus musculus
gttcccaaggacttgtactggtttc

SEQ ID NO: 345091 - DNA, 25 bp, Mus musculus
gttcccaagtcggatgtggaaatgg

SEQ ID NO: 345092 - DNA, 25 bp, Mus musculus
gttcccaagtcggttaacagtgatg

SEQ ID NO: 345093 - DNA, 25 bp, Mus musculus
gttcccaatgatctgattggctgtg

SEQ ID NO: 345094 - DNA, 25 bp, Mus musculus
gttcccaatgatggcagcaagatca

SEQ ID NO: 345095 - DNA, 25 bp, Mus musculus
gttcccacagatgaagtgtcctata

SEQ ID NO: 345096 - DNA, 25 bp, Mus musculus
gttcccacagatggaacagattctg

SEQ ID NO: 345097 - DNA, 25 bp, Mus musculus
gttcccactgggcctgaagtggagg

SEQ ID NO: 345098 - DNA, 25 bp, Mus musculus
gttcccactggggctgaagtggagg

SEQ ID NO: 345099 - DNA, 25 bp, Mus musculus
gttcccagaaagccccgcagcccta

SEQ ID NO: 345100 - DNA, 25 bp, Mus musculus
gttcccagaacaagactgagaatca

SEQ ID NO: 345101 - DNA, 25 bp, Mus musculus
gttcccagaacaagattactactca

SEQ ID NO: 345102 - DNA, 25 bp, Mus musculus
gttcccagggcagcccagcaagacg

SEQ ID NO: 345103 - DNA, 25 bp, Mus musculus
gttcccagtcagacactgcatatgc

SEQ ID NO: 345104 - DNA, 25 bp, Mus musculus
gttcccagtcagagctctgaacatg

SEQ ID NO: 345105 - DNA, 25 bp, Mus musculus
gttcccatgttgttgctggttgttg

SEQ ID NO: 345106 - DNA, 25 bp, Mus musculus
gttcccattccttcaaaaagagtga

SEQ ID NO: 345107 - DNA, 25 bp, Mus musculus
gttcccattcttcaggtgttgggaa

SEQ ID NO: 345108 - DNA, 25 bp, Mus musculus
gttccccaagttcaggaagaagcac

SEQ ID NO: 345109 - DNA, 25 bp, Mus musculus
gttccccaagttcaggagctctgca

SEQ ID NO: 345110 - DNA, 25 bp, Mus musculus
gttccccagacacagaaagccatca

SEQ ID NO: 345111 - DNA, 25 bp, Mus musculus
gttccccgcagaagacctccttccc

SEQ ID NO: 345112 - DNA, 25 bp, Mus musculus
gttcccgacgctcctgcgttctatg

SEQ ID NO: 345113 - DNA, 25 bp, Mus musculus
gttcccgacggtgacaaacttgaag

SEQ ID NO: 345114 - DNA, 25 bp, Mus musculus
gttcccgacggttttggctatggaa

SEQ ID NO: 345115 - DNA, 25 bp, Mus musculus
gttcccgatccaggtctctgagtgt

SEQ ID NO: 345116 - DNA, 25 bp, Mus musculus
gttcccgattgcagcgtgcccttga

SEQ ID NO: 345117 - DNA, 25 bp, Mus musculus
gttcccgcaacaggtgacccaatga

SEQ ID NO: 345118 - DNA, 25 bp, Mus musculus
gttcccgcctggtctctctgggatc

SEQ ID NO: 345119 - DNA, 25 bp, Mus musculus
gttcccgctgagacgtaggcaattt

SEQ ID NO: 345120 - DNA, 25 bp, Mus musculus
gttcccgctgagctcccgccatcct

SEQ ID NO: 345121 - DNA, 25 bp, Mus musculus
gttcccgctgaggtcccgccatcct

SEQ ID NO: 345122 - DNA, 25 bp, Mus musculus
gttcccgctgagtcgtaggcaattt

SEQ ID NO: 345123 - DNA, 25 bp, Mus musculus
gttcccggctgtcactgagcactgg

SEQ ID NO: 345124 - DNA, 25 bp, Mus musculus
gttccctcatcaatggtgaacaacc

SEQ ID NO: 345125 - DNA, 25 bp, Mus musculus
gttccctccactggttggaagaggc

SEQ ID NO: 345126 - DNA, 25 bp, Mus musculus
gttccctccggatggttcagccccc

SEQ ID NO: 345127 - DNA, 25 bp, Mus musculus
gttccctcctggccttcccagaggc

SEQ ID NO: 345128 - DNA, 25 bp, Mus musculus
gttccctctcagggtgcgggtagcg

SEQ ID NO: 345129 - DNA, 25 bp, Mus musculus
gttccctgatcacaaagcagaccca

SEQ ID NO: 345130 - DNA, 25 bp, Mus musculus
gttccctggatgagcaagaaggagt

SEQ ID NO: 345131 - DNA, 25 bp, Mus musculus
gttccctgtcctaggtagcagaggc

SEQ ID NO: 345132 - DNA, 25 bp, Mus musculus
gttcccttcaaggcatgagagaatt

SEQ ID NO: 345133 - DNA, 25 bp, Mus musculus
gttcccttctggccttcccagaggc

SEQ ID NO: 345134 - DNA, 25 bp, Mus musculus
gttcccttgagacaccagagaagaa

SEQ ID NO: 345135 - DNA, 25 bp, Mus musculus
gttccctttgcatcactggctcacc

SEQ ID NO: 345136 - DNA, 25 bp, Mus musculus
gttccgaaagaactggaataagtgg

SEQ ID NO: 345137 - DNA, 25 bp, Mus musculus
gttccgaaagaagtggaataagtgg

SEQ ID NO: 345138 - DNA, 25 bp, Mus musculus
gttccgaagcgcctccctcttgatg

SEQ ID NO: 345139 - DNA, 25 bp, Mus musculus
gttccgaagcgcggtcaacatggct

SEQ ID NO: 345140 - DNA, 25 bp, Mus musculus
gttccgagaagccagctggagattc

SEQ ID NO: 345141 - DNA, 25 bp, Mus musculus
gttccgagaccagacccctgagcag

SEQ ID NO: 345142 - DNA, 25 bp, Mus musculus
gttccgattcctaggggtgttattg

SEQ ID NO: 345143 - DNA, 25 bp, Mus musculus
gttccgcaaggaggtgctggctcag

SEQ ID NO: 345144 - DNA, 25 bp, Mus musculus
gttccgcccaagttggtcacaatgg

SEQ ID NO: 345145 - DNA, 25 bp, Mus musculus
gttccgcgacgccggtgccttcgcc

SEQ ID NO: 345146 - DNA, 25 bp, Mus musculus
gttccgcgcgcttgggaccgcgttg

SEQ ID NO: 345147 - DNA, 25 bp, Mus musculus
gttccgcgcggagaatgactcagga

SEQ ID NO: 345148 - DNA, 25 bp, Mus musculus
gttccggaagctgcagcttcaacca

SEQ ID NO: 345149 - DNA, 25 bp, Mus musculus
gttccggaaggttccatgatggagt

SEQ ID NO: 345150 - DNA, 25 bp, Mus musculus
gttccggacagccagcccaggctat

SEQ ID NO: 345151 - DNA, 25 bp, Mus musculus
gttccggacagccaggcctctgggg

SEQ ID NO: 345152 - DNA, 25 bp, Mus musculus
gttccggaccatcacccttcagagt

SEQ ID NO: 345153 - DNA, 25 bp, Mus musculus
gttccggacctatgagtgtgatcca

SEQ ID NO: 345154 - DNA, 25 bp, Mus musculus
gttccgggcagggatttcagccatg

SEQ ID NO: 345155 - DNA, 25 bp, Mus musculus
gttccgggtccaggcactttctagg

SEQ ID NO: 345156 - DNA, 25 bp, Mus musculus
gttccggtcattaggttcaaccaga

SEQ ID NO: 345157 - DNA, 25 bp, Mus musculus
gttccggttcggattctgtgtcttt

SEQ ID NO: 345158 - DNA, 25 bp, Mus musculus
gttccggtttgcaggagagagggag

SEQ ID NO: 345159 - DNA, 25 bp, Mus musculus
gttccgtgagggaaaagaagaccag

SEQ ID NO: 345160 - DNA, 25 bp, Mus musculus
gttccgttggcagaagccatcccga

SEQ ID NO: 345161 - DNA, 25 bp, Mus musculus
gttccgttggcgtctccaaggccga

SEQ ID NO: 345162 - DNA, 25 bp, Mus musculus
gttccgttgggatccgcgcgggccc

SEQ ID NO: 345163 - DNA, 25 bp, Mus musculus
gttcctaaacccagctggtgccagc

SEQ ID NO: 345164 - DNA, 25 bp, Mus musculus
gttcctaacactaatgagcgagtga

SEQ ID NO: 345165 - DNA, 25 bp, Mus musculus
gttcctacacaaaaagctgttcagc

SEQ ID NO: 345166 - DNA, 25 bp, Mus musculus
gttcctacctccagactttggttct

SEQ ID NO: 345167 - DNA, 25 bp, Mus musculus
gttcctacctccagaggttggcgat

SEQ ID NO: 345168 - DNA, 25 bp, Mus musculus
gttcctacctccagatttaggtcgc

SEQ ID NO: 345169 - DNA, 25 bp, Mus musculus
gttcctacctccaggcacttagcgc

SEQ ID NO: 345170 - DNA, 25 bp, Mus musculus
gttcctacctccagtacctcactgt

SEQ ID NO: 345171 - DNA, 25 bp, Mus musculus
gttcctacggtttcacaaggtattt

SEQ ID NO: 345172 - DNA, 25 bp, Mus musculus
gttcctactagggagagactctaca

SEQ ID NO: 345173 - DNA, 25 bp, Mus musculus
gttcctactggagttaaagggaatg

SEQ ID NO: 345174 - DNA, 25 bp, Mus musculus
gttcctacttccagaacatttaaaa

SEQ ID NO: 345175 - DNA, 25 bp, Mus musculus
gttcctagaacaggccttcgatatg

SEQ ID NO: 345176 - DNA, 25 bp, Mus musculus
gttcctaggcaaggtgctgatagtc

SEQ ID NO: 345177 - DNA, 25 bp, Mus musculus
gttcctaggtgccagattgacgtgt

SEQ ID NO: 345178 - DNA, 25 bp, Mus musculus
gttcctaggtgccaggttggctgat

SEQ ID NO: 345179 - DNA, 25 bp, Mus musculus
gttcctatgagactatggcaggggc

SEQ ID NO: 345180 - DNA, 25 bp, Mus musculus
gttcctcaaacaagaaaaagagaaa

SEQ ID NO: 345181 - DNA, 25 bp, Mus musculus
gttcctcaaacaagaagaatcctgt

SEQ ID NO: 345182 - DNA, 25 bp, Mus musculus
gttcctcaaacaaggcaccaaggag

SEQ ID NO: 345183 - DNA, 25 bp, Mus musculus
gttcctcaaagaaggtcagctggcc

SEQ ID NO: 345184 - DNA, 25 bp, Mus musculus
gttcctcaagatggccgactctgga

SEQ ID NO: 345185 - DNA, 25 bp, Mus musculus
gttcctcatttacgagcacgagtgc

SEQ ID NO: 345186 - DNA, 25 bp, Mus musculus
gttcctccagctctacccgatcaag

SEQ ID NO: 345187 - DNA, 25 bp, Mus musculus
gttcctccctttcggcttcgtgagc

SEQ ID NO: 345188 - DNA, 25 bp, Mus musculus
gttcctccttgtagcaatgctgtgg

SEQ ID NO: 345189 - DNA, 25 bp, Mus musculus
gttcctctagaacagatgcaaaatc

SEQ ID NO: 345190 - DNA, 25 bp, Mus musculus
gttcctctagaacaggagagcctga

SEQ ID NO: 345191 - DNA, 25 bp, Mus musculus
gttcctctgtaccagttgctgtgat

SEQ ID NO: 345192 - DNA, 25 bp, Mus musculus
gttcctctgtcagatgatgatcatt

SEQ ID NO: 345193 - DNA, 25 bp, Mus musculus
gttcctctgtttctgtgaggacctt

SEQ ID NO: 345194 - DNA, 25 bp, Mus musculus
gttcctctgtttcttggaggatctg

SEQ ID NO: 345195 - DNA, 25 bp, Mus musculus
gttcctgaaggttgctagacctgat

SEQ ID NO: 345196 - DNA, 25 bp, Mus musculus
gttcctgatgaaatgctttgaaccc

SEQ ID NO: 345197 - DNA, 25 bp, Mus musculus
gttcctgatgaaatggaaaaactct

SEQ ID NO: 345198 - DNA, 25 bp, Mus musculus
gttcctgatgaaatggtcttcttcc

SEQ ID NO: 345199 - DNA, 25 bp, Mus musculus
gttcctgatgatgatgaaccagctg

SEQ ID NO: 345200 - DNA, 25 bp, Mus musculus
gttcctgatggaaaaccaactctac

SEQ ID NO: 345201 - DNA, 25 bp, Mus musculus
gttcctgatggtgttctccaaaccc

SEQ ID NO: 345202 - DNA, 25 bp, Mus musculus
gttcctgcaaaaggctctgagtttc

SEQ ID NO: 345203 - DNA, 25 bp, Mus musculus
gttcctgcaggaggcagcgggccgt

SEQ ID NO: 345204 - DNA, 25 bp, Mus musculus
gttcctgccagactgggtttgtcat

SEQ ID NO: 345205 - DNA, 25 bp, Mus musculus
gttcctgccccgtgaggagactgct

SEQ ID NO: 345206 - DNA, 25 bp, Mus musculus
gttcctgcctaccactgttcccttc

SEQ ID NO: 345207 - DNA, 25 bp, Mus musculus
gttcctgcctgtgacatggacagat

SEQ ID NO: 345208 - DNA, 25 bp, Mus musculus
gttcctgcgaggctgctccactact

SEQ ID NO: 345209 - DNA, 25 bp, Mus musculus
gttcctgctgcgctctgtgccaacg

SEQ ID NO: 345210 - DNA, 25 bp, Mus musculus
gttcctgcttcctgccacagcaccc

SEQ ID NO: 345211 - DNA, 25 bp, Mus musculus
gttcctggaaatccactgcagctca

SEQ ID NO: 345212 - DNA, 25 bp, Mus musculus
gttcctggaaatgcacggggagatg

SEQ ID NO: 345213 - DNA, 25 bp, Mus musculus
gttcctggacttcgggtcagtgaat

SEQ ID NO: 345214 - DNA, 25 bp, Mus musculus
gttcctggacttcggtatatccaaa

SEQ ID NO: 345215 - DNA, 25 bp, Mus musculus
gttcctggagaggagggtctagaga

SEQ ID NO: 345216 - DNA, 25 bp, Mus musculus
gttcctggagggatcaatgtgacca

SEQ ID NO: 345217 - DNA, 25 bp, Mus musculus
gttcctggatgccaggcgcaagcgg

SEQ ID NO: 345218 - DNA, 25 bp, Mus musculus
gttcctggcttgcacaccggggccc

SEQ ID NO: 345219 - DNA, 25 bp, Mus musculus
gttcctggcttgcagtgtgcctgca

SEQ ID NO: 345220 - DNA, 25 bp, Mus musculus
gttcctggtcacaaggctccgacat

SEQ ID NO: 345221 - DNA, 25 bp, Mus musculus
gttcctggtcacaagtgcgaatctg

SEQ ID NO: 345222 - DNA, 25 bp, Mus musculus
gttcctggtgtcaaaggagaccaag

SEQ ID NO: 345223 - DNA, 25 bp, Mus musculus
gttcctgtaaggagacgttcatttg

SEQ ID NO: 345224 - DNA, 25 bp, Mus musculus
gttcctgtagccaagaccacatcct

SEQ ID NO: 345225 - DNA, 25 bp, Mus musculus
gttcctgtagccaaggtcagattac

SEQ ID NO: 345226 - DNA, 25 bp, Mus musculus
gttcctgtatcagggtgcgcaggct

SEQ ID NO: 345227 - DNA, 25 bp, Mus musculus
gttccttacaggtaaacagggattc

SEQ ID NO: 345228 - DNA, 25 bp, Mus musculus
gttccttcaagagcatgctgggact

SEQ ID NO: 345229 - DNA, 25 bp, Mus musculus
gttccttcaagggacttcctcgccc

SEQ ID NO: 345230 - DNA, 25 bp, Mus musculus
gttccttccgaaccctgtgtattcc

SEQ ID NO: 345231 - DNA, 25 bp, Mus musculus
gttccttcctatgggctggtggaat

SEQ ID NO: 345232 - DNA, 25 bp, Mus musculus
gttccttcctggaggacgacttcat

SEQ ID NO: 345233 - DNA, 25 bp, Mus musculus
gttccttcgggcctctgaagaacac

SEQ ID NO: 345234 - DNA, 25 bp, Mus musculus
gttccttcggtgtgtcctggtcctg

SEQ ID NO: 345235 - DNA, 25 bp, Mus musculus
gttccttctccactacctcctccac

SEQ ID NO: 345236 - DNA, 25 bp, Mus musculus
gttccttctgcggagaacgttttag

SEQ ID NO: 345237 - DNA, 25 bp, Mus musculus
gttccttctgcttctaccaggccct

SEQ ID NO: 345238 - DNA, 25 bp, Mus musculus
gttccttgagatacgacatttcatt

SEQ ID NO: 345239 - DNA, 25 bp, Mus musculus
gttcctttaaaagatcagcatggag

SEQ ID NO: 345240 - DNA, 25 bp, Mus musculus
gttcctttgttcctggggcctgtgt

SEQ ID NO: 345241 - DNA, 25 bp, Mus musculus
gttcctttttcctaactcttggcaa

SEQ ID NO: 345242 - DNA, 25 bp, Mus musculus
gttcgaaagcattgcattggtctct

SEQ ID NO: 345243 - DNA, 25 bp, Mus musculus
gttcgaaagtgaagatatggagtct

SEQ ID NO: 345244 - DNA, 25 bp, Mus musculus
gttcgaataccggcatgtcatgttg

SEQ ID NO: 345245 - DNA, 25 bp, Mus musculus
gttcgaattgctctggcgttaaaag

SEQ ID NO: 345246 - DNA, 25 bp, Mus musculus
gttcgaattgttcactgaggaattt

SEQ ID NO: 345247 - DNA, 25 bp, Mus musculus
gttcgactccagctatgacagggac

SEQ ID NO: 345248 - DNA, 25 bp, Mus musculus
gttcgactccagctatgctcctact

SEQ ID NO: 345249 - DNA, 25 bp, Mus musculus
gttcgacttcaggtctgtggccatg

SEQ ID NO: 345250 - DNA, 25 bp, Mus musculus
gttcgaggccagccggctacacaga

SEQ ID NO: 345251 - DNA, 25 bp, Mus musculus
gttcgaggctaatgaggaagcatta

SEQ ID NO: 345252 - DNA, 25 bp, Mus musculus
gttcgaggctaatgaggtttctggc

SEQ ID NO: 345253 - DNA, 25 bp, Mus musculus
gttcgatgagcgcattttaaagccc

SEQ ID NO: 345254 - DNA, 25 bp, Mus musculus
gttcgatgttcaggagcaggatatt

SEQ ID NO: 345255 - DNA, 25 bp, Mus musculus
gttcgatgttcagggcaaccgtcct

SEQ ID NO: 345256 - DNA, 25 bp, Mus musculus
gttcgcaactatcagcccttgtttc

SEQ ID NO: 345257 - DNA, 25 bp, Mus musculus
gttcgcaactatcaggctcggaact

SEQ ID NO: 345258 - DNA, 25 bp, Mus musculus
gttcgcaccacccctgccactgccg

SEQ ID NO: 345259 - DNA, 25 bp, Mus musculus
gttcgcagcctggacctggggattc

SEQ ID NO: 345260 - DNA, 25 bp, Mus musculus
gttcgcagcctgttcagaattgggg

SEQ ID NO: 345261 - DNA, 25 bp, Mus musculus
gttcgcaggagggcgaagagaaaga

SEQ ID NO: 345262 - DNA, 25 bp, Mus musculus
gttcgccaagtacagacttctggag

SEQ ID NO: 345263 - DNA, 25 bp, Mus musculus
gttcgccagcaacatctccagcacc

SEQ ID NO: 345264 - DNA, 25 bp, Mus musculus
gttcgcccaggataaagcgattgtc

SEQ ID NO: 345265 - DNA, 25 bp, Mus musculus
gttcgcctattgtggcaagtggttt

SEQ ID NO: 345266 - DNA, 25 bp, Mus musculus
gttcgcctgaggattggatggtgag

SEQ ID NO: 345267 - DNA, 25 bp, Mus musculus
gttcgcgaagaatcgagatccgaga

SEQ ID NO: 345268 - DNA, 25 bp, Mus musculus
gttcgcgaagtgcgtccccacgcgg

SEQ ID NO: 345269 - DNA, 25 bp, Mus musculus
gttcgcgagaacagttcaagggcag

SEQ ID NO: 345270 - DNA, 25 bp, Mus musculus
gttcgcgcgcagtggtaactcataa

SEQ ID NO: 345271 - DNA, 25 bp, Mus musculus
gttcgctccaggtgagaagtctggg

SEQ ID NO: 345272 - DNA, 25 bp, Mus musculus
gttcgctgtgcgggtgtctccacga

SEQ ID NO: 345273 - DNA, 25 bp, Mus musculus
gttcgctgtgcgggtgtgggcacat

SEQ ID NO: 345274 - DNA, 25 bp, Mus musculus
gttcggaaaacaaaggcatccttac

SEQ ID NO: 345275 - DNA, 25 bp, Mus musculus
gttcggacatctgtggttcggcaga

SEQ ID NO: 345276 - DNA, 25 bp, Mus musculus
gttcggagaagaagtctcagcgctg

SEQ ID NO: 345277 - DNA, 25 bp, Mus musculus
gttcggagaggctctgtctgcccat

SEQ ID NO: 345278 - DNA, 25 bp, Mus musculus
gttcggagaggtggttctggaatgg

SEQ ID NO: 345279 - DNA, 25 bp, Mus musculus
gttcggataagacagatatgaaccg

SEQ ID NO: 345280 - DNA, 25 bp, Mus musculus
gttcggattcaggcttgtgtgtgag

SEQ ID NO: 345281 - DNA, 25 bp, Mus musculus
gttcggattcaggtaatcgccacgt

SEQ ID NO: 345282 - DNA, 25 bp, Mus musculus
gttcggcaaagagacttctggtgcg

SEQ ID NO: 345283 - DNA, 25 bp, Mus musculus
gttcggcaaaggtgacatttgcaac

SEQ ID NO: 345284 - DNA, 25 bp, Mus musculus
gttcggccggctccattcagaacaa

SEQ ID NO: 345285 - DNA, 25 bp, Mus musculus
gttcggcgctgctcggagcctggtg

SEQ ID NO: 345286 - DNA, 25 bp, Mus musculus
gttcggctacaggagatccagtcac

SEQ ID NO: 345287 - DNA, 25 bp, Mus musculus
gttcgggactacaggcgagcggcgt

SEQ ID NO: 345288 - DNA, 25 bp, Mus musculus
gttcgggactacagggtcaacgtgg

SEQ ID NO: 345289 - DNA, 25 bp, Mus musculus
gttcgggcaggtgcagtaagtgctc

SEQ ID NO: 345290 - DNA, 25 bp, Mus musculus
gttcgggcctaccaggataaggaag

SEQ ID NO: 345291 - DNA, 25 bp, Mus musculus
gttcgggctctggaggtacccactg

SEQ ID NO: 345292 - DNA, 25 bp, Mus musculus
gttcgggtcagccggatgtggagaa

SEQ ID NO: 345293 - DNA, 25 bp, Mus musculus
gttcggtaaacctggagatgggtat

SEQ ID NO: 345294 - DNA, 25 bp, Mus musculus
gttcggtgcagagccaccatgccaa

SEQ ID NO: 345295 - DNA, 25 bp, Mus musculus
gttcgtagaagtggtgattgaaggt

SEQ ID NO: 345296 - DNA, 25 bp, Mus musculus
gttcgtcccagcgtcagcccaggcc

SEQ ID NO: 345297 - DNA, 25 bp, Mus musculus
gttcgtcgtcgtccgctccagaaat

SEQ ID NO: 345298 - DNA, 25 bp, Mus musculus
gttcgtctttcagctacagcggaac

SEQ ID NO: 345299 - DNA, 25 bp, Mus musculus
gttcgtctttcaggctgatgcccca

SEQ ID NO: 345300 - DNA, 25 bp, Mus musculus
gttcgtgaaatcttcagctgctgac

SEQ ID NO: 345301 - DNA, 25 bp, Mus musculus
gttcgtgatttccagtccctgcagg

SEQ ID NO: 345302 - DNA, 25 bp, Mus musculus
gttcgtgcccaaggttgtccagagc

SEQ ID NO: 345303 - DNA, 25 bp, Mus musculus
gttcgtgctgggtgatagcacactc

SEQ ID NO: 345304 - DNA, 25 bp, Mus musculus
gttcgtggaaggcaagaagaaatac

SEQ ID NO: 345305 - DNA, 25 bp, Mus musculus
gttcgtggaaggggaagacagcgcc

SEQ ID NO: 345306 - DNA, 25 bp, Mus musculus
gttcgtggaggtggagcctactacc

SEQ ID NO: 345307 - DNA, 25 bp, Mus musculus
gttcgtggcaggggatgatgagcaa

SEQ ID NO: 345308 - DNA, 25 bp, Mus musculus
gttcgtgggaagatagacccagtga

SEQ ID NO: 345309 - DNA, 25 bp, Mus musculus
gttcgttcaaggggcagaatccttt

SEQ ID NO: 345310 - DNA, 25 bp, Mus musculus
gttcgttcttagaatcctattctaa

SEQ ID NO: 345311 - DNA, 25 bp, Mus musculus
gttcgttttcctgggagactccaga

SEQ ID NO: 345312 - DNA, 25 bp, Mus musculus
gttctaaagaggacagatcacagtg

SEQ ID NO: 345313 - DNA, 25 bp, Mus musculus
gttctaaagagtaaccaggactgcc

SEQ ID NO: 345314 - DNA, 25 bp, Mus musculus
gttctaaagagtccaggtctccatg

SEQ ID NO: 345315 - DNA, 25 bp, Mus musculus
gttctaaagagttggagaacagagg

SEQ ID NO: 345316 - DNA, 25 bp, Mus musculus
gttctaaagatgctgaaggcatcac

SEQ ID NO: 345317 - DNA, 25 bp, Mus musculus
gttctaaagttcaagagctgtttga

SEQ ID NO: 345318 - DNA, 25 bp, Mus musculus
gttctaacactgctgcgaccattgc

SEQ ID NO: 345319 - DNA, 25 bp, Mus musculus
gttctacaaccaagaaggtttgatg

SEQ ID NO: 345320 - DNA, 25 bp, Mus musculus
gttctacaaccaaggagaatagcaa

SEQ ID NO: 345321 - DNA, 25 bp, Mus musculus
gttctacaagctgactcatcatgtc

SEQ ID NO: 345322 - DNA, 25 bp, Mus musculus
gttctacagaagagggtgattaaag

SEQ ID NO: 345323 - DNA, 25 bp, Mus musculus
gttctacagcaagttcgatccttca

SEQ ID NO: 345324 - DNA, 25 bp, Mus musculus
gttctacagcccagggtctggtgag

SEQ ID NO: 345325 - DNA, 25 bp, Mus musculus
gttctacagcccaggtttggtcatc

SEQ ID NO: 345326 - DNA, 25 bp, Mus musculus
gttctacaggctgcggctgtgttgg

SEQ ID NO: 345327 - DNA, 25 bp, Mus musculus
gttctaccagaattatatatgttgg

SEQ ID NO: 345328 - DNA, 25 bp, Mus musculus
gttctaccagaggctgtgtacagcg

SEQ ID NO: 345329 - DNA, 25 bp, Mus musculus
gttctaccgcagtggctgggcactg

SEQ ID NO: 345330 - DNA, 25 bp, Mus musculus
gttctacctgaaggatctgaaaaca

SEQ ID NO: 345331 - DNA, 25 bp, Mus musculus
gttctacgccaagcatcatcagctg

SEQ ID NO: 345332 - DNA, 25 bp, Mus musculus
gttctactttaatggtgagtacgca

SEQ ID NO: 345333 - DNA, 25 bp, Mus musculus
gttctacttttctggaggcattgga

SEQ ID NO: 345334 - DNA, 25 bp, Mus musculus
gttctagaaaacaactcccagacct

SEQ ID NO: 345335 - DNA, 25 bp, Mus musculus
gttctagaaaacaatattgatgggc

SEQ ID NO: 345336 - DNA, 25 bp, Mus musculus
gttctagaacagttcttaggaagca

SEQ ID NO: 345337 - DNA, 25 bp, Mus musculus
gttctagaagttggtagtttacaaa

SEQ ID NO: 345338 - DNA, 25 bp, Mus musculus
gttctagatgagatatgtgaatcct

SEQ ID NO: 345339 - DNA, 25 bp, Mus musculus
gttctagatttaaagtgttcctagg

SEQ ID NO: 345340 - DNA, 25 bp, Mus musculus
gttctaggggcccaggtggacaaca

SEQ ID NO: 345341 - DNA, 25 bp, Mus musculus
gttctataaaagagcatgggtacac

SEQ ID NO: 345342 - DNA, 25 bp, Mus musculus
gttctataaaagaggtatatattat

SEQ ID NO: 345343 - DNA, 25 bp, Mus musculus
gttctataccattgacactggccaa

SEQ ID NO: 345344 - DNA, 25 bp, Mus musculus
gttctatagttcaggcatctactat

SEQ ID NO: 345345 - DNA, 25 bp, Mus musculus
gttctatatgctgtctcctaagaag

SEQ ID NO: 345346 - DNA, 25 bp, Mus musculus
gttctatatgttcgcatggacgcac

SEQ ID NO: 345347 - DNA, 25 bp, Mus musculus
gttctatctatgaatttggaaatac

SEQ ID NO: 345348 - DNA, 25 bp, Mus musculus
gttctatgatgattcggctcctttg

SEQ ID NO: 345349 - DNA, 25 bp, Mus musculus
gttctatgatggagaatccgggctg

SEQ ID NO: 345350 - DNA, 25 bp, Mus musculus
gttctatgccatgaagcagaaggga

SEQ ID NO: 345351 - DNA, 25 bp, Mus musculus
gttctatgctccctggtgcagcatg

SEQ ID NO: 345352 - DNA, 25 bp, Mus musculus
gttctatgctccctttcccaggtgg

SEQ ID NO: 345353 - DNA, 25 bp, Mus musculus
gttctatgctgggacggccttctct

SEQ ID NO: 345354 - DNA, 25 bp, Mus musculus
gttctatgtgagcaactgggacaaa

SEQ ID NO: 345355 - DNA, 25 bp, Mus musculus
gttctatgtgaggaaaaacgggatc

SEQ ID NO: 345356 - DNA, 25 bp, Mus musculus
gttctattaggtcatgacgcatggc

SEQ ID NO: 345357 - DNA, 25 bp, Mus musculus
gttctcaactggctatggctcctgg

SEQ ID NO: 345358 - DNA, 25 bp, Mus musculus
gttctcaaggcggggacgatccgga

SEQ ID NO: 345359 - DNA, 25 bp, Mus musculus
gttctcacttctaggtcgtttcagc

SEQ ID NO: 345360 - DNA, 25 bp, Mus musculus
gttctcagggaaaagcacagagctg

SEQ ID NO: 345361 - DNA, 25 bp, Mus musculus
gttctcagggaaaaggaacaccatg

SEQ ID NO: 345362 - DNA, 25 bp, Mus musculus
gttctcaggttgttcctcaatgtct

SEQ ID NO: 345363 - DNA, 25 bp, Mus musculus
gttctcatccaaagcctttatccat

SEQ ID NO: 345364 - DNA, 25 bp, Mus musculus
gttctccaatgttgtatgtgctatt

SEQ ID NO: 345365 - DNA, 25 bp, Mus musculus
gttctccactggcctctcggacctc

SEQ ID NO: 345366 - DNA, 25 bp, Mus musculus
gttctccagagaggtgcccttctcc

SEQ ID NO: 345367 - DNA, 25 bp, Mus musculus
gttctccagagccaaggctgttgtg

SEQ ID NO: 345368 - DNA, 25 bp, Mus musculus
gttctccagagggaaaaagcctaca

SEQ ID NO: 345369 - DNA, 25 bp, Mus musculus
gttctcccacctacgggtggcggct

SEQ ID NO: 345370 - DNA, 25 bp, Mus musculus
gttctcccagagtggcttcatcact

SEQ ID NO: 345371 - DNA, 25 bp, Mus musculus
gttctcccaggttgttcctcaaagt

SEQ ID NO: 345372 - DNA, 25 bp, Mus musculus
gttctcccgaggaggcatgataagc

SEQ ID NO: 345373 - DNA, 25 bp, Mus musculus
gttctcccgagggctgggataagcg

SEQ ID NO: 345374 - DNA, 25 bp, Mus musculus
gttctccgccgagccggaccgggct

SEQ ID NO: 345375 - DNA, 25 bp, Mus musculus
gttctccgccgagcgcctcggtcct

SEQ ID NO: 345376 - DNA, 25 bp, Mus musculus
gttctcctccgaggtccagtttggc

SEQ ID NO: 345377 - DNA, 25 bp, Mus musculus
gttctcgagcaccctcagaatatgg

SEQ ID NO: 345378 - DNA, 25 bp, Mus musculus
gttctcgggcaaggacttagcattc

SEQ ID NO: 345379 - DNA, 25 bp, Mus musculus
gttctcgggtcgcaggaactggtgc

SEQ ID NO: 345380 - DNA, 25 bp, Mus musculus
gttctcgttcaggttagccagtaca

SEQ ID NO: 345381 - DNA, 25 bp, Mus musculus
gttctctaaagggcctggggatatg

SEQ ID NO: 345382 - DNA, 25 bp, Mus musculus
gttctctaaagttacaaattataat

SEQ ID NO: 345383 - DNA, 25 bp, Mus musculus
gttctctaacctggccctctgctgt

SEQ ID NO: 345384 - DNA, 25 bp, Mus musculus
gttctctaattttccaggtgccgac

SEQ ID NO: 345385 - DNA, 25 bp, Mus musculus
gttctctagcgaaatccctctctac

SEQ ID NO: 345386 - DNA, 25 bp, Mus musculus
gttctctagcgtgatttttcttcca

SEQ ID NO: 345387 - DNA, 25 bp, Mus musculus
gttctctataaaaagaaaaatatta

SEQ ID NO: 345388 - DNA, 25 bp, Mus musculus
gttctctcggctccgctagttctga

SEQ ID NO: 345389 - DNA, 25 bp, Mus musculus
gttctctcggctccgctgccctggg

SEQ ID NO: 345390 - DNA, 25 bp, Mus musculus
gttctctctaaacctttgacatgga

SEQ ID NO: 345391 - DNA, 25 bp, Mus musculus
gttctctgaaccaggttatgaaaat

SEQ ID NO: 345392 - DNA, 25 bp, Mus musculus
gttctctgacaggaatgaatttcat

SEQ ID NO: 345393 - DNA, 25 bp, Mus musculus
gttctctgagactcgtctgccagaa

SEQ ID NO: 345394 - DNA, 25 bp, Mus musculus
gttctctgaggggagcttttcccag

SEQ ID NO: 345395 - DNA, 25 bp, Mus musculus
gttctctgtaagtgcctggtgaaga

SEQ ID NO: 345396 - DNA, 25 bp, Mus musculus
gttctctgtaagttctccctgttca

SEQ ID NO: 345397 - DNA, 25 bp, Mus musculus
gttctctgtcgggtaagcagctgct

SEQ ID NO: 345398 - DNA, 25 bp, Mus musculus
gttctctgttcagcccttcccacaa

SEQ ID NO: 345399 - DNA, 25 bp, Mus musculus
gttctctgttcaggatatgcagtac

SEQ ID NO: 345400 - DNA, 25 bp, Mus musculus
gttctctgtttgacacgtttagggt

SEQ ID NO: 345401 - DNA, 25 bp, Mus musculus
gttctctgtttgagtgatgagccgg

SEQ ID NO: 345402 - DNA, 25 bp, Mus musculus
gttctcttccagctaccactatgcc

SEQ ID NO: 345403 - DNA, 25 bp, Mus musculus
gttctcttccatatgaggaaactga

SEQ ID NO: 345404 - DNA, 25 bp, Mus musculus
gttctcttggagttctgacgggaac

SEQ ID NO: 345405 - DNA, 25 bp, Mus musculus
gttctgaaacaggaaatccggctca

SEQ ID NO: 345406 - DNA, 25 bp, Mus musculus
gttctgaaacataatcacagaactg

SEQ ID NO: 345407 - DNA, 25 bp, Mus musculus
gttctgaacagcagctcccgttact

SEQ ID NO: 345408 - DNA, 25 bp, Mus musculus
gttctgaacagcaggtcccaggatt

SEQ ID NO: 345409 - DNA, 25 bp, Mus musculus
gttctgacaggcctcaagaaaggag

SEQ ID NO: 345410 - DNA, 25 bp, Mus musculus
gttctgactgcgacatttacattgt

SEQ ID NO: 345411 - DNA, 25 bp, Mus musculus
gttctgactgcggttgaaatgggca

SEQ ID NO: 345412 - DNA, 25 bp, Mus musculus
gttctgagaaagacaactgaggata

SEQ ID NO: 345413 - DNA, 25 bp, Mus musculus
gttctgagctggcttgctgcccatt

SEQ ID NO: 345414 - DNA, 25 bp, Mus musculus
gttctgagtcacgtgctgtaattac

SEQ ID NO: 345415 - DNA, 25 bp, Mus musculus
gttctgagtctttcctggttttcta

SEQ ID NO: 345416 - DNA, 25 bp, Mus musculus
gttctgatatgtcacatgctgctgc

SEQ ID NO: 345417 - DNA, 25 bp, Mus musculus
gttctgatcttgaacggggtgccac

SEQ ID NO: 345418 - DNA, 25 bp, Mus musculus
gttctgatgatgattcatgaaaaac

SEQ ID NO: 345419 - DNA, 25 bp, Mus musculus
gttctgattgaagcctgctgcaaaa

SEQ ID NO: 345420 - DNA, 25 bp, Mus musculus
gttctgcaaagggagcttggcatgg

SEQ ID NO: 345421 - DNA, 25 bp, Mus musculus
gttctgcaaggatgaattgtctgga

SEQ ID NO: 345422 - DNA, 25 bp, Mus musculus
gttctgcaccagcaggaagtgatgt

SEQ ID NO: 345423 - DNA, 25 bp, Mus musculus
gttctgcaccaggcatagcaggaag

SEQ ID NO: 345424 - DNA, 25 bp, Mus musculus
gttctgcactctcagctccagctag

SEQ ID NO: 345425 - DNA, 25 bp, Mus musculus
gttctgcagaccatcctgtcagcac

SEQ ID NO: 345426 - DNA, 25 bp, Mus musculus
gttctgcagacgaagacatggggat

SEQ ID NO: 345427 - DNA, 25 bp, Mus musculus
gttctgcagaggaacagctgtgcca

SEQ ID NO: 345428 - DNA, 25 bp, Mus musculus
gttctgcatcccgttcacgcaaaga

SEQ ID NO: 345429 - DNA, 25 bp, Mus musculus
gttctgccagcctccgctccttcag

SEQ ID NO: 345430 - DNA, 25 bp, Mus musculus
gttctgccagcgcctgtgagagaga

SEQ ID NO: 345431 - DNA, 25 bp, Mus musculus
gttctgccaggaatgtaataacatg

SEQ ID NO: 345432 - DNA, 25 bp, Mus musculus
gttctgccagtgtgattttgacatt

SEQ ID NO: 345433 - DNA, 25 bp, Mus musculus
gttctgccagttcggataggtccta

SEQ ID NO: 345434 - DNA, 25 bp, Mus musculus
gttctgcctacatctggtagtttac

SEQ ID NO: 345435 - DNA, 25 bp, Mus musculus
gttctgcctgtattggccttctgta

SEQ ID NO: 345436 - DNA, 25 bp, Mus musculus
gttctgctcacagcctccctcttaa

SEQ ID NO: 345437 - DNA, 25 bp, Mus musculus
gttctgcttcccaggctaaggagaa

SEQ ID NO: 345438 - DNA, 25 bp, Mus musculus
gttctggaaatcctgagaatatctt

SEQ ID NO: 345439 - DNA, 25 bp, Mus musculus
gttctggaaatggctgaccaaggtc

SEQ ID NO: 345440 - DNA, 25 bp, Mus musculus
gttctggaagccctggaagagagac

SEQ ID NO: 345441 - DNA, 25 bp, Mus musculus
gttctggaagcctttgcttccttac

SEQ ID NO: 345442 - DNA, 25 bp, Mus musculus
gttctggaatatcctggaccatgct

SEQ ID NO: 345443 - DNA, 25 bp, Mus musculus
gttctggaatgatctcaacttcctg

SEQ ID NO: 345444 - DNA, 25 bp, Mus musculus
gttctggagacccggatgggagcca

SEQ ID NO: 345445 - DNA, 25 bp, Mus musculus
gttctggatacagacaggatctttc

SEQ ID NO: 345446 - DNA, 25 bp, Mus musculus
gttctggatacagccaaggtctcca

SEQ ID NO: 345447 - DNA, 25 bp, Mus musculus
gttctggatacaggtggaaacgtcc

SEQ ID NO: 345448 - DNA, 25 bp, Mus musculus
gttctggcagccatggtcacgtctc

SEQ ID NO: 345449 - DNA, 25 bp, Mus musculus
gttctggcagggacgaaacttagct

SEQ ID NO: 345450 - DNA, 25 bp, Mus musculus
gttctggcggatgaaatgtggcaac

SEQ ID NO: 345451 - DNA, 25 bp, Mus musculus
gttctggctcagatgcgattcatgc

SEQ ID NO: 345452 - DNA, 25 bp, Mus musculus
gttctggctccagaaggatctgttc

SEQ ID NO: 345453 - DNA, 25 bp, Mus musculus
gttctggcttccagggctggcgctg

SEQ ID NO: 345454 - DNA, 25 bp, Mus musculus
gttctgggaagcttccagctttatc

SEQ ID NO: 345455 - DNA, 25 bp, Mus musculus
gttctgggaagtctccaggctttgg

SEQ ID NO: 345456 - DNA, 25 bp, Mus musculus
gttctgggaagtgcgaaatcaaagt

SEQ ID NO: 345457 - DNA, 25 bp, Mus musculus
gttctgggattaaaggaaacaaatg

SEQ ID NO: 345458 - DNA, 25 bp, Mus musculus
gttctgggggcaaactggaaggagg

SEQ ID NO: 345459 - DNA, 25 bp, Mus musculus
gttctgggtgaaggagagtttgggt

SEQ ID NO: 345460 - DNA, 25 bp, Mus musculus
gttctggtgatggccataaaatcag

SEQ ID NO: 345461 - DNA, 25 bp, Mus musculus
gttctggtgccagcaactggccatg

SEQ ID NO: 345462 - DNA, 25 bp, Mus musculus
gttctggtgccagggtttctctgtg

SEQ ID NO: 345463 - DNA, 25 bp, Mus musculus
gttctggtgctgaaacccttcactg

SEQ ID NO: 345464 - DNA, 25 bp, Mus musculus
gttctgtccagagcctcaaggtccc

SEQ ID NO: 345465 - DNA, 25 bp, Mus musculus
gttctgtccaggatcattttaacct

SEQ ID NO: 345466 - DNA, 25 bp, Mus musculus
gttctgtgaccttagaatcagctgc

SEQ ID NO: 345467 - DNA, 25 bp, Mus musculus
gttctgtgcaggtgcagacctgaag

SEQ ID NO: 345468 - DNA, 25 bp, Mus musculus
gttctgtgctgtttggaagtgaaat

SEQ ID NO: 345469 - DNA, 25 bp, Mus musculus
gttctgtgtctggaggaggtaaatg

SEQ ID NO: 345470 - DNA, 25 bp, Mus musculus
gttctgtgtggaggtactacaagcc

SEQ ID NO: 345471 - DNA, 25 bp, Mus musculus
gttctgttcccatgagaacccctga

SEQ ID NO: 345472 - DNA, 25 bp, Mus musculus
gttctgttcccatggaatcattggt

SEQ ID NO: 345473 - DNA, 25 bp, Mus musculus
gttctgttccttccgaaccctgtgt

SEQ ID NO: 345474 - DNA, 25 bp, Mus musculus
gttctgttgcaagcctacttctccc

SEQ ID NO: 345475 - DNA, 25 bp, Mus musculus
gttctgttgcaaggtgatctctgca

SEQ ID NO: 345476 - DNA, 25 bp, Mus musculus
gttcttaaaaagtgcttctctctga

SEQ ID NO: 345477 - DNA, 25 bp, Mus musculus
gttcttaacaggcacgtgacacaag

SEQ ID NO: 345478 - DNA, 25 bp, Mus musculus
gttcttaccagaacttgatcaccag

SEQ ID NO: 345479 - DNA, 25 bp, Mus musculus
gttcttaccagagttctggccaggg

SEQ ID NO: 345480 - DNA, 25 bp, Mus musculus
gttcttaccagatgacaaatcatca

SEQ ID NO: 345481 - DNA, 25 bp, Mus musculus
gttcttagccgatctctgagaagag

SEQ ID NO: 345482 - DNA, 25 bp, Mus musculus
gttcttagccggtaccagacgttaa

SEQ ID NO: 345483 - DNA, 25 bp, Mus musculus
gttcttagccggtccttcagtagcc

SEQ ID NO: 345484 - DNA, 25 bp, Mus musculus
gttcttaggtaaggtggtcagcgcg

SEQ ID NO: 345485 - DNA, 25 bp, Mus musculus
gttcttatgactctgctgggattcc

SEQ ID NO: 345486 - DNA, 25 bp, Mus musculus
gttcttatgactctgggctgatgcc

SEQ ID NO: 345487 - DNA, 25 bp, Mus musculus
gttcttatgactgcaccattcctgc

SEQ ID NO: 345488 - DNA, 25 bp, Mus musculus
gttcttatgcctgaaaaagaccttc

SEQ ID NO: 345489 - DNA, 25 bp, Mus musculus
gttcttcaagaatgacattgtcaac

SEQ ID NO: 345490 - DNA, 25 bp, Mus musculus
gttcttcaagatctggagaccctgg

SEQ ID NO: 345491 - DNA, 25 bp, Mus musculus
gttcttcaaggccacgaaagaccat

SEQ ID NO: 345492 - DNA, 25 bp, Mus musculus
gttcttcacaggtggcttctgctta

SEQ ID NO: 345493 - DNA, 25 bp, Mus musculus
gttcttcaccagcccagagaactca

SEQ ID NO: 345494 - DNA, 25 bp, Mus musculus
gttcttcacgctggatgttgaatgc

SEQ ID NO: 345495 - DNA, 25 bp, Mus musculus
gttcttcacgctggggtttctctgt

SEQ ID NO: 345496 - DNA, 25 bp, Mus musculus
gttcttcactgactagtctccagag

SEQ ID NO: 345497 - DNA, 25 bp, Mus musculus
gttcttcactgactattttaacagc

SEQ ID NO: 345498 - DNA, 25 bp, Mus musculus
gttcttcagagagatgacataacac

SEQ ID NO: 345499 - DNA, 25 bp, Mus musculus
gttcttcagagggtttcatatgtcc

SEQ ID NO: 345500 - DNA, 25 bp, Mus musculus
gttcttcagagggtttcatctgccc

SEQ ID NO: 345501 - DNA, 25 bp, Mus musculus
gttcttcagcaagacagaggagctg

SEQ ID NO: 345502 - DNA, 25 bp, Mus musculus
gttcttcataaaactctgaaggcat

SEQ ID NO: 345503 - DNA, 25 bp, Mus musculus
gttcttcatgcccacctggtaacat

SEQ ID NO: 345504 - DNA, 25 bp, Mus musculus
gttcttccagccaaggacccctgtc

SEQ ID NO: 345505 - DNA, 25 bp, Mus musculus
gttcttccaggcaaggacccctgtc

SEQ ID NO: 345506 - DNA, 25 bp, Mus musculus
gttcttccgagtcagctacttcctg

SEQ ID NO: 345507 - DNA, 25 bp, Mus musculus
gttcttcctcaaccccctagaatcc

SEQ ID NO: 345508 - DNA, 25 bp, Mus musculus
gttcttcgccccctggtgtggacat

SEQ ID NO: 345509 - DNA, 25 bp, Mus musculus
gttcttcgtgacgataagtgggcag

SEQ ID NO: 345510 - DNA, 25 bp, Mus musculus
gttcttcgtgacgttattagaagcc

SEQ ID NO: 345511 - DNA, 25 bp, Mus musculus
gttcttcgttgggggcactcagaaa

SEQ ID NO: 345512 - DNA, 25 bp, Mus musculus
gttcttctcaggggaggagtacggg

SEQ ID NO: 345513 - DNA, 25 bp, Mus musculus
gttcttctcagggttggaaatcgtg

SEQ ID NO: 345514 - DNA, 25 bp, Mus musculus
gttcttctcaggtatattgaaatat

SEQ ID NO: 345515 - DNA, 25 bp, Mus musculus
gttcttctccacggtactacttgtc

SEQ ID NO: 345516 - DNA, 25 bp, Mus musculus
gttcttctccacgttctaccacgcc

SEQ ID NO: 345517 - DNA, 25 bp, Mus musculus
gttcttctggcaccagcccatcaaa

SEQ ID NO: 345518 - DNA, 25 bp, Mus musculus
gttcttcttcagaaacaaacatatc

SEQ ID NO: 345519 - DNA, 25 bp, Mus musculus
gttcttgagaggccacagacctccc

SEQ ID NO: 345520 - DNA, 25 bp, Mus musculus
gttcttgcatggggatgatgactct

SEQ ID NO: 345521 - DNA, 25 bp, Mus musculus
gttcttgcctgcaggaagcaccatg

SEQ ID NO: 345522 - DNA, 25 bp, Mus musculus
gttcttgcctgcagttccgtttccc

SEQ ID NO: 345523 - DNA, 25 bp, Mus musculus
gttcttgctaacaacaacacctcgt

SEQ ID NO: 345524 - DNA, 25 bp, Mus musculus
gttcttgctaactgtccagttaaat

SEQ ID NO: 345525 - DNA, 25 bp, Mus musculus
gttcttgctggtgcactgcctgttg

SEQ ID NO: 345526 - DNA, 25 bp, Mus musculus
gttcttggaggagggcaatgcgagc

SEQ ID NO: 345527 - DNA, 25 bp, Mus musculus
gttcttggattcgctggttggtggg

SEQ ID NO: 345528 - DNA, 25 bp, Mus musculus
gttcttggcgttatgggtgtgatag

SEQ ID NO: 345529 - DNA, 25 bp, Mus musculus
gttcttggcgttatgtttgagatgg

SEQ ID NO: 345530 - DNA, 25 bp, Mus musculus
gttcttgtcaataaggtaatgttag

SEQ ID NO: 345531 - DNA, 25 bp, Mus musculus
gttcttgtggctcaggggactccag

SEQ ID NO: 345532 - DNA, 25 bp, Mus musculus
gttcttgtgggaagcattcaactac

SEQ ID NO: 345533 - DNA, 25 bp, Mus musculus
gttcttgtgggggatgcttggcctt

SEQ ID NO: 345534 - DNA, 25 bp, Mus musculus
gttcttgtgggtggccatgcagatg

SEQ ID NO: 345535 - DNA, 25 bp, Mus musculus
gttcttgtttcaggaaatggctgca

SEQ ID NO: 345536 - DNA, 25 bp, Mus musculus
gttcttgtttcaggacttcctccat

SEQ ID NO: 345537 - DNA, 25 bp, Mus musculus
gttcttgtttctgactctaaaacaa

SEQ ID NO: 345538 - DNA, 25 bp, Mus musculus
gttcttgtttctggatccttgacac

SEQ ID NO: 345539 - DNA, 25 bp, Mus musculus
gttcttgtttgatactttatgcatg

SEQ ID NO: 345540 - DNA, 25 bp, Mus musculus
gttctttaaaaaagccgagctggaa

SEQ ID NO: 345541 - DNA, 25 bp, Mus musculus
gttctttaaaggggactttgccaca

SEQ ID NO: 345542 - DNA, 25 bp, Mus musculus
gttctttaaaggggagtttgtgtgg

SEQ ID NO: 345543 - DNA, 25 bp, Mus musculus
gttctttaagaaaagcagccactgg

SEQ ID NO: 345544 - DNA, 25 bp, Mus musculus
gttctttaagatcgctccagtggaa

SEQ ID NO: 345545 - DNA, 25 bp, Mus musculus
gttctttaagctacaaaaaattgcc

SEQ ID NO: 345546 - DNA, 25 bp, Mus musculus
gttctttaaggatcctatgtagccc

SEQ ID NO: 345547 - DNA, 25 bp, Mus musculus
gttctttatagacagacgcctgcag

SEQ ID NO: 345548 - DNA, 25 bp, Mus musculus
gttctttatagtgaggctatgggca

SEQ ID NO: 345549 - DNA, 25 bp, Mus musculus
gttctttatttgagtgcagcagctg

SEQ ID NO: 345550 - DNA, 25 bp, Mus musculus
gttctttcagagtgcttctacttct

SEQ ID NO: 345551 - DNA, 25 bp, Mus musculus
gttctttccaaatggacctgaggtg

SEQ ID NO: 345552 - DNA, 25 bp, Mus musculus
gttctttccggctgtgacttctttt

SEQ ID NO: 345553 - DNA, 25 bp, Mus musculus
gttctttctctcagccaaagccttc

SEQ ID NO: 345554 - DNA, 25 bp, Mus musculus
gttctttctgaggtgtcagatgccc

SEQ ID NO: 345555 - DNA, 25 bp, Mus musculus
gttcttttaggaagctcaataaagt

SEQ ID NO: 345556 - DNA, 25 bp, Mus musculus
gttgaaaaaagcttatccatgactg

SEQ ID NO: 345557 - DNA, 25 bp, Mus musculus
gttgaaaaacaagtggagagatttt

SEQ ID NO: 345558 - DNA, 25 bp, Mus musculus
gttgaaaatttaaagtaggaggagc

SEQ ID NO: 345559 - DNA, 25 bp, Mus musculus
gttgaaacaagggggagaagcgagc

SEQ ID NO: 345560 - DNA, 25 bp, Mus musculus
gttgaaacactatggatcgcagctc

SEQ ID NO: 345561 - DNA, 25 bp, Mus musculus
gttgaaacaggctgttgtgcagact

SEQ ID NO: 345562 - DNA, 25 bp, Mus musculus
gttgaaactgttatctgggagtatt

SEQ ID NO: 345563 - DNA, 25 bp, Mus musculus
gttgaaactttagtgccatggcaga

SEQ ID NO: 345564 - DNA, 25 bp, Mus musculus
gttgaaagtggagcaaaatgccatg

SEQ ID NO: 345565 - DNA, 25 bp, Mus musculus
gttgaaatagaattgatggaatcca

SEQ ID NO: 345566 - DNA, 25 bp, Mus musculus
gttgaaatagagggaccagtcttgg

SEQ ID NO: 345567 - DNA, 25 bp, Mus musculus
gttgaacaacagatgcagcgaagcc

SEQ ID NO: 345568 - DNA, 25 bp, Mus musculus
gttgaacaacatgggacgaaactta

SEQ ID NO: 345569 - DNA, 25 bp, Mus musculus
gttgaacctgaaaacattattatgt

SEQ ID NO: 345570 - DNA, 25 bp, Mus musculus
gttgaactcctgagatatgaatctg

SEQ ID NO: 345571 - DNA, 25 bp, Mus musculus
gttgaacttgttggatttgaacttt

SEQ ID NO: 345572 - DNA, 25 bp, Mus musculus
gttgaagaaatgttgttatccgatg

SEQ ID NO: 345573 - DNA, 25 bp, Mus musculus
gttgaagaacagagcatttagctcc

SEQ ID NO: 345574 - DNA, 25 bp, Mus musculus
gttgaagaacagggagtgcttggtg

SEQ ID NO: 345575 - DNA, 25 bp, Mus musculus
gttgaagaagagcctggaagtggga

SEQ ID NO: 345576 - DNA, 25 bp, Mus musculus
gttgaagaagtgggaatccggaaga

SEQ ID NO: 345577 - DNA, 25 bp, Mus musculus
gttgaagacacaggaggcagccagg

SEQ ID NO: 345578 - DNA, 25 bp, Mus musculus
gttgaagagacaaggcatagtgcag

SEQ ID NO: 345579 - DNA, 25 bp, Mus musculus
gttgaagatcctgggggcagtgtat

SEQ ID NO: 345580 - DNA, 25 bp, Mus musculus
gttgaagctatggtaaaagtttcat

SEQ ID NO: 345581 - DNA, 25 bp, Mus musculus
gttgaaggaagataaagccatcccg

SEQ ID NO: 345582 - DNA, 25 bp, Mus musculus
gttgaaggaagatacatgttgtcag

SEQ ID NO: 345583 - DNA, 25 bp, Mus musculus
gttgaatacaaggttctcaggacag

SEQ ID NO: 345584 - DNA, 25 bp, Mus musculus
gttgaatcaacagagtatgtcaata

SEQ ID NO: 345585 - DNA, 25 bp, Mus musculus
gttgaatcaggagcttacagatgtc

SEQ ID NO: 345586 - DNA, 25 bp, Mus musculus
gttgaatgaccctcttccattttgg

SEQ ID NO: 345587 - DNA, 25 bp, Mus musculus
gttgaatgatccagagtcctccccg

SEQ ID NO: 345588 - DNA, 25 bp, Mus musculus
gttgaatgatgcagagtcctccccg

SEQ ID NO: 345589 - DNA, 25 bp, Mus musculus
gttgaattctatgccccttggtgtg

SEQ ID NO: 345590 - DNA, 25 bp, Mus musculus
gttgaatttctggtaatctatgcca

SEQ ID NO: 345591 - DNA, 25 bp, Mus musculus
gttgaatttctggtttgcggtgtag

SEQ ID NO: 345592 - DNA, 25 bp, Mus musculus
gttgacaaaggcacagcgccctcag

SEQ ID NO: 345593 - DNA, 25 bp, Mus musculus
gttgacacactggagggagactgtg

SEQ ID NO: 345594 - DNA, 25 bp, Mus musculus
gttgacactcgaggatgtgaagcag

SEQ ID NO: 345595 - DNA, 25 bp, Mus musculus
gttgacactgaagttggtgagtcta

SEQ ID NO: 345596 - DNA, 25 bp, Mus musculus
gttgacagagaaagatgccaagctg

SEQ ID NO: 345597 - DNA, 25 bp, Mus musculus
gttgacagatttaagagtttgtttc

SEQ ID NO: 345598 - DNA, 25 bp, Mus musculus
gttgacagatttaagcttccttcca

SEQ ID NO: 345599 - DNA, 25 bp, Mus musculus
gttgacaggcagaggcacggtagat

SEQ ID NO: 345600 - DNA, 25 bp, Mus musculus
gttgacagtggaaaggttgagttat

SEQ ID NO: 345601 - DNA, 25 bp, Mus musculus
gttgacagtgtcaagttctgtggat

SEQ ID NO: 345602 - DNA, 25 bp, Mus musculus
gttgacatcaaatacaagaggaatt

SEQ ID NO: 345603 - DNA, 25 bp, Mus musculus
gttgacatcaagactgaaggacaag

SEQ ID NO: 345604 - DNA, 25 bp, Mus musculus
gttgacatccgacttcgccctcagc

SEQ ID NO: 345605 - DNA, 25 bp, Mus musculus
gttgacatgagtaacatacaagaga

SEQ ID NO: 345606 - DNA, 25 bp, Mus musculus
gttgaccagaagcagctggtgaatg

SEQ ID NO: 345607 - DNA, 25 bp, Mus musculus
gttgaccagaagcagggaaaaggct

SEQ ID NO: 345608 - DNA, 25 bp, Mus musculus
gttgaccccaggccctgcaggtcgg

SEQ ID NO: 345609 - DNA, 25 bp, Mus musculus
gttgaccgaaagcacagccatcttg

SEQ ID NO: 345610 - DNA, 25 bp, Mus musculus
gttgacctgaaaaggaaacctgcag

SEQ ID NO: 345611 - DNA, 25 bp, Mus musculus
gttgacctggaggagatggtggaat

SEQ ID NO: 345612 - DNA, 25 bp, Mus musculus
gttgacctggaggagctgttgggcc

SEQ ID NO: 345613 - DNA, 25 bp, Mus musculus
gttgacggacttattgccaaggaaa

SEQ ID NO: 345614 - DNA, 25 bp, Mus musculus
gttgacgtcgtgaagttaagcaaaa

SEQ ID NO: 345615 - DNA, 25 bp, Mus musculus
gttgacgtgattgtgaatacccttt

SEQ ID NO: 345616 - DNA, 25 bp, Mus musculus
gttgactacgtgaagcaacatcctt

SEQ ID NO: 345617 - DNA, 25 bp, Mus musculus
gttgactctggtagagcagatcctg

SEQ ID NO: 345618 - DNA, 25 bp, Mus musculus
gttgactttaggaatgtgaagctct

SEQ ID NO: 345619 - DNA, 25 bp, Mus musculus
gttgactttagggtcttctcagtta

SEQ ID NO: 345620 - DNA, 25 bp, Mus musculus
gttgagaaaggaactcaacagaggc

SEQ ID NO: 345621 - DNA, 25 bp, Mus musculus
gttgagaactgggcgtggaaaagat

SEQ ID NO: 345622 - DNA, 25 bp, Mus musculus
gttgagaagacgggatatcgctcga

SEQ ID NO: 345623 - DNA, 25 bp, Mus musculus
gttgagacagcaacggtggacaaat

SEQ ID NO: 345624 - DNA, 25 bp, Mus musculus
gttgagagaattggaaaatgactcc

SEQ ID NO: 345625 - DNA, 25 bp, Mus musculus
gttgagatggagtctctagccaaga

SEQ ID NO: 345626 - DNA, 25 bp, Mus musculus
gttgagcctcaggactcagagaggc

SEQ ID NO: 345627 - DNA, 25 bp, Mus musculus
gttgagcgaagaacaaattacctgc

SEQ ID NO: 345628 - DNA, 25 bp, Mus musculus
gttgagcgaagacccttaccaggac

SEQ ID NO: 345629 - DNA, 25 bp, Mus musculus
gttgagcggcggctggtaagaacag

SEQ ID NO: 345630 - DNA, 25 bp, Mus musculus
gttgagctactcaggcctgcctact

SEQ ID NO: 345631 - DNA, 25 bp, Mus musculus
gttgagctactcaggtcaaggcttt

SEQ ID NO: 345632 - DNA, 25 bp, Mus musculus
gttgagctgttcagaatgaattagc

SEQ ID NO: 345633 - DNA, 25 bp, Mus musculus
gttgagctgttcagacggtgcgcag

SEQ ID NO: 345634 - DNA, 25 bp, Mus musculus
gttgagctgttcagagacagatggg

SEQ ID NO: 345635 - DNA, 25 bp, Mus musculus
gttgagcttaatgctttaatgactg

SEQ ID NO: 345636 - DNA, 25 bp, Mus musculus
gttgagcttaatgtttgttaacgcg

SEQ ID NO: 345637 - DNA, 25 bp, Mus musculus
gttgaggagagtgaggaagaagacg

SEQ ID NO: 345638 - DNA, 25 bp, Mus musculus
gttgaggcctggcaggtcctgaaac

SEQ ID NO: 345639 - DNA, 25 bp, Mus musculus
gttgaggcctggcaggtgcccttct

SEQ ID NO: 345640 - DNA, 25 bp, Mus musculus
gttgaggcctgggtgtgcattatgt

SEQ ID NO: 345641 - DNA, 25 bp, Mus musculus
gttgagggaggagctttcatggatc

SEQ ID NO: 345642 - DNA, 25 bp, Mus musculus
gttgagtcaaacgagtctcccatta

SEQ ID NO: 345643 - DNA, 25 bp, Mus musculus
gttgagtcaaacgccacatctacat

SEQ ID NO: 345644 - DNA, 25 bp, Mus musculus
gttgagttattggtaacttcaattt

SEQ ID NO: 345645 - DNA, 25 bp, Mus musculus
gttgataaagactccattagcagag

SEQ ID NO: 345646 - DNA, 25 bp, Mus musculus
gttgatacaaatggaaactataagt

SEQ ID NO: 345647 - DNA, 25 bp, Mus musculus
gttgatccaaacatccagaacccag

SEQ ID NO: 345648 - DNA, 25 bp, Mus musculus
gttgatccagttcaggatgagatgc

SEQ ID NO: 345649 - DNA, 25 bp, Mus musculus
gttgatcttaagatgtcagtagaaa

SEQ ID NO: 345650 - DNA, 25 bp, Mus musculus
gttgatcttaaggatcgagagcgat

SEQ ID NO: 345651 - DNA, 25 bp, Mus musculus
gttgatcttaataatcctattgcag

SEQ ID NO: 345652 - DNA, 25 bp, Mus musculus
gttgatgaagagctggagtgattgt

SEQ ID NO: 345653 - DNA, 25 bp, Mus musculus
gttgatgagtggtacatatgacaat

SEQ ID NO: 345654 - DNA, 25 bp, Mus musculus
gttgatgcaaatgtgctagttggct

SEQ ID NO: 345655 - DNA, 25 bp, Mus musculus
gttgatgcaaggctttcctttgata

SEQ ID NO: 345656 - DNA, 25 bp, Mus musculus
gttgatgcaagggagctggaggaac

SEQ ID NO: 345657 - DNA, 25 bp, Mus musculus
gttgatgctgaccagatcgtgagac

SEQ ID NO: 345658 - DNA, 25 bp, Mus musculus
gttgatgctgaccaggatcttccca

SEQ ID NO: 345659 - DNA, 25 bp, Mus musculus
gttgatggctacagggtttatttgg

SEQ ID NO: 345660 - DNA, 25 bp, Mus musculus
gttgattacaggtacagcgcagcag

SEQ ID NO: 345661 - DNA, 25 bp, Mus musculus
gttgattccaaggagattgccctct

SEQ ID NO: 345662 - DNA, 25 bp, Mus musculus
gttgattccaaggagccagaaatca

SEQ ID NO: 345663 - DNA, 25 bp, Mus musculus
gttgattgagaaggagggagagttc

SEQ ID NO: 345664 - DNA, 25 bp, Mus musculus
gttgattgggaatttggcagctggg

SEQ ID NO: 345665 - DNA, 25 bp, Mus musculus
gttgatttgagggatggagagtcag

SEQ ID NO: 345666 - DNA, 25 bp, Mus musculus
gttgcaaatgctggaactgcagcag

SEQ ID NO: 345667 - DNA, 25 bp, Mus musculus
gttgcaaattagtttcgtggttttc

SEQ ID NO: 345668 - DNA, 25 bp, Mus musculus
gttgcaacaagaaggtgacactggc

SEQ ID NO: 345669 - DNA, 25 bp, Mus musculus
gttgcaaccctggaccctgtcctgc

SEQ ID NO: 345670 - DNA, 25 bp, Mus musculus
gttgcaacctcttggaaaggtatgc

SEQ ID NO: 345671 - DNA, 25 bp, Mus musculus
gttgcaactccttatgaagtggcag

SEQ ID NO: 345672 - DNA, 25 bp, Mus musculus
gttgcaagagggtgaagaagctgac

SEQ ID NO: 345673 - DNA, 25 bp, Mus musculus
gttgcaagatgcaggccccttccca

SEQ ID NO: 345674 - DNA, 25 bp, Mus musculus
gttgcaagcctcaagacgaaagtag

SEQ ID NO: 345675 - DNA, 25 bp, Mus musculus
gttgcaattacccacggtctgaaaa

SEQ ID NO: 345676 - DNA, 25 bp, Mus musculus
gttgcaattacgtttctactgcact

SEQ ID NO: 345677 - DNA, 25 bp, Mus musculus
gttgcacaaggcatgtgaagccagt

SEQ ID NO: 345678 - DNA, 25 bp, Mus musculus
gttgcacaaggtcattgaagccagt

SEQ ID NO: 345679 - DNA, 25 bp, Mus musculus
gttgcaccagacaagatgatagtag

SEQ ID NO: 345680 - DNA, 25 bp, Mus musculus
gttgcacgaaatgaggacaagctac

SEQ ID NO: 345681 - DNA, 25 bp, Mus musculus
gttgcagaagacagtgcatttgcag

SEQ ID NO: 345682 - DNA, 25 bp, Mus musculus
gttgcagaagacagtgctcttactg

SEQ ID NO: 345683 - DNA, 25 bp, Mus musculus
gttgcagatactcagcctcagggat

SEQ ID NO: 345684 - DNA, 25 bp, Mus musculus
gttgcagctatgtcaaagataagtg

SEQ ID NO: 345685 - DNA, 25 bp, Mus musculus
gttgcaggagcacccccaccgctgc

SEQ ID NO: 345686 - DNA, 25 bp, Mus musculus
gttgcaggagggtgaagggcctggc

SEQ ID NO: 345687 - DNA, 25 bp, Mus musculus
gttgcaggtgacagacacatctggt

SEQ ID NO: 345688 - DNA, 25 bp, Mus musculus
gttgcaggtgacaggttgctttgaa

SEQ ID NO: 345689 - DNA, 25 bp, Mus musculus
gttgcagtcaagtgccgtgcagctg

SEQ ID NO: 345690 - DNA, 25 bp, Mus musculus
gttgcagttacgtaggtctggtcag

SEQ ID NO: 345691 - DNA, 25 bp, Mus musculus
gttgcataatccagccctctaataa

SEQ ID NO: 345692 - DNA, 25 bp, Mus musculus
gttgcatatctgagattcagtttgc

SEQ ID NO: 345693 - DNA, 25 bp, Mus musculus
gttgcatcacaccagatgctgccag

SEQ ID NO: 345694 - DNA, 25 bp, Mus musculus
gttgcatcacaccagggagcaggat

SEQ ID NO: 345695 - DNA, 25 bp, Mus musculus
gttgcatcaggtactgtaataggtg

SEQ ID NO: 345696 - DNA, 25 bp, Mus musculus
gttgcatgaagacaaatcagagcga

SEQ ID NO: 345697 - DNA, 25 bp, Mus musculus
gttgcatgtttcaggtggtttgttg

SEQ ID NO: 345698 - DNA, 25 bp, Mus musculus
gttgcatttgcaggtcgctatgcat

SEQ ID NO: 345699 - DNA, 25 bp, Mus musculus
gttgccaaattggctccacttacct

SEQ ID NO: 345700 - DNA, 25 bp, Mus musculus
gttgccaagagagtacacggtcatt

SEQ ID NO: 345701 - DNA, 25 bp, Mus musculus
gttgccaagaggaaaatagcttcat

SEQ ID NO: 345702 - DNA, 25 bp, Mus musculus
gttgccaaggcaggtgatttggagt

SEQ ID NO: 345703 - DNA, 25 bp, Mus musculus
gttgccaatggaggtcctgcaccag

SEQ ID NO: 345704 - DNA, 25 bp, Mus musculus
gttgccaatggagtggagattgtgg

SEQ ID NO: 345705 - DNA, 25 bp, Mus musculus
gttgccacaccatataccgaagcaa

SEQ ID NO: 345706 - DNA, 25 bp, Mus musculus
gttgccacaccatatataaactaca

SEQ ID NO: 345707 - DNA, 25 bp, Mus musculus
gttgccaccaagacctgtacatgga

SEQ ID NO: 345708 - DNA, 25 bp, Mus musculus
gttgccaccaagtcctgtacatgga

SEQ ID NO: 345709 - DNA, 25 bp, Mus musculus
gttgccagcccaaagaggatctaag

SEQ ID NO: 345710 - DNA, 25 bp, Mus musculus
gttgccaggctccacccgcggtcag

SEQ ID NO: 345711 - DNA, 25 bp, Mus musculus
gttgccatcattggaaagatctata

SEQ ID NO: 345712 - DNA, 25 bp, Mus musculus
gttgcccagagatggactccagatt

SEQ ID NO: 345713 - DNA, 25 bp, Mus musculus
gttgcccagatcctgtgggccgaag

SEQ ID NO: 345714 - DNA, 25 bp, Mus musculus
gttgcccattgtcaggtgcgtgaag

SEQ ID NO: 345715 - DNA, 25 bp, Mus musculus
gttgccccagtgccagtggcatcaa

SEQ ID NO: 345716 - DNA, 25 bp, Mus musculus
gttgccccagtgccgtttgatttta

SEQ ID NO: 345717 - DNA, 25 bp, Mus musculus
gttgcccctataaaaactccgatga

SEQ ID NO: 345718 - DNA, 25 bp, Mus musculus
gttgccctgaggccctttatgctgc

SEQ ID NO: 345719 - DNA, 25 bp, Mus musculus
gttgccctgatgtaggacgaagaat

SEQ ID NO: 345720 - DNA, 25 bp, Mus musculus
gttgcccttgaacatttatgaacat

SEQ ID NO: 345721 - DNA, 25 bp, Mus musculus
gttgcccttggtgaggcatgcacca

SEQ ID NO: 345722 - DNA, 25 bp, Mus musculus
gttgccgatgagtctgcaatcctga

SEQ ID NO: 345723 - DNA, 25 bp, Mus musculus
gttgccgatgagtctgccaccattt

SEQ ID NO: 345724 - DNA, 25 bp, Mus musculus
gttgccgatgagtctgcctgccatt

SEQ ID NO: 345725 - DNA, 25 bp, Mus musculus
gttgccgccataggtttatggagcc

SEQ ID NO: 345726 - DNA, 25 bp, Mus musculus
gttgccggccagcagtactattact

SEQ ID NO: 345727 - DNA, 25 bp, Mus musculus
gttgccgggcgagctggaaaccatg

SEQ ID NO: 345728 - DNA, 25 bp, Mus musculus
gttgccgggcgaggcctctgagaac

SEQ ID NO: 345729 - DNA, 25 bp, Mus musculus
gttgcctacatgtagctgagaccta

SEQ ID NO: 345730 - DNA, 25 bp, Mus musculus
gttgcctcaagacatttgagggaca

SEQ ID NO: 345731 - DNA, 25 bp, Mus musculus
gttgcctcaaggtcctctgtctctc

SEQ ID NO: 345732 - DNA, 25 bp, Mus musculus
gttgcctcagatttcttgacctaca

SEQ ID NO: 345733 - DNA, 25 bp, Mus musculus
gttgcctcagcaccaaggagatcca

SEQ ID NO: 345734 - DNA, 25 bp, Mus musculus
gttgcctcggagtttcagcctcaac

SEQ ID NO: 345735 - DNA, 25 bp, Mus musculus
gttgcctctggacagcggaggctgc

SEQ ID NO: 345736 - DNA, 25 bp, Mus musculus
gttgcctgactcgctcggaagctgt

SEQ ID NO: 345737 - DNA, 25 bp, Mus musculus
gttgcctgtgagaaggccctgggga

SEQ ID NO: 345738 - DNA, 25 bp, Mus musculus
gttgccttgtggaggaactacttca

SEQ ID NO: 345739 - DNA, 25 bp, Mus musculus
gttgcctttccccggaggaattcgt

SEQ ID NO: 345740 - DNA, 25 bp, Mus musculus
gttgcctttgcacctgagaacccat

SEQ ID NO: 345741 - DNA, 25 bp, Mus musculus
gttgcgagcccccatgattcagtaa

SEQ ID NO: 345742 - DNA, 25 bp, Mus musculus
gttgcgagcccccatggctccatac

SEQ ID NO: 345743 - DNA, 25 bp, Mus musculus
gttgcgagctctgcttgctggttgt

SEQ ID NO: 345744 - DNA, 25 bp, Mus musculus
gttgcgccaggcaggacactgctac

SEQ ID NO: 345745 - DNA, 25 bp, Mus musculus
gttgcgccaggtgtagctccacttt

SEQ ID NO: 345746 - DNA, 25 bp, Mus musculus
gttgcgccccagcctccaccatgcc

SEQ ID NO: 345747 - DNA, 25 bp, Mus musculus
gttgcgcgcacagatttgaagactg

SEQ ID NO: 345748 - DNA, 25 bp, Mus musculus
gttgcgcgcacaggcctcctctgtc

SEQ ID NO: 345749 - DNA, 25 bp, Mus musculus
gttgcgcgctctcaggctagagttc

SEQ ID NO: 345750 - DNA, 25 bp, Mus musculus
gttgcggaaacaggcattgaagaca

SEQ ID NO: 345751 - DNA, 25 bp, Mus musculus
gttgcggcagatgccccacaggatc

SEQ ID NO: 345752 - DNA, 25 bp, Mus musculus
gttgcggccacacggctggatagcc

SEQ ID NO: 345753 - DNA, 25 bp, Mus musculus
gttgcggcgccaagatccccagctc

SEQ ID NO: 345754 - DNA, 25 bp, Mus musculus
gttgcggctgaagaacgggaaccgg

SEQ ID NO: 345755 - DNA, 25 bp, Mus musculus
gttgcggctgagtggagattctaga

SEQ ID NO: 345756 - DNA, 25 bp, Mus musculus
gttgcgtcaagagcctcagcttaag

SEQ ID NO: 345757 - DNA, 25 bp, Mus musculus
gttgctaaaactgccttggggtgct

SEQ ID NO: 345758 - DNA, 25 bp, Mus musculus
gttgctaaaagtgcctcctgagaag

SEQ ID NO: 345759 - DNA, 25 bp, Mus musculus
gttgctaaacagcatccagggaaat

SEQ ID NO: 345760 - DNA, 25 bp, Mus musculus
gttgctatcatgcgtgagtgcatct

SEQ ID NO: 345761 - DNA, 25 bp, Mus musculus
gttgctatgctaagtatgagagcca

SEQ ID NO: 345762 - DNA, 25 bp, Mus musculus
gttgctcagacttggatacccttct

SEQ ID NO: 345763 - DNA, 25 bp, Mus musculus
gttgctcagcagaatggcactacaa

SEQ ID NO: 345764 - DNA, 25 bp, Mus musculus
gttgctcataaatcagccttacgat

SEQ ID NO: 345765 - DNA, 25 bp, Mus musculus
gttgctccccagccctgaggtgcgc

SEQ ID NO: 345766 - DNA, 25 bp, Mus musculus
gttgctgaagaagagcatcatggtc

SEQ ID NO: 345767 - DNA, 25 bp, Mus musculus
gttgctgaagatcaaccgagaaagc

SEQ ID NO: 345768 - DNA, 25 bp, Mus musculus
gttgctgaagcttcaaaagaaagcc

SEQ ID NO: 345769 - DNA, 25 bp, Mus musculus
gttgctgacagaattaacggcacag

SEQ ID NO: 345770 - DNA, 25 bp, Mus musculus
gttgctgacgagatctggccgcccc

SEQ ID NO: 345771 - DNA, 25 bp, Mus musculus
gttgctgcagacccgtggattccca

SEQ ID NO: 345772 - DNA, 25 bp, Mus musculus
gttgctgccctagagatagtcaata

SEQ ID NO: 345773 - DNA, 25 bp, Mus musculus
gttgctgccctagagatcaagatat

SEQ ID NO: 345774 - DNA, 25 bp, Mus musculus
gttgctgctccagggtggggcactg

SEQ ID NO: 345775 - DNA, 25 bp, Mus musculus
gttgctgctgattttcatttcctcc

SEQ ID NO: 345776 - DNA, 25 bp, Mus musculus
gttgctgctggggtctgcgagcttt

SEQ ID NO: 345777 - DNA, 25 bp, Mus musculus
gttgctgctggtgccagggtgtcat

SEQ ID NO: 345778 - DNA, 25 bp, Mus musculus
gttgctgctgttatttccgagagac

SEQ ID NO: 345779 - DNA, 25 bp, Mus musculus
gttgctgggaggagagcgacatgtt

SEQ ID NO: 345780 - DNA, 25 bp, Mus musculus
gttgctgtagaggttgctgcatccc

SEQ ID NO: 345781 - DNA, 25 bp, Mus musculus
gttgctgtccagaaccccgtctgtg

SEQ ID NO: 345782 - DNA, 25 bp, Mus musculus
gttgctgtccagggtgaagcctgct

SEQ ID NO: 345783 - DNA, 25 bp, Mus musculus
gttgctgtcgtgcctcgaggcagca

SEQ ID NO: 345784 - DNA, 25 bp, Mus musculus
gttgctgtggccctctgattgccct

SEQ ID NO: 345785 - DNA, 25 bp, Mus musculus
gttgctgttatcggaaataaagaaa

SEQ ID NO: 345786 - DNA, 25 bp, Mus musculus
gttgcttaatagattgtgcccacct

SEQ ID NO: 345787 - DNA, 25 bp, Mus musculus
gttgcttagaggctcttgaaatgga

SEQ ID NO: 345788 - DNA, 25 bp, Mus musculus
gttgcttcatccaaggcgttagaca

SEQ ID NO: 345789 - DNA, 25 bp, Mus musculus
gttgcttcccagaggaagtcacaga

SEQ ID NO: 345790 - DNA, 25 bp, Mus musculus
gttgcttctcaccaaggtctgagta

SEQ ID NO: 345791 - DNA, 25 bp, Mus musculus
gttgcttctggggtcacaggatgct

SEQ ID NO: 345792 - DNA, 25 bp, Mus musculus
gttgcttctgttaggtgctggagag

SEQ ID NO: 345793 - DNA, 25 bp, Mus musculus
gttgcttgatggtgaaattgaagcc

SEQ ID NO: 345794 - DNA, 25 bp, Mus musculus
gttgctttctgtgaggccaggttcc

SEQ ID NO: 345795 - DNA, 25 bp, Mus musculus
gttgctttctgtttctaatcctggt

SEQ ID NO: 345796 - DNA, 25 bp, Mus musculus
gttgcttttaaaggattaaaggaga

SEQ ID NO: 345797 - DNA, 25 bp, Mus musculus
gttgcttttacatttgtcataatcc

SEQ ID NO: 345798 - DNA, 25 bp, Mus musculus
gttggaaaacattaagtcttgggta

SEQ ID NO: 345799 - DNA, 25 bp, Mus musculus
gttggaaaacattaataattaccgt

SEQ ID NO: 345800 - DNA, 25 bp, Mus musculus
gttggaaaagaaccgacgagctcac

SEQ ID NO: 345801 - DNA, 25 bp, Mus musculus
gttggaaaagaaccgtggctctcca

SEQ ID NO: 345802 - DNA, 25 bp, Mus musculus
gttggaaaaggagaagctacttgca

SEQ ID NO: 345803 - DNA, 25 bp, Mus musculus
gttggaaagacagggggcagtgccc

SEQ ID NO: 345804 - DNA, 25 bp, Mus musculus
gttggaaagacagtgtttgtaagcg

SEQ ID NO: 345805 - DNA, 25 bp, Mus musculus
gttggaaagtcgacagaggcaagac

SEQ ID NO: 345806 - DNA, 25 bp, Mus musculus
gttggaaatcagcaagaagagaacc

SEQ ID NO: 345807 - DNA, 25 bp, Mus musculus
gttggaaatcaggggtctgcaacaa

SEQ ID NO: 345808 - DNA, 25 bp, Mus musculus
gttggaacattattgcttcacctct

SEQ ID NO: 345809 - DNA, 25 bp, Mus musculus
gttggaaccaaagatatttccatat

SEQ ID NO: 345810 - DNA, 25 bp, Mus musculus
gttggaaggacaaggttgttgacct

SEQ ID NO: 345811 - DNA, 25 bp, Mus musculus
gttggaataaaggaaacaagctccc

SEQ ID NO: 345812 - DNA, 25 bp, Mus musculus
gttggaatcagggctacggctacca

SEQ ID NO: 345813 - DNA, 25 bp, Mus musculus
gttggacaagatgcaagttctgctg

SEQ ID NO: 345814 - DNA, 25 bp, Mus musculus
gttggacaagccccacgcaatcatt

SEQ ID NO: 345815 - DNA, 25 bp, Mus musculus
gttggacaagggctgcaaacacaac

SEQ ID NO: 345816 - DNA, 25 bp, Mus musculus
gttggaccagcagagaaattcaaag

SEQ ID NO: 345817 - DNA, 25 bp, Mus musculus
gttggacccaggagccgggtgtggg

SEQ ID NO: 345818 - DNA, 25 bp, Mus musculus
gttggaccccaaatgattataagca

SEQ ID NO: 345819 - DNA, 25 bp, Mus musculus
gttggactcatgagagcaaagacca

SEQ ID NO: 345820 - DNA, 25 bp, Mus musculus
gttggactgcagcctaaatggcaaa

SEQ ID NO: 345821 - DNA, 25 bp, Mus musculus
gttggactggaaaggtggtctactt

SEQ ID NO: 345822 - DNA, 25 bp, Mus musculus
gttggactggaaaggttggtttctt

SEQ ID NO: 345823 - DNA, 25 bp, Mus musculus
gttggacttggtgtgagtcattctg

SEQ ID NO: 345824 - DNA, 25 bp, Mus musculus
gttggagaaacactgaggacgggat

SEQ ID NO: 345825 - DNA, 25 bp, Mus musculus
gttggagaaactggcagagctgtgt

SEQ ID NO: 345826 - DNA, 25 bp, Mus musculus
gttggagaaatctctggtcgcttag

SEQ ID NO: 345827 - DNA, 25 bp, Mus musculus
gttggagaacggggtgaccgtggag

SEQ ID NO: 345828 - DNA, 25 bp, Mus musculus
gttggagatgacatgtttcattggc

SEQ ID NO: 345829 - DNA, 25 bp, Mus musculus
gttggagatgtgggctgcgacccaa

SEQ ID NO: 345830 - DNA, 25 bp, Mus musculus
gttggagatgtgtccagacctttta

SEQ ID NO: 345831 - DNA, 25 bp, Mus musculus
gttggagcaggcggacagagaagtt

SEQ ID NO: 345832 - DNA, 25 bp, Mus musculus
gttggagcaggtactggccttatgg

SEQ ID NO: 345833 - DNA, 25 bp, Mus musculus
gttggagcaggtggcaaagcaacag

SEQ ID NO: 345834 - DNA, 25 bp, Mus musculus
gttggagccagctatgtggccctag

SEQ ID NO: 345835 - DNA, 25 bp, Mus musculus
gttggagccagctcctgctgctgaa

SEQ ID NO: 345836 - DNA, 25 bp, Mus musculus
gttggagcgggcggcaggaaatgct

SEQ ID NO: 345837 - DNA, 25 bp, Mus musculus
gttggagctcaggtgcccctgggag

SEQ ID NO: 345838 - DNA, 25 bp, Mus musculus
gttggagctgcagggcctgttgctc

SEQ ID NO: 345839 - DNA, 25 bp, Mus musculus
gttggagctgcaggggctctgagac

SEQ ID NO: 345840 - DNA, 25 bp, Mus musculus
gttggaggactatggcgtttactgg

SEQ ID NO: 345841 - DNA, 25 bp, Mus musculus
gttggaggactatggggtcacatat

SEQ ID NO: 345842 - DNA, 25 bp, Mus musculus
gttggaggagcgaacctagctcaga

SEQ ID NO: 345843 - DNA, 25 bp, Mus musculus
gttggaggagggaacctagctcaga

SEQ ID NO: 345844 - DNA, 25 bp, Mus musculus
gttggaggcagacgatttacatgga

SEQ ID NO: 345845 - DNA, 25 bp, Mus musculus
gttggaggccaggaatggtaccagc

SEQ ID NO: 345846 - DNA, 25 bp, Mus musculus
gttggaggccagtgcctctctgggc

SEQ ID NO: 345847 - DNA, 25 bp, Mus musculus
gttggaggctaggtcttggtttcct

SEQ ID NO: 345848 - DNA, 25 bp, Mus musculus
gttggagtaatggccttattcagga

SEQ ID NO: 345849 - DNA, 25 bp, Mus musculus
gttggagtgttcggggttaactgct

SEQ ID NO: 345850 - DNA, 25 bp, Mus musculus
gttggataaaggataaggtagctaa

SEQ ID NO: 345851 - DNA, 25 bp, Mus musculus
gttggatagtagtgaattgaatcca

SEQ ID NO: 345852 - DNA, 25 bp, Mus musculus
gttggatcagaggagtccctggtgc

SEQ ID NO: 345853 - DNA, 25 bp, Mus musculus
gttggatcctcctctgtagagctca

SEQ ID NO: 345854 - DNA, 25 bp, Mus musculus
gttggatcctgcgggttgaggcgcc

SEQ ID NO: 345855 - DNA, 25 bp, Mus musculus
gttggatctcataagagaggagcca

SEQ ID NO: 345856 - DNA, 25 bp, Mus musculus
gttggatgcaagctatgccccctca

SEQ ID NO: 345857 - DNA, 25 bp, Mus musculus
gttggatgctgaggacatcgtgaac

SEQ ID NO: 345858 - DNA, 25 bp, Mus musculus
gttggatgctgaggatattgtaggc

SEQ ID NO: 345859 - DNA, 25 bp, Mus musculus
gttggatgctgagggcactctgagg

SEQ ID NO: 345860 - DNA, 25 bp, Mus musculus
gttggatgtaaagacctctcgggaa

SEQ ID NO: 345861 - DNA, 25 bp, Mus musculus
gttggattatgggtgggtgcatcct

SEQ ID NO: 345862 - DNA, 25 bp, Mus musculus
gttggattatggtccacagtgagga

SEQ ID NO: 345863 - DNA, 25 bp, Mus musculus
gttggcaaagctagatctttcagaa

SEQ ID NO: 345864 - DNA, 25 bp, Mus musculus
gttggcaaagctgacaaaccaagtg

SEQ ID NO: 345865 - DNA, 25 bp, Mus musculus
gttggcaaagcttcttcagctgaca

SEQ ID NO: 345866 - DNA, 25 bp, Mus musculus
gttggcaaaggtgactccaatgaag

SEQ ID NO: 345867 - DNA, 25 bp, Mus musculus
gttggcaacctctgaagtcttgaaa

SEQ ID NO: 345868 - DNA, 25 bp, Mus musculus
gttggcaagtgctccggccattcca

SEQ ID NO: 345869 - DNA, 25 bp, Mus musculus
gttggcactgcaggaagaagaggaa

SEQ ID NO: 345870 - DNA, 25 bp, Mus musculus
gttggcactgggatcagtaatggcg

SEQ ID NO: 345871 - DNA, 25 bp, Mus musculus
gttggcatcaatcatggaaaggatt

SEQ ID NO: 345872 - DNA, 25 bp, Mus musculus
gttggcatcagaccacagcagttta

SEQ ID NO: 345873 - DNA, 25 bp, Mus musculus
gttggcatccaaggtccagggagtt

SEQ ID NO: 345874 - DNA, 25 bp, Mus musculus
gttggcatgaccaagttcatgaagc

SEQ ID NO: 345875 - DNA, 25 bp, Mus musculus
gttggccaaggtgtttcccagccac

SEQ ID NO: 345876 - DNA, 25 bp, Mus musculus
gttggccagacagctgagaaggtag

SEQ ID NO: 345877 - DNA, 25 bp, Mus musculus
gttggccaggaaggggagccaggcc

SEQ ID NO: 345878 - DNA, 25 bp, Mus musculus
gttggcccagaggcagcttccaatg

SEQ ID NO: 345879 - DNA, 25 bp, Mus musculus
gttggcccagtgtcaccagactgtt

SEQ ID NO: 345880 - DNA, 25 bp, Mus musculus
gttggcccggcccactcagaggctg

SEQ ID NO: 345881 - DNA, 25 bp, Mus musculus
gttggccctcagggtcccacaggag

SEQ ID NO: 345882 - DNA, 25 bp, Mus musculus
gttggccgaggtggtcctgccgaca

SEQ ID NO: 345883 - DNA, 25 bp, Mus musculus
gttggcctataggaagtttggtgag

SEQ ID NO: 345884 - DNA, 25 bp, Mus musculus
gttggcctccacagaggttgtgccc

SEQ ID NO: 345885 - DNA, 25 bp, Mus musculus
gttggcctctcagaaaacatccagt

SEQ ID NO: 345886 - DNA, 25 bp, Mus musculus
gttggcctctcaggtcaaaggctga

SEQ ID NO: 345887 - DNA, 25 bp, Mus musculus
gttggcctctttaaaagaacagatg

SEQ ID NO: 345888 - DNA, 25 bp, Mus musculus
gttggcctctttaaattgaaaatac

SEQ ID NO: 345889 - DNA, 25 bp, Mus musculus
gttggcctttgagtagagtatcact

SEQ ID NO: 345890 - DNA, 25 bp, Mus musculus
gttggcgattagactctgccttcag

SEQ ID NO: 345891 - DNA, 25 bp, Mus musculus
gttggcgattagaggtctgacatgg

SEQ ID NO: 345892 - DNA, 25 bp, Mus musculus
gttggcggagagagtacccagtatt

SEQ ID NO: 345893 - DNA, 25 bp, Mus musculus
gttggcggcgtgagcccagatcatg

SEQ ID NO: 345894 - DNA, 25 bp, Mus musculus
gttggctaatggagcccgctgtgag

SEQ ID NO: 345895 - DNA, 25 bp, Mus musculus
gttggctaccagggacctcctggcc

SEQ ID NO: 345896 - DNA, 25 bp, Mus musculus
gttggctcaggagggtgtgaagaca

SEQ ID NO: 345897 - DNA, 25 bp, Mus musculus
gttggctgaatgtttgttaactgaa

SEQ ID NO: 345898 - DNA, 25 bp, Mus musculus
gttggctgccagcgggcgaactttc

SEQ ID NO: 345899 - DNA, 25 bp, Mus musculus
gttggctgcccaaggtgaacttgat

SEQ ID NO: 345900 - DNA, 25 bp, Mus musculus
gttggctgcccaaggttgttgctaa

SEQ ID NO: 345901 - DNA, 25 bp, Mus musculus
gttggctggagggaaggtggctggg

SEQ ID NO: 345902 - DNA, 25 bp, Mus musculus
gttggctggcgtgccctacgttggc

SEQ ID NO: 345903 - DNA, 25 bp, Mus musculus
gttggctggtccagctggtcttcac

SEQ ID NO: 345904 - DNA, 25 bp, Mus musculus
gttggctggtccaggtacatccctg

SEQ ID NO: 345905 - DNA, 25 bp, Mus musculus
gttggctggtggagtgttctccagt

SEQ ID NO: 345906 - DNA, 25 bp, Mus musculus
gttggcttcattttaggtttaggat

SEQ ID NO: 345907 - DNA, 25 bp, Mus musculus
gttggcttgtggtctatgttcagaa

SEQ ID NO: 345908 - DNA, 25 bp, Mus musculus
gttggcttgttggaggggactttcc

SEQ ID NO: 345909 - DNA, 25 bp, Mus musculus
gttggctttaacaatctccattcgg

SEQ ID NO: 345910 - DNA, 25 bp, Mus musculus
gttgggaagagtgccatgacaatgc

SEQ ID NO: 345911 - DNA, 25 bp, Mus musculus
gttgggaagagtgtgtcctgagttg

SEQ ID NO: 345912 - DNA, 25 bp, Mus musculus
gttgggaatacaggagacagaaaag

SEQ ID NO: 345913 - DNA, 25 bp, Mus musculus
gttgggaatgtccggcggtttcatg

SEQ ID NO: 345914 - DNA, 25 bp, Mus musculus
gttgggagtaaatatttctaccatt

SEQ ID NO: 345915 - DNA, 25 bp, Mus musculus
gttgggagtaaattagcatatgtat

SEQ ID NO: 345916 - DNA, 25 bp, Mus musculus
gttgggataaactcgcatgtgtgga

SEQ ID NO: 345917 - DNA, 25 bp, Mus musculus
gttgggatcagattgataagtatct

SEQ ID NO: 345918 - DNA, 25 bp, Mus musculus
gttgggattattatgctttctccca

SEQ ID NO: 345919 - DNA, 25 bp, Mus musculus
gttgggattccaggacgcccctgtg

SEQ ID NO: 345920 - DNA, 25 bp, Mus musculus
gttgggattgtaggtcacgctggag

SEQ ID NO: 345921 - DNA, 25 bp, Mus musculus
gttgggatttcagacaggtggagtc

SEQ ID NO: 345922 - DNA, 25 bp, Mus musculus
gttgggatttcaggtctctggcttt

SEQ ID NO: 345923 - DNA, 25 bp, Mus musculus
gttgggcagtgaatccaaaactacc

SEQ ID NO: 345924 - DNA, 25 bp, Mus musculus
gttgggcatggaaccatctggaggt

SEQ ID NO: 345925 - DNA, 25 bp, Mus musculus
gttgggctaaagaatatgacagata

SEQ ID NO: 345926 - DNA, 25 bp, Mus musculus
gttgggcttcagcgagaactttcaa

SEQ ID NO: 345927 - DNA, 25 bp, Mus musculus
gttggggagtatccgcctccgactc

SEQ ID NO: 345928 - DNA, 25 bp, Mus musculus
gttggggatttacagggctgcagaa

SEQ ID NO: 345929 - DNA, 25 bp, Mus musculus
gttggggcgccagacaggattatgg

SEQ ID NO: 345930 - DNA, 25 bp, Mus musculus
gttggggcgccagggatcaacgttg

SEQ ID NO: 345931 - DNA, 25 bp, Mus musculus
gttggggctaggtgtctccagtgcc

SEQ ID NO: 345932 - DNA, 25 bp, Mus musculus
gttggggctagtgcttatcctggtc

SEQ ID NO: 345933 - DNA, 25 bp, Mus musculus
gttggggctgaaaagacactacaag

SEQ ID NO: 345934 - DNA, 25 bp, Mus musculus
gttgggggcagggagacgatactgt

SEQ ID NO: 345935 - DNA, 25 bp, Mus musculus
gttgggggtctgagagaatcgcacg

SEQ ID NO: 345936 - DNA, 25 bp, Mus musculus
gttggggttcagttctgatacccga

SEQ ID NO: 345937 - DNA, 25 bp, Mus musculus
gttggggttcatgagaggccgaggc

SEQ ID NO: 345938 - DNA, 25 bp, Mus musculus
gttggggttgccagccatgctgcaa

SEQ ID NO: 345939 - DNA, 25 bp, Mus musculus
gttgggtatcagatgttcatctaga

SEQ ID NO: 345940 - DNA, 25 bp, Mus musculus
gttgggttcagatacaggagcctaa

SEQ ID NO: 345941 - DNA, 25 bp, Mus musculus
gttgggttttaagtgcggagatcca

SEQ ID NO: 345942 - DNA, 25 bp, Mus musculus
gttggtaaagagcatcataagggtg

SEQ ID NO: 345943 - DNA, 25 bp, Mus musculus
gttggtaaatgtttatggagccgta

SEQ ID NO: 345944 - DNA, 25 bp, Mus musculus
gttggtaatggagcccgagttcgtc

SEQ ID NO: 345945 - DNA, 25 bp, Mus musculus
gttggtaatggaggtgcccctgtgc

SEQ ID NO: 345946 - DNA, 25 bp, Mus musculus
gttggtaatttacagtagttgcagt

SEQ ID NO: 345947 - DNA, 25 bp, Mus musculus
gttggtaggtgcgccaaacagtggg

SEQ ID NO: 345948 - DNA, 25 bp, Mus musculus
gttggtagtaaaatggaaggtgtct

SEQ ID NO: 345949 - DNA, 25 bp, Mus musculus
gttggtcaagtgcatcgaggagttg

SEQ ID NO: 345950 - DNA, 25 bp, Mus musculus
gttggtcactacactgcatatgcga

SEQ ID NO: 345951 - DNA, 25 bp, Mus musculus
gttggtccatatatttcttctgatt

SEQ ID NO: 345952 - DNA, 25 bp, Mus musculus
gttggtccttctggagcccctggtg

SEQ ID NO: 345953 - DNA, 25 bp, Mus musculus
gttggtgaagaaacttgtggaaaca

SEQ ID NO: 345954 - DNA, 25 bp, Mus musculus
gttggtgataaaaaggtgtcactct

SEQ ID NO: 345955 - DNA, 25 bp, Mus musculus
gttggtgataaaaagtctttttatg

SEQ ID NO: 345956 - DNA, 25 bp, Mus musculus
gttggtgccatggtggcttcagtaa

SEQ ID NO: 345957 - DNA, 25 bp, Mus musculus
gttggtggaaatgaggcagctgcga

SEQ ID NO: 345958 - DNA, 25 bp, Mus musculus
gttggtggaagatgtgctcgtagct

SEQ ID NO: 345959 - DNA, 25 bp, Mus musculus
gttggtggcacggatggcaatgtgc

SEQ ID NO: 345960 - DNA, 25 bp, Mus musculus
gttggtggctacctgaagctgatgc

SEQ ID NO: 345961 - DNA, 25 bp, Mus musculus
gttggtgtctgtggggacctctgag

SEQ ID NO: 345962 - DNA, 25 bp, Mus musculus
gttggtgtggaggctcatctcagag

SEQ ID NO: 345963 - DNA, 25 bp, Mus musculus
gttggtgtggaggggctcctctgtc

SEQ ID NO: 345964 - DNA, 25 bp, Mus musculus
gttggttatatttgcctaaagacgt

SEQ ID NO: 345965 - DNA, 25 bp, Mus musculus
gttggttattggtggttttggctcg

SEQ ID NO: 345966 - DNA, 25 bp, Mus musculus
gttggttcaggtggaacatccagac

SEQ ID NO: 345967 - DNA, 25 bp, Mus musculus
gttggttcagtatcctgtggaacat

SEQ ID NO: 345968 - DNA, 25 bp, Mus musculus
gttggttgatccaaacatccagaac

SEQ ID NO: 345969 - DNA, 25 bp, Mus musculus
gttggttggaacgaatgcctccaat

SEQ ID NO: 345970 - DNA, 25 bp, Mus musculus
gttggttggagcatttgacattgtg

SEQ ID NO: 345971 - DNA, 25 bp, Mus musculus
gttggttggagtgctcaaggaggcc

SEQ ID NO: 345972 - DNA, 25 bp, Mus musculus
gttggttggcttttgtttgtcattt

SEQ ID NO: 345973 - DNA, 25 bp, Mus musculus
gttggttgtttttggtgccttcaag

SEQ ID NO: 345974 - DNA, 25 bp, Mus musculus
gttggtttccagcccgtcctttcat

SEQ ID NO: 345975 - DNA, 25 bp, Mus musculus
gttggtttttcagaagatatggcct

SEQ ID NO: 345976 - DNA, 25 bp, Mus musculus
gttggtttttctaggaaatcaagca

SEQ ID NO: 345977 - DNA, 25 bp, Mus musculus
gttggtttttgtctccctgcaacag

SEQ ID NO: 345978 - DNA, 25 bp, Mus musculus
gttgtaaaacgagccctcagggatt

SEQ ID NO: 345979 - DNA, 25 bp, Mus musculus
gttgtaaaatggtatggcctcacaa

SEQ ID NO: 345980 - DNA, 25 bp, Mus musculus
gttgtaaatgcagggtctcgtggtt

SEQ ID NO: 345981 - DNA, 25 bp, Mus musculus
gttgtaaatgcagtgattgatgatg

SEQ ID NO: 345982 - DNA, 25 bp, Mus musculus
gttgtaattccaactctggttgacc

SEQ ID NO: 345983 - DNA, 25 bp, Mus musculus
gttgtaccccaggcattgggcatgg

SEQ ID NO: 345984 - DNA, 25 bp, Mus musculus
gttgtacctgattggactgcccgtg

SEQ ID NO: 345985 - DNA, 25 bp, Mus musculus
gttgtactcagttaggatgaccatt

SEQ ID NO: 345986 - DNA, 25 bp, Mus musculus
gttgtactcagttagtttcctatga

SEQ ID NO: 345987 - DNA, 25 bp, Mus musculus
gttgtacttggccagccgtgtgggt

SEQ ID NO: 345988 - DNA, 25 bp, Mus musculus
gttgtagcccagaaagtcctaggtg

SEQ ID NO: 345989 - DNA, 25 bp, Mus musculus
gttgtaggacaaaggtatggctttg

SEQ ID NO: 345990 - DNA, 25 bp, Mus musculus
gttgtagttgatctggtgtgttatc

SEQ ID NO: 345991 - DNA, 25 bp, Mus musculus
gttgtatggaagagttactttggag

SEQ ID NO: 345992 - DNA, 25 bp, Mus musculus
gttgtatggaagatctctgcgatat

SEQ ID NO: 345993 - DNA, 25 bp, Mus musculus
gttgtcaacaagctcattcagttcc

SEQ ID NO: 345994 - DNA, 25 bp, Mus musculus
gttgtcaatcagcacaatgctccag

SEQ ID NO: 345995 - DNA, 25 bp, Mus musculus
gttgtcacctgaggcccttctcccc

SEQ ID NO: 345996 - DNA, 25 bp, Mus musculus
gttgtcacctggagcattccagaaa

SEQ ID NO: 345997 - DNA, 25 bp, Mus musculus
gttgtcagcgactgggtgccattgt

SEQ ID NO: 345998 - DNA, 25 bp, Mus musculus
gttgtcagcgctgatagaagtggaa

SEQ ID NO: 345999 - DNA, 25 bp, Mus musculus
gttgtcagcgggtgactttgcagtt

SEQ ID NO: 346000 - DNA, 25 bp, Mus musculus
gttgtcaggagatataacagacttt

SEQ ID NO: 346001 - DNA, 25 bp, Mus musculus
gttgtcagggtaagagatggctgtg

SEQ ID NO: 346002 - DNA, 25 bp, Mus musculus
gttgtcagtcttatggggcccagac

SEQ ID NO: 346003 - DNA, 25 bp, Mus musculus
gttgtcatcacagcttagcgctctg

SEQ ID NO: 346004 - DNA, 25 bp, Mus musculus
gttgtcatccacacctccatcccac

SEQ ID NO: 346005 - DNA, 25 bp, Mus musculus
gttgtcatggagagaatgcctccta

SEQ ID NO: 346006 - DNA, 25 bp, Mus musculus
gttgtcatggaggactgtcaccaga

SEQ ID NO: 346007 - DNA, 25 bp, Mus musculus
gttgtcattgagcaagaagagaggc

SEQ ID NO: 346008 - DNA, 25 bp, Mus musculus
gttgtcattgagtaggtggacccat

SEQ ID NO: 346009 - DNA, 25 bp, Mus musculus
gttgtccaagattttaccggaagac

SEQ ID NO: 346010 - DNA, 25 bp, Mus musculus
gttgtccaaggaatgtggcttcggc

SEQ ID NO: 346011 - DNA, 25 bp, Mus musculus
gttgtccatcaaagccccagaagac

SEQ ID NO: 346012 - DNA, 25 bp, Mus musculus
gttgtccatcaaagctgacttctct

SEQ ID NO: 346013 - DNA, 25 bp, Mus musculus
gttgtcccagaggtgccccagctca

SEQ ID NO: 346014 - DNA, 25 bp, Mus musculus
gttgtcccagctgtccctcctccca

SEQ ID NO: 346015 - DNA, 25 bp, Mus musculus
gttgtccccttcgcggccgtcagaa

SEQ ID NO: 346016 - DNA, 25 bp, Mus musculus
gttgtccccttcggatgaattgtct

SEQ ID NO: 346017 - DNA, 25 bp, Mus musculus
gttgtccctgacaggtttggccatc

SEQ ID NO: 346018 - DNA, 25 bp, Mus musculus
gttgtccctgaggagcagggcattt

SEQ ID NO: 346019 - DNA, 25 bp, Mus musculus
gttgtccgcataggcttcagttgtg

SEQ ID NO: 346020 - DNA, 25 bp, Mus musculus
gttgtccgcccgagatcatcagaaa

SEQ ID NO: 346021 - DNA, 25 bp, Mus musculus
gttgtccgccgccgcaaccatcagc

SEQ ID NO: 346022 - DNA, 25 bp, Mus musculus
gttgtcgcaggacagtaatgatgac

SEQ ID NO: 346023 - DNA, 25 bp, Mus musculus
gttgtcggcgtaggaatgtgtttct

SEQ ID NO: 346024 - DNA, 25 bp, Mus musculus
gttgtcgggcagaactgtgtctgta

SEQ ID NO: 346025 - DNA, 25 bp, Mus musculus
gttgtcgggcagccagccattcatg

SEQ ID NO: 346026 - DNA, 25 bp, Mus musculus
gttgtcgtcgtcagcttgacaaaag

SEQ ID NO: 346027 - DNA, 25 bp, Mus musculus
gttgtctcaaagcgcaaatttccca

SEQ ID NO: 346028 - DNA, 25 bp, Mus musculus
gttgtctcaacagcctgacagagca

SEQ ID NO: 346029 - DNA, 25 bp, Mus musculus
gttgtcttccaaaaggctcaaagac

SEQ ID NO: 346030 - DNA, 25 bp, Mus musculus
gttgtgaaagtggaacccagtgaca

SEQ ID NO: 346031 - DNA, 25 bp, Mus musculus
gttgtgaaagtgttacaggtttatg

SEQ ID NO: 346032 - DNA, 25 bp, Mus musculus
gttgtgaaatgcacgatgaggaaac

SEQ ID NO: 346033 - DNA, 25 bp, Mus musculus
gttgtgaataggatggagacaacag

SEQ ID NO: 346034 - DNA, 25 bp, Mus musculus
gttgtgagaataagttcaaggtgct

SEQ ID NO: 346035 - DNA, 25 bp, Mus musculus
gttgtgagagaaggaagaggcaaat

SEQ ID NO: 346036 - DNA, 25 bp, Mus musculus
gttgtgagatttttgtggacagcac

SEQ ID NO: 346037 - DNA, 25 bp, Mus musculus
gttgtgatcttattaattggaggct

SEQ ID NO: 346038 - DNA, 25 bp, Mus musculus
gttgtgatcttggaggctggtccag

SEQ ID NO: 346039 - DNA, 25 bp, Mus musculus
gttgtgattcagatacaaacaggat

SEQ ID NO: 346040 - DNA, 25 bp, Mus musculus
gttgtgattcagatcaactgccacc

SEQ ID NO: 346041 - DNA, 25 bp, Mus musculus
gttgtgcaaatgaagaaaagcaact

SEQ ID NO: 346042 - DNA, 25 bp, Mus musculus
gttgtgcagagactgccttgtgtgg

SEQ ID NO: 346043 - DNA, 25 bp, Mus musculus
gttgtgcagaggcggccatgcttct

SEQ ID NO: 346044 - DNA, 25 bp, Mus musculus
gttgtgcagcacagggggcagtgcc

SEQ ID NO: 346045 - DNA, 25 bp, Mus musculus
gttgtgcattggactcgttactggg

SEQ ID NO: 346046 - DNA, 25 bp, Mus musculus
gttgtgccacacgagaccctggctg

SEQ ID NO: 346047 - DNA, 25 bp, Mus musculus
gttgtgccacaggcttacagtgggt

SEQ ID NO: 346048 - DNA, 25 bp, Mus musculus
gttgtgccacaggtgtcttatgtgt

SEQ ID NO: 346049 - DNA, 25 bp, Mus musculus
gttgtggaaggctcaaagcagtggc

SEQ ID NO: 346050 - DNA, 25 bp, Mus musculus
gttgtggaggttgcatcagatgaag

SEQ ID NO: 346051 - DNA, 25 bp, Mus musculus
gttgtggaggttggtccctgcatcc

SEQ ID NO: 346052 - DNA, 25 bp, Mus musculus
gttgtggatcacagctgcgaccgag

SEQ ID NO: 346053 - DNA, 25 bp, Mus musculus
gttgtggatccttgatcttagaatc

SEQ ID NO: 346054 - DNA, 25 bp, Mus musculus
gttgtggatccttgggggcaggtcc

SEQ ID NO: 346055 - DNA, 25 bp, Mus musculus
gttgtggatgtgatgctttagatga

SEQ ID NO: 346056 - DNA, 25 bp, Mus musculus
gttgtggattaaagctttctcctta

SEQ ID NO: 346057 - DNA, 25 bp, Mus musculus
gttgtggcggttcccgaggagactt

SEQ ID NO: 346058 - DNA, 25 bp, Mus musculus
gttgtggtcaaccacactgtcctgg

SEQ ID NO: 346059 - DNA, 25 bp, Mus musculus
gttgtggtgactgacctatccgctt

SEQ ID NO: 346060 - DNA, 25 bp, Mus musculus
gttgtggtgggacaaccctccatat

SEQ ID NO: 346061 - DNA, 25 bp, Mus musculus
gttgtggttaataaaggaggctttg

SEQ ID NO: 346062 - DNA, 25 bp, Mus musculus
gttgtgtattttggggtgagcgtgg

SEQ ID NO: 346063 - DNA, 25 bp, Mus musculus
gttgtgtccggtataagtgctacat

SEQ ID NO: 346064 - DNA, 25 bp, Mus musculus
gttgtgtctcggctttccagtctgt

SEQ ID NO: 346065 - DNA, 25 bp, Mus musculus
gttgtgtctcttactggggccttca

SEQ ID NO: 346066 - DNA, 25 bp, Mus musculus
gttgttaaagctcccaagctgtttc

SEQ ID NO: 346067 - DNA, 25 bp, Mus musculus
gttgttaagactactgggaatcagc

SEQ ID NO: 346068 - DNA, 25 bp, Mus musculus
gttgttaagatcctggaccgctggt

SEQ ID NO: 346069 - DNA, 25 bp, Mus musculus
gttgttacaagagggaagcctgtca

SEQ ID NO: 346070 - DNA, 25 bp, Mus musculus
gttgttacagtttgccaggcagtac

SEQ ID NO: 346071 - DNA, 25 bp, Mus musculus
gttgttactaacagcaagttcaatg

SEQ ID NO: 346072 - DNA, 25 bp, Mus musculus
gttgttactgaggaacttcctgatg

SEQ ID NO: 346073 - DNA, 25 bp, Mus musculus
gttgttagatcaggctgctttctcc

SEQ ID NO: 346074 - DNA, 25 bp, Mus musculus
gttgttagatcaggggggctttgcc

SEQ ID NO: 346075 - DNA, 25 bp, Mus musculus
gttgttatctgaagaaagaatctgt

SEQ ID NO: 346076 - DNA, 25 bp, Mus musculus
gttgttatctgaaggttttctctgt

SEQ ID NO: 346077 - DNA, 25 bp, Mus musculus
gttgttcaagagaaaccatttattg

SEQ ID NO: 346078 - DNA, 25 bp, Mus musculus
gttgttcaagatgaggagactgacc

SEQ ID NO: 346079 - DNA, 25 bp, Mus musculus
gttgttcaagatgggagaatgaagt

SEQ ID NO: 346080 - DNA, 25 bp, Mus musculus
gttgttcaagcatttatatctactc

SEQ ID NO: 346081 - DNA, 25 bp, Mus musculus
gttgttcaagctgcctcaggcgatg

SEQ ID NO: 346082 - DNA, 25 bp, Mus musculus
gttgttcaaggaatatagagctttt

SEQ ID NO: 346083 - DNA, 25 bp, Mus musculus
gttgttcaagttataggtaaaagct

SEQ ID NO: 346084 - DNA, 25 bp, Mus musculus
gttgttcagagattgacggcggggc

SEQ ID NO: 346085 - DNA, 25 bp, Mus musculus
gttgttcagagccaccagtggtaaa

SEQ ID NO: 346086 - DNA, 25 bp, Mus musculus
gttgttcatggggcagtaaatggct

SEQ ID NO: 346087 - DNA, 25 bp, Mus musculus
gttgttcatgtcctgaaggggaaga

SEQ ID NO: 346088 - DNA, 25 bp, Mus musculus
gttgttccggaggaatttgaagcct

SEQ ID NO: 346089 - DNA, 25 bp, Mus musculus
gttgttgaaggactcgggacacccc

SEQ ID NO: 346090 - DNA, 25 bp, Mus musculus
gttgttgagctctgaactcactgag

SEQ ID NO: 346091 - DNA, 25 bp, Mus musculus
gttgttgctaagacattcgacatga

SEQ ID NO: 346092 - DNA, 25 bp, Mus musculus
gttgttgctgctggggtctgcgagc

SEQ ID NO: 346093 - DNA, 25 bp, Mus musculus
gttgttgctggagacaaccggatcc

SEQ ID NO: 346094 - DNA, 25 bp, Mus musculus
gttgttggagacaaagctggctgcc

SEQ ID NO: 346095 - DNA, 25 bp, Mus musculus
gttgttggaggaactgctgaagaag

SEQ ID NO: 346096 - DNA, 25 bp, Mus musculus
gttgttggcagagaactgatagaag

SEQ ID NO: 346097 - DNA, 25 bp, Mus musculus
gttgttggcaggtattcaatacaca

SEQ ID NO: 346098 - DNA, 25 bp, Mus musculus
gttgttgttcaagatgaggagactg

SEQ ID NO: 346099 - DNA, 25 bp, Mus musculus
gttgttgttcaagcatttatatcta

SEQ ID NO: 346100 - DNA, 25 bp, Mus musculus
gttgttgttcaagctgcctcaggcg

SEQ ID NO: 346101 - DNA, 25 bp, Mus musculus
gttgttgttcaaggaatatagagct

SEQ ID NO: 346102 - DNA, 25 bp, Mus musculus
gttgtttaacggtagcgcctggcat

SEQ ID NO: 346103 - DNA, 25 bp, Mus musculus
gttgtttcacatttctggaaagcag

SEQ ID NO: 346104 - DNA, 25 bp, Mus musculus
gttgtttcacatttggtgagtgggg

SEQ ID NO: 346105 - DNA, 25 bp, Mus musculus
gttgtttgacttaccatgctcgcat

SEQ ID NO: 346106 - DNA, 25 bp, Mus musculus
gttgtttttcatctagataaaaatt

SEQ ID NO: 346107 - DNA, 25 bp, Mus musculus
gttgtttttggtgccttcaagacaa

SEQ ID NO: 346108 - DNA, 25 bp, Mus musculus
gtttaaaaaactggtatccagctca

SEQ ID NO: 346109 - DNA, 25 bp, Mus musculus
gtttaaacaaagatcctgtgtaccg

SEQ ID NO: 346110 - DNA, 25 bp, Mus musculus
gtttaaacaaagatgagtacattga

SEQ ID NO: 346111 - DNA, 25 bp, Mus musculus
gtttaaactgcagaggtatacaagt

SEQ ID NO: 346112 - DNA, 25 bp, Mus musculus
gtttaaagatgaacatctcagcggt

SEQ ID NO: 346113 - DNA, 25 bp, Mus musculus
gtttaaagcaaggtgaatgtttgaa

SEQ ID NO: 346114 - DNA, 25 bp, Mus musculus
gtttaaatgcagacttaattcaggt

SEQ ID NO: 346115 - DNA, 25 bp, Mus musculus
gtttaaatgcaggtctcagccagtc

SEQ ID NO: 346116 - DNA, 25 bp, Mus musculus
gtttaaattggggtccaagtacagc

SEQ ID NO: 346117 - DNA, 25 bp, Mus musculus
gtttaacaagacagtggagcatggc

SEQ ID NO: 346118 - DNA, 25 bp, Mus musculus
gtttaacacaaaggcaaggcagcaa

SEQ ID NO: 346119 - DNA, 25 bp, Mus musculus
gtttaacacacaagattcttccaga

SEQ ID NO: 346120 - DNA, 25 bp, Mus musculus
gtttaacacacaagcctccatgcat

SEQ ID NO: 346121 - DNA, 25 bp, Mus musculus
gtttaacattgggcctaacaggcct

SEQ ID NO: 346122 - DNA, 25 bp, Mus musculus
gtttaacattggggtggccttgcac

SEQ ID NO: 346123 - DNA, 25 bp, Mus musculus
gtttaacggagagggcggcgaagag

SEQ ID NO: 346124 - DNA, 25 bp, Mus musculus
gtttaacggagatgagaaggccact

SEQ ID NO: 346125 - DNA, 25 bp, Mus musculus
gtttaactgactagatcttgatatg

SEQ ID NO: 346126 - DNA, 25 bp, Mus musculus
gtttaagctcaggaggcctcctgat

SEQ ID NO: 346127 - DNA, 25 bp, Mus musculus
gtttaaggagagagctttccctcct

SEQ ID NO: 346128 - DNA, 25 bp, Mus musculus
gtttaaggagagaggagcaagtgtc

SEQ ID NO: 346129 - DNA, 25 bp, Mus musculus
gtttaaggagatgaaaccctgttgc

SEQ ID NO: 346130 - DNA, 25 bp, Mus musculus
gtttaaggatttcctgattccacga

SEQ ID NO: 346131 - DNA, 25 bp, Mus musculus
gtttaagttccgatacttcgctggc

SEQ ID NO: 346132 - DNA, 25 bp, Mus musculus
gtttaatatttcagcagtgtgataa

SEQ ID NO: 346133 - DNA, 25 bp, Mus musculus
gtttaatgaaatgatgaaagttgtt

SEQ ID NO: 346134 - DNA, 25 bp, Mus musculus
gtttaatgaagactttgtatcatct

SEQ ID NO: 346135 - DNA, 25 bp, Mus musculus
gtttaatgaaggtgattcagaagta

SEQ ID NO: 346136 - DNA, 25 bp, Mus musculus
gtttaatgaagtgtcacgagcaaga

SEQ ID NO: 346137 - DNA, 25 bp, Mus musculus
gtttaatgaggaaagactaatagac

SEQ ID NO: 346138 - DNA, 25 bp, Mus musculus
gtttaatgaggaaggcttgttgtca

SEQ ID NO: 346139 - DNA, 25 bp, Mus musculus
gtttaatgcaagagagatgctgagg

SEQ ID NO: 346140 - DNA, 25 bp, Mus musculus
gtttaatggcacaagaacaagtaag

SEQ ID NO: 346141 - DNA, 25 bp, Mus musculus
gtttaatgttttaagttcctgaatg

SEQ ID NO: 346142 - DNA, 25 bp, Mus musculus
gtttaattatgatggagaagaaaca

SEQ ID NO: 346143 - DNA, 25 bp, Mus musculus
gtttaattatggtatgcagccactt

SEQ ID NO: 346144 - DNA, 25 bp, Mus musculus
gtttaattcagattccaaggaaata

SEQ ID NO: 346145 - DNA, 25 bp, Mus musculus
gtttaattccatatttgatggtaga

SEQ ID NO: 346146 - DNA, 25 bp, Mus musculus
gtttaatttcagcaagaggaatatc

SEQ ID NO: 346147 - DNA, 25 bp, Mus musculus
gtttaattttagctgaaccaataac

SEQ ID NO: 346148 - DNA, 25 bp, Mus musculus
gtttacaaaatgagacctgggcggc

SEQ ID NO: 346149 - DNA, 25 bp, Mus musculus
gtttacaaaggagcagccatgtctg

SEQ ID NO: 346150 - DNA, 25 bp, Mus musculus
gtttacaaggacatatggagattac

SEQ ID NO: 346151 - DNA, 25 bp, Mus musculus
gtttacaattcctgtacactcacgc

SEQ ID NO: 346152 - DNA, 25 bp, Mus musculus
gtttacacagtattactatgaatat

SEQ ID NO: 346153 - DNA, 25 bp, Mus musculus
gtttacaccatttaagttgctttct

SEQ ID NO: 346154 - DNA, 25 bp, Mus musculus
gtttacagaaaagggactgatttgc

SEQ ID NO: 346155 - DNA, 25 bp, Mus musculus
gtttacagagaggaccatctgcgac

SEQ ID NO: 346156 - DNA, 25 bp, Mus musculus
gtttacagcagatacagttggtgcc

SEQ ID NO: 346157 - DNA, 25 bp, Mus musculus
gtttacagccacagccacaacctgc

SEQ ID NO: 346158 - DNA, 25 bp, Mus musculus
gtttacatcagtggttggagactag

SEQ ID NO: 346159 - DNA, 25 bp, Mus musculus
gtttacattccacactcccgtatga

SEQ ID NO: 346160 - DNA, 25 bp, Mus musculus
gtttaccacgcatgcagctggtcca

SEQ ID NO: 346161 - DNA, 25 bp, Mus musculus
gtttaccctcttcggtgtttatgga

SEQ ID NO: 346162 - DNA, 25 bp, Mus musculus
gtttacctaccaggacctgatctct

SEQ ID NO: 346163 - DNA, 25 bp, Mus musculus
gtttacctaggtgcctatgatcgct

SEQ ID NO: 346164 - DNA, 25 bp, Mus musculus
gtttacctcactcaggctgccatcc

SEQ ID NO: 346165 - DNA, 25 bp, Mus musculus
gtttacgaactcggctaccaagagc

SEQ ID NO: 346166 - DNA, 25 bp, Mus musculus
gtttacgggggaggctgctctgaga

SEQ ID NO: 346167 - DNA, 25 bp, Mus musculus
gtttacgtaaagggcctgacaagat

SEQ ID NO: 346168 - DNA, 25 bp, Mus musculus
gtttactcactttcaaaacttaagg

SEQ ID NO: 346169 - DNA, 25 bp, Mus musculus
gtttactcactttgaaaaagagaaa

SEQ ID NO: 346170 - DNA, 25 bp, Mus musculus
gtttactcccaatatgaagactctt

SEQ ID NO: 346171 - DNA, 25 bp, Mus musculus
gtttactgcagctctgcattgagtg

SEQ ID NO: 346172 - DNA, 25 bp, Mus musculus
gtttactgcaggacattaaggacgc

SEQ ID NO: 346173 - DNA, 25 bp, Mus musculus
gtttactgcaggtaccgaatgtcta

SEQ ID NO: 346174 - DNA, 25 bp, Mus musculus
gtttagagccaggttcaatatacaa

SEQ ID NO: 346175 - DNA, 25 bp, Mus musculus
gtttagatcagctgaagcttgcttt

SEQ ID NO: 346176 - DNA, 25 bp, Mus musculus
gtttagattattagatatgctctcc

SEQ ID NO: 346177 - DNA, 25 bp, Mus musculus
gtttagcaactccagctatcaccca

SEQ ID NO: 346178 - DNA, 25 bp, Mus musculus
gtttagctacaggaagcagtttgag

SEQ ID NO: 346179 - DNA, 25 bp, Mus musculus
gtttagctacaggagcatctggacc

SEQ ID NO: 346180 - DNA, 25 bp, Mus musculus
gtttagctaccaagaccgagatgcc

SEQ ID NO: 346181 - DNA, 25 bp, Mus musculus
gtttagggtgtcttctaatgttctg

SEQ ID NO: 346182 - DNA, 25 bp, Mus musculus
gtttaggtctggatcccacgcaatg

SEQ ID NO: 346183 - DNA, 25 bp, Mus musculus
gtttagtgtagcacttactagtggc

SEQ ID NO: 346184 - DNA, 25 bp, Mus musculus
gtttagtgtagcttgaactttccac

SEQ ID NO: 346185 - DNA, 25 bp, Mus musculus
gtttagtgtagttccctcctttagc

SEQ ID NO: 346186 - DNA, 25 bp, Mus musculus
gtttataactaccagatgccaccgc

SEQ ID NO: 346187 - DNA, 25 bp, Mus musculus
gtttataactaccaggcttatacaa

SEQ ID NO: 346188 - DNA, 25 bp, Mus musculus
gtttataagaacgagctgcaccgcc

SEQ ID NO: 346189 - DNA, 25 bp, Mus musculus
gtttatacagatctttcatttgtcc

SEQ ID NO: 346190 - DNA, 25 bp, Mus musculus
gtttatacagggtgacatttgtgat

SEQ ID NO: 346191 - DNA, 25 bp, Mus musculus
gtttatagattctgattcttcgtgg

SEQ ID NO: 346192 - DNA, 25 bp, Mus musculus
gtttatagattctttcttgaacact

SEQ ID NO: 346193 - DNA, 25 bp, Mus musculus
gtttatattcaaccagctgtgacca

SEQ ID NO: 346194 - DNA, 25 bp, Mus musculus
gtttatcaaaagacttccaactgaa

SEQ ID NO: 346195 - DNA, 25 bp, Mus musculus
gtttatcaaagtcatgtaggaaatt

SEQ ID NO: 346196 - DNA, 25 bp, Mus musculus
gtttatcaagattactcgggacaag

SEQ ID NO: 346197 - DNA, 25 bp, Mus musculus
gtttatcaagggatccacaaatgct

SEQ ID NO: 346198 - DNA, 25 bp, Mus musculus
gtttatcagaagtttccagagtgtg

SEQ ID NO: 346199 - DNA, 25 bp, Mus musculus
gtttatcatgacaccaagctggatg

SEQ ID NO: 346200 - DNA, 25 bp, Mus musculus
gtttatcgaggaggcagcgggccgt

SEQ ID NO: 346201 - DNA, 25 bp, Mus musculus
gtttatctagactaaaacaaaggca

SEQ ID NO: 346202 - DNA, 25 bp, Mus musculus
gtttatctaggtgcctatgaccgcc

SEQ ID NO: 346203 - DNA, 25 bp, Mus musculus
gtttatctgaaggatcctacccaga

SEQ ID NO: 346204 - DNA, 25 bp, Mus musculus
gtttatgactaacagggagtacacc

SEQ ID NO: 346205 - DNA, 25 bp, Mus musculus
gtttatgatgagtttgtgacttaag

SEQ ID NO: 346206 - DNA, 25 bp, Mus musculus
gtttatgcctgagcgcttcttagat

SEQ ID NO: 346207 - DNA, 25 bp, Mus musculus
gtttatgcctgatccaacaggaagc

SEQ ID NO: 346208 - DNA, 25 bp, Mus musculus
gtttatgctgcgtccctgacccttg

SEQ ID NO: 346209 - DNA, 25 bp, Mus musculus
gtttatgggtacaggacatacagga

SEQ ID NO: 346210 - DNA, 25 bp, Mus musculus
gtttattacagcactcaaatctaca

SEQ ID NO: 346211 - DNA, 25 bp, Mus musculus
gtttattacagtgtgttcaaagcaa

SEQ ID NO: 346212 - DNA, 25 bp, Mus musculus
gtttattcaggtgcactgcatcagc

SEQ ID NO: 346213 - DNA, 25 bp, Mus musculus
gtttatttcaagtgtcaccagactg

SEQ ID NO: 346214 - DNA, 25 bp, Mus musculus
gtttatttggagaagaccaacctgg

SEQ ID NO: 346215 - DNA, 25 bp, Mus musculus
gtttatttggagaaggatcttcaag

SEQ ID NO: 346216 - DNA, 25 bp, Mus musculus
gtttcaaaagctctcttctcccttg

SEQ ID NO: 346217 - DNA, 25 bp, Mus musculus
gtttcaaaaggcattgcgctccctc

SEQ ID NO: 346218 - DNA, 25 bp, Mus musculus
gtttcaacgattgtactgcatctac

SEQ ID NO: 346219 - DNA, 25 bp, Mus musculus
gtttcaatgttggatagagatatgt

SEQ ID NO: 346220 - DNA, 25 bp, Mus musculus
gtttcaattccaatgcaaacaagaa

SEQ ID NO: 346221 - DNA, 25 bp, Mus musculus
gtttcacaagtggatagagagagtg

SEQ ID NO: 346222 - DNA, 25 bp, Mus musculus
gtttcacatttctggaaagcagtgc

SEQ ID NO: 346223 - DNA, 25 bp, Mus musculus
gtttcacatttggtgagtggggcag

SEQ ID NO: 346224 - DNA, 25 bp, Mus musculus
gtttcacccgcaaatgtcagcaatt

SEQ ID NO: 346225 - DNA, 25 bp, Mus musculus
gtttcacccgcaattcccactacct

SEQ ID NO: 346226 - DNA, 25 bp, Mus musculus
gtttcagaacagagggcaatgcgag

SEQ ID NO: 346227 - DNA, 25 bp, Mus musculus
gtttcagaaggtttgaagactccca

SEQ ID NO: 346228 - DNA, 25 bp, Mus musculus
gtttcagataattggaggatagaca

SEQ ID NO: 346229 - DNA, 25 bp, Mus musculus
gtttcagataattgggccattgaca

SEQ ID NO: 346230 - DNA, 25 bp, Mus musculus
gtttcagatactgttacagccctgc

SEQ ID NO: 346231 - DNA, 25 bp, Mus musculus
gtttcagcacaacaatgcagataga

SEQ ID NO: 346232 - DNA, 25 bp, Mus musculus
gtttcagcacaacatgggaaaaccc

SEQ ID NO: 346233 - DNA, 25 bp, Mus musculus
gtttcagccagattctggctggcgg

SEQ ID NO: 346234 - DNA, 25 bp, Mus musculus
gtttcagccctcagtggaccctgat

SEQ ID NO: 346235 - DNA, 25 bp, Mus musculus
gtttcagccgcatcgctctgaagaa

SEQ ID NO: 346236 - DNA, 25 bp, Mus musculus
gtttcagttacaagcaacaacaaca

SEQ ID NO: 346237 - DNA, 25 bp, Mus musculus
gtttcagttacaaggcaatgtatgt

SEQ ID NO: 346238 - DNA, 25 bp, Mus musculus
gtttcataacatagactgaaacagt

SEQ ID NO: 346239 - DNA, 25 bp, Mus musculus
gtttcatcagccaggagccagtcct

SEQ ID NO: 346240 - DNA, 25 bp, Mus musculus
gtttcatccagggtcacaaacctac

SEQ ID NO: 346241 - DNA, 25 bp, Mus musculus
gtttcatctcaaagcatacagctgc

SEQ ID NO: 346242 - DNA, 25 bp, Mus musculus
gtttcatggtagaagtctttataga

SEQ ID NO: 346243 - DNA, 25 bp, Mus musculus
gtttcatttaaaatggatgtgaaat

SEQ ID NO: 346244 - DNA, 25 bp, Mus musculus
gtttcatttactaagactctccttc

SEQ ID NO: 346245 - DNA, 25 bp, Mus musculus
gtttcatttactaagggctacagag

SEQ ID NO: 346246 - DNA, 25 bp, Mus musculus
gtttcatttcctgcttcaacagact

SEQ ID NO: 346247 - DNA, 25 bp, Mus musculus
gtttcatttcctgtcctaataaaag

SEQ ID NO: 346248 - DNA, 25 bp, Mus musculus
gtttcatttgggagaaccatggctc

SEQ ID NO: 346249 - DNA, 25 bp, Mus musculus
gtttcatttgtgaagcctccaggca

SEQ ID NO: 346250 - DNA, 25 bp, Mus musculus
gtttcatttgtgaagctggaagccg

SEQ ID NO: 346251 - DNA, 25 bp, Mus musculus
gtttccaaaagctcctggctagagg

SEQ ID NO: 346252 - DNA, 25 bp, Mus musculus
gtttccaacagccgcgcacactgga

SEQ ID NO: 346253 - DNA, 25 bp, Mus musculus
gtttccaacccaagctcttttgtga

SEQ ID NO: 346254 - DNA, 25 bp, Mus musculus
gtttccacaccgacactgcaaatgg

SEQ ID NO: 346255 - DNA, 25 bp, Mus musculus
gtttccacagaatggactcgctaca

SEQ ID NO: 346256 - DNA, 25 bp, Mus musculus
gtttccacaggcctgagtttcctga

SEQ ID NO: 346257 - DNA, 25 bp, Mus musculus
gtttccactgagtccttagccagga

SEQ ID NO: 346258 - DNA, 25 bp, Mus musculus
gtttccactgcacctcctggccttc

SEQ ID NO: 346259 - DNA, 25 bp, Mus musculus
gtttccagcaagttctggatgattt

SEQ ID NO: 346260 - DNA, 25 bp, Mus musculus
gtttccagctggagggagagcgtga

SEQ ID NO: 346261 - DNA, 25 bp, Mus musculus
gtttccaggacagatggcgctgcca

SEQ ID NO: 346262 - DNA, 25 bp, Mus musculus
gtttccagtgccagtttcctagatt

SEQ ID NO: 346263 - DNA, 25 bp, Mus musculus
gtttccatagaaccagtcttcagta

SEQ ID NO: 346264 - DNA, 25 bp, Mus musculus
gtttccatagtctgagtgacagccc

SEQ ID NO: 346265 - DNA, 25 bp, Mus musculus
gtttcccaaactatgtcggacggcc

SEQ ID NO: 346266 - DNA, 25 bp, Mus musculus
gtttcccagagaagggggaactgat

SEQ ID NO: 346267 - DNA, 25 bp, Mus musculus
gtttcccattgaaggtttcaggaca

SEQ ID NO: 346268 - DNA, 25 bp, Mus musculus
gtttcccattgagtacccagactca

SEQ ID NO: 346269 - DNA, 25 bp, Mus musculus
gtttccccagatcctgtcttccatc

SEQ ID NO: 346270 - DNA, 25 bp, Mus musculus
gtttccccagcacagcaatcttccc

SEQ ID NO: 346271 - DNA, 25 bp, Mus musculus
gtttcccccaacttacagactgaag

SEQ ID NO: 346272 - DNA, 25 bp, Mus musculus
gtttcccccgcccaggacagtcggc

SEQ ID NO: 346273 - DNA, 25 bp, Mus musculus
gtttcccctttggagtcccatggtc

SEQ ID NO: 346274 - DNA, 25 bp, Mus musculus
gtttcccgcgggcaaggcacgagtg

SEQ ID NO: 346275 - DNA, 25 bp, Mus musculus
gtttcccgcgggtgtcctggctgta

SEQ ID NO: 346276 - DNA, 25 bp, Mus musculus
gtttccctggatcaggacatgcaga

SEQ ID NO: 346277 - DNA, 25 bp, Mus musculus
gtttccctggattatgccatctcca

SEQ ID NO: 346278 - DNA, 25 bp, Mus musculus
gtttccctgggtatttctctgagtc

SEQ ID NO: 346279 - DNA, 25 bp, Mus musculus
gtttccgaaatgagctggaattttg

SEQ ID NO: 346280 - DNA, 25 bp, Mus musculus
gtttccgagcagaagcaagccatac

SEQ ID NO: 346281 - DNA, 25 bp, Mus musculus
gtttccgaggctcagtactatggca

SEQ ID NO: 346282 - DNA, 25 bp, Mus musculus
gtttccggagggactcaaagctgga

SEQ ID NO: 346283 - DNA, 25 bp, Mus musculus
gtttccgtccagaagaaaacacacg

SEQ ID NO: 346284 - DNA, 25 bp, Mus musculus
gtttccgtccagaagcccacagtca

SEQ ID NO: 346285 - DNA, 25 bp, Mus musculus
gtttccgtccagaagggtgaaccta

SEQ ID NO: 346286 - DNA, 25 bp, Mus musculus
gtttccgtgcctttgaagatgagca

SEQ ID NO: 346287 - DNA, 25 bp, Mus musculus
gtttcctagaagggaggtggtgtgg

SEQ ID NO: 346288 - DNA, 25 bp, Mus musculus
gtttcctcagccccagtttgacgga

SEQ ID NO: 346289 - DNA, 25 bp, Mus musculus
gtttcctccctgagaatgaggtgta

SEQ ID NO: 346290 - DNA, 25 bp, Mus musculus
gtttcctccgcaccaccaccaccac

SEQ ID NO: 346291 - DNA, 25 bp, Mus musculus
gtttcctctacagacagaccctgct

SEQ ID NO: 346292 - DNA, 25 bp, Mus musculus
gtttcctctacaggggacctggctg

SEQ ID NO: 346293 - DNA, 25 bp, Mus musculus
gtttcctgcagctatccttcggggc

SEQ ID NO: 346294 - DNA, 25 bp, Mus musculus
gtttcctgggagaaacactcatcat

SEQ ID NO: 346295 - DNA, 25 bp, Mus musculus
gtttcctgggcagactcagccatgg

SEQ ID NO: 346296 - DNA, 25 bp, Mus musculus
gtttcctgtgaaccgatttaaagga

SEQ ID NO: 346297 - DNA, 25 bp, Mus musculus
gtttcctgttcagggagaggcggtg

SEQ ID NO: 346298 - DNA, 25 bp, Mus musculus
gtttcctgttcaggtccgcgaatac

SEQ ID NO: 346299 - DNA, 25 bp, Mus musculus
gtttcctgttcggaacctggacttg

SEQ ID NO: 346300 - DNA, 25 bp, Mus musculus
gtttccttatttctgtgacagctat

SEQ ID NO: 346301 - DNA, 25 bp, Mus musculus
gtttccttgcagatatactgctgtt

SEQ ID NO: 346302 - DNA, 25 bp, Mus musculus
gtttccttgcaggtccattcacaca

SEQ ID NO: 346303 - DNA, 25 bp, Mus musculus
gtttccttgtcaaacccaacagttc

SEQ ID NO: 346304 - DNA, 25 bp, Mus musculus
gtttccttgtcaacaatcaagatga

SEQ ID NO: 346305 - DNA, 25 bp, Mus musculus
gtttccttgtggaggtcttccaagt

SEQ ID NO: 346306 - DNA, 25 bp, Mus musculus
gtttcctttcaggatggcctcaggc

SEQ ID NO: 346307 - DNA, 25 bp, Mus musculus
gtttcgagctggggttattcccaat

SEQ ID NO: 346308 - DNA, 25 bp, Mus musculus
gtttcgcagagcttcctctctctgg

SEQ ID NO: 346309 - DNA, 25 bp, Mus musculus
gtttcgcctacaggcatataccagc

SEQ ID NO: 346310 - DNA, 25 bp, Mus musculus
gtttcggaggccgatggcaccaccg

SEQ ID NO: 346311 - DNA, 25 bp, Mus musculus
gtttcggatccaggacctgctgtcc

SEQ ID NO: 346312 - DNA, 25 bp, Mus musculus
gtttcggatttggagatataaccaa

SEQ ID NO: 346313 - DNA, 25 bp, Mus musculus
gtttcggccggacgctagcagaatc

SEQ ID NO: 346314 - DNA, 25 bp, Mus musculus
gtttcggccggacgggaagcttaga

SEQ ID NO: 346315 - DNA, 25 bp, Mus musculus
gtttcgggcatgagccaaagcctgc

SEQ ID NO: 346316 - DNA, 25 bp, Mus musculus
gtttcgggtccccggctacagcaag

SEQ ID NO: 346317 - DNA, 25 bp, Mus musculus
gtttcggtgacagggcggctactaa

SEQ ID NO: 346318 - DNA, 25 bp, Mus musculus
gtttcgtcaagatcaaggtcaccaa

SEQ ID NO: 346319 - DNA, 25 bp, Mus musculus
gtttcgtcaaggtcaccaaggctgg

SEQ ID NO: 346320 - DNA, 25 bp, Mus musculus
gtttcgtcatgagatcaaggacacc

SEQ ID NO: 346321 - DNA, 25 bp, Mus musculus
gtttctaaactacatgagcgatgtc

SEQ ID NO: 346322 - DNA, 25 bp, Mus musculus
gtttctaaagagaaaccatgaagtg

SEQ ID NO: 346323 - DNA, 25 bp, Mus musculus
gtttctacccagaggaagaatttga

SEQ ID NO: 346324 - DNA, 25 bp, Mus musculus
gtttctactctggtgaccatagctg

SEQ ID NO: 346325 - DNA, 25 bp, Mus musculus
gtttctagacttcggatccagcaat

SEQ ID NO: 346326 - DNA, 25 bp, Mus musculus
gtttctagaggcctcaaacagcgcc

SEQ ID NO: 346327 - DNA, 25 bp, Mus musculus
gtttctatgccgatcaaaaggaaaa

SEQ ID NO: 346328 - DNA, 25 bp, Mus musculus
gtttctattgaaaccatagacagaa

SEQ ID NO: 346329 - DNA, 25 bp, Mus musculus
gtttctattgaaatctcacaggcct

SEQ ID NO: 346330 - DNA, 25 bp, Mus musculus
gtttctattgaaggtgttgttgctg

SEQ ID NO: 346331 - DNA, 25 bp, Mus musculus
gtttctattgaatacaggctagtcc

SEQ ID NO: 346332 - DNA, 25 bp, Mus musculus
gtttctcaagggttgagctccataa

SEQ ID NO: 346333 - DNA, 25 bp, Mus musculus
gtttctcactcaaggtggcgtgatt

SEQ ID NO: 346334 - DNA, 25 bp, Mus musculus
gtttctcagtgctgatgcagatgcg

SEQ ID NO: 346335 - DNA, 25 bp, Mus musculus
gtttctcagtgctgatgcgcttcga

SEQ ID NO: 346336 - DNA, 25 bp, Mus musculus
gtttctccaccaggacatggatttg

SEQ ID NO: 346337 - DNA, 25 bp, Mus musculus
gtttctccctggaaggtggaaccta

SEQ ID NO: 346338 - DNA, 25 bp, Mus musculus
gtttctcctacaaattgctaataat

SEQ ID NO: 346339 - DNA, 25 bp, Mus musculus
gtttctcctgggctgcaagcccagc

SEQ ID NO: 346340 - DNA, 25 bp, Mus musculus
gtttctcgcagagtgttcctgactt

SEQ ID NO: 346341 - DNA, 25 bp, Mus musculus
gtttctcgcagatatattaccaaag

SEQ ID NO: 346342 - DNA, 25 bp, Mus musculus
gtttctcgctggaaggctctacaga

SEQ ID NO: 346343 - DNA, 25 bp, Mus musculus
gtttctctaccaggtctgtcaccta

SEQ ID NO: 346344 - DNA, 25 bp, Mus musculus
gtttctctagatctcacactcctca

SEQ ID NO: 346345 - DNA, 25 bp, Mus musculus
gtttctctagatttcaccaacgtat

SEQ ID NO: 346346 - DNA, 25 bp, Mus musculus
gtttctctaggtattctcatgggag

SEQ ID NO: 346347 - DNA, 25 bp, Mus musculus
gtttctctaggtgtgagcatctttc

SEQ ID NO: 346348 - DNA, 25 bp, Mus musculus
gtttctcttgtccatctcagtccat

SEQ ID NO: 346349 - DNA, 25 bp, Mus musculus
gtttctgaaggcactggcactacaa

SEQ ID NO: 346350 - DNA, 25 bp, Mus musculus
gtttctgacaggtaaccaatggagt

SEQ ID NO: 346351 - DNA, 25 bp, Mus musculus
gtttctgaccaacagaacatacaac

SEQ ID NO: 346352 - DNA, 25 bp, Mus musculus
gtttctgaggccatgagttccgact

SEQ ID NO: 346353 - DNA, 25 bp, Mus musculus
gtttctgattatagggtcctgctga

SEQ ID NO: 346354 - DNA, 25 bp, Mus musculus
gtttctgatttcgaggggacccagc

SEQ ID NO: 346355 - DNA, 25 bp, Mus musculus
gtttctgcaagatgaacgagaccgt

SEQ ID NO: 346356 - DNA, 25 bp, Mus musculus
gtttctgcagacttgtactggtttc

SEQ ID NO: 346357 - DNA, 25 bp, Mus musculus
gtttctgcatctgaacaccgacctt

SEQ ID NO: 346358 - DNA, 25 bp, Mus musculus
gtttctgcctccaggagaaggtcct

SEQ ID NO: 346359 - DNA, 25 bp, Mus musculus
gtttctgctctgaaggaaagagatg

SEQ ID NO: 346360 - DNA, 25 bp, Mus musculus
gtttctgctctgcatggtgacatgg

SEQ ID NO: 346361 - DNA, 25 bp, Mus musculus
gtttctgctctggcccgtgggattg

SEQ ID NO: 346362 - DNA, 25 bp, Mus musculus
gtttctgcttgatgtcctagaagac

SEQ ID NO: 346363 - DNA, 25 bp, Mus musculus
gtttctgcttttgtctgctgcccat

SEQ ID NO: 346364 - DNA, 25 bp, Mus musculus
gtttctggtgaagattatgggacag

SEQ ID NO: 346365 - DNA, 25 bp, Mus musculus
gtttctggtttgccagctccggaaa

SEQ ID NO: 346366 - DNA, 25 bp, Mus musculus
gtttctggtttgtcaaagacataga

SEQ ID NO: 346367 - DNA, 25 bp, Mus musculus
gtttctgtcaagcctggaatgaagt

SEQ ID NO: 346368 - DNA, 25 bp, Mus musculus
gtttctgtcatagcaaccaccgctc

SEQ ID NO: 346369 - DNA, 25 bp, Mus musculus
gtttctgtcatagcactggaccacg

SEQ ID NO: 346370 - DNA, 25 bp, Mus musculus
gtttctgtccgaggtcgctcatccg

SEQ ID NO: 346371 - DNA, 25 bp, Mus musculus
gtttctgtgaagatgggaaataagt

SEQ ID NO: 346372 - DNA, 25 bp, Mus musculus
gtttctgtgtgagtgcatgcgggag

SEQ ID NO: 346373 - DNA, 25 bp, Mus musculus
gtttctgttctctgatttggggata

SEQ ID NO: 346374 - DNA, 25 bp, Mus musculus
gtttctgttctctggcgtaatagct

SEQ ID NO: 346375 - DNA, 25 bp, Mus musculus
gtttctgttctctggtgaagaaatc

SEQ ID NO: 346376 - DNA, 25 bp, Mus musculus
gtttctgtttgttttcttctgcttc

SEQ ID NO: 346377 - DNA, 25 bp, Mus musculus
gtttcttaactatatgagcgatgtc

SEQ ID NO: 346378 - DNA, 25 bp, Mus musculus
gtttcttaccatctatggagttgaa

SEQ ID NO: 346379 - DNA, 25 bp, Mus musculus
gtttcttcaaggacgtagagtcaga

SEQ ID NO: 346380 - DNA, 25 bp, Mus musculus
gtttcttccagggcttggctgagta

SEQ ID NO: 346381 - DNA, 25 bp, Mus musculus
gtttcttcccaggtgaagtggaaga

SEQ ID NO: 346382 - DNA, 25 bp, Mus musculus
gtttcttctgatgaaagagaagatg

SEQ ID NO: 346383 - DNA, 25 bp, Mus musculus
gtttcttgcaaagatcactggagat

SEQ ID NO: 346384 - DNA, 25 bp, Mus musculus
gtttcttgggaggaagtccacattg

SEQ ID NO: 346385 - DNA, 25 bp, Mus musculus
gtttcttggtcagaagaagcgcacg

SEQ ID NO: 346386 - DNA, 25 bp, Mus musculus
gtttcttgtctgaagcgaaggtgtc

SEQ ID NO: 346387 - DNA, 25 bp, Mus musculus
gtttctttcagccttttatgtcacc

SEQ ID NO: 346388 - DNA, 25 bp, Mus musculus
gtttctttctgcctgcacatttcat

SEQ ID NO: 346389 - DNA, 25 bp, Mus musculus
gtttcttttggaggtgcagtgtatg

SEQ ID NO: 346390 - DNA, 25 bp, Mus musculus
gtttgaaaaagtcctaatcctggag

SEQ ID NO: 346391 - DNA, 25 bp, Mus musculus
gtttgaaaacagctcgaggctggga

SEQ ID NO: 346392 - DNA, 25 bp, Mus musculus
gtttgaaaggaattccagatggtca

SEQ ID NO: 346393 - DNA, 25 bp, Mus musculus
gtttgaaagggtacagtaagcgagt

SEQ ID NO: 346394 - DNA, 25 bp, Mus musculus
gtttgaaatcattgctatgtccacc

SEQ ID NO: 346395 - DNA, 25 bp, Mus musculus
gtttgaaatctgatggttaccacaa

SEQ ID NO: 346396 - DNA, 25 bp, Mus musculus
gtttgaaatggctcggttttactcc

SEQ ID NO: 346397 - DNA, 25 bp, Mus musculus
gtttgaaatgtcagactcattgaaa

SEQ ID NO: 346398 - DNA, 25 bp, Mus musculus
gtttgaaatgtcaggatgccccagg

SEQ ID NO: 346399 - DNA, 25 bp, Mus musculus
gtttgaacatccaaaagtttgcagt

SEQ ID NO: 346400 - DNA, 25 bp, Mus musculus
gtttgaacatccaaagacacacagg

SEQ ID NO: 346401 - DNA, 25 bp, Mus musculus
gtttgaactcatcaagtgctcggcg

SEQ ID NO: 346402 - DNA, 25 bp, Mus musculus
gtttgaagaccatcttgcagtgcgc

SEQ ID NO: 346403 - DNA, 25 bp, Mus musculus
gtttgaaggaactctcaaggggaag

SEQ ID NO: 346404 - DNA, 25 bp, Mus musculus
gtttgaaggaagaggggatatgtgg

SEQ ID NO: 346405 - DNA, 25 bp, Mus musculus
gtttgaataataggaatatccgaag

SEQ ID NO: 346406 - DNA, 25 bp, Mus musculus
gtttgaataatatttccctcatgga

SEQ ID NO: 346407 - DNA, 25 bp, Mus musculus
gtttgaatgtccaggaccccctggc

SEQ ID NO: 346408 - DNA, 25 bp, Mus musculus
gtttgacaaaggaaaaagaggcctc

SEQ ID NO: 346409 - DNA, 25 bp, Mus musculus
gtttgacaaagttggcatcctgact

SEQ ID NO: 346410 - DNA, 25 bp, Mus musculus
gtttgacaagatgaatgaccaggac

SEQ ID NO: 346411 - DNA, 25 bp, Mus musculus
gtttgacactactgatttcagctct

SEQ ID NO: 346412 - DNA, 25 bp, Mus musculus
gtttgacatggcaacagaagttggt

SEQ ID NO: 346413 - DNA, 25 bp, Mus musculus
gtttgacccaagacaaggtctcact

SEQ ID NO: 346414 - DNA, 25 bp, Mus musculus
gtttgaccccccagacttctggacg

SEQ ID NO: 346415 - DNA, 25 bp, Mus musculus
gtttgactacaacagcgtccatgcc

SEQ ID NO: 346416 - DNA, 25 bp, Mus musculus
gtttgactatcagcatggggctgct

SEQ ID NO: 346417 - DNA, 25 bp, Mus musculus
gtttgactatcaggacctccaggac

SEQ ID NO: 346418 - DNA, 25 bp, Mus musculus
gtttgactcgcacatccttgtggcg

SEQ ID NO: 346419 - DNA, 25 bp, Mus musculus
gtttgagaacaacaggaacctgagg

SEQ ID NO: 346420 - DNA, 25 bp, Mus musculus
gtttgagaacaacaggactccggga

SEQ ID NO: 346421 - DNA, 25 bp, Mus musculus
gtttgagaagctgggcttcaacaaa

SEQ ID NO: 346422 - DNA, 25 bp, Mus musculus
gtttgagaagctgggtatcagtacc

SEQ ID NO: 346423 - DNA, 25 bp, Mus musculus
gtttgagaataccattgagtcagac

SEQ ID NO: 346424 - DNA, 25 bp, Mus musculus
gtttgagaggaaacttcgagtcaaa

SEQ ID NO: 346425 - DNA, 25 bp, Mus musculus
gtttgagcagaagtggttcccagtg

SEQ ID NO: 346426 - DNA, 25 bp, Mus musculus
gtttgagcagcagcaaaaagatgga

SEQ ID NO: 346427 - DNA, 25 bp, Mus musculus
gtttgagctggctgggtttgactct

SEQ ID NO: 346428 - DNA, 25 bp, Mus musculus
gtttgagctggctggtgctggcatg

SEQ ID NO: 346429 - DNA, 25 bp, Mus musculus
gtttgaggagcagttcctgaatgcc

SEQ ID NO: 346430 - DNA, 25 bp, Mus musculus
gtttgaggaggctcaacgcacagcg

SEQ ID NO: 346431 - DNA, 25 bp, Mus musculus
gtttgaggaggtagggtctgaccaa

SEQ ID NO: 346432 - DNA, 25 bp, Mus musculus
gtttgaggaggtgtacaggaatgag

SEQ ID NO: 346433 - DNA, 25 bp, Mus musculus
gtttgaggcgatggattgtaagcgg

SEQ ID NO: 346434 - DNA, 25 bp, Mus musculus
gtttgagtgggaagatgatcttccc

SEQ ID NO: 346435 - DNA, 25 bp, Mus musculus
gtttgatatggcacccgttattgga

SEQ ID NO: 346436 - DNA, 25 bp, Mus musculus
gtttgatctattttcaagaaagtgt

SEQ ID NO: 346437 - DNA, 25 bp, Mus musculus
gtttgatctattttcggatgtacat

SEQ ID NO: 346438 - DNA, 25 bp, Mus musculus
gtttgatgaagccagaagatgtagc

SEQ ID NO: 346439 - DNA, 25 bp, Mus musculus
gtttgatgaagccagatgctgatgc

SEQ ID NO: 346440 - DNA, 25 bp, Mus musculus
gtttgatgaagccagcactagcaac

SEQ ID NO: 346441 - DNA, 25 bp, Mus musculus
gtttgatgatacttatgaccacggc

SEQ ID NO: 346442 - DNA, 25 bp, Mus musculus
gtttgatgcccaaggcaacttaagg

SEQ ID NO: 346443 - DNA, 25 bp, Mus musculus
gtttgatgcccaggcaacttaaggg

SEQ ID NO: 346444 - DNA, 25 bp, Mus musculus
gtttgatggcaagggtcatgtgggt

SEQ ID NO: 346445 - DNA, 25 bp, Mus musculus
gtttgatggcaaggtgctgtctgaa

SEQ ID NO: 346446 - DNA, 25 bp, Mus musculus
gtttgatgtggcctgcccagagtga

SEQ ID NO: 346447 - DNA, 25 bp, Mus musculus
gtttgattcaacagatgtctttcaa

SEQ ID NO: 346448 - DNA, 25 bp, Mus musculus
gtttgattcaacaggcaatcgagat

SEQ ID NO: 346449 - DNA, 25 bp, Mus musculus
gtttgattccagccataatcgcatg

SEQ ID NO: 346450 - DNA, 25 bp, Mus musculus
gtttgattgctaagatcccaccaaa

SEQ ID NO: 346451 - DNA, 25 bp, Mus musculus
gtttgattgctaaggttgagggcaa

SEQ ID NO: 346452 - DNA, 25 bp, Mus musculus
gtttgcaaagaagaaacagcattga

SEQ ID NO: 346453 - DNA, 25 bp, Mus musculus
gtttgcaaaggaaatatatcccgga

SEQ ID NO: 346454 - DNA, 25 bp, Mus musculus
gtttgcaagtcatgtcattgtgctt

SEQ ID NO: 346455 - DNA, 25 bp, Mus musculus
gtttgcacaaagttcgagaaggaat

SEQ ID NO: 346456 - DNA, 25 bp, Mus musculus
gtttgcacgcacaggaaatcccaat

SEQ ID NO: 346457 - DNA, 25 bp, Mus musculus
gtttgcactggtccaacccagactt

SEQ ID NO: 346458 - DNA, 25 bp, Mus musculus
gtttgcagactgcggtgaggggagc

SEQ ID NO: 346459 - DNA, 25 bp, Mus musculus
gtttgcagaggatgacgtcagtgac

SEQ ID NO: 346460 - DNA, 25 bp, Mus musculus
gtttgcagaggtgctggaaatgggg

SEQ ID NO: 346461 - DNA, 25 bp, Mus musculus
gtttgcaggctcaggactggaggac

SEQ ID NO: 346462 - DNA, 25 bp, Mus musculus
gtttgcagtcttctggcagctcaga

SEQ ID NO: 346463 - DNA, 25 bp, Mus musculus
gtttgcatgctaggagatgtacgac

SEQ ID NO: 346464 - DNA, 25 bp, Mus musculus
gtttgcattcacagacacggctaag

SEQ ID NO: 346465 - DNA, 25 bp, Mus musculus
gtttgcattcacagggtacagattt

SEQ ID NO: 346466 - DNA, 25 bp, Mus musculus
gtttgcattccgcttgcttcccaga

SEQ ID NO: 346467 - DNA, 25 bp, Mus musculus
gtttgcatttaggaggactgacaaa

SEQ ID NO: 346468 - DNA, 25 bp, Mus musculus
gtttgccaagatctggtggatcgca

SEQ ID NO: 346469 - DNA, 25 bp, Mus musculus
gtttgccaagatcttgatccagttt

SEQ ID NO: 346470 - DNA, 25 bp, Mus musculus
gtttgccaagggaaagaaggcaatg

SEQ ID NO: 346471 - DNA, 25 bp, Mus musculus
gtttgccaaggggaacttccccaga

SEQ ID NO: 346472 - DNA, 25 bp, Mus musculus
gtttgccaagggtatgtcggagacc

SEQ ID NO: 346473 - DNA, 25 bp, Mus musculus
gtttgccacaacagaaagcctaaaa

SEQ ID NO: 346474 - DNA, 25 bp, Mus musculus
gtttgccagaaggaacctgaatgaa

SEQ ID NO: 346475 - DNA, 25 bp, Mus musculus
gtttgccagaatggaggataggaac

SEQ ID NO: 346476 - DNA, 25 bp, Mus musculus
gtttgccagctccggaactctgtgg

SEQ ID NO: 346477 - DNA, 25 bp, Mus musculus
gtttgccagctccgggcatgggata

SEQ ID NO: 346478 - DNA, 25 bp, Mus musculus
gtttgccagggcgacggaacaagat

SEQ ID NO: 346479 - DNA, 25 bp, Mus musculus
gtttgccatcaggtattggcttgct

SEQ ID NO: 346480 - DNA, 25 bp, Mus musculus
gtttgccatgaagcggctgctgccc

SEQ ID NO: 346481 - DNA, 25 bp, Mus musculus
gtttgcccagatgggttttgatggc

SEQ ID NO: 346482 - DNA, 25 bp, Mus musculus
gtttgcccagctctctgtgctatca

SEQ ID NO: 346483 - DNA, 25 bp, Mus musculus
gtttgccctcaggttcattctgaat

SEQ ID NO: 346484 - DNA, 25 bp, Mus musculus
gtttgccctgagagtgggccatggt

SEQ ID NO: 346485 - DNA, 25 bp, Mus musculus
gtttgccgcagccagccctctgccc

SEQ ID NO: 346486 - DNA, 25 bp, Mus musculus
gtttgccgcaggcccggcacagtca

SEQ ID NO: 346487 - DNA, 25 bp, Mus musculus
gtttgcctatatgaggttggcgcat

SEQ ID NO: 346488 - DNA, 25 bp, Mus musculus
gtttgccttagagcacggcatccct

SEQ ID NO: 346489 - DNA, 25 bp, Mus musculus
gtttgcgcatcctgcagccacattg

SEQ ID NO: 346490 - DNA, 25 bp, Mus musculus
gtttgctatgaacctgcagccagca

SEQ ID NO: 346491 - DNA, 25 bp, Mus musculus
gtttgctattggccaggctggcctt

SEQ ID NO: 346492 - DNA, 25 bp, Mus musculus
gtttgctattgggcacaaatatgcc

SEQ ID NO: 346493 - DNA, 25 bp, Mus musculus
gtttgctattggggggctctgcaac

SEQ ID NO: 346494 - DNA, 25 bp, Mus musculus
gtttgctattgtctaaatctcaggt

SEQ ID NO: 346495 - DNA, 25 bp, Mus musculus
gtttgctcagaagtttacagagcct

SEQ ID NO: 346496 - DNA, 25 bp, Mus musculus
gtttgctcagaatttcatgcctcat

SEQ ID NO: 346497 - DNA, 25 bp, Mus musculus
gtttgctcagggtgcagtgagcctg

SEQ ID NO: 346498 - DNA, 25 bp, Mus musculus
gtttgctcaggtcttggctagcctg

SEQ ID NO: 346499 - DNA, 25 bp, Mus musculus
gtttgctcgccgcacctgcctcagt

SEQ ID NO: 346500 - DNA, 25 bp, Mus musculus
gtttgctctgaagattgtgcccacc

SEQ ID NO: 346501 - DNA, 25 bp, Mus musculus
gtttgctctgaaggtttcttttgat

SEQ ID NO: 346502 - DNA, 25 bp, Mus musculus
gtttgctgaagaccaaggactggtg

SEQ ID NO: 346503 - DNA, 25 bp, Mus musculus
gtttgctgaagcagaactgtgtgtg

SEQ ID NO: 346504 - DNA, 25 bp, Mus musculus
gtttgctgaagcagctcaccatgtc

SEQ ID NO: 346505 - DNA, 25 bp, Mus musculus
gtttgctgaagcaggacacaccagg

SEQ ID NO: 346506 - DNA, 25 bp, Mus musculus
gtttgctgaccagaatttttcagat

SEQ ID NO: 346507 - DNA, 25 bp, Mus musculus
gtttgctgaccagctgtatatctgt

SEQ ID NO: 346508 - DNA, 25 bp, Mus musculus
gtttgctgcagacagtcttcatcag

SEQ ID NO: 346509 - DNA, 25 bp, Mus musculus
gtttgctgcatacccctgcccagat

SEQ ID NO: 346510 - DNA, 25 bp, Mus musculus
gtttgctgccatcaaattattttta

SEQ ID NO: 346511 - DNA, 25 bp, Mus musculus
gtttgctgctcactgacagggtttc

SEQ ID NO: 346512 - DNA, 25 bp, Mus musculus
gtttgctgctcactgcattggatac

SEQ ID NO: 346513 - DNA, 25 bp, Mus musculus
gtttgctgtgggaaagtacattgag

SEQ ID NO: 346514 - DNA, 25 bp, Mus musculus
gtttgcttcatgactttatatggag

SEQ ID NO: 346515 - DNA, 25 bp, Mus musculus
gtttgcttgtaaggtgcaaaagaag

SEQ ID NO: 346516 - DNA, 25 bp, Mus musculus
gtttggaaacgccattatttgcatt

SEQ ID NO: 346517 - DNA, 25 bp, Mus musculus
gtttggaaacggattctgctctaat

SEQ ID NO: 346518 - DNA, 25 bp, Mus musculus
gtttggaaaggatcgtgaactgggc

SEQ ID NO: 346519 - DNA, 25 bp, Mus musculus
gtttggaaaggcgaccgtgctgtgt

SEQ ID NO: 346520 - DNA, 25 bp, Mus musculus
gtttggaaaggctggcaagtttgac

SEQ ID NO: 346521 - DNA, 25 bp, Mus musculus
gtttggaagaaatacaagaaaaatt

SEQ ID NO: 346522 - DNA, 25 bp, Mus musculus
gtttggaagcaacaaggctgagatg

SEQ ID NO: 346523 - DNA, 25 bp, Mus musculus
gtttggacaagatgtttaagacaag

SEQ ID NO: 346524 - DNA, 25 bp, Mus musculus
gtttggacggtgtgccggactcctg

SEQ ID NO: 346525 - DNA, 25 bp, Mus musculus
gtttggagaaatcttcaagacctga

SEQ ID NO: 346526 - DNA, 25 bp, Mus musculus
gtttggagagtggatggcaggagaa

SEQ ID NO: 346527 - DNA, 25 bp, Mus musculus
gtttggagatatgagacgaaagtag

SEQ ID NO: 346528 - DNA, 25 bp, Mus musculus
gtttggagatatgaggtactccatc

SEQ ID NO: 346529 - DNA, 25 bp, Mus musculus
gtttggagccgactgggctgtttcc

SEQ ID NO: 346530 - DNA, 25 bp, Mus musculus
gtttggagctcgaggtaaagaaaac

SEQ ID NO: 346531 - DNA, 25 bp, Mus musculus
gtttggaggtgccctccaagaccat

SEQ ID NO: 346532 - DNA, 25 bp, Mus musculus
gtttggatttgtggagtctggccac

SEQ ID NO: 346533 - DNA, 25 bp, Mus musculus
gtttggatttgtgggggccagaaca

SEQ ID NO: 346534 - DNA, 25 bp, Mus musculus
gtttggcaaggaagcagaacaagcc

SEQ ID NO: 346535 - DNA, 25 bp, Mus musculus
gtttggcatgaaaggaggaagcggc

SEQ ID NO: 346536 - DNA, 25 bp, Mus musculus
gtttggcatgaaaggcccagcttcg

SEQ ID NO: 346537 - DNA, 25 bp, Mus musculus
gtttggcatgaaaggttttgttttg

SEQ ID NO: 346538 - DNA, 25 bp, Mus musculus
gtttggcatgctggtttcaccatcg

SEQ ID NO: 346539 - DNA, 25 bp, Mus musculus
gtttggccacggatccgggaggaga

SEQ ID NO: 346540 - DNA, 25 bp, Mus musculus
gtttggccacgggctccggccattg

SEQ ID NO: 346541 - DNA, 25 bp, Mus musculus
gtttggccccaaaggtgtgaacatt

SEQ ID NO: 346542 - DNA, 25 bp, Mus musculus
gtttggccccagaagtcggtgacct

SEQ ID NO: 346543 - DNA, 25 bp, Mus musculus
gtttggccccagggcctgagccatg

SEQ ID NO: 346544 - DNA, 25 bp, Mus musculus
gtttggccctccttcacgtagaaaa

SEQ ID NO: 346545 - DNA, 25 bp, Mus musculus
gtttggcgcgatgtctcacaccatt

SEQ ID NO: 346546 - DNA, 25 bp, Mus musculus
gtttggcgcgatgtgcctgcgacag

SEQ ID NO: 346547 - DNA, 25 bp, Mus musculus
gtttggctgacaggattgtccggag

SEQ ID NO: 346548 - DNA, 25 bp, Mus musculus
gtttggctgacagtcatgagagccg

SEQ ID NO: 346549 - DNA, 25 bp, Mus musculus
gtttggcttccgcttgccctatgct

SEQ ID NO: 346550 - DNA, 25 bp, Mus musculus
gtttggcttccggttgccctatgct

SEQ ID NO: 346551 - DNA, 25 bp, Mus musculus
gtttgggaaagctggccgaggagtt

SEQ ID NO: 346552 - DNA, 25 bp, Mus musculus
gtttgggaagggctgtcatggggac

SEQ ID NO: 346553 - DNA, 25 bp, Mus musculus
gtttgggagaccgagctcagcagtc

SEQ ID NO: 346554 - DNA, 25 bp, Mus musculus
gtttgggatgaatgccagctctagc

SEQ ID NO: 346555 - DNA, 25 bp, Mus musculus
gtttggggagtctggtaaataagct

SEQ ID NO: 346556 - DNA, 25 bp, Mus musculus
gtttgggggaccagtagttgcagta

SEQ ID NO: 346557 - DNA, 25 bp, Mus musculus
gtttggtaaaagccatggccatgca

SEQ ID NO: 346558 - DNA, 25 bp, Mus musculus
gtttggtcacctgagcaagttgttg

SEQ ID NO: 346559 - DNA, 25 bp, Mus musculus
gtttggtcaggtggtacgtgggctg

SEQ ID NO: 346560 - DNA, 25 bp, Mus musculus
gtttggtctctggtggaattgggct

SEQ ID NO: 346561 - DNA, 25 bp, Mus musculus
gtttggtctgaaggacagggtttct

SEQ ID NO: 346562 - DNA, 25 bp, Mus musculus
gtttggtggaatgcatgcagatgtc

SEQ ID NO: 346563 - DNA, 25 bp, Mus musculus
gtttggtgtgtgtgtgtaataggga

SEQ ID NO: 346564 - DNA, 25 bp, Mus musculus
gtttggttagaacaggtccgagtag

SEQ ID NO: 346565 - DNA, 25 bp, Mus musculus
gtttggttcttcgggcctgtgtgat

SEQ ID NO: 346566 - DNA, 25 bp, Mus musculus
gtttgtaaaagtaaaggagtgagag

SEQ ID NO: 346567 - DNA, 25 bp, Mus musculus
gtttgtaaaattccttctgatgtat

SEQ ID NO: 346568 - DNA, 25 bp, Mus musculus
gtttgtaaagcctcttcggtgatct

SEQ ID NO: 346569 - DNA, 25 bp, Mus musculus
gtttgtaaagtttcggaacaaggag

SEQ ID NO: 346570 - DNA, 25 bp, Mus musculus
gtttgtaaccatgaaaatcagaaaa

SEQ ID NO: 346571 - DNA, 25 bp, Mus musculus
gtttgtaatagctgccactgaagct

SEQ ID NO: 346572 - DNA, 25 bp, Mus musculus
gtttgtaatagctgccactgacaaa

SEQ ID NO: 346573 - DNA, 25 bp, Mus musculus
gtttgtacaaagggcaatcctgcac

SEQ ID NO: 346574 - DNA, 25 bp, Mus musculus
gtttgtaccaggcaacttgccactc

SEQ ID NO: 346575 - DNA, 25 bp, Mus musculus
gtttgtaccaggttcccaagagttc

SEQ ID NO: 346576 - DNA, 25 bp, Mus musculus
gtttgtagaaaaggggcatcgtctg

SEQ ID NO: 346577 - DNA, 25 bp, Mus musculus
gtttgtagtggtgacactcgaggcc

SEQ ID NO: 346578 - DNA, 25 bp, Mus musculus
gtttgtatcgacagttctgtaagca

SEQ ID NO: 346579 - DNA, 25 bp, Mus musculus
gtttgtatcttcgggctcgctgccc

SEQ ID NO: 346580 - DNA, 25 bp, Mus musculus
gtttgtattgcagagctgtttgaca

SEQ ID NO: 346581 - DNA, 25 bp, Mus musculus
gtttgtattgcagcttctagagctg

SEQ ID NO: 346582 - DNA, 25 bp, Mus musculus
gtttgtcaaaaataaggccagcaga

SEQ ID NO: 346583 - DNA, 25 bp, Mus musculus
gtttgtccaacagctcctggagctt

SEQ ID NO: 346584 - DNA, 25 bp, Mus musculus
gtttgtccaacagtaatttgtcaga

SEQ ID NO: 346585 - DNA, 25 bp, Mus musculus
gtttgtccgcagaaatctgtctttc

SEQ ID NO: 346586 - DNA, 25 bp, Mus musculus
gtttgtccgcaggaacctgaatgaa

SEQ ID NO: 346587 - DNA, 25 bp, Mus musculus
gtttgtcctcaaatcgtcctgcttc

SEQ ID NO: 346588 - DNA, 25 bp, Mus musculus
gtttgtccttaagtgtgggaacttc

SEQ ID NO: 346589 - DNA, 25 bp, Mus musculus
gtttgtcggggacagagtctcggcc

SEQ ID NO: 346590 - DNA, 25 bp, Mus musculus
gtttgtgaagcagaagtacctggac

SEQ ID NO: 346591 - DNA, 25 bp, Mus musculus
gtttgtgaataaatgtctcattaag

SEQ ID NO: 346592 - DNA, 25 bp, Mus musculus
gtttgtgaatgattcccatcatgac

SEQ ID NO: 346593 - DNA, 25 bp, Mus musculus
gtttgtgaatggctgcttattggat

SEQ ID NO: 346594 - DNA, 25 bp, Mus musculus
gtttgtgacctcgtactagaagaca

SEQ ID NO: 346595 - DNA, 25 bp, Mus musculus
gtttgtgagagaggctgtccgtacc

SEQ ID NO: 346596 - DNA, 25 bp, Mus musculus
gtttgtgagagagttataaaagatg

SEQ ID NO: 346597 - DNA, 25 bp, Mus musculus
gtttgtgagcctgccgctcatgctg

SEQ ID NO: 346598 - DNA, 25 bp, Mus musculus
gtttgtgagcctgtttgtgggctgt

SEQ ID NO: 346599 - DNA, 25 bp, Mus musculus
gtttgtgagtttgatgcagcctacc

SEQ ID NO: 346600 - DNA, 25 bp, Mus musculus
gtttgtgagtttgtctttggaggcc

SEQ ID NO: 346601 - DNA, 25 bp, Mus musculus
gtttgtgcagggatcgcttacactt

SEQ ID NO: 346602 - DNA, 25 bp, Mus musculus
gtttgtgcagttgctttattctccc

SEQ ID NO: 346603 - DNA, 25 bp, Mus musculus
gtttgtggggtcagggggactatgt

SEQ ID NO: 346604 - DNA, 25 bp, Mus musculus
gtttgtgtggggttcactgatcacc

SEQ ID NO: 346605 - DNA, 25 bp, Mus musculus
gtttgtgttaaggcctcacaccttg

SEQ ID NO: 346606 - DNA, 25 bp, Mus musculus
gtttgtgttacagctgccctatccc

SEQ ID NO: 346607 - DNA, 25 bp, Mus musculus
gtttgtgtttaaggaatcaaaagtc

SEQ ID NO: 346608 - DNA, 25 bp, Mus musculus
gtttgttactaggattgaaattcca

SEQ ID NO: 346609 - DNA, 25 bp, Mus musculus
gtttgttagtgagctgctggaagct

SEQ ID NO: 346610 - DNA, 25 bp, Mus musculus
gtttgttcagtcgacctgataaaaa

SEQ ID NO: 346611 - DNA, 25 bp, Mus musculus
gtttgttcgtggaggtggagcctac

SEQ ID NO: 346612 - DNA, 25 bp, Mus musculus
gtttgttctacaagctgactcatca

SEQ ID NO: 346613 - DNA, 25 bp, Mus musculus
gtttgttgaattctatgccccttgg

SEQ ID NO: 346614 - DNA, 25 bp, Mus musculus
gtttgttggacagatgcaccaacaa

SEQ ID NO: 346615 - DNA, 25 bp, Mus musculus
gtttgttgttaaagctcccaagctg

SEQ ID NO: 346616 - DNA, 25 bp, Mus musculus
gtttgtttgaggaagctcacaagat

SEQ ID NO: 346617 - DNA, 25 bp, Mus musculus
gtttgtttgctcgctcgggcaaagt

SEQ ID NO: 346618 - DNA, 25 bp, Mus musculus
gtttgttttacagcatgtacattgc

SEQ ID NO: 346619 - DNA, 25 bp, Mus musculus
gtttgttttacagcctttcccatgg

SEQ ID NO: 346620 - DNA, 25 bp, Mus musculus
gttttaaaactttgctgcgagacaa

SEQ ID NO: 346621 - DNA, 25 bp, Mus musculus
gttttaaaagcaagtctgcgtggct

SEQ ID NO: 346622 - DNA, 25 bp, Mus musculus
gttttaaaagcctggctccgtggag

SEQ ID NO: 346623 - DNA, 25 bp, Mus musculus
gttttaaaaggtgtccagtgtgaag

SEQ ID NO: 346624 - DNA, 25 bp, Mus musculus
gttttaaaagtccagccatttcaag

SEQ ID NO: 346625 - DNA, 25 bp, Mus musculus
gttttaaagagacaggacctgatag

SEQ ID NO: 346626 - DNA, 25 bp, Mus musculus
gttttaaatggggctctctaagtac

SEQ ID NO: 346627 - DNA, 25 bp, Mus musculus
gttttaacttaatgtttgaaatgcc

SEQ ID NO: 346628 - DNA, 25 bp, Mus musculus
gttttaagagagattcctttctcct

SEQ ID NO: 346629 - DNA, 25 bp, Mus musculus
gttttaagagaggatttaacagtgc

SEQ ID NO: 346630 - DNA, 25 bp, Mus musculus
gttttaagagaggtggctttgcagc

SEQ ID NO: 346631 - DNA, 25 bp, Mus musculus
gttttaaggctgtctgatcccacag

SEQ ID NO: 346632 - DNA, 25 bp, Mus musculus
gttttaatacagatactgggagtcc

SEQ ID NO: 346633 - DNA, 25 bp, Mus musculus
gttttaatacagatacttgtggcaa

SEQ ID NO: 346634 - DNA, 25 bp, Mus musculus
gttttaatcaagtacggcgagctcc

SEQ ID NO: 346635 - DNA, 25 bp, Mus musculus
gttttaatcaagtgctaccggactg

SEQ ID NO: 346636 - DNA, 25 bp, Mus musculus
gttttacaaaaggtcacaaccatgt

SEQ ID NO: 346637 - DNA, 25 bp, Mus musculus
gttttacatattgcaagacgacaag

SEQ ID NO: 346638 - DNA, 25 bp, Mus musculus
gttttacgccccgcaagactttcct

SEQ ID NO: 346639 - DNA, 25 bp, Mus musculus
gttttacggagccagccatgagaag

SEQ ID NO: 346640 - DNA, 25 bp, Mus musculus
gttttacggagccagttttataggt

SEQ ID NO: 346641 - DNA, 25 bp, Mus musculus
gttttacggagtaagccatgagaag

SEQ ID NO: 346642 - DNA, 25 bp, Mus musculus
gttttagaaccaaccgatgttacag

SEQ ID NO: 346643 - DNA, 25 bp, Mus musculus
gttttagaactaagaaataaagatt

SEQ ID NO: 346644 - DNA, 25 bp, Mus musculus
gttttagaactaagtagcaacccag

SEQ ID NO: 346645 - DNA, 25 bp, Mus musculus
gttttagagatccctctgagaccac

SEQ ID NO: 346646 - DNA, 25 bp, Mus musculus
gttttagataagagttgtagtgcaa

SEQ ID NO: 346647 - DNA, 25 bp, Mus musculus
gttttagataagtatgaattacttc

SEQ ID NO: 346648 - DNA, 25 bp, Mus musculus
gttttagatgatcagagtggtaaga

SEQ ID NO: 346649 - DNA, 25 bp, Mus musculus
gttttaggaaagatataccgcattg

SEQ ID NO: 346650 - DNA, 25 bp, Mus musculus
gttttagtagcagaggtaactcagc

SEQ ID NO: 346651 - DNA, 25 bp, Mus musculus
gttttagtccttgccctgccgaaga

SEQ ID NO: 346652 - DNA, 25 bp, Mus musculus
gttttagttaaaggtctctgtgttg

SEQ ID NO: 346653 - DNA, 25 bp, Mus musculus
gttttataaacagacatttccactg

SEQ ID NO: 346654 - DNA, 25 bp, Mus musculus
gttttatatccacgataattttatt

SEQ ID NO: 346655 - DNA, 25 bp, Mus musculus
gttttatcctggtctctaataaaga

SEQ ID NO: 346656 - DNA, 25 bp, Mus musculus
gttttatccttacaatgacactgta

SEQ ID NO: 346657 - DNA, 25 bp, Mus musculus
gttttatgagatgtccagctcgccg

SEQ ID NO: 346658 - DNA, 25 bp, Mus musculus
gttttatgagcagggcgatgaagaa

SEQ ID NO: 346659 - DNA, 25 bp, Mus musculus
gttttatggactacagatttgggac

SEQ ID NO: 346660 - DNA, 25 bp, Mus musculus
gttttattctgagcggtatcaagtt

SEQ ID NO: 346661 - DNA, 25 bp, Mus musculus
gttttcaaaaaagaatatgatgctg

SEQ ID NO: 346662 - DNA, 25 bp, Mus musculus
gttttcaagaaatattatgctgaag

SEQ ID NO: 346663 - DNA, 25 bp, Mus musculus
gttttcaagaaatgtatctttccga

SEQ ID NO: 346664 - DNA, 25 bp, Mus musculus
gttttcaatcccagttacatttcaa

SEQ ID NO: 346665 - DNA, 25 bp, Mus musculus
gttttcaatcccagttatcttgacg

SEQ ID NO: 346666 - DNA, 25 bp, Mus musculus
gttttcacaaatttatcctgtagta

SEQ ID NO: 346667 - DNA, 25 bp, Mus musculus
gttttcacactgacttgaattttat

SEQ ID NO: 346668 - DNA, 25 bp, Mus musculus
gttttcacaggaactggtgactact

SEQ ID NO: 346669 - DNA, 25 bp, Mus musculus
gttttcacaggggccgatcaacagt

SEQ ID NO: 346670 - DNA, 25 bp, Mus musculus
gttttcacagtctttcaggcatgct

SEQ ID NO: 346671 - DNA, 25 bp, Mus musculus
gttttcacctgatagcatgtggcat

SEQ ID NO: 346672 - DNA, 25 bp, Mus musculus
gttttcagacagctggttcgatgcc

SEQ ID NO: 346673 - DNA, 25 bp, Mus musculus
gttttcagagttggaaacaacttcc

SEQ ID NO: 346674 - DNA, 25 bp, Mus musculus
gttttcatccaggtggatcgcactc

SEQ ID NO: 346675 - DNA, 25 bp, Mus musculus
gttttcatgatcatccagtcctcgc

SEQ ID NO: 346676 - DNA, 25 bp, Mus musculus
gttttcattgtgatctctgggctag

SEQ ID NO: 346677 - DNA, 25 bp, Mus musculus
gttttcatttcaagatgtgcccttc

SEQ ID NO: 346678 - DNA, 25 bp, Mus musculus
gttttccagcaagtggaacacattt

SEQ ID NO: 346679 - DNA, 25 bp, Mus musculus
gttttccagtgaagccatggcagaa

SEQ ID NO: 346680 - DNA, 25 bp, Mus musculus
gttttccattgggtcaggatcatgt

SEQ ID NO: 346681 - DNA, 25 bp, Mus musculus
gttttccccaaggcaagtcttggaa

SEQ ID NO: 346682 - DNA, 25 bp, Mus musculus
gttttccccaaggctagcttccgat

SEQ ID NO: 346683 - DNA, 25 bp, Mus musculus
gttttccccttctgttgtactttga

SEQ ID NO: 346684 - DNA, 25 bp, Mus musculus
gttttccctcagaatgggtcagccc

SEQ ID NO: 346685 - DNA, 25 bp, Mus musculus
gttttccctctagtggaaacaagtt

SEQ ID NO: 346686 - DNA, 25 bp, Mus musculus
gttttccctctagttgtgagcggcc

SEQ ID NO: 346687 - DNA, 25 bp, Mus musculus
gttttcctacagagagaacctggag

SEQ ID NO: 346688 - DNA, 25 bp, Mus musculus
gttttcctcaggcgcagacactcag

SEQ ID NO: 346689 - DNA, 25 bp, Mus musculus
gttttcctgggagactccagaaccc

SEQ ID NO: 346690 - DNA, 25 bp, Mus musculus
gttttcgaaggcagtataattcgtt

SEQ ID NO: 346691 - DNA, 25 bp, Mus musculus
gttttcgaaggcatgcttgtagtgt

SEQ ID NO: 346692 - DNA, 25 bp, Mus musculus
gttttcggagtctattgcatctgca

SEQ ID NO: 346693 - DNA, 25 bp, Mus musculus
gttttctcacagcatggtctgagac

SEQ ID NO: 346694 - DNA, 25 bp, Mus musculus
gttttctcaggaaattgggcttgca

SEQ ID NO: 346695 - DNA, 25 bp, Mus musculus
gttttctcaggagaaccagacttgg

SEQ ID NO: 346696 - DNA, 25 bp, Mus musculus
gttttctccagatgacttcttgggt

SEQ ID NO: 346697 - DNA, 25 bp, Mus musculus
gttttctccaggaaggaactcaagt

SEQ ID NO: 346698 - DNA, 25 bp, Mus musculus
gttttctctagatccatttgggctt

SEQ ID NO: 346699 - DNA, 25 bp, Mus musculus
gttttctctgacagctgtcatcagc

SEQ ID NO: 346700 - DNA, 25 bp, Mus musculus
gttttctgaagagatacaaggggac

SEQ ID NO: 346701 - DNA, 25 bp, Mus musculus
gttttctgaggagggtgtaaaagaa

SEQ ID NO: 346702 - DNA, 25 bp, Mus musculus
gttttctgccagattcaagaacctg

SEQ ID NO: 346703 - DNA, 25 bp, Mus musculus
gttttctggagtgacactagcagac

SEQ ID NO: 346704 - DNA, 25 bp, Mus musculus
gttttctgtcaagacaccatgattc

SEQ ID NO: 346705 - DNA, 25 bp, Mus musculus
gttttctgttgagcggctgcaaagt

SEQ ID NO: 346706 - DNA, 25 bp, Mus musculus
gttttcttcccagccggttccagcc

SEQ ID NO: 346707 - DNA, 25 bp, Mus musculus
gttttcttgtgcaaactgggatgga

SEQ ID NO: 346708 - DNA, 25 bp, Mus musculus
gttttctttagattgtcccagttgt

SEQ ID NO: 346709 - DNA, 25 bp, Mus musculus
gttttgaaaaagaatatatttgaaa

SEQ ID NO: 346710 - DNA, 25 bp, Mus musculus
gttttgaaaaaggtgactcattttt

SEQ ID NO: 346711 - DNA, 25 bp, Mus musculus
gttttgaaacatgtccacctcgtac

SEQ ID NO: 346712 - DNA, 25 bp, Mus musculus
gttttgaagcactaggttcacgcta

SEQ ID NO: 346713 - DNA, 25 bp, Mus musculus
gttttgaattgtaatgtggagctgc

SEQ ID NO: 346714 - DNA, 25 bp, Mus musculus
gttttgacaggactggaggaccgac

SEQ ID NO: 346715 - DNA, 25 bp, Mus musculus
gttttgacttatatgatgttgattc

SEQ ID NO: 346716 - DNA, 25 bp, Mus musculus
gttttgatacagtcaccaaggagct

SEQ ID NO: 346717 - DNA, 25 bp, Mus musculus
gttttgatgcagctatgaaggggct

SEQ ID NO: 346718 - DNA, 25 bp, Mus musculus
gttttgcagttcaggtttgctgtct

SEQ ID NO: 346719 - DNA, 25 bp, Mus musculus
gttttgcataggtgcctctcctttc

SEQ ID NO: 346720 - DNA, 25 bp, Mus musculus
gttttgcccacctggctggtttgga

SEQ ID NO: 346721 - DNA, 25 bp, Mus musculus
gttttgcccacctggtacccaggat

SEQ ID NO: 346722 - DNA, 25 bp, Mus musculus
gttttgccctgcactcctgggcatc

SEQ ID NO: 346723 - DNA, 25 bp, Mus musculus
gttttgccctgggctacggcgtgtg

SEQ ID NO: 346724 - DNA, 25 bp, Mus musculus
gttttgcctgtagagacagctgcat

SEQ ID NO: 346725 - DNA, 25 bp, Mus musculus
gttttgctggccagcagtgacgcgc

SEQ ID NO: 346726 - DNA, 25 bp, Mus musculus
gttttgctggtggtggcatcgtttg

SEQ ID NO: 346727 - DNA, 25 bp, Mus musculus
gttttgctggtggtgttcagacagt

SEQ ID NO: 346728 - DNA, 25 bp, Mus musculus
gttttgctttgtttacagacctgca

SEQ ID NO: 346729 - DNA, 25 bp, Mus musculus
gttttggaagaagacgtcaaactcc

SEQ ID NO: 346730 - DNA, 25 bp, Mus musculus
gttttggaagaagtcagttaaggag

SEQ ID NO: 346731 - DNA, 25 bp, Mus musculus
gttttggaatgagagacatgtctac

SEQ ID NO: 346732 - DNA, 25 bp, Mus musculus
gttttggagtaacagctagaaattg

SEQ ID NO: 346733 - DNA, 25 bp, Mus musculus
gttttggcaaggagaggccagctga

SEQ ID NO: 346734 - DNA, 25 bp, Mus musculus
gttttggccaaagttatctccctag

SEQ ID NO: 346735 - DNA, 25 bp, Mus musculus
gttttggccaagatccccagcctca

SEQ ID NO: 346736 - DNA, 25 bp, Mus musculus
gttttggtagagggacagtgtcttg

SEQ ID NO: 346737 - DNA, 25 bp, Mus musculus
gttttggtgaaaagtgaagatgcca

SEQ ID NO: 346738 - DNA, 25 bp, Mus musculus
gttttggttggtatgctgtacatct

SEQ ID NO: 346739 - DNA, 25 bp, Mus musculus
gttttgtcaagacaatggattctga

SEQ ID NO: 346740 - DNA, 25 bp, Mus musculus
gttttgtccgccagggttcggcaga

SEQ ID NO: 346741 - DNA, 25 bp, Mus musculus
gttttgtgaagagtacccagtatta

SEQ ID NO: 346742 - DNA, 25 bp, Mus musculus
gttttgtgaagcctggatggtggag

SEQ ID NO: 346743 - DNA, 25 bp, Mus musculus
gttttgtgaaggacaaggctacact

SEQ ID NO: 346744 - DNA, 25 bp, Mus musculus
gttttgtgagcaccttcagctttca

SEQ ID NO: 346745 - DNA, 25 bp, Mus musculus
gttttgtgcagagattaagcacatg

SEQ ID NO: 346746 - DNA, 25 bp, Mus musculus
gttttgtggaagagagtccagaaaa

SEQ ID NO: 346747 - DNA, 25 bp, Mus musculus
gttttgttgctttcccagcactatg

SEQ ID NO: 346748 - DNA, 25 bp, Mus musculus
gttttgttttggttggtatgctgta

SEQ ID NO: 346749 - DNA, 25 bp, Mus musculus
gttttgttttgttatgaatgcagga

SEQ ID NO: 346750 - DNA, 25 bp, Mus musculus
gtttttaaactaggtcgatccttcg

SEQ ID NO: 346751 - DNA, 25 bp, Mus musculus
gtttttaatgatgaggtccttctgt

SEQ ID NO: 346752 - DNA, 25 bp, Mus musculus
gtttttaatggggcccaaattcatt

SEQ ID NO: 346753 - DNA, 25 bp, Mus musculus
gtttttacttcgcggagtgctctct

SEQ ID NO: 346754 - DNA, 25 bp, Mus musculus
gtttttagcgttctccacccatgag

SEQ ID NO: 346755 - DNA, 25 bp, Mus musculus
gtttttaggaggtatcttgatgtgg

SEQ ID NO: 346756 - DNA, 25 bp, Mus musculus
gtttttatccccatggaaagggctg

SEQ ID NO: 346757 - DNA, 25 bp, Mus musculus
gtttttcaaggatgtcactgatttt

SEQ ID NO: 346758 - DNA, 25 bp, Mus musculus
gtttttcaagtatgaagtcagaggc

SEQ ID NO: 346759 - DNA, 25 bp, Mus musculus
gtttttcacagatcactggtgttat

SEQ ID NO: 346760 - DNA, 25 bp, Mus musculus
gtttttcacctatctgggggcacct

SEQ ID NO: 346761 - DNA, 25 bp, Mus musculus
gtttttcagctatggaccgtcacga

SEQ ID NO: 346762 - DNA, 25 bp, Mus musculus
gtttttcatacagataaaaattatt

SEQ ID NO: 346763 - DNA, 25 bp, Mus musculus
gtttttccaaggagtgtggggccga

SEQ ID NO: 346764 - DNA, 25 bp, Mus musculus
gtttttccaccgctctccagcccct

SEQ ID NO: 346765 - DNA, 25 bp, Mus musculus
gtttttcctcagagcccagatgccc

SEQ ID NO: 346766 - DNA, 25 bp, Mus musculus
gtttttcctggtgtgacttatgagg

SEQ ID NO: 346767 - DNA, 25 bp, Mus musculus
gtttttcctgtgtcccgtgtcacaa

SEQ ID NO: 346768 - DNA, 25 bp, Mus musculus
gtttttcgatgagatggcggatcca

SEQ ID NO: 346769 - DNA, 25 bp, Mus musculus
gtttttcgatgaggctgaattgcat

SEQ ID NO: 346770 - DNA, 25 bp, Mus musculus
gtttttctaagagaacggtcatcaa

SEQ ID NO: 346771 - DNA, 25 bp, Mus musculus
gtttttctggatcttgtttcctcta

SEQ ID NO: 346772 - DNA, 25 bp, Mus musculus
gtttttctgtgaaggcgttaagatc

SEQ ID NO: 346773 - DNA, 25 bp, Mus musculus
gtttttcttgaataggtattgataa

SEQ ID NO: 346774 - DNA, 25 bp, Mus musculus
gtttttgaagagctacagacagtcg

SEQ ID NO: 346775 - DNA, 25 bp, Mus musculus
gtttttgacagacagaatgtacttt

SEQ ID NO: 346776 - DNA, 25 bp, Mus musculus
gtttttgacagaccagccacaccat

SEQ ID NO: 346777 - DNA, 25 bp, Mus musculus
gtttttgacagcctcattaacttcg

SEQ ID NO: 346778 - DNA, 25 bp, Mus musculus
gtttttgcagaatgtgtgctgtgtt

SEQ ID NO: 346779 - DNA, 25 bp, Mus musculus
gtttttgctgatgggaacttttggg

SEQ ID NO: 346780 - DNA, 25 bp, Mus musculus
gtttttgctgatttctaagttattt

SEQ ID NO: 346781 - DNA, 25 bp, Mus musculus
gtttttggaggcaactgtgcccaaa

SEQ ID NO: 346782 - DNA, 25 bp, Mus musculus
gtttttgtgctgttgcttcctggac

SEQ ID NO: 346783 - DNA, 25 bp, Mus musculus
gtttttgttggaaatacagttggag

SEQ ID NO: 346784 - DNA, 25 bp, Mus musculus
gttttttcagagatcccgcccggag

SEQ ID NO: 346785 - DNA, 25 bp, Mus musculus
gttttttcaggatgacttgattatc

SEQ ID NO: 346786 - DNA, 25 bp, Mus musculus
gttttttctggcgagcggcgtgctg

SEQ ID NO: 346787 - DNA, 25 bp, Mus musculus
taaaaaaaccgacaagctgggctgc

SEQ ID NO: 346788 - DNA, 25 bp, Mus musculus
taaaaaaagaaatcacaattcacaa

SEQ ID NO: 346789 - DNA, 25 bp, Mus musculus
taaaaaaagaaggtgacacagcatc

SEQ ID NO: 346790 - DNA, 25 bp, Mus musculus
taaaaaaattcagggaatgcagtcg

SEQ ID NO: 346791 - DNA, 25 bp, Mus musculus
taaaaaaattcatctacaggctctg

SEQ ID NO: 346792 - DNA, 25 bp, Mus musculus
taaaaaacaacaaggagtacctgga

SEQ ID NO: 346793 - DNA, 25 bp, Mus musculus
taaaaaaccagatcatcacctccac

SEQ ID NO: 346794 - DNA, 25 bp, Mus musculus
taaaaaactggtatccagctcatat

SEQ ID NO: 346795 - DNA, 25 bp, Mus musculus
taaaaaagtaaaagaattgcggcga

SEQ ID NO: 346796 - DNA, 25 bp, Mus musculus
taaaaaagtaaaagcacttggtgga

SEQ ID NO: 346797 - DNA, 25 bp, Mus musculus
taaaaaataaggctcatcctaaagt

SEQ ID NO: 346798 - DNA, 25 bp, Mus musculus
taaaaacagaaggcgaaggacgaac

SEQ ID NO: 346799 - DNA, 25 bp, Mus musculus
taaaaacagtacagattgctaagaa

SEQ ID NO: 346800 - DNA, 25 bp, Mus musculus
taaaaacatcgagatcaagaagttg

SEQ ID NO: 346801 - DNA, 25 bp, Mus musculus
taaaaacattgcaaagaactgacat

SEQ ID NO: 346802 - DNA, 25 bp, Mus musculus
taaaaaccagaatgacccattgcca

SEQ ID NO: 346803 - DNA, 25 bp, Mus musculus
taaaaaccagaccgacgtgacaaat

SEQ ID NO: 346804 - DNA, 25 bp, Mus musculus
taaaaaccagtcggcagaccacagg

SEQ ID NO: 346805 - DNA, 25 bp, Mus musculus
taaaaactcaagatgtggagtacat

SEQ ID NO: 346806 - DNA, 25 bp, Mus musculus
taaaaactcaggtcctttgcaaaca

SEQ ID NO: 346807 - DNA, 25 bp, Mus musculus
taaaaactgctttgcacgtgacaca

SEQ ID NO: 346808 - DNA, 25 bp, Mus musculus
taaaaagacttggtgattgggatac

SEQ ID NO: 346809 - DNA, 25 bp, Mus musculus
taaaaagagactgttgtaacagttg

SEQ ID NO: 346810 - DNA, 25 bp, Mus musculus
taaaaagatggatcagtttgacaac

SEQ ID NO: 346811 - DNA, 25 bp, Mus musculus
taaaaagattcaagaacttggggac

SEQ ID NO: 346812 - DNA, 25 bp, Mus musculus
taaaaagcagatgcatgttcctgct

SEQ ID NO: 346813 - DNA, 25 bp, Mus musculus
taaaaagcagatgtcatatgcctgc

SEQ ID NO: 346814 - DNA, 25 bp, Mus musculus
taaaaagcaggggttccttgtggag

SEQ ID NO: 346815 - DNA, 25 bp, Mus musculus
taaaaagtgggaaatgaaagcttgg

SEQ ID NO: 346816 - DNA, 25 bp, Mus musculus
taaaaatattagcatcaaaaatctc

SEQ ID NO: 346817 - DNA, 25 bp, Mus musculus
taaaaatattgagactggaagtgat

SEQ ID NO: 346818 - DNA, 25 bp, Mus musculus
taaaaatattgggtatgaaagtgcc

SEQ ID NO: 346819 - DNA, 25 bp, Mus musculus
taaaaatcaccacagtttcgttatc

SEQ ID NO: 346820 - DNA, 25 bp, Mus musculus
taaaaatgacttcgcactgaaaatc

SEQ ID NO: 346821 - DNA, 25 bp, Mus musculus
taaaaatgacttcggagatgatagg

SEQ ID NO: 346822 - DNA, 25 bp, Mus musculus
taaaaatgcaccaacaattctcttg

SEQ ID NO: 346823 - DNA, 25 bp, Mus musculus
taaaaatggtgtccttggacttctt

SEQ ID NO: 346824 - DNA, 25 bp, Mus musculus
taaaaattaatggtatcctaaagtt

SEQ ID NO: 346825 - DNA, 25 bp, Mus musculus
taaaaattaatggttggctgcaggt

SEQ ID NO: 346826 - DNA, 25 bp, Mus musculus
taaaaattacagtaccaaagcagtc

SEQ ID NO: 346827 - DNA, 25 bp, Mus musculus
taaaaattgagacctctgacagctg

SEQ ID NO: 346828 - DNA, 25 bp, Mus musculus
taaaaattgagagagagaagattat

SEQ ID NO: 346829 - DNA, 25 bp, Mus musculus
taaaacaaagatgtctcatttccgt

SEQ ID NO: 346830 - DNA, 25 bp, Mus musculus
taaaacaaaggggaagcgtgcggcc

SEQ ID NO: 346831 - DNA, 25 bp, Mus musculus
taaaacaacagttaatttagagtgc

SEQ ID NO: 346832 - DNA, 25 bp, Mus musculus
taaaacaagaggagattaggttgtg

SEQ ID NO: 346833 - DNA, 25 bp, Mus musculus
taaaacacaaaaatgggttctctgt

SEQ ID NO: 346834 - DNA, 25 bp, Mus musculus
taaaacacaggagctccttctggcc

SEQ ID NO: 346835 - DNA, 25 bp, Mus musculus
taaaacacgccttggccggaatgtg

SEQ ID NO: 346836 - DNA, 25 bp, Mus musculus
taaaacacgccttggggttctctgt

SEQ ID NO: 346837 - DNA, 25 bp, Mus musculus
taaaacaggcctcaaggctttgatg

SEQ ID NO: 346838 - DNA, 25 bp, Mus musculus
taaaacatgatccaggcgtctcttt

SEQ ID NO: 346839 - DNA, 25 bp, Mus musculus
taaaaccacgactccagatgtagcc

SEQ ID NO: 346840 - DNA, 25 bp, Mus musculus
taaaaccagatcagaaaccagtaaa

SEQ ID NO: 346841 - DNA, 25 bp, Mus musculus
taaaaccagcaaaggaagtggggat

SEQ ID NO: 346842 - DNA, 25 bp, Mus musculus
taaaaccagcaaaggtcctttccag

SEQ ID NO: 346843 - DNA, 25 bp, Mus musculus
taaaacctgagaatctgcccgagag

SEQ ID NO: 346844 - DNA, 25 bp, Mus musculus
taaaactacaagagtggatcatgac

SEQ ID NO: 346845 - DNA, 25 bp, Mus musculus
taaaactacgagctcctgcttcctg

SEQ ID NO: 346846 - DNA, 25 bp, Mus musculus
taaaactacgaggtgttctgcccag

SEQ ID NO: 346847 - DNA, 25 bp, Mus musculus
taaaactacgagtcacaccagaaga

SEQ ID NO: 346848 - DNA, 25 bp, Mus musculus
taaaactacgagtttatagaacaag

SEQ ID NO: 346849 - DNA, 25 bp, Mus musculus
taaaactactgagaaggtccttttc

SEQ ID NO: 346850 - DNA, 25 bp, Mus musculus
taaaactactgtcctcggcccaggt

SEQ ID NO: 346851 - DNA, 25 bp, Mus musculus
taaaactactgttttggtgaaaata

SEQ ID NO: 346852 - DNA, 25 bp, Mus musculus
taaaactatagaggtgccttggagc

SEQ ID NO: 346853 - DNA, 25 bp, Mus musculus
taaaactatttatgaattcacagac

SEQ ID NO: 346854 - DNA, 25 bp, Mus musculus
taaaactatttatgatactgcattt

SEQ ID NO: 346855 - DNA, 25 bp, Mus musculus
taaaactccaatgtcacagaaaaga

SEQ ID NO: 346856 - DNA, 25 bp, Mus musculus
taaaactccagttccttctgatgta

SEQ ID NO: 346857 - DNA, 25 bp, Mus musculus
taaaactctgcgaggcagaggctcc

SEQ ID NO: 346858 - DNA, 25 bp, Mus musculus
taaaactgattgactggggaaacat

SEQ ID NO: 346859 - DNA, 25 bp, Mus musculus
taaaactggggttcgcaacgttctc

SEQ ID NO: 346860 - DNA, 25 bp, Mus musculus
taaaactgggtggtcatatgcttta

SEQ ID NO: 346861 - DNA, 25 bp, Mus musculus
taaaacttcagttgttgacctcctg

SEQ ID NO: 346862 - DNA, 25 bp, Mus musculus
taaaacttgggtgctgaaggggatg

SEQ ID NO: 346863 - DNA, 25 bp, Mus musculus
taaaactttgtagttggtgatgatg

SEQ ID NO: 346864 - DNA, 25 bp, Mus musculus
taaaagaaagaatgctcaaaggtga

SEQ ID NO: 346865 - DNA, 25 bp, Mus musculus
taaaagaatgatgccagcatgtctc

SEQ ID NO: 346866 - DNA, 25 bp, Mus musculus
taaaagaatggaggtccgctgggga

SEQ ID NO: 346867 - DNA, 25 bp, Mus musculus
taaaagacaaaggggaagacatctt

SEQ ID NO: 346868 - DNA, 25 bp, Mus musculus
taaaagaccctgtgtcacgaacccc

SEQ ID NO: 346869 - DNA, 25 bp, Mus musculus
taaaagagatttctattctctacat

SEQ ID NO: 346870 - DNA, 25 bp, Mus musculus
taaaagagatttctgctgaatgtgg

SEQ ID NO: 346871 - DNA, 25 bp, Mus musculus
taaaagaggagcagggcttctattt

SEQ ID NO: 346872 - DNA, 25 bp, Mus musculus
taaaagaggagcagtaaaagctggc

SEQ ID NO: 346873 - DNA, 25 bp, Mus musculus
taaaagataaagagggctacacatc

SEQ ID NO: 346874 - DNA, 25 bp, Mus musculus
taaaagatgaatatgaaaaggtgga

SEQ ID NO: 346875 - DNA, 25 bp, Mus musculus
taaaagatttgtccataagaacttc

SEQ ID NO: 346876 - DNA, 25 bp, Mus musculus
taaaagcaaagagtcttatcagctg

SEQ ID NO: 346877 - DNA, 25 bp, Mus musculus
taaaagcaacagagagtgcactgac

SEQ ID NO: 346878 - DNA, 25 bp, Mus musculus
taaaagcaacagagttcttgcctct

SEQ ID NO: 346879 - DNA, 25 bp, Mus musculus
taaaagcatcaggcaagaggcaaag

SEQ ID NO: 346880 - DNA, 25 bp, Mus musculus
taaaagcatcagttgtgactgtgag

SEQ ID NO: 346881 - DNA, 25 bp, Mus musculus
taaaagcattaaagcccagtgcccc

SEQ ID NO: 346882 - DNA, 25 bp, Mus musculus
taaaagccaagcacggaaataacca

SEQ ID NO: 346883 - DNA, 25 bp, Mus musculus
taaaagccacaagagataagatgaa

SEQ ID NO: 346884 - DNA, 25 bp, Mus musculus
taaaagccatgaaagtatatctcaa

SEQ ID NO: 346885 - DNA, 25 bp, Mus musculus
taaaagccatgcagcaccagcgaat

SEQ ID NO: 346886 - DNA, 25 bp, Mus musculus
taaaagcggccataaactgtacatt

SEQ ID NO: 346887 - DNA, 25 bp, Mus musculus
taaaagctaaacaagagcatgaagg

SEQ ID NO: 346888 - DNA, 25 bp, Mus musculus
taaaagctcaggaagtctttaatga

SEQ ID NO: 346889 - DNA, 25 bp, Mus musculus
taaaagctctgggggtgaaatggga

SEQ ID NO: 346890 - DNA, 25 bp, Mus musculus
taaaagctctgggggtgaacatgat

SEQ ID NO: 346891 - DNA, 25 bp, Mus musculus
taaaagctgaagtgaagtctggcaa

SEQ ID NO: 346892 - DNA, 25 bp, Mus musculus
taaaagcttttacatgaaggtgcat

SEQ ID NO: 346893 - DNA, 25 bp, Mus musculus
taaaaggaactggtctctcatggaa

SEQ ID NO: 346894 - DNA, 25 bp, Mus musculus
taaaaggcagagatgctgattctct

SEQ ID NO: 346895 - DNA, 25 bp, Mus musculus
taaaaggcagagtatgtttgatgtt

SEQ ID NO: 346896 - DNA, 25 bp, Mus musculus
taaaagggaaacaagttctgacagt

SEQ ID NO: 346897 - DNA, 25 bp, Mus musculus
taaaaggttatttgaacacacaggt

SEQ ID NO: 346898 - DNA, 25 bp, Mus musculus
taaaaggttatttggtacaaaatgc

SEQ ID NO: 346899 - DNA, 25 bp, Mus musculus
taaaagtaaatggaagtacgactgc

SEQ ID NO: 346900 - DNA, 25 bp, Mus musculus
taaaagtcaagtgatcaaccggaaa

SEQ ID NO: 346901 - DNA, 25 bp, Mus musculus
taaaagttcaaggagtctcatgaac

SEQ ID NO: 346902 - DNA, 25 bp, Mus musculus
taaaataaaaagcagatgcatgttc

SEQ ID NO: 346903 - DNA, 25 bp, Mus musculus
taaaataaaaagcagatgtcatatg

SEQ ID NO: 346904 - DNA, 25 bp, Mus musculus
taaaataaatatccatgggaaactc

SEQ ID NO: 346905 - DNA, 25 bp, Mus musculus
taaaataaatcatacctgcggtggt

SEQ ID NO: 346906 - DNA, 25 bp, Mus musculus
taaaataatccaaggaagaattctg

SEQ ID NO: 346907 - DNA, 25 bp, Mus musculus
taaaataatcctgtcaaggtattcc

SEQ ID NO: 346908 - DNA, 25 bp, Mus musculus
taaaataatttcagctgccagtgaa

SEQ ID NO: 346909 - DNA, 25 bp, Mus musculus
taaaataccagtgtaagcggtaacc

SEQ ID NO: 346910 - DNA, 25 bp, Mus musculus
taaaatacctgagcatctgtaacac

SEQ ID NO: 346911 - DNA, 25 bp, Mus musculus
taaaatactacatttttttccagag

SEQ ID NO: 346912 - DNA, 25 bp, Mus musculus
taaaatactctcctgggttgtgtta

SEQ ID NO: 346913 - DNA, 25 bp, Mus musculus
taaaatagaaaataaaatcttggca

SEQ ID NO: 346914 - DNA, 25 bp, Mus musculus
taaaatagagctggagtaactgaga

SEQ ID NO: 346915 - DNA, 25 bp, Mus musculus
taaaatatcagaaatcatgaggtcc

SEQ ID NO: 346916 - DNA, 25 bp, Mus musculus
taaaatatcagaggctaaagaaggc

SEQ ID NO: 346917 - DNA, 25 bp, Mus musculus
taaaatatgtcagatttcaactatt

SEQ ID NO: 346918 - DNA, 25 bp, Mus musculus
taaaatcaagatctctgctcctcag

SEQ ID NO: 346919 - DNA, 25 bp, Mus musculus
taaaatcaagatgtctgttggtgac

SEQ ID NO: 346920 - DNA, 25 bp, Mus musculus
taaaatcacagactcaccacctcca

SEQ ID NO: 346921 - DNA, 25 bp, Mus musculus
taaaatcagaggtccggaccgctgt

SEQ ID NO: 346922 - DNA, 25 bp, Mus musculus
taaaatcagcaccgtgcgagtccag

SEQ ID NO: 346923 - DNA, 25 bp, Mus musculus
taaaatccaagaggcggtggtggtg

SEQ ID NO: 346924 - DNA, 25 bp, Mus musculus
taaaatccccagatcccagcctcct

SEQ ID NO: 346925 - DNA, 25 bp, Mus musculus
taaaatccccagctattgcagatcc

SEQ ID NO: 346926 - DNA, 25 bp, Mus musculus
taaaatccccaggtgtgactgcaca

SEQ ID NO: 346927 - DNA, 25 bp, Mus musculus
taaaatcccttgctaacagagaagt

SEQ ID NO: 346928 - DNA, 25 bp, Mus musculus
taaaatcgaggttaataatgcgaca

SEQ ID NO: 346929 - DNA, 25 bp, Mus musculus
taaaatgctatgtgctgagccacct

SEQ ID NO: 346930 - DNA, 25 bp, Mus musculus
taaaatggagagaggtaagaagtat

SEQ ID NO: 346931 - DNA, 25 bp, Mus musculus
taaaatggagagtctggatgtggat

SEQ ID NO: 346932 - DNA, 25 bp, Mus musculus
taaaatgtttgaagcgacagcagtc

SEQ ID NO: 346933 - DNA, 25 bp, Mus musculus
taaaattaaacctaatgcttgcatt

SEQ ID NO: 346934 - DNA, 25 bp, Mus musculus
taaaattacaagttgatcgtgtcct

SEQ ID NO: 346935 - DNA, 25 bp, Mus musculus
taaaattacagagaatgcatcagat

SEQ ID NO: 346936 - DNA, 25 bp, Mus musculus
taaaattacagctcagtctggaacg

SEQ ID NO: 346937 - DNA, 25 bp, Mus musculus
taaaattcagcctttagaaaggaag

SEQ ID NO: 346938 - DNA, 25 bp, Mus musculus
taaaattcaggctgtagctgtttgt

SEQ ID NO: 346939 - DNA, 25 bp, Mus musculus
taaaattcatatgggtaactgtgct

SEQ ID NO: 346940 - DNA, 25 bp, Mus musculus
taaaattctcaagccagtaaaaaag

SEQ ID NO: 346941 - DNA, 25 bp, Mus musculus
taaaattctcaagtcacgaacccct

SEQ ID NO: 346942 - DNA, 25 bp, Mus musculus
taaaattctggagctggaggagaaa

SEQ ID NO: 346943 - DNA, 25 bp, Mus musculus
taaaattgactacagaacacaagac

SEQ ID NO: 346944 - DNA, 25 bp, Mus musculus
taaaattgactacagatttcatata

SEQ ID NO: 346945 - DNA, 25 bp, Mus musculus
taaaattgactacaggaaactataa

SEQ ID NO: 346946 - DNA, 25 bp, Mus musculus
taaaattgatgcatctctgacattt

SEQ ID NO: 346947 - DNA, 25 bp, Mus musculus
taaaattgcctgtacacagagttct

SEQ ID NO: 346948 - DNA, 25 bp, Mus musculus
taaaatttccacctgctgatcttaa

SEQ ID NO: 346949 - DNA, 25 bp, Mus musculus
taaaatttcttgtgaaaatgaacaa

SEQ ID NO: 346950 - DNA, 25 bp, Mus musculus
taaaatttggattcctgtctctgag

SEQ ID NO: 346951 - DNA, 25 bp, Mus musculus
taaacaaaagaaagatataagcata

SEQ ID NO: 346952 - DNA, 25 bp, Mus musculus
taaacaaaataaatggtctactgaa

SEQ ID NO: 346953 - DNA, 25 bp, Mus musculus
taaacaacaagatctgtgatattgc

SEQ ID NO: 346954 - DNA, 25 bp, Mus musculus
taaacaacctagagcttcaggatct

SEQ ID NO: 346955 - DNA, 25 bp, Mus musculus
taaacaagaaactcgggtgccctcc

SEQ ID NO: 346956 - DNA, 25 bp, Mus musculus
taaacaagcccatgaagtgcccccg

SEQ ID NO: 346957 - DNA, 25 bp, Mus musculus
taaacaagcgcagatattaaactaa

SEQ ID NO: 346958 - DNA, 25 bp, Mus musculus
taaacaatcagcccaggagttaaag

SEQ ID NO: 346959 - DNA, 25 bp, Mus musculus
taaacaatcttcaggtggctgtgaa

SEQ ID NO: 346960 - DNA, 25 bp, Mus musculus
taaacacaagagaattcatacagga

SEQ ID NO: 346961 - DNA, 25 bp, Mus musculus
taaacacaagatcttctgcccaatc

SEQ ID NO: 346962 - DNA, 25 bp, Mus musculus
taaacaccagggtctcctagccctt

SEQ ID NO: 346963 - DNA, 25 bp, Mus musculus
taaacactccaggtcgcagacactt

SEQ ID NO: 346964 - DNA, 25 bp, Mus musculus
taaacactctactggatgactggaa

SEQ ID NO: 346965 - DNA, 25 bp, Mus musculus
taaacactttgcaaaggcaaaatca

SEQ ID NO: 346966 - DNA, 25 bp, Mus musculus
taaacagaaagcttcacggaaaccc

SEQ ID NO: 346967 - DNA, 25 bp, Mus musculus
taaacagaaaggtgtcaactctgcc

SEQ ID NO: 346968 - DNA, 25 bp, Mus musculus
taaacagatagaagaagaaaagcag

SEQ ID NO: 346969 - DNA, 25 bp, Mus musculus
taaacagatagaagatcaacaaccc

SEQ ID NO: 346970 - DNA, 25 bp, Mus musculus
taaacagataggtaccctactcgct

SEQ ID NO: 346971 - DNA, 25 bp, Mus musculus
taaacagcaacgttttacaaacctg

SEQ ID NO: 346972 - DNA, 25 bp, Mus musculus
taaacagcaagcctgtcattcctta

SEQ ID NO: 346973 - DNA, 25 bp, Mus musculus
taaacagcaaggggagatgttgcgt

SEQ ID NO: 346974 - DNA, 25 bp, Mus musculus
taaacagcccagatgttctccgcca

SEQ ID NO: 346975 - DNA, 25 bp, Mus musculus
taaacaggagttgacacatggtttg

SEQ ID NO: 346976 - DNA, 25 bp, Mus musculus
taaacaggtcaaggagagtgtcact

SEQ ID NO: 346977 - DNA, 25 bp, Mus musculus
taaacaggtcttgtcaaacacgctg

SEQ ID NO: 346978 - DNA, 25 bp, Mus musculus
taaacataaaagaaattgcatgtgt

SEQ ID NO: 346979 - DNA, 25 bp, Mus musculus
taaacataaaggtgactgattttgg

SEQ ID NO: 346980 - DNA, 25 bp, Mus musculus
taaacatatggaataaatttcaaga

SEQ ID NO: 346981 - DNA, 25 bp, Mus musculus
taaacatatggaatgcaaattgaag

SEQ ID NO: 346982 - DNA, 25 bp, Mus musculus
taaacatcacgaagaaacttgtgga

SEQ ID NO: 346983 - DNA, 25 bp, Mus musculus
taaacatcacgaaggctttacaatg

SEQ ID NO: 346984 - DNA, 25 bp, Mus musculus
taaacatcatcacgaaactgaggct

SEQ ID NO: 346985 - DNA, 25 bp, Mus musculus
taaacatcctgccctatgaccactc

SEQ ID NO: 346986 - DNA, 25 bp, Mus musculus
taaacatcctgccctttctctcttt

SEQ ID NO: 346987 - DNA, 25 bp, Mus musculus
taaacatcgagaagcaactgcgctc

SEQ ID NO: 346988 - DNA, 25 bp, Mus musculus
taaacatcgagaagtatcagcggtg

SEQ ID NO: 346989 - DNA, 25 bp, Mus musculus
taaacatcggtacaggacagctttg

SEQ ID NO: 346990 - DNA, 25 bp, Mus musculus
taaacatcggtacagtggcaggaca

SEQ ID NO: 346991 - DNA, 25 bp, Mus musculus
taaacatctgggacgttaaaggatc

SEQ ID NO: 346992 - DNA, 25 bp, Mus musculus
taaacatctgtggatggatggatgg

SEQ ID NO: 346993 - DNA, 25 bp, Mus musculus
taaacatcttgagatcttcaacttt

SEQ ID NO: 346994 - DNA, 25 bp, Mus musculus
taaacatgcagaagtcgatgcagaa

SEQ ID NO: 346995 - DNA, 25 bp, Mus musculus
taaacatgcccactgtcacgcacgg

SEQ ID NO: 346996 - DNA, 25 bp, Mus musculus
taaacatgtcccagcttacataatt

SEQ ID NO: 346997 - DNA, 25 bp, Mus musculus
taaacatgtcccagtttgacccatt

SEQ ID NO: 346998 - DNA, 25 bp, Mus musculus
taaacattcaagctctgcctcacgt

SEQ ID NO: 346999 - DNA, 25 bp, Mus musculus
taaacattcgacagggaagaagaaa

SEQ ID NO: 347000 - DNA, 25 bp, Mus musculus
taaacattcgacagggaagggaaca

SEQ ID NO: 347001 - DNA, 25 bp, Mus musculus
taaaccaaaagctagagacaagcga

SEQ ID NO: 347002 - DNA, 25 bp, Mus musculus
taaaccaaaagcttgtgggcgaaac

SEQ ID NO: 347003 - DNA, 25 bp, Mus musculus
taaaccaacagaggaattcatcaga

SEQ ID NO: 347004 - DNA, 25 bp, Mus musculus
taaaccacattttgctatgagcttg

SEQ ID NO: 347005 - DNA, 25 bp, Mus musculus
taaaccacattttggtgtgatggag

SEQ ID NO: 347006 - DNA, 25 bp, Mus musculus
taaaccagaactgagcagtgtcgtg

SEQ ID NO: 347007 - DNA, 25 bp, Mus musculus
taaaccagagcaaattcagaaatgg

SEQ ID NO: 347008 - DNA, 25 bp, Mus musculus
taaaccagcagaaaaaattcaagca

SEQ ID NO: 347009 - DNA, 25 bp, Mus musculus
taaaccagcaggaatccatcagcac

SEQ ID NO: 347010 - DNA, 25 bp, Mus musculus
taaaccatctgaaagctgggttgca

SEQ ID NO: 347011 - DNA, 25 bp, Mus musculus
taaaccatgaaggggactcctctcg

SEQ ID NO: 347012 - DNA, 25 bp, Mus musculus
taaaccatgaagtttctctgtgctc

SEQ ID NO: 347013 - DNA, 25 bp, Mus musculus
taaaccatggcccgtattcggaaac

SEQ ID NO: 347014 - DNA, 25 bp, Mus musculus
taaaccatggcccgtgatgcttcat

SEQ ID NO: 347015 - DNA, 25 bp, Mus musculus
taaaccatggcccgtgtgtcagtgg

SEQ ID NO: 347016 - DNA, 25 bp, Mus musculus
taaacccaagagtgatggaaagaac

SEQ ID NO: 347017 - DNA, 25 bp, Mus musculus
taaaccggaagaagttcagagtttt

SEQ ID NO: 347018 - DNA, 25 bp, Mus musculus
taaaccgtcaaggtcacggtctcgg

SEQ ID NO: 347019 - DNA, 25 bp, Mus musculus
taaacctctaaaatggtgcacctcc

SEQ ID NO: 347020 - DNA, 25 bp, Mus musculus
taaacctctgaaactataattttat

SEQ ID NO: 347021 - DNA, 25 bp, Mus musculus
taaacctctgaacctaacacagaag

SEQ ID NO: 347022 - DNA, 25 bp, Mus musculus
taaacctctgaacctataattttat

SEQ ID NO: 347023 - DNA, 25 bp, Mus musculus
taaacctctgaactatgcctgtgtc

SEQ ID NO: 347024 - DNA, 25 bp, Mus musculus
taaacctctgcagcttgcactgagg

SEQ ID NO: 347025 - DNA, 25 bp, Mus musculus
taaacctctgggaggatgttggatg

SEQ ID NO: 347026 - DNA, 25 bp, Mus musculus
taaacctctgggtgaagggagcagt

SEQ ID NO: 347027 - DNA, 25 bp, Mus musculus
taaacctgagcattttaatctgaag

SEQ ID NO: 347028 - DNA, 25 bp, Mus musculus
taaacctgctgaagattcagatatt

SEQ ID NO: 347029 - DNA, 25 bp, Mus musculus
taaacctgctgaagggagcatttcc

SEQ ID NO: 347030 - DNA, 25 bp, Mus musculus
taaacctttccagtatactcctgat

SEQ ID NO: 347031 - DNA, 25 bp, Mus musculus
taaacgacaggtgtgtggaggtcat

SEQ ID NO: 347032 - DNA, 25 bp, Mus musculus
taaacgacaggtgtgttgaaagcag

SEQ ID NO: 347033 - DNA, 25 bp, Mus musculus
taaacgagcaagcttctacatacaa

SEQ ID NO: 347034 - DNA, 25 bp, Mus musculus
taaacgccaggagcccttgcccaga

SEQ ID NO: 347035 - DNA, 25 bp, Mus musculus
taaacgccagggaacctttgcacaa

SEQ ID NO: 347036 - DNA, 25 bp, Mus musculus
taaacggcagaggattcgtaaactt

SEQ ID NO: 347037 - DNA, 25 bp, Mus musculus
taaacgtttcactgcgcaaaccatg

SEQ ID NO: 347038 - DNA, 25 bp, Mus musculus
taaacgttttgctggccttcagtgg

SEQ ID NO: 347039 - DNA, 25 bp, Mus musculus
taaactaatgaaagaggttaggaat

SEQ ID NO: 347040 - DNA, 25 bp, Mus musculus
taaactacagactccatgaatttga

SEQ ID NO: 347041 - DNA, 25 bp, Mus musculus
taaactactcacaggatgagcagaa

SEQ ID NO: 347042 - DNA, 25 bp, Mus musculus
taaactatggcatggttacagtacc

SEQ ID NO: 347043 - DNA, 25 bp, Mus musculus
taaactcaagccaggaaccatgatt

SEQ ID NO: 347044 - DNA, 25 bp, Mus musculus
taaactcaaggaggcagagacccgt

SEQ ID NO: 347045 - DNA, 25 bp, Mus musculus
taaactcaagggctcgggccatcaa

SEQ ID NO: 347046 - DNA, 25 bp, Mus musculus
taaactcggagcaggcagctggccg

SEQ ID NO: 347047 - DNA, 25 bp, Mus musculus
taaactcggagcagtgggaccctga

SEQ ID NO: 347048 - DNA, 25 bp, Mus musculus
taaactctcaccaaaatgtgagcgt

SEQ ID NO: 347049 - DNA, 25 bp, Mus musculus
taaactgcacagagatcccaagtgt

SEQ ID NO: 347050 - DNA, 25 bp, Mus musculus
taaactggataacagtgcctccgga

SEQ ID NO: 347051 - DNA, 25 bp, Mus musculus
taaactgggagtgtgtgccgacaac

SEQ ID NO: 347052 - DNA, 25 bp, Mus musculus
taaacttaatgaggacatggcttgc

SEQ ID NO: 347053 - DNA, 25 bp, Mus musculus
taaacttacatcaaaattatattat

SEQ ID NO: 347054 - DNA, 25 bp, Mus musculus
taaacttacatgtttgaggattgcg

SEQ ID NO: 347055 - DNA, 25 bp, Mus musculus
taaacttcaaggctgtagagaggca

SEQ ID NO: 347056 - DNA, 25 bp, Mus musculus
taaacttctgaaacttacttacagc

SEQ ID NO: 347057 - DNA, 25 bp, Mus musculus
taaacttgaaagatgacagtccccg

SEQ ID NO: 347058 - DNA, 25 bp, Mus musculus
taaactttcttccatgatagagtct

SEQ ID NO: 347059 - DNA, 25 bp, Mus musculus
taaactttcttcgatgatagagtct

SEQ ID NO: 347060 - DNA, 25 bp, Mus musculus
taaactttgtgacttgcactaagaa

SEQ ID NO: 347061 - DNA, 25 bp, Mus musculus
taaactttgttatggctgaatcaga

SEQ ID NO: 347062 - DNA, 25 bp, Mus musculus
taaagaaaacagagacgaagacatc

SEQ ID NO: 347063 - DNA, 25 bp, Mus musculus
taaagaaaacagttgagtggtaccg

SEQ ID NO: 347064 - DNA, 25 bp, Mus musculus
taaagaaaaggctggaagttctgca

SEQ ID NO: 347065 - DNA, 25 bp, Mus musculus
taaagaaaatataaacaccagttta

SEQ ID NO: 347066 - DNA, 25 bp, Mus musculus
taaagaaaatgcagcgttcctgctt

SEQ ID NO: 347067 - DNA, 25 bp, Mus musculus
taaagaaagagtttgacctggtgtg

SEQ ID NO: 347068 - DNA, 25 bp, Mus musculus
taaagaaagatcaggaaaagactga

SEQ ID NO: 347069 - DNA, 25 bp, Mus musculus
taaagaaagatcaggcgagtactaa

SEQ ID NO: 347070 - DNA, 25 bp, Mus musculus
taaagaaagcagggtgaaggaggag

SEQ ID NO: 347071 - DNA, 25 bp, Mus musculus
taaagaaaggaaaaggatgtgagga

SEQ ID NO: 347072 - DNA, 25 bp, Mus musculus
taaagaaagggttgctgttgcatgt

SEQ ID NO: 347073 - DNA, 25 bp, Mus musculus
taaagaaatcaaagagaaaatggat

SEQ ID NO: 347074 - DNA, 25 bp, Mus musculus
taaagaaatcaaagatatagatgtc

SEQ ID NO: 347075 - DNA, 25 bp, Mus musculus
taaagaaccttgtggagatgggcag

SEQ ID NO: 347076 - DNA, 25 bp, Mus musculus
taaagaactactgagactaaagcaa

SEQ ID NO: 347077 - DNA, 25 bp, Mus musculus
taaagaactactgaggcaaggcagc

SEQ ID NO: 347078 - DNA, 25 bp, Mus musculus
taaagaacttgtgtagcttgtagac

SEQ ID NO: 347079 - DNA, 25 bp, Mus musculus
taaagaagaaaaatgataccttaga

SEQ ID NO: 347080 - DNA, 25 bp, Mus musculus
taaagaagaaataaggtttgacaac

SEQ ID NO: 347081 - DNA, 25 bp, Mus musculus
taaagaagattagttgaagaacagt

SEQ ID NO: 347082 - DNA, 25 bp, Mus musculus
taaagaagattccagtcctgcaccg

SEQ ID NO: 347083 - DNA, 25 bp, Mus musculus
taaagaagattggatttaccttcaa

SEQ ID NO: 347084 - DNA, 25 bp, Mus musculus
taaagaagcaaaggaatattttgca

SEQ ID NO: 347085 - DNA, 25 bp, Mus musculus
taaagaagccagcccctctttgctg

SEQ ID NO: 347086 - DNA, 25 bp, Mus musculus
taaagaagccaggccctctttgctg

SEQ ID NO: 347087 - DNA, 25 bp, Mus musculus
taaagaagccatacgaattagtcct

SEQ ID NO: 347088 - DNA, 25 bp, Mus musculus
taaagaaggaagatgcaggttttga

SEQ ID NO: 347089 - DNA, 25 bp, Mus musculus
taaagaaggaaggatccaggccagt

SEQ ID NO: 347090 - DNA, 25 bp, Mus musculus
taaagaagtattagatggacagttc

SEQ ID NO: 347091 - DNA, 25 bp, Mus musculus
taaagaatccagaaacttggaaaag

SEQ ID NO: 347092 - DNA, 25 bp, Mus musculus
taaagaatgaaaggcgttgcagctc

SEQ ID NO: 347093 - DNA, 25 bp, Mus musculus
taaagaatgaaggaataacagcctt

SEQ ID NO: 347094 - DNA, 25 bp, Mus musculus
taaagaatggcgtgcattttctgca

SEQ ID NO: 347095 - DNA, 25 bp, Mus musculus
taaagaatgtggagccactgtatgg

SEQ ID NO: 347096 - DNA, 25 bp, Mus musculus
taaagaatttgggagggctggagac

SEQ ID NO: 347097 - DNA, 25 bp, Mus musculus
taaagacagaggttcttgcagccat

SEQ ID NO: 347098 - DNA, 25 bp, Mus musculus
taaagacagggaggtggacatcaca

SEQ ID NO: 347099 - DNA, 25 bp, Mus musculus
taaagaccacaaagaaacatggtga

SEQ ID NO: 347100 - DNA, 25 bp, Mus musculus
taaagaccagcagtcttgccagaac

SEQ ID NO: 347101 - DNA, 25 bp, Mus musculus
taaagaccaggagtcttgccagaac

SEQ ID NO: 347102 - DNA, 25 bp, Mus musculus
taaagaccctgcagggagagagaat

SEQ ID NO: 347103 - DNA, 25 bp, Mus musculus
taaagaccttgagagctgttctgcc

SEQ ID NO: 347104 - DNA, 25 bp, Mus musculus
taaagacgatgaacgtgtcgtgggc

SEQ ID NO: 347105 - DNA, 25 bp, Mus musculus
taaagacgatgaggagaaagaaaag

SEQ ID NO: 347106 - DNA, 25 bp, Mus musculus
taaagacgtaagttgaagatgtgat

SEQ ID NO: 347107 - DNA, 25 bp, Mus musculus
taaagactcaaagagcaacttgatt

SEQ ID NO: 347108 - DNA, 25 bp, Mus musculus
taaagacttaggaagaagactacga

SEQ ID NO: 347109 - DNA, 25 bp, Mus musculus
taaagacttaggtgggtcggtgatc

SEQ ID NO: 347110 - DNA, 25 bp, Mus musculus
taaagagaaaaggtctttcgcacct

SEQ ID NO: 347111 - DNA, 25 bp, Mus musculus
taaagagaaaagtgttaatggccag

SEQ ID NO: 347112 - DNA, 25 bp, Mus musculus
taaagagaaagtgtttatgggaccg

SEQ ID NO: 347113 - DNA, 25 bp, Mus musculus
taaagagaatgatagcttggagatt

SEQ ID NO: 347114 - DNA, 25 bp, Mus musculus
taaagagacaggacctgatagatga

SEQ ID NO: 347115 - DNA, 25 bp, Mus musculus
taaagagactaaaagatatggaggg

SEQ ID NO: 347116 - DNA, 25 bp, Mus musculus
taaagagactaaaagtgctgaagag

SEQ ID NO: 347117 - DNA, 25 bp, Mus musculus
taaagagcagatcaaattgcttatt

SEQ ID NO: 347118 - DNA, 25 bp, Mus musculus
taaagagcaggtgtcacaactgctg

SEQ ID NO: 347119 - DNA, 25 bp, Mus musculus
taaagagcagttctcctatttcatc

SEQ ID NO: 347120 - DNA, 25 bp, Mus musculus
taaagagcatgaaagccaaagcatt

SEQ ID NO: 347121 - DNA, 25 bp, Mus musculus
taaagagcatggacggagattacaa

SEQ ID NO: 347122 - DNA, 25 bp, Mus musculus
taaagagccaatggaccttgccacc

SEQ ID NO: 347123 - DNA, 25 bp, Mus musculus
taaagagccaatgggtctcataaca

SEQ ID NO: 347124 - DNA, 25 bp, Mus musculus
taaagagccgtgagccagcttcacc

SEQ ID NO: 347125 - DNA, 25 bp, Mus musculus
taaagagcctgaaggaagagagata

SEQ ID NO: 347126 - DNA, 25 bp, Mus musculus
taaagagcctgaaggttaaaatgag

SEQ ID NO: 347127 - DNA, 25 bp, Mus musculus
taaagagcgagtcgaattggcagag

SEQ ID NO: 347128 - DNA, 25 bp, Mus musculus
taaagagtgaaggcttcagatgcta

SEQ ID NO: 347129 - DNA, 25 bp, Mus musculus
taaagagtgtcctagaatcaataag

SEQ ID NO: 347130 - DNA, 25 bp, Mus musculus
taaagagttggcaggaatagtgggc

SEQ ID NO: 347131 - DNA, 25 bp, Mus musculus
taaagataacccggcactgaatgca

SEQ ID NO: 347132 - DNA, 25 bp, Mus musculus
taaagatcatgagacagaacttctg

SEQ ID NO: 347133 - DNA, 25 bp, Mus musculus
taaagatgaacagcaattatagtga

SEQ ID NO: 347134 - DNA, 25 bp, Mus musculus
taaagatgaacatctcagcggttct

SEQ ID NO: 347135 - DNA, 25 bp, Mus musculus
taaagatgacctaggaaacacactg

SEQ ID NO: 347136 - DNA, 25 bp, Mus musculus
taaagatgcagctttgcagaaaccc

SEQ ID NO: 347137 - DNA, 25 bp, Mus musculus
taaagatgcaggaacctccttctca

SEQ ID NO: 347138 - DNA, 25 bp, Mus musculus
taaagatgttaggggagcttctgga

SEQ ID NO: 347139 - DNA, 25 bp, Mus musculus
taaagatgtttccaggagccctgac

SEQ ID NO: 347140 - DNA, 25 bp, Mus musculus
taaagattcagaaagattccaggtt

SEQ ID NO: 347141 - DNA, 25 bp, Mus musculus
taaagattgctgctagagcatggaa

SEQ ID NO: 347142 - DNA, 25 bp, Mus musculus
taaagattttttcagtattggaaaa

SEQ ID NO: 347143 - DNA, 25 bp, Mus musculus
taaagcaaaaagtcaaagcttttag

SEQ ID NO: 347144 - DNA, 25 bp, Mus musculus
taaagcaaatatgcaacacagatat

SEQ ID NO: 347145 - DNA, 25 bp, Mus musculus
taaagcaaggaggggctgagaaaat

SEQ ID NO: 347146 - DNA, 25 bp, Mus musculus
taaagcaattctggatatgctctcc

SEQ ID NO: 347147 - DNA, 25 bp, Mus musculus
taaagcacctcctgattccactgta

SEQ ID NO: 347148 - DNA, 25 bp, Mus musculus
taaagcacttggggccctagagaaa

SEQ ID NO: 347149 - DNA, 25 bp, Mus musculus
taaagcagacccgggcagatatcaa

SEQ ID NO: 347150 - DNA, 25 bp, Mus musculus
taaagcagagacaaattgaacaaga

SEQ ID NO: 347151 - DNA, 25 bp, Mus musculus
taaagcagaggagactctaacacgt

SEQ ID NO: 347152 - DNA, 25 bp, Mus musculus
taaagcagaggtgaaagacaaggag

SEQ ID NO: 347153 - DNA, 25 bp, Mus musculus
taaagcagaggtgcagtgagcctgc

SEQ ID NO: 347154 - DNA, 25 bp, Mus musculus
taaagcaggtactaaaatggatcgt

SEQ ID NO: 347155 - DNA, 25 bp, Mus musculus
taaagcagttttgaattacctgaag

SEQ ID NO: 347156 - DNA, 25 bp, Mus musculus
taaagcagttttgttagttttcatg

SEQ ID NO: 347157 - DNA, 25 bp, Mus musculus
taaagcatgaccccgtggcccttgg

SEQ ID NO: 347158 - DNA, 25 bp, Mus musculus
taaagccaaaaccaacagcagctct

SEQ ID NO: 347159 - DNA, 25 bp, Mus musculus
taaagcccaaactcccacaatctaa

SEQ ID NO: 347160 - DNA, 25 bp, Mus musculus
taaagcccaagtggaacggctgcag

SEQ ID NO: 347161 - DNA, 25 bp, Mus musculus
taaagcccagattcagtttgctgac

SEQ ID NO: 347162 - DNA, 25 bp, Mus musculus
taaagcccattatctccagcctgct

SEQ ID NO: 347163 - DNA, 25 bp, Mus musculus
taaagccgatgctcaggaaaaggtg

SEQ ID NO: 347164 - DNA, 25 bp, Mus musculus
taaagccgatggcttcgggagcaag

SEQ ID NO: 347165 - DNA, 25 bp, Mus musculus
taaagccggagactcttcctgatcc

SEQ ID NO: 347166 - DNA, 25 bp, Mus musculus
taaagccggagcgtgtttggtgctt

SEQ ID NO: 347167 - DNA, 25 bp, Mus musculus
taaagcgaatgaacttttctatctt

SEQ ID NO: 347168 - DNA, 25 bp, Mus musculus
taaagcgatgattcccccgactccc

SEQ ID NO: 347169 - DNA, 25 bp, Mus musculus
taaagctacaggtggtaaagcgggc

SEQ ID NO: 347170 - DNA, 25 bp, Mus musculus
taaagctcaaaagctttgcagccag

SEQ ID NO: 347171 - DNA, 25 bp, Mus musculus
taaagctcaaaaggcactaagcaag

SEQ ID NO: 347172 - DNA, 25 bp, Mus musculus
taaagctcagcagaaaatgaaaatt

SEQ ID NO: 347173 - DNA, 25 bp, Mus musculus
taaagctcagcaggaaataacagtc

SEQ ID NO: 347174 - DNA, 25 bp, Mus musculus
taaagctggcgagcttctgcagttt

SEQ ID NO: 347175 - DNA, 25 bp, Mus musculus
taaagctggcggtccccaaccatct

SEQ ID NO: 347176 - DNA, 25 bp, Mus musculus
taaagcttgtgaaggcgctggttgc

SEQ ID NO: 347177 - DNA, 25 bp, Mus musculus
taaagcttttagagtcgctgactcc

SEQ ID NO: 347178 - DNA, 25 bp, Mus musculus
taaaggaataccaggaaaatagtga

SEQ ID NO: 347179 - DNA, 25 bp, Mus musculus
taaaggaataccaggaaatgataat

SEQ ID NO: 347180 - DNA, 25 bp, Mus musculus
taaaggacagacaggctttccaggg

SEQ ID NO: 347181 - DNA, 25 bp, Mus musculus
taaaggaccgaggattgaagtgagt

SEQ ID NO: 347182 - DNA, 25 bp, Mus musculus
taaaggacttaagggaacgaatgga

SEQ ID NO: 347183 - DNA, 25 bp, Mus musculus
taaaggacttcactggaccttcagg

SEQ ID NO: 347184 - DNA, 25 bp, Mus musculus
taaaggacttcactggaccttcatc

SEQ ID NO: 347185 - DNA, 25 bp, Mus musculus
taaaggagatcagggcatcacaggt

SEQ ID NO: 347186 - DNA, 25 bp, Mus musculus
taaaggatatgttcgcacaactggc

SEQ ID NO: 347187 - DNA, 25 bp, Mus musculus
taaaggatcaaaagcaggaggagcc

SEQ ID NO: 347188 - DNA, 25 bp, Mus musculus
taaaggatggcggtgttagaacaac

SEQ ID NO: 347189 - DNA, 25 bp, Mus musculus
taaaggattctgctcttgctgtcca

SEQ ID NO: 347190 - DNA, 25 bp, Mus musculus
taaaggcacaggaagcggaacagga

SEQ ID NO: 347191 - DNA, 25 bp, Mus musculus
taaaggccttaaagactattaagat

SEQ ID NO: 347192 - DNA, 25 bp, Mus musculus
taaaggccttaaaggaaatgaaagt

SEQ ID NO: 347193 - DNA, 25 bp, Mus musculus
taaaggcgagaaatgagagaaacgc

SEQ ID NO: 347194 - DNA, 25 bp, Mus musculus
taaaggcgagaaatggaaacagctg

SEQ ID NO: 347195 - DNA, 25 bp, Mus musculus
taaaggctgtccaacaggtgcgcca

SEQ ID NO: 347196 - DNA, 25 bp, Mus musculus
taaaggctttttactatgcagtcac

SEQ ID NO: 347197 - DNA, 25 bp, Mus musculus
taaagggacttcaggccttctccca

SEQ ID NO: 347198 - DNA, 25 bp, Mus musculus
taaagggagctagtgaaactgacgt

SEQ ID NO: 347199 - DNA, 25 bp, Mus musculus
taaagggagctagtggcccacgctt

SEQ ID NO: 347200 - DNA, 25 bp, Mus musculus
taaagggagctagtggtttaggtaa

SEQ ID NO: 347201 - DNA, 25 bp, Mus musculus
taaagggatctttgagagaaataca

SEQ ID NO: 347202 - DNA, 25 bp, Mus musculus
taaagggcatcagcgagggctgccg

SEQ ID NO: 347203 - DNA, 25 bp, Mus musculus
taaagggcatcaggaggctgcacag

SEQ ID NO: 347204 - DNA, 25 bp, Mus musculus
taaaggggaagaaaagacatgctca

SEQ ID NO: 347205 - DNA, 25 bp, Mus musculus
taaaggggaagtgaaatcttgtgaa

SEQ ID NO: 347206 - DNA, 25 bp, Mus musculus
taaagggtgaggtgtgccaaagaat

SEQ ID NO: 347207 - DNA, 25 bp, Mus musculus
taaagggtgagttttatgtgataga

SEQ ID NO: 347208 - DNA, 25 bp, Mus musculus
taaaggtctcctggtcttatatcca

SEQ ID NO: 347209 - DNA, 25 bp, Mus musculus
taaaggtgtattcagacttcaagac

SEQ ID NO: 347210 - DNA, 25 bp, Mus musculus
taaaggtgtattcgggttcctggac

SEQ ID NO: 347211 - DNA, 25 bp, Mus musculus
taaagtaaataaaggaatgtgtttc

SEQ ID NO: 347212 - DNA, 25 bp, Mus musculus
taaagtaactctaaatcttcaagta

SEQ ID NO: 347213 - DNA, 25 bp, Mus musculus
taaagtatcagaaatccacttctct

SEQ ID NO: 347214 - DNA, 25 bp, Mus musculus
taaagtatcagatgtctttattcca

SEQ ID NO: 347215 - DNA, 25 bp, Mus musculus
taaagtatcagggctggcagtctgg

SEQ ID NO: 347216 - DNA, 25 bp, Mus musculus
taaagtatgtgggctggaaaaagga

SEQ ID NO: 347217 - DNA, 25 bp, Mus musculus
taaagtatgtggttctgctcattaa

SEQ ID NO: 347218 - DNA, 25 bp, Mus musculus
taaagtattctgtatctgcagtggg

SEQ ID NO: 347219 - DNA, 25 bp, Mus musculus
taaagtcattaagggtgatgtttat

SEQ ID NO: 347220 - DNA, 25 bp, Mus musculus
taaagtccatcacgattcaggctct

SEQ ID NO: 347221 - DNA, 25 bp, Mus musculus
taaagtcccacacctacttcattat

SEQ ID NO: 347222 - DNA, 25 bp, Mus musculus
taaagtcctgggaatcaacaagcaa

SEQ ID NO: 347223 - DNA, 25 bp, Mus musculus
taaagtcggagaggtacagattcct

SEQ ID NO: 347224 - DNA, 25 bp, Mus musculus
taaagtcggagaggttgacgtcgag

SEQ ID NO: 347225 - DNA, 25 bp, Mus musculus
taaagtctctgaaactcaagtcaag

SEQ ID NO: 347226 - DNA, 25 bp, Mus musculus
taaagtgaacaggccatggcgcagg

SEQ ID NO: 347227 - DNA, 25 bp, Mus musculus
taaagtgaacaggtgccttcttcac

SEQ ID NO: 347228 - DNA, 25 bp, Mus musculus
taaagtgaagacgctgactgggaag

SEQ ID NO: 347229 - DNA, 25 bp, Mus musculus
taaagtgaagtccaccacagaaagc

SEQ ID NO: 347230 - DNA, 25 bp, Mus musculus
taaagttcaagagctgtttgacaac

SEQ ID NO: 347231 - DNA, 25 bp, Mus musculus
taaagttcacctcctggctattata

SEQ ID NO: 347232 - DNA, 25 bp, Mus musculus
taaagttcacgtcctggctattata

SEQ ID NO: 347233 - DNA, 25 bp, Mus musculus
taaagttcgaggtcacgttcatgaa

SEQ ID NO: 347234 - DNA, 25 bp, Mus musculus
taaagttgaagagatccacgtctct

SEQ ID NO: 347235 - DNA, 25 bp, Mus musculus
taaagttgaagaggcacagagaact

SEQ ID NO: 347236 - DNA, 25 bp, Mus musculus
taaagttgacagtcccacagtcaac

SEQ ID NO: 347237 - DNA, 25 bp, Mus musculus
taaagttgctgaggttgccaagaag

SEQ ID NO: 347238 - DNA, 25 bp, Mus musculus
taaagtttaaccagctcaggaagaa

SEQ ID NO: 347239 - DNA, 25 bp, Mus musculus
taaagtttcagcaacccagcatgta

SEQ ID NO: 347240 - DNA, 25 bp, Mus musculus
taaagtttcggaacaaggagcccag

SEQ ID NO: 347241 - DNA, 25 bp, Mus musculus
taaagtttgaggtgggatgtgtgtg

SEQ ID NO: 347242 - DNA, 25 bp, Mus musculus
taaagttttacagtggaaagcccat

SEQ ID NO: 347243 - DNA, 25 bp, Mus musculus
taaagttttgagagaagcagaagat

SEQ ID NO: 347244 - DNA, 25 bp, Mus musculus
taaagtttttggaagctttgctgaa

SEQ ID NO: 347245 - DNA, 25 bp, Mus musculus
taaagtttttggtatgctggtgtgc

SEQ ID NO: 347246 - DNA, 25 bp, Mus musculus
taaataaagaaactactcactggcc

SEQ ID NO: 347247 - DNA, 25 bp, Mus musculus
taaataaattgaagggtatttcaac

SEQ ID NO: 347248 - DNA, 25 bp, Mus musculus
taaataaccagagtatgctggataa

SEQ ID NO: 347249 - DNA, 25 bp, Mus musculus
taaataagggcacacctagtcaggt

SEQ ID NO: 347250 - DNA, 25 bp, Mus musculus
taaataagggccacacctagtcagg

SEQ ID NO: 347251 - DNA, 25 bp, Mus musculus
taaataataggtggttagccagcgc

SEQ ID NO: 347252 - DNA, 25 bp, Mus musculus
taaataatcaaagatcttgttttta

SEQ ID NO: 347253 - DNA, 25 bp, Mus musculus
taaataatcagtatgaagctgctct

SEQ ID NO: 347254 - DNA, 25 bp, Mus musculus
taaataattaaggaaagggctgtga

SEQ ID NO: 347255 - DNA, 25 bp, Mus musculus
taaataattcctaccacagaaactg

SEQ ID NO: 347256 - DNA, 25 bp, Mus musculus
taaatacaaaacctgggcattccta

SEQ ID NO: 347257 - DNA, 25 bp, Mus musculus
taaatacaactcagatcccaagcag

SEQ ID NO: 347258 - DNA, 25 bp, Mus musculus
taaatacaactcagatctccatcag

SEQ ID NO: 347259 - DNA, 25 bp, Mus musculus
taaatacaatgcctttaacttgttt

SEQ ID NO: 347260 - DNA, 25 bp, Mus musculus
taaatacactctgattactacaagg

SEQ ID NO: 347261 - DNA, 25 bp, Mus musculus
taaatacataaatatgtaaagaaca

SEQ ID NO: 347262 - DNA, 25 bp, Mus musculus
taaataccggttcttcctcggcaat

SEQ ID NO: 347263 - DNA, 25 bp, Mus musculus
taaataccggtttggagattctcag

SEQ ID NO: 347264 - DNA, 25 bp, Mus musculus
taaatacctggatcctgagcatgct

SEQ ID NO: 347265 - DNA, 25 bp, Mus musculus
taaatactgaagtgtattccttacc

SEQ ID NO: 347266 - DNA, 25 bp, Mus musculus
taaatagataataccaaacgtctat

SEQ ID NO: 347267 - DNA, 25 bp, Mus musculus
taaataggagctccaccccaggcct

SEQ ID NO: 347268 - DNA, 25 bp, Mus musculus
taaatagtccaacagaaagcaaaga

SEQ ID NO: 347269 - DNA, 25 bp, Mus musculus
taaatagtccaacaggtgactgttc

SEQ ID NO: 347270 - DNA, 25 bp, Mus musculus
taaatagtccaacatcttcagcaaa

SEQ ID NO: 347271 - DNA, 25 bp, Mus musculus
taaatataaaaagaggaaactgcac

SEQ ID NO: 347272 - DNA, 25 bp, Mus musculus
taaatataaaaaggtaacaactgat

SEQ ID NO: 347273 - DNA, 25 bp, Mus musculus
taaatataaaatggaagctttaaat

SEQ ID NO: 347274 - DNA, 25 bp, Mus musculus
taaatataaaatgggtcaaatagaa

SEQ ID NO: 347275 - DNA, 25 bp, Mus musculus
taaatatcacgaacacactaaatat

SEQ ID NO: 347276 - DNA, 25 bp, Mus musculus
taaatatgcccttgaaagcagaccg

SEQ ID NO: 347277 - DNA, 25 bp, Mus musculus
taaatattgaaatcgcatcatattt

SEQ ID NO: 347278 - DNA, 25 bp, Mus musculus
taaatattgggaggactcaggaggg

SEQ ID NO: 347279 - DNA, 25 bp, Mus musculus
taaatatttgggcccagcaacctcc

SEQ ID NO: 347280 - DNA, 25 bp, Mus musculus
taaatatttggtgctggtaactcaa

SEQ ID NO: 347281 - DNA, 25 bp, Mus musculus
taaatattttgaggttccatctgtc

SEQ ID NO: 347282 - DNA, 25 bp, Mus musculus
taaatcacatcaggtgacagagtta

SEQ ID NO: 347283 - DNA, 25 bp, Mus musculus
taaatcatcaccagaataagcctgc

SEQ ID NO: 347284 - DNA, 25 bp, Mus musculus
taaatccaaactttatgatggttaa

SEQ ID NO: 347285 - DNA, 25 bp, Mus musculus
taaatccagtacaggtgaatatact

SEQ ID NO: 347286 - DNA, 25 bp, Mus musculus
taaatccgagaggtcgaaggatctc

SEQ ID NO: 347287 - DNA, 25 bp, Mus musculus
taaatcctggagcgttcactgtgag

SEQ ID NO: 347288 - DNA, 25 bp, Mus musculus
taaatctaagatcaactatgggggc

SEQ ID NO: 347289 - DNA, 25 bp, Mus musculus
taaatctctaaaactgaagcacctt

SEQ ID NO: 347290 - DNA, 25 bp, Mus musculus
taaatctctaaaacttctatcatcc

SEQ ID NO: 347291 - DNA, 25 bp, Mus musculus
taaatctctcaaaggatcctgctgg

SEQ ID NO: 347292 - DNA, 25 bp, Mus musculus
taaatctctcaaaggatgacatttg

SEQ ID NO: 347293 - DNA, 25 bp, Mus musculus
taaatctgaagtgcagcgtaagtat

SEQ ID NO: 347294 - DNA, 25 bp, Mus musculus
taaatgaagagatggttacgcccca

SEQ ID NO: 347295 - DNA, 25 bp, Mus musculus
taaatgaagaggtgtttatggagat

SEQ ID NO: 347296 - DNA, 25 bp, Mus musculus
taaatgacatttctgttggaggcct

SEQ ID NO: 347297 - DNA, 25 bp, Mus musculus
taaatgagcaatctgtaaagaaaac

SEQ ID NO: 347298 - DNA, 25 bp, Mus musculus
taaatgagtattttgatgttgcctt

SEQ ID NO: 347299 - DNA, 25 bp, Mus musculus
taaatgagtattttggtataggcag

SEQ ID NO: 347300 - DNA, 25 bp, Mus musculus
taaatgataagaatggcacacgaaa

SEQ ID NO: 347301 - DNA, 25 bp, Mus musculus
taaatgataaggaacatgacattga

SEQ ID NO: 347302 - DNA, 25 bp, Mus musculus
taaatgatcttgaactcacagaagg

SEQ ID NO: 347303 - DNA, 25 bp, Mus musculus
taaatgatgtatgtcgcactggctg

SEQ ID NO: 347304 - DNA, 25 bp, Mus musculus
taaatgcaggctacgaatttaaaga

SEQ ID NO: 347305 - DNA, 25 bp, Mus musculus
taaatgcattcagaggtggggtaag

SEQ ID NO: 347306 - DNA, 25 bp, Mus musculus
taaatgccaaacacactggctctgc

SEQ ID NO: 347307 - DNA, 25 bp, Mus musculus
taaatgccaatccttcccagtttct

SEQ ID NO: 347308 - DNA, 25 bp, Mus musculus
taaatggaaaaacagctctcctctc

SEQ ID NO: 347309 - DNA, 25 bp, Mus musculus
taaatggaaggcatacgatgcgacc

SEQ ID NO: 347310 - DNA, 25 bp, Mus musculus
taaatggaaggttgcttttaacttt

SEQ ID NO: 347311 - DNA, 25 bp, Mus musculus
taaatgggccagatacaatttgttt

SEQ ID NO: 347312 - DNA, 25 bp, Mus musculus
taaatggtcgatgaagagtttgatt

SEQ ID NO: 347313 - DNA, 25 bp, Mus musculus
taaatggtcgatggtggatgtacag

SEQ ID NO: 347314 - DNA, 25 bp, Mus musculus
taaatgtaagtatgccatttgtcac

SEQ ID NO: 347315 - DNA, 25 bp, Mus musculus
taaatgtacagtctaaatccagtga

SEQ ID NO: 347316 - DNA, 25 bp, Mus musculus
taaatgtcaggactcaggacgggga

SEQ ID NO: 347317 - DNA, 25 bp, Mus musculus
taaatgtggaagaggaaccgggcaa

SEQ ID NO: 347318 - DNA, 25 bp, Mus musculus
taaatgtgttgcaacagaccaactg

SEQ ID NO: 347319 - DNA, 25 bp, Mus musculus
taaatgttagtgacagctagaatat

SEQ ID NO: 347320 - DNA, 25 bp, Mus musculus
taaatgtttccaaggatctgttaag

SEQ ID NO: 347321 - DNA, 25 bp, Mus musculus
taaatgtttccaagtgttcatggat

SEQ ID NO: 347322 - DNA, 25 bp, Mus musculus
taaattaaagactgagtgtggatgt

SEQ ID NO: 347323 - DNA, 25 bp, Mus musculus
taaattaaagcaagcctgtggttat

SEQ ID NO: 347324 - DNA, 25 bp, Mus musculus
taaattatgaacagattgatgacat

SEQ ID NO: 347325 - DNA, 25 bp, Mus musculus
taaattcaagtgacaatgccttagc

SEQ ID NO: 347326 - DNA, 25 bp, Mus musculus
taaattcacatgagctgtttcagaa

SEQ ID NO: 347327 - DNA, 25 bp, Mus musculus
taaattccaaaacactgtaacatgg

SEQ ID NO: 347328 - DNA, 25 bp, Mus musculus
taaattccaagccatcttctcttcg

SEQ ID NO: 347329 - DNA, 25 bp, Mus musculus
taaattccatattattataaatgag

SEQ ID NO: 347330 - DNA, 25 bp, Mus musculus
taaattccatttaattgtaaatgaa

SEQ ID NO: 347331 - DNA, 25 bp, Mus musculus
taaattctaagatgggatgtgacca

SEQ ID NO: 347332 - DNA, 25 bp, Mus musculus
taaattctcaaaacccaatgatgag

SEQ ID NO: 347333 - DNA, 25 bp, Mus musculus
taaattctcaaaatgttcaagccat

SEQ ID NO: 347334 - DNA, 25 bp, Mus musculus
taaattgaagggtatttcaacaatc

SEQ ID NO: 347335 - DNA, 25 bp, Mus musculus
taaattgcaccaggatctttctcaa

SEQ ID NO: 347336 - DNA, 25 bp, Mus musculus
taaattgctacagggtggttatgct

SEQ ID NO: 347337 - DNA, 25 bp, Mus musculus
taaattgctcaagagacattttaag

SEQ ID NO: 347338 - DNA, 25 bp, Mus musculus
taaattgctcaagagtcctaaacct

SEQ ID NO: 347339 - DNA, 25 bp, Mus musculus
taaattgtcagatactgctcatcat

SEQ ID NO: 347340 - DNA, 25 bp, Mus musculus
taaatttaaaaagggagatgagtac

SEQ ID NO: 347341 - DNA, 25 bp, Mus musculus
taaatttaagtatgcagtactgttt

SEQ ID NO: 347342 - DNA, 25 bp, Mus musculus
taaatttcagattttatcatgtggg

SEQ ID NO: 347343 - DNA, 25 bp, Mus musculus
taaatttgataatgcaaacccgtgg

SEQ ID NO: 347344 - DNA, 25 bp, Mus musculus
taacaaaaaggccctaggcctgact

SEQ ID NO: 347345 - DNA, 25 bp, Mus musculus
taacaaaaaggtgatgaaggactcg

SEQ ID NO: 347346 - DNA, 25 bp, Mus musculus
taacaaaaatctaggcatggtctgc

SEQ ID NO: 347347 - DNA, 25 bp, Mus musculus
taacaaaatatagtgtcatcatgct

SEQ ID NO: 347348 - DNA, 25 bp, Mus musculus
taacaaaatcaaggatcatgggctc

SEQ ID NO: 347349 - DNA, 25 bp, Mus musculus
taacaaactggatgcagagaatgca

SEQ ID NO: 347350 - DNA, 25 bp, Mus musculus
taacaaaggctgcagaacatgaagt

SEQ ID NO: 347351 - DNA, 25 bp, Mus musculus
taacaaagtagcagacagtgttact

SEQ ID NO: 347352 - DNA, 25 bp, Mus musculus
taacaacaaagaagggattcacccc

SEQ ID NO: 347353 - DNA, 25 bp, Mus musculus
taacaagaaatacgatgaggatgat

SEQ ID NO: 347354 - DNA, 25 bp, Mus musculus
taacaagaaatacggtgaagctctg

SEQ ID NO: 347355 - DNA, 25 bp, Mus musculus
taacaagaacactccagggtttcct

SEQ ID NO: 347356 - DNA, 25 bp, Mus musculus
taacaagaagattgacctgaagttc

SEQ ID NO: 347357 - DNA, 25 bp, Mus musculus
taacaagaagatttacaagattggt

SEQ ID NO: 347358 - DNA, 25 bp, Mus musculus
taacaagactacaatgcttctctcc

SEQ ID NO: 347359 - DNA, 25 bp, Mus musculus
taacaagactaccaagctccacttc

SEQ ID NO: 347360 - DNA, 25 bp, Mus musculus
taacaagactaccaagtgaacacct

SEQ ID NO: 347361 - DNA, 25 bp, Mus musculus
taacaagcaagaaagaagacatctg

SEQ ID NO: 347362 - DNA, 25 bp, Mus musculus
taacaagcaagatccgctgatctta

SEQ ID NO: 347363 - DNA, 25 bp, Mus musculus
taacaagcaaggaatccaagtgaat

SEQ ID NO: 347364 - DNA, 25 bp, Mus musculus
taacaagcacaatgggtgtgtttta

SEQ ID NO: 347365 - DNA, 25 bp, Mus musculus
taacaaggaggcttacagtgggtct

SEQ ID NO: 347366 - DNA, 25 bp, Mus musculus
taacaagtacagcttctggcctcca

SEQ ID NO: 347367 - DNA, 25 bp, Mus musculus
taacaataaagctgcagtgttgaag

SEQ ID NO: 347368 - DNA, 25 bp, Mus musculus
taacaataaggacctccagtcagac

SEQ ID NO: 347369 - DNA, 25 bp, Mus musculus
taacaatgagccgtggaagaagcca

SEQ ID NO: 347370 - DNA, 25 bp, Mus musculus
taacaattgaagtcagaaggagaca

SEQ ID NO: 347371 - DNA, 25 bp, Mus musculus
taacaattttcagcagtacccctct

SEQ ID NO: 347372 - DNA, 25 bp, Mus musculus
taacacaaaggcaaggcagcaaatt

SEQ ID NO: 347373 - DNA, 25 bp, Mus musculus
taacacaagaaggctacatggatgc

SEQ ID NO: 347374 - DNA, 25 bp, Mus musculus
taacacacaagaatcgcagaatgca

SEQ ID NO: 347375 - DNA, 25 bp, Mus musculus
taacacacaagattcttccagatga

SEQ ID NO: 347376 - DNA, 25 bp, Mus musculus
taacacacaagcctccatgcattgc

SEQ ID NO: 347377 - DNA, 25 bp, Mus musculus
taacacagtccaaggtcacacggtt

SEQ ID NO: 347378 - DNA, 25 bp, Mus musculus
taacacagtgtaaaaacagaaagtg

SEQ ID NO: 347379 - DNA, 25 bp, Mus musculus
taacacagttgctcctgaattcgga

SEQ ID NO: 347380 - DNA, 25 bp, Mus musculus
taacacataccaggttacaaggaca

SEQ ID NO: 347381 - DNA, 25 bp, Mus musculus
taacaccaaaggcgacctggcgaga

SEQ ID NO: 347382 - DNA, 25 bp, Mus musculus
taacaccaaggtcacaaagcactta

SEQ ID NO: 347383 - DNA, 25 bp, Mus musculus
taacaccaggcagagagatcgcctt

SEQ ID NO: 347384 - DNA, 25 bp, Mus musculus
taacaccattaaaagggggaggagt

SEQ ID NO: 347385 - DNA, 25 bp, Mus musculus
taacaccattgaaggtcctcaactt

SEQ ID NO: 347386 - DNA, 25 bp, Mus musculus
taacaccctgatgcttcctttgcag

SEQ ID NO: 347387 - DNA, 25 bp, Mus musculus
taacacctagagagttgcttcagat

SEQ ID NO: 347388 - DNA, 25 bp, Mus musculus
taacacctctgcagttacggacgag

SEQ ID NO: 347389 - DNA, 25 bp, Mus musculus
taacacctgcagatgcaagttgttc

SEQ ID NO: 347390 - DNA, 25 bp, Mus musculus
taacaccttcttttgcttctgcagt

SEQ ID NO: 347391 - DNA, 25 bp, Mus musculus
taacaccttcttttggcgtgcccac

SEQ ID NO: 347392 - DNA, 25 bp, Mus musculus
taacacgaagaggtatatgtggttg

SEQ ID NO: 347393 - DNA, 25 bp, Mus musculus
taacacgacaaggtgtccaggcctc

SEQ ID NO: 347394 - DNA, 25 bp, Mus musculus
taacacgaccaggtctcccagtgga

SEQ ID NO: 347395 - DNA, 25 bp, Mus musculus
taacactaaggatcatggatatacc

SEQ ID NO: 347396 - DNA, 25 bp, Mus musculus
taacactcctctacacttagcctgt

SEQ ID NO: 347397 - DNA, 25 bp, Mus musculus
taacactgcagaggactagagtgtc

SEQ ID NO: 347398 - DNA, 25 bp, Mus musculus
taacactgcagggtctccaactgac

SEQ ID NO: 347399 - DNA, 25 bp, Mus musculus
taacactggcagaggtacggagttt

SEQ ID NO: 347400 - DNA, 25 bp, Mus musculus
taacagaaaaggagtgtgtgaggga

SEQ ID NO: 347401 - DNA, 25 bp, Mus musculus
taacagaaaccagattcatccagtg

SEQ ID NO: 347402 - DNA, 25 bp, Mus musculus
taacagaaacttcagaaaagtagat

SEQ ID NO: 347403 - DNA, 25 bp, Mus musculus
taacagaagaaaaattcatcgttaa

SEQ ID NO: 347404 - DNA, 25 bp, Mus musculus
taacagaatgagaacagacaaggtg

SEQ ID NO: 347405 - DNA, 25 bp, Mus musculus
taacagagatgattctgacaatgga

SEQ ID NO: 347406 - DNA, 25 bp, Mus musculus
taacagagatttgctggatctcatg

SEQ ID NO: 347407 - DNA, 25 bp, Mus musculus
taacagagatttgtctcaatggaaa

SEQ ID NO: 347408 - DNA, 25 bp, Mus musculus
taacagataagccctccctgaccct

SEQ ID NO: 347409 - DNA, 25 bp, Mus musculus
taacagataggttctgcctcatgga

SEQ ID NO: 347410 - DNA, 25 bp, Mus musculus
taacagatgacaggtctgaggaggg

SEQ ID NO: 347411 - DNA, 25 bp, Mus musculus
taacagatttcacgtgtcaccatgc

SEQ ID NO: 347412 - DNA, 25 bp, Mus musculus
taacagcaatggcctccaactggag

SEQ ID NO: 347413 - DNA, 25 bp, Mus musculus
taacagcaatgggccaccagaatgc

SEQ ID NO: 347414 - DNA, 25 bp, Mus musculus
taacagcacagattctaccagtgga

SEQ ID NO: 347415 - DNA, 25 bp, Mus musculus
taacagcactaacaggaatgcagaa

SEQ ID NO: 347416 - DNA, 25 bp, Mus musculus
taacagcagcaggaaaatgggaagg

SEQ ID NO: 347417 - DNA, 25 bp, Mus musculus
taacagcgttggcctggaacagcca

SEQ ID NO: 347418 - DNA, 25 bp, Mus musculus
taacagctcaagatggtgaggaaga

SEQ ID NO: 347419 - DNA, 25 bp, Mus musculus
taacagctcagagagaatccacctt

SEQ ID NO: 347420 - DNA, 25 bp, Mus musculus
taacagctctgggatgtcacagccg

SEQ ID NO: 347421 - DNA, 25 bp, Mus musculus
taacagctgcaggaatagtgattga

SEQ ID NO: 347422 - DNA, 25 bp, Mus musculus
taacaggccaattgttcctgtacca

SEQ ID NO: 347423 - DNA, 25 bp, Mus musculus
taacaggccatggatgcccgggtag

SEQ ID NO: 347424 - DNA, 25 bp, Mus musculus
taacagggtcaaaggataattcctt

SEQ ID NO: 347425 - DNA, 25 bp, Mus musculus
taacagggtcaaaggccacattgaa

SEQ ID NO: 347426 - DNA, 25 bp, Mus musculus
taacagtgatgctgatgagtgcctt

SEQ ID NO: 347427 - DNA, 25 bp, Mus musculus
taacagtgatgctggacaccgcctt

SEQ ID NO: 347428 - DNA, 25 bp, Mus musculus
taacagtggggagccagctcccgtg

SEQ ID NO: 347429 - DNA, 25 bp, Mus musculus
taacagttacctagatattgctgtt

SEQ ID NO: 347430 - DNA, 25 bp, Mus musculus
taacagttacctaggcttttcactg

SEQ ID NO: 347431 - DNA, 25 bp, Mus musculus
taacagttgtctacttacagctctg

SEQ ID NO: 347432 - DNA, 25 bp, Mus musculus
taacatacccagtgccttgccatct

SEQ ID NO: 347433 - DNA, 25 bp, Mus musculus
taacatacccagtgtgtcatcaata

SEQ ID NO: 347434 - DNA, 25 bp, Mus musculus
taacatattaaaggaggtcctggcc

SEQ ID NO: 347435 - DNA, 25 bp, Mus musculus
taacatatttgaggcggaggcagcg

SEQ ID NO: 347436 - DNA, 25 bp, Mus musculus
taacatattttaatttcaggaattg

SEQ ID NO: 347437 - DNA, 25 bp, Mus musculus
taacatattttatccaagtttggca

SEQ ID NO: 347438 - DNA, 25 bp, Mus musculus
taacatcacagattgctgaaagaca

SEQ ID NO: 347439 - DNA, 25 bp, Mus musculus
taacatcacccccgccactggcttg

SEQ ID NO: 347440 - DNA, 25 bp, Mus musculus
taacatcacccccggtggtgaaggg

SEQ ID NO: 347441 - DNA, 25 bp, Mus musculus
taacatcacccccgtgctccccctg

SEQ ID NO: 347442 - DNA, 25 bp, Mus musculus
taacatccagctgttgcacaaacag

SEQ ID NO: 347443 - DNA, 25 bp, Mus musculus
taacatccatccttcatgattgtct

SEQ ID NO: 347444 - DNA, 25 bp, Mus musculus
taacatctaaggtgccaagtgctgg

SEQ ID NO: 347445 - DNA, 25 bp, Mus musculus
taacatctacgagcagggcacaact

SEQ ID NO: 347446 - DNA, 25 bp, Mus musculus
taacatcttcacgctaatgaaccgg

SEQ ID NO: 347447 - DNA, 25 bp, Mus musculus
taacatcttcacgtctcgaaaaggt

SEQ ID NO: 347448 - DNA, 25 bp, Mus musculus
taacatcttcctggcttctgctgta

SEQ ID NO: 347449 - DNA, 25 bp, Mus musculus
taacatcttttccaggtgcagagtg

SEQ ID NO: 347450 - DNA, 25 bp, Mus musculus
taacatgaagctgttctttctacag

SEQ ID NO: 347451 - DNA, 25 bp, Mus musculus
taacatgaaggaccttctgtcattc

SEQ ID NO: 347452 - DNA, 25 bp, Mus musculus
taacatgaaggcagacaagttgtta

SEQ ID NO: 347453 - DNA, 25 bp, Mus musculus
taacatgaaggttcttccagcaccc

SEQ ID NO: 347454 - DNA, 25 bp, Mus musculus
taacatgcagatattcagtgaactg

SEQ ID NO: 347455 - DNA, 25 bp, Mus musculus
taacatgctgaataggtatctgatc

SEQ ID NO: 347456 - DNA, 25 bp, Mus musculus
taacatgctgaataggtgaattgag

SEQ ID NO: 347457 - DNA, 25 bp, Mus musculus
taacatggagatgagtgtgaatgtc

SEQ ID NO: 347458 - DNA, 25 bp, Mus musculus
taacatggaggaccctctgtcattc

SEQ ID NO: 347459 - DNA, 25 bp, Mus musculus
taacatgtttaagaaggtgcccact

SEQ ID NO: 347460 - DNA, 25 bp, Mus musculus
taacattcaaggaagccatcactcc

SEQ ID NO: 347461 - DNA, 25 bp, Mus musculus
taacattcaaggcccttctgaaact

SEQ ID NO: 347462 - DNA, 25 bp, Mus musculus
taacattgggcctaacaggcctaca

SEQ ID NO: 347463 - DNA, 25 bp, Mus musculus
taacattggggtggccttgcacgct

SEQ ID NO: 347464 - DNA, 25 bp, Mus musculus
taacatttacagctcccctctccac

SEQ ID NO: 347465 - DNA, 25 bp, Mus musculus
taaccaaagaggatatagatctgat

SEQ ID NO: 347466 - DNA, 25 bp, Mus musculus
taaccaacaacctccagagtcttcg

SEQ ID NO: 347467 - DNA, 25 bp, Mus musculus
taaccaacgtcaatcgctgcctcga

SEQ ID NO: 347468 - DNA, 25 bp, Mus musculus
taaccaatctattaggcatcagacc

SEQ ID NO: 347469 - DNA, 25 bp, Mus musculus
taaccaatctattagggaaagagat

SEQ ID NO: 347470 - DNA, 25 bp, Mus musculus
taaccaatgtcaatcgctgcctcga

SEQ ID NO: 347471 - DNA, 25 bp, Mus musculus
taaccacaattatgcctctgatgaa

SEQ ID NO: 347472 - DNA, 25 bp, Mus musculus
taaccacaattatggaatcccccta

SEQ ID NO: 347473 - DNA, 25 bp, Mus musculus
taaccacacagcttgttcggtttgg

SEQ ID NO: 347474 - DNA, 25 bp, Mus musculus
taaccacagatttattctgtgatga

SEQ ID NO: 347475 - DNA, 25 bp, Mus musculus
taaccacagatttcacctgggccac

SEQ ID NO: 347476 - DNA, 25 bp, Mus musculus
taaccacagtaaggtcacgaagttg

SEQ ID NO: 347477 - DNA, 25 bp, Mus musculus
taaccacatccctccctccaaagct

SEQ ID NO: 347478 - DNA, 25 bp, Mus musculus
taaccacatttaaatgattatagat

SEQ ID NO: 347479 - DNA, 25 bp, Mus musculus
taaccacatttaagtcagattatcg

SEQ ID NO: 347480 - DNA, 25 bp, Mus musculus
taaccactcacaatcagcggagtgg

SEQ ID NO: 347481 - DNA, 25 bp, Mus musculus
taaccagaaaggtgatctgtaaatc

SEQ ID NO: 347482 - DNA, 25 bp, Mus musculus
taaccagaacaatcgattggaagaa

SEQ ID NO: 347483 - DNA, 25 bp, Mus musculus
taaccagaacaatcgggaacagact

SEQ ID NO: 347484 - DNA, 25 bp, Mus musculus
taaccagaatccagtatctcttgct

SEQ ID NO: 347485 - DNA, 25 bp, Mus musculus
taaccagaatccagtttcagataca

SEQ ID NO: 347486 - DNA, 25 bp, Mus musculus
taaccagacagatggagaaagacga

SEQ ID NO: 347487 - DNA, 25 bp, Mus musculus
taaccagactgagatggaccacaca

SEQ ID NO: 347488 - DNA, 25 bp, Mus musculus
taaccagatgagcacgctaacatcc

SEQ ID NO: 347489 - DNA, 25 bp, Mus musculus
taaccagatgagcaggctaacatcc

SEQ ID NO: 347490 - DNA, 25 bp, Mus musculus
taaccagatggactatccatcgctt

SEQ ID NO: 347491 - DNA, 25 bp, Mus musculus
taaccagcaacagctcctgaggaag

SEQ ID NO: 347492 - DNA, 25 bp, Mus musculus
taaccaggcatgctccctgacctca

SEQ ID NO: 347493 - DNA, 25 bp, Mus musculus
taaccagtacttgacaggttcttgt

SEQ ID NO: 347494 - DNA, 25 bp, Mus musculus
taaccagttccatagtgatgttaat

SEQ ID NO: 347495 - DNA, 25 bp, Mus musculus
taaccatagctcaccgtgtctcttc

SEQ ID NO: 347496 - DNA, 25 bp, Mus musculus
taaccatagctcatcgggttcacac

SEQ ID NO: 347497 - DNA, 25 bp, Mus musculus
taaccatcatgagatatctgccaag

SEQ ID NO: 347498 - DNA, 25 bp, Mus musculus
taaccatccttcttgctttgtaagg

SEQ ID NO: 347499 - DNA, 25 bp, Mus musculus
taaccatgagaaagagccactggca

SEQ ID NO: 347500 - DNA, 25 bp, Mus musculus
taacccaaaacaagctaatgtctgc

SEQ ID NO: 347501 - DNA, 25 bp, Mus musculus
taacccaaaacaagttgctcccaaa

SEQ ID NO: 347502 - DNA, 25 bp, Mus musculus
taacccagataccagattaagcttg

SEQ ID NO: 347503 - DNA, 25 bp, Mus musculus
taacccagataccattaaaaagaga

SEQ ID NO: 347504 - DNA, 25 bp, Mus musculus
taacccagcccagagatacattgtt

SEQ ID NO: 347505 - DNA, 25 bp, Mus musculus
taacccaggcactcggggtcctgag

SEQ ID NO: 347506 - DNA, 25 bp, Mus musculus
taacccaggccaaggaggagtcaga

SEQ ID NO: 347507 - DNA, 25 bp, Mus musculus
taacccagtaatttgtactatacca

SEQ ID NO: 347508 - DNA, 25 bp, Mus musculus
taacccccccacaggtcatcctgtt

SEQ ID NO: 347509 - DNA, 25 bp, Mus musculus
taacccccctaagggcagcagcaat

SEQ ID NO: 347510 - DNA, 25 bp, Mus musculus
taaccccgaaggcaaataagattgg

SEQ ID NO: 347511 - DNA, 25 bp, Mus musculus
taacccctctcctccataagcagcc

SEQ ID NO: 347512 - DNA, 25 bp, Mus musculus
taacccggcagaactacacatactc

SEQ ID NO: 347513 - DNA, 25 bp, Mus musculus
taaccctaaaggccttgcatcaaac

SEQ ID NO: 347514 - DNA, 25 bp, Mus musculus
taaccctacagggtgactacaacca

SEQ ID NO: 347515 - DNA, 25 bp, Mus musculus
taaccctgcaactgatgagatgcgc

SEQ ID NO: 347516 - DNA, 25 bp, Mus musculus
taaccctgcctcagcccatacccag

SEQ ID NO: 347517 - DNA, 25 bp, Mus musculus
taaccctggcactgtgaaaattcca

SEQ ID NO: 347518 - DNA, 25 bp, Mus musculus
taacccttcggtgacccaccctctg

SEQ ID NO: 347519 - DNA, 25 bp, Mus musculus
taaccctttagatgctagtggaggt

SEQ ID NO: 347520 - DNA, 25 bp, Mus musculus
taaccctttagatggtgtggatcca

SEQ ID NO: 347521 - DNA, 25 bp, Mus musculus
taaccgacctgagacttcattgaac

SEQ ID NO: 347522 - DNA, 25 bp, Mus musculus
taaccgacctgagcaagaaattatc

SEQ ID NO: 347523 - DNA, 25 bp, Mus musculus
taaccgctcaggtagtagtctggaa

SEQ ID NO: 347524 - DNA, 25 bp, Mus musculus
taaccgctcagttcatctcaaagaa

SEQ ID NO: 347525 - DNA, 25 bp, Mus musculus
taaccgtacctggtctgacagagac

SEQ ID NO: 347526 - DNA, 25 bp, Mus musculus
taaccgtccagttggttctgaccag

SEQ ID NO: 347527 - DNA, 25 bp, Mus musculus
taaccgtgagataccagagagctgt

SEQ ID NO: 347528 - DNA, 25 bp, Mus musculus
taaccgtgggactcgatctgcccac

SEQ ID NO: 347529 - DNA, 25 bp, Mus musculus
taacctacaagctaccacatttgaa

SEQ ID NO: 347530 - DNA, 25 bp, Mus musculus
taacctacaagttgttatccgatgc

SEQ ID NO: 347531 - DNA, 25 bp, Mus musculus
taacctacacagcgtacggcatgtc

SEQ ID NO: 347532 - DNA, 25 bp, Mus musculus
taacctagagcgggtgactgagata

SEQ ID NO: 347533 - DNA, 25 bp, Mus musculus
taacctcaaagcctctccgaccagt

SEQ ID NO: 347534 - DNA, 25 bp, Mus musculus
taacctcacacaggtggctgtgggc

SEQ ID NO: 347535 - DNA, 25 bp, Mus musculus
taacctcacacagtacagatctcaa

SEQ ID NO: 347536 - DNA, 25 bp, Mus musculus
taacctcaccaaaggctattcggaa

SEQ ID NO: 347537 - DNA, 25 bp, Mus musculus
taacctcaccaagtaccgggaagct

SEQ ID NO: 347538 - DNA, 25 bp, Mus musculus
taacctccagggaggtatggaccca

SEQ ID NO: 347539 - DNA, 25 bp, Mus musculus
taacctcttcaggcccgcactttgc

SEQ ID NO: 347540 - DNA, 25 bp, Mus musculus
taacctcttgacctggaagggaaca

SEQ ID NO: 347541 - DNA, 25 bp, Mus musculus
taacctgcaaacactgccccccaaa

SEQ ID NO: 347542 - DNA, 25 bp, Mus musculus
taacctgcatcccagcctatgacca

SEQ ID NO: 347543 - DNA, 25 bp, Mus musculus
taacctgcctgtgatggtatggatc

SEQ ID NO: 347544 - DNA, 25 bp, Mus musculus
taacctggagaatgccctggacttg

SEQ ID NO: 347545 - DNA, 25 bp, Mus musculus
taacctgggggcagccgaggaagtg

SEQ ID NO: 347546 - DNA, 25 bp, Mus musculus
taacctggttggtttgggatgctct

SEQ ID NO: 347547 - DNA, 25 bp, Mus musculus
taacctttggtgctttacatggtga

SEQ ID NO: 347548 - DNA, 25 bp, Mus musculus
taacgacaacagcccaaggagctcg

SEQ ID NO: 347549 - DNA, 25 bp, Mus musculus
taacgaccaagacgcaaatggaact

SEQ ID NO: 347550 - DNA, 25 bp, Mus musculus
taacgacgtgaaagactggaggcca

SEQ ID NO: 347551 - DNA, 25 bp, Mus musculus
taacgccaaggtaaacgatgatgtc

SEQ ID NO: 347552 - DNA, 25 bp, Mus musculus
taacgctcgatgcggccaaagagat

SEQ ID NO: 347553 - DNA, 25 bp, Mus musculus
taacgctcgatgcgggtggtaggaa

SEQ ID NO: 347554 - DNA, 25 bp, Mus musculus
taacgctcgatgcgttcacaatctt

SEQ ID NO: 347555 - DNA, 25 bp, Mus musculus
taacggactgctgaccttggggctt

SEQ ID NO: 347556 - DNA, 25 bp, Mus musculus
taacggagttggtgaatgataccaa

SEQ ID NO: 347557 - DNA, 25 bp, Mus musculus
taacggatttgtcccactcacttac

SEQ ID NO: 347558 - DNA, 25 bp, Mus musculus
taacggatttgttggatggatttat

SEQ ID NO: 347559 - DNA, 25 bp, Mus musculus
taacggtggggtttgcaatagcaat

SEQ ID NO: 347560 - DNA, 25 bp, Mus musculus
taacggtgtgcagttcatggaccgt

SEQ ID NO: 347561 - DNA, 25 bp, Mus musculus
taacgtaacgcccggccacacagcg

SEQ ID NO: 347562 - DNA, 25 bp, Mus musculus
taacgtacacagatatgaggaatta

SEQ ID NO: 347563 - DNA, 25 bp, Mus musculus
taacgtacacaggtttgcagctaga

SEQ ID NO: 347564 - DNA, 25 bp, Mus musculus
taacgtcggctgcccgctttgagct

SEQ ID NO: 347565 - DNA, 25 bp, Mus musculus
taacgtctgcatactatcgtggagc

SEQ ID NO: 347566 - DNA, 25 bp, Mus musculus
taacgtggactgaggtgctgcactg

SEQ ID NO: 347567 - DNA, 25 bp, Mus musculus
taacgttgggaaggaagaacgctgt

SEQ ID NO: 347568 - DNA, 25 bp, Mus musculus
taactaaccccgaaggcaaataaga

SEQ ID NO: 347569 - DNA, 25 bp, Mus musculus
taactaactggtccagctgctgctt

SEQ ID NO: 347570 - DNA, 25 bp, Mus musculus
taactaatggcagttggatcctcca

SEQ ID NO: 347571 - DNA, 25 bp, Mus musculus
taactacaaggatcctgctggccgt

SEQ ID NO: 347572 - DNA, 25 bp, Mus musculus
taactacaatccagaggagtctctg

SEQ ID NO: 347573 - DNA, 25 bp, Mus musculus
taactaccaagcatctatatttgcg

SEQ ID NO: 347574 - DNA, 25 bp, Mus musculus
taactaccagatgccaccgcagtgg

SEQ ID NO: 347575 - DNA, 25 bp, Mus musculus
taactaccaggcttatacaactgtt

SEQ ID NO: 347576 - DNA, 25 bp, Mus musculus
taactactacaggtattaagttcct

SEQ ID NO: 347577 - DNA, 25 bp, Mus musculus
taactacttgcagattctcttctgg

SEQ ID NO: 347578 - DNA, 25 bp, Mus musculus
taactacttgcaggccacagacaag

SEQ ID NO: 347579 - DNA, 25 bp, Mus musculus
taactatcgcgaacgagagagggaa

SEQ ID NO: 347580 - DNA, 25 bp, Mus musculus
taactatgcctgtggttgagcccta

SEQ ID NO: 347581 - DNA, 25 bp, Mus musculus
taactatggattcagtggggtgatg

SEQ ID NO: 347582 - DNA, 25 bp, Mus musculus
taactatttgacatggcctctgaag

SEQ ID NO: 347583 - DNA, 25 bp, Mus musculus
taactcaaaaagcagcctttacttg

SEQ ID NO: 347584 - DNA, 25 bp, Mus musculus
taactcaaggctccagaatgggcga

SEQ ID NO: 347585 - DNA, 25 bp, Mus musculus
taactcaatgggatttggtgcagaa

SEQ ID NO: 347586 - DNA, 25 bp, Mus musculus
taactcacaacggacgcctccttgg

SEQ ID NO: 347587 - DNA, 25 bp, Mus musculus
taactcacaacgggattgtcttggg

SEQ ID NO: 347588 - DNA, 25 bp, Mus musculus
taactcactcagaagagaagagcag

SEQ ID NO: 347589 - DNA, 25 bp, Mus musculus
taactcactcagtgtcaacagggag

SEQ ID NO: 347590 - DNA, 25 bp, Mus musculus
taactcagcaggaactatgaatggg

SEQ ID NO: 347591 - DNA, 25 bp, Mus musculus
taactcaggagaggagccatttatt

SEQ ID NO: 347592 - DNA, 25 bp, Mus musculus
taactcaggagaggctgctcccagg

SEQ ID NO: 347593 - DNA, 25 bp, Mus musculus
taactcaggagaggtacttggaagg

SEQ ID NO: 347594 - DNA, 25 bp, Mus musculus
taactcaggccagatattcagaaac

SEQ ID NO: 347595 - DNA, 25 bp, Mus musculus
taactcaggccagatcaaaaaaggg

SEQ ID NO: 347596 - DNA, 25 bp, Mus musculus
taactcaggccgggaaccgatgatg

SEQ ID NO: 347597 - DNA, 25 bp, Mus musculus
taactcagttttagcctgcggagcc

SEQ ID NO: 347598 - DNA, 25 bp, Mus musculus
taactccaattctaggatgtggtta

SEQ ID NO: 347599 - DNA, 25 bp, Mus musculus
taactcccgtgagcacttcattcaa

SEQ ID NO: 347600 - DNA, 25 bp, Mus musculus
taactcccgtgaggttcttgtagtg

SEQ ID NO: 347601 - DNA, 25 bp, Mus musculus
taactcggagcagaaatgcatcgcc

SEQ ID NO: 347602 - DNA, 25 bp, Mus musculus
taactcggagcagatcggtgcagcc

SEQ ID NO: 347603 - DNA, 25 bp, Mus musculus
taactctctggacgcccctgtgaaa

SEQ ID NO: 347604 - DNA, 25 bp, Mus musculus
taactctgaagaaggctccttcccc

SEQ ID NO: 347605 - DNA, 25 bp, Mus musculus
taactctgagaaggtctattacaat

SEQ ID NO: 347606 - DNA, 25 bp, Mus musculus
taactctgagataaagtgcaggatg

SEQ ID NO: 347607 - DNA, 25 bp, Mus musculus
taactctgagggcacgtcagaggcc

SEQ ID NO: 347608 - DNA, 25 bp, Mus musculus
taactctgagtcacaggaatgtgag

SEQ ID NO: 347609 - DNA, 25 bp, Mus musculus
taactctgagttcctgaaattcgtg

SEQ ID NO: 347610 - DNA, 25 bp, Mus musculus
taactctgggaatagattccaagag

SEQ ID NO: 347611 - DNA, 25 bp, Mus musculus
taactgaagatgaaaaaggtcattt

SEQ ID NO: 347612 - DNA, 25 bp, Mus musculus
taactgacacgagtgcgcaaacttc

SEQ ID NO: 347613 - DNA, 25 bp, Mus musculus
taactgacacgcaacagatagtaaa

SEQ ID NO: 347614 - DNA, 25 bp, Mus musculus
taactgacacggtaagtcttctttt

SEQ ID NO: 347615 - DNA, 25 bp, Mus musculus
taactgactagatcttgatatggaa

SEQ ID NO: 347616 - DNA, 25 bp, Mus musculus
taactgagaaaacagaagattctag

SEQ ID NO: 347617 - DNA, 25 bp, Mus musculus
taactgagaaaacaggatctgactt

SEQ ID NO: 347618 - DNA, 25 bp, Mus musculus
taactgagaccatgcagaggcctcc

SEQ ID NO: 347619 - DNA, 25 bp, Mus musculus
taactgagcatgagcttttatggga

SEQ ID NO: 347620 - DNA, 25 bp, Mus musculus
taactgagcatgaggtctcagacag

SEQ ID NO: 347621 - DNA, 25 bp, Mus musculus
taactgataaaattctaccagtgga

SEQ ID NO: 347622 - DNA, 25 bp, Mus musculus
taactgataaactccagggattccc

SEQ ID NO: 347623 - DNA, 25 bp, Mus musculus
taactgcaaactcccacgtcctccc

SEQ ID NO: 347624 - DNA, 25 bp, Mus musculus
taactgcaaactgccacgtcctccc

SEQ ID NO: 347625 - DNA, 25 bp, Mus musculus
taactgcacaaacagagcagctctg

SEQ ID NO: 347626 - DNA, 25 bp, Mus musculus
taactgcactgccagcacggggtct

SEQ ID NO: 347627 - DNA, 25 bp, Mus musculus
taactgcattttaggagtgcatgcg

SEQ ID NO: 347628 - DNA, 25 bp, Mus musculus
taactgccagatggttcttcgtgga

SEQ ID NO: 347629 - DNA, 25 bp, Mus musculus
taactgcctaacaagtggtggacca

SEQ ID NO: 347630 - DNA, 25 bp, Mus musculus
taactgctcaatagtgaaattccac

SEQ ID NO: 347631 - DNA, 25 bp, Mus musculus
taactggaaagaatgtcttgattgt

SEQ ID NO: 347632 - DNA, 25 bp, Mus musculus
taactggaaaggatataattgacac

SEQ ID NO: 347633 - DNA, 25 bp, Mus musculus
taactggccagagagcaatggaagt

SEQ ID NO: 347634 - DNA, 25 bp, Mus musculus
taactggccagaggacacggatgct

SEQ ID NO: 347635 - DNA, 25 bp, Mus musculus
taactggctgggtggaaccaggccc

SEQ ID NO: 347636 - DNA, 25 bp, Mus musculus
taactgggaaaccatgtggtgctct

SEQ ID NO: 347637 - DNA, 25 bp, Mus musculus
taactgggaggatgagccccaagaa

SEQ ID NO: 347638 - DNA, 25 bp, Mus musculus
taactgggctgttttacctctaggt

SEQ ID NO: 347639 - DNA, 25 bp, Mus musculus
taactggtatgatcctcatgggtgt

SEQ ID NO: 347640 - DNA, 25 bp, Mus musculus
taactggtgcccagggtgctggtgt

SEQ ID NO: 347641 - DNA, 25 bp, Mus musculus
taactgtcgaggaagttttctgaaa

SEQ ID NO: 347642 - DNA, 25 bp, Mus musculus
taactgtgactccaaacatccagaa

SEQ ID NO: 347643 - DNA, 25 bp, Mus musculus
taactgtgagtggacatcatcgaag

SEQ ID NO: 347644 - DNA, 25 bp, Mus musculus
taactgtgtaggtgcaggcaaccat

SEQ ID NO: 347645 - DNA, 25 bp, Mus musculus
taactgttacgaaatctcataagcg

SEQ ID NO: 347646 - DNA, 25 bp, Mus musculus
taactgttacgatccatcttttttg

SEQ ID NO: 347647 - DNA, 25 bp, Mus musculus
taactgttttcacaggaactggtga

SEQ ID NO: 347648 - DNA, 25 bp, Mus musculus
taacttaaaagatactgagagaagt

SEQ ID NO: 347649 - DNA, 25 bp, Mus musculus
taacttaaaagatgattcataatac

SEQ ID NO: 347650 - DNA, 25 bp, Mus musculus
taacttaaagagtatagaaatatca

SEQ ID NO: 347651 - DNA, 25 bp, Mus musculus
taacttaacagcaggctctctggag

SEQ ID NO: 347652 - DNA, 25 bp, Mus musculus
taacttaatgtttgaaatgcccttg

SEQ ID NO: 347653 - DNA, 25 bp, Mus musculus
taacttacaacaacctgaaggagct

SEQ ID NO: 347654 - DNA, 25 bp, Mus musculus
taacttacacctcgttttactgcaa

SEQ ID NO: 347655 - DNA, 25 bp, Mus musculus
taacttacagagttgagtggcctaa

SEQ ID NO: 347656 - DNA, 25 bp, Mus musculus
taacttacaggttctgacgggaaca

SEQ ID NO: 347657 - DNA, 25 bp, Mus musculus
taacttagaggaggcacagacccca

SEQ ID NO: 347658 - DNA, 25 bp, Mus musculus
taacttatggcaggtccaaacatca

SEQ ID NO: 347659 - DNA, 25 bp, Mus musculus
taacttattattcaagattaaacca

SEQ ID NO: 347660 - DNA, 25 bp, Mus musculus
taacttcaaggttatccaggccgtg

SEQ ID NO: 347661 - DNA, 25 bp, Mus musculus
taacttcacaccaggagagcactgt

SEQ ID NO: 347662 - DNA, 25 bp, Mus musculus
taacttcacaccagtcttcgctgat

SEQ ID NO: 347663 - DNA, 25 bp, Mus musculus
taacttcagaaggaataaaagctgt

SEQ ID NO: 347664 - DNA, 25 bp, Mus musculus
taacttcagcaaggaccataatttt

SEQ ID NO: 347665 - DNA, 25 bp, Mus musculus
taacttcagccagaggctccagccg

SEQ ID NO: 347666 - DNA, 25 bp, Mus musculus
taacttcaggaaattcactgagggc

SEQ ID NO: 347667 - DNA, 25 bp, Mus musculus
taacttcagtgcttatccctctgaa

SEQ ID NO: 347668 - DNA, 25 bp, Mus musculus
taacttccagagaatctcagtatgg

SEQ ID NO: 347669 - DNA, 25 bp, Mus musculus
taacttccagatccaggccttcaat

SEQ ID NO: 347670 - DNA, 25 bp, Mus musculus
taacttctccagaggcaagttcaag

SEQ ID NO: 347671 - DNA, 25 bp, Mus musculus
taacttctgggccaacaaattactc

SEQ ID NO: 347672 - DNA, 25 bp, Mus musculus
taacttctttgaggaggtattcaca

SEQ ID NO: 347673 - DNA, 25 bp, Mus musculus
taacttgaaggtagaagactttttg

SEQ ID NO: 347674 - DNA, 25 bp, Mus musculus
taacttgcagattctgcttcgagaa

SEQ ID NO: 347675 - DNA, 25 bp, Mus musculus
taacttgtccatggaggtcttcact

SEQ ID NO: 347676 - DNA, 25 bp, Mus musculus
taacttgtccattttgttgcatatt

SEQ ID NO: 347677 - DNA, 25 bp, Mus musculus
taacttgtttgaatggtaaatgatc

SEQ ID NO: 347678 - DNA, 25 bp, Mus musculus
taactttcagccgatcaacttctga

SEQ ID NO: 347679 - DNA, 25 bp, Mus musculus
taactttcagttcaaaccggaggat

SEQ ID NO: 347680 - DNA, 25 bp, Mus musculus
taactttcatagatcctgaagggtc

SEQ ID NO: 347681 - DNA, 25 bp, Mus musculus
taactttccactatttgctgcctgc

SEQ ID NO: 347682 - DNA, 25 bp, Mus musculus
taactttctgcagcctccatctcac

SEQ ID NO: 347683 - DNA, 25 bp, Mus musculus
taactttgtcaagtccaagacaggc

SEQ ID NO: 347684 - DNA, 25 bp, Mus musculus
taacttttacaagacagtccagcag

SEQ ID NO: 347685 - DNA, 25 bp, Mus musculus
taacttttacaaggtggtacagcaa

SEQ ID NO: 347686 - DNA, 25 bp, Mus musculus
taacttttagtcacagaaaagaaaa

SEQ ID NO: 347687 - DNA, 25 bp, Mus musculus
taagaaaaacaagggaagcttagat

SEQ ID NO: 347688 - DNA, 25 bp, Mus musculus
taagaaaacagagaaacctgatcag

SEQ ID NO: 347689 - DNA, 25 bp, Mus musculus
taagaaaatcatatgtgacaaatac

SEQ ID NO: 347690 - DNA, 25 bp, Mus musculus
taagaaacaaacggctcttgctgag

SEQ ID NO: 347691 - DNA, 25 bp, Mus musculus
taagaaacctcgagatcccaaacgg

SEQ ID NO: 347692 - DNA, 25 bp, Mus musculus
taagaaacggagccagctgtggatc

SEQ ID NO: 347693 - DNA, 25 bp, Mus musculus
taagaaactgccaggagtaggaaca

SEQ ID NO: 347694 - DNA, 25 bp, Mus musculus
taagaaagaaagatggttgtccctg

SEQ ID NO: 347695 - DNA, 25 bp, Mus musculus
taagaaagagaccagtgctgttgca

SEQ ID NO: 347696 - DNA, 25 bp, Mus musculus
taagaaagagcccagtaagagaatc

SEQ ID NO: 347697 - DNA, 25 bp, Mus musculus
taagaaagccagagaaggtgtgatg

SEQ ID NO: 347698 - DNA, 25 bp, Mus musculus
taagaaagccagcagcattagattg

SEQ ID NO: 347699 - DNA, 25 bp, Mus musculus
taagaaagctggacctgggctgaag

SEQ ID NO: 347700 - DNA, 25 bp, Mus musculus
taagaaataagcagatccttgtaag

SEQ ID NO: 347701 - DNA, 25 bp, Mus musculus
taagaaataaggatcgttcatctaa

SEQ ID NO: 347702 - DNA, 25 bp, Mus musculus
taagaaatatgaagacactccagca

SEQ ID NO: 347703 - DNA, 25 bp, Mus musculus
taagaaatatgaagcacaagcccaa

SEQ ID NO: 347704 - DNA, 25 bp, Mus musculus
taagaaatatgaagccactctgata

SEQ ID NO: 347705 - DNA, 25 bp, Mus musculus
taagaaatcttggccaggaccctgc

SEQ ID NO: 347706 - DNA, 25 bp, Mus musculus
taagaaatttcctaatcaccctcat

SEQ ID NO: 347707 - DNA, 25 bp, Mus musculus
taagaacaagaaaacagataaatac

SEQ ID NO: 347708 - DNA, 25 bp, Mus musculus
taagaacaagccagggcctcctgct

SEQ ID NO: 347709 - DNA, 25 bp, Mus musculus
taagaacaaggacaacatccacgct

SEQ ID NO: 347710 - DNA, 25 bp, Mus musculus
taagaacaagtactgaaagtgctgt

SEQ ID NO: 347711 - DNA, 25 bp, Mus musculus
taagaacacgcaagacagcagtccg

SEQ ID NO: 347712 - DNA, 25 bp, Mus musculus
taagaacacgcaagggtgagatctt

SEQ ID NO: 347713 - DNA, 25 bp, Mus musculus
taagaacagacatcatgatcgggag

SEQ ID NO: 347714 - DNA, 25 bp, Mus musculus
taagaaccagactgcagagaaggaa

SEQ ID NO: 347715 - DNA, 25 bp, Mus musculus
taagaaccagagaaggaagaatttg

SEQ ID NO: 347716 - DNA, 25 bp, Mus musculus
taagaaccagtactgggttgaatct

SEQ ID NO: 347717 - DNA, 25 bp, Mus musculus
taagaaccgggacactcttctccaa

SEQ ID NO: 347718 - DNA, 25 bp, Mus musculus
taagaactacaataagtgtttcctc

SEQ ID NO: 347719 - DNA, 25 bp, Mus musculus
taagaagaaagaagatagtaaaaag

SEQ ID NO: 347720 - DNA, 25 bp, Mus musculus
taagaagaaagcagcacacacaggc

SEQ ID NO: 347721 - DNA, 25 bp, Mus musculus
taagaagaaaggactgacagacgaa

SEQ ID NO: 347722 - DNA, 25 bp, Mus musculus
taagaagagtgcagatgggatgctt

SEQ ID NO: 347723 - DNA, 25 bp, Mus musculus
taagaagatgatccccagtgtttcc

SEQ ID NO: 347724 - DNA, 25 bp, Mus musculus
taagaagatgatcgtcttcaagcct

SEQ ID NO: 347725 - DNA, 25 bp, Mus musculus
taagaagatttaccactcggccctg

SEQ ID NO: 347726 - DNA, 25 bp, Mus musculus
taagaagccagatgtgaactggggc

SEQ ID NO: 347727 - DNA, 25 bp, Mus musculus
taagaagctatatccaggaccagcg

SEQ ID NO: 347728 - DNA, 25 bp, Mus musculus
taagaagctcaagtccattacaatg

SEQ ID NO: 347729 - DNA, 25 bp, Mus musculus
taagaagctgacatgccatatgaac

SEQ ID NO: 347730 - DNA, 25 bp, Mus musculus
taagaagctggggacagcactgggt

SEQ ID NO: 347731 - DNA, 25 bp, Mus musculus
taagaaggagaagaccaccagactg

SEQ ID NO: 347732 - DNA, 25 bp, Mus musculus
taagaaggaggggtgaggctgctgg

SEQ ID NO: 347733 - DNA, 25 bp, Mus musculus
taagaaggcaaatgctatgctggat

SEQ ID NO: 347734 - DNA, 25 bp, Mus musculus
taagaaggctcagcggaacctgcct

SEQ ID NO: 347735 - DNA, 25 bp, Mus musculus
taagaataaaagatgcctcaggaac

SEQ ID NO: 347736 - DNA, 25 bp, Mus musculus
taagaatattgagacggccagagca

SEQ ID NO: 347737 - DNA, 25 bp, Mus musculus
taagaatccatttgatgaagctcaa

SEQ ID NO: 347738 - DNA, 25 bp, Mus musculus
taagaatgaggaagaaaaagagaga

SEQ ID NO: 347739 - DNA, 25 bp, Mus musculus
taagaatgaggtggcgagtgggatg

SEQ ID NO: 347740 - DNA, 25 bp, Mus musculus
taagaatgctgttttgaatcagcgg

SEQ ID NO: 347741 - DNA, 25 bp, Mus musculus
taagaatggttatgataattagcac

SEQ ID NO: 347742 - DNA, 25 bp, Mus musculus
taagaattccttgaatccgacgtgg

SEQ ID NO: 347743 - DNA, 25 bp, Mus musculus
taagaattccttgatccaaacgcac

SEQ ID NO: 347744 - DNA, 25 bp, Mus musculus
taagacaaaagactgacacatgcag

SEQ ID NO: 347745 - DNA, 25 bp, Mus musculus
taagacaaaattagagaggaggaaa

SEQ ID NO: 347746 - DNA, 25 bp, Mus musculus
taagacaaaattagtccatttcagt

SEQ ID NO: 347747 - DNA, 25 bp, Mus musculus
taagacaatcagggcaagaaaattc

SEQ ID NO: 347748 - DNA, 25 bp, Mus musculus
taagacacctctcagaaaagttgta

SEQ ID NO: 347749 - DNA, 25 bp, Mus musculus
taagacagacatggggagtcttctg

SEQ ID NO: 347750 - DNA, 25 bp, Mus musculus
taagacataggtggcaggatccaat

SEQ ID NO: 347751 - DNA, 25 bp, Mus musculus
taagacattagaagatctcaggaaa

SEQ ID NO: 347752 - DNA, 25 bp, Mus musculus
taagacattgctagcatttgaagac

SEQ ID NO: 347753 - DNA, 25 bp, Mus musculus
taagaccatcaccctggaggtcgag

SEQ ID NO: 347754 - DNA, 25 bp, Mus musculus
taagaccatcagattatgggacagt

SEQ ID NO: 347755 - DNA, 25 bp, Mus musculus
taagaccattcaaatccctgagcat

SEQ ID NO: 347756 - DNA, 25 bp, Mus musculus
taagacccagcagaataactgccat

SEQ ID NO: 347757 - DNA, 25 bp, Mus musculus
taagaccgtggtaaatgtttcaacc

SEQ ID NO: 347758 - DNA, 25 bp, Mus musculus
taagacgaagatggccaagctgcgc

SEQ ID NO: 347759 - DNA, 25 bp, Mus musculus
taagacgaagggcaaggaggcccct

SEQ ID NO: 347760 - DNA, 25 bp, Mus musculus
taagacgtcagataatcaaattaaa

SEQ ID NO: 347761 - DNA, 25 bp, Mus musculus
taagacgtcaggtaatcaaattaaa

SEQ ID NO: 347762 - DNA, 25 bp, Mus musculus
taagacgtttgtcctgctgtgtttc

SEQ ID NO: 347763 - DNA, 25 bp, Mus musculus
taagactaaatgggtgaccgaggtc

SEQ ID NO: 347764 - DNA, 25 bp, Mus musculus
taagactcaggtaacagttcagtac

SEQ ID NO: 347765 - DNA, 25 bp, Mus musculus
taagactccagagatctacctggcg

SEQ ID NO: 347766 - DNA, 25 bp, Mus musculus
taagactcgatgtgtttacagtgga

SEQ ID NO: 347767 - DNA, 25 bp, Mus musculus
taagactctagatattagctcaatc

SEQ ID NO: 347768 - DNA, 25 bp, Mus musculus
taagactgcagatgcccccgaaaaa

SEQ ID NO: 347769 - DNA, 25 bp, Mus musculus
taagactgggatgtttctttcatca

SEQ ID NO: 347770 - DNA, 25 bp, Mus musculus
taagactgggtaaatttgatcctga

SEQ ID NO: 347771 - DNA, 25 bp, Mus musculus
taagagaaaaaagaatggaatggca

SEQ ID NO: 347772 - DNA, 25 bp, Mus musculus
taagagaaaaaagatttgatgttga

SEQ ID NO: 347773 - DNA, 25 bp, Mus musculus
taagagaacaaattgaaatggatgc

SEQ ID NO: 347774 - DNA, 25 bp, Mus musculus
taagagaaccagcattggattgcaa

SEQ ID NO: 347775 - DNA, 25 bp, Mus musculus
taagagaagaaaaagctctcttaag

SEQ ID NO: 347776 - DNA, 25 bp, Mus musculus
taagagacattaaagggtatagtgc

SEQ ID NO: 347777 - DNA, 25 bp, Mus musculus
taagagatgacagctgaggaccgaa

SEQ ID NO: 347778 - DNA, 25 bp, Mus musculus
taagagatgacgtcaggggaggaga

SEQ ID NO: 347779 - DNA, 25 bp, Mus musculus
taagagcaagatatgaaatcgtgga

SEQ ID NO: 347780 - DNA, 25 bp, Mus musculus
taagagcacagcttctccagcctcc

SEQ ID NO: 347781 - DNA, 25 bp, Mus musculus
taagagcacagtgctggctgcgagg

SEQ ID NO: 347782 - DNA, 25 bp, Mus musculus
taagagccagctggctcgcatacag

SEQ ID NO: 347783 - DNA, 25 bp, Mus musculus
taagagccaggtaatttctaatgcc

SEQ ID NO: 347784 - DNA, 25 bp, Mus musculus
taagagccagttgctatgtccacca

SEQ ID NO: 347785 - DNA, 25 bp, Mus musculus
taagagcccaggttgtctgttcttt

SEQ ID NO: 347786 - DNA, 25 bp, Mus musculus
taagagcccagtgccatgtcggacc

SEQ ID NO: 347787 - DNA, 25 bp, Mus musculus
taagagcgttctctggtgcaagtgt

SEQ ID NO: 347788 - DNA, 25 bp, Mus musculus
taagagctggagcattttctgcagc

SEQ ID NO: 347789 - DNA, 25 bp, Mus musculus
taagagcttgtgccattcctgccaa

SEQ ID NO: 347790 - DNA, 25 bp, Mus musculus
taagagcttgtgttattggattttt

SEQ ID NO: 347791 - DNA, 25 bp, Mus musculus
taagaggaaaaagcgaccagctaca

SEQ ID NO: 347792 - DNA, 25 bp, Mus musculus
taagaggaattctggctgaaagtgg

SEQ ID NO: 347793 - DNA, 25 bp, Mus musculus
taagaggacaccaagggtccaccaa

SEQ ID NO: 347794 - DNA, 25 bp, Mus musculus
taagaggacctaaaggagacttggg

SEQ ID NO: 347795 - DNA, 25 bp, Mus musculus
taagagggcgaatattcgcctccca

SEQ ID NO: 347796 - DNA, 25 bp, Mus musculus
taagagggcgaattgtggagccccg

SEQ ID NO: 347797 - DNA, 25 bp, Mus musculus
taagagtgactcaggaagccataat

SEQ ID NO: 347798 - DNA, 25 bp, Mus musculus
taagagtgcagctcagagacatgtc

SEQ ID NO: 347799 - DNA, 25 bp, Mus musculus
taagagttgcagctaggacttctct

SEQ ID NO: 347800 - DNA, 25 bp, Mus musculus
taagagtttgatacgaacagaacac

SEQ ID NO: 347801 - DNA, 25 bp, Mus musculus
taagataaaaagcaggggttccttg

SEQ ID NO: 347802 - DNA, 25 bp, Mus musculus
taagatagagcggggaaaaatggag

SEQ ID NO: 347803 - DNA, 25 bp, Mus musculus
taagataggaggctccctgctatgt

SEQ ID NO: 347804 - DNA, 25 bp, Mus musculus
taagataggcagcatgtctgatgaa

SEQ ID NO: 347805 - DNA, 25 bp, Mus musculus
taagataggcagcatttccagacag

SEQ ID NO: 347806 - DNA, 25 bp, Mus musculus
taagataggctgagcatcccagcct

SEQ ID NO: 347807 - DNA, 25 bp, Mus musculus
taagataggctggagtcccctcccc

SEQ ID NO: 347808 - DNA, 25 bp, Mus musculus
taagatagttaaagagggttgcccc

SEQ ID NO: 347809 - DNA, 25 bp, Mus musculus
taagatcctctcggtaaatggccaa

SEQ ID NO: 347810 - DNA, 25 bp, Mus musculus
taagatctggaagtgccaaagtaga

SEQ ID NO: 347811 - DNA, 25 bp, Mus musculus
taagatgaaaccttccgacttgtct

SEQ ID NO: 347812 - DNA, 25 bp, Mus musculus
taagatgaaggctcacagcgagtat

SEQ ID NO: 347813 - DNA, 25 bp, Mus musculus
taagatgcactccatgaatgggttc

SEQ ID NO: 347814 - DNA, 25 bp, Mus musculus
taagatggtgcagtgaaccaccatt

SEQ ID NO: 347815 - DNA, 25 bp, Mus musculus
taagatggtggtgagtgcctatgaa

SEQ ID NO: 347816 - DNA, 25 bp, Mus musculus
taagattagacctggttggctcaaa

SEQ ID NO: 347817 - DNA, 25 bp, Mus musculus
taagattcccacctgttgcccatct

SEQ ID NO: 347818 - DNA, 25 bp, Mus musculus
taagattctccttccacgacccatg

SEQ ID NO: 347819 - DNA, 25 bp, Mus musculus
taagattgaagatcgagcgtttgga

SEQ ID NO: 347820 - DNA, 25 bp, Mus musculus
taagattgagaacctagctagcatc

SEQ ID NO: 347821 - DNA, 25 bp, Mus musculus
taagattgtctggagatggctgcag

SEQ ID NO: 347822 - DNA, 25 bp, Mus musculus
taagatttggaagatggagaactct

SEQ ID NO: 347823 - DNA, 25 bp, Mus musculus
taagatttggaagggtggatgtcac

SEQ ID NO: 347824 - DNA, 25 bp, Mus musculus
taagatttggaagtcaagaagtttt

SEQ ID NO: 347825 - DNA, 25 bp, Mus musculus
taagcaaacatgtttccttttagac

SEQ ID NO: 347826 - DNA, 25 bp, Mus musculus
taagcaaagccaagatctccaagcc

SEQ ID NO: 347827 - DNA, 25 bp, Mus musculus
taagcaaagccaagatgtttgaagc

SEQ ID NO: 347828 - DNA, 25 bp, Mus musculus
taagcaactccgcctccctgcctct

SEQ ID NO: 347829 - DNA, 25 bp, Mus musculus
taagcaactccggagcctggtgaaa

SEQ ID NO: 347830 - DNA, 25 bp, Mus musculus
taagcaagaacaatactacaagatc

SEQ ID NO: 347831 - DNA, 25 bp, Mus musculus
taagcaagaagactaagaacattgc

SEQ ID NO: 347832 - DNA, 25 bp, Mus musculus
taagcaagaagtggtggtaatcagt

SEQ ID NO: 347833 - DNA, 25 bp, Mus musculus
taagcaagaatgagctgaagaggcg

SEQ ID NO: 347834 - DNA, 25 bp, Mus musculus
taagcaagatgctaggcaagtcttg

SEQ ID NO: 347835 - DNA, 25 bp, Mus musculus
taagcaaggtaacccagcatgtagt

SEQ ID NO: 347836 - DNA, 25 bp, Mus musculus
taagcaagtgcaagcaatagctgtc

SEQ ID NO: 347837 - DNA, 25 bp, Mus musculus
taagcaagtgcaaggcaaaggcaga

SEQ ID NO: 347838 - DNA, 25 bp, Mus musculus
taagcaagtgcaaggtttctgaaag

SEQ ID NO: 347839 - DNA, 25 bp, Mus musculus
taagcaatcaaagcttatttccaaa

SEQ ID NO: 347840 - DNA, 25 bp, Mus musculus
taagcaatcaaaggtgagacgacaa

SEQ ID NO: 347841 - DNA, 25 bp, Mus musculus
taagcaatgtcaggcgtccgacctc

SEQ ID NO: 347842 - DNA, 25 bp, Mus musculus
taagcaattgcaggactctgatggg

SEQ ID NO: 347843 - DNA, 25 bp, Mus musculus
taagcacaagagtcacctgtaccta

SEQ ID NO: 347844 - DNA, 25 bp, Mus musculus
taagcacacccagaactgagcacaa

SEQ ID NO: 347845 - DNA, 25 bp, Mus musculus
taagcacacccaggtgccagcctca

SEQ ID NO: 347846 - DNA, 25 bp, Mus musculus
taagcacagaaggtgggactgggcg

SEQ ID NO: 347847 - DNA, 25 bp, Mus musculus
taagcaccgaatgcacaatctctgc

SEQ ID NO: 347848 - DNA, 25 bp, Mus musculus
taagcacctagagacaagtaagcag

SEQ ID NO: 347849 - DNA, 25 bp, Mus musculus
taagcactgggtatctctctttctc

SEQ ID NO: 347850 - DNA, 25 bp, Mus musculus
taagcactgggtattttcttgttac

SEQ ID NO: 347851 - DNA, 25 bp, Mus musculus
taagcactgtgttttcagtaaatga

SEQ ID NO: 347852 - DNA, 25 bp, Mus musculus
taagcactttggtaaacttcctaca

SEQ ID NO: 347853 - DNA, 25 bp, Mus musculus
taagcagaagcaccgagtggatttt

SEQ ID NO: 347854 - DNA, 25 bp, Mus musculus
taagcagaaggtattgtcatcacta

SEQ ID NO: 347855 - DNA, 25 bp, Mus musculus
taagcagacagatgagcgttcggcc

SEQ ID NO: 347856 - DNA, 25 bp, Mus musculus
taagcagagcaagatctggtgcttt

SEQ ID NO: 347857 - DNA, 25 bp, Mus musculus
taagcagaggagacctgccaggcct

SEQ ID NO: 347858 - DNA, 25 bp, Mus musculus
taagcagcaaaatggcccaccaaga

SEQ ID NO: 347859 - DNA, 25 bp, Mus musculus
taagcagcaaaatggtaaccctggc

SEQ ID NO: 347860 - DNA, 25 bp, Mus musculus
taagcagccagatttagatcatgcc

SEQ ID NO: 347861 - DNA, 25 bp, Mus musculus
taagcagctgacagagggtacccgg

SEQ ID NO: 347862 - DNA, 25 bp, Mus musculus
taagcagtacaaacctctttctcat

SEQ ID NO: 347863 - DNA, 25 bp, Mus musculus
taagcagtaccagtttgctagtggt

SEQ ID NO: 347864 - DNA, 25 bp, Mus musculus
taagcagtccagatttcatcctgat

SEQ ID NO: 347865 - DNA, 25 bp, Mus musculus
taagcagtccagccctattctgaaa

SEQ ID NO: 347866 - DNA, 25 bp, Mus musculus
taagcagtccagctcgtctgatcct

SEQ ID NO: 347867 - DNA, 25 bp, Mus musculus
taagcagtccaggttcttactctgt

SEQ ID NO: 347868 - DNA, 25 bp, Mus musculus
taagcatcagggaaacctcaccgaa

SEQ ID NO: 347869 - DNA, 25 bp, Mus musculus
taagcatcagttcagaaaccaactt

SEQ ID NO: 347870 - DNA, 25 bp, Mus musculus
taagcatgtgtaggacccagccacc

SEQ ID NO: 347871 - DNA, 25 bp, Mus musculus
taagcatgtgtcatggctccgaacc

SEQ ID NO: 347872 - DNA, 25 bp, Mus musculus
taagcattggtgatgttatctatgc

SEQ ID NO: 347873 - DNA, 25 bp, Mus musculus
taagcatttagaatgcacaaaacaa

SEQ ID NO: 347874 - DNA, 25 bp, Mus musculus
taagcatttcaagacccactccctc

SEQ ID NO: 347875 - DNA, 25 bp, Mus musculus
taagcatttcaaggagaaataccca

SEQ ID NO: 347876 - DNA, 25 bp, Mus musculus
taagcatttcaagggtctcatatac

SEQ ID NO: 347877 - DNA, 25 bp, Mus musculus
taagccacagtgacaacagctacta

SEQ ID NO: 347878 - DNA, 25 bp, Mus musculus
taagccacgaggaaagcgtcatcat

SEQ ID NO: 347879 - DNA, 25 bp, Mus musculus
taagccagaggcaatgggctctggt

SEQ ID NO: 347880 - DNA, 25 bp, Mus musculus
taagccagcaggcctcagggctggc

SEQ ID NO: 347881 - DNA, 25 bp, Mus musculus
taagccagcagggcctgggctggtg

SEQ ID NO: 347882 - DNA, 25 bp, Mus musculus
taagccagggtcagactcagtcacc

SEQ ID NO: 347883 - DNA, 25 bp, Mus musculus
taagccagggtttgcagagcagtcc

SEQ ID NO: 347884 - DNA, 25 bp, Mus musculus
taagccagtgggagtgtgcagccac

SEQ ID NO: 347885 - DNA, 25 bp, Mus musculus
taagccatcaggtccatggagagac

SEQ ID NO: 347886 - DNA, 25 bp, Mus musculus
taagcccaaacttgcacgagccact

SEQ ID NO: 347887 - DNA, 25 bp, Mus musculus
taagcccaggtgttcatgaagcctg

SEQ ID NO: 347888 - DNA, 25 bp, Mus musculus
taagccccaggagccctcccaggcc

SEQ ID NO: 347889 - DNA, 25 bp, Mus musculus
taagcccgagcaggacttggatgtt

SEQ ID NO: 347890 - DNA, 25 bp, Mus musculus
taagccgcaaagaagttccaccagg

SEQ ID NO: 347891 - DNA, 25 bp, Mus musculus
taagccggaaggagtcccagccaag

SEQ ID NO: 347892 - DNA, 25 bp, Mus musculus
taagccgtacagtaagcactacccc

SEQ ID NO: 347893 - DNA, 25 bp, Mus musculus
taagcctaaggtgctgtgctccatc

SEQ ID NO: 347894 - DNA, 25 bp, Mus musculus
taagcctcagaaggatgcgggctcc

SEQ ID NO: 347895 - DNA, 25 bp, Mus musculus
taagcctgaacctggctgcttttgc

SEQ ID NO: 347896 - DNA, 25 bp, Mus musculus
taagcctgagtgaggatcatggctg

SEQ ID NO: 347897 - DNA, 25 bp, Mus musculus
taagcctgcatcaggtcctagacca

SEQ ID NO: 347898 - DNA, 25 bp, Mus musculus
taagcctggtggacccatggatgaa

SEQ ID NO: 347899 - DNA, 25 bp, Mus musculus
taagccttaaattgggtgcttccaa

SEQ ID NO: 347900 - DNA, 25 bp, Mus musculus
taagccttaaattggttctactagt

SEQ ID NO: 347901 - DNA, 25 bp, Mus musculus
taagccttgcatagtcccagaagta

SEQ ID NO: 347902 - DNA, 25 bp, Mus musculus
taagccttgtataaagtacactgga

SEQ ID NO: 347903 - DNA, 25 bp, Mus musculus
taagcgccggaggactgcatgagtt

SEQ ID NO: 347904 - DNA, 25 bp, Mus musculus
taagcgggccgagatgtggtgatct

SEQ ID NO: 347905 - DNA, 25 bp, Mus musculus
taagcgggccgaggttggatcatgg

SEQ ID NO: 347906 - DNA, 25 bp, Mus musculus
taagcgtagaagccgaactcccgtc

SEQ ID NO: 347907 - DNA, 25 bp, Mus musculus
taagctaaaagaattgggatatgac

SEQ ID NO: 347908 - DNA, 25 bp, Mus musculus
taagctaaaagcatggctgctcgct

SEQ ID NO: 347909 - DNA, 25 bp, Mus musculus
taagctacggtctctgctgcgctac

SEQ ID NO: 347910 - DNA, 25 bp, Mus musculus
taagctattcccagctccaccagag

SEQ ID NO: 347911 - DNA, 25 bp, Mus musculus
taagctcaggaggcctcctgatgac

SEQ ID NO: 347912 - DNA, 25 bp, Mus musculus
taagctcttacaggcaccaacagag

SEQ ID NO: 347913 - DNA, 25 bp, Mus musculus
taagctgcagagaagctagaaactc

SEQ ID NO: 347914 - DNA, 25 bp, Mus musculus
taagctgccgggcatgtctaggcca

SEQ ID NO: 347915 - DNA, 25 bp, Mus musculus
taagctgtactacgtaaccaccaaa

SEQ ID NO: 347916 - DNA, 25 bp, Mus musculus
taagcttacaggagtgccaggaggt

SEQ ID NO: 347917 - DNA, 25 bp, Mus musculus
taagcttccagagcagaacatcatg

SEQ ID NO: 347918 - DNA, 25 bp, Mus musculus
taagcttcctggtgcaaatagtcta

SEQ ID NO: 347919 - DNA, 25 bp, Mus musculus
taagcttcgtggctggcggactatt

SEQ ID NO: 347920 - DNA, 25 bp, Mus musculus
taagcttcgtggctggtttgactca

SEQ ID NO: 347921 - DNA, 25 bp, Mus musculus
taagcttgagtgtgcgcgggtcact

SEQ ID NO: 347922 - DNA, 25 bp, Mus musculus
taagcttgctgagactctccgctgg

SEQ ID NO: 347923 - DNA, 25 bp, Mus musculus
taagcttgctgagggtttcccagtg

SEQ ID NO: 347924 - DNA, 25 bp, Mus musculus
taagcttggtatttggaatgcagaa

SEQ ID NO: 347925 - DNA, 25 bp, Mus musculus
taaggaaaaccaagggctcaccttg

SEQ ID NO: 347926 - DNA, 25 bp, Mus musculus
taaggaaaaggggctgtctacagaa

SEQ ID NO: 347927 - DNA, 25 bp, Mus musculus
taaggaaacacagatacctctgaaa

SEQ ID NO: 347928 - DNA, 25 bp, Mus musculus
taaggaaagcagcccatacccagcc

SEQ ID NO: 347929 - DNA, 25 bp, Mus musculus
taaggaaatacagatgctggcccgt

SEQ ID NO: 347930 - DNA, 25 bp, Mus musculus
taaggaacaagactgggatcagatc

SEQ ID NO: 347931 - DNA, 25 bp, Mus musculus
taaggaacaggacggacggaatgac

SEQ ID NO: 347932 - DNA, 25 bp, Mus musculus
taaggaacaggctttcatgctgctc

SEQ ID NO: 347933 - DNA, 25 bp, Mus musculus
taaggaacaggtgtggtatcagtac

SEQ ID NO: 347934 - DNA, 25 bp, Mus musculus
taaggaacagtcagagctaagacat

SEQ ID NO: 347935 - DNA, 25 bp, Mus musculus
taaggaacatggggcagcaggagca

SEQ ID NO: 347936 - DNA, 25 bp, Mus musculus
taaggaacatgggtgtagtgatttt

SEQ ID NO: 347937 - DNA, 25 bp, Mus musculus
taaggaactctttgggcctgcctta

SEQ ID NO: 347938 - DNA, 25 bp, Mus musculus
taaggaactgaaggagtctttgtct

SEQ ID NO: 347939 - DNA, 25 bp, Mus musculus
taaggaatgggtattggcttgcttg

SEQ ID NO: 347940 - DNA, 25 bp, Mus musculus
taaggacaaagcagaaaatggatcg

SEQ ID NO: 347941 - DNA, 25 bp, Mus musculus
taaggacaaagcagacgttgattcc

SEQ ID NO: 347942 - DNA, 25 bp, Mus musculus
taaggacaagggagttgtatttgta

SEQ ID NO: 347943 - DNA, 25 bp, Mus musculus
taaggacaaggtagactgggtacag

SEQ ID NO: 347944 - DNA, 25 bp, Mus musculus
taaggacaataaaaggaaagacaaa

SEQ ID NO: 347945 - DNA, 25 bp, Mus musculus
taaggacattagattgatcagggac

SEQ ID NO: 347946 - DNA, 25 bp, Mus musculus
taaggacattgagacagaaagacat

SEQ ID NO: 347947 - DNA, 25 bp, Mus musculus
taaggaccaggatacaaattggaag

SEQ ID NO: 347948 - DNA, 25 bp, Mus musculus
taaggaccctcaggcattatgagag

SEQ ID NO: 347949 - DNA, 25 bp, Mus musculus
taaggagaaggatggcctcaggcaa

SEQ ID NO: 347950 - DNA, 25 bp, Mus musculus
taaggagacaagaccccagcgcatc

SEQ ID NO: 347951 - DNA, 25 bp, Mus musculus
taaggagagagctttccctcctcca

SEQ ID NO: 347952 - DNA, 25 bp, Mus musculus
taaggagagaggagcaagtgtcgtt

SEQ ID NO: 347953 - DNA, 25 bp, Mus musculus
taaggagagaggcagatgtgagccc

SEQ ID NO: 347954 - DNA, 25 bp, Mus musculus
taaggagagcaaggctctgtacaac

SEQ ID NO: 347955 - DNA, 25 bp, Mus musculus
taaggagagctaacatttagaggag

SEQ ID NO: 347956 - DNA, 25 bp, Mus musculus
taaggagagctcacattcaggggtt

SEQ ID NO: 347957 - DNA, 25 bp, Mus musculus
taaggagcagaatgagaagactttg

SEQ ID NO: 347958 - DNA, 25 bp, Mus musculus
taaggagccgagtgcagttcctcca

SEQ ID NO: 347959 - DNA, 25 bp, Mus musculus
taaggagccttagctgccagcggca

SEQ ID NO: 347960 - DNA, 25 bp, Mus musculus
taaggagccttgccctgtgtgtcaa

SEQ ID NO: 347961 - DNA, 25 bp, Mus musculus
taaggaggaaaatgggatggagaca

SEQ ID NO: 347962 - DNA, 25 bp, Mus musculus
taaggaggaaaatggtgaggaggtt

SEQ ID NO: 347963 - DNA, 25 bp, Mus musculus
taaggaggagaacatttcagagtaa

SEQ ID NO: 347964 - DNA, 25 bp, Mus musculus
taaggaggagtacatttcagagtaa

SEQ ID NO: 347965 - DNA, 25 bp, Mus musculus
taaggagggcctggtttctcacttg

SEQ ID NO: 347966 - DNA, 25 bp, Mus musculus
taaggagtgaggagtcaccactact

SEQ ID NO: 347967 - DNA, 25 bp, Mus musculus
taaggatatcgatggccgccctgtc

SEQ ID NO: 347968 - DNA, 25 bp, Mus musculus
taaggatattagggtctctgctact

SEQ ID NO: 347969 - DNA, 25 bp, Mus musculus
taaggatattcctaggaccttctac

SEQ ID NO: 347970 - DNA, 25 bp, Mus musculus
taaggatccagcgtctgttgacatt

SEQ ID NO: 347971 - DNA, 25 bp, Mus musculus
taaggatccaggaccacaagccagc

SEQ ID NO: 347972 - DNA, 25 bp, Mus musculus
taaggatccagggctcactgatcac

SEQ ID NO: 347973 - DNA, 25 bp, Mus musculus
taaggatccggatggagcttttaag

SEQ ID NO: 347974 - DNA, 25 bp, Mus musculus
taaggatccggatgggtatagtgcc

SEQ ID NO: 347975 - DNA, 25 bp, Mus musculus
taaggatcctgaccccgaacttctc

SEQ ID NO: 347976 - DNA, 25 bp, Mus musculus
taaggatgatgggccagatcatctg

SEQ ID NO: 347977 - DNA, 25 bp, Mus musculus
taaggatggaaagaaagatctgatg

SEQ ID NO: 347978 - DNA, 25 bp, Mus musculus
taaggatggaaagagcttaacaaaa

SEQ ID NO: 347979 - DNA, 25 bp, Mus musculus
taaggatggagatcccccaggtcca

SEQ ID NO: 347980 - DNA, 25 bp, Mus musculus
taaggatgtggtccttctggcttct

SEQ ID NO: 347981 - DNA, 25 bp, Mus musculus
taaggattcaggctaaaaccgactc

SEQ ID NO: 347982 - DNA, 25 bp, Mus musculus
taaggattgtcccgaaagggtctcc

SEQ ID NO: 347983 - DNA, 25 bp, Mus musculus
taaggattgtcccgatgtgaaacat

SEQ ID NO: 347984 - DNA, 25 bp, Mus musculus
taaggatttcctgattccacgagga

SEQ ID NO: 347985 - DNA, 25 bp, Mus musculus
taaggcaaagattattggatttggt

SEQ ID NO: 347986 - DNA, 25 bp, Mus musculus
taaggcaaccagagtaccagtgatg

SEQ ID NO: 347987 - DNA, 25 bp, Mus musculus
taaggcaagacagattacaaaagaa

SEQ ID NO: 347988 - DNA, 25 bp, Mus musculus
taaggcaatcgtgaagtcctaccta

SEQ ID NO: 347989 - DNA, 25 bp, Mus musculus
taaggcactgaagggccacacatgg

SEQ ID NO: 347990 - DNA, 25 bp, Mus musculus
taaggcagagcaggttatttcgctt

SEQ ID NO: 347991 - DNA, 25 bp, Mus musculus
taaggccaaaaatgtcagcagctat

SEQ ID NO: 347992 - DNA, 25 bp, Mus musculus
taaggccaagcttctggggtttggc

SEQ ID NO: 347993 - DNA, 25 bp, Mus musculus
taaggccaaggtttcctttgccaag

SEQ ID NO: 347994 - DNA, 25 bp, Mus musculus
taaggccacatgttttatggctata

SEQ ID NO: 347995 - DNA, 25 bp, Mus musculus
taaggcccagggctgtaccatggct

SEQ ID NO: 347996 - DNA, 25 bp, Mus musculus
taaggcccaggtccctatttgttca

SEQ ID NO: 347997 - DNA, 25 bp, Mus musculus
taaggccggaaggtagcgatggtgg

SEQ ID NO: 347998 - DNA, 25 bp, Mus musculus
taaggcgagggattttaggtgatgg

SEQ ID NO: 347999 - DNA, 25 bp, Mus musculus
taaggcgcagaaggatcgccacgac

SEQ ID NO: 348000 - DNA, 25 bp, Mus musculus
taaggcggcaggaccctgagccgta

SEQ ID NO: 348001 - DNA, 25 bp, Mus musculus
taaggctcagagagtctgcaggaga

SEQ ID NO: 348002 - DNA, 25 bp, Mus musculus
taaggctggccagtgggttgatttc

SEQ ID NO: 348003 - DNA, 25 bp, Mus musculus
taaggctggctcagagttctcagta

SEQ ID NO: 348004 - DNA, 25 bp, Mus musculus
taagggaacacgaggttccgagtcc

SEQ ID NO: 348005 - DNA, 25 bp, Mus musculus
taagggaagagatggctacatggga

SEQ ID NO: 348006 - DNA, 25 bp, Mus musculus
taagggaagagatgggtattgcttt

SEQ ID NO: 348007 - DNA, 25 bp, Mus musculus
taagggaaggaaccaagtggttgtt

SEQ ID NO: 348008 - DNA, 25 bp, Mus musculus
taagggaaggtaaagatacacctat

SEQ ID NO: 348009 - DNA, 25 bp, Mus musculus
taagggacagatggctatgaacggc

SEQ ID NO: 348010 - DNA, 25 bp, Mus musculus
taagggacagcaaggagtccgtgga

SEQ ID NO: 348011 - DNA, 25 bp, Mus musculus
taagggacagggggctgaaagaggg

SEQ ID NO: 348012 - DNA, 25 bp, Mus musculus
taagggatgcttcagatacgggaag

SEQ ID NO: 348013 - DNA, 25 bp, Mus musculus
taagggcacacctagtcaggtgagg

SEQ ID NO: 348014 - DNA, 25 bp, Mus musculus
taagggcgagaagggagatcctggt

SEQ ID NO: 348015 - DNA, 25 bp, Mus musculus
taagggcgagatgagcaaccctggg

SEQ ID NO: 348016 - DNA, 25 bp, Mus musculus
taagggctactccaggaggcaccat

SEQ ID NO: 348017 - DNA, 25 bp, Mus musculus
taagggctgagaggcaggaaatgtt

SEQ ID NO: 348018 - DNA, 25 bp, Mus musculus
taaggggagagctcctgctttctga

SEQ ID NO: 348019 - DNA, 25 bp, Mus musculus
taaggggagaggaagctttgtctcc

SEQ ID NO: 348020 - DNA, 25 bp, Mus musculus
taagggggcagccttgcagcagaat

SEQ ID NO: 348021 - DNA, 25 bp, Mus musculus
taagggggcagctttgtcgaaacac

SEQ ID NO: 348022 - DNA, 25 bp, Mus musculus
taagggtagaccttctgtctagtga

SEQ ID NO: 348023 - DNA, 25 bp, Mus musculus
taagggtagaccttgtgtctagtga

SEQ ID NO: 348024 - DNA, 25 bp, Mus musculus
taagggtgaccgaggtggcatagga

SEQ ID NO: 348025 - DNA, 25 bp, Mus musculus
taaggtataaggcttgctcttcagc

SEQ ID NO: 348026 - DNA, 25 bp, Mus musculus
taaggtcaagcctgtgggccgaagc

SEQ ID NO: 348027 - DNA, 25 bp, Mus musculus
taaggtccaagaaggtgaatgaata

SEQ ID NO: 348028 - DNA, 25 bp, Mus musculus
taaggtcggacaagctctactccag

SEQ ID NO: 348029 - DNA, 25 bp, Mus musculus
taaggtcggacaaggaaacacagag

SEQ ID NO: 348030 - DNA, 25 bp, Mus musculus
taaggtggctctcagccaccacctt

SEQ ID NO: 348031 - DNA, 25 bp, Mus musculus
taaggtggttcctttggggagatac

SEQ ID NO: 348032 - DNA, 25 bp, Mus musculus
taaggttcccaggatcaccgacaac

SEQ ID NO: 348033 - DNA, 25 bp, Mus musculus
taagtaaccaaatgagtaagaaagc

SEQ ID NO: 348034 - DNA, 25 bp, Mus musculus
taagtaaccaacacagatccagtcc

SEQ ID NO: 348035 - DNA, 25 bp, Mus musculus
taagtaacttgataacaaagttgtt

SEQ ID NO: 348036 - DNA, 25 bp, Mus musculus
taagtaataaaatagagaatcatca

SEQ ID NO: 348037 - DNA, 25 bp, Mus musculus
taagtacacaaatgatgacttctgg

SEQ ID NO: 348038 - DNA, 25 bp, Mus musculus
taagtacagaagatctaaagcggga

SEQ ID NO: 348039 - DNA, 25 bp, Mus musculus
taagtacatggcgcagcagcagttt

SEQ ID NO: 348040 - DNA, 25 bp, Mus musculus
taagtaccagctgctggacggagag

SEQ ID NO: 348041 - DNA, 25 bp, Mus musculus
taagtaccaggctggtaagaacagt

SEQ ID NO: 348042 - DNA, 25 bp, Mus musculus
taagtaccaggtgctggacggagag

SEQ ID NO: 348043 - DNA, 25 bp, Mus musculus
taagtaccgagtgctgcttttgata

SEQ ID NO: 348044 - DNA, 25 bp, Mus musculus
taagtacctagaagatcttggtaat

SEQ ID NO: 348045 - DNA, 25 bp, Mus musculus
taagtactacaaggacatcaatgca

SEQ ID NO: 348046 - DNA, 25 bp, Mus musculus
taagtactagaaaagttcctgtgga

SEQ ID NO: 348047 - DNA, 25 bp, Mus musculus
taagtactgacaaggggtgtgattt

SEQ ID NO: 348048 - DNA, 25 bp, Mus musculus
taagtacttgaagcatgcctcatgg

SEQ ID NO: 348049 - DNA, 25 bp, Mus musculus
taagtactttggcagcccgggccaa

SEQ ID NO: 348050 - DNA, 25 bp, Mus musculus
taagtagaagaactatactatgcag

SEQ ID NO: 348051 - DNA, 25 bp, Mus musculus
taagtagtgagtctattgagaacct

SEQ ID NO: 348052 - DNA, 25 bp, Mus musculus
taagtatttgatgctggagaagcgc

SEQ ID NO: 348053 - DNA, 25 bp, Mus musculus
taagtatttggctcagtgtttagag

SEQ ID NO: 348054 - DNA, 25 bp, Mus musculus
taagtcagaactgagtacacaaaca

SEQ ID NO: 348055 - DNA, 25 bp, Mus musculus
taagtcaggaggatcgcaagtccta

SEQ ID NO: 348056 - DNA, 25 bp, Mus musculus
taagtccagatctgatgaacacaat

SEQ ID NO: 348057 - DNA, 25 bp, Mus musculus
taagtcccgatcaagatcaacaacc

SEQ ID NO: 348058 - DNA, 25 bp, Mus musculus
taagtccctcttagagtttcaagaa

SEQ ID NO: 348059 - DNA, 25 bp, Mus musculus
taagtcctcagccagcaaacaggcc

SEQ ID NO: 348060 - DNA, 25 bp, Mus musculus
taagtcctgacaagccgcccctcgg

SEQ ID NO: 348061 - DNA, 25 bp, Mus musculus
taagtcctgacacaagcgaccggga

SEQ ID NO: 348062 - DNA, 25 bp, Mus musculus
taagtcgaaagagttataccctgac

SEQ ID NO: 348063 - DNA, 25 bp, Mus musculus
taagtcgcaggtagaatggatgagt

SEQ ID NO: 348064 - DNA, 25 bp, Mus musculus
taagtcgcagtggtgcaggcagtgc

SEQ ID NO: 348065 - DNA, 25 bp, Mus musculus
taagtcgtattaggcttaactccgg

SEQ ID NO: 348066 - DNA, 25 bp, Mus musculus
taagtcgttgacaggaaagagtagg

SEQ ID NO: 348067 - DNA, 25 bp, Mus musculus
taagtctacccggcagttgggttct

SEQ ID NO: 348068 - DNA, 25 bp, Mus musculus
taagtctacccggtttattatatac

SEQ ID NO: 348069 - DNA, 25 bp, Mus musculus
taagtctgacccccattgttcccac

SEQ ID NO: 348070 - DNA, 25 bp, Mus musculus
taagtgaagagagaagtttattgat

SEQ ID NO: 348071 - DNA, 25 bp, Mus musculus
taagtgaaggacagagggtacccgg

SEQ ID NO: 348072 - DNA, 25 bp, Mus musculus
taagtgacaagaaaatgacaagatt

SEQ ID NO: 348073 - DNA, 25 bp, Mus musculus
taagtgacaagaatatagaacgata

SEQ ID NO: 348074 - DNA, 25 bp, Mus musculus
taagtgacctaacaggtgtgaaaga

SEQ ID NO: 348075 - DNA, 25 bp, Mus musculus
taagtgaggacaggcttttgattgc

SEQ ID NO: 348076 - DNA, 25 bp, Mus musculus
taagtgattctgcaaaaaatacttt

SEQ ID NO: 348077 - DNA, 25 bp, Mus musculus
taagtgcaaagaatggctacatctt

SEQ ID NO: 348078 - DNA, 25 bp, Mus musculus
taagtgcaaagagagacaggaatcc

SEQ ID NO: 348079 - DNA, 25 bp, Mus musculus
taagtgcaacacaagatttccaccc

SEQ ID NO: 348080 - DNA, 25 bp, Mus musculus
taagtgcaacacaaggctgtgtctc

SEQ ID NO: 348081 - DNA, 25 bp, Mus musculus
taagtgcaagatatgaaattgttga

SEQ ID NO: 348082 - DNA, 25 bp, Mus musculus
taagtgcacttagcatgatgacttg

SEQ ID NO: 348083 - DNA, 25 bp, Mus musculus
taagtgctcaccaagagctttgtaa

SEQ ID NO: 348084 - DNA, 25 bp, Mus musculus
taagtggttctagctttaaggacca

SEQ ID NO: 348085 - DNA, 25 bp, Mus musculus
taagtggttctaggagctcagactg

SEQ ID NO: 348086 - DNA, 25 bp, Mus musculus
taagtgtgagatcgagtgcttcagg

SEQ ID NO: 348087 - DNA, 25 bp, Mus musculus
taagtgttgaccctgcagaaaactt

SEQ ID NO: 348088 - DNA, 25 bp, Mus musculus
taagttaatatcaaggtactgtctg

SEQ ID NO: 348089 - DNA, 25 bp, Mus musculus
taagttaccatgcctgtctcctccc

SEQ ID NO: 348090 - DNA, 25 bp, Mus musculus
taagttatggttatcaccattcctc

SEQ ID NO: 348091 - DNA, 25 bp, Mus musculus
taagttcaaacaggcagctgagaca

SEQ ID NO: 348092 - DNA, 25 bp, Mus musculus
taagttcaaacagtcgagagctatg

SEQ ID NO: 348093 - DNA, 25 bp, Mus musculus
taagttccaacagactggattttgg

SEQ ID NO: 348094 - DNA, 25 bp, Mus musculus
taagttccaacagtctgatgatttg

SEQ ID NO: 348095 - DNA, 25 bp, Mus musculus
taagttccagtggtaactcataaat

SEQ ID NO: 348096 - DNA, 25 bp, Mus musculus
taagttcccagcttcttctgtgtgg

SEQ ID NO: 348097 - DNA, 25 bp, Mus musculus
taagttgtgtgccaccatttgaaag

SEQ ID NO: 348098 - DNA, 25 bp, Mus musculus
taagttgtgtgccattgctgctgat

SEQ ID NO: 348099 - DNA, 25 bp, Mus musculus
taagtttatgaattcctcagagaga

SEQ ID NO: 348100 - DNA, 25 bp, Mus musculus
taagtttatggctgcagttccggct

SEQ ID NO: 348101 - DNA, 25 bp, Mus musculus
taagtttatgtgctctatgcccagg

SEQ ID NO: 348102 - DNA, 25 bp, Mus musculus
taagtttccagcaagttctggatga

SEQ ID NO: 348103 - DNA, 25 bp, Mus musculus
taagtttgaggtattctgctatgcc

SEQ ID NO: 348104 - DNA, 25 bp, Mus musculus
taagtttgcagcttggatgctcaac

SEQ ID NO: 348105 - DNA, 25 bp, Mus musculus
taagtttttcagaatttcttaatgt

SEQ ID NO: 348106 - DNA, 25 bp, Mus musculus
taataaaaacagaacagttgaatag

SEQ ID NO: 348107 - DNA, 25 bp, Mus musculus
taataaaaagaagctgaagtcattt

SEQ ID NO: 348108 - DNA, 25 bp, Mus musculus
taataaaaagacctcacagtggatg

SEQ ID NO: 348109 - DNA, 25 bp, Mus musculus
taataaaaagatgccagcagagggg

SEQ ID NO: 348110 - DNA, 25 bp, Mus musculus
taataaaaagtgctctatgcccagg

SEQ ID NO: 348111 - DNA, 25 bp, Mus musculus
taataaaatagagaatcatcattca

SEQ ID NO: 348112 - DNA, 25 bp, Mus musculus
taataaacaaatttctttcaactgg

SEQ ID NO: 348113 - DNA, 25 bp, Mus musculus
taataaagaagatatgcacctattt

SEQ ID NO: 348114 - DNA, 25 bp, Mus musculus
taataaagaagattagttgaagaac

SEQ ID NO: 348115 - DNA, 25 bp, Mus musculus
taataaatattgggaggactcagga

SEQ ID NO: 348116 - DNA, 25 bp, Mus musculus
taataacaaaaactgaacgaacaca

SEQ ID NO: 348117 - DNA, 25 bp, Mus musculus
taataacagaagaaattaaagagac

SEQ ID NO: 348118 - DNA, 25 bp, Mus musculus
taataacatccatccttcatgattg

SEQ ID NO: 348119 - DNA, 25 bp, Mus musculus
taataacccaggtagtataactcca

SEQ ID NO: 348120 - DNA, 25 bp, Mus musculus
taataacccagtgggtaagctgaag

SEQ ID NO: 348121 - DNA, 25 bp, Mus musculus
taataacctcaagtgactgtggtct

SEQ ID NO: 348122 - DNA, 25 bp, Mus musculus
taataacgtaacgcccggccacaca

SEQ ID NO: 348123 - DNA, 25 bp, Mus musculus
taataagatgcactccatgaatggg

SEQ ID NO: 348124 - DNA, 25 bp, Mus musculus
taataagtgcgtgaagactctacag

SEQ ID NO: 348125 - DNA, 25 bp, Mus musculus
taataatatgatgaggggttgccac

SEQ ID NO: 348126 - DNA, 25 bp, Mus musculus
taataattgcaaagataactgggaa

SEQ ID NO: 348127 - DNA, 25 bp, Mus musculus
taataattgcaaaggaaggaaggtc

SEQ ID NO: 348128 - DNA, 25 bp, Mus musculus
taatacagatactgggagtcctttg

SEQ ID NO: 348129 - DNA, 25 bp, Mus musculus
taatacagatacttgtggcaatatg

SEQ ID NO: 348130 - DNA, 25 bp, Mus musculus
taataccatccggttatgggatatt

SEQ ID NO: 348131 - DNA, 25 bp, Mus musculus
taatactagaagatacatcactaaa

SEQ ID NO: 348132 - DNA, 25 bp, Mus musculus
taatactctttaaggaagattactt

SEQ ID NO: 348133 - DNA, 25 bp, Mus musculus
taatactgcttaagtatttttctga

SEQ ID NO: 348134 - DNA, 25 bp, Mus musculus
taatagaagatattaaacgacacaa

SEQ ID NO: 348135 - DNA, 25 bp, Mus musculus
taatagaagatattttttgagaaat

SEQ ID NO: 348136 - DNA, 25 bp, Mus musculus
taatagcagagggctaccgtgtgat

SEQ ID NO: 348137 - DNA, 25 bp, Mus musculus
taatagccagaacaaatataaagcc

SEQ ID NO: 348138 - DNA, 25 bp, Mus musculus
taatagctctcaggtcaactcctgg

SEQ ID NO: 348139 - DNA, 25 bp, Mus musculus
taatagctgccactgaagctggggg

SEQ ID NO: 348140 - DNA, 25 bp, Mus musculus
taatagctgccactgacaaagcaat

SEQ ID NO: 348141 - DNA, 25 bp, Mus musculus
taataggagacaggtggcgacagac

SEQ ID NO: 348142 - DNA, 25 bp, Mus musculus
taataggagacagtcagtggatacg

SEQ ID NO: 348143 - DNA, 25 bp, Mus musculus
taataggatcgagatcccgctcaag

SEQ ID NO: 348144 - DNA, 25 bp, Mus musculus
taatagtcttttacccagtagagat

SEQ ID NO: 348145 - DNA, 25 bp, Mus musculus
taatagtgaagcagagccatgaaga

SEQ ID NO: 348146 - DNA, 25 bp, Mus musculus
taatagtgaggtagaggaggcttcc

SEQ ID NO: 348147 - DNA, 25 bp, Mus musculus
taatagtgtccatgtcaatatacag

SEQ ID NO: 348148 - DNA, 25 bp, Mus musculus
taatataaacaacttccattcgaac

SEQ ID NO: 348149 - DNA, 25 bp, Mus musculus
taatataccaagtgtcctggttgcc

SEQ ID NO: 348150 - DNA, 25 bp, Mus musculus
taatataccaatgtctcttggacct

SEQ ID NO: 348151 - DNA, 25 bp, Mus musculus
taatatcaaggtactgtctgatgag

SEQ ID NO: 348152 - DNA, 25 bp, Mus musculus
taatatcacagaacagcacttctta

SEQ ID NO: 348153 - DNA, 25 bp, Mus musculus
taatatcagaagtttcagtctggaa

SEQ ID NO: 348154 - DNA, 25 bp, Mus musculus
taatatcatccagttgctgcttcaa

SEQ ID NO: 348155 - DNA, 25 bp, Mus musculus
taatatcccaacggagtcctccttt

SEQ ID NO: 348156 - DNA, 25 bp, Mus musculus
taatatctcacccagacaggcttct

SEQ ID NO: 348157 - DNA, 25 bp, Mus musculus
taatatcttggctttcccccttgtc

SEQ ID NO: 348158 - DNA, 25 bp, Mus musculus
taatatctttgggagacgctctgtc

SEQ ID NO: 348159 - DNA, 25 bp, Mus musculus
taatatctttggtctgtccgaatct

SEQ ID NO: 348160 - DNA, 25 bp, Mus musculus
taatatgaaggaagtacttaagcag

SEQ ID NO: 348161 - DNA, 25 bp, Mus musculus
taatatgaatgtctcaggtgaaaag

SEQ ID NO: 348162 - DNA, 25 bp, Mus musculus
taatatgatgaggggttgccacatc

SEQ ID NO: 348163 - DNA, 25 bp, Mus musculus
taatatgcctaaagggtatgtgtat

SEQ ID NO: 348164 - DNA, 25 bp, Mus musculus
taatattaaagagtccttcactcgt

SEQ ID NO: 348165 - DNA, 25 bp, Mus musculus
taatattacgcaacatatgaaagta

SEQ ID NO: 348166 - DNA, 25 bp, Mus musculus
taatattcaaacaagttcaaagaag

SEQ ID NO: 348167 - DNA, 25 bp, Mus musculus
taatattcaagacgccttgggatgt

SEQ ID NO: 348168 - DNA, 25 bp, Mus musculus
taatatttctaatgcggcattccaa

SEQ ID NO: 348169 - DNA, 25 bp, Mus musculus
taatcaaacattatcagcagcgtcg

SEQ ID NO: 348170 - DNA, 25 bp, Mus musculus
taatcaaactacgaccccagcagcg

SEQ ID NO: 348171 - DNA, 25 bp, Mus musculus
taatcaaagagagaatccatggagc

SEQ ID NO: 348172 - DNA, 25 bp, Mus musculus
taatcaaagatcttgtttttagcca

SEQ ID NO: 348173 - DNA, 25 bp, Mus musculus
taatcaacagattcaaggcctcttc

SEQ ID NO: 348174 - DNA, 25 bp, Mus musculus
taatcaagagatcttctcggacctg

SEQ ID NO: 348175 - DNA, 25 bp, Mus musculus
taatcaagagatgttctcggacctg

SEQ ID NO: 348176 - DNA, 25 bp, Mus musculus
taatcacaaaaatataattggcctt

SEQ ID NO: 348177 - DNA, 25 bp, Mus musculus
taatcacactgaagtgatcccaaca

SEQ ID NO: 348178 - DNA, 25 bp, Mus musculus
taatcacatccgctgcgagcctgcg

SEQ ID NO: 348179 - DNA, 25 bp, Mus musculus
taatcaccaaggtcacgtgaaacta

SEQ ID NO: 348180 - DNA, 25 bp, Mus musculus
taatcaccccatcggtgtagcccgg

SEQ ID NO: 348181 - DNA, 25 bp, Mus musculus
taatcactaataaagaagtgtgctg

SEQ ID NO: 348182 - DNA, 25 bp, Mus musculus
taatcactgaaaaatgtagttccta

SEQ ID NO: 348183 - DNA, 25 bp, Mus musculus
taatcactgcttgcccaagtgtgcc

SEQ ID NO: 348184 - DNA, 25 bp, Mus musculus
taatcagaaagggtccccagaagca

SEQ ID NO: 348185 - DNA, 25 bp, Mus musculus
taatcagagagtgtcacgatgtctg

SEQ ID NO: 348186 - DNA, 25 bp, Mus musculus
taatcagagtacagaggtccctcgg

SEQ ID NO: 348187 - DNA, 25 bp, Mus musculus
taatcagcaaggagctagctgagcc

SEQ ID NO: 348188 - DNA, 25 bp, Mus musculus
taatcagcagaaggaagagcggtcg

SEQ ID NO: 348189 - DNA, 25 bp, Mus musculus
taatcagcagctgttctcatatgct

SEQ ID NO: 348190 - DNA, 25 bp, Mus musculus
taatcagtgagaccaagtaccgtaa

SEQ ID NO: 348191 - DNA, 25 bp, Mus musculus
taatcagtgagcaagtacaaatctg

SEQ ID NO: 348192 - DNA, 25 bp, Mus musculus
taatcagtgtaagctgctcttaacc

SEQ ID NO: 348193 - DNA, 25 bp, Mus musculus
taatcagttcaagtctgttatctcc

SEQ ID NO: 348194 - DNA, 25 bp, Mus musculus
taatcataacgctaacaggatgaga

SEQ ID NO: 348195 - DNA, 25 bp, Mus musculus
taatcataacgctaagtgtgatgaa

SEQ ID NO: 348196 - DNA, 25 bp, Mus musculus
taatcatcgtttaacaatggaacat

SEQ ID NO: 348197 - DNA, 25 bp, Mus musculus
taatcatcttcttcagggtgatgca

SEQ ID NO: 348198 - DNA, 25 bp, Mus musculus
taatcatgcaggaggatctgctgga

SEQ ID NO: 348199 - DNA, 25 bp, Mus musculus
taatcatgcagggtcccacctcctg

SEQ ID NO: 348200 - DNA, 25 bp, Mus musculus
taatcatgctcggatcaagcaaatc

SEQ ID NO: 348201 - DNA, 25 bp, Mus musculus
taatcatgctcggctatctgcacct

SEQ ID NO: 348202 - DNA, 25 bp, Mus musculus
taatcatgtcacagcgtctgttgac

SEQ ID NO: 348203 - DNA, 25 bp, Mus musculus
taatcatgtcacagggcagcaagtt

SEQ ID NO: 348204 - DNA, 25 bp, Mus musculus
taatcattataaatgctacaataaa

SEQ ID NO: 348205 - DNA, 25 bp, Mus musculus
taatcattattcgagcccccaagct

SEQ ID NO: 348206 - DNA, 25 bp, Mus musculus
taatcattattcgagctatcttcag

SEQ ID NO: 348207 - DNA, 25 bp, Mus musculus
taatcattcttgtgaatctcttggc

SEQ ID NO: 348208 - DNA, 25 bp, Mus musculus
taatcattctttctgagcagaagtg

SEQ ID NO: 348209 - DNA, 25 bp, Mus musculus
taatcattgacagattctttctaaa

SEQ ID NO: 348210 - DNA, 25 bp, Mus musculus
taatcattgacagtcctgatgcttc

SEQ ID NO: 348211 - DNA, 25 bp, Mus musculus
taatcattgagaatgaaaagaagca

SEQ ID NO: 348212 - DNA, 25 bp, Mus musculus
taatccacaacagtgagaggacttt

SEQ ID NO: 348213 - DNA, 25 bp, Mus musculus
taatccacagctacacacttgaatg

SEQ ID NO: 348214 - DNA, 25 bp, Mus musculus
taatccaccccaagaaaaagctccc

SEQ ID NO: 348215 - DNA, 25 bp, Mus musculus
taatccaggaagcatttgtcaaggc

SEQ ID NO: 348216 - DNA, 25 bp, Mus musculus
taatcccaatgacagttctgcccca

SEQ ID NO: 348217 - DNA, 25 bp, Mus musculus
taatcccacaggctctgttgtcatg

SEQ ID NO: 348218 - DNA, 25 bp, Mus musculus
taatcccttctcctgagctacatat

SEQ ID NO: 348219 - DNA, 25 bp, Mus musculus
taatccgggagctttctccagacca

SEQ ID NO: 348220 - DNA, 25 bp, Mus musculus
taatcctaaatctccacagttgacg

SEQ ID NO: 348221 - DNA, 25 bp, Mus musculus
taatcctagctggggatttgtatac

SEQ ID NO: 348222 - DNA, 25 bp, Mus musculus
taatcctccaatcactgttaagaat

SEQ ID NO: 348223 - DNA, 25 bp, Mus musculus
taatcctctgtgaaggtcacagtaa

SEQ ID NO: 348224 - DNA, 25 bp, Mus musculus
taatcctgaacaggatgctgccagc

SEQ ID NO: 348225 - DNA, 25 bp, Mus musculus
taatcctggaggtcctagaagaccc

SEQ ID NO: 348226 - DNA, 25 bp, Mus musculus
taatcctggagttagcagcccaagt

SEQ ID NO: 348227 - DNA, 25 bp, Mus musculus
taatcctgtggctgaccatatcagt

SEQ ID NO: 348228 - DNA, 25 bp, Mus musculus
taatcctgttttgatggaaggaccc

SEQ ID NO: 348229 - DNA, 25 bp, Mus musculus
taatccttgagcatgatgttgccat

SEQ ID NO: 348230 - DNA, 25 bp, Mus musculus
taatccttgagcatgcaccagccac

SEQ ID NO: 348231 - DNA, 25 bp, Mus musculus
taatcgaaggttggctgctgagcag

SEQ ID NO: 348232 - DNA, 25 bp, Mus musculus
taatcgatatctaatttttaagaca

SEQ ID NO: 348233 - DNA, 25 bp, Mus musculus
taatcgattgaggcccaaggggctg

SEQ ID NO: 348234 - DNA, 25 bp, Mus musculus
taatcgattggattttcaccttgta

SEQ ID NO: 348235 - DNA, 25 bp, Mus musculus
taatcgcaaaaacatcaaactgaag

SEQ ID NO: 348236 - DNA, 25 bp, Mus musculus
taatcgcaattggaaggatgcaggg

SEQ ID NO: 348237 - DNA, 25 bp, Mus musculus
taatcgtggcaaaaagtcagtccga

SEQ ID NO: 348238 - DNA, 25 bp, Mus musculus
taatctgaagaccatggagcaagtc

SEQ ID NO: 348239 - DNA, 25 bp, Mus musculus
taatctgaaggggagaaaactggtt

SEQ ID NO: 348240 - DNA, 25 bp, Mus musculus
taatctgaaggtgccctgggacaac

SEQ ID NO: 348241 - DNA, 25 bp, Mus musculus
taatctgtcacagaaagaaagactg

SEQ ID NO: 348242 - DNA, 25 bp, Mus musculus
taatctgtctaagaatctcctgtaa

SEQ ID NO: 348243 - DNA, 25 bp, Mus musculus
taatctgtgaagatgtccagctcgc

SEQ ID NO: 348244 - DNA, 25 bp, Mus musculus
taatcttaacagtgtcttggctgaa

SEQ ID NO: 348245 - DNA, 25 bp, Mus musculus
taatcttatgtcaaggcaccgagat

SEQ ID NO: 348246 - DNA, 25 bp, Mus musculus
taatcttcatcaagtcacagtaatg

SEQ ID NO: 348247 - DNA, 25 bp, Mus musculus
taatcttccttcctactagacgtga

SEQ ID NO: 348248 - DNA, 25 bp, Mus musculus
taatcttggctataaaaaatgccag

SEQ ID NO: 348249 - DNA, 25 bp, Mus musculus
taatcttggtggagaaactcttcat

SEQ ID NO: 348250 - DNA, 25 bp, Mus musculus
taatctttcaaggaccctgatttta

SEQ ID NO: 348251 - DNA, 25 bp, Mus musculus
taatctttcaaggtttgaccaaaag

SEQ ID NO: 348252 - DNA, 25 bp, Mus musculus
taatctttgaggcctgcagcatgct

SEQ ID NO: 348253 - DNA, 25 bp, Mus musculus
taatctttgagggaaccaatgagat

SEQ ID NO: 348254 - DNA, 25 bp, Mus musculus
taatgaaaagatctccaagagggtt

SEQ ID NO: 348255 - DNA, 25 bp, Mus musculus
taatgaaaaggtaatgtatgtggaa

SEQ ID NO: 348256 - DNA, 25 bp, Mus musculus
taatgaaaagtatttttctgaccta

SEQ ID NO: 348257 - DNA, 25 bp, Mus musculus
taatgaaaattattggattgcagtg

SEQ ID NO: 348258 - DNA, 25 bp, Mus musculus
taatgaaacccacagcactggtcag

SEQ ID NO: 348259 - DNA, 25 bp, Mus musculus
taatgaaagacagaaacaaactgtt

SEQ ID NO: 348260 - DNA, 25 bp, Mus musculus
taatgaaagacagggacatgaaacc

SEQ ID NO: 348261 - DNA, 25 bp, Mus musculus
taatgaaatggatataaccaagaac

SEQ ID NO: 348262 - DNA, 25 bp, Mus musculus
taatgaaatggggattggtgtgtgc

SEQ ID NO: 348263 - DNA, 25 bp, Mus musculus
taatgaactaaagcttgacaaaaaa

SEQ ID NO: 348264 - DNA, 25 bp, Mus musculus
taatgaaggaatggtcacgatctag

SEQ ID NO: 348265 - DNA, 25 bp, Mus musculus
taatgaaggacatagtttcaggcac

SEQ ID NO: 348266 - DNA, 25 bp, Mus musculus
taatgaaggttcatctctcccttct

SEQ ID NO: 348267 - DNA, 25 bp, Mus musculus
taatgaatggattggtatgtgtgca

SEQ ID NO: 348268 - DNA, 25 bp, Mus musculus
taatgaatgtcaagggaagttgaga

SEQ ID NO: 348269 - DNA, 25 bp, Mus musculus
taatgacaaattaaaagagatgttt

SEQ ID NO: 348270 - DNA, 25 bp, Mus musculus
taatgacagcataggtccctcactc

SEQ ID NO: 348271 - DNA, 25 bp, Mus musculus
taatgacatcaggacccgggtcggt

SEQ ID NO: 348272 - DNA, 25 bp, Mus musculus
taatgacatgtcaaggtcctgggtg

SEQ ID NO: 348273 - DNA, 25 bp, Mus musculus
taatgaccaagccttagggtcagca

SEQ ID NO: 348274 - DNA, 25 bp, Mus musculus
taatgacgctgaggttttatataac

SEQ ID NO: 348275 - DNA, 25 bp, Mus musculus
taatgacgctggtgaaatacaggac

SEQ ID NO: 348276 - DNA, 25 bp, Mus musculus
taatgactggttaggaaacctgcca

SEQ ID NO: 348277 - DNA, 25 bp, Mus musculus
taatgacttgggacaaaagaaagat

SEQ ID NO: 348278 - DNA, 25 bp, Mus musculus
taatgagaaatgttgtcagagaatt

SEQ ID NO: 348279 - DNA, 25 bp, Mus musculus
taatgagaagggagccttctgggga

SEQ ID NO: 348280 - DNA, 25 bp, Mus musculus
taatgagatcctcacattagctttt

SEQ ID NO: 348281 - DNA, 25 bp, Mus musculus
taatgagatggatcccccggatgtg

SEQ ID NO: 348282 - DNA, 25 bp, Mus musculus
taatgagcgactggtctgtgagttt

SEQ ID NO: 348283 - DNA, 25 bp, Mus musculus
taatgaggaaagactaatagacaag

SEQ ID NO: 348284 - DNA, 25 bp, Mus musculus
taatgaggaaggcttgttgtcatcc

SEQ ID NO: 348285 - DNA, 25 bp, Mus musculus
taatgaggccatgagagtcctcgtt

SEQ ID NO: 348286 - DNA, 25 bp, Mus musculus
taatgaggtcaagagtgggccatga

SEQ ID NO: 348287 - DNA, 25 bp, Mus musculus
taatgagtaagtggcttgcagcgtg

SEQ ID NO: 348288 - DNA, 25 bp, Mus musculus
taatgagtttgagatactaagcaac

SEQ ID NO: 348289 - DNA, 25 bp, Mus musculus
taatgatactgtcggccagtgaagc

SEQ ID NO: 348290 - DNA, 25 bp, Mus musculus
taatgatcaaagcgctgcaggggta

SEQ ID NO: 348291 - DNA, 25 bp, Mus musculus
taatgatcaacggttccagtttgtg

SEQ ID NO: 348292 - DNA, 25 bp, Mus musculus
taatgatccagattatatcagaatt

SEQ ID NO: 348293 - DNA, 25 bp, Mus musculus
taatgatccggaccttcgagaagtc

SEQ ID NO: 348294 - DNA, 25 bp, Mus musculus
taatgatgaagatgcagatagactg

SEQ ID NO: 348295 - DNA, 25 bp, Mus musculus
taatgatgatgcagggccctggcca

SEQ ID NO: 348296 - DNA, 25 bp, Mus musculus
taatgatgcctatcctggcccgccc

SEQ ID NO: 348297 - DNA, 25 bp, Mus musculus
taatgatgggaagaaacctgatcag

SEQ ID NO: 348298 - DNA, 25 bp, Mus musculus
taatgatgggaaggacaaaccagag

SEQ ID NO: 348299 - DNA, 25 bp, Mus musculus
taatgattcagagacctgcttctgg

SEQ ID NO: 348300 - DNA, 25 bp, Mus musculus
taatgattcagatatcctgttagat

SEQ ID NO: 348301 - DNA, 25 bp, Mus musculus
taatgattccgatggagggacggct

SEQ ID NO: 348302 - DNA, 25 bp, Mus musculus
taatgcaaaagactaacctaacatg

SEQ ID NO: 348303 - DNA, 25 bp, Mus musculus
taatgcaaacaagggcaccctggag

SEQ ID NO: 348304 - DNA, 25 bp, Mus musculus
taatgcaagagagatgctgaggatg

SEQ ID NO: 348305 - DNA, 25 bp, Mus musculus
taatgcactagcaggtatggcggct

SEQ ID NO: 348306 - DNA, 25 bp, Mus musculus
taatgcactagcagttgctcaaatg

SEQ ID NO: 348307 - DNA, 25 bp, Mus musculus
taatgcagagatccactgccagaag

SEQ ID NO: 348308 - DNA, 25 bp, Mus musculus
taatgcagaggggagtttgcccaat

SEQ ID NO: 348309 - DNA, 25 bp, Mus musculus
taatgcagctaaagatgaacatgaa

SEQ ID NO: 348310 - DNA, 25 bp, Mus musculus
taatgcagttctcgttgtgaaaatg

SEQ ID NO: 348311 - DNA, 25 bp, Mus musculus
taatgcatcatttgaacaatgccca

SEQ ID NO: 348312 - DNA, 25 bp, Mus musculus
taatgcatcatttgactgaggacca

SEQ ID NO: 348313 - DNA, 25 bp, Mus musculus
taatgcatctgagccttctaggaaa

SEQ ID NO: 348314 - DNA, 25 bp, Mus musculus
taatgccaacagcactatagttccc

SEQ ID NO: 348315 - DNA, 25 bp, Mus musculus
taatgccaatcccatcttcatgcgc

SEQ ID NO: 348316 - DNA, 25 bp, Mus musculus
taatgccactaaacctggacccttt

SEQ ID NO: 348317 - DNA, 25 bp, Mus musculus
taatgccactgaggagctcctagtt

SEQ ID NO: 348318 - DNA, 25 bp, Mus musculus
taatgccactgagtgaagcgtctgc

SEQ ID NO: 348319 - DNA, 25 bp, Mus musculus
taatgccagcacccgccgccgctcc

SEQ ID NO: 348320 - DNA, 25 bp, Mus musculus
taatgccatttagttcgctacaccc

SEQ ID NO: 348321 - DNA, 25 bp, Mus musculus
taatgccgtggctgctccagtttct

SEQ ID NO: 348322 - DNA, 25 bp, Mus musculus
taatgccgtggtgtggcttgaccta

SEQ ID NO: 348323 - DNA, 25 bp, Mus musculus
taatgccttgctgtgcttctacagg

SEQ ID NO: 348324 - DNA, 25 bp, Mus musculus
taatgccttgggcgctgggctgcat

SEQ ID NO: 348325 - DNA, 25 bp, Mus musculus
taatgcggttacgaagaagaggaaa

SEQ ID NO: 348326 - DNA, 25 bp, Mus musculus
taatgctacgcaggggaaatcctgg

SEQ ID NO: 348327 - DNA, 25 bp, Mus musculus
taatgctgacagctcctcatggact

SEQ ID NO: 348328 - DNA, 25 bp, Mus musculus
taatgctgacaggtcctcatggact

SEQ ID NO: 348329 - DNA, 25 bp, Mus musculus
taatgctgaggccgggataactggg

SEQ ID NO: 348330 - DNA, 25 bp, Mus musculus
taatgctgtaggcaccagacctgtt

SEQ ID NO: 348331 - DNA, 25 bp, Mus musculus
taatgcttatgaggaagaattcttt

SEQ ID NO: 348332 - DNA, 25 bp, Mus musculus
taatggaaaaagcaggtttctggac

SEQ ID NO: 348333 - DNA, 25 bp, Mus musculus
taatggaaaaaggtgttcgaatttg

SEQ ID NO: 348334 - DNA, 25 bp, Mus musculus
taatggaaaacacagtttggcttgt

SEQ ID NO: 348335 - DNA, 25 bp, Mus musculus
taatggaacagatggcagtgaaaat

SEQ ID NO: 348336 - DNA, 25 bp, Mus musculus
taatggaagccagaaataggaccaa

SEQ ID NO: 348337 - DNA, 25 bp, Mus musculus
taatggaatgggcattatatttagt

SEQ ID NO: 348338 - DNA, 25 bp, Mus musculus
taatggaatgggccttgcatttagt

SEQ ID NO: 348339 - DNA, 25 bp, Mus musculus
taatggacagaaagaatgtcactgc

SEQ ID NO: 348340 - DNA, 25 bp, Mus musculus
taatggaccagctagtggaaccctg

SEQ ID NO: 348341 - DNA, 25 bp, Mus musculus
taatggacccacatgaaaaatgtgt

SEQ ID NO: 348342 - DNA, 25 bp, Mus musculus
taatggacgggcattttgttcccaa

SEQ ID NO: 348343 - DNA, 25 bp, Mus musculus
taatggactaaacctctgaaactgt

SEQ ID NO: 348344 - DNA, 25 bp, Mus musculus
taatggagatggttctgccgatctt

SEQ ID NO: 348345 - DNA, 25 bp, Mus musculus
taatggagcaaggtgtccatgttgg

SEQ ID NO: 348346 - DNA, 25 bp, Mus musculus
taatggaggccaggaaaacggcaac

SEQ ID NO: 348347 - DNA, 25 bp, Mus musculus
taatggaggccaggctgtaattcaa

SEQ ID NO: 348348 - DNA, 25 bp, Mus musculus
taatggaggccaggtgacataccgc

SEQ ID NO: 348349 - DNA, 25 bp, Mus musculus
taatggaggtgcccctgtgctcaag

SEQ ID NO: 348350 - DNA, 25 bp, Mus musculus
taatggatgcaggggtcccaatttc

SEQ ID NO: 348351 - DNA, 25 bp, Mus musculus
taatggatgcaggtgtagcagtggg

SEQ ID NO: 348352 - DNA, 25 bp, Mus musculus
taatggcaaagggagttttgtgctg

SEQ ID NO: 348353 - DNA, 25 bp, Mus musculus
taatggcacaagaacaagtaagaag

SEQ ID NO: 348354 - DNA, 25 bp, Mus musculus
taatggcacagacgcagcctccttt

SEQ ID NO: 348355 - DNA, 25 bp, Mus musculus
taatggcagtggtcctacggctctg

SEQ ID NO: 348356 - DNA, 25 bp, Mus musculus
taatggcctcggtcactttcacgaa

SEQ ID NO: 348357 - DNA, 25 bp, Mus musculus
taatggcggagaggtattagaagat

SEQ ID NO: 348358 - DNA, 25 bp, Mus musculus
taatggcggagaggtgttctctgag

SEQ ID NO: 348359 - DNA, 25 bp, Mus musculus
taatggcggggaagctcagtttaag

SEQ ID NO: 348360 - DNA, 25 bp, Mus musculus
taatggctcagctttcaacatttcc

SEQ ID NO: 348361 - DNA, 25 bp, Mus musculus
taatgggaagagtacatctcggatt

SEQ ID NO: 348362 - DNA, 25 bp, Mus musculus
taatgggcatcacagtcagtacagg

SEQ ID NO: 348363 - DNA, 25 bp, Mus musculus
taatggggcccaaattcattggtgc

SEQ ID NO: 348364 - DNA, 25 bp, Mus musculus
taatgggtctggttctccacatgac

SEQ ID NO: 348365 - DNA, 25 bp, Mus musculus
taatgggttatattatgggcaaagc

SEQ ID NO: 348366 - DNA, 25 bp, Mus musculus
taatggtccatctctacaacatctt

SEQ ID NO: 348367 - DNA, 25 bp, Mus musculus
taatggtccattacccaggcaagac

SEQ ID NO: 348368 - DNA, 25 bp, Mus musculus
taatggtgatggtcttctccatcgt

SEQ ID NO: 348369 - DNA, 25 bp, Mus musculus
taatggtggagttggccaaacagtg

SEQ ID NO: 348370 - DNA, 25 bp, Mus musculus
taatgtaaacctgaactatgacaat

SEQ ID NO: 348371 - DNA, 25 bp, Mus musculus
taatgtaaacctgttgccaagaact

SEQ ID NO: 348372 - DNA, 25 bp, Mus musculus
taatgtaaaggggctctttcctgca

SEQ ID NO: 348373 - DNA, 25 bp, Mus musculus
taatgtaagaatgtctacaagcagg

SEQ ID NO: 348374 - DNA, 25 bp, Mus musculus
taatgtaatctgggtgttgacgatg

SEQ ID NO: 348375 - DNA, 25 bp, Mus musculus
taatgtaccagctcaaacaggccga

SEQ ID NO: 348376 - DNA, 25 bp, Mus musculus
taatgtaccagtgtatctctatggt

SEQ ID NO: 348377 - DNA, 25 bp, Mus musculus
taatgtagaaaagattaatggggaa

SEQ ID NO: 348378 - DNA, 25 bp, Mus musculus
taatgtagaaagattaatggggaat

SEQ ID NO: 348379 - DNA, 25 bp, Mus musculus
taatgtagaacagattagtgggtat

SEQ ID NO: 348380 - DNA, 25 bp, Mus musculus
taatgtagatgaaactgaaggctca

SEQ ID NO: 348381 - DNA, 25 bp, Mus musculus
taatgtagatgaggaagcaagggaa

SEQ ID NO: 348382 - DNA, 25 bp, Mus musculus
taatgtatcggaggacaccaaagtg

SEQ ID NO: 348383 - DNA, 25 bp, Mus musculus
taatgtcaacagaccgctccggcct

SEQ ID NO: 348384 - DNA, 25 bp, Mus musculus
taatgtcatggaattggggaattcc

SEQ ID NO: 348385 - DNA, 25 bp, Mus musculus
taatgtccaagccatgtacatagtt

SEQ ID NO: 348386 - DNA, 25 bp, Mus musculus
taatgtctatggcagtcctgacttc

SEQ ID NO: 348387 - DNA, 25 bp, Mus musculus
taatgtcttccaggccaagttcctt

SEQ ID NO: 348388 - DNA, 25 bp, Mus musculus
taatgtgaaagactaggccaatccc

SEQ ID NO: 348389 - DNA, 25 bp, Mus musculus
taatgtgaagctgcagcctgtcaac

SEQ ID NO: 348390 - DNA, 25 bp, Mus musculus
taatgtgaaggcaaagcccatggtc

SEQ ID NO: 348391 - DNA, 25 bp, Mus musculus
taatgtggcagatatcattaatgga

SEQ ID NO: 348392 - DNA, 25 bp, Mus musculus
taatgtgtgagcaaagaagatagag

SEQ ID NO: 348393 - DNA, 25 bp, Mus musculus
taatgtgtgagcaacttggcatcag

SEQ ID NO: 348394 - DNA, 25 bp, Mus musculus
taatgtgtgccaagatattgatgag

SEQ ID NO: 348395 - DNA, 25 bp, Mus musculus
taatgttagagagaatggactgctg

SEQ ID NO: 348396 - DNA, 25 bp, Mus musculus
taatgttcattttactgtgtggaga

SEQ ID NO: 348397 - DNA, 25 bp, Mus musculus
taatgttgaaggaagccaaaaacgg

SEQ ID NO: 348398 - DNA, 25 bp, Mus musculus
taatgttgcaattacccacggtctg

SEQ ID NO: 348399 - DNA, 25 bp, Mus musculus
taatgttgcaattacgtttctactg

SEQ ID NO: 348400 - DNA, 25 bp, Mus musculus
taatgttggaggacctggataaggc

SEQ ID NO: 348401 - DNA, 25 bp, Mus musculus
taatgttggaggatttagacaagag

SEQ ID NO: 348402 - DNA, 25 bp, Mus musculus
taatgttttaagttcctgaatgcca

SEQ ID NO: 348403 - DNA, 25 bp, Mus musculus
taattaaaaagtttgcatttcctcc

SEQ ID NO: 348404 - DNA, 25 bp, Mus musculus
taattaaaattcagcctttagaaag

SEQ ID NO: 348405 - DNA, 25 bp, Mus musculus
taattaaaattcaggctgtagctgt

SEQ ID NO: 348406 - DNA, 25 bp, Mus musculus
taattaaagtgaagacgctgactgg

SEQ ID NO: 348407 - DNA, 25 bp, Mus musculus
taattaaagtgaagtccaccacaga

SEQ ID NO: 348408 - DNA, 25 bp, Mus musculus
taattaccaacgattgaaaaatgca

SEQ ID NO: 348409 - DNA, 25 bp, Mus musculus
taattacgccacttatggatgtagg

SEQ ID NO: 348410 - DNA, 25 bp, Mus musculus
taattacgtggagaggtcaacagtc

SEQ ID NO: 348411 - DNA, 25 bp, Mus musculus
taattactgagacaacactggtagc

SEQ ID NO: 348412 - DNA, 25 bp, Mus musculus
taattactgctaccgccatcttaga

SEQ ID NO: 348413 - DNA, 25 bp, Mus musculus
taattactgctaccgctgtggcaat

SEQ ID NO: 348414 - DNA, 25 bp, Mus musculus
taattactttctggatgagcagaag

SEQ ID NO: 348415 - DNA, 25 bp, Mus musculus
taattaggttctcaggctattgata

SEQ ID NO: 348416 - DNA, 25 bp, Mus musculus
taattatttggctgatgaagaatgt

SEQ ID NO: 348417 - DNA, 25 bp, Mus musculus
taattcacacagaagtgctgtcgac

SEQ ID NO: 348418 - DNA, 25 bp, Mus musculus
taattcacagaactgggaagcacgc

SEQ ID NO: 348419 - DNA, 25 bp, Mus musculus
taattcactgctaaaatacattaca

SEQ ID NO: 348420 - DNA, 25 bp, Mus musculus
taattcagacacaatggcctgtgag

SEQ ID NO: 348421 - DNA, 25 bp, Mus musculus
taattcaggctgctcatcctaaatt

SEQ ID NO: 348422 - DNA, 25 bp, Mus musculus
taattcaggctggtcatcctaaatt

SEQ ID NO: 348423 - DNA, 25 bp, Mus musculus
taattcatacagattcatctgaaaa

SEQ ID NO: 348424 - DNA, 25 bp, Mus musculus
taattcatacaggtcccatggcctc

SEQ ID NO: 348425 - DNA, 25 bp, Mus musculus
taattcatccaggtcaagtggagaa

SEQ ID NO: 348426 - DNA, 25 bp, Mus musculus
taattcatccaggttcttaaattcc

SEQ ID NO: 348427 - DNA, 25 bp, Mus musculus
taattccaatgatgttgcaaaatct

SEQ ID NO: 348428 - DNA, 25 bp, Mus musculus
taattccccagaaattgatgagaag

SEQ ID NO: 348429 - DNA, 25 bp, Mus musculus
taattccccaggcgttaagcatctg

SEQ ID NO: 348430 - DNA, 25 bp, Mus musculus
taattccctctgacaaaaggcttga

SEQ ID NO: 348431 - DNA, 25 bp, Mus musculus
taattcctaccacagaaactgcact

SEQ ID NO: 348432 - DNA, 25 bp, Mus musculus
taattcctcacagacacactggatg

SEQ ID NO: 348433 - DNA, 25 bp, Mus musculus
taattcctgaaacagagaagcccgt

SEQ ID NO: 348434 - DNA, 25 bp, Mus musculus
taattcctgaggtaaaggggaatgc

SEQ ID NO: 348435 - DNA, 25 bp, Mus musculus
taattcctgaggttcttaatatgtt

SEQ ID NO: 348436 - DNA, 25 bp, Mus musculus
taattcgcgacatgaatggaatgac

SEQ ID NO: 348437 - DNA, 25 bp, Mus musculus
taattcgcgacatgatctacttctc

SEQ ID NO: 348438 - DNA, 25 bp, Mus musculus
taattcgtctgaggaagaatgtttc

SEQ ID NO: 348439 - DNA, 25 bp, Mus musculus
taattctagaaggttttctgtccac

SEQ ID NO: 348440 - DNA, 25 bp, Mus musculus
taattctatcacagagctgtttgga

SEQ ID NO: 348441 - DNA, 25 bp, Mus musculus
taattctccattgaaatgttgtcct

SEQ ID NO: 348442 - DNA, 25 bp, Mus musculus
taattcttgatgagacctctttgac

SEQ ID NO: 348443 - DNA, 25 bp, Mus musculus
taattctttaagttcaagtttggac

SEQ ID NO: 348444 - DNA, 25 bp, Mus musculus
taattgaagaagcaacagactttat

SEQ ID NO: 348445 - DNA, 25 bp, Mus musculus
taattgacagattagctttatttgc

SEQ ID NO: 348446 - DNA, 25 bp, Mus musculus
taattgagaaggcatacaaatgctc

SEQ ID NO: 348447 - DNA, 25 bp, Mus musculus
taattgatgagatggttggtaaagg

SEQ ID NO: 348448 - DNA, 25 bp, Mus musculus
taattgcaaagataactgggaaaaa

SEQ ID NO: 348449 - DNA, 25 bp, Mus musculus
taattgcaaaggaaggaaggtctga

SEQ ID NO: 348450 - DNA, 25 bp, Mus musculus
taattgcccaggactcgttaatgtt

SEQ ID NO: 348451 - DNA, 25 bp, Mus musculus
taattgcccagtatttaacagacct

SEQ ID NO: 348452 - DNA, 25 bp, Mus musculus
taattgctacaggaggatctaagat

SEQ ID NO: 348453 - DNA, 25 bp, Mus musculus
taattgctacctcaggctctgacca

SEQ ID NO: 348454 - DNA, 25 bp, Mus musculus
taattgctggccttcgttttcacaa

SEQ ID NO: 348455 - DNA, 25 bp, Mus musculus
taattggctcttaggtaagaagaca

SEQ ID NO: 348456 - DNA, 25 bp, Mus musculus
taattggggaagcgagccctgaaga

SEQ ID NO: 348457 - DNA, 25 bp, Mus musculus
taattggggaagcggtaggtgcacg

SEQ ID NO: 348458 - DNA, 25 bp, Mus musculus
taattggtttaagtgctgtgaagag

SEQ ID NO: 348459 - DNA, 25 bp, Mus musculus
taattgtgctaaagaaatgctctac

SEQ ID NO: 348460 - DNA, 25 bp, Mus musculus
taattgtgctaaagaaattgccaac

SEQ ID NO: 348461 - DNA, 25 bp, Mus musculus
taattgtgggagtctgcagtgatga

SEQ ID NO: 348462 - DNA, 25 bp, Mus musculus
taatttaaccgcttggctgaagagg

SEQ ID NO: 348463 - DNA, 25 bp, Mus musculus
taatttacagtagttgcagtaaggt

SEQ ID NO: 348464 - DNA, 25 bp, Mus musculus
taatttagagatgaaatccttcagg

SEQ ID NO: 348465 - DNA, 25 bp, Mus musculus
taatttagaggggctccatagacaa

SEQ ID NO: 348466 - DNA, 25 bp, Mus musculus
taatttaggcaagggaaggacattt

SEQ ID NO: 348467 - DNA, 25 bp, Mus musculus
taatttataagagagatggttgtcc

SEQ ID NO: 348468 - DNA, 25 bp, Mus musculus
taatttcaaggttgattctttcaga

SEQ ID NO: 348469 - DNA, 25 bp, Mus musculus
taatttcagcaagaggaatatcctc

SEQ ID NO: 348470 - DNA, 25 bp, Mus musculus
taatttcatacagacgcttgatcct

SEQ ID NO: 348471 - DNA, 25 bp, Mus musculus
taatttcatacaggattcaatgttg

SEQ ID NO: 348472 - DNA, 25 bp, Mus musculus
taatttccagcaagcttgagtctac

SEQ ID NO: 348473 - DNA, 25 bp, Mus musculus
taatttccagcaagtaccaggaatg

SEQ ID NO: 348474 - DNA, 25 bp, Mus musculus
taatttctgaaacagcctcaaggag

SEQ ID NO: 348475 - DNA, 25 bp, Mus musculus
taatttcttggggcgctttcatctt

SEQ ID NO: 348476 - DNA, 25 bp, Mus musculus
taatttcttggtgaatgaactcatt

SEQ ID NO: 348477 - DNA, 25 bp, Mus musculus
taatttgaagggtgattcagaagta

SEQ ID NO: 348478 - DNA, 25 bp, Mus musculus
taatttgctgtggagatcggcctgg

SEQ ID NO: 348479 - DNA, 25 bp, Mus musculus
taatttgctgtggagctccttcaaa

SEQ ID NO: 348480 - DNA, 25 bp, Mus musculus
taattttattacgtttggcaaacat

SEQ ID NO: 348481 - DNA, 25 bp, Mus musculus
taattttgtgctcgattacgctcga

SEQ ID NO: 348482 - DNA, 25 bp, Mus musculus
taatttttcaggtgccgacttatta

SEQ ID NO: 348483 - DNA, 25 bp, Mus musculus
tacaaaaaagtctgttgcaagaatg

SEQ ID NO: 348484 - DNA, 25 bp, Mus musculus
tacaaaaacaacatcctgcggtatt

SEQ ID NO: 348485 - DNA, 25 bp, Mus musculus
tacaaaaagattgaagacctgatta

SEQ ID NO: 348486 - DNA, 25 bp, Mus musculus
tacaaaacaactgataaaagagtct

SEQ ID NO: 348487 - DNA, 25 bp, Mus musculus
tacaaaaccagaagaagctcgagtg

SEQ ID NO: 348488 - DNA, 25 bp, Mus musculus
tacaaaacgctgtaagccgtgcctc

SEQ ID NO: 348489 - DNA, 25 bp, Mus musculus
tacaaaactgtgggaacctggataa

SEQ ID NO: 348490 - DNA, 25 bp, Mus musculus
tacaaaagcagaatgattgaagata

SEQ ID NO: 348491 - DNA, 25 bp, Mus musculus
tacaaaaggatgattgatctgatgg

SEQ ID NO: 348492 - DNA, 25 bp, Mus musculus
tacaaaaggtgcaccaatgggcagc

SEQ ID NO: 348493 - DNA, 25 bp, Mus musculus
tacaaaatatttggtgacttcacct

SEQ ID NO: 348494 - DNA, 25 bp, Mus musculus
tacaaaatgagacctgggcggccct

SEQ ID NO: 348495 - DNA, 25 bp, Mus musculus
tacaaacagaggatcaataccagtt

SEQ ID NO: 348496 - DNA, 25 bp, Mus musculus
tacaaacagcatgatgcagctgcct

SEQ ID NO: 348497 - DNA, 25 bp, Mus musculus
tacaaacagcatggaactgacccga

SEQ ID NO: 348498 - DNA, 25 bp, Mus musculus
tacaaaccatctgatggcctgctgg

SEQ ID NO: 348499 - DNA, 25 bp, Mus musculus
tacaaactaaaggctatggtcatgc

SEQ ID NO: 348500 - DNA, 25 bp, Mus musculus
tacaaactgactggttctgcagcat

SEQ ID NO: 348501 - DNA, 25 bp, Mus musculus
tacaaactgagtagcactcagcatg

SEQ ID NO: 348502 - DNA, 25 bp, Mus musculus
tacaaactgttcaggtagcaacaat

SEQ ID NO: 348503 - DNA, 25 bp, Mus musculus
tacaaagaaatggcaaccagataaa

SEQ ID NO: 348504 - DNA, 25 bp, Mus musculus
tacaaagacaggagcgaatccgtaa

SEQ ID NO: 348505 - DNA, 25 bp, Mus musculus
tacaaagacaggtgtaacgtggaga

SEQ ID NO: 348506 - DNA, 25 bp, Mus musculus
tacaaagacagttcagggcgacagc

SEQ ID NO: 348507 - DNA, 25 bp, Mus musculus
tacaaagagccagttccaagaatta

SEQ ID NO: 348508 - DNA, 25 bp, Mus musculus
tacaaagagtctgaggatcctaaac

SEQ ID NO: 348509 - DNA, 25 bp, Mus musculus
tacaaagatattcaggtccttaaaa

SEQ ID NO: 348510 - DNA, 25 bp, Mus musculus
tacaaagatgacagcaaaaatgtat

SEQ ID NO: 348511 - DNA, 25 bp, Mus musculus
tacaaagatgacagcaaacataaag

SEQ ID NO: 348512 - DNA, 25 bp, Mus musculus
tacaaagcaaagatcattgcttgtc

SEQ ID NO: 348513 - DNA, 25 bp, Mus musculus
tacaaagcaacaggtggaccgtacg

SEQ ID NO: 348514 - DNA, 25 bp, Mus musculus
tacaaaggggaagttccaggatcca

SEQ ID NO: 348515 - DNA, 25 bp, Mus musculus
tacaaaggtgccaacatctatttca

SEQ ID NO: 348516 - DNA, 25 bp, Mus musculus
tacaaagtagctcaaccgaagaacc

SEQ ID NO: 348517 - DNA, 25 bp, Mus musculus
tacaaagtcagatactccatatcat

SEQ ID NO: 348518 - DNA, 25 bp, Mus musculus
tacaaagtgaagtgctcaggagctg

SEQ ID NO: 348519 - DNA, 25 bp, Mus musculus
tacaaatacaggaagacatttcaga

SEQ ID NO: 348520 - DNA, 25 bp, Mus musculus
tacaaatacgatacactaaagattc

SEQ ID NO: 348521 - DNA, 25 bp, Mus musculus
tacaaatacggtacccatgtgaaag

SEQ ID NO: 348522 - DNA, 25 bp, Mus musculus
tacaaatagcagattttggagtaag

SEQ ID NO: 348523 - DNA, 25 bp, Mus musculus
tacaaatatgtggggatgatcctta

SEQ ID NO: 348524 - DNA, 25 bp, Mus musculus
tacaaatatgtggggtacgatcttt

SEQ ID NO: 348525 - DNA, 25 bp, Mus musculus
tacaaatcaggagtatacaagcatg

SEQ ID NO: 348526 - DNA, 25 bp, Mus musculus
tacaaatgaacagctctggagtgca

SEQ ID NO: 348527 - DNA, 25 bp, Mus musculus
tacaaatgaacaggcctattcctgg

SEQ ID NO: 348528 - DNA, 25 bp, Mus musculus
tacaaatgaacaggtgtgcggacca

SEQ ID NO: 348529 - DNA, 25 bp, Mus musculus
tacaaattgagcaggccgcttggac

SEQ ID NO: 348530 - DNA, 25 bp, Mus musculus
tacaacaaaactacagacagtcgag

SEQ ID NO: 348531 - DNA, 25 bp, Mus musculus
tacaacaaaaggccaactactcaaa

SEQ ID NO: 348532 - DNA, 25 bp, Mus musculus
tacaacaaagaagctcttagccccc

SEQ ID NO: 348533 - DNA, 25 bp, Mus musculus
tacaacaacgagcatcgaggagttg

SEQ ID NO: 348534 - DNA, 25 bp, Mus musculus
tacaacaagaacattctcaagatcg

SEQ ID NO: 348535 - DNA, 25 bp, Mus musculus
tacaacaagaaggtagaggcagtca

SEQ ID NO: 348536 - DNA, 25 bp, Mus musculus
tacaacaccaaaaggccgaggggca

SEQ ID NO: 348537 - DNA, 25 bp, Mus musculus
tacaacaccaagagaggtattgtgg

SEQ ID NO: 348538 - DNA, 25 bp, Mus musculus
tacaacaccaagagcttactggcgg

SEQ ID NO: 348539 - DNA, 25 bp, Mus musculus
tacaacaccgacgagtccatttcgg

SEQ ID NO: 348540 - DNA, 25 bp, Mus musculus
tacaacactggaagaaaatatccac

SEQ ID NO: 348541 - DNA, 25 bp, Mus musculus
tacaacactggtgtgtcagtcacct

SEQ ID NO: 348542 - DNA, 25 bp, Mus musculus
tacaacagcgtttatggggcccaga

SEQ ID NO: 348543 - DNA, 25 bp, Mus musculus
tacaacaggaagcgtggaggatgag

SEQ ID NO: 348544 - DNA, 25 bp, Mus musculus
tacaacaggggcagtcccaggacgg

SEQ ID NO: 348545 - DNA, 25 bp, Mus musculus
tacaacaggggcagtgtttgccaag

SEQ ID NO: 348546 - DNA, 25 bp, Mus musculus
tacaacatctgatggaacctgtacc

SEQ ID NO: 348547 - DNA, 25 bp, Mus musculus
tacaacatctgatggtctatctcca

SEQ ID NO: 348548 - DNA, 25 bp, Mus musculus
tacaacatgcagatggtgtcagtgg

SEQ ID NO: 348549 - DNA, 25 bp, Mus musculus
tacaacatggagcatatccgtgtgg

SEQ ID NO: 348550 - DNA, 25 bp, Mus musculus
tacaaccaagaaggtttgatgagcc

SEQ ID NO: 348551 - DNA, 25 bp, Mus musculus
tacaaccaaggagaatagcaaaaag

SEQ ID NO: 348552 - DNA, 25 bp, Mus musculus
tacaaccaagggtacttcgagaata

SEQ ID NO: 348553 - DNA, 25 bp, Mus musculus
tacaaccacaaggcgctacagcaac

SEQ ID NO: 348554 - DNA, 25 bp, Mus musculus
tacaaccacagactgcagttttcag

SEQ ID NO: 348555 - DNA, 25 bp, Mus musculus
tacaaccactcagggcttcacacct

SEQ ID NO: 348556 - DNA, 25 bp, Mus musculus
tacaaccagcacgaagccccccagc

SEQ ID NO: 348557 - DNA, 25 bp, Mus musculus
tacaaccatggaaggctcacccacg

SEQ ID NO: 348558 - DNA, 25 bp, Mus musculus
tacaacccacccaggaacaattgtg

SEQ ID NO: 348559 - DNA, 25 bp, Mus musculus
tacaaccccacccaggtggaggatg

SEQ ID NO: 348560 - DNA, 25 bp, Mus musculus
tacaaccccacccagtttctgtgtt

SEQ ID NO: 348561 - DNA, 25 bp, Mus musculus
tacaaccctgactttactaggacct

SEQ ID NO: 348562 - DNA, 25 bp, Mus musculus
tacaaccctgactttgtggctgttc

SEQ ID NO: 348563 - DNA, 25 bp, Mus musculus
tacaaccgggattgacccaccgttc

SEQ ID NO: 348564 - DNA, 25 bp, Mus musculus
tacaaccgggattggcagaattact

SEQ ID NO: 348565 - DNA, 25 bp, Mus musculus
tacaacctagagaagaagcgagatg

SEQ ID NO: 348566 - DNA, 25 bp, Mus musculus
tacaacctagagaagcgagatgagc

SEQ ID NO: 348567 - DNA, 25 bp, Mus musculus
tacaacctcgaggaatcatgcaccc

SEQ ID NO: 348568 - DNA, 25 bp, Mus musculus
tacaacctctcccagctccctggct

SEQ ID NO: 348569 - DNA, 25 bp, Mus musculus
tacaacctctcccaggtgtgtgacg

SEQ ID NO: 348570 - DNA, 25 bp, Mus musculus
tacaacgctgactttgagaagctga

SEQ ID NO: 348571 - DNA, 25 bp, Mus musculus
tacaactaccagaacaatgaaaagg

SEQ ID NO: 348572 - DNA, 25 bp, Mus musculus
tacaactaccagattatccagctga

SEQ ID NO: 348573 - DNA, 25 bp, Mus musculus
tacaactaccaggcaggacccgacg

SEQ ID NO: 348574 - DNA, 25 bp, Mus musculus
tacaactagaatatgacttgggtca

SEQ ID NO: 348575 - DNA, 25 bp, Mus musculus
tacaactagaatatggtggcccata

SEQ ID NO: 348576 - DNA, 25 bp, Mus musculus
tacaactaggccagatttaccttat

SEQ ID NO: 348577 - DNA, 25 bp, Mus musculus
tacaactaggccagctgctcagcca

SEQ ID NO: 348578 - DNA, 25 bp, Mus musculus
tacaactcagatcccaagcagtatt

SEQ ID NO: 348579 - DNA, 25 bp, Mus musculus
tacaactcagatctccatcagaatc

SEQ ID NO: 348580 - DNA, 25 bp, Mus musculus
tacaactctgatcagagtgccagaa

SEQ ID NO: 348581 - DNA, 25 bp, Mus musculus
tacaactgaaaaaggacggctcctc

SEQ ID NO: 348582 - DNA, 25 bp, Mus musculus
tacaacttcaggaaaagctcctccc

SEQ ID NO: 348583 - DNA, 25 bp, Mus musculus
tacaacttcaggtgaaaattttgat

SEQ ID NO: 348584 - DNA, 25 bp, Mus musculus
tacaagaaatggaaggtggtgtagt

SEQ ID NO: 348585 - DNA, 25 bp, Mus musculus
tacaagaaatggaagtggctaccaa

SEQ ID NO: 348586 - DNA, 25 bp, Mus musculus
tacaagaagacaggtaaacacaaga

SEQ ID NO: 348587 - DNA, 25 bp, Mus musculus
tacaagaagagatacgaggaggaag

SEQ ID NO: 348588 - DNA, 25 bp, Mus musculus
tacaagaagagtaccagcctcactg

SEQ ID NO: 348589 - DNA, 25 bp, Mus musculus
tacaagaagatgaccgcggagggca

SEQ ID NO: 348590 - DNA, 25 bp, Mus musculus
tacaagaatgaggaaggcacttggt

SEQ ID NO: 348591 - DNA, 25 bp, Mus musculus
tacaagaatgcggaaggcacttggt

SEQ ID NO: 348592 - DNA, 25 bp, Mus musculus
tacaagacaacactgcttatcttta

SEQ ID NO: 348593 - DNA, 25 bp, Mus musculus
tacaagacagcacagaccggaagaa

SEQ ID NO: 348594 - DNA, 25 bp, Mus musculus
tacaagacagtgacagccctggaga

SEQ ID NO: 348595 - DNA, 25 bp, Mus musculus
tacaagaccaggggttcaaggaagg

SEQ ID NO: 348596 - DNA, 25 bp, Mus musculus
tacaagaccataccactctcctcct

SEQ ID NO: 348597 - DNA, 25 bp, Mus musculus
tacaagaccatgtttatgtctggga

SEQ ID NO: 348598 - DNA, 25 bp, Mus musculus
tacaagacgcagctcggtgaggacc

SEQ ID NO: 348599 - DNA, 25 bp, Mus musculus
tacaagactgtggagaccacagaca

SEQ ID NO: 348600 - DNA, 25 bp, Mus musculus
tacaagactgtggaggtcttctgcg

SEQ ID NO: 348601 - DNA, 25 bp, Mus musculus
tacaagagcatcctggtgaccagcc

SEQ ID NO: 348602 - DNA, 25 bp, Mus musculus
tacaagagcgaggaagaggaagtag

SEQ ID NO: 348603 - DNA, 25 bp, Mus musculus
tacaagagcgagggtccagattata

SEQ ID NO: 348604 - DNA, 25 bp, Mus musculus
tacaagagcttctactggtgcagtc

SEQ ID NO: 348605 - DNA, 25 bp, Mus musculus
tacaagagcttctgagtctatcctg

SEQ ID NO: 348606 - DNA, 25 bp, Mus musculus
tacaagataaagctcacttcaattg

SEQ ID NO: 348607 - DNA, 25 bp, Mus musculus
tacaagatagcgggacacggctctt

SEQ ID NO: 348608 - DNA, 25 bp, Mus musculus
tacaagatgaggatgataatgatgt

SEQ ID NO: 348609 - DNA, 25 bp, Mus musculus
tacaagatgcagtatggtggggctc

SEQ ID NO: 348610 - DNA, 25 bp, Mus musculus
tacaagatgtgaagtgggagctggg

SEQ ID NO: 348611 - DNA, 25 bp, Mus musculus
tacaagattcaaaaggataaaccag

SEQ ID NO: 348612 - DNA, 25 bp, Mus musculus
tacaagattgggcagcccagacaca

SEQ ID NO: 348613 - DNA, 25 bp, Mus musculus
tacaagattggtcaactcagatcaa

SEQ ID NO: 348614 - DNA, 25 bp, Mus musculus
tacaagcaaggagttacaccctgga

SEQ ID NO: 348615 - DNA, 25 bp, Mus musculus
tacaagcacaactcctaatagtaca

SEQ ID NO: 348616 - DNA, 25 bp, Mus musculus
tacaagcacacagggttttggtaaa

SEQ ID NO: 348617 - DNA, 25 bp, Mus musculus
tacaagcaggtttttctccaggagt

SEQ ID NO: 348618 - DNA, 25 bp, Mus musculus
tacaagcagtgagcttatgggggcc

SEQ ID NO: 348619 - DNA, 25 bp, Mus musculus
tacaagcatgagggacaaagcccca

SEQ ID NO: 348620 - DNA, 25 bp, Mus musculus
tacaagccagcaatcagagcgaagc

SEQ ID NO: 348621 - DNA, 25 bp, Mus musculus
tacaagccaggaatcagagcgaagc

SEQ ID NO: 348622 - DNA, 25 bp, Mus musculus
tacaagccaggagccatgcgaggcc

SEQ ID NO: 348623 - DNA, 25 bp, Mus musculus
tacaagcgggatctctaccagaagt

SEQ ID NO: 348624 - DNA, 25 bp, Mus musculus
tacaagcgggcaggtccatggagag

SEQ ID NO: 348625 - DNA, 25 bp, Mus musculus
tacaagctccttaagaaggcagatg

SEQ ID NO: 348626 - DNA, 25 bp, Mus musculus
tacaagctgaaccctcacctgtgcc

SEQ ID NO: 348627 - DNA, 25 bp, Mus musculus
tacaaggaaggaaaagatggcatct

SEQ ID NO: 348628 - DNA, 25 bp, Mus musculus
tacaaggaagggcaaatgacttggt

SEQ ID NO: 348629 - DNA, 25 bp, Mus musculus
tacaaggacagcaaggtggtgtggg

SEQ ID NO: 348630 - DNA, 25 bp, Mus musculus
tacaaggacccccagagttgatggt

SEQ ID NO: 348631 - DNA, 25 bp, Mus musculus
tacaaggagaacgtggacttatggt

SEQ ID NO: 348632 - DNA, 25 bp, Mus musculus
tacaaggagaacgttgacatttggt

SEQ ID NO: 348633 - DNA, 25 bp, Mus musculus
tacaaggaggtccggagtcaccggc

SEQ ID NO: 348634 - DNA, 25 bp, Mus musculus
tacaaggataagaatgaagaagaag

SEQ ID NO: 348635 - DNA, 25 bp, Mus musculus
tacaaggatctgatttaaattagct

SEQ ID NO: 348636 - DNA, 25 bp, Mus musculus
tacaaggatgaggaggagaaagaaa

SEQ ID NO: 348637 - DNA, 25 bp, Mus musculus
tacaaggatgatgaggagaaagaga

SEQ ID NO: 348638 - DNA, 25 bp, Mus musculus
tacaaggatggaacggtgtggaccg

SEQ ID NO: 348639 - DNA, 25 bp, Mus musculus
tacaagggacaggtgctgaagcatg

SEQ ID NO: 348640 - DNA, 25 bp, Mus musculus
tacaagggaccaagcattcacagct

SEQ ID NO: 348641 - DNA, 25 bp, Mus musculus
tacaagggattccagtactagtact

SEQ ID NO: 348642 - DNA, 25 bp, Mus musculus
tacaagggccagatgctgcatattc

SEQ ID NO: 348643 - DNA, 25 bp, Mus musculus
tacaaggtagcaaagggtgtggaat

SEQ ID NO: 348644 - DNA, 25 bp, Mus musculus
tacaagtatgaacacaattttgaaa

SEQ ID NO: 348645 - DNA, 25 bp, Mus musculus
tacaagtgcaaccagacatccagaa

SEQ ID NO: 348646 - DNA, 25 bp, Mus musculus
tacaagtggatgaacagccagtcct

SEQ ID NO: 348647 - DNA, 25 bp, Mus musculus
tacaagtgtaaagtagtcgccgggt

SEQ ID NO: 348648 - DNA, 25 bp, Mus musculus
tacaagtgtgaggactgtgggaaac

SEQ ID NO: 348649 - DNA, 25 bp, Mus musculus
tacaagtgttgatacccataatatc

SEQ ID NO: 348650 - DNA, 25 bp, Mus musculus
tacaagtgttgttcccatggtgcac

SEQ ID NO: 348651 - DNA, 25 bp, Mus musculus
tacaagttctacaggcctgagaata

SEQ ID NO: 348652 - DNA, 25 bp, Mus musculus
tacaagttctacaggctgccacagg

SEQ ID NO: 348653 - DNA, 25 bp, Mus musculus
tacaagttgtcagggctccagtggc

SEQ ID NO: 348654 - DNA, 25 bp, Mus musculus
tacaagtttatacagatctttcatt

SEQ ID NO: 348655 - DNA, 25 bp, Mus musculus
tacaagtttatacagggtgacattt

SEQ ID NO: 348656 - DNA, 25 bp, Mus musculus
tacaataacaaagctgcagtgttga

SEQ ID NO: 348657 - DNA, 25 bp, Mus musculus
tacaataaccagtctgtgaacctac

SEQ ID NO: 348658 - DNA, 25 bp, Mus musculus
tacaatatctcggacgtgagggtca

SEQ ID NO: 348659 - DNA, 25 bp, Mus musculus
tacaatatctcggagcggtttcctc

SEQ ID NO: 348660 - DNA, 25 bp, Mus musculus
tacaatatggggctgccggtggact

SEQ ID NO: 348661 - DNA, 25 bp, Mus musculus
tacaatattagaaggaacaactgtg

SEQ ID NO: 348662 - DNA, 25 bp, Mus musculus
tacaatcaagatttctgaccgagga

SEQ ID NO: 348663 - DNA, 25 bp, Mus musculus
tacaatcaagttttctgaccgagga

SEQ ID NO: 348664 - DNA, 25 bp, Mus musculus
tacaatccagaggagtctctgtttg

SEQ ID NO: 348665 - DNA, 25 bp, Mus musculus
tacaatcttaaaggggcaagcggat

SEQ ID NO: 348666 - DNA, 25 bp, Mus musculus
tacaatgacactcagatcaaattgc

SEQ ID NO: 348667 - DNA, 25 bp, Mus musculus
tacaatgagattctgatatctgcac

SEQ ID NO: 348668 - DNA, 25 bp, Mus musculus
tacaatgagattctgcacacttcca

SEQ ID NO: 348669 - DNA, 25 bp, Mus musculus
tacaatgagcacaagactgacctag

SEQ ID NO: 348670 - DNA, 25 bp, Mus musculus
tacaatgagcacaagagctgcgagg

SEQ ID NO: 348671 - DNA, 25 bp, Mus musculus
tacaatgcaacgtggccctgaattc

SEQ ID NO: 348672 - DNA, 25 bp, Mus musculus
tacaatgcaagaaatcctaccttga

SEQ ID NO: 348673 - DNA, 25 bp, Mus musculus
tacaatgcagagactgatgaagtat

SEQ ID NO: 348674 - DNA, 25 bp, Mus musculus
tacaatgcagagagtgacctcagtt

SEQ ID NO: 348675 - DNA, 25 bp, Mus musculus
tacaatgcctacagctcttaacctt

SEQ ID NO: 348676 - DNA, 25 bp, Mus musculus
tacaatgcctacaggttcttcttca

SEQ ID NO: 348677 - DNA, 25 bp, Mus musculus
tacaatgcgtacagaaaagcggcat

SEQ ID NO: 348678 - DNA, 25 bp, Mus musculus
tacaatgcgtacagccaggagtagg

SEQ ID NO: 348679 - DNA, 25 bp, Mus musculus
tacaatgggaaaacggtatatgcac

SEQ ID NO: 348680 - DNA, 25 bp, Mus musculus
tacaatgggagatgatggcccttca

SEQ ID NO: 348681 - DNA, 25 bp, Mus musculus
tacaatgggaggtgctggatagttt

SEQ ID NO: 348682 - DNA, 25 bp, Mus musculus
tacaatgggagtgaacacggattcg

SEQ ID NO: 348683 - DNA, 25 bp, Mus musculus
tacaatggtggtccatgagaaacaa

SEQ ID NO: 348684 - DNA, 25 bp, Mus musculus
tacaatgttgggcaggatgtttgga

SEQ ID NO: 348685 - DNA, 25 bp, Mus musculus
tacaatgtttgtgtgtggacaggcc

SEQ ID NO: 348686 - DNA, 25 bp, Mus musculus
tacaattcctgtacactcacgcctt

SEQ ID NO: 348687 - DNA, 25 bp, Mus musculus
tacaattgagaccaggccatgctca

SEQ ID NO: 348688 - DNA, 25 bp, Mus musculus
tacaatttccccgccgactggccaa

SEQ ID NO: 348689 - DNA, 25 bp, Mus musculus
tacaatttctggaaatgatatattg

SEQ ID NO: 348690 - DNA, 25 bp, Mus musculus
tacaatttgtcgataatctgtatcg

SEQ ID NO: 348691 - DNA, 25 bp, Mus musculus
tacacaaaaagctgttcagcagaca

SEQ ID NO: 348692 - DNA, 25 bp, Mus musculus
tacacaaaaggtggttgttggagat

SEQ ID NO: 348693 - DNA, 25 bp, Mus musculus
tacacaaaagtcaaatgtggatatg

SEQ ID NO: 348694 - DNA, 25 bp, Mus musculus
tacacaaacagatctttgaggggag

SEQ ID NO: 348695 - DNA, 25 bp, Mus musculus
tacacaaacagtcaaagcagtcctt

SEQ ID NO: 348696 - DNA, 25 bp, Mus musculus
tacacaaacttttaggtagacattt

SEQ ID NO: 348697 - DNA, 25 bp, Mus musculus
tacacaaagcagagcaaaaaggggt

SEQ ID NO: 348698 - DNA, 25 bp, Mus musculus
tacacaaagcagggctttgggaatc

SEQ ID NO: 348699 - DNA, 25 bp, Mus musculus
tacacaaaggaccgatgtagcaggc

SEQ ID NO: 348700 - DNA, 25 bp, Mus musculus
tacacaaatggctacacggatgcag

SEQ ID NO: 348701 - DNA, 25 bp, Mus musculus
tacacaaccagtttccgttcagaca

SEQ ID NO: 348702 - DNA, 25 bp, Mus musculus
tacacaagaaactaacactaagcag

SEQ ID NO: 348703 - DNA, 25 bp, Mus musculus
tacacaagaagcagtcgttccccat

SEQ ID NO: 348704 - DNA, 25 bp, Mus musculus
tacacaagaggctttggtcatccag

SEQ ID NO: 348705 - DNA, 25 bp, Mus musculus
tacacaagcacagcacggccctgcc

SEQ ID NO: 348706 - DNA, 25 bp, Mus musculus
tacacaataatggagtgatagaagg

SEQ ID NO: 348707 - DNA, 25 bp, Mus musculus
tacacaatgagactcaccataagtg

SEQ ID NO: 348708 - DNA, 25 bp, Mus musculus
tacacaatggagcatatccgtgtgg

SEQ ID NO: 348709 - DNA, 25 bp, Mus musculus
tacacaatttgggagtgagctactt

SEQ ID NO: 348710 - DNA, 25 bp, Mus musculus
tacacacaaaacaggctggccttgt

SEQ ID NO: 348711 - DNA, 25 bp, Mus musculus
tacacacacgaggtatgacgctgtg

SEQ ID NO: 348712 - DNA, 25 bp, Mus musculus
tacacaccccccggtcacccgctgc

SEQ ID NO: 348713 - DNA, 25 bp, Mus musculus
tacacaccccctacctatggagttc

SEQ ID NO: 348714 - DNA, 25 bp, Mus musculus
tacacacctgaacctgatatctgtc

SEQ ID NO: 348715 - DNA, 25 bp, Mus musculus
tacacacgagttgggccattccagc

SEQ ID NO: 348716 - DNA, 25 bp, Mus musculus
tacacactccctgtcctgttagcct

SEQ ID NO: 348717 - DNA, 25 bp, Mus musculus
tacacactccgacagctttccacca

SEQ ID NO: 348718 - DNA, 25 bp, Mus musculus
tacacactgcagcaatgcacggctg

SEQ ID NO: 348719 - DNA, 25 bp, Mus musculus
tacacactgtgggcatcctctacac

SEQ ID NO: 348720 - DNA, 25 bp, Mus musculus
tacacactgtgggccatccacgaaa

SEQ ID NO: 348721 - DNA, 25 bp, Mus musculus
tacacactgtggggtgcccaattac

SEQ ID NO: 348722 - DNA, 25 bp, Mus musculus
tacacagagaacaaaggctccttct

SEQ ID NO: 348723 - DNA, 25 bp, Mus musculus
tacacagagaagtatagaagaagaa

SEQ ID NO: 348724 - DNA, 25 bp, Mus musculus
tacacagccatggggaaccagcctg

SEQ ID NO: 348725 - DNA, 25 bp, Mus musculus
tacacagccgtccagacggtgcaga

SEQ ID NO: 348726 - DNA, 25 bp, Mus musculus
tacacagccgtccagcacttccacg

SEQ ID NO: 348727 - DNA, 25 bp, Mus musculus
tacacagctgaaggagagactagaa

SEQ ID NO: 348728 - DNA, 25 bp, Mus musculus
tacacaggacatcatgcctatgcct

SEQ ID NO: 348729 - DNA, 25 bp, Mus musculus
tacacaggacttcatgcctatgcct

SEQ ID NO: 348730 - DNA, 25 bp, Mus musculus
tacacagtgagagttcgatgcccaa

SEQ ID NO: 348731 - DNA, 25 bp, Mus musculus
tacacatacacagggagcatgactt

SEQ ID NO: 348732 - DNA, 25 bp, Mus musculus
tacacatacagagttcgttatctag

SEQ ID NO: 348733 - DNA, 25 bp, Mus musculus
tacacatccttgctgaggatcaaac

SEQ ID NO: 348734 - DNA, 25 bp, Mus musculus
tacacatcctttaaaaagtatggag

SEQ ID NO: 348735 - DNA, 25 bp, Mus musculus
tacacatcgataaggctcctgaggg

SEQ ID NO: 348736 - DNA, 25 bp, Mus musculus
tacacatcgataaggttgaagaaca

SEQ ID NO: 348737 - DNA, 25 bp, Mus musculus
tacacatctgaccccagtacatgga

SEQ ID NO: 348738 - DNA, 25 bp, Mus musculus
tacacatgcaactgtgttattggct

SEQ ID NO: 348739 - DNA, 25 bp, Mus musculus
tacacatgctattgatctgatggag

SEQ ID NO: 348740 - DNA, 25 bp, Mus musculus
tacacatgctattgatgcttgcttt

SEQ ID NO: 348741 - DNA, 25 bp, Mus musculus
tacacattaaccagtgcacttaagg

SEQ ID NO: 348742 - DNA, 25 bp, Mus musculus
tacacattctcaataacctgtgtga

SEQ ID NO: 348743 - DNA, 25 bp, Mus musculus
tacacattgcggatagagacatcgg

SEQ ID NO: 348744 - DNA, 25 bp, Mus musculus
tacacatttttgttgtgaagttatc

SEQ ID NO: 348745 - DNA, 25 bp, Mus musculus
tacaccaaacagagttattggaagc

SEQ ID NO: 348746 - DNA, 25 bp, Mus musculus
tacaccaaacaggaaggtaccaggt

SEQ ID NO: 348747 - DNA, 25 bp, Mus musculus
tacaccaaacaggcaccatcacagg

SEQ ID NO: 348748 - DNA, 25 bp, Mus musculus
tacaccaaactgcagctgcatggag

SEQ ID NO: 348749 - DNA, 25 bp, Mus musculus
tacaccaaactgcaggaatgggcaa

SEQ ID NO: 348750 - DNA, 25 bp, Mus musculus
tacaccaagcaagaatgtgaaactc

SEQ ID NO: 348751 - DNA, 25 bp, Mus musculus
tacaccaagcaagatcgacatcagg

SEQ ID NO: 348752 - DNA, 25 bp, Mus musculus
tacaccaagtcaaaagtgagaccaa

SEQ ID NO: 348753 - DNA, 25 bp, Mus musculus
tacaccaagtcggacttacggttaa

SEQ ID NO: 348754 - DNA, 25 bp, Mus musculus
tacaccaatggctggaaattaaatc

SEQ ID NO: 348755 - DNA, 25 bp, Mus musculus
tacaccacaaggggaggcaaaattc

SEQ ID NO: 348756 - DNA, 25 bp, Mus musculus
tacaccacacagacagaggagttga

SEQ ID NO: 348757 - DNA, 25 bp, Mus musculus
tacaccacagattatcagctgtatc

SEQ ID NO: 348758 - DNA, 25 bp, Mus musculus
tacaccacgactggtggaaaaattc

SEQ ID NO: 348759 - DNA, 25 bp, Mus musculus
tacaccactacatggaaaaaagata

SEQ ID NO: 348760 - DNA, 25 bp, Mus musculus
tacaccagcccataaaaacgtcaac

SEQ ID NO: 348761 - DNA, 25 bp, Mus musculus
tacaccagcgtcaagcaggtgtctt

SEQ ID NO: 348762 - DNA, 25 bp, Mus musculus
tacaccagctccaacatagtttgtg

SEQ ID NO: 348763 - DNA, 25 bp, Mus musculus
tacaccagctccaatttttcaagac

SEQ ID NO: 348764 - DNA, 25 bp, Mus musculus
tacaccaggcaccagtacagaaagc

SEQ ID NO: 348765 - DNA, 25 bp, Mus musculus
tacaccagtggaaggcaaaggctgc

SEQ ID NO: 348766 - DNA, 25 bp, Mus musculus
tacaccatcacagaatacactgtaa

SEQ ID NO: 348767 - DNA, 25 bp, Mus musculus
tacaccatcacagtgttccttcctg

SEQ ID NO: 348768 - DNA, 25 bp, Mus musculus
tacaccatccccccgcaggctggcc

SEQ ID NO: 348769 - DNA, 25 bp, Mus musculus
tacaccatgccagtcttcccaccag

SEQ ID NO: 348770 - DNA, 25 bp, Mus musculus
tacaccatgcttctgtggacgcaga

SEQ ID NO: 348771 - DNA, 25 bp, Mus musculus
tacaccattggtctgcaggcaccgc

SEQ ID NO: 348772 - DNA, 25 bp, Mus musculus
tacaccatttaagttgctttctgat

SEQ ID NO: 348773 - DNA, 25 bp, Mus musculus
tacacccaaaagatttttgaatgtc

SEQ ID NO: 348774 - DNA, 25 bp, Mus musculus
tacacccaaaaggtcactccattct

SEQ ID NO: 348775 - DNA, 25 bp, Mus musculus
tacacccacagttccagggtccctg

SEQ ID NO: 348776 - DNA, 25 bp, Mus musculus
tacacccacgaaatggcaaatccca

SEQ ID NO: 348777 - DNA, 25 bp, Mus musculus
tacacccagacaagtaggtatcgca

SEQ ID NO: 348778 - DNA, 25 bp, Mus musculus
tacacccaggtgattcgagtcatct

SEQ ID NO: 348779 - DNA, 25 bp, Mus musculus
tacacccatgagcacttgctggctc

SEQ ID NO: 348780 - DNA, 25 bp, Mus musculus
tacacccccatgtatggctgtaaga

SEQ ID NO: 348781 - DNA, 25 bp, Mus musculus
tacacccgtcaaatatgaataccca

SEQ ID NO: 348782 - DNA, 25 bp, Mus musculus
tacaccgttttcagatagcggccat

SEQ ID NO: 348783 - DNA, 25 bp, Mus musculus
tacaccgttttcaggctttctggct

SEQ ID NO: 348784 - DNA, 25 bp, Mus musculus
tacaccgttttcagttatttgccag

SEQ ID NO: 348785 - DNA, 25 bp, Mus musculus
tacacctacacaaatgtcccctttg

SEQ ID NO: 348786 - DNA, 25 bp, Mus musculus
tacacctgcaaggaatattgaagag

SEQ ID NO: 348787 - DNA, 25 bp, Mus musculus
tacacctgcatgctgaccctgttgg

SEQ ID NO: 348788 - DNA, 25 bp, Mus musculus
tacacctgcatgctggctcttcata

SEQ ID NO: 348789 - DNA, 25 bp, Mus musculus
tacacctgccggtcagggatccccc

SEQ ID NO: 348790 - DNA, 25 bp, Mus musculus
tacacctgccggtccaaccgtgact

SEQ ID NO: 348791 - DNA, 25 bp, Mus musculus
tacaccttagccagtccaaactgaa

SEQ ID NO: 348792 - DNA, 25 bp, Mus musculus
tacaccttccgccagtttcgtgatc

SEQ ID NO: 348793 - DNA, 25 bp, Mus musculus
tacaccttctgcagcaaatctcccg

SEQ ID NO: 348794 - DNA, 25 bp, Mus musculus
tacacgaccagtgcagcccctggaa

SEQ ID NO: 348795 - DNA, 25 bp, Mus musculus
tacacgacccaaggaggcaagtgtt

SEQ ID NO: 348796 - DNA, 25 bp, Mus musculus
tacacgacccaagtggcagcaatgt

SEQ ID NO: 348797 - DNA, 25 bp, Mus musculus
tacacgagatgatggattatctatt

SEQ ID NO: 348798 - DNA, 25 bp, Mus musculus
tacacgatgtgctggatttccactt

SEQ ID NO: 348799 - DNA, 25 bp, Mus musculus
tacacgcagacagtggacatttggt

SEQ ID NO: 348800 - DNA, 25 bp, Mus musculus
tacacgcagtccgaggtcgccatgg

SEQ ID NO: 348801 - DNA, 25 bp, Mus musculus
tacacgcatgctgtggataccctat

SEQ ID NO: 348802 - DNA, 25 bp, Mus musculus
tacacgcatggagtcgccctagtta

SEQ ID NO: 348803 - DNA, 25 bp, Mus musculus
tacacgggctatgagccaacttcca

SEQ ID NO: 348804 - DNA, 25 bp, Mus musculus
tacacggtccagcagcaaccctatc

SEQ ID NO: 348805 - DNA, 25 bp, Mus musculus
tacacggtccaggatgagagtcatt

SEQ ID NO: 348806 - DNA, 25 bp, Mus musculus
tacacgtacgtgaaggaattccgca

SEQ ID NO: 348807 - DNA, 25 bp, Mus musculus
tacacgtcaaagaagtcttctaaac

SEQ ID NO: 348808 - DNA, 25 bp, Mus musculus
tacacgtcaaagacctaactaccgt

SEQ ID NO: 348809 - DNA, 25 bp, Mus musculus
tacacgtctgcccgtgtgctgatgt

SEQ ID NO: 348810 - DNA, 25 bp, Mus musculus
tacacgtgcaggtactgtggcaaga

SEQ ID NO: 348811 - DNA, 25 bp, Mus musculus
tacactaaagtagagactcagggtg

SEQ ID NO: 348812 - DNA, 25 bp, Mus musculus
tacactaagaacaagaaaacagata

SEQ ID NO: 348813 - DNA, 25 bp, Mus musculus
tacactacatacgatctcctccaca

SEQ ID NO: 348814 - DNA, 25 bp, Mus musculus
tacactactgactccatgcctgcaa

SEQ ID NO: 348815 - DNA, 25 bp, Mus musculus
tacactataaggtttgctatgcgcg

SEQ ID NO: 348816 - DNA, 25 bp, Mus musculus
tacactatacagtggtggaagatac

SEQ ID NO: 348817 - DNA, 25 bp, Mus musculus
tacactccaggagctgcagccccag

SEQ ID NO: 348818 - DNA, 25 bp, Mus musculus
tacactctagatggagtggatggaa

SEQ ID NO: 348819 - DNA, 25 bp, Mus musculus
tacactcttacccagaccaacagca

SEQ ID NO: 348820 - DNA, 25 bp, Mus musculus
tacactcttacccagcatatatttg

SEQ ID NO: 348821 - DNA, 25 bp, Mus musculus
tacactcttacccaggtttttgtgc

SEQ ID NO: 348822 - DNA, 25 bp, Mus musculus
tacactcttccagacccatgaaaat

SEQ ID NO: 348823 - DNA, 25 bp, Mus musculus
tacactgaccctcagatagtgtttc

SEQ ID NO: 348824 - DNA, 25 bp, Mus musculus
tacactgacgaggatagtgccatgt

SEQ ID NO: 348825 - DNA, 25 bp, Mus musculus
tacactgacgtccagaaacgctgaa

SEQ ID NO: 348826 - DNA, 25 bp, Mus musculus
tacactgagctcatgaccaggtgct

SEQ ID NO: 348827 - DNA, 25 bp, Mus musculus
tacactgcactgggtgggctgaagg

SEQ ID NO: 348828 - DNA, 25 bp, Mus musculus
tacactgcagtgctggtgttggcag

SEQ ID NO: 348829 - DNA, 25 bp, Mus musculus
tacactgccaaccagaactgcgtag

SEQ ID NO: 348830 - DNA, 25 bp, Mus musculus
tacactgctccgacaatatgcacct

SEQ ID NO: 348831 - DNA, 25 bp, Mus musculus
tacactgctccgacaatgtagattt

SEQ ID NO: 348832 - DNA, 25 bp, Mus musculus
tacactgtggcaggtgttcttctgg

SEQ ID NO: 348833 - DNA, 25 bp, Mus musculus
tacactgttgttggccgccccatcc

SEQ ID NO: 348834 - DNA, 25 bp, Mus musculus
tacacttacaagagcctcaggacag

SEQ ID NO: 348835 - DNA, 25 bp, Mus musculus
tacacttacaagagggggaaggact

SEQ ID NO: 348836 - DNA, 25 bp, Mus musculus
tacacttatgacctgatggccaact

SEQ ID NO: 348837 - DNA, 25 bp, Mus musculus
tacacttatgacctggcagaacagc

SEQ ID NO: 348838 - DNA, 25 bp, Mus musculus
tacacttcaacggtctgagcgcaag

SEQ ID NO: 348839 - DNA, 25 bp, Mus musculus
tacacttcaagatgtttgatgtggg

SEQ ID NO: 348840 - DNA, 25 bp, Mus musculus
tacacttcagatttccaaaaggccc

SEQ ID NO: 348841 - DNA, 25 bp, Mus musculus
tacacttcccaaaaagaagattata

SEQ ID NO: 348842 - DNA, 25 bp, Mus musculus
tacacttctcaggttcctgtcccac

SEQ ID NO: 348843 - DNA, 25 bp, Mus musculus
tacacttctggagaccacatgtgtc

SEQ ID NO: 348844 - DNA, 25 bp, Mus musculus
tacacttctggaggaaaatatgtcg

SEQ ID NO: 348845 - DNA, 25 bp, Mus musculus
tacacttgcaaggccataccttctg

SEQ ID NO: 348846 - DNA, 25 bp, Mus musculus
tacactttcaaacttccaaaggaat

SEQ ID NO: 348847 - DNA, 25 bp, Mus musculus
tacactttggaacagattcaagtca

SEQ ID NO: 348848 - DNA, 25 bp, Mus musculus
tacacttttcatgcagatcctgtgt

SEQ ID NO: 348849 - DNA, 25 bp, Mus musculus
tacagaaaaagaggctcctcaactt

SEQ ID NO: 348850 - DNA, 25 bp, Mus musculus
tacagaaaaagctcctgccaccctt

SEQ ID NO: 348851 - DNA, 25 bp, Mus musculus
tacagaaaagggactgatttgctta

SEQ ID NO: 348852 - DNA, 25 bp, Mus musculus
tacagaaaagggtgtgtttgacgtg

SEQ ID NO: 348853 - DNA, 25 bp, Mus musculus
tacagaaaatactttccgtccagat

SEQ ID NO: 348854 - DNA, 25 bp, Mus musculus
tacagaaacaggagaatccaaatgg

SEQ ID NO: 348855 - DNA, 25 bp, Mus musculus
tacagaaacaggagttattaaaatg

SEQ ID NO: 348856 - DNA, 25 bp, Mus musculus
tacagaaacccatgtgagcatgccc

SEQ ID NO: 348857 - DNA, 25 bp, Mus musculus
tacagaaagagtatgaaaagacaca

SEQ ID NO: 348858 - DNA, 25 bp, Mus musculus
tacagaaagcaagatttgtcttcgg

SEQ ID NO: 348859 - DNA, 25 bp, Mus musculus
tacagaaagccttgagggtgtttct

SEQ ID NO: 348860 - DNA, 25 bp, Mus musculus
tacagaaatcgagctgaggaaacgt

SEQ ID NO: 348861 - DNA, 25 bp, Mus musculus
tacagaaatgaaagtatcaagcact

SEQ ID NO: 348862 - DNA, 25 bp, Mus musculus
tacagaaattgagtgctcctgtgct

SEQ ID NO: 348863 - DNA, 25 bp, Mus musculus
tacagaaattgagtgggacgacttg

SEQ ID NO: 348864 - DNA, 25 bp, Mus musculus
tacagaacagctaggactcagattg

SEQ ID NO: 348865 - DNA, 25 bp, Mus musculus
tacagaacaggcaaagacaagaaag

SEQ ID NO: 348866 - DNA, 25 bp, Mus musculus
tacagaacaggtgggcactctggtt

SEQ ID NO: 348867 - DNA, 25 bp, Mus musculus
tacagaacagtctatacaaccatat

SEQ ID NO: 348868 - DNA, 25 bp, Mus musculus
tacagaaccgaggtagtcaagaaca

SEQ ID NO: 348869 - DNA, 25 bp, Mus musculus
tacagaacctgacaggtatgtcatt

SEQ ID NO: 348870 - DNA, 25 bp, Mus musculus
tacagaactcaggtttaacagaaga

SEQ ID NO: 348871 - DNA, 25 bp, Mus musculus
tacagaagaagaaaagctcaacaga

SEQ ID NO: 348872 - DNA, 25 bp, Mus musculus
tacagaagacaaaggaaacagaggc

SEQ ID NO: 348873 - DNA, 25 bp, Mus musculus
tacagaagagacaggtgagaactca

SEQ ID NO: 348874 - DNA, 25 bp, Mus musculus
tacagaagagggtgattaaagttta

SEQ ID NO: 348875 - DNA, 25 bp, Mus musculus
tacagaagcaagggaaaatacagaa

SEQ ID NO: 348876 - DNA, 25 bp, Mus musculus
tacagaagcaagggaacctgcaact

SEQ ID NO: 348877 - DNA, 25 bp, Mus musculus
tacagaagcagattaagcacatgat

SEQ ID NO: 348878 - DNA, 25 bp, Mus musculus
tacagaagctatgaggtaactgtgg

SEQ ID NO: 348879 - DNA, 25 bp, Mus musculus
tacagaagctatgaggtcatggagg

SEQ ID NO: 348880 - DNA, 25 bp, Mus musculus
tacagaagctgaagcctgcaggtct

SEQ ID NO: 348881 - DNA, 25 bp, Mus musculus
tacagaagtccctaaatcaaaaagt

SEQ ID NO: 348882 - DNA, 25 bp, Mus musculus
tacagaagtccctactccggaccaa

SEQ ID NO: 348883 - DNA, 25 bp, Mus musculus
tacagaataagcttagatatgccaa

SEQ ID NO: 348884 - DNA, 25 bp, Mus musculus
tacagaatactgtaataccagaaga

SEQ ID NO: 348885 - DNA, 25 bp, Mus musculus
tacagaatatttaatacgaacagaa

SEQ ID NO: 348886 - DNA, 25 bp, Mus musculus
tacagaatgaggccggggacgacca

SEQ ID NO: 348887 - DNA, 25 bp, Mus musculus
tacagaatgggataaagatgacctc

SEQ ID NO: 348888 - DNA, 25 bp, Mus musculus
tacagaatgggatctttttaaagcg

SEQ ID NO: 348889 - DNA, 25 bp, Mus musculus
tacagaatgggctgaaccaataacg

SEQ ID NO: 348890 - DNA, 25 bp, Mus musculus
tacagaatggggggtcaacaggaca

SEQ ID NO: 348891 - DNA, 25 bp, Mus musculus
tacagaattgcatactgggacccaa

SEQ ID NO: 348892 - DNA, 25 bp, Mus musculus
tacagaattggacaaaatccccatg

SEQ ID NO: 348893 - DNA, 25 bp, Mus musculus
tacagaattggagttcatagaggac

SEQ ID NO: 348894 - DNA, 25 bp, Mus musculus
tacagaccaggacaaagagaaaaag

SEQ ID NO: 348895 - DNA, 25 bp, Mus musculus
tacagacctccaagggcaccatgaa

SEQ ID NO: 348896 - DNA, 25 bp, Mus musculus
tacagaccttactgtggcctcagag

SEQ ID NO: 348897 - DNA, 25 bp, Mus musculus
tacagagaatccccggcagcccaac

SEQ ID NO: 348898 - DNA, 25 bp, Mus musculus
tacagagaatgaaaagtgaagctga

SEQ ID NO: 348899 - DNA, 25 bp, Mus musculus
tacagagacaggttgcttttaactt

SEQ ID NO: 348900 - DNA, 25 bp, Mus musculus
tacagagaccaggtctttggccagt

SEQ ID NO: 348901 - DNA, 25 bp, Mus musculus
tacagagagcagattctgccctttc

SEQ ID NO: 348902 - DNA, 25 bp, Mus musculus
tacagagaggaagaaacttcaccct

SEQ ID NO: 348903 - DNA, 25 bp, Mus musculus
tacagagaggaagatgtttgagaca

SEQ ID NO: 348904 - DNA, 25 bp, Mus musculus
tacagagcagcagaaaattgtccag

SEQ ID NO: 348905 - DNA, 25 bp, Mus musculus
tacagagcatgaaatgcattgatat

SEQ ID NO: 348906 - DNA, 25 bp, Mus musculus
tacagagccctgggcccttcctgtc

SEQ ID NO: 348907 - DNA, 25 bp, Mus musculus
tacagagctatctaaactctgttca

SEQ ID NO: 348908 - DNA, 25 bp, Mus musculus
tacagaggaaatccaacagcttccc

SEQ ID NO: 348909 - DNA, 25 bp, Mus musculus
tacagaggacaggctcacaactcag

SEQ ID NO: 348910 - DNA, 25 bp, Mus musculus
tacagaggatggctccccttccaat

SEQ ID NO: 348911 - DNA, 25 bp, Mus musculus
tacagaggatggctgttttaaaatc

SEQ ID NO: 348912 - DNA, 25 bp, Mus musculus
tacagaggtgggcttactgtaagtg

SEQ ID NO: 348913 - DNA, 25 bp, Mus musculus
tacagaggtgtccaacaggccatcg

SEQ ID NO: 348914 - DNA, 25 bp, Mus musculus
tacagagtactgcagaaatatgccg

SEQ ID NO: 348915 - DNA, 25 bp, Mus musculus
tacagagtctcagcctactgaggcc

SEQ ID NO: 348916 - DNA, 25 bp, Mus musculus
tacagagtctcaggtggtccacaag

SEQ ID NO: 348917 - DNA, 25 bp, Mus musculus
tacagagtgcaagggtagctaagaa

SEQ ID NO: 348918 - DNA, 25 bp, Mus musculus
tacagagtgcaaggtaaatctttat

SEQ ID NO: 348919 - DNA, 25 bp, Mus musculus
tacagagtggccaccctttgtggtg

SEQ ID NO: 348920 - DNA, 25 bp, Mus musculus
tacagataaagaggactcacggagc

SEQ ID NO: 348921 - DNA, 25 bp, Mus musculus
tacagataaagaggtgctaggacct

SEQ ID NO: 348922 - DNA, 25 bp, Mus musculus
tacagataaagagtgtgactggctc

SEQ ID NO: 348923 - DNA, 25 bp, Mus musculus
tacagataacccccggcagcccaac

SEQ ID NO: 348924 - DNA, 25 bp, Mus musculus
tacagataaggaactgctgaagaag

SEQ ID NO: 348925 - DNA, 25 bp, Mus musculus
tacagataaggtgttctcattgtta

SEQ ID NO: 348926 - DNA, 25 bp, Mus musculus
tacagatatggagaaagagaaaaaa

SEQ ID NO: 348927 - DNA, 25 bp, Mus musculus
tacagatatggagtaacaactgttc

SEQ ID NO: 348928 - DNA, 25 bp, Mus musculus
tacagatatggagtatacaatagat

SEQ ID NO: 348929 - DNA, 25 bp, Mus musculus
tacagatcagagaaaatatggcacc

SEQ ID NO: 348930 - DNA, 25 bp, Mus musculus
tacagatcagggagcctttgcctac

SEQ ID NO: 348931 - DNA, 25 bp, Mus musculus
tacagatccagggagcatggcactc

SEQ ID NO: 348932 - DNA, 25 bp, Mus musculus
tacagatgaccgtgataaaggtgat

SEQ ID NO: 348933 - DNA, 25 bp, Mus musculus
tacagatgatggcgagtcattcgac

SEQ ID NO: 348934 - DNA, 25 bp, Mus musculus
tacagatgtgcacaggacattgccc

SEQ ID NO: 348935 - DNA, 25 bp, Mus musculus
tacagatgtgcacaggctacattgc

SEQ ID NO: 348936 - DNA, 25 bp, Mus musculus
tacagattgctaaaagtactattaa

SEQ ID NO: 348937 - DNA, 25 bp, Mus musculus
tacagattgctaaagaccagagtaa

SEQ ID NO: 348938 - DNA, 25 bp, Mus musculus
tacagattgctaaagcagtgggaac

SEQ ID NO: 348939 - DNA, 25 bp, Mus musculus
tacagatttacaaagttgcttcaga

SEQ ID NO: 348940 - DNA, 25 bp, Mus musculus
tacagatttttctgggattgggtcg

SEQ ID NO: 348941 - DNA, 25 bp, Mus musculus
tacagatttttctgggcccctgatg

SEQ ID NO: 348942 - DNA, 25 bp, Mus musculus
tacagcaaaataggaaacctcgtgt

SEQ ID NO: 348943 - DNA, 25 bp, Mus musculus
tacagcaaaataggacggaaagtta

SEQ ID NO: 348944 - DNA, 25 bp, Mus musculus
tacagcaaacagatgcgtgtacatc

SEQ ID NO: 348945 - DNA, 25 bp, Mus musculus
tacagcaaacagccatttcgtagag

SEQ ID NO: 348946 - DNA, 25 bp, Mus musculus
tacagcaaaccacgactagacaagg

SEQ ID NO: 348947 - DNA, 25 bp, Mus musculus
tacagcaaaccaggactagacaagg

SEQ ID NO: 348948 - DNA, 25 bp, Mus musculus
tacagcaaataaggagacagtgatg

SEQ ID NO: 348949 - DNA, 25 bp, Mus musculus
tacagcaacgaccctgaggacgggg

SEQ ID NO: 348950 - DNA, 25 bp, Mus musculus
tacagcaatgggatacggacagaac

SEQ ID NO: 348951 - DNA, 25 bp, Mus musculus
tacagcacaataaaacccaagcaac

SEQ ID NO: 348952 - DNA, 25 bp, Mus musculus
tacagcacacaggcagaggtgttaa

SEQ ID NO: 348953 - DNA, 25 bp, Mus musculus
tacagcacaggctaaataaaacgga

SEQ ID NO: 348954 - DNA, 25 bp, Mus musculus
tacagcacaggttaccagtgcagaa

SEQ ID NO: 348955 - DNA, 25 bp, Mus musculus
tacagcacaggttgctggttgttgg

SEQ ID NO: 348956 - DNA, 25 bp, Mus musculus
tacagcaccctttcacaccggaact

SEQ ID NO: 348957 - DNA, 25 bp, Mus musculus
tacagcagaagaggaccacgacttc

SEQ ID NO: 348958 - DNA, 25 bp, Mus musculus
tacagcagaggaataaatgaagaag

SEQ ID NO: 348959 - DNA, 25 bp, Mus musculus
tacagcagaggatgctttcgcagca

SEQ ID NO: 348960 - DNA, 25 bp, Mus musculus
tacagcagcagggcacgtcagaggc

SEQ ID NO: 348961 - DNA, 25 bp, Mus musculus
tacagcagcccagtgtcacgagcaa

SEQ ID NO: 348962 - DNA, 25 bp, Mus musculus
tacagcagcctaaaaaagggcaaga

SEQ ID NO: 348963 - DNA, 25 bp, Mus musculus
tacagcagcctaaataagggcaaga

SEQ ID NO: 348964 - DNA, 25 bp, Mus musculus
tacagcagcggcgagagatgctcag

SEQ ID NO: 348965 - DNA, 25 bp, Mus musculus
tacagcaggaagggtgagtttttct

SEQ ID NO: 348966 - DNA, 25 bp, Mus musculus
tacagcagtcactgctggggttcga

SEQ ID NO: 348967 - DNA, 25 bp, Mus musculus
tacagcagttgaaaggagaggatgc

SEQ ID NO: 348968 - DNA, 25 bp, Mus musculus
tacagcagttgcaaggactggacca

SEQ ID NO: 348969 - DNA, 25 bp, Mus musculus
tacagcagttgcaaggtaacctccg

SEQ ID NO: 348970 - DNA, 25 bp, Mus musculus
tacagcatagccctcagggattcat

SEQ ID NO: 348971 - DNA, 25 bp, Mus musculus
tacagcatagggaagcagctgcccc

SEQ ID NO: 348972 - DNA, 25 bp, Mus musculus
tacagcatggggcaaggagagggaa

SEQ ID NO: 348973 - DNA, 25 bp, Mus musculus
tacagcatgggtatcaccagcctcc

SEQ ID NO: 348974 - DNA, 25 bp, Mus musculus
tacagcattactcagagaaagctga

SEQ ID NO: 348975 - DNA, 25 bp, Mus musculus
tacagcattactcagagagagccgc

SEQ ID NO: 348976 - DNA, 25 bp, Mus musculus
tacagccaacagagcttggccagag

SEQ ID NO: 348977 - DNA, 25 bp, Mus musculus
tacagccaaggccaggtagctgaag

SEQ ID NO: 348978 - DNA, 25 bp, Mus musculus
tacagccagctggctttttctaaaa

SEQ ID NO: 348979 - DNA, 25 bp, Mus musculus
tacagccaggatctgagtgttcgag

SEQ ID NO: 348980 - DNA, 25 bp, Mus musculus
tacagccaggatgaggtagatgact

SEQ ID NO: 348981 - DNA, 25 bp, Mus musculus
tacagccatcgggtgggaaaatggc

SEQ ID NO: 348982 - DNA, 25 bp, Mus musculus
tacagccatgatgattgtgggttct

SEQ ID NO: 348983 - DNA, 25 bp, Mus musculus
tacagcccaagcagccacctagatc

SEQ ID NO: 348984 - DNA, 25 bp, Mus musculus
tacagcccagggtctggtgagaagg

SEQ ID NO: 348985 - DNA, 25 bp, Mus musculus
tacagcccaggtttggtcatctccg

SEQ ID NO: 348986 - DNA, 25 bp, Mus musculus
tacagccctgatcacaagtgctctg

SEQ ID NO: 348987 - DNA, 25 bp, Mus musculus
tacagcctagaacaggcagcagaag

SEQ ID NO: 348988 - DNA, 25 bp, Mus musculus
tacagcctcagatgaaatcatgcac

SEQ ID NO: 348989 - DNA, 25 bp, Mus musculus
tacagcctgggctgcgccttcccct

SEQ ID NO: 348990 - DNA, 25 bp, Mus musculus
tacagcgaagccgaagtcttactcc

SEQ ID NO: 348991 - DNA, 25 bp, Mus musculus
tacagcgaagccggagactatctgg

SEQ ID NO: 348992 - DNA, 25 bp, Mus musculus
tacagcgacagagagcacctaaagg

SEQ ID NO: 348993 - DNA, 25 bp, Mus musculus
tacagcgctgactttgagaaacgga

SEQ ID NO: 348994 - DNA, 25 bp, Mus musculus
tacagcgctgactttggcctgcatg

SEQ ID NO: 348995 - DNA, 25 bp, Mus musculus
tacagcggagaagagaatacagaca

SEQ ID NO: 348996 - DNA, 25 bp, Mus musculus
tacagcggagaagaggaattcatga

SEQ ID NO: 348997 - DNA, 25 bp, Mus musculus
tacagcggagcaactgaagactcag

SEQ ID NO: 348998 - DNA, 25 bp, Mus musculus
tacagcgtccccaactcttcctccc

SEQ ID NO: 348999 - DNA, 25 bp, Mus musculus
tacagcgtgcgcatcacccagaaca

SEQ ID NO: 349000 - DNA, 25 bp, Mus musculus
tacagctaaagagaatggactcgct

SEQ ID NO: 349001 - DNA, 25 bp, Mus musculus
tacagctacctagcatgtccaaaat

SEQ ID NO: 349002 - DNA, 25 bp, Mus musculus
tacagctactatgagaagctccata

SEQ ID NO: 349003 - DNA, 25 bp, Mus musculus
tacagctagttcatcactatttcat

SEQ ID NO: 349004 - DNA, 25 bp, Mus musculus
tacagctattgcgtctgcaccaggg

SEQ ID NO: 349005 - DNA, 25 bp, Mus musculus
tacagctcacagaaggacatggctt

SEQ ID NO: 349006 - DNA, 25 bp, Mus musculus
tacagctcagcaaatggagacagag

SEQ ID NO: 349007 - DNA, 25 bp, Mus musculus
tacagctcagcaacaagaagaaatt

SEQ ID NO: 349008 - DNA, 25 bp, Mus musculus
tacagctcagccctgcccacctcaa

SEQ ID NO: 349009 - DNA, 25 bp, Mus musculus
tacagctcaggaaatggagacagag

SEQ ID NO: 349010 - DNA, 25 bp, Mus musculus
tacagctcaggaacaagaagaaatt

SEQ ID NO: 349011 - DNA, 25 bp, Mus musculus
tacagctctttaggtctgaacggcg

SEQ ID NO: 349012 - DNA, 25 bp, Mus musculus
tacagctgctggaaattagagcgct

SEQ ID NO: 349013 - DNA, 25 bp, Mus musculus
tacagctgctggctgagggtgggat

SEQ ID NO: 349014 - DNA, 25 bp, Mus musculus
tacagcttcagaagggtcatgtttc

SEQ ID NO: 349015 - DNA, 25 bp, Mus musculus
tacagcttcagcagctctatgccgc

SEQ ID NO: 349016 - DNA, 25 bp, Mus musculus
tacagcttggggaagggaacataat

SEQ ID NO: 349017 - DNA, 25 bp, Mus musculus
tacagcttgtacaagcttcaaaacc

SEQ ID NO: 349018 - DNA, 25 bp, Mus musculus
tacagcttgtacaagtctgcagatg

SEQ ID NO: 349019 - DNA, 25 bp, Mus musculus
tacagcttttatcaaaggtgtgcca

SEQ ID NO: 349020 - DNA, 25 bp, Mus musculus
tacaggaaaacaggtttcaagtgcc

SEQ ID NO: 349021 - DNA, 25 bp, Mus musculus
tacaggaaaaccaggttgctggtga

SEQ ID NO: 349022 - DNA, 25 bp, Mus musculus
tacaggaaatacatcctgtctgtgc

SEQ ID NO: 349023 - DNA, 25 bp, Mus musculus
tacaggaaatacatgctgtctgtgc

SEQ ID NO: 349024 - DNA, 25 bp, Mus musculus
tacaggaacagcgctcatccactgc

SEQ ID NO: 349025 - DNA, 25 bp, Mus musculus
tacaggaacagcggaaaatacagaa

SEQ ID NO: 349026 - DNA, 25 bp, Mus musculus
tacaggaacccgtcattgcctttct

SEQ ID NO: 349027 - DNA, 25 bp, Mus musculus
tacaggaatacagagaccgtctcga

SEQ ID NO: 349028 - DNA, 25 bp, Mus musculus
tacaggaatacaggattttggttcc

SEQ ID NO: 349029 - DNA, 25 bp, Mus musculus
tacaggaatggagagtggcaagcgt

SEQ ID NO: 349030 - DNA, 25 bp, Mus musculus
tacaggacaagaatgccctggactt

SEQ ID NO: 349031 - DNA, 25 bp, Mus musculus
tacaggacaagctaagcattgagga

SEQ ID NO: 349032 - DNA, 25 bp, Mus musculus
tacaggacatgagctactatagaaa

SEQ ID NO: 349033 - DNA, 25 bp, Mus musculus
tacaggacccagagcaagtccacat

SEQ ID NO: 349034 - DNA, 25 bp, Mus musculus
tacaggactcaggtagatgagaggc

SEQ ID NO: 349035 - DNA, 25 bp, Mus musculus
tacaggactcaggtaggttgatgga

SEQ ID NO: 349036 - DNA, 25 bp, Mus musculus
tacaggagaagtggtgcatggatgt

SEQ ID NO: 349037 - DNA, 25 bp, Mus musculus
tacaggagaagtggtggcctgcttg

SEQ ID NO: 349038 - DNA, 25 bp, Mus musculus
tacaggagaataaaggacctttttc

SEQ ID NO: 349039 - DNA, 25 bp, Mus musculus
tacaggagacagagggcatggtggc

SEQ ID NO: 349040 - DNA, 25 bp, Mus musculus
tacaggagatatgagcaacaaaagc

SEQ ID NO: 349041 - DNA, 25 bp, Mus musculus
tacaggagatatgcgcaacaaaagc

SEQ ID NO: 349042 - DNA, 25 bp, Mus musculus
tacaggagccaggccacagaggatc

SEQ ID NO: 349043 - DNA, 25 bp, Mus musculus
tacaggagctcgagaacttcaagtt

SEQ ID NO: 349044 - DNA, 25 bp, Mus musculus
tacaggatacaaggcaaaaacagct

SEQ ID NO: 349045 - DNA, 25 bp, Mus musculus
tacaggatagagactaatgctcata

SEQ ID NO: 349046 - DNA, 25 bp, Mus musculus
tacaggattagtttccttttagacc

SEQ ID NO: 349047 - DNA, 25 bp, Mus musculus
tacaggattgagacaccggtaccaa

SEQ ID NO: 349048 - DNA, 25 bp, Mus musculus
tacaggcaacgggggtctctttagg

SEQ ID NO: 349049 - DNA, 25 bp, Mus musculus
tacaggcagcagctccggtctgata

SEQ ID NO: 349050 - DNA, 25 bp, Mus musculus
tacaggcagtgtccccaccttcaaa

SEQ ID NO: 349051 - DNA, 25 bp, Mus musculus
tacaggccaactgccaatttgtggt

SEQ ID NO: 349052 - DNA, 25 bp, Mus musculus
tacaggccctggtaaaagcagaagc

SEQ ID NO: 349053 - DNA, 25 bp, Mus musculus
tacaggcgagatgatttttgatcct

SEQ ID NO: 349054 - DNA, 25 bp, Mus musculus
tacaggctcaggaggcctttcccag

SEQ ID NO: 349055 - DNA, 25 bp, Mus musculus
tacaggctccagtctttcacccctt

SEQ ID NO: 349056 - DNA, 25 bp, Mus musculus
tacaggctttttcttacttctcgct

SEQ ID NO: 349057 - DNA, 25 bp, Mus musculus
tacagggaacccaagcaccccttgg

SEQ ID NO: 349058 - DNA, 25 bp, Mus musculus
tacagggatgagactttgaagagaa

SEQ ID NO: 349059 - DNA, 25 bp, Mus musculus
tacagggatgagctagttaaaggcc

SEQ ID NO: 349060 - DNA, 25 bp, Mus musculus
tacagggcaagcttgatgcttgcct

SEQ ID NO: 349061 - DNA, 25 bp, Mus musculus
tacagggggccaggtgagttggagt

SEQ ID NO: 349062 - DNA, 25 bp, Mus musculus
tacaggtacaggcaggcaaaggctc

SEQ ID NO: 349063 - DNA, 25 bp, Mus musculus
tacaggtagggtttcgatgagactg

SEQ ID NO: 349064 - DNA, 25 bp, Mus musculus
tacaggtcatcaagatgaacaggat

SEQ ID NO: 349065 - DNA, 25 bp, Mus musculus
tacaggtcatcaaggacttcccatg

SEQ ID NO: 349066 - DNA, 25 bp, Mus musculus
tacaggtgatcacgctcaccatcat

SEQ ID NO: 349067 - DNA, 25 bp, Mus musculus
tacaggtgctgaaaggtattcccaa

SEQ ID NO: 349068 - DNA, 25 bp, Mus musculus
tacaggtggggtttaggtcacaatc

SEQ ID NO: 349069 - DNA, 25 bp, Mus musculus
tacaggtgtctagtggtaaagcggg

SEQ ID NO: 349070 - DNA, 25 bp, Mus musculus
tacagtaaatggaagatcaagatcg

SEQ ID NO: 349071 - DNA, 25 bp, Mus musculus
tacagtaacagaggtgataagattt

SEQ ID NO: 349072 - DNA, 25 bp, Mus musculus
tacagtaacagagttgacagttcct

SEQ ID NO: 349073 - DNA, 25 bp, Mus musculus
tacagtaaccatccttcttgctttg

SEQ ID NO: 349074 - DNA, 25 bp, Mus musculus
tacagtaagaaggtggaggagcctg

SEQ ID NO: 349075 - DNA, 25 bp, Mus musculus
tacagtaagaaggtggagtacctct

SEQ ID NO: 349076 - DNA, 25 bp, Mus musculus
tacagtaagaccgtggtaaatgttt

SEQ ID NO: 349077 - DNA, 25 bp, Mus musculus
tacagtaagaggtaaagttcaagtt

SEQ ID NO: 349078 - DNA, 25 bp, Mus musculus
tacagtacagctaggtagaagccca

SEQ ID NO: 349079 - DNA, 25 bp, Mus musculus
tacagtacaggcaaatttccagggc

SEQ ID NO: 349080 - DNA, 25 bp, Mus musculus
tacagtactatggggatgtctgtgt

SEQ ID NO: 349081 - DNA, 25 bp, Mus musculus
tacagtatgagggagtggggccggc

SEQ ID NO: 349082 - DNA, 25 bp, Mus musculus
tacagtatgtattggatatgatggt

SEQ ID NO: 349083 - DNA, 25 bp, Mus musculus
tacagtattcagaggaaatataaga

SEQ ID NO: 349084 - DNA, 25 bp, Mus musculus
tacagtattcagttacggtctttgg

SEQ ID NO: 349085 - DNA, 25 bp, Mus musculus
tacagtattcatgagaacctgcagc

SEQ ID NO: 349086 - DNA, 25 bp, Mus musculus
tacagtcactaccaggtgcagaccc

SEQ ID NO: 349087 - DNA, 25 bp, Mus musculus
tacagtcagaagccggagcctggcg

SEQ ID NO: 349088 - DNA, 25 bp, Mus musculus
tacagtcagcacaaactacagctgt

SEQ ID NO: 349089 - DNA, 25 bp, Mus musculus
tacagtcagcacaactcctccagtg

SEQ ID NO: 349090 - DNA, 25 bp, Mus musculus
tacagtcagtacctaccgtgctgtg

SEQ ID NO: 349091 - DNA, 25 bp, Mus musculus
tacagtcagtacctagatcgacagc

SEQ ID NO: 349092 - DNA, 25 bp, Mus musculus
tacagtcagttaaaagaaggtacca

SEQ ID NO: 349093 - DNA, 25 bp, Mus musculus
tacagtcatacagtccagacaagac

SEQ ID NO: 349094 - DNA, 25 bp, Mus musculus
tacagtcccagcagagtgatggttg

SEQ ID NO: 349095 - DNA, 25 bp, Mus musculus
tacagtcccagcaggacatggattt

SEQ ID NO: 349096 - DNA, 25 bp, Mus musculus
tacagtcctagaaaaccaaactgca

SEQ ID NO: 349097 - DNA, 25 bp, Mus musculus
tacagtcctcagaagagcatggcag

SEQ ID NO: 349098 - DNA, 25 bp, Mus musculus
tacagtcctcagaagcatggtgtgc

SEQ ID NO: 349099 - DNA, 25 bp, Mus musculus
tacagtctatcttggaaaagatgac

SEQ ID NO: 349100 - DNA, 25 bp, Mus musculus
tacagtctcagaagtcagcggctgc

SEQ ID NO: 349101 - DNA, 25 bp, Mus musculus
tacagtgaagatcgttaccagaaaa

SEQ ID NO: 349102 - DNA, 25 bp, Mus musculus
tacagtgacagaaatcagttcgtct

SEQ ID NO: 349103 - DNA, 25 bp, Mus musculus
tacagtgacaggtatatctttgcaa

SEQ ID NO: 349104 - DNA, 25 bp, Mus musculus
tacagtgacagttacggacgagttt

SEQ ID NO: 349105 - DNA, 25 bp, Mus musculus
tacagtgatcaggttcagcgtcctc

SEQ ID NO: 349106 - DNA, 25 bp, Mus musculus
tacagtgcaaaggtaatgctgatgg

SEQ ID NO: 349107 - DNA, 25 bp, Mus musculus
tacagtgcacagctggtatgcatgg

SEQ ID NO: 349108 - DNA, 25 bp, Mus musculus
tacagtgcagggctggaagccattc

SEQ ID NO: 349109 - DNA, 25 bp, Mus musculus
tacagtgcgcctccgccggtgagct

SEQ ID NO: 349110 - DNA, 25 bp, Mus musculus
tacagtgcgcgcgatgaggctgtag

SEQ ID NO: 349111 - DNA, 25 bp, Mus musculus
tacagtgcttctcagacacaaatca

SEQ ID NO: 349112 - DNA, 25 bp, Mus musculus
tacagttaaggaagctgtgctgaat

SEQ ID NO: 349113 - DNA, 25 bp, Mus musculus
tacagttaagtagtcttttcacaga

SEQ ID NO: 349114 - DNA, 25 bp, Mus musculus
tacagttaccaggaccgctcctttg

SEQ ID NO: 349115 - DNA, 25 bp, Mus musculus
tacagttaccaggggcacgaccagt

SEQ ID NO: 349116 - DNA, 25 bp, Mus musculus
tacagttccagaggcagcagtggtc

SEQ ID NO: 349117 - DNA, 25 bp, Mus musculus
tacagttccagattcagcacttagg

SEQ ID NO: 349118 - DNA, 25 bp, Mus musculus
tacagttgcaggcatcccacaaaga

SEQ ID NO: 349119 - DNA, 25 bp, Mus musculus
tacagtttcagagtttctaagctga

SEQ ID NO: 349120 - DNA, 25 bp, Mus musculus
tacagtttgaaatcattgctatgtc

SEQ ID NO: 349121 - DNA, 25 bp, Mus musculus
tacagtttttggaggcaactgtgcc

SEQ ID NO: 349122 - DNA, 25 bp, Mus musculus
tacataaaagaggaactcattatac

SEQ ID NO: 349123 - DNA, 25 bp, Mus musculus
tacataaatatgcaaacagggagga

SEQ ID NO: 349124 - DNA, 25 bp, Mus musculus
tacataacccttcggtgacccaccc

SEQ ID NO: 349125 - DNA, 25 bp, Mus musculus
tacataagcgaagctctggggtctg

SEQ ID NO: 349126 - DNA, 25 bp, Mus musculus
tacatacagccagagaagtgacagg

SEQ ID NO: 349127 - DNA, 25 bp, Mus musculus
tacatacagccaggaaacaaagctt

SEQ ID NO: 349128 - DNA, 25 bp, Mus musculus
tacatacagccaggaaggaatctgc

SEQ ID NO: 349129 - DNA, 25 bp, Mus musculus
tacatacctagggatgccctggacc

SEQ ID NO: 349130 - DNA, 25 bp, Mus musculus
tacatacgacagctgcctcctagct

SEQ ID NO: 349131 - DNA, 25 bp, Mus musculus
tacatacgacagctgggctacttga

SEQ ID NO: 349132 - DNA, 25 bp, Mus musculus
tacatactcaagctaccactacccc

SEQ ID NO: 349133 - DNA, 25 bp, Mus musculus
tacatacttccatgaaacaatccca

SEQ ID NO: 349134 - DNA, 25 bp, Mus musculus
tacatacttccatggccgtaattaa

SEQ ID NO: 349135 - DNA, 25 bp, Mus musculus
tacatacttctacactccagaagag

SEQ ID NO: 349136 - DNA, 25 bp, Mus musculus
tacatagaagttgaccagatatatc

SEQ ID NO: 349137 - DNA, 25 bp, Mus musculus
tacatagcgacagcgaaggacgaac

SEQ ID NO: 349138 - DNA, 25 bp, Mus musculus
tacataggcaaggatagttcatgca

SEQ ID NO: 349139 - DNA, 25 bp, Mus musculus
tacatagtgaacgagccacctccca

SEQ ID NO: 349140 - DNA, 25 bp, Mus musculus
tacatagtgaccatggtggtgatga

SEQ ID NO: 349141 - DNA, 25 bp, Mus musculus
tacatataataagaacctatgggct

SEQ ID NO: 349142 - DNA, 25 bp, Mus musculus
tacatataattcatattacaggcct

SEQ ID NO: 349143 - DNA, 25 bp, Mus musculus
tacatatgagtcgaacaccaaacag

SEQ ID NO: 349144 - DNA, 25 bp, Mus musculus
tacatatgcagacatcaagccctac

SEQ ID NO: 349145 - DNA, 25 bp, Mus musculus
tacatatgcaggaatctccacacaa

SEQ ID NO: 349146 - DNA, 25 bp, Mus musculus
tacatatggaagtgctccttccgct

SEQ ID NO: 349147 - DNA, 25 bp, Mus musculus
tacatattcttcatcgtcatttact

SEQ ID NO: 349148 - DNA, 25 bp, Mus musculus
tacatatttgcaggtgtcctccacc

SEQ ID NO: 349149 - DNA, 25 bp, Mus musculus
tacatcaaaagaggcttccagtttg

SEQ ID NO: 349150 - DNA, 25 bp, Mus musculus
tacatcaaaagctgcagaatctgtg

SEQ ID NO: 349151 - DNA, 25 bp, Mus musculus
tacatcaaaaggtacttcgagtttt

SEQ ID NO: 349152 - DNA, 25 bp, Mus musculus
tacatcaagcgcgccaacagcctcg

SEQ ID NO: 349153 - DNA, 25 bp, Mus musculus
tacatcaatatcacagaaaagtgtg

SEQ ID NO: 349154 - DNA, 25 bp, Mus musculus
tacatcaccagaagacaagactggc

SEQ ID NO: 349155 - DNA, 25 bp, Mus musculus
tacatcacgaatccagttcactctg

SEQ ID NO: 349156 - DNA, 25 bp, Mus musculus
tacatcagagacttcagtactcgct

SEQ ID NO: 349157 - DNA, 25 bp, Mus musculus
tacatcatcatggaaggcgtcacct

SEQ ID NO: 349158 - DNA, 25 bp, Mus musculus
tacatcatgccaagacaactcctga

SEQ ID NO: 349159 - DNA, 25 bp, Mus musculus
tacatcatgccaagcctgttcatta

SEQ ID NO: 349160 - DNA, 25 bp, Mus musculus
tacatcatgccaaggactctggagg

SEQ ID NO: 349161 - DNA, 25 bp, Mus musculus
tacatcatgtttggacctgatattt

SEQ ID NO: 349162 - DNA, 25 bp, Mus musculus
tacatccaccctgaaacgatcagca

SEQ ID NO: 349163 - DNA, 25 bp, Mus musculus
tacatccccaccgtctttgacaact

SEQ ID NO: 349164 - DNA, 25 bp, Mus musculus
tacatccccaccgtgacgtgttctt

SEQ ID NO: 349165 - DNA, 25 bp, Mus musculus
tacatccctctggatcggttaagca

SEQ ID NO: 349166 - DNA, 25 bp, Mus musculus
tacatccctctggtgaattccaagg

SEQ ID NO: 349167 - DNA, 25 bp, Mus musculus
tacatccctgccaaatttccaagca

SEQ ID NO: 349168 - DNA, 25 bp, Mus musculus
tacatccctgccaacaagaacctga

SEQ ID NO: 349169 - DNA, 25 bp, Mus musculus
tacatccggccaggacctagggaag

SEQ ID NO: 349170 - DNA, 25 bp, Mus musculus
tacatcgacagacatctgcaactat

SEQ ID NO: 349171 - DNA, 25 bp, Mus musculus
tacatcgaccctgagactggtatgg

SEQ ID NO: 349172 - DNA, 25 bp, Mus musculus
tacatcgctgggactaatggcaatt

SEQ ID NO: 349173 - DNA, 25 bp, Mus musculus
tacatcggaggaaatgaggccaggt

SEQ ID NO: 349174 - DNA, 25 bp, Mus musculus
tacatcgtggtggacagtgaacttt

SEQ ID NO: 349175 - DNA, 25 bp, Mus musculus
tacatcgtggtgtatgttgtatggg

SEQ ID NO: 349176 - DNA, 25 bp, Mus musculus
tacatctaccaggaaataatccttg

SEQ ID NO: 349177 - DNA, 25 bp, Mus musculus
tacatctagtggcagagagttgaag

SEQ ID NO: 349178 - DNA, 25 bp, Mus musculus
tacatctatcagccatggcgagtgc

SEQ ID NO: 349179 - DNA, 25 bp, Mus musculus
tacatctcaggccagggctttgacc

SEQ ID NO: 349180 - DNA, 25 bp, Mus musculus
tacatctcaggcccctggtttgata

SEQ ID NO: 349181 - DNA, 25 bp, Mus musculus
tacatctgaaacatggtggtaagag

SEQ ID NO: 349182 - DNA, 25 bp, Mus musculus
tacatctgactcaagggaagtaagc

SEQ ID NO: 349183 - DNA, 25 bp, Mus musculus
tacatctgccagtgtcctggcataa

SEQ ID NO: 349184 - DNA, 25 bp, Mus musculus
tacatctggcacagaagctgattgg

SEQ ID NO: 349185 - DNA, 25 bp, Mus musculus
tacatctttgaaggtctgggacacc

SEQ ID NO: 349186 - DNA, 25 bp, Mus musculus
tacatctttggtattgttgggtgtg

SEQ ID NO: 349187 - DNA, 25 bp, Mus musculus
tacatgaaggcaccaatttcgttgt

SEQ ID NO: 349188 - DNA, 25 bp, Mus musculus
tacatgatccagagaggtgctcggt

SEQ ID NO: 349189 - DNA, 25 bp, Mus musculus
tacatgatgatcgtggaccctgcca

SEQ ID NO: 349190 - DNA, 25 bp, Mus musculus
tacatgatgatcgtggcgggatccg

SEQ ID NO: 349191 - DNA, 25 bp, Mus musculus
tacatgatgatcgtggtttggcctg

SEQ ID NO: 349192 - DNA, 25 bp, Mus musculus
tacatgatgcaggtgaagacttttg

SEQ ID NO: 349193 - DNA, 25 bp, Mus musculus
tacatgcagcagattcaagtcaatc

SEQ ID NO: 349194 - DNA, 25 bp, Mus musculus
tacatgctaccagaagccagatgag

SEQ ID NO: 349195 - DNA, 25 bp, Mus musculus
tacatgctaccagcatttgatgacc

SEQ ID NO: 349196 - DNA, 25 bp, Mus musculus
tacatgctcaggtgcgctggtaccc

SEQ ID NO: 349197 - DNA, 25 bp, Mus musculus
tacatgctgacagatcgggagaatc

SEQ ID NO: 349198 - DNA, 25 bp, Mus musculus
tacatgctgcagctgctgttgatgc

SEQ ID NO: 349199 - DNA, 25 bp, Mus musculus
tacatgctgcagttggtgcttcccg

SEQ ID NO: 349200 - DNA, 25 bp, Mus musculus
tacatgctttgatgtcccgcatggt

SEQ ID NO: 349201 - DNA, 25 bp, Mus musculus
tacatggaaagatcagtactgagtc

SEQ ID NO: 349202 - DNA, 25 bp, Mus musculus
tacatggaaagggatcagtaatggc

SEQ ID NO: 349203 - DNA, 25 bp, Mus musculus
tacatggaaggaggcatggagaagc

SEQ ID NO: 349204 - DNA, 25 bp, Mus musculus
tacatggaagggcgtggagctggtg

SEQ ID NO: 349205 - DNA, 25 bp, Mus musculus
tacatggacgacctgcaactttttg

SEQ ID NO: 349206 - DNA, 25 bp, Mus musculus
tacatggagcagttaacgcgggggg

SEQ ID NO: 349207 - DNA, 25 bp, Mus musculus
tacatggaggaatgtctataacaat

SEQ ID NO: 349208 - DNA, 25 bp, Mus musculus
tacatggaggaggtgcggcggcagc

SEQ ID NO: 349209 - DNA, 25 bp, Mus musculus
tacatggctcctgctgactgggttt

SEQ ID NO: 349210 - DNA, 25 bp, Mus musculus
tacatgggatgctagccaacgacca

SEQ ID NO: 349211 - DNA, 25 bp, Mus musculus
tacatgggcaacgctggacgtaaag

SEQ ID NO: 349212 - DNA, 25 bp, Mus musculus
tacatgggcgagtgcggtttcgtgg

SEQ ID NO: 349213 - DNA, 25 bp, Mus musculus
tacatggggagatcctttctctgct

SEQ ID NO: 349214 - DNA, 25 bp, Mus musculus
tacatggggaggattcagtccttct

SEQ ID NO: 349215 - DNA, 25 bp, Mus musculus
tacatggtgtttaaggccaagcatc

SEQ ID NO: 349216 - DNA, 25 bp, Mus musculus
tacatgtaaaggtcaagtagcatca

SEQ ID NO: 349217 - DNA, 25 bp, Mus musculus
tacatgtatatcagacactgtcctg

SEQ ID NO: 349218 - DNA, 25 bp, Mus musculus
tacatgtcaagatgtgaatgagtgc

SEQ ID NO: 349219 - DNA, 25 bp, Mus musculus
tacatgtcaagatgtggatgagtgc

SEQ ID NO: 349220 - DNA, 25 bp, Mus musculus
tacatgtcaagcatcagtgaacact

SEQ ID NO: 349221 - DNA, 25 bp, Mus musculus
tacatgtgcgcagacaaacccggag

SEQ ID NO: 349222 - DNA, 25 bp, Mus musculus
tacatgtgcgcagccgcctgggaaa

SEQ ID NO: 349223 - DNA, 25 bp, Mus musculus
tacatgtgtgaaaaccttgtcacta

SEQ ID NO: 349224 - DNA, 25 bp, Mus musculus
tacatgtttttacaagagctaagtg

SEQ ID NO: 349225 - DNA, 25 bp, Mus musculus
tacattaaaagttttcagcagactc

SEQ ID NO: 349226 - DNA, 25 bp, Mus musculus
tacattaaaggaggcacttgactca

SEQ ID NO: 349227 - DNA, 25 bp, Mus musculus
tacattaaagtgacatatgacatcc

SEQ ID NO: 349228 - DNA, 25 bp, Mus musculus
tacattaaagtgcccagccacagct

SEQ ID NO: 349229 - DNA, 25 bp, Mus musculus
tacattaaagttctttcagattacg

SEQ ID NO: 349230 - DNA, 25 bp, Mus musculus
tacattaacgtggttcattatgatg

SEQ ID NO: 349231 - DNA, 25 bp, Mus musculus
tacattaatgattccattggcttac

SEQ ID NO: 349232 - DNA, 25 bp, Mus musculus
tacattaatgccaccctgcaggcat

SEQ ID NO: 349233 - DNA, 25 bp, Mus musculus
tacattaatgccatttagttcgcta

SEQ ID NO: 349234 - DNA, 25 bp, Mus musculus
tacattaatgctaccgtcttgattc

SEQ ID NO: 349235 - DNA, 25 bp, Mus musculus
tacattacacaagaaaaaagtgaaa

SEQ ID NO: 349236 - DNA, 25 bp, Mus musculus
tacattagtgggaagcagctatact

SEQ ID NO: 349237 - DNA, 25 bp, Mus musculus
tacattagtgggtagcagctatact

SEQ ID NO: 349238 - DNA, 25 bp, Mus musculus
tacattatatatgcaagttctgctg

SEQ ID NO: 349239 - DNA, 25 bp, Mus musculus
tacattatatctacatcaaatgggt

SEQ ID NO: 349240 - DNA, 25 bp, Mus musculus
tacattattgagatgacacagagac

SEQ ID NO: 349241 - DNA, 25 bp, Mus musculus
tacattattgaggccactgcagatg

SEQ ID NO: 349242 - DNA, 25 bp, Mus musculus
tacattattggagatcgtggccttc

SEQ ID NO: 349243 - DNA, 25 bp, Mus musculus
tacattattggaggtgctctgcccg

SEQ ID NO: 349244 - DNA, 25 bp, Mus musculus
tacattcaatgctcagtgctgcctg

SEQ ID NO: 349245 - DNA, 25 bp, Mus musculus
tacattcagagcaggagcctttgac

SEQ ID NO: 349246 - DNA, 25 bp, Mus musculus
tacattcagcccacttggtgcctcc

SEQ ID NO: 349247 - DNA, 25 bp, Mus musculus
tacattcagctctggtgattgttca

SEQ ID NO: 349248 - DNA, 25 bp, Mus musculus
tacattccaaaggtgtgcaggattt

SEQ ID NO: 349249 - DNA, 25 bp, Mus musculus
tacattccacactcccgtatgaaaa

SEQ ID NO: 349250 - DNA, 25 bp, Mus musculus
tacattccagaggtgatggtggccc

SEQ ID NO: 349251 - DNA, 25 bp, Mus musculus
tacattccagcagaccgacttgtct

SEQ ID NO: 349252 - DNA, 25 bp, Mus musculus
tacattccagggccttattttggcg

SEQ ID NO: 349253 - DNA, 25 bp, Mus musculus
tacattcctcagggaactgaaacca

SEQ ID NO: 349254 - DNA, 25 bp, Mus musculus
tacattcctgagccagtcctagagg

SEQ ID NO: 349255 - DNA, 25 bp, Mus musculus
tacattcctgagccgggataactgg

SEQ ID NO: 349256 - DNA, 25 bp, Mus musculus
tacattcgcataccggatggaaatg

SEQ ID NO: 349257 - DNA, 25 bp, Mus musculus
tacattctcaaggtttcttttacag

SEQ ID NO: 349258 - DNA, 25 bp, Mus musculus
tacattctcttaaggttgtgtggag

SEQ ID NO: 349259 - DNA, 25 bp, Mus musculus
tacattgaactaaaggagtcaagga

SEQ ID NO: 349260 - DNA, 25 bp, Mus musculus
tacattgagagtcaggtacagtgcg

SEQ ID NO: 349261 - DNA, 25 bp, Mus musculus
tacattgagagtcatcctttttcag

SEQ ID NO: 349262 - DNA, 25 bp, Mus musculus
tacattgaggggtacgtgccatcac

SEQ ID NO: 349263 - DNA, 25 bp, Mus musculus
tacattgaggggtctgtgcacttgt

SEQ ID NO: 349264 - DNA, 25 bp, Mus musculus
tacattgcaaagattctgaaaggcc

SEQ ID NO: 349265 - DNA, 25 bp, Mus musculus
tacattgcaatggatgagtttcatc

SEQ ID NO: 349266 - DNA, 25 bp, Mus musculus
tacattggcatagctccttattacc

SEQ ID NO: 349267 - DNA, 25 bp, Mus musculus
tacattggctggggctccaacggca

SEQ ID NO: 349268 - DNA, 25 bp, Mus musculus
tacattggctggtgtcccttctggt

SEQ ID NO: 349269 - DNA, 25 bp, Mus musculus
tacattgtctatgagtttctgatgt

SEQ ID NO: 349270 - DNA, 25 bp, Mus musculus
tacattgtcttgctgagtatcctgc

SEQ ID NO: 349271 - DNA, 25 bp, Mus musculus
tacattgtgctatagggattgtgcc

SEQ ID NO: 349272 - DNA, 25 bp, Mus musculus
tacattgtgctcaagaccttcctgg

SEQ ID NO: 349273 - DNA, 25 bp, Mus musculus
tacatttaaaagctatgacttcaca

SEQ ID NO: 349274 - DNA, 25 bp, Mus musculus
tacatttaaaaggccatatcaatat

SEQ ID NO: 349275 - DNA, 25 bp, Mus musculus
tacatttaagacaaatgaagagaaa

SEQ ID NO: 349276 - DNA, 25 bp, Mus musculus
tacatttcaaaggtaccaaagcagt

SEQ ID NO: 349277 - DNA, 25 bp, Mus musculus
tacatttcaaaggttagcgatgcaa

SEQ ID NO: 349278 - DNA, 25 bp, Mus musculus
tacatttcaaggcacagaagaaaat

SEQ ID NO: 349279 - DNA, 25 bp, Mus musculus
tacatttcaagtcttcaggaaagac

SEQ ID NO: 349280 - DNA, 25 bp, Mus musculus
tacatttcagacatcccgcttacgc

SEQ ID NO: 349281 - DNA, 25 bp, Mus musculus
tacatttcagatcctcctaccacca

SEQ ID NO: 349282 - DNA, 25 bp, Mus musculus
tacatttctaactgggttatgggtg

SEQ ID NO: 349283 - DNA, 25 bp, Mus musculus
tacatttctaactggtagtgtgagg

SEQ ID NO: 349284 - DNA, 25 bp, Mus musculus
tacattttaaaaaagtcgagcctgt

SEQ ID NO: 349285 - DNA, 25 bp, Mus musculus
tacattttcacggacaagccctcag

SEQ ID NO: 349286 - DNA, 25 bp, Mus musculus
tacattttgatggagcctgaaacat

SEQ ID NO: 349287 - DNA, 25 bp, Mus musculus
taccaaaaagcagatggagacacgg

SEQ ID NO: 349288 - DNA, 25 bp, Mus musculus
taccaaaaagcagattgtccatccc

SEQ ID NO: 349289 - DNA, 25 bp, Mus musculus
taccaaaaatagcgaccagttcgtg

SEQ ID NO: 349290 - DNA, 25 bp, Mus musculus
taccaaaacaaccctggcctatgga

SEQ ID NO: 349291 - DNA, 25 bp, Mus musculus
taccaaaacgaaaatgcaaaattac

SEQ ID NO: 349292 - DNA, 25 bp, Mus musculus
taccaaaatctcagaactcaagtga

SEQ ID NO: 349293 - DNA, 25 bp, Mus musculus
taccaaaatctcaggctggcctgtg

SEQ ID NO: 349294 - DNA, 25 bp, Mus musculus
taccaaagcagagttctcgtcattt

SEQ ID NO: 349295 - DNA, 25 bp, Mus musculus
taccaaagcaggcttcttcccttac

SEQ ID NO: 349296 - DNA, 25 bp, Mus musculus
taccaaagtcttgtgatttgaactg

SEQ ID NO: 349297 - DNA, 25 bp, Mus musculus
taccaaagtgatcctatcccatcac

SEQ ID NO: 349298 - DNA, 25 bp, Mus musculus
taccaaatcagcagaaatggaggaa

SEQ ID NO: 349299 - DNA, 25 bp, Mus musculus
taccaacaaggcaaagggtggtgga

SEQ ID NO: 349300 - DNA, 25 bp, Mus musculus
taccaacaccatggacaaaagcttc

SEQ ID NO: 349301 - DNA, 25 bp, Mus musculus
taccaacaccatggtgtttcctggc

SEQ ID NO: 349302 - DNA, 25 bp, Mus musculus
taccaacatgtggagtgaaaaatct

SEQ ID NO: 349303 - DNA, 25 bp, Mus musculus
taccaacattgctggacatttcaat

SEQ ID NO: 349304 - DNA, 25 bp, Mus musculus
taccaacattgctggatcctctccc

SEQ ID NO: 349305 - DNA, 25 bp, Mus musculus
taccaacggaggtcctgggtgggat

SEQ ID NO: 349306 - DNA, 25 bp, Mus musculus
taccaacggtaagacaataaaatta

SEQ ID NO: 349307 - DNA, 25 bp, Mus musculus
taccaacgtggtccactgacaaagc

SEQ ID NO: 349308 - DNA, 25 bp, Mus musculus
taccaactacaggtcaccttgttgg

SEQ ID NO: 349309 - DNA, 25 bp, Mus musculus
taccaactgcttgtggactaaagag

SEQ ID NO: 349310 - DNA, 25 bp, Mus musculus
taccaacttcttaactgacaggcca

SEQ ID NO: 349311 - DNA, 25 bp, Mus musculus
taccaagaaaaagacgctgggctgc

SEQ ID NO: 349312 - DNA, 25 bp, Mus musculus
taccaagaaaaagacttcaaggagg

SEQ ID NO: 349313 - DNA, 25 bp, Mus musculus
taccaagaagtgtcgagagctgtac

SEQ ID NO: 349314 - DNA, 25 bp, Mus musculus
taccaagacagcagggagtgtgtgc

SEQ ID NO: 349315 - DNA, 25 bp, Mus musculus
taccaagacagcagggtttcaatgc

SEQ ID NO: 349316 - DNA, 25 bp, Mus musculus
taccaagagaaccggcatggagagt

SEQ ID NO: 349317 - DNA, 25 bp, Mus musculus
taccaagagtaaggacgagtcttgc

SEQ ID NO: 349318 - DNA, 25 bp, Mus musculus
taccaagccatggtacactgtggga

SEQ ID NO: 349319 - DNA, 25 bp, Mus musculus
taccaagcctagtgctaccaaggga

SEQ ID NO: 349320 - DNA, 25 bp, Mus musculus
taccaaggactgctacaccttacaa

SEQ ID NO: 349321 - DNA, 25 bp, Mus musculus
taccaaggactggccttctcagtat

SEQ ID NO: 349322 - DNA, 25 bp, Mus musculus
taccaaggagctggagaaggtgtat

SEQ ID NO: 349323 - DNA, 25 bp, Mus musculus
taccaaggaggccaaattgggacag

SEQ ID NO: 349324 - DNA, 25 bp, Mus musculus
taccaaggagtttctatgattgttt

SEQ ID NO: 349325 - DNA, 25 bp, Mus musculus
taccaaggcgggcagacgtatgttt

SEQ ID NO: 349326 - DNA, 25 bp, Mus musculus
taccaaggctacactggggcttaca

SEQ ID NO: 349327 - DNA, 25 bp, Mus musculus
taccaaggtgagactctgctgctaa

SEQ ID NO: 349328 - DNA, 25 bp, Mus musculus
taccaatagagggggctactgagtg

SEQ ID NO: 349329 - DNA, 25 bp, Mus musculus
taccaatagttcagacatcctacag

SEQ ID NO: 349330 - DNA, 25 bp, Mus musculus
taccaatcccagtgactctggacgt

SEQ ID NO: 349331 - DNA, 25 bp, Mus musculus
taccaatgaaaacaggcccagagga

SEQ ID NO: 349332 - DNA, 25 bp, Mus musculus
taccaatgaaaacagggcacctccg

SEQ ID NO: 349333 - DNA, 25 bp, Mus musculus
taccaatgaaaagggtgccttctca

SEQ ID NO: 349334 - DNA, 25 bp, Mus musculus
taccaatgaagacagttgattcagg

SEQ ID NO: 349335 - DNA, 25 bp, Mus musculus
taccaatggcctgatcacaactggc

SEQ ID NO: 349336 - DNA, 25 bp, Mus musculus
taccaatgtatgcagggacgcatcg

SEQ ID NO: 349337 - DNA, 25 bp, Mus musculus
taccaatgtcctgatttcagagtgg

SEQ ID NO: 349338 - DNA, 25 bp, Mus musculus
taccaatttaagctccagctccaga

SEQ ID NO: 349339 - DNA, 25 bp, Mus musculus
taccaatttttgtagtgccaggaca

SEQ ID NO: 349340 - DNA, 25 bp, Mus musculus
taccacaacacaacaatcttgggat

SEQ ID NO: 349341 - DNA, 25 bp, Mus musculus
taccacaaccacagactggaaccag

SEQ ID NO: 349342 - DNA, 25 bp, Mus musculus
taccacaaccagctgctgaaccgaa

SEQ ID NO: 349343 - DNA, 25 bp, Mus musculus
taccacaagaaggttgtggatcatt

SEQ ID NO: 349344 - DNA, 25 bp, Mus musculus
taccacaaggagccagaactacagc

SEQ ID NO: 349345 - DNA, 25 bp, Mus musculus
taccacacaagattccgcagggcca

SEQ ID NO: 349346 - DNA, 25 bp, Mus musculus
taccacacaagggccatcaaaagtg

SEQ ID NO: 349347 - DNA, 25 bp, Mus musculus
taccacacaaggtttgacggatgaa

SEQ ID NO: 349348 - DNA, 25 bp, Mus musculus
taccacacagcaaggggacggggca

SEQ ID NO: 349349 - DNA, 25 bp, Mus musculus
taccacacagcaagggggaagcatg

SEQ ID NO: 349350 - DNA, 25 bp, Mus musculus
taccacagcgtgctctcaatgaagg

SEQ ID NO: 349351 - DNA, 25 bp, Mus musculus
taccacagtcactggacccaaagtc

SEQ ID NO: 349352 - DNA, 25 bp, Mus musculus
taccacatccactggtggagctgcc

SEQ ID NO: 349353 - DNA, 25 bp, Mus musculus
taccaccaaactggctgataggacc

SEQ ID NO: 349354 - DNA, 25 bp, Mus musculus
taccaccaacgagagccatccttcc

SEQ ID NO: 349355 - DNA, 25 bp, Mus musculus
taccaccaccaccacggcgacgaca

SEQ ID NO: 349356 - DNA, 25 bp, Mus musculus
taccaccatggagaacaagcattga

SEQ ID NO: 349357 - DNA, 25 bp, Mus musculus
taccacccaagattcagtttgctga

SEQ ID NO: 349358 - DNA, 25 bp, Mus musculus
taccacccaggaactaaggcaagag

SEQ ID NO: 349359 - DNA, 25 bp, Mus musculus
taccacccaggctgacccttccagc

SEQ ID NO: 349360 - DNA, 25 bp, Mus musculus
taccaccccacaaacctgacgagat

SEQ ID NO: 349361 - DNA, 25 bp, Mus musculus
taccaccgcgtaggatctttctcaa

SEQ ID NO: 349362 - DNA, 25 bp, Mus musculus
taccacctccaagaagccaaatctt

SEQ ID NO: 349363 - DNA, 25 bp, Mus musculus
taccacctcccaagattccactttg

SEQ ID NO: 349364 - DNA, 25 bp, Mus musculus
taccacctgtggtggactggtgata

SEQ ID NO: 349365 - DNA, 25 bp, Mus musculus
taccacgagcagcccgaggagctca

SEQ ID NO: 349366 - DNA, 25 bp, Mus musculus
taccacgctccagaggctttgctga

SEQ ID NO: 349367 - DNA, 25 bp, Mus musculus
taccacgctccagagtgtgcactct

SEQ ID NO: 349368 - DNA, 25 bp, Mus musculus
taccacgcttggaaagcaaatgcaa

SEQ ID NO: 349369 - DNA, 25 bp, Mus musculus
taccacgcttggaaagttgtccagt

SEQ ID NO: 349370 - DNA, 25 bp, Mus musculus
taccacggagtttgtcacagtaaca

SEQ ID NO: 349371 - DNA, 25 bp, Mus musculus
taccacggcatgcagaggaatctgg

SEQ ID NO: 349372 - DNA, 25 bp, Mus musculus
taccacggcatgcagggtgtgtctg

SEQ ID NO: 349373 - DNA, 25 bp, Mus musculus
taccacggctcgccagaggcctcgc

SEQ ID NO: 349374 - DNA, 25 bp, Mus musculus
taccacggctctacttccccacgag

SEQ ID NO: 349375 - DNA, 25 bp, Mus musculus
taccacgggcagagacttaaagttc

SEQ ID NO: 349376 - DNA, 25 bp, Mus musculus
taccacgggcagtgacttaaagttc

SEQ ID NO: 349377 - DNA, 25 bp, Mus musculus
taccacgtcagtcctcgttgccatt

SEQ ID NO: 349378 - DNA, 25 bp, Mus musculus
taccactaaacgattggtgacccag

SEQ ID NO: 349379 - DNA, 25 bp, Mus musculus
taccactacacccagctgccctcac

SEQ ID NO: 349380 - DNA, 25 bp, Mus musculus
taccactcaggctctcgccttgata

SEQ ID NO: 349381 - DNA, 25 bp, Mus musculus
taccactgcggcaagtttgatggtg

SEQ ID NO: 349382 - DNA, 25 bp, Mus musculus
taccactggtgcgaacaaagtctcc

SEQ ID NO: 349383 - DNA, 25 bp, Mus musculus
taccacttagatagttgaagtattg

SEQ ID NO: 349384 - DNA, 25 bp, Mus musculus
taccacttgcagacaaatgaattcc

SEQ ID NO: 349385 - DNA, 25 bp, Mus musculus
taccagaaagccttgtgcctctgca

SEQ ID NO: 349386 - DNA, 25 bp, Mus musculus
taccagaaagtttgcttacctgggg

SEQ ID NO: 349387 - DNA, 25 bp, Mus musculus
taccagaaataggagcagttgacct

SEQ ID NO: 349388 - DNA, 25 bp, Mus musculus
taccagaaccaactgataaccaagc

SEQ ID NO: 349389 - DNA, 25 bp, Mus musculus
taccagaaccaactggagagacttc

SEQ ID NO: 349390 - DNA, 25 bp, Mus musculus
taccagaagacctcatcgggaacca

SEQ ID NO: 349391 - DNA, 25 bp, Mus musculus
taccagaagcagtgcgatgactttg

SEQ ID NO: 349392 - DNA, 25 bp, Mus musculus
taccagaatgaggatcccagaaagc

SEQ ID NO: 349393 - DNA, 25 bp, Mus musculus
taccagaatgttgaccccaacaagg

SEQ ID NO: 349394 - DNA, 25 bp, Mus musculus
taccagaattatatatgttgggtaa

SEQ ID NO: 349395 - DNA, 25 bp, Mus musculus
taccagacactaatctgaccccagt

SEQ ID NO: 349396 - DNA, 25 bp, Mus musculus
taccagacactgcacaagggcacca

SEQ ID NO: 349397 - DNA, 25 bp, Mus musculus
taccagaccagtatcacagagcagc

SEQ ID NO: 349398 - DNA, 25 bp, Mus musculus
taccagaccagtcgtgttgaggaga

SEQ ID NO: 349399 - DNA, 25 bp, Mus musculus
taccagaccccaggtatgcgagacc

SEQ ID NO: 349400 - DNA, 25 bp, Mus musculus
taccagaccccaggttccagtgccc

SEQ ID NO: 349401 - DNA, 25 bp, Mus musculus
taccagagatagagacaaaagactg

SEQ ID NO: 349402 - DNA, 25 bp, Mus musculus
taccagagcaaccggtgaaaaaagc

SEQ ID NO: 349403 - DNA, 25 bp, Mus musculus
taccagagcaaccgtcaagtaaaca

SEQ ID NO: 349404 - DNA, 25 bp, Mus musculus
taccagagcaaccgtttctatggcg

SEQ ID NO: 349405 - DNA, 25 bp, Mus musculus
taccagaggaagtgggtagaggaac

SEQ ID NO: 349406 - DNA, 25 bp, Mus musculus
taccagatagaggctgatcttaaat

SEQ ID NO: 349407 - DNA, 25 bp, Mus musculus
taccagatagaggtctccctgtgta

SEQ ID NO: 349408 - DNA, 25 bp, Mus musculus
taccagatcaaggtggttgaagatg

SEQ ID NO: 349409 - DNA, 25 bp, Mus musculus
taccagatcagctcaaggcaaggat

SEQ ID NO: 349410 - DNA, 25 bp, Mus musculus
taccagatgcaaagttctgctttca

SEQ ID NO: 349411 - DNA, 25 bp, Mus musculus
taccagcaaatgagggcgaacagct

SEQ ID NO: 349412 - DNA, 25 bp, Mus musculus
taccagcaaggttggcccctaggtg

SEQ ID NO: 349413 - DNA, 25 bp, Mus musculus
taccagcaatgtgtgtccgtcctgc

SEQ ID NO: 349414 - DNA, 25 bp, Mus musculus
taccagcagaacagcacagcccccg

SEQ ID NO: 349415 - DNA, 25 bp, Mus musculus
taccagcagacccaatggaactgaa

SEQ ID NO: 349416 - DNA, 25 bp, Mus musculus
taccagcagacttttgatttcaaaa

SEQ ID NO: 349417 - DNA, 25 bp, Mus musculus
taccagcagggtcagggactcatgc

SEQ ID NO: 349418 - DNA, 25 bp, Mus musculus
taccagccacaggagctcttaggga

SEQ ID NO: 349419 - DNA, 25 bp, Mus musculus
taccagcccaggtcaaccattcgag

SEQ ID NO: 349420 - DNA, 25 bp, Mus musculus
taccagcctcagattcagcgtttaa

SEQ ID NO: 349421 - DNA, 25 bp, Mus musculus
taccagcctctggggccctggccca

SEQ ID NO: 349422 - DNA, 25 bp, Mus musculus
taccagcctgtggaatagtcactgc

SEQ ID NO: 349423 - DNA, 25 bp, Mus musculus
taccagcctgtgggtccgaagcagt

SEQ ID NO: 349424 - DNA, 25 bp, Mus musculus
taccagcgaggggtcccgtagccgc

SEQ ID NO: 349425 - DNA, 25 bp, Mus musculus
taccagcggagcatgcacgcctacc

SEQ ID NO: 349426 - DNA, 25 bp, Mus musculus
taccagcggagggtttctctgtgta

SEQ ID NO: 349427 - DNA, 25 bp, Mus musculus
taccagctagaaacgagatgtccct

SEQ ID NO: 349428 - DNA, 25 bp, Mus musculus
taccagctagaaacttctcctctgt

SEQ ID NO: 349429 - DNA, 25 bp, Mus musculus
taccagctgaagacttgattgcaat

SEQ ID NO: 349430 - DNA, 25 bp, Mus musculus
taccagctgacccactgaagctggg

SEQ ID NO: 349431 - DNA, 25 bp, Mus musculus
taccagctggacaaaatggggtgga

SEQ ID NO: 349432 - DNA, 25 bp, Mus musculus
taccagcttcagatctacccaaacg

SEQ ID NO: 349433 - DNA, 25 bp, Mus musculus
taccagcttcaggttgcatcagtga

SEQ ID NO: 349434 - DNA, 25 bp, Mus musculus
taccagctttagaaggcatggatga

SEQ ID NO: 349435 - DNA, 25 bp, Mus musculus
taccagctttagtcctcaaaggcca

SEQ ID NO: 349436 - DNA, 25 bp, Mus musculus
taccaggaagcatctgtctgagcat

SEQ ID NO: 349437 - DNA, 25 bp, Mus musculus
taccaggaattcagcaccccatgaa

SEQ ID NO: 349438 - DNA, 25 bp, Mus musculus
taccaggaattcaggaaatattttc

SEQ ID NO: 349439 - DNA, 25 bp, Mus musculus
taccaggacagcagggtgtgcaggg

SEQ ID NO: 349440 - DNA, 25 bp, Mus musculus
taccaggagaaggtgaggtacacca

SEQ ID NO: 349441 - DNA, 25 bp, Mus musculus
taccaggaggacagatcttctatcg

SEQ ID NO: 349442 - DNA, 25 bp, Mus musculus
taccaggaggtgacgggtctcactc

SEQ ID NO: 349443 - DNA, 25 bp, Mus musculus
taccaggaggtgacggtgcagcgga

SEQ ID NO: 349444 - DNA, 25 bp, Mus musculus
taccaggaggtgacgttgctgtccc

SEQ ID NO: 349445 - DNA, 25 bp, Mus musculus
taccaggagtttgttcaggaagtgg

SEQ ID NO: 349446 - DNA, 25 bp, Mus musculus
taccaggcaattctagtggctgcgg

SEQ ID NO: 349447 - DNA, 25 bp, Mus musculus
taccaggcataactcctggctcttg

SEQ ID NO: 349448 - DNA, 25 bp, Mus musculus
taccaggcatgaggggccataaagg

SEQ ID NO: 349449 - DNA, 25 bp, Mus musculus
taccagggaaactgggatctgttgg

SEQ ID NO: 349450 - DNA, 25 bp, Mus musculus
taccagggacatcagttccagacac

SEQ ID NO: 349451 - DNA, 25 bp, Mus musculus
taccagggcaccaaggctgctttgg

SEQ ID NO: 349452 - DNA, 25 bp, Mus musculus
taccagggcaccaagttctccagcc

SEQ ID NO: 349453 - DNA, 25 bp, Mus musculus
taccagggtcggacaaatgacaaag

SEQ ID NO: 349454 - DNA, 25 bp, Mus musculus
taccaggtacagcaatgacatttct

SEQ ID NO: 349455 - DNA, 25 bp, Mus musculus
taccaggtagatgctgagaggaaaa

SEQ ID NO: 349456 - DNA, 25 bp, Mus musculus
taccaggtccgaagtgctgactggt

SEQ ID NO: 349457 - DNA, 25 bp, Mus musculus
taccaggttcccagtcttctcacca

SEQ ID NO: 349458 - DNA, 25 bp, Mus musculus
taccagtacctggagcaatcaaagt

SEQ ID NO: 349459 - DNA, 25 bp, Mus musculus
taccagtacctggagggcctgttct

SEQ ID NO: 349460 - DNA, 25 bp, Mus musculus
taccagtagaacaagagactaagtc

SEQ ID NO: 349461 - DNA, 25 bp, Mus musculus
taccagtagaacaagtatcatctca

SEQ ID NO: 349462 - DNA, 25 bp, Mus musculus
taccagtatagatgaaggcaaaaga

SEQ ID NO: 349463 - DNA, 25 bp, Mus musculus
taccagtatagatgtaggcaaaaga

SEQ ID NO: 349464 - DNA, 25 bp, Mus musculus
taccagtattgtacccatgatgcac

SEQ ID NO: 349465 - DNA, 25 bp, Mus musculus
taccagtgaaatgcctgcccagaaa

SEQ ID NO: 349466 - DNA, 25 bp, Mus musculus
taccagtgaaatgtctgcccagaaa

SEQ ID NO: 349467 - DNA, 25 bp, Mus musculus
taccagtgtaagattaatgtggctg

SEQ ID NO: 349468 - DNA, 25 bp, Mus musculus
taccagtgtagcctatgcccatcct

SEQ ID NO: 349469 - DNA, 25 bp, Mus musculus
taccagttccccgaattccgtgtag

SEQ ID NO: 349470 - DNA, 25 bp, Mus musculus
taccagttccccggtatccctctca

SEQ ID NO: 349471 - DNA, 25 bp, Mus musculus
taccagttgcggatgagtacagcat

SEQ ID NO: 349472 - DNA, 25 bp, Mus musculus
taccagttgtcgccctttaaccatg

SEQ ID NO: 349473 - DNA, 25 bp, Mus musculus
taccataaacagtatggcggctctg

SEQ ID NO: 349474 - DNA, 25 bp, Mus musculus
taccatacacaaggccagctgttgc

SEQ ID NO: 349475 - DNA, 25 bp, Mus musculus
taccatacggacatatagattcttg

SEQ ID NO: 349476 - DNA, 25 bp, Mus musculus
taccatagaagtacctcaaatcgtt

SEQ ID NO: 349477 - DNA, 25 bp, Mus musculus
taccatagaagttgctcctttggta

SEQ ID NO: 349478 - DNA, 25 bp, Mus musculus
taccatatcaagtttagagacgtgg

SEQ ID NO: 349479 - DNA, 25 bp, Mus musculus
taccatatcagtgccttgtatgtgg

SEQ ID NO: 349480 - DNA, 25 bp, Mus musculus
taccatatcccaagtgtctgataac

SEQ ID NO: 349481 - DNA, 25 bp, Mus musculus
taccatatgctgaaggagttattcc

SEQ ID NO: 349482 - DNA, 25 bp, Mus musculus
taccatatgctgaagtatttcatgg

SEQ ID NO: 349483 - DNA, 25 bp, Mus musculus
taccatatggaagactcggagatca

SEQ ID NO: 349484 - DNA, 25 bp, Mus musculus
taccatcacagagtcaaatccacgg

SEQ ID NO: 349485 - DNA, 25 bp, Mus musculus
taccatcaccaaagccccccatcaa

SEQ ID NO: 349486 - DNA, 25 bp, Mus musculus
taccatcagctgactacccaggcgg

SEQ ID NO: 349487 - DNA, 25 bp, Mus musculus
taccatcagctgagtgactgtggag

SEQ ID NO: 349488 - DNA, 25 bp, Mus musculus
taccatcataacagcactaccacct

SEQ ID NO: 349489 - DNA, 25 bp, Mus musculus
taccatcataggccagttcacaatg

SEQ ID NO: 349490 - DNA, 25 bp, Mus musculus
taccatcatcacagacaccacggcg

SEQ ID NO: 349491 - DNA, 25 bp, Mus musculus
taccatcatcacagattctcgagca

SEQ ID NO: 349492 - DNA, 25 bp, Mus musculus
taccatcccatgcccctgtttcact

SEQ ID NO: 349493 - DNA, 25 bp, Mus musculus
taccatccccaaggaacctgatgga

SEQ ID NO: 349494 - DNA, 25 bp, Mus musculus
taccatcctcagtggtacacttagc

SEQ ID NO: 349495 - DNA, 25 bp, Mus musculus
taccatctcaaccaggatgcgtaca

SEQ ID NO: 349496 - DNA, 25 bp, Mus musculus
taccatctgaagagtctactcggat

SEQ ID NO: 349497 - DNA, 25 bp, Mus musculus
taccatcttgcttagcctcaaagag

SEQ ID NO: 349498 - DNA, 25 bp, Mus musculus
taccatgaagtacaggctggacatt

SEQ ID NO: 349499 - DNA, 25 bp, Mus musculus
taccatgaccaagaggtcgctcgca

SEQ ID NO: 349500 - DNA, 25 bp, Mus musculus
taccatgactctcaggcaaggccag

SEQ ID NO: 349501 - DNA, 25 bp, Mus musculus
taccatgcaggcgagacttcagcag

SEQ ID NO: 349502 - DNA, 25 bp, Mus musculus
taccatgcagggttctgaggaggac

SEQ ID NO: 349503 - DNA, 25 bp, Mus musculus
taccatgccatcaagaatgaggaga

SEQ ID NO: 349504 - DNA, 25 bp, Mus musculus
taccatggccagggctctgacagct

SEQ ID NO: 349505 - DNA, 25 bp, Mus musculus
taccatggccagtgaggtgttcgga

SEQ ID NO: 349506 - DNA, 25 bp, Mus musculus
taccatggtgaagggaatgtacggc

SEQ ID NO: 349507 - DNA, 25 bp, Mus musculus
taccatgtgaagttccgctcgctgt

SEQ ID NO: 349508 - DNA, 25 bp, Mus musculus
taccatgtgcaggacccaaggctgg

SEQ ID NO: 349509 - DNA, 25 bp, Mus musculus
taccatgtgctgcacaatcctggag

SEQ ID NO: 349510 - DNA, 25 bp, Mus musculus
taccattaaaaagcctcaagcccaa

SEQ ID NO: 349511 - DNA, 25 bp, Mus musculus
taccattaaaaagctcactctgcag

SEQ ID NO: 349512 - DNA, 25 bp, Mus musculus
taccattaataaggaccaaaatgtc

SEQ ID NO: 349513 - DNA, 25 bp, Mus musculus
taccattgatcatgctactaatcgt

SEQ ID NO: 349514 - DNA, 25 bp, Mus musculus
taccatttatggaagccctgcagag

SEQ ID NO: 349515 - DNA, 25 bp, Mus musculus
tacccaaagtcagagaagtcctgca

SEQ ID NO: 349516 - DNA, 25 bp, Mus musculus
tacccaaattgacaggtagctacat

SEQ ID NO: 349517 - DNA, 25 bp, Mus musculus
tacccaacttcaggtaccaatgggg

SEQ ID NO: 349518 - DNA, 25 bp, Mus musculus
tacccaagaaaatggatgagtatgt

SEQ ID NO: 349519 - DNA, 25 bp, Mus musculus
tacccaagctgctttctggcttgct

SEQ ID NO: 349520 - DNA, 25 bp, Mus musculus
tacccaatcagggggagatcttggt

SEQ ID NO: 349521 - DNA, 25 bp, Mus musculus
tacccaatcaggtgatccgcagggg

SEQ ID NO: 349522 - DNA, 25 bp, Mus musculus
tacccaatggaggttctgaagaccc

SEQ ID NO: 349523 - DNA, 25 bp, Mus musculus
tacccacacacaagtctggccacag

SEQ ID NO: 349524 - DNA, 25 bp, Mus musculus
tacccacacacccaaaccaggtggc

SEQ ID NO: 349525 - DNA, 25 bp, Mus musculus
tacccacaggccagccttcttgcta

SEQ ID NO: 349526 - DNA, 25 bp, Mus musculus
tacccacctatgtgctcccaagatg

SEQ ID NO: 349527 - DNA, 25 bp, Mus musculus
tacccacctttggaatgactattcc

SEQ ID NO: 349528 - DNA, 25 bp, Mus musculus
tacccactcagaaaagcggccttat

SEQ ID NO: 349529 - DNA, 25 bp, Mus musculus
tacccagaaaagaaggtctctggta

SEQ ID NO: 349530 - DNA, 25 bp, Mus musculus
tacccagaaggacggcactagaaag

SEQ ID NO: 349531 - DNA, 25 bp, Mus musculus
tacccagaaggacggcattagaaag

SEQ ID NO: 349532 - DNA, 25 bp, Mus musculus
tacccagcaaccaggagctggagcc

SEQ ID NO: 349533 - DNA, 25 bp, Mus musculus
tacccagcatagccccttcacagaa

SEQ ID NO: 349534 - DNA, 25 bp, Mus musculus
tacccagccaaagccctggactatt

SEQ ID NO: 349535 - DNA, 25 bp, Mus musculus
tacccagcctggtctatacagagga

SEQ ID NO: 349536 - DNA, 25 bp, Mus musculus
tacccagctcgatcgagagctgaga

SEQ ID NO: 349537 - DNA, 25 bp, Mus musculus
tacccaggagagaaggatgtgcggg

SEQ ID NO: 349538 - DNA, 25 bp, Mus musculus
tacccaggcccaggtgttatctgca

SEQ ID NO: 349539 - DNA, 25 bp, Mus musculus
tacccaggcgggtatggtggggctc

SEQ ID NO: 349540 - DNA, 25 bp, Mus musculus
tacccaggtggatggaacatgaagc

SEQ ID NO: 349541 - DNA, 25 bp, Mus musculus
tacccagtcttcctaaatctgcaga

SEQ ID NO: 349542 - DNA, 25 bp, Mus musculus
tacccagtgaggaaaggagggcgga

SEQ ID NO: 349543 - DNA, 25 bp, Mus musculus
tacccagtggggtacatgtacccct

SEQ ID NO: 349544 - DNA, 25 bp, Mus musculus
tacccatcaactaattgtcaacagt

SEQ ID NO: 349545 - DNA, 25 bp, Mus musculus
tacccatcaagccaccctgtattcc

SEQ ID NO: 349546 - DNA, 25 bp, Mus musculus
tacccatgaaactgcatttctaggt

SEQ ID NO: 349547 - DNA, 25 bp, Mus musculus
tacccatggctcagactccgtggtt

SEQ ID NO: 349548 - DNA, 25 bp, Mus musculus
tacccatgtctgaccttctgccccc

SEQ ID NO: 349549 - DNA, 25 bp, Mus musculus
tacccattcaggctgcaacaggtga

SEQ ID NO: 349550 - DNA, 25 bp, Mus musculus
tacccatttcacagggagcccgaac

SEQ ID NO: 349551 - DNA, 25 bp, Mus musculus
tacccattttctctatgagtattgg

SEQ ID NO: 349552 - DNA, 25 bp, Mus musculus
taccccaaaacaggccccagggctg

SEQ ID NO: 349553 - DNA, 25 bp, Mus musculus
taccccaaaacagtgggaaatgcct

SEQ ID NO: 349554 - DNA, 25 bp, Mus musculus
taccccaaaagagaatcgcacgtcc

SEQ ID NO: 349555 - DNA, 25 bp, Mus musculus
taccccaacaagaatcagcacacaa

SEQ ID NO: 349556 - DNA, 25 bp, Mus musculus
taccccaacaagacccgtctaaatg

SEQ ID NO: 349557 - DNA, 25 bp, Mus musculus
taccccaacaatgcaccttccggtt

SEQ ID NO: 349558 - DNA, 25 bp, Mus musculus
taccccaacaggccccgggtgctgt

SEQ ID NO: 349559 - DNA, 25 bp, Mus musculus
taccccaaggacagtttagagacgt

SEQ ID NO: 349560 - DNA, 25 bp, Mus musculus
taccccaatcggatctgtgtaagaa

SEQ ID NO: 349561 - DNA, 25 bp, Mus musculus
taccccaatcggggcaccacctgtc

SEQ ID NO: 349562 - DNA, 25 bp, Mus musculus
taccccacacaagtcaaaggagccc

SEQ ID NO: 349563 - DNA, 25 bp, Mus musculus
taccccacacaatgtttagttctgt

SEQ ID NO: 349564 - DNA, 25 bp, Mus musculus
taccccatatcaagtttcttactta

SEQ ID NO: 349565 - DNA, 25 bp, Mus musculus
taccccatgcagctatctaacttca

SEQ ID NO: 349566 - DNA, 25 bp, Mus musculus
taccccatggagactcggctgactc

SEQ ID NO: 349567 - DNA, 25 bp, Mus musculus
taccccatggaggttatttttgaag

SEQ ID NO: 349568 - DNA, 25 bp, Mus musculus
taccccatgtcagggagacagctgt

SEQ ID NO: 349569 - DNA, 25 bp, Mus musculus
taccccatttggtgacttcatggtc

SEQ ID NO: 349570 - DNA, 25 bp, Mus musculus
taccccatttggtgatctgaatgag

SEQ ID NO: 349571 - DNA, 25 bp, Mus musculus
tacccccaagtgctgcaggaggcta

SEQ ID NO: 349572 - DNA, 25 bp, Mus musculus
tacccccgagctgctcttgtgaagt

SEQ ID NO: 349573 - DNA, 25 bp, Mus musculus
tacccccgccacattgacagttctc

SEQ ID NO: 349574 - DNA, 25 bp, Mus musculus
taccccctttggagacctccacaca

SEQ ID NO: 349575 - DNA, 25 bp, Mus musculus
taccccgaaagagctcctgggctcc

SEQ ID NO: 349576 - DNA, 25 bp, Mus musculus
taccccgaatccagaatcggaagac

SEQ ID NO: 349577 - DNA, 25 bp, Mus musculus
taccccgagcgcccgcgtccagagg

SEQ ID NO: 349578 - DNA, 25 bp, Mus musculus
taccccgcggacaggtttggccgtc

SEQ ID NO: 349579 - DNA, 25 bp, Mus musculus
taccccgctggccctgtccacggac

SEQ ID NO: 349580 - DNA, 25 bp, Mus musculus
taccccgctggctggctttgggtac

SEQ ID NO: 349581 - DNA, 25 bp, Mus musculus
taccccggcctagatgcagcttcag

SEQ ID NO: 349582 - DNA, 25 bp, Mus musculus
taccccggcgctggagccccaaact

SEQ ID NO: 349583 - DNA, 25 bp, Mus musculus
taccccgggaggcaccaggatcatc

SEQ ID NO: 349584 - DNA, 25 bp, Mus musculus
taccccgtcggcaatgatggcagtg

SEQ ID NO: 349585 - DNA, 25 bp, Mus musculus
tacccctacaggaaggcccaggacc

SEQ ID NO: 349586 - DNA, 25 bp, Mus musculus
tacccctaggcaagactggacgagt

SEQ ID NO: 349587 - DNA, 25 bp, Mus musculus
tacccctccacatggcttcttctcc

SEQ ID NO: 349588 - DNA, 25 bp, Mus musculus
tacccctccacatgtctctggattt

SEQ ID NO: 349589 - DNA, 25 bp, Mus musculus
tacccctcggggcagggatgccctg

SEQ ID NO: 349590 - DNA, 25 bp, Mus musculus
tacccctcttgacccagccctgcag

SEQ ID NO: 349591 - DNA, 25 bp, Mus musculus
tacccctgagggaggtgaccattgt

SEQ ID NO: 349592 - DNA, 25 bp, Mus musculus
tacccctggggagagatctccatag

SEQ ID NO: 349593 - DNA, 25 bp, Mus musculus
tacccctgtgacacctgttgagggc

SEQ ID NO: 349594 - DNA, 25 bp, Mus musculus
tacccctttcagattgtaagctcct

SEQ ID NO: 349595 - DNA, 25 bp, Mus musculus
tacccctttcaggactccttctaat

SEQ ID NO: 349596 - DNA, 25 bp, Mus musculus
tacccgacaatgcttttgtcaatct

SEQ ID NO: 349597 - DNA, 25 bp, Mus musculus
tacccgacagacatacttcctgcca

SEQ ID NO: 349598 - DNA, 25 bp, Mus musculus
tacccgacagccccataaggcctcg

SEQ ID NO: 349599 - DNA, 25 bp, Mus musculus
tacccgacaggaaggtctatatgga

SEQ ID NO: 349600 - DNA, 25 bp, Mus musculus
tacccgacagggtgtgaacaaagac

SEQ ID NO: 349601 - DNA, 25 bp, Mus musculus
tacccgacccgatttctctgtgtag

SEQ ID NO: 349602 - DNA, 25 bp, Mus musculus
tacccgacccggcaccagccacaca

SEQ ID NO: 349603 - DNA, 25 bp, Mus musculus
tacccgaggagaaactggaaacaaa

SEQ ID NO: 349604 - DNA, 25 bp, Mus musculus
tacccgaggagaccaaacagtcttc

SEQ ID NO: 349605 - DNA, 25 bp, Mus musculus
tacccgaggagaccaaagaagagag

SEQ ID NO: 349606 - DNA, 25 bp, Mus musculus
tacccgatagaggtccaggtctgtt

SEQ ID NO: 349607 - DNA, 25 bp, Mus musculus
tacccgcagacagacgtgttcttaa

SEQ ID NO: 349608 - DNA, 25 bp, Mus musculus
tacccgcagacagttggagacacat

SEQ ID NO: 349609 - DNA, 25 bp, Mus musculus
tacccgcccccaggccttctgggtt

SEQ ID NO: 349610 - DNA, 25 bp, Mus musculus
tacccgctggtggagggtgtcaccg

SEQ ID NO: 349611 - DNA, 25 bp, Mus musculus
tacccggagaactggtgcctcgtct

SEQ ID NO: 349612 - DNA, 25 bp, Mus musculus
tacccggagctgagggttccagacc

SEQ ID NO: 349613 - DNA, 25 bp, Mus musculus
tacccggggaaacaatggagaagtg

SEQ ID NO: 349614 - DNA, 25 bp, Mus musculus
tacccggtgcatcaggtttgcaagt

SEQ ID NO: 349615 - DNA, 25 bp, Mus musculus
taccctacagaaacactcaaggctg

SEQ ID NO: 349616 - DNA, 25 bp, Mus musculus
taccctagccagatcaatacagaat

SEQ ID NO: 349617 - DNA, 25 bp, Mus musculus
taccctagccagcataattaaatcc

SEQ ID NO: 349618 - DNA, 25 bp, Mus musculus
taccctagccagcccgcttcgatga

SEQ ID NO: 349619 - DNA, 25 bp, Mus musculus
taccctagccagggttgatttcttc

SEQ ID NO: 349620 - DNA, 25 bp, Mus musculus
taccctagccggaaagccagtgtaa

SEQ ID NO: 349621 - DNA, 25 bp, Mus musculus
taccctagccgtgtacaagtctcca

SEQ ID NO: 349622 - DNA, 25 bp, Mus musculus
taccctattaatgcctcctcctcta

SEQ ID NO: 349623 - DNA, 25 bp, Mus musculus
taccctattaatggcttccaggctc

SEQ ID NO: 349624 - DNA, 25 bp, Mus musculus
taccctcacaaccccggctacaacc

SEQ ID NO: 349625 - DNA, 25 bp, Mus musculus
taccctccaatgaaagtgctaatgc

SEQ ID NO: 349626 - DNA, 25 bp, Mus musculus
taccctccagctggaccctggagga

SEQ ID NO: 349627 - DNA, 25 bp, Mus musculus
taccctccgaagctctggatgggtc

SEQ ID NO: 349628 - DNA, 25 bp, Mus musculus
taccctcctatgtgctcccaagatg

SEQ ID NO: 349629 - DNA, 25 bp, Mus musculus
taccctcctctgcagttgttgacct

SEQ ID NO: 349630 - DNA, 25 bp, Mus musculus
taccctctggatcagaattaaaatg

SEQ ID NO: 349631 - DNA, 25 bp, Mus musculus
taccctctggatcagatctccatga

SEQ ID NO: 349632 - DNA, 25 bp, Mus musculus
taccctctggatcagattgattatg

SEQ ID NO: 349633 - DNA, 25 bp, Mus musculus
taccctctgtggtgagcatcagatg

SEQ ID NO: 349634 - DNA, 25 bp, Mus musculus
taccctctgtgtgacagctcaactt

SEQ ID NO: 349635 - DNA, 25 bp, Mus musculus
taccctcttagcagaaatctagatc

SEQ ID NO: 349636 - DNA, 25 bp, Mus musculus
taccctcttcggtgtttatggagat

SEQ ID NO: 349637 - DNA, 25 bp, Mus musculus
taccctgaaagagttaaacatctta

SEQ ID NO: 349638 - DNA, 25 bp, Mus musculus
taccctgagaaggagcttcctgtca

SEQ ID NO: 349639 - DNA, 25 bp, Mus musculus
taccctgagaaggaggtcactctta

SEQ ID NO: 349640 - DNA, 25 bp, Mus musculus
taccctgatggaaactcccagtatg

SEQ ID NO: 349641 - DNA, 25 bp, Mus musculus
taccctgatggtcataatgattacg

SEQ ID NO: 349642 - DNA, 25 bp, Mus musculus
taccctgcagcatagcatctcccgg

SEQ ID NO: 349643 - DNA, 25 bp, Mus musculus
taccctgcaggtgatctgtctggcc

SEQ ID NO: 349644 - DNA, 25 bp, Mus musculus
taccctgcctgatgagctgggagac

SEQ ID NO: 349645 - DNA, 25 bp, Mus musculus
taccctgctaaatgttaggccgggg

SEQ ID NO: 349646 - DNA, 25 bp, Mus musculus
taccctgcttcagcaacttgatttc

SEQ ID NO: 349647 - DNA, 25 bp, Mus musculus
taccctggcaagaggtccgtcttcc

SEQ ID NO: 349648 - DNA, 25 bp, Mus musculus
taccctggtaactgctgggggctct

SEQ ID NO: 349649 - DNA, 25 bp, Mus musculus
taccctgtccaagcccacaggactg

SEQ ID NO: 349650 - DNA, 25 bp, Mus musculus
taccctgttgaggtttttcatcttg

SEQ ID NO: 349651 - DNA, 25 bp, Mus musculus
tacccttaaccaaggacattcactg

SEQ ID NO: 349652 - DNA, 25 bp, Mus musculus
tacccttaaccaagggatgactggc

SEQ ID NO: 349653 - DNA, 25 bp, Mus musculus
tacccttaccacctatgtgccatgg

SEQ ID NO: 349654 - DNA, 25 bp, Mus musculus
tacccttcgatgtcgctcaccaggc

SEQ ID NO: 349655 - DNA, 25 bp, Mus musculus
tacccttctggttctttgtgtggag

SEQ ID NO: 349656 - DNA, 25 bp, Mus musculus
tacccttgcagggagactccggcag

SEQ ID NO: 349657 - DNA, 25 bp, Mus musculus
tacccttgccaaaagcggggagccc

SEQ ID NO: 349658 - DNA, 25 bp, Mus musculus
tacccttgccaaggttcccagaagc

SEQ ID NO: 349659 - DNA, 25 bp, Mus musculus
tacccttgctgcaatgaagctgatg

SEQ ID NO: 349660 - DNA, 25 bp, Mus musculus
tacccttgtggaccagcagagaaca

SEQ ID NO: 349661 - DNA, 25 bp, Mus musculus
taccctttactgaaattaccatggt

SEQ ID NO: 349662 - DNA, 25 bp, Mus musculus
taccctttattcaggagatgatttg

SEQ ID NO: 349663 - DNA, 25 bp, Mus musculus
taccctttcactggggatcacaagc

SEQ ID NO: 349664 - DNA, 25 bp, Mus musculus
taccctttcatagattaccaaggaa

SEQ ID NO: 349665 - DNA, 25 bp, Mus musculus
taccctttcatagctatgataagtt

SEQ ID NO: 349666 - DNA, 25 bp, Mus musculus
taccctttggagaatgcagttcctt

SEQ ID NO: 349667 - DNA, 25 bp, Mus musculus
tacccttttcagactcttgtgtact

SEQ ID NO: 349668 - DNA, 25 bp, Mus musculus
tacccttttcaggtcgtgcatgaca

SEQ ID NO: 349669 - DNA, 25 bp, Mus musculus
taccgaaaatgaaggttctgggctg

SEQ ID NO: 349670 - DNA, 25 bp, Mus musculus
taccgaaaatgaagtcgagcctgtt

SEQ ID NO: 349671 - DNA, 25 bp, Mus musculus
taccgactttcacgatatgtgacca

SEQ ID NO: 349672 - DNA, 25 bp, Mus musculus
taccgagcaggacccttcatgttcc

SEQ ID NO: 349673 - DNA, 25 bp, Mus musculus
taccgagcaggtcacggaagagtaa

SEQ ID NO: 349674 - DNA, 25 bp, Mus musculus
taccgaggagggacttcaaaacatg

SEQ ID NO: 349675 - DNA, 25 bp, Mus musculus
taccgaggcctaggatcagttctta

SEQ ID NO: 349676 - DNA, 25 bp, Mus musculus
taccgatcaccgcaacggccattcc

SEQ ID NO: 349677 - DNA, 25 bp, Mus musculus
taccgatcaccggggctaccgtgtg

SEQ ID NO: 349678 - DNA, 25 bp, Mus musculus
taccgcaacagaggcctttcagtca

SEQ ID NO: 349679 - DNA, 25 bp, Mus musculus
taccgcaacagagggccttaacaat

SEQ ID NO: 349680 - DNA, 25 bp, Mus musculus
taccgcaacgtggtctccattgagg

SEQ ID NO: 349681 - DNA, 25 bp, Mus musculus
taccgcaagagacagataaatccca

SEQ ID NO: 349682 - DNA, 25 bp, Mus musculus
taccgcaagatcgtctacttcatgg

SEQ ID NO: 349683 - DNA, 25 bp, Mus musculus
taccgcaagcagcagtctctggtcc

SEQ ID NO: 349684 - DNA, 25 bp, Mus musculus
taccgcaagggcctgctgaaaatga

SEQ ID NO: 349685 - DNA, 25 bp, Mus musculus
taccgcaccaagtgtgaggagataa

SEQ ID NO: 349686 - DNA, 25 bp, Mus musculus
taccgcaccaagtgtgaggagatga

SEQ ID NO: 349687 - DNA, 25 bp, Mus musculus
taccgcacggataattgtgtggagg

SEQ ID NO: 349688 - DNA, 25 bp, Mus musculus
taccgcagaagttgcagaagctgga

SEQ ID NO: 349689 - DNA, 25 bp, Mus musculus
taccgcatcttcaggcttctcggct

SEQ ID NO: 349690 - DNA, 25 bp, Mus musculus
taccgcatgaggttctactttacca

SEQ ID NO: 349691 - DNA, 25 bp, Mus musculus
taccgcatggttcctgctctgcacc

SEQ ID NO: 349692 - DNA, 25 bp, Mus musculus
taccgcggcggcaggattgtcttga

SEQ ID NO: 349693 - DNA, 25 bp, Mus musculus
taccgcggcggcaggctcctcctac

SEQ ID NO: 349694 - DNA, 25 bp, Mus musculus
taccgctcccctgagaacacaagga

SEQ ID NO: 349695 - DNA, 25 bp, Mus musculus
taccgctcccctggttctggttaac

SEQ ID NO: 349696 - DNA, 25 bp, Mus musculus
taccgctccgcccgtgttggtggaa

SEQ ID NO: 349697 - DNA, 25 bp, Mus musculus
taccgctccgtagggaagacatctt

SEQ ID NO: 349698 - DNA, 25 bp, Mus musculus
taccgctgctgctcggcaatgatgg

SEQ ID NO: 349699 - DNA, 25 bp, Mus musculus
taccggacagctttcttcggaaaat

SEQ ID NO: 349700 - DNA, 25 bp, Mus musculus
taccggagttggatcggtcatggga

SEQ ID NO: 349701 - DNA, 25 bp, Mus musculus
taccggcaaatggttgaaactgagc

SEQ ID NO: 349702 - DNA, 25 bp, Mus musculus
taccggcactgggcactgaaagaaa

SEQ ID NO: 349703 - DNA, 25 bp, Mus musculus
taccggccaggtgtatgatgaaaaa

SEQ ID NO: 349704 - DNA, 25 bp, Mus musculus
taccggctattctaggaaggctgcc

SEQ ID NO: 349705 - DNA, 25 bp, Mus musculus
taccggctattctagtgacgccaag

SEQ ID NO: 349706 - DNA, 25 bp, Mus musculus
taccggctgagcatggtggctgtat

SEQ ID NO: 349707 - DNA, 25 bp, Mus musculus
taccgggcatcggccctgggcagtg

SEQ ID NO: 349708 - DNA, 25 bp, Mus musculus
taccgggccttccgctctgtgcctc

SEQ ID NO: 349709 - DNA, 25 bp, Mus musculus
taccggggactggagggcttcgtgg

SEQ ID NO: 349710 - DNA, 25 bp, Mus musculus
taccggggactggagggcttctcat

SEQ ID NO: 349711 - DNA, 25 bp, Mus musculus
taccggggagcattcagcctgtgta

SEQ ID NO: 349712 - DNA, 25 bp, Mus musculus
taccggggagtaacaatgaagagga

SEQ ID NO: 349713 - DNA, 25 bp, Mus musculus
taccgggtcggagactgcaagtggc

SEQ ID NO: 349714 - DNA, 25 bp, Mus musculus
taccgggtgcagagagacatcccaa

SEQ ID NO: 349715 - DNA, 25 bp, Mus musculus
taccggtttcagacaccctattttt

SEQ ID NO: 349716 - DNA, 25 bp, Mus musculus
taccgtaaacccaaggcagtgggct

SEQ ID NO: 349717 - DNA, 25 bp, Mus musculus
taccgtaatggacggatctttgcca

SEQ ID NO: 349718 - DNA, 25 bp, Mus musculus
taccgtagcccagaaaaatatgaag

SEQ ID NO: 349719 - DNA, 25 bp, Mus musculus
taccgtagcccagagcaagtccctc

SEQ ID NO: 349720 - DNA, 25 bp, Mus musculus
taccgtaggtggtcaactattcctc

SEQ ID NO: 349721 - DNA, 25 bp, Mus musculus
taccgtcgctttctccagctgagtc

SEQ ID NO: 349722 - DNA, 25 bp, Mus musculus
taccgtcttgctggtgagcaccgag

SEQ ID NO: 349723 - DNA, 25 bp, Mus musculus
taccgtgacatcaagctggaaaacc

SEQ ID NO: 349724 - DNA, 25 bp, Mus musculus
taccgtgagcaggtacctggagtct

SEQ ID NO: 349725 - DNA, 25 bp, Mus musculus
taccgtgagcttcaggaaaaacata

SEQ ID NO: 349726 - DNA, 25 bp, Mus musculus
taccgtgagcttcaggttcatggac

SEQ ID NO: 349727 - DNA, 25 bp, Mus musculus
taccgtgatctcaagttggagaatt

SEQ ID NO: 349728 - DNA, 25 bp, Mus musculus
taccgtggtggagggaaaaatggtg

SEQ ID NO: 349729 - DNA, 25 bp, Mus musculus
taccgtggtggaggttgaagaaatt

SEQ ID NO: 349730 - DNA, 25 bp, Mus musculus
taccgttgtcccagaggtgccccag

SEQ ID NO: 349731 - DNA, 25 bp, Mus musculus
taccgttgtcccagctgtccctcct

SEQ ID NO: 349732 - DNA, 25 bp, Mus musculus
taccgttgtgagctgctggggccac

SEQ ID NO: 349733 - DNA, 25 bp, Mus musculus
tacctaaagctacaggtggtaaagc

SEQ ID NO: 349734 - DNA, 25 bp, Mus musculus
tacctaaatgactgataatggtctt

SEQ ID NO: 349735 - DNA, 25 bp, Mus musculus
tacctaaatggacaggatccttgtc

SEQ ID NO: 349736 - DNA, 25 bp, Mus musculus
tacctaagtaacttgataacaaagt

SEQ ID NO: 349737 - DNA, 25 bp, Mus musculus
tacctaatcgattgaggcccaaggg

SEQ ID NO: 349738 - DNA, 25 bp, Mus musculus
tacctaatcgattggattttcacct

SEQ ID NO: 349739 - DNA, 25 bp, Mus musculus
tacctaatgaaaagatctccaagag

SEQ ID NO: 349740 - DNA, 25 bp, Mus musculus
tacctacaagagaactctgaaggca

SEQ ID NO: 349741 - DNA, 25 bp, Mus musculus
tacctacaagaggagagtcaaacac

SEQ ID NO: 349742 - DNA, 25 bp, Mus musculus
tacctacaagaggtagaaagtccct

SEQ ID NO: 349743 - DNA, 25 bp, Mus musculus
tacctacaagatgtgaagtgggagc

SEQ ID NO: 349744 - DNA, 25 bp, Mus musculus
tacctacaatacccttcgagcacat

SEQ ID NO: 349745 - DNA, 25 bp, Mus musculus
tacctacacccacagttccagggtc

SEQ ID NO: 349746 - DNA, 25 bp, Mus musculus
tacctacacttcagatttccaaaag

SEQ ID NO: 349747 - DNA, 25 bp, Mus musculus
tacctaccagccctgggtcctgagt

SEQ ID NO: 349748 - DNA, 25 bp, Mus musculus
tacctaccaggacctgatctctgca

SEQ ID NO: 349749 - DNA, 25 bp, Mus musculus
tacctaccaggatggtccacctcca

SEQ ID NO: 349750 - DNA, 25 bp, Mus musculus
tacctaccaggtgaaacctttgtcc

SEQ ID NO: 349751 - DNA, 25 bp, Mus musculus
tacctacccctcaagaaaagctact

SEQ ID NO: 349752 - DNA, 25 bp, Mus musculus
tacctacccctcaagccttcctgcc

SEQ ID NO: 349753 - DNA, 25 bp, Mus musculus
tacctacgaccaggttcagaacagc

SEQ ID NO: 349754 - DNA, 25 bp, Mus musculus
tacctactagagccggagaacagtg

SEQ ID NO: 349755 - DNA, 25 bp, Mus musculus
tacctagaaaagatttcacacaccg

SEQ ID NO: 349756 - DNA, 25 bp, Mus musculus
tacctagaagatcttggtaatgttc

SEQ ID NO: 349757 - DNA, 25 bp, Mus musculus
tacctagaaggaagagaaaagagaa

SEQ ID NO: 349758 - DNA, 25 bp, Mus musculus
tacctagagaagacggaatggttcc

SEQ ID NO: 349759 - DNA, 25 bp, Mus musculus
tacctagaggtgggaggctttgtgg

SEQ ID NO: 349760 - DNA, 25 bp, Mus musculus
tacctagcaggtcctcatgggtatc

SEQ ID NO: 349761 - DNA, 25 bp, Mus musculus
tacctagtcacagagggctttaagg

SEQ ID NO: 349762 - DNA, 25 bp, Mus musculus
tacctagtcacagcaacaacacttg

SEQ ID NO: 349763 - DNA, 25 bp, Mus musculus
tacctataaccagacacgcagtgct

SEQ ID NO: 349764 - DNA, 25 bp, Mus musculus
tacctataaccaggtgcagacacgc

SEQ ID NO: 349765 - DNA, 25 bp, Mus musculus
tacctatgaccatctgtgtaagaac

SEQ ID NO: 349766 - DNA, 25 bp, Mus musculus
tacctatgaccgaatataccatgct

SEQ ID NO: 349767 - DNA, 25 bp, Mus musculus
tacctatgacttagcaggttcttgt

SEQ ID NO: 349768 - DNA, 25 bp, Mus musculus
tacctatggcagggccaccaaagca

SEQ ID NO: 349769 - DNA, 25 bp, Mus musculus
tacctcaaacccagaaccaaggaga

SEQ ID NO: 349770 - DNA, 25 bp, Mus musculus
tacctcaacagacatttgctccaag

SEQ ID NO: 349771 - DNA, 25 bp, Mus musculus
tacctcaacagagaataggtgaggc

SEQ ID NO: 349772 - DNA, 25 bp, Mus musculus
tacctcaacagggattctgaagggt

SEQ ID NO: 349773 - DNA, 25 bp, Mus musculus
tacctcaacctcagggaaccagctc

SEQ ID NO: 349774 - DNA, 25 bp, Mus musculus
tacctcaactaatttgtgatcctgt

SEQ ID NO: 349775 - DNA, 25 bp, Mus musculus
tacctcaatcaaggacagtcttatg

SEQ ID NO: 349776 - DNA, 25 bp, Mus musculus
tacctcaatcaaggtcagtcgtatg

SEQ ID NO: 349777 - DNA, 25 bp, Mus musculus
tacctcaatcaaggtgtggtcccaa

SEQ ID NO: 349778 - DNA, 25 bp, Mus musculus
tacctcaatgagatccagagttttt

SEQ ID NO: 349779 - DNA, 25 bp, Mus musculus
tacctcacaggacctggagttgctg

SEQ ID NO: 349780 - DNA, 25 bp, Mus musculus
tacctcacaggtgatccactgcgtt

SEQ ID NO: 349781 - DNA, 25 bp, Mus musculus
tacctcactcacgctgcccaacatg

SEQ ID NO: 349782 - DNA, 25 bp, Mus musculus
tacctcactcaggctgccatccaga

SEQ ID NO: 349783 - DNA, 25 bp, Mus musculus
tacctcactccaaagacaaatatga

SEQ ID NO: 349784 - DNA, 25 bp, Mus musculus
tacctcactccaaagtccccagtct

SEQ ID NO: 349785 - DNA, 25 bp, Mus musculus
tacctcactgcattgaaaaaatccc

SEQ ID NO: 349786 - DNA, 25 bp, Mus musculus
tacctcactgcattggacttccttg

SEQ ID NO: 349787 - DNA, 25 bp, Mus musculus
tacctcagctacaaaggcaacatct

SEQ ID NO: 349788 - DNA, 25 bp, Mus musculus
tacctcatctgtggtcaaaatccag

SEQ ID NO: 349789 - DNA, 25 bp, Mus musculus
tacctcatggcacagagaagccatc

SEQ ID NO: 349790 - DNA, 25 bp, Mus musculus
tacctcattaaatgaatctcctgta

SEQ ID NO: 349791 - DNA, 25 bp, Mus musculus
tacctcattggctttatctcggacc

SEQ ID NO: 349792 - DNA, 25 bp, Mus musculus
tacctcattggtctaatctctgacc

SEQ ID NO: 349793 - DNA, 25 bp, Mus musculus
tacctccaaaccaagcagtcctatg

SEQ ID NO: 349794 - DNA, 25 bp, Mus musculus
tacctccacgaggcgagcctgtcac

SEQ ID NO: 349795 - DNA, 25 bp, Mus musculus
tacctcccacccttggactctcctg

SEQ ID NO: 349796 - DNA, 25 bp, Mus musculus
tacctcccagtactgggtacagagc

SEQ ID NO: 349797 - DNA, 25 bp, Mus musculus
tacctcccatactcggtccctgaat

SEQ ID NO: 349798 - DNA, 25 bp, Mus musculus
tacctcctaatggtttctgtagctg

SEQ ID NO: 349799 - DNA, 25 bp, Mus musculus
tacctcctcaggacttctagcagca

SEQ ID NO: 349800 - DNA, 25 bp, Mus musculus
tacctcctcaggagccgtctctcag

SEQ ID NO: 349801 - DNA, 25 bp, Mus musculus
tacctcctccaacccgggaagcaca

SEQ ID NO: 349802 - DNA, 25 bp, Mus musculus
tacctccttggatttccataagacg

SEQ ID NO: 349803 - DNA, 25 bp, Mus musculus
tacctccttgggcatccccaaagct

SEQ ID NO: 349804 - DNA, 25 bp, Mus musculus
tacctcctttcgcttcaagcacaaa

SEQ ID NO: 349805 - DNA, 25 bp, Mus musculus
tacctcgcttctaaggtggtggcct

SEQ ID NO: 349806 - DNA, 25 bp, Mus musculus
tacctctagacgccagccttctctg

SEQ ID NO: 349807 - DNA, 25 bp, Mus musculus
tacctctaggcctgctctgttcacc

SEQ ID NO: 349808 - DNA, 25 bp, Mus musculus
tacctctaggccttatattgtgtgc

SEQ ID NO: 349809 - DNA, 25 bp, Mus musculus
tacctctatttcgccatgagctaca

SEQ ID NO: 349810 - DNA, 25 bp, Mus musculus
tacctctgcacgaagatctgttagc

SEQ ID NO: 349811 - DNA, 25 bp, Mus musculus
tacctctggatgtcgtcacgctggc

SEQ ID NO: 349812 - DNA, 25 bp, Mus musculus
tacctctggatgtgtcttcggagcc

SEQ ID NO: 349813 - DNA, 25 bp, Mus musculus
tacctctggatgttgaacagcgtca

SEQ ID NO: 349814 - DNA, 25 bp, Mus musculus
tacctctggcaaaatgcgtgcccac

SEQ ID NO: 349815 - DNA, 25 bp, Mus musculus
tacctctggggtgaatgagagtgaa

SEQ ID NO: 349816 - DNA, 25 bp, Mus musculus
tacctctgtgaggtttttcaagaca

SEQ ID NO: 349817 - DNA, 25 bp, Mus musculus
tacctctgtgcaatgaaggtaaccg

SEQ ID NO: 349818 - DNA, 25 bp, Mus musculus
tacctctgtggaagctcggattctg

SEQ ID NO: 349819 - DNA, 25 bp, Mus musculus
tacctcttaggtctctttgagcccg

SEQ ID NO: 349820 - DNA, 25 bp, Mus musculus
tacctcttcaggctctgtgttccga

SEQ ID NO: 349821 - DNA, 25 bp, Mus musculus
tacctctttaaagatactatcgtgg

SEQ ID NO: 349822 - DNA, 25 bp, Mus musculus
tacctctttgaggaactttgatgtt

SEQ ID NO: 349823 - DNA, 25 bp, Mus musculus
tacctctttgagggaagaagccagc

SEQ ID NO: 349824 - DNA, 25 bp, Mus musculus
tacctgaaatgtgagctcactctgc

SEQ ID NO: 349825 - DNA, 25 bp, Mus musculus
tacctgaacagggacccagaagggc

SEQ ID NO: 349826 - DNA, 25 bp, Mus musculus
tacctgaaggaggaggttggaagtc

SEQ ID NO: 349827 - DNA, 25 bp, Mus musculus
tacctgaaggagtaggccctgtatt

SEQ ID NO: 349828 - DNA, 25 bp, Mus musculus
tacctgaaggttgggccttacatca

SEQ ID NO: 349829 - DNA, 25 bp, Mus musculus
tacctgacaggagtggggatactgt

SEQ ID NO: 349830 - DNA, 25 bp, Mus musculus
tacctgacaggcaggccaggagtgt

SEQ ID NO: 349831 - DNA, 25 bp, Mus musculus
tacctgaccacggtgattgggatac

SEQ ID NO: 349832 - DNA, 25 bp, Mus musculus
tacctgaccacggtttggctccttc

SEQ ID NO: 349833 - DNA, 25 bp, Mus musculus
tacctgagaattgattcatctgttt

SEQ ID NO: 349834 - DNA, 25 bp, Mus musculus
tacctgagctcgatgtcggttggac

SEQ ID NO: 349835 - DNA, 25 bp, Mus musculus
tacctgagctcgctggcttctcccc

SEQ ID NO: 349836 - DNA, 25 bp, Mus musculus
tacctgatgccgaatgatcaccgct

SEQ ID NO: 349837 - DNA, 25 bp, Mus musculus
tacctgatgcctggcctggtctgtt

SEQ ID NO: 349838 - DNA, 25 bp, Mus musculus
tacctgatgcgcctggagctgtgcg

SEQ ID NO: 349839 - DNA, 25 bp, Mus musculus
tacctgattggactgcccgtggttg

SEQ ID NO: 349840 - DNA, 25 bp, Mus musculus
tacctgcaaaatgtaactgcggatc

SEQ ID NO: 349841 - DNA, 25 bp, Mus musculus
tacctgcaaagtaacagcctccacc

SEQ ID NO: 349842 - DNA, 25 bp, Mus musculus
tacctgcaactcaaggatggatgcc

SEQ ID NO: 349843 - DNA, 25 bp, Mus musculus
tacctgcaactcaaggtctaaggta

SEQ ID NO: 349844 - DNA, 25 bp, Mus musculus
tacctgcacaagctgactcatcatg

SEQ ID NO: 349845 - DNA, 25 bp, Mus musculus
tacctgcaccagagacggaaaaccc

SEQ ID NO: 349846 - DNA, 25 bp, Mus musculus
tacctgcaccaggattctaatccct

SEQ ID NO: 349847 - DNA, 25 bp, Mus musculus
tacctgcacctggatgcaccctgct

SEQ ID NO: 349848 - DNA, 25 bp, Mus musculus
tacctgcacctggatgcattttgtt

SEQ ID NO: 349849 - DNA, 25 bp, Mus musculus
tacctgcagaccagaggctgcctgg

SEQ ID NO: 349850 - DNA, 25 bp, Mus musculus
tacctgcataaagacagacccctgt

SEQ ID NO: 349851 - DNA, 25 bp, Mus musculus
tacctgcataagaattgaattagaa

SEQ ID NO: 349852 - DNA, 25 bp, Mus musculus
tacctgcatgattgccacaatctct

SEQ ID NO: 349853 - DNA, 25 bp, Mus musculus
tacctgcatgggtgaaagaattgac

SEQ ID NO: 349854 - DNA, 25 bp, Mus musculus
tacctgccacctgcgagcccactcg

SEQ ID NO: 349855 - DNA, 25 bp, Mus musculus
tacctgccactggtgcggaagattg

SEQ ID NO: 349856 - DNA, 25 bp, Mus musculus
tacctgccactggtgtagatacagg

SEQ ID NO: 349857 - DNA, 25 bp, Mus musculus
tacctgcccccagaggctgaagatg

SEQ ID NO: 349858 - DNA, 25 bp, Mus musculus
tacctgcccccagagggagaagggg

SEQ ID NO: 349859 - DNA, 25 bp, Mus musculus
tacctgcctggaaagccaacaggtg

SEQ ID NO: 349860 - DNA, 25 bp, Mus musculus
tacctgcctgggtctgggatctgga

SEQ ID NO: 349861 - DNA, 25 bp, Mus musculus
tacctgcgacccagccattcattga

SEQ ID NO: 349862 - DNA, 25 bp, Mus musculus
tacctgcgacccaggtgcctggctg

SEQ ID NO: 349863 - DNA, 25 bp, Mus musculus
tacctgcgaccgtggctcctaatgt

SEQ ID NO: 349864 - DNA, 25 bp, Mus musculus
tacctgcggacagacaactgaggat

SEQ ID NO: 349865 - DNA, 25 bp, Mus musculus
tacctgcggacagtctcctgccctg

SEQ ID NO: 349866 - DNA, 25 bp, Mus musculus
tacctgctcagcagaatcgggttga

SEQ ID NO: 349867 - DNA, 25 bp, Mus musculus
tacctgctgcccctctcctgggaag

SEQ ID NO: 349868 - DNA, 25 bp, Mus musculus
tacctgctggaaggagcagcggtca

SEQ ID NO: 349869 - DNA, 25 bp, Mus musculus
tacctgctggaaggtgtgaccccac

SEQ ID NO: 349870 - DNA, 25 bp, Mus musculus
tacctgctggcaggtcgcttctccg

SEQ ID NO: 349871 - DNA, 25 bp, Mus musculus
tacctgcttaccggtatgacccata

SEQ ID NO: 349872 - DNA, 25 bp, Mus musculus
tacctgcttttgaggagttccactc

SEQ ID NO: 349873 - DNA, 25 bp, Mus musculus
tacctggaaagagctgttattagac

SEQ ID NO: 349874 - DNA, 25 bp, Mus musculus
tacctggaaaggtggtggtggcagg

SEQ ID NO: 349875 - DNA, 25 bp, Mus musculus
tacctggaaccaggcacggctggag

SEQ ID NO: 349876 - DNA, 25 bp, Mus musculus
tacctggaagaagccctgcagaggc

SEQ ID NO: 349877 - DNA, 25 bp, Mus musculus
tacctggaagagtgcctgctcactg

SEQ ID NO: 349878 - DNA, 25 bp, Mus musculus
tacctggaccaaagggtgctcaggg

SEQ ID NO: 349879 - DNA, 25 bp, Mus musculus
tacctggaccagaggagccccagga

SEQ ID NO: 349880 - DNA, 25 bp, Mus musculus
tacctggaccagcaacagtatcaaa

SEQ ID NO: 349881 - DNA, 25 bp, Mus musculus
tacctggactgggaggtaggggtcc

SEQ ID NO: 349882 - DNA, 25 bp, Mus musculus
tacctggacttaactgtgccaccac

SEQ ID NO: 349883 - DNA, 25 bp, Mus musculus
tacctggagaaaaaggggaccatgg

SEQ ID NO: 349884 - DNA, 25 bp, Mus musculus
tacctggagaagacctgtgccgtgt

SEQ ID NO: 349885 - DNA, 25 bp, Mus musculus
tacctggagagagttcaccttttcc

SEQ ID NO: 349886 - DNA, 25 bp, Mus musculus
tacctggagatgttccgagaacaag

SEQ ID NO: 349887 - DNA, 25 bp, Mus musculus
tacctggagctgatggaacacccat

SEQ ID NO: 349888 - DNA, 25 bp, Mus musculus
tacctggatagcatgtacatcatgt

SEQ ID NO: 349889 - DNA, 25 bp, Mus musculus
tacctggatcctgagcatgctgccc

SEQ ID NO: 349890 - DNA, 25 bp, Mus musculus
tacctggatgacgagttgatagaca

SEQ ID NO: 349891 - DNA, 25 bp, Mus musculus
tacctggatgacgttaatgaaatca

SEQ ID NO: 349892 - DNA, 25 bp, Mus musculus
tacctggatgaggagaaacttgaac

SEQ ID NO: 349893 - DNA, 25 bp, Mus musculus
tacctggatgaggagaactttgtga

SEQ ID NO: 349894 - DNA, 25 bp, Mus musculus
tacctggatgcctatgctgaacacc

SEQ ID NO: 349895 - DNA, 25 bp, Mus musculus
tacctggcaccagaggtattagaag

SEQ ID NO: 349896 - DNA, 25 bp, Mus musculus
tacctggcagagatggacatgctag

SEQ ID NO: 349897 - DNA, 25 bp, Mus musculus
tacctggcagagccgctgatggact

SEQ ID NO: 349898 - DNA, 25 bp, Mus musculus
tacctggcagaggtgatatgtaaag

SEQ ID NO: 349899 - DNA, 25 bp, Mus musculus
tacctggccccgtgggagcccttgg

SEQ ID NO: 349900 - DNA, 25 bp, Mus musculus
tacctggcggacaggctgggccgtc

SEQ ID NO: 349901 - DNA, 25 bp, Mus musculus
tacctgggagccatcgagggaatgg

SEQ ID NO: 349902 - DNA, 25 bp, Mus musculus
tacctgggcccccgtcacagtttgc

SEQ ID NO: 349903 - DNA, 25 bp, Mus musculus
tacctggggacagaattgccctaga

SEQ ID NO: 349904 - DNA, 25 bp, Mus musculus
tacctggtccaggataaataggatt

SEQ ID NO: 349905 - DNA, 25 bp, Mus musculus
tacctggtttcaggccttcccctga

SEQ ID NO: 349906 - DNA, 25 bp, Mus musculus
tacctggtttcagggcagcccctgg

SEQ ID NO: 349907 - DNA, 25 bp, Mus musculus
tacctgtacagggctggtacttcta

SEQ ID NO: 349908 - DNA, 25 bp, Mus musculus
tacctgtacagttttgtggcggctg

SEQ ID NO: 349909 - DNA, 25 bp, Mus musculus
tacctgtatacaggccgcttggaca

SEQ ID NO: 349910 - DNA, 25 bp, Mus musculus
tacctgtgaaaagatcatctgttct

SEQ ID NO: 349911 - DNA, 25 bp, Mus musculus
tacctgtgaaaatggctctggagat

SEQ ID NO: 349912 - DNA, 25 bp, Mus musculus
tacctgtgatgtctcacaccatttt

SEQ ID NO: 349913 - DNA, 25 bp, Mus musculus
tacctgtgcctggaggaccagctct

SEQ ID NO: 349914 - DNA, 25 bp, Mus musculus
tacctgtgctcaggtcgcaggcatc

SEQ ID NO: 349915 - DNA, 25 bp, Mus musculus
tacctgtggctaagactctagcctt

SEQ ID NO: 349916 - DNA, 25 bp, Mus musculus
tacctgtggctaagctaccgattta

SEQ ID NO: 349917 - DNA, 25 bp, Mus musculus
tacctgttcttcagaaacaacatgc

SEQ ID NO: 349918 - DNA, 25 bp, Mus musculus
tacctgttcttcagaaacagacatc

SEQ ID NO: 349919 - DNA, 25 bp, Mus musculus
taccttaccactgagatactagatt

SEQ ID NO: 349920 - DNA, 25 bp, Mus musculus
taccttaccagttttacaggaatca

SEQ ID NO: 349921 - DNA, 25 bp, Mus musculus
taccttagtataggtgattgaagcc

SEQ ID NO: 349922 - DNA, 25 bp, Mus musculus
taccttagtataggtgtcctcagat

SEQ ID NO: 349923 - DNA, 25 bp, Mus musculus
taccttagttcagaatgtgattctg

SEQ ID NO: 349924 - DNA, 25 bp, Mus musculus
taccttagttcagatcctagcccga

SEQ ID NO: 349925 - DNA, 25 bp, Mus musculus
taccttattgaaaggatgaagaaac

SEQ ID NO: 349926 - DNA, 25 bp, Mus musculus
taccttcaaacctggtgcgttcatt

SEQ ID NO: 349927 - DNA, 25 bp, Mus musculus
taccttcaagatgctgggtgccctg

SEQ ID NO: 349928 - DNA, 25 bp, Mus musculus
taccttcaagccaccttcaagacca

SEQ ID NO: 349929 - DNA, 25 bp, Mus musculus
taccttcaaggcctgcacgctgctg

SEQ ID NO: 349930 - DNA, 25 bp, Mus musculus
taccttcaagggatttaaacgagtg

SEQ ID NO: 349931 - DNA, 25 bp, Mus musculus
taccttcaccaggactgggaggtac

SEQ ID NO: 349932 - DNA, 25 bp, Mus musculus
taccttcagaattggataaccacga

SEQ ID NO: 349933 - DNA, 25 bp, Mus musculus
taccttcattacgtgcgaccctggc

SEQ ID NO: 349934 - DNA, 25 bp, Mus musculus
taccttcattgaactccaagattcc

SEQ ID NO: 349935 - DNA, 25 bp, Mus musculus
taccttccaggaatcctgctgcatc

SEQ ID NO: 349936 - DNA, 25 bp, Mus musculus
taccttcctcccctgctacaaaaaa

SEQ ID NO: 349937 - DNA, 25 bp, Mus musculus
taccttcctcctaaggcgcctgtgt

SEQ ID NO: 349938 - DNA, 25 bp, Mus musculus
taccttcgagatgctgggtgccctg

SEQ ID NO: 349939 - DNA, 25 bp, Mus musculus
taccttcgagccttcccagaggcca

SEQ ID NO: 349940 - DNA, 25 bp, Mus musculus
taccttcgctaggtatatatggtct

SEQ ID NO: 349941 - DNA, 25 bp, Mus musculus
taccttctgaggaagcactggattg

SEQ ID NO: 349942 - DNA, 25 bp, Mus musculus
taccttctgaggaaggtattcggca

SEQ ID NO: 349943 - DNA, 25 bp, Mus musculus
taccttctgcaagaaggagatctgg

SEQ ID NO: 349944 - DNA, 25 bp, Mus musculus
taccttctggattcttggcgcccgt

SEQ ID NO: 349945 - DNA, 25 bp, Mus musculus
taccttcttctgtatatgcaccatc

SEQ ID NO: 349946 - DNA, 25 bp, Mus musculus
taccttctttctgcccttgcagaac

SEQ ID NO: 349947 - DNA, 25 bp, Mus musculus
taccttgaactgagctggtggggag

SEQ ID NO: 349948 - DNA, 25 bp, Mus musculus
taccttgaaggcccacaatgtcctg

SEQ ID NO: 349949 - DNA, 25 bp, Mus musculus
taccttgacgtcccacacttgcatg

SEQ ID NO: 349950 - DNA, 25 bp, Mus musculus
taccttgcaaagaatccaaaacctg

SEQ ID NO: 349951 - DNA, 25 bp, Mus musculus
taccttgcaaaggagtggccgtcca

SEQ ID NO: 349952 - DNA, 25 bp, Mus musculus
taccttgcttgtgggattcacagcc

SEQ ID NO: 349953 - DNA, 25 bp, Mus musculus
taccttggcaggagccaacagagaa

SEQ ID NO: 349954 - DNA, 25 bp, Mus musculus
taccttggtgagaccatagcccagt

SEQ ID NO: 349955 - DNA, 25 bp, Mus musculus
taccttgtgaagaagggaagtgtgt

SEQ ID NO: 349956 - DNA, 25 bp, Mus musculus
taccttgtgatctagccagatcttc

SEQ ID NO: 349957 - DNA, 25 bp, Mus musculus
taccttgttgtctctgcttcctgag

SEQ ID NO: 349958 - DNA, 25 bp, Mus musculus
tacctttaacagcccttagggccat

SEQ ID NO: 349959 - DNA, 25 bp, Mus musculus
tacctttaacagcctctttccaggc

SEQ ID NO: 349960 - DNA, 25 bp, Mus musculus
tacctttaacaggattccagtctta

SEQ ID NO: 349961 - DNA, 25 bp, Mus musculus
tacctttaacagggccatcatggag

SEQ ID NO: 349962 - DNA, 25 bp, Mus musculus
tacctttaatttccgagtggacaag

SEQ ID NO: 349963 - DNA, 25 bp, Mus musculus
tacctttccaataccaaatatgaat

SEQ ID NO: 349964 - DNA, 25 bp, Mus musculus
tacctttccagagctgccttacaga

SEQ ID NO: 349965 - DNA, 25 bp, Mus musculus
tacctttgaacgaatcccgctcaag

SEQ ID NO: 349966 - DNA, 25 bp, Mus musculus
tacctttgagtacaggtgatttgaa

SEQ ID NO: 349967 - DNA, 25 bp, Mus musculus
tacctttgcagaaagaagaatcctc

SEQ ID NO: 349968 - DNA, 25 bp, Mus musculus
tacctttgctttgtattacgtgcac

SEQ ID NO: 349969 - DNA, 25 bp, Mus musculus
tacctttgtaatcagcttggcttac

SEQ ID NO: 349970 - DNA, 25 bp, Mus musculus
taccttttgagcaggtagaagagaa

SEQ ID NO: 349971 - DNA, 25 bp, Mus musculus
taccttttgggaaagcttcaccacg

SEQ ID NO: 349972 - DNA, 25 bp, Mus musculus
tacgaaacaagtgcctgctttttct

SEQ ID NO: 349973 - DNA, 25 bp, Mus musculus
tacgaaagcaaagtggccaaagtga

SEQ ID NO: 349974 - DNA, 25 bp, Mus musculus
tacgaaagtcccagcactccgtcct

SEQ ID NO: 349975 - DNA, 25 bp, Mus musculus
tacgaacacggccaaagtgaaagag

SEQ ID NO: 349976 - DNA, 25 bp, Mus musculus
tacgaaccacactgtaccagcaagg

SEQ ID NO: 349977 - DNA, 25 bp, Mus musculus
tacgaacgtggatgaggctgtagag

SEQ ID NO: 349978 - DNA, 25 bp, Mus musculus
tacgaactcggctaccaagagcaaa

SEQ ID NO: 349979 - DNA, 25 bp, Mus musculus
tacgaactgcctgatgtaaagaatg

SEQ ID NO: 349980 - DNA, 25 bp, Mus musculus
tacgaagaaggcaaatagcacccag

SEQ ID NO: 349981 - DNA, 25 bp, Mus musculus
tacgaagactgcgagcacgtagaag

SEQ ID NO: 349982 - DNA, 25 bp, Mus musculus
tacgaagactgcgaggaccgtcacg

SEQ ID NO: 349983 - DNA, 25 bp, Mus musculus
tacgaagaggaagaggaggcccaag

SEQ ID NO: 349984 - DNA, 25 bp, Mus musculus
tacgaagcagctccttaattgatgg

SEQ ID NO: 349985 - DNA, 25 bp, Mus musculus
tacgaagcaggctgcaccctggagg

SEQ ID NO: 349986 - DNA, 25 bp, Mus musculus
tacgaagccgatttttgggaataaa

SEQ ID NO: 349987 - DNA, 25 bp, Mus musculus
tacgaagccgtgacactgatgagac

SEQ ID NO: 349988 - DNA, 25 bp, Mus musculus
tacgaagcgccctttccgtcagaat

SEQ ID NO: 349989 - DNA, 25 bp, Mus musculus
tacgaaggaggaaactcccagtatg

SEQ ID NO: 349990 - DNA, 25 bp, Mus musculus
tacgaaggcaaggcgacccctctga

SEQ ID NO: 349991 - DNA, 25 bp, Mus musculus
tacgacaaacctgaggtctggaaga

SEQ ID NO: 349992 - DNA, 25 bp, Mus musculus
tacgacaaataagatgcacgccatc

SEQ ID NO: 349993 - DNA, 25 bp, Mus musculus
tacgacaaatgtgtgccaaagaatc

SEQ ID NO: 349994 - DNA, 25 bp, Mus musculus
tacgacactgtacttcgcagatatg

SEQ ID NO: 349995 - DNA, 25 bp, Mus musculus
tacgacagctgcctcctagctttcc

SEQ ID NO: 349996 - DNA, 25 bp, Mus musculus
tacgacagctgggctacttgattag

SEQ ID NO: 349997 - DNA, 25 bp, Mus musculus
tacgacatccttcaggctggtggct

SEQ ID NO: 349998 - DNA, 25 bp, Mus musculus
tacgacatggctgccagaaaatgcc

SEQ ID NO: 349999 - DNA, 25 bp, Mus musculus
tacgacctccctaggattctcaaag

SEQ ID NO: 350000 - DNA, 25 bp, Mus musculus
tacgacctccctaggtgaggattat

SEQ ID NO: 350001 - DNA, 25 bp, Mus musculus
tacgacgttaagcagattttgaagc

SEQ ID NO: 350002 - DNA, 25 bp, Mus musculus
tacgacgttaagcagatttttcatt

SEQ ID NO: 350003 - DNA, 25 bp, Mus musculus
tacgactacagaagtgacctctagg

SEQ ID NO: 350004 - DNA, 25 bp, Mus musculus
tacgactacagaagtgacctctggt

SEQ ID NO: 350005 - DNA, 25 bp, Mus musculus
tacgactacagtcagggtagtacaa

SEQ ID NO: 350006 - DNA, 25 bp, Mus musculus
tacgactgaaggagaaaattttgag

SEQ ID NO: 350007 - DNA, 25 bp, Mus musculus
tacgagacgctcaaggatgaagaaa

SEQ ID NO: 350008 - DNA, 25 bp, Mus musculus
tacgagacgctcaagtcctcctgca

SEQ ID NO: 350009 - DNA, 25 bp, Mus musculus
tacgagagctttaattttgccaaaa

SEQ ID NO: 350010 - DNA, 25 bp, Mus musculus
tacgagagctttggtctctttgctg

SEQ ID NO: 350011 - DNA, 25 bp, Mus musculus
tacgagattgcaaaggtcatttggt

SEQ ID NO: 350012 - DNA, 25 bp, Mus musculus
tacgagcctggcttctaataacatg

SEQ ID NO: 350013 - DNA, 25 bp, Mus musculus
tacgagctcagaaacaaatacattc

SEQ ID NO: 350014 - DNA, 25 bp, Mus musculus
tacgagctcagaatattattggcgt

SEQ ID NO: 350015 - DNA, 25 bp, Mus musculus
tacgagctcaggtcctgaactttgt

SEQ ID NO: 350016 - DNA, 25 bp, Mus musculus
tacgagctgcagaaccagctagctg

SEQ ID NO: 350017 - DNA, 25 bp, Mus musculus
tacgagctgccgtgggttgaaaaat

SEQ ID NO: 350018 - DNA, 25 bp, Mus musculus
tacgaggaagtaccatttaggtcca

SEQ ID NO: 350019 - DNA, 25 bp, Mus musculus
tacgaggcaaaggtgtacagtgcca

SEQ ID NO: 350020 - DNA, 25 bp, Mus musculus
tacgaggcagaaatgctgagcttcc

SEQ ID NO: 350021 - DNA, 25 bp, Mus musculus
tacgagtaccggcatgtcatgttac

SEQ ID NO: 350022 - DNA, 25 bp, Mus musculus
tacgagtatctggaagtacaaagga

SEQ ID NO: 350023 - DNA, 25 bp, Mus musculus
tacgagtatctggacatgtcctcac

SEQ ID NO: 350024 - DNA, 25 bp, Mus musculus
tacgagtatctggctcagagacatg

SEQ ID NO: 350025 - DNA, 25 bp, Mus musculus
tacgagtatctggttttaacagcgt

SEQ ID NO: 350026 - DNA, 25 bp, Mus musculus
tacgagtccgaaaggcaagagctgg

SEQ ID NO: 350027 - DNA, 25 bp, Mus musculus
tacgagtctgaggctgcttatgatc

SEQ ID NO: 350028 - DNA, 25 bp, Mus musculus
tacgatacagacaggttaactgagg

SEQ ID NO: 350029 - DNA, 25 bp, Mus musculus
tacgatagaggactcctacaggaaa

SEQ ID NO: 350030 - DNA, 25 bp, Mus musculus
tacgatagagttgttggagtttttt

SEQ ID NO: 350031 - DNA, 25 bp, Mus musculus
tacgatagccatgagggcagaagtg

SEQ ID NO: 350032 - DNA, 25 bp, Mus musculus
tacgatagccattcccttcaggccc

SEQ ID NO: 350033 - DNA, 25 bp, Mus musculus
tacgatatcacaaatgttaactcat

SEQ ID NO: 350034 - DNA, 25 bp, Mus musculus
tacgatcacaagatgtctggtcagc

SEQ ID NO: 350035 - DNA, 25 bp, Mus musculus
tacgatcacaagattggcgaaagac

SEQ ID NO: 350036 - DNA, 25 bp, Mus musculus
tacgatcacagataactatgctaaa

SEQ ID NO: 350037 - DNA, 25 bp, Mus musculus
tacgatcacagggatctcgattgtc

SEQ ID NO: 350038 - DNA, 25 bp, Mus musculus
tacgatccaccaggtttgaggagtt

SEQ ID NO: 350039 - DNA, 25 bp, Mus musculus
tacgatctcatcaagaccctgaaga

SEQ ID NO: 350040 - DNA, 25 bp, Mus musculus
tacgatctcatcaaggcacatacca

SEQ ID NO: 350041 - DNA, 25 bp, Mus musculus
tacgatctctttgggtccattttct

SEQ ID NO: 350042 - DNA, 25 bp, Mus musculus
tacgatgaagactgccaaagtggct

SEQ ID NO: 350043 - DNA, 25 bp, Mus musculus
tacgatgaaggctgtcatggtatcc

SEQ ID NO: 350044 - DNA, 25 bp, Mus musculus
tacgatgagaaccggaagaaagccg

SEQ ID NO: 350045 - DNA, 25 bp, Mus musculus
tacgatgagtccaaattttatattg

SEQ ID NO: 350046 - DNA, 25 bp, Mus musculus
tacgatgagtccaagttctatattg

SEQ ID NO: 350047 - DNA, 25 bp, Mus musculus
tacgatgagtgtaaacgaagattta

SEQ ID NO: 350048 - DNA, 25 bp, Mus musculus
tacgatgctgctacgaaatccatac

SEQ ID NO: 350049 - DNA, 25 bp, Mus musculus
tacgatgctgctacgaggaggaaga

SEQ ID NO: 350050 - DNA, 25 bp, Mus musculus
tacgatgcttgccagggtgacagtg

SEQ ID NO: 350051 - DNA, 25 bp, Mus musculus
tacgatgcttgccagtgggggaccg

SEQ ID NO: 350052 - DNA, 25 bp, Mus musculus
tacgatggaagcagggaggctgcaa

SEQ ID NO: 350053 - DNA, 25 bp, Mus musculus
tacgattatccagataagtagcaga

SEQ ID NO: 350054 - DNA, 25 bp, Mus musculus
tacgattcagatggttacggctctg

SEQ ID NO: 350055 - DNA, 25 bp, Mus musculus
tacgattgatcacagttttcattga

SEQ ID NO: 350056 - DNA, 25 bp, Mus musculus
tacgcaaaaagcaggcctgttgctg

SEQ ID NO: 350057 - DNA, 25 bp, Mus musculus
tacgcaaaataataggaagaagggg

SEQ ID NO: 350058 - DNA, 25 bp, Mus musculus
tacgcaaaatagttgaaaaacattt

SEQ ID NO: 350059 - DNA, 25 bp, Mus musculus
tacgcaaggagctagactctgagga

SEQ ID NO: 350060 - DNA, 25 bp, Mus musculus
tacgcaaggagctagactctgagta

SEQ ID NO: 350061 - DNA, 25 bp, Mus musculus
tacgcaccaaaggtgtgactttgag

SEQ ID NO: 350062 - DNA, 25 bp, Mus musculus
tacgcatcatgccactgccttctgg

SEQ ID NO: 350063 - DNA, 25 bp, Mus musculus
tacgcatgcccagctcaagaagggg

SEQ ID NO: 350064 - DNA, 25 bp, Mus musculus
tacgcatgcccaggctcctgctcct

SEQ ID NO: 350065 - DNA, 25 bp, Mus musculus
tacgccaagaaatcattcatcgacc

SEQ ID NO: 350066 - DNA, 25 bp, Mus musculus
tacgccaagaaatccaggaagtaag

SEQ ID NO: 350067 - DNA, 25 bp, Mus musculus
tacgccacaagaactggaacagact

SEQ ID NO: 350068 - DNA, 25 bp, Mus musculus
tacgccacaagtaatcagccagtca

SEQ ID NO: 350069 - DNA, 25 bp, Mus musculus
tacgccacttatggatgtaggtcat

SEQ ID NO: 350070 - DNA, 25 bp, Mus musculus
tacgccagaagaagcgagtacttac

SEQ ID NO: 350071 - DNA, 25 bp, Mus musculus
tacgccagggccaggtcctgtgcgc

SEQ ID NO: 350072 - DNA, 25 bp, Mus musculus
tacgccatgggctggcgccaccctc

SEQ ID NO: 350073 - DNA, 25 bp, Mus musculus
tacgcccagaagcaggtactctatc

SEQ ID NO: 350074 - DNA, 25 bp, Mus musculus
tacgcccaggtcaaggactatgaga

SEQ ID NO: 350075 - DNA, 25 bp, Mus musculus
tacgcccaggtcaaggagtccatga

SEQ ID NO: 350076 - DNA, 25 bp, Mus musculus
tacgccccgcaagactttcctttgc

SEQ ID NO: 350077 - DNA, 25 bp, Mus musculus
tacgcccgaggacttcaggaaccat

SEQ ID NO: 350078 - DNA, 25 bp, Mus musculus
tacgccgcctatgtattgtattctt

SEQ ID NO: 350079 - DNA, 25 bp, Mus musculus
tacgccgcctctgtttggggcaact

SEQ ID NO: 350080 - DNA, 25 bp, Mus musculus
tacgccggggtgacggtggtcaaca

SEQ ID NO: 350081 - DNA, 25 bp, Mus musculus
tacgcctcccccggcccacaatgtc

SEQ ID NO: 350082 - DNA, 25 bp, Mus musculus
tacgcctgcagagcccacatggtgg

SEQ ID NO: 350083 - DNA, 25 bp, Mus musculus
tacgcctgcagtgctgtgaagagct

SEQ ID NO: 350084 - DNA, 25 bp, Mus musculus
tacgcctggagagaggagcaccgtg

SEQ ID NO: 350085 - DNA, 25 bp, Mus musculus
tacgcctgtgaggtctgtgcatttt

SEQ ID NO: 350086 - DNA, 25 bp, Mus musculus
tacgccttcccgaactacgctgcca

SEQ ID NO: 350087 - DNA, 25 bp, Mus musculus
tacgccttcttctgggagaagtttg

SEQ ID NO: 350088 - DNA, 25 bp, Mus musculus
tacgcctttgagatggctgtctcaa

SEQ ID NO: 350089 - DNA, 25 bp, Mus musculus
tacgccttttatgcatcttggcatg

SEQ ID NO: 350090 - DNA, 25 bp, Mus musculus
tacgcgactcagtaattggcaactg

SEQ ID NO: 350091 - DNA, 25 bp, Mus musculus
tacgcgaggaggaggccctgcgggc

SEQ ID NO: 350092 - DNA, 25 bp, Mus musculus
tacgcggagcccgagggctactctt

SEQ ID NO: 350093 - DNA, 25 bp, Mus musculus
tacgcggatgagcatcaccctggaa

SEQ ID NO: 350094 - DNA, 25 bp, Mus musculus
tacgcggcaaagcagctcctggagg

SEQ ID NO: 350095 - DNA, 25 bp, Mus musculus
tacgcgggacgggcccagttctgcg

SEQ ID NO: 350096 - DNA, 25 bp, Mus musculus
tacgcgggacggggcttctgacccc

SEQ ID NO: 350097 - DNA, 25 bp, Mus musculus
tacgctacacgactggcccagatgg

SEQ ID NO: 350098 - DNA, 25 bp, Mus musculus
tacgctcagccatgaagatgagggt

SEQ ID NO: 350099 - DNA, 25 bp, Mus musculus
tacgctctgagaagtactctcaagt

SEQ ID NO: 350100 - DNA, 25 bp, Mus musculus
tacgctctgagaatgtatgactcgg

SEQ ID NO: 350101 - DNA, 25 bp, Mus musculus
tacgctgatggcagtgaagacaaag

SEQ ID NO: 350102 - DNA, 25 bp, Mus musculus
tacgctgatggcggtgaagacaaag

SEQ ID NO: 350103 - DNA, 25 bp, Mus musculus
tacgctgccgtgtacccctccacac

SEQ ID NO: 350104 - DNA, 25 bp, Mus musculus
tacgctgcgccaaattttcacctga

SEQ ID NO: 350105 - DNA, 25 bp, Mus musculus
tacgctgcgcgagaggaatgcgctc

SEQ ID NO: 350106 - DNA, 25 bp, Mus musculus
tacgctgcgcgagagtatgtcttgg

SEQ ID NO: 350107 - DNA, 25 bp, Mus musculus
tacgctgctgagataggacgggaga

SEQ ID NO: 350108 - DNA, 25 bp, Mus musculus
tacgctgctgagcttcacctggttc

SEQ ID NO: 350109 - DNA, 25 bp, Mus musculus
tacgctggccactggtttatatcca

SEQ ID NO: 350110 - DNA, 25 bp, Mus musculus
tacgctggtgctgccccacacctct

SEQ ID NO: 350111 - DNA, 25 bp, Mus musculus
tacgctggtgctgcccccggccagc

SEQ ID NO: 350112 - DNA, 25 bp, Mus musculus
tacgctgtggaactgtttgaaggct

SEQ ID NO: 350113 - DNA, 25 bp, Mus musculus
tacgcttcctgaagggatgggctct

SEQ ID NO: 350114 - DNA, 25 bp, Mus musculus
tacgcttgccacactgtgaccctaa

SEQ ID NO: 350115 - DNA, 25 bp, Mus musculus
tacgctttgaagaagatgaagaggt

SEQ ID NO: 350116 - DNA, 25 bp, Mus musculus
tacgctttggccccaaacccatgcg

SEQ ID NO: 350117 - DNA, 25 bp, Mus musculus
tacggaagcaaggaaaatccaattg

SEQ ID NO: 350118 - DNA, 25 bp, Mus musculus
tacggaagcccctctggaaccggga

SEQ ID NO: 350119 - DNA, 25 bp, Mus musculus
tacggaagccgcagtggtggaggtg

SEQ ID NO: 350120 - DNA, 25 bp, Mus musculus
tacggaagcttggtaatgcaggtgg

SEQ ID NO: 350121 - DNA, 25 bp, Mus musculus
tacggacacataactggctctgtcc

SEQ ID NO: 350122 - DNA, 25 bp, Mus musculus
tacggacaggaggcgttgtctgtct

SEQ ID NO: 350123 - DNA, 25 bp, Mus musculus
tacggacaggaggggagaagagacg

SEQ ID NO: 350124 - DNA, 25 bp, Mus musculus
tacggacataaatattcttgtagac

SEQ ID NO: 350125 - DNA, 25 bp, Mus musculus
tacggaccaaatggaatgaataaaa

SEQ ID NO: 350126 - DNA, 25 bp, Mus musculus
tacggactaggccagcaggtggcca

SEQ ID NO: 350127 - DNA, 25 bp, Mus musculus
tacggactagggccctgcacacagt

SEQ ID NO: 350128 - DNA, 25 bp, Mus musculus
tacggactaggtggccatcaagaag

SEQ ID NO: 350129 - DNA, 25 bp, Mus musculus
tacggactgacgctgcacctggtgg

SEQ ID NO: 350130 - DNA, 25 bp, Mus musculus
tacggacttggacattaaggcccgc

SEQ ID NO: 350131 - DNA, 25 bp, Mus musculus
tacggagagattttatacaagctgt

SEQ ID NO: 350132 - DNA, 25 bp, Mus musculus
tacggagagattttatgagaggctg

SEQ ID NO: 350133 - DNA, 25 bp, Mus musculus
tacggagcagtctggcatgctccca

SEQ ID NO: 350134 - DNA, 25 bp, Mus musculus
tacggagccagccatgagaagttgc

SEQ ID NO: 350135 - DNA, 25 bp, Mus musculus
tacggagccagcggatgaagctacc

SEQ ID NO: 350136 - DNA, 25 bp, Mus musculus
tacggagccagttttataggtagaa

SEQ ID NO: 350137 - DNA, 25 bp, Mus musculus
tacggagctggtgggaggagtgaag

SEQ ID NO: 350138 - DNA, 25 bp, Mus musculus
tacggagctgtccaatgacgaagct

SEQ ID NO: 350139 - DNA, 25 bp, Mus musculus
tacggagctgtccaatttttggcct

SEQ ID NO: 350140 - DNA, 25 bp, Mus musculus
tacggagtcaagagccttcgtgagc

SEQ ID NO: 350141 - DNA, 25 bp, Mus musculus
tacggagtcaagaggttctccccaa

SEQ ID NO: 350142 - DNA, 25 bp, Mus musculus
tacggagtcaagagtcccctgtcgc

SEQ ID NO: 350143 - DNA, 25 bp, Mus musculus
tacggatagggagttcttccccaga

SEQ ID NO: 350144 - DNA, 25 bp, Mus musculus
tacggatcaggtcgtgtcttatgca

SEQ ID NO: 350145 - DNA, 25 bp, Mus musculus
tacggatcagtgacctgagggtgga

SEQ ID NO: 350146 - DNA, 25 bp, Mus musculus
tacggatggaggaatcacttggacc

SEQ ID NO: 350147 - DNA, 25 bp, Mus musculus
tacggcaaagtctcatacatcccag

SEQ ID NO: 350148 - DNA, 25 bp, Mus musculus
tacggcaacactgggtaacctccgt

SEQ ID NO: 350149 - DNA, 25 bp, Mus musculus
tacggcacagtgcttgctgaatttc

SEQ ID NO: 350150 - DNA, 25 bp, Mus musculus
tacggcacctcgacacgtgtgcaaa

SEQ ID NO: 350151 - DNA, 25 bp, Mus musculus
tacggcacctcggctggaaccctga

SEQ ID NO: 350152 - DNA, 25 bp, Mus musculus
tacggcactacggatgatctgagaa

SEQ ID NO: 350153 - DNA, 25 bp, Mus musculus
tacggcactacgggttccaatattg

SEQ ID NO: 350154 - DNA, 25 bp, Mus musculus
tacggcaggaactaaatcttccatc

SEQ ID NO: 350155 - DNA, 25 bp, Mus musculus
tacggccaggaatggacatttggtc

SEQ ID NO: 350156 - DNA, 25 bp, Mus musculus
tacggcccagcaggaccaaactctt

SEQ ID NO: 350157 - DNA, 25 bp, Mus musculus
tacggccctgcaacattggttcttt

SEQ ID NO: 350158 - DNA, 25 bp, Mus musculus
tacggccctgcagtggaagacttcg

SEQ ID NO: 350159 - DNA, 25 bp, Mus musculus
tacggccgcgccatcactcggaacc

SEQ ID NO: 350160 - DNA, 25 bp, Mus musculus
tacggcctctaccggacacacctgc

SEQ ID NO: 350161 - DNA, 25 bp, Mus musculus
tacggcctttattaagtacagtcca

SEQ ID NO: 350162 - DNA, 25 bp, Mus musculus
tacggcgagccaggatgtccacctc

SEQ ID NO: 350163 - DNA, 25 bp, Mus musculus
tacggcgagccagggcaaaggagca

SEQ ID NO: 350164 - DNA, 25 bp, Mus musculus
tacggcggagatgaagttggcgctc

SEQ ID NO: 350165 - DNA, 25 bp, Mus musculus
tacggcggagtggaacactcgggcc

SEQ ID NO: 350166 - DNA, 25 bp, Mus musculus
tacggcgtggccttttacaactacg

SEQ ID NO: 350167 - DNA, 25 bp, Mus musculus
tacggctgcgaggaagaagaaatgc

SEQ ID NO: 350168 - DNA, 25 bp, Mus musculus
tacggctgcgaggaattcatcagag

SEQ ID NO: 350169 - DNA, 25 bp, Mus musculus
tacggctgtcaacctaatgtctgcg

SEQ ID NO: 350170 - DNA, 25 bp, Mus musculus
tacggcttgtcacattcccacgagg

SEQ ID NO: 350171 - DNA, 25 bp, Mus musculus
tacgggaagcaaacattcgagatct

SEQ ID NO: 350172 - DNA, 25 bp, Mus musculus
tacgggaagcacgggacgcctcaga

SEQ ID NO: 350173 - DNA, 25 bp, Mus musculus
tacgggaaggacaggacagcaaggt

SEQ ID NO: 350174 - DNA, 25 bp, Mus musculus
tacgggaaggacaggttcaactgga

SEQ ID NO: 350175 - DNA, 25 bp, Mus musculus
tacgggattggcctagaaggagggg

SEQ ID NO: 350176 - DNA, 25 bp, Mus musculus
tacgggatttgctggacaggacgcc

SEQ ID NO: 350177 - DNA, 25 bp, Mus musculus
tacgggcaacaaaatggcagtgaaa

SEQ ID NO: 350178 - DNA, 25 bp, Mus musculus
tacgggcaacaaagatttctgaaaa

SEQ ID NO: 350179 - DNA, 25 bp, Mus musculus
tacgggcaacaaagtgcactaggcc

SEQ ID NO: 350180 - DNA, 25 bp, Mus musculus
tacgggcaacaaatatgtctggatt

SEQ ID NO: 350181 - DNA, 25 bp, Mus musculus
tacgggcactggcaggcctgtacgg

SEQ ID NO: 350182 - DNA, 25 bp, Mus musculus
tacgggcactggcagggctggtcta

SEQ ID NO: 350183 - DNA, 25 bp, Mus musculus
tacgggcagatcagctgtcctggaa

SEQ ID NO: 350184 - DNA, 25 bp, Mus musculus
tacgggcagatcagtccgcactgga

SEQ ID NO: 350185 - DNA, 25 bp, Mus musculus
tacgggcagcagagttcattccgac

SEQ ID NO: 350186 - DNA, 25 bp, Mus musculus
tacgggcatggcagccaaagcttaa

SEQ ID NO: 350187 - DNA, 25 bp, Mus musculus
tacgggccaaagaagattgcagagt

SEQ ID NO: 350188 - DNA, 25 bp, Mus musculus
tacgggccggaaaagacaaggacca

SEQ ID NO: 350189 - DNA, 25 bp, Mus musculus
tacgggcgcgagggcgccgagcgcg

SEQ ID NO: 350190 - DNA, 25 bp, Mus musculus
tacggggcttgggagcatttagctc

SEQ ID NO: 350191 - DNA, 25 bp, Mus musculus
tacgggggaggctgctctgagatgc

SEQ ID NO: 350192 - DNA, 25 bp, Mus musculus
tacgggtactggggcctggatattc

SEQ ID NO: 350193 - DNA, 25 bp, Mus musculus
tacggtagtagctcctggtttgctt

SEQ ID NO: 350194 - DNA, 25 bp, Mus musculus
tacggtcacaaacttaatctagaga

SEQ ID NO: 350195 - DNA, 25 bp, Mus musculus
tacggtctctgctgcgctacatggt

SEQ ID NO: 350196 - DNA, 25 bp, Mus musculus
tacggtgccaggctgtactgcctga

SEQ ID NO: 350197 - DNA, 25 bp, Mus musculus
tacggtggtgcaatctgccagcttg

SEQ ID NO: 350198 - DNA, 25 bp, Mus musculus
tacggtggtgcacctcgcctgcatg

SEQ ID NO: 350199 - DNA, 25 bp, Mus musculus
tacggtggtgcaggctctccttcct

SEQ ID NO: 350200 - DNA, 25 bp, Mus musculus
tacggtggtggagtgcacctgtcaa

SEQ ID NO: 350201 - DNA, 25 bp, Mus musculus
tacggtgttcagggactgctgacct

SEQ ID NO: 350202 - DNA, 25 bp, Mus musculus
tacggtgttcaggtcactgcaagac

SEQ ID NO: 350203 - DNA, 25 bp, Mus musculus
tacggttgtcagaaacttatggaac

SEQ ID NO: 350204 - DNA, 25 bp, Mus musculus
tacggttgtcagtccgcagatgcac

SEQ ID NO: 350205 - DNA, 25 bp, Mus musculus
tacgtaaagggcctgacaagatcaa

SEQ ID NO: 350206 - DNA, 25 bp, Mus musculus
tacgtacaagatgaacatctgcaac

SEQ ID NO: 350207 - DNA, 25 bp, Mus musculus
tacgtacaaggaatcaaagaagagt

SEQ ID NO: 350208 - DNA, 25 bp, Mus musculus
tacgtacacaggttttcctttggaa

SEQ ID NO: 350209 - DNA, 25 bp, Mus musculus
tacgtaccagatcagctcaaggcaa

SEQ ID NO: 350210 - DNA, 25 bp, Mus musculus
tacgtagactccgagggacatctct

SEQ ID NO: 350211 - DNA, 25 bp, Mus musculus
tacgtatagccaggtggtgaccgtt

SEQ ID NO: 350212 - DNA, 25 bp, Mus musculus
tacgtcaaagtcatagttgatattc

SEQ ID NO: 350213 - DNA, 25 bp, Mus musculus
tacgtcaaagtcattgttgatattc

SEQ ID NO: 350214 - DNA, 25 bp, Mus musculus
tacgtcatcttaccgatcaagaagc

SEQ ID NO: 350215 - DNA, 25 bp, Mus musculus
tacgtcatgccagatgtctctccga

SEQ ID NO: 350216 - DNA, 25 bp, Mus musculus
tacgtcattgggaggaaaactccct

SEQ ID NO: 350217 - DNA, 25 bp, Mus musculus
tacgtcattgggtgggtgttcgtgt

SEQ ID NO: 350218 - DNA, 25 bp, Mus musculus
tacgtccagcaggcgggcttggagg

SEQ ID NO: 350219 - DNA, 25 bp, Mus musculus
tacgtccctcaagagtttacaaacc

SEQ ID NO: 350220 - DNA, 25 bp, Mus musculus
tacgtccgagacatgatagaagcga

SEQ ID NO: 350221 - DNA, 25 bp, Mus musculus
tacgtccgagacatggagatcgagg

SEQ ID NO: 350222 - DNA, 25 bp, Mus musculus
tacgtcctcccgaccatgctcgcat

SEQ ID NO: 350223 - DNA, 25 bp, Mus musculus
tacgtcctgaacacgacccgagcaa

SEQ ID NO: 350224 - DNA, 25 bp, Mus musculus
tacgtcctgcagagcgacgtttttc

SEQ ID NO: 350225 - DNA, 25 bp, Mus musculus
tacgtcctgttccaccatagccatc

SEQ ID NO: 350226 - DNA, 25 bp, Mus musculus
tacgtcgtccgagtctccaggaaca

SEQ ID NO: 350227 - DNA, 25 bp, Mus musculus
tacgtgaagagagggcacatctgct

SEQ ID NO: 350228 - DNA, 25 bp, Mus musculus
tacgtgagcaggaggagctgagcaa

SEQ ID NO: 350229 - DNA, 25 bp, Mus musculus
tacgtgagcctggacagaccctcta

SEQ ID NO: 350230 - DNA, 25 bp, Mus musculus
tacgtgcaaaaggtaactttcggcc

SEQ ID NO: 350231 - DNA, 25 bp, Mus musculus
tacgtgctaataagattgagtctgt

SEQ ID NO: 350232 - DNA, 25 bp, Mus musculus
tacgtgctaataaggggttgatagt

SEQ ID NO: 350233 - DNA, 25 bp, Mus musculus
tacgtgctgaagtatgccgcctgtg

SEQ ID NO: 350234 - DNA, 25 bp, Mus musculus
tacgtgcttggcggcgcctgtgaga

SEQ ID NO: 350235 - DNA, 25 bp, Mus musculus
tacgtggaccccagacatcacgagc

SEQ ID NO: 350236 - DNA, 25 bp, Mus musculus
tacgtggaccccagcggcagctccg

SEQ ID NO: 350237 - DNA, 25 bp, Mus musculus
tacgtggcagatggcagcctgcacc

SEQ ID NO: 350238 - DNA, 25 bp, Mus musculus
tacgtggcagctggatcagacattg

SEQ ID NO: 350239 - DNA, 25 bp, Mus musculus
tacgtggcaggtggatcagacattg

SEQ ID NO: 350240 - DNA, 25 bp, Mus musculus
tacgtgggaaggcactttccggatg

SEQ ID NO: 350241 - DNA, 25 bp, Mus musculus
tacgtggtcaccaacagtcagcgtg

SEQ ID NO: 350242 - DNA, 25 bp, Mus musculus
tacgtggtcgcagacgaagaaatgg

SEQ ID NO: 350243 - DNA, 25 bp, Mus musculus
tacgtgtactcctggaccatgatgt

SEQ ID NO: 350244 - DNA, 25 bp, Mus musculus
tacgtgtcctatgctgtcttccttg

SEQ ID NO: 350245 - DNA, 25 bp, Mus musculus
tacgtgtcgtcagcagccttttggt

SEQ ID NO: 350246 - DNA, 25 bp, Mus musculus
tacgtgttcaatgggcatgttcatc

SEQ ID NO: 350247 - DNA, 25 bp, Mus musculus
tacgttactggttgcttctataact

SEQ ID NO: 350248 - DNA, 25 bp, Mus musculus
tacgttatgaaagacctgtgttgcg

SEQ ID NO: 350249 - DNA, 25 bp, Mus musculus
tacgttcaacaggcaaagcgagtgg

SEQ ID NO: 350250 - DNA, 25 bp, Mus musculus
tacgttccaggagttacagcttcct

SEQ ID NO: 350251 - DNA, 25 bp, Mus musculus
tacgttcgcaactcacggatgattg

SEQ ID NO: 350252 - DNA, 25 bp, Mus musculus
tacgttgttgctaagacattcgaca

SEQ ID NO: 350253 - DNA, 25 bp, Mus musculus
tacgtttactgtgagttccttcggg

SEQ ID NO: 350254 - DNA, 25 bp, Mus musculus
tacgttttcattgtgatctctgggc

SEQ ID NO: 350255 - DNA, 25 bp, Mus musculus
tacgtttttcagaatgccggacaca

SEQ ID NO: 350256 - DNA, 25 bp, Mus musculus
tactaaaaatagcccagaagagatc

SEQ ID NO: 350257 - DNA, 25 bp, Mus musculus
tactaaaactccagttccttctgat

SEQ ID NO: 350258 - DNA, 25 bp, Mus musculus
tactaaagttgttcaaggcctggca

SEQ ID NO: 350259 - DNA, 25 bp, Mus musculus
tactaaataatcagtatgaagctgc

SEQ ID NO: 350260 - DNA, 25 bp, Mus musculus
tactaacattagaaatccacaggta

SEQ ID NO: 350261 - DNA, 25 bp, Mus musculus
tactaactaaaggatgacagtcccc

SEQ ID NO: 350262 - DNA, 25 bp, Mus musculus
tactaagaaagagaccagtgctgtt

SEQ ID NO: 350263 - DNA, 25 bp, Mus musculus
tactaaggagggcgcagatgtccaa

SEQ ID NO: 350264 - DNA, 25 bp, Mus musculus
tactaaggagggcgctctctgtgag

SEQ ID NO: 350265 - DNA, 25 bp, Mus musculus
tactaaggccaagcttctggggttt

SEQ ID NO: 350266 - DNA, 25 bp, Mus musculus
tactaagtgcaagatatgaaattgt

SEQ ID NO: 350267 - DNA, 25 bp, Mus musculus
tactaagtggaggttccatgttgga

SEQ ID NO: 350268 - DNA, 25 bp, Mus musculus
tactaatcaaaatacgcctactatt

SEQ ID NO: 350269 - DNA, 25 bp, Mus musculus
tactaatcaaagtggacccaacagt

SEQ ID NO: 350270 - DNA, 25 bp, Mus musculus
tactaatcaggattgtcttgcctgt

SEQ ID NO: 350271 - DNA, 25 bp, Mus musculus
tactaatggaatgggcattatattt

SEQ ID NO: 350272 - DNA, 25 bp, Mus musculus
tactaatggaatgggccttgcattt

SEQ ID NO: 350273 - DNA, 25 bp, Mus musculus
tactaattactgaaaaagaagttat

SEQ ID NO: 350274 - DNA, 25 bp, Mus musculus
tactaattactggattctgctctaa

SEQ ID NO: 350275 - DNA, 25 bp, Mus musculus
tactaatttatgccggaaccctctg

SEQ ID NO: 350276 - DNA, 25 bp, Mus musculus
tactaatttatggcggaaccctctg

SEQ ID NO: 350277 - DNA, 25 bp, Mus musculus
tactacaacctggactgcagtgagg

SEQ ID NO: 350278 - DNA, 25 bp, Mus musculus
tactacaacctggcgtgacgggact

SEQ ID NO: 350279 - DNA, 25 bp, Mus musculus
tactacaaccttgcggagtgtgcag

SEQ ID NO: 350280 - DNA, 25 bp, Mus musculus
tactacacagttcaacgggaagggt

SEQ ID NO: 350281 - DNA, 25 bp, Mus musculus
tactacaccacagattatcagctgt

SEQ ID NO: 350282 - DNA, 25 bp, Mus musculus
tactacaccactacatggaaaaaag

SEQ ID NO: 350283 - DNA, 25 bp, Mus musculus
tactacagagtgatgctgaggaaga

SEQ ID NO: 350284 - DNA, 25 bp, Mus musculus
tactacagagttggtgaatatgtga

SEQ ID NO: 350285 - DNA, 25 bp, Mus musculus
tactacagccctgatcacaagtgct

SEQ ID NO: 350286 - DNA, 25 bp, Mus musculus
tactacagtgtctaatgcactaccg

SEQ ID NO: 350287 - DNA, 25 bp, Mus musculus
tactacattatatatgcaagttctg

SEQ ID NO: 350288 - DNA, 25 bp, Mus musculus
tactacattatatctacatcaaatg

SEQ ID NO: 350289 - DNA, 25 bp, Mus musculus
tactaccaagccccaggagatgggc

SEQ ID NO: 350290 - DNA, 25 bp, Mus musculus
tactaccacaaggggacatgaagca

SEQ ID NO: 350291 - DNA, 25 bp, Mus musculus
tactacccaggcgggtatggtgggg

SEQ ID NO: 350292 - DNA, 25 bp, Mus musculus
tactaccccatgagcatgtaccaga

SEQ ID NO: 350293 - DNA, 25 bp, Mus musculus
tactaccccatgcctccagtccctg

SEQ ID NO: 350294 - DNA, 25 bp, Mus musculus
tactacctacaatacccttcgagca

SEQ ID NO: 350295 - DNA, 25 bp, Mus musculus
tactacctgccactggtgcggaaga

SEQ ID NO: 350296 - DNA, 25 bp, Mus musculus
tactacctgccactggtgtagatac

SEQ ID NO: 350297 - DNA, 25 bp, Mus musculus
tactacgaaggaggaaactcccagt

SEQ ID NO: 350298 - DNA, 25 bp, Mus musculus
tactacgccatggagatgctctaca

SEQ ID NO: 350299 - DNA, 25 bp, Mus musculus
tactacgtacaagatgaacatctgc

SEQ ID NO: 350300 - DNA, 25 bp, Mus musculus
tactacgtacaaggaatcaaagaag

SEQ ID NO: 350301 - DNA, 25 bp, Mus musculus
tactacgtcatgcagtgcccttcca

SEQ ID NO: 350302 - DNA, 25 bp, Mus musculus
tactacgtcatggtcatctgctata

SEQ ID NO: 350303 - DNA, 25 bp, Mus musculus
tactacgtgtcctatgctgtcttcc

SEQ ID NO: 350304 - DNA, 25 bp, Mus musculus
tactacgttgatcacctcaaccaga

SEQ ID NO: 350305 - DNA, 25 bp, Mus musculus
tactactacatgatcatctccagag

SEQ ID NO: 350306 - DNA, 25 bp, Mus musculus
tactactaccccatgagcatgtacc

SEQ ID NO: 350307 - DNA, 25 bp, Mus musculus
tactactaccccatgcctccagtcc

SEQ ID NO: 350308 - DNA, 25 bp, Mus musculus
tactactatggagacatttcgactt

SEQ ID NO: 350309 - DNA, 25 bp, Mus musculus
tactactatggaggacagtggttct

SEQ ID NO: 350310 - DNA, 25 bp, Mus musculus
tactactcgtccagctcaagtctct

SEQ ID NO: 350311 - DNA, 25 bp, Mus musculus
tactactgaataccccaagtaccac

SEQ ID NO: 350312 - DNA, 25 bp, Mus musculus
tactactgtggggtatccgagtggt

SEQ ID NO: 350313 - DNA, 25 bp, Mus musculus
tactagaaaagttcctgtggaagac

SEQ ID NO: 350314 - DNA, 25 bp, Mus musculus
tactagaaacagaaaattcatttgc

SEQ ID NO: 350315 - DNA, 25 bp, Mus musculus
tactagacatacagtatgctcctga

SEQ ID NO: 350316 - DNA, 25 bp, Mus musculus
tactagactttcccaataaagactg

SEQ ID NO: 350317 - DNA, 25 bp, Mus musculus
tactagcacaaggtgactacgagaa

SEQ ID NO: 350318 - DNA, 25 bp, Mus musculus
tactaggaaaaaaagtggtcatgct

SEQ ID NO: 350319 - DNA, 25 bp, Mus musculus
tactaggaagaggaacacgcagcac

SEQ ID NO: 350320 - DNA, 25 bp, Mus musculus
tactagggagagactctacaggagc

SEQ ID NO: 350321 - DNA, 25 bp, Mus musculus
tactagtgaggccacaggcaggatg

SEQ ID NO: 350322 - DNA, 25 bp, Mus musculus
tactagttaagtgcctgaagacctg

SEQ ID NO: 350323 - DNA, 25 bp, Mus musculus
tactatacctctaggcctgctctgt

SEQ ID NO: 350324 - DNA, 25 bp, Mus musculus
tactatacctctaggccttatattg

SEQ ID NO: 350325 - DNA, 25 bp, Mus musculus
tactatatcaaccacgagacccaaa

SEQ ID NO: 350326 - DNA, 25 bp, Mus musculus
tactatcaaagtattctgcagatgc

SEQ ID NO: 350327 - DNA, 25 bp, Mus musculus
tactatccatggagggctgagccgg

SEQ ID NO: 350328 - DNA, 25 bp, Mus musculus
tactatcccagccccccaggttcgc

SEQ ID NO: 350329 - DNA, 25 bp, Mus musculus
tactatcccagtatgcaaccgagga

SEQ ID NO: 350330 - DNA, 25 bp, Mus musculus
tactatcccagtgtttgaaagacgt

SEQ ID NO: 350331 - DNA, 25 bp, Mus musculus
tactatcccgagaaagcctacatct

SEQ ID NO: 350332 - DNA, 25 bp, Mus musculus
tactatcccgaggcccgagtccgga

SEQ ID NO: 350333 - DNA, 25 bp, Mus musculus
tactatcctaaaggggtctttgtga

SEQ ID NO: 350334 - DNA, 25 bp, Mus musculus
tactatcctaaagggtgacaaaggg

SEQ ID NO: 350335 - DNA, 25 bp, Mus musculus
tactatcctgacagctacgacacgt

SEQ ID NO: 350336 - DNA, 25 bp, Mus musculus
tactatcctttttcaacttggagaa

SEQ ID NO: 350337 - DNA, 25 bp, Mus musculus
tactatcggcgacgcctgggctcct

SEQ ID NO: 350338 - DNA, 25 bp, Mus musculus
tactatcggcgtcttcccaaagccg

SEQ ID NO: 350339 - DNA, 25 bp, Mus musculus
tactatctatgcaaaagtagacaat

SEQ ID NO: 350340 - DNA, 25 bp, Mus musculus
tactatctgacaagcacaaacggga

SEQ ID NO: 350341 - DNA, 25 bp, Mus musculus
tactatctgacaagcacctatagtc

SEQ ID NO: 350342 - DNA, 25 bp, Mus musculus
tactatctgacagaagtggtccttc

SEQ ID NO: 350343 - DNA, 25 bp, Mus musculus
tactatctgacaggatggcttgcct

SEQ ID NO: 350344 - DNA, 25 bp, Mus musculus
tactatgaaaagggatggatcttta

SEQ ID NO: 350345 - DNA, 25 bp, Mus musculus
tactatgaaaaggtgacgtgcacag

SEQ ID NO: 350346 - DNA, 25 bp, Mus musculus
tactatgaactctggtggttcacca

SEQ ID NO: 350347 - DNA, 25 bp, Mus musculus
tactatgaagacatccgttctcatg

SEQ ID NO: 350348 - DNA, 25 bp, Mus musculus
tactatgaaggcgtgaatatgacat

SEQ ID NO: 350349 - DNA, 25 bp, Mus musculus
tactatgaaggcgtgggtatgcaat

SEQ ID NO: 350350 - DNA, 25 bp, Mus musculus
tactatgctgagcagattaagaaac

SEQ ID NO: 350351 - DNA, 25 bp, Mus musculus
tactatgctgagggccaaggatgtc

SEQ ID NO: 350352 - DNA, 25 bp, Mus musculus
tactatggagacatttcgactttgg

SEQ ID NO: 350353 - DNA, 25 bp, Mus musculus
tactatggagatgtcatctgggtga

SEQ ID NO: 350354 - DNA, 25 bp, Mus musculus
tactatggaggacagtggttcttgt

SEQ ID NO: 350355 - DNA, 25 bp, Mus musculus
tactatggaggggctccacgggcct

SEQ ID NO: 350356 - DNA, 25 bp, Mus musculus
tactatggtaaagatccctcaagaa

SEQ ID NO: 350357 - DNA, 25 bp, Mus musculus
tactatgtttagcgcagtgcttgac

SEQ ID NO: 350358 - DNA, 25 bp, Mus musculus
tactatgtttagggcagtgcttgac

SEQ ID NO: 350359 - DNA, 25 bp, Mus musculus
tactattacgacaagaacatcatca

SEQ ID NO: 350360 - DNA, 25 bp, Mus musculus
tactattacgacaagacaccaagtg

SEQ ID NO: 350361 - DNA, 25 bp, Mus musculus
tactattacggcatcctgagtgatg

SEQ ID NO: 350362 - DNA, 25 bp, Mus musculus
tactattacggcatggaccttgact

SEQ ID NO: 350363 - DNA, 25 bp, Mus musculus
tactattggggagagagaaaaaacc

SEQ ID NO: 350364 - DNA, 25 bp, Mus musculus
tactattgttgcaatcatggcagaa

SEQ ID NO: 350365 - DNA, 25 bp, Mus musculus
tactcaaaaaggtctatcctaaagt

SEQ ID NO: 350366 - DNA, 25 bp, Mus musculus
tactcaaacccgcaacttgaattgg

SEQ ID NO: 350367 - DNA, 25 bp, Mus musculus
tactcaactcaaatattatgagaag

SEQ ID NO: 350368 - DNA, 25 bp, Mus musculus
tactcaactcaaatattttgaaaaa

SEQ ID NO: 350369 - DNA, 25 bp, Mus musculus
tactcaactcaactctctgaaaact

SEQ ID NO: 350370 - DNA, 25 bp, Mus musculus
tactcaagacagcagcaaaggccgt

SEQ ID NO: 350371 - DNA, 25 bp, Mus musculus
tactcaagctccgccctcagtcatc

SEQ ID NO: 350372 - DNA, 25 bp, Mus musculus
tactcaagctcctgtcttctaattg

SEQ ID NO: 350373 - DNA, 25 bp, Mus musculus
tactcaataagctgagagtgctagc

SEQ ID NO: 350374 - DNA, 25 bp, Mus musculus
tactcaatacaattgctgatacttt

SEQ ID NO: 350375 - DNA, 25 bp, Mus musculus
tactcaatagcagaaagttccctgg

SEQ ID NO: 350376 - DNA, 25 bp, Mus musculus
tactcacaaagaagcacagaccctg

SEQ ID NO: 350377 - DNA, 25 bp, Mus musculus
tactcacaaagaaggatggaaggtt

SEQ ID NO: 350378 - DNA, 25 bp, Mus musculus
tactcacccaagattgatgaccagc

SEQ ID NO: 350379 - DNA, 25 bp, Mus musculus
tactcacccaagctatgagcttgga

SEQ ID NO: 350380 - DNA, 25 bp, Mus musculus
tactcacccaaggagctgctagcac

SEQ ID NO: 350381 - DNA, 25 bp, Mus musculus
tactcacctagagtggaccagattg

SEQ ID NO: 350382 - DNA, 25 bp, Mus musculus
tactcacctggttcaaccagatgtg

SEQ ID NO: 350383 - DNA, 25 bp, Mus musculus
tactcacgactagggaatgtgtgac

SEQ ID NO: 350384 - DNA, 25 bp, Mus musculus
tactcacgactagggagaaagagag

SEQ ID NO: 350385 - DNA, 25 bp, Mus musculus
tactcactcagggatgactatgagg

SEQ ID NO: 350386 - DNA, 25 bp, Mus musculus
tactcactgcttaagagggttcagt

SEQ ID NO: 350387 - DNA, 25 bp, Mus musculus
tactcacttgaagcccatctctgag

SEQ ID NO: 350388 - DNA, 25 bp, Mus musculus
tactcagaaaacattccgtgcagta

SEQ ID NO: 350389 - DNA, 25 bp, Mus musculus
tactcagaaagagatcccattcctg

SEQ ID NO: 350390 - DNA, 25 bp, Mus musculus
tactcagagacatggagttcttttc

SEQ ID NO: 350391 - DNA, 25 bp, Mus musculus
tactcagagacatgtatgcactgaa

SEQ ID NO: 350392 - DNA, 25 bp, Mus musculus
tactcagccccagagcagctcttat

SEQ ID NO: 350393 - DNA, 25 bp, Mus musculus
tactcaggaccccagctctgtcagc

SEQ ID NO: 350394 - DNA, 25 bp, Mus musculus
tactcaggaccccaggaccttgcca

SEQ ID NO: 350395 - DNA, 25 bp, Mus musculus
tactcaggagcagagagtgacaaca

SEQ ID NO: 350396 - DNA, 25 bp, Mus musculus
tactcaggagcagagatcatagcag

SEQ ID NO: 350397 - DNA, 25 bp, Mus musculus
tactcaggcagatccgttttgtgca

SEQ ID NO: 350398 - DNA, 25 bp, Mus musculus
tactcaggcagtatctccaggaggt

SEQ ID NO: 350399 - DNA, 25 bp, Mus musculus
tactcagtccattgtaatctcagat

SEQ ID NO: 350400 - DNA, 25 bp, Mus musculus
tactcagttaggatgaccattgatg

SEQ ID NO: 350401 - DNA, 25 bp, Mus musculus
tactcagttagtttcctatgatgac

SEQ ID NO: 350402 - DNA, 25 bp, Mus musculus
tactcatacaccagcaactctgatg

SEQ ID NO: 350403 - DNA, 25 bp, Mus musculus
tactcatcctgggtcactgacaata

SEQ ID NO: 350404 - DNA, 25 bp, Mus musculus
tactcatctcaggacagctccctct

SEQ ID NO: 350405 - DNA, 25 bp, Mus musculus
tactcatctcagggctgtccaagaa

SEQ ID NO: 350406 - DNA, 25 bp, Mus musculus
tactcatgaaaacttgctagaaatg

SEQ ID NO: 350407 - DNA, 25 bp, Mus musculus
tactcatgatgcaagttactgtaac

SEQ ID NO: 350408 - DNA, 25 bp, Mus musculus
tactcattcattcgatattacacaa

SEQ ID NO: 350409 - DNA, 25 bp, Mus musculus
tactcattctgaatctagtaagagc

SEQ ID NO: 350410 - DNA, 25 bp, Mus musculus
tactcattcttcttttagctctacc

SEQ ID NO: 350411 - DNA, 25 bp, Mus musculus
tactccaaagtctttggaagcatat

SEQ ID NO: 350412 - DNA, 25 bp, Mus musculus
tactccaagagacaggaggctgtcc

SEQ ID NO: 350413 - DNA, 25 bp, Mus musculus
tactccaagaggctcgggtctttaa

SEQ ID NO: 350414 - DNA, 25 bp, Mus musculus
tactccaagcccatccaaggttact

SEQ ID NO: 350415 - DNA, 25 bp, Mus musculus
tactccaaggagaggtcaatactat

SEQ ID NO: 350416 - DNA, 25 bp, Mus musculus
tactccaaggagaggttttccttac

SEQ ID NO: 350417 - DNA, 25 bp, Mus musculus
tactccaaggcaaaggtgttgaacg

SEQ ID NO: 350418 - DNA, 25 bp, Mus musculus
tactccaagttcggggaatgcagca

SEQ ID NO: 350419 - DNA, 25 bp, Mus musculus
tactccaagttcggtcccctgtgta

SEQ ID NO: 350420 - DNA, 25 bp, Mus musculus
tactccaattaatccccccttctag

SEQ ID NO: 350421 - DNA, 25 bp, Mus musculus
tactccaccgaacagtggccacagt

SEQ ID NO: 350422 - DNA, 25 bp, Mus musculus
tactccaccgaccagtggccacagt

SEQ ID NO: 350423 - DNA, 25 bp, Mus musculus
tactccacgggaggatgctccagtg

SEQ ID NO: 350424 - DNA, 25 bp, Mus musculus
tactccacgtgatccgaggacccag

SEQ ID NO: 350425 - DNA, 25 bp, Mus musculus
tactccactcttggatatcacgtat

SEQ ID NO: 350426 - DNA, 25 bp, Mus musculus
tactccactcttggcaagtcggctc

SEQ ID NO: 350427 - DNA, 25 bp, Mus musculus
tactccagcacagatggatacagtg

SEQ ID NO: 350428 - DNA, 25 bp, Mus musculus
tactcccaagactctgaggtccata

SEQ ID NO: 350429 - DNA, 25 bp, Mus musculus
tactcccaagatggctgtctcaaat

SEQ ID NO: 350430 - DNA, 25 bp, Mus musculus
tactcccaagcccctggaccttcgg

SEQ ID NO: 350431 - DNA, 25 bp, Mus musculus
tactcccaatatgaagactcttcag

SEQ ID NO: 350432 - DNA, 25 bp, Mus musculus
tactcccaccccgggatcgctcaat

SEQ ID NO: 350433 - DNA, 25 bp, Mus musculus
tactccccagaagtctggagagctg

SEQ ID NO: 350434 - DNA, 25 bp, Mus musculus
tactcccctgtgagggctgaactga

SEQ ID NO: 350435 - DNA, 25 bp, Mus musculus
tactcccgtttggtgaactgactct

SEQ ID NO: 350436 - DNA, 25 bp, Mus musculus
tactccctccagacatggaccctac

SEQ ID NO: 350437 - DNA, 25 bp, Mus musculus
tactccctgagtggctatggagtta

SEQ ID NO: 350438 - DNA, 25 bp, Mus musculus
tactcccttcagagggaggggcgac

SEQ ID NO: 350439 - DNA, 25 bp, Mus musculus
tactccgagcaggacacttggcaag

SEQ ID NO: 350440 - DNA, 25 bp, Mus musculus
tactccgagcaggatgacagcacca

SEQ ID NO: 350441 - DNA, 25 bp, Mus musculus
tactccgagcagtcatcctttgcag

SEQ ID NO: 350442 - DNA, 25 bp, Mus musculus
tactccgcaaccgatcacttgtgga

SEQ ID NO: 350443 - DNA, 25 bp, Mus musculus
tactcctattacttgaagctggcta

SEQ ID NO: 350444 - DNA, 25 bp, Mus musculus
tactcctattacttgtcccaaagga

SEQ ID NO: 350445 - DNA, 25 bp, Mus musculus
tactcctcagcagagttacgtcaat

SEQ ID NO: 350446 - DNA, 25 bp, Mus musculus
tactcctcagcaggtatttgtcaag

SEQ ID NO: 350447 - DNA, 25 bp, Mus musculus
tactcctcagctggaattttggagg

SEQ ID NO: 350448 - DNA, 25 bp, Mus musculus
tactcctgatgaacaaaacagggat

SEQ ID NO: 350449 - DNA, 25 bp, Mus musculus
tactcctgctccaaggctacagctc

SEQ ID NO: 350450 - DNA, 25 bp, Mus musculus
tactccttctcccaggaagtgatcc

SEQ ID NO: 350451 - DNA, 25 bp, Mus musculus
tactcgagccaggttctctccacta

SEQ ID NO: 350452 - DNA, 25 bp, Mus musculus
tactcgatggcggagaggtgtctgt

SEQ ID NO: 350453 - DNA, 25 bp, Mus musculus
tactcgatggcggagagtgaggggt

SEQ ID NO: 350454 - DNA, 25 bp, Mus musculus
tactcgccaggcaagcgcttccagg

SEQ ID NO: 350455 - DNA, 25 bp, Mus musculus
tactcgcccatcaagggaaaactcg

SEQ ID NO: 350456 - DNA, 25 bp, Mus musculus
tactcgctccaaagaacctaaggaa

SEQ ID NO: 350457 - DNA, 25 bp, Mus musculus
tactcgctccaaagagaaaacggcc

SEQ ID NO: 350458 - DNA, 25 bp, Mus musculus
tactcgctccaaagatcctgtctct

SEQ ID NO: 350459 - DNA, 25 bp, Mus musculus
tactcgctccaaaggctgcctgctt

SEQ ID NO: 350460 - DNA, 25 bp, Mus musculus
tactcggaggatcagacatggtctc

SEQ ID NO: 350461 - DNA, 25 bp, Mus musculus
tactcggggactggacagatggagc

SEQ ID NO: 350462 - DNA, 25 bp, Mus musculus
tactcgtccagctcaagtctctgcg

SEQ ID NO: 350463 - DNA, 25 bp, Mus musculus
tactctaacataagctgcttcctgc

SEQ ID NO: 350464 - DNA, 25 bp, Mus musculus
tactctaacataagtcttctttttt

SEQ ID NO: 350465 - DNA, 25 bp, Mus musculus
tactctacgacacgaacctgccaga

SEQ ID NO: 350466 - DNA, 25 bp, Mus musculus
tactctagaggaggcctctaggtcg

SEQ ID NO: 350467 - DNA, 25 bp, Mus musculus
tactctagctcaggatgatatcctc

SEQ ID NO: 350468 - DNA, 25 bp, Mus musculus
tactctagctcaggtagcaacaatt

SEQ ID NO: 350469 - DNA, 25 bp, Mus musculus
tactctagctcaggtttctgtagct

SEQ ID NO: 350470 - DNA, 25 bp, Mus musculus
tactctagtcctcagaactgtggac

SEQ ID NO: 350471 - DNA, 25 bp, Mus musculus
tactctcaaactagatttcctctga

SEQ ID NO: 350472 - DNA, 25 bp, Mus musculus
tactctcaattagttgacattaaaa

SEQ ID NO: 350473 - DNA, 25 bp, Mus musculus
tactctcacaatgctctgtcagaaa

SEQ ID NO: 350474 - DNA, 25 bp, Mus musculus
tactctcacaatgtgtcctactgaa

SEQ ID NO: 350475 - DNA, 25 bp, Mus musculus
tactctccaaacagacgatccagaa

SEQ ID NO: 350476 - DNA, 25 bp, Mus musculus
tactctccagggtcttcctggcttt

SEQ ID NO: 350477 - DNA, 25 bp, Mus musculus
tactctcccagcatgctggactatg

SEQ ID NO: 350478 - DNA, 25 bp, Mus musculus
tactctcctcaaaactcagattgca

SEQ ID NO: 350479 - DNA, 25 bp, Mus musculus
tactctcctcgacccatgagcttcc

SEQ ID NO: 350480 - DNA, 25 bp, Mus musculus
tactctctacaaatgataaaactat

SEQ ID NO: 350481 - DNA, 25 bp, Mus musculus
tactctctctcaggcacttgtggaa

SEQ ID NO: 350482 - DNA, 25 bp, Mus musculus
tactctctctcaggtctgaacataa

SEQ ID NO: 350483 - DNA, 25 bp, Mus musculus
tactctcttagcagtgaagcagatt

SEQ ID NO: 350484 - DNA, 25 bp, Mus musculus
tactctcttaggaaaagaagaccag

SEQ ID NO: 350485 - DNA, 25 bp, Mus musculus
tactctcttggacctatatccagac

SEQ ID NO: 350486 - DNA, 25 bp, Mus musculus
tactctctttttagtctctggaaga

SEQ ID NO: 350487 - DNA, 25 bp, Mus musculus
tactctgaaactagactctacagga

SEQ ID NO: 350488 - DNA, 25 bp, Mus musculus
tactctgaaactctgccgagtgttt

SEQ ID NO: 350489 - DNA, 25 bp, Mus musculus
tactctgacaacctgcttggaaagt

SEQ ID NO: 350490 - DNA, 25 bp, Mus musculus
tactctgatccttcatggcagtgaa

SEQ ID NO: 350491 - DNA, 25 bp, Mus musculus
tactctgcaaccaaggcctttgtag

SEQ ID NO: 350492 - DNA, 25 bp, Mus musculus
tactctgctgccggcttttctcctg

SEQ ID NO: 350493 - DNA, 25 bp, Mus musculus
tactctgctgccgggtcagcacctc

SEQ ID NO: 350494 - DNA, 25 bp, Mus musculus
tactctgggcacgctaataattttc

SEQ ID NO: 350495 - DNA, 25 bp, Mus musculus
tactctgtatccctgttgctgagct

SEQ ID NO: 350496 - DNA, 25 bp, Mus musculus
tactctgtccctggcgtggggacag

SEQ ID NO: 350497 - DNA, 25 bp, Mus musculus
tactctgtctgaagaagagctggag

SEQ ID NO: 350498 - DNA, 25 bp, Mus musculus
tactctgtgaaggcccgagaccaga

SEQ ID NO: 350499 - DNA, 25 bp, Mus musculus
tactctgtgccagacatcctgcagt

SEQ ID NO: 350500 - DNA, 25 bp, Mus musculus
tactctgtgccagccatgaatgtcc

SEQ ID NO: 350501 - DNA, 25 bp, Mus musculus
tactctgtttcagtggaaacaagtt

SEQ ID NO: 350502 - DNA, 25 bp, Mus musculus
tactcttcagaggaatgatattgcc

SEQ ID NO: 350503 - DNA, 25 bp, Mus musculus
tactcttgggccagagagctgggtt

SEQ ID NO: 350504 - DNA, 25 bp, Mus musculus
tactcttgtgtatatgctgtagaaa

SEQ ID NO: 350505 - DNA, 25 bp, Mus musculus
tactctttaaggaagattactttgc

SEQ ID NO: 350506 - DNA, 25 bp, Mus musculus
tactgaaacatgactttctgggaca

SEQ ID NO: 350507 - DNA, 25 bp, Mus musculus
tactgaaactgcaggtcacggaagc

SEQ ID NO: 350508 - DNA, 25 bp, Mus musculus
tactgaaactgcagtggactgagtt

SEQ ID NO: 350509 - DNA, 25 bp, Mus musculus
tactgaacattccaccatgccagca

SEQ ID NO: 350510 - DNA, 25 bp, Mus musculus
tactgaaccacaagaacccatgtac

SEQ ID NO: 350511 - DNA, 25 bp, Mus musculus
tactgaagaaggacagctcctctgt

SEQ ID NO: 350512 - DNA, 25 bp, Mus musculus
tactgaagacatagggaatctgtcc

SEQ ID NO: 350513 - DNA, 25 bp, Mus musculus
tactgaagcagaaggagctaggtgg

SEQ ID NO: 350514 - DNA, 25 bp, Mus musculus
tactgaagctcctgcagactgcaga

SEQ ID NO: 350515 - DNA, 25 bp, Mus musculus
tactgaagctgtggggattgccctt

SEQ ID NO: 350516 - DNA, 25 bp, Mus musculus
tactgaatctgtcagacgtgttgat

SEQ ID NO: 350517 - DNA, 25 bp, Mus musculus
tactgaatcttcagtgagcatgttt

SEQ ID NO: 350518 - DNA, 25 bp, Mus musculus
tactgaatcttcattgagcatgttt

SEQ ID NO: 350519 - DNA, 25 bp, Mus musculus
tactgacaaggggtgtgattttgcc

SEQ ID NO: 350520 - DNA, 25 bp, Mus musculus
tactgacagttgaacaccagtgtac

SEQ ID NO: 350521 - DNA, 25 bp, Mus musculus
tactgacatgtaccataatgtcacc

SEQ ID NO: 350522 - DNA, 25 bp, Mus musculus
tactgactcaggctctgggggacct

SEQ ID NO: 350523 - DNA, 25 bp, Mus musculus
tactgactcagtatgaagagcgcat

SEQ ID NO: 350524 - DNA, 25 bp, Mus musculus
tactgacttgttggcccgtgggatt

SEQ ID NO: 350525 - DNA, 25 bp, Mus musculus
tactgagaaggaaggtctgtctgca

SEQ ID NO: 350526 - DNA, 25 bp, Mus musculus
tactgagacaggatttacatggata

SEQ ID NO: 350527 - DNA, 25 bp, Mus musculus
tactgagattacaggaatggaagaa

SEQ ID NO: 350528 - DNA, 25 bp, Mus musculus
tactgagcacggtgcctgtggccta

SEQ ID NO: 350529 - DNA, 25 bp, Mus musculus
tactgagcacggtgttcctgtagtt

SEQ ID NO: 350530 - DNA, 25 bp, Mus musculus
tactgagcccaggaaactacaacct

SEQ ID NO: 350531 - DNA, 25 bp, Mus musculus
tactgagctgactaagccccagtct

SEQ ID NO: 350532 - DNA, 25 bp, Mus musculus
tactgagggtggaagggccagggac

SEQ ID NO: 350533 - DNA, 25 bp, Mus musculus
tactgagtcttaagtatgttcaaag

SEQ ID NO: 350534 - DNA, 25 bp, Mus musculus
tactgagtcttatgtatgttcaaag

SEQ ID NO: 350535 - DNA, 25 bp, Mus musculus
tactgagtttttagatattatgaga

SEQ ID NO: 350536 - DNA, 25 bp, Mus musculus
tactgatactggtgaagaaaatcta

SEQ ID NO: 350537 - DNA, 25 bp, Mus musculus
tactgatagcaaaactccaccagag

SEQ ID NO: 350538 - DNA, 25 bp, Mus musculus
tactgatagttgccttatcttccgt

SEQ ID NO: 350539 - DNA, 25 bp, Mus musculus
tactgatagttgcggatgacggagg

SEQ ID NO: 350540 - DNA, 25 bp, Mus musculus
tactgatcctgagacttgttcaagg

SEQ ID NO: 350541 - DNA, 25 bp, Mus musculus
tactgatctgtgctctaccgtgtga

SEQ ID NO: 350542 - DNA, 25 bp, Mus musculus
tactgatctgtggtgctgcacagtt

SEQ ID NO: 350543 - DNA, 25 bp, Mus musculus
tactgatgcctcaggttcaaccagg

SEQ ID NO: 350544 - DNA, 25 bp, Mus musculus
tactgatgctggggagaatcccgta

SEQ ID NO: 350545 - DNA, 25 bp, Mus musculus
tactgatgtcgcagggacactgggt

SEQ ID NO: 350546 - DNA, 25 bp, Mus musculus
tactgattctgtggaactagtcttg

SEQ ID NO: 350547 - DNA, 25 bp, Mus musculus
tactgattttagctctgatctcact

SEQ ID NO: 350548 - DNA, 25 bp, Mus musculus
tactgcaaagtaatatctccatctc

SEQ ID NO: 350549 - DNA, 25 bp, Mus musculus
tactgcaacagctttttctaaaagc

SEQ ID NO: 350550 - DNA, 25 bp, Mus musculus
tactgcaacatacaggttaccaaag

SEQ ID NO: 350551 - DNA, 25 bp, Mus musculus
tactgcaagattggcaaagagaccc

SEQ ID NO: 350552 - DNA, 25 bp, Mus musculus
tactgcaagtataggacaacctcaa

SEQ ID NO: 350553 - DNA, 25 bp, Mus musculus
tactgcacagacgagctgttcaagg

SEQ ID NO: 350554 - DNA, 25 bp, Mus musculus
tactgcaccgatcctagttccgtgg

SEQ ID NO: 350555 - DNA, 25 bp, Mus musculus
tactgcagagccatcctgactcgga

SEQ ID NO: 350556 - DNA, 25 bp, Mus musculus
tactgcagagctacgagtctggtct

SEQ ID NO: 350557 - DNA, 25 bp, Mus musculus
tactgcagcagcttcaaactgttcc

SEQ ID NO: 350558 - DNA, 25 bp, Mus musculus
tactgcagcaggagtgtgataatta

SEQ ID NO: 350559 - DNA, 25 bp, Mus musculus
tactgcaggtaccgaatgtctacac

SEQ ID NO: 350560 - DNA, 25 bp, Mus musculus
tactgcatacacaggaaagggctgt

SEQ ID NO: 350561 - DNA, 25 bp, Mus musculus
tactgcataccgacaacatctgggg

SEQ ID NO: 350562 - DNA, 25 bp, Mus musculus
tactgcatagctctgtggagcgacc

SEQ ID NO: 350563 - DNA, 25 bp, Mus musculus
tactgcatcagcagtgatgatcttt

SEQ ID NO: 350564 - DNA, 25 bp, Mus musculus
tactgcatcgcccttgactacaagt

SEQ ID NO: 350565 - DNA, 25 bp, Mus musculus
tactgccaaaggtcttttccgggct

SEQ ID NO: 350566 - DNA, 25 bp, Mus musculus
tactgccaagatatagatgagtgca

SEQ ID NO: 350567 - DNA, 25 bp, Mus musculus
tactgccaaggtcaaggctggttct

SEQ ID NO: 350568 - DNA, 25 bp, Mus musculus
tactgccacagtggttccggaagcc

SEQ ID NO: 350569 - DNA, 25 bp, Mus musculus
tactgccacatgctgctggggccac

SEQ ID NO: 350570 - DNA, 25 bp, Mus musculus
tactgccatcaaggcccctaacagc

SEQ ID NO: 350571 - DNA, 25 bp, Mus musculus
tactgccatgacattctacggagaa

SEQ ID NO: 350572 - DNA, 25 bp, Mus musculus
tactgccatgactttctacggagaa

SEQ ID NO: 350573 - DNA, 25 bp, Mus musculus
tactgcccagacaagtgctgttgcc

SEQ ID NO: 350574 - DNA, 25 bp, Mus musculus
tactgcccagaccgtgccagtgcca

SEQ ID NO: 350575 - DNA, 25 bp, Mus musculus
tactgcccttggctctggtcagggt

SEQ ID NO: 350576 - DNA, 25 bp, Mus musculus
tactgccgtaccagagccattcatc

SEQ ID NO: 350577 - DNA, 25 bp, Mus musculus
tactgccgtaccagggacattcttc

SEQ ID NO: 350578 - DNA, 25 bp, Mus musculus
tactgcgaagatgtcaatgaatgtg

SEQ ID NO: 350579 - DNA, 25 bp, Mus musculus
tactgcgagcgagaagatgtttggc

SEQ ID NO: 350580 - DNA, 25 bp, Mus musculus
tactgcgagcgagactatgagaaga

SEQ ID NO: 350581 - DNA, 25 bp, Mus musculus
tactgctaaagggagaaaagacatg

SEQ ID NO: 350582 - DNA, 25 bp, Mus musculus
tactgctaccgccatcttagaactg

SEQ ID NO: 350583 - DNA, 25 bp, Mus musculus
tactgctaccgctgtggcaatgtgg

SEQ ID NO: 350584 - DNA, 25 bp, Mus musculus
tactgctatggagcggaattcctaa

SEQ ID NO: 350585 - DNA, 25 bp, Mus musculus
tactgctatgggtttcagtccccaa

SEQ ID NO: 350586 - DNA, 25 bp, Mus musculus
tactgctattatcatagaccttcag

SEQ ID NO: 350587 - DNA, 25 bp, Mus musculus
tactgctattatcatgatactacca

SEQ ID NO: 350588 - DNA, 25 bp, Mus musculus
tactgctcaatccatcgagacacag

SEQ ID NO: 350589 - DNA, 25 bp, Mus musculus
tactgctgactggttgcccattgga

SEQ ID NO: 350590 - DNA, 25 bp, Mus musculus
tactgctgcatgccctgaagccagg

SEQ ID NO: 350591 - DNA, 25 bp, Mus musculus
tactgctgcctcaggtacaactgat

SEQ ID NO: 350592 - DNA, 25 bp, Mus musculus
tactgctgctgaaagaaattagccg

SEQ ID NO: 350593 - DNA, 25 bp, Mus musculus
tactgctgctgaatttgaagtcctg

SEQ ID NO: 350594 - DNA, 25 bp, Mus musculus
tactgctgctttggctaccgctgct

SEQ ID NO: 350595 - DNA, 25 bp, Mus musculus
tactgctggagggctgcagtatggc

SEQ ID NO: 350596 - DNA, 25 bp, Mus musculus
tactgctgtacggtagcagatatca

SEQ ID NO: 350597 - DNA, 25 bp, Mus musculus
tactgctgtacgtgagtcagccggc

SEQ ID NO: 350598 - DNA, 25 bp, Mus musculus
tactgcttcaacttctcttgcaggt

SEQ ID NO: 350599 - DNA, 25 bp, Mus musculus
tactgcttccggtgtggagaagaca

SEQ ID NO: 350600 - DNA, 25 bp, Mus musculus
tactgctttaaacctaaacagaata

SEQ ID NO: 350601 - DNA, 25 bp, Mus musculus
tactgctttaaacgacctgatctct

SEQ ID NO: 350602 - DNA, 25 bp, Mus musculus
tactgctttaaacgtcgattgagtg

SEQ ID NO: 350603 - DNA, 25 bp, Mus musculus
tactgctttgactgtactccctccc

SEQ ID NO: 350604 - DNA, 25 bp, Mus musculus
tactggaaaaggtgtactttgtggg

SEQ ID NO: 350605 - DNA, 25 bp, Mus musculus
tactggaaatgtagggtaagggtcg

SEQ ID NO: 350606 - DNA, 25 bp, Mus musculus
tactggaaccacagggagttaatga

SEQ ID NO: 350607 - DNA, 25 bp, Mus musculus
tactggaatagctacctcaggctct

SEQ ID NO: 350608 - DNA, 25 bp, Mus musculus
tactggaattacaggctgacccctg

SEQ ID NO: 350609 - DNA, 25 bp, Mus musculus
tactggacacacaatgggtgatcca

SEQ ID NO: 350610 - DNA, 25 bp, Mus musculus
tactggacatctcccaaacccaagc

SEQ ID NO: 350611 - DNA, 25 bp, Mus musculus
tactggactatccgatacacctcct

SEQ ID NO: 350612 - DNA, 25 bp, Mus musculus
tactggactcaagctctcttgagtc

SEQ ID NO: 350613 - DNA, 25 bp, Mus musculus
tactggagaaaagggtgaacctggt

SEQ ID NO: 350614 - DNA, 25 bp, Mus musculus
tactggagaaacagggtcatgatgg

SEQ ID NO: 350615 - DNA, 25 bp, Mus musculus
tactggagaagaagtcttggacagg

SEQ ID NO: 350616 - DNA, 25 bp, Mus musculus
tactggagaaggtgcaaaacatgtc

SEQ ID NO: 350617 - DNA, 25 bp, Mus musculus
tactggagaagttatttccgagaga

SEQ ID NO: 350618 - DNA, 25 bp, Mus musculus
tactggagacaccaacaggtggaag

SEQ ID NO: 350619 - DNA, 25 bp, Mus musculus
tactggagacaggccgggtgaccaa

SEQ ID NO: 350620 - DNA, 25 bp, Mus musculus
tactggagatggaagtgtaaatggc

SEQ ID NO: 350621 - DNA, 25 bp, Mus musculus
tactggagatggacctcctctggta

SEQ ID NO: 350622 - DNA, 25 bp, Mus musculus
tactggagccaagatgataaatcat

SEQ ID NO: 350623 - DNA, 25 bp, Mus musculus
tactggagtccataggctgtaccaa

SEQ ID NO: 350624 - DNA, 25 bp, Mus musculus
tactggatacaggggtctgtgatgt

SEQ ID NO: 350625 - DNA, 25 bp, Mus musculus
tactggcaagagagtgctaacagcc

SEQ ID NO: 350626 - DNA, 25 bp, Mus musculus
tactggcaaggtggtctacttcacc

SEQ ID NO: 350627 - DNA, 25 bp, Mus musculus
tactggcaaggtggtctatttcacc

SEQ ID NO: 350628 - DNA, 25 bp, Mus musculus
tactggcacgatcctcaccacgatg

SEQ ID NO: 350629 - DNA, 25 bp, Mus musculus
tactggcattgcagatttatttcct

SEQ ID NO: 350630 - DNA, 25 bp, Mus musculus
tactggcattgcaggccgaggagaa

SEQ ID NO: 350631 - DNA, 25 bp, Mus musculus
tactggcattggaccatctgctgca

SEQ ID NO: 350632 - DNA, 25 bp, Mus musculus
tactggcattggatctcaggaaaaa

SEQ ID NO: 350633 - DNA, 25 bp, Mus musculus
tactggccacaggaccagctgccaa

SEQ ID NO: 350634 - DNA, 25 bp, Mus musculus
tactggccagaaggccagcaacatg

SEQ ID NO: 350635 - DNA, 25 bp, Mus musculus
tactggcccggctgtgaagttgaga

SEQ ID NO: 350636 - DNA, 25 bp, Mus musculus
tactggccctgctctctgctctctg

SEQ ID NO: 350637 - DNA, 25 bp, Mus musculus
tactggcctcaaaaatactgggcgg

SEQ ID NO: 350638 - DNA, 25 bp, Mus musculus
tactggcgattggggtggtcctgcc

SEQ ID NO: 350639 - DNA, 25 bp, Mus musculus
tactggctattgagctcttcctcat

SEQ ID NO: 350640 - DNA, 25 bp, Mus musculus
tactggctgccacgcagactgtatc

SEQ ID NO: 350641 - DNA, 25 bp, Mus musculus
tactggctgtctgaccaagtaactt

SEQ ID NO: 350642 - DNA, 25 bp, Mus musculus
tactggctgtctggtttaacttgca

SEQ ID NO: 350643 - DNA, 25 bp, Mus musculus
tactgggagtacagctgactcaaga

SEQ ID NO: 350644 - DNA, 25 bp, Mus musculus
tactgggattaaagatggcagactt

SEQ ID NO: 350645 - DNA, 25 bp, Mus musculus
tactgggattaaaggatgaaaatga

SEQ ID NO: 350646 - DNA, 25 bp, Mus musculus
tactgggattaaaggtatagtccag

SEQ ID NO: 350647 - DNA, 25 bp, Mus musculus
tactgggattacaggggctgagatt

SEQ ID NO: 350648 - DNA, 25 bp, Mus musculus
tactgggctcctctgggatttgttt

SEQ ID NO: 350649 - DNA, 25 bp, Mus musculus
tactggtacctgcggctgaaggtga

SEQ ID NO: 350650 - DNA, 25 bp, Mus musculus
tactggtcaatagggtacacctggt

SEQ ID NO: 350651 - DNA, 25 bp, Mus musculus
tactggtcataaaggttccagatga

SEQ ID NO: 350652 - DNA, 25 bp, Mus musculus
tactggtgtgtctagggtgtgctta

SEQ ID NO: 350653 - DNA, 25 bp, Mus musculus
tactgtaactccaggggcactatga

SEQ ID NO: 350654 - DNA, 25 bp, Mus musculus
tactgtaagaggcttctcaggatgg

SEQ ID NO: 350655 - DNA, 25 bp, Mus musculus
tactgtagaggaatgcctccaattc

SEQ ID NO: 350656 - DNA, 25 bp, Mus musculus
tactgtagaggagaatccttccttg

SEQ ID NO: 350657 - DNA, 25 bp, Mus musculus
tactgtagcaaagacggtttacagc

SEQ ID NO: 350658 - DNA, 25 bp, Mus musculus
tactgtagcaaggacaaatctgttg

SEQ ID NO: 350659 - DNA, 25 bp, Mus musculus
tactgtaggaacccagcccaaccta

SEQ ID NO: 350660 - DNA, 25 bp, Mus musculus
tactgtatgccccgagcacagatat

SEQ ID NO: 350661 - DNA, 25 bp, Mus musculus
tactgtatgcccggagcacagatat

SEQ ID NO: 350662 - DNA, 25 bp, Mus musculus
tactgtcaagcagatgagacaagga

SEQ ID NO: 350663 - DNA, 25 bp, Mus musculus
tactgtcacagatgcaggagacaag

SEQ ID NO: 350664 - DNA, 25 bp, Mus musculus
tactgtcacaggtctggggctttcc

SEQ ID NO: 350665 - DNA, 25 bp, Mus musculus
tactgtcatccttgtctcattggga

SEQ ID NO: 350666 - DNA, 25 bp, Mus musculus
tactgtccagaaagcgaccataacc

SEQ ID NO: 350667 - DNA, 25 bp, Mus musculus
tactgtccccatatgagcataaatc

SEQ ID NO: 350668 - DNA, 25 bp, Mus musculus
tactgtccccatatgatgggaaata

SEQ ID NO: 350669 - DNA, 25 bp, Mus musculus
tactgtcccggtgtgccagccttcc

SEQ ID NO: 350670 - DNA, 25 bp, Mus musculus
tactgtcgagagaagggtttctcat

SEQ ID NO: 350671 - DNA, 25 bp, Mus musculus
tactgtctactggtgccctcccatg

SEQ ID NO: 350672 - DNA, 25 bp, Mus musculus
tactgtctactgttccaccaagggt

SEQ ID NO: 350673 - DNA, 25 bp, Mus musculus
tactgtctgccagccaggtgcccag

SEQ ID NO: 350674 - DNA, 25 bp, Mus musculus
tactgtcttctctgcctcccgagtg

SEQ ID NO: 350675 - DNA, 25 bp, Mus musculus
tactgtgaaagagttgttatttcta

SEQ ID NO: 350676 - DNA, 25 bp, Mus musculus
tactgtgaaagatatgaatttggac

SEQ ID NO: 350677 - DNA, 25 bp, Mus musculus
tactgtgaacagtatgtctggattt

SEQ ID NO: 350678 - DNA, 25 bp, Mus musculus
tactgtgaaggaagccaaagagaaa

SEQ ID NO: 350679 - DNA, 25 bp, Mus musculus
tactgtgaaggtgtggtccggtgtt

SEQ ID NO: 350680 - DNA, 25 bp, Mus musculus
tactgtgacaggagggctggcggca

SEQ ID NO: 350681 - DNA, 25 bp, Mus musculus
tactgtgagaggcagggcttgtcaa

SEQ ID NO: 350682 - DNA, 25 bp, Mus musculus
tactgtgagctggcccagtcctcct

SEQ ID NO: 350683 - DNA, 25 bp, Mus musculus
tactgtgagctggttcacccaccca

SEQ ID NO: 350684 - DNA, 25 bp, Mus musculus
tactgtgatctactgctgagaagag

SEQ ID NO: 350685 - DNA, 25 bp, Mus musculus
tactgtgatctactgtacagagcta

SEQ ID NO: 350686 - DNA, 25 bp, Mus musculus
tactgtgcaagaattactacggtag

SEQ ID NO: 350687 - DNA, 25 bp, Mus musculus
tactgtgccatggaagggtctgttc

SEQ ID NO: 350688 - DNA, 25 bp, Mus musculus
tactgtgcccccaagtctgtcttct

SEQ ID NO: 350689 - DNA, 25 bp, Mus musculus
tactgtgcgcaatggatctgtccgt

SEQ ID NO: 350690 - DNA, 25 bp, Mus musculus
tactgtggaagtgtggattctttaa

SEQ ID NO: 350691 - DNA, 25 bp, Mus musculus
tactgtggaagtgtggcttcttcaa

SEQ ID NO: 350692 - DNA, 25 bp, Mus musculus
tactgtggcactaaggctggtgttc

SEQ ID NO: 350693 - DNA, 25 bp, Mus musculus
tactgtggggtatccgagtggtgaa

SEQ ID NO: 350694 - DNA, 25 bp, Mus musculus
tactgtggttcctgatatgctctct

SEQ ID NO: 350695 - DNA, 25 bp, Mus musculus
tactgttaacaggacattcgacatg

SEQ ID NO: 350696 - DNA, 25 bp, Mus musculus
tactgttcaaaatcgaacaccaaac

SEQ ID NO: 350697 - DNA, 25 bp, Mus musculus
tactgttcctacggtttcacaaggt

SEQ ID NO: 350698 - DNA, 25 bp, Mus musculus
tactgttcgagaggcctccaacatg

SEQ ID NO: 350699 - DNA, 25 bp, Mus musculus
tactgttcttgatatacatgataat

SEQ ID NO: 350700 - DNA, 25 bp, Mus musculus
tactgttcttgatccataacaaact

SEQ ID NO: 350701 - DNA, 25 bp, Mus musculus
tactgttgagcctgagaaatgccag

SEQ ID NO: 350702 - DNA, 25 bp, Mus musculus
tactgtttacagtacagcaataacc

SEQ ID NO: 350703 - DNA, 25 bp, Mus musculus
tactgtttcaacttctactactaaa

SEQ ID NO: 350704 - DNA, 25 bp, Mus musculus
tactgtttcctgaactcggaaggtg

SEQ ID NO: 350705 - DNA, 25 bp, Mus musculus
tactgtttcctgatgcttttgggtc

SEQ ID NO: 350706 - DNA, 25 bp, Mus musculus
tacttaaaaagagtgtgtaagcttt

SEQ ID NO: 350707 - DNA, 25 bp, Mus musculus
tacttaaaccagaatgcatacacag

SEQ ID NO: 350708 - DNA, 25 bp, Mus musculus
tacttaaaccaggtttgcatgcagc

SEQ ID NO: 350709 - DNA, 25 bp, Mus musculus
tacttaaatcgggagagtgtgctgg

SEQ ID NO: 350710 - DNA, 25 bp, Mus musculus
tacttaacagcgttggcctggaaca

SEQ ID NO: 350711 - DNA, 25 bp, Mus musculus
tacttaactggtatgatcctcatgg

SEQ ID NO: 350712 - DNA, 25 bp, Mus musculus
tacttacatatataaataaataaat

SEQ ID NO: 350713 - DNA, 25 bp, Mus musculus
tacttaccatcataacagcactacc

SEQ ID NO: 350714 - DNA, 25 bp, Mus musculus
tacttaccatcataggccagttcac

SEQ ID NO: 350715 - DNA, 25 bp, Mus musculus
tacttaccatggcattgatatgaac

SEQ ID NO: 350716 - DNA, 25 bp, Mus musculus
tacttaccatgggaaggtgtcttgc

SEQ ID NO: 350717 - DNA, 25 bp, Mus musculus
tacttaccatgggcttcactgtata

SEQ ID NO: 350718 - DNA, 25 bp, Mus musculus
tacttacgaaggaagtggttccagc

SEQ ID NO: 350719 - DNA, 25 bp, Mus musculus
tacttactcccaagactctgaggtc

SEQ ID NO: 350720 - DNA, 25 bp, Mus musculus
tacttactcccaagatggctgtctc

SEQ ID NO: 350721 - DNA, 25 bp, Mus musculus
tacttactcccaagcccctggacct

SEQ ID NO: 350722 - DNA, 25 bp, Mus musculus
tacttactctggatccaagacactt

SEQ ID NO: 350723 - DNA, 25 bp, Mus musculus
tacttagaaccaccataacacaaag

SEQ ID NO: 350724 - DNA, 25 bp, Mus musculus
tacttagacaggtatccattatgat

SEQ ID NO: 350725 - DNA, 25 bp, Mus musculus
tacttaggaaagccccggcagccca

SEQ ID NO: 350726 - DNA, 25 bp, Mus musculus
tacttatccctgtcctctacagcct

SEQ ID NO: 350727 - DNA, 25 bp, Mus musculus
tacttattcaaagactcctggaagt

SEQ ID NO: 350728 - DNA, 25 bp, Mus musculus
tacttattcaaagttgtccgtgtaa

SEQ ID NO: 350729 - DNA, 25 bp, Mus musculus
tacttcaaacagcggatcactgcag

SEQ ID NO: 350730 - DNA, 25 bp, Mus musculus
tacttcaaagccaaggactacgaga

SEQ ID NO: 350731 - DNA, 25 bp, Mus musculus
tacttcaaaggtggtgaaagtgaag

SEQ ID NO: 350732 - DNA, 25 bp, Mus musculus
tacttcaatcaagtttttgcagcct

SEQ ID NO: 350733 - DNA, 25 bp, Mus musculus
tacttcacagagaaatattactgga

SEQ ID NO: 350734 - DNA, 25 bp, Mus musculus
tacttcacagagagcatgtgaccga

SEQ ID NO: 350735 - DNA, 25 bp, Mus musculus
tacttcagaaacagacctcgatgca

SEQ ID NO: 350736 - DNA, 25 bp, Mus musculus
tacttcagaaacatctcctttcagc

SEQ ID NO: 350737 - DNA, 25 bp, Mus musculus
tacttcagcaggtccctgcatccct

SEQ ID NO: 350738 - DNA, 25 bp, Mus musculus
tacttcagccctgcattttgcagaa

SEQ ID NO: 350739 - DNA, 25 bp, Mus musculus
tacttcataaatatccttttatctt

SEQ ID NO: 350740 - DNA, 25 bp, Mus musculus
tacttcatccccaaggggacaaatg

SEQ ID NO: 350741 - DNA, 25 bp, Mus musculus
tacttcatgataagaaccaacttct

SEQ ID NO: 350742 - DNA, 25 bp, Mus musculus
tacttcatgataagggaagaagaca

SEQ ID NO: 350743 - DNA, 25 bp, Mus musculus
tacttcattgaccataacacaaaga

SEQ ID NO: 350744 - DNA, 25 bp, Mus musculus
tacttcattgatcataatacgaaga

SEQ ID NO: 350745 - DNA, 25 bp, Mus musculus
tacttccaaaaggagactttctgca

SEQ ID NO: 350746 - DNA, 25 bp, Mus musculus
tacttccaagccaactaagaagatc

SEQ ID NO: 350747 - DNA, 25 bp, Mus musculus
tacttccaccttcagcaacaacact

SEQ ID NO: 350748 - DNA, 25 bp, Mus musculus
tacttccataattgtgtggattctt

SEQ ID NO: 350749 - DNA, 25 bp, Mus musculus
tacttccatgaaacaatcccacgca

SEQ ID NO: 350750 - DNA, 25 bp, Mus musculus
tacttccatggccgtaattaacaac

SEQ ID NO: 350751 - DNA, 25 bp, Mus musculus
tacttcccaagacagcattttcccc

SEQ ID NO: 350752 - DNA, 25 bp, Mus musculus
tacttccctgcaattttgaacccac

SEQ ID NO: 350753 - DNA, 25 bp, Mus musculus
tacttccctggatcaataagtcgga

SEQ ID NO: 350754 - DNA, 25 bp, Mus musculus
tacttccgccaggtctcagttgtgg

SEQ ID NO: 350755 - DNA, 25 bp, Mus musculus
tacttcctcgaggcctacaattcaa

SEQ ID NO: 350756 - DNA, 25 bp, Mus musculus
tacttcctctggactctgtgaaggg

SEQ ID NO: 350757 - DNA, 25 bp, Mus musculus
tacttcctctgtggaaggactctgt

SEQ ID NO: 350758 - DNA, 25 bp, Mus musculus
tacttcctggatgcgttaagatctc

SEQ ID NO: 350759 - DNA, 25 bp, Mus musculus
tacttcctgtccagagagaacatta

SEQ ID NO: 350760 - DNA, 25 bp, Mus musculus
tacttcctgtccaggagagaacaca

SEQ ID NO: 350761 - DNA, 25 bp, Mus musculus
tacttcgcacaggtgcaggtgtccg

SEQ ID NO: 350762 - DNA, 25 bp, Mus musculus
tacttcggctgtcccagggctccca

SEQ ID NO: 350763 - DNA, 25 bp, Mus musculus
tacttcgggaggaattatgcttcag

SEQ ID NO: 350764 - DNA, 25 bp, Mus musculus
tacttcgggagggatgtactgagct

SEQ ID NO: 350765 - DNA, 25 bp, Mus musculus
tacttctacagttacccagctgtgt

SEQ ID NO: 350766 - DNA, 25 bp, Mus musculus
tacttctaccaggcggaagatggac

SEQ ID NO: 350767 - DNA, 25 bp, Mus musculus
tacttctactcctcgctgagcacct

SEQ ID NO: 350768 - DNA, 25 bp, Mus musculus
tacttctcaaggaaacttcattctc

SEQ ID NO: 350769 - DNA, 25 bp, Mus musculus
tacttctcaaggaggcgcttccatg

SEQ ID NO: 350770 - DNA, 25 bp, Mus musculus
tacttctccaaagccaagcccgata

SEQ ID NO: 350771 - DNA, 25 bp, Mus musculus
tacttctccaaaggtctgtcaaata

SEQ ID NO: 350772 - DNA, 25 bp, Mus musculus
tacttctccaaggaaaaggaatcca

SEQ ID NO: 350773 - DNA, 25 bp, Mus musculus
tacttctcctggacgtgcgaccgca

SEQ ID NO: 350774 - DNA, 25 bp, Mus musculus
tacttctcctggcaacgatatccct

SEQ ID NO: 350775 - DNA, 25 bp, Mus musculus
tacttctctgtcagcacagggtatg

SEQ ID NO: 350776 - DNA, 25 bp, Mus musculus
tacttctgcaatgcctggcttccca

SEQ ID NO: 350777 - DNA, 25 bp, Mus musculus
tacttctgcacggcgggtaacttca

SEQ ID NO: 350778 - DNA, 25 bp, Mus musculus
tacttctgcccgggctgagcgccct

SEQ ID NO: 350779 - DNA, 25 bp, Mus musculus
tacttctgcccggtgctggccacag

SEQ ID NO: 350780 - DNA, 25 bp, Mus musculus
tacttctgtagagatttggcccagt

SEQ ID NO: 350781 - DNA, 25 bp, Mus musculus
tacttctgtgccaggctgtttgatt

SEQ ID NO: 350782 - DNA, 25 bp, Mus musculus
tacttctgtgtactgccttctgaaa

SEQ ID NO: 350783 - DNA, 25 bp, Mus musculus
tacttctgtgtagtagtttacaaat

SEQ ID NO: 350784 - DNA, 25 bp, Mus musculus
tacttcttcagctgcagtgttgaag

SEQ ID NO: 350785 - DNA, 25 bp, Mus musculus
tacttcttcaggttccggaagcaga

SEQ ID NO: 350786 - DNA, 25 bp, Mus musculus
tacttcttcagttaccctgcagttt

SEQ ID NO: 350787 - DNA, 25 bp, Mus musculus
tacttcttcatccacatctacatcc

SEQ ID NO: 350788 - DNA, 25 bp, Mus musculus
tacttcttcctcatcggacccccag

SEQ ID NO: 350789 - DNA, 25 bp, Mus musculus
tacttctttcaggtactcatgtgat

SEQ ID NO: 350790 - DNA, 25 bp, Mus musculus
tacttctttcctggagtaggtgaca

SEQ ID NO: 350791 - DNA, 25 bp, Mus musculus
tacttgacaattcagcctggagatg

SEQ ID NO: 350792 - DNA, 25 bp, Mus musculus
tacttgacatagcctgcaggggtcc

SEQ ID NO: 350793 - DNA, 25 bp, Mus musculus
tacttgatgaaattgagcaactgaa

SEQ ID NO: 350794 - DNA, 25 bp, Mus musculus
tacttgcaagggtgactcaggaggc

SEQ ID NO: 350795 - DNA, 25 bp, Mus musculus
tacttgcacaccgctggtttgtcct

SEQ ID NO: 350796 - DNA, 25 bp, Mus musculus
tacttgcacagggaacaagaatgtg

SEQ ID NO: 350797 - DNA, 25 bp, Mus musculus
tacttgccagctggacatcaacgat

SEQ ID NO: 350798 - DNA, 25 bp, Mus musculus
tacttgccagctggacgccaatgag

SEQ ID NO: 350799 - DNA, 25 bp, Mus musculus
tacttgccgtccggtggagagtaca

SEQ ID NO: 350800 - DNA, 25 bp, Mus musculus
tacttgctagctgccgactacaggt

SEQ ID NO: 350801 - DNA, 25 bp, Mus musculus
tacttgctcaaccagatccttgcat

SEQ ID NO: 350802 - DNA, 25 bp, Mus musculus
tacttgctcaaccagggcatcgttc

SEQ ID NO: 350803 - DNA, 25 bp, Mus musculus
tacttggacttgagcagcgaccact

SEQ ID NO: 350804 - DNA, 25 bp, Mus musculus
tacttggcaccggtgcagccttgct

SEQ ID NO: 350805 - DNA, 25 bp, Mus musculus
tacttggccgagcagcctgcgccag

SEQ ID NO: 350806 - DNA, 25 bp, Mus musculus
tacttggccttgatgaggagtggga

SEQ ID NO: 350807 - DNA, 25 bp, Mus musculus
tacttggcgcctgaggtgctagagg

SEQ ID NO: 350808 - DNA, 25 bp, Mus musculus
tacttggctgcagaggtagaccctg

SEQ ID NO: 350809 - DNA, 25 bp, Mus musculus
tacttggctgcagaggtggaccctg

SEQ ID NO: 350810 - DNA, 25 bp, Mus musculus
tacttgggaaaaaattatgcttcag

SEQ ID NO: 350811 - DNA, 25 bp, Mus musculus
tacttgggacagcagatccatgccc

SEQ ID NO: 350812 - DNA, 25 bp, Mus musculus
tacttgggacagcagggccgcctca

SEQ ID NO: 350813 - DNA, 25 bp, Mus musculus
tacttggttcggtacatgggctgtg

SEQ ID NO: 350814 - DNA, 25 bp, Mus musculus
tacttgtaaagatttgagaaacctg

SEQ ID NO: 350815 - DNA, 25 bp, Mus musculus
tacttgtcagattgctgcccgggaa

SEQ ID NO: 350816 - DNA, 25 bp, Mus musculus
tacttgtgaaactataagcagcaaa

SEQ ID NO: 350817 - DNA, 25 bp, Mus musculus
tacttgtgccagtctaatgcactac

SEQ ID NO: 350818 - DNA, 25 bp, Mus musculus
tacttgtgctggaggtgtccaaaga

SEQ ID NO: 350819 - DNA, 25 bp, Mus musculus
tacttgtgttccagaatggggaggt

SEQ ID NO: 350820 - DNA, 25 bp, Mus musculus
tacttgtgttccagggagatgctat

SEQ ID NO: 350821 - DNA, 25 bp, Mus musculus
tactttaaagagaatgtggtctttt

SEQ ID NO: 350822 - DNA, 25 bp, Mus musculus
tactttaaagatgaaaactttattc

SEQ ID NO: 350823 - DNA, 25 bp, Mus musculus
tactttaaaggcaaatggaagatat

SEQ ID NO: 350824 - DNA, 25 bp, Mus musculus
tactttaatgctgaggccgggataa

SEQ ID NO: 350825 - DNA, 25 bp, Mus musculus
tactttaatggtgagtacgcaggtt

SEQ ID NO: 350826 - DNA, 25 bp, Mus musculus
tactttacaagattaatgccgctgc

SEQ ID NO: 350827 - DNA, 25 bp, Mus musculus
tactttacaagccccaagcattctg

SEQ ID NO: 350828 - DNA, 25 bp, Mus musculus
tactttacaagcttcaacaaatcca

SEQ ID NO: 350829 - DNA, 25 bp, Mus musculus
tactttacagaccagtgtgtgccat

SEQ ID NO: 350830 - DNA, 25 bp, Mus musculus
tactttacagtctattaaaggttgc

SEQ ID NO: 350831 - DNA, 25 bp, Mus musculus
tactttacagtctgttatcaagaaa

SEQ ID NO: 350832 - DNA, 25 bp, Mus musculus
tactttacatgctcttcctcatggt

SEQ ID NO: 350833 - DNA, 25 bp, Mus musculus
tactttacctctctgcagaaagcct

SEQ ID NO: 350834 - DNA, 25 bp, Mus musculus
tactttatcaaagtgatctcagcgc

SEQ ID NO: 350835 - DNA, 25 bp, Mus musculus
tactttatccagtcgcccctcccag

SEQ ID NO: 350836 - DNA, 25 bp, Mus musculus
tactttatccagtcgccttctcctt

SEQ ID NO: 350837 - DNA, 25 bp, Mus musculus
tactttcaatggagagccgtgcagc

SEQ ID NO: 350838 - DNA, 25 bp, Mus musculus
tactttcattctctttacagggaaa

SEQ ID NO: 350839 - DNA, 25 bp, Mus musculus
tactttcattctttagtaacaaatg

SEQ ID NO: 350840 - DNA, 25 bp, Mus musculus
tactttccagaacacttcagttatg

SEQ ID NO: 350841 - DNA, 25 bp, Mus musculus
tactttcccatccagctggtgaaga

SEQ ID NO: 350842 - DNA, 25 bp, Mus musculus
tactttctgctccagcaaggtgcag

SEQ ID NO: 350843 - DNA, 25 bp, Mus musculus
tactttctggacaaggtcagtcctc

SEQ ID NO: 350844 - DNA, 25 bp, Mus musculus
tactttgactcggtccctaccaccc

SEQ ID NO: 350845 - DNA, 25 bp, Mus musculus
tactttgactcgtgaagtcatcaga

SEQ ID NO: 350846 - DNA, 25 bp, Mus musculus
tactttgagaatctcctgtccaaga

SEQ ID NO: 350847 - DNA, 25 bp, Mus musculus
tactttgataagaatggcaatccca

SEQ ID NO: 350848 - DNA, 25 bp, Mus musculus
tactttgataaggatggcattgtag

SEQ ID NO: 350849 - DNA, 25 bp, Mus musculus
tactttgcagccaagtccctgccgc

SEQ ID NO: 350850 - DNA, 25 bp, Mus musculus
tactttgcccgagggctccggggaa

SEQ ID NO: 350851 - DNA, 25 bp, Mus musculus
tactttggctttaagacactggaac

SEQ ID NO: 350852 - DNA, 25 bp, Mus musculus
tactttgtaaagcaatccgaaggtc

SEQ ID NO: 350853 - DNA, 25 bp, Mus musculus
tactttgtgaagctctgaaaacctg

SEQ ID NO: 350854 - DNA, 25 bp, Mus musculus
tactttgtgaaggacatctttggct

SEQ ID NO: 350855 - DNA, 25 bp, Mus musculus
tactttgtgaaggggcagcattttg

SEQ ID NO: 350856 - DNA, 25 bp, Mus musculus
tactttgtgcaggtcccagccagct

SEQ ID NO: 350857 - DNA, 25 bp, Mus musculus
tactttgtgcagtggctcgtgggtt

SEQ ID NO: 350858 - DNA, 25 bp, Mus musculus
tactttgttctcgagcaggttagcc

SEQ ID NO: 350859 - DNA, 25 bp, Mus musculus
tacttttaagatttttgaagactat

SEQ ID NO: 350860 - DNA, 25 bp, Mus musculus
tacttttcatcgtccaactttaacc

SEQ ID NO: 350861 - DNA, 25 bp, Mus musculus
tacttttccagaagaccagtttccc

SEQ ID NO: 350862 - DNA, 25 bp, Mus musculus
tacttttgaattaggacgagtcttg

SEQ ID NO: 350863 - DNA, 25 bp, Mus musculus
tacttttgaattgttcctgtgaagg

SEQ ID NO: 350864 - DNA, 25 bp, Mus musculus
tacttttgagaatgctctggcttct

SEQ ID NO: 350865 - DNA, 25 bp, Mus musculus
tacttttgggggagctgaagaagaa

SEQ ID NO: 350866 - DNA, 25 bp, Mus musculus
tactttttattcaggccacgcaacg

SEQ ID NO: 350867 - DNA, 25 bp, Mus musculus
tactttttattcagggatgtgaaat

SEQ ID NO: 350868 - DNA, 25 bp, Mus musculus
tacttttttggttatgggcaaagca

SEQ ID NO: 350869 - DNA, 25 bp, Mus musculus
tagaaaaaaacacctggacttctct

SEQ ID NO: 350870 - DNA, 25 bp, Mus musculus
tagaaaaaacagacagtgatgtgac

SEQ ID NO: 350871 - DNA, 25 bp, Mus musculus
tagaaaaaagatgacctcaatgcca

SEQ ID NO: 350872 - DNA, 25 bp, Mus musculus
tagaaaaacccaaagatgcagacag

SEQ ID NO: 350873 - DNA, 25 bp, Mus musculus
tagaaaaagggcttttcctagatga

SEQ ID NO: 350874 - DNA, 25 bp, Mus musculus
tagaaaaagtaagtgcttccttggc

SEQ ID NO: 350875 - DNA, 25 bp, Mus musculus
tagaaaaatgtctacgaagagatct

SEQ ID NO: 350876 - DNA, 25 bp, Mus musculus
tagaaaacaactcccagacctacaa

SEQ ID NO: 350877 - DNA, 25 bp, Mus musculus
tagaaaacaatattgatgggcagtt

SEQ ID NO: 350878 - DNA, 25 bp, Mus musculus
tagaaaaccagacagaataagaatg

SEQ ID NO: 350879 - DNA, 25 bp, Mus musculus
tagaaaagaccactaaccatgagtt

SEQ ID NO: 350880 - DNA, 25 bp, Mus musculus
tagaaaagaccactgggttatccta

SEQ ID NO: 350881 - DNA, 25 bp, Mus musculus
tagaaaagatggcagcctttacttg

SEQ ID NO: 350882 - DNA, 25 bp, Mus musculus
tagaaaagcacagacgagctaaact

SEQ ID NO: 350883 - DNA, 25 bp, Mus musculus
tagaaaagtaccaggtgttttcagc

SEQ ID NO: 350884 - DNA, 25 bp, Mus musculus
tagaaaatattggattggaagcctg

SEQ ID NO: 350885 - DNA, 25 bp, Mus musculus
tagaaaatgaagtttctacactaaa

SEQ ID NO: 350886 - DNA, 25 bp, Mus musculus
tagaaaatgagctgaacattatcca

SEQ ID NO: 350887 - DNA, 25 bp, Mus musculus
tagaaaatgctaaggtttatgggac

SEQ ID NO: 350888 - DNA, 25 bp, Mus musculus
tagaaacaaaggctagtctacccaa

SEQ ID NO: 350889 - DNA, 25 bp, Mus musculus
tagaaacaaatgggatggaagactg

SEQ ID NO: 350890 - DNA, 25 bp, Mus musculus
tagaaacaaatggtgaagaagatgg

SEQ ID NO: 350891 - DNA, 25 bp, Mus musculus
tagaaacaaggtgctctgttgccgt

SEQ ID NO: 350892 - DNA, 25 bp, Mus musculus
tagaaacccacaactggagcaagcc

SEQ ID NO: 350893 - DNA, 25 bp, Mus musculus
tagaaacccagaactggagcaagcc

SEQ ID NO: 350894 - DNA, 25 bp, Mus musculus
tagaaagaagcatgtctgctgtgac

SEQ ID NO: 350895 - DNA, 25 bp, Mus musculus
tagaaagagaaatggattccctgct

SEQ ID NO: 350896 - DNA, 25 bp, Mus musculus
tagaaagagcaactgtcctgtcctc

SEQ ID NO: 350897 - DNA, 25 bp, Mus musculus
tagaaagcagatggaaaggcagcgg

SEQ ID NO: 350898 - DNA, 25 bp, Mus musculus
tagaaagcggcctgacctgctgaat

SEQ ID NO: 350899 - DNA, 25 bp, Mus musculus
tagaaagcgggactttgccagcgaa

SEQ ID NO: 350900 - DNA, 25 bp, Mus musculus
tagaaaggaagatcctggccctgag

SEQ ID NO: 350901 - DNA, 25 bp, Mus musculus
tagaaataaagatgatcagtcagtt

SEQ ID NO: 350902 - DNA, 25 bp, Mus musculus
tagaaatataatagatgtggtatct

SEQ ID NO: 350903 - DNA, 25 bp, Mus musculus
tagaaatatagctcccgttacttcc

SEQ ID NO: 350904 - DNA, 25 bp, Mus musculus
tagaaatatgcggctatggatgttg

SEQ ID NO: 350905 - DNA, 25 bp, Mus musculus
tagaaatcggaagatcttagatgag

SEQ ID NO: 350906 - DNA, 25 bp, Mus musculus
tagaaatgaaaactgagggagatga

SEQ ID NO: 350907 - DNA, 25 bp, Mus musculus
tagaaatgcaaaaggaccctgatag

SEQ ID NO: 350908 - DNA, 25 bp, Mus musculus
tagaaatgcaagtttgtcaatatac

SEQ ID NO: 350909 - DNA, 25 bp, Mus musculus
tagaaatggcccatgattttgttct

SEQ ID NO: 350910 - DNA, 25 bp, Mus musculus
tagaaatggcccatgtgctctgtaa

SEQ ID NO: 350911 - DNA, 25 bp, Mus musculus
tagaaatggcccattgaaaagagtc

SEQ ID NO: 350912 - DNA, 25 bp, Mus musculus
tagaaattaccctaagttatacatt

SEQ ID NO: 350913 - DNA, 25 bp, Mus musculus
tagaaattctcacctccctagcact

SEQ ID NO: 350914 - DNA, 25 bp, Mus musculus
tagaacaaaaggaagccagatgccc

SEQ ID NO: 350915 - DNA, 25 bp, Mus musculus
tagaacaacagcgacagctatttga

SEQ ID NO: 350916 - DNA, 25 bp, Mus musculus
tagaacaacaggtgttgggagccct

SEQ ID NO: 350917 - DNA, 25 bp, Mus musculus
tagaacacataaaggcaagaaaact

SEQ ID NO: 350918 - DNA, 25 bp, Mus musculus
tagaacacatagtgtggatccaact

SEQ ID NO: 350919 - DNA, 25 bp, Mus musculus
tagaacacatagttaaccttggtga

SEQ ID NO: 350920 - DNA, 25 bp, Mus musculus
tagaacagatggaaagtgggaagcc

SEQ ID NO: 350921 - DNA, 25 bp, Mus musculus
tagaacaggagcagatcaggaatct

SEQ ID NO: 350922 - DNA, 25 bp, Mus musculus
tagaacaggagcagatccgctctca

SEQ ID NO: 350923 - DNA, 25 bp, Mus musculus
tagaacagtcacagactgtatgaga

SEQ ID NO: 350924 - DNA, 25 bp, Mus musculus
tagaacagtcacagagagtggtgaa

SEQ ID NO: 350925 - DNA, 25 bp, Mus musculus
tagaacagtcacagatggctttatg

SEQ ID NO: 350926 - DNA, 25 bp, Mus musculus
tagaacagtcacagcgtattgtcag

SEQ ID NO: 350927 - DNA, 25 bp, Mus musculus
tagaacagtcacaggcagatattgt

SEQ ID NO: 350928 - DNA, 25 bp, Mus musculus
tagaacataagcgtattatttatgt

SEQ ID NO: 350929 - DNA, 25 bp, Mus musculus
tagaaccacaacccaccaagcagtt

SEQ ID NO: 350930 - DNA, 25 bp, Mus musculus
tagaaccagaagagccaccaaccaa

SEQ ID NO: 350931 - DNA, 25 bp, Mus musculus
tagaaccagaagatgccatctcatc

SEQ ID NO: 350932 - DNA, 25 bp, Mus musculus
tagaaccagaaggagcaccgtactg

SEQ ID NO: 350933 - DNA, 25 bp, Mus musculus
tagaaccagcagatgacaccgtaca

SEQ ID NO: 350934 - DNA, 25 bp, Mus musculus
tagaacccacagagatataaactac

SEQ ID NO: 350935 - DNA, 25 bp, Mus musculus
tagaaccccggtggcgacagacaag

SEQ ID NO: 350936 - DNA, 25 bp, Mus musculus
tagaacccgataatgctgaggcttg

SEQ ID NO: 350937 - DNA, 25 bp, Mus musculus
tagaaccctcaaccgtgttaggagt

SEQ ID NO: 350938 - DNA, 25 bp, Mus musculus
tagaacctctgcaaggtttgtctgg

SEQ ID NO: 350939 - DNA, 25 bp, Mus musculus
tagaacctgccctctgaccgtgctt

SEQ ID NO: 350940 - DNA, 25 bp, Mus musculus
tagaacctggcctcatctgtatgcc

SEQ ID NO: 350941 - DNA, 25 bp, Mus musculus
tagaacgagccatttattgaaactc

SEQ ID NO: 350942 - DNA, 25 bp, Mus musculus
tagaactaagaaataaagattttag

SEQ ID NO: 350943 - DNA, 25 bp, Mus musculus
tagaactaagtagcaacccagctca

SEQ ID NO: 350944 - DNA, 25 bp, Mus musculus
tagaactcaggcaggaagaggaacg

SEQ ID NO: 350945 - DNA, 25 bp, Mus musculus
tagaactccatcatgtccttcagtg

SEQ ID NO: 350946 - DNA, 25 bp, Mus musculus
tagaactgccgggttcatcgtggca

SEQ ID NO: 350947 - DNA, 25 bp, Mus musculus
tagaactgtatttggaataaccaca

SEQ ID NO: 350948 - DNA, 25 bp, Mus musculus
tagaactgtggagtatcacggtgat

SEQ ID NO: 350949 - DNA, 25 bp, Mus musculus
tagaagaaaagaaaaatcaagaact

SEQ ID NO: 350950 - DNA, 25 bp, Mus musculus
tagaagaaaagtttctgtttctatt

SEQ ID NO: 350951 - DNA, 25 bp, Mus musculus
tagaagaaacggaaggcatgaaaga

SEQ ID NO: 350952 - DNA, 25 bp, Mus musculus
tagaagaaagcagggctttctgtga

SEQ ID NO: 350953 - DNA, 25 bp, Mus musculus
tagaagaaagttggggctgtgcggg

SEQ ID NO: 350954 - DNA, 25 bp, Mus musculus
tagaagaaatcaaggaaacactcat

SEQ ID NO: 350955 - DNA, 25 bp, Mus musculus
tagaagaacagaaactacataaagc

SEQ ID NO: 350956 - DNA, 25 bp, Mus musculus
tagaagaactaaaggataacttcaa

SEQ ID NO: 350957 - DNA, 25 bp, Mus musculus
tagaagaagctggtcccgtccatgg

SEQ ID NO: 350958 - DNA, 25 bp, Mus musculus
tagaagacactagggtggctaccgt

SEQ ID NO: 350959 - DNA, 25 bp, Mus musculus
tagaagacctacaaggtcggacatc

SEQ ID NO: 350960 - DNA, 25 bp, Mus musculus
tagaagagatggagttttttggacc

SEQ ID NO: 350961 - DNA, 25 bp, Mus musculus
tagaagagcagtcgggtgctcttac

SEQ ID NO: 350962 - DNA, 25 bp, Mus musculus
tagaagagctgccctctgaagccaa

SEQ ID NO: 350963 - DNA, 25 bp, Mus musculus
tagaagagcttagcctatcttcaga

SEQ ID NO: 350964 - DNA, 25 bp, Mus musculus
tagaagaggagggactgatttgctt

SEQ ID NO: 350965 - DNA, 25 bp, Mus musculus
tagaagaggcaatattgataataca

SEQ ID NO: 350966 - DNA, 25 bp, Mus musculus
tagaagataggttaagagcaggatt

SEQ ID NO: 350967 - DNA, 25 bp, Mus musculus
tagaagatattaaacgacacaaggc

SEQ ID NO: 350968 - DNA, 25 bp, Mus musculus
tagaagatattttttgagaaatggt

SEQ ID NO: 350969 - DNA, 25 bp, Mus musculus
tagaagatggagatcagccagatgc

SEQ ID NO: 350970 - DNA, 25 bp, Mus musculus
tagaagatggagatggctcttggac

SEQ ID NO: 350971 - DNA, 25 bp, Mus musculus
tagaagcaacaggcatgacttgcca

SEQ ID NO: 350972 - DNA, 25 bp, Mus musculus
tagaagcatggtcttagaaatgaga

SEQ ID NO: 350973 - DNA, 25 bp, Mus musculus
tagaagccaccaaaggagtaaccta

SEQ ID NO: 350974 - DNA, 25 bp, Mus musculus
tagaagccaccaaaggttacagaga

SEQ ID NO: 350975 - DNA, 25 bp, Mus musculus
tagaagccatccgttctcgtgctgc

SEQ ID NO: 350976 - DNA, 25 bp, Mus musculus
tagaagcctggcaaaatgaaggatc

SEQ ID NO: 350977 - DNA, 25 bp, Mus musculus
tagaagctctcatctgaaaataatg

SEQ ID NO: 350978 - DNA, 25 bp, Mus musculus
tagaagctctgaatgacaaaaagca

SEQ ID NO: 350979 - DNA, 25 bp, Mus musculus
tagaagctgagcagaaaggcgctct

SEQ ID NO: 350980 - DNA, 25 bp, Mus musculus
tagaagctgagcaggcggaggaaga

SEQ ID NO: 350981 - DNA, 25 bp, Mus musculus
tagaagctgagggttcaaggaaggt

SEQ ID NO: 350982 - DNA, 25 bp, Mus musculus
tagaaggaaacagttcagggcgaca

SEQ ID NO: 350983 - DNA, 25 bp, Mus musculus
tagaaggaaggtatcatgccaaaga

SEQ ID NO: 350984 - DNA, 25 bp, Mus musculus
tagaaggacagaaaaaaagcagagg

SEQ ID NO: 350985 - DNA, 25 bp, Mus musculus
tagaaggacagctcctgaattcgga

SEQ ID NO: 350986 - DNA, 25 bp, Mus musculus
tagaaggagaaggtctcaggagcta

SEQ ID NO: 350987 - DNA, 25 bp, Mus musculus
tagaaggaggattattaattggagg

SEQ ID NO: 350988 - DNA, 25 bp, Mus musculus
tagaaggaggattctgataatcagc

SEQ ID NO: 350989 - DNA, 25 bp, Mus musculus
tagaaggaggattgcttcctgagga

SEQ ID NO: 350990 - DNA, 25 bp, Mus musculus
tagaaggaggccattaggaaacctg

SEQ ID NO: 350991 - DNA, 25 bp, Mus musculus
tagaaggaggggctaaggagaaggc

SEQ ID NO: 350992 - DNA, 25 bp, Mus musculus
tagaaggataccctgctgggggctc

SEQ ID NO: 350993 - DNA, 25 bp, Mus musculus
tagaaggcagaggtggcacggcgac

SEQ ID NO: 350994 - DNA, 25 bp, Mus musculus
tagaaggttttagggcaagtctgat

SEQ ID NO: 350995 - DNA, 25 bp, Mus musculus
tagaagtaagcggactggaaacagc

SEQ ID NO: 350996 - DNA, 25 bp, Mus musculus
tagaagtatcttgatcccacctaaa

SEQ ID NO: 350997 - DNA, 25 bp, Mus musculus
tagaagtcatccttggcatggatga

SEQ ID NO: 350998 - DNA, 25 bp, Mus musculus
tagaagtcggccaaaactgttatgg

SEQ ID NO: 350999 - DNA, 25 bp, Mus musculus
tagaagtgagtcaggtgttaaatga

SEQ ID NO: 351000 - DNA, 25 bp, Mus musculus
tagaagtggtagaaatggacctacc

SEQ ID NO: 351001 - DNA, 25 bp, Mus musculus
tagaagtggtagtaatggacctacc

SEQ ID NO: 351002 - DNA, 25 bp, Mus musculus
tagaagttcaccacagtgactccat

SEQ ID NO: 351003 - DNA, 25 bp, Mus musculus
tagaagttgtcctagaatcgaatca

SEQ ID NO: 351004 - DNA, 25 bp, Mus musculus
tagaataatagcagtggcagcaatg

SEQ ID NO: 351005 - DNA, 25 bp, Mus musculus
tagaatacatggcccctgaaatctt

SEQ ID NO: 351006 - DNA, 25 bp, Mus musculus
tagaatagacaaggctttgatgagg

SEQ ID NO: 351007 - DNA, 25 bp, Mus musculus
tagaatatgaagctttggttccagt

SEQ ID NO: 351008 - DNA, 25 bp, Mus musculus
tagaatcagcaacactacagatgct

SEQ ID NO: 351009 - DNA, 25 bp, Mus musculus
tagaatcagcaagactacagatgct

SEQ ID NO: 351010 - DNA, 25 bp, Mus musculus
tagaatcagcaggtctgatcttgct

SEQ ID NO: 351011 - DNA, 25 bp, Mus musculus
tagaatccgttgaagactttctggg

SEQ ID NO: 351012 - DNA, 25 bp, Mus musculus
tagaatggactttgaagcatttttc

SEQ ID NO: 351013 - DNA, 25 bp, Mus musculus
tagaatggcagggacggtcaagact

SEQ ID NO: 351014 - DNA, 25 bp, Mus musculus
tagaatgggccaagcagaaaagaaa

SEQ ID NO: 351015 - DNA, 25 bp, Mus musculus
tagaattaaaggtttgggatcaaag

SEQ ID NO: 351016 - DNA, 25 bp, Mus musculus
tagaattcctccaggagtacatcat

SEQ ID NO: 351017 - DNA, 25 bp, Mus musculus
tagaattgattgaggactctcaaag

SEQ ID NO: 351018 - DNA, 25 bp, Mus musculus
tagaattgattgaggggtctcactc

SEQ ID NO: 351019 - DNA, 25 bp, Mus musculus
tagacaaaggagagaagagaggctc

SEQ ID NO: 351020 - DNA, 25 bp, Mus musculus
tagacaagaccaagccccagctgcg

SEQ ID NO: 351021 - DNA, 25 bp, Mus musculus
tagacaaggaaagggatcttgctgg

SEQ ID NO: 351022 - DNA, 25 bp, Mus musculus
tagacaaggaaaggtacgacatgat

SEQ ID NO: 351023 - DNA, 25 bp, Mus musculus
tagacaaggcaaagcggtcccacca

SEQ ID NO: 351024 - DNA, 25 bp, Mus musculus
tagacaagtgtgagaaaaaacaaga

SEQ ID NO: 351025 - DNA, 25 bp, Mus musculus
tagacacacagcccatcctcagccc

SEQ ID NO: 351026 - DNA, 25 bp, Mus musculus
tagacacagtgaagtcccctcctgg

SEQ ID NO: 351027 - DNA, 25 bp, Mus musculus
tagacaccacgggtgctggtgacag

SEQ ID NO: 351028 - DNA, 25 bp, Mus musculus
tagacacctgagatatcaagttcat

SEQ ID NO: 351029 - DNA, 25 bp, Mus musculus
tagacactgagggccgatatctctt

SEQ ID NO: 351030 - DNA, 25 bp, Mus musculus
tagacacttgtggaaggaatctgct

SEQ ID NO: 351031 - DNA, 25 bp, Mus musculus
tagacagaaaggcggaacagagtgt

SEQ ID NO: 351032 - DNA, 25 bp, Mus musculus
tagacagaaaggcgggaaagggctg

SEQ ID NO: 351033 - DNA, 25 bp, Mus musculus
tagacagccagctgttgaggaccct

SEQ ID NO: 351034 - DNA, 25 bp, Mus musculus
tagacaggcaggacaggtcctggaa

SEQ ID NO: 351035 - DNA, 25 bp, Mus musculus
tagacaggctatgaggtacatccct

SEQ ID NO: 351036 - DNA, 25 bp, Mus musculus
tagacagtagaggctccgcaggagg

SEQ ID NO: 351037 - DNA, 25 bp, Mus musculus
tagacatacagtatgctcctgaagt

SEQ ID NO: 351038 - DNA, 25 bp, Mus musculus
tagacatgtacgatggctttctgtc

SEQ ID NO: 351039 - DNA, 25 bp, Mus musculus
tagacattgagcaggcatacaaatg

SEQ ID NO: 351040 - DNA, 25 bp, Mus musculus
tagacattggatgccgccttggacc

SEQ ID NO: 351041 - DNA, 25 bp, Mus musculus
tagacattggctgcggttctgggct

SEQ ID NO: 351042 - DNA, 25 bp, Mus musculus
tagaccaaaccgcaggcaatactag

SEQ ID NO: 351043 - DNA, 25 bp, Mus musculus
tagaccaaaccgcaggtataatcaa

SEQ ID NO: 351044 - DNA, 25 bp, Mus musculus
tagaccacagtaaggtgtaacacgg

SEQ ID NO: 351045 - DNA, 25 bp, Mus musculus
tagaccacgaggagctgaaggacca

SEQ ID NO: 351046 - DNA, 25 bp, Mus musculus
tagaccactggactgcatggtctga

SEQ ID NO: 351047 - DNA, 25 bp, Mus musculus
tagaccagatctcacaggaaaacca

SEQ ID NO: 351048 - DNA, 25 bp, Mus musculus
tagaccagcgctcctccagacaacc

SEQ ID NO: 351049 - DNA, 25 bp, Mus musculus
tagaccagtaacttccctctcactc

SEQ ID NO: 351050 - DNA, 25 bp, Mus musculus
tagacccagccagggttgtcgccct

SEQ ID NO: 351051 - DNA, 25 bp, Mus musculus
tagaccccagtcagggtctggaggt

SEQ ID NO: 351052 - DNA, 25 bp, Mus musculus
tagaccccattgagctcatgtttgc

SEQ ID NO: 351053 - DNA, 25 bp, Mus musculus
tagaccccattgagctggtggtttt

SEQ ID NO: 351054 - DNA, 25 bp, Mus musculus
tagacccccgagaaaccagctcttc

SEQ ID NO: 351055 - DNA, 25 bp, Mus musculus
tagacccgtcagaagccactccgtg

SEQ ID NO: 351056 - DNA, 25 bp, Mus musculus
tagaccctgataatgcactgctccc

SEQ ID NO: 351057 - DNA, 25 bp, Mus musculus
tagaccctgcacggctgtggactta

SEQ ID NO: 351058 - DNA, 25 bp, Mus musculus
tagaccctggagggaagggtggtga

SEQ ID NO: 351059 - DNA, 25 bp, Mus musculus
tagaccgtaggggttcacgaaccag

SEQ ID NO: 351060 - DNA, 25 bp, Mus musculus
tagacctcaagaattaaaacaggaa

SEQ ID NO: 351061 - DNA, 25 bp, Mus musculus
tagacctcaagggagaaggtgatat

SEQ ID NO: 351062 - DNA, 25 bp, Mus musculus
tagacctcatcttcagtccctaaag

SEQ ID NO: 351063 - DNA, 25 bp, Mus musculus
tagacctcatggcctctacaagcac

SEQ ID NO: 351064 - DNA, 25 bp, Mus musculus
tagacctcattgggcaagagcttgt

SEQ ID NO: 351065 - DNA, 25 bp, Mus musculus
tagacctgaagagtacagtcgcttt

SEQ ID NO: 351066 - DNA, 25 bp, Mus musculus
tagacctgaaggtgtcccccttgtc

SEQ ID NO: 351067 - DNA, 25 bp, Mus musculus
tagacctggaacctgatgaagagct

SEQ ID NO: 351068 - DNA, 25 bp, Mus musculus
tagacctggaatcagatgaagagct

SEQ ID NO: 351069 - DNA, 25 bp, Mus musculus
tagacctgtcttgtaaccctgagat

SEQ ID NO: 351070 - DNA, 25 bp, Mus musculus
tagaccttaacctagcttaccatct

SEQ ID NO: 351071 - DNA, 25 bp, Mus musculus
tagacgagaggctcagagccctgaa

SEQ ID NO: 351072 - DNA, 25 bp, Mus musculus
tagacgaggaggtggagttgttaca

SEQ ID NO: 351073 - DNA, 25 bp, Mus musculus
tagacgccaaggttgtggagctgaa

SEQ ID NO: 351074 - DNA, 25 bp, Mus musculus
tagacgctcttttcagacccaagtt

SEQ ID NO: 351075 - DNA, 25 bp, Mus musculus
tagacgctgctgcctctgattggcc

SEQ ID NO: 351076 - DNA, 25 bp, Mus musculus
tagacgctgctgcctgtattgacca

SEQ ID NO: 351077 - DNA, 25 bp, Mus musculus
tagacggctatgaatcatccaggtt

SEQ ID NO: 351078 - DNA, 25 bp, Mus musculus
tagacgtcaggtggccatcaaagta

SEQ ID NO: 351079 - DNA, 25 bp, Mus musculus
tagactacagggaaagccacccacc

SEQ ID NO: 351080 - DNA, 25 bp, Mus musculus
tagactacatgtccttctgcgcgtg

SEQ ID NO: 351081 - DNA, 25 bp, Mus musculus
tagactaccaggttgggataaacat

SEQ ID NO: 351082 - DNA, 25 bp, Mus musculus
tagactagatatggaacgggagcga

SEQ ID NO: 351083 - DNA, 25 bp, Mus musculus
tagactatacatgtgaatgaactca

SEQ ID NO: 351084 - DNA, 25 bp, Mus musculus
tagactcagagagctgcatgcctca

SEQ ID NO: 351085 - DNA, 25 bp, Mus musculus
tagactcagaggagctgtgattggt

SEQ ID NO: 351086 - DNA, 25 bp, Mus musculus
tagactcagagtcataaggtcacct

SEQ ID NO: 351087 - DNA, 25 bp, Mus musculus
tagactcagatcagaagagcagcag

SEQ ID NO: 351088 - DNA, 25 bp, Mus musculus
tagactcagatcagccttgcagcag

SEQ ID NO: 351089 - DNA, 25 bp, Mus musculus
tagactcagatcagctgggaagggc

SEQ ID NO: 351090 - DNA, 25 bp, Mus musculus
tagactccatagaactttccaaagc

SEQ ID NO: 351091 - DNA, 25 bp, Mus musculus
tagactccataggaccttctgtctc

SEQ ID NO: 351092 - DNA, 25 bp, Mus musculus
tagactccatgtgctcggcgctctc

SEQ ID NO: 351093 - DNA, 25 bp, Mus musculus
tagactccgagggacatctctacac

SEQ ID NO: 351094 - DNA, 25 bp, Mus musculus
tagactgactgggagacttgtggca

SEQ ID NO: 351095 - DNA, 25 bp, Mus musculus
tagactgataggactccagaggacc

SEQ ID NO: 351096 - DNA, 25 bp, Mus musculus
tagactggcctcatctgttccggcc

SEQ ID NO: 351097 - DNA, 25 bp, Mus musculus
tagactgggtctatggctatcgagg

SEQ ID NO: 351098 - DNA, 25 bp, Mus musculus
tagactgtattccagaatgcccata

SEQ ID NO: 351099 - DNA, 25 bp, Mus musculus
tagacttattaaggtcacagtaatg

SEQ ID NO: 351100 - DNA, 25 bp, Mus musculus
tagacttcaggaataaagtggtgac

SEQ ID NO: 351101 - DNA, 25 bp, Mus musculus
tagacttcagtttgatttccaggaa

SEQ ID NO: 351102 - DNA, 25 bp, Mus musculus
tagacttgaaagcacagtggttgaa

SEQ ID NO: 351103 - DNA, 25 bp, Mus musculus
tagacttgaacagcattgaggatcc

SEQ ID NO: 351104 - DNA, 25 bp, Mus musculus
tagacttgcctaagttggaaaagcg

SEQ ID NO: 351105 - DNA, 25 bp, Mus musculus
tagacttggccagggagccacagct

SEQ ID NO: 351106 - DNA, 25 bp, Mus musculus
tagacttggtggttctccgttctga

SEQ ID NO: 351107 - DNA, 25 bp, Mus musculus
tagacttgttaagtttctagtggga

SEQ ID NO: 351108 - DNA, 25 bp, Mus musculus
tagactttcccaataaagactgagt

SEQ ID NO: 351109 - DNA, 25 bp, Mus musculus
tagactttgaggaggaagaagtgct

SEQ ID NO: 351110 - DNA, 25 bp, Mus musculus
tagactttgcagaaatgaagcagat

SEQ ID NO: 351111 - DNA, 25 bp, Mus musculus
tagagaaaacgtgaaaaaggtccaa

SEQ ID NO: 351112 - DNA, 25 bp, Mus musculus
tagagaaaaggttttctgtccacac

SEQ ID NO: 351113 - DNA, 25 bp, Mus musculus
tagagaaacagaggtaatctacaaa

SEQ ID NO: 351114 - DNA, 25 bp, Mus musculus
tagagaaacatggtggcgacagaca

SEQ ID NO: 351115 - DNA, 25 bp, Mus musculus
tagagaaagaaaaagtggagtacat

SEQ ID NO: 351116 - DNA, 25 bp, Mus musculus
tagagaaagccaatgcaccatgaac

SEQ ID NO: 351117 - DNA, 25 bp, Mus musculus
tagagaaatatgtgcatgagctcat

SEQ ID NO: 351118 - DNA, 25 bp, Mus musculus
tagagaacagcagaggttcagaagg

SEQ ID NO: 351119 - DNA, 25 bp, Mus musculus
tagagaacagcagctccattttatt

SEQ ID NO: 351120 - DNA, 25 bp, Mus musculus
tagagaacagggaccgtgtgggctg

SEQ ID NO: 351121 - DNA, 25 bp, Mus musculus
tagagaaccccaggcacggccacca

SEQ ID NO: 351122 - DNA, 25 bp, Mus musculus
tagagaagaacaaggtattgacaaa

SEQ ID NO: 351123 - DNA, 25 bp, Mus musculus
tagagaagacggaatggttccattt

SEQ ID NO: 351124 - DNA, 25 bp, Mus musculus
tagagaagagttggttgatcgtgtt

SEQ ID NO: 351125 - DNA, 25 bp, Mus musculus
tagagaaggagctggagcagagcca

SEQ ID NO: 351126 - DNA, 25 bp, Mus musculus
tagagaagtgattgtgaagccagag

SEQ ID NO: 351127 - DNA, 25 bp, Mus musculus
tagagaagtgcctagacaagtattt

SEQ ID NO: 351128 - DNA, 25 bp, Mus musculus
tagagaataataaggagaatctgta

SEQ ID NO: 351129 - DNA, 25 bp, Mus musculus
tagagaataatcaggttttaaaatc

SEQ ID NO: 351130 - DNA, 25 bp, Mus musculus
tagagaatcaggctgtcaccaacga

SEQ ID NO: 351131 - DNA, 25 bp, Mus musculus
tagagaatcttgccggtcctgttag

SEQ ID NO: 351132 - DNA, 25 bp, Mus musculus
tagagacaaaggttctaatcagaga

SEQ ID NO: 351133 - DNA, 25 bp, Mus musculus
tagagacacagagaacacactctac

SEQ ID NO: 351134 - DNA, 25 bp, Mus musculus
tagagacacagccagctcaggaaga

SEQ ID NO: 351135 - DNA, 25 bp, Mus musculus
tagagacacagcctgagtgcataca

SEQ ID NO: 351136 - DNA, 25 bp, Mus musculus
tagagacacaggcaccattttaaca

SEQ ID NO: 351137 - DNA, 25 bp, Mus musculus
tagagacacggaagcctgtgctggg

SEQ ID NO: 351138 - DNA, 25 bp, Mus musculus
tagagacagaaagctcagaggctga

SEQ ID NO: 351139 - DNA, 25 bp, Mus musculus
tagagaccaagaaaatccagcctca

SEQ ID NO: 351140 - DNA, 25 bp, Mus musculus
tagagaccaagatgaagaaccacct

SEQ ID NO: 351141 - DNA, 25 bp, Mus musculus
tagagaccattgacaaagccaactt

SEQ ID NO: 351142 - DNA, 25 bp, Mus musculus
tagagaccctgaattaccggtattg

SEQ ID NO: 351143 - DNA, 25 bp, Mus musculus
tagagacgccagttctacctccagt

SEQ ID NO: 351144 - DNA, 25 bp, Mus musculus
tagagagaaagggtacagatttatt

SEQ ID NO: 351145 - DNA, 25 bp, Mus musculus
tagagagaacttacctaaagacgtc

SEQ ID NO: 351146 - DNA, 25 bp, Mus musculus
tagagagaagaaagaatatcttgtt

SEQ ID NO: 351147 - DNA, 25 bp, Mus musculus
tagagagaagaaatctccacagcaa

SEQ ID NO: 351148 - DNA, 25 bp, Mus musculus
tagagagaagcaactggtctccgat

SEQ ID NO: 351149 - DNA, 25 bp, Mus musculus
tagagagcaagttcattacagcatc

SEQ ID NO: 351150 - DNA, 25 bp, Mus musculus
tagagagccggaacaggtacttaaa

SEQ ID NO: 351151 - DNA, 25 bp, Mus musculus
tagagagccggaaggataaagaaat

SEQ ID NO: 351152 - DNA, 25 bp, Mus musculus
tagagagccttagaggcccacgagg

SEQ ID NO: 351153 - DNA, 25 bp, Mus musculus
tagagaggcgagggttgtgagcccc

SEQ ID NO: 351154 - DNA, 25 bp, Mus musculus
tagagaggctgtgtcccattgtatc

SEQ ID NO: 351155 - DNA, 25 bp, Mus musculus
tagagagggctcaggtggtggagaa

SEQ ID NO: 351156 - DNA, 25 bp, Mus musculus
tagagagtgagaaaggagacacggt

SEQ ID NO: 351157 - DNA, 25 bp, Mus musculus
tagagagttcaaggggctgagattt

SEQ ID NO: 351158 - DNA, 25 bp, Mus musculus
tagagataaggttcatcatttggaa

SEQ ID NO: 351159 - DNA, 25 bp, Mus musculus
tagagatcagtcggtactccctggc

SEQ ID NO: 351160 - DNA, 25 bp, Mus musculus
tagagatccctctgagaccaccttc

SEQ ID NO: 351161 - DNA, 25 bp, Mus musculus
tagagatctcagtgcccttatgcat

SEQ ID NO: 351162 - DNA, 25 bp, Mus musculus
tagagatgaatccgccagttcctta

SEQ ID NO: 351163 - DNA, 25 bp, Mus musculus
tagagatgaggctggaggggtagca

SEQ ID NO: 351164 - DNA, 25 bp, Mus musculus
tagagatggagaaggaaaaacacag

SEQ ID NO: 351165 - DNA, 25 bp, Mus musculus
tagagatggtgaagaatttaagaag

SEQ ID NO: 351166 - DNA, 25 bp, Mus musculus
tagagatgtcccagcaacattttga

SEQ ID NO: 351167 - DNA, 25 bp, Mus musculus
tagagattaaggagctatcgaagaa

SEQ ID NO: 351168 - DNA, 25 bp, Mus musculus
tagagcagaaagccaatgctcttca

SEQ ID NO: 351169 - DNA, 25 bp, Mus musculus
tagagcagcaggtatggacaacagg

SEQ ID NO: 351170 - DNA, 25 bp, Mus musculus
tagagcagccaggacaatcccagaa

SEQ ID NO: 351171 - DNA, 25 bp, Mus musculus
tagagcaggtaaagtaccaaatatg

SEQ ID NO: 351172 - DNA, 25 bp, Mus musculus
tagagcagtagtggcttcacggaaa

SEQ ID NO: 351173 - DNA, 25 bp, Mus musculus
tagagcataaggtttatctcaagtc

SEQ ID NO: 351174 - DNA, 25 bp, Mus musculus
tagagcatggaaaaccgtggacttg

SEQ ID NO: 351175 - DNA, 25 bp, Mus musculus
tagagccaaagaacaaattggaaga

SEQ ID NO: 351176 - DNA, 25 bp, Mus musculus
tagagccacagaactgtcctggctc

SEQ ID NO: 351177 - DNA, 25 bp, Mus musculus
tagagccacagagacagtgtttcac

SEQ ID NO: 351178 - DNA, 25 bp, Mus musculus
tagagccacaggatctcaattcaca

SEQ ID NO: 351179 - DNA, 25 bp, Mus musculus
tagagccaggaagtgactgtggact

SEQ ID NO: 351180 - DNA, 25 bp, Mus musculus
tagagcccatcaggtggttgaagat

SEQ ID NO: 351181 - DNA, 25 bp, Mus musculus
tagagccccgaaggactgctgcaga

SEQ ID NO: 351182 - DNA, 25 bp, Mus musculus
tagagccccgaaggcacacatgatg

SEQ ID NO: 351183 - DNA, 25 bp, Mus musculus
tagagccctccatggacatagtctt

SEQ ID NO: 351184 - DNA, 25 bp, Mus musculus
tagagccgtcaagctgatttatcca

SEQ ID NO: 351185 - DNA, 25 bp, Mus musculus
tagagcctagccccgtgtctgaaga

SEQ ID NO: 351186 - DNA, 25 bp, Mus musculus
tagagcctgaacagagagctgaaat

SEQ ID NO: 351187 - DNA, 25 bp, Mus musculus
tagagcctgctggcaatcatctggg

SEQ ID NO: 351188 - DNA, 25 bp, Mus musculus
tagagcggcgagagtaatccatatg

SEQ ID NO: 351189 - DNA, 25 bp, Mus musculus
tagagcgtgatctcggagtcctccg

SEQ ID NO: 351190 - DNA, 25 bp, Mus musculus
tagagcgtgatctcgggcaatggca

SEQ ID NO: 351191 - DNA, 25 bp, Mus musculus
tagagcgtgtgggcatcgttctgcc

SEQ ID NO: 351192 - DNA, 25 bp, Mus musculus
tagagctaagcccagatggctctga

SEQ ID NO: 351193 - DNA, 25 bp, Mus musculus
tagagctagcgggttatgcctccac

SEQ ID NO: 351194 - DNA, 25 bp, Mus musculus
tagagctatcttataatctggaggc

SEQ ID NO: 351195 - DNA, 25 bp, Mus musculus
tagagctcatagaagttaatggaac

SEQ ID NO: 351196 - DNA, 25 bp, Mus musculus
tagagctgacgggggtggcaccgaa

SEQ ID NO: 351197 - DNA, 25 bp, Mus musculus
tagagctgcttcaggaattctctga

SEQ ID NO: 351198 - DNA, 25 bp, Mus musculus
tagagctggaggataaataaggaaa

SEQ ID NO: 351199 - DNA, 25 bp, Mus musculus
tagagctggatagagcggcagtaca

SEQ ID NO: 351200 - DNA, 25 bp, Mus musculus
tagagcttgggattttctttgaggt

SEQ ID NO: 351201 - DNA, 25 bp, Mus musculus
tagagcttggggttttatggcaatt

SEQ ID NO: 351202 - DNA, 25 bp, Mus musculus
tagagcttgggtggtcgttgaagtt

SEQ ID NO: 351203 - DNA, 25 bp, Mus musculus
tagaggaacattgtaaattcaagat

SEQ ID NO: 351204 - DNA, 25 bp, Mus musculus
tagaggaacttggagggccatggcg

SEQ ID NO: 351205 - DNA, 25 bp, Mus musculus
tagaggaagatggaggttccatttt

SEQ ID NO: 351206 - DNA, 25 bp, Mus musculus
tagaggacatgtcgtccctaatgtg

SEQ ID NO: 351207 - DNA, 25 bp, Mus musculus
tagaggacatgtcgtgtttctttca

SEQ ID NO: 351208 - DNA, 25 bp, Mus musculus
tagaggactgttatgaaagagaaga

SEQ ID NO: 351209 - DNA, 25 bp, Mus musculus
tagaggagacagaggtattgacctc

SEQ ID NO: 351210 - DNA, 25 bp, Mus musculus
tagaggagagccaagttgaagttca

SEQ ID NO: 351211 - DNA, 25 bp, Mus musculus
tagaggagctgaaagcactgacaca

SEQ ID NO: 351212 - DNA, 25 bp, Mus musculus
tagaggagctgaaagggactgccct

SEQ ID NO: 351213 - DNA, 25 bp, Mus musculus
tagaggaggagctggagcgctcgga

SEQ ID NO: 351214 - DNA, 25 bp, Mus musculus
tagaggaggatgccctctgaagcca

SEQ ID NO: 351215 - DNA, 25 bp, Mus musculus
tagaggaggcctcattgcatacatc

SEQ ID NO: 351216 - DNA, 25 bp, Mus musculus
tagaggaggcctcctcctggactgc

SEQ ID NO: 351217 - DNA, 25 bp, Mus musculus
tagaggagtaagctggatggtccac

SEQ ID NO: 351218 - DNA, 25 bp, Mus musculus
tagaggagtgttgagagtcctttgc

SEQ ID NO: 351219 - DNA, 25 bp, Mus musculus
tagaggatctcagttcacatatgga

SEQ ID NO: 351220 - DNA, 25 bp, Mus musculus
tagaggcagagccccactccacagc

SEQ ID NO: 351221 - DNA, 25 bp, Mus musculus
tagaggcctcactagggcagggcct

SEQ ID NO: 351222 - DNA, 25 bp, Mus musculus
tagaggccttggaaggaggtgggcc

SEQ ID NO: 351223 - DNA, 25 bp, Mus musculus
tagagggatggatgtgattttttca

SEQ ID NO: 351224 - DNA, 25 bp, Mus musculus
tagagggcagagacaatgaatatgt

SEQ ID NO: 351225 - DNA, 25 bp, Mus musculus
tagagggcaggacaataagactgca

SEQ ID NO: 351226 - DNA, 25 bp, Mus musculus
tagagggctaggcctgcctgcccca

SEQ ID NO: 351227 - DNA, 25 bp, Mus musculus
tagagggtccctaagagctctcttc

SEQ ID NO: 351228 - DNA, 25 bp, Mus musculus
tagaggtaaaggtcgatcgcgatcg

SEQ ID NO: 351229 - DNA, 25 bp, Mus musculus
tagaggtcacaacttctcacacata

SEQ ID NO: 351230 - DNA, 25 bp, Mus musculus
tagaggtcatctgagggaaagccac

SEQ ID NO: 351231 - DNA, 25 bp, Mus musculus
tagaggtgaccagtgtgagaagaaa

SEQ ID NO: 351232 - DNA, 25 bp, Mus musculus
tagaggtgggccaaggattctccca

SEQ ID NO: 351233 - DNA, 25 bp, Mus musculus
tagagtacttgagctaccaggagcc

SEQ ID NO: 351234 - DNA, 25 bp, Mus musculus
tagagtatgagaacttctatgcgga

SEQ ID NO: 351235 - DNA, 25 bp, Mus musculus
tagagtcacaccaagattgtttatt

SEQ ID NO: 351236 - DNA, 25 bp, Mus musculus
tagagtcacaccaagcaaaacaatt

SEQ ID NO: 351237 - DNA, 25 bp, Mus musculus
tagagtcacagaaatcactcaagga

SEQ ID NO: 351238 - DNA, 25 bp, Mus musculus
tagagtcattgcaggcccggcacaa

SEQ ID NO: 351239 - DNA, 25 bp, Mus musculus
tagagtcccagacaggcctcatggt

SEQ ID NO: 351240 - DNA, 25 bp, Mus musculus
tagagtcccagctgcctgctgaata

SEQ ID NO: 351241 - DNA, 25 bp, Mus musculus
tagagtgcaatccagcccttacaga

SEQ ID NO: 351242 - DNA, 25 bp, Mus musculus
tagagtgcaatccaggtcctggaat

SEQ ID NO: 351243 - DNA, 25 bp, Mus musculus
tagagtggaatgggatgagaaagat

SEQ ID NO: 351244 - DNA, 25 bp, Mus musculus
tagagtggaatggggatggcactgg

SEQ ID NO: 351245 - DNA, 25 bp, Mus musculus
tagagtggaatggggcctagccgcc

SEQ ID NO: 351246 - DNA, 25 bp, Mus musculus
tagagtgtaaattccccttttatgc

SEQ ID NO: 351247 - DNA, 25 bp, Mus musculus
tagagtgtgtgggaaagggccgata

SEQ ID NO: 351248 - DNA, 25 bp, Mus musculus
tagagttacaccaactttctgggct

SEQ ID NO: 351249 - DNA, 25 bp, Mus musculus
tagagttacaccaagtttctgggct

SEQ ID NO: 351250 - DNA, 25 bp, Mus musculus
tagagttcaaaggcggcgagtccac

SEQ ID NO: 351251 - DNA, 25 bp, Mus musculus
tagagttgcttcacgtcttacccac

SEQ ID NO: 351252 - DNA, 25 bp, Mus musculus
tagagtttatggatccgcctccgac

SEQ ID NO: 351253 - DNA, 25 bp, Mus musculus
tagagtttcagatacaccaagtatc

SEQ ID NO: 351254 - DNA, 25 bp, Mus musculus
tagagtttcagcacccacagagttg

SEQ ID NO: 351255 - DNA, 25 bp, Mus musculus
tagagttttggtcccagcaacagat

SEQ ID NO: 351256 - DNA, 25 bp, Mus musculus
tagataaatagatatgttttcttct

SEQ ID NO: 351257 - DNA, 25 bp, Mus musculus
tagataagaaggacttcctagggaa

SEQ ID NO: 351258 - DNA, 25 bp, Mus musculus
tagataagaaggtcggagctgaaag

SEQ ID NO: 351259 - DNA, 25 bp, Mus musculus
tagataatccacttaaacatttaaa

SEQ ID NO: 351260 - DNA, 25 bp, Mus musculus
tagatactattgttgcaatcatggc

SEQ ID NO: 351261 - DNA, 25 bp, Mus musculus
tagatagtccttgtgaggcccagcc

SEQ ID NO: 351262 - DNA, 25 bp, Mus musculus
tagatatcgaaggatgttttatttc

SEQ ID NO: 351263 - DNA, 25 bp, Mus musculus
tagatcaatatgagtggtactgcag

SEQ ID NO: 351264 - DNA, 25 bp, Mus musculus
tagatcaatgttaagggatcgctta

SEQ ID NO: 351265 - DNA, 25 bp, Mus musculus
tagatcactgccaaggacgaaaagg

SEQ ID NO: 351266 - DNA, 25 bp, Mus musculus
tagatcagatccgtgccatcgctga

SEQ ID NO: 351267 - DNA, 25 bp, Mus musculus
tagatcatatacaggagcagtacag

SEQ ID NO: 351268 - DNA, 25 bp, Mus musculus
tagatccaaaacacacagtgtatga

SEQ ID NO: 351269 - DNA, 25 bp, Mus musculus
tagatccagtaaagccaacaaatta

SEQ ID NO: 351270 - DNA, 25 bp, Mus musculus
tagatccagtaaagtccaggtacat

SEQ ID NO: 351271 - DNA, 25 bp, Mus musculus
tagatcccgatcaagatcatactct

SEQ ID NO: 351272 - DNA, 25 bp, Mus musculus
tagatcctgaagatgttgctgtgca

SEQ ID NO: 351273 - DNA, 25 bp, Mus musculus
tagatcctgaatgttgctgtgcatc

SEQ ID NO: 351274 - DNA, 25 bp, Mus musculus
tagatccttccaagactcagattag

SEQ ID NO: 351275 - DNA, 25 bp, Mus musculus
tagatctaaaggagctgtgaaatca

SEQ ID NO: 351276 - DNA, 25 bp, Mus musculus
tagatctaaggaactaatgaaacag

SEQ ID NO: 351277 - DNA, 25 bp, Mus musculus
tagatctcacgagacatatctgaag

SEQ ID NO: 351278 - DNA, 25 bp, Mus musculus
tagatctcacgagggagaaactgcc

SEQ ID NO: 351279 - DNA, 25 bp, Mus musculus
tagatcttgggaacctggtggccat

SEQ ID NO: 351280 - DNA, 25 bp, Mus musculus
tagatctttcctggctagaccacat

SEQ ID NO: 351281 - DNA, 25 bp, Mus musculus
tagatctttcctggtccatcaacct

SEQ ID NO: 351282 - DNA, 25 bp, Mus musculus
tagatgaacttgggaatgtacctga

SEQ ID NO: 351283 - DNA, 25 bp, Mus musculus
tagatgaacttgggttttatgattc

SEQ ID NO: 351284 - DNA, 25 bp, Mus musculus
tagatgaagaaaagcccctttcctc

SEQ ID NO: 351285 - DNA, 25 bp, Mus musculus
tagatgaagaaaagcgcagaagagc

SEQ ID NO: 351286 - DNA, 25 bp, Mus musculus
tagatgacctccaagggcccaatgt

SEQ ID NO: 351287 - DNA, 25 bp, Mus musculus
tagatgactcagaagaaaaaaagta

SEQ ID NO: 351288 - DNA, 25 bp, Mus musculus
tagatgactcagaagctcttgtcct

SEQ ID NO: 351289 - DNA, 25 bp, Mus musculus
tagatgagaattttacagaatcctg

SEQ ID NO: 351290 - DNA, 25 bp, Mus musculus
tagatgaggatagggttgtcgatga

SEQ ID NO: 351291 - DNA, 25 bp, Mus musculus
tagatgatatggagagcaccacttc

SEQ ID NO: 351292 - DNA, 25 bp, Mus musculus
tagatgatatggcccactatgactt

SEQ ID NO: 351293 - DNA, 25 bp, Mus musculus
tagatgatcagagtggtaagaaaag

SEQ ID NO: 351294 - DNA, 25 bp, Mus musculus
tagatgatgcaagggttctggaata

SEQ ID NO: 351295 - DNA, 25 bp, Mus musculus
tagatgatgttggtgatctgaaaac

SEQ ID NO: 351296 - DNA, 25 bp, Mus musculus
tagatgcaggaggattggaagctga

SEQ ID NO: 351297 - DNA, 25 bp, Mus musculus
tagatgcaggagtgagattatatag

SEQ ID NO: 351298 - DNA, 25 bp, Mus musculus
tagatgcctgagggcaggatggccc

SEQ ID NO: 351299 - DNA, 25 bp, Mus musculus
tagatgcttacagctcaaaggtgac

SEQ ID NO: 351300 - DNA, 25 bp, Mus musculus
tagatggaaaggtgtcgcaacatcc

SEQ ID NO: 351301 - DNA, 25 bp, Mus musculus
tagatggaacaagtaaggatagatg

SEQ ID NO: 351302 - DNA, 25 bp, Mus musculus
tagatggagaatggtaccgcgcccg

SEQ ID NO: 351303 - DNA, 25 bp, Mus musculus
tagatggcattgatggtgaccgagg

SEQ ID NO: 351304 - DNA, 25 bp, Mus musculus
tagatgtgaggtcacctcagcacct

SEQ ID NO: 351305 - DNA, 25 bp, Mus musculus
tagatgttgtgaggctggtggagga

SEQ ID NO: 351306 - DNA, 25 bp, Mus musculus
tagatgttttctctgacagctgtca

SEQ ID NO: 351307 - DNA, 25 bp, Mus musculus
tagattattagatatgctctccaaa

SEQ ID NO: 351308 - DNA, 25 bp, Mus musculus
tagattcacttgctgtaagaactaa

SEQ ID NO: 351309 - DNA, 25 bp, Mus musculus
tagattcacttggcttgttacatga

SEQ ID NO: 351310 - DNA, 25 bp, Mus musculus
tagattcatcggagaaggaactcag

SEQ ID NO: 351311 - DNA, 25 bp, Mus musculus
tagattcatcgttttgcgaggtggc

SEQ ID NO: 351312 - DNA, 25 bp, Mus musculus
tagattccaactaaaaataggaaat

SEQ ID NO: 351313 - DNA, 25 bp, Mus musculus
tagattccaactaagagttggccat

SEQ ID NO: 351314 - DNA, 25 bp, Mus musculus
tagattctataggagctgagaccct

SEQ ID NO: 351315 - DNA, 25 bp, Mus musculus
tagattctggtggctttgatgaact

SEQ ID NO: 351316 - DNA, 25 bp, Mus musculus
tagattctggtggtggacttctcaa

SEQ ID NO: 351317 - DNA, 25 bp, Mus musculus
tagattcttagaagggctggaaaaa

SEQ ID NO: 351318 - DNA, 25 bp, Mus musculus
tagattgatacagggacaagtgacc

SEQ ID NO: 351319 - DNA, 25 bp, Mus musculus
tagattgccagagctccacgcagga

SEQ ID NO: 351320 - DNA, 25 bp, Mus musculus
tagatttaaagtgttcctaggatcc

SEQ ID NO: 351321 - DNA, 25 bp, Mus musculus
tagatttattgttgattcttccaag

SEQ ID NO: 351322 - DNA, 25 bp, Mus musculus
tagatttcctacagggaaatcagtc

SEQ ID NO: 351323 - DNA, 25 bp, Mus musculus
tagatttcctacaggtggggcttta

SEQ ID NO: 351324 - DNA, 25 bp, Mus musculus
tagatttccttctgggttctcaaaa

SEQ ID NO: 351325 - DNA, 25 bp, Mus musculus
tagatttggaagagacctcaattat

SEQ ID NO: 351326 - DNA, 25 bp, Mus musculus
tagatttggaagcaggaatgtctga

SEQ ID NO: 351327 - DNA, 25 bp, Mus musculus
tagattttagcaggtcaatggccaa

SEQ ID NO: 351328 - DNA, 25 bp, Mus musculus
tagcaaaaaagggtctcgtagcatc

SEQ ID NO: 351329 - DNA, 25 bp, Mus musculus
tagcaaaaaaggtgttcctcagcac

SEQ ID NO: 351330 - DNA, 25 bp, Mus musculus
tagcaaaaccaaggctgagccgagc

SEQ ID NO: 351331 - DNA, 25 bp, Mus musculus
tagcaaaaccaaggctgaggcgagc

SEQ ID NO: 351332 - DNA, 25 bp, Mus musculus
tagcaaaaggacaggatgtagatat

SEQ ID NO: 351333 - DNA, 25 bp, Mus musculus
tagcaaagaggaaagcgattggcca

SEQ ID NO: 351334 - DNA, 25 bp, Mus musculus
tagcaaagaggctcctgacagtgct

SEQ ID NO: 351335 - DNA, 25 bp, Mus musculus
tagcaaagcaacaggtttcagatag

SEQ ID NO: 351336 - DNA, 25 bp, Mus musculus
tagcaaagcactgctgttcttgagt

SEQ ID NO: 351337 - DNA, 25 bp, Mus musculus
tagcaaagtatgatgatataagctt

SEQ ID NO: 351338 - DNA, 25 bp, Mus musculus
tagcaaagtgcagaggttcaaggca

SEQ ID NO: 351339 - DNA, 25 bp, Mus musculus
tagcaaatcagaagttacgagacta

SEQ ID NO: 351340 - DNA, 25 bp, Mus musculus
tagcaaatcaggaggtgcttgtctg

SEQ ID NO: 351341 - DNA, 25 bp, Mus musculus
tagcaaattcccaggtgaagccttt

SEQ ID NO: 351342 - DNA, 25 bp, Mus musculus
tagcaacaaaacgctgccgtccagg

SEQ ID NO: 351343 - DNA, 25 bp, Mus musculus
tagcaacaaacaattcctccatctg

SEQ ID NO: 351344 - DNA, 25 bp, Mus musculus
tagcaacaaagagcagcggtcagca

SEQ ID NO: 351345 - DNA, 25 bp, Mus musculus
tagcaacaacagccatgggttctcc

SEQ ID NO: 351346 - DNA, 25 bp, Mus musculus
tagcaacaagctgcgcaaaccatgc

SEQ ID NO: 351347 - DNA, 25 bp, Mus musculus
tagcaacaaggaatcaaaaatgaat

SEQ ID NO: 351348 - DNA, 25 bp, Mus musculus
tagcaacacctctactgccgcccac

SEQ ID NO: 351349 - DNA, 25 bp, Mus musculus
tagcaacagaggaacatgtgtatgt

SEQ ID NO: 351350 - DNA, 25 bp, Mus musculus
tagcaacatgaaggtcatgtaggaa

SEQ ID NO: 351351 - DNA, 25 bp, Mus musculus
tagcaaccgctatggaattgccatg

SEQ ID NO: 351352 - DNA, 25 bp, Mus musculus
tagcaacctccaaagatggaaaagc

SEQ ID NO: 351353 - DNA, 25 bp, Mus musculus
tagcaacgggggcatctgcaacggc

SEQ ID NO: 351354 - DNA, 25 bp, Mus musculus
tagcaactgccaggagaatcccagt

SEQ ID NO: 351355 - DNA, 25 bp, Mus musculus
tagcaactggagcactaaagcgaaa

SEQ ID NO: 351356 - DNA, 25 bp, Mus musculus
tagcaagcagctatggccggtgatt

SEQ ID NO: 351357 - DNA, 25 bp, Mus musculus
tagcaagcaggcatgacttgccaag

SEQ ID NO: 351358 - DNA, 25 bp, Mus musculus
tagcaagcagtccatctcagtccat

SEQ ID NO: 351359 - DNA, 25 bp, Mus musculus
tagcaagcccgtcctggacaatact

SEQ ID NO: 351360 - DNA, 25 bp, Mus musculus
tagcaagcttccctgtttttagcaa

SEQ ID NO: 351361 - DNA, 25 bp, Mus musculus
tagcaaggagaaagaaaagtcaaaa

SEQ ID NO: 351362 - DNA, 25 bp, Mus musculus
tagcaaggagggattttgaacttta

SEQ ID NO: 351363 - DNA, 25 bp, Mus musculus
tagcaagggcaggactcctttacac

SEQ ID NO: 351364 - DNA, 25 bp, Mus musculus
tagcaagtattaccgtaataaaaga

SEQ ID NO: 351365 - DNA, 25 bp, Mus musculus
tagcaatcagaacccaagagatgaa

SEQ ID NO: 351366 - DNA, 25 bp, Mus musculus
tagcaatctctgcacctttggggaa

SEQ ID NO: 351367 - DNA, 25 bp, Mus musculus
tagcaatgagaatgattcccttcag

SEQ ID NO: 351368 - DNA, 25 bp, Mus musculus
tagcaattaaggaactagaggctgc

SEQ ID NO: 351369 - DNA, 25 bp, Mus musculus
tagcaattaagggagtggccaggtt

SEQ ID NO: 351370 - DNA, 25 bp, Mus musculus
tagcacaaacagaggcaaatattgt

SEQ ID NO: 351371 - DNA, 25 bp, Mus musculus
tagcacacacaagggctgggtatgg

SEQ ID NO: 351372 - DNA, 25 bp, Mus musculus
tagcacatgggagggactgggggcg

SEQ ID NO: 351373 - DNA, 25 bp, Mus musculus
tagcaccaagaaattcattcctgag

SEQ ID NO: 351374 - DNA, 25 bp, Mus musculus
tagcacccaggttactcggcggccg

SEQ ID NO: 351375 - DNA, 25 bp, Mus musculus
tagcaccccaggtgttgactgtctt

SEQ ID NO: 351376 - DNA, 25 bp, Mus musculus
tagcaccccagttcttgcaggtgtt

SEQ ID NO: 351377 - DNA, 25 bp, Mus musculus
tagcaccgtgaaggtctggacatgc

SEQ ID NO: 351378 - DNA, 25 bp, Mus musculus
tagcaccgtggtgagtaatagttcc

SEQ ID NO: 351379 - DNA, 25 bp, Mus musculus
tagcacctattatggtaactttcgg

SEQ ID NO: 351380 - DNA, 25 bp, Mus musculus
tagcacctgagggatatgatgctgc

SEQ ID NO: 351381 - DNA, 25 bp, Mus musculus
tagcacctgagttctcactcaacag

SEQ ID NO: 351382 - DNA, 25 bp, Mus musculus
tagcacgaaagagaccagctatgga

SEQ ID NO: 351383 - DNA, 25 bp, Mus musculus
tagcacgaatgtgtgagaaaacctt

SEQ ID NO: 351384 - DNA, 25 bp, Mus musculus
tagcacgtggctgttttgcccattg

SEQ ID NO: 351385 - DNA, 25 bp, Mus musculus
tagcactaacgtgaccctggctgag

SEQ ID NO: 351386 - DNA, 25 bp, Mus musculus
tagcactaactgacctgggcctggt

SEQ ID NO: 351387 - DNA, 25 bp, Mus musculus
tagcactcacagcagggaccctggg

SEQ ID NO: 351388 - DNA, 25 bp, Mus musculus
tagcacttatcggaaatggtgaagc

SEQ ID NO: 351389 - DNA, 25 bp, Mus musculus
tagcagaacaggtgtttggatttgt

SEQ ID NO: 351390 - DNA, 25 bp, Mus musculus
tagcagacagattgatgacattgct

SEQ ID NO: 351391 - DNA, 25 bp, Mus musculus
tagcagacatgaaggcctttgttga

SEQ ID NO: 351392 - DNA, 25 bp, Mus musculus
tagcagaccaaaagcccttgccaga

SEQ ID NO: 351393 - DNA, 25 bp, Mus musculus
tagcagaccggatcctcttcagcag

SEQ ID NO: 351394 - DNA, 25 bp, Mus musculus
tagcagagcagagagatcaataagc

SEQ ID NO: 351395 - DNA, 25 bp, Mus musculus
tagcagagcaggatccaagtgaacg

SEQ ID NO: 351396 - DNA, 25 bp, Mus musculus
tagcagagcaggggaagcactgcat

SEQ ID NO: 351397 - DNA, 25 bp, Mus musculus
tagcagagtggcagcacgatggtcc

SEQ ID NO: 351398 - DNA, 25 bp, Mus musculus
tagcagatcagatgtggcaggcagg

SEQ ID NO: 351399 - DNA, 25 bp, Mus musculus
tagcagatcaggctcctggagtcca

SEQ ID NO: 351400 - DNA, 25 bp, Mus musculus
tagcagatgaagatctcaggcccat

SEQ ID NO: 351401 - DNA, 25 bp, Mus musculus
tagcagattttaaactgtttcagaa

SEQ ID NO: 351402 - DNA, 25 bp, Mus musculus
tagcagcagaaagagccgtctctca

SEQ ID NO: 351403 - DNA, 25 bp, Mus musculus
tagcagccaggggggagctgctgca

SEQ ID NO: 351404 - DNA, 25 bp, Mus musculus
tagcagcccaggatcaaagaatccc

SEQ ID NO: 351405 - DNA, 25 bp, Mus musculus
tagcagcccaggggaacggggggtc

SEQ ID NO: 351406 - DNA, 25 bp, Mus musculus
tagcagcccaggggtggaggagaag

SEQ ID NO: 351407 - DNA, 25 bp, Mus musculus
tagcagcccatacaatcctcctgat

SEQ ID NO: 351408 - DNA, 25 bp, Mus musculus
tagcagcctggcccatctccgagtt

SEQ ID NO: 351409 - DNA, 25 bp, Mus musculus
tagcagcctggtacccccttgcaga

SEQ ID NO: 351410 - DNA, 25 bp, Mus musculus
tagcagctctttagggttctacttt

SEQ ID NO: 351411 - DNA, 25 bp, Mus musculus
tagcagcttgggtcttgacgaagtg

SEQ ID NO: 351412 - DNA, 25 bp, Mus musculus
tagcaggaggcccaagcctttccac

SEQ ID NO: 351413 - DNA, 25 bp, Mus musculus
tagcaggaggcccaatgattagcat

SEQ ID NO: 351414 - DNA, 25 bp, Mus musculus
tagcaggtctcaaaagcgctcctgg

SEQ ID NO: 351415 - DNA, 25 bp, Mus musculus
tagcagtaatggtaagtatactgta

SEQ ID NO: 351416 - DNA, 25 bp, Mus musculus
tagcagtaatggtccatcctgataa

SEQ ID NO: 351417 - DNA, 25 bp, Mus musculus
tagcagtagtccaacatgcctttga

SEQ ID NO: 351418 - DNA, 25 bp, Mus musculus
tagcagtagtccaactgattagaat

SEQ ID NO: 351419 - DNA, 25 bp, Mus musculus
tagcagtagtccaagatgcctttga

SEQ ID NO: 351420 - DNA, 25 bp, Mus musculus
tagcagtagtccaagtgattagaat

SEQ ID NO: 351421 - DNA, 25 bp, Mus musculus
tagcagtcaaactcagcaacagcat

SEQ ID NO: 351422 - DNA, 25 bp, Mus musculus
tagcagtcaatatatggactaatgc

SEQ ID NO: 351423 - DNA, 25 bp, Mus musculus
tagcagtgatcccgcttcgatgact

SEQ ID NO: 351424 - DNA, 25 bp, Mus musculus
tagcagtgcaaggtgtccgcaaata

SEQ ID NO: 351425 - DNA, 25 bp, Mus musculus
tagcagtggagactgagcaaatcgg

SEQ ID NO: 351426 - DNA, 25 bp, Mus musculus
tagcagtggagactggtcttgcttt

SEQ ID NO: 351427 - DNA, 25 bp, Mus musculus
tagcagtggcgaggccatggtggcg

SEQ ID NO: 351428 - DNA, 25 bp, Mus musculus
tagcagtgtcagtgggttatttcgc

SEQ ID NO: 351429 - DNA, 25 bp, Mus musculus
tagcagttccagtcagctgcgggca

SEQ ID NO: 351430 - DNA, 25 bp, Mus musculus
tagcagttcgcagaacagaaactgg

SEQ ID NO: 351431 - DNA, 25 bp, Mus musculus
tagcataaaggcatttacactcttc

SEQ ID NO: 351432 - DNA, 25 bp, Mus musculus
tagcataattcagaaaatcagaaaa

SEQ ID NO: 351433 - DNA, 25 bp, Mus musculus
tagcatacagaatatgaacatcgac

SEQ ID NO: 351434 - DNA, 25 bp, Mus musculus
tagcatacaggtccaacccagtgga

SEQ ID NO: 351435 - DNA, 25 bp, Mus musculus
tagcatacctgtatgaccggttgct

SEQ ID NO: 351436 - DNA, 25 bp, Mus musculus
tagcatactcagcgagagaagcggg

SEQ ID NO: 351437 - DNA, 25 bp, Mus musculus
tagcatataaaatagaaatgtgaat

SEQ ID NO: 351438 - DNA, 25 bp, Mus musculus
tagcatcaaagatcttcaggattta

SEQ ID NO: 351439 - DNA, 25 bp, Mus musculus
tagcatcaaaggccagaaacatcag

SEQ ID NO: 351440 - DNA, 25 bp, Mus musculus
tagcatccagtgggtgtataacatt

SEQ ID NO: 351441 - DNA, 25 bp, Mus musculus
tagcatccgccacgccgtctgggta

SEQ ID NO: 351442 - DNA, 25 bp, Mus musculus
tagcatcggcaggacagcagcgctc

SEQ ID NO: 351443 - DNA, 25 bp, Mus musculus
tagcatctaggaggctttgatgagg

SEQ ID NO: 351444 - DNA, 25 bp, Mus musculus
tagcatctagtaatgacaagccctc

SEQ ID NO: 351445 - DNA, 25 bp, Mus musculus
tagcatctcagctgcctttggcaac

SEQ ID NO: 351446 - DNA, 25 bp, Mus musculus
tagcatctgacattgagattctttt

SEQ ID NO: 351447 - DNA, 25 bp, Mus musculus
tagcatctgggaagaagccaccatg

SEQ ID NO: 351448 - DNA, 25 bp, Mus musculus
tagcatctgttgaattgtggaacaa

SEQ ID NO: 351449 - DNA, 25 bp, Mus musculus
tagcatctgttgacttgactgaaaa

SEQ ID NO: 351450 - DNA, 25 bp, Mus musculus
tagcatctgttgggccagagggcat

SEQ ID NO: 351451 - DNA, 25 bp, Mus musculus
tagcatgctgccagggcaccagcgt

SEQ ID NO: 351452 - DNA, 25 bp, Mus musculus
tagcatggcagatgaaccggacaaa

SEQ ID NO: 351453 - DNA, 25 bp, Mus musculus
tagcatgtctgacctgtcaaactgg

SEQ ID NO: 351454 - DNA, 25 bp, Mus musculus
tagcatgttgtccggcattggaaga

SEQ ID NO: 351455 - DNA, 25 bp, Mus musculus
tagcattaaggaatcttgggaagct

SEQ ID NO: 351456 - DNA, 25 bp, Mus musculus
tagcattacaaggaggtgcccctga

SEQ ID NO: 351457 - DNA, 25 bp, Mus musculus
tagcattccccaatggtccatttac

SEQ ID NO: 351458 - DNA, 25 bp, Mus musculus
tagcattgtacagaggcctatggat

SEQ ID NO: 351459 - DNA, 25 bp, Mus musculus
tagcattgtacagagggatgaaatg

SEQ ID NO: 351460 - DNA, 25 bp, Mus musculus
tagcatttcaggatggaaccgcgcc

SEQ ID NO: 351461 - DNA, 25 bp, Mus musculus
tagccaaaaccctgaggccacaaga

SEQ ID NO: 351462 - DNA, 25 bp, Mus musculus
tagccaaaaccctgctatcttccag

SEQ ID NO: 351463 - DNA, 25 bp, Mus musculus
tagccaacaggaatgatccaagcag

SEQ ID NO: 351464 - DNA, 25 bp, Mus musculus
tagccaagagaggtcactatggtgc

SEQ ID NO: 351465 - DNA, 25 bp, Mus musculus
tagccaagagagttctgttggctca

SEQ ID NO: 351466 - DNA, 25 bp, Mus musculus
tagccaagcaggacagagaagaagg

SEQ ID NO: 351467 - DNA, 25 bp, Mus musculus
tagccaaggacaagaaacatctttc

SEQ ID NO: 351468 - DNA, 25 bp, Mus musculus
tagccaaggacaagagtttcttgga

SEQ ID NO: 351469 - DNA, 25 bp, Mus musculus
tagccaaggatccagacttggagaa

SEQ ID NO: 351470 - DNA, 25 bp, Mus musculus
tagccaatgatcatgaagaagattt

SEQ ID NO: 351471 - DNA, 25 bp, Mus musculus
tagccaatgatttatctgttttctt

SEQ ID NO: 351472 - DNA, 25 bp, Mus musculus
tagccaattacagaatctgggagca

SEQ ID NO: 351473 - DNA, 25 bp, Mus musculus
tagccaattctcccacacagatctg

SEQ ID NO: 351474 - DNA, 25 bp, Mus musculus
tagccaccaaagcgatgttaaagaa

SEQ ID NO: 351475 - DNA, 25 bp, Mus musculus
tagccaccaggacacagaatgttct

SEQ ID NO: 351476 - DNA, 25 bp, Mus musculus
tagccaccttcggcactgcagtaac

SEQ ID NO: 351477 - DNA, 25 bp, Mus musculus
tagccagaaaggtccacaccagtca

SEQ ID NO: 351478 - DNA, 25 bp, Mus musculus
tagccagaaagtttcaggccatcca

SEQ ID NO: 351479 - DNA, 25 bp, Mus musculus
tagccagccactcacaacccctggc

SEQ ID NO: 351480 - DNA, 25 bp, Mus musculus
tagccagccactcagaacccctggc

SEQ ID NO: 351481 - DNA, 25 bp, Mus musculus
tagccagctgctgagaacccaatat

SEQ ID NO: 351482 - DNA, 25 bp, Mus musculus
tagccaggagggacgattctgacgt

SEQ ID NO: 351483 - DNA, 25 bp, Mus musculus
tagccatattgccctctgttttctg

SEQ ID NO: 351484 - DNA, 25 bp, Mus musculus
tagccatccccagaggattatcaca

SEQ ID NO: 351485 - DNA, 25 bp, Mus musculus
tagccatgatggttactaactttca

SEQ ID NO: 351486 - DNA, 25 bp, Mus musculus
tagccattctaacagcctgcagact

SEQ ID NO: 351487 - DNA, 25 bp, Mus musculus
tagcccaacgctagaacatacaaca

SEQ ID NO: 351488 - DNA, 25 bp, Mus musculus
tagcccaattccaagagatatgtcc

SEQ ID NO: 351489 - DNA, 25 bp, Mus musculus
tagcccactcttcagttctgagaag

SEQ ID NO: 351490 - DNA, 25 bp, Mus musculus
tagcccagaaggcgggcaggaagac

SEQ ID NO: 351491 - DNA, 25 bp, Mus musculus
tagcccagcaaggaacaccagtgta

SEQ ID NO: 351492 - DNA, 25 bp, Mus musculus
tagcccagcaggaagcaacttcttc

SEQ ID NO: 351493 - DNA, 25 bp, Mus musculus
tagcccagcaggtgaccaaccactt

SEQ ID NO: 351494 - DNA, 25 bp, Mus musculus
tagcccatatgcaactgccccctga

SEQ ID NO: 351495 - DNA, 25 bp, Mus musculus
tagccccactccaggatcttttccc

SEQ ID NO: 351496 - DNA, 25 bp, Mus musculus
tagccccactccaggcacactggca

SEQ ID NO: 351497 - DNA, 25 bp, Mus musculus
tagccccagactggtgaatgagagt

SEQ ID NO: 351498 - DNA, 25 bp, Mus musculus
tagccccagaggccttcggacagtt

SEQ ID NO: 351499 - DNA, 25 bp, Mus musculus
tagccccagtcattgctgagacatg

SEQ ID NO: 351500 - DNA, 25 bp, Mus musculus
tagccccagtgtaagcttcaagctg

SEQ ID NO: 351501 - DNA, 25 bp, Mus musculus
tagccccctcaccagccccggctgc

SEQ ID NO: 351502 - DNA, 25 bp, Mus musculus
tagccccgtggacccagcagctgtc

SEQ ID NO: 351503 - DNA, 25 bp, Mus musculus
tagccccgtgggtgctcgtgtgcag

SEQ ID NO: 351504 - DNA, 25 bp, Mus musculus
tagcccctatggctgtagcagtggc

SEQ ID NO: 351505 - DNA, 25 bp, Mus musculus
tagccccttcctgagcatctgtggg

SEQ ID NO: 351506 - DNA, 25 bp, Mus musculus
tagcccgaggggaccctgttgactg

SEQ ID NO: 351507 - DNA, 25 bp, Mus musculus
tagcccgcgaggaacagtctgagat

SEQ ID NO: 351508 - DNA, 25 bp, Mus musculus
tagcccggtgcacgatgcccccgaa

SEQ ID NO: 351509 - DNA, 25 bp, Mus musculus
tagcccgtttgcaggatgccggtgc

SEQ ID NO: 351510 - DNA, 25 bp, Mus musculus
tagccctcaactcaagtagtaggcg

SEQ ID NO: 351511 - DNA, 25 bp, Mus musculus
tagccctctgattgaaattttcttc

SEQ ID NO: 351512 - DNA, 25 bp, Mus musculus
tagccctgagacagactcacaccgc

SEQ ID NO: 351513 - DNA, 25 bp, Mus musculus
tagccctgtggaggagtctctatgg

SEQ ID NO: 351514 - DNA, 25 bp, Mus musculus
tagccctttggaaaaatacatttat

SEQ ID NO: 351515 - DNA, 25 bp, Mus musculus
tagccgaagcgatctgctaatgcct

SEQ ID NO: 351516 - DNA, 25 bp, Mus musculus
tagccgaaggcagcttggagaagag

SEQ ID NO: 351517 - DNA, 25 bp, Mus musculus
tagccgaaggcagtctttcagaaat

SEQ ID NO: 351518 - DNA, 25 bp, Mus musculus
tagccgagcgtaagatcccctgctt

SEQ ID NO: 351519 - DNA, 25 bp, Mus musculus
tagccgagcgtaaggctgatggatg

SEQ ID NO: 351520 - DNA, 25 bp, Mus musculus
tagccgaggctgtgtgtgtgaagtt

SEQ ID NO: 351521 - DNA, 25 bp, Mus musculus
tagccgagggagaggcactgatgga

SEQ ID NO: 351522 - DNA, 25 bp, Mus musculus
tagccgcagcccaaggagatacaga

SEQ ID NO: 351523 - DNA, 25 bp, Mus musculus
tagccgccgtggaagaaaccctgat

SEQ ID NO: 351524 - DNA, 25 bp, Mus musculus
tagccgctgtggtgactgggctggt

SEQ ID NO: 351525 - DNA, 25 bp, Mus musculus
tagccggagcgatctttgggttcct

SEQ ID NO: 351526 - DNA, 25 bp, Mus musculus
tagccggaggatactcagctctgga

SEQ ID NO: 351527 - DNA, 25 bp, Mus musculus
tagccggtgacgccgccgaagatgg

SEQ ID NO: 351528 - DNA, 25 bp, Mus musculus
tagcctacagatgaaaaacgactgt

SEQ ID NO: 351529 - DNA, 25 bp, Mus musculus
tagcctacaggtggcggaggacgag

SEQ ID NO: 351530 - DNA, 25 bp, Mus musculus
tagcctaccagggatggctctgagc

SEQ ID NO: 351531 - DNA, 25 bp, Mus musculus
tagcctacccaggaagaagctcact

SEQ ID NO: 351532 - DNA, 25 bp, Mus musculus
tagcctacccctgaccatcccctca

SEQ ID NO: 351533 - DNA, 25 bp, Mus musculus
tagcctcagagatgctggagtgtca

SEQ ID NO: 351534 - DNA, 25 bp, Mus musculus
tagcctcagagatgctggagtgtcc

SEQ ID NO: 351535 - DNA, 25 bp, Mus musculus
tagcctcccaggtggaatgaacctt

SEQ ID NO: 351536 - DNA, 25 bp, Mus musculus
tagcctccggctatgcatatggaga

SEQ ID NO: 351537 - DNA, 25 bp, Mus musculus
tagcctctgaggaaagatataaaaa

SEQ ID NO: 351538 - DNA, 25 bp, Mus musculus
tagcctctgagggaactacatgaat

SEQ ID NO: 351539 - DNA, 25 bp, Mus musculus
tagcctgaatctcctggagaaagaa

SEQ ID NO: 351540 - DNA, 25 bp, Mus musculus
tagcctggaaggagctttggttaag

SEQ ID NO: 351541 - DNA, 25 bp, Mus musculus
tagcctggaagggcatactttgaga

SEQ ID NO: 351542 - DNA, 25 bp, Mus musculus
tagcctggatgttgccaaggcacct

SEQ ID NO: 351543 - DNA, 25 bp, Mus musculus
tagcctggggagaggccgacccgtg

SEQ ID NO: 351544 - DNA, 25 bp, Mus musculus
tagcctggggcaggtcacctagcat

SEQ ID NO: 351545 - DNA, 25 bp, Mus musculus
tagcctggtcctacgatcccaggct

SEQ ID NO: 351546 - DNA, 25 bp, Mus musculus
tagcctggtcctacggctgtgtggt

SEQ ID NO: 351547 - DNA, 25 bp, Mus musculus
tagcctgtgccttggacggctgttc

SEQ ID NO: 351548 - DNA, 25 bp, Mus musculus
tagccttcaggaaacaaagcaaacc

SEQ ID NO: 351549 - DNA, 25 bp, Mus musculus
tagccttctgcaccaaggagatcca

SEQ ID NO: 351550 - DNA, 25 bp, Mus musculus
tagcctttcaaaggtagtttacaaa

SEQ ID NO: 351551 - DNA, 25 bp, Mus musculus
tagcctttgacaaaaaatcagctgc

SEQ ID NO: 351552 - DNA, 25 bp, Mus musculus
tagcctttgagaggaacaaatgtgg

SEQ ID NO: 351553 - DNA, 25 bp, Mus musculus
tagcctttgaggtgtgcctgcagtc

SEQ ID NO: 351554 - DNA, 25 bp, Mus musculus
tagcgaaagaaggtaaaatttatga

SEQ ID NO: 351555 - DNA, 25 bp, Mus musculus
tagcgaacaatacaggtggccaaga

SEQ ID NO: 351556 - DNA, 25 bp, Mus musculus
tagcgaacaatacagtcaggatggc

SEQ ID NO: 351557 - DNA, 25 bp, Mus musculus
tagcgaaccagtaatggtcagcaag

SEQ ID NO: 351558 - DNA, 25 bp, Mus musculus
tagcgagcagggcgtaagaacaaga

SEQ ID NO: 351559 - DNA, 25 bp, Mus musculus
tagcgaggacagaaccatccgagta

SEQ ID NO: 351560 - DNA, 25 bp, Mus musculus
tagcgaggacagccccttgctctgc

SEQ ID NO: 351561 - DNA, 25 bp, Mus musculus
tagcgatgaggaagatgatgatgaa

SEQ ID NO: 351562 - DNA, 25 bp, Mus musculus
tagcgattctcatcgcttttatgaa

SEQ ID NO: 351563 - DNA, 25 bp, Mus musculus
tagcgatttccgggacctcatgtct

SEQ ID NO: 351564 - DNA, 25 bp, Mus musculus
tagcgccacaggcatggggaggatt

SEQ ID NO: 351565 - DNA, 25 bp, Mus musculus
tagcgccatcagcgaggctgctgcg

SEQ ID NO: 351566 - DNA, 25 bp, Mus musculus
tagcgccgagagatagtgctggagg

SEQ ID NO: 351567 - DNA, 25 bp, Mus musculus
tagcgccgagagattggagaatgat

SEQ ID NO: 351568 - DNA, 25 bp, Mus musculus
tagcgcgctttgagggcctgaagaa

SEQ ID NO: 351569 - DNA, 25 bp, Mus musculus
tagcgctcctcgagggcataacctg

SEQ ID NO: 351570 - DNA, 25 bp, Mus musculus
tagcgctcctggcaggaaggcctgc

SEQ ID NO: 351571 - DNA, 25 bp, Mus musculus
tagcgctgcccgggatctccatctt

SEQ ID NO: 351572 - DNA, 25 bp, Mus musculus
tagcggacaaagcagatctgcaggt

SEQ ID NO: 351573 - DNA, 25 bp, Mus musculus
tagcggacaaagcagcttccaggag

SEQ ID NO: 351574 - DNA, 25 bp, Mus musculus
tagcggacaaagcaggggtcgggtc

SEQ ID NO: 351575 - DNA, 25 bp, Mus musculus
tagcggacccagttcagcttgctca

SEQ ID NO: 351576 - DNA, 25 bp, Mus musculus
tagcggataacaggctgaccacagt

SEQ ID NO: 351577 - DNA, 25 bp, Mus musculus
tagcggcagccaggacatagtcaca

SEQ ID NO: 351578 - DNA, 25 bp, Mus musculus
tagcggcagccagggaacatctcaa

SEQ ID NO: 351579 - DNA, 25 bp, Mus musculus
tagcggcagccaggtgcagggcagt

SEQ ID NO: 351580 - DNA, 25 bp, Mus musculus
tagcggcagccaggtgggatgctat

SEQ ID NO: 351581 - DNA, 25 bp, Mus musculus
tagcggccgccagtctccacagagg

SEQ ID NO: 351582 - DNA, 25 bp, Mus musculus
tagcggcggccccggagaagatgga

SEQ ID NO: 351583 - DNA, 25 bp, Mus musculus
tagcgggtaagcagttatgcctcca

SEQ ID NO: 351584 - DNA, 25 bp, Mus musculus
tagcggtccttggacttcaggaacc

SEQ ID NO: 351585 - DNA, 25 bp, Mus musculus
tagcggtgagtgatcgtgagacatg

SEQ ID NO: 351586 - DNA, 25 bp, Mus musculus
tagcgtcagcgggggaacagtacat

SEQ ID NO: 351587 - DNA, 25 bp, Mus musculus
tagcgtctcagagtgcctggtgaag

SEQ ID NO: 351588 - DNA, 25 bp, Mus musculus
tagcgtctcagccaacaagatagct

SEQ ID NO: 351589 - DNA, 25 bp, Mus musculus
tagcgtgaaggttcttcatgagaag

SEQ ID NO: 351590 - DNA, 25 bp, Mus musculus
tagcgttaccctgggaatctgagac

SEQ ID NO: 351591 - DNA, 25 bp, Mus musculus
tagcgttggggagtatccgcctccg

SEQ ID NO: 351592 - DNA, 25 bp, Mus musculus
tagctaaggatccagcgtctgttga

SEQ ID NO: 351593 - DNA, 25 bp, Mus musculus
tagctaaggatccaggaccacaagc

SEQ ID NO: 351594 - DNA, 25 bp, Mus musculus
tagctaaggatccagggctcactga

SEQ ID NO: 351595 - DNA, 25 bp, Mus musculus
tagctacaacaaccgccgagacctg

SEQ ID NO: 351596 - DNA, 25 bp, Mus musculus
tagctacagaataagcttagatatg

SEQ ID NO: 351597 - DNA, 25 bp, Mus musculus
tagctaccaagaccgagatgccgcg

SEQ ID NO: 351598 - DNA, 25 bp, Mus musculus
tagctacctgcctaaccagcccctc

SEQ ID NO: 351599 - DNA, 25 bp, Mus musculus
tagctactccaggtacgtaggtgcc

SEQ ID NO: 351600 - DNA, 25 bp, Mus musculus
tagctagaggcaactcgccatgatg

SEQ ID NO: 351601 - DNA, 25 bp, Mus musculus
tagctagagggtacaaaggatttaa

SEQ ID NO: 351602 - DNA, 25 bp, Mus musculus
tagctagtccgtgtactttgtgggt

SEQ ID NO: 351603 - DNA, 25 bp, Mus musculus
tagctagttcaggcactggctccag

SEQ ID NO: 351604 - DNA, 25 bp, Mus musculus
tagctatagtcatttacaaaatggt

SEQ ID NO: 351605 - DNA, 25 bp, Mus musculus
tagctatcacaaataaagaaaagga

SEQ ID NO: 351606 - DNA, 25 bp, Mus musculus
tagctatcacaaatatttcctcttc

SEQ ID NO: 351607 - DNA, 25 bp, Mus musculus
tagctatctggaggtgacccctgat

SEQ ID NO: 351608 - DNA, 25 bp, Mus musculus
tagctatgaaggagatgaagaggaa

SEQ ID NO: 351609 - DNA, 25 bp, Mus musculus
tagctcacgccgagcagctgcccca

SEQ ID NO: 351610 - DNA, 25 bp, Mus musculus
tagctcagcagacaagaaaaatctt

SEQ ID NO: 351611 - DNA, 25 bp, Mus musculus
tagctcagttgtggtagtgtgaagc

SEQ ID NO: 351612 - DNA, 25 bp, Mus musculus
tagctccacatgaactcacagaaga

SEQ ID NO: 351613 - DNA, 25 bp, Mus musculus
tagctccacatgacattctctggct

SEQ ID NO: 351614 - DNA, 25 bp, Mus musculus
tagctccacatgccatttaccaatc

SEQ ID NO: 351615 - DNA, 25 bp, Mus musculus
tagctcccacctgcaccttatagcc

SEQ ID NO: 351616 - DNA, 25 bp, Mus musculus
tagctcccacctggttttctctgta

SEQ ID NO: 351617 - DNA, 25 bp, Mus musculus
tagctccctccgatgtcatatgcct

SEQ ID NO: 351618 - DNA, 25 bp, Mus musculus
tagctcctccagagctcccagacct

SEQ ID NO: 351619 - DNA, 25 bp, Mus musculus
tagctcctcggaagaggagaagggg

SEQ ID NO: 351620 - DNA, 25 bp, Mus musculus
tagctcctcggaagcactgctacag

SEQ ID NO: 351621 - DNA, 25 bp, Mus musculus
tagctcctcggaagcatctcctctg

SEQ ID NO: 351622 - DNA, 25 bp, Mus musculus
tagctccttgaaagacctgcctgga

SEQ ID NO: 351623 - DNA, 25 bp, Mus musculus
tagctcgagaagggcagttatacga

SEQ ID NO: 351624 - DNA, 25 bp, Mus musculus
tagctcgagaagtctgatcagcgga

SEQ ID NO: 351625 - DNA, 25 bp, Mus musculus
tagctctcagagctcctcctcccat

SEQ ID NO: 351626 - DNA, 25 bp, Mus musculus
tagctctcaggtcaactcctggagt

SEQ ID NO: 351627 - DNA, 25 bp, Mus musculus
tagctctccagacacaagcatctat

SEQ ID NO: 351628 - DNA, 25 bp, Mus musculus
tagctctcggcaggccgtttaggga

SEQ ID NO: 351629 - DNA, 25 bp, Mus musculus
tagctctgtaccttggacaaagtgg

SEQ ID NO: 351630 - DNA, 25 bp, Mus musculus
tagctcttcagctctggggacactg

SEQ ID NO: 351631 - DNA, 25 bp, Mus musculus
tagctcttcaggactgggcagctca

SEQ ID NO: 351632 - DNA, 25 bp, Mus musculus
tagctgaaaagaaagggccaaataa

SEQ ID NO: 351633 - DNA, 25 bp, Mus musculus
tagctgaaaaggtgtctctggttgg

SEQ ID NO: 351634 - DNA, 25 bp, Mus musculus
tagctgaagagttgtgttagggttt

SEQ ID NO: 351635 - DNA, 25 bp, Mus musculus
tagctgaagctgaacctgagccagc

SEQ ID NO: 351636 - DNA, 25 bp, Mus musculus
tagctgaccgtgctattcactggca

SEQ ID NO: 351637 - DNA, 25 bp, Mus musculus
tagctgaccgtggtgagttgagggg

SEQ ID NO: 351638 - DNA, 25 bp, Mus musculus
tagctgacctcgaggaagtggacat

SEQ ID NO: 351639 - DNA, 25 bp, Mus musculus
tagctgactatgctcactctttggg

SEQ ID NO: 351640 - DNA, 25 bp, Mus musculus
tagctgagaaagaagctgctccagc

SEQ ID NO: 351641 - DNA, 25 bp, Mus musculus
tagctgagagtaagatttatgacat

SEQ ID NO: 351642 - DNA, 25 bp, Mus musculus
tagctgagcaaacagctgcccggga

SEQ ID NO: 351643 - DNA, 25 bp, Mus musculus
tagctgaggaacatctgattgcctt

SEQ ID NO: 351644 - DNA, 25 bp, Mus musculus
tagctgaggagctcttccaggaatc

SEQ ID NO: 351645 - DNA, 25 bp, Mus musculus
tagctgaggtgcggagctgacccgg

SEQ ID NO: 351646 - DNA, 25 bp, Mus musculus
tagctgatgactccgaaccaactgt

SEQ ID NO: 351647 - DNA, 25 bp, Mus musculus
tagctgcagtagaaaaagttaagaa

SEQ ID NO: 351648 - DNA, 25 bp, Mus musculus
tagctgccgctccacagtggctcca

SEQ ID NO: 351649 - DNA, 25 bp, Mus musculus
tagctgctgctaactgtgtggttta

SEQ ID NO: 351650 - DNA, 25 bp, Mus musculus
tagctgcttggaagttggcagtatc

SEQ ID NO: 351651 - DNA, 25 bp, Mus musculus
tagctggaaatgtaggtggttgtga

SEQ ID NO: 351652 - DNA, 25 bp, Mus musculus
tagctggaagagtatctgtgggagg

SEQ ID NO: 351653 - DNA, 25 bp, Mus musculus
tagctggaaggactgggcaaagcca

SEQ ID NO: 351654 - DNA, 25 bp, Mus musculus
tagctggaatgttacagaattttga

SEQ ID NO: 351655 - DNA, 25 bp, Mus musculus
tagctggactgaaggacgcagatag

SEQ ID NO: 351656 - DNA, 25 bp, Mus musculus
tagctggcaaagattttctttgagg

SEQ ID NO: 351657 - DNA, 25 bp, Mus musculus
tagctggctgaatagcctgagaaat

SEQ ID NO: 351658 - DNA, 25 bp, Mus musculus
tagctgggacctacctgaactacct

SEQ ID NO: 351659 - DNA, 25 bp, Mus musculus
tagctgggacctacgtatcacaagg

SEQ ID NO: 351660 - DNA, 25 bp, Mus musculus
tagctgggcaagatggtgtcacatt

SEQ ID NO: 351661 - DNA, 25 bp, Mus musculus
tagctgggccgggattctgaaaggc

SEQ ID NO: 351662 - DNA, 25 bp, Mus musculus
tagctggttcgaaggccatgacagt

SEQ ID NO: 351663 - DNA, 25 bp, Mus musculus
tagctggttcgaaggggctcatcct

SEQ ID NO: 351664 - DNA, 25 bp, Mus musculus
tagctgtcatggacagttacttcaa

SEQ ID NO: 351665 - DNA, 25 bp, Mus musculus
tagctgtcgggacacagattgggtg

SEQ ID NO: 351666 - DNA, 25 bp, Mus musculus
tagctgtctacgagaccctgaagaa

SEQ ID NO: 351667 - DNA, 25 bp, Mus musculus
tagctgtctatgagacattgaaaaa

SEQ ID NO: 351668 - DNA, 25 bp, Mus musculus
tagctgtctgcaatcccaaaccttg

SEQ ID NO: 351669 - DNA, 25 bp, Mus musculus
tagctgtctggtttgtggacagtct

SEQ ID NO: 351670 - DNA, 25 bp, Mus musculus
tagctgtcttactcatcagagttgt

SEQ ID NO: 351671 - DNA, 25 bp, Mus musculus
tagctgtgcaagctgacttcggaga

SEQ ID NO: 351672 - DNA, 25 bp, Mus musculus
tagctgttggccgaggtggtcctgc

SEQ ID NO: 351673 - DNA, 25 bp, Mus musculus
tagcttaatagttgaaccaagactc

SEQ ID NO: 351674 - DNA, 25 bp, Mus musculus
tagcttacatacccttcgcaggtgt

SEQ ID NO: 351675 - DNA, 25 bp, Mus musculus
tagcttcactgataaaacacggacc

SEQ ID NO: 351676 - DNA, 25 bp, Mus musculus
tagcttccaggtggtggtcctcacc

SEQ ID NO: 351677 - DNA, 25 bp, Mus musculus
tagcttcctagagaccaagatcaca

SEQ ID NO: 351678 - DNA, 25 bp, Mus musculus
tagcttcctgagagtgcccgaggcg

SEQ ID NO: 351679 - DNA, 25 bp, Mus musculus
tagcttctccctccggaaagaacaa

SEQ ID NO: 351680 - DNA, 25 bp, Mus musculus
tagcttgcatgcctgggccctggcc

SEQ ID NO: 351681 - DNA, 25 bp, Mus musculus
tagcttggtccaggaaaatggacaa

SEQ ID NO: 351682 - DNA, 25 bp, Mus musculus
tagctttccaggacaagaagatgcc

SEQ ID NO: 351683 - DNA, 25 bp, Mus musculus
tagctttgaactgataagacgcctt

SEQ ID NO: 351684 - DNA, 25 bp, Mus musculus
tagctttgaactgataatggcaaag

SEQ ID NO: 351685 - DNA, 25 bp, Mus musculus
tagctttgaagaatgaagaggaata

SEQ ID NO: 351686 - DNA, 25 bp, Mus musculus
tagctttgataaatttgaattctgt

SEQ ID NO: 351687 - DNA, 25 bp, Mus musculus
tagctttggctcttttacagacctc

SEQ ID NO: 351688 - DNA, 25 bp, Mus musculus
tagcttttatggcgcgagcttcatt

SEQ ID NO: 351689 - DNA, 25 bp, Mus musculus
tagcttttccaacgccgagatgact

SEQ ID NO: 351690 - DNA, 25 bp, Mus musculus
taggaaaaaaagtggtcatgctgcc

SEQ ID NO: 351691 - DNA, 25 bp, Mus musculus
taggaaaacaataaatgcacctgag

SEQ ID NO: 351692 - DNA, 25 bp, Mus musculus
taggaaaacagtccttcacgtcttg

SEQ ID NO: 351693 - DNA, 25 bp, Mus musculus
taggaaaaccaatggctcaccctgt

SEQ ID NO: 351694 - DNA, 25 bp, Mus musculus
taggaaacagaagagtctgaggtta

SEQ ID NO: 351695 - DNA, 25 bp, Mus musculus
taggaaacagctatataaaagaacc

SEQ ID NO: 351696 - DNA, 25 bp, Mus musculus
taggaaacagggtggactctcccag

SEQ ID NO: 351697 - DNA, 25 bp, Mus musculus
taggaaacatacagtggatgaatat

SEQ ID NO: 351698 - DNA, 25 bp, Mus musculus
taggaaagcaagggaacctagtaac

SEQ ID NO: 351699 - DNA, 25 bp, Mus musculus
taggaaataggttaaatggaatcca

SEQ ID NO: 351700 - DNA, 25 bp, Mus musculus
taggaaatgcagaccagcagaactt

SEQ ID NO: 351701 - DNA, 25 bp, Mus musculus
taggaacaaagacaggaaatctgca

SEQ ID NO: 351702 - DNA, 25 bp, Mus musculus
taggaacaaagagaacctgcaccca

SEQ ID NO: 351703 - DNA, 25 bp, Mus musculus
taggaacaaagagaccccgaggcaa

SEQ ID NO: 351704 - DNA, 25 bp, Mus musculus
taggaacaaaggtcaggtgcccatt

SEQ ID NO: 351705 - DNA, 25 bp, Mus musculus
taggaacatgatgaactttcaacca

SEQ ID NO: 351706 - DNA, 25 bp, Mus musculus
taggaacatggtgtccatcctgtcg

SEQ ID NO: 351707 - DNA, 25 bp, Mus musculus
taggaaccaaggtagcttctccata

SEQ ID NO: 351708 - DNA, 25 bp, Mus musculus
taggaacccagattttgttcctggc

SEQ ID NO: 351709 - DNA, 25 bp, Mus musculus
taggaacccgtgaggtcaatatcca

SEQ ID NO: 351710 - DNA, 25 bp, Mus musculus
taggaactgcaggacagtaatgatg

SEQ ID NO: 351711 - DNA, 25 bp, Mus musculus
taggaactgtcaggctggtctgctc

SEQ ID NO: 351712 - DNA, 25 bp, Mus musculus
taggaagaagagaatggaccgggtt

SEQ ID NO: 351713 - DNA, 25 bp, Mus musculus
taggaagaagccattgctcctgtgc

SEQ ID NO: 351714 - DNA, 25 bp, Mus musculus
taggaagaggaacacgcagcactgt

SEQ ID NO: 351715 - DNA, 25 bp, Mus musculus
taggaagcagaagatgccatactcc

SEQ ID NO: 351716 - DNA, 25 bp, Mus musculus
taggaagccagtgacgccaagagac

SEQ ID NO: 351717 - DNA, 25 bp, Mus musculus
taggaaggctcatagacagggtttc

SEQ ID NO: 351718 - DNA, 25 bp, Mus musculus
taggaaggctcataggccaaactca

SEQ ID NO: 351719 - DNA, 25 bp, Mus musculus
taggaagggaagttcttccatcagt

SEQ ID NO: 351720 - DNA, 25 bp, Mus musculus
taggaagtatattacaggattcact

SEQ ID NO: 351721 - DNA, 25 bp, Mus musculus
taggaagtatgacccacagggctct

SEQ ID NO: 351722 - DNA, 25 bp, Mus musculus
taggaagtgtgtggacatcaatgag

SEQ ID NO: 351723 - DNA, 25 bp, Mus musculus
taggaagttccgattaatggaacgg

SEQ ID NO: 351724 - DNA, 25 bp, Mus musculus
taggaatacaacttctcgccgaggg

SEQ ID NO: 351725 - DNA, 25 bp, Mus musculus
taggaatacaagagaggactagaag

SEQ ID NO: 351726 - DNA, 25 bp, Mus musculus
taggaatacaagttgactgcattca

SEQ ID NO: 351727 - DNA, 25 bp, Mus musculus
taggaatcagtggcaacagtaccat

SEQ ID NO: 351728 - DNA, 25 bp, Mus musculus
taggaatgaagaacggcccctccgg

SEQ ID NO: 351729 - DNA, 25 bp, Mus musculus
taggaatgaagatggccagctgagg

SEQ ID NO: 351730 - DNA, 25 bp, Mus musculus
taggaattgtagagaatttcttgct

SEQ ID NO: 351731 - DNA, 25 bp, Mus musculus
taggaattgtagagttgctcacaga

SEQ ID NO: 351732 - DNA, 25 bp, Mus musculus
taggaattgtagagttggctcacgt

SEQ ID NO: 351733 - DNA, 25 bp, Mus musculus
taggacaaaggtatggctttgtgga

SEQ ID NO: 351734 - DNA, 25 bp, Mus musculus
taggacacattctggtgctggagac

SEQ ID NO: 351735 - DNA, 25 bp, Mus musculus
taggacactacgaacagcacattag

SEQ ID NO: 351736 - DNA, 25 bp, Mus musculus
taggacagaaaggaagcagaggcct

SEQ ID NO: 351737 - DNA, 25 bp, Mus musculus
taggacagagatcggtaccgttgct

SEQ ID NO: 351738 - DNA, 25 bp, Mus musculus
taggacaggacggggtccctccaat

SEQ ID NO: 351739 - DNA, 25 bp, Mus musculus
taggacaggaggggaagaaaatgga

SEQ ID NO: 351740 - DNA, 25 bp, Mus musculus
taggacatacccggttacataggat

SEQ ID NO: 351741 - DNA, 25 bp, Mus musculus
taggacatctgaaagctgagcccca

SEQ ID NO: 351742 - DNA, 25 bp, Mus musculus
taggacattttccttcccgtcgaat

SEQ ID NO: 351743 - DNA, 25 bp, Mus musculus
taggaccacgagtattgttacagtc

SEQ ID NO: 351744 - DNA, 25 bp, Mus musculus
taggaccgcttatagcccaaggaac

SEQ ID NO: 351745 - DNA, 25 bp, Mus musculus
taggaccgcttataggcttggggca

SEQ ID NO: 351746 - DNA, 25 bp, Mus musculus
taggaccggaaagcgtctgcaccag

SEQ ID NO: 351747 - DNA, 25 bp, Mus musculus
taggacctcgagtataactgcaacc

SEQ ID NO: 351748 - DNA, 25 bp, Mus musculus
taggacctcggggagaaagagggaa

SEQ ID NO: 351749 - DNA, 25 bp, Mus musculus
taggacctgggatggattgtaagcg

SEQ ID NO: 351750 - DNA, 25 bp, Mus musculus
taggacggcagagaatccgtgacct

SEQ ID NO: 351751 - DNA, 25 bp, Mus musculus
taggactcagctccatgtctatccg

SEQ ID NO: 351752 - DNA, 25 bp, Mus musculus
taggactcaggtctggctgtgcatc

SEQ ID NO: 351753 - DNA, 25 bp, Mus musculus
taggactgctgatggaattgtcagc

SEQ ID NO: 351754 - DNA, 25 bp, Mus musculus
taggacttaggagtacagagactca

SEQ ID NO: 351755 - DNA, 25 bp, Mus musculus
taggactttgagctgaggctgcagc

SEQ ID NO: 351756 - DNA, 25 bp, Mus musculus
taggagaacagctcggggactttct

SEQ ID NO: 351757 - DNA, 25 bp, Mus musculus
taggagaacagctcgggtttgagtt

SEQ ID NO: 351758 - DNA, 25 bp, Mus musculus
taggagaacagggcgtggtacccac

SEQ ID NO: 351759 - DNA, 25 bp, Mus musculus
taggagaaccaaaaataatctataa

SEQ ID NO: 351760 - DNA, 25 bp, Mus musculus
taggagaaccaaacaaatgaagaag

SEQ ID NO: 351761 - DNA, 25 bp, Mus musculus
taggagaacttaggcttctttggct

SEQ ID NO: 351762 - DNA, 25 bp, Mus musculus
taggagaagcagagcactggcagat

SEQ ID NO: 351763 - DNA, 25 bp, Mus musculus
taggagaagggaaatatgctggctt

SEQ ID NO: 351764 - DNA, 25 bp, Mus musculus
taggagaagggagtaaaggtatcag

SEQ ID NO: 351765 - DNA, 25 bp, Mus musculus
taggagaatctaggcggcttcagcg

SEQ ID NO: 351766 - DNA, 25 bp, Mus musculus
taggagaatctagggctcaccatca

SEQ ID NO: 351767 - DNA, 25 bp, Mus musculus
taggagacaaggtgagccctagatt

SEQ ID NO: 351768 - DNA, 25 bp, Mus musculus
taggagacacaggtgacaaacttga

SEQ ID NO: 351769 - DNA, 25 bp, Mus musculus
taggagacacaggttttggctatgg

SEQ ID NO: 351770 - DNA, 25 bp, Mus musculus
taggagacaggtggcgacagacaag

SEQ ID NO: 351771 - DNA, 25 bp, Mus musculus
taggagacagtcagtggatacggtg

SEQ ID NO: 351772 - DNA, 25 bp, Mus musculus
taggagacgacgaagcaaacctttg

SEQ ID NO: 351773 - DNA, 25 bp, Mus musculus
taggagacgacgaagcactggggaa

SEQ ID NO: 351774 - DNA, 25 bp, Mus musculus
taggagacgacgaagtcgttctccc

SEQ ID NO: 351775 - DNA, 25 bp, Mus musculus
taggagactggacagaacgattccg

SEQ ID NO: 351776 - DNA, 25 bp, Mus musculus
taggagagattgatgctgcacctcc

SEQ ID NO: 351777 - DNA, 25 bp, Mus musculus
taggagagcagctgctgaaagacct

SEQ ID NO: 351778 - DNA, 25 bp, Mus musculus
taggagagggaaaggtctgaaaagg

SEQ ID NO: 351779 - DNA, 25 bp, Mus musculus
taggagccagaagctgactgctgcc

SEQ ID NO: 351780 - DNA, 25 bp, Mus musculus
taggagccagaaggaggctggcaag

SEQ ID NO: 351781 - DNA, 25 bp, Mus musculus
taggagccagaggaagtcacagaca

SEQ ID NO: 351782 - DNA, 25 bp, Mus musculus
taggagcggtgtcctgtgccatctc

SEQ ID NO: 351783 - DNA, 25 bp, Mus musculus
taggagctgggcttgcaggcaaggg

SEQ ID NO: 351784 - DNA, 25 bp, Mus musculus
taggagcttacgtagatgaagaact

SEQ ID NO: 351785 - DNA, 25 bp, Mus musculus
taggagcttacgtaggctccatggt

SEQ ID NO: 351786 - DNA, 25 bp, Mus musculus
taggagcttcatgggaggatccaaa

SEQ ID NO: 351787 - DNA, 25 bp, Mus musculus
taggagctttactgaagactgtttt

SEQ ID NO: 351788 - DNA, 25 bp, Mus musculus
taggagctttgttttttgccatctc

SEQ ID NO: 351789 - DNA, 25 bp, Mus musculus
taggaggaatgccctgctggaggcc

SEQ ID NO: 351790 - DNA, 25 bp, Mus musculus
taggaggaatggcctactgaaccaa

SEQ ID NO: 351791 - DNA, 25 bp, Mus musculus
taggaggagagcaattatgaagccc

SEQ ID NO: 351792 - DNA, 25 bp, Mus musculus
taggaggcacggagcacttgtctct

SEQ ID NO: 351793 - DNA, 25 bp, Mus musculus
taggaggccctggaccttggtgtga

SEQ ID NO: 351794 - DNA, 25 bp, Mus musculus
taggaggccctgttcacctctgggg

SEQ ID NO: 351795 - DNA, 25 bp, Mus musculus
taggagggattgatgctgcacctcc

SEQ ID NO: 351796 - DNA, 25 bp, Mus musculus
taggagggattgatgctgcgcctcc

SEQ ID NO: 351797 - DNA, 25 bp, Mus musculus
taggagggcagaaggaagaaaacgg

SEQ ID NO: 351798 - DNA, 25 bp, Mus musculus
taggagggctgaggtacagtcatgt

SEQ ID NO: 351799 - DNA, 25 bp, Mus musculus
taggaggggctgaggaaaggaaacc

SEQ ID NO: 351800 - DNA, 25 bp, Mus musculus
taggaggtatcttgatgtggttatt

SEQ ID NO: 351801 - DNA, 25 bp, Mus musculus
taggaggtcctaacaagacagaact

SEQ ID NO: 351802 - DNA, 25 bp, Mus musculus
taggaggttggaggctcggatggcg

SEQ ID NO: 351803 - DNA, 25 bp, Mus musculus
taggagtaaagcagtcagtggaaga

SEQ ID NO: 351804 - DNA, 25 bp, Mus musculus
taggagtaaagctgcttctaaacaa

SEQ ID NO: 351805 - DNA, 25 bp, Mus musculus
taggagtacaaaaagctgtgagtac

SEQ ID NO: 351806 - DNA, 25 bp, Mus musculus
taggagtacaaaaaggtgcatccaa

SEQ ID NO: 351807 - DNA, 25 bp, Mus musculus
taggagtccggtgagttggagtgag

SEQ ID NO: 351808 - DNA, 25 bp, Mus musculus
taggagtgtgaaaaaagtcattgaa

SEQ ID NO: 351809 - DNA, 25 bp, Mus musculus
taggagttcacagcatgaaggactt

SEQ ID NO: 351810 - DNA, 25 bp, Mus musculus
taggagttcacagcgcactgtttga

SEQ ID NO: 351811 - DNA, 25 bp, Mus musculus
taggagttgaatgcccaaaggataa

SEQ ID NO: 351812 - DNA, 25 bp, Mus musculus
taggataacaggtccagttgtccct

SEQ ID NO: 351813 - DNA, 25 bp, Mus musculus
taggataacagtgacgtatgacttc

SEQ ID NO: 351814 - DNA, 25 bp, Mus musculus
taggatacaggtgccctagctgtgc

SEQ ID NO: 351815 - DNA, 25 bp, Mus musculus
taggatattgtgtagaatatatttg

SEQ ID NO: 351816 - DNA, 25 bp, Mus musculus
taggatcagcatagaagctgcgttg

SEQ ID NO: 351817 - DNA, 25 bp, Mus musculus
taggatcagcataggatcaagtaga

SEQ ID NO: 351818 - DNA, 25 bp, Mus musculus
taggatcatggggtactcaatgcag

SEQ ID NO: 351819 - DNA, 25 bp, Mus musculus
taggatcatgggttcctcggcctct

SEQ ID NO: 351820 - DNA, 25 bp, Mus musculus
taggatccctggagtccctggctcc

SEQ ID NO: 351821 - DNA, 25 bp, Mus musculus
taggatcgagatcccgctcaaggtc

SEQ ID NO: 351822 - DNA, 25 bp, Mus musculus
taggatctacaggtgaaagagctgg

SEQ ID NO: 351823 - DNA, 25 bp, Mus musculus
taggatcttctagtgaacagcgtca

SEQ ID NO: 351824 - DNA, 25 bp, Mus musculus
taggatgcagggcattttcccgact

SEQ ID NO: 351825 - DNA, 25 bp, Mus musculus
taggatgcaggggtctcactgtgta

SEQ ID NO: 351826 - DNA, 25 bp, Mus musculus
taggatgcgatacaaatctcaaaca

SEQ ID NO: 351827 - DNA, 25 bp, Mus musculus
taggatgcgatgccctgtggaatcc

SEQ ID NO: 351828 - DNA, 25 bp, Mus musculus
taggatgctacggaggtgccttagc

SEQ ID NO: 351829 - DNA, 25 bp, Mus musculus
taggatgctggacgctggatcgcgg

SEQ ID NO: 351830 - DNA, 25 bp, Mus musculus
taggatgcttcctttctagtgagtg

SEQ ID NO: 351831 - DNA, 25 bp, Mus musculus
taggatgtaggtgaattatacttca

SEQ ID NO: 351832 - DNA, 25 bp, Mus musculus
taggatgtttaacagtattgcagaa

SEQ ID NO: 351833 - DNA, 25 bp, Mus musculus
taggatgtttcctgagatgtaaaga

SEQ ID NO: 351834 - DNA, 25 bp, Mus musculus
taggatgtttcctgaggctactgaa

SEQ ID NO: 351835 - DNA, 25 bp, Mus musculus
taggatgtttcctgtctagtgagtg

SEQ ID NO: 351836 - DNA, 25 bp, Mus musculus
taggatgtttcctgtctggtgagtg

SEQ ID NO: 351837 - DNA, 25 bp, Mus musculus
taggattaccgaaggcaaatggaaa

SEQ ID NO: 351838 - DNA, 25 bp, Mus musculus
taggattatagatcctggcagccac

SEQ ID NO: 351839 - DNA, 25 bp, Mus musculus
taggattccaggagtccctggctcc

SEQ ID NO: 351840 - DNA, 25 bp, Mus musculus
taggattgcagcacctaccctcagg

SEQ ID NO: 351841 - DNA, 25 bp, Mus musculus
taggatttcagtttacccatcatgg

SEQ ID NO: 351842 - DNA, 25 bp, Mus musculus
taggatttgttgtggctttttaaag

SEQ ID NO: 351843 - DNA, 25 bp, Mus musculus
taggcaagggaaggacatttggatc

SEQ ID NO: 351844 - DNA, 25 bp, Mus musculus
taggcacaaggatactgagaactca

SEQ ID NO: 351845 - DNA, 25 bp, Mus musculus
taggcacatacccaggatcaaaacc

SEQ ID NO: 351846 - DNA, 25 bp, Mus musculus
taggcacatacccaggttgctgcct

SEQ ID NO: 351847 - DNA, 25 bp, Mus musculus
taggcaccagtctgcgttaagcatc

SEQ ID NO: 351848 - DNA, 25 bp, Mus musculus
taggcacgtgtgggatctttctcaa

SEQ ID NO: 351849 - DNA, 25 bp, Mus musculus
taggcagaagggaactgagccgtgg

SEQ ID NO: 351850 - DNA, 25 bp, Mus musculus
taggcagatccggcgaatacaggag

SEQ ID NO: 351851 - DNA, 25 bp, Mus musculus
taggcagcatgtctgatgaaagtga

SEQ ID NO: 351852 - DNA, 25 bp, Mus musculus
taggcagcatttccagacagtcatc

SEQ ID NO: 351853 - DNA, 25 bp, Mus musculus
taggcagtgtccatgctcttttgtg

SEQ ID NO: 351854 - DNA, 25 bp, Mus musculus
taggcatcgagggcttcttcggctt

SEQ ID NO: 351855 - DNA, 25 bp, Mus musculus
taggcatgccgggtggctttgctga

SEQ ID NO: 351856 - DNA, 25 bp, Mus musculus
taggcattaaacaggacattcacct

SEQ ID NO: 351857 - DNA, 25 bp, Mus musculus
taggccaaaaagagcttggacagag

SEQ ID NO: 351858 - DNA, 25 bp, Mus musculus
taggccaaaaagagtgtgcaaagac

SEQ ID NO: 351859 - DNA, 25 bp, Mus musculus
taggccagagtgggtcatctctgag

SEQ ID NO: 351860 - DNA, 25 bp, Mus musculus
taggccagagtggtggttcccgacc

SEQ ID NO: 351861 - DNA, 25 bp, Mus musculus
taggccagcctggtctccgttatga

SEQ ID NO: 351862 - DNA, 25 bp, Mus musculus
taggcccaaagctctacagactcag

SEQ ID NO: 351863 - DNA, 25 bp, Mus musculus
taggcccaaaggtacagagatgttg

SEQ ID NO: 351864 - DNA, 25 bp, Mus musculus
taggcccaaaggtgttctacactca

SEQ ID NO: 351865 - DNA, 25 bp, Mus musculus
taggccctattggagaccctgggaa

SEQ ID NO: 351866 - DNA, 25 bp, Mus musculus
taggccctcagatcaatgatgatgt

SEQ ID NO: 351867 - DNA, 25 bp, Mus musculus
taggccgcgcgcggggtgctgtgag

SEQ ID NO: 351868 - DNA, 25 bp, Mus musculus
taggccgcggaggtcacaggctctg

SEQ ID NO: 351869 - DNA, 25 bp, Mus musculus
taggcctcaactataagtcttgctt

SEQ ID NO: 351870 - DNA, 25 bp, Mus musculus
taggcctccaggaggaccttgttga

SEQ ID NO: 351871 - DNA, 25 bp, Mus musculus
taggcctccaggaggagactcccat

SEQ ID NO: 351872 - DNA, 25 bp, Mus musculus
taggcctcgtctaggtgccgcccca

SEQ ID NO: 351873 - DNA, 25 bp, Mus musculus
taggcctgagacttccttaccgagc

SEQ ID NO: 351874 - DNA, 25 bp, Mus musculus
taggccttctatagcccgtgtgatt

SEQ ID NO: 351875 - DNA, 25 bp, Mus musculus
taggccttctataggcctctgctcg

SEQ ID NO: 351876 - DNA, 25 bp, Mus musculus
taggccttctatagtgagattatat

SEQ ID NO: 351877 - DNA, 25 bp, Mus musculus
taggcgaatgatcagatgagaggct

SEQ ID NO: 351878 - DNA, 25 bp, Mus musculus
taggcgaggttcaagtagtatcttt

SEQ ID NO: 351879 - DNA, 25 bp, Mus musculus
taggcgctccccgaggtgtgaatga

SEQ ID NO: 351880 - DNA, 25 bp, Mus musculus
taggcgctcgggaaggctcctcgcc

SEQ ID NO: 351881 - DNA, 25 bp, Mus musculus
taggcgctcgggaaggcttttgacc

SEQ ID NO: 351882 - DNA, 25 bp, Mus musculus
taggcggacaggagatgaccggttc

SEQ ID NO: 351883 - DNA, 25 bp, Mus musculus
taggcggatcaaccccccttaagac

SEQ ID NO: 351884 - DNA, 25 bp, Mus musculus
taggcggatcaagatcagtataact

SEQ ID NO: 351885 - DNA, 25 bp, Mus musculus
taggcgggaggtgtttctgtttgag

SEQ ID NO: 351886 - DNA, 25 bp, Mus musculus
taggcgtgcagataaagggagaaga

SEQ ID NO: 351887 - DNA, 25 bp, Mus musculus
taggcgtgcagtgggagatttttca

SEQ ID NO: 351888 - DNA, 25 bp, Mus musculus
taggctaacgaggacgtctgcctgg

SEQ ID NO: 351889 - DNA, 25 bp, Mus musculus
taggctaccggtgatggtgtggatc

SEQ ID NO: 351890 - DNA, 25 bp, Mus musculus
taggctataaagagcaaaacaattg

SEQ ID NO: 351891 - DNA, 25 bp, Mus musculus
taggctatgcaagggctacagagcc

SEQ ID NO: 351892 - DNA, 25 bp, Mus musculus
taggctcagaggctgatggtgaccg

SEQ ID NO: 351893 - DNA, 25 bp, Mus musculus
taggctcccgagttctacacagctg

SEQ ID NO: 351894 - DNA, 25 bp, Mus musculus
taggctccgaggtggcgaaatggat

SEQ ID NO: 351895 - DNA, 25 bp, Mus musculus
taggctgaagctcggaaacaagctc

SEQ ID NO: 351896 - DNA, 25 bp, Mus musculus
taggctgagaacggaaacctccaca

SEQ ID NO: 351897 - DNA, 25 bp, Mus musculus
taggctgaggccaggtctcttaacc

SEQ ID NO: 351898 - DNA, 25 bp, Mus musculus
taggctgccaatcaacaatgtgccc

SEQ ID NO: 351899 - DNA, 25 bp, Mus musculus
taggctgcgatgggtggatgagagg

SEQ ID NO: 351900 - DNA, 25 bp, Mus musculus
taggctggccgcaggctggcaacat

SEQ ID NO: 351901 - DNA, 25 bp, Mus musculus
taggctgtaagctgtacttcttcca

SEQ ID NO: 351902 - DNA, 25 bp, Mus musculus
taggcttgcttgttggtgattgtat

SEQ ID NO: 351903 - DNA, 25 bp, Mus musculus
taggctttgccaatgctcagcagag

SEQ ID NO: 351904 - DNA, 25 bp, Mus musculus
taggcttttggccactcttggggat

SEQ ID NO: 351905 - DNA, 25 bp, Mus musculus
tagggaaagagacagcacggcggct

SEQ ID NO: 351906 - DNA, 25 bp, Mus musculus
tagggaaagagataacagcagacag

SEQ ID NO: 351907 - DNA, 25 bp, Mus musculus
tagggaaataattgttgcttgtgcc

SEQ ID NO: 351908 - DNA, 25 bp, Mus musculus
tagggaacagacactctccccgacc

SEQ ID NO: 351909 - DNA, 25 bp, Mus musculus
tagggaacgggagagtggccttgtg

SEQ ID NO: 351910 - DNA, 25 bp, Mus musculus
tagggaagaaagtgtctggactctc

SEQ ID NO: 351911 - DNA, 25 bp, Mus musculus
tagggaagaagaagcccagggtgct

SEQ ID NO: 351912 - DNA, 25 bp, Mus musculus
tagggaagcacttcaccagtaaaaa

SEQ ID NO: 351913 - DNA, 25 bp, Mus musculus
tagggaatgaaaggtgatgaagtct

SEQ ID NO: 351914 - DNA, 25 bp, Mus musculus
tagggacaagtcactgttctgggag

SEQ ID NO: 351915 - DNA, 25 bp, Mus musculus
tagggacagctggttccgtggcttc

SEQ ID NO: 351916 - DNA, 25 bp, Mus musculus
tagggaccaaggaagctcgaagcgg

SEQ ID NO: 351917 - DNA, 25 bp, Mus musculus
tagggagaggagccgccgccatgtc

SEQ ID NO: 351918 - DNA, 25 bp, Mus musculus
tagggagaggagccgcctgtccacg

SEQ ID NO: 351919 - DNA, 25 bp, Mus musculus
tagggagccgtgtggagcaaaaata

SEQ ID NO: 351920 - DNA, 25 bp, Mus musculus
tagggaggaagcacctctgggagcc

SEQ ID NO: 351921 - DNA, 25 bp, Mus musculus
tagggagtcgcgaggaggaaagcga

SEQ ID NO: 351922 - DNA, 25 bp, Mus musculus
tagggagtgtgacagtgattggaag

SEQ ID NO: 351923 - DNA, 25 bp, Mus musculus
tagggatgtgatgctctttctcatc

SEQ ID NO: 351924 - DNA, 25 bp, Mus musculus
tagggatttgctggttttaggctag

SEQ ID NO: 351925 - DNA, 25 bp, Mus musculus
tagggcacaggtatattgaaatatt

SEQ ID NO: 351926 - DNA, 25 bp, Mus musculus
tagggcagaatatgcagacagacat

SEQ ID NO: 351927 - DNA, 25 bp, Mus musculus
tagggcagatctggtattcttttgg

SEQ ID NO: 351928 - DNA, 25 bp, Mus musculus
tagggccggacaggattgtggaatt

SEQ ID NO: 351929 - DNA, 25 bp, Mus musculus
tagggccggacagtgtctcgttcga

SEQ ID NO: 351930 - DNA, 25 bp, Mus musculus
tagggcctgcaggtctacagtgctg

SEQ ID NO: 351931 - DNA, 25 bp, Mus musculus
tagggcctttttcctatattgttga

SEQ ID NO: 351932 - DNA, 25 bp, Mus musculus
tagggctctgcaggaagcctgctga

SEQ ID NO: 351933 - DNA, 25 bp, Mus musculus
tagggctggagctgaggagattatt

SEQ ID NO: 351934 - DNA, 25 bp, Mus musculus
tagggctgggggagtccagggccgc

SEQ ID NO: 351935 - DNA, 25 bp, Mus musculus
taggggaatctccgaaatcccgcaa

SEQ ID NO: 351936 - DNA, 25 bp, Mus musculus
taggggaatctccggtcccgcacac

SEQ ID NO: 351937 - DNA, 25 bp, Mus musculus
taggggagaagcagaccatggtgaa

SEQ ID NO: 351938 - DNA, 25 bp, Mus musculus
taggggagcagccctggctgtcctg

SEQ ID NO: 351939 - DNA, 25 bp, Mus musculus
taggggagcagggcatgaatctttc

SEQ ID NO: 351940 - DNA, 25 bp, Mus musculus
taggggaggcgagagttccagaaac

SEQ ID NO: 351941 - DNA, 25 bp, Mus musculus
taggggatggtgatgaacgagaccg

SEQ ID NO: 351942 - DNA, 25 bp, Mus musculus
taggggcccaggtggacaacatcag

SEQ ID NO: 351943 - DNA, 25 bp, Mus musculus
taggggcccataacgtgtttcatcc

SEQ ID NO: 351944 - DNA, 25 bp, Mus musculus
taggggcgaggcacccaagcagtga

SEQ ID NO: 351945 - DNA, 25 bp, Mus musculus
taggggctacctcacttacatcaca

SEQ ID NO: 351946 - DNA, 25 bp, Mus musculus
taggggctcggcaggttcgcttatc

SEQ ID NO: 351947 - DNA, 25 bp, Mus musculus
taggggcttggcaaatggaatctat

SEQ ID NO: 351948 - DNA, 25 bp, Mus musculus
tagggggacagtgaggggacgatcc

SEQ ID NO: 351949 - DNA, 25 bp, Mus musculus
tagggggcaagcggttcagtacctc

SEQ ID NO: 351950 - DNA, 25 bp, Mus musculus
tagggggcctatacgctgcctggct

SEQ ID NO: 351951 - DNA, 25 bp, Mus musculus
tagggggggatctgatggatacgga

SEQ ID NO: 351952 - DNA, 25 bp, Mus musculus
taggggtaaagatctaagctggaac

SEQ ID NO: 351953 - DNA, 25 bp, Mus musculus
taggggtcaggctccttccgatgag

SEQ ID NO: 351954 - DNA, 25 bp, Mus musculus
taggggtggaagccccaggcctggt

SEQ ID NO: 351955 - DNA, 25 bp, Mus musculus
taggggtgggagatccgaattcgag

SEQ ID NO: 351956 - DNA, 25 bp, Mus musculus
taggggtggtgacgtgctgtgtgac

SEQ ID NO: 351957 - DNA, 25 bp, Mus musculus
tagggtagaaaaaagatgacctcaa

SEQ ID NO: 351958 - DNA, 25 bp, Mus musculus
tagggtagttaaagagggctgtcct

SEQ ID NO: 351959 - DNA, 25 bp, Mus musculus
tagggtccacatggtgatatcatgg

SEQ ID NO: 351960 - DNA, 25 bp, Mus musculus
tagggtggcggggccctccatgatg

SEQ ID NO: 351961 - DNA, 25 bp, Mus musculus
tagggtgtcttctaatgttctgatg

SEQ ID NO: 351962 - DNA, 25 bp, Mus musculus
tagggttaaaggagacattccaaat

SEQ ID NO: 351963 - DNA, 25 bp, Mus musculus
tagggttcaggaggggtgagtcaga

SEQ ID NO: 351964 - DNA, 25 bp, Mus musculus
taggtaaatgagatcatgattctgg

SEQ ID NO: 351965 - DNA, 25 bp, Mus musculus
taggtaccacaggtaatctagctgc

SEQ ID NO: 351966 - DNA, 25 bp, Mus musculus
taggtaggctcagagtgcgatgcgg

SEQ ID NO: 351967 - DNA, 25 bp, Mus musculus
taggtaggctcagagttcgaggaag

SEQ ID NO: 351968 - DNA, 25 bp, Mus musculus
taggtataatggcctcggccctgcg

SEQ ID NO: 351969 - DNA, 25 bp, Mus musculus
taggtatatgactcaattctacggt

SEQ ID NO: 351970 - DNA, 25 bp, Mus musculus
taggtatcagggtggactcagtact

SEQ ID NO: 351971 - DNA, 25 bp, Mus musculus
taggtatgggagaacagaacactga

SEQ ID NO: 351972 - DNA, 25 bp, Mus musculus
taggtcagcgaggtattgaagcccc

SEQ ID NO: 351973 - DNA, 25 bp, Mus musculus
taggtcagtcattgggaagactctt

SEQ ID NO: 351974 - DNA, 25 bp, Mus musculus
taggtcccgagaaacattccagagt

SEQ ID NO: 351975 - DNA, 25 bp, Mus musculus
taggtcccgagaaagattccagagt

SEQ ID NO: 351976 - DNA, 25 bp, Mus musculus
taggtcccgtacccacatcacagct

SEQ ID NO: 351977 - DNA, 25 bp, Mus musculus
taggtccgccggtttcaacctcttg

SEQ ID NO: 351978 - DNA, 25 bp, Mus musculus
taggtccggagttcgtgcctccgga

SEQ ID NO: 351979 - DNA, 25 bp, Mus musculus
taggtcctacagctataggccgtac

SEQ ID NO: 351980 - DNA, 25 bp, Mus musculus
taggtcgctgatctgccaggatcct

SEQ ID NO: 351981 - DNA, 25 bp, Mus musculus
taggtcgctgcacacagggccagag

SEQ ID NO: 351982 - DNA, 25 bp, Mus musculus
taggtctgcccctgcctaagcctga

SEQ ID NO: 351983 - DNA, 25 bp, Mus musculus
taggtgacaaggaaggagctttgac

SEQ ID NO: 351984 - DNA, 25 bp, Mus musculus
taggtgattccaccagtggacagag

SEQ ID NO: 351985 - DNA, 25 bp, Mus musculus
taggtgccaagagggagctccgctt

SEQ ID NO: 351986 - DNA, 25 bp, Mus musculus
taggtgccagattgacgtgttgtat

SEQ ID NO: 351987 - DNA, 25 bp, Mus musculus
taggtgccaggttggctgatgttag

SEQ ID NO: 351988 - DNA, 25 bp, Mus musculus
taggtgccctgcgggcttcgagggt

SEQ ID NO: 351989 - DNA, 25 bp, Mus musculus
taggtgcgcccaggccaaacagtgg

SEQ ID NO: 351990 - DNA, 25 bp, Mus musculus
taggtggaagtcttctatgagtgct

SEQ ID NO: 351991 - DNA, 25 bp, Mus musculus
taggtgtaagcccatctgctggcaa

SEQ ID NO: 351992 - DNA, 25 bp, Mus musculus
taggtgtggccttgcaaagctgttg

SEQ ID NO: 351993 - DNA, 25 bp, Mus musculus
taggtgttccctgctgctctcaagg

SEQ ID NO: 351994 - DNA, 25 bp, Mus musculus
taggttcccttgagacaccagagaa

SEQ ID NO: 351995 - DNA, 25 bp, Mus musculus
taggttctcaggctattgatacaga

SEQ ID NO: 351996 - DNA, 25 bp, Mus musculus
taggttctgggaagtgcgaaatcaa

SEQ ID NO: 351997 - DNA, 25 bp, Mus musculus
taggttgacgtgattgtgaataccc

SEQ ID NO: 351998 - DNA, 25 bp, Mus musculus
taggttgcagacagtaaccagtttt

SEQ ID NO: 351999 - DNA, 25 bp, Mus musculus
taggttgtcagcgggtgactttgca

SEQ ID NO: 352000 - DNA, 25 bp, Mus musculus
taggtttaatatttcagcagtgtga

SEQ ID NO: 352001 - DNA, 25 bp, Mus musculus
taggtttgcagatgatacgtatacg

SEQ ID NO: 352002 - DNA, 25 bp, Mus musculus
taggtttgcatgggacacagcaggc

SEQ ID NO: 352003 - DNA, 25 bp, Mus musculus
taggtttgtagtgagcttagcctac

SEQ ID NO: 352004 - DNA, 25 bp, Mus musculus
tagtaaaacttacctcactgtggac

SEQ ID NO: 352005 - DNA, 25 bp, Mus musculus
tagtaaaatggaaggtgtcttgctg

SEQ ID NO: 352006 - DNA, 25 bp, Mus musculus
tagtaaagaatccagaaacttggaa

SEQ ID NO: 352007 - DNA, 25 bp, Mus musculus
tagtaaatgaaggctggagccagtt

SEQ ID NO: 352008 - DNA, 25 bp, Mus musculus
tagtaacctttaggtcttgctaggt

SEQ ID NO: 352009 - DNA, 25 bp, Mus musculus
tagtaactcaaaaagcagcctttac

SEQ ID NO: 352010 - DNA, 25 bp, Mus musculus
tagtaagagaacaaattgaaatgga

SEQ ID NO: 352011 - DNA, 25 bp, Mus musculus
tagtaagagtttgatacgaacagaa

SEQ ID NO: 352012 - DNA, 25 bp, Mus musculus
tagtaagcatgtgtcatggctccga

SEQ ID NO: 352013 - DNA, 25 bp, Mus musculus
tagtaattccctctgacaaaaggct

SEQ ID NO: 352014 - DNA, 25 bp, Mus musculus
tagtaccatgcaggcgagacttcag

SEQ ID NO: 352015 - DNA, 25 bp, Mus musculus
tagtaccatgcagggttctgaggag

SEQ ID NO: 352016 - DNA, 25 bp, Mus musculus
tagtacgaaggcaaggcgacccctc

SEQ ID NO: 352017 - DNA, 25 bp, Mus musculus
tagtactagtgaggccacaggcagg

SEQ ID NO: 352018 - DNA, 25 bp, Mus musculus
tagtactcattctgaatctagtaag

SEQ ID NO: 352019 - DNA, 25 bp, Mus musculus
tagtactcattcttcttttagctct

SEQ ID NO: 352020 - DNA, 25 bp, Mus musculus
tagtactccctccagacatggaccc

SEQ ID NO: 352021 - DNA, 25 bp, Mus musculus
tagtactggaaggaaggtgcacact

SEQ ID NO: 352022 - DNA, 25 bp, Mus musculus
tagtacttttttggttatgggcaaa

SEQ ID NO: 352023 - DNA, 25 bp, Mus musculus
tagtagaagagaaaactctctactt

SEQ ID NO: 352024 - DNA, 25 bp, Mus musculus
tagtagacaagggagcatatgcagg

SEQ ID NO: 352025 - DNA, 25 bp, Mus musculus
tagtagagaaccccaggcacggcca

SEQ ID NO: 352026 - DNA, 25 bp, Mus musculus
tagtagagaagtgattgtgaagcca

SEQ ID NO: 352027 - DNA, 25 bp, Mus musculus
tagtagagaagtgcctagacaagta

SEQ ID NO: 352028 - DNA, 25 bp, Mus musculus
tagtagcagaggtaactcagcaact

SEQ ID NO: 352029 - DNA, 25 bp, Mus musculus
tagtagccatgatggttactaactt

SEQ ID NO: 352030 - DNA, 25 bp, Mus musculus
tagtagcttccaggtggtggtcctc

SEQ ID NO: 352031 - DNA, 25 bp, Mus musculus
tagtaggaagggcatttgtgtactt

SEQ ID NO: 352032 - DNA, 25 bp, Mus musculus
tagtaggcactgatattcgagactc

SEQ ID NO: 352033 - DNA, 25 bp, Mus musculus
tagtagtgacaggacactactggac

SEQ ID NO: 352034 - DNA, 25 bp, Mus musculus
tagtagtgttccctgacgctgccgg

SEQ ID NO: 352035 - DNA, 25 bp, Mus musculus
tagtagtgttccctgggttctgcag

SEQ ID NO: 352036 - DNA, 25 bp, Mus musculus
tagtatcaaaacttctctattctcg

SEQ ID NO: 352037 - DNA, 25 bp, Mus musculus
tagtatgaaagcaaggccagaagtc

SEQ ID NO: 352038 - DNA, 25 bp, Mus musculus
tagtattaaagataatcaaatacaa

SEQ ID NO: 352039 - DNA, 25 bp, Mus musculus
tagtattaagtgcgtaatagcttgg

SEQ ID NO: 352040 - DNA, 25 bp, Mus musculus
tagtattccaggaaaagatggcatc

SEQ ID NO: 352041 - DNA, 25 bp, Mus musculus
tagtattgcatatagtcctgatggg

SEQ ID NO: 352042 - DNA, 25 bp, Mus musculus
tagtatttaagaaaagtgagaggca

SEQ ID NO: 352043 - DNA, 25 bp, Mus musculus
tagtatttccaactttcactcagtg

SEQ ID NO: 352044 - DNA, 25 bp, Mus musculus
tagtatttccaagtttcactcagtg

SEQ ID NO: 352045 - DNA, 25 bp, Mus musculus
tagtcaacaacagggaaagaaggca

SEQ ID NO: 352046 - DNA, 25 bp, Mus musculus
tagtcaatgggccacgtctaaagag

SEQ ID NO: 352047 - DNA, 25 bp, Mus musculus
tagtcacaggtgtagcttactacca

SEQ ID NO: 352048 - DNA, 25 bp, Mus musculus
tagtcacaggtgtagggcagaggag

SEQ ID NO: 352049 - DNA, 25 bp, Mus musculus
tagtcacaggtgtaggggttgtgct

SEQ ID NO: 352050 - DNA, 25 bp, Mus musculus
tagtcaccagtgccagcggattgaa

SEQ ID NO: 352051 - DNA, 25 bp, Mus musculus
tagtcaccatcctgtcctactgtgt

SEQ ID NO: 352052 - DNA, 25 bp, Mus musculus
tagtcacccagacctggagcctgtt

SEQ ID NO: 352053 - DNA, 25 bp, Mus musculus
tagtcactaaggagatgttagatgt

SEQ ID NO: 352054 - DNA, 25 bp, Mus musculus
tagtcactgggaggtgtccctgtat

SEQ ID NO: 352055 - DNA, 25 bp, Mus musculus
tagtcagactcaagcaagacctgca

SEQ ID NO: 352056 - DNA, 25 bp, Mus musculus
tagtcagcttgtctggaacctctca

SEQ ID NO: 352057 - DNA, 25 bp, Mus musculus
tagtcagtaagctgtggtgtacctg

SEQ ID NO: 352058 - DNA, 25 bp, Mus musculus
tagtcatctgcgaacacgactcctt

SEQ ID NO: 352059 - DNA, 25 bp, Mus musculus
tagtcattataacaggtgagacgac

SEQ ID NO: 352060 - DNA, 25 bp, Mus musculus
tagtcattttcatgatcacaaaatt

SEQ ID NO: 352061 - DNA, 25 bp, Mus musculus
tagtccaacagaaagcaaagatatc

SEQ ID NO: 352062 - DNA, 25 bp, Mus musculus
tagtccaacagagaatgaagcactc

SEQ ID NO: 352063 - DNA, 25 bp, Mus musculus
tagtccaacaggtgactgttcagaa

SEQ ID NO: 352064 - DNA, 25 bp, Mus musculus
tagtccaacatcttcagcaaacgac

SEQ ID NO: 352065 - DNA, 25 bp, Mus musculus
tagtccactgcattgaacagcgtct

SEQ ID NO: 352066 - DNA, 25 bp, Mus musculus
tagtccagcagactgatacctccga

SEQ ID NO: 352067 - DNA, 25 bp, Mus musculus
tagtcccagaacagatcgggaagct

SEQ ID NO: 352068 - DNA, 25 bp, Mus musculus
tagtcccagcgagatggagttgcta

SEQ ID NO: 352069 - DNA, 25 bp, Mus musculus
tagtcccagtggaagcaccagccta

SEQ ID NO: 352070 - DNA, 25 bp, Mus musculus
tagtccccaaggactttctgagccc

SEQ ID NO: 352071 - DNA, 25 bp, Mus musculus
tagtccccagcaagcaagaggaggc

SEQ ID NO: 352072 - DNA, 25 bp, Mus musculus
tagtccgagccgccatgggctgcct

SEQ ID NO: 352073 - DNA, 25 bp, Mus musculus
tagtccgcagacccccaggaaacac

SEQ ID NO: 352074 - DNA, 25 bp, Mus musculus
tagtcctcagaactgtggacctcca

SEQ ID NO: 352075 - DNA, 25 bp, Mus musculus
tagtcctcagaggccagttgttgct

SEQ ID NO: 352076 - DNA, 25 bp, Mus musculus
tagtcctccatgatcgtcctgcttc

SEQ ID NO: 352077 - DNA, 25 bp, Mus musculus
tagtcctggcaggactttcctggaa

SEQ ID NO: 352078 - DNA, 25 bp, Mus musculus
tagtcctgggaaaggtgtggtatct

SEQ ID NO: 352079 - DNA, 25 bp, Mus musculus
tagtccttgtgaggcccagcctcgt

SEQ ID NO: 352080 - DNA, 25 bp, Mus musculus
tagtccttttcagacccgggtcggt

SEQ ID NO: 352081 - DNA, 25 bp, Mus musculus
tagtcgataaggttgaaagacacac

SEQ ID NO: 352082 - DNA, 25 bp, Mus musculus
tagtcgcagaactgcactggcgtct

SEQ ID NO: 352083 - DNA, 25 bp, Mus musculus
tagtctagaaaacataggagacagc

SEQ ID NO: 352084 - DNA, 25 bp, Mus musculus
tagtctagaaaacgctaatctttct

SEQ ID NO: 352085 - DNA, 25 bp, Mus musculus
tagtctcagaggatagctctctaca

SEQ ID NO: 352086 - DNA, 25 bp, Mus musculus
tagtctcattttaaggccctgtggt

SEQ ID NO: 352087 - DNA, 25 bp, Mus musculus
tagtctctaggatgctccagacctt

SEQ ID NO: 352088 - DNA, 25 bp, Mus musculus
tagtctctgcaagtggccctgccgc

SEQ ID NO: 352089 - DNA, 25 bp, Mus musculus
tagtctggggggtcagcagccttat

SEQ ID NO: 352090 - DNA, 25 bp, Mus musculus
tagtctggtcagatagttttgagat

SEQ ID NO: 352091 - DNA, 25 bp, Mus musculus
tagtctttcagatcctgcctcagag

SEQ ID NO: 352092 - DNA, 25 bp, Mus musculus
tagtctttctaacagagaagaatat

SEQ ID NO: 352093 - DNA, 25 bp, Mus musculus
tagtctttggacctccctccaactc

SEQ ID NO: 352094 - DNA, 25 bp, Mus musculus
tagtcttttacccagtagagatgaa

SEQ ID NO: 352095 - DNA, 25 bp, Mus musculus
tagtgaaaagctgcagcaatacccg

SEQ ID NO: 352096 - DNA, 25 bp, Mus musculus
tagtgaacgagccacctcccaagct

SEQ ID NO: 352097 - DNA, 25 bp, Mus musculus
tagtgaactgaatgtgtttcctttg

SEQ ID NO: 352098 - DNA, 25 bp, Mus musculus
tagtgaagattcaggcttgttcccc

SEQ ID NO: 352099 - DNA, 25 bp, Mus musculus
tagtgaagctatgccattgtgcggg

SEQ ID NO: 352100 - DNA, 25 bp, Mus musculus
tagtgaagctccttggcgagcaata

SEQ ID NO: 352101 - DNA, 25 bp, Mus musculus
tagtgaaggggcagtctgtccatca

SEQ ID NO: 352102 - DNA, 25 bp, Mus musculus
tagtgaccagatactgttaaagcac

SEQ ID NO: 352103 - DNA, 25 bp, Mus musculus
tagtgaccagatggttcagaacttt

SEQ ID NO: 352104 - DNA, 25 bp, Mus musculus
tagtgaccaggatcgactgcgggct

SEQ ID NO: 352105 - DNA, 25 bp, Mus musculus
tagtgaccagtaaaaggtacttttc

SEQ ID NO: 352106 - DNA, 25 bp, Mus musculus
tagtgaccatggtggtgatgaccat

SEQ ID NO: 352107 - DNA, 25 bp, Mus musculus
tagtgacctgacgttgatgtcagtg

SEQ ID NO: 352108 - DNA, 25 bp, Mus musculus
tagtgacctgactcctgggtgccag

SEQ ID NO: 352109 - DNA, 25 bp, Mus musculus
tagtgacctggaaagtgtctttgcc

SEQ ID NO: 352110 - DNA, 25 bp, Mus musculus
tagtgactcctttcccaacactatg

SEQ ID NO: 352111 - DNA, 25 bp, Mus musculus
tagtgactgaaaaagttccaccagg

SEQ ID NO: 352112 - DNA, 25 bp, Mus musculus
tagtgactggaggattctgtaccca

SEQ ID NO: 352113 - DNA, 25 bp, Mus musculus
tagtgactggggaattgatgtccga

SEQ ID NO: 352114 - DNA, 25 bp, Mus musculus
tagtgagaccggaccagctccccat

SEQ ID NO: 352115 - DNA, 25 bp, Mus musculus
tagtgagacctgcgacaacaacggg

SEQ ID NO: 352116 - DNA, 25 bp, Mus musculus
tagtgagtttcccccacttacagac

SEQ ID NO: 352117 - DNA, 25 bp, Mus musculus
tagtgataagcaccctgtgacctgg

SEQ ID NO: 352118 - DNA, 25 bp, Mus musculus
tagtgatcaggagaataatgttttt

SEQ ID NO: 352119 - DNA, 25 bp, Mus musculus
tagtgatgctgcgaagctgatggtg

SEQ ID NO: 352120 - DNA, 25 bp, Mus musculus
tagtgatggggcagaagaaactctt

SEQ ID NO: 352121 - DNA, 25 bp, Mus musculus
tagtgattgtaagaatgaagatatc

SEQ ID NO: 352122 - DNA, 25 bp, Mus musculus
tagtgattgtaatctacttttttac

SEQ ID NO: 352123 - DNA, 25 bp, Mus musculus
tagtgcaacccgtggcagtcaagct

SEQ ID NO: 352124 - DNA, 25 bp, Mus musculus
tagtgcagcttgagtagcttatcta

SEQ ID NO: 352125 - DNA, 25 bp, Mus musculus
tagtgcagcttggagtggatttgtc

SEQ ID NO: 352126 - DNA, 25 bp, Mus musculus
tagtgcaggaaacttcgcggctcag

SEQ ID NO: 352127 - DNA, 25 bp, Mus musculus
tagtgcagtaagtctggagccaatt

SEQ ID NO: 352128 - DNA, 25 bp, Mus musculus
tagtgcatgagtttccagatccaga

SEQ ID NO: 352129 - DNA, 25 bp, Mus musculus
tagtgcattagcctgccaccaccac

SEQ ID NO: 352130 - DNA, 25 bp, Mus musculus
tagtgcccctcaggcggtgctatac

SEQ ID NO: 352131 - DNA, 25 bp, Mus musculus
tagtgcgtacagaagaactcctggc

SEQ ID NO: 352132 - DNA, 25 bp, Mus musculus
tagtgcgtacagagaacttaccgat

SEQ ID NO: 352133 - DNA, 25 bp, Mus musculus
tagtgctacaggcactcttcaacct

SEQ ID NO: 352134 - DNA, 25 bp, Mus musculus
tagtgctacaggttctcacgcggtt

SEQ ID NO: 352135 - DNA, 25 bp, Mus musculus
tagtgctacaggttctgctgacttt

SEQ ID NO: 352136 - DNA, 25 bp, Mus musculus
tagtgctcagagtgcctgcagtccg

SEQ ID NO: 352137 - DNA, 25 bp, Mus musculus
tagtgctcagctacagcaacgtttt

SEQ ID NO: 352138 - DNA, 25 bp, Mus musculus
tagtgctcttcagaatgtgaagaga

SEQ ID NO: 352139 - DNA, 25 bp, Mus musculus
tagtgctgaagatgatcaaaaagcc

SEQ ID NO: 352140 - DNA, 25 bp, Mus musculus
tagtgctgaagatgtttccacagtg

SEQ ID NO: 352141 - DNA, 25 bp, Mus musculus
tagtgctgaccgttgaatcttttga

SEQ ID NO: 352142 - DNA, 25 bp, Mus musculus
tagtggaaaagaaccaaagaattcc

SEQ ID NO: 352143 - DNA, 25 bp, Mus musculus
tagtggaacgcagggatgccctgct

SEQ ID NO: 352144 - DNA, 25 bp, Mus musculus
tagtggaagaaagcacattgtagtc

SEQ ID NO: 352145 - DNA, 25 bp, Mus musculus
tagtggaccagaggatatctgggcg

SEQ ID NO: 352146 - DNA, 25 bp, Mus musculus
tagtggaccctcagattgatgacat

SEQ ID NO: 352147 - DNA, 25 bp, Mus musculus
tagtggagggtgtcccctgaactga

SEQ ID NO: 352148 - DNA, 25 bp, Mus musculus
tagtggagtccacgtacaagtatga

SEQ ID NO: 352149 - DNA, 25 bp, Mus musculus
tagtggatcaggcactggcccagtt

SEQ ID NO: 352150 - DNA, 25 bp, Mus musculus
tagtggatcaggtactggcccttgg

SEQ ID NO: 352151 - DNA, 25 bp, Mus musculus
tagtggatccctgctgacaaggaca

SEQ ID NO: 352152 - DNA, 25 bp, Mus musculus
tagtggcaccggtttacatctcgga

SEQ ID NO: 352153 - DNA, 25 bp, Mus musculus
tagtggcagcgaagatcacaaggtt

SEQ ID NO: 352154 - DNA, 25 bp, Mus musculus
tagtggcagcgaaggcctccttgaa

SEQ ID NO: 352155 - DNA, 25 bp, Mus musculus
tagtggcatgtgggcatcatcgcag

SEQ ID NO: 352156 - DNA, 25 bp, Mus musculus
tagtggcatgtggttcttcccgaaa

SEQ ID NO: 352157 - DNA, 25 bp, Mus musculus
tagtggccagggttgaagacaatga

SEQ ID NO: 352158 - DNA, 25 bp, Mus musculus
tagtggccaggtcctgctctctctg

SEQ ID NO: 352159 - DNA, 25 bp, Mus musculus
tagtggccctgtcctgccatcatga

SEQ ID NO: 352160 - DNA, 25 bp, Mus musculus
tagtggcgagaatttgctgagagat

SEQ ID NO: 352161 - DNA, 25 bp, Mus musculus
tagtggcgagactttatgatgcatt

SEQ ID NO: 352162 - DNA, 25 bp, Mus musculus
tagtggcgagcacatgccaacgaga

SEQ ID NO: 352163 - DNA, 25 bp, Mus musculus
tagtggctcctggcactttgaattg

SEQ ID NO: 352164 - DNA, 25 bp, Mus musculus
tagtggctctggcatgctgagccgg

SEQ ID NO: 352165 - DNA, 25 bp, Mus musculus
tagtggctgcagagaatgatgtcac

SEQ ID NO: 352166 - DNA, 25 bp, Mus musculus
tagtggctgcggctgttaagaagaa

SEQ ID NO: 352167 - DNA, 25 bp, Mus musculus
tagtggctgcgggtattcccaggtt

SEQ ID NO: 352168 - DNA, 25 bp, Mus musculus
tagtgggaacgcagagcagtgggaa

SEQ ID NO: 352169 - DNA, 25 bp, Mus musculus
tagtggggcttatggtgtctgatct

SEQ ID NO: 352170 - DNA, 25 bp, Mus musculus
tagtggtaaggccatcgaagacggc

SEQ ID NO: 352171 - DNA, 25 bp, Mus musculus
tagtggtaagtgcggctggctctgg

SEQ ID NO: 352172 - DNA, 25 bp, Mus musculus
tagtggtgctcaggcaagatgggca

SEQ ID NO: 352173 - DNA, 25 bp, Mus musculus
tagtggtgctcagtggcagcatgga

SEQ ID NO: 352174 - DNA, 25 bp, Mus musculus
tagtgtaaaagaaagatgatgacat

SEQ ID NO: 352175 - DNA, 25 bp, Mus musculus
tagtgtactgtgaccgtgatacaca

SEQ ID NO: 352176 - DNA, 25 bp, Mus musculus
tagtgtattcaaagaacttagtagt

SEQ ID NO: 352177 - DNA, 25 bp, Mus musculus
tagtgtcaatccctgatactgtaga

SEQ ID NO: 352178 - DNA, 25 bp, Mus musculus
tagtgtcattaagcccacaaggccc

SEQ ID NO: 352179 - DNA, 25 bp, Mus musculus
tagtgtctgccagatctgtggccag

SEQ ID NO: 352180 - DNA, 25 bp, Mus musculus
tagtgtctgccattgcaggatctgt

SEQ ID NO: 352181 - DNA, 25 bp, Mus musculus
tagtgtcttctcgcatgcacgccta

SEQ ID NO: 352182 - DNA, 25 bp, Mus musculus
tagtgtgcagaatgtctcacagatc

SEQ ID NO: 352183 - DNA, 25 bp, Mus musculus
tagtgtggccaatggcatgccttgg

SEQ ID NO: 352184 - DNA, 25 bp, Mus musculus
tagtgtggccaatggctgtcgatat

SEQ ID NO: 352185 - DNA, 25 bp, Mus musculus
tagtgttactcaggtaccagcgctg

SEQ ID NO: 352186 - DNA, 25 bp, Mus musculus
tagtgttccctgacgctgccggcga

SEQ ID NO: 352187 - DNA, 25 bp, Mus musculus
tagtgttccctgggttctgcagctt

SEQ ID NO: 352188 - DNA, 25 bp, Mus musculus
tagtgttctgttgttattttccttc

SEQ ID NO: 352189 - DNA, 25 bp, Mus musculus
tagttaaaagctgtatcgacatgga

SEQ ID NO: 352190 - DNA, 25 bp, Mus musculus
tagttaagaggtttggacatttccc

SEQ ID NO: 352191 - DNA, 25 bp, Mus musculus
tagttaagccagaggcaatgggctc

SEQ ID NO: 352192 - DNA, 25 bp, Mus musculus
tagttaagctgagtgtcctggttgc

SEQ ID NO: 352193 - DNA, 25 bp, Mus musculus
tagttacctatgaccatctgtgtaa

SEQ ID NO: 352194 - DNA, 25 bp, Mus musculus
tagttacctatgaccgaatatacca

SEQ ID NO: 352195 - DNA, 25 bp, Mus musculus
tagttagtacagatgcagacagcct

SEQ ID NO: 352196 - DNA, 25 bp, Mus musculus
tagttatgaagccagacaagttggc

SEQ ID NO: 352197 - DNA, 25 bp, Mus musculus
tagttatgaagccaggtccctcaaa

SEQ ID NO: 352198 - DNA, 25 bp, Mus musculus
tagttatgctccagagtgagagact

SEQ ID NO: 352199 - DNA, 25 bp, Mus musculus
tagttatgctccagagtttcagttc

SEQ ID NO: 352200 - DNA, 25 bp, Mus musculus
tagttatgctccagccactctgctg

SEQ ID NO: 352201 - DNA, 25 bp, Mus musculus
tagttcaaagcatgattggagagag

SEQ ID NO: 352202 - DNA, 25 bp, Mus musculus
tagttcaaagcatgtcttttgctga

SEQ ID NO: 352203 - DNA, 25 bp, Mus musculus
tagttcaaatgcgcttaaaggatag

SEQ ID NO: 352204 - DNA, 25 bp, Mus musculus
tagttcaagaggaagaaatgccccc

SEQ ID NO: 352205 - DNA, 25 bp, Mus musculus
tagttcaagaggacacaatgtagga

SEQ ID NO: 352206 - DNA, 25 bp, Mus musculus
tagttcagaaaacagcatcaaggat

SEQ ID NO: 352207 - DNA, 25 bp, Mus musculus
tagttcagaaaacaggtaaaggcta

SEQ ID NO: 352208 - DNA, 25 bp, Mus musculus
tagttcagagcaagaacagaagcag

SEQ ID NO: 352209 - DNA, 25 bp, Mus musculus
tagttcagagtgtcaaaaccgcttt

SEQ ID NO: 352210 - DNA, 25 bp, Mus musculus
tagttcattttgaaacacgagaagc

SEQ ID NO: 352211 - DNA, 25 bp, Mus musculus
tagttccagataactgcctttgtac

SEQ ID NO: 352212 - DNA, 25 bp, Mus musculus
tagttcccaacggggttaagcctga

SEQ ID NO: 352213 - DNA, 25 bp, Mus musculus
tagttctaaagtgtcatatttgaag

SEQ ID NO: 352214 - DNA, 25 bp, Mus musculus
tagttctgcagagttctacagcctc

SEQ ID NO: 352215 - DNA, 25 bp, Mus musculus
tagttctgcaggacaatgccttagc

SEQ ID NO: 352216 - DNA, 25 bp, Mus musculus
tagttctgtgcatctgggtggtcta

SEQ ID NO: 352217 - DNA, 25 bp, Mus musculus
tagttctttatttgagtgcagcagc

SEQ ID NO: 352218 - DNA, 25 bp, Mus musculus
tagttgaaactttagtgccatggca

SEQ ID NO: 352219 - DNA, 25 bp, Mus musculus
tagttgatctggtgtgttatcgacg

SEQ ID NO: 352220 - DNA, 25 bp, Mus musculus
tagttgattgggaatttggcagctg

SEQ ID NO: 352221 - DNA, 25 bp, Mus musculus
tagttgcctgtgagaaggccctggg

SEQ ID NO: 352222 - DNA, 25 bp, Mus musculus
tagttgctgcagacccgtggattcc

SEQ ID NO: 352223 - DNA, 25 bp, Mus musculus
tagttgctgccttgcgctggcgctg

SEQ ID NO: 352224 - DNA, 25 bp, Mus musculus
tagttggaaaggcatttacactctt

SEQ ID NO: 352225 - DNA, 25 bp, Mus musculus
tagttggaaggctccgcccactacc

SEQ ID NO: 352226 - DNA, 25 bp, Mus musculus
tagttggacagagctggcaagggaa

SEQ ID NO: 352227 - DNA, 25 bp, Mus musculus
tagttgttcaagagaaaccatttat

SEQ ID NO: 352228 - DNA, 25 bp, Mus musculus
tagttgttcaagatgggagaatgaa

SEQ ID NO: 352229 - DNA, 25 bp, Mus musculus
tagttgttggaggaactgctgaaga

SEQ ID NO: 352230 - DNA, 25 bp, Mus musculus
tagtttagagccaggttcaatatac

SEQ ID NO: 352231 - DNA, 25 bp, Mus musculus
tagtttccttgcagatatactgctg

SEQ ID NO: 352232 - DNA, 25 bp, Mus musculus
tagtttccttgcaggtccattcaca

SEQ ID NO: 352233 - DNA, 25 bp, Mus musculus
tagtttgaggagcagttcctgaatg

SEQ ID NO: 352234 - DNA, 25 bp, Mus musculus
tagtttgatgagtcttgattggagt

SEQ ID NO: 352235 - DNA, 25 bp, Mus musculus
tagtttgccatcaggtattggcttg

SEQ ID NO: 352236 - DNA, 25 bp, Mus musculus
tagtttgctgtagtaattcttcagt

SEQ ID NO: 352237 - DNA, 25 bp, Mus musculus
tagtttgtttgaggaagctcacaag

SEQ ID NO: 352238 - DNA, 25 bp, Mus musculus
tagttttaaggccgaagtcaattca

SEQ ID NO: 352239 - DNA, 25 bp, Mus musculus
tagttttaagtatggcgcccagaat

SEQ ID NO: 352240 - DNA, 25 bp, Mus musculus
tagttttccaggtcgtggttcaatt

SEQ ID NO: 352241 - DNA, 25 bp, Mus musculus
tagttttctcaggagaaccagactt

SEQ ID NO: 352242 - DNA, 25 bp, Mus musculus
tagtttttctgatggtctgcagatg

SEQ ID NO: 352243 - DNA, 25 bp, Mus musculus
tataaaaaacgcaataccacagatg

SEQ ID NO: 352244 - DNA, 25 bp, Mus musculus
tataaaaatggtgtccttggacttc

SEQ ID NO: 352245 - DNA, 25 bp, Mus musculus
tataaaaatggtgtcctttggccgt

SEQ ID NO: 352246 - DNA, 25 bp, Mus musculus
tataaaaattacagtaccaaagcag

SEQ ID NO: 352247 - DNA, 25 bp, Mus musculus
tataaaacatatttccagggtagcc

SEQ ID NO: 352248 - DNA, 25 bp, Mus musculus
tataaaacccatacaatttgtttat

SEQ ID NO: 352249 - DNA, 25 bp, Mus musculus
tataaaacccatccagaatgaagag

SEQ ID NO: 352250 - DNA, 25 bp, Mus musculus
tataaaacttgggtgctgaagggga

SEQ ID NO: 352251 - DNA, 25 bp, Mus musculus
tataaaagacggcatccagctcagc

SEQ ID NO: 352252 - DNA, 25 bp, Mus musculus
tataaaagagcatgggtacacaatg

SEQ ID NO: 352253 - DNA, 25 bp, Mus musculus
tataaaagaggtatatattatgagc

SEQ ID NO: 352254 - DNA, 25 bp, Mus musculus
tataaaatagaaaataaaatcttgg

SEQ ID NO: 352255 - DNA, 25 bp, Mus musculus
tataaaatagaaatgtgaatcctca

SEQ ID NO: 352256 - DNA, 25 bp, Mus musculus
tataaaatgctatgtgctgagccac

SEQ ID NO: 352257 - DNA, 25 bp, Mus musculus
tataaaattacagagaatgcatcag

SEQ ID NO: 352258 - DNA, 25 bp, Mus musculus
tataaaattacagctcagtctggaa

SEQ ID NO: 352259 - DNA, 25 bp, Mus musculus
tataaaattgatgcatctctgacat

SEQ ID NO: 352260 - DNA, 25 bp, Mus musculus
tataaacactggaacttagcaggac

SEQ ID NO: 352261 - DNA, 25 bp, Mus musculus
tataaacactgtaaaggatctccct

SEQ ID NO: 352262 - DNA, 25 bp, Mus musculus
tataaacattcaagctctgcctcac

SEQ ID NO: 352263 - DNA, 25 bp, Mus musculus
tataaaccaaaagctagagacaagc

SEQ ID NO: 352264 - DNA, 25 bp, Mus musculus
tataaaccaaaagcttgtgggcgaa

SEQ ID NO: 352265 - DNA, 25 bp, Mus musculus
tataaaccaacagaggaattcatca

SEQ ID NO: 352266 - DNA, 25 bp, Mus musculus
tataaactcaagccaggaaccatga

SEQ ID NO: 352267 - DNA, 25 bp, Mus musculus
tataaactcaagggctcgggccatc

SEQ ID NO: 352268 - DNA, 25 bp, Mus musculus
tataaactggcgagatgtccctgct

SEQ ID NO: 352269 - DNA, 25 bp, Mus musculus
tataaacttaatgaggacatggctt

SEQ ID NO: 352270 - DNA, 25 bp, Mus musculus
tataaagacagggaggtggacatca

SEQ ID NO: 352271 - DNA, 25 bp, Mus musculus
tataaagacgatgaggagaaagaaa

SEQ ID NO: 352272 - DNA, 25 bp, Mus musculus
tataaagcagtatcgtcatctgaag

SEQ ID NO: 352273 - DNA, 25 bp, Mus musculus
tataaagcagttttgaattacctga

SEQ ID NO: 352274 - DNA, 25 bp, Mus musculus
tataaagcagttttgttagttttca

SEQ ID NO: 352275 - DNA, 25 bp, Mus musculus
tataaagccagagccatcgtgactt

SEQ ID NO: 352276 - DNA, 25 bp, Mus musculus
tataaaggactgattgtgaattccc

SEQ ID NO: 352277 - DNA, 25 bp, Mus musculus
tataaaggatggcggtgttagaaca

SEQ ID NO: 352278 - DNA, 25 bp, Mus musculus
tataaaggctttttactatgcagtc

SEQ ID NO: 352279 - DNA, 25 bp, Mus musculus
tataaagtaactctaaatcttcaag

SEQ ID NO: 352280 - DNA, 25 bp, Mus musculus
tataaagtattctgtatctgcagtg

SEQ ID NO: 352281 - DNA, 25 bp, Mus musculus
tataaagtcgtaaaatatgaaagaa

SEQ ID NO: 352282 - DNA, 25 bp, Mus musculus
tataaagtctctgaaactcaagtca

SEQ ID NO: 352283 - DNA, 25 bp, Mus musculus
tataaatactgaagtgtattcctta

SEQ ID NO: 352284 - DNA, 25 bp, Mus musculus
tataaatgagtctgctattgatagc

SEQ ID NO: 352285 - DNA, 25 bp, Mus musculus
tataaatgtcaggactcaggacggg

SEQ ID NO: 352286 - DNA, 25 bp, Mus musculus
tataaattctcaaaacccaatgatg

SEQ ID NO: 352287 - DNA, 25 bp, Mus musculus
tataaattctcaaaatgttcaagcc

SEQ ID NO: 352288 - DNA, 25 bp, Mus musculus
tataaatttgcaagagccagaggga

SEQ ID NO: 352289 - DNA, 25 bp, Mus musculus
tataacaaactggatgcagagaatg

SEQ ID NO: 352290 - DNA, 25 bp, Mus musculus
tataacaagactacaatgcttctct

SEQ ID NO: 352291 - DNA, 25 bp, Mus musculus
tataacaataaagctgcagtgttga

SEQ ID NO: 352292 - DNA, 25 bp, Mus musculus
tataacacagcagtcatactactgc

SEQ ID NO: 352293 - DNA, 25 bp, Mus musculus
tataacacaggagtcatactactgc

SEQ ID NO: 352294 - DNA, 25 bp, Mus musculus
tataacacttgacatctcaataaat

SEQ ID NO: 352295 - DNA, 25 bp, Mus musculus
tataacacttgattctcattgaaat

SEQ ID NO: 352296 - DNA, 25 bp, Mus musculus
tataacatgcagatattcagtgaac

SEQ ID NO: 352297 - DNA, 25 bp, Mus musculus
tataacatgtttaagaaggtgccca

SEQ ID NO: 352298 - DNA, 25 bp, Mus musculus
tataacattcaaggaagccatcact

SEQ ID NO: 352299 - DNA, 25 bp, Mus musculus
tataacattcaaggcccttctgaaa

SEQ ID NO: 352300 - DNA, 25 bp, Mus musculus
tataacggactgctgaccttggggc

SEQ ID NO: 352301 - DNA, 25 bp, Mus musculus
tataacggctgggcacgtggagata

SEQ ID NO: 352302 - DNA, 25 bp, Mus musculus
tataacgtctgcatactatcgtgga

SEQ ID NO: 352303 - DNA, 25 bp, Mus musculus
tataactacaaggatcctgctggcc

SEQ ID NO: 352304 - DNA, 25 bp, Mus musculus
tataactaccagatgccaccgcagt

SEQ ID NO: 352305 - DNA, 25 bp, Mus musculus
tataactaccaggcttatacaactg

SEQ ID NO: 352306 - DNA, 25 bp, Mus musculus
tataactcaaggctccagaatgggc

SEQ ID NO: 352307 - DNA, 25 bp, Mus musculus
tataacttcaaaaagcagccttcat

SEQ ID NO: 352308 - DNA, 25 bp, Mus musculus
tataacttcaatgtctttaacatcc

SEQ ID NO: 352309 - DNA, 25 bp, Mus musculus
tataacttgcagattctgcttcgag

SEQ ID NO: 352310 - DNA, 25 bp, Mus musculus
tataagaaagaaagatggttgtccc

SEQ ID NO: 352311 - DNA, 25 bp, Mus musculus
tataagaactgctccgctcggctct

SEQ ID NO: 352312 - DNA, 25 bp, Mus musculus
tataagaactggcacaagtctaaga

SEQ ID NO: 352313 - DNA, 25 bp, Mus musculus
tataagaagatgatccccagtgttt

SEQ ID NO: 352314 - DNA, 25 bp, Mus musculus
tataagaagatgatcgtcttcaagc

SEQ ID NO: 352315 - DNA, 25 bp, Mus musculus
tataagaagccagatgtgaactggg

SEQ ID NO: 352316 - DNA, 25 bp, Mus musculus
tataagacagatttcttctgcccgt

SEQ ID NO: 352317 - DNA, 25 bp, Mus musculus
tataagacagtaagcgtcaccctgg

SEQ ID NO: 352318 - DNA, 25 bp, Mus musculus
tataagagagatgctaacattttta

SEQ ID NO: 352319 - DNA, 25 bp, Mus musculus
tataagagaggtagaaatgggtcca

SEQ ID NO: 352320 - DNA, 25 bp, Mus musculus
tataagatagagcggggaaaaatgg

SEQ ID NO: 352321 - DNA, 25 bp, Mus musculus
tataagcaaatgggggaagccctat

SEQ ID NO: 352322 - DNA, 25 bp, Mus musculus
tataagcaccgaatgcacaatctct

SEQ ID NO: 352323 - DNA, 25 bp, Mus musculus
tataagcccgagcaggacttggatg

SEQ ID NO: 352324 - DNA, 25 bp, Mus musculus
tataagcgggccgagatgtggtgat

SEQ ID NO: 352325 - DNA, 25 bp, Mus musculus
tataagcgggccgaggttggatcat

SEQ ID NO: 352326 - DNA, 25 bp, Mus musculus
tataaggagccgagtgcagttcctc

SEQ ID NO: 352327 - DNA, 25 bp, Mus musculus
tataaggatattagggtctctgcta

SEQ ID NO: 352328 - DNA, 25 bp, Mus musculus
tataaggtcaagcctgtgggccgaa

SEQ ID NO: 352329 - DNA, 25 bp, Mus musculus
tataagtaaggaatgaattcgaagc

SEQ ID NO: 352330 - DNA, 25 bp, Mus musculus
tataagtaaggctgtagaaaaccct

SEQ ID NO: 352331 - DNA, 25 bp, Mus musculus
tataagtactacaaggacatcaatg

SEQ ID NO: 352332 - DNA, 25 bp, Mus musculus
tataagtcgtattaggcttaactcc

SEQ ID NO: 352333 - DNA, 25 bp, Mus musculus
tataagtgaggtgttacatcctgaa

SEQ ID NO: 352334 - DNA, 25 bp, Mus musculus
tataagtgtgagatcgagtgcttca

SEQ ID NO: 352335 - DNA, 25 bp, Mus musculus
tataagttccaacagactggatttt

SEQ ID NO: 352336 - DNA, 25 bp, Mus musculus
tataagttccaacagtctgatgatt

SEQ ID NO: 352337 - DNA, 25 bp, Mus musculus
tataataaatattgggaggactcag

SEQ ID NO: 352338 - DNA, 25 bp, Mus musculus
tataataggatcgagatcccgctca

SEQ ID NO: 352339 - DNA, 25 bp, Mus musculus
tataatatgaatgtctcaggtgaaa

SEQ ID NO: 352340 - DNA, 25 bp, Mus musculus
tataatcccaatgacagttctgccc

SEQ ID NO: 352341 - DNA, 25 bp, Mus musculus
tataatcctgtggctgaccatatca

SEQ ID NO: 352342 - DNA, 25 bp, Mus musculus
tataatgaaaaggtaatgtatgtgg

SEQ ID NO: 352343 - DNA, 25 bp, Mus musculus
tataatgaaagcccagttcggaaaa

SEQ ID NO: 352344 - DNA, 25 bp, Mus musculus
tataatgagaaatgttgtcagagaa

SEQ ID NO: 352345 - DNA, 25 bp, Mus musculus
tataatgattccgatggagggacgg

SEQ ID NO: 352346 - DNA, 25 bp, Mus musculus
tataatgccaacagcactatagttc

SEQ ID NO: 352347 - DNA, 25 bp, Mus musculus
tataatgccgtggctgctccagttt

SEQ ID NO: 352348 - DNA, 25 bp, Mus musculus
tataatgccgtggtgtggcttgacc

SEQ ID NO: 352349 - DNA, 25 bp, Mus musculus
tataatgctagataaatgggagaag

SEQ ID NO: 352350 - DNA, 25 bp, Mus musculus
tataatgtaatctgggtgttgacga

SEQ ID NO: 352351 - DNA, 25 bp, Mus musculus
tataatgtgtctgacttcttccgac

SEQ ID NO: 352352 - DNA, 25 bp, Mus musculus
tataattaaaaagtttgcatttcct

SEQ ID NO: 352353 - DNA, 25 bp, Mus musculus
tataattactgagacaacactggta

SEQ ID NO: 352354 - DNA, 25 bp, Mus musculus
tataattcacagaactgggaagcac

SEQ ID NO: 352355 - DNA, 25 bp, Mus musculus
tataattcaggttgatgaaaaaact

SEQ ID NO: 352356 - DNA, 25 bp, Mus musculus
tataattcagtgactcactatgtaa

SEQ ID NO: 352357 - DNA, 25 bp, Mus musculus
tataattcatattacaggcctgagc

SEQ ID NO: 352358 - DNA, 25 bp, Mus musculus
tataattcattttgaccagcctcga

SEQ ID NO: 352359 - DNA, 25 bp, Mus musculus
tataattgaagaagcaacagacttt

SEQ ID NO: 352360 - DNA, 25 bp, Mus musculus
tataatttataagagagatggttgt

SEQ ID NO: 352361 - DNA, 25 bp, Mus musculus
tataatttcaaggttgattctttca

SEQ ID NO: 352362 - DNA, 25 bp, Mus musculus
tataatttcatacagacgcttgatc

SEQ ID NO: 352363 - DNA, 25 bp, Mus musculus
tataatttcatacaggattcaatgt

SEQ ID NO: 352364 - DNA, 25 bp, Mus musculus
tatacaaaaggatttactaggtcat

SEQ ID NO: 352365 - DNA, 25 bp, Mus musculus
tatacaaactatatatttgtccttg

SEQ ID NO: 352366 - DNA, 25 bp, Mus musculus
tatacaaatgtcggagtcttctaac

SEQ ID NO: 352367 - DNA, 25 bp, Mus musculus
tatacaagaccaggggttcaaggaa

SEQ ID NO: 352368 - DNA, 25 bp, Mus musculus
tatacacaaccagtttccgttcaga

SEQ ID NO: 352369 - DNA, 25 bp, Mus musculus
tatacacaatgagactcaccataag

SEQ ID NO: 352370 - DNA, 25 bp, Mus musculus
tatacacatagttacttgggatttg

SEQ ID NO: 352371 - DNA, 25 bp, Mus musculus
tatacaccaggcatccacatggtgc

SEQ ID NO: 352372 - DNA, 25 bp, Mus musculus
tatacagaccttactgtggcctcag

SEQ ID NO: 352373 - DNA, 25 bp, Mus musculus
tatacagaggctctccctacggact

SEQ ID NO: 352374 - DNA, 25 bp, Mus musculus
tatacagatcagagaaaatatggca

SEQ ID NO: 352375 - DNA, 25 bp, Mus musculus
tatacagcagcagggcacgtcagag

SEQ ID NO: 352376 - DNA, 25 bp, Mus musculus
tatacaggaggataccagatgtttg

SEQ ID NO: 352377 - DNA, 25 bp, Mus musculus
tatacaggaggttcaagttctttct

SEQ ID NO: 352378 - DNA, 25 bp, Mus musculus
tatacaggagtacttatgtggtagt

SEQ ID NO: 352379 - DNA, 25 bp, Mus musculus
tatacatattcttcatcgtcattta

SEQ ID NO: 352380 - DNA, 25 bp, Mus musculus
tatacatcagagacttcagtactcg

SEQ ID NO: 352381 - DNA, 25 bp, Mus musculus
tatacatggtggtacaccatgaggc

SEQ ID NO: 352382 - DNA, 25 bp, Mus musculus
tatacattattggagatcgtggcct

SEQ ID NO: 352383 - DNA, 25 bp, Mus musculus
tatacattattggaggtgctctgcc

SEQ ID NO: 352384 - DNA, 25 bp, Mus musculus
tatacatttcaaggcacagaagaaa

SEQ ID NO: 352385 - DNA, 25 bp, Mus musculus
tatacatttcaagtcttcaggaaag

SEQ ID NO: 352386 - DNA, 25 bp, Mus musculus
tataccaaaggttcaaaagaggaat

SEQ ID NO: 352387 - DNA, 25 bp, Mus musculus
tataccaagaagtgtcgagagctgt

SEQ ID NO: 352388 - DNA, 25 bp, Mus musculus
tataccaaggaggccaaattgggac

SEQ ID NO: 352389 - DNA, 25 bp, Mus musculus
tataccaaggagtttctatgattgt

SEQ ID NO: 352390 - DNA, 25 bp, Mus musculus
tataccagcacctgaggagaggtgc

SEQ ID NO: 352391 - DNA, 25 bp, Mus musculus
tataccaggaatttccacagtgcct

SEQ ID NO: 352392 - DNA, 25 bp, Mus musculus
tataccatgaggcttacagtccaag

SEQ ID NO: 352393 - DNA, 25 bp, Mus musculus
tataccattgacactggccaaaaga

SEQ ID NO: 352394 - DNA, 25 bp, Mus musculus
tatacccacacacaagtctggccac

SEQ ID NO: 352395 - DNA, 25 bp, Mus musculus
tataccccatggagactcggctgac

SEQ ID NO: 352396 - DNA, 25 bp, Mus musculus
tatacccgacaatgcttttgtcaat

SEQ ID NO: 352397 - DNA, 25 bp, Mus musculus
tataccctagccggaaagccagtgt

SEQ ID NO: 352398 - DNA, 25 bp, Mus musculus
tataccctagccgtgtacaagtctc

SEQ ID NO: 352399 - DNA, 25 bp, Mus musculus
tataccctctcctaccaccactggc

SEQ ID NO: 352400 - DNA, 25 bp, Mus musculus
tatacctacccctcaagaaaagcta

SEQ ID NO: 352401 - DNA, 25 bp, Mus musculus
tatacctacccctcaagccttcctg

SEQ ID NO: 352402 - DNA, 25 bp, Mus musculus
tatacctcaagctggcacagtgatg

SEQ ID NO: 352403 - DNA, 25 bp, Mus musculus
tatacctcacaggtgatccactgcg

SEQ ID NO: 352404 - DNA, 25 bp, Mus musculus
tatacctccggcttatacaactgtt

SEQ ID NO: 352405 - DNA, 25 bp, Mus musculus
tatacctctaggcctgctctgttca

SEQ ID NO: 352406 - DNA, 25 bp, Mus musculus
tatacctctaggccttatattgtgt

SEQ ID NO: 352407 - DNA, 25 bp, Mus musculus
tatacctgcttaccggtatgaccca

SEQ ID NO: 352408 - DNA, 25 bp, Mus musculus
tatacctggggttttgtatgaacaa

SEQ ID NO: 352409 - DNA, 25 bp, Mus musculus
tataccttacggtccctttccttgc

SEQ ID NO: 352410 - DNA, 25 bp, Mus musculus
tataccttgaactgagctggtgggg

SEQ ID NO: 352411 - DNA, 25 bp, Mus musculus
tatacctttaacagcccttagggcc

SEQ ID NO: 352412 - DNA, 25 bp, Mus musculus
tatacctttaacagcctctttccag

SEQ ID NO: 352413 - DNA, 25 bp, Mus musculus
tatacctttaacaggattccagtct

SEQ ID NO: 352414 - DNA, 25 bp, Mus musculus
tatacctttaacagggccatcatgg

SEQ ID NO: 352415 - DNA, 25 bp, Mus musculus
tatacgaaaaggaacttacacattt

SEQ ID NO: 352416 - DNA, 25 bp, Mus musculus
tatacgaaaaggctctacctctgaa

SEQ ID NO: 352417 - DNA, 25 bp, Mus musculus
tatacgacaaacctgaggtctggaa

SEQ ID NO: 352418 - DNA, 25 bp, Mus musculus
tatacgacaaataagatgcacgcca

SEQ ID NO: 352419 - DNA, 25 bp, Mus musculus
tatacgacacgggccggactggaaa

SEQ ID NO: 352420 - DNA, 25 bp, Mus musculus
tatacgacgacccgtctcgatactg

SEQ ID NO: 352421 - DNA, 25 bp, Mus musculus
tatacgacgactcgtccgtctcggg

SEQ ID NO: 352422 - DNA, 25 bp, Mus musculus
tatacgacgatgttgagactgtgcc

SEQ ID NO: 352423 - DNA, 25 bp, Mus musculus
tatacgctgccgtgtacccctccac

SEQ ID NO: 352424 - DNA, 25 bp, Mus musculus
tatacgctggccactggtttatatc

SEQ ID NO: 352425 - DNA, 25 bp, Mus musculus
tatacggaagcccctctggaaccgg

SEQ ID NO: 352426 - DNA, 25 bp, Mus musculus
tatacgggcaacaaaatggcagtga

SEQ ID NO: 352427 - DNA, 25 bp, Mus musculus
tatacgggcaacaaagatttctgaa

SEQ ID NO: 352428 - DNA, 25 bp, Mus musculus
tatacgggcaacaaagtgcactagg

SEQ ID NO: 352429 - DNA, 25 bp, Mus musculus
tatacgggcaacaaatatgtctgga

SEQ ID NO: 352430 - DNA, 25 bp, Mus musculus
tatacgggctgattcgctactcgga

SEQ ID NO: 352431 - DNA, 25 bp, Mus musculus
tatacgggctggccaagcccagaga

SEQ ID NO: 352432 - DNA, 25 bp, Mus musculus
tatacgggctggtccaaaaggaact

SEQ ID NO: 352433 - DNA, 25 bp, Mus musculus
tatacgtatagccaggtggtgaccg

SEQ ID NO: 352434 - DNA, 25 bp, Mus musculus
tatactaccacaaggggacatgaag

SEQ ID NO: 352435 - DNA, 25 bp, Mus musculus
tatactcaaagggcagcacatgagc

SEQ ID NO: 352436 - DNA, 25 bp, Mus musculus
tatactcaaaggtgttggggccact

SEQ ID NO: 352437 - DNA, 25 bp, Mus musculus
tatactcaaggtatcgcagggtgga

SEQ ID NO: 352438 - DNA, 25 bp, Mus musculus
tatactcagccccagagcagctctt

SEQ ID NO: 352439 - DNA, 25 bp, Mus musculus
tatactcatcctgggtcactgacaa

SEQ ID NO: 352440 - DNA, 25 bp, Mus musculus
tatactccaattaatccccccttct

SEQ ID NO: 352441 - DNA, 25 bp, Mus musculus
tatactcccgtttggtgaactgact

SEQ ID NO: 352442 - DNA, 25 bp, Mus musculus
tatactctacgacacgaacctgcca

SEQ ID NO: 352443 - DNA, 25 bp, Mus musculus
tatactgaaatgactggaaagttaa

SEQ ID NO: 352444 - DNA, 25 bp, Mus musculus
tatactgccaaaggtcttttccggg

SEQ ID NO: 352445 - DNA, 25 bp, Mus musculus
tatactgctggagggctgcagtatg

SEQ ID NO: 352446 - DNA, 25 bp, Mus musculus
tatactgtgacaggagggctggcgg

SEQ ID NO: 352447 - DNA, 25 bp, Mus musculus
tatacttagacaggtatccattatg

SEQ ID NO: 352448 - DNA, 25 bp, Mus musculus
tatacttcagaatctgaccacagag

SEQ ID NO: 352449 - DNA, 25 bp, Mus musculus
tatacttcagctccaacagaggaag

SEQ ID NO: 352450 - DNA, 25 bp, Mus musculus
tatacttcaggaactaattctgaag

SEQ ID NO: 352451 - DNA, 25 bp, Mus musculus
tatacttctgcaatgcctggcttcc

SEQ ID NO: 352452 - DNA, 25 bp, Mus musculus
tatacttgctagctgccgactacag

SEQ ID NO: 352453 - DNA, 25 bp, Mus musculus
tatactttaagaggctggattgtcc

SEQ ID NO: 352454 - DNA, 25 bp, Mus musculus
tatactttgtgaagctctgaaaacc

SEQ ID NO: 352455 - DNA, 25 bp, Mus musculus
tatagaaaaaaacacctggacttct

SEQ ID NO: 352456 - DNA, 25 bp, Mus musculus
tatagaaaaggtcattttgagtgcc

SEQ ID NO: 352457 - DNA, 25 bp, Mus musculus
tatagaaaatgaagtttctacacta

SEQ ID NO: 352458 - DNA, 25 bp, Mus musculus
tatagaaacgggttctgctgcctta

SEQ ID NO: 352459 - DNA, 25 bp, Mus musculus
tatagaaaggctgaaggcactgggc

SEQ ID NO: 352460 - DNA, 25 bp, Mus musculus
tatagaaagggcgctttcgttgctg

SEQ ID NO: 352461 - DNA, 25 bp, Mus musculus
tatagaacacatagtgtggatccaa

SEQ ID NO: 352462 - DNA, 25 bp, Mus musculus
tatagaacacatagttaaccttggt

SEQ ID NO: 352463 - DNA, 25 bp, Mus musculus
tatagaacctggcctcatctgtatg

SEQ ID NO: 352464 - DNA, 25 bp, Mus musculus
tatagacctgaagagtacagtcgct

SEQ ID NO: 352465 - DNA, 25 bp, Mus musculus
tatagacggctatgaatcatccagg

SEQ ID NO: 352466 - DNA, 25 bp, Mus musculus
tatagactggcctcatctgttccgg

SEQ ID NO: 352467 - DNA, 25 bp, Mus musculus
tatagacttcagtttgatttccagg

SEQ ID NO: 352468 - DNA, 25 bp, Mus musculus
tatagagaaaacgtgaaaaaggtcc

SEQ ID NO: 352469 - DNA, 25 bp, Mus musculus
tatagagacacagccagctcaggaa

SEQ ID NO: 352470 - DNA, 25 bp, Mus musculus
tatagagacacagcctgagtgcata

SEQ ID NO: 352471 - DNA, 25 bp, Mus musculus
tatagagcagtaccaaatatgcccc

SEQ ID NO: 352472 - DNA, 25 bp, Mus musculus
tatagagctggaggataaataagga

SEQ ID NO: 352473 - DNA, 25 bp, Mus musculus
tatagataaatagatatgttttctt

SEQ ID NO: 352474 - DNA, 25 bp, Mus musculus
tatagataagaatagcagagaaagg

SEQ ID NO: 352475 - DNA, 25 bp, Mus musculus
tatagataaggtgaagaaactgctg

SEQ ID NO: 352476 - DNA, 25 bp, Mus musculus
tatagataagtgtcatatttgaaga

SEQ ID NO: 352477 - DNA, 25 bp, Mus musculus
tatagatgcttatgtggatatgcta

SEQ ID NO: 352478 - DNA, 25 bp, Mus musculus
tatagattctgattcttcgtggtgt

SEQ ID NO: 352479 - DNA, 25 bp, Mus musculus
tatagattctttcttgaacacttcc

SEQ ID NO: 352480 - DNA, 25 bp, Mus musculus
tatagatttccttctgggttctcaa

SEQ ID NO: 352481 - DNA, 25 bp, Mus musculus
tatagcaacttggttctcacgagag

SEQ ID NO: 352482 - DNA, 25 bp, Mus musculus
tatagcacagaacctatcaacacat

SEQ ID NO: 352483 - DNA, 25 bp, Mus musculus
tatagcacatgggagggactggggg

SEQ ID NO: 352484 - DNA, 25 bp, Mus musculus
tatagcagagggctcctgctgaagg

SEQ ID NO: 352485 - DNA, 25 bp, Mus musculus
tatagcagcctggtacccccttgca

SEQ ID NO: 352486 - DNA, 25 bp, Mus musculus
tatagcagtgatcccgcttcgatga

SEQ ID NO: 352487 - DNA, 25 bp, Mus musculus
tatagcatttcaggatggaaccgcg

SEQ ID NO: 352488 - DNA, 25 bp, Mus musculus
tatagccaaggacattaaggacgcc

SEQ ID NO: 352489 - DNA, 25 bp, Mus musculus
tatagccagagaatgtattcttcag

SEQ ID NO: 352490 - DNA, 25 bp, Mus musculus
tatagccagataactggggtgagta

SEQ ID NO: 352491 - DNA, 25 bp, Mus musculus
tatagccttcaggaaacaaagcaaa

SEQ ID NO: 352492 - DNA, 25 bp, Mus musculus
tatagctcagctgcctcatatacag

SEQ ID NO: 352493 - DNA, 25 bp, Mus musculus
tatagctccccgaaagaaaagtttc

SEQ ID NO: 352494 - DNA, 25 bp, Mus musculus
tatagctctccaggtcaatggccaa

SEQ ID NO: 352495 - DNA, 25 bp, Mus musculus
tatagctctctgctcagtacaagcc

SEQ ID NO: 352496 - DNA, 25 bp, Mus musculus
tatagcttcactgataaaacacgga

SEQ ID NO: 352497 - DNA, 25 bp, Mus musculus
tatagcttggtccaggaaaatggac

SEQ ID NO: 352498 - DNA, 25 bp, Mus musculus
tataggacactacgaacagcacatt

SEQ ID NO: 352499 - DNA, 25 bp, Mus musculus
tataggacaggacggggtccctcca

SEQ ID NO: 352500 - DNA, 25 bp, Mus musculus
tataggacggcagagaatccgtgac

SEQ ID NO: 352501 - DNA, 25 bp, Mus musculus
tataggagctttactgaagactgtt

SEQ ID NO: 352502 - DNA, 25 bp, Mus musculus
tataggcaaaggttctgcctcatgg

SEQ ID NO: 352503 - DNA, 25 bp, Mus musculus
tataggcaattcaacttgatttctt

SEQ ID NO: 352504 - DNA, 25 bp, Mus musculus
tataggcaattgggtccccatcctc

SEQ ID NO: 352505 - DNA, 25 bp, Mus musculus
tataggcatagactacttttaaggg

SEQ ID NO: 352506 - DNA, 25 bp, Mus musculus
tatagggagtcgcgaggaggaaagc

SEQ ID NO: 352507 - DNA, 25 bp, Mus musculus
tatagggatgtgatgctctttctca

SEQ ID NO: 352508 - DNA, 25 bp, Mus musculus
tataggtatgggagaacagaacact

SEQ ID NO: 352509 - DNA, 25 bp, Mus musculus
tatagtatgagagcatattccgcgt

SEQ ID NO: 352510 - DNA, 25 bp, Mus musculus
tatagtatgaggtacctgtcgtagg

SEQ ID NO: 352511 - DNA, 25 bp, Mus musculus
tatagtatgagtgatgtcctcgcat

SEQ ID NO: 352512 - DNA, 25 bp, Mus musculus
tatagtcatttacaaaatggttctt

SEQ ID NO: 352513 - DNA, 25 bp, Mus musculus
tatagtccaggacagccagggctgt

SEQ ID NO: 352514 - DNA, 25 bp, Mus musculus
tatagtgaagcccctggtcataagc

SEQ ID NO: 352515 - DNA, 25 bp, Mus musculus
tatagtgaaggtgtttcctacttgg

SEQ ID NO: 352516 - DNA, 25 bp, Mus musculus
tatagttcaggcatctactatgaac

SEQ ID NO: 352517 - DNA, 25 bp, Mus musculus
tatataaagaggcttgcacagcata

SEQ ID NO: 352518 - DNA, 25 bp, Mus musculus
tatataacacttgacatctcaataa

SEQ ID NO: 352519 - DNA, 25 bp, Mus musculus
tatataacacttgattctcattgaa

SEQ ID NO: 352520 - DNA, 25 bp, Mus musculus
tatataagaagaccctatctaactt

SEQ ID NO: 352521 - DNA, 25 bp, Mus musculus
tatataagaagcccctccaggccgg

SEQ ID NO: 352522 - DNA, 25 bp, Mus musculus
tatataagaaggcactaaccctatc

SEQ ID NO: 352523 - DNA, 25 bp, Mus musculus
tatataattaaaaagtttgcatttc

SEQ ID NO: 352524 - DNA, 25 bp, Mus musculus
tatatacacaggccatcctggacat

SEQ ID NO: 352525 - DNA, 25 bp, Mus musculus
tatataccaaaggttcaaaagagga

SEQ ID NO: 352526 - DNA, 25 bp, Mus musculus
tatataccatgaggcttacagtcca

SEQ ID NO: 352527 - DNA, 25 bp, Mus musculus
tatatactcaaggtatcgcagggtg

SEQ ID NO: 352528 - DNA, 25 bp, Mus musculus
tatatactgaaatgactggaaagtt

SEQ ID NO: 352529 - DNA, 25 bp, Mus musculus
tatatacttctgcaatgcctggctt

SEQ ID NO: 352530 - DNA, 25 bp, Mus musculus
tatatagcaaaaatgtgaatcctca

SEQ ID NO: 352531 - DNA, 25 bp, Mus musculus
tatatagcaactttaaaggattaac

SEQ ID NO: 352532 - DNA, 25 bp, Mus musculus
tatataggcaaaggtgatttatctc

SEQ ID NO: 352533 - DNA, 25 bp, Mus musculus
tatataggcaattcaacttgatttc

SEQ ID NO: 352534 - DNA, 25 bp, Mus musculus
tatataggcaattgggtccccatcc

SEQ ID NO: 352535 - DNA, 25 bp, Mus musculus
tatatatagcaaaaatgtgaatcct

SEQ ID NO: 352536 - DNA, 25 bp, Mus musculus
tatatatagcaactttaaaggatta

SEQ ID NO: 352537 - DNA, 25 bp, Mus musculus
tatatatatggacatacatgtttaa

SEQ ID NO: 352538 - DNA, 25 bp, Mus musculus
tatatatatggatttgttgctgtta

SEQ ID NO: 352539 - DNA, 25 bp, Mus musculus
tatatatgaggtaccagctctactc

SEQ ID NO: 352540 - DNA, 25 bp, Mus musculus
tatatatgcgaaaggcctgtccgag

SEQ ID NO: 352541 - DNA, 25 bp, Mus musculus
tatatatgcgaaagggaacttcccc

SEQ ID NO: 352542 - DNA, 25 bp, Mus musculus
tatatattaggctatgtggtggttg

SEQ ID NO: 352543 - DNA, 25 bp, Mus musculus
tatatattgaaaatccctgactctg

SEQ ID NO: 352544 - DNA, 25 bp, Mus musculus
tatatattgaagtgcggtgtttaaa

SEQ ID NO: 352545 - DNA, 25 bp, Mus musculus
tatatcaagaaggctgctttgcgtt

SEQ ID NO: 352546 - DNA, 25 bp, Mus musculus
tatatcacacaaaaattccagaggt

SEQ ID NO: 352547 - DNA, 25 bp, Mus musculus
tatatcacacaaagacccacagtta

SEQ ID NO: 352548 - DNA, 25 bp, Mus musculus
tatatcaccaaagctgaaaggggtc

SEQ ID NO: 352549 - DNA, 25 bp, Mus musculus
tatatcaccaaagtcctgaagggga

SEQ ID NO: 352550 - DNA, 25 bp, Mus musculus
tatatcaccattaaggactctgcag

SEQ ID NO: 352551 - DNA, 25 bp, Mus musculus
tatatcaccattaaggactgcaggc

SEQ ID NO: 352552 - DNA, 25 bp, Mus musculus
tatatcaccattaaggacttcctga

SEQ ID NO: 352553 - DNA, 25 bp, Mus musculus
tatatcagtgagatttcaccgagat

SEQ ID NO: 352554 - DNA, 25 bp, Mus musculus
tatatcatttagaggacattcactg

SEQ ID NO: 352555 - DNA, 25 bp, Mus musculus
tatatccacagtcaagccctgcttc

SEQ ID NO: 352556 - DNA, 25 bp, Mus musculus
tatatccacgataattttattccca

SEQ ID NO: 352557 - DNA, 25 bp, Mus musculus
tatatccaggaagaaattccaaatt

SEQ ID NO: 352558 - DNA, 25 bp, Mus musculus
tatatccccacagcagtcctgtgga

SEQ ID NO: 352559 - DNA, 25 bp, Mus musculus
tatatcccttgcattccatattgga

SEQ ID NO: 352560 - DNA, 25 bp, Mus musculus
tatatccttctagtgttgggcaacc

SEQ ID NO: 352561 - DNA, 25 bp, Mus musculus
tatatcggagacacagcttcatgag

SEQ ID NO: 352562 - DNA, 25 bp, Mus musculus
tatatcgtccaggtatttgataaca

SEQ ID NO: 352563 - DNA, 25 bp, Mus musculus
tatatctacactgaattttagaaag

SEQ ID NO: 352564 - DNA, 25 bp, Mus musculus
tatatctacactgagtccaaacatc

SEQ ID NO: 352565 - DNA, 25 bp, Mus musculus
tatatctacactgagtgccagtcat

SEQ ID NO: 352566 - DNA, 25 bp, Mus musculus
tatatctacactgagtggttcctca

SEQ ID NO: 352567 - DNA, 25 bp, Mus musculus
tatatctacaggtctgacaagacac

SEQ ID NO: 352568 - DNA, 25 bp, Mus musculus
tatatctgcttgtagagctgtcggc

SEQ ID NO: 352569 - DNA, 25 bp, Mus musculus
tatatcttcaatgaaattacacttg

SEQ ID NO: 352570 - DNA, 25 bp, Mus musculus
tatatcttcaatggtctgacagtct

SEQ ID NO: 352571 - DNA, 25 bp, Mus musculus
tatatcttgtaagctaaacagaaag

SEQ ID NO: 352572 - DNA, 25 bp, Mus musculus
tatatctttaagcaacctcactttg

SEQ ID NO: 352573 - DNA, 25 bp, Mus musculus
tatatgaaagttacgagaagcaggg

SEQ ID NO: 352574 - DNA, 25 bp, Mus musculus
tatatgaactatgatggattcaata

SEQ ID NO: 352575 - DNA, 25 bp, Mus musculus
tatatgaagcacacaggggtagtgt

SEQ ID NO: 352576 - DNA, 25 bp, Mus musculus
tatatgacagactccattagcagag

SEQ ID NO: 352577 - DNA, 25 bp, Mus musculus
tatatgacagagtccgctcctgcca

SEQ ID NO: 352578 - DNA, 25 bp, Mus musculus
tatatgacagggcttctggtgtaaa

SEQ ID NO: 352579 - DNA, 25 bp, Mus musculus
tatatgacaggtcatggagggaatg

SEQ ID NO: 352580 - DNA, 25 bp, Mus musculus
tatatgactcaattctacggtgaga

SEQ ID NO: 352581 - DNA, 25 bp, Mus musculus
tatatgagtccaccaatggctcaac

SEQ ID NO: 352582 - DNA, 25 bp, Mus musculus
tatatgcaatttcggagcttcaccc

SEQ ID NO: 352583 - DNA, 25 bp, Mus musculus
tatatgccagggggctctgtaaaag

SEQ ID NO: 352584 - DNA, 25 bp, Mus musculus
tatatgcgaaaggcctgtccgagga

SEQ ID NO: 352585 - DNA, 25 bp, Mus musculus
tatatgcgaaagggaacttccccat

SEQ ID NO: 352586 - DNA, 25 bp, Mus musculus
tatatgctctacaagaattttacag

SEQ ID NO: 352587 - DNA, 25 bp, Mus musculus
tatatggaaagtaaattcagttcca

SEQ ID NO: 352588 - DNA, 25 bp, Mus musculus
tatatggagcaaaaaatgggctaca

SEQ ID NO: 352589 - DNA, 25 bp, Mus musculus
tatatggagcaaaagtatgaattag

SEQ ID NO: 352590 - DNA, 25 bp, Mus musculus
tatatggagcagaagcaaatcagaa

SEQ ID NO: 352591 - DNA, 25 bp, Mus musculus
tatatggcacccaagaatcagagcg

SEQ ID NO: 352592 - DNA, 25 bp, Mus musculus
tatatggcacccaagctttcagatg

SEQ ID NO: 352593 - DNA, 25 bp, Mus musculus
tatatgtataacaaggattctcaaa

SEQ ID NO: 352594 - DNA, 25 bp, Mus musculus
tatatgtgcggctcggtccgacgca

SEQ ID NO: 352595 - DNA, 25 bp, Mus musculus
tatatgtgttatgagtttgtgatgt

SEQ ID NO: 352596 - DNA, 25 bp, Mus musculus
tatattaaaaggtgtccagtgtgaa

SEQ ID NO: 352597 - DNA, 25 bp, Mus musculus
tatattaacccttggagtaaaaatg

SEQ ID NO: 352598 - DNA, 25 bp, Mus musculus
tatattacatagacatgcagaagtt

SEQ ID NO: 352599 - DNA, 25 bp, Mus musculus
tatattactcaacaacatccccgat

SEQ ID NO: 352600 - DNA, 25 bp, Mus musculus
tatattatatgaactatgatggatt

SEQ ID NO: 352601 - DNA, 25 bp, Mus musculus
tatattatgaaagaatcccagtaaa

SEQ ID NO: 352602 - DNA, 25 bp, Mus musculus
tatattatgaaagctatcatgagaa

SEQ ID NO: 352603 - DNA, 25 bp, Mus musculus
tatattcaaccagctgtgaccatag

SEQ ID NO: 352604 - DNA, 25 bp, Mus musculus
tatattcacagaattggcagagggg

SEQ ID NO: 352605 - DNA, 25 bp, Mus musculus
tatattcacaggagtcgatagcggc

SEQ ID NO: 352606 - DNA, 25 bp, Mus musculus
tatattcagggtcacagcttcccag

SEQ ID NO: 352607 - DNA, 25 bp, Mus musculus
tatattcctagacagacaaagtttc

SEQ ID NO: 352608 - DNA, 25 bp, Mus musculus
tatattcctagacagtgttcctagg

SEQ ID NO: 352609 - DNA, 25 bp, Mus musculus
tatattcttggggaacttagcataa

SEQ ID NO: 352610 - DNA, 25 bp, Mus musculus
tatattcttggggttgaatctccag

SEQ ID NO: 352611 - DNA, 25 bp, Mus musculus
tatattgatgttgattgatgtgggt

SEQ ID NO: 352612 - DNA, 25 bp, Mus musculus
tatattgatgttggaaactgtggct

SEQ ID NO: 352613 - DNA, 25 bp, Mus musculus
tatattgcaggattcactagcaaaa

SEQ ID NO: 352614 - DNA, 25 bp, Mus musculus
tatattggaaggtcctcagaatggt

SEQ ID NO: 352615 - DNA, 25 bp, Mus musculus
tatattgtaacagaatccgaatctt

SEQ ID NO: 352616 - DNA, 25 bp, Mus musculus
tatattgttacatgggtttatccat

SEQ ID NO: 352617 - DNA, 25 bp, Mus musculus
tatattgttacatgtgtatctccag

SEQ ID NO: 352618 - DNA, 25 bp, Mus musculus
tatatttctagaagatcattgcaac

SEQ ID NO: 352619 - DNA, 25 bp, Mus musculus
tatatttgctcaaagccatcttcag

SEQ ID NO: 352620 - DNA, 25 bp, Mus musculus
tatatttgctcaaatggcctcctgg

SEQ ID NO: 352621 - DNA, 25 bp, Mus musculus
tatatttgcttctgaggtggtcctg

SEQ ID NO: 352622 - DNA, 25 bp, Mus musculus
tatattttgccaaaggtgttttaca

SEQ ID NO: 352623 - DNA, 25 bp, Mus musculus
tatatttttacagggaggagcctcg

SEQ ID NO: 352624 - DNA, 25 bp, Mus musculus
tatcaaaaagggaatcttacttcag

SEQ ID NO: 352625 - DNA, 25 bp, Mus musculus
tatcaaaaccaaacaatttgctcct

SEQ ID NO: 352626 - DNA, 25 bp, Mus musculus
tatcaaaacggaaggacctgcaatg

SEQ ID NO: 352627 - DNA, 25 bp, Mus musculus
tatcaaaatcagagccagaaactcc

SEQ ID NO: 352628 - DNA, 25 bp, Mus musculus
tatcaaaatcaggagatggagttcc

SEQ ID NO: 352629 - DNA, 25 bp, Mus musculus
tatcaaaatttctatgaggagagag

SEQ ID NO: 352630 - DNA, 25 bp, Mus musculus
tatcaaagaggatgtctcggaacta

SEQ ID NO: 352631 - DNA, 25 bp, Mus musculus
tatcaaagaggtagtagtctggaag

SEQ ID NO: 352632 - DNA, 25 bp, Mus musculus
tatcaaaggaccatgatgatttctg

SEQ ID NO: 352633 - DNA, 25 bp, Mus musculus
tatcaaaggaccatggcatcaaccc

SEQ ID NO: 352634 - DNA, 25 bp, Mus musculus
tatcaacatcaaagtaatcccctcc

SEQ ID NO: 352635 - DNA, 25 bp, Mus musculus
tatcaacctgaagattacgctcgat

SEQ ID NO: 352636 - DNA, 25 bp, Mus musculus
tatcaacctgaccctctatgggatc

SEQ ID NO: 352637 - DNA, 25 bp, Mus musculus
tatcaacctggaggacggtgagatc

SEQ ID NO: 352638 - DNA, 25 bp, Mus musculus
tatcaacgagtactgtattggcaat

SEQ ID NO: 352639 - DNA, 25 bp, Mus musculus
tatcaacttgattcgaggaactggg

SEQ ID NO: 352640 - DNA, 25 bp, Mus musculus
tatcaagaaacccccatagaatgtg

SEQ ID NO: 352641 - DNA, 25 bp, Mus musculus
tatcaagaaactaatactctacagg

SEQ ID NO: 352642 - DNA, 25 bp, Mus musculus
tatcaagaaatctgcccttagtggg

SEQ ID NO: 352643 - DNA, 25 bp, Mus musculus
tatcaagaagaaggacttttcccct

SEQ ID NO: 352644 - DNA, 25 bp, Mus musculus
tatcaagaagccctggctgtcctgg

SEQ ID NO: 352645 - DNA, 25 bp, Mus musculus
tatcaagaaggagtttgacaagaag

SEQ ID NO: 352646 - DNA, 25 bp, Mus musculus
tatcaagaaggctgctttgcgtttg

SEQ ID NO: 352647 - DNA, 25 bp, Mus musculus
tatcaagaattccattatgtgagct

SEQ ID NO: 352648 - DNA, 25 bp, Mus musculus
tatcaagagtcagacgaaggaagaa

SEQ ID NO: 352649 - DNA, 25 bp, Mus musculus
tatcaagccgcctgtttctggacca

SEQ ID NO: 352650 - DNA, 25 bp, Mus musculus
tatcaagccgcgttttacgatggga

SEQ ID NO: 352651 - DNA, 25 bp, Mus musculus
tatcaaggaacaagctagtggggta

SEQ ID NO: 352652 - DNA, 25 bp, Mus musculus
tatcaagtagcaatgaaggggtaga

SEQ ID NO: 352653 - DNA, 25 bp, Mus musculus
tatcaagtccagaagaaatattatg

SEQ ID NO: 352654 - DNA, 25 bp, Mus musculus
tatcaagttctcagatgaatatctg

SEQ ID NO: 352655 - DNA, 25 bp, Mus musculus
tatcaatacagggtctgtgatggtg

SEQ ID NO: 352656 - DNA, 25 bp, Mus musculus
tatcaatcaatctatctacctatct

SEQ ID NO: 352657 - DNA, 25 bp, Mus musculus
tatcaatgacaacttcatcgactgc

SEQ ID NO: 352658 - DNA, 25 bp, Mus musculus
tatcaattcaggaggaaacagttgc

SEQ ID NO: 352659 - DNA, 25 bp, Mus musculus
tatcacaaaagctgcatagactcat

SEQ ID NO: 352660 - DNA, 25 bp, Mus musculus
tatcacaaataaagaaaaggaaaaa

SEQ ID NO: 352661 - DNA, 25 bp, Mus musculus
tatcacaaatatttcctcttctgat

SEQ ID NO: 352662 - DNA, 25 bp, Mus musculus
tatcacaacaagattgaggaagaca

SEQ ID NO: 352663 - DNA, 25 bp, Mus musculus
tatcacaacaaggcccatctgctca

SEQ ID NO: 352664 - DNA, 25 bp, Mus musculus
tatcacaagtgtgtgggataagagc

SEQ ID NO: 352665 - DNA, 25 bp, Mus musculus
tatcacaatgaggttgacattgtgg

SEQ ID NO: 352666 - DNA, 25 bp, Mus musculus
tatcacacaaaaattccagaggttg

SEQ ID NO: 352667 - DNA, 25 bp, Mus musculus
tatcacacaaagacccacagttatc

SEQ ID NO: 352668 - DNA, 25 bp, Mus musculus
tatcacaccatagatgaccactgtg

SEQ ID NO: 352669 - DNA, 25 bp, Mus musculus
tatcacagacacgtgcgaccgcatt

SEQ ID NO: 352670 - DNA, 25 bp, Mus musculus
tatcacagacgatctagaagcaaga

SEQ ID NO: 352671 - DNA, 25 bp, Mus musculus
tatcacatagatgagaattctccag

SEQ ID NO: 352672 - DNA, 25 bp, Mus musculus
tatcacatatacgcagtactccgga

SEQ ID NO: 352673 - DNA, 25 bp, Mus musculus
tatcaccaaacagacaccaactttt

SEQ ID NO: 352674 - DNA, 25 bp, Mus musculus
tatcaccaaagctgaaaggggtctg

SEQ ID NO: 352675 - DNA, 25 bp, Mus musculus
tatcaccaaagtcctgaaggggaag

SEQ ID NO: 352676 - DNA, 25 bp, Mus musculus
tatcaccacagacagatgccctttg

SEQ ID NO: 352677 - DNA, 25 bp, Mus musculus
tatcaccaccacataagattgtctc

SEQ ID NO: 352678 - DNA, 25 bp, Mus musculus
tatcaccattaaggactctgcagga

SEQ ID NO: 352679 - DNA, 25 bp, Mus musculus
tatcaccattaaggactgcaggctg

SEQ ID NO: 352680 - DNA, 25 bp, Mus musculus
tatcaccattaaggacttcctgaag

SEQ ID NO: 352681 - DNA, 25 bp, Mus musculus
tatcacccaaggttcagacaatgaa

SEQ ID NO: 352682 - DNA, 25 bp, Mus musculus
tatcaccgactcagacagagtcttt

SEQ ID NO: 352683 - DNA, 25 bp, Mus musculus
tatcaccgactcagctgactcaaga

SEQ ID NO: 352684 - DNA, 25 bp, Mus musculus
tatcaccgtccagatccccaccctc

SEQ ID NO: 352685 - DNA, 25 bp, Mus musculus
tatcaccgtccaggtctgggtggcc

SEQ ID NO: 352686 - DNA, 25 bp, Mus musculus
tatcacctccagaacaatgagcttc

SEQ ID NO: 352687 - DNA, 25 bp, Mus musculus
tatcacctccagctaattgccttgt

SEQ ID NO: 352688 - DNA, 25 bp, Mus musculus
tatcaccttccagaactctgcagcc

SEQ ID NO: 352689 - DNA, 25 bp, Mus musculus
tatcaccttccagactcagaacttt

SEQ ID NO: 352690 - DNA, 25 bp, Mus musculus
tatcaccttccaggctcaaactacc

SEQ ID NO: 352691 - DNA, 25 bp, Mus musculus
tatcacgaagaaaaacgtgaacatt

SEQ ID NO: 352692 - DNA, 25 bp, Mus musculus
tatcacgctgcatgaactggagaat

SEQ ID NO: 352693 - DNA, 25 bp, Mus musculus
tatcacggtacccttatttgaccag

SEQ ID NO: 352694 - DNA, 25 bp, Mus musculus
tatcacgtgcagcacctggccacat

SEQ ID NO: 352695 - DNA, 25 bp, Mus musculus
tatcacgtgcagggtctttcaggtt

SEQ ID NO: 352696 - DNA, 25 bp, Mus musculus
tatcactactggggaaacaggcact

SEQ ID NO: 352697 - DNA, 25 bp, Mus musculus
tatcactactgtggtcgtgcagact

SEQ ID NO: 352698 - DNA, 25 bp, Mus musculus
tatcactagaggtcgatcgcgatcg

SEQ ID NO: 352699 - DNA, 25 bp, Mus musculus
tatcactcagataacccttcctcag

SEQ ID NO: 352700 - DNA, 25 bp, Mus musculus
tatcactcaggcccaggcctgggag

SEQ ID NO: 352701 - DNA, 25 bp, Mus musculus
tatcactctgggaggcccggtgctc

SEQ ID NO: 352702 - DNA, 25 bp, Mus musculus
tatcactctgttccatgccatggat

SEQ ID NO: 352703 - DNA, 25 bp, Mus musculus
tatcactgcgagatgagctttgatc

SEQ ID NO: 352704 - DNA, 25 bp, Mus musculus
tatcactgcgagctgcttgacatgg

SEQ ID NO: 352705 - DNA, 25 bp, Mus musculus
tatcactgtccaagagttgtttgca

SEQ ID NO: 352706 - DNA, 25 bp, Mus musculus
tatcactgtccaaggatggaaggtc

SEQ ID NO: 352707 - DNA, 25 bp, Mus musculus
tatcactgtggaatatcgttcagaa

SEQ ID NO: 352708 - DNA, 25 bp, Mus musculus
tatcactgtggcaatagtaattgtc

SEQ ID NO: 352709 - DNA, 25 bp, Mus musculus
tatcactgtgggccccctcccttct

SEQ ID NO: 352710 - DNA, 25 bp, Mus musculus
tatcactgttgagggatgacctgcc

SEQ ID NO: 352711 - DNA, 25 bp, Mus musculus
tatcacttgggtgagaatgcctgga

SEQ ID NO: 352712 - DNA, 25 bp, Mus musculus
tatcactttcaaaggcatctagtct

SEQ ID NO: 352713 - DNA, 25 bp, Mus musculus
tatcagaaactccaggaccaggagg

SEQ ID NO: 352714 - DNA, 25 bp, Mus musculus
tatcagaaagctgtcggtgaccctg

SEQ ID NO: 352715 - DNA, 25 bp, Mus musculus
tatcagaaaggagatgaatatgacg

SEQ ID NO: 352716 - DNA, 25 bp, Mus musculus
tatcagaaagggatgaatatgagga

SEQ ID NO: 352717 - DNA, 25 bp, Mus musculus
tatcagaagaagattggagcatatg

SEQ ID NO: 352718 - DNA, 25 bp, Mus musculus
tatcagaagaagattggagcctatg

SEQ ID NO: 352719 - DNA, 25 bp, Mus musculus
tatcagaagaagggtttcaaaaaca

SEQ ID NO: 352720 - DNA, 25 bp, Mus musculus
tatcagaagaaggtcaaagaaggca

SEQ ID NO: 352721 - DNA, 25 bp, Mus musculus
tatcagaataaggttcagcctatgg

SEQ ID NO: 352722 - DNA, 25 bp, Mus musculus
tatcagacagctcttgctgtttcca

SEQ ID NO: 352723 - DNA, 25 bp, Mus musculus
tatcagacagtgacccagttgacat

SEQ ID NO: 352724 - DNA, 25 bp, Mus musculus
tatcagactcttcatttgatgcagc

SEQ ID NO: 352725 - DNA, 25 bp, Mus musculus
tatcagagagacaagattgaggatg

SEQ ID NO: 352726 - DNA, 25 bp, Mus musculus
tatcagagatatcataggacccaga

SEQ ID NO: 352727 - DNA, 25 bp, Mus musculus
tatcagagatggacctgcaggtgaa

SEQ ID NO: 352728 - DNA, 25 bp, Mus musculus
tatcagatgcaggttgcgttacagt

SEQ ID NO: 352729 - DNA, 25 bp, Mus musculus
tatcagcaaaaacaaatcattgcaa

SEQ ID NO: 352730 - DNA, 25 bp, Mus musculus
tatcagcaactgacaggggagcaaa

SEQ ID NO: 352731 - DNA, 25 bp, Mus musculus
tatcagcacattatagtggaacacc

SEQ ID NO: 352732 - DNA, 25 bp, Mus musculus
tatcagcacggacgattccggagct

SEQ ID NO: 352733 - DNA, 25 bp, Mus musculus
tatcagcacgggtcacccagaagcg

SEQ ID NO: 352734 - DNA, 25 bp, Mus musculus
tatcagcccggcagccacatgttcc

SEQ ID NO: 352735 - DNA, 25 bp, Mus musculus
tatcagctgcaggtggccaagacga

SEQ ID NO: 352736 - DNA, 25 bp, Mus musculus
tatcagcttagaaggctgtgaatga

SEQ ID NO: 352737 - DNA, 25 bp, Mus musculus
tatcagcttttgcagatgaatatga

SEQ ID NO: 352738 - DNA, 25 bp, Mus musculus
tatcagcttttgcagggggcaccct

SEQ ID NO: 352739 - DNA, 25 bp, Mus musculus
tatcagcttttgcagtggacatccc

SEQ ID NO: 352740 - DNA, 25 bp, Mus musculus
tatcagggatgtaggagatgagccg

SEQ ID NO: 352741 - DNA, 25 bp, Mus musculus
tatcagggctcaaggaggtagatga

SEQ ID NO: 352742 - DNA, 25 bp, Mus musculus
tatcagtcagccccaacatccagaa

SEQ ID NO: 352743 - DNA, 25 bp, Mus musculus
tatcagtcaggattctgaatcagga

SEQ ID NO: 352744 - DNA, 25 bp, Mus musculus
tatcagtcagggttacagagtcatc

SEQ ID NO: 352745 - DNA, 25 bp, Mus musculus
tatcagtctcagcatcctcatgtgt

SEQ ID NO: 352746 - DNA, 25 bp, Mus musculus
tatcagtgagatttcaccgagatga

SEQ ID NO: 352747 - DNA, 25 bp, Mus musculus
tatcagtgagtaccgtggccttcca

SEQ ID NO: 352748 - DNA, 25 bp, Mus musculus
tatcagtggattctgaccacctcat

SEQ ID NO: 352749 - DNA, 25 bp, Mus musculus
tatcagttatctgacccttcctatc

SEQ ID NO: 352750 - DNA, 25 bp, Mus musculus
tatcagttgttgagctctgaactca

SEQ ID NO: 352751 - DNA, 25 bp, Mus musculus
tatcagtttaggattcagctggcgg

SEQ ID NO: 352752 - DNA, 25 bp, Mus musculus
tatcataactatcgcgaacgagaga

SEQ ID NO: 352753 - DNA, 25 bp, Mus musculus
tatcatatctggccatcagacactg

SEQ ID NO: 352754 - DNA, 25 bp, Mus musculus
tatcatatctgtgtgaaaataggat

SEQ ID NO: 352755 - DNA, 25 bp, Mus musculus
tatcatatgataatattaagaatgc

SEQ ID NO: 352756 - DNA, 25 bp, Mus musculus
tatcatatgatagtctgatatgccg

SEQ ID NO: 352757 - DNA, 25 bp, Mus musculus
tatcatcaaaactggaagtttggtg

SEQ ID NO: 352758 - DNA, 25 bp, Mus musculus
tatcatccaggccattccccagtat

SEQ ID NO: 352759 - DNA, 25 bp, Mus musculus
tatcatccaggtgtgttatccacgc

SEQ ID NO: 352760 - DNA, 25 bp, Mus musculus
tatcatccagttgctgcttcaagcg

SEQ ID NO: 352761 - DNA, 25 bp, Mus musculus
tatcatccggaaggctgtggcagtt

SEQ ID NO: 352762 - DNA, 25 bp, Mus musculus
tatcatccggaagtgtgtccctcca

SEQ ID NO: 352763 - DNA, 25 bp, Mus musculus
tatcatccttagcaagagatgtcga

SEQ ID NO: 352764 - DNA, 25 bp, Mus musculus
tatcatctcagatggaggctgcagc

SEQ ID NO: 352765 - DNA, 25 bp, Mus musculus
tatcatgacattcgcttcaaaatcc

SEQ ID NO: 352766 - DNA, 25 bp, Mus musculus
tatcatgaggtcggcagattcagag

SEQ ID NO: 352767 - DNA, 25 bp, Mus musculus
tatcatgggaatctgatccgctgta

SEQ ID NO: 352768 - DNA, 25 bp, Mus musculus
tatcatgggtattggtccagtccct

SEQ ID NO: 352769 - DNA, 25 bp, Mus musculus
tatcatggtgagtcatctccatcca

SEQ ID NO: 352770 - DNA, 25 bp, Mus musculus
tatcatggtgcagtaccatgcacta

SEQ ID NO: 352771 - DNA, 25 bp, Mus musculus
tatcatgtcacacagcactcatgaa

SEQ ID NO: 352772 - DNA, 25 bp, Mus musculus
tatcatgtcttcaagtaaaggatct

SEQ ID NO: 352773 - DNA, 25 bp, Mus musculus
tatcatgttgaagatggtaaaagct

SEQ ID NO: 352774 - DNA, 25 bp, Mus musculus
tatcatgttgaagctcatctacgga

SEQ ID NO: 352775 - DNA, 25 bp, Mus musculus
tatcattaagcaaagcactattgtg

SEQ ID NO: 352776 - DNA, 25 bp, Mus musculus
tatcattagcaacgctgttcctggg

SEQ ID NO: 352777 - DNA, 25 bp, Mus musculus
tatcattattcagggattgcttaca

SEQ ID NO: 352778 - DNA, 25 bp, Mus musculus
tatcattattcagttgtttgttgct

SEQ ID NO: 352779 - DNA, 25 bp, Mus musculus
tatcattgagggcagcctggacact

SEQ ID NO: 352780 - DNA, 25 bp, Mus musculus
tatcatttagaggacattcactgaa

SEQ ID NO: 352781 - DNA, 25 bp, Mus musculus
tatcatttttaatcagtctgttatc

SEQ ID NO: 352782 - DNA, 25 bp, Mus musculus
tatcattttttcgtcacagatcaca

SEQ ID NO: 352783 - DNA, 25 bp, Mus musculus
tatccaaaagaaatccagagagaga

SEQ ID NO: 352784 - DNA, 25 bp, Mus musculus
tatccaaaagataggaagtgcagag

SEQ ID NO: 352785 - DNA, 25 bp, Mus musculus
tatccaaaagcaaatttcgcagaaa

SEQ ID NO: 352786 - DNA, 25 bp, Mus musculus
tatccaaaatcaggaacccactggt

SEQ ID NO: 352787 - DNA, 25 bp, Mus musculus
tatccaagcaggctgtcgcttaccg

SEQ ID NO: 352788 - DNA, 25 bp, Mus musculus
tatccaagtaatgagaggaagacga

SEQ ID NO: 352789 - DNA, 25 bp, Mus musculus
tatccaatgccaatcgctgcctcca

SEQ ID NO: 352790 - DNA, 25 bp, Mus musculus
tatccacaacaggtgtgagcaggtg

SEQ ID NO: 352791 - DNA, 25 bp, Mus musculus
tatccacaacaggttccacccgact

SEQ ID NO: 352792 - DNA, 25 bp, Mus musculus
tatccacagcccctttgacactcct

SEQ ID NO: 352793 - DNA, 25 bp, Mus musculus
tatccacatgggtctcctggaagag

SEQ ID NO: 352794 - DNA, 25 bp, Mus musculus
tatccaccctgacaggatgcaagct

SEQ ID NO: 352795 - DNA, 25 bp, Mus musculus
tatccaccctgacaggcaggtacca

SEQ ID NO: 352796 - DNA, 25 bp, Mus musculus
tatccaccctgacaggggcataagg

SEQ ID NO: 352797 - DNA, 25 bp, Mus musculus
tatccacgcagcctctgcctcggtg

SEQ ID NO: 352798 - DNA, 25 bp, Mus musculus
tatccacgcagctgccccttaccgg

SEQ ID NO: 352799 - DNA, 25 bp, Mus musculus
tatccacgctttctctgctgcccta

SEQ ID NO: 352800 - DNA, 25 bp, Mus musculus
tatccactcaattttaaagaaatcc

SEQ ID NO: 352801 - DNA, 25 bp, Mus musculus
tatccactttcttgggtctttgggg

SEQ ID NO: 352802 - DNA, 25 bp, Mus musculus
tatccagaacagggcgtgcctagga

SEQ ID NO: 352803 - DNA, 25 bp, Mus musculus
tatccagaacaggtgaccttggagt

SEQ ID NO: 352804 - DNA, 25 bp, Mus musculus
tatccagaggaagttgtcctggtca

SEQ ID NO: 352805 - DNA, 25 bp, Mus musculus
tatccagagtggagctgtaatagac

SEQ ID NO: 352806 - DNA, 25 bp, Mus musculus
tatccagatgtaagtgccctggaac

SEQ ID NO: 352807 - DNA, 25 bp, Mus musculus
tatccagcaaaccagaagagccctt

SEQ ID NO: 352808 - DNA, 25 bp, Mus musculus
tatccagcagctcagggactcagcg

SEQ ID NO: 352809 - DNA, 25 bp, Mus musculus
tatccaggaagaaattccaaattac

SEQ ID NO: 352810 - DNA, 25 bp, Mus musculus
tatccaggaaggctcagcaacaact

SEQ ID NO: 352811 - DNA, 25 bp, Mus musculus
tatccaggacagttgtccacgtaca

SEQ ID NO: 352812 - DNA, 25 bp, Mus musculus
tatccaggagagagtctccgctgct

SEQ ID NO: 352813 - DNA, 25 bp, Mus musculus
tatccaggaggtgacccacaaccag

SEQ ID NO: 352814 - DNA, 25 bp, Mus musculus
tatccaggagttgatctttatagag

SEQ ID NO: 352815 - DNA, 25 bp, Mus musculus
tatccagtcgcccctcccagagacc

SEQ ID NO: 352816 - DNA, 25 bp, Mus musculus
tatccagtcgccttctccttgcagc

SEQ ID NO: 352817 - DNA, 25 bp, Mus musculus
tatccataaacacggcttttttcac

SEQ ID NO: 352818 - DNA, 25 bp, Mus musculus
tatccatcggagccggggggacctc

SEQ ID NO: 352819 - DNA, 25 bp, Mus musculus
tatccatgaaggagcctacagaaac

SEQ ID NO: 352820 - DNA, 25 bp, Mus musculus
tatccatgaaggagtccgctcagaa

SEQ ID NO: 352821 - DNA, 25 bp, Mus musculus
tatccatgcggctgtgtggagatgg

SEQ ID NO: 352822 - DNA, 25 bp, Mus musculus
tatccatggagggctgagccggatc

SEQ ID NO: 352823 - DNA, 25 bp, Mus musculus
tatccatggcatcagaacggggctc

SEQ ID NO: 352824 - DNA, 25 bp, Mus musculus
tatccatggcatcaggacgggcctc

SEQ ID NO: 352825 - DNA, 25 bp, Mus musculus
tatccattgcataaccccaaatctc

SEQ ID NO: 352826 - DNA, 25 bp, Mus musculus
tatcccaaagcctgaaaccaaaatt

SEQ ID NO: 352827 - DNA, 25 bp, Mus musculus
tatcccaaagcctgatgaggatgat

SEQ ID NO: 352828 - DNA, 25 bp, Mus musculus
tatcccaagagggtgtagcccggat

SEQ ID NO: 352829 - DNA, 25 bp, Mus musculus
tatcccaatgtggaagaagctcaga

SEQ ID NO: 352830 - DNA, 25 bp, Mus musculus
tatcccacagatggtatggtgtatg

SEQ ID NO: 352831 - DNA, 25 bp, Mus musculus
tatcccagaaaggatgaggccatcc

SEQ ID NO: 352832 - DNA, 25 bp, Mus musculus
tatcccagatctctctggcttttgg

SEQ ID NO: 352833 - DNA, 25 bp, Mus musculus
tatcccagatgctcatctttgggta

SEQ ID NO: 352834 - DNA, 25 bp, Mus musculus
tatcccagttctcagagccccgtat

SEQ ID NO: 352835 - DNA, 25 bp, Mus musculus
tatccccaacacggtcggaaactcc

SEQ ID NO: 352836 - DNA, 25 bp, Mus musculus
tatccccaacagcgggaacttcatt

SEQ ID NO: 352837 - DNA, 25 bp, Mus musculus
tatccccaacaggtggtgaagcagt

SEQ ID NO: 352838 - DNA, 25 bp, Mus musculus
tatccccacagcagtcctgtggatc

SEQ ID NO: 352839 - DNA, 25 bp, Mus musculus
tatccccatggaaagggctgtgagg

SEQ ID NO: 352840 - DNA, 25 bp, Mus musculus
tatccccctcacagtaattcttcag

SEQ ID NO: 352841 - DNA, 25 bp, Mus musculus
tatccccttatcagagcctgcccca

SEQ ID NO: 352842 - DNA, 25 bp, Mus musculus
tatcccggagaagaggcaatcaagc

SEQ ID NO: 352843 - DNA, 25 bp, Mus musculus
tatccctaagattttgttcctggca

SEQ ID NO: 352844 - DNA, 25 bp, Mus musculus
tatccctcaagtgaccacacactgg

SEQ ID NO: 352845 - DNA, 25 bp, Mus musculus
tatccctgagagctgctcctttgga

SEQ ID NO: 352846 - DNA, 25 bp, Mus musculus
tatccctgctatgacactggctgga

SEQ ID NO: 352847 - DNA, 25 bp, Mus musculus
tatccctggctccctcatcagcgaa

SEQ ID NO: 352848 - DNA, 25 bp, Mus musculus
tatccgaagcccaagaaataaatca

SEQ ID NO: 352849 - DNA, 25 bp, Mus musculus
tatccgactacgggtggactatagt

SEQ ID NO: 352850 - DNA, 25 bp, Mus musculus
tatccgagtaatcctgtgtcttggt

SEQ ID NO: 352851 - DNA, 25 bp, Mus musculus
tatccgcccaacaggcgctgtgagg

SEQ ID NO: 352852 - DNA, 25 bp, Mus musculus
tatccgcccaacatgccaccttaca

SEQ ID NO: 352853 - DNA, 25 bp, Mus musculus
tatccgccccagaccctgttagacc

SEQ ID NO: 352854 - DNA, 25 bp, Mus musculus
tatccgtgagtcagatgttccagcc

SEQ ID NO: 352855 - DNA, 25 bp, Mus musculus
tatcctaaaggggtctttgtgaaca

SEQ ID NO: 352856 - DNA, 25 bp, Mus musculus
tatcctaaagggtgacaaaggggac

SEQ ID NO: 352857 - DNA, 25 bp, Mus musculus
tatcctaaatttaagtatgcagtac

SEQ ID NO: 352858 - DNA, 25 bp, Mus musculus
tatcctacagggaaatgcatagatc

SEQ ID NO: 352859 - DNA, 25 bp, Mus musculus
tatcctacctacggtgactctggca

SEQ ID NO: 352860 - DNA, 25 bp, Mus musculus
tatcctatgaaggtggtatgtccgt

SEQ ID NO: 352861 - DNA, 25 bp, Mus musculus
tatcctctctggcctctctcttgtg

SEQ ID NO: 352862 - DNA, 25 bp, Mus musculus
tatcctctggagtcgagctcctggg

SEQ ID NO: 352863 - DNA, 25 bp, Mus musculus
tatcctctggagtcgatgaggatcc

SEQ ID NO: 352864 - DNA, 25 bp, Mus musculus
tatcctctttgacactctcgtgggc

SEQ ID NO: 352865 - DNA, 25 bp, Mus musculus
tatcctctttgacacttttctcaac

SEQ ID NO: 352866 - DNA, 25 bp, Mus musculus
tatcctgaaggaaagaccgtagagg

SEQ ID NO: 352867 - DNA, 25 bp, Mus musculus
tatcctgaagtgattttcctcgcat

SEQ ID NO: 352868 - DNA, 25 bp, Mus musculus
tatcctgacagctacgacacgtgga

SEQ ID NO: 352869 - DNA, 25 bp, Mus musculus
tatcctgagagacaggcaataccgg

SEQ ID NO: 352870 - DNA, 25 bp, Mus musculus
tatcctgagcaaaggctacaacaag

SEQ ID NO: 352871 - DNA, 25 bp, Mus musculus
tatcctgaggttgcaggtcagcaat

SEQ ID NO: 352872 - DNA, 25 bp, Mus musculus
tatcctgcaagggagcccggtggtt

SEQ ID NO: 352873 - DNA, 25 bp, Mus musculus
tatcctggactgagctcctggctaa

SEQ ID NO: 352874 - DNA, 25 bp, Mus musculus
tatcctggtgcctagatgctgaatg

SEQ ID NO: 352875 - DNA, 25 bp, Mus musculus
tatcctggtgttgggtatgagatgg

SEQ ID NO: 352876 - DNA, 25 bp, Mus musculus
tatccttaagatgactgcttacggg

SEQ ID NO: 352877 - DNA, 25 bp, Mus musculus
tatccttcaggatggaacagactat

SEQ ID NO: 352878 - DNA, 25 bp, Mus musculus
tatccttccagatgtatcgggatat

SEQ ID NO: 352879 - DNA, 25 bp, Mus musculus
tatccttccagatgtatctggatat

SEQ ID NO: 352880 - DNA, 25 bp, Mus musculus
tatccttccaggagtttatcatgtg

SEQ ID NO: 352881 - DNA, 25 bp, Mus musculus
tatccttctagtgttgggcaaccat

SEQ ID NO: 352882 - DNA, 25 bp, Mus musculus
tatccttggagaatggttataagta

SEQ ID NO: 352883 - DNA, 25 bp, Mus musculus
tatcctttttcaacttggagaagaa

SEQ ID NO: 352884 - DNA, 25 bp, Mus musculus
tatcgaaaaggctgtaatttggcct

SEQ ID NO: 352885 - DNA, 25 bp, Mus musculus
tatcgaaaatgagcaactggtggtt

SEQ ID NO: 352886 - DNA, 25 bp, Mus musculus
tatcgacaacatgaatgaatctgag

SEQ ID NO: 352887 - DNA, 25 bp, Mus musculus
tatcgacccgaagagtacagtcgtt

SEQ ID NO: 352888 - DNA, 25 bp, Mus musculus
tatcgacccgaaggtcgttttgaag

SEQ ID NO: 352889 - DNA, 25 bp, Mus musculus
tatcgacttcaggctgatctcttcg

SEQ ID NO: 352890 - DNA, 25 bp, Mus musculus
tatcgaggaggcagcgggccgtgaa

SEQ ID NO: 352891 - DNA, 25 bp, Mus musculus
tatcgaggatttagctggtccaaag

SEQ ID NO: 352892 - DNA, 25 bp, Mus musculus
tatcgagtacgaagtgggctaaagc

SEQ ID NO: 352893 - DNA, 25 bp, Mus musculus
tatcgcatttttcaataatgtatat

SEQ ID NO: 352894 - DNA, 25 bp, Mus musculus
tatcgccagtgatttccggtacaaa

SEQ ID NO: 352895 - DNA, 25 bp, Mus musculus
tatcgccccctggcaggtgatgctt

SEQ ID NO: 352896 - DNA, 25 bp, Mus musculus
tatcgctgcaggaacgtttggatga

SEQ ID NO: 352897 - DNA, 25 bp, Mus musculus
tatcggaactgagccatctcttggc

SEQ ID NO: 352898 - DNA, 25 bp, Mus musculus
tatcggattcacaaataaagtggtg

SEQ ID NO: 352899 - DNA, 25 bp, Mus musculus
tatcggcagcgtcaggggacagacc

SEQ ID NO: 352900 - DNA, 25 bp, Mus musculus
tatcggcaggcagaggcagatatca

SEQ ID NO: 352901 - DNA, 25 bp, Mus musculus
tatcggcatggtttgctaggtattg

SEQ ID NO: 352902 - DNA, 25 bp, Mus musculus
tatcggcatgttctctgaattcctg

SEQ ID NO: 352903 - DNA, 25 bp, Mus musculus
tatcggcgagcccagggaatatttt

SEQ ID NO: 352904 - DNA, 25 bp, Mus musculus
tatcggcgagcccagtacgctccag

SEQ ID NO: 352905 - DNA, 25 bp, Mus musculus
tatcgggcttcagggggctgaggcg

SEQ ID NO: 352906 - DNA, 25 bp, Mus musculus
tatcgggtcatctaagaatgaagcc

SEQ ID NO: 352907 - DNA, 25 bp, Mus musculus
tatcgtcaaagaaggggaggaagtt

SEQ ID NO: 352908 - DNA, 25 bp, Mus musculus
tatcgtcaagtactggttgggtggt

SEQ ID NO: 352909 - DNA, 25 bp, Mus musculus
tatcgtcaagtactggtttacagga

SEQ ID NO: 352910 - DNA, 25 bp, Mus musculus
tatcgtccaggtatttgataacacg

SEQ ID NO: 352911 - DNA, 25 bp, Mus musculus
tatcgtcccagttttcgcataccat

SEQ ID NO: 352912 - DNA, 25 bp, Mus musculus
tatcgtcctgcgctctttgagcgct

SEQ ID NO: 352913 - DNA, 25 bp, Mus musculus
tatcgtcggtattttcaggaaatca

SEQ ID NO: 352914 - DNA, 25 bp, Mus musculus
tatcgtgggtggagctgaagaaagc

SEQ ID NO: 352915 - DNA, 25 bp, Mus musculus
tatcgtgtgagccagatcttctgga

SEQ ID NO: 352916 - DNA, 25 bp, Mus musculus
tatcgttatgttgattcacaatgac

SEQ ID NO: 352917 - DNA, 25 bp, Mus musculus
tatcgttcttgtcaataaggtaatg

SEQ ID NO: 352918 - DNA, 25 bp, Mus musculus
tatcgtttgaaaaagtcctaatcct

SEQ ID NO: 352919 - DNA, 25 bp, Mus musculus
tatctaaagtggttccctcaacccc

SEQ ID NO: 352920 - DNA, 25 bp, Mus musculus
tatctaaccagcagatagtctacat

SEQ ID NO: 352921 - DNA, 25 bp, Mus musculus
tatctaagagtgcttggctgtctgg

SEQ ID NO: 352922 - DNA, 25 bp, Mus musculus
tatctaaggaaggaaaaccataagg

SEQ ID NO: 352923 - DNA, 25 bp, Mus musculus
tatctaatatcagcgctcatgctcc

SEQ ID NO: 352924 - DNA, 25 bp, Mus musculus
tatctaatgatgctttcagacttgg

SEQ ID NO: 352925 - DNA, 25 bp, Mus musculus
tatctaatgatggaacatgtctcag

SEQ ID NO: 352926 - DNA, 25 bp, Mus musculus
tatctacactgaattttagaaagga

SEQ ID NO: 352927 - DNA, 25 bp, Mus musculus
tatctacactgagtccaaacatcac

SEQ ID NO: 352928 - DNA, 25 bp, Mus musculus
tatctacactgagtgccagtcatta

SEQ ID NO: 352929 - DNA, 25 bp, Mus musculus
tatctacactgagtggttcctcaga

SEQ ID NO: 352930 - DNA, 25 bp, Mus musculus
tatctacagtgggcagcaaagattc

SEQ ID NO: 352931 - DNA, 25 bp, Mus musculus
tatctacagtgggccggcggccaat

SEQ ID NO: 352932 - DNA, 25 bp, Mus musculus
tatctacatatcaactcaacaagga

SEQ ID NO: 352933 - DNA, 25 bp, Mus musculus
tatctacatttcagacatcccgctt

SEQ ID NO: 352934 - DNA, 25 bp, Mus musculus
tatctacatttcagatcctcctacc

SEQ ID NO: 352935 - DNA, 25 bp, Mus musculus
tatctaccacaaatattatcactac

SEQ ID NO: 352936 - DNA, 25 bp, Mus musculus
tatctaccacaacctgaagaacatg

SEQ ID NO: 352937 - DNA, 25 bp, Mus musculus
tatctaccaccaacgagagccatcc

SEQ ID NO: 352938 - DNA, 25 bp, Mus musculus
tatctaccaggtaagattaaaagac

SEQ ID NO: 352939 - DNA, 25 bp, Mus musculus
tatctacctgcagagctttgtggcg

SEQ ID NO: 352940 - DNA, 25 bp, Mus musculus
tatctacctgcaggtcacccacgtg

SEQ ID NO: 352941 - DNA, 25 bp, Mus musculus
tatctacgagaccctcctctggctg

SEQ ID NO: 352942 - DNA, 25 bp, Mus musculus
tatctacggcagaaaggggagtgtg

SEQ ID NO: 352943 - DNA, 25 bp, Mus musculus
tatctacggcagtacatttttatac

SEQ ID NO: 352944 - DNA, 25 bp, Mus musculus
tatctacgggcaggctcccggacct

SEQ ID NO: 352945 - DNA, 25 bp, Mus musculus
tatctactacaaggtttgaagagtg

SEQ ID NO: 352946 - DNA, 25 bp, Mus musculus
tatctagagaaatatgtgcatgagc

SEQ ID NO: 352947 - DNA, 25 bp, Mus musculus
tatctagcacccaggttactcggcg

SEQ ID NO: 352948 - DNA, 25 bp, Mus musculus
tatctagtgccaggaaaatactaaa

SEQ ID NO: 352949 - DNA, 25 bp, Mus musculus
tatctataccagataaaaactacag

SEQ ID NO: 352950 - DNA, 25 bp, Mus musculus
tatctatatggcaccagaggtcatc

SEQ ID NO: 352951 - DNA, 25 bp, Mus musculus
tatctatcgaaaatgagcaactggt

SEQ ID NO: 352952 - DNA, 25 bp, Mus musculus
tatctatctatcatctatctaccta

SEQ ID NO: 352953 - DNA, 25 bp, Mus musculus
tatctatgcagggtgacaagggaga

SEQ ID NO: 352954 - DNA, 25 bp, Mus musculus
tatctcaaagcaagccccgcccaac

SEQ ID NO: 352955 - DNA, 25 bp, Mus musculus
tatctcaacaaggcacggcagctct

SEQ ID NO: 352956 - DNA, 25 bp, Mus musculus
tatctcaacagcaagctgcctagtt

SEQ ID NO: 352957 - DNA, 25 bp, Mus musculus
tatctcaccagttgtgtgaattatg

SEQ ID NO: 352958 - DNA, 25 bp, Mus musculus
tatctcaccattgttataataaaga

SEQ ID NO: 352959 - DNA, 25 bp, Mus musculus
tatctcacccagacaggcttctaaa

SEQ ID NO: 352960 - DNA, 25 bp, Mus musculus
tatctcactacggaggtgcatcctg

SEQ ID NO: 352961 - DNA, 25 bp, Mus musculus
tatctcactgaaagatttgtataca

SEQ ID NO: 352962 - DNA, 25 bp, Mus musculus
tatctcagcaggtaaatgagaaaac

SEQ ID NO: 352963 - DNA, 25 bp, Mus musculus
tatctcagcaggtggcagctagttt

SEQ ID NO: 352964 - DNA, 25 bp, Mus musculus
tatctcagccatgatggtaacaaaa

SEQ ID NO: 352965 - DNA, 25 bp, Mus musculus
tatctcagtggaggagaactattta

SEQ ID NO: 352966 - DNA, 25 bp, Mus musculus
tatctcatcatagatatcacaacca

SEQ ID NO: 352967 - DNA, 25 bp, Mus musculus
tatctcatcatagatgacttccata

SEQ ID NO: 352968 - DNA, 25 bp, Mus musculus
tatctccaaaccccattcaacctct

SEQ ID NO: 352969 - DNA, 25 bp, Mus musculus
tatctccaaacccctgagggagagc

SEQ ID NO: 352970 - DNA, 25 bp, Mus musculus
tatctccaagcatgctggactatga

SEQ ID NO: 352971 - DNA, 25 bp, Mus musculus
tatctccaagtcggttgtggggttg

SEQ ID NO: 352972 - DNA, 25 bp, Mus musculus
tatctccacaaaggtgtattccctg

SEQ ID NO: 352973 - DNA, 25 bp, Mus musculus
tatctccaccagtcggtgttgactt

SEQ ID NO: 352974 - DNA, 25 bp, Mus musculus
tatctccagtaccattgcaagtact

SEQ ID NO: 352975 - DNA, 25 bp, Mus musculus
tatctccatctcttcccactggaag

SEQ ID NO: 352976 - DNA, 25 bp, Mus musculus
tatctccgggtctcactgttagagt

SEQ ID NO: 352977 - DNA, 25 bp, Mus musculus
tatctcctccagcggcagtacatcc

SEQ ID NO: 352978 - DNA, 25 bp, Mus musculus
tatctcctccgcagaggccaagtga

SEQ ID NO: 352979 - DNA, 25 bp, Mus musculus
tatctcctcgacgggtcctgcatgg

SEQ ID NO: 352980 - DNA, 25 bp, Mus musculus
tatctcctcgctcttcgaacggacc

SEQ ID NO: 352981 - DNA, 25 bp, Mus musculus
tatctcctctcctgaaaatgactcc

SEQ ID NO: 352982 - DNA, 25 bp, Mus musculus
tatctcgcagaggagttagcgacgc

SEQ ID NO: 352983 - DNA, 25 bp, Mus musculus
tatctcgtgggccttacgatgggcc

SEQ ID NO: 352984 - DNA, 25 bp, Mus musculus
tatctctacagctcagatgttttta

SEQ ID NO: 352985 - DNA, 25 bp, Mus musculus
tatctctcctaaaaggattgcaaaa

SEQ ID NO: 352986 - DNA, 25 bp, Mus musculus
tatctctctctgtggaggtgaagcc

SEQ ID NO: 352987 - DNA, 25 bp, Mus musculus
tatctctgaagcactgcgcaagatg

SEQ ID NO: 352988 - DNA, 25 bp, Mus musculus
tatctctgctttcctgggaaggtgt

SEQ ID NO: 352989 - DNA, 25 bp, Mus musculus
tatctctgttggggcttcacaccta

SEQ ID NO: 352990 - DNA, 25 bp, Mus musculus
tatctcttcaggtgccagcctcaca

SEQ ID NO: 352991 - DNA, 25 bp, Mus musculus
tatctctttcaggtagagcttgaga

SEQ ID NO: 352992 - DNA, 25 bp, Mus musculus
tatctctttcagtatcctgtgcgtc

SEQ ID NO: 352993 - DNA, 25 bp, Mus musculus
tatctgaaagaccccgcttggctgt

SEQ ID NO: 352994 - DNA, 25 bp, Mus musculus
tatctgaaagattgctgaagctaaa

SEQ ID NO: 352995 - DNA, 25 bp, Mus musculus
tatctgaaaggcttacctctaaaaa

SEQ ID NO: 352996 - DNA, 25 bp, Mus musculus
tatctgaaagtggtcccaaaccaag

SEQ ID NO: 352997 - DNA, 25 bp, Mus musculus
tatctgacaggatggcttgccttct

SEQ ID NO: 352998 - DNA, 25 bp, Mus musculus
tatctgacctgtgctgagcctacca

SEQ ID NO: 352999 - DNA, 25 bp, Mus musculus
tatctgagaaaacaggtcttaattt

SEQ ID NO: 353000 - DNA, 25 bp, Mus musculus
tatctgagaaatcaggtcttaattt

SEQ ID NO: 353001 - DNA, 25 bp, Mus musculus
tatctgaggatacagcaacttctaa

SEQ ID NO: 353002 - DNA, 25 bp, Mus musculus
tatctgatagcctgggtttgtcact

SEQ ID NO: 353003 - DNA, 25 bp, Mus musculus
tatctgattcaggtacacaactgga

SEQ ID NO: 353004 - DNA, 25 bp, Mus musculus
tatctgcaagccaagcagtctctgg

SEQ ID NO: 353005 - DNA, 25 bp, Mus musculus
tatctgcatgagcagtaccccctgg

SEQ ID NO: 353006 - DNA, 25 bp, Mus musculus
tatctgcatgagcagtcgatggctg

SEQ ID NO: 353007 - DNA, 25 bp, Mus musculus
tatctgcatgttgagacacaaagat

SEQ ID NO: 353008 - DNA, 25 bp, Mus musculus
tatctgccagcagaatggcattgta

SEQ ID NO: 353009 - DNA, 25 bp, Mus musculus
tatctgcctaccaggtgcagagccc

SEQ ID NO: 353010 - DNA, 25 bp, Mus musculus
tatctgcctaccaggtggcaaagga

SEQ ID NO: 353011 - DNA, 25 bp, Mus musculus
tatctgcgctggcaggttgtagata

SEQ ID NO: 353012 - DNA, 25 bp, Mus musculus
tatctgctaaggctttggagttttt

SEQ ID NO: 353013 - DNA, 25 bp, Mus musculus
tatctgctgcccctcctgggccctg

SEQ ID NO: 353014 - DNA, 25 bp, Mus musculus
tatctgcttgtagagctgtcggcca

SEQ ID NO: 353015 - DNA, 25 bp, Mus musculus
tatctggaaaatgccactccgtgta

SEQ ID NO: 353016 - DNA, 25 bp, Mus musculus
tatctggaacagggaacaagcttat

SEQ ID NO: 353017 - DNA, 25 bp, Mus musculus
tatctggaggagctggaccagatct

SEQ ID NO: 353018 - DNA, 25 bp, Mus musculus
tatctggcaagagcggcctcggtgc

SEQ ID NO: 353019 - DNA, 25 bp, Mus musculus
tatctggccagaaatggcctccacc

SEQ ID NO: 353020 - DNA, 25 bp, Mus musculus
tatctggggattctacagcacaggg

SEQ ID NO: 353021 - DNA, 25 bp, Mus musculus
tatctgtaccagggtgtacattggt

SEQ ID NO: 353022 - DNA, 25 bp, Mus musculus
tatctgtctgcaggtgttatttcca

SEQ ID NO: 353023 - DNA, 25 bp, Mus musculus
tatctgtgaagcttcttaaccccaa

SEQ ID NO: 353024 - DNA, 25 bp, Mus musculus
tatctgtgcatgggccagcgtgacg

SEQ ID NO: 353025 - DNA, 25 bp, Mus musculus
tatctgtgtacagggttcggcagac

SEQ ID NO: 353026 - DNA, 25 bp, Mus musculus
tatctgtgtatagagttcgaaattt

SEQ ID NO: 353027 - DNA, 25 bp, Mus musculus
tatctgtgtatagatgatgaggaat

SEQ ID NO: 353028 - DNA, 25 bp, Mus musculus
tatctgtgtttccctacatccagaa

SEQ ID NO: 353029 - DNA, 25 bp, Mus musculus
tatctgttatgaaacaaatgtcctc

SEQ ID NO: 353030 - DNA, 25 bp, Mus musculus
tatctgtttgtctctagataaggtg

SEQ ID NO: 353031 - DNA, 25 bp, Mus musculus
tatcttaagaggaggtccttgttca

SEQ ID NO: 353032 - DNA, 25 bp, Mus musculus
tatcttactcagaaaaatttcctat

SEQ ID NO: 353033 - DNA, 25 bp, Mus musculus
tatcttactcagggcattacacaag

SEQ ID NO: 353034 - DNA, 25 bp, Mus musculus
tatcttcaagcagagaaagaacgaa

SEQ ID NO: 353035 - DNA, 25 bp, Mus musculus
tatcttcaagcagcctgaaaggcaa

SEQ ID NO: 353036 - DNA, 25 bp, Mus musculus
tatcttcaatgaaattacacttgtg

SEQ ID NO: 353037 - DNA, 25 bp, Mus musculus
tatcttcaatggtctgacagtctct

SEQ ID NO: 353038 - DNA, 25 bp, Mus musculus
tatcttcagtcaagacctttggagc

SEQ ID NO: 353039 - DNA, 25 bp, Mus musculus
tatcttcattaagatggatgtaggt

SEQ ID NO: 353040 - DNA, 25 bp, Mus musculus
tatcttcctgagatgctgtcccctc

SEQ ID NO: 353041 - DNA, 25 bp, Mus musculus
tatcttcgagataagacagtgatga

SEQ ID NO: 353042 - DNA, 25 bp, Mus musculus
tatcttctacatggtgccatcagca

SEQ ID NO: 353043 - DNA, 25 bp, Mus musculus
tatcttctccaagttgctgcaatag

SEQ ID NO: 353044 - DNA, 25 bp, Mus musculus
tatcttctgggcggaacgaagagct

SEQ ID NO: 353045 - DNA, 25 bp, Mus musculus
tatcttcttcacaggaagtcctcgg

SEQ ID NO: 353046 - DNA, 25 bp, Mus musculus
tatcttctttctcatctttgggtaa

SEQ ID NO: 353047 - DNA, 25 bp, Mus musculus
tatcttgaagcaggtggactcccct

SEQ ID NO: 353048 - DNA, 25 bp, Mus musculus
tatcttgcagttcatggcatctcat

SEQ ID NO: 353049 - DNA, 25 bp, Mus musculus
tatcttgcttcgaagccagacacac

SEQ ID NO: 353050 - DNA, 25 bp, Mus musculus
tatcttggaccacgctatggttttg

SEQ ID NO: 353051 - DNA, 25 bp, Mus musculus
tatcttgtaagctaaacagaaagaa

SEQ ID NO: 353052 - DNA, 25 bp, Mus musculus
tatctttaagcaacctcactttggc

SEQ ID NO: 353053 - DNA, 25 bp, Mus musculus
tatctttatatcttaaaagatgtga

SEQ ID NO: 353054 - DNA, 25 bp, Mus musculus
tatctttcagaggagcctatcacgg

SEQ ID NO: 353055 - DNA, 25 bp, Mus musculus
tatctttcaggtggtatagctgtat

SEQ ID NO: 353056 - DNA, 25 bp, Mus musculus
tatctttccaagagctggagaagct

SEQ ID NO: 353057 - DNA, 25 bp, Mus musculus
tatctttgaagaccttgcttttaca

SEQ ID NO: 353058 - DNA, 25 bp, Mus musculus
tatctttgaagatgctgtcttcagt

SEQ ID NO: 353059 - DNA, 25 bp, Mus musculus
tatctttgaaggacgtgtaattccc

SEQ ID NO: 353060 - DNA, 25 bp, Mus musculus
tatctttgaagtactaagtataact

SEQ ID NO: 353061 - DNA, 25 bp, Mus musculus
tatctttttgagttgtgtaaaaatt

SEQ ID NO: 353062 - DNA, 25 bp, Mus musculus
tatgaaaaagggggccacattatct

SEQ ID NO: 353063 - DNA, 25 bp, Mus musculus
tatgaaaaataagattggccaggtg

SEQ ID NO: 353064 - DNA, 25 bp, Mus musculus
tatgaaaaataaggtagagcaactg

SEQ ID NO: 353065 - DNA, 25 bp, Mus musculus
tatgaaaaccgacctatgtcacctt

SEQ ID NO: 353066 - DNA, 25 bp, Mus musculus
tatgaaaaccgacttccagattacc

SEQ ID NO: 353067 - DNA, 25 bp, Mus musculus
tatgaaaactggtgaagggccggat

SEQ ID NO: 353068 - DNA, 25 bp, Mus musculus
tatgaaaatagattagcattcttga

SEQ ID NO: 353069 - DNA, 25 bp, Mus musculus
tatgaaacaaagagttcaactagat

SEQ ID NO: 353070 - DNA, 25 bp, Mus musculus
tatgaaacagaaaaacaccgagggt

SEQ ID NO: 353071 - DNA, 25 bp, Mus musculus
tatgaaacctgggactttactggaa

SEQ ID NO: 353072 - DNA, 25 bp, Mus musculus
tatgaaagagtagtttcaagaacat

SEQ ID NO: 353073 - DNA, 25 bp, Mus musculus
tatgaaagcaaggccagaagtcaat

SEQ ID NO: 353074 - DNA, 25 bp, Mus musculus
tatgaaagcagggcttacataccta

SEQ ID NO: 353075 - DNA, 25 bp, Mus musculus
tatgaaagtacagggttgtttcaaa

SEQ ID NO: 353076 - DNA, 25 bp, Mus musculus
tatgaaagtacaggtagagatctgc

SEQ ID NO: 353077 - DNA, 25 bp, Mus musculus
tatgaaatatgcaggaggggaagca

SEQ ID NO: 353078 - DNA, 25 bp, Mus musculus
tatgaaatatgcagtgagcatgttt

SEQ ID NO: 353079 - DNA, 25 bp, Mus musculus
tatgaaatcagccacaccttcaact

SEQ ID NO: 353080 - DNA, 25 bp, Mus musculus
tatgaaatgggtgggatgctatgga

SEQ ID NO: 353081 - DNA, 25 bp, Mus musculus
tatgaacacaataaggctcatgcac

SEQ ID NO: 353082 - DNA, 25 bp, Mus musculus
tatgaacaccagaagcctaagagtt

SEQ ID NO: 353083 - DNA, 25 bp, Mus musculus
tatgaacaccaggtttggacgtcat

SEQ ID NO: 353084 - DNA, 25 bp, Mus musculus
tatgaacaccctccttgacggccct

SEQ ID NO: 353085 - DNA, 25 bp, Mus musculus
tatgaacagacagctgaaattaccc

SEQ ID NO: 353086 - DNA, 25 bp, Mus musculus
tatgaacagctggccgactgctttt

SEQ ID NO: 353087 - DNA, 25 bp, Mus musculus
tatgaacatggtgaagtatttgttt

SEQ ID NO: 353088 - DNA, 25 bp, Mus musculus
tatgaacatgtgaagatttctgctc

SEQ ID NO: 353089 - DNA, 25 bp, Mus musculus
tatgaacatttaagagtgaatgcca

SEQ ID NO: 353090 - DNA, 25 bp, Mus musculus
tatgaacatttaaggcaattctgcc

SEQ ID NO: 353091 - DNA, 25 bp, Mus musculus
tatgaaccaaagaagatgccgctcc

SEQ ID NO: 353092 - DNA, 25 bp, Mus musculus
tatgaaccaaagaagtacggcgagc

SEQ ID NO: 353093 - DNA, 25 bp, Mus musculus
tatgaaccatcccccatgcggctgg

SEQ ID NO: 353094 - DNA, 25 bp, Mus musculus
tatgaaccggcagtttcgaaactgc

SEQ ID NO: 353095 - DNA, 25 bp, Mus musculus
tatgaacgagcagttttggcaatcc

SEQ ID NO: 353096 - DNA, 25 bp, Mus musculus
tatgaacggcatcaggcgcagatag

SEQ ID NO: 353097 - DNA, 25 bp, Mus musculus
tatgaactacttaaactccgactga

SEQ ID NO: 353098 - DNA, 25 bp, Mus musculus
tatgaactacttaaagctctggatt

SEQ ID NO: 353099 - DNA, 25 bp, Mus musculus
tatgaactctggtggttcaccaccc

SEQ ID NO: 353100 - DNA, 25 bp, Mus musculus
tatgaactcttcaagagagatcctg

SEQ ID NO: 353101 - DNA, 25 bp, Mus musculus
tatgaactcttcaagatcctaaatt

SEQ ID NO: 353102 - DNA, 25 bp, Mus musculus
tatgaagaaatcgagcgccaggctc

SEQ ID NO: 353103 - DNA, 25 bp, Mus musculus
tatgaagaagcacttttagatggct

SEQ ID NO: 353104 - DNA, 25 bp, Mus musculus
tatgaagacaggagtcttttattca

SEQ ID NO: 353105 - DNA, 25 bp, Mus musculus
tatgaagagaaaatgaaagcagacc

SEQ ID NO: 353106 - DNA, 25 bp, Mus musculus
tatgaagagaagagccttgttgata

SEQ ID NO: 353107 - DNA, 25 bp, Mus musculus
tatgaagaggaggcgggccccgggg

SEQ ID NO: 353108 - DNA, 25 bp, Mus musculus
tatgaagatcccacataccattttg

SEQ ID NO: 353109 - DNA, 25 bp, Mus musculus
tatgaagcacacaggggtagtgttg

SEQ ID NO: 353110 - DNA, 25 bp, Mus musculus
tatgaagcagattgattatacggta

SEQ ID NO: 353111 - DNA, 25 bp, Mus musculus
tatgaagccaagattgtaagggcca

SEQ ID NO: 353112 - DNA, 25 bp, Mus musculus
tatgaagccagacaagttggcatta

SEQ ID NO: 353113 - DNA, 25 bp, Mus musculus
tatgaagccaggtccctcaaagttg

SEQ ID NO: 353114 - DNA, 25 bp, Mus musculus
tatgaagcgaaggacggatcttgta

SEQ ID NO: 353115 - DNA, 25 bp, Mus musculus
tatgaaggagataacaggacggact

SEQ ID NO: 353116 - DNA, 25 bp, Mus musculus
tatgaaggcgtgaatatgacatctg

SEQ ID NO: 353117 - DNA, 25 bp, Mus musculus
tatgaaggcgtgggtatgcaatata

SEQ ID NO: 353118 - DNA, 25 bp, Mus musculus
tatgaagtattagaaaaagatgttg

SEQ ID NO: 353119 - DNA, 25 bp, Mus musculus
tatgaagtattagaataaatgaagg

SEQ ID NO: 353120 - DNA, 25 bp, Mus musculus
tatgaagttttcaggggctctctgc

SEQ ID NO: 353121 - DNA, 25 bp, Mus musculus
tatgaatacaggagtggaggctgga

SEQ ID NO: 353122 - DNA, 25 bp, Mus musculus
tatgaatatacagcgtttgactttt

SEQ ID NO: 353123 - DNA, 25 bp, Mus musculus
tatgaatattagtgaacttatttct

SEQ ID NO: 353124 - DNA, 25 bp, Mus musculus
tatgaatattgctggcctataaaga

SEQ ID NO: 353125 - DNA, 25 bp, Mus musculus
tatgaatccagaggttggaatgaaa

SEQ ID NO: 353126 - DNA, 25 bp, Mus musculus
tatgaatgcactgacactgaagatg

SEQ ID NO: 353127 - DNA, 25 bp, Mus musculus
tatgaatgttccccattgtaacata

SEQ ID NO: 353128 - DNA, 25 bp, Mus musculus
tatgaatgttccccgtaacaaatca

SEQ ID NO: 353129 - DNA, 25 bp, Mus musculus
tatgaatgttccccgtcagaaacgt

SEQ ID NO: 353130 - DNA, 25 bp, Mus musculus
tatgaatttgaacagggcctgtctg

SEQ ID NO: 353131 - DNA, 25 bp, Mus musculus
tatgaatttgaacaggtcatgcagt

SEQ ID NO: 353132 - DNA, 25 bp, Mus musculus
tatgacaaacatttttcagtatggt

SEQ ID NO: 353133 - DNA, 25 bp, Mus musculus
tatgacaactgttggctggctctca

SEQ ID NO: 353134 - DNA, 25 bp, Mus musculus
tatgacaagtacaggagctttgtca

SEQ ID NO: 353135 - DNA, 25 bp, Mus musculus
tatgacaagtacaggaggccgagtg

SEQ ID NO: 353136 - DNA, 25 bp, Mus musculus
tatgacaccatcaagcacccaggag

SEQ ID NO: 353137 - DNA, 25 bp, Mus musculus
tatgacagaacagtttttggccttt

SEQ ID NO: 353138 - DNA, 25 bp, Mus musculus
tatgacagaagtctgcgtggtggct

SEQ ID NO: 353139 - DNA, 25 bp, Mus musculus
tatgacaggactaagagggtgtttc

SEQ ID NO: 353140 - DNA, 25 bp, Mus musculus
tatgacaggactaaggggaagactg

SEQ ID NO: 353141 - DNA, 25 bp, Mus musculus
tatgacaggtctaaaaggcttggtg

SEQ ID NO: 353142 - DNA, 25 bp, Mus musculus
tatgacaggtctatgctgaggggtg

SEQ ID NO: 353143 - DNA, 25 bp, Mus musculus
tatgacatagcttgtgacgaatgga

SEQ ID NO: 353144 - DNA, 25 bp, Mus musculus
tatgacatccagtcaccagatttcg

SEQ ID NO: 353145 - DNA, 25 bp, Mus musculus
tatgacatccggatgctgaccttca

SEQ ID NO: 353146 - DNA, 25 bp, Mus musculus
tatgacatccgggtcaaggctggtt

SEQ ID NO: 353147 - DNA, 25 bp, Mus musculus
tatgacatcttctgggtattcggca

SEQ ID NO: 353148 - DNA, 25 bp, Mus musculus
tatgacatggagtggaagacatgaa

SEQ ID NO: 353149 - DNA, 25 bp, Mus musculus
tatgacattgcctcccacccgctgg

SEQ ID NO: 353150 - DNA, 25 bp, Mus musculus
tatgaccaccactaccatcacggag

SEQ ID NO: 353151 - DNA, 25 bp, Mus musculus
tatgaccactgcaaggtgctgagac

SEQ ID NO: 353152 - DNA, 25 bp, Mus musculus
tatgacccccctctctcccttctgt

SEQ ID NO: 353153 - DNA, 25 bp, Mus musculus
tatgacccctgcgaggcggtgctgg

SEQ ID NO: 353154 - DNA, 25 bp, Mus musculus
tatgaccctcagaaaaaagtggtta

SEQ ID NO: 353155 - DNA, 25 bp, Mus musculus
tatgaccctgcctccacaggagtgt

SEQ ID NO: 353156 - DNA, 25 bp, Mus musculus
tatgaccctgctttttaaattggcc

SEQ ID NO: 353157 - DNA, 25 bp, Mus musculus
tatgaccgcctggtctacgtgatca

SEQ ID NO: 353158 - DNA, 25 bp, Mus musculus
tatgaccgtatcaccattgaaatac

SEQ ID NO: 353159 - DNA, 25 bp, Mus musculus
tatgacctcaagggctctctagtgt

SEQ ID NO: 353160 - DNA, 25 bp, Mus musculus
tatgacctggacaagatcatagaac

SEQ ID NO: 353161 - DNA, 25 bp, Mus musculus
tatgaccttactgtcccttttgctc

SEQ ID NO: 353162 - DNA, 25 bp, Mus musculus
tatgaccttgaccagctcttcattg

SEQ ID NO: 353163 - DNA, 25 bp, Mus musculus
tatgaccttgaggacagacaaggaa

SEQ ID NO: 353164 - DNA, 25 bp, Mus musculus
tatgacgccagctgtgactccagtt

SEQ ID NO: 353165 - DNA, 25 bp, Mus musculus
tatgacgtgaccctggaagacatcc

SEQ ID NO: 353166 - DNA, 25 bp, Mus musculus
tatgacgtggccagcttcatcttcc

SEQ ID NO: 353167 - DNA, 25 bp, Mus musculus
tatgacgtggccagtgcttttacag

SEQ ID NO: 353168 - DNA, 25 bp, Mus musculus
tatgacgttgctgatcactggagat

SEQ ID NO: 353169 - DNA, 25 bp, Mus musculus
tatgactaacagggagtacaccttt

SEQ ID NO: 353170 - DNA, 25 bp, Mus musculus
tatgactagagacctgcaggggagc

SEQ ID NO: 353171 - DNA, 25 bp, Mus musculus
tatgactcagactggttgatcccca

SEQ ID NO: 353172 - DNA, 25 bp, Mus musculus
tatgactccctcaagaacaaagtca

SEQ ID NO: 353173 - DNA, 25 bp, Mus musculus
tatgactccctcaagattcaaacag

SEQ ID NO: 353174 - DNA, 25 bp, Mus musculus
tatgacttagcaggttcttgtctgg

SEQ ID NO: 353175 - DNA, 25 bp, Mus musculus
tatgacttcaaggctgacatctggt

SEQ ID NO: 353176 - DNA, 25 bp, Mus musculus
tatgacttccatataagtttctttg

SEQ ID NO: 353177 - DNA, 25 bp, Mus musculus
tatgagaaaatttccaggacctttg

SEQ ID NO: 353178 - DNA, 25 bp, Mus musculus
tatgagaacaaagtggcctatgagc

SEQ ID NO: 353179 - DNA, 25 bp, Mus musculus
tatgagactggagagacgagagaat

SEQ ID NO: 353180 - DNA, 25 bp, Mus musculus
tatgagactggatctctttcctttg

SEQ ID NO: 353181 - DNA, 25 bp, Mus musculus
tatgagaggatgctgagagtccatg

SEQ ID NO: 353182 - DNA, 25 bp, Mus musculus
tatgagagggagcttcgttacgacg

SEQ ID NO: 353183 - DNA, 25 bp, Mus musculus
tatgagagggaggtctgggacatgt

SEQ ID NO: 353184 - DNA, 25 bp, Mus musculus
tatgagatcaaccgtgaccatttga

SEQ ID NO: 353185 - DNA, 25 bp, Mus musculus
tatgagatcaacggtgaccatttga

SEQ ID NO: 353186 - DNA, 25 bp, Mus musculus
tatgagatggaagctgccactgact

SEQ ID NO: 353187 - DNA, 25 bp, Mus musculus
tatgagatgggggaatgcacccgag

SEQ ID NO: 353188 - DNA, 25 bp, Mus musculus
tatgagatggggtcacctccaaggt

SEQ ID NO: 353189 - DNA, 25 bp, Mus musculus
tatgagcaaacgtatgcagagatgc

SEQ ID NO: 353190 - DNA, 25 bp, Mus musculus
tatgagcaagaccatgactggccaa

SEQ ID NO: 353191 - DNA, 25 bp, Mus musculus
tatgagcaagatccagtatgtacct

SEQ ID NO: 353192 - DNA, 25 bp, Mus musculus
tatgagcagaagaaaccttgttccc

SEQ ID NO: 353193 - DNA, 25 bp, Mus musculus
tatgagcatccagtgtatccagagt

SEQ ID NO: 353194 - DNA, 25 bp, Mus musculus
tatgagcatcccgactttaagctcg

SEQ ID NO: 353195 - DNA, 25 bp, Mus musculus
tatgagctaccgggacaagagtgaa

SEQ ID NO: 353196 - DNA, 25 bp, Mus musculus
tatgaggaatgagtggccttgtgaa

SEQ ID NO: 353197 - DNA, 25 bp, Mus musculus
tatgaggactgtgagtgttcccagg

SEQ ID NO: 353198 - DNA, 25 bp, Mus musculus
tatgaggagggtattcctacatgag

SEQ ID NO: 353199 - DNA, 25 bp, Mus musculus
tatgaggatggccagtggaagaaac

SEQ ID NO: 353200 - DNA, 25 bp, Mus musculus
tatgaggcacaaggagcaagaccca

SEQ ID NO: 353201 - DNA, 25 bp, Mus musculus
tatgaggcagccatctccattctac

SEQ ID NO: 353202 - DNA, 25 bp, Mus musculus
tatgaggcagggctcattttcactg

SEQ ID NO: 353203 - DNA, 25 bp, Mus musculus
tatgaggctttggttttgttgagtt

SEQ ID NO: 353204 - DNA, 25 bp, Mus musculus
tatgagggctcaagtcgcaatgtgt

SEQ ID NO: 353205 - DNA, 25 bp, Mus musculus
tatgagggggtccggatcaaaagcc

SEQ ID NO: 353206 - DNA, 25 bp, Mus musculus
tatgagtagtgggatgagagtcatt

SEQ ID NO: 353207 - DNA, 25 bp, Mus musculus
tatgagtatgcaggtcctgatgaag

SEQ ID NO: 353208 - DNA, 25 bp, Mus musculus
tatgagtccaccaatggctcaacaa

SEQ ID NO: 353209 - DNA, 25 bp, Mus musculus
tatgagtcccaggtgtattccctgg

SEQ ID NO: 353210 - DNA, 25 bp, Mus musculus
tatgagtctccacagattgacggcg

SEQ ID NO: 353211 - DNA, 25 bp, Mus musculus
tatgagtctcccaggaagatctgct

SEQ ID NO: 353212 - DNA, 25 bp, Mus musculus
tatgagtctctcaagcgtcaagaac

SEQ ID NO: 353213 - DNA, 25 bp, Mus musculus
tatgagtctcttcagcgtcaagaac

SEQ ID NO: 353214 - DNA, 25 bp, Mus musculus
tatgagtgcagaaaatattaatggt

SEQ ID NO: 353215 - DNA, 25 bp, Mus musculus
tatgagtgcagcgtgttacccattc

SEQ ID NO: 353216 - DNA, 25 bp, Mus musculus
tatgagtgcagttttcagcagatca

SEQ ID NO: 353217 - DNA, 25 bp, Mus musculus
tatgagtggaaggtggcccagatga

SEQ ID NO: 353218 - DNA, 25 bp, Mus musculus
tatgagtggaaggtgggattggttt

SEQ ID NO: 353219 - DNA, 25 bp, Mus musculus
tatgagttagaggtcttgttgcggg

SEQ ID NO: 353220 - DNA, 25 bp, Mus musculus
tatgagttgctaaaactgccttggg

SEQ ID NO: 353221 - DNA, 25 bp, Mus musculus
tatgagttgctaaaagtgcctcctg

SEQ ID NO: 353222 - DNA, 25 bp, Mus musculus
tatgataatgaaggaattgctatct

SEQ ID NO: 353223 - DNA, 25 bp, Mus musculus
tatgatacaggtctaccgcagccga

SEQ ID NO: 353224 - DNA, 25 bp, Mus musculus
tatgatacatatgagtcaaacgttc

SEQ ID NO: 353225 - DNA, 25 bp, Mus musculus
tatgatacatccaggtgcatggagg

SEQ ID NO: 353226 - DNA, 25 bp, Mus musculus
tatgatatcacaaatgttaactcat

SEQ ID NO: 353227 - DNA, 25 bp, Mus musculus
tatgatattaagatgctaacatttt

SEQ ID NO: 353228 - DNA, 25 bp, Mus musculus
tatgatattgtcatatccaactgtg

SEQ ID NO: 353229 - DNA, 25 bp, Mus musculus
tatgatcaacgaagcaatggcacca

SEQ ID NO: 353230 - DNA, 25 bp, Mus musculus
tatgatcaacgcctgtagggacttc

SEQ ID NO: 353231 - DNA, 25 bp, Mus musculus
tatgatcagacaggaaaggatgtgg

SEQ ID NO: 353232 - DNA, 25 bp, Mus musculus
tatgatccacaggccctttggagac

SEQ ID NO: 353233 - DNA, 25 bp, Mus musculus
tatgatcccagagctggtttggccc

SEQ ID NO: 353234 - DNA, 25 bp, Mus musculus
tatgatgacgagctaaccttctttt

SEQ ID NO: 353235 - DNA, 25 bp, Mus musculus
tatgatgacgagctctcttctcttc

SEQ ID NO: 353236 - DNA, 25 bp, Mus musculus
tatgatgagaggccgggcccctccc

SEQ ID NO: 353237 - DNA, 25 bp, Mus musculus
tatgatgagaggcgacgtagtcacc

SEQ ID NO: 353238 - DNA, 25 bp, Mus musculus
tatgatgagtcacaattttatattg

SEQ ID NO: 353239 - DNA, 25 bp, Mus musculus
tatgatgagtgtaaaagaagataca

SEQ ID NO: 353240 - DNA, 25 bp, Mus musculus
tatgatgagtgtttatcaccagatc

SEQ ID NO: 353241 - DNA, 25 bp, Mus musculus
tatgatgagtttgtgacttaagctc

SEQ ID NO: 353242 - DNA, 25 bp, Mus musculus
tatgatgcatccgatgtcgtcctgg

SEQ ID NO: 353243 - DNA, 25 bp, Mus musculus
tatgatgcatcggatgtcgtcctgg

SEQ ID NO: 353244 - DNA, 25 bp, Mus musculus
tatgatgcccaggacttagaagagt

SEQ ID NO: 353245 - DNA, 25 bp, Mus musculus
tatgatgcccagtcttaccatgagc

SEQ ID NO: 353246 - DNA, 25 bp, Mus musculus
tatgatggtggctatggaggttttg

SEQ ID NO: 353247 - DNA, 25 bp, Mus musculus
tatgatgtacaggtcatagatgagc

SEQ ID NO: 353248 - DNA, 25 bp, Mus musculus
tatgatgtaccagggagtggctgga

SEQ ID NO: 353249 - DNA, 25 bp, Mus musculus
tatgatgtcctatatgaactgagaa

SEQ ID NO: 353250 - DNA, 25 bp, Mus musculus
tatgattcatctagaggttttacag

SEQ ID NO: 353251 - DNA, 25 bp, Mus musculus
tatgattcatctagagtacaaaaca

SEQ ID NO: 353252 - DNA, 25 bp, Mus musculus
tatgattccagatgcacgccatccc

SEQ ID NO: 353253 - DNA, 25 bp, Mus musculus
tatgattccaggctactagtcagtg

SEQ ID NO: 353254 - DNA, 25 bp, Mus musculus
tatgattcctctgaggatgacaagg

SEQ ID NO: 353255 - DNA, 25 bp, Mus musculus
tatgattctgctgagcatttgctag

SEQ ID NO: 353256 - DNA, 25 bp, Mus musculus
tatgattctgctggtgtgggacttg

SEQ ID NO: 353257 - DNA, 25 bp, Mus musculus
tatgattggctgtagtttccagagt

SEQ ID NO: 353258 - DNA, 25 bp, Mus musculus
tatgattgtaaagggtctcctgtga

SEQ ID NO: 353259 - DNA, 25 bp, Mus musculus
tatgatttgaggacccagttccgcc

SEQ ID NO: 353260 - DNA, 25 bp, Mus musculus
tatgcaaaacgtataaatcctcgag

SEQ ID NO: 353261 - DNA, 25 bp, Mus musculus
tatgcaaaactgcttcaccgataca

SEQ ID NO: 353262 - DNA, 25 bp, Mus musculus
tatgcaaaagttatgatggttaatg

SEQ ID NO: 353263 - DNA, 25 bp, Mus musculus
tatgcaaatagagtaaaggagtttg

SEQ ID NO: 353264 - DNA, 25 bp, Mus musculus
tatgcaaatagggtgaaagaattga

SEQ ID NO: 353265 - DNA, 25 bp, Mus musculus
tatgcaaatgaggatgcccctaaat

SEQ ID NO: 353266 - DNA, 25 bp, Mus musculus
tatgcaaatgagttccagacaggat

SEQ ID NO: 353267 - DNA, 25 bp, Mus musculus
tatgcaaccgaagctgacattatct

SEQ ID NO: 353268 - DNA, 25 bp, Mus musculus
tatgcaagtggaggtgaagtatttg

SEQ ID NO: 353269 - DNA, 25 bp, Mus musculus
tatgcaatttcggagcttcaccctg

SEQ ID NO: 353270 - DNA, 25 bp, Mus musculus
tatgcacacagtggatgaagaagag

SEQ ID NO: 353271 - DNA, 25 bp, Mus musculus
tatgcacacagtggtaccgttttgc

SEQ ID NO: 353272 - DNA, 25 bp, Mus musculus
tatgcacagtggcttctattttgat

SEQ ID NO: 353273 - DNA, 25 bp, Mus musculus
tatgcacctacggcccagaccaccg

SEQ ID NO: 353274 - DNA, 25 bp, Mus musculus
tatgcacctcaagagggagagaaaa

SEQ ID NO: 353275 - DNA, 25 bp, Mus musculus
tatgcacctcaagaggtacctaaga

SEQ ID NO: 353276 - DNA, 25 bp, Mus musculus
tatgcacgaaggatggcgagacacc

SEQ ID NO: 353277 - DNA, 25 bp, Mus musculus
tatgcactcaactggctcgggagcc

SEQ ID NO: 353278 - DNA, 25 bp, Mus musculus
tatgcactcctcccagcagttatga

SEQ ID NO: 353279 - DNA, 25 bp, Mus musculus
tatgcactcctggatatccggcgcc

SEQ ID NO: 353280 - DNA, 25 bp, Mus musculus
tatgcagaaaaagcttcaaactctc

SEQ ID NO: 353281 - DNA, 25 bp, Mus musculus
tatgcagaaaatacaacctccaaga

SEQ ID NO: 353282 - DNA, 25 bp, Mus musculus
tatgcagaagagaagaaaaattcaa

SEQ ID NO: 353283 - DNA, 25 bp, Mus musculus
tatgcagaagagttagcaaaacgtg

SEQ ID NO: 353284 - DNA, 25 bp, Mus musculus
tatgcagacacgagatcttgtacaa

SEQ ID NO: 353285 - DNA, 25 bp, Mus musculus
tatgcagcaaagagttccaacaccc

SEQ ID NO: 353286 - DNA, 25 bp, Mus musculus
tatgcagcaaaggaaggacagacga

SEQ ID NO: 353287 - DNA, 25 bp, Mus musculus
tatgcagcagatttttatcattaaa

SEQ ID NO: 353288 - DNA, 25 bp, Mus musculus
tatgcagcaggggggagcaccgtct

SEQ ID NO: 353289 - DNA, 25 bp, Mus musculus
tatgcagctgaggcgtaagttggat

SEQ ID NO: 353290 - DNA, 25 bp, Mus musculus
tatgcagctgagtccacgtgaagtc

SEQ ID NO: 353291 - DNA, 25 bp, Mus musculus
tatgcaggcttatgctttgatccag

SEQ ID NO: 353292 - DNA, 25 bp, Mus musculus
tatgcagttgtggtatcccaagggt

SEQ ID NO: 353293 - DNA, 25 bp, Mus musculus
tatgcagttgtgtgactatgcaagc

SEQ ID NO: 353294 - DNA, 25 bp, Mus musculus
tatgcagttgtgtgggtgaatggga

SEQ ID NO: 353295 - DNA, 25 bp, Mus musculus
tatgcatcaacgctgtaagatgaac

SEQ ID NO: 353296 - DNA, 25 bp, Mus musculus
tatgcatcactaggaacagcatctg

SEQ ID NO: 353297 - DNA, 25 bp, Mus musculus
tatgcatccaagaaggatcctgtag

SEQ ID NO: 353298 - DNA, 25 bp, Mus musculus
tatgcatccaaggctgtcggcgagc

SEQ ID NO: 353299 - DNA, 25 bp, Mus musculus
tatgcatgcggtctcccactgctca

SEQ ID NO: 353300 - DNA, 25 bp, Mus musculus
tatgcatgcggtgtgagcatctatc

SEQ ID NO: 353301 - DNA, 25 bp, Mus musculus
tatgcatggaaaggaagttggcagt

SEQ ID NO: 353302 - DNA, 25 bp, Mus musculus
tatgcattgagacgtccgagatacc

SEQ ID NO: 353303 - DNA, 25 bp, Mus musculus
tatgccaaagagatgaaggagtcag

SEQ ID NO: 353304 - DNA, 25 bp, Mus musculus
tatgccaaaggctttaacagaaaat

SEQ ID NO: 353305 - DNA, 25 bp, Mus musculus
tatgccaagagcaagaaagtatgag

SEQ ID NO: 353306 - DNA, 25 bp, Mus musculus
tatgccaagaggaataaaaggaaaa

SEQ ID NO: 353307 - DNA, 25 bp, Mus musculus
tatgccaaggcaggctgtcaggttg

SEQ ID NO: 353308 - DNA, 25 bp, Mus musculus
tatgccaatggctggaagctaaacc

SEQ ID NO: 353309 - DNA, 25 bp, Mus musculus
tatgccacatcctgtgccaataact

SEQ ID NO: 353310 - DNA, 25 bp, Mus musculus
tatgccaccatccgtgactgtcctg

SEQ ID NO: 353311 - DNA, 25 bp, Mus musculus
tatgccagaacagatagtcgtacaa

SEQ ID NO: 353312 - DNA, 25 bp, Mus musculus
tatgccagcatgtctgattgcctca

SEQ ID NO: 353313 - DNA, 25 bp, Mus musculus
tatgccagggggctctgtaaaagac

SEQ ID NO: 353314 - DNA, 25 bp, Mus musculus
tatgccatgaagcagaagggactca

SEQ ID NO: 353315 - DNA, 25 bp, Mus musculus
tatgccccaagattcagtcccaagt

SEQ ID NO: 353316 - DNA, 25 bp, Mus musculus
tatgccccaaggaaagagtgccacc

SEQ ID NO: 353317 - DNA, 25 bp, Mus musculus
tatgcccctgtcatctctcaccctc

SEQ ID NO: 353318 - DNA, 25 bp, Mus musculus
tatgcccggaattgaaagaatttgc

SEQ ID NO: 353319 - DNA, 25 bp, Mus musculus
tatgccctgcaggtcaatgtgattg

SEQ ID NO: 353320 - DNA, 25 bp, Mus musculus
tatgcccttgaaagcagaccgcgca

SEQ ID NO: 353321 - DNA, 25 bp, Mus musculus
tatgccgctgaagagcgtattgaag

SEQ ID NO: 353322 - DNA, 25 bp, Mus musculus
tatgccgtcatgtcccggaacagcc

SEQ ID NO: 353323 - DNA, 25 bp, Mus musculus
tatgccgtggacaacaattacgatg

SEQ ID NO: 353324 - DNA, 25 bp, Mus musculus
tatgccgtggatgaacggggtaagg

SEQ ID NO: 353325 - DNA, 25 bp, Mus musculus
tatgcctaaagggtatgtgtatttg

SEQ ID NO: 353326 - DNA, 25 bp, Mus musculus
tatgcctgactcagactggttgggc

SEQ ID NO: 353327 - DNA, 25 bp, Mus musculus
tatgcctgactcaggcaggccagct

SEQ ID NO: 353328 - DNA, 25 bp, Mus musculus
tatgcctgccatgagacgaaagtag

SEQ ID NO: 353329 - DNA, 25 bp, Mus musculus
tatgcctgccatgaggaattcttct

SEQ ID NO: 353330 - DNA, 25 bp, Mus musculus
tatgcctgtcatgaggaactcagaa

SEQ ID NO: 353331 - DNA, 25 bp, Mus musculus
tatgcctgtcatgaggaactcagcc

SEQ ID NO: 353332 - DNA, 25 bp, Mus musculus
tatgcctgtgctcaggggagaaagg

SEQ ID NO: 353333 - DNA, 25 bp, Mus musculus
tatgcctgtgctcaggtaatggaaa

SEQ ID NO: 353334 - DNA, 25 bp, Mus musculus
tatgcctttccattggacacccccg

SEQ ID NO: 353335 - DNA, 25 bp, Mus musculus
tatgcgaaaggcctgtccgaggact

SEQ ID NO: 353336 - DNA, 25 bp, Mus musculus
tatgcgaaagggaacttccccatga

SEQ ID NO: 353337 - DNA, 25 bp, Mus musculus
tatgcgaaattcaacatggccaatg

SEQ ID NO: 353338 - DNA, 25 bp, Mus musculus
tatgcgaagcagatttatggtctgc

SEQ ID NO: 353339 - DNA, 25 bp, Mus musculus
tatgcgaagcagggtgtgcagatta

SEQ ID NO: 353340 - DNA, 25 bp, Mus musculus
tatgcgaagctcccgccatgagaat

SEQ ID NO: 353341 - DNA, 25 bp, Mus musculus
tatgcgatttttgagaactgatagt

SEQ ID NO: 353342 - DNA, 25 bp, Mus musculus
tatgcgcaaggcttcattctcattc

SEQ ID NO: 353343 - DNA, 25 bp, Mus musculus
tatgcgtctgccaggcagacggctc

SEQ ID NO: 353344 - DNA, 25 bp, Mus musculus
tatgcgtcttcaggtaataaagctc

SEQ ID NO: 353345 - DNA, 25 bp, Mus musculus
tatgctaagttctttgaaaccatca

SEQ ID NO: 353346 - DNA, 25 bp, Mus musculus
tatgctacaaaggaaagaattgaat

SEQ ID NO: 353347 - DNA, 25 bp, Mus musculus
tatgctaccctaggaaggagtatgg

SEQ ID NO: 353348 - DNA, 25 bp, Mus musculus
tatgctacgatagccatgagggcag

SEQ ID NO: 353349 - DNA, 25 bp, Mus musculus
tatgctacgatagccattcccttca

SEQ ID NO: 353350 - DNA, 25 bp, Mus musculus
tatgctactgcaggtaaatgagatc

SEQ ID NO: 353351 - DNA, 25 bp, Mus musculus
tatgctagaaaaggttgcacgattt

SEQ ID NO: 353352 - DNA, 25 bp, Mus musculus
tatgctatcgagatggtgacttgcc

SEQ ID NO: 353353 - DNA, 25 bp, Mus musculus
tatgctatcgaggtttttaagccta

SEQ ID NO: 353354 - DNA, 25 bp, Mus musculus
tatgctcatagggtacagcatgttt

SEQ ID NO: 353355 - DNA, 25 bp, Mus musculus
tatgctccagagtgagagacttgcc

SEQ ID NO: 353356 - DNA, 25 bp, Mus musculus
tatgctccagagtttcagttcctgc

SEQ ID NO: 353357 - DNA, 25 bp, Mus musculus
tatgctccagccactctgctgatga

SEQ ID NO: 353358 - DNA, 25 bp, Mus musculus
tatgctccctggtgcagcatgtgca

SEQ ID NO: 353359 - DNA, 25 bp, Mus musculus
tatgctccctttcccaggtggtaca

SEQ ID NO: 353360 - DNA, 25 bp, Mus musculus
tatgctccggggagaaaaatgtata

SEQ ID NO: 353361 - DNA, 25 bp, Mus musculus
tatgctccttggctgaaccttcggg

SEQ ID NO: 353362 - DNA, 25 bp, Mus musculus
tatgctctacaagaattttacagcc

SEQ ID NO: 353363 - DNA, 25 bp, Mus musculus
tatgctctcagaggttcctgacacc

SEQ ID NO: 353364 - DNA, 25 bp, Mus musculus
tatgctctcaggctggcatcatgcc

SEQ ID NO: 353365 - DNA, 25 bp, Mus musculus
tatgctctcttcattctcatacaag

SEQ ID NO: 353366 - DNA, 25 bp, Mus musculus
tatgctgaaggagttattcctgatg

SEQ ID NO: 353367 - DNA, 25 bp, Mus musculus
tatgctgaagtatttcatggttcta

SEQ ID NO: 353368 - DNA, 25 bp, Mus musculus
tatgctgactcgagcattgcagagc

SEQ ID NO: 353369 - DNA, 25 bp, Mus musculus
tatgctgactgacccttcctaccta

SEQ ID NO: 353370 - DNA, 25 bp, Mus musculus
tatgctgactggtgtcgtttcagcc

SEQ ID NO: 353371 - DNA, 25 bp, Mus musculus
tatgctgagctgacacttatgcctc

SEQ ID NO: 353372 - DNA, 25 bp, Mus musculus
tatgctgagctgctggaagagcatc

SEQ ID NO: 353373 - DNA, 25 bp, Mus musculus
tatgctgataaggccttgctcaaca

SEQ ID NO: 353374 - DNA, 25 bp, Mus musculus
tatgctgcagagcttcacttggttc

SEQ ID NO: 353375 - DNA, 25 bp, Mus musculus
tatgctgcaggaaatgacctgcagc

SEQ ID NO: 353376 - DNA, 25 bp, Mus musculus
tatgctgccattgagaaaatgaaac

SEQ ID NO: 353377 - DNA, 25 bp, Mus musculus
tatgctgccattgagacgtaccacc

SEQ ID NO: 353378 - DNA, 25 bp, Mus musculus
tatgctgcccagccggtaagaccag

SEQ ID NO: 353379 - DNA, 25 bp, Mus musculus
tatgctgctgtgtgctgctctggtt

SEQ ID NO: 353380 - DNA, 25 bp, Mus musculus
tatgctggcctggcgttccacgcct

SEQ ID NO: 353381 - DNA, 25 bp, Mus musculus
tatgctgggaaagaatctgcatgtg

SEQ ID NO: 353382 - DNA, 25 bp, Mus musculus
tatgctgggaaagggaattttaata

SEQ ID NO: 353383 - DNA, 25 bp, Mus musculus
tatgctgtagtagtgactctctttt

SEQ ID NO: 353384 - DNA, 25 bp, Mus musculus
tatgctgtggaccagtacctgatac

SEQ ID NO: 353385 - DNA, 25 bp, Mus musculus
tatgctgtttgcaagaatgcatctt

SEQ ID NO: 353386 - DNA, 25 bp, Mus musculus
tatgctgtttgcaaggtatccatta

SEQ ID NO: 353387 - DNA, 25 bp, Mus musculus
tatgcttatgggaggtccaaatatc

SEQ ID NO: 353388 - DNA, 25 bp, Mus musculus
tatgcttcagatggagtggatggaa

SEQ ID NO: 353389 - DNA, 25 bp, Mus musculus
tatgcttcagcccctggtcataagc

SEQ ID NO: 353390 - DNA, 25 bp, Mus musculus
tatgcttccggcatcgtgttggatt

SEQ ID NO: 353391 - DNA, 25 bp, Mus musculus
tatgctttaggtgaaggcgataaag

SEQ ID NO: 353392 - DNA, 25 bp, Mus musculus
tatgcttttaaggcagcccacccaa

SEQ ID NO: 353393 - DNA, 25 bp, Mus musculus
tatggaaaaaggaaatatatgaaga

SEQ ID NO: 353394 - DNA, 25 bp, Mus musculus
tatggaaaaatatggaacaaaagtt

SEQ ID NO: 353395 - DNA, 25 bp, Mus musculus
tatggaaaagataaaacagcgttta

SEQ ID NO: 353396 - DNA, 25 bp, Mus musculus
tatggaaaatgattcaaggcctctt

SEQ ID NO: 353397 - DNA, 25 bp, Mus musculus
tatggaaaatggtgttgctgtcatc

SEQ ID NO: 353398 - DNA, 25 bp, Mus musculus
tatggaaaatgtttcaacctggatg

SEQ ID NO: 353399 - DNA, 25 bp, Mus musculus
tatggaaagcacagaactctttgtt

SEQ ID NO: 353400 - DNA, 25 bp, Mus musculus
tatggaaagtcacagctttctcagg

SEQ ID NO: 353401 - DNA, 25 bp, Mus musculus
tatggaagaaggatattacaaatga

SEQ ID NO: 353402 - DNA, 25 bp, Mus musculus
tatggaagagagtttcatgggatca

SEQ ID NO: 353403 - DNA, 25 bp, Mus musculus
tatggaagaggaatcttcaaagtcc

SEQ ID NO: 353404 - DNA, 25 bp, Mus musculus
tatggaagtagacacctacatacag

SEQ ID NO: 353405 - DNA, 25 bp, Mus musculus
tatggaagtgctccttccgcttcca

SEQ ID NO: 353406 - DNA, 25 bp, Mus musculus
tatggaatacacagcagggcatcag

SEQ ID NO: 353407 - DNA, 25 bp, Mus musculus
tatggacaagcctgactgcctcttt

SEQ ID NO: 353408 - DNA, 25 bp, Mus musculus
tatggacaggggatagcccacctca

SEQ ID NO: 353409 - DNA, 25 bp, Mus musculus
tatggaccaaggtgttggggccact

SEQ ID NO: 353410 - DNA, 25 bp, Mus musculus
tatggaccagggatttaaaatccaa

SEQ ID NO: 353411 - DNA, 25 bp, Mus musculus
tatggaccctgctgaccctgtacac

SEQ ID NO: 353412 - DNA, 25 bp, Mus musculus
tatggaccgccaggcactgggaaaa

SEQ ID NO: 353413 - DNA, 25 bp, Mus musculus
tatggacgaagaggatcttagtgaa

SEQ ID NO: 353414 - DNA, 25 bp, Mus musculus
tatggacgaagagtgaattcgggat

SEQ ID NO: 353415 - DNA, 25 bp, Mus musculus
tatggacttaaaggtgcctggaaga

SEQ ID NO: 353416 - DNA, 25 bp, Mus musculus
tatggacttaagaacttttcctatt

SEQ ID NO: 353417 - DNA, 25 bp, Mus musculus
tatggacttaagaccatgctcgcat

SEQ ID NO: 353418 - DNA, 25 bp, Mus musculus
tatggagaacaggtgagtgaaatcc

SEQ ID NO: 353419 - DNA, 25 bp, Mus musculus
tatggagagaagcaaatttccattg

SEQ ID NO: 353420 - DNA, 25 bp, Mus musculus
tatggagagaagcaggagcttgaac

SEQ ID NO: 353421 - DNA, 25 bp, Mus musculus
tatggagcaaaaaatgggctacaca

SEQ ID NO: 353422 - DNA, 25 bp, Mus musculus
tatggagcaaaagtatgaattaggg

SEQ ID NO: 353423 - DNA, 25 bp, Mus musculus
tatggagcagaagcaaatcagaaga

SEQ ID NO: 353424 - DNA, 25 bp, Mus musculus
tatggagcagagaatgacggacaag

SEQ ID NO: 353425 - DNA, 25 bp, Mus musculus
tatggagcagcccaggcctcctcaa

SEQ ID NO: 353426 - DNA, 25 bp, Mus musculus
tatggagcggtgtgctcggccatcg

SEQ ID NO: 353427 - DNA, 25 bp, Mus musculus
tatggagcggtgtggtcattgggct

SEQ ID NO: 353428 - DNA, 25 bp, Mus musculus
tatggagcttttagaacgttttaga

SEQ ID NO: 353429 - DNA, 25 bp, Mus musculus
tatggaggaagaagacagcatgaag

SEQ ID NO: 353430 - DNA, 25 bp, Mus musculus
tatggaggaaggtcgtggacttcct

SEQ ID NO: 353431 - DNA, 25 bp, Mus musculus
tatggaggagaaaccaaggtatatg

SEQ ID NO: 353432 - DNA, 25 bp, Mus musculus
tatggaggaggaaattatggaagtg

SEQ ID NO: 353433 - DNA, 25 bp, Mus musculus
tatggagggagcctggaggatgaaa

SEQ ID NO: 353434 - DNA, 25 bp, Mus musculus
tatggagtgcctttctttctgccct

SEQ ID NO: 353435 - DNA, 25 bp, Mus musculus
tatggataaggttaaaaattttgca

SEQ ID NO: 353436 - DNA, 25 bp, Mus musculus
tatggatacttacaggagctgatct

SEQ ID NO: 353437 - DNA, 25 bp, Mus musculus
tatggatgcataaggaaagacaaga

SEQ ID NO: 353438 - DNA, 25 bp, Mus musculus
tatggatgccctcttggcttctgga

SEQ ID NO: 353439 - DNA, 25 bp, Mus musculus
tatggatgggagacaatcccagctg

SEQ ID NO: 353440 - DNA, 25 bp, Mus musculus
tatggatgggagacctggaacccta

SEQ ID NO: 353441 - DNA, 25 bp, Mus musculus
tatggatgggagacgatctggacgt

SEQ ID NO: 353442 - DNA, 25 bp, Mus musculus
tatggattattgggcttgggtgact

SEQ ID NO: 353443 - DNA, 25 bp, Mus musculus
tatggattcagattactcgggacaa

SEQ ID NO: 353444 - DNA, 25 bp, Mus musculus
tatggattcagggctgaggcactag

SEQ ID NO: 353445 - DNA, 25 bp, Mus musculus
tatggattcagtggggtgatgctcc

SEQ ID NO: 353446 - DNA, 25 bp, Mus musculus
tatggattcccaggtgaggacactt

SEQ ID NO: 353447 - DNA, 25 bp, Mus musculus
tatggcaatggcagaaagaactcac

SEQ ID NO: 353448 - DNA, 25 bp, Mus musculus
tatggcaatggcagtgagcaccact

SEQ ID NO: 353449 - DNA, 25 bp, Mus musculus
tatggcacacagaaaggggagtgtg

SEQ ID NO: 353450 - DNA, 25 bp, Mus musculus
tatggcacagacatgatggtgggca

SEQ ID NO: 353451 - DNA, 25 bp, Mus musculus
tatggcacccaagaatcagagcgag

SEQ ID NO: 353452 - DNA, 25 bp, Mus musculus
tatggcacccaagctttcagatgca

SEQ ID NO: 353453 - DNA, 25 bp, Mus musculus
tatggcactggtatctcattcagtt

SEQ ID NO: 353454 - DNA, 25 bp, Mus musculus
tatggcagtgtgcagatttgtgaat

SEQ ID NO: 353455 - DNA, 25 bp, Mus musculus
tatggcatatcagccatggacggag

SEQ ID NO: 353456 - DNA, 25 bp, Mus musculus
tatggcatcacgggagacaatgtcc

SEQ ID NO: 353457 - DNA, 25 bp, Mus musculus
tatggccaatgaggtcactcgttac

SEQ ID NO: 353458 - DNA, 25 bp, Mus musculus
tatggccaatggtcagttggtgaag

SEQ ID NO: 353459 - DNA, 25 bp, Mus musculus
tatggccagccctgctctcggagac

SEQ ID NO: 353460 - DNA, 25 bp, Mus musculus
tatggccatcaagacctctcacagc

SEQ ID NO: 353461 - DNA, 25 bp, Mus musculus
tatggcccacaaggaatgtgggtgc

SEQ ID NO: 353462 - DNA, 25 bp, Mus musculus
tatggccctaaaggggttggtgcta

SEQ ID NO: 353463 - DNA, 25 bp, Mus musculus
tatggccgggacaaggtaatgttct

SEQ ID NO: 353464 - DNA, 25 bp, Mus musculus
tatggcgaggagccatcaagcaaat

SEQ ID NO: 353465 - DNA, 25 bp, Mus musculus
tatggcgaggaggaggtgtagccca

SEQ ID NO: 353466 - DNA, 25 bp, Mus musculus
tatggcggagtgacaaagaattact

SEQ ID NO: 353467 - DNA, 25 bp, Mus musculus
tatggcggagtttcaacaccgtgaa

SEQ ID NO: 353468 - DNA, 25 bp, Mus musculus
tatggcggtggacatcatcctgggc

SEQ ID NO: 353469 - DNA, 25 bp, Mus musculus
tatggcgtaaagagactgatgtctg

SEQ ID NO: 353470 - DNA, 25 bp, Mus musculus
tatggcgtaaagaggttctccccaa

SEQ ID NO: 353471 - DNA, 25 bp, Mus musculus
tatggcgttggagatctcatcccgt

SEQ ID NO: 353472 - DNA, 25 bp, Mus musculus
tatggcgttggagtgtcccatcctg

SEQ ID NO: 353473 - DNA, 25 bp, Mus musculus
tatggctactatactctgtattctg

SEQ ID NO: 353474 - DNA, 25 bp, Mus musculus
tatggctatgccttctaggtttgat

SEQ ID NO: 353475 - DNA, 25 bp, Mus musculus
tatggctccacccaggctaccttca

SEQ ID NO: 353476 - DNA, 25 bp, Mus musculus
tatggctcggtgtgtcccttagaag

SEQ ID NO: 353477 - DNA, 25 bp, Mus musculus
tatggctcggtgtgtgctgcttttg

SEQ ID NO: 353478 - DNA, 25 bp, Mus musculus
tatggctctcattattttcacaaag

SEQ ID NO: 353479 - DNA, 25 bp, Mus musculus
tatggctctggtcgtggacgcagac

SEQ ID NO: 353480 - DNA, 25 bp, Mus musculus
tatggctgacaagatgcaggtacta

SEQ ID NO: 353481 - DNA, 25 bp, Mus musculus
tatggctgacaagcctatcctctac

SEQ ID NO: 353482 - DNA, 25 bp, Mus musculus
tatggctgcaaaaaagcactggaat

SEQ ID NO: 353483 - DNA, 25 bp, Mus musculus
tatggctgcaaacactcagagtgat

SEQ ID NO: 353484 - DNA, 25 bp, Mus musculus
tatggctgcaaagttgcagatatca

SEQ ID NO: 353485 - DNA, 25 bp, Mus musculus
tatggctggaggaatctgcgaagtt

SEQ ID NO: 353486 - DNA, 25 bp, Mus musculus
tatggcttaagaccgaagggaggag

SEQ ID NO: 353487 - DNA, 25 bp, Mus musculus
tatggcttaagggaccgacgtctgc

SEQ ID NO: 353488 - DNA, 25 bp, Mus musculus
tatggcttatatgtgcacatggcga

SEQ ID NO: 353489 - DNA, 25 bp, Mus musculus
tatggcttatatgtggagctgtgtg

SEQ ID NO: 353490 - DNA, 25 bp, Mus musculus
tatggcttctttctccttgtggaca

SEQ ID NO: 353491 - DNA, 25 bp, Mus musculus
tatggctttttatttagaagaaagc

SEQ ID NO: 353492 - DNA, 25 bp, Mus musculus
tatgggaaagagattctgaaaagct

SEQ ID NO: 353493 - DNA, 25 bp, Mus musculus
tatgggaaggacatgaatgtgttaa

SEQ ID NO: 353494 - DNA, 25 bp, Mus musculus
tatgggacaccactgtcccaatact

SEQ ID NO: 353495 - DNA, 25 bp, Mus musculus
tatgggacctaatgacagcccatat

SEQ ID NO: 353496 - DNA, 25 bp, Mus musculus
tatgggacctcaggtctgttgtggg

SEQ ID NO: 353497 - DNA, 25 bp, Mus musculus
tatgggacctctcaatgaaagtgag

SEQ ID NO: 353498 - DNA, 25 bp, Mus musculus
tatgggacgaagaagacctgtattc

SEQ ID NO: 353499 - DNA, 25 bp, Mus musculus
tatgggagaccggggaaaatgcact

SEQ ID NO: 353500 - DNA, 25 bp, Mus musculus
tatgggagatgataaaagctttgat

SEQ ID NO: 353501 - DNA, 25 bp, Mus musculus
tatgggatatcttcagaaaaaatgt

SEQ ID NO: 353502 - DNA, 25 bp, Mus musculus
tatgggatgaaacggaacattttcc

SEQ ID NO: 353503 - DNA, 25 bp, Mus musculus
tatgggatgaaacggttctgtgatg

SEQ ID NO: 353504 - DNA, 25 bp, Mus musculus
tatgggattatcagaacaaaacgtg

SEQ ID NO: 353505 - DNA, 25 bp, Mus musculus
tatgggattccaggagaaccacaat

SEQ ID NO: 353506 - DNA, 25 bp, Mus musculus
tatgggcaggtattcacctacaagc

SEQ ID NO: 353507 - DNA, 25 bp, Mus musculus
tatgggcatgatgcccccgcctcct

SEQ ID NO: 353508 - DNA, 25 bp, Mus musculus
tatgggcatgctagcaaaaaagtat

SEQ ID NO: 353509 - DNA, 25 bp, Mus musculus
tatgggcatggcatcgtcttcagca

SEQ ID NO: 353510 - DNA, 25 bp, Mus musculus
tatgggccctctgggaccaagagga

SEQ ID NO: 353511 - DNA, 25 bp, Mus musculus
tatgggccctgcaggactgttcccg

SEQ ID NO: 353512 - DNA, 25 bp, Mus musculus
tatgggcgggctgacgcttcccaac

SEQ ID NO: 353513 - DNA, 25 bp, Mus musculus
tatgggcgggctgctgagaagacgc

SEQ ID NO: 353514 - DNA, 25 bp, Mus musculus
tatgggcgggctggtatgcgtcttc

SEQ ID NO: 353515 - DNA, 25 bp, Mus musculus
tatgggcgggtaatctatgccagca

SEQ ID NO: 353516 - DNA, 25 bp, Mus musculus
tatgggctagagcaagccccgccca

SEQ ID NO: 353517 - DNA, 25 bp, Mus musculus
tatgggctgaagagatttgaaagtg

SEQ ID NO: 353518 - DNA, 25 bp, Mus musculus
tatgggctgcagaggattctcattg

SEQ ID NO: 353519 - DNA, 25 bp, Mus musculus
tatgggctgcagagtgtcctttatt

SEQ ID NO: 353520 - DNA, 25 bp, Mus musculus
tatggggcagtttagaaatgcactt

SEQ ID NO: 353521 - DNA, 25 bp, Mus musculus
tatgggggaaggtgacgccatctgg

SEQ ID NO: 353522 - DNA, 25 bp, Mus musculus
tatgggggcaggtggctttgtggct

SEQ ID NO: 353523 - DNA, 25 bp, Mus musculus
tatgggggcccacaggtgcagttgg

SEQ ID NO: 353524 - DNA, 25 bp, Mus musculus
tatgggggcccacagttggtgaaca

SEQ ID NO: 353525 - DNA, 25 bp, Mus musculus
tatgggggcctgggtccaagccggc

SEQ ID NO: 353526 - DNA, 25 bp, Mus musculus
tatggggggacctgcactcagcagg

SEQ ID NO: 353527 - DNA, 25 bp, Mus musculus
tatggggtgctgatggggaaggacc

SEQ ID NO: 353528 - DNA, 25 bp, Mus musculus
tatggggtgctgatgtttgagatgc

SEQ ID NO: 353529 - DNA, 25 bp, Mus musculus
tatgggtacaggacatacaggaagt

SEQ ID NO: 353530 - DNA, 25 bp, Mus musculus
tatgggtcaggtagtgggcagcagt

SEQ ID NO: 353531 - DNA, 25 bp, Mus musculus
tatgggttcaggttctgccaccagc

SEQ ID NO: 353532 - DNA, 25 bp, Mus musculus
tatgggttggggagtattactatga

SEQ ID NO: 353533 - DNA, 25 bp, Mus musculus
tatggtaaagatccctcaagaacag

SEQ ID NO: 353534 - DNA, 25 bp, Mus musculus
tatggtaaggagaaggatggcctca

SEQ ID NO: 353535 - DNA, 25 bp, Mus musculus
tatggtactgagtactctctgagta

SEQ ID NO: 353536 - DNA, 25 bp, Mus musculus
tatggtagcaagatctaaaggggtg

SEQ ID NO: 353537 - DNA, 25 bp, Mus musculus
tatggtatgccaaacagcagttatt

SEQ ID NO: 353538 - DNA, 25 bp, Mus musculus
tatggtcaaggcggagccagatgtt

SEQ ID NO: 353539 - DNA, 25 bp, Mus musculus
tatggtccaacgacctgagcccaac

SEQ ID NO: 353540 - DNA, 25 bp, Mus musculus
tatggtctcgagatgaagatatcac

SEQ ID NO: 353541 - DNA, 25 bp, Mus musculus
tatggtctcgagcagcagtgaaggc

SEQ ID NO: 353542 - DNA, 25 bp, Mus musculus
tatggtgaactctgtctgcaatcct

SEQ ID NO: 353543 - DNA, 25 bp, Mus musculus
tatggtgaactggctgacagttgat

SEQ ID NO: 353544 - DNA, 25 bp, Mus musculus
tatggtgaactggctgagacttgct

SEQ ID NO: 353545 - DNA, 25 bp, Mus musculus
tatggtgcagtgcatcattgaggag

SEQ ID NO: 353546 - DNA, 25 bp, Mus musculus
tatggtgccgtgttctcgaaaaggt

SEQ ID NO: 353547 - DNA, 25 bp, Mus musculus
tatggtggaggtagaagattttgtg

SEQ ID NO: 353548 - DNA, 25 bp, Mus musculus
tatggtgtcactgcaagagcggccc

SEQ ID NO: 353549 - DNA, 25 bp, Mus musculus
tatggtgtcagaaaaaatgtgggga

SEQ ID NO: 353550 - DNA, 25 bp, Mus musculus
tatggtttaagacgcttaaaggatg

SEQ ID NO: 353551 - DNA, 25 bp, Mus musculus
tatggttttgctgtacagagaggca

SEQ ID NO: 353552 - DNA, 25 bp, Mus musculus
tatgtactacaatggcattggagtc

SEQ ID NO: 353553 - DNA, 25 bp, Mus musculus
tatgtactcaggatatgctgtcatt

SEQ ID NO: 353554 - DNA, 25 bp, Mus musculus
tatgtactcagggggaaaatgctat

SEQ ID NO: 353555 - DNA, 25 bp, Mus musculus
tatgtacttcattgtacgatctttg

SEQ ID NO: 353556 - DNA, 25 bp, Mus musculus
tatgtagaaataaagatgatcagtc

SEQ ID NO: 353557 - DNA, 25 bp, Mus musculus
tatgtagaggcagagccccactcca

SEQ ID NO: 353558 - DNA, 25 bp, Mus musculus
tatgtagcagctgtggcagacctta

SEQ ID NO: 353559 - DNA, 25 bp, Mus musculus
tatgtagctcagaatgtgaagctct

SEQ ID NO: 353560 - DNA, 25 bp, Mus musculus
tatgtagctcaggttcccctccaga

SEQ ID NO: 353561 - DNA, 25 bp, Mus musculus
tatgtaggtggaagtcttctatgag

SEQ ID NO: 353562 - DNA, 25 bp, Mus musculus
tatgtataacaaggattctcaaagc

SEQ ID NO: 353563 - DNA, 25 bp, Mus musculus
tatgtatacaggtttgttaactgaa

SEQ ID NO: 353564 - DNA, 25 bp, Mus musculus
tatgtatacgacaccacggcgacga

SEQ ID NO: 353565 - DNA, 25 bp, Mus musculus
tatgtatacgatccccccacaacta

SEQ ID NO: 353566 - DNA, 25 bp, Mus musculus
tatgtatacgcaccaccaccaccat

SEQ ID NO: 353567 - DNA, 25 bp, Mus musculus
tatgtatgacgttgctgatcactgg

SEQ ID NO: 353568 - DNA, 25 bp, Mus musculus
tatgtattacagagtgatggcgtgc

SEQ ID NO: 353569 - DNA, 25 bp, Mus musculus
tatgtcaaaacctgggcaagatccg

SEQ ID NO: 353570 - DNA, 25 bp, Mus musculus
tatgtcaacagaattccagaggttg

SEQ ID NO: 353571 - DNA, 25 bp, Mus musculus
tatgtcaacagcccagaaggctctt

SEQ ID NO: 353572 - DNA, 25 bp, Mus musculus
tatgtcaacaggacccacagttatc

SEQ ID NO: 353573 - DNA, 25 bp, Mus musculus
tatgtcaatgcccccaaccccatcc

SEQ ID NO: 353574 - DNA, 25 bp, Mus musculus
tatgtcagaggaggtggagcctact

SEQ ID NO: 353575 - DNA, 25 bp, Mus musculus
tatgtcagcacagctgtctgggatt

SEQ ID NO: 353576 - DNA, 25 bp, Mus musculus
tatgtcagcagatcaacttctgaga

SEQ ID NO: 353577 - DNA, 25 bp, Mus musculus
tatgtcagcttcaaggtggacagca

SEQ ID NO: 353578 - DNA, 25 bp, Mus musculus
tatgtcaggagttcaccttttccac

SEQ ID NO: 353579 - DNA, 25 bp, Mus musculus
tatgtcagtgaggttcctgctgctg

SEQ ID NO: 353580 - DNA, 25 bp, Mus musculus
tatgtcatcaaccaccatggcgagg

SEQ ID NO: 353581 - DNA, 25 bp, Mus musculus
tatgtcatcaaccagcatggcgagg

SEQ ID NO: 353582 - DNA, 25 bp, Mus musculus
tatgtcatcctcagacaacattgtg

SEQ ID NO: 353583 - DNA, 25 bp, Mus musculus
tatgtcatcctcagctgggagggca

SEQ ID NO: 353584 - DNA, 25 bp, Mus musculus
tatgtcatcctcaggcacaccaaga

SEQ ID NO: 353585 - DNA, 25 bp, Mus musculus
tatgtcatcctcaggcagtgccctg

SEQ ID NO: 353586 - DNA, 25 bp, Mus musculus
tatgtcatgatggtgtttggccttg

SEQ ID NO: 353587 - DNA, 25 bp, Mus musculus
tatgtccccacaggggcaggtgctg

SEQ ID NO: 353588 - DNA, 25 bp, Mus musculus
tatgtccctggatgatattatcaaa

SEQ ID NO: 353589 - DNA, 25 bp, Mus musculus
tatgtcggtgctatgagtgctctgg

SEQ ID NO: 353590 - DNA, 25 bp, Mus musculus
tatgtcggtgctatggcctgtgctg

SEQ ID NO: 353591 - DNA, 25 bp, Mus musculus
tatgtctcaggctgaatttgacaaa

SEQ ID NO: 353592 - DNA, 25 bp, Mus musculus
tatgtctgagggtttggaaatagtg

SEQ ID NO: 353593 - DNA, 25 bp, Mus musculus
tatgtctgaggtatctcatttaagc

SEQ ID NO: 353594 - DNA, 25 bp, Mus musculus
tatgtctgagtaaggagagtccttc

SEQ ID NO: 353595 - DNA, 25 bp, Mus musculus
tatgtctgccagtgtgccccaggct

SEQ ID NO: 353596 - DNA, 25 bp, Mus musculus
tatgtctgtatgagaacaaagccag

SEQ ID NO: 353597 - DNA, 25 bp, Mus musculus
tatgtctgtatgagtggctgagagg

SEQ ID NO: 353598 - DNA, 25 bp, Mus musculus
tatgtgaaataggtgagaagccaga

SEQ ID NO: 353599 - DNA, 25 bp, Mus musculus
tatgtgaaatagttttgggattttg

SEQ ID NO: 353600 - DNA, 25 bp, Mus musculus
tatgtgaagagctggttttggggtc

SEQ ID NO: 353601 - DNA, 25 bp, Mus musculus
tatgtgaagaggtttgttgtctcat

SEQ ID NO: 353602 - DNA, 25 bp, Mus musculus
tatgtgaatacatacacaaaggcat

SEQ ID NO: 353603 - DNA, 25 bp, Mus musculus
tatgtgaatttgggaggtcataagt

SEQ ID NO: 353604 - DNA, 25 bp, Mus musculus
tatgtgaatttgggcacctccgcac

SEQ ID NO: 353605 - DNA, 25 bp, Mus musculus
tatgtgacctgaaggagccaacaca

SEQ ID NO: 353606 - DNA, 25 bp, Mus musculus
tatgtgacctggactcagccttgga

SEQ ID NO: 353607 - DNA, 25 bp, Mus musculus
tatgtgagacgtgggactccagtga

SEQ ID NO: 353608 - DNA, 25 bp, Mus musculus
tatgtgagtcaaaggtcacatgctg

SEQ ID NO: 353609 - DNA, 25 bp, Mus musculus
tatgtgcaagacggcccccttgaga

SEQ ID NO: 353610 - DNA, 25 bp, Mus musculus
tatgtgcacaggaaaggaagttcct

SEQ ID NO: 353611 - DNA, 25 bp, Mus musculus
tatgtgcacagggtcgggagaacag

SEQ ID NO: 353612 - DNA, 25 bp, Mus musculus
tatgtgcaccaggttggcagagttg

SEQ ID NO: 353613 - DNA, 25 bp, Mus musculus
tatgtgcatatgtggcaaagtttat

SEQ ID NO: 353614 - DNA, 25 bp, Mus musculus
tatgtgccagctgcaacggaagatc

SEQ ID NO: 353615 - DNA, 25 bp, Mus musculus
tatgtgccaggctgcccgcccacgg

SEQ ID NO: 353616 - DNA, 25 bp, Mus musculus
tatgtgcggctcggtccgacgcaca

SEQ ID NO: 353617 - DNA, 25 bp, Mus musculus
tatgtgctgcagactgaagtggcca

SEQ ID NO: 353618 - DNA, 25 bp, Mus musculus
tatgtgctgcaggctacatgtgagc

SEQ ID NO: 353619 - DNA, 25 bp, Mus musculus
tatgtggaaatgcagtccctgcaga

SEQ ID NO: 353620 - DNA, 25 bp, Mus musculus
tatgtggcaggctgggtcctagagt

SEQ ID NO: 353621 - DNA, 25 bp, Mus musculus
tatgtggcttagcagatcatcagtg

SEQ ID NO: 353622 - DNA, 25 bp, Mus musculus
tatgtgggtggagtgctctctgaaa

SEQ ID NO: 353623 - DNA, 25 bp, Mus musculus
tatgtgggtggagtggtccattcgt

SEQ ID NO: 353624 - DNA, 25 bp, Mus musculus
tatgtgtagcctcaggatgcctggt

SEQ ID NO: 353625 - DNA, 25 bp, Mus musculus
tatgtgtatggcttggcaaattgtg

SEQ ID NO: 353626 - DNA, 25 bp, Mus musculus
tatgtgtatggtgattccaccagtg

SEQ ID NO: 353627 - DNA, 25 bp, Mus musculus
tatgtgtattaagaggagtgtctcc

SEQ ID NO: 353628 - DNA, 25 bp, Mus musculus
tatgtgtattaagagttccgaggtg

SEQ ID NO: 353629 - DNA, 25 bp, Mus musculus
tatgtgtcctcagagtctcccatta

SEQ ID NO: 353630 - DNA, 25 bp, Mus musculus
tatgtgtgctgactgcctgtttctg

SEQ ID NO: 353631 - DNA, 25 bp, Mus musculus
tatgtgtgggaacagctggaaggta

SEQ ID NO: 353632 - DNA, 25 bp, Mus musculus
tatgtgttatgagtttgtgatgtct

SEQ ID NO: 353633 - DNA, 25 bp, Mus musculus
tatgtgttattgagctgggaggcac

SEQ ID NO: 353634 - DNA, 25 bp, Mus musculus
tatgttacagaacccaagagtgttt

SEQ ID NO: 353635 - DNA, 25 bp, Mus musculus
tatgttatacctccggcttatacaa

SEQ ID NO: 353636 - DNA, 25 bp, Mus musculus
tatgttattcagaggaccagagttc

SEQ ID NO: 353637 - DNA, 25 bp, Mus musculus
tatgttccaggattgaaccagctgc

SEQ ID NO: 353638 - DNA, 25 bp, Mus musculus
tatgttctcatccaaagcctttatc

SEQ ID NO: 353639 - DNA, 25 bp, Mus musculus
tatgttctcatccagagcctttatc

SEQ ID NO: 353640 - DNA, 25 bp, Mus musculus
tatgttgaagaaatgttgttatccg

SEQ ID NO: 353641 - DNA, 25 bp, Mus musculus
tatgtttagagcttcccccacccag

SEQ ID NO: 353642 - DNA, 25 bp, Mus musculus
tatgtttttgtgctgttgcttcctg

SEQ ID NO: 353643 - DNA, 25 bp, Mus musculus
tattaaaaacaatctggaacttcct

SEQ ID NO: 353644 - DNA, 25 bp, Mus musculus
tattaaaaattgagacctctgacag

SEQ ID NO: 353645 - DNA, 25 bp, Mus musculus
tattaaaaattgagagagagaagat

SEQ ID NO: 353646 - DNA, 25 bp, Mus musculus
tattaaaagtaaatggaagtacgac

SEQ ID NO: 353647 - DNA, 25 bp, Mus musculus
tattaaaccaggtgctgtggaaaga

SEQ ID NO: 353648 - DNA, 25 bp, Mus musculus
tattaaacttacatcaaaattatat

SEQ ID NO: 353649 - DNA, 25 bp, Mus musculus
tattaaacttacatgtttgaggatt

SEQ ID NO: 353650 - DNA, 25 bp, Mus musculus
tattaaagagtccttcactcgtctg

SEQ ID NO: 353651 - DNA, 25 bp, Mus musculus
tattaaagtggttggctatgatatg

SEQ ID NO: 353652 - DNA, 25 bp, Mus musculus
tattaaagtttaaccagctcaggaa

SEQ ID NO: 353653 - DNA, 25 bp, Mus musculus
tattaacaagtaagtgtggacattc

SEQ ID NO: 353654 - DNA, 25 bp, Mus musculus
tattaacacagatgctgctcagact

SEQ ID NO: 353655 - DNA, 25 bp, Mus musculus
tattaacacagcacggtgcaacaga

SEQ ID NO: 353656 - DNA, 25 bp, Mus musculus
tattaacacaggatcacactatgga

SEQ ID NO: 353657 - DNA, 25 bp, Mus musculus
tattaacagataagccctccctgac

SEQ ID NO: 353658 - DNA, 25 bp, Mus musculus
tattaacatttacagctcccctctc

SEQ ID NO: 353659 - DNA, 25 bp, Mus musculus
tattaaccaggtcttcaagatgatc

SEQ ID NO: 353660 - DNA, 25 bp, Mus musculus
tattaacccttggagtaaaaatggc

SEQ ID NO: 353661 - DNA, 25 bp, Mus musculus
tattaagaagaagacaaaaaagcgt

SEQ ID NO: 353662 - DNA, 25 bp, Mus musculus
tattaagaatgaggtggcgagtggg

SEQ ID NO: 353663 - DNA, 25 bp, Mus musculus
tattaatataaacaacttccattcg

SEQ ID NO: 353664 - DNA, 25 bp, Mus musculus
tattaatatggaaatgaaagtgccc

SEQ ID NO: 353665 - DNA, 25 bp, Mus musculus
tattaattacagttctccaagccag

SEQ ID NO: 353666 - DNA, 25 bp, Mus musculus
tattaattagaggaggttcgccttc

SEQ ID NO: 353667 - DNA, 25 bp, Mus musculus
tattacaacctcgaggaatcatgca

SEQ ID NO: 353668 - DNA, 25 bp, Mus musculus
tattacaactaccagaacaatgaaa

SEQ ID NO: 353669 - DNA, 25 bp, Mus musculus
tattacaactaccagattatccagc

SEQ ID NO: 353670 - DNA, 25 bp, Mus musculus
tattacaactaccaggcaggacccg

SEQ ID NO: 353671 - DNA, 25 bp, Mus musculus
tattacaagcatgagggacaaagcc

SEQ ID NO: 353672 - DNA, 25 bp, Mus musculus
tattacaccgggtgaacctgaattt

SEQ ID NO: 353673 - DNA, 25 bp, Mus musculus
tattacagcagcaatattcacaacc

SEQ ID NO: 353674 - DNA, 25 bp, Mus musculus
tattacaggatagagactaatgctc

SEQ ID NO: 353675 - DNA, 25 bp, Mus musculus
tattacaggtaatgaagaaggatat

SEQ ID NO: 353676 - DNA, 25 bp, Mus musculus
tattacatagacatgcagaagttcc

SEQ ID NO: 353677 - DNA, 25 bp, Mus musculus
tattacatcaaccatcaaacacaga

SEQ ID NO: 353678 - DNA, 25 bp, Mus musculus
tattaccaagatgaacccccaaaga

SEQ ID NO: 353679 - DNA, 25 bp, Mus musculus
tattaccaagcataccacaaaaaga

SEQ ID NO: 353680 - DNA, 25 bp, Mus musculus
tattaccaaggtgctatatctgaag

SEQ ID NO: 353681 - DNA, 25 bp, Mus musculus
tattaccacagcgtttatgtttgaa

SEQ ID NO: 353682 - DNA, 25 bp, Mus musculus
tattaccacaggaactgcatgagtg

SEQ ID NO: 353683 - DNA, 25 bp, Mus musculus
tattacccaggggaccccagctctg

SEQ ID NO: 353684 - DNA, 25 bp, Mus musculus
tattaccctagattggtgctgatgg

SEQ ID NO: 353685 - DNA, 25 bp, Mus musculus
tattaccctgatggaaactcccagt

SEQ ID NO: 353686 - DNA, 25 bp, Mus musculus
tattaccctgatggtcataatgatt

SEQ ID NO: 353687 - DNA, 25 bp, Mus musculus
tattaccgctctagccgcagccaga

SEQ ID NO: 353688 - DNA, 25 bp, Mus musculus
tattacctcaatgagatccagagtt

SEQ ID NO: 353689 - DNA, 25 bp, Mus musculus
tattacgacaagaacatcatcaaga

SEQ ID NO: 353690 - DNA, 25 bp, Mus musculus
tattacgacaagacaccaagtggac

SEQ ID NO: 353691 - DNA, 25 bp, Mus musculus
tattacgagtatggctacatctttt

SEQ ID NO: 353692 - DNA, 25 bp, Mus musculus
tattacggcatcctgagtgatgttc

SEQ ID NO: 353693 - DNA, 25 bp, Mus musculus
tattacggcatggaccttgacttcc

SEQ ID NO: 353694 - DNA, 25 bp, Mus musculus
tattactaccaagccccaggagatg

SEQ ID NO: 353695 - DNA, 25 bp, Mus musculus
tattactatgaagtttctctgccca

SEQ ID NO: 353696 - DNA, 25 bp, Mus musculus
tattactatgaatacctctctgacg

SEQ ID NO: 353697 - DNA, 25 bp, Mus musculus
tattactcaacaacatccccgatga

SEQ ID NO: 353698 - DNA, 25 bp, Mus musculus
tattactgaagcttaaaaagcaagc

SEQ ID NO: 353699 - DNA, 25 bp, Mus musculus
tattactgactgcagcaccacagcc

SEQ ID NO: 353700 - DNA, 25 bp, Mus musculus
tattactggcccggctgtgaagttg

SEQ ID NO: 353701 - DNA, 25 bp, Mus musculus
tattactgtagcaaagacggtttac

SEQ ID NO: 353702 - DNA, 25 bp, Mus musculus
tattactgtagcaaggacaaatctg

SEQ ID NO: 353703 - DNA, 25 bp, Mus musculus
tattactgtgcaagaattactacgg

SEQ ID NO: 353704 - DNA, 25 bp, Mus musculus
tattacttgcacagggaacaagaat

SEQ ID NO: 353705 - DNA, 25 bp, Mus musculus
tattacttgtaaagatttgagaaac

SEQ ID NO: 353706 - DNA, 25 bp, Mus musculus
tattagaaaaggaaactgcattcag

SEQ ID NO: 353707 - DNA, 25 bp, Mus musculus
tattagaaaagtctctccagaggcg

SEQ ID NO: 353708 - DNA, 25 bp, Mus musculus
tattagaaggacagaaaaaaagcag

SEQ ID NO: 353709 - DNA, 25 bp, Mus musculus
tattagaaggacagctcctgaattc

SEQ ID NO: 353710 - DNA, 25 bp, Mus musculus
tattagaggagtcgctaagattgtt

SEQ ID NO: 353711 - DNA, 25 bp, Mus musculus
tattagccaccaaagcgatgttaaa

SEQ ID NO: 353712 - DNA, 25 bp, Mus musculus
tattagcccatatgcaactgccccc

SEQ ID NO: 353713 - DNA, 25 bp, Mus musculus
tattagcctttgaggtgtgcctgca

SEQ ID NO: 353714 - DNA, 25 bp, Mus musculus
tattagtattaaagataatcaaata

SEQ ID NO: 353715 - DNA, 25 bp, Mus musculus
tattataactacaaggatcctgctg

SEQ ID NO: 353716 - DNA, 25 bp, Mus musculus
tattatatatagcaaaaatgtgaat

SEQ ID NO: 353717 - DNA, 25 bp, Mus musculus
tattatatatagcaactttaaagga

SEQ ID NO: 353718 - DNA, 25 bp, Mus musculus
tattatatgaactatgatggattca

SEQ ID NO: 353719 - DNA, 25 bp, Mus musculus
tattatcaacctgaccctctatggg

SEQ ID NO: 353720 - DNA, 25 bp, Mus musculus
tattatcaacctggaggacggtgag

SEQ ID NO: 353721 - DNA, 25 bp, Mus musculus
tattatccccatggagaaaatcccc

SEQ ID NO: 353722 - DNA, 25 bp, Mus musculus
tattatccccatgttagaattgccc

SEQ ID NO: 353723 - DNA, 25 bp, Mus musculus
tattatcgttatgagtattggagaa

SEQ ID NO: 353724 - DNA, 25 bp, Mus musculus
tattatgaaagaatcccagtaaacc

SEQ ID NO: 353725 - DNA, 25 bp, Mus musculus
tattatgaaagctatcatgagaagt

SEQ ID NO: 353726 - DNA, 25 bp, Mus musculus
tattatgcagttgtggtatcccaag

SEQ ID NO: 353727 - DNA, 25 bp, Mus musculus
tattatgcagttgtgtgggtgaatg

SEQ ID NO: 353728 - DNA, 25 bp, Mus musculus
tattatggaagagagtttcatggga

SEQ ID NO: 353729 - DNA, 25 bp, Mus musculus
tattatggtagcaagatctaaaggg

SEQ ID NO: 353730 - DNA, 25 bp, Mus musculus
tattatgtagatgtgcagaaattcc

SEQ ID NO: 353731 - DNA, 25 bp, Mus musculus
tattattaaagtggttggctatgat

SEQ ID NO: 353732 - DNA, 25 bp, Mus musculus
tattattaatatggaaatgaaagtg

SEQ ID NO: 353733 - DNA, 25 bp, Mus musculus
tattattcaagattaaaccagaaga

SEQ ID NO: 353734 - DNA, 25 bp, Mus musculus
tattattcccggtgtggaatattat

SEQ ID NO: 353735 - DNA, 25 bp, Mus musculus
tattattcggcatacccatgtacct

SEQ ID NO: 353736 - DNA, 25 bp, Mus musculus
tattattgatacatccatggggtcc

SEQ ID NO: 353737 - DNA, 25 bp, Mus musculus
tattattgatattgacccattgatc

SEQ ID NO: 353738 - DNA, 25 bp, Mus musculus
tattattggcaggattgaaagctac

SEQ ID NO: 353739 - DNA, 25 bp, Mus musculus
tattattggcagggcagaggagacc

SEQ ID NO: 353740 - DNA, 25 bp, Mus musculus
tattatttaggcttggctggtgttg

SEQ ID NO: 353741 - DNA, 25 bp, Mus musculus
tattatttaggtcattttgagtgcc

SEQ ID NO: 353742 - DNA, 25 bp, Mus musculus
tattatttccaactatgaaaagaaa

SEQ ID NO: 353743 - DNA, 25 bp, Mus musculus
tattattttatggatattcattagc

SEQ ID NO: 353744 - DNA, 25 bp, Mus musculus
tattatttttttggccatattccca

SEQ ID NO: 353745 - DNA, 25 bp, Mus musculus
tattcaaaaaggtatctggaggagc

SEQ ID NO: 353746 - DNA, 25 bp, Mus musculus
tattcaaaaagtatgtttcattatg

SEQ ID NO: 353747 - DNA, 25 bp, Mus musculus
tattcaaacaaggcaagcttctagc

SEQ ID NO: 353748 - DNA, 25 bp, Mus musculus
tattcaaacaagttcaaagaagaag

SEQ ID NO: 353749 - DNA, 25 bp, Mus musculus
tattcaaactaacagaaattgatga

SEQ ID NO: 353750 - DNA, 25 bp, Mus musculus
tattcaaactaacaggtcaaggaaa

SEQ ID NO: 353751 - DNA, 25 bp, Mus musculus
tattcaaatctggaatgttccggag

SEQ ID NO: 353752 - DNA, 25 bp, Mus musculus
tattcaaccagctgtgaccatagcc

SEQ ID NO: 353753 - DNA, 25 bp, Mus musculus
tattcaagacgccttgggatgtctc

SEQ ID NO: 353754 - DNA, 25 bp, Mus musculus
tattcaagagcccccaattttatcc

SEQ ID NO: 353755 - DNA, 25 bp, Mus musculus
tattcaagcaaccatttaagaagac

SEQ ID NO: 353756 - DNA, 25 bp, Mus musculus
tattcaatgaagagcggctgattga

SEQ ID NO: 353757 - DNA, 25 bp, Mus musculus
tattcaatgaagagggcatctcctc

SEQ ID NO: 353758 - DNA, 25 bp, Mus musculus
tattcacaagagcgttataacctgg

SEQ ID NO: 353759 - DNA, 25 bp, Mus musculus
tattcacaagttgagatgaagcccg

SEQ ID NO: 353760 - DNA, 25 bp, Mus musculus
tattcacagaagaacactcaaggct

SEQ ID NO: 353761 - DNA, 25 bp, Mus musculus
tattcacagaagggttgactacagt

SEQ ID NO: 353762 - DNA, 25 bp, Mus musculus
tattcacagattatttatagcacaa

SEQ ID NO: 353763 - DNA, 25 bp, Mus musculus
tattcacagctgccgggcccttcga

SEQ ID NO: 353764 - DNA, 25 bp, Mus musculus
tattcacattcacgtatcacgtatg

SEQ ID NO: 353765 - DNA, 25 bp, Mus musculus
tattcacattcaggtatcacgtatg

SEQ ID NO: 353766 - DNA, 25 bp, Mus musculus
tattcaccgatcagaaacctgatat

SEQ ID NO: 353767 - DNA, 25 bp, Mus musculus
tattcaccgatcaggacaacatcca

SEQ ID NO: 353768 - DNA, 25 bp, Mus musculus
tattcacgacagtgttgaaggctcc

SEQ ID NO: 353769 - DNA, 25 bp, Mus musculus
tattcacgtagggtgatatgggacc

SEQ ID NO: 353770 - DNA, 25 bp, Mus musculus
tattcactggacatgggtgaagaag

SEQ ID NO: 353771 - DNA, 25 bp, Mus musculus
tattcacttccaacgtgaaactcat

SEQ ID NO: 353772 - DNA, 25 bp, Mus musculus
tattcagatggaaaactacagactg

SEQ ID NO: 353773 - DNA, 25 bp, Mus musculus
tattcagcaacagcatccgccacca

SEQ ID NO: 353774 - DNA, 25 bp, Mus musculus
tattcagcagatttgtgaaaacatc

SEQ ID NO: 353775 - DNA, 25 bp, Mus musculus
tattcagcaggaagcgtcccaggtt

SEQ ID NO: 353776 - DNA, 25 bp, Mus musculus
tattcagcaggaagtaaaatctctt

SEQ ID NO: 353777 - DNA, 25 bp, Mus musculus
tattcagccagatgaactttcaagt

SEQ ID NO: 353778 - DNA, 25 bp, Mus musculus
tattcagtacaggaaggctgtgaag

SEQ ID NO: 353779 - DNA, 25 bp, Mus musculus
tattcagtacagggcttcttcgtgt

SEQ ID NO: 353780 - DNA, 25 bp, Mus musculus
tattcatagtagttctcttcccata

SEQ ID NO: 353781 - DNA, 25 bp, Mus musculus
tattcatccaaagatgactggttta

SEQ ID NO: 353782 - DNA, 25 bp, Mus musculus
tattcatccatggaccggcacgatg

SEQ ID NO: 353783 - DNA, 25 bp, Mus musculus
tattcatcccagaaggaagaattct

SEQ ID NO: 353784 - DNA, 25 bp, Mus musculus
tattcatgcaggtccacgcctcaaa

SEQ ID NO: 353785 - DNA, 25 bp, Mus musculus
tattcatgccaggactactgttgaa

SEQ ID NO: 353786 - DNA, 25 bp, Mus musculus
tattcattacgtaatgaagtactta

SEQ ID NO: 353787 - DNA, 25 bp, Mus musculus
tattccaaacacagccagccaatgc

SEQ ID NO: 353788 - DNA, 25 bp, Mus musculus
tattccaaacacagcccacctgcat

SEQ ID NO: 353789 - DNA, 25 bp, Mus musculus
tattccaaacacagccccagccagc

SEQ ID NO: 353790 - DNA, 25 bp, Mus musculus
tattccaaagatactggcattgccc

SEQ ID NO: 353791 - DNA, 25 bp, Mus musculus
tattccaaaggatggaggccagtat

SEQ ID NO: 353792 - DNA, 25 bp, Mus musculus
tattccagagatgagatcacatagc

SEQ ID NO: 353793 - DNA, 25 bp, Mus musculus
tattccagaggcatttggatttaat

SEQ ID NO: 353794 - DNA, 25 bp, Mus musculus
tattccaggaaacagaaagctggtc

SEQ ID NO: 353795 - DNA, 25 bp, Mus musculus
tattccaggaaacaggaaggagtct

SEQ ID NO: 353796 - DNA, 25 bp, Mus musculus
tattccataagatcatctttagatg

SEQ ID NO: 353797 - DNA, 25 bp, Mus musculus
tattccatagggatccaagcctatt

SEQ ID NO: 353798 - DNA, 25 bp, Mus musculus
tattccatagggcatgccttcaggc

SEQ ID NO: 353799 - DNA, 25 bp, Mus musculus
tattccctacagaactcttgagccc

SEQ ID NO: 353800 - DNA, 25 bp, Mus musculus
tattccctacagcctgcccactgaa

SEQ ID NO: 353801 - DNA, 25 bp, Mus musculus
tattccctgactgctgcccgaatgt

SEQ ID NO: 353802 - DNA, 25 bp, Mus musculus
tattccctgatgttgcattgatgaa

SEQ ID NO: 353803 - DNA, 25 bp, Mus musculus
tattccctttaaggcatcaatactt

SEQ ID NO: 353804 - DNA, 25 bp, Mus musculus
tattccgaggccttcagaatctgag

SEQ ID NO: 353805 - DNA, 25 bp, Mus musculus
tattccgaggccttcaggtggttga

SEQ ID NO: 353806 - DNA, 25 bp, Mus musculus
tattcctacgccagagatgcgatga

SEQ ID NO: 353807 - DNA, 25 bp, Mus musculus
tattcctacggatctcatagaaaat

SEQ ID NO: 353808 - DNA, 25 bp, Mus musculus
tattcctagacagacaaagtttctc

SEQ ID NO: 353809 - DNA, 25 bp, Mus musculus
tattcctagacagtgttcctaggat

SEQ ID NO: 353810 - DNA, 25 bp, Mus musculus
tattcctcagaagcaaatggagacc

SEQ ID NO: 353811 - DNA, 25 bp, Mus musculus
tattcctcagaagttgtggagtttg

SEQ ID NO: 353812 - DNA, 25 bp, Mus musculus
tattcctcagacagtaaagactgta

SEQ ID NO: 353813 - DNA, 25 bp, Mus musculus
tattcctcagcttatggctattata

SEQ ID NO: 353814 - DNA, 25 bp, Mus musculus
tattcctcaggttatggctattata

SEQ ID NO: 353815 - DNA, 25 bp, Mus musculus
tattcctccaaaatactgttcagcc

SEQ ID NO: 353816 - DNA, 25 bp, Mus musculus
tattcctccaaagtgtgacttatga

SEQ ID NO: 353817 - DNA, 25 bp, Mus musculus
tattcctccatacgaacagcaaggc

SEQ ID NO: 353818 - DNA, 25 bp, Mus musculus
tattcctcctatgaggcgtctggaa

SEQ ID NO: 353819 - DNA, 25 bp, Mus musculus
tattcctcgcctgtgaactcatcag

SEQ ID NO: 353820 - DNA, 25 bp, Mus musculus
tattcctgaagcagaaccaccaatg

SEQ ID NO: 353821 - DNA, 25 bp, Mus musculus
tattcctgaaggaggctgtgaaaga

SEQ ID NO: 353822 - DNA, 25 bp, Mus musculus
tattcctgcatcttccttcctaggc

SEQ ID NO: 353823 - DNA, 25 bp, Mus musculus
tattcctgggacctggtcactcctg

SEQ ID NO: 353824 - DNA, 25 bp, Mus musculus
tattcctgggggttcggcagactcc

SEQ ID NO: 353825 - DNA, 25 bp, Mus musculus
tattccttaaacaagatccatgcat

SEQ ID NO: 353826 - DNA, 25 bp, Mus musculus
tattcgaaaagagagtgtatctgtc

SEQ ID NO: 353827 - DNA, 25 bp, Mus musculus
tattcgagcaggtggggcgagctat

SEQ ID NO: 353828 - DNA, 25 bp, Mus musculus
tattcgaggagactcctgaggcttt

SEQ ID NO: 353829 - DNA, 25 bp, Mus musculus
tattcgtaatgatttcattatgaaa

SEQ ID NO: 353830 - DNA, 25 bp, Mus musculus
tattcgtgagcgctctctgctctct

SEQ ID NO: 353831 - DNA, 25 bp, Mus musculus
tattcgtgagcggcaattcaaatga

SEQ ID NO: 353832 - DNA, 25 bp, Mus musculus
tattcgtttgtcagattttccactc

SEQ ID NO: 353833 - DNA, 25 bp, Mus musculus
tattctacaagcatggcctgattgt

SEQ ID NO: 353834 - DNA, 25 bp, Mus musculus
tattctacagcccaggagtgttcgc

SEQ ID NO: 353835 - DNA, 25 bp, Mus musculus
tattctacagctcaagactgcagtg

SEQ ID NO: 353836 - DNA, 25 bp, Mus musculus
tattctacagctgaggaatgtgctg

SEQ ID NO: 353837 - DNA, 25 bp, Mus musculus
tattctacaggaaaaatccgctgca

SEQ ID NO: 353838 - DNA, 25 bp, Mus musculus
tattctatgccagacttggaggtaa

SEQ ID NO: 353839 - DNA, 25 bp, Mus musculus
tattctcccagagatcttcaaaatt

SEQ ID NO: 353840 - DNA, 25 bp, Mus musculus
tattctgaagtagcttgccacaagc

SEQ ID NO: 353841 - DNA, 25 bp, Mus musculus
tattctgacgctgagctccaacagt

SEQ ID NO: 353842 - DNA, 25 bp, Mus musculus
tattctgactggagccctttcagtg

SEQ ID NO: 353843 - DNA, 25 bp, Mus musculus
tattctgagaaggggctcctgtttg

SEQ ID NO: 353844 - DNA, 25 bp, Mus musculus
tattctgagaaggttccctgtagcc

SEQ ID NO: 353845 - DNA, 25 bp, Mus musculus
tattctgagccaggtatcatacaga

SEQ ID NO: 353846 - DNA, 25 bp, Mus musculus
tattctgagcggtatcaagttatag

SEQ ID NO: 353847 - DNA, 25 bp, Mus musculus
tattctgagttttcgcgagaacttt

SEQ ID NO: 353848 - DNA, 25 bp, Mus musculus
tattctgatgatgttgctttcccct

SEQ ID NO: 353849 - DNA, 25 bp, Mus musculus
tattctgcaaaaccttatgcacaca

SEQ ID NO: 353850 - DNA, 25 bp, Mus musculus
tattctgcaaacttcaagcacaaat

SEQ ID NO: 353851 - DNA, 25 bp, Mus musculus
tattctgcagaagataccgggacac

SEQ ID NO: 353852 - DNA, 25 bp, Mus musculus
tattctgcagaagggggactatgta

SEQ ID NO: 353853 - DNA, 25 bp, Mus musculus
tattctgcatctgagtgggaactgg

SEQ ID NO: 353854 - DNA, 25 bp, Mus musculus
tattctgcctttgaaacagacataa

SEQ ID NO: 353855 - DNA, 25 bp, Mus musculus
tattctgcctttgaacatgattctg

SEQ ID NO: 353856 - DNA, 25 bp, Mus musculus
tattctgctcggcagcacatcatgc

SEQ ID NO: 353857 - DNA, 25 bp, Mus musculus
tattctgctcgtcagcacatcatgc

SEQ ID NO: 353858 - DNA, 25 bp, Mus musculus
tattctgtaacgtatgatggatcga

SEQ ID NO: 353859 - DNA, 25 bp, Mus musculus
tattctgtaacgtatgatggattca

SEQ ID NO: 353860 - DNA, 25 bp, Mus musculus
tattcttactacaggaatgagtgcc

SEQ ID NO: 353861 - DNA, 25 bp, Mus musculus
tattcttatccaggtaccattacta

SEQ ID NO: 353862 - DNA, 25 bp, Mus musculus
tattcttctaagggaatacagtgag

SEQ ID NO: 353863 - DNA, 25 bp, Mus musculus
tattcttgacggacttaaaaggaca

SEQ ID NO: 353864 - DNA, 25 bp, Mus musculus
tattcttggggaacttagcataact

SEQ ID NO: 353865 - DNA, 25 bp, Mus musculus
tattcttggggttgaatctccagta

SEQ ID NO: 353866 - DNA, 25 bp, Mus musculus
tattcttttggcctaagatcaccaa

SEQ ID NO: 353867 - DNA, 25 bp, Mus musculus
tattgaaaagagagccaagcctccc

SEQ ID NO: 353868 - DNA, 25 bp, Mus musculus
tattgaaaaggcggcaaagtgcgtg

SEQ ID NO: 353869 - DNA, 25 bp, Mus musculus
tattgaaacatccatttcagtcctc

SEQ ID NO: 353870 - DNA, 25 bp, Mus musculus
tattgaaagaaaagcgggtgccctc

SEQ ID NO: 353871 - DNA, 25 bp, Mus musculus
tattgaaagagaggtcttacttgtt

SEQ ID NO: 353872 - DNA, 25 bp, Mus musculus
tattgaagacacaggattatgtact

SEQ ID NO: 353873 - DNA, 25 bp, Mus musculus
tattgaatatgtggtgctgctgttt

SEQ ID NO: 353874 - DNA, 25 bp, Mus musculus
tattgacacacatgcgggtggagtg

SEQ ID NO: 353875 - DNA, 25 bp, Mus musculus
tattgacagtaagggtgatgcccgg

SEQ ID NO: 353876 - DNA, 25 bp, Mus musculus
tattgagaaggagaacactgaaggt

SEQ ID NO: 353877 - DNA, 25 bp, Mus musculus
tattgagaccctacacttattcatc

SEQ ID NO: 353878 - DNA, 25 bp, Mus musculus
tattgagaccctacatgtacccctc

SEQ ID NO: 353879 - DNA, 25 bp, Mus musculus
tattgagactgtgggatagtgtgct

SEQ ID NO: 353880 - DNA, 25 bp, Mus musculus
tattgagactgtggtgtgtctgcag

SEQ ID NO: 353881 - DNA, 25 bp, Mus musculus
tattgagataaaagccagagttact

SEQ ID NO: 353882 - DNA, 25 bp, Mus musculus
tattgagcagattctcgactatctc

SEQ ID NO: 353883 - DNA, 25 bp, Mus musculus
tattgagcctcgaagtctttacctg

SEQ ID NO: 353884 - DNA, 25 bp, Mus musculus
tattgagcgcaaggtaatagaactt

SEQ ID NO: 353885 - DNA, 25 bp, Mus musculus
tattgagttcagctatgaactctcg

SEQ ID NO: 353886 - DNA, 25 bp, Mus musculus
tattgagttcattcaggctggtggg

SEQ ID NO: 353887 - DNA, 25 bp, Mus musculus
tattgataaacgccaccgctccctt

SEQ ID NO: 353888 - DNA, 25 bp, Mus musculus
tattgataaagttcaacttcttgag

SEQ ID NO: 353889 - DNA, 25 bp, Mus musculus
tattgataaggctgcctttgatatt

SEQ ID NO: 353890 - DNA, 25 bp, Mus musculus
tattgataaggtaacaagccgatgg

SEQ ID NO: 353891 - DNA, 25 bp, Mus musculus
tattgatcaaagtgccagtgaaccc

SEQ ID NO: 353892 - DNA, 25 bp, Mus musculus
tattgatcaaagtggaaatggatcc

SEQ ID NO: 353893 - DNA, 25 bp, Mus musculus
tattgatgaaaagatttatttattc

SEQ ID NO: 353894 - DNA, 25 bp, Mus musculus
tattgatgaaatagactctttccta

SEQ ID NO: 353895 - DNA, 25 bp, Mus musculus
tattgatgatgtgcctgatgacatt

SEQ ID NO: 353896 - DNA, 25 bp, Mus musculus
tattgatgcatcattgtcgctgccc

SEQ ID NO: 353897 - DNA, 25 bp, Mus musculus
tattgatgctgctgtccggcggttt

SEQ ID NO: 353898 - DNA, 25 bp, Mus musculus
tattgatggaaaagggttcctttga

SEQ ID NO: 353899 - DNA, 25 bp, Mus musculus
tattgatggaaagggtccaattggt

SEQ ID NO: 353900 - DNA, 25 bp, Mus musculus
tattgatgttgattgatgtgggtcg

SEQ ID NO: 353901 - DNA, 25 bp, Mus musculus
tattgatgttggaaactgtggctgt

SEQ ID NO: 353902 - DNA, 25 bp, Mus musculus
tattgattagtacaaacaggccatc

SEQ ID NO: 353903 - DNA, 25 bp, Mus musculus
tattgcagagatggagactcaaaga

SEQ ID NO: 353904 - DNA, 25 bp, Mus musculus
tattgcagagggcaagtttatccag

SEQ ID NO: 353905 - DNA, 25 bp, Mus musculus
tattgcatagggtaaatgagaaaac

SEQ ID NO: 353906 - DNA, 25 bp, Mus musculus
tattgcatatagtcctgatgggaaa

SEQ ID NO: 353907 - DNA, 25 bp, Mus musculus
tattgccaaagatactgatcaatgg

SEQ ID NO: 353908 - DNA, 25 bp, Mus musculus
tattgccaaagctagttatgaacaa

SEQ ID NO: 353909 - DNA, 25 bp, Mus musculus
tattgccaaagctgcgtctttgcct

SEQ ID NO: 353910 - DNA, 25 bp, Mus musculus
tattgccaatggtgcagccggatgt

SEQ ID NO: 353911 - DNA, 25 bp, Mus musculus
tattgccagagaaggaacatggctt

SEQ ID NO: 353912 - DNA, 25 bp, Mus musculus
tattgccagtgactacaaatacaaa

SEQ ID NO: 353913 - DNA, 25 bp, Mus musculus
tattgcccaaggacctgagcccaac

SEQ ID NO: 353914 - DNA, 25 bp, Mus musculus
tattgcccaagtcaaagtaaacaaa

SEQ ID NO: 353915 - DNA, 25 bp, Mus musculus
tattgccgtgaaagaaaccggctct

SEQ ID NO: 353916 - DNA, 25 bp, Mus musculus
tattgccgtgaaaggctcagcggct

SEQ ID NO: 353917 - DNA, 25 bp, Mus musculus
tattgctaagatggcagttgggttc

SEQ ID NO: 353918 - DNA, 25 bp, Mus musculus
tattgctactgggggctacgggcga

SEQ ID NO: 353919 - DNA, 25 bp, Mus musculus
tattgctatgaagttgaatctgcgt

SEQ ID NO: 353920 - DNA, 25 bp, Mus musculus
tattgctcaggccctggcacatctt

SEQ ID NO: 353921 - DNA, 25 bp, Mus musculus
tattgctcggggtgacaaagacttc

SEQ ID NO: 353922 - DNA, 25 bp, Mus musculus
tattggaagcatagaaggcctactc

SEQ ID NO: 353923 - DNA, 25 bp, Mus musculus
tattggacaagaagttgttcaaggg

SEQ ID NO: 353924 - DNA, 25 bp, Mus musculus
tattggacaagtagaggggaccatg

SEQ ID NO: 353925 - DNA, 25 bp, Mus musculus
tattggacttgcaagctctttacag

SEQ ID NO: 353926 - DNA, 25 bp, Mus musculus
tattggacttgcaagtctctttaca

SEQ ID NO: 353927 - DNA, 25 bp, Mus musculus
tattggataagaccaccgctcttga

SEQ ID NO: 353928 - DNA, 25 bp, Mus musculus
tattggcaacagacctgcctggagt

SEQ ID NO: 353929 - DNA, 25 bp, Mus musculus
tattggcaacagttggaacgctatc

SEQ ID NO: 353930 - DNA, 25 bp, Mus musculus
tattggcaagaaccgagctcaagct

SEQ ID NO: 353931 - DNA, 25 bp, Mus musculus
tattggcaagagtccagaaaacctt

SEQ ID NO: 353932 - DNA, 25 bp, Mus musculus
tattggccagcctggcacggatgct

SEQ ID NO: 353933 - DNA, 25 bp, Mus musculus
tattggcgcaccactctcaagctga

SEQ ID NO: 353934 - DNA, 25 bp, Mus musculus
tattggcgtgagcggaggctgctga

SEQ ID NO: 353935 - DNA, 25 bp, Mus musculus
tattggctatgccagctcttctcct

SEQ ID NO: 353936 - DNA, 25 bp, Mus musculus
tattggctatgccaggaacccatct

SEQ ID NO: 353937 - DNA, 25 bp, Mus musculus
tattggctcctccagggtccggtac

SEQ ID NO: 353938 - DNA, 25 bp, Mus musculus
tattggctcctccaggtgtttgtgg

SEQ ID NO: 353939 - DNA, 25 bp, Mus musculus
tattggctggaccagatgcggtgag

SEQ ID NO: 353940 - DNA, 25 bp, Mus musculus
tattggctggatcccaagtcttcct

SEQ ID NO: 353941 - DNA, 25 bp, Mus musculus
tattggctgggcaatgaatgcagcc

SEQ ID NO: 353942 - DNA, 25 bp, Mus musculus
tattgggaacgaccaaggactcacc

SEQ ID NO: 353943 - DNA, 25 bp, Mus musculus
tattgggacagacacaggaattgtg

SEQ ID NO: 353944 - DNA, 25 bp, Mus musculus
tattgggagctccagtggcagtggg

SEQ ID NO: 353945 - DNA, 25 bp, Mus musculus
tattggggagagagaaaaaaccatt

SEQ ID NO: 353946 - DNA, 25 bp, Mus musculus
tattgggtaatgggccaattcaatt

SEQ ID NO: 353947 - DNA, 25 bp, Mus musculus
tattggtaagttccctgctatcaat

SEQ ID NO: 353948 - DNA, 25 bp, Mus musculus
tattggtagcagatttcttagattt

SEQ ID NO: 353949 - DNA, 25 bp, Mus musculus
tattgtaacagaatccgaatcttga

SEQ ID NO: 353950 - DNA, 25 bp, Mus musculus
tattgtagacaggtactggcatagc

SEQ ID NO: 353951 - DNA, 25 bp, Mus musculus
tattgtcaagaagcaagacttggga

SEQ ID NO: 353952 - DNA, 25 bp, Mus musculus
tattgtcaagatcgtaccgagaagc

SEQ ID NO: 353953 - DNA, 25 bp, Mus musculus
tattgtcaaggaactgaaagacaac

SEQ ID NO: 353954 - DNA, 25 bp, Mus musculus
tattgtcagcaagcttcaggagctc

SEQ ID NO: 353955 - DNA, 25 bp, Mus musculus
tattgtcagcaggttgatgcaagtt

SEQ ID NO: 353956 - DNA, 25 bp, Mus musculus
tattgtcctttcatgtaaatttaca

SEQ ID NO: 353957 - DNA, 25 bp, Mus musculus
tattgtcgttggcttcctgcctggt

SEQ ID NO: 353958 - DNA, 25 bp, Mus musculus
tattgtctaccaacgataaaacaat

SEQ ID NO: 353959 - DNA, 25 bp, Mus musculus
tattgtgagtaccctgggaaaagag

SEQ ID NO: 353960 - DNA, 25 bp, Mus musculus
tattgtgcaggcatccagggtatcg

SEQ ID NO: 353961 - DNA, 25 bp, Mus musculus
tattgtgctgctgatgaagagacta

SEQ ID NO: 353962 - DNA, 25 bp, Mus musculus
tattgtggaaggatacgccaatgtc

SEQ ID NO: 353963 - DNA, 25 bp, Mus musculus
tattgtggaggaattaattcgagaa

SEQ ID NO: 353964 - DNA, 25 bp, Mus musculus
tattgtgtaagcagaatattcaagg

SEQ ID NO: 353965 - DNA, 25 bp, Mus musculus
tattgtgtagaatatatttgaaata

SEQ ID NO: 353966 - DNA, 25 bp, Mus musculus
tattgttaaaggaaattcgatagca

SEQ ID NO: 353967 - DNA, 25 bp, Mus musculus
tattgttacatgggtttatccatgg

SEQ ID NO: 353968 - DNA, 25 bp, Mus musculus
tattgttacatgtgtatctccagag

SEQ ID NO: 353969 - DNA, 25 bp, Mus musculus
tattgttcctgacaaccctccatat

SEQ ID NO: 353970 - DNA, 25 bp, Mus musculus
tattgttcctggtttctctttgtac

SEQ ID NO: 353971 - DNA, 25 bp, Mus musculus
tattgttcggatgctgaatccctac

SEQ ID NO: 353972 - DNA, 25 bp, Mus musculus
tattgttgcatcaggtactgtaata

SEQ ID NO: 353973 - DNA, 25 bp, Mus musculus
tattgtttaaactacagaactttgt

SEQ ID NO: 353974 - DNA, 25 bp, Mus musculus
tattgtttaaactgcagaggtatac

SEQ ID NO: 353975 - DNA, 25 bp, Mus musculus
tattgtttggttcttcgggcctgtg

SEQ ID NO: 353976 - DNA, 25 bp, Mus musculus
tatttaaaataccagtgtaagcggt

SEQ ID NO: 353977 - DNA, 25 bp, Mus musculus
tatttaaacaccagggtctcctagc

SEQ ID NO: 353978 - DNA, 25 bp, Mus musculus
tatttaaagaacttgtgtagcttgt

SEQ ID NO: 353979 - DNA, 25 bp, Mus musculus
tatttaaatatcacgaacacactaa

SEQ ID NO: 353980 - DNA, 25 bp, Mus musculus
tatttaacagacaaatggtggcccg

SEQ ID NO: 353981 - DNA, 25 bp, Mus musculus
tatttaacagacaatcatggccctg

SEQ ID NO: 353982 - DNA, 25 bp, Mus musculus
tatttaagaagagaaggtggctgca

SEQ ID NO: 353983 - DNA, 25 bp, Mus musculus
tatttaagaagatgaaaccagattt

SEQ ID NO: 353984 - DNA, 25 bp, Mus musculus
tatttaagcagagatgacgtcagtg

SEQ ID NO: 353985 - DNA, 25 bp, Mus musculus
tatttaataaaggcctgtgatactc

SEQ ID NO: 353986 - DNA, 25 bp, Mus musculus
tatttacagagcccatggatgggat

SEQ ID NO: 353987 - DNA, 25 bp, Mus musculus
tatttaccaagcgctgatcctgacc

SEQ ID NO: 353988 - DNA, 25 bp, Mus musculus
tatttaccaaggaggcatcctcatg

SEQ ID NO: 353989 - DNA, 25 bp, Mus musculus
tatttaccagaccaagaaggtctac

SEQ ID NO: 353990 - DNA, 25 bp, Mus musculus
tatttaccaggacattcgacatgaa

SEQ ID NO: 353991 - DNA, 25 bp, Mus musculus
tatttaccaggtgaggacacttgtg

SEQ ID NO: 353992 - DNA, 25 bp, Mus musculus
tatttagaaggttctacttagccaa

SEQ ID NO: 353993 - DNA, 25 bp, Mus musculus
tatttatcagataaccacattttaa

SEQ ID NO: 353994 - DNA, 25 bp, Mus musculus
tatttatccaaaggtgttttacatg

SEQ ID NO: 353995 - DNA, 25 bp, Mus musculus
tatttattatttaggcttggctggt

SEQ ID NO: 353996 - DNA, 25 bp, Mus musculus
tatttattatttaggtcattttgag

SEQ ID NO: 353997 - DNA, 25 bp, Mus musculus
tatttattccagctacctggagaac

SEQ ID NO: 353998 - DNA, 25 bp, Mus musculus
tatttattgatgaaaagatttattt

SEQ ID NO: 353999 - DNA, 25 bp, Mus musculus
tatttattggcacagacacaggaat

SEQ ID NO: 354000 - DNA, 25 bp, Mus musculus
tatttattgggacagacacaggaat

SEQ ID NO: 354001 - DNA, 25 bp, Mus musculus
tatttcaaaaatgggaacttgacga

SEQ ID NO: 354002 - DNA, 25 bp, Mus musculus
tatttcaaaaatgggatagatgtgc

SEQ ID NO: 354003 - DNA, 25 bp, Mus musculus
tatttcaaaatggagctgaagttcc

SEQ ID NO: 354004 - DNA, 25 bp, Mus musculus
tatttcaactttggccaccagttct

SEQ ID NO: 354005 - DNA, 25 bp, Mus musculus
tatttcaactttggcctaccttctt

SEQ ID NO: 354006 - DNA, 25 bp, Mus musculus
tatttcaagaaaagagaaaattgga

SEQ ID NO: 354007 - DNA, 25 bp, Mus musculus
tatttcaagaaaaggaaaatgtccc

SEQ ID NO: 354008 - DNA, 25 bp, Mus musculus
tatttcagacaggattggtagctta

SEQ ID NO: 354009 - DNA, 25 bp, Mus musculus
tatttcagggaaaacaggcagcaca

SEQ ID NO: 354010 - DNA, 25 bp, Mus musculus
tatttcagttgacacgagccgtcta

SEQ ID NO: 354011 - DNA, 25 bp, Mus musculus
tatttcagttgacacggaacagtcc

SEQ ID NO: 354012 - DNA, 25 bp, Mus musculus
tatttcatgctggatgacctcaatg

SEQ ID NO: 354013 - DNA, 25 bp, Mus musculus
tatttcatggagagacgtgacactc

SEQ ID NO: 354014 - DNA, 25 bp, Mus musculus
tatttcatggagagggaggggcgga

SEQ ID NO: 354015 - DNA, 25 bp, Mus musculus
tatttccaaccacggctcactccag

SEQ ID NO: 354016 - DNA, 25 bp, Mus musculus
tatttccaactatgaaaagaaagtt

SEQ ID NO: 354017 - DNA, 25 bp, Mus musculus
tatttccaagattcactcagtgtct

SEQ ID NO: 354018 - DNA, 25 bp, Mus musculus
tatttccaagtttcactcagtgtct

SEQ ID NO: 354019 - DNA, 25 bp, Mus musculus
tatttccacgatggggtccgagtgg

SEQ ID NO: 354020 - DNA, 25 bp, Mus musculus
tatttccagattggtgccattcagt

SEQ ID NO: 354021 - DNA, 25 bp, Mus musculus
tatttccagcagggtgacatggagt

SEQ ID NO: 354022 - DNA, 25 bp, Mus musculus
tatttccaggtatggtatgaaacca

SEQ ID NO: 354023 - DNA, 25 bp, Mus musculus
tatttccagtgcaccagcagaacag

SEQ ID NO: 354024 - DNA, 25 bp, Mus musculus
tatttcccactgaggccaatgtgct

SEQ ID NO: 354025 - DNA, 25 bp, Mus musculus
tatttcccaggtgcggggtcctcca

SEQ ID NO: 354026 - DNA, 25 bp, Mus musculus
tatttccctgtctctcagaactgag

SEQ ID NO: 354027 - DNA, 25 bp, Mus musculus
tatttccctgtctctttggtcaaga

SEQ ID NO: 354028 - DNA, 25 bp, Mus musculus
tatttccggctgctcctgatgctgt

SEQ ID NO: 354029 - DNA, 25 bp, Mus musculus
tatttcctagagctgtttgacaact

SEQ ID NO: 354030 - DNA, 25 bp, Mus musculus
tatttcggcaggaattagctctgcg

SEQ ID NO: 354031 - DNA, 25 bp, Mus musculus
tatttcggcaggcaatacggaatat

SEQ ID NO: 354032 - DNA, 25 bp, Mus musculus
tatttcgtgcacagcaaaactcttt

SEQ ID NO: 354033 - DNA, 25 bp, Mus musculus
tatttcgtgcacatttttgcagcct

SEQ ID NO: 354034 - DNA, 25 bp, Mus musculus
tatttctaatgggggtcctgctcca

SEQ ID NO: 354035 - DNA, 25 bp, Mus musculus
tatttctacatggtctcttcatggg

SEQ ID NO: 354036 - DNA, 25 bp, Mus musculus
tatttctagaagatcattgcaacga

SEQ ID NO: 354037 - DNA, 25 bp, Mus musculus
tatttctccagagcgtgcccctgga

SEQ ID NO: 354038 - DNA, 25 bp, Mus musculus
tatttctccaggcttcacagagatc

SEQ ID NO: 354039 - DNA, 25 bp, Mus musculus
tatttctcccagagcctggcacccc

SEQ ID NO: 354040 - DNA, 25 bp, Mus musculus
tatttctcccagaggcaaaatctca

SEQ ID NO: 354041 - DNA, 25 bp, Mus musculus
tatttctgaacctagtctctgtcca

SEQ ID NO: 354042 - DNA, 25 bp, Mus musculus
tatttctggaagctttgcaaaaagg

SEQ ID NO: 354043 - DNA, 25 bp, Mus musculus
tatttcttccaaggcagaagagtgg

SEQ ID NO: 354044 - DNA, 25 bp, Mus musculus
tatttctttaaaaggtgaggcatga

SEQ ID NO: 354045 - DNA, 25 bp, Mus musculus
tatttctttacctgacaaagccaag

SEQ ID NO: 354046 - DNA, 25 bp, Mus musculus
tatttgacatggcctctgaagaaca

SEQ ID NO: 354047 - DNA, 25 bp, Mus musculus
tatttgacgaaaacgacagaagata

SEQ ID NO: 354048 - DNA, 25 bp, Mus musculus
tatttgacgaaaacgagctgttgcg

SEQ ID NO: 354049 - DNA, 25 bp, Mus musculus
tatttgagaggtagtgatttaatac

SEQ ID NO: 354050 - DNA, 25 bp, Mus musculus
tatttgatcaacagacgtatgttgt

SEQ ID NO: 354051 - DNA, 25 bp, Mus musculus
tatttgatcaacagccaaaccactg

SEQ ID NO: 354052 - DNA, 25 bp, Mus musculus
tatttgatgcactagctgaaaaaca

SEQ ID NO: 354053 - DNA, 25 bp, Mus musculus
tatttgattttcaggcagaaattta

SEQ ID NO: 354054 - DNA, 25 bp, Mus musculus
tatttgattttcaggggctccaaca

SEQ ID NO: 354055 - DNA, 25 bp, Mus musculus
tatttgcaaagtaaaaacaaatata

SEQ ID NO: 354056 - DNA, 25 bp, Mus musculus
tatttgcaagatgagatgaacgatc

SEQ ID NO: 354057 - DNA, 25 bp, Mus musculus
tatttgcagaagtcgagtccctgca

SEQ ID NO: 354058 - DNA, 25 bp, Mus musculus
tatttgccaataatccgtgccggca

SEQ ID NO: 354059 - DNA, 25 bp, Mus musculus
tatttgccaataatgcagaccagca

SEQ ID NO: 354060 - DNA, 25 bp, Mus musculus
tatttgcccttaaggccctggaatt

SEQ ID NO: 354061 - DNA, 25 bp, Mus musculus
tatttgcccttaaggtccctgccct

SEQ ID NO: 354062 - DNA, 25 bp, Mus musculus
tatttgcgtagccgcctgtgtggtc

SEQ ID NO: 354063 - DNA, 25 bp, Mus musculus
tatttgctcaaagccatcttcagag

SEQ ID NO: 354064 - DNA, 25 bp, Mus musculus
tatttgctcaaatggcctcctgggt

SEQ ID NO: 354065 - DNA, 25 bp, Mus musculus
tatttgctccgctttttgcaatgtt

SEQ ID NO: 354066 - DNA, 25 bp, Mus musculus
tatttgcttctgaggtggtcctgga

SEQ ID NO: 354067 - DNA, 25 bp, Mus musculus
tatttggagaagaccaacctggtct

SEQ ID NO: 354068 - DNA, 25 bp, Mus musculus
tatttggagaaggatcttcaagcta

SEQ ID NO: 354069 - DNA, 25 bp, Mus musculus
tatttggagccagacacttgtctcc

SEQ ID NO: 354070 - DNA, 25 bp, Mus musculus
tatttggagccagcgacccatacgt

SEQ ID NO: 354071 - DNA, 25 bp, Mus musculus
tatttggcttgcaaggctaccaagg

SEQ ID NO: 354072 - DNA, 25 bp, Mus musculus
tatttgggaaaaggactagcggaca

SEQ ID NO: 354073 - DNA, 25 bp, Mus musculus
tatttgggaaaaggtgatgcctgct

SEQ ID NO: 354074 - DNA, 25 bp, Mus musculus
tatttgggtggggagaagagacgtg

SEQ ID NO: 354075 - DNA, 25 bp, Mus musculus
tatttgtcccgtggcccctctggtt

SEQ ID NO: 354076 - DNA, 25 bp, Mus musculus
tatttgtcccgtgggcccaagaact

SEQ ID NO: 354077 - DNA, 25 bp, Mus musculus
tatttgtccgtatgttatatctcaa

SEQ ID NO: 354078 - DNA, 25 bp, Mus musculus
tatttgtcgactggaaggataggtg

SEQ ID NO: 354079 - DNA, 25 bp, Mus musculus
tatttgtctgcaaggaatggaccgg

SEQ ID NO: 354080 - DNA, 25 bp, Mus musculus
tatttgtctgcaaggatctctcctc

SEQ ID NO: 354081 - DNA, 25 bp, Mus musculus
tatttgtgaaaggcactgaagatcc

SEQ ID NO: 354082 - DNA, 25 bp, Mus musculus
tatttgtgaggcgaacattgaggct

SEQ ID NO: 354083 - DNA, 25 bp, Mus musculus
tatttgtggtgataatgagtctacc

SEQ ID NO: 354084 - DNA, 25 bp, Mus musculus
tatttgttcttaaggatacagagga

SEQ ID NO: 354085 - DNA, 25 bp, Mus musculus
tatttgttcttaagtggccaaatgt

SEQ ID NO: 354086 - DNA, 25 bp, Mus musculus
tattttacagtgaaaatgtgctatt

SEQ ID NO: 354087 - DNA, 25 bp, Mus musculus
tattttagccaccaggacacagaat

SEQ ID NO: 354088 - DNA, 25 bp, Mus musculus
tattttaggtgtaagcccatctgct

SEQ ID NO: 354089 - DNA, 25 bp, Mus musculus
tattttatataattggcctacaggg

SEQ ID NO: 354090 - DNA, 25 bp, Mus musculus
tattttatggatattcattagctta

SEQ ID NO: 354091 - DNA, 25 bp, Mus musculus
tattttcaataatggacgctgtagt

SEQ ID NO: 354092 - DNA, 25 bp, Mus musculus
tattttcaggcaaaagcgagcggag

SEQ ID NO: 354093 - DNA, 25 bp, Mus musculus
tattttccaagcagggaccaggata

SEQ ID NO: 354094 - DNA, 25 bp, Mus musculus
tattttccaagcagttactgctgac

SEQ ID NO: 354095 - DNA, 25 bp, Mus musculus
tattttcccaccaagcccacaaggc

SEQ ID NO: 354096 - DNA, 25 bp, Mus musculus
tattttctacagctctcaacctacg

SEQ ID NO: 354097 - DNA, 25 bp, Mus musculus
tattttctcagcaagccccgcccaa

SEQ ID NO: 354098 - DNA, 25 bp, Mus musculus
tattttctcaggtgtgcatgtagcc

SEQ ID NO: 354099 - DNA, 25 bp, Mus musculus
tattttctccagaaggtcgcttata

SEQ ID NO: 354100 - DNA, 25 bp, Mus musculus
tattttctgaatcacggagtcaaag

SEQ ID NO: 354101 - DNA, 25 bp, Mus musculus
tattttctgaatcacgtgtcgagtg

SEQ ID NO: 354102 - DNA, 25 bp, Mus musculus
tattttctggcattgatggtttgtc

SEQ ID NO: 354103 - DNA, 25 bp, Mus musculus
tattttctggcattggatctactgc

SEQ ID NO: 354104 - DNA, 25 bp, Mus musculus
tattttgaagtgatgagactatcca

SEQ ID NO: 354105 - DNA, 25 bp, Mus musculus
tattttgaccttggacttcctggac

SEQ ID NO: 354106 - DNA, 25 bp, Mus musculus
tattttgccaaaggtgttttacatg

SEQ ID NO: 354107 - DNA, 25 bp, Mus musculus
tattttgccgatcagaaccagtttg

SEQ ID NO: 354108 - DNA, 25 bp, Mus musculus
tattttgccgatcagctatatttct

SEQ ID NO: 354109 - DNA, 25 bp, Mus musculus
tattttgtcgttcggtgctcgtagc

SEQ ID NO: 354110 - DNA, 25 bp, Mus musculus
tattttgtttcggaagacaacatgg

SEQ ID NO: 354111 - DNA, 25 bp, Mus musculus
tattttgtttcggacaggccaggag

SEQ ID NO: 354112 - DNA, 25 bp, Mus musculus
tattttgtttcgggacaactgccac

SEQ ID NO: 354113 - DNA, 25 bp, Mus musculus
tatttttaagaggcaagaaacaaaa

SEQ ID NO: 354114 - DNA, 25 bp, Mus musculus
tatttttaagtaggaaaatgacaga

SEQ ID NO: 354115 - DNA, 25 bp, Mus musculus
tatttttaagtgtgatcccaccagt

SEQ ID NO: 354116 - DNA, 25 bp, Mus musculus
tatttttaatgagctacccatgaca

SEQ ID NO: 354117 - DNA, 25 bp, Mus musculus
tatttttacagggaggagcctcgat

SEQ ID NO: 354118 - DNA, 25 bp, Mus musculus
tatttttcccccctcaagatcggct

SEQ ID NO: 354119 - DNA, 25 bp, Mus musculus
tatttttgaaggttaatatccttcc

SEQ ID NO: 354120 - DNA, 25 bp, Mus musculus
tatttttgaagtatgcgagcattga

SEQ ID NO: 354121 - DNA, 25 bp, Mus musculus
tattttttacaaatggtattctctg

SEQ ID NO: 354122 - DNA, 25 bp, Mus musculus
tattttttacaaatgttatccaagc

SEQ ID NO: 354123 - DNA, 25 bp, Mus musculus
tattttttgagacaaaagatgtatt

SEQ ID NO: 354124 - DNA, 25 bp, Mus musculus
tatttttttggccatattcccaaag

SEQ ID NO: 354125 - DNA, 25 bp, Mus musculus
tcaaaaaaactggaagccaagtaca

SEQ ID NO: 354126 - DNA, 25 bp, Mus musculus
tcaaaaaaactggaagtcagcaggg

SEQ ID NO: 354127 - DNA, 25 bp, Mus musculus
tcaaaaaacacagctgcctgccttg

SEQ ID NO: 354128 - DNA, 25 bp, Mus musculus
tcaaaaaaccagtgcctccgaagcc

SEQ ID NO: 354129 - DNA, 25 bp, Mus musculus
tcaaaaaagccaggcctctgatcct

SEQ ID NO: 354130 - DNA, 25 bp, Mus musculus
tcaaaaaatcagggcttgcggctta

SEQ ID NO: 354131 - DNA, 25 bp, Mus musculus
tcaaaaacaacagaatcaagacaca

SEQ ID NO: 354132 - DNA, 25 bp, Mus musculus
tcaaaaacaacaggctcctcaactt

SEQ ID NO: 354133 - DNA, 25 bp, Mus musculus
tcaaaaacaggatctgagtcttcag

SEQ ID NO: 354134 - DNA, 25 bp, Mus musculus
tcaaaaacaggtcagcccttcttaa

SEQ ID NO: 354135 - DNA, 25 bp, Mus musculus
tcaaaaaccaagaatggattgtcgc

SEQ ID NO: 354136 - DNA, 25 bp, Mus musculus
tcaaaaactggagacctcaggaaag

SEQ ID NO: 354137 - DNA, 25 bp, Mus musculus
tcaaaaagacaggttagaaagctgt

SEQ ID NO: 354138 - DNA, 25 bp, Mus musculus
tcaaaaagaccaaaggccagccttt

SEQ ID NO: 354139 - DNA, 25 bp, Mus musculus
tcaaaaagataaaggagcgaatccg

SEQ ID NO: 354140 - DNA, 25 bp, Mus musculus
tcaaaaagcacagaacaagcctgcc

SEQ ID NO: 354141 - DNA, 25 bp, Mus musculus
tcaaaaagtatcaggaatacatccc

SEQ ID NO: 354142 - DNA, 25 bp, Mus musculus
tcaaaaagtgtgcaggtttcaactc

SEQ ID NO: 354143 - DNA, 25 bp, Mus musculus
tcaaaaagtgtgcagttcagaggtt

SEQ ID NO: 354144 - DNA, 25 bp, Mus musculus
tcaaaaataattggtttggattcag

SEQ ID NO: 354145 - DNA, 25 bp, Mus musculus
tcaaaaatagccagccaagtctgaa

SEQ ID NO: 354146 - DNA, 25 bp, Mus musculus
tcaaaaatagccagcctgtcaagac

SEQ ID NO: 354147 - DNA, 25 bp, Mus musculus
tcaaaaatagctcggtcgaggagtg

SEQ ID NO: 354148 - DNA, 25 bp, Mus musculus
tcaaaaatcagataacaactattcc

SEQ ID NO: 354149 - DNA, 25 bp, Mus musculus
tcaaaaatcagataagaaacctgac

SEQ ID NO: 354150 - DNA, 25 bp, Mus musculus
tcaaaaatctggtagtgcaacttca

SEQ ID NO: 354151 - DNA, 25 bp, Mus musculus
tcaaaaatgggaacttgacgagagg

SEQ ID NO: 354152 - DNA, 25 bp, Mus musculus
tcaaaaatgggatagatgtgcatga

SEQ ID NO: 354153 - DNA, 25 bp, Mus musculus
tcaaaaattaagtgtctctgccacc

SEQ ID NO: 354154 - DNA, 25 bp, Mus musculus
tcaaaaattaagttagctgacaagg

SEQ ID NO: 354155 - DNA, 25 bp, Mus musculus
tcaaaaattataattgcttctactt

SEQ ID NO: 354156 - DNA, 25 bp, Mus musculus
tcaaaacacacgaattgtcacaatg

SEQ ID NO: 354157 - DNA, 25 bp, Mus musculus
tcaaaacagaggtgcaaagaaatgg

SEQ ID NO: 354158 - DNA, 25 bp, Mus musculus
tcaaaaccaaaaatcctgacttttg

SEQ ID NO: 354159 - DNA, 25 bp, Mus musculus
tcaaaaccaaacaatttgctcctat

SEQ ID NO: 354160 - DNA, 25 bp, Mus musculus
tcaaaaccaagattaattgcctgag

SEQ ID NO: 354161 - DNA, 25 bp, Mus musculus
tcaaaaccaagtcactccttgtggt

SEQ ID NO: 354162 - DNA, 25 bp, Mus musculus
tcaaaaccagggatactgggaacct

SEQ ID NO: 354163 - DNA, 25 bp, Mus musculus
tcaaaacccaaaggaagagcccaga

SEQ ID NO: 354164 - DNA, 25 bp, Mus musculus
tcaaaacccagagggccagtaagag

SEQ ID NO: 354165 - DNA, 25 bp, Mus musculus
tcaaaaccgctatggcaacgtgatc

SEQ ID NO: 354166 - DNA, 25 bp, Mus musculus
tcaaaacggaaggacctgcaatgac

SEQ ID NO: 354167 - DNA, 25 bp, Mus musculus
tcaaaactactaaatggaaatgatc

SEQ ID NO: 354168 - DNA, 25 bp, Mus musculus
tcaaaactagttggacacccccgcg

SEQ ID NO: 354169 - DNA, 25 bp, Mus musculus
tcaaaactgcaagttgcacccagct

SEQ ID NO: 354170 - DNA, 25 bp, Mus musculus
tcaaaactggcttggagtcaaaatt

SEQ ID NO: 354171 - DNA, 25 bp, Mus musculus
tcaaaactgggattattggcccagg

SEQ ID NO: 354172 - DNA, 25 bp, Mus musculus
tcaaaagaaagaattcctgagacaa

SEQ ID NO: 354173 - DNA, 25 bp, Mus musculus
tcaaaagaatgctgtgtctgcttca

SEQ ID NO: 354174 - DNA, 25 bp, Mus musculus
tcaaaagatcaagggtgacaggaaa

SEQ ID NO: 354175 - DNA, 25 bp, Mus musculus
tcaaaagatcaaggtgatctacgtt

SEQ ID NO: 354176 - DNA, 25 bp, Mus musculus
tcaaaagcaggttgtccagagctag

SEQ ID NO: 354177 - DNA, 25 bp, Mus musculus
tcaaaaggagaagaaatgcttattc

SEQ ID NO: 354178 - DNA, 25 bp, Mus musculus
tcaaaaggaggaagctggctaagaa

SEQ ID NO: 354179 - DNA, 25 bp, Mus musculus
tcaaaaggaggccacctatgaaaat

SEQ ID NO: 354180 - DNA, 25 bp, Mus musculus
tcaaaaggaggtttccccagaagtg

SEQ ID NO: 354181 - DNA, 25 bp, Mus musculus
tcaaaaggagtatgaaggcttagag

SEQ ID NO: 354182 - DNA, 25 bp, Mus musculus
tcaaaaggagtttgttgaaggatca

SEQ ID NO: 354183 - DNA, 25 bp, Mus musculus
tcaaaaggatgcagaaaatgtaggc

SEQ ID NO: 354184 - DNA, 25 bp, Mus musculus
tcaaaaggcctgaagcacgtaactt

SEQ ID NO: 354185 - DNA, 25 bp, Mus musculus
tcaaaaggctcaagggctttgctga

SEQ ID NO: 354186 - DNA, 25 bp, Mus musculus
tcaaaaggctctgtggaggaagcaa

SEQ ID NO: 354187 - DNA, 25 bp, Mus musculus
tcaaaagtatggcttagacttgtgt

SEQ ID NO: 354188 - DNA, 25 bp, Mus musculus
tcaaaagtcacaagggaacagcagt

SEQ ID NO: 354189 - DNA, 25 bp, Mus musculus
tcaaaatcagagccagaaactccgg

SEQ ID NO: 354190 - DNA, 25 bp, Mus musculus
tcaaaatcaggagatggagttcctg

SEQ ID NO: 354191 - DNA, 25 bp, Mus musculus
tcaaaatcttggtggaagatgagct

SEQ ID NO: 354192 - DNA, 25 bp, Mus musculus
tcaaaatgaaaaatatggaattgcc

SEQ ID NO: 354193 - DNA, 25 bp, Mus musculus
tcaaaatgaaaaatggaatgactgt

SEQ ID NO: 354194 - DNA, 25 bp, Mus musculus
tcaaaatgagccccggcagcccaac

SEQ ID NO: 354195 - DNA, 25 bp, Mus musculus
tcaaaatgcgactggaagaactaaa

SEQ ID NO: 354196 - DNA, 25 bp, Mus musculus
tcaaaatgcgactggtggcaattaa

SEQ ID NO: 354197 - DNA, 25 bp, Mus musculus
tcaaaatgcgtttcaagcaccaact

SEQ ID NO: 354198 - DNA, 25 bp, Mus musculus
tcaaaatgtcaggttctggcacccc

SEQ ID NO: 354199 - DNA, 25 bp, Mus musculus
tcaaaatgtgcctctcccagtgtct

SEQ ID NO: 354200 - DNA, 25 bp, Mus musculus
tcaaaattcaattgctgatagccca

SEQ ID NO: 354201 - DNA, 25 bp, Mus musculus
tcaaaattcaatttctgttgcccct

SEQ ID NO: 354202 - DNA, 25 bp, Mus musculus
tcaaaattcagattgccttctccca

SEQ ID NO: 354203 - DNA, 25 bp, Mus musculus
tcaaacaaagcatcgctgatagaca

SEQ ID NO: 354204 - DNA, 25 bp, Mus musculus
tcaaacaaagcatctatccagccag

SEQ ID NO: 354205 - DNA, 25 bp, Mus musculus
tcaaacaagcggagtttggtgaaag

SEQ ID NO: 354206 - DNA, 25 bp, Mus musculus
tcaaacaaggggcaggtaccacaga

SEQ ID NO: 354207 - DNA, 25 bp, Mus musculus
tcaaacacaaagtgctgcagtcgca

SEQ ID NO: 354208 - DNA, 25 bp, Mus musculus
tcaaacacaagttggaaatctacat

SEQ ID NO: 354209 - DNA, 25 bp, Mus musculus
tcaaacacagctcaaagattagaac

SEQ ID NO: 354210 - DNA, 25 bp, Mus musculus
tcaaacacatccacttcagcacctc

SEQ ID NO: 354211 - DNA, 25 bp, Mus musculus
tcaaacacatgtgactctcctattc

SEQ ID NO: 354212 - DNA, 25 bp, Mus musculus
tcaaacagaaatggtgaggacactc

SEQ ID NO: 354213 - DNA, 25 bp, Mus musculus
tcaaacagcggatcactgcagacct

SEQ ID NO: 354214 - DNA, 25 bp, Mus musculus
tcaaacagctccaagatgagcgtga

SEQ ID NO: 354215 - DNA, 25 bp, Mus musculus
tcaaacagctggaaggtgatttcaa

SEQ ID NO: 354216 - DNA, 25 bp, Mus musculus
tcaaacaggaaagatcgcaaaagat

SEQ ID NO: 354217 - DNA, 25 bp, Mus musculus
tcaaacaggtaagctatgaaaaaag

SEQ ID NO: 354218 - DNA, 25 bp, Mus musculus
tcaaacagtggcttgcattgttcat

SEQ ID NO: 354219 - DNA, 25 bp, Mus musculus
tcaaacagtggtattttaacagtag

SEQ ID NO: 354220 - DNA, 25 bp, Mus musculus
tcaaacatatgctgagaaatccatt

SEQ ID NO: 354221 - DNA, 25 bp, Mus musculus
tcaaacatatggcacttcttggaca

SEQ ID NO: 354222 - DNA, 25 bp, Mus musculus
tcaaacatccaggtggctctggtcc

SEQ ID NO: 354223 - DNA, 25 bp, Mus musculus
tcaaacatcggaagaactctcagct

SEQ ID NO: 354224 - DNA, 25 bp, Mus musculus
tcaaacattatcagcagcgtcgcca

SEQ ID NO: 354225 - DNA, 25 bp, Mus musculus
tcaaacattgcataggtagccaagg

SEQ ID NO: 354226 - DNA, 25 bp, Mus musculus
tcaaacatttatggtgaagtatttg

SEQ ID NO: 354227 - DNA, 25 bp, Mus musculus
tcaaaccaaaaggcatcatagctgc

SEQ ID NO: 354228 - DNA, 25 bp, Mus musculus
tcaaaccaaatcagatgtcatggca

SEQ ID NO: 354229 - DNA, 25 bp, Mus musculus
tcaaaccaacagtatcacatctgcc

SEQ ID NO: 354230 - DNA, 25 bp, Mus musculus
tcaaaccaacagttccctgccgctc

SEQ ID NO: 354231 - DNA, 25 bp, Mus musculus
tcaaaccaacattcagcaggacttg

SEQ ID NO: 354232 - DNA, 25 bp, Mus musculus
tcaaaccacagctgcactggcgtct

SEQ ID NO: 354233 - DNA, 25 bp, Mus musculus
tcaaaccacagtgagaagtctgtcc

SEQ ID NO: 354234 - DNA, 25 bp, Mus musculus
tcaaaccagagaggacctgagctgt

SEQ ID NO: 354235 - DNA, 25 bp, Mus musculus
tcaaacccaaccaggtgatgagact

SEQ ID NO: 354236 - DNA, 25 bp, Mus musculus
tcaaacccaaggtatggaagacttg

SEQ ID NO: 354237 - DNA, 25 bp, Mus musculus
tcaaacccagaaccaaggagagcat

SEQ ID NO: 354238 - DNA, 25 bp, Mus musculus
tcaaacccagctctgcatgcccatg

SEQ ID NO: 354239 - DNA, 25 bp, Mus musculus
tcaaacccagggcaagacagactac

SEQ ID NO: 354240 - DNA, 25 bp, Mus musculus
tcaaacccctcatctccccggccgc

SEQ ID NO: 354241 - DNA, 25 bp, Mus musculus
tcaaacccctctgtggtttctcagc

SEQ ID NO: 354242 - DNA, 25 bp, Mus musculus
tcaaaccgcctgaggcacagacccc

SEQ ID NO: 354243 - DNA, 25 bp, Mus musculus
tcaaaccgcctgagtcaaatcagaa

SEQ ID NO: 354244 - DNA, 25 bp, Mus musculus
tcaaaccggagcacgggattcgagt

SEQ ID NO: 354245 - DNA, 25 bp, Mus musculus
tcaaacctatggggcctcagactca

SEQ ID NO: 354246 - DNA, 25 bp, Mus musculus
tcaaacctgcatgccatgatcaaag

SEQ ID NO: 354247 - DNA, 25 bp, Mus musculus
tcaaacctgccatgggaaggagatg

SEQ ID NO: 354248 - DNA, 25 bp, Mus musculus
tcaaacctgccatgggagctggact

SEQ ID NO: 354249 - DNA, 25 bp, Mus musculus
tcaaaccttgatcaggatcttccca

SEQ ID NO: 354250 - DNA, 25 bp, Mus musculus
tcaaacgtggggttctatggcctac

SEQ ID NO: 354251 - DNA, 25 bp, Mus musculus
tcaaactaacagaaattgatgatgc

SEQ ID NO: 354252 - DNA, 25 bp, Mus musculus
tcaaactaacaggtcaaggaaaacg

SEQ ID NO: 354253 - DNA, 25 bp, Mus musculus
tcaaactacgaccccagcagcgaca

SEQ ID NO: 354254 - DNA, 25 bp, Mus musculus
tcaaactatcaggtactctatctac

SEQ ID NO: 354255 - DNA, 25 bp, Mus musculus
tcaaactcaactctcgatccacact

SEQ ID NO: 354256 - DNA, 25 bp, Mus musculus
tcaaactcacaagagcaaagccaaa

SEQ ID NO: 354257 - DNA, 25 bp, Mus musculus
tcaaactcacaaggtatcgaagtga

SEQ ID NO: 354258 - DNA, 25 bp, Mus musculus
tcaaactcctgccctgcataaggta

SEQ ID NO: 354259 - DNA, 25 bp, Mus musculus
tcaaactctcagagaaccgagcccg

SEQ ID NO: 354260 - DNA, 25 bp, Mus musculus
tcaaactctccaaggccgacgtgga

SEQ ID NO: 354261 - DNA, 25 bp, Mus musculus
tcaaactcttgcaaggtctggtttt

SEQ ID NO: 354262 - DNA, 25 bp, Mus musculus
tcaaactgaaactattaggcaggaa

SEQ ID NO: 354263 - DNA, 25 bp, Mus musculus
tcaaactgcctggaattacatgaat

SEQ ID NO: 354264 - DNA, 25 bp, Mus musculus
tcaaactgcctgggtagtccatgat

SEQ ID NO: 354265 - DNA, 25 bp, Mus musculus
tcaaactggagcaggcagactgttt

SEQ ID NO: 354266 - DNA, 25 bp, Mus musculus
tcaaactggaggaaagcacagacaa

SEQ ID NO: 354267 - DNA, 25 bp, Mus musculus
tcaaactggaggagttcaggagggg

SEQ ID NO: 354268 - DNA, 25 bp, Mus musculus
tcaaacttcagagtgaatgccatcc

SEQ ID NO: 354269 - DNA, 25 bp, Mus musculus
tcaaagaaaggcgagtctacgtgac

SEQ ID NO: 354270 - DNA, 25 bp, Mus musculus
tcaaagaagaaaagctcaacagagg

SEQ ID NO: 354271 - DNA, 25 bp, Mus musculus
tcaaagaagctcagagtctacagtg

SEQ ID NO: 354272 - DNA, 25 bp, Mus musculus
tcaaagaatgattctgttggctcat

SEQ ID NO: 354273 - DNA, 25 bp, Mus musculus
tcaaagacaagaccggacaatacac

SEQ ID NO: 354274 - DNA, 25 bp, Mus musculus
tcaaagacaagacgtggacacgcat

SEQ ID NO: 354275 - DNA, 25 bp, Mus musculus
tcaaagacaagctcaaacatgtctg

SEQ ID NO: 354276 - DNA, 25 bp, Mus musculus
tcaaagacaaggtgagggtggtgag

SEQ ID NO: 354277 - DNA, 25 bp, Mus musculus
tcaaagacactcaggtccctccagc

SEQ ID NO: 354278 - DNA, 25 bp, Mus musculus
tcaaagacagaaataaaaataagaa

SEQ ID NO: 354279 - DNA, 25 bp, Mus musculus
tcaaagacagagttgactcctgagg

SEQ ID NO: 354280 - DNA, 25 bp, Mus musculus
tcaaagacagcggcagacactctgg

SEQ ID NO: 354281 - DNA, 25 bp, Mus musculus
tcaaagacagcggcattgactcggg

SEQ ID NO: 354282 - DNA, 25 bp, Mus musculus
tcaaagacagcggccctggcccagc

SEQ ID NO: 354283 - DNA, 25 bp, Mus musculus
tcaaagacaggccagttaaatttat

SEQ ID NO: 354284 - DNA, 25 bp, Mus musculus
tcaaagacctgatctccaagctgct

SEQ ID NO: 354285 - DNA, 25 bp, Mus musculus
tcaaagacctgtttctctagatctc

SEQ ID NO: 354286 - DNA, 25 bp, Mus musculus
tcaaagactgccttactaaagatca

SEQ ID NO: 354287 - DNA, 25 bp, Mus musculus
tcaaagagaaaacaggcatgtaatg

SEQ ID NO: 354288 - DNA, 25 bp, Mus musculus
tcaaagagaaaacaggtctcagcat

SEQ ID NO: 354289 - DNA, 25 bp, Mus musculus
tcaaagagagaatccatggagctta

SEQ ID NO: 354290 - DNA, 25 bp, Mus musculus
tcaaagagcagcctctattaagatt

SEQ ID NO: 354291 - DNA, 25 bp, Mus musculus
tcaaagagctgggtctctccagtgt

SEQ ID NO: 354292 - DNA, 25 bp, Mus musculus
tcaaagagtgcagcatcgccctgag

SEQ ID NO: 354293 - DNA, 25 bp, Mus musculus
tcaaagagtgcagttttggttctaa

SEQ ID NO: 354294 - DNA, 25 bp, Mus musculus
tcaaagatacgaaggaagaagttct

SEQ ID NO: 354295 - DNA, 25 bp, Mus musculus
tcaaagatacgaagtgatgtcctgg

SEQ ID NO: 354296 - DNA, 25 bp, Mus musculus
tcaaagatctgtgaagttcattcaa

SEQ ID NO: 354297 - DNA, 25 bp, Mus musculus
tcaaagatgagattccatattaata

SEQ ID NO: 354298 - DNA, 25 bp, Mus musculus
tcaaagatgcagtgccagttttgca

SEQ ID NO: 354299 - DNA, 25 bp, Mus musculus
tcaaagattcaaggaagcctggggg

SEQ ID NO: 354300 - DNA, 25 bp, Mus musculus
tcaaagattcaggctggacaatttg

SEQ ID NO: 354301 - DNA, 25 bp, Mus musculus
tcaaagattcaggttctccccaatc

SEQ ID NO: 354302 - DNA, 25 bp, Mus musculus
tcaaagattggaaggagacttcaaa

SEQ ID NO: 354303 - DNA, 25 bp, Mus musculus
tcaaagattggaaggtattcccatc

SEQ ID NO: 354304 - DNA, 25 bp, Mus musculus
tcaaagattggaagtggttctgtgt

SEQ ID NO: 354305 - DNA, 25 bp, Mus musculus
tcaaagattggaagttcctgtggaa

SEQ ID NO: 354306 - DNA, 25 bp, Mus musculus
tcaaagatttctgttttggtcgtgt

SEQ ID NO: 354307 - DNA, 25 bp, Mus musculus
tcaaagcaacaggaactttgcatca

SEQ ID NO: 354308 - DNA, 25 bp, Mus musculus
tcaaagcagaagcctcctgccaaag

SEQ ID NO: 354309 - DNA, 25 bp, Mus musculus
tcaaagcagacagaatttcagcata

SEQ ID NO: 354310 - DNA, 25 bp, Mus musculus
tcaaagcagacaggttcagctccta

SEQ ID NO: 354311 - DNA, 25 bp, Mus musculus
tcaaagcagcaggagcagaccccct

SEQ ID NO: 354312 - DNA, 25 bp, Mus musculus
tcaaagcagtccggcatgaggatcg

SEQ ID NO: 354313 - DNA, 25 bp, Mus musculus
tcaaagcagttgaaaactgaaccga

SEQ ID NO: 354314 - DNA, 25 bp, Mus musculus
tcaaagcatgattggagagagagat

SEQ ID NO: 354315 - DNA, 25 bp, Mus musculus
tcaaagcatggggacattcaatcct

SEQ ID NO: 354316 - DNA, 25 bp, Mus musculus
tcaaagcatgtcttttgctgatcat

SEQ ID NO: 354317 - DNA, 25 bp, Mus musculus
tcaaagcattcgctatggagttact

SEQ ID NO: 354318 - DNA, 25 bp, Mus musculus
tcaaagccaaactgcagatgacaga

SEQ ID NO: 354319 - DNA, 25 bp, Mus musculus
tcaaagccaaggcaaagctgatggg

SEQ ID NO: 354320 - DNA, 25 bp, Mus musculus
tcaaagccaaggctgcctacctgaa

SEQ ID NO: 354321 - DNA, 25 bp, Mus musculus
tcaaagccagcagaaaccacagatg

SEQ ID NO: 354322 - DNA, 25 bp, Mus musculus
tcaaagccagggtctcttgtggtac

SEQ ID NO: 354323 - DNA, 25 bp, Mus musculus
tcaaagccaggtgccagctgggacc

SEQ ID NO: 354324 - DNA, 25 bp, Mus musculus
tcaaagccatctgtccctcaattcc

SEQ ID NO: 354325 - DNA, 25 bp, Mus musculus
tcaaagccatggtttgactctgctg

SEQ ID NO: 354326 - DNA, 25 bp, Mus musculus
tcaaagcccaagaaatagcagacaa

SEQ ID NO: 354327 - DNA, 25 bp, Mus musculus
tcaaagcccaaggacatgggagaag

SEQ ID NO: 354328 - DNA, 25 bp, Mus musculus
tcaaagcccaggagaagcgccccga

SEQ ID NO: 354329 - DNA, 25 bp, Mus musculus
tcaaagcccaggtcaaactctggtt

SEQ ID NO: 354330 - DNA, 25 bp, Mus musculus
tcaaagcccgggtaacatccggata

SEQ ID NO: 354331 - DNA, 25 bp, Mus musculus
tcaaagcccgggtatcatccggata

SEQ ID NO: 354332 - DNA, 25 bp, Mus musculus
tcaaagccctgaaggcactaagtga

SEQ ID NO: 354333 - DNA, 25 bp, Mus musculus
tcaaagcctgcgacgtatgtgatga

SEQ ID NO: 354334 - DNA, 25 bp, Mus musculus
tcaaagcctgggacgtatgtgatga

SEQ ID NO: 354335 - DNA, 25 bp, Mus musculus
tcaaagcgtggttgatctggtggct

SEQ ID NO: 354336 - DNA, 25 bp, Mus musculus
tcaaagctctgaccattcccggagc

SEQ ID NO: 354337 - DNA, 25 bp, Mus musculus
tcaaagctgaggtacggcatccaga

SEQ ID NO: 354338 - DNA, 25 bp, Mus musculus
tcaaagctgcagaggagcaactttc

SEQ ID NO: 354339 - DNA, 25 bp, Mus musculus
tcaaagctgcagagtttcatgatgg

SEQ ID NO: 354340 - DNA, 25 bp, Mus musculus
tcaaagctgctatcgggggaggagt

SEQ ID NO: 354341 - DNA, 25 bp, Mus musculus
tcaaagctggcaaggcttttgctgt

SEQ ID NO: 354342 - DNA, 25 bp, Mus musculus
tcaaagctggcaaggtacggactcg

SEQ ID NO: 354343 - DNA, 25 bp, Mus musculus
tcaaagctggcaaggttcgaacctc

SEQ ID NO: 354344 - DNA, 25 bp, Mus musculus
tcaaaggaagaagatgtagaatgtg

SEQ ID NO: 354345 - DNA, 25 bp, Mus musculus
tcaaaggaagaagttacagattcat

SEQ ID NO: 354346 - DNA, 25 bp, Mus musculus
tcaaaggaccatgatgatttctggc

SEQ ID NO: 354347 - DNA, 25 bp, Mus musculus
tcaaaggaccatggcatcaacccta

SEQ ID NO: 354348 - DNA, 25 bp, Mus musculus
tcaaaggactgaagggagtggaaaa

SEQ ID NO: 354349 - DNA, 25 bp, Mus musculus
tcaaaggagaagcaggtctccctgg

SEQ ID NO: 354350 - DNA, 25 bp, Mus musculus
tcaaaggagagaaatgtcaacgtgt

SEQ ID NO: 354351 - DNA, 25 bp, Mus musculus
tcaaaggagcggatttccatttcct

SEQ ID NO: 354352 - DNA, 25 bp, Mus musculus
tcaaaggatgagttgcttcagaggt

SEQ ID NO: 354353 - DNA, 25 bp, Mus musculus
tcaaaggatggctccggtgaggacg

SEQ ID NO: 354354 - DNA, 25 bp, Mus musculus
tcaaaggatggtggtgtgcgaatcg

SEQ ID NO: 354355 - DNA, 25 bp, Mus musculus
tcaaaggcaaaattcttccaagaag

SEQ ID NO: 354356 - DNA, 25 bp, Mus musculus
tcaaaggcaaagcttccctggttgt

SEQ ID NO: 354357 - DNA, 25 bp, Mus musculus
tcaaaggctaaaggtctgtacacat

SEQ ID NO: 354358 - DNA, 25 bp, Mus musculus
tcaaaggctcatcagatgtaaacag

SEQ ID NO: 354359 - DNA, 25 bp, Mus musculus
tcaaaggctctccaggcagtgcttt

SEQ ID NO: 354360 - DNA, 25 bp, Mus musculus
tcaaaggctctccaggtagcctttc

SEQ ID NO: 354361 - DNA, 25 bp, Mus musculus
tcaaaggctctccaggtttgtgtaa

SEQ ID NO: 354362 - DNA, 25 bp, Mus musculus
tcaaagggaaggaaaacgcttgtgc

SEQ ID NO: 354363 - DNA, 25 bp, Mus musculus
tcaaagggatggttcaggctgtgcg

SEQ ID NO: 354364 - DNA, 25 bp, Mus musculus
tcaaagggcaagcttctactcagac

SEQ ID NO: 354365 - DNA, 25 bp, Mus musculus
tcaaaggtcagaaagcctctccgac

SEQ ID NO: 354366 - DNA, 25 bp, Mus musculus
tcaaaggtttggcttctccagttgg

SEQ ID NO: 354367 - DNA, 25 bp, Mus musculus
tcaaagtaaacaaacatggaagatg

SEQ ID NO: 354368 - DNA, 25 bp, Mus musculus
tcaaagtaaacattttctatttaaa

SEQ ID NO: 354369 - DNA, 25 bp, Mus musculus
tcaaagtaccaggaaaggacacagt

SEQ ID NO: 354370 - DNA, 25 bp, Mus musculus
tcaaagtagaaggttacatccaggc

SEQ ID NO: 354371 - DNA, 25 bp, Mus musculus
tcaaagtcaagaaaaaacaagaagg

SEQ ID NO: 354372 - DNA, 25 bp, Mus musculus
tcaaagtcaagatctcaaaatgttg

SEQ ID NO: 354373 - DNA, 25 bp, Mus musculus
tcaaagtcaagctgaacagggccag

SEQ ID NO: 354374 - DNA, 25 bp, Mus musculus
tcaaagtcagaagggcatcctggcc

SEQ ID NO: 354375 - DNA, 25 bp, Mus musculus
tcaaagtcgccaaggtgaccccagg

SEQ ID NO: 354376 - DNA, 25 bp, Mus musculus
tcaaagtgaaagttaatgaaatcat

SEQ ID NO: 354377 - DNA, 25 bp, Mus musculus
tcaaagtgagaggttcagacagtaa

SEQ ID NO: 354378 - DNA, 25 bp, Mus musculus
tcaaagtgatagtggcaatccagat

SEQ ID NO: 354379 - DNA, 25 bp, Mus musculus
tcaaagtgctgaggctgcctgctgt

SEQ ID NO: 354380 - DNA, 25 bp, Mus musculus
tcaaagtggcaggccgcatccacgc

SEQ ID NO: 354381 - DNA, 25 bp, Mus musculus
tcaaagtgggggatcctgcagagga

SEQ ID NO: 354382 - DNA, 25 bp, Mus musculus
tcaaagttcagccctgaaaagtccc

SEQ ID NO: 354383 - DNA, 25 bp, Mus musculus
tcaaagttcagccctgagaagagcc

SEQ ID NO: 354384 - DNA, 25 bp, Mus musculus
tcaaagttcccctggcctggggaag

SEQ ID NO: 354385 - DNA, 25 bp, Mus musculus
tcaaataaaaaggtgcttgagcagg

SEQ ID NO: 354386 - DNA, 25 bp, Mus musculus
tcaaataagaatgaagagcatggct

SEQ ID NO: 354387 - DNA, 25 bp, Mus musculus
tcaaatacacgccttccttcaggca

SEQ ID NO: 354388 - DNA, 25 bp, Mus musculus
tcaaatacacgctgatgttcctctg

SEQ ID NO: 354389 - DNA, 25 bp, Mus musculus
tcaaatacattcaggaagccgaaat

SEQ ID NO: 354390 - DNA, 25 bp, Mus musculus
tcaaatactgaactgtccctgatgg

SEQ ID NO: 354391 - DNA, 25 bp, Mus musculus
tcaaatactgagctgactaagcccc

SEQ ID NO: 354392 - DNA, 25 bp, Mus musculus
tcaaatattacatgggtcattcaca

SEQ ID NO: 354393 - DNA, 25 bp, Mus musculus
tcaaatcaagatgtcattaaagcga

SEQ ID NO: 354394 - DNA, 25 bp, Mus musculus
tcaaatccacccgagaagacagcat

SEQ ID NO: 354395 - DNA, 25 bp, Mus musculus
tcaaatccacccgagcactgtctat

SEQ ID NO: 354396 - DNA, 25 bp, Mus musculus
tcaaatccaccgccatctccctctt

SEQ ID NO: 354397 - DNA, 25 bp, Mus musculus
tcaaatcccaagttccgtgaggagg

SEQ ID NO: 354398 - DNA, 25 bp, Mus musculus
tcaaatctattacaggtgaatacat

SEQ ID NO: 354399 - DNA, 25 bp, Mus musculus
tcaaatctcagagccccaaggacga

SEQ ID NO: 354400 - DNA, 25 bp, Mus musculus
tcaaatctgatagggaaaacatcag

SEQ ID NO: 354401 - DNA, 25 bp, Mus musculus
tcaaatgaactaactacttgatgaa

SEQ ID NO: 354402 - DNA, 25 bp, Mus musculus
tcaaatgaactgggaaactagaaca

SEQ ID NO: 354403 - DNA, 25 bp, Mus musculus
tcaaatgaagaatcaccgccgcccc

SEQ ID NO: 354404 - DNA, 25 bp, Mus musculus
tcaaatgaaggaggaattttattga

SEQ ID NO: 354405 - DNA, 25 bp, Mus musculus
tcaaatgaaggaggcaagtcttctg

SEQ ID NO: 354406 - DNA, 25 bp, Mus musculus
tcaaatggcagaggtcacttttgtc

SEQ ID NO: 354407 - DNA, 25 bp, Mus musculus
tcaaatggcagtatatatgttttgt

SEQ ID NO: 354408 - DNA, 25 bp, Mus musculus
tcaaatgggacctcacctacccaaa

SEQ ID NO: 354409 - DNA, 25 bp, Mus musculus
tcaaatgggacctcagagtaatata

SEQ ID NO: 354410 - DNA, 25 bp, Mus musculus
tcaaatgtcaaagctggcaagatgt

SEQ ID NO: 354411 - DNA, 25 bp, Mus musculus
tcaaatgtcaaaggatgaccttgat

SEQ ID NO: 354412 - DNA, 25 bp, Mus musculus
tcaaatgtgaaaaagtattcaaaca

SEQ ID NO: 354413 - DNA, 25 bp, Mus musculus
tcaaatgtgatgcatgtggcatgaa

SEQ ID NO: 354414 - DNA, 25 bp, Mus musculus
tcaaatgttacaggcatcaaaaagt

SEQ ID NO: 354415 - DNA, 25 bp, Mus musculus
tcaaatgttacaggtcatggaaaat

SEQ ID NO: 354416 - DNA, 25 bp, Mus musculus
tcaaatgttgtggcagaataccaga

SEQ ID NO: 354417 - DNA, 25 bp, Mus musculus
tcaaatgttgtgtcctctgttgtgc

SEQ ID NO: 354418 - DNA, 25 bp, Mus musculus
tcaaattaaaaatgatgtcttcatt

SEQ ID NO: 354419 - DNA, 25 bp, Mus musculus
tcaaattctcagcacagcagccctc

SEQ ID NO: 354420 - DNA, 25 bp, Mus musculus
tcaaattctcaggacagcagccctc

SEQ ID NO: 354421 - DNA, 25 bp, Mus musculus
tcaaattcttcaacgagcgggctga

SEQ ID NO: 354422 - DNA, 25 bp, Mus musculus
tcaaatttatctgaggtgagaagtc

SEQ ID NO: 354423 - DNA, 25 bp, Mus musculus
tcaaatttcatggctacctctgtcg

SEQ ID NO: 354424 - DNA, 25 bp, Mus musculus
tcaaatttctggagcctatcttcca

SEQ ID NO: 354425 - DNA, 25 bp, Mus musculus
tcaaatttgcaccccaggggtggct

SEQ ID NO: 354426 - DNA, 25 bp, Mus musculus
tcaaattttgctacaaaaggcattc

SEQ ID NO: 354427 - DNA, 25 bp, Mus musculus
tcaaattttggcacgcagctacaaa

SEQ ID NO: 354428 - DNA, 25 bp, Mus musculus
tcaacaaaacctttggtagatgcca

SEQ ID NO: 354429 - DNA, 25 bp, Mus musculus
tcaacaaaactcagggaccaagagc

SEQ ID NO: 354430 - DNA, 25 bp, Mus musculus
tcaacaaacgaactccaatgtggag

SEQ ID NO: 354431 - DNA, 25 bp, Mus musculus
tcaacaaacggtgtttgcctgcatt

SEQ ID NO: 354432 - DNA, 25 bp, Mus musculus
tcaacaaacgttgacttgctggtga

SEQ ID NO: 354433 - DNA, 25 bp, Mus musculus
tcaacaacagaaatgtgaaaaactc

SEQ ID NO: 354434 - DNA, 25 bp, Mus musculus
tcaacaacaggcatgttacatggaa

SEQ ID NO: 354435 - DNA, 25 bp, Mus musculus
tcaacaacagggaaagaaggcaatg

SEQ ID NO: 354436 - DNA, 25 bp, Mus musculus
tcaacaacctgaaagattttgatag

SEQ ID NO: 354437 - DNA, 25 bp, Mus musculus
tcaacaacgcagccactcttgggga

SEQ ID NO: 354438 - DNA, 25 bp, Mus musculus
tcaacaacgcagccctacaaaggct

SEQ ID NO: 354439 - DNA, 25 bp, Mus musculus
tcaacaagaaaaatatgttccaagt

SEQ ID NO: 354440 - DNA, 25 bp, Mus musculus
tcaacaagaagttaattatacccga

SEQ ID NO: 354441 - DNA, 25 bp, Mus musculus
tcaacaagaatcagcttcagaggat

SEQ ID NO: 354442 - DNA, 25 bp, Mus musculus
tcaacaagaatcaggttgtggagtt

SEQ ID NO: 354443 - DNA, 25 bp, Mus musculus
tcaacaagcaaaaagctattgacct

SEQ ID NO: 354444 - DNA, 25 bp, Mus musculus
tcaacaaggtcccagtgaagaagat

SEQ ID NO: 354445 - DNA, 25 bp, Mus musculus
tcaacaatcatggctgcttgtgcct

SEQ ID NO: 354446 - DNA, 25 bp, Mus musculus
tcaacaatctggctcttctgtcagt

SEQ ID NO: 354447 - DNA, 25 bp, Mus musculus
tcaacaatgaagcaggtttagatga

SEQ ID NO: 354448 - DNA, 25 bp, Mus musculus
tcaacaatggcaagattgagctccg

SEQ ID NO: 354449 - DNA, 25 bp, Mus musculus
tcaacaatggcaatcatgaggcagt

SEQ ID NO: 354450 - DNA, 25 bp, Mus musculus
tcaacacaatttcaataacttacag

SEQ ID NO: 354451 - DNA, 25 bp, Mus musculus
tcaacacaatttcaatgtgttacag

SEQ ID NO: 354452 - DNA, 25 bp, Mus musculus
tcaacacaatttcagactacaaaag

SEQ ID NO: 354453 - DNA, 25 bp, Mus musculus
tcaacacaccctttggggcgatggt

SEQ ID NO: 354454 - DNA, 25 bp, Mus musculus
tcaacacatataaggaggaatttgg

SEQ ID NO: 354455 - DNA, 25 bp, Mus musculus
tcaacacatcacttgtcttccccag

SEQ ID NO: 354456 - DNA, 25 bp, Mus musculus
tcaacacccatgtgaagcctttgat

SEQ ID NO: 354457 - DNA, 25 bp, Mus musculus
tcaacacgccgcggggagaccatga

SEQ ID NO: 354458 - DNA, 25 bp, Mus musculus
tcaacacgccgcggggatccacctg

SEQ ID NO: 354459 - DNA, 25 bp, Mus musculus
tcaacactggccgagggatggaatt

SEQ ID NO: 354460 - DNA, 25 bp, Mus musculus
tcaacagaacaggatttgtgcagga

SEQ ID NO: 354461 - DNA, 25 bp, Mus musculus
tcaacagaacagtgctcttggctcc

SEQ ID NO: 354462 - DNA, 25 bp, Mus musculus
tcaacagaagcgagacggtgttctg

SEQ ID NO: 354463 - DNA, 25 bp, Mus musculus
tcaacagaagggatacttaccgcag

SEQ ID NO: 354464 - DNA, 25 bp, Mus musculus
tcaacagacaagtcaagagcaatct

SEQ ID NO: 354465 - DNA, 25 bp, Mus musculus
tcaacagacaggtggaggaagagct

SEQ ID NO: 354466 - DNA, 25 bp, Mus musculus
tcaacagagaggtgataggtgcttg

SEQ ID NO: 354467 - DNA, 25 bp, Mus musculus
tcaacagagaggtttatttcctgct

SEQ ID NO: 354468 - DNA, 25 bp, Mus musculus
tcaacagccatctccagtggcttct

SEQ ID NO: 354469 - DNA, 25 bp, Mus musculus
tcaacagccatctgcaatggctgct

SEQ ID NO: 354470 - DNA, 25 bp, Mus musculus
tcaacagcccaatggtgcaggtttc

SEQ ID NO: 354471 - DNA, 25 bp, Mus musculus
tcaacagcccaatggtttcgccacg

SEQ ID NO: 354472 - DNA, 25 bp, Mus musculus
tcaacagcccgaaaagcgactcaag

SEQ ID NO: 354473 - DNA, 25 bp, Mus musculus
tcaacagcccgacgtatgtttcctt

SEQ ID NO: 354474 - DNA, 25 bp, Mus musculus
tcaacagccctggaaatgtggactc

SEQ ID NO: 354475 - DNA, 25 bp, Mus musculus
tcaacagccctggcactgaagatcc

SEQ ID NO: 354476 - DNA, 25 bp, Mus musculus
tcaacagccgcctggtttaccatga

SEQ ID NO: 354477 - DNA, 25 bp, Mus musculus
tcaacagccggagcagctgggcagt

SEQ ID NO: 354478 - DNA, 25 bp, Mus musculus
tcaacagccggtgataactccctag

SEQ ID NO: 354479 - DNA, 25 bp, Mus musculus
tcaacagctgaggaaggtgtcttgc

SEQ ID NO: 354480 - DNA, 25 bp, Mus musculus
tcaacagcttgtgaccttgtttgag

SEQ ID NO: 354481 - DNA, 25 bp, Mus musculus
tcaacaggaaggtgactgtggactc

SEQ ID NO: 354482 - DNA, 25 bp, Mus musculus
tcaacagtgagcaactgatggtgtc

SEQ ID NO: 354483 - DNA, 25 bp, Mus musculus
tcaacataatagcctgctttttctc

SEQ ID NO: 354484 - DNA, 25 bp, Mus musculus
tcaacataataggtgagcacataga

SEQ ID NO: 354485 - DNA, 25 bp, Mus musculus
tcaacatcaaagtaatcccctcccc

SEQ ID NO: 354486 - DNA, 25 bp, Mus musculus
tcaacatcacactcaatgacgaggc

SEQ ID NO: 354487 - DNA, 25 bp, Mus musculus
tcaacatcatcttggtggagaggct

SEQ ID NO: 354488 - DNA, 25 bp, Mus musculus
tcaacatcgacagcatcaataggat

SEQ ID NO: 354489 - DNA, 25 bp, Mus musculus
tcaacatcgtagagggagattcatt

SEQ ID NO: 354490 - DNA, 25 bp, Mus musculus
tcaacatgaacaagcgattatacac

SEQ ID NO: 354491 - DNA, 25 bp, Mus musculus
tcaacatgaacaagcgcttgtacac

SEQ ID NO: 354492 - DNA, 25 bp, Mus musculus
tcaacatgaatgtgaccgagataat

SEQ ID NO: 354493 - DNA, 25 bp, Mus musculus
tcaacatgagcctcctgatgctgct

SEQ ID NO: 354494 - DNA, 25 bp, Mus musculus
tcaacatggcttcaggttgatatca

SEQ ID NO: 354495 - DNA, 25 bp, Mus musculus
tcaacattcaggagcagagcccagt

SEQ ID NO: 354496 - DNA, 25 bp, Mus musculus
tcaacattcagtacacactgcgctg

SEQ ID NO: 354497 - DNA, 25 bp, Mus musculus
tcaacattgaggatcataaagacac

SEQ ID NO: 354498 - DNA, 25 bp, Mus musculus
tcaaccaaaagctggcatctgaccc

SEQ ID NO: 354499 - DNA, 25 bp, Mus musculus
tcaaccaaaccctttgcactgagca

SEQ ID NO: 354500 - DNA, 25 bp, Mus musculus
tcaaccaacagcctcctggactgcc

SEQ ID NO: 354501 - DNA, 25 bp, Mus musculus
tcaaccaacaggagctctttggaag

SEQ ID NO: 354502 - DNA, 25 bp, Mus musculus
tcaaccacaagcaacgatgcctact

SEQ ID NO: 354503 - DNA, 25 bp, Mus musculus
tcaaccacagtgtggacaagaaggg

SEQ ID NO: 354504 - DNA, 25 bp, Mus musculus
tcaaccacccccacgacccactgat

SEQ ID NO: 354505 - DNA, 25 bp, Mus musculus
tcaaccaccgaccaggcagccacct

SEQ ID NO: 354506 - DNA, 25 bp, Mus musculus
tcaaccaccgaccaggtcgtccgta

SEQ ID NO: 354507 - DNA, 25 bp, Mus musculus
tcaaccagcgaattcagcttgctga

SEQ ID NO: 354508 - DNA, 25 bp, Mus musculus
tcaaccagctccaaccctttgcgga

SEQ ID NO: 354509 - DNA, 25 bp, Mus musculus
tcaaccaggggcaaggtttcagcca

SEQ ID NO: 354510 - DNA, 25 bp, Mus musculus
tcaaccatagggttctacagtgagt

SEQ ID NO: 354511 - DNA, 25 bp, Mus musculus
tcaaccatcaggggctggtgtcatt

SEQ ID NO: 354512 - DNA, 25 bp, Mus musculus
tcaaccatcaggtctaggtggctgt

SEQ ID NO: 354513 - DNA, 25 bp, Mus musculus
tcaaccatgggaagatcccaacgct

SEQ ID NO: 354514 - DNA, 25 bp, Mus musculus
tcaacccacaaacaggtcagccctt

SEQ ID NO: 354515 - DNA, 25 bp, Mus musculus
tcaacccactgggtggctttgtgca

SEQ ID NO: 354516 - DNA, 25 bp, Mus musculus
tcaaccccacagtaaactacatttt

SEQ ID NO: 354517 - DNA, 25 bp, Mus musculus
tcaaccccataccacatgtgagatc

SEQ ID NO: 354518 - DNA, 25 bp, Mus musculus
tcaaccccataccagatgtgagatc

SEQ ID NO: 354519 - DNA, 25 bp, Mus musculus
tcaaccccatggagacatatgagga

SEQ ID NO: 354520 - DNA, 25 bp, Mus musculus
tcaaccccgggaggaagctatgctc

SEQ ID NO: 354521 - DNA, 25 bp, Mus musculus
tcaaccctcaggaatccaaacgctt

SEQ ID NO: 354522 - DNA, 25 bp, Mus musculus
tcaaccctccagaaagccatcgatc

SEQ ID NO: 354523 - DNA, 25 bp, Mus musculus
tcaaccctccggagatggcgtcaga

SEQ ID NO: 354524 - DNA, 25 bp, Mus musculus
tcaaccctcgtctcttctgtcggaa

SEQ ID NO: 354525 - DNA, 25 bp, Mus musculus
tcaaccctctcagtgtgtgactttc

SEQ ID NO: 354526 - DNA, 25 bp, Mus musculus
tcaaccctctccagcaggcacctcc

SEQ ID NO: 354527 - DNA, 25 bp, Mus musculus
tcaaccctgaagatattgtgaacaa

SEQ ID NO: 354528 - DNA, 25 bp, Mus musculus
tcaaccctgagacagctcttcttca

SEQ ID NO: 354529 - DNA, 25 bp, Mus musculus
tcaaccctgagtgccaggaccctgg

SEQ ID NO: 354530 - DNA, 25 bp, Mus musculus
tcaacccttcaagatcccgattcgc

SEQ ID NO: 354531 - DNA, 25 bp, Mus musculus
tcaacccttgtgatgtggtgaagac

SEQ ID NO: 354532 - DNA, 25 bp, Mus musculus
tcaaccgacccccaggctcaacagt

SEQ ID NO: 354533 - DNA, 25 bp, Mus musculus
tcaaccgagttgagtccattcgccc

SEQ ID NO: 354534 - DNA, 25 bp, Mus musculus
tcaaccggcttaatcgtgattttgc

SEQ ID NO: 354535 - DNA, 25 bp, Mus musculus
tcaaccggcttaatggtgattttgc

SEQ ID NO: 354536 - DNA, 25 bp, Mus musculus
tcaaccgggagaggtctgctctgac

SEQ ID NO: 354537 - DNA, 25 bp, Mus musculus
tcaaccgggagcaggaggacaggaa

SEQ ID NO: 354538 - DNA, 25 bp, Mus musculus
tcaaccgggagcattctcagagctt

SEQ ID NO: 354539 - DNA, 25 bp, Mus musculus
tcaacctagcagaagcgctcctgga

SEQ ID NO: 354540 - DNA, 25 bp, Mus musculus
tcaacctcaactgtgtgtgcaacag

SEQ ID NO: 354541 - DNA, 25 bp, Mus musculus
tcaacctcaagggctgtgaggtggt

SEQ ID NO: 354542 - DNA, 25 bp, Mus musculus
tcaacctcagggaaccagctcagta

SEQ ID NO: 354543 - DNA, 25 bp, Mus musculus
tcaacctcccaagactcctacagga

SEQ ID NO: 354544 - DNA, 25 bp, Mus musculus
tcaacctcccatcagcaagccccgc

SEQ ID NO: 354545 - DNA, 25 bp, Mus musculus
tcaacctctaaaagcccgatttggc

SEQ ID NO: 354546 - DNA, 25 bp, Mus musculus
tcaacctctatgtgacggacgccgc

SEQ ID NO: 354547 - DNA, 25 bp, Mus musculus
tcaacctgaaaaggacaagaagatg

SEQ ID NO: 354548 - DNA, 25 bp, Mus musculus
tcaacctgaagattacgctcgattt

SEQ ID NO: 354549 - DNA, 25 bp, Mus musculus
tcaacctgaatcagggcagcgctgt

SEQ ID NO: 354550 - DNA, 25 bp, Mus musculus
tcaacctgccagatgcagagaagaa

SEQ ID NO: 354551 - DNA, 25 bp, Mus musculus
tcaacctgccaggatatgctctcca

SEQ ID NO: 354552 - DNA, 25 bp, Mus musculus
tcaacctgcccaaggagctggaggg

SEQ ID NO: 354553 - DNA, 25 bp, Mus musculus
tcaacctggatgaaagtgaggcagc

SEQ ID NO: 354554 - DNA, 25 bp, Mus musculus
tcaacctggctgtgggtggtgagaa

SEQ ID NO: 354555 - DNA, 25 bp, Mus musculus
tcaacctggtcacccatccctgacg

SEQ ID NO: 354556 - DNA, 25 bp, Mus musculus
tcaacctggtctatgaaacaactga

SEQ ID NO: 354557 - DNA, 25 bp, Mus musculus
tcaacctgtaagtgctgtgacccaa

SEQ ID NO: 354558 - DNA, 25 bp, Mus musculus
tcaacctgtaagttcacttgttcaa

SEQ ID NO: 354559 - DNA, 25 bp, Mus musculus
tcaacctgtcaggtgactcaagtgc

SEQ ID NO: 354560 - DNA, 25 bp, Mus musculus
tcaacctgtcaggtgactccaatga

SEQ ID NO: 354561 - DNA, 25 bp, Mus musculus
tcaaccttgctggcaccatcggttt

SEQ ID NO: 354562 - DNA, 25 bp, Mus musculus
tcaacgacaaggtggcccagctgcc

SEQ ID NO: 354563 - DNA, 25 bp, Mus musculus
tcaacgagaggacggcctgggtcca

SEQ ID NO: 354564 - DNA, 25 bp, Mus musculus
tcaacgagcagcaagtggtggaatc

SEQ ID NO: 354565 - DNA, 25 bp, Mus musculus
tcaacgagcaggatgaggtgttgat

SEQ ID NO: 354566 - DNA, 25 bp, Mus musculus
tcaacgagcctggtgccttctgggg

SEQ ID NO: 354567 - DNA, 25 bp, Mus musculus
tcaacgccaatgaaacttccataga

SEQ ID NO: 354568 - DNA, 25 bp, Mus musculus
tcaacgccatccagggtggagcttt

SEQ ID NO: 354569 - DNA, 25 bp, Mus musculus
tcaacgccatccaggtccctaagcc

SEQ ID NO: 354570 - DNA, 25 bp, Mus musculus
tcaacgcgccacacctggccgccgc

SEQ ID NO: 354571 - DNA, 25 bp, Mus musculus
tcaacggagagtatgagagttcctc

SEQ ID NO: 354572 - DNA, 25 bp, Mus musculus
tcaacggaggtactgtattggcaat

SEQ ID NO: 354573 - DNA, 25 bp, Mus musculus
tcaacggctggacctgtttacactg

SEQ ID NO: 354574 - DNA, 25 bp, Mus musculus
tcaacggcttgtctgtgccaccaaa

SEQ ID NO: 354575 - DNA, 25 bp, Mus musculus
tcaacgggcagagggaatccggaga

SEQ ID NO: 354576 - DNA, 25 bp, Mus musculus
tcaacgggctgagatctcttgatgc

SEQ ID NO: 354577 - DNA, 25 bp, Mus musculus
tcaacgggctgaggtctgtgcagac

SEQ ID NO: 354578 - DNA, 25 bp, Mus musculus
tcaacggggagaagtactgcggtga

SEQ ID NO: 354579 - DNA, 25 bp, Mus musculus
tcaacgtccacaagcttgtgacaca

SEQ ID NO: 354580 - DNA, 25 bp, Mus musculus
tcaacgtgctccccttctgctgcag

SEQ ID NO: 354581 - DNA, 25 bp, Mus musculus
tcaacgtgctggaacttggcacaca

SEQ ID NO: 354582 - DNA, 25 bp, Mus musculus
tcaacgtgctggacctataagaaca

SEQ ID NO: 354583 - DNA, 25 bp, Mus musculus
tcaacgttaatgtggttcgtctcca

SEQ ID NO: 354584 - DNA, 25 bp, Mus musculus
tcaactaaggcccagggctgtacca

SEQ ID NO: 354585 - DNA, 25 bp, Mus musculus
tcaactaaggcccaggtccctattt

SEQ ID NO: 354586 - DNA, 25 bp, Mus musculus
tcaactacaagctgtatcttttcat

SEQ ID NO: 354587 - DNA, 25 bp, Mus musculus
tcaactacaagggcccacccttcat

SEQ ID NO: 354588 - DNA, 25 bp, Mus musculus
tcaactacagcgagagtctatataa

SEQ ID NO: 354589 - DNA, 25 bp, Mus musculus
tcaactacgattatccagataagta

SEQ ID NO: 354590 - DNA, 25 bp, Mus musculus
tcaactactgcgaggaggcggtggg

SEQ ID NO: 354591 - DNA, 25 bp, Mus musculus
tcaactagggaacatattcaaaaga

SEQ ID NO: 354592 - DNA, 25 bp, Mus musculus
tcaactatgcagtaaagacgctcct

SEQ ID NO: 354593 - DNA, 25 bp, Mus musculus
tcaactatgcttaactgcggatccc

SEQ ID NO: 354594 - DNA, 25 bp, Mus musculus
tcaactatggcggagtgacaaagaa

SEQ ID NO: 354595 - DNA, 25 bp, Mus musculus
tcaactatggcggagtttcaacacc

SEQ ID NO: 354596 - DNA, 25 bp, Mus musculus
tcaactccaccccagcctgctgttt

SEQ ID NO: 354597 - DNA, 25 bp, Mus musculus
tcaactccaccctgaagagctttga

SEQ ID NO: 354598 - DNA, 25 bp, Mus musculus
tcaactccagcagcatccacaggat

SEQ ID NO: 354599 - DNA, 25 bp, Mus musculus
tcaactccagcaggtctcggacaaa

SEQ ID NO: 354600 - DNA, 25 bp, Mus musculus
tcaactccaggcctctagactgtgt

SEQ ID NO: 354601 - DNA, 25 bp, Mus musculus
tcaactccaggtatctccacaggcc

SEQ ID NO: 354602 - DNA, 25 bp, Mus musculus
tcaactccatcaaggagctgaatga

SEQ ID NO: 354603 - DNA, 25 bp, Mus musculus
tcaactccatggtcagcaacatcaa

SEQ ID NO: 354604 - DNA, 25 bp, Mus musculus
tcaactccccagagcaccccttggg

SEQ ID NO: 354605 - DNA, 25 bp, Mus musculus
tcaactccccaggaagctacaggga

SEQ ID NO: 354606 - DNA, 25 bp, Mus musculus
tcaactcgaagctcctcccaacctt

SEQ ID NO: 354607 - DNA, 25 bp, Mus musculus
tcaactctcatctgttctcagccaa

SEQ ID NO: 354608 - DNA, 25 bp, Mus musculus
tcaactctccatcctacctcacgag

SEQ ID NO: 354609 - DNA, 25 bp, Mus musculus
tcaactctcccagggctttctgagg

SEQ ID NO: 354610 - DNA, 25 bp, Mus musculus
tcaactctgtagtgaatgtgggctg

SEQ ID NO: 354611 - DNA, 25 bp, Mus musculus
tcaactctttcgatatgtcttgtcg

SEQ ID NO: 354612 - DNA, 25 bp, Mus musculus
tcaactctttcgtctccttttacca

SEQ ID NO: 354613 - DNA, 25 bp, Mus musculus
tcaactgacaggccataaaatcagg

SEQ ID NO: 354614 - DNA, 25 bp, Mus musculus
tcaactgatgggaccctgccacttc

SEQ ID NO: 354615 - DNA, 25 bp, Mus musculus
tcaactgcaagatggccactgagat

SEQ ID NO: 354616 - DNA, 25 bp, Mus musculus
tcaactgcaagattgcccagctgcc

SEQ ID NO: 354617 - DNA, 25 bp, Mus musculus
tcaactgccaaatcaacatcaacga

SEQ ID NO: 354618 - DNA, 25 bp, Mus musculus
tcaactgccttacagacgtggctct

SEQ ID NO: 354619 - DNA, 25 bp, Mus musculus
tcaactgcgagatgaaatggaaggg

SEQ ID NO: 354620 - DNA, 25 bp, Mus musculus
tcaactgctcacagagtcagtccga

SEQ ID NO: 354621 - DNA, 25 bp, Mus musculus
tcaactggaagcaggacaacaatcc

SEQ ID NO: 354622 - DNA, 25 bp, Mus musculus
tcaactggcaggcgtgaagtgcagc

SEQ ID NO: 354623 - DNA, 25 bp, Mus musculus
tcaactggcctgaagacattgtctt

SEQ ID NO: 354624 - DNA, 25 bp, Mus musculus
tcaactggctatggctcctgggcgg

SEQ ID NO: 354625 - DNA, 25 bp, Mus musculus
tcaactggctgatgcttgacttccc

SEQ ID NO: 354626 - DNA, 25 bp, Mus musculus
tcaactgtgcaggctatgtggtggt

SEQ ID NO: 354627 - DNA, 25 bp, Mus musculus
tcaactgtgcaggtgacagtaacca

SEQ ID NO: 354628 - DNA, 25 bp, Mus musculus
tcaacttacagaactatgtagaaga

SEQ ID NO: 354629 - DNA, 25 bp, Mus musculus
tcaacttacagcatctgctggtgac

SEQ ID NO: 354630 - DNA, 25 bp, Mus musculus
tcaacttaggcgtgtataagtgagg

SEQ ID NO: 354631 - DNA, 25 bp, Mus musculus
tcaacttcaaccgaagtgagtccat

SEQ ID NO: 354632 - DNA, 25 bp, Mus musculus
tcaacttcaagccctccaaccacag

SEQ ID NO: 354633 - DNA, 25 bp, Mus musculus
tcaacttcaagggccagctagagat

SEQ ID NO: 354634 - DNA, 25 bp, Mus musculus
tcaacttcagagctgtgcctgagat

SEQ ID NO: 354635 - DNA, 25 bp, Mus musculus
tcaacttcagccactggaactctgg

SEQ ID NO: 354636 - DNA, 25 bp, Mus musculus
tcaacttcaggagcctttggagact

SEQ ID NO: 354637 - DNA, 25 bp, Mus musculus
tcaacttcaggagggcctgggggag

SEQ ID NO: 354638 - DNA, 25 bp, Mus musculus
tcaacttccaaagtgggatccggca

SEQ ID NO: 354639 - DNA, 25 bp, Mus musculus
tcaacttccgcctggactagcaccc

SEQ ID NO: 354640 - DNA, 25 bp, Mus musculus
tcaacttctccaggtttggaggaga

SEQ ID NO: 354641 - DNA, 25 bp, Mus musculus
tcaacttctggtctcacccaaaatg

SEQ ID NO: 354642 - DNA, 25 bp, Mus musculus
tcaacttcttccagagaatttgttt

SEQ ID NO: 354643 - DNA, 25 bp, Mus musculus
tcaacttcttccagcttcacccctc

SEQ ID NO: 354644 - DNA, 25 bp, Mus musculus
tcaacttcttccaggctgaaggaag

SEQ ID NO: 354645 - DNA, 25 bp, Mus musculus
tcaacttgaaagctatccttcacca

SEQ ID NO: 354646 - DNA, 25 bp, Mus musculus
tcaacttgaaagcttatctgagtcc

SEQ ID NO: 354647 - DNA, 25 bp, Mus musculus
tcaacttgaacaatgattttgtggt

SEQ ID NO: 354648 - DNA, 25 bp, Mus musculus
tcaacttgaacaatgttatgatggt

SEQ ID NO: 354649 - DNA, 25 bp, Mus musculus
tcaacttgaggccatccgctgcaca

SEQ ID NO: 354650 - DNA, 25 bp, Mus musculus
tcaacttgagtcagaagaggcagaa

SEQ ID NO: 354651 - DNA, 25 bp, Mus musculus
tcaacttgtccaatttcgaggactc

SEQ ID NO: 354652 - DNA, 25 bp, Mus musculus
tcaactttccagacccagcatgtag

SEQ ID NO: 354653 - DNA, 25 bp, Mus musculus
tcaactttgatgtcctagcagggcg

SEQ ID NO: 354654 - DNA, 25 bp, Mus musculus
tcaagaaaagagaaaattggagatg

SEQ ID NO: 354655 - DNA, 25 bp, Mus musculus
tcaagaaaagaggagcgctggccgc

SEQ ID NO: 354656 - DNA, 25 bp, Mus musculus
tcaagaaaaggaaaatgtccctgtc

SEQ ID NO: 354657 - DNA, 25 bp, Mus musculus
tcaagaaaatggaaggtcactacgt

SEQ ID NO: 354658 - DNA, 25 bp, Mus musculus
tcaagaaactaatactctacaggct

SEQ ID NO: 354659 - DNA, 25 bp, Mus musculus
tcaagaaactagaagatgaaatgaa

SEQ ID NO: 354660 - DNA, 25 bp, Mus musculus
tcaagaaaggctccgtgctgccaca

SEQ ID NO: 354661 - DNA, 25 bp, Mus musculus
tcaagaaatccagcgtgcgagaaga

SEQ ID NO: 354662 - DNA, 25 bp, Mus musculus
tcaagaaatccggcaacttgaattg

SEQ ID NO: 354663 - DNA, 25 bp, Mus musculus
tcaagaaatccgggcagtttaggac

SEQ ID NO: 354664 - DNA, 25 bp, Mus musculus
tcaagaaatctgcccttagtgggga

SEQ ID NO: 354665 - DNA, 25 bp, Mus musculus
tcaagaacaaaaaaggcctgatgga

SEQ ID NO: 354666 - DNA, 25 bp, Mus musculus
tcaagaacaacggctcggaagtggc

SEQ ID NO: 354667 - DNA, 25 bp, Mus musculus
tcaagaacaagctcggaagtggcct

SEQ ID NO: 354668 - DNA, 25 bp, Mus musculus
tcaagaacaaggcccagtctgtgcg

SEQ ID NO: 354669 - DNA, 25 bp, Mus musculus
tcaagaacaagtatgaggatgaaat

SEQ ID NO: 354670 - DNA, 25 bp, Mus musculus
tcaagaacaatggctcggaagtggc

SEQ ID NO: 354671 - DNA, 25 bp, Mus musculus
tcaagaacagcatgggtacacaatg

SEQ ID NO: 354672 - DNA, 25 bp, Mus musculus
tcaagaacagctggggaagtgaatg

SEQ ID NO: 354673 - DNA, 25 bp, Mus musculus
tcaagaacattgcgacgctccaggg

SEQ ID NO: 354674 - DNA, 25 bp, Mus musculus
tcaagaagaagatgtgttacagcac

SEQ ID NO: 354675 - DNA, 25 bp, Mus musculus
tcaagaagaaggacttttcccctga

SEQ ID NO: 354676 - DNA, 25 bp, Mus musculus
tcaagaagaaggattccaaggaaat

SEQ ID NO: 354677 - DNA, 25 bp, Mus musculus
tcaagaagacaccctgatatctgca

SEQ ID NO: 354678 - DNA, 25 bp, Mus musculus
tcaagaagatagcgaaacagagata

SEQ ID NO: 354679 - DNA, 25 bp, Mus musculus
tcaagaagatcaaggaacgcatccg

SEQ ID NO: 354680 - DNA, 25 bp, Mus musculus
tcaagaagcaggttgcctagcagag

SEQ ID NO: 354681 - DNA, 25 bp, Mus musculus
tcaagaagcagtgtgacgtgctggt

SEQ ID NO: 354682 - DNA, 25 bp, Mus musculus
tcaagaagcgaccttcctatgaaag

SEQ ID NO: 354683 - DNA, 25 bp, Mus musculus
tcaagaaggagaacagagaaagcac

SEQ ID NO: 354684 - DNA, 25 bp, Mus musculus
tcaagaaggagctaattcgatgact

SEQ ID NO: 354685 - DNA, 25 bp, Mus musculus
tcaagaaggagtatggctgtaagaa

SEQ ID NO: 354686 - DNA, 25 bp, Mus musculus
tcaagaaggcaagattactgtgtag

SEQ ID NO: 354687 - DNA, 25 bp, Mus musculus
tcaagaaggcgtaccgaaagaaggc

SEQ ID NO: 354688 - DNA, 25 bp, Mus musculus
tcaagaagtcctgagtttatccatg

SEQ ID NO: 354689 - DNA, 25 bp, Mus musculus
tcaagaagtcctggtctttgcctgc

SEQ ID NO: 354690 - DNA, 25 bp, Mus musculus
tcaagaagtcctgtggaagtgtttg

SEQ ID NO: 354691 - DNA, 25 bp, Mus musculus
tcaagaatatgttgttgatcacata

SEQ ID NO: 354692 - DNA, 25 bp, Mus musculus
tcaagaatgaagtgtatcccctact

SEQ ID NO: 354693 - DNA, 25 bp, Mus musculus
tcaagaatgctggcagaaggagcta

SEQ ID NO: 354694 - DNA, 25 bp, Mus musculus
tcaagaatggcatgattgaggactg

SEQ ID NO: 354695 - DNA, 25 bp, Mus musculus
tcaagaattaggtaagtggagaaag

SEQ ID NO: 354696 - DNA, 25 bp, Mus musculus
tcaagaattccattatgtgagctct

SEQ ID NO: 354697 - DNA, 25 bp, Mus musculus
tcaagacaagataagccgacaacct

SEQ ID NO: 354698 - DNA, 25 bp, Mus musculus
tcaagacaagcaagagtccggccac

SEQ ID NO: 354699 - DNA, 25 bp, Mus musculus
tcaagacaatcattttctctgttgt

SEQ ID NO: 354700 - DNA, 25 bp, Mus musculus
tcaagacagcagcaaaggccgtttg

SEQ ID NO: 354701 - DNA, 25 bp, Mus musculus
tcaagacagtgaggggaaacaggca

SEQ ID NO: 354702 - DNA, 25 bp, Mus musculus
tcaagaccaaacggcccccttgaga

SEQ ID NO: 354703 - DNA, 25 bp, Mus musculus
tcaagaccagcaggctagatatgga

SEQ ID NO: 354704 - DNA, 25 bp, Mus musculus
tcaagaccagcaggttacagtcggg

SEQ ID NO: 354705 - DNA, 25 bp, Mus musculus
tcaagaccatcaaggcactagatgg

SEQ ID NO: 354706 - DNA, 25 bp, Mus musculus
tcaagacccacgcaaactacagctg

SEQ ID NO: 354707 - DNA, 25 bp, Mus musculus
tcaagacctatccagcccaccagaa

SEQ ID NO: 354708 - DNA, 25 bp, Mus musculus
tcaagacctccagagtggtggattg

SEQ ID NO: 354709 - DNA, 25 bp, Mus musculus
tcaagacggactgaggaaaacaaaa

SEQ ID NO: 354710 - DNA, 25 bp, Mus musculus
tcaagactatgactcagacaagcta

SEQ ID NO: 354711 - DNA, 25 bp, Mus musculus
tcaagactccgtgtgtcacattagc

SEQ ID NO: 354712 - DNA, 25 bp, Mus musculus
tcaagactggcaaggttactttgga

SEQ ID NO: 354713 - DNA, 25 bp, Mus musculus
tcaagacttgccgggtggagacaga

SEQ ID NO: 354714 - DNA, 25 bp, Mus musculus
tcaagagaaaagaaccaagaaagaa

SEQ ID NO: 354715 - DNA, 25 bp, Mus musculus
tcaagagaaagccttgtttgcagtc

SEQ ID NO: 354716 - DNA, 25 bp, Mus musculus
tcaagagaaaggttcaattttatat

SEQ ID NO: 354717 - DNA, 25 bp, Mus musculus
tcaagagaagcccgagttcgtgagt

SEQ ID NO: 354718 - DNA, 25 bp, Mus musculus
tcaagagaagcgagccagagcccca

SEQ ID NO: 354719 - DNA, 25 bp, Mus musculus
tcaagagaatcgagcctagaatacc

SEQ ID NO: 354720 - DNA, 25 bp, Mus musculus
tcaagagagcaagctcatcattctg

SEQ ID NO: 354721 - DNA, 25 bp, Mus musculus
tcaagagattacaaggagctagagg

SEQ ID NO: 354722 - DNA, 25 bp, Mus musculus
tcaagagattacaaggctctaaggg

SEQ ID NO: 354723 - DNA, 25 bp, Mus musculus
tcaagagcaagaagaagcagaccat

SEQ ID NO: 354724 - DNA, 25 bp, Mus musculus
tcaagagcaagtttggcgccgagtt

SEQ ID NO: 354725 - DNA, 25 bp, Mus musculus
tcaagaggaaattgatgagctcctt

SEQ ID NO: 354726 - DNA, 25 bp, Mus musculus
tcaagaggaaggcagtagagtccat

SEQ ID NO: 354727 - DNA, 25 bp, Mus musculus
tcaagaggaaggccgaggatgagag

SEQ ID NO: 354728 - DNA, 25 bp, Mus musculus
tcaagaggaaggctacgtgttctgt

SEQ ID NO: 354729 - DNA, 25 bp, Mus musculus
tcaagaggaccctggcccagtcgtt

SEQ ID NO: 354730 - DNA, 25 bp, Mus musculus
tcaagaggacgtccttcatttcttc

SEQ ID NO: 354731 - DNA, 25 bp, Mus musculus
tcaagaggcagccaggagcccttga

SEQ ID NO: 354732 - DNA, 25 bp, Mus musculus
tcaagaggcagggtgctgaggggtg

SEQ ID NO: 354733 - DNA, 25 bp, Mus musculus
tcaagagggcgaggcagaggtagag

SEQ ID NO: 354734 - DNA, 25 bp, Mus musculus
tcaagagtatggggaaaaagaggga

SEQ ID NO: 354735 - DNA, 25 bp, Mus musculus
tcaagagtattcggggaaacctcaa

SEQ ID NO: 354736 - DNA, 25 bp, Mus musculus
tcaagagtcagacgaaggaagaaca

SEQ ID NO: 354737 - DNA, 25 bp, Mus musculus
tcaagagtctggacaacatgtgcat

SEQ ID NO: 354738 - DNA, 25 bp, Mus musculus
tcaagagtgaccagccgtgggaatg

SEQ ID NO: 354739 - DNA, 25 bp, Mus musculus
tcaagagtttggcagagtatacgaa

SEQ ID NO: 354740 - DNA, 25 bp, Mus musculus
tcaagagtttggcagtgtcaaaggt

SEQ ID NO: 354741 - DNA, 25 bp, Mus musculus
tcaagataagagatatgccagaatt

SEQ ID NO: 354742 - DNA, 25 bp, Mus musculus
tcaagatataaaattcacagaggag

SEQ ID NO: 354743 - DNA, 25 bp, Mus musculus
tcaagatatgtggtgacatccacgg

SEQ ID NO: 354744 - DNA, 25 bp, Mus musculus
tcaagatcaagcttctcttgcaggt

SEQ ID NO: 354745 - DNA, 25 bp, Mus musculus
tcaagatcagaggatcccactgacc

SEQ ID NO: 354746 - DNA, 25 bp, Mus musculus
tcaagatcatccggaagaagattcc

SEQ ID NO: 354747 - DNA, 25 bp, Mus musculus
tcaagatctttaaaaggctactgaa

SEQ ID NO: 354748 - DNA, 25 bp, Mus musculus
tcaagatgaaggtctcagatctgac

SEQ ID NO: 354749 - DNA, 25 bp, Mus musculus
tcaagatgactaagatgctaaaagg

SEQ ID NO: 354750 - DNA, 25 bp, Mus musculus
tcaagatgagagcgatgacagagaa

SEQ ID NO: 354751 - DNA, 25 bp, Mus musculus
tcaagatgaggcgagtggcagtgtg

SEQ ID NO: 354752 - DNA, 25 bp, Mus musculus
tcaagatgagtatgggaagagtcac

SEQ ID NO: 354753 - DNA, 25 bp, Mus musculus
tcaagatgatgaggctgagaaggca

SEQ ID NO: 354754 - DNA, 25 bp, Mus musculus
tcaagatgcagggttccaagcgtgt

SEQ ID NO: 354755 - DNA, 25 bp, Mus musculus
tcaagatgcagtacccccacttcct

SEQ ID NO: 354756 - DNA, 25 bp, Mus musculus
tcaagattatccagagtcctattgt

SEQ ID NO: 354757 - DNA, 25 bp, Mus musculus
tcaagattatccagggaaaggaaga

SEQ ID NO: 354758 - DNA, 25 bp, Mus musculus
tcaagattccagaaggagaaaaaaa

SEQ ID NO: 354759 - DNA, 25 bp, Mus musculus
tcaagcaaacccaggaagagcggtc

SEQ ID NO: 354760 - DNA, 25 bp, Mus musculus
tcaagcaaacccaggagacacaccc

SEQ ID NO: 354761 - DNA, 25 bp, Mus musculus
tcaagcaaacccagttgagcaaaaa

SEQ ID NO: 354762 - DNA, 25 bp, Mus musculus
tcaagcaacagcaaatgaagctggt

SEQ ID NO: 354763 - DNA, 25 bp, Mus musculus
tcaagcaagaaggcacttgctatca

SEQ ID NO: 354764 - DNA, 25 bp, Mus musculus
tcaagcaagcagcaggagaaaaaaa

SEQ ID NO: 354765 - DNA, 25 bp, Mus musculus
tcaagcaagtgcaaagaaacgatga

SEQ ID NO: 354766 - DNA, 25 bp, Mus musculus
tcaagcaccttggacaaagtctcga

SEQ ID NO: 354767 - DNA, 25 bp, Mus musculus
tcaagcacgcacctggaagggtctg

SEQ ID NO: 354768 - DNA, 25 bp, Mus musculus
tcaagcacgggaaagaaaacaaaca

SEQ ID NO: 354769 - DNA, 25 bp, Mus musculus
tcaagcacgggaaagaaacactcat

SEQ ID NO: 354770 - DNA, 25 bp, Mus musculus
tcaagcacggggcgggggcagagat

SEQ ID NO: 354771 - DNA, 25 bp, Mus musculus
tcaagcagaaaatgagtccactcga

SEQ ID NO: 354772 - DNA, 25 bp, Mus musculus
tcaagcagaacagccttccagaaat

SEQ ID NO: 354773 - DNA, 25 bp, Mus musculus
tcaagcagaacagggcggcagatca

SEQ ID NO: 354774 - DNA, 25 bp, Mus musculus
tcaagcagaacaggtttgccagatc

SEQ ID NO: 354775 - DNA, 25 bp, Mus musculus
tcaagcagaggcgatgctttttaaa

SEQ ID NO: 354776 - DNA, 25 bp, Mus musculus
tcaagcagagggttcgcaaagaact

SEQ ID NO: 354777 - DNA, 25 bp, Mus musculus
tcaagcagataccgggcccaacgaa

SEQ ID NO: 354778 - DNA, 25 bp, Mus musculus
tcaagcagataccgggtggggacga

SEQ ID NO: 354779 - DNA, 25 bp, Mus musculus
tcaagcagatgaagatcatccatga

SEQ ID NO: 354780 - DNA, 25 bp, Mus musculus
tcaagcagccgagcctcgggatgga

SEQ ID NO: 354781 - DNA, 25 bp, Mus musculus
tcaagcaggagccatgcagtggtgc

SEQ ID NO: 354782 - DNA, 25 bp, Mus musculus
tcaagcaggcaaggagacggaagag

SEQ ID NO: 354783 - DNA, 25 bp, Mus musculus
tcaagcaggcaaggtgaccacatta

SEQ ID NO: 354784 - DNA, 25 bp, Mus musculus
tcaagcagggaccaggccctctgcc

SEQ ID NO: 354785 - DNA, 25 bp, Mus musculus
tcaagcagggaccatggttggggtg

SEQ ID NO: 354786 - DNA, 25 bp, Mus musculus
tcaagcagtggcatcagaaatttct

SEQ ID NO: 354787 - DNA, 25 bp, Mus musculus
tcaagcagtgggtatatgcttgtca

SEQ ID NO: 354788 - DNA, 25 bp, Mus musculus
tcaagcatgacttaacctgtgtgaa

SEQ ID NO: 354789 - DNA, 25 bp, Mus musculus
tcaagcatggatgagttggcagagt

SEQ ID NO: 354790 - DNA, 25 bp, Mus musculus
tcaagccaaaaggtgaaacctcagg

SEQ ID NO: 354791 - DNA, 25 bp, Mus musculus
tcaagccacagagcccaagatgatt

SEQ ID NO: 354792 - DNA, 25 bp, Mus musculus
tcaagccagagagccctggcacaaa

SEQ ID NO: 354793 - DNA, 25 bp, Mus musculus
tcaagccagagagtgctcaacctca

SEQ ID NO: 354794 - DNA, 25 bp, Mus musculus
tcaagccattgctgcatgcctgtgg

SEQ ID NO: 354795 - DNA, 25 bp, Mus musculus
tcaagccattgcttttgggactcgc

SEQ ID NO: 354796 - DNA, 25 bp, Mus musculus
tcaagcccagctactaaaggagatc

SEQ ID NO: 354797 - DNA, 25 bp, Mus musculus
tcaagcccagctatgggacccctgc

SEQ ID NO: 354798 - DNA, 25 bp, Mus musculus
tcaagcccagtcttgcctccagcat

SEQ ID NO: 354799 - DNA, 25 bp, Mus musculus
tcaagcccatcagaaaatcaccgtg

SEQ ID NO: 354800 - DNA, 25 bp, Mus musculus
tcaagcccccaaaggttgctttcac

SEQ ID NO: 354801 - DNA, 25 bp, Mus musculus
tcaagccctggtaacccatagtccc

SEQ ID NO: 354802 - DNA, 25 bp, Mus musculus
tcaagccctggtgtctcttgctcaa

SEQ ID NO: 354803 - DNA, 25 bp, Mus musculus
tcaagcccttcacagtggagattgt

SEQ ID NO: 354804 - DNA, 25 bp, Mus musculus
tcaagccgcgacttttgccatgagg

SEQ ID NO: 354805 - DNA, 25 bp, Mus musculus
tcaagccgcggcttctacaaaccat

SEQ ID NO: 354806 - DNA, 25 bp, Mus musculus
tcaagcctcagcagggatcacatgc

SEQ ID NO: 354807 - DNA, 25 bp, Mus musculus
tcaagcctgcggacttgactgcgtt

SEQ ID NO: 354808 - DNA, 25 bp, Mus musculus
tcaagcctgcggggacttgactgcg

SEQ ID NO: 354809 - DNA, 25 bp, Mus musculus
tcaagccttctaagctacctgaacc

SEQ ID NO: 354810 - DNA, 25 bp, Mus musculus
tcaagcgactgctctttacagccgt

SEQ ID NO: 354811 - DNA, 25 bp, Mus musculus
tcaagcgactgtttagctttttctc

SEQ ID NO: 354812 - DNA, 25 bp, Mus musculus
tcaagcgacttaaagaaggtccttt

SEQ ID NO: 354813 - DNA, 25 bp, Mus musculus
tcaagcgcaaaggaaaatgactcag

SEQ ID NO: 354814 - DNA, 25 bp, Mus musculus
tcaagcgcaaagggcccacatggta

SEQ ID NO: 354815 - DNA, 25 bp, Mus musculus
tcaagcgcaagtattttccgccaag

SEQ ID NO: 354816 - DNA, 25 bp, Mus musculus
tcaagcgcagcgggagaacagttaa

SEQ ID NO: 354817 - DNA, 25 bp, Mus musculus
tcaagcgcgccctggccaacagcct

SEQ ID NO: 354818 - DNA, 25 bp, Mus musculus
tcaagcgctctacaggggaggtgga

SEQ ID NO: 354819 - DNA, 25 bp, Mus musculus
tcaagcgctggacgggtggagtgtc

SEQ ID NO: 354820 - DNA, 25 bp, Mus musculus
tcaagcggccagggacgatccgtaa

SEQ ID NO: 354821 - DNA, 25 bp, Mus musculus
tcaagcggccagggagagacgacat

SEQ ID NO: 354822 - DNA, 25 bp, Mus musculus
tcaagcgggcagagatgaacgggct

SEQ ID NO: 354823 - DNA, 25 bp, Mus musculus
tcaagcgggcagagtctgctcattg

SEQ ID NO: 354824 - DNA, 25 bp, Mus musculus
tcaagcgggcagagttttatcttta

SEQ ID NO: 354825 - DNA, 25 bp, Mus musculus
tcaagcgtgttagatatcgatgagt

SEQ ID NO: 354826 - DNA, 25 bp, Mus musculus
tcaagctacagatatgggacacagc

SEQ ID NO: 354827 - DNA, 25 bp, Mus musculus
tcaagctatgatgaccagacctgct

SEQ ID NO: 354828 - DNA, 25 bp, Mus musculus
tcaagctccaggagctgattcagaa

SEQ ID NO: 354829 - DNA, 25 bp, Mus musculus
tcaagctcttatgtgagacgtggaa

SEQ ID NO: 354830 - DNA, 25 bp, Mus musculus
tcaagctgagactgttggtgaaatt

SEQ ID NO: 354831 - DNA, 25 bp, Mus musculus
tcaagctgcaggaggaggcaaaaaa

SEQ ID NO: 354832 - DNA, 25 bp, Mus musculus
tcaagcttgaagaagaccttcccca

SEQ ID NO: 354833 - DNA, 25 bp, Mus musculus
tcaagcttgccccagcggggacgaa

SEQ ID NO: 354834 - DNA, 25 bp, Mus musculus
tcaagcttgccccagctgacgagat

SEQ ID NO: 354835 - DNA, 25 bp, Mus musculus
tcaaggaaaacaaattgatgatgca

SEQ ID NO: 354836 - DNA, 25 bp, Mus musculus
tcaaggaaaacaggacccatcctct

SEQ ID NO: 354837 - DNA, 25 bp, Mus musculus
tcaaggaaaacagtctataaagcac

SEQ ID NO: 354838 - DNA, 25 bp, Mus musculus
tcaaggaaaagagttaccgtcaagt

SEQ ID NO: 354839 - DNA, 25 bp, Mus musculus
tcaaggaaatggtggctgcgttgat

SEQ ID NO: 354840 - DNA, 25 bp, Mus musculus
tcaaggaacaagctagtggggtagt

SEQ ID NO: 354841 - DNA, 25 bp, Mus musculus
tcaaggaagaagcaggtgattaaag

SEQ ID NO: 354842 - DNA, 25 bp, Mus musculus
tcaaggaagaaggagaaagcaagct

SEQ ID NO: 354843 - DNA, 25 bp, Mus musculus
tcaaggaagaaggagagctcactac

SEQ ID NO: 354844 - DNA, 25 bp, Mus musculus
tcaaggaagcctctgtgcctctggg

SEQ ID NO: 354845 - DNA, 25 bp, Mus musculus
tcaaggaatagtgtgataattggcc

SEQ ID NO: 354846 - DNA, 25 bp, Mus musculus
tcaaggaatagtgtgtgcagcttat

SEQ ID NO: 354847 - DNA, 25 bp, Mus musculus
tcaaggaccgagagggttacacatc

SEQ ID NO: 354848 - DNA, 25 bp, Mus musculus
tcaaggaccgagaggtgagacgtgg

SEQ ID NO: 354849 - DNA, 25 bp, Mus musculus
tcaaggaccgagaggtgatctgtaa

SEQ ID NO: 354850 - DNA, 25 bp, Mus musculus
tcaaggacctccaggacctcagggt

SEQ ID NO: 354851 - DNA, 25 bp, Mus musculus
tcaaggacgacagggccccaaagga

SEQ ID NO: 354852 - DNA, 25 bp, Mus musculus
tcaaggactccaggcatgtcatgtt

SEQ ID NO: 354853 - DNA, 25 bp, Mus musculus
tcaaggagaacaaggctgaatcaga

SEQ ID NO: 354854 - DNA, 25 bp, Mus musculus
tcaaggagaacaagtgccagaacca

SEQ ID NO: 354855 - DNA, 25 bp, Mus musculus
tcaaggagaagaagaaaaagtcagc

SEQ ID NO: 354856 - DNA, 25 bp, Mus musculus
tcaaggagaagaagcaatgtctgac

SEQ ID NO: 354857 - DNA, 25 bp, Mus musculus
tcaaggagaagagaacagaaagcct

SEQ ID NO: 354858 - DNA, 25 bp, Mus musculus
tcaaggagaggtctggtccatcgaa

SEQ ID NO: 354859 - DNA, 25 bp, Mus musculus
tcaaggagaggttgctatggtgaca

SEQ ID NO: 354860 - DNA, 25 bp, Mus musculus
tcaaggagctcccctcccacccacc

SEQ ID NO: 354861 - DNA, 25 bp, Mus musculus
tcaaggagctgcaacaacatttttt

SEQ ID NO: 354862 - DNA, 25 bp, Mus musculus
tcaaggagctgtaggtggcgatgtc

SEQ ID NO: 354863 - DNA, 25 bp, Mus musculus
tcaaggagcttcaggcacgcatcga

SEQ ID NO: 354864 - DNA, 25 bp, Mus musculus
tcaaggaggacagattaattgtggt

SEQ ID NO: 354865 - DNA, 25 bp, Mus musculus
tcaaggaggacaggacaaaagaggc

SEQ ID NO: 354866 - DNA, 25 bp, Mus musculus
tcaaggatatcgacgtgatcatggg

SEQ ID NO: 354867 - DNA, 25 bp, Mus musculus
tcaaggatcacaaagacctgtgccc

SEQ ID NO: 354868 - DNA, 25 bp, Mus musculus
tcaaggatcacaaagtgagtttcct

SEQ ID NO: 354869 - DNA, 25 bp, Mus musculus
tcaaggatggacacattcattactt

SEQ ID NO: 354870 - DNA, 25 bp, Mus musculus
tcaaggattaattagaaaaggaggc

SEQ ID NO: 354871 - DNA, 25 bp, Mus musculus
tcaaggcaaaattggaaagagaact

SEQ ID NO: 354872 - DNA, 25 bp, Mus musculus
tcaaggcaaaattgtctgtccactc

SEQ ID NO: 354873 - DNA, 25 bp, Mus musculus
tcaaggcaaagaggaacagagtgtt

SEQ ID NO: 354874 - DNA, 25 bp, Mus musculus
tcaaggcacaggatctagataaaac

SEQ ID NO: 354875 - DNA, 25 bp, Mus musculus
tcaaggcagagtgctcgatccgact

SEQ ID NO: 354876 - DNA, 25 bp, Mus musculus
tcaaggccaagatccgggacttgca

SEQ ID NO: 354877 - DNA, 25 bp, Mus musculus
tcaaggccaaggccaacctggagaa

SEQ ID NO: 354878 - DNA, 25 bp, Mus musculus
tcaaggccaagggtctactatacca

SEQ ID NO: 354879 - DNA, 25 bp, Mus musculus
tcaaggccagcagattgtgatatct

SEQ ID NO: 354880 - DNA, 25 bp, Mus musculus
tcaaggccagcaggtctcataacaa

SEQ ID NO: 354881 - DNA, 25 bp, Mus musculus
tcaaggccaggttgatggaaaccaa

SEQ ID NO: 354882 - DNA, 25 bp, Mus musculus
tcaaggccataaagactcactccga

SEQ ID NO: 354883 - DNA, 25 bp, Mus musculus
tcaaggccataaaggcttctgggga

SEQ ID NO: 354884 - DNA, 25 bp, Mus musculus
tcaaggccctcagattgacaaggaa

SEQ ID NO: 354885 - DNA, 25 bp, Mus musculus
tcaaggccctggcagatgagcgtga

SEQ ID NO: 354886 - DNA, 25 bp, Mus musculus
tcaaggccgttcggaaggctgtggg

SEQ ID NO: 354887 - DNA, 25 bp, Mus musculus
tcaaggcctcaggtggagccagtga

SEQ ID NO: 354888 - DNA, 25 bp, Mus musculus
tcaaggcctgacaacatcgctgtca

SEQ ID NO: 354889 - DNA, 25 bp, Mus musculus
tcaaggcgacaatgttctcaaacag

SEQ ID NO: 354890 - DNA, 25 bp, Mus musculus
tcaaggctacctagaaagtcccaag

SEQ ID NO: 354891 - DNA, 25 bp, Mus musculus
tcaaggctacctagaacatcagaaa

SEQ ID NO: 354892 - DNA, 25 bp, Mus musculus
tcaaggctagactggctgcgaagct

SEQ ID NO: 354893 - DNA, 25 bp, Mus musculus
tcaaggctctacattcccaaggtga

SEQ ID NO: 354894 - DNA, 25 bp, Mus musculus
tcaagggacatgaaggtagcatcgc

SEQ ID NO: 354895 - DNA, 25 bp, Mus musculus
tcaagggcaagatcctatttatctt

SEQ ID NO: 354896 - DNA, 25 bp, Mus musculus
tcaagggcaaggactacctggacca

SEQ ID NO: 354897 - DNA, 25 bp, Mus musculus
tcaagggcagtgggtgctggtcttc

SEQ ID NO: 354898 - DNA, 25 bp, Mus musculus
tcaagggcatggtgggcagcaaaga

SEQ ID NO: 354899 - DNA, 25 bp, Mus musculus
tcaagggcggaggtgagtgcaggat

SEQ ID NO: 354900 - DNA, 25 bp, Mus musculus
tcaagggctatttccctgcagtctg

SEQ ID NO: 354901 - DNA, 25 bp, Mus musculus
tcaagggctcttgctgttccggggc

SEQ ID NO: 354902 - DNA, 25 bp, Mus musculus
tcaagggctcttgggcagcgctcac

SEQ ID NO: 354903 - DNA, 25 bp, Mus musculus
tcaaggggaagactgccgtgagcat

SEQ ID NO: 354904 - DNA, 25 bp, Mus musculus
tcaaggggaagactggcgcaagcgg

SEQ ID NO: 354905 - DNA, 25 bp, Mus musculus
tcaaggggaagactgggagatggaa

SEQ ID NO: 354906 - DNA, 25 bp, Mus musculus
tcaaggggaagactggtccctgtgg

SEQ ID NO: 354907 - DNA, 25 bp, Mus musculus
tcaaggggaagactggtctctaact

SEQ ID NO: 354908 - DNA, 25 bp, Mus musculus
tcaagggtcacagaggttacccagg

SEQ ID NO: 354909 - DNA, 25 bp, Mus musculus
tcaagggtttgaatgtatcgcaaac

SEQ ID NO: 354910 - DNA, 25 bp, Mus musculus
tcaaggtactcaagcgagctgcagc

SEQ ID NO: 354911 - DNA, 25 bp, Mus musculus
tcaaggtactcaaggtaggctgctt

SEQ ID NO: 354912 - DNA, 25 bp, Mus musculus
tcaaggtagaggcccctaacagctc

SEQ ID NO: 354913 - DNA, 25 bp, Mus musculus
tcaaggtcaaaagggagaacctggc

SEQ ID NO: 354914 - DNA, 25 bp, Mus musculus
tcaaggtcaacaggcgcaacctggt

SEQ ID NO: 354915 - DNA, 25 bp, Mus musculus
tcaaggtcagatctataccttcctc

SEQ ID NO: 354916 - DNA, 25 bp, Mus musculus
tcaaggtcctgaagcactcggggat

SEQ ID NO: 354917 - DNA, 25 bp, Mus musculus
tcaaggtcctgaagcgcctgtgaga

SEQ ID NO: 354918 - DNA, 25 bp, Mus musculus
tcaaggtcctgaaggccgccggtgt

SEQ ID NO: 354919 - DNA, 25 bp, Mus musculus
tcaaggtcgaacacatgggtcggag

SEQ ID NO: 354920 - DNA, 25 bp, Mus musculus
tcaaggtctggatattgaagtaatg

SEQ ID NO: 354921 - DNA, 25 bp, Mus musculus
tcaaggtctggtgagaagctggatg

SEQ ID NO: 354922 - DNA, 25 bp, Mus musculus
tcaaggtctttgcaaagcccaaaat

SEQ ID NO: 354923 - DNA, 25 bp, Mus musculus
tcaaggtggtggaaggagctcaagg

SEQ ID NO: 354924 - DNA, 25 bp, Mus musculus
tcaaggttaaggctagatatggatt

SEQ ID NO: 354925 - DNA, 25 bp, Mus musculus
tcaaggttcaggtcttatatccaga

SEQ ID NO: 354926 - DNA, 25 bp, Mus musculus
tcaaggttccaggagagacatgcta

SEQ ID NO: 354927 - DNA, 25 bp, Mus musculus
tcaagtaatacaagctatggtgaaa

SEQ ID NO: 354928 - DNA, 25 bp, Mus musculus
tcaagtacaatcaggcctggctgct

SEQ ID NO: 354929 - DNA, 25 bp, Mus musculus
tcaagtacagagatgaactcaagcg

SEQ ID NO: 354930 - DNA, 25 bp, Mus musculus
tcaagtacaggtatgaactcaagcg

SEQ ID NO: 354931 - DNA, 25 bp, Mus musculus
tcaagtacctttccaataccaaata

SEQ ID NO: 354932 - DNA, 25 bp, Mus musculus
tcaagtacctttccagagctgcctt

SEQ ID NO: 354933 - DNA, 25 bp, Mus musculus
tcaagtacgagctttatggccacgc

SEQ ID NO: 354934 - DNA, 25 bp, Mus musculus
tcaagtactggttgggtggtccgga

SEQ ID NO: 354935 - DNA, 25 bp, Mus musculus
tcaagtactggtttacaggaacaga

SEQ ID NO: 354936 - DNA, 25 bp, Mus musculus
tcaagtactttgcccgagggctccg

SEQ ID NO: 354937 - DNA, 25 bp, Mus musculus
tcaagtagcaaagactctgttacgg

SEQ ID NO: 354938 - DNA, 25 bp, Mus musculus
tcaagtagcaaaggtgattggatgt

SEQ ID NO: 354939 - DNA, 25 bp, Mus musculus
tcaagtagcaatgaaggggtagagg

SEQ ID NO: 354940 - DNA, 25 bp, Mus musculus
tcaagtatgtaccccaactgtgcca

SEQ ID NO: 354941 - DNA, 25 bp, Mus musculus
tcaagtcaaagaaatggcctccacc

SEQ ID NO: 354942 - DNA, 25 bp, Mus musculus
tcaagtcacaagctcctcaggatcc

SEQ ID NO: 354943 - DNA, 25 bp, Mus musculus
tcaagtcacaaggacaaagtataga

SEQ ID NO: 354944 - DNA, 25 bp, Mus musculus
tcaagtcatttcctgtagaagaccc

SEQ ID NO: 354945 - DNA, 25 bp, Mus musculus
tcaagtccagaagaaatattatggg

SEQ ID NO: 354946 - DNA, 25 bp, Mus musculus
tcaagtccatcaacatcctaatcct

SEQ ID NO: 354947 - DNA, 25 bp, Mus musculus
tcaagtcctgagatgagccgccagc

SEQ ID NO: 354948 - DNA, 25 bp, Mus musculus
tcaagtcctgctctacagagggaag

SEQ ID NO: 354949 - DNA, 25 bp, Mus musculus
tcaagtcctggtgtggaggctgagg

SEQ ID NO: 354950 - DNA, 25 bp, Mus musculus
tcaagtccttggaaattagaaggat

SEQ ID NO: 354951 - DNA, 25 bp, Mus musculus
tcaagtccttggaccatggtatcta

SEQ ID NO: 354952 - DNA, 25 bp, Mus musculus
tcaagtcctttcagtcttttgatgg

SEQ ID NO: 354953 - DNA, 25 bp, Mus musculus
tcaagtcctttccgggtggcaagga

SEQ ID NO: 354954 - DNA, 25 bp, Mus musculus
tcaagtcttcacagagctgtgaaat

SEQ ID NO: 354955 - DNA, 25 bp, Mus musculus
tcaagtgaaagaggtcaaccggatg

SEQ ID NO: 354956 - DNA, 25 bp, Mus musculus
tcaagtgatgaagaagccttcctgt

SEQ ID NO: 354957 - DNA, 25 bp, Mus musculus
tcaagtgatgaaggagaggatgatg

SEQ ID NO: 354958 - DNA, 25 bp, Mus musculus
tcaagtgcaaggtcatcttccatga

SEQ ID NO: 354959 - DNA, 25 bp, Mus musculus
tcaagtgcctcagggcaccaccgtg

SEQ ID NO: 354960 - DNA, 25 bp, Mus musculus
tcaagtggtcccagaatggaagccc

SEQ ID NO: 354961 - DNA, 25 bp, Mus musculus
tcaagtggtcccagggccagaaaaa

SEQ ID NO: 354962 - DNA, 25 bp, Mus musculus
tcaagtggttgcgaacaatttcgaa

SEQ ID NO: 354963 - DNA, 25 bp, Mus musculus
tcaagtggttgcggagaggtttgca

SEQ ID NO: 354964 - DNA, 25 bp, Mus musculus
tcaagtggttgcggagcgagcccgg

SEQ ID NO: 354965 - DNA, 25 bp, Mus musculus
tcaagtgtaagagtgtgtttgacat

SEQ ID NO: 354966 - DNA, 25 bp, Mus musculus
tcaagtgttggactggaacttcctt

SEQ ID NO: 354967 - DNA, 25 bp, Mus musculus
tcaagtgttggcagcagtggtggtt

SEQ ID NO: 354968 - DNA, 25 bp, Mus musculus
tcaagtgtttggcaggatgctcggg

SEQ ID NO: 354969 - DNA, 25 bp, Mus musculus
tcaagtgtttggcagtctccaaaac

SEQ ID NO: 354970 - DNA, 25 bp, Mus musculus
tcaagttaaagagaatgaaaatgtc

SEQ ID NO: 354971 - DNA, 25 bp, Mus musculus
tcaagttactcaggggtggatgaga

SEQ ID NO: 354972 - DNA, 25 bp, Mus musculus
tcaagttacttctgatggcctcgaa

SEQ ID NO: 354973 - DNA, 25 bp, Mus musculus
tcaagttagttgatctgcctgcctc

SEQ ID NO: 354974 - DNA, 25 bp, Mus musculus
tcaagttcaccaagatatttatcaa

SEQ ID NO: 354975 - DNA, 25 bp, Mus musculus
tcaagttcaggacctctcctattac

SEQ ID NO: 354976 - DNA, 25 bp, Mus musculus
tcaagttctcagatgaatatctgac

SEQ ID NO: 354977 - DNA, 25 bp, Mus musculus
tcaagttctgcaaggatgaattgtc

SEQ ID NO: 354978 - DNA, 25 bp, Mus musculus
tcaagtttataagggtcgtcatgtc

SEQ ID NO: 354979 - DNA, 25 bp, Mus musculus
tcaagtttcagcctcttagcaagta

SEQ ID NO: 354980 - DNA, 25 bp, Mus musculus
tcaagtttcaggacacacaggacca

SEQ ID NO: 354981 - DNA, 25 bp, Mus musculus
tcaagtttctcccctaccactgaca

SEQ ID NO: 354982 - DNA, 25 bp, Mus musculus
tcaagtttctgccctaccactgaca

SEQ ID NO: 354983 - DNA, 25 bp, Mus musculus
tcaagtttgagctgggaagatgccg

SEQ ID NO: 354984 - DNA, 25 bp, Mus musculus
tcaagtttgcaaagaagaaacagca

SEQ ID NO: 354985 - DNA, 25 bp, Mus musculus
tcaagtttgcaaaggaaatatatcc

SEQ ID NO: 354986 - DNA, 25 bp, Mus musculus
tcaagtttgctattggccaggctgg

SEQ ID NO: 354987 - DNA, 25 bp, Mus musculus
tcaagtttgctattggggggctctg

SEQ ID NO: 354988 - DNA, 25 bp, Mus musculus
tcaagtttgctattgtctaaatctc

SEQ ID NO: 354989 - DNA, 25 bp, Mus musculus
tcaagtttgtgggtgaatccgtgga

SEQ ID NO: 354990 - DNA, 25 bp, Mus musculus
tcaagtttttataatgtaaagctgt

SEQ ID NO: 354991 - DNA, 25 bp, Mus musculus
tcaataaagagcaggtgtcacaact

SEQ ID NO: 354992 - DNA, 25 bp, Mus musculus
tcaataaagcagttttccacatcga

SEQ ID NO: 354993 - DNA, 25 bp, Mus musculus
tcaataaatggatggaaacccttgg

SEQ ID NO: 354994 - DNA, 25 bp, Mus musculus
tcaataaattaaagcaagcctgtgg

SEQ ID NO: 354995 - DNA, 25 bp, Mus musculus
tcaataagcagctgacagagggtac

SEQ ID NO: 354996 - DNA, 25 bp, Mus musculus
tcaataagcctggtggacccatgga

SEQ ID NO: 354997 - DNA, 25 bp, Mus musculus
tcaataataacccaggtagtataac

SEQ ID NO: 354998 - DNA, 25 bp, Mus musculus
tcaataataacccagtgggtaagct

SEQ ID NO: 354999 - DNA, 25 bp, Mus musculus
tcaataatcatcttcttcagggtga

SEQ ID NO: 355000 - DNA, 25 bp, Mus musculus
tcaataatggactcccttttatttg

SEQ ID NO: 355001 - DNA, 25 bp, Mus musculus
tcaatacaattgctgatactttgtg

SEQ ID NO: 355002 - DNA, 25 bp, Mus musculus
tcaatacagatcagggagcctttgc

SEQ ID NO: 355003 - DNA, 25 bp, Mus musculus
tcaatacagtagtctggacagagga

SEQ ID NO: 355004 - DNA, 25 bp, Mus musculus
tcaatacccaaagatctttataagc

SEQ ID NO: 355005 - DNA, 25 bp, Mus musculus
tcaatacctggagcacacatccatt

SEQ ID NO: 355006 - DNA, 25 bp, Mus musculus
tcaatacctggagtgtctggtcctg

SEQ ID NO: 355007 - DNA, 25 bp, Mus musculus
tcaatactacatttatgatctgcag

SEQ ID NO: 355008 - DNA, 25 bp, Mus musculus
tcaatacttctaccagaatcgagct

SEQ ID NO: 355009 - DNA, 25 bp, Mus musculus
tcaatacttctatttttttattcat

SEQ ID NO: 355010 - DNA, 25 bp, Mus musculus
tcaatagcagaaagttccctggctc

SEQ ID NO: 355011 - DNA, 25 bp, Mus musculus
tcaatagcatagacatggactaggg

SEQ ID NO: 355012 - DNA, 25 bp, Mus musculus
tcaatagcatagacatggactttgt

SEQ ID NO: 355013 - DNA, 25 bp, Mus musculus
tcaatagcccctatggctgtagcag

SEQ ID NO: 355014 - DNA, 25 bp, Mus musculus
tcaataggatccctggagtccctgg

SEQ ID NO: 355015 - DNA, 25 bp, Mus musculus
tcaataggattccaggagtccctgg

SEQ ID NO: 355016 - DNA, 25 bp, Mus musculus
tcaatagtcaaggtgaatatgaaga

SEQ ID NO: 355017 - DNA, 25 bp, Mus musculus
tcaatataatgctagataaatggga

SEQ ID NO: 355018 - DNA, 25 bp, Mus musculus
tcaatatagcacagaacctatcaac

SEQ ID NO: 355019 - DNA, 25 bp, Mus musculus
tcaatatcacagaaaagtgtgtaat

SEQ ID NO: 355020 - DNA, 25 bp, Mus musculus
tcaatatcacgaggacaaagataat

SEQ ID NO: 355021 - DNA, 25 bp, Mus musculus
tcaatatcttgggagccgaagaggc

SEQ ID NO: 355022 - DNA, 25 bp, Mus musculus
tcaatatcttggtacagggagccga

SEQ ID NO: 355023 - DNA, 25 bp, Mus musculus
tcaatatgaagagtaaagatgggaa

SEQ ID NO: 355024 - DNA, 25 bp, Mus musculus
tcaatcaatggtgtcccagatgacc

SEQ ID NO: 355025 - DNA, 25 bp, Mus musculus
tcaatcacaacttgaaagatgccaa

SEQ ID NO: 355026 - DNA, 25 bp, Mus musculus
tcaatcacgcagtcatgtttactgg

SEQ ID NO: 355027 - DNA, 25 bp, Mus musculus
tcaatcacgcagtggatcgtagaca

SEQ ID NO: 355028 - DNA, 25 bp, Mus musculus
tcaatcacttggggaaaggcgaagc

SEQ ID NO: 355029 - DNA, 25 bp, Mus musculus
tcaatcagaggtgcttcttaaaaga

SEQ ID NO: 355030 - DNA, 25 bp, Mus musculus
tcaatcagctacaagatgctgggtg

SEQ ID NO: 355031 - DNA, 25 bp, Mus musculus
tcaatcataaggatgagaacaagtt

SEQ ID NO: 355032 - DNA, 25 bp, Mus musculus
tcaatcataagggcgagatgtgtga

SEQ ID NO: 355033 - DNA, 25 bp, Mus musculus
tcaatccactttgtcaagtggatta

SEQ ID NO: 355034 - DNA, 25 bp, Mus musculus
tcaatccattatgaaattgaagacc

SEQ ID NO: 355035 - DNA, 25 bp, Mus musculus
tcaatccattatgaagaaacaggga

SEQ ID NO: 355036 - DNA, 25 bp, Mus musculus
tcaatcccagggctccgggatctgt

SEQ ID NO: 355037 - DNA, 25 bp, Mus musculus
tcaatcccatgcagctcggggtctg

SEQ ID NO: 355038 - DNA, 25 bp, Mus musculus
tcaatccccaagaccctgaagaaga

SEQ ID NO: 355039 - DNA, 25 bp, Mus musculus
tcaatccccaaggttcattctgtgg

SEQ ID NO: 355040 - DNA, 25 bp, Mus musculus
tcaatcccccaatgtgccttcagga

SEQ ID NO: 355041 - DNA, 25 bp, Mus musculus
tcaatcctctagactttgagagttt

SEQ ID NO: 355042 - DNA, 25 bp, Mus musculus
tcaatcctctagttttgacctgcct

SEQ ID NO: 355043 - DNA, 25 bp, Mus musculus
tcaatcgcagaggagaactgcggca

SEQ ID NO: 355044 - DNA, 25 bp, Mus musculus
tcaatcggacagggatgagaccggg

SEQ ID NO: 355045 - DNA, 25 bp, Mus musculus
tcaatctagaaggtggtgacattcg

SEQ ID NO: 355046 - DNA, 25 bp, Mus musculus
tcaatctccaacaacaaagaagcct

SEQ ID NO: 355047 - DNA, 25 bp, Mus musculus
tcaatctgaaagagttcttgcctct

SEQ ID NO: 355048 - DNA, 25 bp, Mus musculus
tcaatctgaaaggtacccagaactt

SEQ ID NO: 355049 - DNA, 25 bp, Mus musculus
tcaatctgcagaagcggcctctgga

SEQ ID NO: 355050 - DNA, 25 bp, Mus musculus
tcaatcttcctagtgacggctctgc

SEQ ID NO: 355051 - DNA, 25 bp, Mus musculus
tcaatcttcctagtgagccccgggt

SEQ ID NO: 355052 - DNA, 25 bp, Mus musculus
tcaatcttctcagggacaggggcag

SEQ ID NO: 355053 - DNA, 25 bp, Mus musculus
tcaatctttttaaggtacagcaagg

SEQ ID NO: 355054 - DNA, 25 bp, Mus musculus
tcaatgaaaagtgcggggaagcgct

SEQ ID NO: 355055 - DNA, 25 bp, Mus musculus
tcaatgaaaatgtcatggtttttac

SEQ ID NO: 355056 - DNA, 25 bp, Mus musculus
tcaatgaacaggttgataaagaaaa

SEQ ID NO: 355057 - DNA, 25 bp, Mus musculus
tcaatgaagagaaagtacacactgc

SEQ ID NO: 355058 - DNA, 25 bp, Mus musculus
tcaatgaagagcggctgattgacaa

SEQ ID NO: 355059 - DNA, 25 bp, Mus musculus
tcaatgaagagggcatctcctccca

SEQ ID NO: 355060 - DNA, 25 bp, Mus musculus
tcaatgacaacttcatcgactgctt

SEQ ID NO: 355061 - DNA, 25 bp, Mus musculus
tcaatgacactgaggtcgcatcaaa

SEQ ID NO: 355062 - DNA, 25 bp, Mus musculus
tcaatgaccaaacaggccatcgtgt

SEQ ID NO: 355063 - DNA, 25 bp, Mus musculus
tcaatgaccaaacaggcgctgctaa

SEQ ID NO: 355064 - DNA, 25 bp, Mus musculus
tcaatgaccaatatgagaaagtttg

SEQ ID NO: 355065 - DNA, 25 bp, Mus musculus
tcaatgacccgctgttcattccttg

SEQ ID NO: 355066 - DNA, 25 bp, Mus musculus
tcaatgacgcctgggtcctaaagga

SEQ ID NO: 355067 - DNA, 25 bp, Mus musculus
tcaatgacttcagagaatacctgtc

SEQ ID NO: 355068 - DNA, 25 bp, Mus musculus
tcaatgacttcagctgctgacctca

SEQ ID NO: 355069 - DNA, 25 bp, Mus musculus
tcaatgactttaaggaggccacgca

SEQ ID NO: 355070 - DNA, 25 bp, Mus musculus
tcaatgagaaatacggtgaggccct

SEQ ID NO: 355071 - DNA, 25 bp, Mus musculus
tcaatgagaagtgaacatgtatgag

SEQ ID NO: 355072 - DNA, 25 bp, Mus musculus
tcaatgagacagccaagcagcacga

SEQ ID NO: 355073 - DNA, 25 bp, Mus musculus
tcaatgagacaggacatgggtcagc

SEQ ID NO: 355074 - DNA, 25 bp, Mus musculus
tcaatgagagcaggtcaaggaggcc

SEQ ID NO: 355075 - DNA, 25 bp, Mus musculus
tcaatgagagcagtgggagccggtg

SEQ ID NO: 355076 - DNA, 25 bp, Mus musculus
tcaatgagcagggttggtttttgct

SEQ ID NO: 355077 - DNA, 25 bp, Mus musculus
tcaatgagcaggtttcagcggacgt

SEQ ID NO: 355078 - DNA, 25 bp, Mus musculus
tcaatgagcggtttgagtgggatct

SEQ ID NO: 355079 - DNA, 25 bp, Mus musculus
tcaatgagtcctttggcttcaccgc

SEQ ID NO: 355080 - DNA, 25 bp, Mus musculus
tcaatgatgttgatgccctgctggc

SEQ ID NO: 355081 - DNA, 25 bp, Mus musculus
tcaatgcaattgtttacatgataga

SEQ ID NO: 355082 - DNA, 25 bp, Mus musculus
tcaatgcacaggatgcagaagggag

SEQ ID NO: 355083 - DNA, 25 bp, Mus musculus
tcaatgcacatcttcaagaaaaatt

SEQ ID NO: 355084 - DNA, 25 bp, Mus musculus
tcaatgcagatgggtggcaagacat

SEQ ID NO: 355085 - DNA, 25 bp, Mus musculus
tcaatgcccccaaccccatccaacg

SEQ ID NO: 355086 - DNA, 25 bp, Mus musculus
tcaatgcctcagcttcggtagccct

SEQ ID NO: 355087 - DNA, 25 bp, Mus musculus
tcaatgcctgcctgcaaatttcagg

SEQ ID NO: 355088 - DNA, 25 bp, Mus musculus
tcaatgcgtacagtagcatccgggc

SEQ ID NO: 355089 - DNA, 25 bp, Mus musculus
tcaatgctaaggttcactacaacat

SEQ ID NO: 355090 - DNA, 25 bp, Mus musculus
tcaatgctatgtcagaaggcttatc

SEQ ID NO: 355091 - DNA, 25 bp, Mus musculus
tcaatgctatgtcaggaaaccatcc

SEQ ID NO: 355092 - DNA, 25 bp, Mus musculus
tcaatgctcaggtgcagtgtcttga

SEQ ID NO: 355093 - DNA, 25 bp, Mus musculus
tcaatgctgaagaaagcgaaatccg

SEQ ID NO: 355094 - DNA, 25 bp, Mus musculus
tcaatgctttgaatttaaaatctgg

SEQ ID NO: 355095 - DNA, 25 bp, Mus musculus
tcaatgctttgttcacagaggcgaa

SEQ ID NO: 355096 - DNA, 25 bp, Mus musculus
tcaatggaaatgaggaggctgctca

SEQ ID NO: 355097 - DNA, 25 bp, Mus musculus
tcaatggataaaggagccgggtgtg

SEQ ID NO: 355098 - DNA, 25 bp, Mus musculus
tcaatggccagaagcaccaagaatg

SEQ ID NO: 355099 - DNA, 25 bp, Mus musculus
tcaatggccaggtcaggagtttact

SEQ ID NO: 355100 - DNA, 25 bp, Mus musculus
tcaatggcgtgatccaggaagcccc

SEQ ID NO: 355101 - DNA, 25 bp, Mus musculus
tcaatggctatgttggaaatataaa

SEQ ID NO: 355102 - DNA, 25 bp, Mus musculus
tcaatgggaagtcattcagctggtc

SEQ ID NO: 355103 - DNA, 25 bp, Mus musculus
tcaatgggccacgtctaaagagcct

SEQ ID NO: 355104 - DNA, 25 bp, Mus musculus
tcaatgggtcccttttgcagtctgg

SEQ ID NO: 355105 - DNA, 25 bp, Mus musculus
tcaatggtcgaattcgccgcatgtc

SEQ ID NO: 355106 - DNA, 25 bp, Mus musculus
tcaatggttgggaaggaaaagggct

SEQ ID NO: 355107 - DNA, 25 bp, Mus musculus
tcaatgtcacctataattcacagaa

SEQ ID NO: 355108 - DNA, 25 bp, Mus musculus
tcaatgtctcagatgcactcccatc

SEQ ID NO: 355109 - DNA, 25 bp, Mus musculus
tcaatgtgaacaagcttgtgacaca

SEQ ID NO: 355110 - DNA, 25 bp, Mus musculus
tcaatgtgaatcttctggacatgtt

SEQ ID NO: 355111 - DNA, 25 bp, Mus musculus
tcaatgtgccaatattcaaggacaa

SEQ ID NO: 355112 - DNA, 25 bp, Mus musculus
tcaatgtggagaatgcatttttcac

SEQ ID NO: 355113 - DNA, 25 bp, Mus musculus
tcaatgtgttccttgcccagtctcg

SEQ ID NO: 355114 - DNA, 25 bp, Mus musculus
tcaatgtgttgcaacagaccaactg

SEQ ID NO: 355115 - DNA, 25 bp, Mus musculus
tcaatgttaagggatcgcttacact

SEQ ID NO: 355116 - DNA, 25 bp, Mus musculus
tcaatgttcaccagaaaccaggtgg

SEQ ID NO: 355117 - DNA, 25 bp, Mus musculus
tcaatgttggatagagatatgtccg

SEQ ID NO: 355118 - DNA, 25 bp, Mus musculus
tcaatgttgggcagatcctgctcat

SEQ ID NO: 355119 - DNA, 25 bp, Mus musculus
tcaatgttggtgggcttccaccact

SEQ ID NO: 355120 - DNA, 25 bp, Mus musculus
tcaatgtttcaggacagtcggccca

SEQ ID NO: 355121 - DNA, 25 bp, Mus musculus
tcaattacatcaagaagtccaaggt

SEQ ID NO: 355122 - DNA, 25 bp, Mus musculus
tcaattaccagggtgaaagaattga

SEQ ID NO: 355123 - DNA, 25 bp, Mus musculus
tcaattactacaagggccagtatat

SEQ ID NO: 355124 - DNA, 25 bp, Mus musculus
tcaattatgaagagtttgtacagat

SEQ ID NO: 355125 - DNA, 25 bp, Mus musculus
tcaattcacaccgaaactatgttcc

SEQ ID NO: 355126 - DNA, 25 bp, Mus musculus
tcaattccaatgcaaacaagaatgc

SEQ ID NO: 355127 - DNA, 25 bp, Mus musculus
tcaattcccggacggcctatgcaat

SEQ ID NO: 355128 - DNA, 25 bp, Mus musculus
tcaattcctctacgctgagcggcag

SEQ ID NO: 355129 - DNA, 25 bp, Mus musculus
tcaattctgatgtactaaaaatcac

SEQ ID NO: 355130 - DNA, 25 bp, Mus musculus
tcaattcttcacctactacagacaa

SEQ ID NO: 355131 - DNA, 25 bp, Mus musculus
tcaattcttcaccttctacagacaa

SEQ ID NO: 355132 - DNA, 25 bp, Mus musculus
tcaattggaaaagaggtccttctgt

SEQ ID NO: 355133 - DNA, 25 bp, Mus musculus
tcaattggaaaaggaatcttctatt

SEQ ID NO: 355134 - DNA, 25 bp, Mus musculus
tcaatttagacaagtatgatgatgt

SEQ ID NO: 355135 - DNA, 25 bp, Mus musculus
tcaatttagacaattggtggccatt

SEQ ID NO: 355136 - DNA, 25 bp, Mus musculus
tcaatttagtgagccacagtacacg

SEQ ID NO: 355137 - DNA, 25 bp, Mus musculus
tcaatttataagacaaaaaagaaga

SEQ ID NO: 355138 - DNA, 25 bp, Mus musculus
tcaatttcaagtcagaagacatgtc

SEQ ID NO: 355139 - DNA, 25 bp, Mus musculus
tcaatttcaggaaaatctgggtttg

SEQ ID NO: 355140 - DNA, 25 bp, Mus musculus
tcaatttcaggatactggctcgaat

SEQ ID NO: 355141 - DNA, 25 bp, Mus musculus
tcaatttcaggggctctctaaatac

SEQ ID NO: 355142 - DNA, 25 bp, Mus musculus
tcaatttggagaaggtacattattt

SEQ ID NO: 355143 - DNA, 25 bp, Mus musculus
tcaattttaagatgaaaatacttgg

SEQ ID NO: 355144 - DNA, 25 bp, Mus musculus
tcaattttaaggcagtgtgtgaaga

SEQ ID NO: 355145 - DNA, 25 bp, Mus musculus
tcaattttcaggaatgggacggctt

SEQ ID NO: 355146 - DNA, 25 bp, Mus musculus
tcaattttcaggtaataccagaaga

SEQ ID NO: 355147 - DNA, 25 bp, Mus musculus
tcaattttgaaatgtgctgctctgg

SEQ ID NO: 355148 - DNA, 25 bp, Mus musculus
tcacaaaaaaagattttggagtaag

SEQ ID NO: 355149 - DNA, 25 bp, Mus musculus
tcacaaaaaacttcatcaaagaaag

SEQ ID NO: 355150 - DNA, 25 bp, Mus musculus
tcacaaaaactgccagttggtggca

SEQ ID NO: 355151 - DNA, 25 bp, Mus musculus
tcacaaaaatataattggccttttg

SEQ ID NO: 355152 - DNA, 25 bp, Mus musculus
tcacaaaacaaaccaaggctactat

SEQ ID NO: 355153 - DNA, 25 bp, Mus musculus
tcacaaaacaggagacatttgatgc

SEQ ID NO: 355154 - DNA, 25 bp, Mus musculus
tcacaaaagtaggagttaccattga

SEQ ID NO: 355155 - DNA, 25 bp, Mus musculus
tcacaaacacagacattcccagcta

SEQ ID NO: 355156 - DNA, 25 bp, Mus musculus
tcacaaacacagaggagcttaattt

SEQ ID NO: 355157 - DNA, 25 bp, Mus musculus
tcacaaaccacttccattgaagatt

SEQ ID NO: 355158 - DNA, 25 bp, Mus musculus
tcacaaacgtgacaacagcactgtt

SEQ ID NO: 355159 - DNA, 25 bp, Mus musculus
tcacaaactcttacgacatgatggg

SEQ ID NO: 355160 - DNA, 25 bp, Mus musculus
tcacaaacttaatctagagaagcag

SEQ ID NO: 355161 - DNA, 25 bp, Mus musculus
tcacaaagaagcacagaccctggat

SEQ ID NO: 355162 - DNA, 25 bp, Mus musculus
tcacaaagaaggatggaaggtttga

SEQ ID NO: 355163 - DNA, 25 bp, Mus musculus
tcacaaagcaaagacaaatgagctt

SEQ ID NO: 355164 - DNA, 25 bp, Mus musculus
tcacaaagcaaagccagggcatagt

SEQ ID NO: 355165 - DNA, 25 bp, Mus musculus
tcacaaagcaaagccagtgaaactg

SEQ ID NO: 355166 - DNA, 25 bp, Mus musculus
tcacaaagtccaagaactgatgtct

SEQ ID NO: 355167 - DNA, 25 bp, Mus musculus
tcacaaagtccaagattgcgctggc

SEQ ID NO: 355168 - DNA, 25 bp, Mus musculus
tcacaaagttcagagtgcagagagc

SEQ ID NO: 355169 - DNA, 25 bp, Mus musculus
tcacaaagtttgagagtggatgtaa

SEQ ID NO: 355170 - DNA, 25 bp, Mus musculus
tcacaaatatcagaggccacctatg

SEQ ID NO: 355171 - DNA, 25 bp, Mus musculus
tcacaaatgcccagctcctaacctc

SEQ ID NO: 355172 - DNA, 25 bp, Mus musculus
tcacaaatttatcctgtagtatgtg

SEQ ID NO: 355173 - DNA, 25 bp, Mus musculus
tcacaacaaaccgagaaaggaaccg

SEQ ID NO: 355174 - DNA, 25 bp, Mus musculus
tcacaacaacaagcatcaccctacc

SEQ ID NO: 355175 - DNA, 25 bp, Mus musculus
tcacaacaacaaggagcactttagt

SEQ ID NO: 355176 - DNA, 25 bp, Mus musculus
tcacaacaagattgaggaagacaca

SEQ ID NO: 355177 - DNA, 25 bp, Mus musculus
tcacaacaaggcccatctgctcaac

SEQ ID NO: 355178 - DNA, 25 bp, Mus musculus
tcacaacagcgaggtgtaccacgag

SEQ ID NO: 355179 - DNA, 25 bp, Mus musculus
tcacaaccaaaaatactgaagcaga

SEQ ID NO: 355180 - DNA, 25 bp, Mus musculus
tcacaaccaatgaggaatacttgga

SEQ ID NO: 355181 - DNA, 25 bp, Mus musculus
tcacaacccagttcccacttggact

SEQ ID NO: 355182 - DNA, 25 bp, Mus musculus
tcacaacccctgaccataggtcaaa

SEQ ID NO: 355183 - DNA, 25 bp, Mus musculus
tcacaacccctgggtggagtttacc

SEQ ID NO: 355184 - DNA, 25 bp, Mus musculus
tcacaaccttgccagaaaaccttgc

SEQ ID NO: 355185 - DNA, 25 bp, Mus musculus
tcacaaccttggtaccttcactcaa

SEQ ID NO: 355186 - DNA, 25 bp, Mus musculus
tcacaacgttaaaggatatcactta

SEQ ID NO: 355187 - DNA, 25 bp, Mus musculus
tcacaactcacatccttgtctgtaa

SEQ ID NO: 355188 - DNA, 25 bp, Mus musculus
tcacaacttagtcttgacttctttg

SEQ ID NO: 355189 - DNA, 25 bp, Mus musculus
tcacaacttagtgtcttcaagaggc

SEQ ID NO: 355190 - DNA, 25 bp, Mus musculus
tcacaactttgctcggaaaacgttc

SEQ ID NO: 355191 - DNA, 25 bp, Mus musculus
tcacaagaaagaagagccaagtgga

SEQ ID NO: 355192 - DNA, 25 bp, Mus musculus
tcacaagaagaaacatgtcattcag

SEQ ID NO: 355193 - DNA, 25 bp, Mus musculus
tcacaagaagacttccaactgaata

SEQ ID NO: 355194 - DNA, 25 bp, Mus musculus
tcacaagaagtcgcaatgtgtcttc

SEQ ID NO: 355195 - DNA, 25 bp, Mus musculus
tcacaagcaccaagagcccgaccgt

SEQ ID NO: 355196 - DNA, 25 bp, Mus musculus
tcacaagcagaaacacctggtgtgt

SEQ ID NO: 355197 - DNA, 25 bp, Mus musculus
tcacaagcagtcatgaaagtccact

SEQ ID NO: 355198 - DNA, 25 bp, Mus musculus
tcacaagcagtctgaccaaggacat

SEQ ID NO: 355199 - DNA, 25 bp, Mus musculus
tcacaagcagtctttcacagaaaca

SEQ ID NO: 355200 - DNA, 25 bp, Mus musculus
tcacaaggaagtaatgtgatttatt

SEQ ID NO: 355201 - DNA, 25 bp, Mus musculus
tcacaaggaagtggatgatcttttc

SEQ ID NO: 355202 - DNA, 25 bp, Mus musculus
tcacaaggcagccatggaatttcat

SEQ ID NO: 355203 - DNA, 25 bp, Mus musculus
tcacaaggcaggggcaagcggatct

SEQ ID NO: 355204 - DNA, 25 bp, Mus musculus
tcacaagtcaaaggtttaacagaag

SEQ ID NO: 355205 - DNA, 25 bp, Mus musculus
tcacaagtgtgtctcaaaagattca

SEQ ID NO: 355206 - DNA, 25 bp, Mus musculus
tcacaagttgagatgaagcccgagg

SEQ ID NO: 355207 - DNA, 25 bp, Mus musculus
tcacaataaagatctgggacatagg

SEQ ID NO: 355208 - DNA, 25 bp, Mus musculus
tcacaataaaggtactagtacttgg

SEQ ID NO: 355209 - DNA, 25 bp, Mus musculus
tcacaatagggcgctctgcctcacg

SEQ ID NO: 355210 - DNA, 25 bp, Mus musculus
tcacaatagggcggctatcctacct

SEQ ID NO: 355211 - DNA, 25 bp, Mus musculus
tcacaatagggcggttatgggtgct

SEQ ID NO: 355212 - DNA, 25 bp, Mus musculus
tcacaatagggcggtttatctgagc

SEQ ID NO: 355213 - DNA, 25 bp, Mus musculus
tcacaatcaggttgactcttcacca

SEQ ID NO: 355214 - DNA, 25 bp, Mus musculus
tcacaatcctttagcagctactcca

SEQ ID NO: 355215 - DNA, 25 bp, Mus musculus
tcacaatgcagcccttttgatctct

SEQ ID NO: 355216 - DNA, 25 bp, Mus musculus
tcacaatggaggaagaacgagccat

SEQ ID NO: 355217 - DNA, 25 bp, Mus musculus
tcacaatggccaaagatgagagctg

SEQ ID NO: 355218 - DNA, 25 bp, Mus musculus
tcacaatggccagaaagaagactca

SEQ ID NO: 355219 - DNA, 25 bp, Mus musculus
tcacaatgtgatacctgactgtcag

SEQ ID NO: 355220 - DNA, 25 bp, Mus musculus
tcacaatgttgagctctctggcaag

SEQ ID NO: 355221 - DNA, 25 bp, Mus musculus
tcacaattttacgcagatagagctc

SEQ ID NO: 355222 - DNA, 25 bp, Mus musculus
tcacaattttctggactgaagggta

SEQ ID NO: 355223 - DNA, 25 bp, Mus musculus
tcacacaaagaaacaggtatgtgat

SEQ ID NO: 355224 - DNA, 25 bp, Mus musculus
tcacacaaaggtatgtgatgatatc

SEQ ID NO: 355225 - DNA, 25 bp, Mus musculus
tcacacaaagtttgctaggtattga

SEQ ID NO: 355226 - DNA, 25 bp, Mus musculus
tcacacaacccaggtggatcccact

SEQ ID NO: 355227 - DNA, 25 bp, Mus musculus
tcacacaactatgttcagcaggact

SEQ ID NO: 355228 - DNA, 25 bp, Mus musculus
tcacacaaggaggatacatctctac

SEQ ID NO: 355229 - DNA, 25 bp, Mus musculus
tcacacaagtcaatcgaaaatttcc

SEQ ID NO: 355230 - DNA, 25 bp, Mus musculus
tcacacaagtcaatcgccagctaat

SEQ ID NO: 355231 - DNA, 25 bp, Mus musculus
tcacacaagtcaatggaaaatttcc

SEQ ID NO: 355232 - DNA, 25 bp, Mus musculus
tcacacaagtcaatggccagctaat

SEQ ID NO: 355233 - DNA, 25 bp, Mus musculus
tcacacacagctttcttctgcagga

SEQ ID NO: 355234 - DNA, 25 bp, Mus musculus
tcacacacaggacacagaagaccta

SEQ ID NO: 355235 - DNA, 25 bp, Mus musculus
tcacacacagggcgtgcgcagggac

SEQ ID NO: 355236 - DNA, 25 bp, Mus musculus
tcacacacagtaaggaaatgatata

SEQ ID NO: 355237 - DNA, 25 bp, Mus musculus
tcacacacagtaaggctttaccgcc

SEQ ID NO: 355238 - DNA, 25 bp, Mus musculus
tcacacacatttaccttcagtgaac

SEQ ID NO: 355239 - DNA, 25 bp, Mus musculus
tcacacactgtgccgggtgcacaca

SEQ ID NO: 355240 - DNA, 25 bp, Mus musculus
tcacacagaacggagattatcagct

SEQ ID NO: 355241 - DNA, 25 bp, Mus musculus
tcacacagagcactggcctgaggca

SEQ ID NO: 355242 - DNA, 25 bp, Mus musculus
tcacacagatgccccactgaaactg

SEQ ID NO: 355243 - DNA, 25 bp, Mus musculus
tcacacagcagaaagtgtcaccgtg

SEQ ID NO: 355244 - DNA, 25 bp, Mus musculus
tcacacagcattaaggctcggctat

SEQ ID NO: 355245 - DNA, 25 bp, Mus musculus
tcacacagcgacatgtgagggagca

SEQ ID NO: 355246 - DNA, 25 bp, Mus musculus
tcacacagctgaaaaagtctggttt

SEQ ID NO: 355247 - DNA, 25 bp, Mus musculus
tcacacagggcgaaacaaaggtccc

SEQ ID NO: 355248 - DNA, 25 bp, Mus musculus
tcacacatcagcaggcccgggagat

SEQ ID NO: 355249 - DNA, 25 bp, Mus musculus
tcacaccaaaggagcagttcaggga

SEQ ID NO: 355250 - DNA, 25 bp, Mus musculus
tcacaccaaaggagtgccaggaggt

SEQ ID NO: 355251 - DNA, 25 bp, Mus musculus
tcacaccaagattgtttatttagtt

SEQ ID NO: 355252 - DNA, 25 bp, Mus musculus
tcacaccaagcaaaacaattgcaga

SEQ ID NO: 355253 - DNA, 25 bp, Mus musculus
tcacaccacagggctatgagaagtt

SEQ ID NO: 355254 - DNA, 25 bp, Mus musculus
tcacaccacaggtcccaggagaaac

SEQ ID NO: 355255 - DNA, 25 bp, Mus musculus
tcacaccacagttgctaagggtact

SEQ ID NO: 355256 - DNA, 25 bp, Mus musculus
tcacaccaccacgggttggatcagg

SEQ ID NO: 355257 - DNA, 25 bp, Mus musculus
tcacaccagagagctatcattgagg

SEQ ID NO: 355258 - DNA, 25 bp, Mus musculus
tcacacccatcaaggcgacctggca

SEQ ID NO: 355259 - DNA, 25 bp, Mus musculus
tcacacctaaagagcaatgcaagtg

SEQ ID NO: 355260 - DNA, 25 bp, Mus musculus
tcacacctaaagagtctgacacgta

SEQ ID NO: 355261 - DNA, 25 bp, Mus musculus
tcacacctaagatggaacagctagc

SEQ ID NO: 355262 - DNA, 25 bp, Mus musculus
tcacacctaagattgagcagctagc

SEQ ID NO: 355263 - DNA, 25 bp, Mus musculus
tcacacctgacatctggcctacaca

SEQ ID NO: 355264 - DNA, 25 bp, Mus musculus
tcacacctgcagcccggacaagtgg

SEQ ID NO: 355265 - DNA, 25 bp, Mus musculus
tcacacgcagatgaggattgagctc

SEQ ID NO: 355266 - DNA, 25 bp, Mus musculus
tcacacgcatgccaggttggcctgc

SEQ ID NO: 355267 - DNA, 25 bp, Mus musculus
tcacacgctgtgctgaatgagcaac

SEQ ID NO: 355268 - DNA, 25 bp, Mus musculus
tcacacggcaagtactgaaccttcc

SEQ ID NO: 355269 - DNA, 25 bp, Mus musculus
tcacacgtgtgcagataccccggta

SEQ ID NO: 355270 - DNA, 25 bp, Mus musculus
tcacacgtgtgcagcctttgctttt

SEQ ID NO: 355271 - DNA, 25 bp, Mus musculus
tcacacgtgtgcagttggcagatat

SEQ ID NO: 355272 - DNA, 25 bp, Mus musculus
tcacactaatcttgtaaccaccaaa

SEQ ID NO: 355273 - DNA, 25 bp, Mus musculus
tcacactattgggatggaagactgt

SEQ ID NO: 355274 - DNA, 25 bp, Mus musculus
tcacactattggtcctgagttcaat

SEQ ID NO: 355275 - DNA, 25 bp, Mus musculus
tcacactcaagaataaatttgtgga

SEQ ID NO: 355276 - DNA, 25 bp, Mus musculus
tcacactcaaggataagtttgttga

SEQ ID NO: 355277 - DNA, 25 bp, Mus musculus
tcacactcaccctcaggctctgagt

SEQ ID NO: 355278 - DNA, 25 bp, Mus musculus
tcacactcacgataaaagctggcag

SEQ ID NO: 355279 - DNA, 25 bp, Mus musculus
tcacactcactgtatgcttccactg

SEQ ID NO: 355280 - DNA, 25 bp, Mus musculus
tcacactcactgtttcttctagtat

SEQ ID NO: 355281 - DNA, 25 bp, Mus musculus
tcacactcaggggacaattcaagct

SEQ ID NO: 355282 - DNA, 25 bp, Mus musculus
tcacactccttaacactgtcatagg

SEQ ID NO: 355283 - DNA, 25 bp, Mus musculus
tcacactcgcctgagactcgtcctc

SEQ ID NO: 355284 - DNA, 25 bp, Mus musculus
tcacactcttcaaggtaaagtggat

SEQ ID NO: 355285 - DNA, 25 bp, Mus musculus
tcacactgaacaatggtttgctatc

SEQ ID NO: 355286 - DNA, 25 bp, Mus musculus
tcacactgaagctcgcactggacac

SEQ ID NO: 355287 - DNA, 25 bp, Mus musculus
tcacactgaaggccgttcctcagtt

SEQ ID NO: 355288 - DNA, 25 bp, Mus musculus
tcacactgagagcagacttctttct

SEQ ID NO: 355289 - DNA, 25 bp, Mus musculus
tcacactgagaggagacttctttct

SEQ ID NO: 355290 - DNA, 25 bp, Mus musculus
tcacactgcgagttacacttccaaa

SEQ ID NO: 355291 - DNA, 25 bp, Mus musculus
tcacactgcgggagaaagcaagaca

SEQ ID NO: 355292 - DNA, 25 bp, Mus musculus
tcacactgctttggtgcggcaagtg

SEQ ID NO: 355293 - DNA, 25 bp, Mus musculus
tcacactggccaatgactgtgaggt

SEQ ID NO: 355294 - DNA, 25 bp, Mus musculus
tcacactgtgatgtggtggaggtgg

SEQ ID NO: 355295 - DNA, 25 bp, Mus musculus
tcacacttacgaagatggctctgac

SEQ ID NO: 355296 - DNA, 25 bp, Mus musculus
tcacacttgttcagggtgacagaag

SEQ ID NO: 355297 - DNA, 25 bp, Mus musculus
tcacagaaaagaaccggcactgtct

SEQ ID NO: 355298 - DNA, 25 bp, Mus musculus
tcacagaaaagcctcatatagatct

SEQ ID NO: 355299 - DNA, 25 bp, Mus musculus
tcacagaaaagggaacagagagacc

SEQ ID NO: 355300 - DNA, 25 bp, Mus musculus
tcacagaaaataatacaatggattc

SEQ ID NO: 355301 - DNA, 25 bp, Mus musculus
tcacagaaaggtgtccacccagctg

SEQ ID NO: 355302 - DNA, 25 bp, Mus musculus
tcacagaacaagcagacttccagca

SEQ ID NO: 355303 - DNA, 25 bp, Mus musculus
tcacagaacttgacgtcagggccgt

SEQ ID NO: 355304 - DNA, 25 bp, Mus musculus
tcacagaacttgtgcaggtgttctt

SEQ ID NO: 355305 - DNA, 25 bp, Mus musculus
tcacagaagagaagagttgatacaa

SEQ ID NO: 355306 - DNA, 25 bp, Mus musculus
tcacagaagggttgactacagtcag

SEQ ID NO: 355307 - DNA, 25 bp, Mus musculus
tcacagaataattgcctgtcaccta

SEQ ID NO: 355308 - DNA, 25 bp, Mus musculus
tcacagaatagttgatctttataag

SEQ ID NO: 355309 - DNA, 25 bp, Mus musculus
tcacagaatagttggtcaaaagaag

SEQ ID NO: 355310 - DNA, 25 bp, Mus musculus
tcacagaatgatgtgagccctgtct

SEQ ID NO: 355311 - DNA, 25 bp, Mus musculus
tcacagaatgcaagtcacacaagga

SEQ ID NO: 355312 - DNA, 25 bp, Mus musculus
tcacagacaagacaggaaccctgac

SEQ ID NO: 355313 - DNA, 25 bp, Mus musculus
tcacagacagactgtcagtgttcct

SEQ ID NO: 355314 - DNA, 25 bp, Mus musculus
tcacagacatctcaggaggctgcgg

SEQ ID NO: 355315 - DNA, 25 bp, Mus musculus
tcacagacctgttagggatccttgt

SEQ ID NO: 355316 - DNA, 25 bp, Mus musculus
tcacagacttctacctggtgatgcc

SEQ ID NO: 355317 - DNA, 25 bp, Mus musculus
tcacagagcacagctgtcccagaag

SEQ ID NO: 355318 - DNA, 25 bp, Mus musculus
tcacagagcacttttaataacccac

SEQ ID NO: 355319 - DNA, 25 bp, Mus musculus
tcacagagcagaatgattggcagca

SEQ ID NO: 355320 - DNA, 25 bp, Mus musculus
tcacagagcagttttaataacccac

SEQ ID NO: 355321 - DNA, 25 bp, Mus musculus
tcacagaggaaaagattgataagta

SEQ ID NO: 355322 - DNA, 25 bp, Mus musculus
tcacagagtgcagagtaaatccctg

SEQ ID NO: 355323 - DNA, 25 bp, Mus musculus
tcacagatcaagagattggtgagct

SEQ ID NO: 355324 - DNA, 25 bp, Mus musculus
tcacagatcaagaggcctgggattg

SEQ ID NO: 355325 - DNA, 25 bp, Mus musculus
tcacagatggcctgcaatgcctctg

SEQ ID NO: 355326 - DNA, 25 bp, Mus musculus
tcacagatgtgcagcttgaaggagg

SEQ ID NO: 355327 - DNA, 25 bp, Mus musculus
tcacagcacaggaggaagcaagggc

SEQ ID NO: 355328 - DNA, 25 bp, Mus musculus
tcacagcacggtctctctgctcctt

SEQ ID NO: 355329 - DNA, 25 bp, Mus musculus
tcacagcatcaaggtggcccggcag

SEQ ID NO: 355330 - DNA, 25 bp, Mus musculus
tcacagcatgactgtgtgtccattg

SEQ ID NO: 355331 - DNA, 25 bp, Mus musculus
tcacagccaggaagtcacctgggca

SEQ ID NO: 355332 - DNA, 25 bp, Mus musculus
tcacagccatgagcctcagggctaa

SEQ ID NO: 355333 - DNA, 25 bp, Mus musculus
tcacagccccagatcacagccatga

SEQ ID NO: 355334 - DNA, 25 bp, Mus musculus
tcacagccccaggtggtgatgaagc

SEQ ID NO: 355335 - DNA, 25 bp, Mus musculus
tcacagccccagttcacagccatga

SEQ ID NO: 355336 - DNA, 25 bp, Mus musculus
tcacagcctagcctgtgtttgtgat

SEQ ID NO: 355337 - DNA, 25 bp, Mus musculus
tcacagcctcatcattacagatggt

SEQ ID NO: 355338 - DNA, 25 bp, Mus musculus
tcacagcctctccaggggaaaataa

SEQ ID NO: 355339 - DNA, 25 bp, Mus musculus
tcacagcctctccagttcctttgtc

SEQ ID NO: 355340 - DNA, 25 bp, Mus musculus
tcacagcctgtgaccatctttggag

SEQ ID NO: 355341 - DNA, 25 bp, Mus musculus
tcacagccttactggggtttggaaa

SEQ ID NO: 355342 - DNA, 25 bp, Mus musculus
tcacagctactgcgggggactcccc

SEQ ID NO: 355343 - DNA, 25 bp, Mus musculus
tcacagctctacctaggattcgagt

SEQ ID NO: 355344 - DNA, 25 bp, Mus musculus
tcacagctctaggcttttcagatgt

SEQ ID NO: 355345 - DNA, 25 bp, Mus musculus
tcacagctgccgggcccttcgacaa

SEQ ID NO: 355346 - DNA, 25 bp, Mus musculus
tcacagctgtctagtccccatggac

SEQ ID NO: 355347 - DNA, 25 bp, Mus musculus
tcacagctgttctgcccgaggacgg

SEQ ID NO: 355348 - DNA, 25 bp, Mus musculus
tcacagctttccagaattcctcaga

SEQ ID NO: 355349 - DNA, 25 bp, Mus musculus
tcacagctttccagacttacaacag

SEQ ID NO: 355350 - DNA, 25 bp, Mus musculus
tcacaggaaactggccaggtgctct

SEQ ID NO: 355351 - DNA, 25 bp, Mus musculus
tcacaggaaactggttggctgggaa

SEQ ID NO: 355352 - DNA, 25 bp, Mus musculus
tcacaggaacatcgtgactttatat

SEQ ID NO: 355353 - DNA, 25 bp, Mus musculus
tcacaggaatagatttcttatctgc

SEQ ID NO: 355354 - DNA, 25 bp, Mus musculus
tcacaggacggaaagcgaatggacc

SEQ ID NO: 355355 - DNA, 25 bp, Mus musculus
tcacaggactcaagtcctccacaga

SEQ ID NO: 355356 - DNA, 25 bp, Mus musculus
tcacaggagaacagataagccaaag

SEQ ID NO: 355357 - DNA, 25 bp, Mus musculus
tcacaggagagatagacccagtgac

SEQ ID NO: 355358 - DNA, 25 bp, Mus musculus
tcacaggataactttaaccagacac

SEQ ID NO: 355359 - DNA, 25 bp, Mus musculus
tcacaggataactttgatgtgtatg

SEQ ID NO: 355360 - DNA, 25 bp, Mus musculus
tcacaggatcagaggtcaccttccg

SEQ ID NO: 355361 - DNA, 25 bp, Mus musculus
tcacaggattcagctctgtttccta

SEQ ID NO: 355362 - DNA, 25 bp, Mus musculus
tcacaggattcaggccactaaacct

SEQ ID NO: 355363 - DNA, 25 bp, Mus musculus
tcacaggattgtggcgacaaataac

SEQ ID NO: 355364 - DNA, 25 bp, Mus musculus
tcacaggcaaacaggggcaattatt

SEQ ID NO: 355365 - DNA, 25 bp, Mus musculus
tcacaggcaaacagggtacctttca

SEQ ID NO: 355366 - DNA, 25 bp, Mus musculus
tcacaggcaagaaggagaggaatac

SEQ ID NO: 355367 - DNA, 25 bp, Mus musculus
tcacaggcaccagtcttggaggagg

SEQ ID NO: 355368 - DNA, 25 bp, Mus musculus
tcacaggcagccggggcgagaaggg

SEQ ID NO: 355369 - DNA, 25 bp, Mus musculus
tcacaggcctgcagacatttttagc

SEQ ID NO: 355370 - DNA, 25 bp, Mus musculus
tcacaggcctgcagccaggtgattt

SEQ ID NO: 355371 - DNA, 25 bp, Mus musculus
tcacagggcacccatgcatcagcat

SEQ ID NO: 355372 - DNA, 25 bp, Mus musculus
tcacagggtggcatacacagagatt

SEQ ID NO: 355373 - DNA, 25 bp, Mus musculus
tcacagggtggcatctacccagctg

SEQ ID NO: 355374 - DNA, 25 bp, Mus musculus
tcacaggtaaaaatggattagtcgt

SEQ ID NO: 355375 - DNA, 25 bp, Mus musculus
tcacaggtccagttgtactgcagcc

SEQ ID NO: 355376 - DNA, 25 bp, Mus musculus
tcacaggtgacaggttttactgcaa

SEQ ID NO: 355377 - DNA, 25 bp, Mus musculus
tcacaggtgtagcttactaccagcc

SEQ ID NO: 355378 - DNA, 25 bp, Mus musculus
tcacaggtgtagggcagaggagact

SEQ ID NO: 355379 - DNA, 25 bp, Mus musculus
tcacaggtgtaggggttgtgctggg

SEQ ID NO: 355380 - DNA, 25 bp, Mus musculus
tcacagtaccgtcacctccaagtaa

SEQ ID NO: 355381 - DNA, 25 bp, Mus musculus
tcacagtctcagaaaccattgaatc

SEQ ID NO: 355382 - DNA, 25 bp, Mus musculus
tcacagtctcagccacagagaacca

SEQ ID NO: 355383 - DNA, 25 bp, Mus musculus
tcacagtctcctcagagagtcagtc

SEQ ID NO: 355384 - DNA, 25 bp, Mus musculus
tcacagtctcctcagagtctgcgag

SEQ ID NO: 355385 - DNA, 25 bp, Mus musculus
tcacagtctcctcagccaaaacaac

SEQ ID NO: 355386 - DNA, 25 bp, Mus musculus
tcacagtctcctcagccaaaacgac

SEQ ID NO: 355387 - DNA, 25 bp, Mus musculus
tcacagtctcctcagctacaacaac

SEQ ID NO: 355388 - DNA, 25 bp, Mus musculus
tcacagtctctgcccttcaggatga

SEQ ID NO: 355389 - DNA, 25 bp, Mus musculus
tcacagtgaatcagcctcaccttca

SEQ ID NO: 355390 - DNA, 25 bp, Mus musculus
tcacagtgacagggcccaatgtaaa

SEQ ID NO: 355391 - DNA, 25 bp, Mus musculus
tcacagtgatagaatgcctgaatct

SEQ ID NO: 355392 - DNA, 25 bp, Mus musculus
tcacagtgatgagaattttaaatgc

SEQ ID NO: 355393 - DNA, 25 bp, Mus musculus
tcacagtgccattaggttttcttaa

SEQ ID NO: 355394 - DNA, 25 bp, Mus musculus
tcacagtgcctggacaggtcctgga

SEQ ID NO: 355395 - DNA, 25 bp, Mus musculus
tcacagtgcctggtgtcgaggaggc

SEQ ID NO: 355396 - DNA, 25 bp, Mus musculus
tcacagtggagatgaatctggctac

SEQ ID NO: 355397 - DNA, 25 bp, Mus musculus
tcacagtggataaatagatgcccgt

SEQ ID NO: 355398 - DNA, 25 bp, Mus musculus
tcacagtgtcccaggtccctgtggc

SEQ ID NO: 355399 - DNA, 25 bp, Mus musculus
tcacagtgtcccaggtctctaactg

SEQ ID NO: 355400 - DNA, 25 bp, Mus musculus
tcacagtgtggttgatgacattaat

SEQ ID NO: 355401 - DNA, 25 bp, Mus musculus
tcacagttgtagaggatctgagaaa

SEQ ID NO: 355402 - DNA, 25 bp, Mus musculus
tcacagttgtctacgtcacagagct

SEQ ID NO: 355403 - DNA, 25 bp, Mus musculus
tcacagtttaggaactggtatgtgg

SEQ ID NO: 355404 - DNA, 25 bp, Mus musculus
tcacagtttagtggctgacctactg

SEQ ID NO: 355405 - DNA, 25 bp, Mus musculus
tcacataaaggctgaaggtgaagac

SEQ ID NO: 355406 - DNA, 25 bp, Mus musculus
tcacatacacgatattgatgagtgc

SEQ ID NO: 355407 - DNA, 25 bp, Mus musculus
tcacatacacgcaatgcaccgatgg

SEQ ID NO: 355408 - DNA, 25 bp, Mus musculus
tcacatacactgatcatagaactca

SEQ ID NO: 355409 - DNA, 25 bp, Mus musculus
tcacatacaggagcgacagttttga

SEQ ID NO: 355410 - DNA, 25 bp, Mus musculus
tcacataccacacagcaaggggacg

SEQ ID NO: 355411 - DNA, 25 bp, Mus musculus
tcacataccacacagcaagggggaa

SEQ ID NO: 355412 - DNA, 25 bp, Mus musculus
tcacataccaggggctgcgatggac

SEQ ID NO: 355413 - DNA, 25 bp, Mus musculus
tcacatactggctacccaggcggct

SEQ ID NO: 355414 - DNA, 25 bp, Mus musculus
tcacataggctatgggcacgtgcgg

SEQ ID NO: 355415 - DNA, 25 bp, Mus musculus
tcacatatacgcagtactccggagg

SEQ ID NO: 355416 - DNA, 25 bp, Mus musculus
tcacatattgaaaagagagccaagc

SEQ ID NO: 355417 - DNA, 25 bp, Mus musculus
tcacatattgaaaaggcggcaaagt

SEQ ID NO: 355418 - DNA, 25 bp, Mus musculus
tcacatcagcaggaacgtcatccat

SEQ ID NO: 355419 - DNA, 25 bp, Mus musculus
tcacatcagcagtgcctgcagaagc

SEQ ID NO: 355420 - DNA, 25 bp, Mus musculus
tcacatcatgaagtgtgatctgggc

SEQ ID NO: 355421 - DNA, 25 bp, Mus musculus
tcacatccagggtaaagccccaaag

SEQ ID NO: 355422 - DNA, 25 bp, Mus musculus
tcacatccaggtaaccgagaagggt

SEQ ID NO: 355423 - DNA, 25 bp, Mus musculus
tcacatccatggaaagaaaggagag

SEQ ID NO: 355424 - DNA, 25 bp, Mus musculus
tcacatccatggtcctattaaactt

SEQ ID NO: 355425 - DNA, 25 bp, Mus musculus
tcacatccgtcctgcctctgcctct

SEQ ID NO: 355426 - DNA, 25 bp, Mus musculus
tcacatcctgtgtggaccagcagag

SEQ ID NO: 355427 - DNA, 25 bp, Mus musculus
tcacatcgagaaagcctttgagtca

SEQ ID NO: 355428 - DNA, 25 bp, Mus musculus
tcacatcgagctggagtacctcacc

SEQ ID NO: 355429 - DNA, 25 bp, Mus musculus
tcacatctcacagactgtggatatt

SEQ ID NO: 355430 - DNA, 25 bp, Mus musculus
tcacatgaaggggcctctgctgtgg

SEQ ID NO: 355431 - DNA, 25 bp, Mus musculus
tcacatgaccagtgatcggcgccag

SEQ ID NO: 355432 - DNA, 25 bp, Mus musculus
tcacatgaccagtggaaatgatgta

SEQ ID NO: 355433 - DNA, 25 bp, Mus musculus
tcacatgaccagtgtcgttaggaga

SEQ ID NO: 355434 - DNA, 25 bp, Mus musculus
tcacatgagccaggacgacctggcg

SEQ ID NO: 355435 - DNA, 25 bp, Mus musculus
tcacatgaggcgtgggcttcgggac

SEQ ID NO: 355436 - DNA, 25 bp, Mus musculus
tcacatgagttgtgcctgccgacat

SEQ ID NO: 355437 - DNA, 25 bp, Mus musculus
tcacatgcagatgacctagagctcg

SEQ ID NO: 355438 - DNA, 25 bp, Mus musculus
tcacatgcagatgagctcggatttc

SEQ ID NO: 355439 - DNA, 25 bp, Mus musculus
tcacatgcagatgatcgagtgcttc

SEQ ID NO: 355440 - DNA, 25 bp, Mus musculus
tcacatgcaggatccaaaccaagct

SEQ ID NO: 355441 - DNA, 25 bp, Mus musculus
tcacatgctaggtggagagagccag

SEQ ID NO: 355442 - DNA, 25 bp, Mus musculus
tcacatggagaaactgctgtcattc

SEQ ID NO: 355443 - DNA, 25 bp, Mus musculus
tcacatggatgaaaaaaaggacctg

SEQ ID NO: 355444 - DNA, 25 bp, Mus musculus
tcacatggatggtgttctcgggaca

SEQ ID NO: 355445 - DNA, 25 bp, Mus musculus
tcacatggctgctgccacaggtgac

SEQ ID NO: 355446 - DNA, 25 bp, Mus musculus
tcacatggtgcagtggtggagcaaa

SEQ ID NO: 355447 - DNA, 25 bp, Mus musculus
tcacatgtatgtctctgcccttcca

SEQ ID NO: 355448 - DNA, 25 bp, Mus musculus
tcacatgttcttggcattgggagag

SEQ ID NO: 355449 - DNA, 25 bp, Mus musculus
tcacattaaagtttcactagaagaa

SEQ ID NO: 355450 - DNA, 25 bp, Mus musculus
tcacattaccccggagcgagcccat

SEQ ID NO: 355451 - DNA, 25 bp, Mus musculus
tcacattcagctatcacgtatggac

SEQ ID NO: 355452 - DNA, 25 bp, Mus musculus
tcacattcaggcacaccaagatgaa

SEQ ID NO: 355453 - DNA, 25 bp, Mus musculus
tcacattcaggtatcacgtatggac

SEQ ID NO: 355454 - DNA, 25 bp, Mus musculus
tcacattcataaaggtcagaaggct

SEQ ID NO: 355455 - DNA, 25 bp, Mus musculus
tcacattcataaaggtctagagggc

SEQ ID NO: 355456 - DNA, 25 bp, Mus musculus
tcacattcatttagaaactccccaa

SEQ ID NO: 355457 - DNA, 25 bp, Mus musculus
tcacattcatttagtatccgctcca

SEQ ID NO: 355458 - DNA, 25 bp, Mus musculus
tcacattctacagggtcacagacag

SEQ ID NO: 355459 - DNA, 25 bp, Mus musculus
tcacattgatgagaaaaagaaatcc

SEQ ID NO: 355460 - DNA, 25 bp, Mus musculus
tcacattgatgagtatgcacctgag

SEQ ID NO: 355461 - DNA, 25 bp, Mus musculus
tcacattgtcagatctcagggcagt

SEQ ID NO: 355462 - DNA, 25 bp, Mus musculus
tcacattgtcagatgtccattcagc

SEQ ID NO: 355463 - DNA, 25 bp, Mus musculus
tcacatttcaagttcatggcatctc

SEQ ID NO: 355464 - DNA, 25 bp, Mus musculus
tcacatttgggtcttctaattgtca

SEQ ID NO: 355465 - DNA, 25 bp, Mus musculus
tcaccaaaaagggaactacaagaat

SEQ ID NO: 355466 - DNA, 25 bp, Mus musculus
tcaccaaacagacaccaactttttg

SEQ ID NO: 355467 - DNA, 25 bp, Mus musculus
tcaccaacctgcagatggcagcagt

SEQ ID NO: 355468 - DNA, 25 bp, Mus musculus
tcaccaacctgcagatggcagctca

SEQ ID NO: 355469 - DNA, 25 bp, Mus musculus
tcaccaactcagctctctgctctct

SEQ ID NO: 355470 - DNA, 25 bp, Mus musculus
tcaccaactccacagaccctgctca

SEQ ID NO: 355471 - DNA, 25 bp, Mus musculus
tcaccaactccacaggatctttgga

SEQ ID NO: 355472 - DNA, 25 bp, Mus musculus
tcaccaactccgcggatgtggtgga

SEQ ID NO: 355473 - DNA, 25 bp, Mus musculus
tcaccaactccgcgggctcagggac

SEQ ID NO: 355474 - DNA, 25 bp, Mus musculus
tcaccaactccgcgtctcttacatc

SEQ ID NO: 355475 - DNA, 25 bp, Mus musculus
tcaccaacttctcagatttactgaa

SEQ ID NO: 355476 - DNA, 25 bp, Mus musculus
tcaccaacttctcaggggcagattt

SEQ ID NO: 355477 - DNA, 25 bp, Mus musculus
tcaccaactttccaagattaccttc

SEQ ID NO: 355478 - DNA, 25 bp, Mus musculus
tcaccaagacacacccgcagtggta

SEQ ID NO: 355479 - DNA, 25 bp, Mus musculus
tcaccaagacacaggggaagtccct

SEQ ID NO: 355480 - DNA, 25 bp, Mus musculus
tcaccaagaccccaggccagcgctc

SEQ ID NO: 355481 - DNA, 25 bp, Mus musculus
tcaccaagagagcaggtgtaaaaga

SEQ ID NO: 355482 - DNA, 25 bp, Mus musculus
tcaccaagatatcgactgatatctt

SEQ ID NO: 355483 - DNA, 25 bp, Mus musculus
tcaccaagatctcggtggatatgtt

SEQ ID NO: 355484 - DNA, 25 bp, Mus musculus
tcaccaagccacagcaatgtggggc

SEQ ID NO: 355485 - DNA, 25 bp, Mus musculus
tcaccaagccacaggatggtgacat

SEQ ID NO: 355486 - DNA, 25 bp, Mus musculus
tcaccaagccaggatcctgtcccca

SEQ ID NO: 355487 - DNA, 25 bp, Mus musculus
tcaccaagccaggtggacttgtttg

SEQ ID NO: 355488 - DNA, 25 bp, Mus musculus
tcaccaagcgggtcaaaaatgctgc

SEQ ID NO: 355489 - DNA, 25 bp, Mus musculus
tcaccaagctgctgtccagagtcag

SEQ ID NO: 355490 - DNA, 25 bp, Mus musculus
tcaccaaggccagcttttcctagat

SEQ ID NO: 355491 - DNA, 25 bp, Mus musculus
tcaccaagtccatgaagccatgtat

SEQ ID NO: 355492 - DNA, 25 bp, Mus musculus
tcaccaagtccatgagtttaagatc

SEQ ID NO: 355493 - DNA, 25 bp, Mus musculus
tcaccaagtccatgattctgtaacc

SEQ ID NO: 355494 - DNA, 25 bp, Mus musculus
tcaccaagtccatgcaacagggagc

SEQ ID NO: 355495 - DNA, 25 bp, Mus musculus
tcaccaagtgcaatgaaattgaatc

SEQ ID NO: 355496 - DNA, 25 bp, Mus musculus
tcaccaataaagcccacagaagctg

SEQ ID NO: 355497 - DNA, 25 bp, Mus musculus
tcaccaataaaggcaaatcctcctc

SEQ ID NO: 355498 - DNA, 25 bp, Mus musculus
tcaccaatcttgatcgcagtaagag

SEQ ID NO: 355499 - DNA, 25 bp, Mus musculus
tcaccacacagacagaggagctgaa

SEQ ID NO: 355500 - DNA, 25 bp, Mus musculus
tcaccacacagacagaggagttgaa

SEQ ID NO: 355501 - DNA, 25 bp, Mus musculus
tcaccacacaggtatcagtgagcaa

SEQ ID NO: 355502 - DNA, 25 bp, Mus musculus
tcaccacacagtcttaggcaacccc

SEQ ID NO: 355503 - DNA, 25 bp, Mus musculus
tcaccacacctcagcagggacctct

SEQ ID NO: 355504 - DNA, 25 bp, Mus musculus
tcaccacactgctccgcaggaggct

SEQ ID NO: 355505 - DNA, 25 bp, Mus musculus
tcaccacagacagatgccctttgaa

SEQ ID NO: 355506 - DNA, 25 bp, Mus musculus
tcaccacagctgcagcaggagcaac

SEQ ID NO: 355507 - DNA, 25 bp, Mus musculus
tcaccacagctgcaggtaaaaataa

SEQ ID NO: 355508 - DNA, 25 bp, Mus musculus
tcaccaccaaaggggagcgaggaca

SEQ ID NO: 355509 - DNA, 25 bp, Mus musculus
tcaccaccaaggaaaagttgtatgg

SEQ ID NO: 355510 - DNA, 25 bp, Mus musculus
tcaccaccaagggaacttaatacag

SEQ ID NO: 355511 - DNA, 25 bp, Mus musculus
tcaccaccacagcaggcactacaga

SEQ ID NO: 355512 - DNA, 25 bp, Mus musculus
tcaccaccacataagattgtctcat

SEQ ID NO: 355513 - DNA, 25 bp, Mus musculus
tcaccaccaccagagagtcggctct

SEQ ID NO: 355514 - DNA, 25 bp, Mus musculus
tcaccaccatcatttttgatgactt

SEQ ID NO: 355515 - DNA, 25 bp, Mus musculus
tcaccaccatcggctatggtcatgc

SEQ ID NO: 355516 - DNA, 25 bp, Mus musculus
tcaccacccagaaggaatacacaga

SEQ ID NO: 355517 - DNA, 25 bp, Mus musculus
tcaccacccaggcctcccaagacca

SEQ ID NO: 355518 - DNA, 25 bp, Mus musculus
tcaccaccccttgggggctcgctcc

SEQ ID NO: 355519 - DNA, 25 bp, Mus musculus
tcaccaccctgaggcaaagaaatgt

SEQ ID NO: 355520 - DNA, 25 bp, Mus musculus
tcaccaccctgagtccagacagaag

SEQ ID NO: 355521 - DNA, 25 bp, Mus musculus
tcaccacgaaaatctccttcgggct

SEQ ID NO: 355522 - DNA, 25 bp, Mus musculus
tcaccacgtagagagttccctcagt

SEQ ID NO: 355523 - DNA, 25 bp, Mus musculus
tcaccactaacgactctgacaccac

SEQ ID NO: 355524 - DNA, 25 bp, Mus musculus
tcaccactaacgggactcagaagaa

SEQ ID NO: 355525 - DNA, 25 bp, Mus musculus
tcaccactcgcagaggaccgccttc

SEQ ID NO: 355526 - DNA, 25 bp, Mus musculus
tcaccactgtccgccgggagcagca

SEQ ID NO: 355527 - DNA, 25 bp, Mus musculus
tcaccacttgagctcctggccagtt

SEQ ID NO: 355528 - DNA, 25 bp, Mus musculus
tcaccacttggtgaacagtgagtcc

SEQ ID NO: 355529 - DNA, 25 bp, Mus musculus
tcaccacttttgatcttgattctga

SEQ ID NO: 355530 - DNA, 25 bp, Mus musculus
tcaccagaaactatggtggccctgt

SEQ ID NO: 355531 - DNA, 25 bp, Mus musculus
tcaccagaaccaggttatgtagtaa

SEQ ID NO: 355532 - DNA, 25 bp, Mus musculus
tcaccagaagacaagactggcaggc

SEQ ID NO: 355533 - DNA, 25 bp, Mus musculus
tcaccagacagaacttctgtgggaa

SEQ ID NO: 355534 - DNA, 25 bp, Mus musculus
tcaccagacagggcacgttctcagc

SEQ ID NO: 355535 - DNA, 25 bp, Mus musculus
tcaccagagaatagccatgatgctg

SEQ ID NO: 355536 - DNA, 25 bp, Mus musculus
tcaccagagaatgtgcccacagacc

SEQ ID NO: 355537 - DNA, 25 bp, Mus musculus
tcaccagagcaagaaaattgtgcaa

SEQ ID NO: 355538 - DNA, 25 bp, Mus musculus
tcaccagagcaagatatggcgtgat

SEQ ID NO: 355539 - DNA, 25 bp, Mus musculus
tcaccagatgtgtcggtgtcccgat

SEQ ID NO: 355540 - DNA, 25 bp, Mus musculus
tcaccagatgtgtcgtaacatatcg

SEQ ID NO: 355541 - DNA, 25 bp, Mus musculus
tcaccagatgttcagccagtatccg

SEQ ID NO: 355542 - DNA, 25 bp, Mus musculus
tcaccagcagtgcccggggtctgga

SEQ ID NO: 355543 - DNA, 25 bp, Mus musculus
tcaccagccaccatcgagacacaga

SEQ ID NO: 355544 - DNA, 25 bp, Mus musculus
tcaccagccagtgtggggcaggcat

SEQ ID NO: 355545 - DNA, 25 bp, Mus musculus
tcaccagcccgaggacaagaaaaga

SEQ ID NO: 355546 - DNA, 25 bp, Mus musculus
tcaccagcccgtaagtttggtgagc

SEQ ID NO: 355547 - DNA, 25 bp, Mus musculus
tcaccagcgcgaaggtgatgctaga

SEQ ID NO: 355548 - DNA, 25 bp, Mus musculus
tcaccagctgacagaaccagcagat

SEQ ID NO: 355549 - DNA, 25 bp, Mus musculus
tcaccagcttcagtaaagagggctg

SEQ ID NO: 355550 - DNA, 25 bp, Mus musculus
tcaccagcttcagtgaatggaactc

SEQ ID NO: 355551 - DNA, 25 bp, Mus musculus
tcaccagctttttgctgccccttac

SEQ ID NO: 355552 - DNA, 25 bp, Mus musculus
tcaccaggactcaaatattctcctt

SEQ ID NO: 355553 - DNA, 25 bp, Mus musculus
tcaccaggagctcggacggcgccca

SEQ ID NO: 355554 - DNA, 25 bp, Mus musculus
tcaccaggagctctcctcccaagga

SEQ ID NO: 355555 - DNA, 25 bp, Mus musculus
tcaccaggagctggaatttggagtg

SEQ ID NO: 355556 - DNA, 25 bp, Mus musculus
tcaccaggagtatgcttgagagttc

SEQ ID NO: 355557 - DNA, 25 bp, Mus musculus
tcaccaggatcccctcctgtgcccc

SEQ ID NO: 355558 - DNA, 25 bp, Mus musculus
tcaccaggatcccctggcctcgctg

SEQ ID NO: 355559 - DNA, 25 bp, Mus musculus
tcaccaggcaggcagtacaggccag

SEQ ID NO: 355560 - DNA, 25 bp, Mus musculus
tcaccaggcaggtaagcttcaagct

SEQ ID NO: 355561 - DNA, 25 bp, Mus musculus
tcaccaggcagttgcccatggaggc

SEQ ID NO: 355562 - DNA, 25 bp, Mus musculus
tcaccaggtggagagcatatccgag

SEQ ID NO: 355563 - DNA, 25 bp, Mus musculus
tcaccaggtggagataagtcattgt

SEQ ID NO: 355564 - DNA, 25 bp, Mus musculus
tcaccaggtgtttcagggctaccag

SEQ ID NO: 355565 - DNA, 25 bp, Mus musculus
tcaccagtatgggagtcaagctgtg

SEQ ID NO: 355566 - DNA, 25 bp, Mus musculus
tcaccagtgaggagattccccccct

SEQ ID NO: 355567 - DNA, 25 bp, Mus musculus
tcaccagtgcacggtgatatttttg

SEQ ID NO: 355568 - DNA, 25 bp, Mus musculus
tcaccagttcgagggggctgaagaa

SEQ ID NO: 355569 - DNA, 25 bp, Mus musculus
tcaccagtttgggctcaagagtgtc

SEQ ID NO: 355570 - DNA, 25 bp, Mus musculus
tcaccatagccatgctttctggcat

SEQ ID NO: 355571 - DNA, 25 bp, Mus musculus
tcaccatcaatgagatcagtgaaat

SEQ ID NO: 355572 - DNA, 25 bp, Mus musculus
tcaccatcacacagcctcggcccac

SEQ ID NO: 355573 - DNA, 25 bp, Mus musculus
tcaccatcatccgggccatccgaac

SEQ ID NO: 355574 - DNA, 25 bp, Mus musculus
tcaccatccatagtgaccatgaggg

SEQ ID NO: 355575 - DNA, 25 bp, Mus musculus
tcaccatccccaaagatggacaaaa

SEQ ID NO: 355576 - DNA, 25 bp, Mus musculus
tcaccatcctggtatccgtggtcac

SEQ ID NO: 355577 - DNA, 25 bp, Mus musculus
tcaccatgagagggtgtggaccgtg

SEQ ID NO: 355578 - DNA, 25 bp, Mus musculus
tcaccatgagttcaaagaaaatccc

SEQ ID NO: 355579 - DNA, 25 bp, Mus musculus
tcaccatgatctgtgccattgccag

SEQ ID NO: 355580 - DNA, 25 bp, Mus musculus
tcaccatgatgcatatcttcctcct

SEQ ID NO: 355581 - DNA, 25 bp, Mus musculus
tcaccatgcccctggctagagatct

SEQ ID NO: 355582 - DNA, 25 bp, Mus musculus
tcaccatggcagaacctgcaactgc

SEQ ID NO: 355583 - DNA, 25 bp, Mus musculus
tcaccatgggaaggatcatgcgtcc

SEQ ID NO: 355584 - DNA, 25 bp, Mus musculus
tcaccattaaggactctgcaggact

SEQ ID NO: 355585 - DNA, 25 bp, Mus musculus
tcaccattaaggactgcaggctgtc

SEQ ID NO: 355586 - DNA, 25 bp, Mus musculus
tcaccattaaggacttcctgaagac

SEQ ID NO: 355587 - DNA, 25 bp, Mus musculus
tcaccattagacaagccctgacgtc

SEQ ID NO: 355588 - DNA, 25 bp, Mus musculus
tcaccattgctggggtggagaccat

SEQ ID NO: 355589 - DNA, 25 bp, Mus musculus
tcaccattgctggtcaacgtcctgc

SEQ ID NO: 355590 - DNA, 25 bp, Mus musculus
tcaccattggcaagggcacagtcag

SEQ ID NO: 355591 - DNA, 25 bp, Mus musculus
tcaccattggggctgtgcatttggg

SEQ ID NO: 355592 - DNA, 25 bp, Mus musculus
tcaccattgggttcacaggctgtgc

SEQ ID NO: 355593 - DNA, 25 bp, Mus musculus
tcaccatttgcagaggcaggcaggt

SEQ ID NO: 355594 - DNA, 25 bp, Mus musculus
tcacccaaacatagtgaagttgttc

SEQ ID NO: 355595 - DNA, 25 bp, Mus musculus
tcacccaaacattatagccagtgat

SEQ ID NO: 355596 - DNA, 25 bp, Mus musculus
tcacccaagagcagagagatcatct

SEQ ID NO: 355597 - DNA, 25 bp, Mus musculus
tcacccaataggcaactccgaagat

SEQ ID NO: 355598 - DNA, 25 bp, Mus musculus
tcacccacaaggtggagaaatgggg

SEQ ID NO: 355599 - DNA, 25 bp, Mus musculus
tcacccacagagtgctgacctagct

SEQ ID NO: 355600 - DNA, 25 bp, Mus musculus
tcacccacgtctcttcaacagactc

SEQ ID NO: 355601 - DNA, 25 bp, Mus musculus
tcacccacttactggtgcccggcgc

SEQ ID NO: 355602 - DNA, 25 bp, Mus musculus
tcacccagacaagggaggatctcct

SEQ ID NO: 355603 - DNA, 25 bp, Mus musculus
tcacccagacaagggccctctggtg

SEQ ID NO: 355604 - DNA, 25 bp, Mus musculus
tcacccagacctggagcctgttctg

SEQ ID NO: 355605 - DNA, 25 bp, Mus musculus
tcacccagagcttgtcaatgtccca

SEQ ID NO: 355606 - DNA, 25 bp, Mus musculus
tcacccagcagcaccctcagcgcca

SEQ ID NO: 355607 - DNA, 25 bp, Mus musculus
tcacccagccatgcctatggaggcc

SEQ ID NO: 355608 - DNA, 25 bp, Mus musculus
tcacccagccatgctatcccaatag

SEQ ID NO: 355609 - DNA, 25 bp, Mus musculus
tcacccaggaatatattccaatgca

SEQ ID NO: 355610 - DNA, 25 bp, Mus musculus
tcacccaggaatattggcagtgctg

SEQ ID NO: 355611 - DNA, 25 bp, Mus musculus
tcacccaggagatcttcagaacaaa

SEQ ID NO: 355612 - DNA, 25 bp, Mus musculus
tcacccaggagatggagttccagaa

SEQ ID NO: 355613 - DNA, 25 bp, Mus musculus
tcacccaggctgccggaaccagctg

SEQ ID NO: 355614 - DNA, 25 bp, Mus musculus
tcacccatggaagacaaagtctgga

SEQ ID NO: 355615 - DNA, 25 bp, Mus musculus
tcacccatggaagcaccccccattg

SEQ ID NO: 355616 - DNA, 25 bp, Mus musculus
tcaccccaagatgctttgtgacgac

SEQ ID NO: 355617 - DNA, 25 bp, Mus musculus
tcaccccaatagagataatgcaggg

SEQ ID NO: 355618 - DNA, 25 bp, Mus musculus
tcaccccaatagagatggcttgcca

SEQ ID NO: 355619 - DNA, 25 bp, Mus musculus
tcaccccacagctgaacaatgtggg

SEQ ID NO: 355620 - DNA, 25 bp, Mus musculus
tcaccccacaggtgcgactggacct

SEQ ID NO: 355621 - DNA, 25 bp, Mus musculus
tcaccccagaagagggctacagggg

SEQ ID NO: 355622 - DNA, 25 bp, Mus musculus
tcaccccagaagagtttgtggcagc

SEQ ID NO: 355623 - DNA, 25 bp, Mus musculus
tcaccccagaggtgtggccaaacgt

SEQ ID NO: 355624 - DNA, 25 bp, Mus musculus
tcaccccatcggtgtagcccggatc

SEQ ID NO: 355625 - DNA, 25 bp, Mus musculus
tcacccccaagaccagtgacagtgg

SEQ ID NO: 355626 - DNA, 25 bp, Mus musculus
tcacccccaagaccatgtgtgccga

SEQ ID NO: 355627 - DNA, 25 bp, Mus musculus
tcacccccagcccagccaagcggct

SEQ ID NO: 355628 - DNA, 25 bp, Mus musculus
tcacccccagctccaaccctcttgc

SEQ ID NO: 355629 - DNA, 25 bp, Mus musculus
tcacccccaggagttcaactagatg

SEQ ID NO: 355630 - DNA, 25 bp, Mus musculus
tcaccccccatggcttttcaagatc

SEQ ID NO: 355631 - DNA, 25 bp, Mus musculus
tcaccccgcttccgagcctcgattg

SEQ ID NO: 355632 - DNA, 25 bp, Mus musculus
tcaccccggtccctccgagccatct

SEQ ID NO: 355633 - DNA, 25 bp, Mus musculus
tcaccccgtgacgctgcggatttat

SEQ ID NO: 355634 - DNA, 25 bp, Mus musculus
tcacccctatctgagctgctgttgc

SEQ ID NO: 355635 - DNA, 25 bp, Mus musculus
tcacccctctccatatcgctgtatt

SEQ ID NO: 355636 - DNA, 25 bp, Mus musculus
tcacccctggccctgaaggcagccc

SEQ ID NO: 355637 - DNA, 25 bp, Mus musculus
tcacccctgtatatcaacctgaatt

SEQ ID NO: 355638 - DNA, 25 bp, Mus musculus
tcacccgagacgtgatcgtccgcgc

SEQ ID NO: 355639 - DNA, 25 bp, Mus musculus
tcacccgagtcccctgagggatctg

SEQ ID NO: 355640 - DNA, 25 bp, Mus musculus
tcacccgcaaatgtcagcaattgag

SEQ ID NO: 355641 - DNA, 25 bp, Mus musculus
tcacccgcaattcccactacctgac

SEQ ID NO: 355642 - DNA, 25 bp, Mus musculus
tcacccggaacaaggatgtatttat

SEQ ID NO: 355643 - DNA, 25 bp, Mus musculus
tcacccggaacaaggtcctacatct

SEQ ID NO: 355644 - DNA, 25 bp, Mus musculus
tcacccggaaggccctcaatgacat

SEQ ID NO: 355645 - DNA, 25 bp, Mus musculus
tcacccggactcagatcatctttag

SEQ ID NO: 355646 - DNA, 25 bp, Mus musculus
tcacccggaggtttcagaaagtggg

SEQ ID NO: 355647 - DNA, 25 bp, Mus musculus
tcacccgtcctgaggagatcatctt

SEQ ID NO: 355648 - DNA, 25 bp, Mus musculus
tcaccctaatatgaggaactgtact

SEQ ID NO: 355649 - DNA, 25 bp, Mus musculus
tcaccctaccctaagaacacagatc

SEQ ID NO: 355650 - DNA, 25 bp, Mus musculus
tcaccctcacagaacatctaactag

SEQ ID NO: 355651 - DNA, 25 bp, Mus musculus
tcaccctcagaagacccccgtcaga

SEQ ID NO: 355652 - DNA, 25 bp, Mus musculus
tcaccctcagaggagctggactaca

SEQ ID NO: 355653 - DNA, 25 bp, Mus musculus
tcaccctcaggaggagaatgaaatg

SEQ ID NO: 355654 - DNA, 25 bp, Mus musculus
tcaccctcagtttgtgcttgtcctt

SEQ ID NO: 355655 - DNA, 25 bp, Mus musculus
tcaccctcatgcctggtggggcagt

SEQ ID NO: 355656 - DNA, 25 bp, Mus musculus
tcaccctccgcaagtgtccattgtg

SEQ ID NO: 355657 - DNA, 25 bp, Mus musculus
tcaccctgacctgcaactcctcact

SEQ ID NO: 355658 - DNA, 25 bp, Mus musculus
tcaccctggacagccccggcagccc

SEQ ID NO: 355659 - DNA, 25 bp, Mus musculus
tcaccctggagacgactctagagaa

SEQ ID NO: 355660 - DNA, 25 bp, Mus musculus
tcaccctggatctggtcttctaggg

SEQ ID NO: 355661 - DNA, 25 bp, Mus musculus
tcaccctgtaaaagatttctaacga

SEQ ID NO: 355662 - DNA, 25 bp, Mus musculus
tcaccctgtctggaaagaaatgatg

SEQ ID NO: 355663 - DNA, 25 bp, Mus musculus
tcaccctgtgcacctctcctcttgt

SEQ ID NO: 355664 - DNA, 25 bp, Mus musculus
tcacccttacccagatgaggctctg

SEQ ID NO: 355665 - DNA, 25 bp, Mus musculus
tcacccttacccagcccagagcccg

SEQ ID NO: 355666 - DNA, 25 bp, Mus musculus
tcacccttccctgagacaatgtcta

SEQ ID NO: 355667 - DNA, 25 bp, Mus musculus
tcacccttccctggaaaatctggat

SEQ ID NO: 355668 - DNA, 25 bp, Mus musculus
tcacccttcttagtatcctttagcc

SEQ ID NO: 355669 - DNA, 25 bp, Mus musculus
tcacccttcttagtgggtcctgtgt

SEQ ID NO: 355670 - DNA, 25 bp, Mus musculus
tcacccttgcagcatacgaaggaca

SEQ ID NO: 355671 - DNA, 25 bp, Mus musculus
tcaccctttgggaagcgcctgctga

SEQ ID NO: 355672 - DNA, 25 bp, Mus musculus
tcaccgaaaagaggactaggaaaag

SEQ ID NO: 355673 - DNA, 25 bp, Mus musculus
tcaccgactcagacagagtctttct

SEQ ID NO: 355674 - DNA, 25 bp, Mus musculus
tcaccgactcagctgactcaagaga

SEQ ID NO: 355675 - DNA, 25 bp, Mus musculus
tcaccgagaggcttcattaacaaaa

SEQ ID NO: 355676 - DNA, 25 bp, Mus musculus
tcaccgaggtaagaaatggcgctca

SEQ ID NO: 355677 - DNA, 25 bp, Mus musculus
tcaccgagtgatagggtaaaattta

SEQ ID NO: 355678 - DNA, 25 bp, Mus musculus
tcaccgatcagaaacctgatatctc

SEQ ID NO: 355679 - DNA, 25 bp, Mus musculus
tcaccgatcaggacaacatccacgc

SEQ ID NO: 355680 - DNA, 25 bp, Mus musculus
tcaccgcacagacaccaagtggact

SEQ ID NO: 355681 - DNA, 25 bp, Mus musculus
tcaccgcacggaatgacatcactcc

SEQ ID NO: 355682 - DNA, 25 bp, Mus musculus
tcaccgcactgattttggctctggg

SEQ ID NO: 355683 - DNA, 25 bp, Mus musculus
tcaccgcactgcttcaggaccccag

SEQ ID NO: 355684 - DNA, 25 bp, Mus musculus
tcaccgccagaaagacagggtttca

SEQ ID NO: 355685 - DNA, 25 bp, Mus musculus
tcaccgccagaaaggaacacccctg

SEQ ID NO: 355686 - DNA, 25 bp, Mus musculus
tcaccgccataaaaagatgcaggag

SEQ ID NO: 355687 - DNA, 25 bp, Mus musculus
tcaccgcggtgggtgatgtcttccc

SEQ ID NO: 355688 - DNA, 25 bp, Mus musculus
tcaccgctcgaggtggccaggcaga

SEQ ID NO: 355689 - DNA, 25 bp, Mus musculus
tcaccgctcggctctgggtgctcta

SEQ ID NO: 355690 - DNA, 25 bp, Mus musculus
tcaccgctcgggcctgtgctctcta

SEQ ID NO: 355691 - DNA, 25 bp, Mus musculus
tcaccgctctccctacagccttgca

SEQ ID NO: 355692 - DNA, 25 bp, Mus musculus
tcaccgcttcatgtttctctgccga

SEQ ID NO: 355693 - DNA, 25 bp, Mus musculus
tcaccggcaaggtgatgcttcttgg

SEQ ID NO: 355694 - DNA, 25 bp, Mus musculus
tcaccggcagaggctgaaggcggca

SEQ ID NO: 355695 - DNA, 25 bp, Mus musculus
tcaccggcgaggagtctgcaggtgc

SEQ ID NO: 355696 - DNA, 25 bp, Mus musculus
tcaccggctctgtggggctgctgcc

SEQ ID NO: 355697 - DNA, 25 bp, Mus musculus
tcaccgggtacttaggtgctggaaa

SEQ ID NO: 355698 - DNA, 25 bp, Mus musculus
tcaccgtatggctccatggtgtatt

SEQ ID NO: 355699 - DNA, 25 bp, Mus musculus
tcaccgtcacagagccccctgtgcg

SEQ ID NO: 355700 - DNA, 25 bp, Mus musculus
tcaccgtcacagagtcataccaaag

SEQ ID NO: 355701 - DNA, 25 bp, Mus musculus
tcaccgtcagtcagatcccattgtt

SEQ ID NO: 355702 - DNA, 25 bp, Mus musculus
tcaccgtccagatccccaccctcag

SEQ ID NO: 355703 - DNA, 25 bp, Mus musculus
tcaccgtccaggtctgggtggccag

SEQ ID NO: 355704 - DNA, 25 bp, Mus musculus
tcaccgtctcctcagagagtcagtc

SEQ ID NO: 355705 - DNA, 25 bp, Mus musculus
tcaccgtctcctcagagtctgcgag

SEQ ID NO: 355706 - DNA, 25 bp, Mus musculus
tcaccgtctcctcagccaaaacaac

SEQ ID NO: 355707 - DNA, 25 bp, Mus musculus
tcaccgtctcctcagccaaaacgac

SEQ ID NO: 355708 - DNA, 25 bp, Mus musculus
tcaccgtctcctcagcctctatcag

SEQ ID NO: 355709 - DNA, 25 bp, Mus musculus
tcaccgtgagcaagtgtgggaccca

SEQ ID NO: 355710 - DNA, 25 bp, Mus musculus
tcaccgtggagacaggacctcacgc

SEQ ID NO: 355711 - DNA, 25 bp, Mus musculus
tcaccgtggagacagtttgaagagg

SEQ ID NO: 355712 - DNA, 25 bp, Mus musculus
tcaccgtggccagaggcggaggcag

SEQ ID NO: 355713 - DNA, 25 bp, Mus musculus
tcaccgttggcttcattttaggttt

SEQ ID NO: 355714 - DNA, 25 bp, Mus musculus
tcaccgtttgtagtggtgacactcg

SEQ ID NO: 355715 - DNA, 25 bp, Mus musculus
tcacctacaagtggccatggatcgg

SEQ ID NO: 355716 - DNA, 25 bp, Mus musculus
tcacctacaagtgggcccgtgattt

SEQ ID NO: 355717 - DNA, 25 bp, Mus musculus
tcacctacacccaaaaacacagata

SEQ ID NO: 355718 - DNA, 25 bp, Mus musculus
tcacctacacccaatacaagcagct

SEQ ID NO: 355719 - DNA, 25 bp, Mus musculus
tcacctacatccgcaggctgctggt

SEQ ID NO: 355720 - DNA, 25 bp, Mus musculus
tcacctacatcctcctgagcggagc

SEQ ID NO: 355721 - DNA, 25 bp, Mus musculus
tcacctaccaggaccctgtcctgct

SEQ ID NO: 355722 - DNA, 25 bp, Mus musculus
tcacctacgggccctatgccgtcaa

SEQ ID NO: 355723 - DNA, 25 bp, Mus musculus
tcacctagttcagagcaagaacaga

SEQ ID NO: 355724 - DNA, 25 bp, Mus musculus
tcacctatccctgagagctgctcct

SEQ ID NO: 355725 - DNA, 25 bp, Mus musculus
tcacctatgacgagtccatgctgga

SEQ ID NO: 355726 - DNA, 25 bp, Mus musculus
tcacctatgagacactaaagtacat

SEQ ID NO: 355727 - DNA, 25 bp, Mus musculus
tcacctatgagagcggagaagctgc

SEQ ID NO: 355728 - DNA, 25 bp, Mus musculus
tcacctatgagatggtagaagagag

SEQ ID NO: 355729 - DNA, 25 bp, Mus musculus
tcacctatgatgaggactaccagca

SEQ ID NO: 355730 - DNA, 25 bp, Mus musculus
tcacctatgatggacaagaagctga

SEQ ID NO: 355731 - DNA, 25 bp, Mus musculus
tcacctcaatgaggacaataatact

SEQ ID NO: 355732 - DNA, 25 bp, Mus musculus
tcacctcagaggatacaagcagcag

SEQ ID NO: 355733 - DNA, 25 bp, Mus musculus
tcacctcagccaacactgatagggc

SEQ ID NO: 355734 - DNA, 25 bp, Mus musculus
tcacctcagccaagtaccaaaggct

SEQ ID NO: 355735 - DNA, 25 bp, Mus musculus
tcacctcatgcagaaggtgattacc

SEQ ID NO: 355736 - DNA, 25 bp, Mus musculus
tcacctcatgcaggagtatgcaaac

SEQ ID NO: 355737 - DNA, 25 bp, Mus musculus
tcacctccagaacaatgagcttctc

SEQ ID NO: 355738 - DNA, 25 bp, Mus musculus
tcacctccagagccagctccagctc

SEQ ID NO: 355739 - DNA, 25 bp, Mus musculus
tcacctccagctaattgccttgttt

SEQ ID NO: 355740 - DNA, 25 bp, Mus musculus
tcacctccattgggcacatgaccga

SEQ ID NO: 355741 - DNA, 25 bp, Mus musculus
tcacctcccagatcttctccctggg

SEQ ID NO: 355742 - DNA, 25 bp, Mus musculus
tcacctcccagtggcaccaccgagg

SEQ ID NO: 355743 - DNA, 25 bp, Mus musculus
tcacctccctcttcatgacacccct

SEQ ID NO: 355744 - DNA, 25 bp, Mus musculus
tcacctccctgccttcagccatctg

SEQ ID NO: 355745 - DNA, 25 bp, Mus musculus
tcacctcgccaggctgcctaaacca

SEQ ID NO: 355746 - DNA, 25 bp, Mus musculus
tcacctcgccagggtgcactcgtga

SEQ ID NO: 355747 - DNA, 25 bp, Mus musculus
tcacctcgccaggtggaggtgggaa

SEQ ID NO: 355748 - DNA, 25 bp, Mus musculus
tcacctcggaggtcccacccaggag

SEQ ID NO: 355749 - DNA, 25 bp, Mus musculus
tcacctcggtgcaggctatctatgt

SEQ ID NO: 355750 - DNA, 25 bp, Mus musculus
tcacctctaagagacgtggagctat

SEQ ID NO: 355751 - DNA, 25 bp, Mus musculus
tcacctctacagatttcctccctcc

SEQ ID NO: 355752 - DNA, 25 bp, Mus musculus
tcacctctaggtcattttacctggg

SEQ ID NO: 355753 - DNA, 25 bp, Mus musculus
tcacctctcaattgtgggttgaatg

SEQ ID NO: 355754 - DNA, 25 bp, Mus musculus
tcacctctcgtcagatgtcgtcacc

SEQ ID NO: 355755 - DNA, 25 bp, Mus musculus
tcacctctcgtcaggactgcaagag

SEQ ID NO: 355756 - DNA, 25 bp, Mus musculus
tcacctctgagatacttggagatga

SEQ ID NO: 355757 - DNA, 25 bp, Mus musculus
tcacctctgtccaccattccaagga

SEQ ID NO: 355758 - DNA, 25 bp, Mus musculus
tcacctcttgcaaaggtgaccctta

SEQ ID NO: 355759 - DNA, 25 bp, Mus musculus
tcacctgaacagtgagacggtttaa

SEQ ID NO: 355760 - DNA, 25 bp, Mus musculus
tcacctgaagaaaaaagcagtcatc

SEQ ID NO: 355761 - DNA, 25 bp, Mus musculus
tcacctgaagggatgtctgaatttt

SEQ ID NO: 355762 - DNA, 25 bp, Mus musculus
tcacctgaatgcagattgaggatgg

SEQ ID NO: 355763 - DNA, 25 bp, Mus musculus
tcacctgaatgcagtgacaagcatc

SEQ ID NO: 355764 - DNA, 25 bp, Mus musculus
tcacctgagggccaacgaggtgaca

SEQ ID NO: 355765 - DNA, 25 bp, Mus musculus
tcacctgataaaaagtatgtctacg

SEQ ID NO: 355766 - DNA, 25 bp, Mus musculus
tcacctgatagcatgtggcatgaac

SEQ ID NO: 355767 - DNA, 25 bp, Mus musculus
tcacctgatctaaggagattacctg

SEQ ID NO: 355768 - DNA, 25 bp, Mus musculus
tcacctgatgagagtgttcgaggaa

SEQ ID NO: 355769 - DNA, 25 bp, Mus musculus
tcacctgcaccccggagtatgatcc

SEQ ID NO: 355770 - DNA, 25 bp, Mus musculus
tcacctgcagatactttatgcatgg

SEQ ID NO: 355771 - DNA, 25 bp, Mus musculus
tcacctgccacgctccagtggcttc

SEQ ID NO: 355772 - DNA, 25 bp, Mus musculus
tcacctgctgcagaatcaagctata

SEQ ID NO: 355773 - DNA, 25 bp, Mus musculus
tcacctgctgtaattggcaactgga

SEQ ID NO: 355774 - DNA, 25 bp, Mus musculus
tcacctggaagaaggtcaagcactc

SEQ ID NO: 355775 - DNA, 25 bp, Mus musculus
tcacctggaagaagtgcatgctttc

SEQ ID NO: 355776 - DNA, 25 bp, Mus musculus
tcacctggacaagcctccattaacc

SEQ ID NO: 355777 - DNA, 25 bp, Mus musculus
tcacctggacaagctgatgccttca

SEQ ID NO: 355778 - DNA, 25 bp, Mus musculus
tcacctggagacaagctacgcatgg

SEQ ID NO: 355779 - DNA, 25 bp, Mus musculus
tcacctggagacaatacgcatggag

SEQ ID NO: 355780 - DNA, 25 bp, Mus musculus
tcacctggagacgagagctggcatt

SEQ ID NO: 355781 - DNA, 25 bp, Mus musculus
tcacctggcaagcttcacatggagt

SEQ ID NO: 355782 - DNA, 25 bp, Mus musculus
tcacctggtatctggttggcagata

SEQ ID NO: 355783 - DNA, 25 bp, Mus musculus
tcacctgtaaggtagaaatttacaa

SEQ ID NO: 355784 - DNA, 25 bp, Mus musculus
tcacctgtaaggtctctagcatcaa

SEQ ID NO: 355785 - DNA, 25 bp, Mus musculus
tcacctgttaggaaagaatcttcaa

SEQ ID NO: 355786 - DNA, 25 bp, Mus musculus
tcaccttaacgctgttggtcagaaa

SEQ ID NO: 355787 - DNA, 25 bp, Mus musculus
tcaccttagagctggtgtgtctcca

SEQ ID NO: 355788 - DNA, 25 bp, Mus musculus
tcaccttagatgatgtgaacgagat

SEQ ID NO: 355789 - DNA, 25 bp, Mus musculus
tcaccttcagctacccctgcagacc

SEQ ID NO: 355790 - DNA, 25 bp, Mus musculus
tcaccttcatggagaaggtgcaccg

SEQ ID NO: 355791 - DNA, 25 bp, Mus musculus
tcaccttccagaactctgcagcccc

SEQ ID NO: 355792 - DNA, 25 bp, Mus musculus
tcaccttccagactcagaactttcg

SEQ ID NO: 355793 - DNA, 25 bp, Mus musculus
tcaccttccaggctcaaactaccat

SEQ ID NO: 355794 - DNA, 25 bp, Mus musculus
tcaccttccgagaactccgtgcaag

SEQ ID NO: 355795 - DNA, 25 bp, Mus musculus
tcaccttccttggcggcagaacccg

SEQ ID NO: 355796 - DNA, 25 bp, Mus musculus
tcaccttctacagaaaaccgtcaag

SEQ ID NO: 355797 - DNA, 25 bp, Mus musculus
tcaccttctacgacggggtggagtc

SEQ ID NO: 355798 - DNA, 25 bp, Mus musculus
tcaccttctacgctgtggaggtgag

SEQ ID NO: 355799 - DNA, 25 bp, Mus musculus
tcaccttctcagagagacctgcttc

SEQ ID NO: 355800 - DNA, 25 bp, Mus musculus
tcaccttctttaagagaagaatgtg

SEQ ID NO: 355801 - DNA, 25 bp, Mus musculus
tcaccttgcaaagcctttcccaact

SEQ ID NO: 355802 - DNA, 25 bp, Mus musculus
tcaccttgctgtgccctcacgctcc

SEQ ID NO: 355803 - DNA, 25 bp, Mus musculus
tcacctttaccagcggcactcagtc

SEQ ID NO: 355804 - DNA, 25 bp, Mus musculus
tcacctttcgggcaggtgatattac

SEQ ID NO: 355805 - DNA, 25 bp, Mus musculus
tcacctttcgggtcatctagtagca

SEQ ID NO: 355806 - DNA, 25 bp, Mus musculus
tcacctttctgtccttggggatggg

SEQ ID NO: 355807 - DNA, 25 bp, Mus musculus
tcacctttgcaatcgatggcagctc

SEQ ID NO: 355808 - DNA, 25 bp, Mus musculus
tcacctttggtgtcctgtgcatgtg

SEQ ID NO: 355809 - DNA, 25 bp, Mus musculus
tcaccttttaaaggctgctggcacc

SEQ ID NO: 355810 - DNA, 25 bp, Mus musculus
tcacgaaaagatcctgagcaagcag

SEQ ID NO: 355811 - DNA, 25 bp, Mus musculus
tcacgaaacaccagctgcgatacta

SEQ ID NO: 355812 - DNA, 25 bp, Mus musculus
tcacgaaagaaaggccagagggagg

SEQ ID NO: 355813 - DNA, 25 bp, Mus musculus
tcacgaactacaggaagagagagtc

SEQ ID NO: 355814 - DNA, 25 bp, Mus musculus
tcacgaagagataggtgatttcaga

SEQ ID NO: 355815 - DNA, 25 bp, Mus musculus
tcacgaagcacagctgtgacgagct

SEQ ID NO: 355816 - DNA, 25 bp, Mus musculus
tcacgacagcctgcctggcccccat

SEQ ID NO: 355817 - DNA, 25 bp, Mus musculus
tcacgaccaagaagcttcgttacac

SEQ ID NO: 355818 - DNA, 25 bp, Mus musculus
tcacgactagggaatgtgtgaccaa

SEQ ID NO: 355819 - DNA, 25 bp, Mus musculus
tcacgactagggagaaagagagagc

SEQ ID NO: 355820 - DNA, 25 bp, Mus musculus
tcacgagaagaagagctgaagggtc

SEQ ID NO: 355821 - DNA, 25 bp, Mus musculus
tcacgagaagaaggtgatggatggg

SEQ ID NO: 355822 - DNA, 25 bp, Mus musculus
tcacgagaagatgtgtatgtcgaca

SEQ ID NO: 355823 - DNA, 25 bp, Mus musculus
tcacgagcacacagatggagtgatc

SEQ ID NO: 355824 - DNA, 25 bp, Mus musculus
tcacgagcacacaggagagaccttc

SEQ ID NO: 355825 - DNA, 25 bp, Mus musculus
tcacgaggcaatcaagtattctgag

SEQ ID NO: 355826 - DNA, 25 bp, Mus musculus
tcacgagggcgaggctcggctatta

SEQ ID NO: 355827 - DNA, 25 bp, Mus musculus
tcacgagtttcaggctccatttgga

SEQ ID NO: 355828 - DNA, 25 bp, Mus musculus
tcacgataggcaaggggaagtcaga

SEQ ID NO: 355829 - DNA, 25 bp, Mus musculus
tcacgatccaggtcagagcagcagg

SEQ ID NO: 355830 - DNA, 25 bp, Mus musculus
tcacgatccaggtgttcactggggc

SEQ ID NO: 355831 - DNA, 25 bp, Mus musculus
tcacgatgttaaagctgtctgctcc

SEQ ID NO: 355832 - DNA, 25 bp, Mus musculus
tcacgatttgtgaagatatagatga

SEQ ID NO: 355833 - DNA, 25 bp, Mus musculus
tcacgcagcatgcttccctagcgtt

SEQ ID NO: 355834 - DNA, 25 bp, Mus musculus
tcacgcagcatgggctccggctgga

SEQ ID NO: 355835 - DNA, 25 bp, Mus musculus
tcacgcagccttcaggctcagttct

SEQ ID NO: 355836 - DNA, 25 bp, Mus musculus
tcacgcagtgtggcttgacctcaga

SEQ ID NO: 355837 - DNA, 25 bp, Mus musculus
tcacgccgagcagctgccccaggag

SEQ ID NO: 355838 - DNA, 25 bp, Mus musculus
tcacgcctctcttctgtattatggg

SEQ ID NO: 355839 - DNA, 25 bp, Mus musculus
tcacgcctctgggaaacctaaatgt

SEQ ID NO: 355840 - DNA, 25 bp, Mus musculus
tcacgcctcttgaccagcagttatt

SEQ ID NO: 355841 - DNA, 25 bp, Mus musculus
tcacgcgccgcggccttagaagaaa

SEQ ID NO: 355842 - DNA, 25 bp, Mus musculus
tcacgcgccgcggctccatgttcta

SEQ ID NO: 355843 - DNA, 25 bp, Mus musculus
tcacgcgcctctgtaaaacccagaa

SEQ ID NO: 355844 - DNA, 25 bp, Mus musculus
tcacgcgcgtagtgattgaggatgg

SEQ ID NO: 355845 - DNA, 25 bp, Mus musculus
tcacgctacggaatgaagctaccca

SEQ ID NO: 355846 - DNA, 25 bp, Mus musculus
tcacgctattgtgaggatgaagttt

SEQ ID NO: 355847 - DNA, 25 bp, Mus musculus
tcacgctgcatgaactggagaattt

SEQ ID NO: 355848 - DNA, 25 bp, Mus musculus
tcacgcttctataaacctgactcta

SEQ ID NO: 355849 - DNA, 25 bp, Mus musculus
tcacgcttctattaaaccgggaggc

SEQ ID NO: 355850 - DNA, 25 bp, Mus musculus
tcacggaactcgatggagcaaaccc

SEQ ID NO: 355851 - DNA, 25 bp, Mus musculus
tcacggaactcgctaagccgggcaa

SEQ ID NO: 355852 - DNA, 25 bp, Mus musculus
tcacggaactcgtgaatgataccaa

SEQ ID NO: 355853 - DNA, 25 bp, Mus musculus
tcacggaggagtaagacgtcgcctc

SEQ ID NO: 355854 - DNA, 25 bp, Mus musculus
tcacggattccttatggatcgcagc

SEQ ID NO: 355855 - DNA, 25 bp, Mus musculus
tcacggcacaggtcagacgggaaca

SEQ ID NO: 355856 - DNA, 25 bp, Mus musculus
tcacggcagagcaggatgcccgggg

SEQ ID NO: 355857 - DNA, 25 bp, Mus musculus
tcacggcccaaggggtttcctgaga

SEQ ID NO: 355858 - DNA, 25 bp, Mus musculus
tcacggccctcccagagccgtactg

SEQ ID NO: 355859 - DNA, 25 bp, Mus musculus
tcacggcctccagtgacctgacagt

SEQ ID NO: 355860 - DNA, 25 bp, Mus musculus
tcacggcctccagtgactgccgggt

SEQ ID NO: 355861 - DNA, 25 bp, Mus musculus
tcacggcggaaggcaagattgagat

SEQ ID NO: 355862 - DNA, 25 bp, Mus musculus
tcacgggaattccaggtctcaaggg

SEQ ID NO: 355863 - DNA, 25 bp, Mus musculus
tcacgggacaaggtcccatctgcag

SEQ ID NO: 355864 - DNA, 25 bp, Mus musculus
tcacgggacaagttaattcaggaca

SEQ ID NO: 355865 - DNA, 25 bp, Mus musculus
tcacgggacctcgagactgccactc

SEQ ID NO: 355866 - DNA, 25 bp, Mus musculus
tcacgggcacagaaatggaagccca

SEQ ID NO: 355867 - DNA, 25 bp, Mus musculus
tcacgggccagctggctctggaatc

SEQ ID NO: 355868 - DNA, 25 bp, Mus musculus
tcacgggctgcttagttcaaaccgg

SEQ ID NO: 355869 - DNA, 25 bp, Mus musculus
tcacgggggctggcacaggtgatga

SEQ ID NO: 355870 - DNA, 25 bp, Mus musculus
tcacggtacccttatttgaccagat

SEQ ID NO: 355871 - DNA, 25 bp, Mus musculus
tcacggtcaccaggccattccaagg

SEQ ID NO: 355872 - DNA, 25 bp, Mus musculus
tcacggtccaagtgtgggacttgac

SEQ ID NO: 355873 - DNA, 25 bp, Mus musculus
tcacgtaagcagagagtggctgaag

SEQ ID NO: 355874 - DNA, 25 bp, Mus musculus
tcacgtaagcagggtcttgacaatg

SEQ ID NO: 355875 - DNA, 25 bp, Mus musculus
tcacgtaagcagggtcttggagagc

SEQ ID NO: 355876 - DNA, 25 bp, Mus musculus
tcacgtatttaccgcagaaacagta

SEQ ID NO: 355877 - DNA, 25 bp, Mus musculus
tcacgtcaaggtagccatcccttgg

SEQ ID NO: 355878 - DNA, 25 bp, Mus musculus
tcacgtccaagaatttcacccacct

SEQ ID NO: 355879 - DNA, 25 bp, Mus musculus
tcacgtccaaggtggctgtgcctgg

SEQ ID NO: 355880 - DNA, 25 bp, Mus musculus
tcacgtcccaggctgatagagacat

SEQ ID NO: 355881 - DNA, 25 bp, Mus musculus
tcacgtcccaggctggacagagatt

SEQ ID NO: 355882 - DNA, 25 bp, Mus musculus
tcacgtcccaggctggagaaagctg

SEQ ID NO: 355883 - DNA, 25 bp, Mus musculus
tcacgtccggaaggtgaatcggttt

SEQ ID NO: 355884 - DNA, 25 bp, Mus musculus
tcacgtctctggacaagccctcagt

SEQ ID NO: 355885 - DNA, 25 bp, Mus musculus
tcacgtctgtgaagatcactgttaa

SEQ ID NO: 355886 - DNA, 25 bp, Mus musculus
tcacgtgcagatggtggacccagtg

SEQ ID NO: 355887 - DNA, 25 bp, Mus musculus
tcacgtgcagcacctggccacattc

SEQ ID NO: 355888 - DNA, 25 bp, Mus musculus
tcacgtgcagggtctttcaggttag

SEQ ID NO: 355889 - DNA, 25 bp, Mus musculus
tcacgtggcttaggattgtctaaag

SEQ ID NO: 355890 - DNA, 25 bp, Mus musculus
tcacgtgggaccggcccttggtgct

SEQ ID NO: 355891 - DNA, 25 bp, Mus musculus
tcacgtgggaccggggtgttgtgct

SEQ ID NO: 355892 - DNA, 25 bp, Mus musculus
tcacgtggtacaaccacttccagct

SEQ ID NO: 355893 - DNA, 25 bp, Mus musculus
tcacgtggtacaacccaagtaatga

SEQ ID NO: 355894 - DNA, 25 bp, Mus musculus
tcacgtggttggaaattgatggaaa

SEQ ID NO: 355895 - DNA, 25 bp, Mus musculus
tcacgtggttggaatgtggtgtttg

SEQ ID NO: 355896 - DNA, 25 bp, Mus musculus
tcacgtgttcatttgtgattcatgg

SEQ ID NO: 355897 - DNA, 25 bp, Mus musculus
tcacgttggttggcttttgtttgtc

SEQ ID NO: 355898 - DNA, 25 bp, Mus musculus
tcacgtttctcaggttattactctg

SEQ ID NO: 355899 - DNA, 25 bp, Mus musculus
tcactaaaagaagtgctcagagttc

SEQ ID NO: 355900 - DNA, 25 bp, Mus musculus
tcactaaacaagacctcctaagcca

SEQ ID NO: 355901 - DNA, 25 bp, Mus musculus
tcactaacaaggataagaagcattt

SEQ ID NO: 355902 - DNA, 25 bp, Mus musculus
tcactaacaccaaggtcacaaagca

SEQ ID NO: 355903 - DNA, 25 bp, Mus musculus
tcactaacagcatcaaggtgtaatg

SEQ ID NO: 355904 - DNA, 25 bp, Mus musculus
tcactaagaagacccagagtgatat

SEQ ID NO: 355905 - DNA, 25 bp, Mus musculus
tcactaaggcaaagattattggatt

SEQ ID NO: 355906 - DNA, 25 bp, Mus musculus
tcactaagttgaaacactaattacc

SEQ ID NO: 355907 - DNA, 25 bp, Mus musculus
tcactaagttgtcccgagtttatgt

SEQ ID NO: 355908 - DNA, 25 bp, Mus musculus
tcactaataaagaagtgtgctggtg

SEQ ID NO: 355909 - DNA, 25 bp, Mus musculus
tcactacaagatgaggatgataatg

SEQ ID NO: 355910 - DNA, 25 bp, Mus musculus
tcactacataagcgaagctctgggg

SEQ ID NO: 355911 - DNA, 25 bp, Mus musculus
tcactaccaggtgcagacccacctg

SEQ ID NO: 355912 - DNA, 25 bp, Mus musculus
tcactaccatcggctatggcaatat

SEQ ID NO: 355913 - DNA, 25 bp, Mus musculus
tcactaccctcccaaactggcctca

SEQ ID NO: 355914 - DNA, 25 bp, Mus musculus
tcactacggaggtgcatcctgagct

SEQ ID NO: 355915 - DNA, 25 bp, Mus musculus
tcactactcactcagggatgactat

SEQ ID NO: 355916 - DNA, 25 bp, Mus musculus
tcactagaggtaaaggtcgatcgcg

SEQ ID NO: 355917 - DNA, 25 bp, Mus musculus
tcactagccagtgagcgcatgagct

SEQ ID NO: 355918 - DNA, 25 bp, Mus musculus
tcactagccagtgcctaaggaagaa

SEQ ID NO: 355919 - DNA, 25 bp, Mus musculus
tcactagctgggtacctcttgtgtc

SEQ ID NO: 355920 - DNA, 25 bp, Mus musculus
tcactaggaacatgatgaactttca

SEQ ID NO: 355921 - DNA, 25 bp, Mus musculus
tcactaggaacatggtgtccatcct

SEQ ID NO: 355922 - DNA, 25 bp, Mus musculus
tcactaggaagggtgagtggggcag

SEQ ID NO: 355923 - DNA, 25 bp, Mus musculus
tcactaggttgcagacagtaaccag

SEQ ID NO: 355924 - DNA, 25 bp, Mus musculus
tcactagtggcaccggtttacatct

SEQ ID NO: 355925 - DNA, 25 bp, Mus musculus
tcactataaagggagttggaaagag

SEQ ID NO: 355926 - DNA, 25 bp, Mus musculus
tcactataaaggggtgctggtgttg

SEQ ID NO: 355927 - DNA, 25 bp, Mus musculus
tcactatcagttggtttacctgctg

SEQ ID NO: 355928 - DNA, 25 bp, Mus musculus
tcactatcgacagagtcccagatcc

SEQ ID NO: 355929 - DNA, 25 bp, Mus musculus
tcactatcgacagtttttgtggttc

SEQ ID NO: 355930 - DNA, 25 bp, Mus musculus
tcactatgaaacaaagagttcaact

SEQ ID NO: 355931 - DNA, 25 bp, Mus musculus
tcactatgaagattcacagacacag

SEQ ID NO: 355932 - DNA, 25 bp, Mus musculus
tcactatgatgcctgttcctgccaa

SEQ ID NO: 355933 - DNA, 25 bp, Mus musculus
tcactatgtgcaagacggccccctt

SEQ ID NO: 355934 - DNA, 25 bp, Mus musculus
tcactattctgaggttggtgtcatt

SEQ ID NO: 355935 - DNA, 25 bp, Mus musculus
tcactcaacttcagccactggaact

SEQ ID NO: 355936 - DNA, 25 bp, Mus musculus
tcactcaacttcaggagggcctggg

SEQ ID NO: 355937 - DNA, 25 bp, Mus musculus
tcactcacaaggaagtaatgtgatt

SEQ ID NO: 355938 - DNA, 25 bp, Mus musculus
tcactcacaaggaagtggatgatct

SEQ ID NO: 355939 - DNA, 25 bp, Mus musculus
tcactcacatagctaacccaaggag

SEQ ID NO: 355940 - DNA, 25 bp, Mus musculus
tcactcacatctgtgtctgataaca

SEQ ID NO: 355941 - DNA, 25 bp, Mus musculus
tcactcacatcttcttccctttcaa

SEQ ID NO: 355942 - DNA, 25 bp, Mus musculus
tcactcacatgtgctggagagtctg

SEQ ID NO: 355943 - DNA, 25 bp, Mus musculus
tcactcagaggcagccatggaacgt

SEQ ID NO: 355944 - DNA, 25 bp, Mus musculus
tcactcagctaacagtggtaccagt

SEQ ID NO: 355945 - DNA, 25 bp, Mus musculus
tcactcagctcacagtggtaccagt

SEQ ID NO: 355946 - DNA, 25 bp, Mus musculus
tcactcaggagaagccctcgaaggg

SEQ ID NO: 355947 - DNA, 25 bp, Mus musculus
tcactcaggagccgttgcccacgga

SEQ ID NO: 355948 - DNA, 25 bp, Mus musculus
tcactcaggaggttctgacgggaac

SEQ ID NO: 355949 - DNA, 25 bp, Mus musculus
tcactcaggagttgcagctccaccc

SEQ ID NO: 355950 - DNA, 25 bp, Mus musculus
tcactcagtgcatgaggaagcagcc

SEQ ID NO: 355951 - DNA, 25 bp, Mus musculus
tcactcagtggaagttctggatgat

SEQ ID NO: 355952 - DNA, 25 bp, Mus musculus
tcactcatgcaggttgctgatgccc

SEQ ID NO: 355953 - DNA, 25 bp, Mus musculus
tcactccaaagacaaatatgaaaca

SEQ ID NO: 355954 - DNA, 25 bp, Mus musculus
tcactccaaagtccccagtcttcat

SEQ ID NO: 355955 - DNA, 25 bp, Mus musculus
tcactccactccagggtctagagat

SEQ ID NO: 355956 - DNA, 25 bp, Mus musculus
tcactccactggttcgtcgcctgca

SEQ ID NO: 355957 - DNA, 25 bp, Mus musculus
tcactccagagaaattcccaacatt

SEQ ID NO: 355958 - DNA, 25 bp, Mus musculus
tcactccagaggccacaaaagaagt

SEQ ID NO: 355959 - DNA, 25 bp, Mus musculus
tcactccagccaaaggactgcaggc

SEQ ID NO: 355960 - DNA, 25 bp, Mus musculus
tcactccagtaaagactccttgttg

SEQ ID NO: 355961 - DNA, 25 bp, Mus musculus
tcactcccaagacaagtgtcagcgg

SEQ ID NO: 355962 - DNA, 25 bp, Mus musculus
tcactccccagccgtgggaatggtg

SEQ ID NO: 355963 - DNA, 25 bp, Mus musculus
tcactcccccgcacttctagacagc

SEQ ID NO: 355964 - DNA, 25 bp, Mus musculus
tcactccctgaaaaatcgagttgag

SEQ ID NO: 355965 - DNA, 25 bp, Mus musculus
tcactccctgcagtctcgaatggaa

SEQ ID NO: 355966 - DNA, 25 bp, Mus musculus
tcactcctaagcaccaaggaacccg

SEQ ID NO: 355967 - DNA, 25 bp, Mus musculus
tcactcctaagcggttaatttctaa

SEQ ID NO: 355968 - DNA, 25 bp, Mus musculus
tcactcctggagcaggcagcacccg

SEQ ID NO: 355969 - DNA, 25 bp, Mus musculus
tcactcctggagtagaaaaagacat

SEQ ID NO: 355970 - DNA, 25 bp, Mus musculus
tcactcgaagtgagattgaccttgt

SEQ ID NO: 355971 - DNA, 25 bp, Mus musculus
tcactcgagaagcagagattttatt

SEQ ID NO: 355972 - DNA, 25 bp, Mus musculus
tcactcggttcccttctctgggtcc

SEQ ID NO: 355973 - DNA, 25 bp, Mus musculus
tcactcgtgcagcgactgcaggacc

SEQ ID NO: 355974 - DNA, 25 bp, Mus musculus
tcactcgtgcagctcagagagccga

SEQ ID NO: 355975 - DNA, 25 bp, Mus musculus
tcactcgtgcagtgccaccgtgcca

SEQ ID NO: 355976 - DNA, 25 bp, Mus musculus
tcactctaaccggtcatttggcaga

SEQ ID NO: 355977 - DNA, 25 bp, Mus musculus
tcactctaagaaacattccctgtgt

SEQ ID NO: 355978 - DNA, 25 bp, Mus musculus
tcactctcaacatggaaaagtataa

SEQ ID NO: 355979 - DNA, 25 bp, Mus musculus
tcactctcaacctgctgtcgctaca

SEQ ID NO: 355980 - DNA, 25 bp, Mus musculus
tcactctcagtcaggtttggacgtc

SEQ ID NO: 355981 - DNA, 25 bp, Mus musculus
tcactctccggatgttgggaagtct

SEQ ID NO: 355982 - DNA, 25 bp, Mus musculus
tcactctcctctcaactccacgtca

SEQ ID NO: 355983 - DNA, 25 bp, Mus musculus
tcactctcctctcaagcaagctata

SEQ ID NO: 355984 - DNA, 25 bp, Mus musculus
tcactctctcatgaggagccccagg

SEQ ID NO: 355985 - DNA, 25 bp, Mus musculus
tcactctgctgtcaggtacaggtca

SEQ ID NO: 355986 - DNA, 25 bp, Mus musculus
tcactctggccgtcgcggctggact

SEQ ID NO: 355987 - DNA, 25 bp, Mus musculus
tcactctgtcgcagattggaagaat

SEQ ID NO: 355988 - DNA, 25 bp, Mus musculus
tcactctgttcagtgaacctaacac

SEQ ID NO: 355989 - DNA, 25 bp, Mus musculus
tcactcttccttggtactctcaagt

SEQ ID NO: 355990 - DNA, 25 bp, Mus musculus
tcactcttctaaaacgttaccacct

SEQ ID NO: 355991 - DNA, 25 bp, Mus musculus
tcactcttctaaagatccactatgg

SEQ ID NO: 355992 - DNA, 25 bp, Mus musculus
tcactctttgtcttcttgtctgggg

SEQ ID NO: 355993 - DNA, 25 bp, Mus musculus
tcactgaaaaatgtagttcctaata

SEQ ID NO: 355994 - DNA, 25 bp, Mus musculus
tcactgaaagctgggaagtcatcaa

SEQ ID NO: 355995 - DNA, 25 bp, Mus musculus
tcactgaacagacagctccgaagat

SEQ ID NO: 355996 - DNA, 25 bp, Mus musculus
tcactgaacaggttgctccaggacc

SEQ ID NO: 355997 - DNA, 25 bp, Mus musculus
tcactgaacccaaccagaatcgagc

SEQ ID NO: 355998 - DNA, 25 bp, Mus musculus
tcactgaagaagtggactctcgaaa

SEQ ID NO: 355999 - DNA, 25 bp, Mus musculus
tcactgaatttatcgtcagatacag

SEQ ID NO: 356000 - DNA, 25 bp, Mus musculus
tcactgacaagcaaggaaagactgc

SEQ ID NO: 356001 - DNA, 25 bp, Mus musculus
tcactgaccggaggaacaaggatga

SEQ ID NO: 356002 - DNA, 25 bp, Mus musculus
tcactgacggacagatcttcttgga

SEQ ID NO: 356003 - DNA, 25 bp, Mus musculus
tcactgactacaggcactggcagat

SEQ ID NO: 356004 - DNA, 25 bp, Mus musculus
tcactgactagtctccagaggctct

SEQ ID NO: 356005 - DNA, 25 bp, Mus musculus
tcactgactattttaacagcgtatg

SEQ ID NO: 356006 - DNA, 25 bp, Mus musculus
tcactgagaaggtgtccttggtgct

SEQ ID NO: 356007 - DNA, 25 bp, Mus musculus
tcactgagctcaagcccccggaagc

SEQ ID NO: 356008 - DNA, 25 bp, Mus musculus
tcactgagtgagcaggctcctgcaa

SEQ ID NO: 356009 - DNA, 25 bp, Mus musculus
tcactgatgaggcatcaatacttgt

SEQ ID NO: 356010 - DNA, 25 bp, Mus musculus
tcactgcaaaaacagctcaatgaca

SEQ ID NO: 356011 - DNA, 25 bp, Mus musculus
tcactgcaaaaacagctctgtccaa

SEQ ID NO: 356012 - DNA, 25 bp, Mus musculus
tcactgcaaaatgaacccacagctt

SEQ ID NO: 356013 - DNA, 25 bp, Mus musculus
tcactgcaaaggaagctcaatgaca

SEQ ID NO: 356014 - DNA, 25 bp, Mus musculus
tcactgcaacaaggtgtcagctgat

SEQ ID NO: 356015 - DNA, 25 bp, Mus musculus
tcactgcacagcccatcgtttctga

SEQ ID NO: 356016 - DNA, 25 bp, Mus musculus
tcactgcagaggaggagggtggacg

SEQ ID NO: 356017 - DNA, 25 bp, Mus musculus
tcactgcagcgacggctccgggtgc

SEQ ID NO: 356018 - DNA, 25 bp, Mus musculus
tcactgcagcgctgctgtggctgga

SEQ ID NO: 356019 - DNA, 25 bp, Mus musculus
tcactgcattgaaaaaatcccatgt

SEQ ID NO: 356020 - DNA, 25 bp, Mus musculus
tcactgcattggacttccttgtgga

SEQ ID NO: 356021 - DNA, 25 bp, Mus musculus
tcactgccaaggacgaaaagggggt

SEQ ID NO: 356022 - DNA, 25 bp, Mus musculus
tcactgccaaggggacaatgacggc

SEQ ID NO: 356023 - DNA, 25 bp, Mus musculus
tcactgccaaggtgaaagcagccat

SEQ ID NO: 356024 - DNA, 25 bp, Mus musculus
tcactgccactcagcttgatactca

SEQ ID NO: 356025 - DNA, 25 bp, Mus musculus
tcactgccaggtatgtgaaggggat

SEQ ID NO: 356026 - DNA, 25 bp, Mus musculus
tcactgcccaggtggaagaactaag

SEQ ID NO: 356027 - DNA, 25 bp, Mus musculus
tcactgcccaggtggagcaactaga

SEQ ID NO: 356028 - DNA, 25 bp, Mus musculus
tcactgcccatagaactagatcagt

SEQ ID NO: 356029 - DNA, 25 bp, Mus musculus
tcactgcctccaggtctggagagct

SEQ ID NO: 356030 - DNA, 25 bp, Mus musculus
tcactgcctgataaatacaacacca

SEQ ID NO: 356031 - DNA, 25 bp, Mus musculus
tcactgcctgatgttgtccaggaag

SEQ ID NO: 356032 - DNA, 25 bp, Mus musculus
tcactgcgacccccagcccagtagg

SEQ ID NO: 356033 - DNA, 25 bp, Mus musculus
tcactgcgagatgagctttgatcca

SEQ ID NO: 356034 - DNA, 25 bp, Mus musculus
tcactgcgagctgcttgacatggag

SEQ ID NO: 356035 - DNA, 25 bp, Mus musculus
tcactgcgccacaggaaagcactgc

SEQ ID NO: 356036 - DNA, 25 bp, Mus musculus
tcactgcggaaactgaaacctttgt

SEQ ID NO: 356037 - DNA, 25 bp, Mus musculus
tcactgcggagctcggaattagctg

SEQ ID NO: 356038 - DNA, 25 bp, Mus musculus
tcactgctaatgagactcagtccgc

SEQ ID NO: 356039 - DNA, 25 bp, Mus musculus
tcactgctaggtatggcactgcaac

SEQ ID NO: 356040 - DNA, 25 bp, Mus musculus
tcactgctataggatacaaattgga

SEQ ID NO: 356041 - DNA, 25 bp, Mus musculus
tcactgctataggttgatcagatcc

SEQ ID NO: 356042 - DNA, 25 bp, Mus musculus
tcactgcttaagagggttcagtaac

SEQ ID NO: 356043 - DNA, 25 bp, Mus musculus
tcactgcttccccagagaacacagc

SEQ ID NO: 356044 - DNA, 25 bp, Mus musculus
tcactgcttgcccaagtgtgcctgc

SEQ ID NO: 356045 - DNA, 25 bp, Mus musculus
tcactgctttaccagaccatagaat

SEQ ID NO: 356046 - DNA, 25 bp, Mus musculus
tcactgctttaccagagcaaggctt

SEQ ID NO: 356047 - DNA, 25 bp, Mus musculus
tcactggaaagacatgcagctgttt

SEQ ID NO: 356048 - DNA, 25 bp, Mus musculus
tcactggaagagccgcccgcacccg

SEQ ID NO: 356049 - DNA, 25 bp, Mus musculus
tcactggaagagcctcagaaacact

SEQ ID NO: 356050 - DNA, 25 bp, Mus musculus
tcactggacatgggtgaagaagggg

SEQ ID NO: 356051 - DNA, 25 bp, Mus musculus
tcactggacgagaggatggctgtgc

SEQ ID NO: 356052 - DNA, 25 bp, Mus musculus
tcactggacgagtccgttagatcgg

SEQ ID NO: 356053 - DNA, 25 bp, Mus musculus
tcactggagagccagaagtacctgc

SEQ ID NO: 356054 - DNA, 25 bp, Mus musculus
tcactggagatgtggctcaccatgc

SEQ ID NO: 356055 - DNA, 25 bp, Mus musculus
tcactggagcaggccttatgacctg

SEQ ID NO: 356056 - DNA, 25 bp, Mus musculus
tcactggagggaggttgtgtagcct

SEQ ID NO: 356057 - DNA, 25 bp, Mus musculus
tcactggatcgccgcccttcactgc

SEQ ID NO: 356058 - DNA, 25 bp, Mus musculus
tcactggcagtgagatccgccatcg

SEQ ID NO: 356059 - DNA, 25 bp, Mus musculus
tcactggcatagttggagcgatagg

SEQ ID NO: 356060 - DNA, 25 bp, Mus musculus
tcactggcatcatgggagcaggctg

SEQ ID NO: 356061 - DNA, 25 bp, Mus musculus
tcactggcatcatggtcaaaaatgc

SEQ ID NO: 356062 - DNA, 25 bp, Mus musculus
tcactggccagtaaggcccgaatgg

SEQ ID NO: 356063 - DNA, 25 bp, Mus musculus
tcactggcctagcctatgctgctgg

SEQ ID NO: 356064 - DNA, 25 bp, Mus musculus
tcactggctgagaacccttctggtt

SEQ ID NO: 356065 - DNA, 25 bp, Mus musculus
tcactgggaaaaggtaaatgttgga

SEQ ID NO: 356066 - DNA, 25 bp, Mus musculus
tcactgggaaaaggtggcagtgggg

SEQ ID NO: 356067 - DNA, 25 bp, Mus musculus
tcactgggaaaagtgagccccaggc

SEQ ID NO: 356068 - DNA, 25 bp, Mus musculus
tcactgggactacagggatccgtga

SEQ ID NO: 356069 - DNA, 25 bp, Mus musculus
tcactgggaggtgtccctgtataaa

SEQ ID NO: 356070 - DNA, 25 bp, Mus musculus
tcactgggctataggtcggatatga

SEQ ID NO: 356071 - DNA, 25 bp, Mus musculus
tcactggggttttaaggtgtctggc

SEQ ID NO: 356072 - DNA, 25 bp, Mus musculus
tcactggtcaagattcatgaaaaac

SEQ ID NO: 356073 - DNA, 25 bp, Mus musculus
tcactggttatgctttccatgaagt

SEQ ID NO: 356074 - DNA, 25 bp, Mus musculus
tcactggttatggatccatctgttg

SEQ ID NO: 356075 - DNA, 25 bp, Mus musculus
tcactggtttgtacagtgtctaccc

SEQ ID NO: 356076 - DNA, 25 bp, Mus musculus
tcactgtaaaccaggtcactcctgt

SEQ ID NO: 356077 - DNA, 25 bp, Mus musculus
tcactgtaaaggtgcgagaagatgt

SEQ ID NO: 356078 - DNA, 25 bp, Mus musculus
tcactgtaaggcccatcctttgtga

SEQ ID NO: 356079 - DNA, 25 bp, Mus musculus
tcactgtactcaagactgcaggcgc

SEQ ID NO: 356080 - DNA, 25 bp, Mus musculus
tcactgtactcaagtcctggatcag

SEQ ID NO: 356081 - DNA, 25 bp, Mus musculus
tcactgtagagccaaacatccagaa

SEQ ID NO: 356082 - DNA, 25 bp, Mus musculus
tcactgtattctcagttcctgtagt

SEQ ID NO: 356083 - DNA, 25 bp, Mus musculus
tcactgtcaagtcaagactgttggt

SEQ ID NO: 356084 - DNA, 25 bp, Mus musculus
tcactgtcaggaagttggtgtcctt

SEQ ID NO: 356085 - DNA, 25 bp, Mus musculus
tcactgtcattagaccatttccagg

SEQ ID NO: 356086 - DNA, 25 bp, Mus musculus
tcactgtccaagacccagcaactac

SEQ ID NO: 356087 - DNA, 25 bp, Mus musculus
tcactgtccaagagttgtttgcagc

SEQ ID NO: 356088 - DNA, 25 bp, Mus musculus
tcactgtccaaggatggaaggtcac

SEQ ID NO: 356089 - DNA, 25 bp, Mus musculus
tcactgtccaagtggacacgggcct

SEQ ID NO: 356090 - DNA, 25 bp, Mus musculus
tcactgtccagcttgccagtgcaac

SEQ ID NO: 356091 - DNA, 25 bp, Mus musculus
tcactgtccagtgcttctacttctc

SEQ ID NO: 356092 - DNA, 25 bp, Mus musculus
tcactgtccagttaatgtgttaaga

SEQ ID NO: 356093 - DNA, 25 bp, Mus musculus
tcactgtccttcgggacctgctaga

SEQ ID NO: 356094 - DNA, 25 bp, Mus musculus
tcactgtctctgcagaacaacactg

SEQ ID NO: 356095 - DNA, 25 bp, Mus musculus
tcactgtctctgcagagagtcagtc

SEQ ID NO: 356096 - DNA, 25 bp, Mus musculus
tcactgtctctgcagagtctgcgag

SEQ ID NO: 356097 - DNA, 25 bp, Mus musculus
tcactgtctctgcagccaaaacaac

SEQ ID NO: 356098 - DNA, 25 bp, Mus musculus
tcactgtctctgcaggtaatgaaaa

SEQ ID NO: 356099 - DNA, 25 bp, Mus musculus
tcactgtcttttctgcccccagcta

SEQ ID NO: 356100 - DNA, 25 bp, Mus musculus
tcactgtgaatggttaccataccac

SEQ ID NO: 356101 - DNA, 25 bp, Mus musculus
tcactgtgaccactcgtcctgaggt

SEQ ID NO: 356102 - DNA, 25 bp, Mus musculus
tcactgtgacgagggtggctcacac

SEQ ID NO: 356103 - DNA, 25 bp, Mus musculus
tcactgtgcagctcattctctttgg

SEQ ID NO: 356104 - DNA, 25 bp, Mus musculus
tcactgtgcagttccgctcgctgtc

SEQ ID NO: 356105 - DNA, 25 bp, Mus musculus
tcactgtgctaaaggcccacgttgt

SEQ ID NO: 356106 - DNA, 25 bp, Mus musculus
tcactgtgctaatggcccacgttgt

SEQ ID NO: 356107 - DNA, 25 bp, Mus musculus
tcactgtggaagtggtcccaaccga

SEQ ID NO: 356108 - DNA, 25 bp, Mus musculus
tcactgtggacctagattcatcagc

SEQ ID NO: 356109 - DNA, 25 bp, Mus musculus
tcactgtggacctagggtttctctg

SEQ ID NO: 356110 - DNA, 25 bp, Mus musculus
tcactgtggacgatgctcagaccag

SEQ ID NO: 356111 - DNA, 25 bp, Mus musculus
tcactgtggaggagctgaagttcaa

SEQ ID NO: 356112 - DNA, 25 bp, Mus musculus
tcactgtggataaaaatatgcccaa

SEQ ID NO: 356113 - DNA, 25 bp, Mus musculus
tcactgtgtaaaaggccttaaccat

SEQ ID NO: 356114 - DNA, 25 bp, Mus musculus
tcactgtgtgatgcgggtgcctggc

SEQ ID NO: 356115 - DNA, 25 bp, Mus musculus
tcactgttcagcccacagtgagaat

SEQ ID NO: 356116 - DNA, 25 bp, Mus musculus
tcactgttcaggcatccgaaggtgt

SEQ ID NO: 356117 - DNA, 25 bp, Mus musculus
tcactgttgagggatgacctgccat

SEQ ID NO: 356118 - DNA, 25 bp, Mus musculus
tcactgttgctcacctttcaacagt

SEQ ID NO: 356119 - DNA, 25 bp, Mus musculus
tcacttagacagacttacaacagct

SEQ ID NO: 356120 - DNA, 25 bp, Mus musculus
tcacttcaaaggagtgtcactactc

SEQ ID NO: 356121 - DNA, 25 bp, Mus musculus
tcacttcactccctgaaaaatcgag

SEQ ID NO: 356122 - DNA, 25 bp, Mus musculus
tcacttcactccctgcagtctcgaa

SEQ ID NO: 356123 - DNA, 25 bp, Mus musculus
tcacttccaacgtgaaactcatccg

SEQ ID NO: 356124 - DNA, 25 bp, Mus musculus
tcacttccaatgcagcctgtggcat

SEQ ID NO: 356125 - DNA, 25 bp, Mus musculus
tcacttcccacagaggttgaaatgg

SEQ ID NO: 356126 - DNA, 25 bp, Mus musculus
tcacttccccaaattcctgtccatg

SEQ ID NO: 356127 - DNA, 25 bp, Mus musculus
tcacttcggtgggctcggatggcgt

SEQ ID NO: 356128 - DNA, 25 bp, Mus musculus
tcacttctaggtcgtttcagctctg

SEQ ID NO: 356129 - DNA, 25 bp, Mus musculus
tcacttctgttcaggaaactggaga

SEQ ID NO: 356130 - DNA, 25 bp, Mus musculus
tcacttctttacaaggattttcacc

SEQ ID NO: 356131 - DNA, 25 bp, Mus musculus
tcacttgaagcccatctctgagcga

SEQ ID NO: 356132 - DNA, 25 bp, Mus musculus
tcacttgaaggacacccagctccag

SEQ ID NO: 356133 - DNA, 25 bp, Mus musculus
tcacttgcaggtgttgtttgtggca

SEQ ID NO: 356134 - DNA, 25 bp, Mus musculus
tcacttgcagtcgagcaaaagacgt

SEQ ID NO: 356135 - DNA, 25 bp, Mus musculus
tcacttgccaaaggaaagcgagctt

SEQ ID NO: 356136 - DNA, 25 bp, Mus musculus
tcacttgccaaaggcagtttgatgt

SEQ ID NO: 356137 - DNA, 25 bp, Mus musculus
tcacttgccagctcctgtgcggcac

SEQ ID NO: 356138 - DNA, 25 bp, Mus musculus
tcacttgctacaagtgtggtgagaa

SEQ ID NO: 356139 - DNA, 25 bp, Mus musculus
tcacttgctacaagtgtggtgggct

SEQ ID NO: 356140 - DNA, 25 bp, Mus musculus
tcacttgcttcagccagagtaacag

SEQ ID NO: 356141 - DNA, 25 bp, Mus musculus
tcacttggccttgatgaagaacaac

SEQ ID NO: 356142 - DNA, 25 bp, Mus musculus
tcacttgggcatgatccagagcaat

SEQ ID NO: 356143 - DNA, 25 bp, Mus musculus
tcacttgggcatgctttggtggccc

SEQ ID NO: 356144 - DNA, 25 bp, Mus musculus
tcacttggtgcatcgggagcaatca

SEQ ID NO: 356145 - DNA, 25 bp, Mus musculus
tcacttgtacatggaggctttgctg

SEQ ID NO: 356146 - DNA, 25 bp, Mus musculus
tcacttgtacatggtgctctagact

SEQ ID NO: 356147 - DNA, 25 bp, Mus musculus
tcacttgtgacagagccctgcttca

SEQ ID NO: 356148 - DNA, 25 bp, Mus musculus
tcacttgtgctgcttctcaggatgg

SEQ ID NO: 356149 - DNA, 25 bp, Mus musculus
tcacttgttgccagaaagcagcagc

SEQ ID NO: 356150 - DNA, 25 bp, Mus musculus
tcacttgttgccaggtgaacagctg

SEQ ID NO: 356151 - DNA, 25 bp, Mus musculus
tcactttaaaacggctaggacttct

SEQ ID NO: 356152 - DNA, 25 bp, Mus musculus
tcactttcaaaggcatctagtcttg

SEQ ID NO: 356153 - DNA, 25 bp, Mus musculus
tcactttcacgaggagaacatttgt

SEQ ID NO: 356154 - DNA, 25 bp, Mus musculus
tcactttcagacatccggctccggg

SEQ ID NO: 356155 - DNA, 25 bp, Mus musculus
tcactttccaaggaatttgaagcct

SEQ ID NO: 356156 - DNA, 25 bp, Mus musculus
tcactttccacagagcctttgatat

SEQ ID NO: 356157 - DNA, 25 bp, Mus musculus
tcactttccacagagctctggagac

SEQ ID NO: 356158 - DNA, 25 bp, Mus musculus
tcactttcctaaccgcacagaccag

SEQ ID NO: 356159 - DNA, 25 bp, Mus musculus
tcactttcctaccagcaatgccagt

SEQ ID NO: 356160 - DNA, 25 bp, Mus musculus
tcactttcggctggggaactgacag

SEQ ID NO: 356161 - DNA, 25 bp, Mus musculus
tcactttcgtgggagccacatatag

SEQ ID NO: 356162 - DNA, 25 bp, Mus musculus
tcactttctacaagactatggcgac

SEQ ID NO: 356163 - DNA, 25 bp, Mus musculus
tcactttctacaaggtcatggaggc

SEQ ID NO: 356164 - DNA, 25 bp, Mus musculus
tcactttctacaaggtcattcccaa

SEQ ID NO: 356165 - DNA, 25 bp, Mus musculus
tcactttctacaagtctcgcctgct

SEQ ID NO: 356166 - DNA, 25 bp, Mus musculus
tcactttgaaaaggctgtcaccctt

SEQ ID NO: 356167 - DNA, 25 bp, Mus musculus
tcactttgagattgtaaaagctggc

SEQ ID NO: 356168 - DNA, 25 bp, Mus musculus
tcactttgcagtgccctgctctgct

SEQ ID NO: 356169 - DNA, 25 bp, Mus musculus
tcactttggaagagctcattgccca

SEQ ID NO: 356170 - DNA, 25 bp, Mus musculus
tcactttggaggaatgggagggcag

SEQ ID NO: 356171 - DNA, 25 bp, Mus musculus
tcactttgtgctggaaggcgctttt

SEQ ID NO: 356172 - DNA, 25 bp, Mus musculus
tcactttgtgctgggaaagagtatg

SEQ ID NO: 356173 - DNA, 25 bp, Mus musculus
tcacttttactgtataagtcttgct

SEQ ID NO: 356174 - DNA, 25 bp, Mus musculus
tcacttttcagtatatatggtctgg

SEQ ID NO: 356175 - DNA, 25 bp, Mus musculus
tcacttttcctactttcactctact

SEQ ID NO: 356176 - DNA, 25 bp, Mus musculus
tcagaaaaatttgctcaggaaaccg

SEQ ID NO: 356177 - DNA, 25 bp, Mus musculus
tcagaaaacagcatcaaggatgaag

SEQ ID NO: 356178 - DNA, 25 bp, Mus musculus
tcagaaaacaggtaaaggctattaa

SEQ ID NO: 356179 - DNA, 25 bp, Mus musculus
tcagaaaacattccgtgcagtaaac

SEQ ID NO: 356180 - DNA, 25 bp, Mus musculus
tcagaaaagagctctgtcttccccg

SEQ ID NO: 356181 - DNA, 25 bp, Mus musculus
tcagaaaagccaggcctgtgatcct

SEQ ID NO: 356182 - DNA, 25 bp, Mus musculus
tcagaaaagcccagttctaattcag

SEQ ID NO: 356183 - DNA, 25 bp, Mus musculus
tcagaaaatagccaggactatcaac

SEQ ID NO: 356184 - DNA, 25 bp, Mus musculus
tcagaaaataggtattgaggctctg

SEQ ID NO: 356185 - DNA, 25 bp, Mus musculus
tcagaaaatgagctctgttaaggaa

SEQ ID NO: 356186 - DNA, 25 bp, Mus musculus
tcagaaaatggctcctcggtggcag

SEQ ID NO: 356187 - DNA, 25 bp, Mus musculus
tcagaaacagaagactctattcttc

SEQ ID NO: 356188 - DNA, 25 bp, Mus musculus
tcagaaacaggcggaaaaactgatg

SEQ ID NO: 356189 - DNA, 25 bp, Mus musculus
tcagaaacaggtctggatgcttaag

SEQ ID NO: 356190 - DNA, 25 bp, Mus musculus
tcagaaacaggtctggcaggatcaa

SEQ ID NO: 356191 - DNA, 25 bp, Mus musculus
tcagaaacaggtggtgatgaagcat

SEQ ID NO: 356192 - DNA, 25 bp, Mus musculus
tcagaaacagtggaagcatcagttc

SEQ ID NO: 356193 - DNA, 25 bp, Mus musculus
tcagaaaccaaaccatatggagaag

SEQ ID NO: 356194 - DNA, 25 bp, Mus musculus
tcagaaaccaaaccggataagctgg

SEQ ID NO: 356195 - DNA, 25 bp, Mus musculus
tcagaaaccatggtcgcttatacca

SEQ ID NO: 356196 - DNA, 25 bp, Mus musculus
tcagaaaccatgtctcgaagatatg

SEQ ID NO: 356197 - DNA, 25 bp, Mus musculus
tcagaaaccgtggatgatgaaaaca

SEQ ID NO: 356198 - DNA, 25 bp, Mus musculus
tcagaaacctgaacctgtggacaaa

SEQ ID NO: 356199 - DNA, 25 bp, Mus musculus
tcagaaacctgatattcagacacac

SEQ ID NO: 356200 - DNA, 25 bp, Mus musculus
tcagaaacgaagaaagacccaggag

SEQ ID NO: 356201 - DNA, 25 bp, Mus musculus
tcagaaacgcttcctcagactgctg

SEQ ID NO: 356202 - DNA, 25 bp, Mus musculus
tcagaaactccaggaccaggaggat

SEQ ID NO: 356203 - DNA, 25 bp, Mus musculus
tcagaaactgaacagtaaccgattt

SEQ ID NO: 356204 - DNA, 25 bp, Mus musculus
tcagaaactgaacagtgtaccatct

SEQ ID NO: 356205 - DNA, 25 bp, Mus musculus
tcagaaagaagctagacgaaaggga

SEQ ID NO: 356206 - DNA, 25 bp, Mus musculus
tcagaaagagagtcctgttgaagag

SEQ ID NO: 356207 - DNA, 25 bp, Mus musculus
tcagaaagagatcccattcctggag

SEQ ID NO: 356208 - DNA, 25 bp, Mus musculus
tcagaaagataaggtgaccatagct

SEQ ID NO: 356209 - DNA, 25 bp, Mus musculus
tcagaaaggaagagatcaaagatga

SEQ ID NO: 356210 - DNA, 25 bp, Mus musculus
tcagaaaggagattaacaagtggtg

SEQ ID NO: 356211 - DNA, 25 bp, Mus musculus
tcagaaaggaggcatcatagctgcg

SEQ ID NO: 356212 - DNA, 25 bp, Mus musculus
tcagaaaggagttcgtgaagtgact

SEQ ID NO: 356213 - DNA, 25 bp, Mus musculus
tcagaaatatgatatcaccaccctc

SEQ ID NO: 356214 - DNA, 25 bp, Mus musculus
tcagaaatatgatatcatgactgtc

SEQ ID NO: 356215 - DNA, 25 bp, Mus musculus
tcagaaatatgatcagcaagaaggc

SEQ ID NO: 356216 - DNA, 25 bp, Mus musculus
tcagaaatgacacacttttgtgtaa

SEQ ID NO: 356217 - DNA, 25 bp, Mus musculus
tcagaaattgctcaggaaaatggac

SEQ ID NO: 356218 - DNA, 25 bp, Mus musculus
tcagaaattgctcagtgagcaaccc

SEQ ID NO: 356219 - DNA, 25 bp, Mus musculus
tcagaacacaagatggcccgcagag

SEQ ID NO: 356220 - DNA, 25 bp, Mus musculus
tcagaacacctaaagccttagggtc

SEQ ID NO: 356221 - DNA, 25 bp, Mus musculus
tcagaacacctaaagcggactcctc

SEQ ID NO: 356222 - DNA, 25 bp, Mus musculus
tcagaacagaaatgctgccaagaag

SEQ ID NO: 356223 - DNA, 25 bp, Mus musculus
tcagaacagaagcccacaaggagat

SEQ ID NO: 356224 - DNA, 25 bp, Mus musculus
tcagaacagaaggagtgtgtaagct

SEQ ID NO: 356225 - DNA, 25 bp, Mus musculus
tcagaacagatcattgtgacagaaa

SEQ ID NO: 356226 - DNA, 25 bp, Mus musculus
tcagaacataatggactccctggaa

SEQ ID NO: 356227 - DNA, 25 bp, Mus musculus
tcagaacataatggatggagaggag

SEQ ID NO: 356228 - DNA, 25 bp, Mus musculus
tcagaacatctctgatgtggatgcc

SEQ ID NO: 356229 - DNA, 25 bp, Mus musculus
tcagaaccagcctgggcccgaaggg

SEQ ID NO: 356230 - DNA, 25 bp, Mus musculus
tcagaaccagctttgaatggcagag

SEQ ID NO: 356231 - DNA, 25 bp, Mus musculus
tcagaaccaggtgaccaacgccagt

SEQ ID NO: 356232 - DNA, 25 bp, Mus musculus
tcagaacccgagggtttctctgccg

SEQ ID NO: 356233 - DNA, 25 bp, Mus musculus
tcagaacccggaggctgtttacttt

SEQ ID NO: 356234 - DNA, 25 bp, Mus musculus
tcagaaccgcgtgttgatcgtgtcc

SEQ ID NO: 356235 - DNA, 25 bp, Mus musculus
tcagaaccttcctgacctgggcggc

SEQ ID NO: 356236 - DNA, 25 bp, Mus musculus
tcagaaccttcctggggtctgtgat

SEQ ID NO: 356237 - DNA, 25 bp, Mus musculus
tcagaacctttgaggtctcagagct

SEQ ID NO: 356238 - DNA, 25 bp, Mus musculus
tcagaacctttgagttcctcatgaa

SEQ ID NO: 356239 - DNA, 25 bp, Mus musculus
tcagaacgcaccggtagctggagtt

SEQ ID NO: 356240 - DNA, 25 bp, Mus musculus
tcagaacgcgagcactttcatcaac

SEQ ID NO: 356241 - DNA, 25 bp, Mus musculus
tcagaactcaaataattttgcactc

SEQ ID NO: 356242 - DNA, 25 bp, Mus musculus
tcagaactcagcatcttatggaaga

SEQ ID NO: 356243 - DNA, 25 bp, Mus musculus
tcagaactcagtcaggctgttcctg

SEQ ID NO: 356244 - DNA, 25 bp, Mus musculus
tcagaactgagtacacaaacaagtt

SEQ ID NO: 356245 - DNA, 25 bp, Mus musculus
tcagaactgcagttggagctgcact

SEQ ID NO: 356246 - DNA, 25 bp, Mus musculus
tcagaactggatgaaggacattgat

SEQ ID NO: 356247 - DNA, 25 bp, Mus musculus
tcagaactggccagacaccttgttg

SEQ ID NO: 356248 - DNA, 25 bp, Mus musculus
tcagaactggccagatccgtctacc

SEQ ID NO: 356249 - DNA, 25 bp, Mus musculus
tcagaactggccagccccctgcctt

SEQ ID NO: 356250 - DNA, 25 bp, Mus musculus
tcagaacttacgagagtatttggag

SEQ ID NO: 356251 - DNA, 25 bp, Mus musculus
tcagaacttgggagacgactgcaca

SEQ ID NO: 356252 - DNA, 25 bp, Mus musculus
tcagaagaaagagtgcagcagctgc

SEQ ID NO: 356253 - DNA, 25 bp, Mus musculus
tcagaagaaatacgatgacagcgat

SEQ ID NO: 356254 - DNA, 25 bp, Mus musculus
tcagaagaaatacggcttcttggta

SEQ ID NO: 356255 - DNA, 25 bp, Mus musculus
tcagaagaagattggagcatatgat

SEQ ID NO: 356256 - DNA, 25 bp, Mus musculus
tcagaagaagattggagcctatgat

SEQ ID NO: 356257 - DNA, 25 bp, Mus musculus
tcagaagaagggtttcaaaaacaaa

SEQ ID NO: 356258 - DNA, 25 bp, Mus musculus
tcagaagaaggtcaaagaaggcaaa

SEQ ID NO: 356259 - DNA, 25 bp, Mus musculus
tcagaagacatcaagtgctgtaaca

SEQ ID NO: 356260 - DNA, 25 bp, Mus musculus
tcagaagagaaatatattgagcggt

SEQ ID NO: 356261 - DNA, 25 bp, Mus musculus
tcagaagagaaattttgaaatgccc

SEQ ID NO: 356262 - DNA, 25 bp, Mus musculus
tcagaagaggaggagggtccggacc

SEQ ID NO: 356263 - DNA, 25 bp, Mus musculus
tcagaagagggggacctacacactg

SEQ ID NO: 356264 - DNA, 25 bp, Mus musculus
tcagaagataccatctatgtctttt

SEQ ID NO: 356265 - DNA, 25 bp, Mus musculus
tcagaagatctagatcccgctcaag

SEQ ID NO: 356266 - DNA, 25 bp, Mus musculus
tcagaagatgaaaaagggttcaaag

SEQ ID NO: 356267 - DNA, 25 bp, Mus musculus
tcagaagatgattcagctaaatttg

SEQ ID NO: 356268 - DNA, 25 bp, Mus musculus
tcagaagatgcaaccctgagacctc

SEQ ID NO: 356269 - DNA, 25 bp, Mus musculus
tcagaagatgtacagattttccagg

SEQ ID NO: 356270 - DNA, 25 bp, Mus musculus
tcagaagattcagatggggctgagg

SEQ ID NO: 356271 - DNA, 25 bp, Mus musculus
tcagaagcaacaggagtgcaggagg

SEQ ID NO: 356272 - DNA, 25 bp, Mus musculus
tcagaagcaaggttttcgggttgca

SEQ ID NO: 356273 - DNA, 25 bp, Mus musculus
tcagaagcacggtactacaagaagt

SEQ ID NO: 356274 - DNA, 25 bp, Mus musculus
tcagaagcaggcagtgaggccaggt

SEQ ID NO: 356275 - DNA, 25 bp, Mus musculus
tcagaagcatctccatcgcctggtt

SEQ ID NO: 356276 - DNA, 25 bp, Mus musculus
tcagaagccaagctgctgcattttt

SEQ ID NO: 356277 - DNA, 25 bp, Mus musculus
tcagaagcccagatggtgcagtcac

SEQ ID NO: 356278 - DNA, 25 bp, Mus musculus
tcagaagccggggagtcccatggtc

SEQ ID NO: 356279 - DNA, 25 bp, Mus musculus
tcagaagctcaagacatgaagcgcc

SEQ ID NO: 356280 - DNA, 25 bp, Mus musculus
tcagaaggaatgcggcctccttccc

SEQ ID NO: 356281 - DNA, 25 bp, Mus musculus
tcagaaggctcggggaacctccgct

SEQ ID NO: 356282 - DNA, 25 bp, Mus musculus
tcagaaggtggccttcccaggacag

SEQ ID NO: 356283 - DNA, 25 bp, Mus musculus
tcagaagtctgagaactcagatgat

SEQ ID NO: 356284 - DNA, 25 bp, Mus musculus
tcagaagtctgagatgattgggaga

SEQ ID NO: 356285 - DNA, 25 bp, Mus musculus
tcagaagttaaggaaacatattcaa

SEQ ID NO: 356286 - DNA, 25 bp, Mus musculus
tcagaagttgcagcggcaatatggt

SEQ ID NO: 356287 - DNA, 25 bp, Mus musculus
tcagaagttgcaggaattattgaag

SEQ ID NO: 356288 - DNA, 25 bp, Mus musculus
tcagaataaggttcagcctatggaa

SEQ ID NO: 356289 - DNA, 25 bp, Mus musculus
tcagaatataacatctttaactaca

SEQ ID NO: 356290 - DNA, 25 bp, Mus musculus
tcagaatatcaccggattcatggtt

SEQ ID NO: 356291 - DNA, 25 bp, Mus musculus
tcagaatcaaaaggtggcagatgag

SEQ ID NO: 356292 - DNA, 25 bp, Mus musculus
tcagaatcacaaccagccagaccac

SEQ ID NO: 356293 - DNA, 25 bp, Mus musculus
tcagaatgaagaaagagctgtgcaa

SEQ ID NO: 356294 - DNA, 25 bp, Mus musculus
tcagaatgaagtatgagaatgaact

SEQ ID NO: 356295 - DNA, 25 bp, Mus musculus
tcagaatgctggtggacaagaagcc

SEQ ID NO: 356296 - DNA, 25 bp, Mus musculus
tcagaattcaagcagatttacaagg

SEQ ID NO: 356297 - DNA, 25 bp, Mus musculus
tcagaattcagggaagctaccttga

SEQ ID NO: 356298 - DNA, 25 bp, Mus musculus
tcagaattcaggtgttccatgagca

SEQ ID NO: 356299 - DNA, 25 bp, Mus musculus
tcagaattccaggtctatggaaatg

SEQ ID NO: 356300 - DNA, 25 bp, Mus musculus
tcagaattccccctcctcaggtaca

SEQ ID NO: 356301 - DNA, 25 bp, Mus musculus
tcagaattccgggagtgatcgagtt

SEQ ID NO: 356302 - DNA, 25 bp, Mus musculus
tcagaattgctagattagtggagta

SEQ ID NO: 356303 - DNA, 25 bp, Mus musculus
tcagaattggggaccctctgactat

SEQ ID NO: 356304 - DNA, 25 bp, Mus musculus
tcagaattttccagttccagtgcag

SEQ ID NO: 356305 - DNA, 25 bp, Mus musculus
tcagacaaaagattcgcctaaaact

SEQ ID NO: 356306 - DNA, 25 bp, Mus musculus
tcagacaaagacgaggaaccttcag

SEQ ID NO: 356307 - DNA, 25 bp, Mus musculus
tcagacaaagatgggctacaccccg

SEQ ID NO: 356308 - DNA, 25 bp, Mus musculus
tcagacaaagctaaaaatatcttta

SEQ ID NO: 356309 - DNA, 25 bp, Mus musculus
tcagacaaatgtcagtgagatcgag

SEQ ID NO: 356310 - DNA, 25 bp, Mus musculus
tcagacaactggaggagttggaaga

SEQ ID NO: 356311 - DNA, 25 bp, Mus musculus
tcagacaagaaaagtgaagaactgg

SEQ ID NO: 356312 - DNA, 25 bp, Mus musculus
tcagacaagaaagggatctgtgtgg

SEQ ID NO: 356313 - DNA, 25 bp, Mus musculus
tcagacaagaggtaaagaagaagaa

SEQ ID NO: 356314 - DNA, 25 bp, Mus musculus
tcagacacaaaccaaatgaacacac

SEQ ID NO: 356315 - DNA, 25 bp, Mus musculus
tcagacacaagcaggtcagatgtac

SEQ ID NO: 356316 - DNA, 25 bp, Mus musculus
tcagacaccaggaagcccctgagga

SEQ ID NO: 356317 - DNA, 25 bp, Mus musculus
tcagacacctgctcaacatggcgcc

SEQ ID NO: 356318 - DNA, 25 bp, Mus musculus
tcagacacctggcagtgcttaattt

SEQ ID NO: 356319 - DNA, 25 bp, Mus musculus
tcagacacgcggagcctctgacctc

SEQ ID NO: 356320 - DNA, 25 bp, Mus musculus
tcagacactggtgaggagcatgtcc

SEQ ID NO: 356321 - DNA, 25 bp, Mus musculus
tcagacagaggactactgttgaaga

SEQ ID NO: 356322 - DNA, 25 bp, Mus musculus
tcagacagataccagaccttcctgc

SEQ ID NO: 356323 - DNA, 25 bp, Mus musculus
tcagacagcaagacaaacgagggcc

SEQ ID NO: 356324 - DNA, 25 bp, Mus musculus
tcagacagcagtgggaccaggatgg

SEQ ID NO: 356325 - DNA, 25 bp, Mus musculus
tcagacagccgtgcttatggagaca

SEQ ID NO: 356326 - DNA, 25 bp, Mus musculus
tcagacagctcttgctgtttccaaa

SEQ ID NO: 356327 - DNA, 25 bp, Mus musculus
tcagacagtgacccagttgacatcc

SEQ ID NO: 356328 - DNA, 25 bp, Mus musculus
tcagacagtgggtgtccacccagct

SEQ ID NO: 356329 - DNA, 25 bp, Mus musculus
tcagacatagtcacagcccagcaca

SEQ ID NO: 356330 - DNA, 25 bp, Mus musculus
tcagacatgctggatagtctcacta

SEQ ID NO: 356331 - DNA, 25 bp, Mus musculus
tcagacattccagatgtctggccag

SEQ ID NO: 356332 - DNA, 25 bp, Mus musculus
tcagacattccaggtttcgtcttga

SEQ ID NO: 356333 - DNA, 25 bp, Mus musculus
tcagacattgtggagacattgagaa

SEQ ID NO: 356334 - DNA, 25 bp, Mus musculus
tcagacattgtggaggcattgaaca

SEQ ID NO: 356335 - DNA, 25 bp, Mus musculus
tcagaccaaagatgggttaatatcc

SEQ ID NO: 356336 - DNA, 25 bp, Mus musculus
tcagaccacaggttctcccctatgg

SEQ ID NO: 356337 - DNA, 25 bp, Mus musculus
tcagaccacaggtttgtccagaggg

SEQ ID NO: 356338 - DNA, 25 bp, Mus musculus
tcagaccagcagaacgagatggtgc

SEQ ID NO: 356339 - DNA, 25 bp, Mus musculus
tcagaccagcagagacgttcacagc

SEQ ID NO: 356340 - DNA, 25 bp, Mus musculus
tcagaccaggcagcgagtactaaca

SEQ ID NO: 356341 - DNA, 25 bp, Mus musculus
tcagaccatacagtcgtttaccctt

SEQ ID NO: 356342 - DNA, 25 bp, Mus musculus
tcagacccgcgcggcccgcgcagcc

SEQ ID NO: 356343 - DNA, 25 bp, Mus musculus
tcagacccgcgcgggcccacactcg

SEQ ID NO: 356344 - DNA, 25 bp, Mus musculus
tcagaccctggagccaccccgctgg

SEQ ID NO: 356345 - DNA, 25 bp, Mus musculus
tcagacccttgaactgaggaacggg

SEQ ID NO: 356346 - DNA, 25 bp, Mus musculus
tcagacctcgcaggaaattctacag

SEQ ID NO: 356347 - DNA, 25 bp, Mus musculus
tcagacctcgcaggaagacagatct

SEQ ID NO: 356348 - DNA, 25 bp, Mus musculus
tcagacctctcctgagatgggggtt

SEQ ID NO: 356349 - DNA, 25 bp, Mus musculus
tcagaccttaagggatagagaaggc

SEQ ID NO: 356350 - DNA, 25 bp, Mus musculus
tcagaccttaggggacttacttcta

SEQ ID NO: 356351 - DNA, 25 bp, Mus musculus
tcagacgacctagagatgtggtcag

SEQ ID NO: 356352 - DNA, 25 bp, Mus musculus
tcagacgataatgaagaaaacggga

SEQ ID NO: 356353 - DNA, 25 bp, Mus musculus
tcagacgatgaaggtgaagatgcca

SEQ ID NO: 356354 - DNA, 25 bp, Mus musculus
tcagacgatgaagtaaggaaagcca

SEQ ID NO: 356355 - DNA, 25 bp, Mus musculus
tcagacgatgagatggaactggagg

SEQ ID NO: 356356 - DNA, 25 bp, Mus musculus
tcagacgcaagaccattctttaaag

SEQ ID NO: 356357 - DNA, 25 bp, Mus musculus
tcagacgctcagatatgctgaagga

SEQ ID NO: 356358 - DNA, 25 bp, Mus musculus
tcagacgggagctgcaggagatgcg

SEQ ID NO: 356359 - DNA, 25 bp, Mus musculus
tcagacgtcactggagttcttttca

SEQ ID NO: 356360 - DNA, 25 bp, Mus musculus
tcagactaaggtggacttcacctcg

SEQ ID NO: 356361 - DNA, 25 bp, Mus musculus
tcagactacatggaatatgctcaga

SEQ ID NO: 356362 - DNA, 25 bp, Mus musculus
tcagactactccacggattacctca

SEQ ID NO: 356363 - DNA, 25 bp, Mus musculus
tcagactcaagcaagacctgcaggc

SEQ ID NO: 356364 - DNA, 25 bp, Mus musculus
tcagactcaagtacgaaaacgagct

SEQ ID NO: 356365 - DNA, 25 bp, Mus musculus
tcagactcagggttgagctccataa

SEQ ID NO: 356366 - DNA, 25 bp, Mus musculus
tcagactccggaagaacctcagcta

SEQ ID NO: 356367 - DNA, 25 bp, Mus musculus
tcagactcttcatttgatgcagcaa

SEQ ID NO: 356368 - DNA, 25 bp, Mus musculus
tcagactgaggcaccaagtatagat

SEQ ID NO: 356369 - DNA, 25 bp, Mus musculus
tcagactgctctacgaagcgctgcg

SEQ ID NO: 356370 - DNA, 25 bp, Mus musculus
tcagactggagaggctcccccaccg

SEQ ID NO: 356371 - DNA, 25 bp, Mus musculus
tcagactgggcccagtcttctggga

SEQ ID NO: 356372 - DNA, 25 bp, Mus musculus
tcagactggttaacgcttatttcct

SEQ ID NO: 356373 - DNA, 25 bp, Mus musculus
tcagacttcagatctgttgaacagg

SEQ ID NO: 356374 - DNA, 25 bp, Mus musculus
tcagacttctaaggcctctcctgca

SEQ ID NO: 356375 - DNA, 25 bp, Mus musculus
tcagacttctacctgtgtcttcctg

SEQ ID NO: 356376 - DNA, 25 bp, Mus musculus
tcagacttctcaaggctcagaaatc

SEQ ID NO: 356377 - DNA, 25 bp, Mus musculus
tcagacttgctggtacaagtatgaa

SEQ ID NO: 356378 - DNA, 25 bp, Mus musculus
tcagacttggatacccttctgcaag

SEQ ID NO: 356379 - DNA, 25 bp, Mus musculus
tcagactttgggcaggaaacaagtt

SEQ ID NO: 356380 - DNA, 25 bp, Mus musculus
tcagagaaaaacggctcttgcttct

SEQ ID NO: 356381 - DNA, 25 bp, Mus musculus
tcagagaaagatatgctggcatcgc

SEQ ID NO: 356382 - DNA, 25 bp, Mus musculus
tcagagaaagatatggcagtgaaaa

SEQ ID NO: 356383 - DNA, 25 bp, Mus musculus
tcagagaaagatgtgcactaggcct

SEQ ID NO: 356384 - DNA, 25 bp, Mus musculus
tcagagaaagcaggttcatgtttta

SEQ ID NO: 356385 - DNA, 25 bp, Mus musculus
tcagagaaaggttctcaacgcctgc

SEQ ID NO: 356386 - DNA, 25 bp, Mus musculus
tcagagaaaggtttaacatctcaac

SEQ ID NO: 356387 - DNA, 25 bp, Mus musculus
tcagagaagaagtgtttgaaagacg

SEQ ID NO: 356388 - DNA, 25 bp, Mus musculus
tcagagaagctcaagacatactttg

SEQ ID NO: 356389 - DNA, 25 bp, Mus musculus
tcagagaatagtcagacttctgcca

SEQ ID NO: 356390 - DNA, 25 bp, Mus musculus
tcagagaatgacactgtctctggct

SEQ ID NO: 356391 - DNA, 25 bp, Mus musculus
tcagagacaaggttctccccaccca

SEQ ID NO: 356392 - DNA, 25 bp, Mus musculus
tcagagacagaggtctcaagggagc

SEQ ID NO: 356393 - DNA, 25 bp, Mus musculus
tcagagacaggcctcaggatatcat

SEQ ID NO: 356394 - DNA, 25 bp, Mus musculus
tcagagacatggagttcttttcaaa

SEQ ID NO: 356395 - DNA, 25 bp, Mus musculus
tcagagacatgtatgcactgaagaa

SEQ ID NO: 356396 - DNA, 25 bp, Mus musculus
tcagagacccaagtgcataagtaaa

SEQ ID NO: 356397 - DNA, 25 bp, Mus musculus
tcagagaccgcaatctcactggtct

SEQ ID NO: 356398 - DNA, 25 bp, Mus musculus
tcagagaccgcaatgtgtatgtcga

SEQ ID NO: 356399 - DNA, 25 bp, Mus musculus
tcagagactcaggattgaaaagatg

SEQ ID NO: 356400 - DNA, 25 bp, Mus musculus
tcagagagaagaatgaaagtaacaa

SEQ ID NO: 356401 - DNA, 25 bp, Mus musculus
tcagagagaaggcagattctcattg

SEQ ID NO: 356402 - DNA, 25 bp, Mus musculus
tcagagagacatcttctctgtcacc

SEQ ID NO: 356403 - DNA, 25 bp, Mus musculus
tcagagagaggtaccgacccttgac

SEQ ID NO: 356404 - DNA, 25 bp, Mus musculus
tcagagagagtctttctgcaggtac

SEQ ID NO: 356405 - DNA, 25 bp, Mus musculus
tcagagagatgcaggtaacccctct

SEQ ID NO: 356406 - DNA, 25 bp, Mus musculus
tcagagagatgcagtatgacttctc

SEQ ID NO: 356407 - DNA, 25 bp, Mus musculus
tcagagagctgcatgcctcatggct

SEQ ID NO: 356408 - DNA, 25 bp, Mus musculus
tcagagaggaagattacaacaaccc

SEQ ID NO: 356409 - DNA, 25 bp, Mus musculus
tcagagaggagggccaaggaggctg

SEQ ID NO: 356410 - DNA, 25 bp, Mus musculus
tcagagagtcggcgtccctacagcc

SEQ ID NO: 356411 - DNA, 25 bp, Mus musculus
tcagagagtcgggtctgagtgcccg

SEQ ID NO: 356412 - DNA, 25 bp, Mus musculus
tcagagagtgatgcatggagcagtg

SEQ ID NO: 356413 - DNA, 25 bp, Mus musculus
tcagagagttaggctgccaacagct

SEQ ID NO: 356414 - DNA, 25 bp, Mus musculus
tcagagatacttttggactgaccaa

SEQ ID NO: 356415 - DNA, 25 bp, Mus musculus
tcagagatcccccaggcccggctct

SEQ ID NO: 356416 - DNA, 25 bp, Mus musculus
tcagagatcggcaggatgactgact

SEQ ID NO: 356417 - DNA, 25 bp, Mus musculus
tcagagattttgactttgtcttcgg

SEQ ID NO: 356418 - DNA, 25 bp, Mus musculus
tcagagcaaagatttctgctggacc

SEQ ID NO: 356419 - DNA, 25 bp, Mus musculus
tcagagcaaaggggggctctactac

SEQ ID NO: 356420 - DNA, 25 bp, Mus musculus
tcagagcaagcatcgctgccatgaa

SEQ ID NO: 356421 - DNA, 25 bp, Mus musculus
tcagagcaagcctggctgttttgac

SEQ ID NO: 356422 - DNA, 25 bp, Mus musculus
tcagagcacaggctcagaaatcctg

SEQ ID NO: 356423 - DNA, 25 bp, Mus musculus
tcagagcactagtgggactctgtaa

SEQ ID NO: 356424 - DNA, 25 bp, Mus musculus
tcagagcagcagaaactagacacca

SEQ ID NO: 356425 - DNA, 25 bp, Mus musculus
tcagagcagcagacaccatgtgcga

SEQ ID NO: 356426 - DNA, 25 bp, Mus musculus
tcagagcagcagactcctccctccc

SEQ ID NO: 356427 - DNA, 25 bp, Mus musculus
tcagagcagtgagcagtgggagaca

SEQ ID NO: 356428 - DNA, 25 bp, Mus musculus
tcagagcagtgaggataccgctatt

SEQ ID NO: 356429 - DNA, 25 bp, Mus musculus
tcagagccaaaagattcttcagttt

SEQ ID NO: 356430 - DNA, 25 bp, Mus musculus
tcagagccacgaaggagattctggg

SEQ ID NO: 356431 - DNA, 25 bp, Mus musculus
tcagagccagatagacctcttggcc

SEQ ID NO: 356432 - DNA, 25 bp, Mus musculus
tcagagccaggccaaggcatacttt

SEQ ID NO: 356433 - DNA, 25 bp, Mus musculus
tcagagccaggttggttcctgtaca

SEQ ID NO: 356434 - DNA, 25 bp, Mus musculus
tcagagccaggttgtaaaagttaac

SEQ ID NO: 356435 - DNA, 25 bp, Mus musculus
tcagagccagttgtcactcagccca

SEQ ID NO: 356436 - DNA, 25 bp, Mus musculus
tcagagccatagaggtggagtacat

SEQ ID NO: 356437 - DNA, 25 bp, Mus musculus
tcagagcccagtctcagatctcggt

SEQ ID NO: 356438 - DNA, 25 bp, Mus musculus
tcagagcctcagaattgctcagcca

SEQ ID NO: 356439 - DNA, 25 bp, Mus musculus
tcagagcctcagggggcctgtggca

SEQ ID NO: 356440 - DNA, 25 bp, Mus musculus
tcagagcgagggagcccgaaccaac

SEQ ID NO: 356441 - DNA, 25 bp, Mus musculus
tcagagcgatgtctggtccttcggg

SEQ ID NO: 356442 - DNA, 25 bp, Mus musculus
tcagagcgtcaaggtgtgggataag

SEQ ID NO: 356443 - DNA, 25 bp, Mus musculus
tcagagcgtctcatgatggagagaa

SEQ ID NO: 356444 - DNA, 25 bp, Mus musculus
tcagagctagaggatgtggagaaag

SEQ ID NO: 356445 - DNA, 25 bp, Mus musculus
tcagagctctcgtgacagccttgag

SEQ ID NO: 356446 - DNA, 25 bp, Mus musculus
tcagagctctttgatgacttgggtg

SEQ ID NO: 356447 - DNA, 25 bp, Mus musculus
tcagagctgaagccagcaagcctgc

SEQ ID NO: 356448 - DNA, 25 bp, Mus musculus
tcagagctgaaggctattctagact

SEQ ID NO: 356449 - DNA, 25 bp, Mus musculus
tcagagctgagatactagtgactgc

SEQ ID NO: 356450 - DNA, 25 bp, Mus musculus
tcagagctggaaccctgccacatgg

SEQ ID NO: 356451 - DNA, 25 bp, Mus musculus
tcagagctggacacggctgtccagg

SEQ ID NO: 356452 - DNA, 25 bp, Mus musculus
tcagagctggagagttgaagcagaa

SEQ ID NO: 356453 - DNA, 25 bp, Mus musculus
tcagagctggagcagaggagataat

SEQ ID NO: 356454 - DNA, 25 bp, Mus musculus
tcagagctggagcagaggagatcat

SEQ ID NO: 356455 - DNA, 25 bp, Mus musculus
tcagagctggcttccatggagatga

SEQ ID NO: 356456 - DNA, 25 bp, Mus musculus
tcagaggaatggcgtactcagttcg

SEQ ID NO: 356457 - DNA, 25 bp, Mus musculus
tcagaggaggagtattccaccaaag

SEQ ID NO: 356458 - DNA, 25 bp, Mus musculus
tcagaggaggatacgggaagccagg

SEQ ID NO: 356459 - DNA, 25 bp, Mus musculus
tcagaggatcacaagctgaagattc

SEQ ID NO: 356460 - DNA, 25 bp, Mus musculus
tcagaggcacagagaaagaatcata

SEQ ID NO: 356461 - DNA, 25 bp, Mus musculus
tcagaggcacagagatcaaaggcac

SEQ ID NO: 356462 - DNA, 25 bp, Mus musculus
tcagaggcagaagaacctgtgctgg

SEQ ID NO: 356463 - DNA, 25 bp, Mus musculus
tcagaggcagatgacctggatggac

SEQ ID NO: 356464 - DNA, 25 bp, Mus musculus
tcagaggccagaagacaccagtgca

SEQ ID NO: 356465 - DNA, 25 bp, Mus musculus
tcagaggccaggaccatccttgctg

SEQ ID NO: 356466 - DNA, 25 bp, Mus musculus
tcagaggcccaggcctctctttctg

SEQ ID NO: 356467 - DNA, 25 bp, Mus musculus
tcagaggctatggaattggaagcct

SEQ ID NO: 356468 - DNA, 25 bp, Mus musculus
tcagaggctgagaaaataatgttga

SEQ ID NO: 356469 - DNA, 25 bp, Mus musculus
tcagaggctgaggacaaatgagaag

SEQ ID NO: 356470 - DNA, 25 bp, Mus musculus
tcagagggaaaaatgccagatctct

SEQ ID NO: 356471 - DNA, 25 bp, Mus musculus
tcagagggacctctgttctcctcgg

SEQ ID NO: 356472 - DNA, 25 bp, Mus musculus
tcagaggggcaggagctccgggtca

SEQ ID NO: 356473 - DNA, 25 bp, Mus musculus
tcagagggtccgagattgtctaaag

SEQ ID NO: 356474 - DNA, 25 bp, Mus musculus
tcagaggtaaacagaaagaatttac

SEQ ID NO: 356475 - DNA, 25 bp, Mus musculus
tcagaggtggtaaaagagaagtcca

SEQ ID NO: 356476 - DNA, 25 bp, Mus musculus
tcagaggtttgagatggaagctcta

SEQ ID NO: 356477 - DNA, 25 bp, Mus musculus
tcagagtacagaggtccctcggttg

SEQ ID NO: 356478 - DNA, 25 bp, Mus musculus
tcagagtatgagaaaataaaggact

SEQ ID NO: 356479 - DNA, 25 bp, Mus musculus
tcagagtatgagaggctgttatgtt

SEQ ID NO: 356480 - DNA, 25 bp, Mus musculus
tcagagtatgaggaagaagattcca

SEQ ID NO: 356481 - DNA, 25 bp, Mus musculus
tcagagtatgagtttctcctcatct

SEQ ID NO: 356482 - DNA, 25 bp, Mus musculus
tcagagtatgtgtcttcaccctgct

SEQ ID NO: 356483 - DNA, 25 bp, Mus musculus
tcagagtattaaaaatgatacatcc

SEQ ID NO: 356484 - DNA, 25 bp, Mus musculus
tcagagtcatgtatcgagtggccca

SEQ ID NO: 356485 - DNA, 25 bp, Mus musculus
tcagagtccggggaaaacagtaaga

SEQ ID NO: 356486 - DNA, 25 bp, Mus musculus
tcagagtcggagtcttattttagtc

SEQ ID NO: 356487 - DNA, 25 bp, Mus musculus
tcagagtgaagaagaactcctacct

SEQ ID NO: 356488 - DNA, 25 bp, Mus musculus
tcagagtgaagaagcgagatcatca

SEQ ID NO: 356489 - DNA, 25 bp, Mus musculus
tcagagtgagatcatcatccaagtc

SEQ ID NO: 356490 - DNA, 25 bp, Mus musculus
tcagagtggcctcgcatggtcatgg

SEQ ID NO: 356491 - DNA, 25 bp, Mus musculus
tcagagtggcctctcaaaggcaggg

SEQ ID NO: 356492 - DNA, 25 bp, Mus musculus
tcagagtgggtacagagtataaagg

SEQ ID NO: 356493 - DNA, 25 bp, Mus musculus
tcagagttaacaaacatgatcaggg

SEQ ID NO: 356494 - DNA, 25 bp, Mus musculus
tcagagttaacaggtggctggatcc

SEQ ID NO: 356495 - DNA, 25 bp, Mus musculus
tcagagttacaggggcccagactga

SEQ ID NO: 356496 - DNA, 25 bp, Mus musculus
tcagagttacagggtatttttctta

SEQ ID NO: 356497 - DNA, 25 bp, Mus musculus
tcagagttgaaaccgacagagcatg

SEQ ID NO: 356498 - DNA, 25 bp, Mus musculus
tcagagttggaaacaacttcctgcg

SEQ ID NO: 356499 - DNA, 25 bp, Mus musculus
tcagagtttgaactctcttgctctc

SEQ ID NO: 356500 - DNA, 25 bp, Mus musculus
tcagagtttgaatctgtcggggctg

SEQ ID NO: 356501 - DNA, 25 bp, Mus musculus
tcagagtttgtcatccgtccttggc

SEQ ID NO: 356502 - DNA, 25 bp, Mus musculus
tcagataaagcaaattaaaaaggat

SEQ ID NO: 356503 - DNA, 25 bp, Mus musculus
tcagataaatcagatgttttcggtg

SEQ ID NO: 356504 - DNA, 25 bp, Mus musculus
tcagataaatcagcttctctccacg

SEQ ID NO: 356505 - DNA, 25 bp, Mus musculus
tcagatacagatatggagtaacaac

SEQ ID NO: 356506 - DNA, 25 bp, Mus musculus
tcagatacagatatggagtatacaa

SEQ ID NO: 356507 - DNA, 25 bp, Mus musculus
tcagatacataccaaggagggtgag

SEQ ID NO: 356508 - DNA, 25 bp, Mus musculus
tcagataccacggccagagatcctc

SEQ ID NO: 356509 - DNA, 25 bp, Mus musculus
tcagatactgaatgaatctgagctc

SEQ ID NO: 356510 - DNA, 25 bp, Mus musculus
tcagatactgttacagccctgccct

SEQ ID NO: 356511 - DNA, 25 bp, Mus musculus
tcagatagccttctgcaccaaggag

SEQ ID NO: 356512 - DNA, 25 bp, Mus musculus
tcagatatgctcggactcaaccgtg

SEQ ID NO: 356513 - DNA, 25 bp, Mus musculus
tcagatattgttgttgttacagatc

SEQ ID NO: 356514 - DNA, 25 bp, Mus musculus
tcagatcagacagaggactactgtt

SEQ ID NO: 356515 - DNA, 25 bp, Mus musculus
tcagatcaggaagaagactgcccgt

SEQ ID NO: 356516 - DNA, 25 bp, Mus musculus
tcagatccaaatcagacccggcact

SEQ ID NO: 356517 - DNA, 25 bp, Mus musculus
tcagatccatagggatttgaaagct

SEQ ID NO: 356518 - DNA, 25 bp, Mus musculus
tcagatcccagacttggagagagac

SEQ ID NO: 356519 - DNA, 25 bp, Mus musculus
tcagatcccaggaagccatgacatt

SEQ ID NO: 356520 - DNA, 25 bp, Mus musculus
tcagatcccagtatatttgtgtctt

SEQ ID NO: 356521 - DNA, 25 bp, Mus musculus
tcagatccgtgccatcgctgaacgc

SEQ ID NO: 356522 - DNA, 25 bp, Mus musculus
tcagatcgtccaaccttctgtgtta

SEQ ID NO: 356523 - DNA, 25 bp, Mus musculus
tcagatcgtccaagttgaaaggcca

SEQ ID NO: 356524 - DNA, 25 bp, Mus musculus
tcagatctcctgagccacagcctgc

SEQ ID NO: 356525 - DNA, 25 bp, Mus musculus
tcagatcttgcttagatggcaggtt

SEQ ID NO: 356526 - DNA, 25 bp, Mus musculus
tcagatcttggaggactccctgcag

SEQ ID NO: 356527 - DNA, 25 bp, Mus musculus
tcagatgagggaaagcactgccacc

SEQ ID NO: 356528 - DNA, 25 bp, Mus musculus
tcagatgagttcaaggccttgctgt

SEQ ID NO: 356529 - DNA, 25 bp, Mus musculus
tcagatgagttcaaggtggtggtcg

SEQ ID NO: 356530 - DNA, 25 bp, Mus musculus
tcagatgcacatatggatgcatctg

SEQ ID NO: 356531 - DNA, 25 bp, Mus musculus
tcagatgcacatcctcttctagaaa

SEQ ID NO: 356532 - DNA, 25 bp, Mus musculus
tcagatgcaggaacccagagtgggg

SEQ ID NO: 356533 - DNA, 25 bp, Mus musculus
tcagatgcaggatgccaggcagatc

SEQ ID NO: 356534 - DNA, 25 bp, Mus musculus
tcagatgcaggttgcgttacagtaa

SEQ ID NO: 356535 - DNA, 25 bp, Mus musculus
tcagatgcccagcaccccttgggga

SEQ ID NO: 356536 - DNA, 25 bp, Mus musculus
tcagatgctgtctatgtactgtgct

SEQ ID NO: 356537 - DNA, 25 bp, Mus musculus
tcagatgcttgtcccctgctctgcc

SEQ ID NO: 356538 - DNA, 25 bp, Mus musculus
tcagatggatgaggaagacatgggg

SEQ ID NO: 356539 - DNA, 25 bp, Mus musculus
tcagatggcagagagtgcagcagct

SEQ ID NO: 356540 - DNA, 25 bp, Mus musculus
tcagatggcaggaccccacaggccc

SEQ ID NO: 356541 - DNA, 25 bp, Mus musculus
tcagatggcaggcccaagtatctgg

SEQ ID NO: 356542 - DNA, 25 bp, Mus musculus
tcagatgtaccctcctgaaaagaag

SEQ ID NO: 356543 - DNA, 25 bp, Mus musculus
tcagatgtcacaggttaaagaaact

SEQ ID NO: 356544 - DNA, 25 bp, Mus musculus
tcagatgtccaagcccccaccttct

SEQ ID NO: 356545 - DNA, 25 bp, Mus musculus
tcagatgtccaaggtcagagtacac

SEQ ID NO: 356546 - DNA, 25 bp, Mus musculus
tcagatgtccaagtttggcaatgag

SEQ ID NO: 356547 - DNA, 25 bp, Mus musculus
tcagatgtctccagaacacttcagt

SEQ ID NO: 356548 - DNA, 25 bp, Mus musculus
tcagatgtggagatgacttggactg

SEQ ID NO: 356549 - DNA, 25 bp, Mus musculus
tcagatgtggagatggagtatacaa

SEQ ID NO: 356550 - DNA, 25 bp, Mus musculus
tcagatgttagaagatgtagctaaa

SEQ ID NO: 356551 - DNA, 25 bp, Mus musculus
tcagatgttagcactagcaacaagc

SEQ ID NO: 356552 - DNA, 25 bp, Mus musculus
tcagattaagggtttcaaaaacaaa

SEQ ID NO: 356553 - DNA, 25 bp, Mus musculus
tcagattacagatcccaggcaggca

SEQ ID NO: 356554 - DNA, 25 bp, Mus musculus
tcagattacagatttctgctcctaa

SEQ ID NO: 356555 - DNA, 25 bp, Mus musculus
tcagattcaggcaacaatatctttg

SEQ ID NO: 356556 - DNA, 25 bp, Mus musculus
tcagattccagagacactgtactac

SEQ ID NO: 356557 - DNA, 25 bp, Mus musculus
tcagattcctcagttccaccagagg

SEQ ID NO: 356558 - DNA, 25 bp, Mus musculus
tcagattctcagcttttaatatatt

SEQ ID NO: 356559 - DNA, 25 bp, Mus musculus
tcagattctcaggtaagctctgatg

SEQ ID NO: 356560 - DNA, 25 bp, Mus musculus
tcagattctgagagtctgctagtct

SEQ ID NO: 356561 - DNA, 25 bp, Mus musculus
tcagattctgagtctgatatccttt

SEQ ID NO: 356562 - DNA, 25 bp, Mus musculus
tcagattctgagtggggacctcatc

SEQ ID NO: 356563 - DNA, 25 bp, Mus musculus
tcagattgaaaagcttactaagcac

SEQ ID NO: 356564 - DNA, 25 bp, Mus musculus
tcagattgaaggtcagatgtaccag

SEQ ID NO: 356565 - DNA, 25 bp, Mus musculus
tcagatttaaaggttatagttatga

SEQ ID NO: 356566 - DNA, 25 bp, Mus musculus
tcagatttatggagtgtttgatgag

SEQ ID NO: 356567 - DNA, 25 bp, Mus musculus
tcagatttcacagagacagccattc

SEQ ID NO: 356568 - DNA, 25 bp, Mus musculus
tcagatttggacagcttccttgtga

SEQ ID NO: 356569 - DNA, 25 bp, Mus musculus
tcagatttggacagtttccagcagg

SEQ ID NO: 356570 - DNA, 25 bp, Mus musculus
tcagatttggggccaggaccctgcc

SEQ ID NO: 356571 - DNA, 25 bp, Mus musculus
tcagcaaaaacaaatcattgcaacg

SEQ ID NO: 356572 - DNA, 25 bp, Mus musculus
tcagcaaaaagcctaagaaagttgt

SEQ ID NO: 356573 - DNA, 25 bp, Mus musculus
tcagcaaatccagaggatctctctc

SEQ ID NO: 356574 - DNA, 25 bp, Mus musculus
tcagcaaatccagaggtgaaaatcc

SEQ ID NO: 356575 - DNA, 25 bp, Mus musculus
tcagcaaatgacatctggattatgc

SEQ ID NO: 356576 - DNA, 25 bp, Mus musculus
tcagcaaatgtggtaaacagctgga

SEQ ID NO: 356577 - DNA, 25 bp, Mus musculus
tcagcaacagcatccgccaccacgc

SEQ ID NO: 356578 - DNA, 25 bp, Mus musculus
tcagcaacctcatacattaaagtga

SEQ ID NO: 356579 - DNA, 25 bp, Mus musculus
tcagcaacctcatccctggcagccc

SEQ ID NO: 356580 - DNA, 25 bp, Mus musculus
tcagcaacctcatttccctgactga

SEQ ID NO: 356581 - DNA, 25 bp, Mus musculus
tcagcaacctccaagcctgaagggc

SEQ ID NO: 356582 - DNA, 25 bp, Mus musculus
tcagcaacctccaaggagtgtctaa

SEQ ID NO: 356583 - DNA, 25 bp, Mus musculus
tcagcaaccttgacgcatcgtggct

SEQ ID NO: 356584 - DNA, 25 bp, Mus musculus
tcagcaactgacaggggagcaaatt

SEQ ID NO: 356585 - DNA, 25 bp, Mus musculus
tcagcaactgagaggggagcaaatt

SEQ ID NO: 356586 - DNA, 25 bp, Mus musculus
tcagcaactgcaggacagtctccgt

SEQ ID NO: 356587 - DNA, 25 bp, Mus musculus
tcagcaactgcaggtggaagagctg

SEQ ID NO: 356588 - DNA, 25 bp, Mus musculus
tcagcaagaaagatgttattcttca

SEQ ID NO: 356589 - DNA, 25 bp, Mus musculus
tcagcaagaaagctgcaggaatgag

SEQ ID NO: 356590 - DNA, 25 bp, Mus musculus
tcagcaagagcttatttcctcaagc

SEQ ID NO: 356591 - DNA, 25 bp, Mus musculus
tcagcaagatactgggatctcgctg

SEQ ID NO: 356592 - DNA, 25 bp, Mus musculus
tcagcaagatactggggtctcacta

SEQ ID NO: 356593 - DNA, 25 bp, Mus musculus
tcagcaagatcaaggcattatgtta

SEQ ID NO: 356594 - DNA, 25 bp, Mus musculus
tcagcaagatgaagacatcccggca

SEQ ID NO: 356595 - DNA, 25 bp, Mus musculus
tcagcaagatgagtcgaaaggacaa

SEQ ID NO: 356596 - DNA, 25 bp, Mus musculus
tcagcaagccagagggcacccacaa

SEQ ID NO: 356597 - DNA, 25 bp, Mus musculus
tcagcaagccagaggtgtttgggaa

SEQ ID NO: 356598 - DNA, 25 bp, Mus musculus
tcagcaagggtattcttcagtatga

SEQ ID NO: 356599 - DNA, 25 bp, Mus musculus
tcagcaagttccagaacctgggtgt

SEQ ID NO: 356600 - DNA, 25 bp, Mus musculus
tcagcaatagtctggaagaaaggac

SEQ ID NO: 356601 - DNA, 25 bp, Mus musculus
tcagcaatgcttctgattcttataa

SEQ ID NO: 356602 - DNA, 25 bp, Mus musculus
tcagcaatgcttctggtgaccttgg

SEQ ID NO: 356603 - DNA, 25 bp, Mus musculus
tcagcaatggaagggcagcagagct

SEQ ID NO: 356604 - DNA, 25 bp, Mus musculus
tcagcaatggtgacctgctccagtg

SEQ ID NO: 356605 - DNA, 25 bp, Mus musculus
tcagcaatggtgtgaacaacccaga

SEQ ID NO: 356606 - DNA, 25 bp, Mus musculus
tcagcaatgtggacctggccatggg

SEQ ID NO: 356607 - DNA, 25 bp, Mus musculus
tcagcacaaagcagatttcaggtat

SEQ ID NO: 356608 - DNA, 25 bp, Mus musculus
tcagcacaaagcagtgtggtcatcc

SEQ ID NO: 356609 - DNA, 25 bp, Mus musculus
tcagcacaacaatgcagatagactg

SEQ ID NO: 356610 - DNA, 25 bp, Mus musculus
tcagcacaacatgggaaaacccagg

SEQ ID NO: 356611 - DNA, 25 bp, Mus musculus
tcagcacacatggaaccatgaattt

SEQ ID NO: 356612 - DNA, 25 bp, Mus musculus
tcagcacaccagaactatgccgagt

SEQ ID NO: 356613 - DNA, 25 bp, Mus musculus
tcagcacacctggagcctgttattc

SEQ ID NO: 356614 - DNA, 25 bp, Mus musculus
tcagcacagcaagagtgctgtcgac

SEQ ID NO: 356615 - DNA, 25 bp, Mus musculus
tcagcacagcttcagaacaaaagtc

SEQ ID NO: 356616 - DNA, 25 bp, Mus musculus
tcagcacagcttcagattccatcaa

SEQ ID NO: 356617 - DNA, 25 bp, Mus musculus
tcagcacagtgaaggcagtcggagc

SEQ ID NO: 356618 - DNA, 25 bp, Mus musculus
tcagcacatcagctgcacctcagtc

SEQ ID NO: 356619 - DNA, 25 bp, Mus musculus
tcagcacatcagctggtcctatgta

SEQ ID NO: 356620 - DNA, 25 bp, Mus musculus
tcagcacatgggagtggtcacagct

SEQ ID NO: 356621 - DNA, 25 bp, Mus musculus
tcagcacatgggctttcccagtgac

SEQ ID NO: 356622 - DNA, 25 bp, Mus musculus
tcagcacattatagtggaacaccag

SEQ ID NO: 356623 - DNA, 25 bp, Mus musculus
tcagcaccagatcagaatttcagca

SEQ ID NO: 356624 - DNA, 25 bp, Mus musculus
tcagcaccagatccctgctgtctga

SEQ ID NO: 356625 - DNA, 25 bp, Mus musculus
tcagcaccagctcgcagtggtcctt

SEQ ID NO: 356626 - DNA, 25 bp, Mus musculus
tcagcaccaggagggagctatggat

SEQ ID NO: 356627 - DNA, 25 bp, Mus musculus
tcagcaccagggattctgggcacat

SEQ ID NO: 356628 - DNA, 25 bp, Mus musculus
tcagcaccatcagggtatatccgaa

SEQ ID NO: 356629 - DNA, 25 bp, Mus musculus
tcagcaccatgcaggctgtcttctc

SEQ ID NO: 356630 - DNA, 25 bp, Mus musculus
tcagcaccatgtcaaatcctctggg

SEQ ID NO: 356631 - DNA, 25 bp, Mus musculus
tcagcacctttcagggaagccagct

SEQ ID NO: 356632 - DNA, 25 bp, Mus musculus
tcagcacgaatggtgcagtctttgt

SEQ ID NO: 356633 - DNA, 25 bp, Mus musculus
tcagcactcggtaattcagagatct

SEQ ID NO: 356634 - DNA, 25 bp, Mus musculus
tcagcactgaggttcaagaatttgg

SEQ ID NO: 356635 - DNA, 25 bp, Mus musculus
tcagcactggagagaccagccacga

SEQ ID NO: 356636 - DNA, 25 bp, Mus musculus
tcagcactgtcaagcggaagatgga

SEQ ID NO: 356637 - DNA, 25 bp, Mus musculus
tcagcactgtcaagcttctcatgct

SEQ ID NO: 356638 - DNA, 25 bp, Mus musculus
tcagcactgtcaaggatgtgtttga

SEQ ID NO: 356639 - DNA, 25 bp, Mus musculus
tcagcactgtcagacatagatattt

SEQ ID NO: 356640 - DNA, 25 bp, Mus musculus
tcagcactgtgtgtcaccgtgccgt

SEQ ID NO: 356641 - DNA, 25 bp, Mus musculus
tcagcacttatgtgatccgtgatga

SEQ ID NO: 356642 - DNA, 25 bp, Mus musculus
tcagcacttggcagaatcgtatgga

SEQ ID NO: 356643 - DNA, 25 bp, Mus musculus
tcagcacttttcctttgatcgctgc

SEQ ID NO: 356644 - DNA, 25 bp, Mus musculus
tcagcacttttcctttgatctctga

SEQ ID NO: 356645 - DNA, 25 bp, Mus musculus
tcagcagaacaaaccaaagaaaaag

SEQ ID NO: 356646 - DNA, 25 bp, Mus musculus
tcagcagaagcaacagcagaagcag

SEQ ID NO: 356647 - DNA, 25 bp, Mus musculus
tcagcagaagctgggtgccattgtg

SEQ ID NO: 356648 - DNA, 25 bp, Mus musculus
tcagcagaaggaagagcggtcgaga

SEQ ID NO: 356649 - DNA, 25 bp, Mus musculus
tcagcagaagtgcaggtattggttt

SEQ ID NO: 356650 - DNA, 25 bp, Mus musculus
tcagcagaatggcactacaagatgt

SEQ ID NO: 356651 - DNA, 25 bp, Mus musculus
tcagcagacacagattcaaaataaa

SEQ ID NO: 356652 - DNA, 25 bp, Mus musculus
tcagcagaccaaaatcacccaggac

SEQ ID NO: 356653 - DNA, 25 bp, Mus musculus
tcagcagactgagtcgtggtcctgc

SEQ ID NO: 356654 - DNA, 25 bp, Mus musculus
tcagcagagggaaggcctggccttg

SEQ ID NO: 356655 - DNA, 25 bp, Mus musculus
tcagcagagggaaggtgaccaacca

SEQ ID NO: 356656 - DNA, 25 bp, Mus musculus
tcagcagagtgaaaacacttcagct

SEQ ID NO: 356657 - DNA, 25 bp, Mus musculus
tcagcagatgatcctctaggcaccg

SEQ ID NO: 356658 - DNA, 25 bp, Mus musculus
tcagcagatggtacctggaccctgt

SEQ ID NO: 356659 - DNA, 25 bp, Mus musculus
tcagcagcagcggcaggaaaagccc

SEQ ID NO: 356660 - DNA, 25 bp, Mus musculus
tcagcagcaggtccaggggcagccg

SEQ ID NO: 356661 - DNA, 25 bp, Mus musculus
tcagcagcatccagttcgtgaagag

SEQ ID NO: 356662 - DNA, 25 bp, Mus musculus
tcagcagcatgcagggctttcagat

SEQ ID NO: 356663 - DNA, 25 bp, Mus musculus
tcagcagcatgcagggtaagcgcaa

SEQ ID NO: 356664 - DNA, 25 bp, Mus musculus
tcagcagcccagaccctacaagtac

SEQ ID NO: 356665 - DNA, 25 bp, Mus musculus
tcagcagcgagcagatgtctcattt

SEQ ID NO: 356666 - DNA, 25 bp, Mus musculus
tcagcagcgagtcagtaccatctgc

SEQ ID NO: 356667 - DNA, 25 bp, Mus musculus
tcagcagcggggttctctggaaacc

SEQ ID NO: 356668 - DNA, 25 bp, Mus musculus
tcagcagcgtcatggagatgctcag

SEQ ID NO: 356669 - DNA, 25 bp, Mus musculus
tcagcagctgtggctaacttcgacc

SEQ ID NO: 356670 - DNA, 25 bp, Mus musculus
tcagcagcttccagaaccacgtcaa

SEQ ID NO: 356671 - DNA, 25 bp, Mus musculus
tcagcagcttccagatttgtctcaa

SEQ ID NO: 356672 - DNA, 25 bp, Mus musculus
tcagcagcttccaggcgtccgcgag

SEQ ID NO: 356673 - DNA, 25 bp, Mus musculus
tcagcaggaagcgcatccagtatgg

SEQ ID NO: 356674 - DNA, 25 bp, Mus musculus
tcagcaggaagcgtcccaggttcct

SEQ ID NO: 356675 - DNA, 25 bp, Mus musculus
tcagcaggaagtaaaatctctttgt

SEQ ID NO: 356676 - DNA, 25 bp, Mus musculus
tcagcaggaagtatggaagcttctc

SEQ ID NO: 356677 - DNA, 25 bp, Mus musculus
tcagcaggacgtggtgacagagtta

SEQ ID NO: 356678 - DNA, 25 bp, Mus musculus
tcagcaggactccagagatcccgat

SEQ ID NO: 356679 - DNA, 25 bp, Mus musculus
tcagcaggataaaggcataatcaac

SEQ ID NO: 356680 - DNA, 25 bp, Mus musculus
tcagcaggatggaagagaagctgaa

SEQ ID NO: 356681 - DNA, 25 bp, Mus musculus
tcagcaggccaactctacaatggct

SEQ ID NO: 356682 - DNA, 25 bp, Mus musculus
tcagcagggacgcccgaggagctca

SEQ ID NO: 356683 - DNA, 25 bp, Mus musculus
tcagcaggggtggatctggcttctc

SEQ ID NO: 356684 - DNA, 25 bp, Mus musculus
tcagcagggtcagaccacacccgtg

SEQ ID NO: 356685 - DNA, 25 bp, Mus musculus
tcagcaggtaattagtgaaatggtt

SEQ ID NO: 356686 - DNA, 25 bp, Mus musculus
tcagcagtacagacgaaatgcctgg

SEQ ID NO: 356687 - DNA, 25 bp, Mus musculus
tcagcagtacaggccggccacgaag

SEQ ID NO: 356688 - DNA, 25 bp, Mus musculus
tcagcagtcagcatcaggggcgcat

SEQ ID NO: 356689 - DNA, 25 bp, Mus musculus
tcagcagtgctaattcaggtcttgc

SEQ ID NO: 356690 - DNA, 25 bp, Mus musculus
tcagcatacaagggagactctggag

SEQ ID NO: 356691 - DNA, 25 bp, Mus musculus
tcagcatagaaagtcctcgcgtgtc

SEQ ID NO: 356692 - DNA, 25 bp, Mus musculus
tcagcatagaagtttaccgacaaga

SEQ ID NO: 356693 - DNA, 25 bp, Mus musculus
tcagcatagtctccattcagaacca

SEQ ID NO: 356694 - DNA, 25 bp, Mus musculus
tcagcatagtgaagggcgagcttca

SEQ ID NO: 356695 - DNA, 25 bp, Mus musculus
tcagcatattccagatgttctgatg

SEQ ID NO: 356696 - DNA, 25 bp, Mus musculus
tcagcatcagattccaaatctatgc

SEQ ID NO: 356697 - DNA, 25 bp, Mus musculus
tcagcatcagggagccataattcca

SEQ ID NO: 356698 - DNA, 25 bp, Mus musculus
tcagcatcagggattgttacagagg

SEQ ID NO: 356699 - DNA, 25 bp, Mus musculus
tcagcatcaggggttcggcatgctg

SEQ ID NO: 356700 - DNA, 25 bp, Mus musculus
tcagcatcagtctggagcaaaagca

SEQ ID NO: 356701 - DNA, 25 bp, Mus musculus
tcagcatccagtcctggcttaacag

SEQ ID NO: 356702 - DNA, 25 bp, Mus musculus
tcagcatccgcctgatctctcaaca

SEQ ID NO: 356703 - DNA, 25 bp, Mus musculus
tcagcatcctgccagccaggagaca

SEQ ID NO: 356704 - DNA, 25 bp, Mus musculus
tcagcatcgtcaagagccgcctgca

SEQ ID NO: 356705 - DNA, 25 bp, Mus musculus
tcagcatcgtgtttactccagactt

SEQ ID NO: 356706 - DNA, 25 bp, Mus musculus
tcagcatctatcaagggagcaccat

SEQ ID NO: 356707 - DNA, 25 bp, Mus musculus
tcagcatgagagctggattgtcatt

SEQ ID NO: 356708 - DNA, 25 bp, Mus musculus
tcagcatgagaggaaccatttgtaa

SEQ ID NO: 356709 - DNA, 25 bp, Mus musculus
tcagcatgcaaaattctaaagataa

SEQ ID NO: 356710 - DNA, 25 bp, Mus musculus
tcagcatgcaagagactctgcagat

SEQ ID NO: 356711 - DNA, 25 bp, Mus musculus
tcagcatggctcaggaattttattg

SEQ ID NO: 356712 - DNA, 25 bp, Mus musculus
tcagcatggctcaggcaagtcttct

SEQ ID NO: 356713 - DNA, 25 bp, Mus musculus
tcagcattggatcttctgcgtgctg

SEQ ID NO: 356714 - DNA, 25 bp, Mus musculus
tcagcattggatcttttgggatgac

SEQ ID NO: 356715 - DNA, 25 bp, Mus musculus
tcagcattttctggggaatgaattc

SEQ ID NO: 356716 - DNA, 25 bp, Mus musculus
tcagccaaagaaccccaaatctcag

SEQ ID NO: 356717 - DNA, 25 bp, Mus musculus
tcagccaaagcctattggtgtaggt

SEQ ID NO: 356718 - DNA, 25 bp, Mus musculus
tcagccaaaggagccagtcacactg

SEQ ID NO: 356719 - DNA, 25 bp, Mus musculus
tcagccaaaggattgggacatgatc

SEQ ID NO: 356720 - DNA, 25 bp, Mus musculus
tcagccaaatggtgttgtgtgaagg

SEQ ID NO: 356721 - DNA, 25 bp, Mus musculus
tcagccaaatgtctttctgtaactc

SEQ ID NO: 356722 - DNA, 25 bp, Mus musculus
tcagccaaattgaggatgccatgag

SEQ ID NO: 356723 - DNA, 25 bp, Mus musculus
tcagccaaccagacatgccatgtcg

SEQ ID NO: 356724 - DNA, 25 bp, Mus musculus
tcagccaagaagaccaccaagtttt

SEQ ID NO: 356725 - DNA, 25 bp, Mus musculus
tcagccaagaaggccagcaccctgc

SEQ ID NO: 356726 - DNA, 25 bp, Mus musculus
tcagccaagcatccaaatatccagg

SEQ ID NO: 356727 - DNA, 25 bp, Mus musculus
tcagccaagcatccagaaggacatt

SEQ ID NO: 356728 - DNA, 25 bp, Mus musculus
tcagccaagccgctgcccagactac

SEQ ID NO: 356729 - DNA, 25 bp, Mus musculus
tcagccaatgctgagagcaactgtg

SEQ ID NO: 356730 - DNA, 25 bp, Mus musculus
tcagccaatgctgaggatgcccaag

SEQ ID NO: 356731 - DNA, 25 bp, Mus musculus
tcagccacactcagggcaggaggac

SEQ ID NO: 356732 - DNA, 25 bp, Mus musculus
tcagccacactcagggcgcttattc

SEQ ID NO: 356733 - DNA, 25 bp, Mus musculus
tcagccacagctgttctagctgaca

SEQ ID NO: 356734 - DNA, 25 bp, Mus musculus
tcagccacaggggcattaggagact

SEQ ID NO: 356735 - DNA, 25 bp, Mus musculus
tcagccaccctccagggatacggac

SEQ ID NO: 356736 - DNA, 25 bp, Mus musculus
tcagccactagacggttcttcatga

SEQ ID NO: 356737 - DNA, 25 bp, Mus musculus
tcagccacttactacaatttctgaa

SEQ ID NO: 356738 - DNA, 25 bp, Mus musculus
tcagccagacagagtccggccacaa

SEQ ID NO: 356739 - DNA, 25 bp, Mus musculus
tcagccagagatcaccagaagctgg

SEQ ID NO: 356740 - DNA, 25 bp, Mus musculus
tcagccagagcaaagtaaagacatt

SEQ ID NO: 356741 - DNA, 25 bp, Mus musculus
tcagccagagggggcttttacagct

SEQ ID NO: 356742 - DNA, 25 bp, Mus musculus
tcagccagatgaactttcaagttgt

SEQ ID NO: 356743 - DNA, 25 bp, Mus musculus
tcagccagcctattcttttactttt

SEQ ID NO: 356744 - DNA, 25 bp, Mus musculus
tcagccagctacagatgcagactca

SEQ ID NO: 356745 - DNA, 25 bp, Mus musculus
tcagccagctgagggagtatgattt

SEQ ID NO: 356746 - DNA, 25 bp, Mus musculus
tcagccaggagggagcggacatgga

SEQ ID NO: 356747 - DNA, 25 bp, Mus musculus
tcagccaggtaagaatctacccagc

SEQ ID NO: 356748 - DNA, 25 bp, Mus musculus
tcagccagtgctccacctggtggca

SEQ ID NO: 356749 - DNA, 25 bp, Mus musculus
tcagccatacggacacatgtgctga

SEQ ID NO: 356750 - DNA, 25 bp, Mus musculus
tcagccatacggagtgagcctgtga

SEQ ID NO: 356751 - DNA, 25 bp, Mus musculus
tcagccatcaactggaccctcattc

SEQ ID NO: 356752 - DNA, 25 bp, Mus musculus
tcagccatccaaggatgaggccatc

SEQ ID NO: 356753 - DNA, 25 bp, Mus musculus
tcagcccaatgaatccccagcttca

SEQ ID NO: 356754 - DNA, 25 bp, Mus musculus
tcagcccacagaaaccactcactct

SEQ ID NO: 356755 - DNA, 25 bp, Mus musculus
tcagcccacagctccccataggtgc

SEQ ID NO: 356756 - DNA, 25 bp, Mus musculus
tcagcccactggatcaaacaacatc

SEQ ID NO: 356757 - DNA, 25 bp, Mus musculus
tcagcccactggcctcttcaggtgg

SEQ ID NO: 356758 - DNA, 25 bp, Mus musculus
tcagcccatcagaagttttcctgac

SEQ ID NO: 356759 - DNA, 25 bp, Mus musculus
tcagcccatgaagcaagcttgggca

SEQ ID NO: 356760 - DNA, 25 bp, Mus musculus
tcagccccagagcacagaggacatc

SEQ ID NO: 356761 - DNA, 25 bp, Mus musculus
tcagccccagagcttcggtgcaacc

SEQ ID NO: 356762 - DNA, 25 bp, Mus musculus
tcagccccagaggtctcagcaatct

SEQ ID NO: 356763 - DNA, 25 bp, Mus musculus
tcagccccagcctggtagggatgca

SEQ ID NO: 356764 - DNA, 25 bp, Mus musculus
tcagccccagctcgtgcccccttat

SEQ ID NO: 356765 - DNA, 25 bp, Mus musculus
tcagccccagctctcgggacagtcc

SEQ ID NO: 356766 - DNA, 25 bp, Mus musculus
tcagccccagctggtgcccccttat

SEQ ID NO: 356767 - DNA, 25 bp, Mus musculus
tcagccccagggaagaggaacagct

SEQ ID NO: 356768 - DNA, 25 bp, Mus musculus
tcagcccccatttgaataagactgt

SEQ ID NO: 356769 - DNA, 25 bp, Mus musculus
tcagccccctgaaagcctctggaga

SEQ ID NO: 356770 - DNA, 25 bp, Mus musculus
tcagccccgtctgagggcagtcctt

SEQ ID NO: 356771 - DNA, 25 bp, Mus musculus
tcagcccctcctcctccctccctca

SEQ ID NO: 356772 - DNA, 25 bp, Mus musculus
tcagcccctctgcacctaccctgtg

SEQ ID NO: 356773 - DNA, 25 bp, Mus musculus
tcagcccggcagccacatgttccca

SEQ ID NO: 356774 - DNA, 25 bp, Mus musculus
tcagccctcagtggaccctgatcag

SEQ ID NO: 356775 - DNA, 25 bp, Mus musculus
tcagccctcatcaatgaggaactct

SEQ ID NO: 356776 - DNA, 25 bp, Mus musculus
tcagccctcccaaaacatgactttg

SEQ ID NO: 356777 - DNA, 25 bp, Mus musculus
tcagccctgagagggagattcgtaa

SEQ ID NO: 356778 - DNA, 25 bp, Mus musculus
tcagccctgagggcagagcagccat

SEQ ID NO: 356779 - DNA, 25 bp, Mus musculus
tcagccctgaggttatttcgtcatc

SEQ ID NO: 356780 - DNA, 25 bp, Mus musculus
tcagccctgcacaggctagccctgc

SEQ ID NO: 356781 - DNA, 25 bp, Mus musculus
tcagccctgcgcagatggtggacct

SEQ ID NO: 356782 - DNA, 25 bp, Mus musculus
tcagccctgctgctggctgtcatct

SEQ ID NO: 356783 - DNA, 25 bp, Mus musculus
tcagccctgctgctgtggtgaaagg

SEQ ID NO: 356784 - DNA, 25 bp, Mus musculus
tcagccgaaagtttaagaggcgagt

SEQ ID NO: 356785 - DNA, 25 bp, Mus musculus
tcagccgcatcgctctgaagaaaga

SEQ ID NO: 356786 - DNA, 25 bp, Mus musculus
tcagccgcgtccagaccatttttgc

SEQ ID NO: 356787 - DNA, 25 bp, Mus musculus
tcagccgcttatcattaccagttca

SEQ ID NO: 356788 - DNA, 25 bp, Mus musculus
tcagccggcaggctcatagtggcag

SEQ ID NO: 356789 - DNA, 25 bp, Mus musculus
tcagccgggaagaggtgctgagcta

SEQ ID NO: 356790 - DNA, 25 bp, Mus musculus
tcagccgtggatgaacaggccgatc

SEQ ID NO: 356791 - DNA, 25 bp, Mus musculus
tcagcctaccaggtacaaccacgtt

SEQ ID NO: 356792 - DNA, 25 bp, Mus musculus
tcagcctcagaaccgcaaatttatt

SEQ ID NO: 356793 - DNA, 25 bp, Mus musculus
tcagcctcagcccagcgtaagcgga

SEQ ID NO: 356794 - DNA, 25 bp, Mus musculus
tcagcctcaggaagaaactatcaat

SEQ ID NO: 356795 - DNA, 25 bp, Mus musculus
tcagcctcaggaatacatcatggaa

SEQ ID NO: 356796 - DNA, 25 bp, Mus musculus
tcagcctcaggttatgaaaatgact

SEQ ID NO: 356797 - DNA, 25 bp, Mus musculus
tcagcctcagtggtgacccaagcag

SEQ ID NO: 356798 - DNA, 25 bp, Mus musculus
tcagcctccagaaccgcaaagatgc

SEQ ID NO: 356799 - DNA, 25 bp, Mus musculus
tcagcctctgcagatgcctgagcac

SEQ ID NO: 356800 - DNA, 25 bp, Mus musculus
tcagcctctgcagcactgccagagt

SEQ ID NO: 356801 - DNA, 25 bp, Mus musculus
tcagcctgaccaaggagcaggcgga

SEQ ID NO: 356802 - DNA, 25 bp, Mus musculus
tcagcctgcagttctgtttctctct

SEQ ID NO: 356803 - DNA, 25 bp, Mus musculus
tcagcctgcagttcttccacttgat

SEQ ID NO: 356804 - DNA, 25 bp, Mus musculus
tcagcctgcataaggctgcggagaa

SEQ ID NO: 356805 - DNA, 25 bp, Mus musculus
tcagcctgctgctgcctccaggtgg

SEQ ID NO: 356806 - DNA, 25 bp, Mus musculus
tcagcctggaagacctgccaggcct

SEQ ID NO: 356807 - DNA, 25 bp, Mus musculus
tcagcctggaggacacagagctgca

SEQ ID NO: 356808 - DNA, 25 bp, Mus musculus
tcagcctgtctgccccatgtccatc

SEQ ID NO: 356809 - DNA, 25 bp, Mus musculus
tcagcctgttgttgctcaccaaggt

SEQ ID NO: 356810 - DNA, 25 bp, Mus musculus
tcagccttatgccctggttccacgg

SEQ ID NO: 356811 - DNA, 25 bp, Mus musculus
tcagccttcaaaagaatggcagtct

SEQ ID NO: 356812 - DNA, 25 bp, Mus musculus
tcagccttcaaaagtgtgctgggga

SEQ ID NO: 356813 - DNA, 25 bp, Mus musculus
tcagccttgaggtcccactggaaga

SEQ ID NO: 356814 - DNA, 25 bp, Mus musculus
tcagccttggtacaggcagcagtta

SEQ ID NO: 356815 - DNA, 25 bp, Mus musculus
tcagcctttagttcctctttccaca

SEQ ID NO: 356816 - DNA, 25 bp, Mus musculus
tcagcgaaaccaggtccacaggatg

SEQ ID NO: 356817 - DNA, 25 bp, Mus musculus
tcagcgacacgcgggcgtccgaaac

SEQ ID NO: 356818 - DNA, 25 bp, Mus musculus
tcagcgacatcgatggagatgggtg

SEQ ID NO: 356819 - DNA, 25 bp, Mus musculus
tcagcgactgggtgccattgtggct

SEQ ID NO: 356820 - DNA, 25 bp, Mus musculus
tcagcgagaaaggagacaccgtggc

SEQ ID NO: 356821 - DNA, 25 bp, Mus musculus
tcagcgaggaagatgaggacgatgt

SEQ ID NO: 356822 - DNA, 25 bp, Mus musculus
tcagcgaggctggaggcaccatgag

SEQ ID NO: 356823 - DNA, 25 bp, Mus musculus
tcagcgaggggtgagctgaaccccc

SEQ ID NO: 356824 - DNA, 25 bp, Mus musculus
tcagcgatcaggatatgacattaca

SEQ ID NO: 356825 - DNA, 25 bp, Mus musculus
tcagcgatctggagccccgcaagtg

SEQ ID NO: 356826 - DNA, 25 bp, Mus musculus
tcagcgatctggagctgcagcgctc

SEQ ID NO: 356827 - DNA, 25 bp, Mus musculus
tcagcgatgagaaagatgtctcaac

SEQ ID NO: 356828 - DNA, 25 bp, Mus musculus
tcagcgatgagatggtacagaactt

SEQ ID NO: 356829 - DNA, 25 bp, Mus musculus
tcagcgatgaggtagttttgagctg

SEQ ID NO: 356830 - DNA, 25 bp, Mus musculus
tcagcgcaaactgggcaaacgctac

SEQ ID NO: 356831 - DNA, 25 bp, Mus musculus
tcagcgcaactcagatggctccaga

SEQ ID NO: 356832 - DNA, 25 bp, Mus musculus
tcagcgcaactcaggctgactcccc

SEQ ID NO: 356833 - DNA, 25 bp, Mus musculus
tcagcgccgccgctggagagatgtc

SEQ ID NO: 356834 - DNA, 25 bp, Mus musculus
tcagcgcctctggagttagtgagct

SEQ ID NO: 356835 - DNA, 25 bp, Mus musculus
tcagcgcctctggtgacagagtgcc

SEQ ID NO: 356836 - DNA, 25 bp, Mus musculus
tcagcgcctctgtcttgttttcaga

SEQ ID NO: 356837 - DNA, 25 bp, Mus musculus
tcagcgcgctcaagaatttgtcttc

SEQ ID NO: 356838 - DNA, 25 bp, Mus musculus
tcagcgctatgagaaaattattttc

SEQ ID NO: 356839 - DNA, 25 bp, Mus musculus
tcagcgctatgagaaattactcttc

SEQ ID NO: 356840 - DNA, 25 bp, Mus musculus
tcagcgctgacaggtacagagctat

SEQ ID NO: 356841 - DNA, 25 bp, Mus musculus
tcagcgcttagcccggaagaccagc

SEQ ID NO: 356842 - DNA, 25 bp, Mus musculus
tcagcggaggggtatctgctataga

SEQ ID NO: 356843 - DNA, 25 bp, Mus musculus
tcagcggataccaaactgttttctg

SEQ ID NO: 356844 - DNA, 25 bp, Mus musculus
tcagcggcccagcgtccgatgcaag

SEQ ID NO: 356845 - DNA, 25 bp, Mus musculus
tcagcggcggacagggagaatcccg

SEQ ID NO: 356846 - DNA, 25 bp, Mus musculus
tcagcggctcaggatggcctcaggc

SEQ ID NO: 356847 - DNA, 25 bp, Mus musculus
tcagcggctcaggccctgcccattt

SEQ ID NO: 356848 - DNA, 25 bp, Mus musculus
tcagcgggccctgacgatctgctgg

SEQ ID NO: 356849 - DNA, 25 bp, Mus musculus
tcagcgggtcaggtatatgcaccat

SEQ ID NO: 356850 - DNA, 25 bp, Mus musculus
tcagcgggtcaggtatggatgagcg

SEQ ID NO: 356851 - DNA, 25 bp, Mus musculus
tcagcggttacaggatgagctgagt

SEQ ID NO: 356852 - DNA, 25 bp, Mus musculus
tcagcggttacagggtcttacttat

SEQ ID NO: 356853 - DNA, 25 bp, Mus musculus
tcagcgtcagggccgcgttggcctc

SEQ ID NO: 356854 - DNA, 25 bp, Mus musculus
tcagcgtcagtctgaaggtgcttcc

SEQ ID NO: 356855 - DNA, 25 bp, Mus musculus
tcagcgtcagtctgcctttgcctga

SEQ ID NO: 356856 - DNA, 25 bp, Mus musculus
tcagcgtcccatggcctagccgccc

SEQ ID NO: 356857 - DNA, 25 bp, Mus musculus
tcagcgtctgggaaagaagaggtta

SEQ ID NO: 356858 - DNA, 25 bp, Mus musculus
tcagcgtgaagatgtactggttccg

SEQ ID NO: 356859 - DNA, 25 bp, Mus musculus
tcagcgtgatcgcaatgagaggtat

SEQ ID NO: 356860 - DNA, 25 bp, Mus musculus
tcagcgtggagcccttggatgaagc

SEQ ID NO: 356861 - DNA, 25 bp, Mus musculus
tcagcgtggagctgcagcccttgga

SEQ ID NO: 356862 - DNA, 25 bp, Mus musculus
tcagcgtgtcctatgactggccact

SEQ ID NO: 356863 - DNA, 25 bp, Mus musculus
tcagcgtgtcctatgactggctgat

SEQ ID NO: 356864 - DNA, 25 bp, Mus musculus
tcagcgtgtctcatactacaaggaa

SEQ ID NO: 356865 - DNA, 25 bp, Mus musculus
tcagctaaaaagtgggaaatgaaag

SEQ ID NO: 356866 - DNA, 25 bp, Mus musculus
tcagctaacagtggtaccagtgggg

SEQ ID NO: 356867 - DNA, 25 bp, Mus musculus
tcagctaaccaaggaagggatgcta

SEQ ID NO: 356868 - DNA, 25 bp, Mus musculus
tcagctaaccaaggtttgcccacag

SEQ ID NO: 356869 - DNA, 25 bp, Mus musculus
tcagctaaggaaaggtacaaaaata

SEQ ID NO: 356870 - DNA, 25 bp, Mus musculus
tcagctacaaaggcaacatctggga

SEQ ID NO: 356871 - DNA, 25 bp, Mus musculus
tcagctacaagatgctgggtgccct

SEQ ID NO: 356872 - DNA, 25 bp, Mus musculus
tcagctacaggctcagaaagaagaa

SEQ ID NO: 356873 - DNA, 25 bp, Mus musculus
tcagctacccaggttgaggctgagg

SEQ ID NO: 356874 - DNA, 25 bp, Mus musculus
tcagctacctcggtaccagtacttg

SEQ ID NO: 356875 - DNA, 25 bp, Mus musculus
tcagctacgcatcatgccactgcct

SEQ ID NO: 356876 - DNA, 25 bp, Mus musculus
tcagctatagcctggacctgctctc

SEQ ID NO: 356877 - DNA, 25 bp, Mus musculus
tcagctatagcctggtgcttgagaa

SEQ ID NO: 356878 - DNA, 25 bp, Mus musculus
tcagctatctccggtccaaatatca

SEQ ID NO: 356879 - DNA, 25 bp, Mus musculus
tcagctcaaggctgtcaagtcctct

SEQ ID NO: 356880 - DNA, 25 bp, Mus musculus
tcagctcagagcagctttgacctcg

SEQ ID NO: 356881 - DNA, 25 bp, Mus musculus
tcagctcagcctggaagacctgcca

SEQ ID NO: 356882 - DNA, 25 bp, Mus musculus
tcagctccagccagggatagagaag

SEQ ID NO: 356883 - DNA, 25 bp, Mus musculus
tcagctcccaggttgaagaaatggt

SEQ ID NO: 356884 - DNA, 25 bp, Mus musculus
tcagctccctcaaagatgaacgaga

SEQ ID NO: 356885 - DNA, 25 bp, Mus musculus
tcagctcctacctccttcttcagag

SEQ ID NO: 356886 - DNA, 25 bp, Mus musculus
tcagctcctgcagccggatgtatgg

SEQ ID NO: 356887 - DNA, 25 bp, Mus musculus
tcagctcctggaactatgtcttcag

SEQ ID NO: 356888 - DNA, 25 bp, Mus musculus
tcagctcctggaactgaataaaagc

SEQ ID NO: 356889 - DNA, 25 bp, Mus musculus
tcagctcctggaactgtgttacatc

SEQ ID NO: 356890 - DNA, 25 bp, Mus musculus
tcagctcgagtgccatccgtgagcg

SEQ ID NO: 356891 - DNA, 25 bp, Mus musculus
tcagctcgcacagtgatgatgtgct

SEQ ID NO: 356892 - DNA, 25 bp, Mus musculus
tcagctcgcacagtgggctgttggt

SEQ ID NO: 356893 - DNA, 25 bp, Mus musculus
tcagctcgcacagtggtttcaagtg

SEQ ID NO: 356894 - DNA, 25 bp, Mus musculus
tcagctcgcccaacttcatcaagcc

SEQ ID NO: 356895 - DNA, 25 bp, Mus musculus
tcagctcggaggacaggtcaatggc

SEQ ID NO: 356896 - DNA, 25 bp, Mus musculus
tcagctcgtttcaagagaacggcag

SEQ ID NO: 356897 - DNA, 25 bp, Mus musculus
tcagctctaaagcgagacctagatg

SEQ ID NO: 356898 - DNA, 25 bp, Mus musculus
tcagctctaattggtttcaaatgta

SEQ ID NO: 356899 - DNA, 25 bp, Mus musculus
tcagctctacctaggcacaaaaggc

SEQ ID NO: 356900 - DNA, 25 bp, Mus musculus
tcagctctctccccatgactgactt

SEQ ID NO: 356901 - DNA, 25 bp, Mus musculus
tcagctctgagaggatgtgcccgat

SEQ ID NO: 356902 - DNA, 25 bp, Mus musculus
tcagctctgcaccagagattgtgca

SEQ ID NO: 356903 - DNA, 25 bp, Mus musculus
tcagctctgcaccaggtctacctgg

SEQ ID NO: 356904 - DNA, 25 bp, Mus musculus
tcagctctgcggaggtgctgctggg

SEQ ID NO: 356905 - DNA, 25 bp, Mus musculus
tcagctgaaaaacattggattgcaa

SEQ ID NO: 356906 - DNA, 25 bp, Mus musculus
tcagctgaaggaactcagagaaagc

SEQ ID NO: 356907 - DNA, 25 bp, Mus musculus
tcagctgaagtcaggaaagtcagca

SEQ ID NO: 356908 - DNA, 25 bp, Mus musculus
tcagctgaagtgtgggagtatggat

SEQ ID NO: 356909 - DNA, 25 bp, Mus musculus
tcagctgacactgtagctcagtgga

SEQ ID NO: 356910 - DNA, 25 bp, Mus musculus
tcagctgagcccagtccctgcaggg

SEQ ID NO: 356911 - DNA, 25 bp, Mus musculus
tcagctgcagactctgatactacca

SEQ ID NO: 356912 - DNA, 25 bp, Mus musculus
tcagctgcagagtgctgatcccagc

SEQ ID NO: 356913 - DNA, 25 bp, Mus musculus
tcagctgcaggtggccaagacgaag

SEQ ID NO: 356914 - DNA, 25 bp, Mus musculus
tcagctgctgagcagctgcagcagc

SEQ ID NO: 356915 - DNA, 25 bp, Mus musculus
tcagctgctgagcaggttcaatttt

SEQ ID NO: 356916 - DNA, 25 bp, Mus musculus
tcagctgctgaggttatttaaactg

SEQ ID NO: 356917 - DNA, 25 bp, Mus musculus
tcagctgctgcgcagaagaagagct

SEQ ID NO: 356918 - DNA, 25 bp, Mus musculus
tcagctgctgggactccgaggtgac

SEQ ID NO: 356919 - DNA, 25 bp, Mus musculus
tcagctggaaggaggaagatgggct

SEQ ID NO: 356920 - DNA, 25 bp, Mus musculus
tcagctggacagagagttaattgac

SEQ ID NO: 356921 - DNA, 25 bp, Mus musculus
tcagctggagaaggtggacggtatc

SEQ ID NO: 356922 - DNA, 25 bp, Mus musculus
tcagctggcaacacccaaggccctg

SEQ ID NO: 356923 - DNA, 25 bp, Mus musculus
tcagctggcaagaccggggttcgat

SEQ ID NO: 356924 - DNA, 25 bp, Mus musculus
tcagctggttgtgcagacaaaatgg

SEQ ID NO: 356925 - DNA, 25 bp, Mus musculus
tcagctggttgtgcagtcaaaatgg

SEQ ID NO: 356926 - DNA, 25 bp, Mus musculus
tcagctgtaatggtgcgtctaatgc

SEQ ID NO: 356927 - DNA, 25 bp, Mus musculus
tcagctgtaccagataacatgttta

SEQ ID NO: 356928 - DNA, 25 bp, Mus musculus
tcagctgtatccttcaggagcccaa

SEQ ID NO: 356929 - DNA, 25 bp, Mus musculus
tcagctgtcagtgcactgatgtctg

SEQ ID NO: 356930 - DNA, 25 bp, Mus musculus
tcagctgtcagttctttgccagaac

SEQ ID NO: 356931 - DNA, 25 bp, Mus musculus
tcagctgtgacaaaggggaggaaat

SEQ ID NO: 356932 - DNA, 25 bp, Mus musculus
tcagcttaccaaaaggatatccagg

SEQ ID NO: 356933 - DNA, 25 bp, Mus musculus
tcagcttaccaaaaggtacctgtgt

SEQ ID NO: 356934 - DNA, 25 bp, Mus musculus
tcagcttagaaggctgtgaatgaag

SEQ ID NO: 356935 - DNA, 25 bp, Mus musculus
tcagcttatcaggtgcccagataga

SEQ ID NO: 356936 - DNA, 25 bp, Mus musculus
tcagcttcaaatcagtaccacactt

SEQ ID NO: 356937 - DNA, 25 bp, Mus musculus
tcagcttcaaggtggacagcagcaa

SEQ ID NO: 356938 - DNA, 25 bp, Mus musculus
tcagcttcaaggtttggattcagga

SEQ ID NO: 356939 - DNA, 25 bp, Mus musculus
tcagcttcattgatgaagcccgctc

SEQ ID NO: 356940 - DNA, 25 bp, Mus musculus
tcagcttcattggggttccttggag

SEQ ID NO: 356941 - DNA, 25 bp, Mus musculus
tcagcttcatttcaggctcctgtgg

SEQ ID NO: 356942 - DNA, 25 bp, Mus musculus
tcagcttccacagaaactcaagtca

SEQ ID NO: 356943 - DNA, 25 bp, Mus musculus
tcagcttccacagaccatgccttaa

SEQ ID NO: 356944 - DNA, 25 bp, Mus musculus
tcagcttccacaggtttcctttgga

SEQ ID NO: 356945 - DNA, 25 bp, Mus musculus
tcagcttctcagtgaatttgacaaa

SEQ ID NO: 356946 - DNA, 25 bp, Mus musculus
tcagcttctcatgctcatctttcct

SEQ ID NO: 356947 - DNA, 25 bp, Mus musculus
tcagcttctcatgtgcaggctgagc

SEQ ID NO: 356948 - DNA, 25 bp, Mus musculus
tcagcttgcaagaagaacatccaga

SEQ ID NO: 356949 - DNA, 25 bp, Mus musculus
tcagcttgcaagaaggggaccagct

SEQ ID NO: 356950 - DNA, 25 bp, Mus musculus
tcagcttggcagaacacatgtcgga

SEQ ID NO: 356951 - DNA, 25 bp, Mus musculus
tcagcttggggaatctggagcaatt

SEQ ID NO: 356952 - DNA, 25 bp, Mus musculus
tcagcttggggaatcttgctctttg

SEQ ID NO: 356953 - DNA, 25 bp, Mus musculus
tcagcttgtctggaacctctcagga

SEQ ID NO: 356954 - DNA, 25 bp, Mus musculus
tcagctttatcaggtccacagagtt

SEQ ID NO: 356955 - DNA, 25 bp, Mus musculus
tcagctttgaacgctgtgtgagaat

SEQ ID NO: 356956 - DNA, 25 bp, Mus musculus
tcagctttgacgttaccaccaggtt

SEQ ID NO: 356957 - DNA, 25 bp, Mus musculus
tcagctttgagtcggtctatgtgca

SEQ ID NO: 356958 - DNA, 25 bp, Mus musculus
tcagctttggggtggtaatactgga

SEQ ID NO: 356959 - DNA, 25 bp, Mus musculus
tcagcttttactcggaccaacatat

SEQ ID NO: 356960 - DNA, 25 bp, Mus musculus
tcagcttttctaaggcatcaatact

SEQ ID NO: 356961 - DNA, 25 bp, Mus musculus
tcagcttttgcagatgaatatgaag

SEQ ID NO: 356962 - DNA, 25 bp, Mus musculus
tcagcttttgcagggggcaccctcc

SEQ ID NO: 356963 - DNA, 25 bp, Mus musculus
tcagcttttgcagtggacatcccag

SEQ ID NO: 356964 - DNA, 25 bp, Mus musculus
tcagcttttttacaggagaaaccct

SEQ ID NO: 356965 - DNA, 25 bp, Mus musculus
tcaggaaaagaggaccccaggactt

SEQ ID NO: 356966 - DNA, 25 bp, Mus musculus
tcaggaaaagaggagtgggagctca

SEQ ID NO: 356967 - DNA, 25 bp, Mus musculus
tcaggaaaattggaacaatccactt

SEQ ID NO: 356968 - DNA, 25 bp, Mus musculus
tcaggaaacaacagatcccccacct

SEQ ID NO: 356969 - DNA, 25 bp, Mus musculus
tcaggaaacagcagattcctcagac

SEQ ID NO: 356970 - DNA, 25 bp, Mus musculus
tcaggaaacagcagggaaggatctg

SEQ ID NO: 356971 - DNA, 25 bp, Mus musculus
tcaggaaacttcaggacccctgtgc

SEQ ID NO: 356972 - DNA, 25 bp, Mus musculus
tcaggaaagagcaaataagttggtc

SEQ ID NO: 356973 - DNA, 25 bp, Mus musculus
tcaggaaatgagtccacagatgatt

SEQ ID NO: 356974 - DNA, 25 bp, Mus musculus
tcaggaacagccccacagcagcaaa

SEQ ID NO: 356975 - DNA, 25 bp, Mus musculus
tcaggaacagtatcatcaacatttc

SEQ ID NO: 356976 - DNA, 25 bp, Mus musculus
tcaggaaccatatcctaggcaatgc

SEQ ID NO: 356977 - DNA, 25 bp, Mus musculus
tcaggaaccatatgactgcttacgg

SEQ ID NO: 356978 - DNA, 25 bp, Mus musculus
tcaggaaccatattctgttttattt

SEQ ID NO: 356979 - DNA, 25 bp, Mus musculus
tcaggaactggcggtcttctgttcc

SEQ ID NO: 356980 - DNA, 25 bp, Mus musculus
tcaggaacttcagtttgaaaatgaa

SEQ ID NO: 356981 - DNA, 25 bp, Mus musculus
tcaggaacttttttgtaagaagaca

SEQ ID NO: 356982 - DNA, 25 bp, Mus musculus
tcaggaagaagactgcccgtggttg

SEQ ID NO: 356983 - DNA, 25 bp, Mus musculus
tcaggaagaggagctttggctgtgg

SEQ ID NO: 356984 - DNA, 25 bp, Mus musculus
tcaggaagaggctgtcaacaggaaa

SEQ ID NO: 356985 - DNA, 25 bp, Mus musculus
tcaggaagagggagtcccagcaggc

SEQ ID NO: 356986 - DNA, 25 bp, Mus musculus
tcaggaagagggttcactgatcacc

SEQ ID NO: 356987 - DNA, 25 bp, Mus musculus
tcaggaagctaagctgtggtcctct

SEQ ID NO: 356988 - DNA, 25 bp, Mus musculus
tcaggaagggactggaatacgctaa

SEQ ID NO: 356989 - DNA, 25 bp, Mus musculus
tcaggaaggggaaggtgatctgagc

SEQ ID NO: 356990 - DNA, 25 bp, Mus musculus
tcaggaagtgaagggggaggtgacc

SEQ ID NO: 356991 - DNA, 25 bp, Mus musculus
tcaggaagtgaagtgttgaagaaag

SEQ ID NO: 356992 - DNA, 25 bp, Mus musculus
tcaggaagtgcttctgtttcctgcc

SEQ ID NO: 356993 - DNA, 25 bp, Mus musculus
tcaggaatccccatgatgaatcagc

SEQ ID NO: 356994 - DNA, 25 bp, Mus musculus
tcaggaatgcaacttctcggtatcc

SEQ ID NO: 356995 - DNA, 25 bp, Mus musculus
tcaggaatgcttgggaattgaatcc

SEQ ID NO: 356996 - DNA, 25 bp, Mus musculus
tcaggaatgcttgggagagttaacc

SEQ ID NO: 356997 - DNA, 25 bp, Mus musculus
tcaggaatggagactttggagacta

SEQ ID NO: 356998 - DNA, 25 bp, Mus musculus
tcaggaatgtctcctgaacttcgag

SEQ ID NO: 356999 - DNA, 25 bp, Mus musculus
tcaggaatgtctcctgtctgtggtg

SEQ ID NO: 357000 - DNA, 25 bp, Mus musculus
tcaggaattccttaactccattctt

SEQ ID NO: 357001 - DNA, 25 bp, Mus musculus
tcaggacaaggttttcaaaataaaa

SEQ ID NO: 357002 - DNA, 25 bp, Mus musculus
tcaggacaatgcagcttcacttggt

SEQ ID NO: 357003 - DNA, 25 bp, Mus musculus
tcaggacaatgcagtgctgaaagga

SEQ ID NO: 357004 - DNA, 25 bp, Mus musculus
tcaggacacacagacactgtcctgt

SEQ ID NO: 357005 - DNA, 25 bp, Mus musculus
tcaggacacccctcatgtttctgca

SEQ ID NO: 357006 - DNA, 25 bp, Mus musculus
tcaggacactggagatgatccttac

SEQ ID NO: 357007 - DNA, 25 bp, Mus musculus
tcaggacagagggactgctgcagag

SEQ ID NO: 357008 - DNA, 25 bp, Mus musculus
tcaggacaggaagaggacgccctac

SEQ ID NO: 357009 - DNA, 25 bp, Mus musculus
tcaggaccaagcccttcccctgggg

SEQ ID NO: 357010 - DNA, 25 bp, Mus musculus
tcaggaccaagtatgagtcagagct

SEQ ID NO: 357011 - DNA, 25 bp, Mus musculus
tcaggaccaggtagattccataatg

SEQ ID NO: 357012 - DNA, 25 bp, Mus musculus
tcaggaccatgcgcaatcaggattc

SEQ ID NO: 357013 - DNA, 25 bp, Mus musculus
tcaggaccatgcgcctgcggagttc

SEQ ID NO: 357014 - DNA, 25 bp, Mus musculus
tcaggacccacagggccctgtgtgc

SEQ ID NO: 357015 - DNA, 25 bp, Mus musculus
tcaggaccccaaggtcatgatgcta

SEQ ID NO: 357016 - DNA, 25 bp, Mus musculus
tcaggaccccagctctgtcagcatc

SEQ ID NO: 357017 - DNA, 25 bp, Mus musculus
tcaggaccccaggaccttgccacac

SEQ ID NO: 357018 - DNA, 25 bp, Mus musculus
tcaggaccgcttggctctacagagg

SEQ ID NO: 357019 - DNA, 25 bp, Mus musculus
tcaggacgatgagcgaggctgctgc

SEQ ID NO: 357020 - DNA, 25 bp, Mus musculus
tcaggacggagatgaacatctgcaa

SEQ ID NO: 357021 - DNA, 25 bp, Mus musculus
tcaggacgtgacagaaaagatcaag

SEQ ID NO: 357022 - DNA, 25 bp, Mus musculus
tcaggacgtgacagggaggcccgga

SEQ ID NO: 357023 - DNA, 25 bp, Mus musculus
tcaggactccatttacaacttcagg

SEQ ID NO: 357024 - DNA, 25 bp, Mus musculus
tcaggactctcaggtaaatgcattg

SEQ ID NO: 357025 - DNA, 25 bp, Mus musculus
tcaggactgcacagtgtacaaggca

SEQ ID NO: 357026 - DNA, 25 bp, Mus musculus
tcaggacttgctgatgtggatgcct

SEQ ID NO: 357027 - DNA, 25 bp, Mus musculus
tcaggagaacagcagtaccactagc

SEQ ID NO: 357028 - DNA, 25 bp, Mus musculus
tcaggagaagagtctgttcaagatc

SEQ ID NO: 357029 - DNA, 25 bp, Mus musculus
tcaggagaaggatagagatggttgt

SEQ ID NO: 357030 - DNA, 25 bp, Mus musculus
tcaggagaagtggctggtgaggtga

SEQ ID NO: 357031 - DNA, 25 bp, Mus musculus
tcaggagacagcctgccccgcgaga

SEQ ID NO: 357032 - DNA, 25 bp, Mus musculus
tcaggagacagcctgccgagggagc

SEQ ID NO: 357033 - DNA, 25 bp, Mus musculus
tcaggagacagggaagaagccagct

SEQ ID NO: 357034 - DNA, 25 bp, Mus musculus
tcaggagagaaggattggaagaaag

SEQ ID NO: 357035 - DNA, 25 bp, Mus musculus
tcaggagagaaggcattggaagaag

SEQ ID NO: 357036 - DNA, 25 bp, Mus musculus
tcaggagagaggtacaaagaagacc

SEQ ID NO: 357037 - DNA, 25 bp, Mus musculus
tcaggagagatgacttgtaccagag

SEQ ID NO: 357038 - DNA, 25 bp, Mus musculus
tcaggagagatgagagcaatcacct

SEQ ID NO: 357039 - DNA, 25 bp, Mus musculus
tcaggagagccaggcttagaatcag

SEQ ID NO: 357040 - DNA, 25 bp, Mus musculus
tcaggagatcatgcctcccgcagca

SEQ ID NO: 357041 - DNA, 25 bp, Mus musculus
tcaggagatggtaaccaagtcaaac

SEQ ID NO: 357042 - DNA, 25 bp, Mus musculus
tcaggagattctgagaccttgctac

SEQ ID NO: 357043 - DNA, 25 bp, Mus musculus
tcaggagattctgaggcgaatggac

SEQ ID NO: 357044 - DNA, 25 bp, Mus musculus
tcaggagcaagattgccaagggatc

SEQ ID NO: 357045 - DNA, 25 bp, Mus musculus
tcaggagcaagtttcaggttagtcc

SEQ ID NO: 357046 - DNA, 25 bp, Mus musculus
tcaggagcagaaggtatatgtggtt

SEQ ID NO: 357047 - DNA, 25 bp, Mus musculus
tcaggagcagagagtgacaacagtg

SEQ ID NO: 357048 - DNA, 25 bp, Mus musculus
tcaggagcagagatcatagcagtct

SEQ ID NO: 357049 - DNA, 25 bp, Mus musculus
tcaggagcagattgccagggcaaca

SEQ ID NO: 357050 - DNA, 25 bp, Mus musculus
tcaggagcagcgggtttattgccta

SEQ ID NO: 357051 - DNA, 25 bp, Mus musculus
tcaggagcgaaagtgacaccagcag

SEQ ID NO: 357052 - DNA, 25 bp, Mus musculus
tcaggagcgcagaaggctgagaccg

SEQ ID NO: 357053 - DNA, 25 bp, Mus musculus
tcaggagcggaggtacactgtagct

SEQ ID NO: 357054 - DNA, 25 bp, Mus musculus
tcaggagcggcagtctcagagagaa

SEQ ID NO: 357055 - DNA, 25 bp, Mus musculus
tcaggagctcaacgagctggactac

SEQ ID NO: 357056 - DNA, 25 bp, Mus musculus
tcaggagctgacaggcagtatctga

SEQ ID NO: 357057 - DNA, 25 bp, Mus musculus
tcaggagctgctactcaggtgcaag

SEQ ID NO: 357058 - DNA, 25 bp, Mus musculus
tcaggagctggagagaaaaatatca

SEQ ID NO: 357059 - DNA, 25 bp, Mus musculus
tcaggagctggagaggaaagccata

SEQ ID NO: 357060 - DNA, 25 bp, Mus musculus
tcaggaggaggacttactgtgttct

SEQ ID NO: 357061 - DNA, 25 bp, Mus musculus
tcaggaggaggtggcaaaccctgct

SEQ ID NO: 357062 - DNA, 25 bp, Mus musculus
tcaggaggatcaaggaactgcattg

SEQ ID NO: 357063 - DNA, 25 bp, Mus musculus
tcaggagtacagacagcacccttgt

SEQ ID NO: 357064 - DNA, 25 bp, Mus musculus
tcaggagtacgcagtggaagcccac

SEQ ID NO: 357065 - DNA, 25 bp, Mus musculus
tcaggagtagcaactggtctctgga

SEQ ID NO: 357066 - DNA, 25 bp, Mus musculus
tcaggagtgagcacggttatttttg

SEQ ID NO: 357067 - DNA, 25 bp, Mus musculus
tcaggagtttgaaaggatgtcttcc

SEQ ID NO: 357068 - DNA, 25 bp, Mus musculus
tcaggagtttgggttaatatttgcc

SEQ ID NO: 357069 - DNA, 25 bp, Mus musculus
tcaggatatcaaggcctctgtgtcc

SEQ ID NO: 357070 - DNA, 25 bp, Mus musculus
tcaggatatcagctcttgcactgcg

SEQ ID NO: 357071 - DNA, 25 bp, Mus musculus
tcaggatatgacataatgaaatcta

SEQ ID NO: 357072 - DNA, 25 bp, Mus musculus
tcaggatcaccaggtgctcgaggct

SEQ ID NO: 357073 - DNA, 25 bp, Mus musculus
tcaggatccacacagcaggacagtt

SEQ ID NO: 357074 - DNA, 25 bp, Mus musculus
tcaggatccacacaggcgagaagcc

SEQ ID NO: 357075 - DNA, 25 bp, Mus musculus
tcaggatccccaggctgcccttggg

SEQ ID NO: 357076 - DNA, 25 bp, Mus musculus
tcaggatcctaccctctagacgtcc

SEQ ID NO: 357077 - DNA, 25 bp, Mus musculus
tcaggatcggactaggtctgcctgg

SEQ ID NO: 357078 - DNA, 25 bp, Mus musculus
tcaggatcggactagtggccacagt

SEQ ID NO: 357079 - DNA, 25 bp, Mus musculus
tcaggatcttgagactaccaaagga

SEQ ID NO: 357080 - DNA, 25 bp, Mus musculus
tcaggatcttgagtttaccaaatta

SEQ ID NO: 357081 - DNA, 25 bp, Mus musculus
tcaggatgaagaactacaaagcaat

SEQ ID NO: 357082 - DNA, 25 bp, Mus musculus
tcaggatgaagaggagaagacaccc

SEQ ID NO: 357083 - DNA, 25 bp, Mus musculus
tcaggatgagctgcaaaggctgcgg

SEQ ID NO: 357084 - DNA, 25 bp, Mus musculus
tcaggatgccacgaaagcgctaact

SEQ ID NO: 357085 - DNA, 25 bp, Mus musculus
tcaggatgccacggatccttttgtg

SEQ ID NO: 357086 - DNA, 25 bp, Mus musculus
tcaggatggccaggtactgcagggt

SEQ ID NO: 357087 - DNA, 25 bp, Mus musculus
tcaggatggccagtcgtggggcctg

SEQ ID NO: 357088 - DNA, 25 bp, Mus musculus
tcaggatgtcgagatgcagatctct

SEQ ID NO: 357089 - DNA, 25 bp, Mus musculus
tcaggatgtcgaggtacggtcagaa

SEQ ID NO: 357090 - DNA, 25 bp, Mus musculus
tcaggattctcgatccagagacaat

SEQ ID NO: 357091 - DNA, 25 bp, Mus musculus
tcaggattctgaagtgagtaatagt

SEQ ID NO: 357092 - DNA, 25 bp, Mus musculus
tcaggattggaagatcgaagcctgt

SEQ ID NO: 357093 - DNA, 25 bp, Mus musculus
tcaggatttggagtctgtctccaag

SEQ ID NO: 357094 - DNA, 25 bp, Mus musculus
tcaggcaaaagcgagcggagctcct

SEQ ID NO: 357095 - DNA, 25 bp, Mus musculus
tcaggcaacatgaaattgatgggaa

SEQ ID NO: 357096 - DNA, 25 bp, Mus musculus
tcaggcaactccgagtttgtgggga

SEQ ID NO: 357097 - DNA, 25 bp, Mus musculus
tcaggcaagcagctccagtcagtct

SEQ ID NO: 357098 - DNA, 25 bp, Mus musculus
tcaggcaccaggttcctccaacacc

SEQ ID NO: 357099 - DNA, 25 bp, Mus musculus
tcaggcagagctggaaaaggtgcag

SEQ ID NO: 357100 - DNA, 25 bp, Mus musculus
tcaggcagatgatgtgtgttaaagg

SEQ ID NO: 357101 - DNA, 25 bp, Mus musculus
tcaggcagatttaagattattaaaa

SEQ ID NO: 357102 - DNA, 25 bp, Mus musculus
tcaggcagctccaggtataatggcc

SEQ ID NO: 357103 - DNA, 25 bp, Mus musculus
tcaggcagcttgatcagtggaccat

SEQ ID NO: 357104 - DNA, 25 bp, Mus musculus
tcaggcagcttggaggaagagtcac

SEQ ID NO: 357105 - DNA, 25 bp, Mus musculus
tcaggcatcaatgctgttttctact

SEQ ID NO: 357106 - DNA, 25 bp, Mus musculus
tcaggcatccagtgagctgcttatc

SEQ ID NO: 357107 - DNA, 25 bp, Mus musculus
tcaggcatgaactatgaagatgact

SEQ ID NO: 357108 - DNA, 25 bp, Mus musculus
tcaggccaacaaggtacgcacgcgg

SEQ ID NO: 357109 - DNA, 25 bp, Mus musculus
tcaggccaagacatgcccggaaccg

SEQ ID NO: 357110 - DNA, 25 bp, Mus musculus
tcaggccaagacgcccacagattaa

SEQ ID NO: 357111 - DNA, 25 bp, Mus musculus
tcaggccaagactaaggggtcccca

SEQ ID NO: 357112 - DNA, 25 bp, Mus musculus
tcaggccagatattcagaaaccctg

SEQ ID NO: 357113 - DNA, 25 bp, Mus musculus
tcaggccagatcaaaaaagggaaaa

SEQ ID NO: 357114 - DNA, 25 bp, Mus musculus
tcaggccagggaccgagaacacgcc

SEQ ID NO: 357115 - DNA, 25 bp, Mus musculus
tcaggccagttgggctgtgactcga

SEQ ID NO: 357116 - DNA, 25 bp, Mus musculus
tcaggcccagcagtgcatcctgcct

SEQ ID NO: 357117 - DNA, 25 bp, Mus musculus
tcaggcccagccctgctcctgccat

SEQ ID NO: 357118 - DNA, 25 bp, Mus musculus
tcaggccgcaggcctctctgtccct

SEQ ID NO: 357119 - DNA, 25 bp, Mus musculus
tcaggccgccacagcgtggtgtcct

SEQ ID NO: 357120 - DNA, 25 bp, Mus musculus
tcaggccggaggctcctgtagtttc

SEQ ID NO: 357121 - DNA, 25 bp, Mus musculus
tcaggcctttcagagacgaagagag

SEQ ID NO: 357122 - DNA, 25 bp, Mus musculus
tcaggcgatatccgtaaagaacttg

SEQ ID NO: 357123 - DNA, 25 bp, Mus musculus
tcaggcgcatcaggtgaagaagagt

SEQ ID NO: 357124 - DNA, 25 bp, Mus musculus
tcaggcgcgaggagctccagaaatc

SEQ ID NO: 357125 - DNA, 25 bp, Mus musculus
tcaggcgcggggtgatggcaggaga

SEQ ID NO: 357126 - DNA, 25 bp, Mus musculus
tcaggcgctagggtctgggaacgta

SEQ ID NO: 357127 - DNA, 25 bp, Mus musculus
tcaggcgctatgggtcatctgttcc

SEQ ID NO: 357128 - DNA, 25 bp, Mus musculus
tcaggcggagaagtactctcaaaaa

SEQ ID NO: 357129 - DNA, 25 bp, Mus musculus
tcaggctaagaatggttttagctct

SEQ ID NO: 357130 - DNA, 25 bp, Mus musculus
tcaggctcacaagaaataccattct

SEQ ID NO: 357131 - DNA, 25 bp, Mus musculus
tcaggctcacaaggcagaaaaaaaa

SEQ ID NO: 357132 - DNA, 25 bp, Mus musculus
tcaggctcagcaccaaggagatcca

SEQ ID NO: 357133 - DNA, 25 bp, Mus musculus
tcaggctccacagattgcagcccgg

SEQ ID NO: 357134 - DNA, 25 bp, Mus musculus
tcaggctcgcgctgacgcagtatga

SEQ ID NO: 357135 - DNA, 25 bp, Mus musculus
tcaggctcgcgctgggtgcatgtac

SEQ ID NO: 357136 - DNA, 25 bp, Mus musculus
tcaggctcgcgctgtatttcagggt

SEQ ID NO: 357137 - DNA, 25 bp, Mus musculus
tcaggctcggaaacgaatacctcca

SEQ ID NO: 357138 - DNA, 25 bp, Mus musculus
tcaggctcggaagaaattgataatt

SEQ ID NO: 357139 - DNA, 25 bp, Mus musculus
tcaggctctgggagttggaaccctg

SEQ ID NO: 357140 - DNA, 25 bp, Mus musculus
tcaggctgaaagtttggcttttcat

SEQ ID NO: 357141 - DNA, 25 bp, Mus musculus
tcaggctgagaagtactctcagaag

SEQ ID NO: 357142 - DNA, 25 bp, Mus musculus
tcaggctgcactcagaaccattgtt

SEQ ID NO: 357143 - DNA, 25 bp, Mus musculus
tcaggctgcactcagctgccaactc

SEQ ID NO: 357144 - DNA, 25 bp, Mus musculus
tcaggctggaaaggagctggaggaa

SEQ ID NO: 357145 - DNA, 25 bp, Mus musculus
tcaggctggagtgacgagtatctgt

SEQ ID NO: 357146 - DNA, 25 bp, Mus musculus
tcaggctgtcagaaaaagatgcaag

SEQ ID NO: 357147 - DNA, 25 bp, Mus musculus
tcaggctgtcagtctagtctcctga

SEQ ID NO: 357148 - DNA, 25 bp, Mus musculus
tcaggctgtgagatatctgtttcaa

SEQ ID NO: 357149 - DNA, 25 bp, Mus musculus
tcaggcttaaagggtatgtccctga

SEQ ID NO: 357150 - DNA, 25 bp, Mus musculus
tcaggcttactcagactctaaggag

SEQ ID NO: 357151 - DNA, 25 bp, Mus musculus
tcaggcttcaggaagtgtgccatga

SEQ ID NO: 357152 - DNA, 25 bp, Mus musculus
tcaggcttcaggtgcaggtcctgcc

SEQ ID NO: 357153 - DNA, 25 bp, Mus musculus
tcaggcttcgtggcgaagcagcagg

SEQ ID NO: 357154 - DNA, 25 bp, Mus musculus
tcaggcttcgtggcgatcaagaaga

SEQ ID NO: 357155 - DNA, 25 bp, Mus musculus
tcaggcttctctgcaagagctgtgg

SEQ ID NO: 357156 - DNA, 25 bp, Mus musculus
tcaggctttccccaggccctccatg

SEQ ID NO: 357157 - DNA, 25 bp, Mus musculus
tcagggaaaagcacagagctgatga

SEQ ID NO: 357158 - DNA, 25 bp, Mus musculus
tcagggaaaaggaacaccatggacg

SEQ ID NO: 357159 - DNA, 25 bp, Mus musculus
tcagggaaaaggtcattaaaggggc

SEQ ID NO: 357160 - DNA, 25 bp, Mus musculus
tcagggaaacacagaaatatgccga

SEQ ID NO: 357161 - DNA, 25 bp, Mus musculus
tcagggaaatcaaggaacttaatga

SEQ ID NO: 357162 - DNA, 25 bp, Mus musculus
tcagggaaatcaaggactcgctggc

SEQ ID NO: 357163 - DNA, 25 bp, Mus musculus
tcagggaacaagcccaggactgtgg

SEQ ID NO: 357164 - DNA, 25 bp, Mus musculus
tcagggaacacagagcagctgcagg

SEQ ID NO: 357165 - DNA, 25 bp, Mus musculus
tcagggaacacagagttcttcttgc

SEQ ID NO: 357166 - DNA, 25 bp, Mus musculus
tcagggaacacttgggggagaagcg

SEQ ID NO: 357167 - DNA, 25 bp, Mus musculus
tcagggaaccaggatgagattctgg

SEQ ID NO: 357168 - DNA, 25 bp, Mus musculus
tcagggaatggactatttgcatgca

SEQ ID NO: 357169 - DNA, 25 bp, Mus musculus
tcagggagaaagagcctggcccaac

SEQ ID NO: 357170 - DNA, 25 bp, Mus musculus
tcagggagaatcggggtgcaccttc

SEQ ID NO: 357171 - DNA, 25 bp, Mus musculus
tcagggagaatcgggttggaggggt

SEQ ID NO: 357172 - DNA, 25 bp, Mus musculus
tcagggagaccctggtctccctggt

SEQ ID NO: 357173 - DNA, 25 bp, Mus musculus
tcagggagagatgagcaataacagc

SEQ ID NO: 357174 - DNA, 25 bp, Mus musculus
tcagggatctccaagacctcactat

SEQ ID NO: 357175 - DNA, 25 bp, Mus musculus
tcagggatctccaaggaccacaatg

SEQ ID NO: 357176 - DNA, 25 bp, Mus musculus
tcagggatggaggcaaattccaccc

SEQ ID NO: 357177 - DNA, 25 bp, Mus musculus
tcagggatgtaggagatgagccgct

SEQ ID NO: 357178 - DNA, 25 bp, Mus musculus
tcagggattacagtgctgtgctcca

SEQ ID NO: 357179 - DNA, 25 bp, Mus musculus
tcagggcacaggaataacagaagcc

SEQ ID NO: 357180 - DNA, 25 bp, Mus musculus
tcagggcagggataatcttaagctt

SEQ ID NO: 357181 - DNA, 25 bp, Mus musculus
tcagggcatatcagatacgagggca

SEQ ID NO: 357182 - DNA, 25 bp, Mus musculus
tcagggcatatcaggtcaggggtca

SEQ ID NO: 357183 - DNA, 25 bp, Mus musculus
tcagggccaatcagggtccctgagt

SEQ ID NO: 357184 - DNA, 25 bp, Mus musculus
tcagggccacactggtgctgtgaca

SEQ ID NO: 357185 - DNA, 25 bp, Mus musculus
tcagggccagggattctgggcacat

SEQ ID NO: 357186 - DNA, 25 bp, Mus musculus
tcagggccaggtgtctccagtgcca

SEQ ID NO: 357187 - DNA, 25 bp, Mus musculus
tcagggccatgtcttccctctcatg

SEQ ID NO: 357188 - DNA, 25 bp, Mus musculus
tcagggcccagccaggtagccatcc

SEQ ID NO: 357189 - DNA, 25 bp, Mus musculus
tcagggcccagccaggttttcaggc

SEQ ID NO: 357190 - DNA, 25 bp, Mus musculus
tcagggcccagtgggaggagtgaag

SEQ ID NO: 357191 - DNA, 25 bp, Mus musculus
tcagggccctgaagagcatgacgtt

SEQ ID NO: 357192 - DNA, 25 bp, Mus musculus
tcagggccgaggaagaactccagtt

SEQ ID NO: 357193 - DNA, 25 bp, Mus musculus
tcagggccgtaagagtgcagaccat

SEQ ID NO: 357194 - DNA, 25 bp, Mus musculus
tcagggcctggacagccacttccaa

SEQ ID NO: 357195 - DNA, 25 bp, Mus musculus
tcagggcctttgctggggacagtaa

SEQ ID NO: 357196 - DNA, 25 bp, Mus musculus
tcagggcgtggccatagtgaacaga

SEQ ID NO: 357197 - DNA, 25 bp, Mus musculus
tcagggctacggcaaatactggtaa

SEQ ID NO: 357198 - DNA, 25 bp, Mus musculus
tcagggctcaaggaggtagatgact

SEQ ID NO: 357199 - DNA, 25 bp, Mus musculus
tcaggggattgattatgagaagatc

SEQ ID NO: 357200 - DNA, 25 bp, Mus musculus
tcaggggcccgggcttccgtgacct

SEQ ID NO: 357201 - DNA, 25 bp, Mus musculus
tcaggggctttcagggggactgcag

SEQ ID NO: 357202 - DNA, 25 bp, Mus musculus
tcagggggacaagaggttgcctgca

SEQ ID NO: 357203 - DNA, 25 bp, Mus musculus
tcagggggcaaagccaggaggaagc

SEQ ID NO: 357204 - DNA, 25 bp, Mus musculus
tcaggggggaggacctgtgtcatgt

SEQ ID NO: 357205 - DNA, 25 bp, Mus musculus
tcaggggggcccagattcacaacat

SEQ ID NO: 357206 - DNA, 25 bp, Mus musculus
tcagggggtaaatgtgattagtgtt

SEQ ID NO: 357207 - DNA, 25 bp, Mus musculus
tcaggggtcaggaggcgggagcctt

SEQ ID NO: 357208 - DNA, 25 bp, Mus musculus
tcaggggttcagatgccccatatag

SEQ ID NO: 357209 - DNA, 25 bp, Mus musculus
tcaggggttcagccaacaattctct

SEQ ID NO: 357210 - DNA, 25 bp, Mus musculus
tcagggtaagagatggctgtgaata

SEQ ID NO: 357211 - DNA, 25 bp, Mus musculus
tcagggtaggagggtgggatggaga

SEQ ID NO: 357212 - DNA, 25 bp, Mus musculus
tcagggtcaagacaaatcttcctat

SEQ ID NO: 357213 - DNA, 25 bp, Mus musculus
tcagggtcaaggttgtagttccccc

SEQ ID NO: 357214 - DNA, 25 bp, Mus musculus
tcagggtcacagaaaccggcgatga

SEQ ID NO: 357215 - DNA, 25 bp, Mus musculus
tcagggtcacaggctctgtgggtga

SEQ ID NO: 357216 - DNA, 25 bp, Mus musculus
tcagggtcccagaagggtcagaaag

SEQ ID NO: 357217 - DNA, 25 bp, Mus musculus
tcagggtcttcctggtgcagtgggg

SEQ ID NO: 357218 - DNA, 25 bp, Mus musculus
tcagggtgaggcgacccctctgagg

SEQ ID NO: 357219 - DNA, 25 bp, Mus musculus
tcagggtgatgctctcccagtgtct

SEQ ID NO: 357220 - DNA, 25 bp, Mus musculus
tcagggtgcacaggaaatactgggg

SEQ ID NO: 357221 - DNA, 25 bp, Mus musculus
tcagggtggcaaaggtgatgttcgt

SEQ ID NO: 357222 - DNA, 25 bp, Mus musculus
tcagggtgtaccagcctccagctca

SEQ ID NO: 357223 - DNA, 25 bp, Mus musculus
tcagggttccagggacttcctggcc

SEQ ID NO: 357224 - DNA, 25 bp, Mus musculus
tcagggttctccaagtgttgaatca

SEQ ID NO: 357225 - DNA, 25 bp, Mus musculus
tcaggtaagagagatctggagctgc

SEQ ID NO: 357226 - DNA, 25 bp, Mus musculus
tcaggtacaagattgagaaatggca

SEQ ID NO: 357227 - DNA, 25 bp, Mus musculus
tcaggtactgtcggaccagcagtgc

SEQ ID NO: 357228 - DNA, 25 bp, Mus musculus
tcaggtatccaacgcttgtatcaga

SEQ ID NO: 357229 - DNA, 25 bp, Mus musculus
tcaggtcaccagcatgggattttgc

SEQ ID NO: 357230 - DNA, 25 bp, Mus musculus
tcaggtcaccaggatgggattttgc

SEQ ID NO: 357231 - DNA, 25 bp, Mus musculus
tcaggtccaagagtctgaaggaagg

SEQ ID NO: 357232 - DNA, 25 bp, Mus musculus
tcaggtccaagtccgtaattgagca

SEQ ID NO: 357233 - DNA, 25 bp, Mus musculus
tcaggtccacgtgagacatggcaca

SEQ ID NO: 357234 - DNA, 25 bp, Mus musculus
tcaggtccacgtgagatccttctta

SEQ ID NO: 357235 - DNA, 25 bp, Mus musculus
tcaggtccagggcaatggcagcaga

SEQ ID NO: 357236 - DNA, 25 bp, Mus musculus
tcaggtcccacgccctggcacatct

SEQ ID NO: 357237 - DNA, 25 bp, Mus musculus
tcaggtcccagagaccagagggttt

SEQ ID NO: 357238 - DNA, 25 bp, Mus musculus
tcaggtcccaggctgtgtcccactg

SEQ ID NO: 357239 - DNA, 25 bp, Mus musculus
tcaggtcccccggtatagaacgtgt

SEQ ID NO: 357240 - DNA, 25 bp, Mus musculus
tcaggtccctcactaaaagcacctt

SEQ ID NO: 357241 - DNA, 25 bp, Mus musculus
tcaggtcctaaaaggtgcaactaca

SEQ ID NO: 357242 - DNA, 25 bp, Mus musculus
tcaggtcctgacagaaatccatgcg

SEQ ID NO: 357243 - DNA, 25 bp, Mus musculus
tcaggtcctggatgaacgagaccgt

SEQ ID NO: 357244 - DNA, 25 bp, Mus musculus
tcaggtctccagggcctggaatgtc

SEQ ID NO: 357245 - DNA, 25 bp, Mus musculus
tcaggtctcggccagaaggtttgga

SEQ ID NO: 357246 - DNA, 25 bp, Mus musculus
tcaggtctgaggatatgacattaca

SEQ ID NO: 357247 - DNA, 25 bp, Mus musculus
tcaggtctgtaaaaaagcaacacgt

SEQ ID NO: 357248 - DNA, 25 bp, Mus musculus
tcaggtgaccttggaggatttgagg

SEQ ID NO: 357249 - DNA, 25 bp, Mus musculus
tcaggtgagcaggatcggaacgtca

SEQ ID NO: 357250 - DNA, 25 bp, Mus musculus
tcaggtgaggcctttaccctccggt

SEQ ID NO: 357251 - DNA, 25 bp, Mus musculus
tcaggtgcaaaatggaacactgtgg

SEQ ID NO: 357252 - DNA, 25 bp, Mus musculus
tcaggtgcaagtgcagaatggaaca

SEQ ID NO: 357253 - DNA, 25 bp, Mus musculus
tcaggtgctaggttaaagatcgagg

SEQ ID NO: 357254 - DNA, 25 bp, Mus musculus
tcaggtgctcaggtgtgtgtgacgg

SEQ ID NO: 357255 - DNA, 25 bp, Mus musculus
tcaggtgctgatttcaacgttgaag

SEQ ID NO: 357256 - DNA, 25 bp, Mus musculus
tcaggtggaactaagggactttgaa

SEQ ID NO: 357257 - DNA, 25 bp, Mus musculus
tcaggtggacacctccctttcctcg

SEQ ID NO: 357258 - DNA, 25 bp, Mus musculus
tcaggtggaggctgcctccacttcc

SEQ ID NO: 357259 - DNA, 25 bp, Mus musculus
tcaggtggatttgaaagaaactgcc

SEQ ID NO: 357260 - DNA, 25 bp, Mus musculus
tcaggtgggaggttgtgcccaccag

SEQ ID NO: 357261 - DNA, 25 bp, Mus musculus
tcaggtgggttagccaaccccacca

SEQ ID NO: 357262 - DNA, 25 bp, Mus musculus
tcaggtgtactcctccctttcctcg

SEQ ID NO: 357263 - DNA, 25 bp, Mus musculus
tcaggtgtactcctctcttttcatc

SEQ ID NO: 357264 - DNA, 25 bp, Mus musculus
tcaggtgttaggggatgctggcaag

SEQ ID NO: 357265 - DNA, 25 bp, Mus musculus
tcaggttaggattcccaggaaaact

SEQ ID NO: 357266 - DNA, 25 bp, Mus musculus
tcaggttcatgatggatgacattca

SEQ ID NO: 357267 - DNA, 25 bp, Mus musculus
tcaggttctgagaaaacctatcctt

SEQ ID NO: 357268 - DNA, 25 bp, Mus musculus
tcaggttctgccgcctcctgatgac

SEQ ID NO: 357269 - DNA, 25 bp, Mus musculus
tcaggttctgccggggacccctgtg

SEQ ID NO: 357270 - DNA, 25 bp, Mus musculus
tcaggttgccaagcaacacgtgcag

SEQ ID NO: 357271 - DNA, 25 bp, Mus musculus
tcaggttgccaaggccttaatccag

SEQ ID NO: 357272 - DNA, 25 bp, Mus musculus
tcaggttgcgtcaagagcctcagct

SEQ ID NO: 357273 - DNA, 25 bp, Mus musculus
tcaggttgtaggttatcttgacgaa

SEQ ID NO: 357274 - DNA, 25 bp, Mus musculus
tcaggttgttcctcaatgtctgctt

SEQ ID NO: 357275 - DNA, 25 bp, Mus musculus
tcaggttttatggactacagatttg

SEQ ID NO: 357276 - DNA, 25 bp, Mus musculus
tcaggttttggctaccggctctctg

SEQ ID NO: 357277 - DNA, 25 bp, Mus musculus
tcagtaacaagcttcttaaccccaa

SEQ ID NO: 357278 - DNA, 25 bp, Mus musculus
tcagtaactgaaggtgtccactccc

SEQ ID NO: 357279 - DNA, 25 bp, Mus musculus
tcagtaagccagaccactgagcaag

SEQ ID NO: 357280 - DNA, 25 bp, Mus musculus
tcagtaagcggtgggtacagtcctc

SEQ ID NO: 357281 - DNA, 25 bp, Mus musculus
tcagtaagggggtccaaggctgcag

SEQ ID NO: 357282 - DNA, 25 bp, Mus musculus
tcagtaatcctccaatcactgttaa

SEQ ID NO: 357283 - DNA, 25 bp, Mus musculus
tcagtaatgcaacgtttcagtctac

SEQ ID NO: 357284 - DNA, 25 bp, Mus musculus
tcagtaatgcaacgtttcagtctga

SEQ ID NO: 357285 - DNA, 25 bp, Mus musculus
tcagtaattatggatgggatcagtc

SEQ ID NO: 357286 - DNA, 25 bp, Mus musculus
tcagtacaatcctgatttgtactgt

SEQ ID NO: 357287 - DNA, 25 bp, Mus musculus
tcagtacagaagagacaggtgagaa

SEQ ID NO: 357288 - DNA, 25 bp, Mus musculus
tcagtacagaatactgtaataccag

SEQ ID NO: 357289 - DNA, 25 bp, Mus musculus
tcagtacaggattagtttcctttta

SEQ ID NO: 357290 - DNA, 25 bp, Mus musculus
tcagtacctaccgtgctgtgcggaa

SEQ ID NO: 357291 - DNA, 25 bp, Mus musculus
tcagtacctagatcgacagctgaaa

SEQ ID NO: 357292 - DNA, 25 bp, Mus musculus
tcagtacttttgggggagctgaaga

SEQ ID NO: 357293 - DNA, 25 bp, Mus musculus
tcagtagcaacaagctgcgcaaacc

SEQ ID NO: 357294 - DNA, 25 bp, Mus musculus
tcagtagcagcccatacaatcctcc

SEQ ID NO: 357295 - DNA, 25 bp, Mus musculus
tcagtagcccagggcagcgagatga

SEQ ID NO: 357296 - DNA, 25 bp, Mus musculus
tcagtagctttgaagaatgaagagg

SEQ ID NO: 357297 - DNA, 25 bp, Mus musculus
tcagtaggagtgtgacttggaaggg

SEQ ID NO: 357298 - DNA, 25 bp, Mus musculus
tcagtagtctttcagatcctgcctc

SEQ ID NO: 357299 - DNA, 25 bp, Mus musculus
tcagtatacatgggagactctggag

SEQ ID NO: 357300 - DNA, 25 bp, Mus musculus
tcagtatcactgtggaatatcgttc

SEQ ID NO: 357301 - DNA, 25 bp, Mus musculus
tcagtatcactgtggcaatagtaat

SEQ ID NO: 357302 - DNA, 25 bp, Mus musculus
tcagtatcctgatcacatttgacaa

SEQ ID NO: 357303 - DNA, 25 bp, Mus musculus
tcagtatgacgttcgcctggctctc

SEQ ID NO: 357304 - DNA, 25 bp, Mus musculus
tcagtattacccttctagctggggg

SEQ ID NO: 357305 - DNA, 25 bp, Mus musculus
tcagtatttaccaagcgctgatcct

SEQ ID NO: 357306 - DNA, 25 bp, Mus musculus
tcagtatttaccaaggaggcatcct

SEQ ID NO: 357307 - DNA, 25 bp, Mus musculus
tcagtcaaagaatgtcccctatata

SEQ ID NO: 357308 - DNA, 25 bp, Mus musculus
tcagtcaaagagaaacaaagcaaac

SEQ ID NO: 357309 - DNA, 25 bp, Mus musculus
tcagtcaatggagagaacaagccca

SEQ ID NO: 357310 - DNA, 25 bp, Mus musculus
tcagtcacatccatggaaagaaagg

SEQ ID NO: 357311 - DNA, 25 bp, Mus musculus
tcagtcacatccatggtcctattaa

SEQ ID NO: 357312 - DNA, 25 bp, Mus musculus
tcagtcacgctcaatgagaagccct

SEQ ID NO: 357313 - DNA, 25 bp, Mus musculus
tcagtcactaagttgaaacactaat

SEQ ID NO: 357314 - DNA, 25 bp, Mus musculus
tcagtcactaagttgtcccgagttt

SEQ ID NO: 357315 - DNA, 25 bp, Mus musculus
tcagtcactgctaggtatggcactg

SEQ ID NO: 357316 - DNA, 25 bp, Mus musculus
tcagtcagagatatatttctgagtt

SEQ ID NO: 357317 - DNA, 25 bp, Mus musculus
tcagtcagagcaagcatcgctgcca

SEQ ID NO: 357318 - DNA, 25 bp, Mus musculus
tcagtcagagcaagcctggctgttt

SEQ ID NO: 357319 - DNA, 25 bp, Mus musculus
tcagtcagagccacgaaggagattc

SEQ ID NO: 357320 - DNA, 25 bp, Mus musculus
tcagtcagccccaacatccagaacc

SEQ ID NO: 357321 - DNA, 25 bp, Mus musculus
tcagtcaggacttgctagacctgat

SEQ ID NO: 357322 - DNA, 25 bp, Mus musculus
tcagtcagttgggagaccgtaccac

SEQ ID NO: 357323 - DNA, 25 bp, Mus musculus
tcagtcagttgggagcttgcactag

SEQ ID NO: 357324 - DNA, 25 bp, Mus musculus
tcagtcatgagaacacaaattgaag

SEQ ID NO: 357325 - DNA, 25 bp, Mus musculus
tcagtcattgggaagactcttcaag

SEQ ID NO: 357326 - DNA, 25 bp, Mus musculus
tcagtccaaagctgctcagccatct

SEQ ID NO: 357327 - DNA, 25 bp, Mus musculus
tcagtccaacgaaaggtaacatttc

SEQ ID NO: 357328 - DNA, 25 bp, Mus musculus
tcagtccaagatatgagaaccacag

SEQ ID NO: 357329 - DNA, 25 bp, Mus musculus
tcagtccaagattgcccaatgatcc

SEQ ID NO: 357330 - DNA, 25 bp, Mus musculus
tcagtccaagcacgccgcagcagcc

SEQ ID NO: 357331 - DNA, 25 bp, Mus musculus
tcagtccaagcacggggacagcttc

SEQ ID NO: 357332 - DNA, 25 bp, Mus musculus
tcagtccattaggctcttctgcgat

SEQ ID NO: 357333 - DNA, 25 bp, Mus musculus
tcagtccattgtaatctcagatgga

SEQ ID NO: 357334 - DNA, 25 bp, Mus musculus
tcagtcccagcagactgagcaagag

SEQ ID NO: 357335 - DNA, 25 bp, Mus musculus
tcagtcctacaggtttgttaagaag

SEQ ID NO: 357336 - DNA, 25 bp, Mus musculus
tcagtcctagtactgatgtcaacac

SEQ ID NO: 357337 - DNA, 25 bp, Mus musculus
tcagtcctagtaggagagatccagc

SEQ ID NO: 357338 - DNA, 25 bp, Mus musculus
tcagtcctatggcagtaccagtgac

SEQ ID NO: 357339 - DNA, 25 bp, Mus musculus
tcagtcctcagatgcggtgagcacc

SEQ ID NO: 357340 - DNA, 25 bp, Mus musculus
tcagtcctccccagaaatagatgaa

SEQ ID NO: 357341 - DNA, 25 bp, Mus musculus
tcagtcctggccgccaagttgaagt

SEQ ID NO: 357342 - DNA, 25 bp, Mus musculus
tcagtcctgggctgggccgtcggaa

SEQ ID NO: 357343 - DNA, 25 bp, Mus musculus
tcagtcctggtgaactgtccatcca

SEQ ID NO: 357344 - DNA, 25 bp, Mus musculus
tcagtcctggtggtccccagcaggc

SEQ ID NO: 357345 - DNA, 25 bp, Mus musculus
tcagtcctttctggtgtccgccgat

SEQ ID NO: 357346 - DNA, 25 bp, Mus musculus
tcagtcgaaaggcaagaagcgaaac

SEQ ID NO: 357347 - DNA, 25 bp, Mus musculus
tcagtcgcattcgaagagccaccga

SEQ ID NO: 357348 - DNA, 25 bp, Mus musculus
tcagtcgcattcgatgaaatcgtgg

SEQ ID NO: 357349 - DNA, 25 bp, Mus musculus
tcagtcggatgaggaagggcccggg

SEQ ID NO: 357350 - DNA, 25 bp, Mus musculus
tcagtcgtttggacttcaaatctca

SEQ ID NO: 357351 - DNA, 25 bp, Mus musculus
tcagtctaagtgtacacaggagaat

SEQ ID NO: 357352 - DNA, 25 bp, Mus musculus
tcagtctcaccggctggggagagac

SEQ ID NO: 357353 - DNA, 25 bp, Mus musculus
tcagtctcacctggcaagatgaata

SEQ ID NO: 357354 - DNA, 25 bp, Mus musculus
tcagtctcagcatcctcatgtgtac

SEQ ID NO: 357355 - DNA, 25 bp, Mus musculus
tcagtctcccagtggtactgccacc

SEQ ID NO: 357356 - DNA, 25 bp, Mus musculus
tcagtctcctgtcagatgggattga

SEQ ID NO: 357357 - DNA, 25 bp, Mus musculus
tcagtctccttgcagagcaggcaag

SEQ ID NO: 357358 - DNA, 25 bp, Mus musculus
tcagtctctcagtgcctgtgctgac

SEQ ID NO: 357359 - DNA, 25 bp, Mus musculus
tcagtctctgcaggttcaggggcac

SEQ ID NO: 357360 - DNA, 25 bp, Mus musculus
tcagtctgaaaggctccagatacct

SEQ ID NO: 357361 - DNA, 25 bp, Mus musculus
tcagtctgagattggccaggtgaaa

SEQ ID NO: 357362 - DNA, 25 bp, Mus musculus
tcagtctgcaacagttgtttaatga

SEQ ID NO: 357363 - DNA, 25 bp, Mus musculus
tcagtctgctcactgggggaatgcg

SEQ ID NO: 357364 - DNA, 25 bp, Mus musculus
tcagtctgtacaggttcctgcagac

SEQ ID NO: 357365 - DNA, 25 bp, Mus musculus
tcagtctgtcaagggggtggcaccg

SEQ ID NO: 357366 - DNA, 25 bp, Mus musculus
tcagtcttacaatacggactctgac

SEQ ID NO: 357367 - DNA, 25 bp, Mus musculus
tcagtcttgaactttaagaaaagat

SEQ ID NO: 357368 - DNA, 25 bp, Mus musculus
tcagtcttgaactttgcaaattgaa

SEQ ID NO: 357369 - DNA, 25 bp, Mus musculus
tcagtcttggctgttccttcttgga

SEQ ID NO: 357370 - DNA, 25 bp, Mus musculus
tcagtctttaagtgccttcagtcaa

SEQ ID NO: 357371 - DNA, 25 bp, Mus musculus
tcagtgaaaacctgcttgtttctgg

SEQ ID NO: 357372 - DNA, 25 bp, Mus musculus
tcagtgaaaggtaaaccagatgtgg

SEQ ID NO: 357373 - DNA, 25 bp, Mus musculus
tcagtgaagagcgagatgttgaact

SEQ ID NO: 357374 - DNA, 25 bp, Mus musculus
tcagtgaagaggaggtcccccagag

SEQ ID NO: 357375 - DNA, 25 bp, Mus musculus
tcagtgaagagtcacatactcacca

SEQ ID NO: 357376 - DNA, 25 bp, Mus musculus
tcagtgacaactccacagagtcatt

SEQ ID NO: 357377 - DNA, 25 bp, Mus musculus
tcagtgacagattgctgttcttctt

SEQ ID NO: 357378 - DNA, 25 bp, Mus musculus
tcagtgaccacccagatgttgccgc

SEQ ID NO: 357379 - DNA, 25 bp, Mus musculus
tcagtgaccacgctgtgttgacatc

SEQ ID NO: 357380 - DNA, 25 bp, Mus musculus
tcagtgaccacggggtaaaggccga

SEQ ID NO: 357381 - DNA, 25 bp, Mus musculus
tcagtgactgcagaaccaagggcca

SEQ ID NO: 357382 - DNA, 25 bp, Mus musculus
tcagtgactgcaggctcatgagcag

SEQ ID NO: 357383 - DNA, 25 bp, Mus musculus
tcagtgactgtaagttgtctgacat

SEQ ID NO: 357384 - DNA, 25 bp, Mus musculus
tcagtgactgtagtctgacatctct

SEQ ID NO: 357385 - DNA, 25 bp, Mus musculus
tcagtgagaaagtggacaccatggt

SEQ ID NO: 357386 - DNA, 25 bp, Mus musculus
tcagtgagaatgagacgtccagcgt

SEQ ID NO: 357387 - DNA, 25 bp, Mus musculus
tcagtgagaatgaggaaggcaagcg

SEQ ID NO: 357388 - DNA, 25 bp, Mus musculus
tcagtgagactaatagtgcagagga

SEQ ID NO: 357389 - DNA, 25 bp, Mus musculus
tcagtgagactaatccagctgaaca

SEQ ID NO: 357390 - DNA, 25 bp, Mus musculus
tcagtgagctcctgctgttctatga

SEQ ID NO: 357391 - DNA, 25 bp, Mus musculus
tcagtgaggacacagagaagctcat

SEQ ID NO: 357392 - DNA, 25 bp, Mus musculus
tcagtgaggacttacagaagctcat

SEQ ID NO: 357393 - DNA, 25 bp, Mus musculus
tcagtgaggatggattcctgaaagg

SEQ ID NO: 357394 - DNA, 25 bp, Mus musculus
tcagtgagtagcaccaatgggcata

SEQ ID NO: 357395 - DNA, 25 bp, Mus musculus
tcagtgagtcggcagggctctgagt

SEQ ID NO: 357396 - DNA, 25 bp, Mus musculus
tcagtgagtcggcagttgaaagtgg

SEQ ID NO: 357397 - DNA, 25 bp, Mus musculus
tcagtgatggctgtcacgaccggag

SEQ ID NO: 357398 - DNA, 25 bp, Mus musculus
tcagtgcaagacagtattggagagg

SEQ ID NO: 357399 - DNA, 25 bp, Mus musculus
tcagtgcaagccaaggtgaaacttc

SEQ ID NO: 357400 - DNA, 25 bp, Mus musculus
tcagtgcaagccaaggttacctctg

SEQ ID NO: 357401 - DNA, 25 bp, Mus musculus
tcagtgcaaggatggaaggaccctc

SEQ ID NO: 357402 - DNA, 25 bp, Mus musculus
tcagtgcaaggttatcctgctcgga

SEQ ID NO: 357403 - DNA, 25 bp, Mus musculus
tcagtgcaagtacagagactcagcc

SEQ ID NO: 357404 - DNA, 25 bp, Mus musculus
tcagtgcaagtcatggggaccctga

SEQ ID NO: 357405 - DNA, 25 bp, Mus musculus
tcagtgcaatggatcagttggagaa

SEQ ID NO: 357406 - DNA, 25 bp, Mus musculus
tcagtgcaatggcttccatacgaca

SEQ ID NO: 357407 - DNA, 25 bp, Mus musculus
tcagtgcacagaacctcgttgccat

SEQ ID NO: 357408 - DNA, 25 bp, Mus musculus
tcagtgccaacctttttgcccagac

SEQ ID NO: 357409 - DNA, 25 bp, Mus musculus
tcagtgcccacccgagtcattcgac

SEQ ID NO: 357410 - DNA, 25 bp, Mus musculus
tcagtgcctcatcttttgctggaat

SEQ ID NO: 357411 - DNA, 25 bp, Mus musculus
tcagtgctcagaagtttgcagggac

SEQ ID NO: 357412 - DNA, 25 bp, Mus musculus
tcagtgctcagcaggtttgggaaaa

SEQ ID NO: 357413 - DNA, 25 bp, Mus musculus
tcagtgctcagggtttaagtcttga

SEQ ID NO: 357414 - DNA, 25 bp, Mus musculus
tcagtgctcccaggggtgatctgct

SEQ ID NO: 357415 - DNA, 25 bp, Mus musculus
tcagtgctgaatggggctttcccgc

SEQ ID NO: 357416 - DNA, 25 bp, Mus musculus
tcagtgctgggttttcagagcacag

SEQ ID NO: 357417 - DNA, 25 bp, Mus musculus
tcagtgctgttcagggtgactcata

SEQ ID NO: 357418 - DNA, 25 bp, Mus musculus
tcagtgcttttaatcagcttaagat

SEQ ID NO: 357419 - DNA, 25 bp, Mus musculus
tcagtggaagccaaggataaccttg

SEQ ID NO: 357420 - DNA, 25 bp, Mus musculus
tcagtggaaggcagttaaaccagag

SEQ ID NO: 357421 - DNA, 25 bp, Mus musculus
tcagtggaaggtaaacagaatctgg

SEQ ID NO: 357422 - DNA, 25 bp, Mus musculus
tcagtggaagtcttgaaatacagcc

SEQ ID NO: 357423 - DNA, 25 bp, Mus musculus
tcagtggaagttctggatgatttaa

SEQ ID NO: 357424 - DNA, 25 bp, Mus musculus
tcagtggacatgaagctgtttgtat

SEQ ID NO: 357425 - DNA, 25 bp, Mus musculus
tcagtggacatgaaggtgcctcagc

SEQ ID NO: 357426 - DNA, 25 bp, Mus musculus
tcagtggaccaaattttcaggatgg

SEQ ID NO: 357427 - DNA, 25 bp, Mus musculus
tcagtggaccagccttcgtggtgaa

SEQ ID NO: 357428 - DNA, 25 bp, Mus musculus
tcagtggagagatgaataagttgcc

SEQ ID NO: 357429 - DNA, 25 bp, Mus musculus
tcagtggagcagcttacagatgtcc

SEQ ID NO: 357430 - DNA, 25 bp, Mus musculus
tcagtggattctgaccacctcatcc

SEQ ID NO: 357431 - DNA, 25 bp, Mus musculus
tcagtggcagcactccgccagagtg

SEQ ID NO: 357432 - DNA, 25 bp, Mus musculus
tcagtggcaggcggtgtggctacag

SEQ ID NO: 357433 - DNA, 25 bp, Mus musculus
tcagtggcagttgctgcgattgtgg

SEQ ID NO: 357434 - DNA, 25 bp, Mus musculus
tcagtggccccgaggtctcagatct

SEQ ID NO: 357435 - DNA, 25 bp, Mus musculus
tcagtggccccgagtgccagttgcc

SEQ ID NO: 357436 - DNA, 25 bp, Mus musculus
tcagtggcctacagggctggctgtg

SEQ ID NO: 357437 - DNA, 25 bp, Mus musculus
tcagtggctcggatgttcagcacaa

SEQ ID NO: 357438 - DNA, 25 bp, Mus musculus
tcagtgggaagttggtacagagcat

SEQ ID NO: 357439 - DNA, 25 bp, Mus musculus
tcagtgggagcactggctcacccat

SEQ ID NO: 357440 - DNA, 25 bp, Mus musculus
tcagtgggaggaggaatttgacaag

SEQ ID NO: 357441 - DNA, 25 bp, Mus musculus
tcagtgggcagatgcacatgcagaa

SEQ ID NO: 357442 - DNA, 25 bp, Mus musculus
tcagtggggcggcccctgcccggat

SEQ ID NO: 357443 - DNA, 25 bp, Mus musculus
tcagtggtccagaccctcagtgctc

SEQ ID NO: 357444 - DNA, 25 bp, Mus musculus
tcagtggtccaggttctaagcgcag

SEQ ID NO: 357445 - DNA, 25 bp, Mus musculus
tcagtggtgggttttttcagggatt

SEQ ID NO: 357446 - DNA, 25 bp, Mus musculus
tcagtggtgtcggcattgctagctt

SEQ ID NO: 357447 - DNA, 25 bp, Mus musculus
tcagtggtgtcggtgttgccagtgt

SEQ ID NO: 357448 - DNA, 25 bp, Mus musculus
tcagtgtaacccagtgtggtgaact

SEQ ID NO: 357449 - DNA, 25 bp, Mus musculus
tcagtgtaggatctcttcactggtc

SEQ ID NO: 357450 - DNA, 25 bp, Mus musculus
tcagtgtatcaggatgatgctgttg

SEQ ID NO: 357451 - DNA, 25 bp, Mus musculus
tcagtgtatgccgcttacaagcacg

SEQ ID NO: 357452 - DNA, 25 bp, Mus musculus
tcagtgtcagacttaaatggagtgg

SEQ ID NO: 357453 - DNA, 25 bp, Mus musculus
tcagtgtcagggagtgttcctgtat

SEQ ID NO: 357454 - DNA, 25 bp, Mus musculus
tcagtgtcagtgattcgggtacctt

SEQ ID NO: 357455 - DNA, 25 bp, Mus musculus
tcagtgtcatcaaggtctttccgga

SEQ ID NO: 357456 - DNA, 25 bp, Mus musculus
tcagtgtctccctccaagccacacc

SEQ ID NO: 357457 - DNA, 25 bp, Mus musculus
tcagtgtctgaaaccaaggaagaag

SEQ ID NO: 357458 - DNA, 25 bp, Mus musculus
tcagtgtctggacatttattcagag

SEQ ID NO: 357459 - DNA, 25 bp, Mus musculus
tcagtgtctggatgccagccactgc

SEQ ID NO: 357460 - DNA, 25 bp, Mus musculus
tcagtgtctggtgcagagtggtggc

SEQ ID NO: 357461 - DNA, 25 bp, Mus musculus
tcagtgtgagtatatacacttctga

SEQ ID NO: 357462 - DNA, 25 bp, Mus musculus
tcagtgtggaagagctcccgccagt

SEQ ID NO: 357463 - DNA, 25 bp, Mus musculus
tcagtgtggcctcccctggttttct

SEQ ID NO: 357464 - DNA, 25 bp, Mus musculus
tcagtgtgtcaaatctctcatggaa

SEQ ID NO: 357465 - DNA, 25 bp, Mus musculus
tcagtgttcacatcaacaggaacgt

SEQ ID NO: 357466 - DNA, 25 bp, Mus musculus
tcagtgttgtgtccggtataagtgc

SEQ ID NO: 357467 - DNA, 25 bp, Mus musculus
tcagttaaaaaacaaggtgagacag

SEQ ID NO: 357468 - DNA, 25 bp, Mus musculus
tcagttaaaagaaggtaccaggtga

SEQ ID NO: 357469 - DNA, 25 bp, Mus musculus
tcagttaatggaatcttctgagagc

SEQ ID NO: 357470 - DNA, 25 bp, Mus musculus
tcagttacaagcaacaacaacaaaa

SEQ ID NO: 357471 - DNA, 25 bp, Mus musculus
tcagttacaaggcaatgtatgtgaa

SEQ ID NO: 357472 - DNA, 25 bp, Mus musculus
tcagttagaagctcttaaaaaacag

SEQ ID NO: 357473 - DNA, 25 bp, Mus musculus
tcagttagctgagacacttgtgagc

SEQ ID NO: 357474 - DNA, 25 bp, Mus musculus
tcagttagctgagtcggctgcacgg

SEQ ID NO: 357475 - DNA, 25 bp, Mus musculus
tcagttatagccaggatttcccagc

SEQ ID NO: 357476 - DNA, 25 bp, Mus musculus
tcagttatagccaggtctccagcag

SEQ ID NO: 357477 - DNA, 25 bp, Mus musculus
tcagttatctgacccttcctatctg

SEQ ID NO: 357478 - DNA, 25 bp, Mus musculus
tcagttcaaagatctaaatgcaaat

SEQ ID NO: 357479 - DNA, 25 bp, Mus musculus
tcagttcagttagcccccaaccatc

SEQ ID NO: 357480 - DNA, 25 bp, Mus musculus
tcagttcagttttgctaactgtgga

SEQ ID NO: 357481 - DNA, 25 bp, Mus musculus
tcagttcctggaaatccactgcagc

SEQ ID NO: 357482 - DNA, 25 bp, Mus musculus
tcagttcctggaaatgcacggggag

SEQ ID NO: 357483 - DNA, 25 bp, Mus musculus
tcagttctcccaggttgttcctcaa

SEQ ID NO: 357484 - DNA, 25 bp, Mus musculus
tcagttctgggaagcttccagcttt

SEQ ID NO: 357485 - DNA, 25 bp, Mus musculus
tcagttctgggaagtctccaggctt

SEQ ID NO: 357486 - DNA, 25 bp, Mus musculus
tcagttctgtgactgatgaagtatt

SEQ ID NO: 357487 - DNA, 25 bp, Mus musculus
tcagttcttaccagaacttgatcac

SEQ ID NO: 357488 - DNA, 25 bp, Mus musculus
tcagttcttaccagagttctggcca

SEQ ID NO: 357489 - DNA, 25 bp, Mus musculus
tcagttcttaccagatgacaaatca

SEQ ID NO: 357490 - DNA, 25 bp, Mus musculus
tcagttcttctcaggggaggagtac

SEQ ID NO: 357491 - DNA, 25 bp, Mus musculus
tcagttcttctcagggttggaaatc

SEQ ID NO: 357492 - DNA, 25 bp, Mus musculus
tcagttcttctcaggtatattgaaa

SEQ ID NO: 357493 - DNA, 25 bp, Mus musculus
tcagttcttttaggaagctcaataa

SEQ ID NO: 357494 - DNA, 25 bp, Mus musculus
tcagttgacacgagccgtctaccct

SEQ ID NO: 357495 - DNA, 25 bp, Mus musculus
tcagttgacacggaacagtccaatt

SEQ ID NO: 357496 - DNA, 25 bp, Mus musculus
tcagttgcagcgacaagttctacca

SEQ ID NO: 357497 - DNA, 25 bp, Mus musculus
tcagttgccgattgctgttcttctt

SEQ ID NO: 357498 - DNA, 25 bp, Mus musculus
tcagttgcctcaagacatttgaggg

SEQ ID NO: 357499 - DNA, 25 bp, Mus musculus
tcagttgcctcaaggtcctctgtct

SEQ ID NO: 357500 - DNA, 25 bp, Mus musculus
tcagttgcctgactcgctcggaagc

SEQ ID NO: 357501 - DNA, 25 bp, Mus musculus
tcagttgctaaacagcatccaggga

SEQ ID NO: 357502 - DNA, 25 bp, Mus musculus
tcagttgctttctgtgaggccaggt

SEQ ID NO: 357503 - DNA, 25 bp, Mus musculus
tcagttgctttctgtttctaatcct

SEQ ID NO: 357504 - DNA, 25 bp, Mus musculus
tcagttggagcaggccctgcaggaa

SEQ ID NO: 357505 - DNA, 25 bp, Mus musculus
tcagttggatgaaaattccaagttg

SEQ ID NO: 357506 - DNA, 25 bp, Mus musculus
tcagttggccaaggtgtttcccagc

SEQ ID NO: 357507 - DNA, 25 bp, Mus musculus
tcagttgggaaattcctaaatgcaa

SEQ ID NO: 357508 - DNA, 25 bp, Mus musculus
tcagttgtagagggcatctcctccc

SEQ ID NO: 357509 - DNA, 25 bp, Mus musculus
tcagttgttgagctctgaactcact

SEQ ID NO: 357510 - DNA, 25 bp, Mus musculus
tcagtttaaagcaaggtgaatgttt

SEQ ID NO: 357511 - DNA, 25 bp, Mus musculus
tcagtttaacacacaagattcttcc

SEQ ID NO: 357512 - DNA, 25 bp, Mus musculus
tcagtttaattatgatggagaagaa

SEQ ID NO: 357513 - DNA, 25 bp, Mus musculus
tcagtttaattatggtatgcagcca

SEQ ID NO: 357514 - DNA, 25 bp, Mus musculus
tcagtttacagccacagccacaacc

SEQ ID NO: 357515 - DNA, 25 bp, Mus musculus
tcagtttatcaaagtcatgtaggaa

SEQ ID NO: 357516 - DNA, 25 bp, Mus musculus
tcagtttccacaccgacactgcaaa

SEQ ID NO: 357517 - DNA, 25 bp, Mus musculus
tcagtttccacagaatggactcgct

SEQ ID NO: 357518 - DNA, 25 bp, Mus musculus
tcagtttcgagctggggttattccc

SEQ ID NO: 357519 - DNA, 25 bp, Mus musculus
tcagtttctcagaatcccctggttg

SEQ ID NO: 357520 - DNA, 25 bp, Mus musculus
tcagtttctcgcagagtgttcctga

SEQ ID NO: 357521 - DNA, 25 bp, Mus musculus
tcagtttctcgcagatatattacca

SEQ ID NO: 357522 - DNA, 25 bp, Mus musculus
tcagtttctgcagacttgtactggt

SEQ ID NO: 357523 - DNA, 25 bp, Mus musculus
tcagtttgacaaaggaaaaagaggc

SEQ ID NO: 357524 - DNA, 25 bp, Mus musculus
tcagtttgataccggatggtggatt

SEQ ID NO: 357525 - DNA, 25 bp, Mus musculus
tcagtttggcatgctggtttcacca

SEQ ID NO: 357526 - DNA, 25 bp, Mus musculus
tcagttttagatcaagaatgaccca

SEQ ID NO: 357527 - DNA, 25 bp, Mus musculus
tcagttttagcctgcggagcccaag

SEQ ID NO: 357528 - DNA, 25 bp, Mus musculus
tcagttttagtgcattgcagaagtt

SEQ ID NO: 357529 - DNA, 25 bp, Mus musculus
tcagttttagtggcatcccctgtga

SEQ ID NO: 357530 - DNA, 25 bp, Mus musculus
tcagttttcccaagcaaccctacat

SEQ ID NO: 357531 - DNA, 25 bp, Mus musculus
tcagttttcgcatcaaggtgtaatg

SEQ ID NO: 357532 - DNA, 25 bp, Mus musculus
tcagttttgaaaaagaatatatttg

SEQ ID NO: 357533 - DNA, 25 bp, Mus musculus
tcagttttgaaaaaggtgactcatt

SEQ ID NO: 357534 - DNA, 25 bp, Mus musculus
tcagtttttagcgttctccacccat

SEQ ID NO: 357535 - DNA, 25 bp, Mus musculus
tcagtttttgttggaaatacagttg

SEQ ID NO: 357536 - DNA, 25 bp, Mus musculus
tcagtttttttgcattttgttccca

SEQ ID NO: 357537 - DNA, 25 bp, Mus musculus
tcataaacaagatgaaattatagat

SEQ ID NO: 357538 - DNA, 25 bp, Mus musculus
tcataaacaaggtcgctggtcatcc

SEQ ID NO: 357539 - DNA, 25 bp, Mus musculus
tcataaacgacaggtgtgtggaggt

SEQ ID NO: 357540 - DNA, 25 bp, Mus musculus
tcataaacgacaggtgtgttgaaag

SEQ ID NO: 357541 - DNA, 25 bp, Mus musculus
tcataaagaggctcacaactcagtg

SEQ ID NO: 357542 - DNA, 25 bp, Mus musculus
tcataaagccaggcagtgaagcaga

SEQ ID NO: 357543 - DNA, 25 bp, Mus musculus
tcataaataaggtgcgagaagatgt

SEQ ID NO: 357544 - DNA, 25 bp, Mus musculus
tcataaataaggttgtgcatttttg

SEQ ID NO: 357545 - DNA, 25 bp, Mus musculus
tcataaatacaaaacctgggcattc

SEQ ID NO: 357546 - DNA, 25 bp, Mus musculus
tcataaatcagccttacgatgggcc

SEQ ID NO: 357547 - DNA, 25 bp, Mus musculus
tcataaatgatgtatgtcgcactgg

SEQ ID NO: 357548 - DNA, 25 bp, Mus musculus
tcataacaaggatatagtgcacaga

SEQ ID NO: 357549 - DNA, 25 bp, Mus musculus
tcataacatagactgaaacagtccc

SEQ ID NO: 357550 - DNA, 25 bp, Mus musculus
tcataacccggcagaactacacata

SEQ ID NO: 357551 - DNA, 25 bp, Mus musculus
tcataacgctaacaggatgagattg

SEQ ID NO: 357552 - DNA, 25 bp, Mus musculus
tcataacgctaagtgtgatgaatgc

SEQ ID NO: 357553 - DNA, 25 bp, Mus musculus
tcataactatcgcgaacgagagagg

SEQ ID NO: 357554 - DNA, 25 bp, Mus musculus
tcataactcgaatgaaactttgcta

SEQ ID NO: 357555 - DNA, 25 bp, Mus musculus
tcataacttccagagaatctcagta

SEQ ID NO: 357556 - DNA, 25 bp, Mus musculus
tcataacttccagatccaggccttc

SEQ ID NO: 357557 - DNA, 25 bp, Mus musculus
tcataagaagacacacacaggagaa

SEQ ID NO: 357558 - DNA, 25 bp, Mus musculus
tcataagaagtgtttccacgatgat

SEQ ID NO: 357559 - DNA, 25 bp, Mus musculus
tcataagcaaacatgtttcctttta

SEQ ID NO: 357560 - DNA, 25 bp, Mus musculus
tcataaggaccaggatacaaattgg

SEQ ID NO: 357561 - DNA, 25 bp, Mus musculus
tcataagtaaaggagaggagccaaa

SEQ ID NO: 357562 - DNA, 25 bp, Mus musculus
tcataagtaccaggctggtaagaac

SEQ ID NO: 357563 - DNA, 25 bp, Mus musculus
tcataatcaaggcgtatgggcaagt

SEQ ID NO: 357564 - DNA, 25 bp, Mus musculus
tcataatcgcaaaaacatcaaactg

SEQ ID NO: 357565 - DNA, 25 bp, Mus musculus
tcataattgcccaggactcgttaat

SEQ ID NO: 357566 - DNA, 25 bp, Mus musculus
tcataattgcccagtatttaacaga

SEQ ID NO: 357567 - DNA, 25 bp, Mus musculus
tcataattttattacgtttggcaaa

SEQ ID NO: 357568 - DNA, 25 bp, Mus musculus
tcatacaagtttgtgtggccatcat

SEQ ID NO: 357569 - DNA, 25 bp, Mus musculus
tcatacaccagcaactctgatgatc

SEQ ID NO: 357570 - DNA, 25 bp, Mus musculus
tcatacagaaccatgaccatccaca

SEQ ID NO: 357571 - DNA, 25 bp, Mus musculus
tcatacagaggtaccttccttgcgt

SEQ ID NO: 357572 - DNA, 25 bp, Mus musculus
tcatacagaggttaaattaaaaata

SEQ ID NO: 357573 - DNA, 25 bp, Mus musculus
tcatacagccaaggccaggtagctg

SEQ ID NO: 357574 - DNA, 25 bp, Mus musculus
tcatacatcaaaagctgcagaatct

SEQ ID NO: 357575 - DNA, 25 bp, Mus musculus
tcatacatctagtggcagagagttg

SEQ ID NO: 357576 - DNA, 25 bp, Mus musculus
tcataccaatttaagctccagctcc

SEQ ID NO: 357577 - DNA, 25 bp, Mus musculus
tcataccccatgcagctatctaact

SEQ ID NO: 357578 - DNA, 25 bp, Mus musculus
tcataccctctgtggtgagcatcag

SEQ ID NO: 357579 - DNA, 25 bp, Mus musculus
tcataccctctgtgtgacagctcaa

SEQ ID NO: 357580 - DNA, 25 bp, Mus musculus
tcatacctcgagaattatagtgaac

SEQ ID NO: 357581 - DNA, 25 bp, Mus musculus
tcatacgatcacagataactatgct

SEQ ID NO: 357582 - DNA, 25 bp, Mus musculus
tcatacgatcacagggatctcgatt

SEQ ID NO: 357583 - DNA, 25 bp, Mus musculus
tcatactacaggtgagcgtcctcac

SEQ ID NO: 357584 - DNA, 25 bp, Mus musculus
tcatactctgagtgacagcttcctc

SEQ ID NO: 357585 - DNA, 25 bp, Mus musculus
tcatactgcaggcagagaggtggct

SEQ ID NO: 357586 - DNA, 25 bp, Mus musculus
tcatactgcagtctggacagaggat

SEQ ID NO: 357587 - DNA, 25 bp, Mus musculus
tcatactgcatgacatcaacagtga

SEQ ID NO: 357588 - DNA, 25 bp, Mus musculus
tcatactgtagaggaatgcctccaa

SEQ ID NO: 357589 - DNA, 25 bp, Mus musculus
tcatactgtagaggagaatccttcc

SEQ ID NO: 357590 - DNA, 25 bp, Mus musculus
tcatacttgcacaccgctggtttgt

SEQ ID NO: 357591 - DNA, 25 bp, Mus musculus
tcatagaatccgttgaagactttct

SEQ ID NO: 357592 - DNA, 25 bp, Mus musculus
tcatagatgcaggaggattggaagc

SEQ ID NO: 357593 - DNA, 25 bp, Mus musculus
tcatagatgcaggagtgagattata

SEQ ID NO: 357594 - DNA, 25 bp, Mus musculus
tcatagatgtaggtgaaaaatctct

SEQ ID NO: 357595 - DNA, 25 bp, Mus musculus
tcatagattcacttgctgtaagaac

SEQ ID NO: 357596 - DNA, 25 bp, Mus musculus
tcatagattcacttggcttgttaca

SEQ ID NO: 357597 - DNA, 25 bp, Mus musculus
tcatagcagggtgttcttctggaca

SEQ ID NO: 357598 - DNA, 25 bp, Mus musculus
tcatagcatcaggcactgttgtagg

SEQ ID NO: 357599 - DNA, 25 bp, Mus musculus
tcatagccaaggaaggtggggttgt

SEQ ID NO: 357600 - DNA, 25 bp, Mus musculus
tcatagccaaggtggacggtatcct

SEQ ID NO: 357601 - DNA, 25 bp, Mus musculus
tcatagccaagttcctgtacgggaa

SEQ ID NO: 357602 - DNA, 25 bp, Mus musculus
tcatagccagggttcagccgactcc

SEQ ID NO: 357603 - DNA, 25 bp, Mus musculus
tcatagctccagtgacccaccgttc

SEQ ID NO: 357604 - DNA, 25 bp, Mus musculus
tcatagctgtctggtttgtggacag

SEQ ID NO: 357605 - DNA, 25 bp, Mus musculus
tcatagcttacatacccttcgcagg

SEQ ID NO: 357606 - DNA, 25 bp, Mus musculus
tcataggaacaaagacaggaaatct

SEQ ID NO: 357607 - DNA, 25 bp, Mus musculus
tcataggaacagattgagaaatggc

SEQ ID NO: 357608 - DNA, 25 bp, Mus musculus
tcataggacagtctcccatggctat

SEQ ID NO: 357609 - DNA, 25 bp, Mus musculus
tcataggagaagtatgagctggtgt

SEQ ID NO: 357610 - DNA, 25 bp, Mus musculus
tcataggcttttggccactcttggg

SEQ ID NO: 357611 - DNA, 25 bp, Mus musculus
tcatagggcggtcagctcactaagg

SEQ ID NO: 357612 - DNA, 25 bp, Mus musculus
tcatagtactagattcatcccaggg

SEQ ID NO: 357613 - DNA, 25 bp, Mus musculus
tcatagtagttctcttcccatactg

SEQ ID NO: 357614 - DNA, 25 bp, Mus musculus
tcatagtctctaggatgctccagac

SEQ ID NO: 357615 - DNA, 25 bp, Mus musculus
tcatagtgcagtaagtctggagcca

SEQ ID NO: 357616 - DNA, 25 bp, Mus musculus
tcatagtgcatttctcatctacatt

SEQ ID NO: 357617 - DNA, 25 bp, Mus musculus
tcatagtggaaaagaaccaaagaat

SEQ ID NO: 357618 - DNA, 25 bp, Mus musculus
tcatagtggctgcggctgttaagaa

SEQ ID NO: 357619 - DNA, 25 bp, Mus musculus
tcatagtggctgcgggtattcccag

SEQ ID NO: 357620 - DNA, 25 bp, Mus musculus
tcatagttgctgcagacccgtggat

SEQ ID NO: 357621 - DNA, 25 bp, Mus musculus
tcatatacaggagcagtacagtggg

SEQ ID NO: 357622 - DNA, 25 bp, Mus musculus
tcatatcagcacggacgattccgga

SEQ ID NO: 357623 - DNA, 25 bp, Mus musculus
tcatatcagcacgggtcacccagaa

SEQ ID NO: 357624 - DNA, 25 bp, Mus musculus
tcatatccaggagagagtctccgct

SEQ ID NO: 357625 - DNA, 25 bp, Mus musculus
tcatatccaggaggtgacccacaac

SEQ ID NO: 357626 - DNA, 25 bp, Mus musculus
tcatatccaggagttgatctttata

SEQ ID NO: 357627 - DNA, 25 bp, Mus musculus
tcatatccttcaggatggaacagac

SEQ ID NO: 357628 - DNA, 25 bp, Mus musculus
tcatatctaccgtcgacttaaaaca

SEQ ID NO: 357629 - DNA, 25 bp, Mus musculus
tcatatctgctaaggctttggagtt

SEQ ID NO: 357630 - DNA, 25 bp, Mus musculus
tcatatctttcagaggagcctatca

SEQ ID NO: 357631 - DNA, 25 bp, Mus musculus
tcatatctttcaggtggtatagctg

SEQ ID NO: 357632 - DNA, 25 bp, Mus musculus
tcatatgataatattaagaatgccc

SEQ ID NO: 357633 - DNA, 25 bp, Mus musculus
tcatatgatagtctgatatgccgag

SEQ ID NO: 357634 - DNA, 25 bp, Mus musculus
tcatatggaccacagccacctgggc

SEQ ID NO: 357635 - DNA, 25 bp, Mus musculus
tcatatggagagacgtgtcctgggc

SEQ ID NO: 357636 - DNA, 25 bp, Mus musculus
tcatatggagagtatgctattaaga

SEQ ID NO: 357637 - DNA, 25 bp, Mus musculus
tcatatgtagcagctgtggcagacc

SEQ ID NO: 357638 - DNA, 25 bp, Mus musculus
tcatattaaatcctgaagtccacaa

SEQ ID NO: 357639 - DNA, 25 bp, Mus musculus
tcatattaaggaggccttgtcagtt

SEQ ID NO: 357640 - DNA, 25 bp, Mus musculus
tcatattactgaagatgagctaaga

SEQ ID NO: 357641 - DNA, 25 bp, Mus musculus
tcatattactggtgatgaatctttc

SEQ ID NO: 357642 - DNA, 25 bp, Mus musculus
tcatattactgtatcatccagataa

SEQ ID NO: 357643 - DNA, 25 bp, Mus musculus
tcatattcagagcctcagcttaagg

SEQ ID NO: 357644 - DNA, 25 bp, Mus musculus
tcatattcggtggatttctttattc

SEQ ID NO: 357645 - DNA, 25 bp, Mus musculus
tcatattcttctaagggaatacagt

SEQ ID NO: 357646 - DNA, 25 bp, Mus musculus
tcatattggacaagaagttgttcaa

SEQ ID NO: 357647 - DNA, 25 bp, Mus musculus
tcatattggacaagtagaggggacc

SEQ ID NO: 357648 - DNA, 25 bp, Mus musculus
tcatatttccggctgctcctgatgc

SEQ ID NO: 357649 - DNA, 25 bp, Mus musculus
tcatatttggccacagccttcgtgt

SEQ ID NO: 357650 - DNA, 25 bp, Mus musculus
tcatattttggtttttgggaataac

SEQ ID NO: 357651 - DNA, 25 bp, Mus musculus
tcatcaaaactggaagtttggtgag

SEQ ID NO: 357652 - DNA, 25 bp, Mus musculus
tcatcaaacccctctgtggtttctc

SEQ ID NO: 357653 - DNA, 25 bp, Mus musculus
tcatcaaagaaacccatcttcatgc

SEQ ID NO: 357654 - DNA, 25 bp, Mus musculus
tcatcaaagagtgtggcctgctcaa

SEQ ID NO: 357655 - DNA, 25 bp, Mus musculus
tcatcaaaggtttggcttctccagt

SEQ ID NO: 357656 - DNA, 25 bp, Mus musculus
tcatcaacaacgcagccactcttgg

SEQ ID NO: 357657 - DNA, 25 bp, Mus musculus
tcatcaacaacgcagccctacaaag

SEQ ID NO: 357658 - DNA, 25 bp, Mus musculus
tcatcaacacagactttcctgcccc

SEQ ID NO: 357659 - DNA, 25 bp, Mus musculus
tcatcaacagagctggcatgtttgt

SEQ ID NO: 357660 - DNA, 25 bp, Mus musculus
tcatcaacaggctctcctttttacc

SEQ ID NO: 357661 - DNA, 25 bp, Mus musculus
tcatcaacagggctgatatccctgt

SEQ ID NO: 357662 - DNA, 25 bp, Mus musculus
tcatcaacagtgagggggactcaga

SEQ ID NO: 357663 - DNA, 25 bp, Mus musculus
tcatcaacagtttgcaggacatggt

SEQ ID NO: 357664 - DNA, 25 bp, Mus musculus
tcatcaaccaaaagctggcatctga

SEQ ID NO: 357665 - DNA, 25 bp, Mus musculus
tcatcaacgtgctggaacttggcac

SEQ ID NO: 357666 - DNA, 25 bp, Mus musculus
tcatcaacgtgctggacctataaga

SEQ ID NO: 357667 - DNA, 25 bp, Mus musculus
tcatcaactatcatgcttcggatgt

SEQ ID NO: 357668 - DNA, 25 bp, Mus musculus
tcatcaactctatattagctcaatc

SEQ ID NO: 357669 - DNA, 25 bp, Mus musculus
tcatcaacttaggcgtgtataagtg

SEQ ID NO: 357670 - DNA, 25 bp, Mus musculus
tcatcaactttgatgtcctagcagg

SEQ ID NO: 357671 - DNA, 25 bp, Mus musculus
tcatcaagaaagggtacacccagca

SEQ ID NO: 357672 - DNA, 25 bp, Mus musculus
tcatcaagaagagcctccccaggtg

SEQ ID NO: 357673 - DNA, 25 bp, Mus musculus
tcatcaagaaggtgcaggtggttca

SEQ ID NO: 357674 - DNA, 25 bp, Mus musculus
tcatcaagagggctgggtcaaggaa

SEQ ID NO: 357675 - DNA, 25 bp, Mus musculus
tcatcaagcagtgctatcaagatca

SEQ ID NO: 357676 - DNA, 25 bp, Mus musculus
tcatcaagcctggtacttgctacag

SEQ ID NO: 357677 - DNA, 25 bp, Mus musculus
tcatcaaggccaaggccaacctgga

SEQ ID NO: 357678 - DNA, 25 bp, Mus musculus
tcatcaagggccactccagaagtgt

SEQ ID NO: 357679 - DNA, 25 bp, Mus musculus
tcatcaagtcaggctcagatgaggt

SEQ ID NO: 357680 - DNA, 25 bp, Mus musculus
tcatcaagtgaggaatctgaggaag

SEQ ID NO: 357681 - DNA, 25 bp, Mus musculus
tcatcaataaggactgcatcgacgt

SEQ ID NO: 357682 - DNA, 25 bp, Mus musculus
tcatcaatccaaacatctgtggcca

SEQ ID NO: 357683 - DNA, 25 bp, Mus musculus
tcatcaatcccagggctccgggatc

SEQ ID NO: 357684 - DNA, 25 bp, Mus musculus
tcatcaatctagaaggtggtgacat

SEQ ID NO: 357685 - DNA, 25 bp, Mus musculus
tcatcaatgcaggaaaggaaacagt

SEQ ID NO: 357686 - DNA, 25 bp, Mus musculus
tcatcaatgccaaccgtcctgggct

SEQ ID NO: 357687 - DNA, 25 bp, Mus musculus
tcatcaatgccagtcccatcccatc

SEQ ID NO: 357688 - DNA, 25 bp, Mus musculus
tcatcaatgggtcccttttgcagtc

SEQ ID NO: 357689 - DNA, 25 bp, Mus musculus
tcatcaatgtgccaatattcaagga

SEQ ID NO: 357690 - DNA, 25 bp, Mus musculus
tcatcaatgtgttccttgcccagtc

SEQ ID NO: 357691 - DNA, 25 bp, Mus musculus
tcatcacaccggtgttttggccagg

SEQ ID NO: 357692 - DNA, 25 bp, Mus musculus
tcatcacactgttgaagagaaggag

SEQ ID NO: 357693 - DNA, 25 bp, Mus musculus
tcatcacagcaatccgccacttgag

SEQ ID NO: 357694 - DNA, 25 bp, Mus musculus
tcatcacagcacaggaggaagcaag

SEQ ID NO: 357695 - DNA, 25 bp, Mus musculus
tcatcacagccaggaagtcacctgg

SEQ ID NO: 357696 - DNA, 25 bp, Mus musculus
tcatcacagcctggcaccctcctgc

SEQ ID NO: 357697 - DNA, 25 bp, Mus musculus
tcatcacagcctgtaaaaagaaccc

SEQ ID NO: 357698 - DNA, 25 bp, Mus musculus
tcatcacaggagcatctcaatggga

SEQ ID NO: 357699 - DNA, 25 bp, Mus musculus
tcatcacaggagttggtgacacaca

SEQ ID NO: 357700 - DNA, 25 bp, Mus musculus
tcatcacaggcaagaaggagaggaa

SEQ ID NO: 357701 - DNA, 25 bp, Mus musculus
tcatcaccaactttccaagattacc

SEQ ID NO: 357702 - DNA, 25 bp, Mus musculus
tcatcaccaaggaggatataaatgc

SEQ ID NO: 357703 - DNA, 25 bp, Mus musculus
tcatcaccaccatcggctatggtca

SEQ ID NO: 357704 - DNA, 25 bp, Mus musculus
tcatcaccagaataagcctgcacga

SEQ ID NO: 357705 - DNA, 25 bp, Mus musculus
tcatcaccagctatcacgtatggac

SEQ ID NO: 357706 - DNA, 25 bp, Mus musculus
tcatcaccaggagctcggacggcgc

SEQ ID NO: 357707 - DNA, 25 bp, Mus musculus
tcatcaccaggagctctcctcccaa

SEQ ID NO: 357708 - DNA, 25 bp, Mus musculus
tcatcaccaggagtatgcttgagag

SEQ ID NO: 357709 - DNA, 25 bp, Mus musculus
tcatcaccaggtatcacgtatggac

SEQ ID NO: 357710 - DNA, 25 bp, Mus musculus
tcatcaccatgatctgtgccattgc

SEQ ID NO: 357711 - DNA, 25 bp, Mus musculus
tcatcacccaagatcatcatgcacg

SEQ ID NO: 357712 - DNA, 25 bp, Mus musculus
tcatcaccggggcttgcgacaagga

SEQ ID NO: 357713 - DNA, 25 bp, Mus musculus
tcatcaccggggttccattttgggg

SEQ ID NO: 357714 - DNA, 25 bp, Mus musculus
tcatcacctacatccgcaggctgct

SEQ ID NO: 357715 - DNA, 25 bp, Mus musculus
tcatcacctctggaacttagcccag

SEQ ID NO: 357716 - DNA, 25 bp, Mus musculus
tcatcacggaactcgctaagccggg

SEQ ID NO: 357717 - DNA, 25 bp, Mus musculus
tcatcacggaactcgtgaatgatac

SEQ ID NO: 357718 - DNA, 25 bp, Mus musculus
tcatcacggcagatggcagtgaaat

SEQ ID NO: 357719 - DNA, 25 bp, Mus musculus
tcatcactaccatcggctatggcaa

SEQ ID NO: 357720 - DNA, 25 bp, Mus musculus
tcatcactcagtgcatgaggaagca

SEQ ID NO: 357721 - DNA, 25 bp, Mus musculus
tcatcactgtcatccaggacatgga

SEQ ID NO: 357722 - DNA, 25 bp, Mus musculus
tcatcagaacaggagtaagcatgga

SEQ ID NO: 357723 - DNA, 25 bp, Mus musculus
tcatcagactgtgtcagaagtttgg

SEQ ID NO: 357724 - DNA, 25 bp, Mus musculus
tcatcagagcgatgtctggtccttc

SEQ ID NO: 357725 - DNA, 25 bp, Mus musculus
tcatcagaggagattgaagggcgga

SEQ ID NO: 357726 - DNA, 25 bp, Mus musculus
tcatcagatgcccagcaccccttgg

SEQ ID NO: 357727 - DNA, 25 bp, Mus musculus
tcatcagcaaatgacatctggatta

SEQ ID NO: 357728 - DNA, 25 bp, Mus musculus
tcatcagcaagagcttatttcctca

SEQ ID NO: 357729 - DNA, 25 bp, Mus musculus
tcatcagcacagaccggggagctct

SEQ ID NO: 357730 - DNA, 25 bp, Mus musculus
tcatcagcaggccaactctacaatg

SEQ ID NO: 357731 - DNA, 25 bp, Mus musculus
tcatcagcagtacagacgaaatgcc

SEQ ID NO: 357732 - DNA, 25 bp, Mus musculus
tcatcagcagtacaggccggccacg

SEQ ID NO: 357733 - DNA, 25 bp, Mus musculus
tcatcagcatccagtcctggcttaa

SEQ ID NO: 357734 - DNA, 25 bp, Mus musculus
tcatcagccaggagccagtcctgtt

SEQ ID NO: 357735 - DNA, 25 bp, Mus musculus
tcatcagcgatgagatggtacagaa

SEQ ID NO: 357736 - DNA, 25 bp, Mus musculus
tcatcagcgatgaggtagttttgag

SEQ ID NO: 357737 - DNA, 25 bp, Mus musculus
tcatcagcttctcagtgaatttgac

SEQ ID NO: 357738 - DNA, 25 bp, Mus musculus
tcatcaggaggtgcttacatgttgc

SEQ ID NO: 357739 - DNA, 25 bp, Mus musculus
tcatcagtcaaagaatgtcccctat

SEQ ID NO: 357740 - DNA, 25 bp, Mus musculus
tcatcagtcaaagagaaacaaagca

SEQ ID NO: 357741 - DNA, 25 bp, Mus musculus
tcatcataaatgttaaaattctgtg

SEQ ID NO: 357742 - DNA, 25 bp, Mus musculus
tcatcatacagaacagtaccttttt

SEQ ID NO: 357743 - DNA, 25 bp, Mus musculus
tcatcatagatatcacaaccacctt

SEQ ID NO: 357744 - DNA, 25 bp, Mus musculus
tcatcatagatgacttccatagttt

SEQ ID NO: 357745 - DNA, 25 bp, Mus musculus
tcatcatcaaggtctttcgcttcct

SEQ ID NO: 357746 - DNA, 25 bp, Mus musculus
tcatcatcacccaagatcatcatgc

SEQ ID NO: 357747 - DNA, 25 bp, Mus musculus
tcatcatcacggtcttctggccacc

SEQ ID NO: 357748 - DNA, 25 bp, Mus musculus
tcatcatccagctggatagcagtgt

SEQ ID NO: 357749 - DNA, 25 bp, Mus musculus
tcatcatccaggcagatgaagaggt

SEQ ID NO: 357750 - DNA, 25 bp, Mus musculus
tcatcatccaggcaggtataaaaga

SEQ ID NO: 357751 - DNA, 25 bp, Mus musculus
tcatcatcccaggagtgttactaga

SEQ ID NO: 357752 - DNA, 25 bp, Mus musculus
tcatcatcccagtcttcatcagctg

SEQ ID NO: 357753 - DNA, 25 bp, Mus musculus
tcatcatcctgctgacaggactatg

SEQ ID NO: 357754 - DNA, 25 bp, Mus musculus
tcatcatcctgctgacctacattca

SEQ ID NO: 357755 - DNA, 25 bp, Mus musculus
tcatcatcctgctgtcaggactatg

SEQ ID NO: 357756 - DNA, 25 bp, Mus musculus
tcatcatcctgctgtcctacattca

SEQ ID NO: 357757 - DNA, 25 bp, Mus musculus
tcatcatcgggaagttctgattcaa

SEQ ID NO: 357758 - DNA, 25 bp, Mus musculus
tcatcatgaacctgctcctggccgt

SEQ ID NO: 357759 - DNA, 25 bp, Mus musculus
tcatcatgaatgtgaaagagtttct

SEQ ID NO: 357760 - DNA, 25 bp, Mus musculus
tcatcattgcaaaggatgaagtcgc

SEQ ID NO: 357761 - DNA, 25 bp, Mus musculus
tcatccaaaatgaagccaatgctga

SEQ ID NO: 357762 - DNA, 25 bp, Mus musculus
tcatccaaaatgaaggcaaagggat

SEQ ID NO: 357763 - DNA, 25 bp, Mus musculus
tcatccaaagatgactggtttacaa

SEQ ID NO: 357764 - DNA, 25 bp, Mus musculus
tcatccaagaatatagtcaagttac

SEQ ID NO: 357765 - DNA, 25 bp, Mus musculus
tcatccacaagactgcgggaaggag

SEQ ID NO: 357766 - DNA, 25 bp, Mus musculus
tcatccacacctccatcccactctc

SEQ ID NO: 357767 - DNA, 25 bp, Mus musculus
tcatccacagaatcctagactttgg

SEQ ID NO: 357768 - DNA, 25 bp, Mus musculus
tcatccacagagacttgaagcctgg

SEQ ID NO: 357769 - DNA, 25 bp, Mus musculus
tcatccacagcagttgagtggtgat

SEQ ID NO: 357770 - DNA, 25 bp, Mus musculus
tcatccacattgagagcaccaagac

SEQ ID NO: 357771 - DNA, 25 bp, Mus musculus
tcatccaccatcaagagcaccccat

SEQ ID NO: 357772 - DNA, 25 bp, Mus musculus
tcatccacgcagtgattgacgagag

SEQ ID NO: 357773 - DNA, 25 bp, Mus musculus
tcatccacggtgtggcctcttcctg

SEQ ID NO: 357774 - DNA, 25 bp, Mus musculus
tcatccagaaacgagaagaagcaga

SEQ ID NO: 357775 - DNA, 25 bp, Mus musculus
tcatccagaagtttggggacctgga

SEQ ID NO: 357776 - DNA, 25 bp, Mus musculus
tcatccagaatggtggccacttgga

SEQ ID NO: 357777 - DNA, 25 bp, Mus musculus
tcatccagactcggggttctctgga

SEQ ID NO: 357778 - DNA, 25 bp, Mus musculus
tcatccagcaccagtacctcatgcc

SEQ ID NO: 357779 - DNA, 25 bp, Mus musculus
tcatccagcagaaaaaagatggatt

SEQ ID NO: 357780 - DNA, 25 bp, Mus musculus
tcatccagcagacgtcccccgccac

SEQ ID NO: 357781 - DNA, 25 bp, Mus musculus
tcatccagcatgtgtctaacaagca

SEQ ID NO: 357782 - DNA, 25 bp, Mus musculus
tcatccagccctacatccagaaccc

SEQ ID NO: 357783 - DNA, 25 bp, Mus musculus
tcatccaggacacgtttctgtgttg

SEQ ID NO: 357784 - DNA, 25 bp, Mus musculus
tcatccaggcagatgaagaggtcgg

SEQ ID NO: 357785 - DNA, 25 bp, Mus musculus
tcatccaggcagctgggtaccgggt

SEQ ID NO: 357786 - DNA, 25 bp, Mus musculus
tcatccaggcaggtataaaagaggt

SEQ ID NO: 357787 - DNA, 25 bp, Mus musculus
tcatccaggttgtagcaaatgacaa

SEQ ID NO: 357788 - DNA, 25 bp, Mus musculus
tcatccagtgagaaaattgtacaat

SEQ ID NO: 357789 - DNA, 25 bp, Mus musculus
tcatccagtgaggaatcttccgagg

SEQ ID NO: 357790 - DNA, 25 bp, Mus musculus
tcatccataaacatgctcagcaaag

SEQ ID NO: 357791 - DNA, 25 bp, Mus musculus
tcatccataaacatggaataccaaa

SEQ ID NO: 357792 - DNA, 25 bp, Mus musculus
tcatccatcaggcgtggtttctgtc

SEQ ID NO: 357793 - DNA, 25 bp, Mus musculus
tcatccattcaggcgtccgcgagtt

SEQ ID NO: 357794 - DNA, 25 bp, Mus musculus
tcatcccagccggagtgttcttttg

SEQ ID NO: 357795 - DNA, 25 bp, Mus musculus
tcatcccaggaaaggtgattgatga

SEQ ID NO: 357796 - DNA, 25 bp, Mus musculus
tcatcccaggagatcttcccacggt

SEQ ID NO: 357797 - DNA, 25 bp, Mus musculus
tcatcccatgcttccaaactataag

SEQ ID NO: 357798 - DNA, 25 bp, Mus musculus
tcatccccaaggccgcagatcatgc

SEQ ID NO: 357799 - DNA, 25 bp, Mus musculus
tcatccccaaggggacaaatgtaat

SEQ ID NO: 357800 - DNA, 25 bp, Mus musculus
tcatccccaaggggtcaatcctcat

SEQ ID NO: 357801 - DNA, 25 bp, Mus musculus
tcatccccacagataattctgaaat

SEQ ID NO: 357802 - DNA, 25 bp, Mus musculus
tcatccccacagggtcagttttgtg

SEQ ID NO: 357803 - DNA, 25 bp, Mus musculus
tcatccccacagtacccatgatgca

SEQ ID NO: 357804 - DNA, 25 bp, Mus musculus
tcatccccagagagaaccttcttcc

SEQ ID NO: 357805 - DNA, 25 bp, Mus musculus
tcatccccagagagatgaggaaagt

SEQ ID NO: 357806 - DNA, 25 bp, Mus musculus
tcatccccagagagcatttctggct

SEQ ID NO: 357807 - DNA, 25 bp, Mus musculus
tcatccccaggcgctttgccctgtc

SEQ ID NO: 357808 - DNA, 25 bp, Mus musculus
tcatcccccacgctgacagccctgt

SEQ ID NO: 357809 - DNA, 25 bp, Mus musculus
tcatccccgatgatcatcccctctg

SEQ ID NO: 357810 - DNA, 25 bp, Mus musculus
tcatccccggggatgagtcctcaaa

SEQ ID NO: 357811 - DNA, 25 bp, Mus musculus
tcatccccgtggccctgttgcatcg

SEQ ID NO: 357812 - DNA, 25 bp, Mus musculus
tcatccctaaaggtgtcataagccg

SEQ ID NO: 357813 - DNA, 25 bp, Mus musculus
tcatccctcctcaggtggggctccc

SEQ ID NO: 357814 - DNA, 25 bp, Mus musculus
tcatccctcctgaggggatcccagg

SEQ ID NO: 357815 - DNA, 25 bp, Mus musculus
tcatccctcctgaggggatgcttga

SEQ ID NO: 357816 - DNA, 25 bp, Mus musculus
tcatccctgaactgcacacgccaaa

SEQ ID NO: 357817 - DNA, 25 bp, Mus musculus
tcatccctgctctgttgtgtatcca

SEQ ID NO: 357818 - DNA, 25 bp, Mus musculus
tcatccctggaaaagcctgaaaatc

SEQ ID NO: 357819 - DNA, 25 bp, Mus musculus
tcatccctgtgcgggccatcaatta

SEQ ID NO: 357820 - DNA, 25 bp, Mus musculus
tcatccctgtgcgggttgccgatgc

SEQ ID NO: 357821 - DNA, 25 bp, Mus musculus
tcatccgaaaggcacagtgttcctt

SEQ ID NO: 357822 - DNA, 25 bp, Mus musculus
tcatccgaaagggactcctctagcc

SEQ ID NO: 357823 - DNA, 25 bp, Mus musculus
tcatccgaagtatcctggagaacac

SEQ ID NO: 357824 - DNA, 25 bp, Mus musculus
tcatccgacttctaggcgtgtgtat

SEQ ID NO: 357825 - DNA, 25 bp, Mus musculus
tcatccgcaacactgaccgaggcaa

SEQ ID NO: 357826 - DNA, 25 bp, Mus musculus
tcatccgcattgcagatgaacgaga

SEQ ID NO: 357827 - DNA, 25 bp, Mus musculus
tcatccgctgagacccatgcggact

SEQ ID NO: 357828 - DNA, 25 bp, Mus musculus
tcatccgctgagatgctggtggact

SEQ ID NO: 357829 - DNA, 25 bp, Mus musculus
tcatccggaagctggcaaaaacgca

SEQ ID NO: 357830 - DNA, 25 bp, Mus musculus
tcatccggaaggctgtggcagtttc

SEQ ID NO: 357831 - DNA, 25 bp, Mus musculus
tcatccggaagtgtgtccctccagc

SEQ ID NO: 357832 - DNA, 25 bp, Mus musculus
tcatccggcagaagcgcctgtctca

SEQ ID NO: 357833 - DNA, 25 bp, Mus musculus
tcatccgggaggaactgcacgggcg

SEQ ID NO: 357834 - DNA, 25 bp, Mus musculus
tcatccgggccgtggaagcatcagt

SEQ ID NO: 357835 - DNA, 25 bp, Mus musculus
tcatccgtatccaggattccctgga

SEQ ID NO: 357836 - DNA, 25 bp, Mus musculus
tcatcctagcggtttgcctgagaat

SEQ ID NO: 357837 - DNA, 25 bp, Mus musculus
tcatcctcaatagttgaactttcta

SEQ ID NO: 357838 - DNA, 25 bp, Mus musculus
tcatcctcagacaacattgtgcact

SEQ ID NO: 357839 - DNA, 25 bp, Mus musculus
tcatcctcagctgggagggcattga

SEQ ID NO: 357840 - DNA, 25 bp, Mus musculus
tcatcctcaggcacaccaagatgaa

SEQ ID NO: 357841 - DNA, 25 bp, Mus musculus
tcatcctcaggcagtgccctgaaaa

SEQ ID NO: 357842 - DNA, 25 bp, Mus musculus
tcatcctcattgagacccccgatgg

SEQ ID NO: 357843 - DNA, 25 bp, Mus musculus
tcatcctccccctcaagttcaaaag

SEQ ID NO: 357844 - DNA, 25 bp, Mus musculus
tcatcctcgaccagagagaagcaac

SEQ ID NO: 357845 - DNA, 25 bp, Mus musculus
tcatcctcttctatgcggcaggcca

SEQ ID NO: 357846 - DNA, 25 bp, Mus musculus
tcatcctcttctgagcattccggct

SEQ ID NO: 357847 - DNA, 25 bp, Mus musculus
tcatcctgaacatgccaggcacgag

SEQ ID NO: 357848 - DNA, 25 bp, Mus musculus
tcatcctgaagacgcatttagtaaa

SEQ ID NO: 357849 - DNA, 25 bp, Mus musculus
tcatcctgacagaaacacataaacc

SEQ ID NO: 357850 - DNA, 25 bp, Mus musculus
tcatcctgacagaagatgattctga

SEQ ID NO: 357851 - DNA, 25 bp, Mus musculus
tcatcctgacaggtgctgagttccc

SEQ ID NO: 357852 - DNA, 25 bp, Mus musculus
tcatcctgaccagagagcttctgtg

SEQ ID NO: 357853 - DNA, 25 bp, Mus musculus
tcatcctgagccttgagccagatga

SEQ ID NO: 357854 - DNA, 25 bp, Mus musculus
tcatcctgagtgagcagaaaatgcg

SEQ ID NO: 357855 - DNA, 25 bp, Mus musculus
tcatcctgagttctccacaccctgc

SEQ ID NO: 357856 - DNA, 25 bp, Mus musculus
tcatcctgcactcaggtagtgacat

SEQ ID NO: 357857 - DNA, 25 bp, Mus musculus
tcatcctgccacaggtactactggg

SEQ ID NO: 357858 - DNA, 25 bp, Mus musculus
tcatcctgctgacaggactatgact

SEQ ID NO: 357859 - DNA, 25 bp, Mus musculus
tcatcctgctgacctacattcagcc

SEQ ID NO: 357860 - DNA, 25 bp, Mus musculus
tcatcctgctgagaggactatgact

SEQ ID NO: 357861 - DNA, 25 bp, Mus musculus
tcatcctgctgagctacattcagcc

SEQ ID NO: 357862 - DNA, 25 bp, Mus musculus
tcatcctggacatggcccgtgtggt

SEQ ID NO: 357863 - DNA, 25 bp, Mus musculus
tcatcctggaccctgcatgctgatg

SEQ ID NO: 357864 - DNA, 25 bp, Mus musculus
tcatcctggtgcgagacacccccca

SEQ ID NO: 357865 - DNA, 25 bp, Mus musculus
tcatcctggtgcgagagtcacccag

SEQ ID NO: 357866 - DNA, 25 bp, Mus musculus
tcatcctggtgttcctgctggcaga

SEQ ID NO: 357867 - DNA, 25 bp, Mus musculus
tcatcctgtgagttgggtgcaaagc

SEQ ID NO: 357868 - DNA, 25 bp, Mus musculus
tcatccttatagcagaaaccatcaa

SEQ ID NO: 357869 - DNA, 25 bp, Mus musculus
tcatccttataggagaaaccatcaa

SEQ ID NO: 357870 - DNA, 25 bp, Mus musculus
tcatccttcgaggatgtctcggaac

SEQ ID NO: 357871 - DNA, 25 bp, Mus musculus
tcatccttcgaggcttgctttgctt

SEQ ID NO: 357872 - DNA, 25 bp, Mus musculus
tcatccttgcatgatatggcataag

SEQ ID NO: 357873 - DNA, 25 bp, Mus musculus
tcatccttgtcaaagatcgactgtg

SEQ ID NO: 357874 - DNA, 25 bp, Mus musculus
tcatccttgtcaaagtctacaaaat

SEQ ID NO: 357875 - DNA, 25 bp, Mus musculus
tcatccttgttaggtgccgcattgc

SEQ ID NO: 357876 - DNA, 25 bp, Mus musculus
tcatcctttgttgatggtattgcgc

SEQ ID NO: 357877 - DNA, 25 bp, Mus musculus
tcatccttttccagacagtccagga

SEQ ID NO: 357878 - DNA, 25 bp, Mus musculus
tcatcctttttataatcatgctgct

SEQ ID NO: 357879 - DNA, 25 bp, Mus musculus
tcatcgaaagcaagtctcgttacat

SEQ ID NO: 357880 - DNA, 25 bp, Mus musculus
tcatcgaaatgaagattggataacc

SEQ ID NO: 357881 - DNA, 25 bp, Mus musculus
tcatcgaaatgatgccagaatttca

SEQ ID NO: 357882 - DNA, 25 bp, Mus musculus
tcatcgaaatggaaatcagagatgg

SEQ ID NO: 357883 - DNA, 25 bp, Mus musculus
tcatcgaacagactcaccacctcca

SEQ ID NO: 357884 - DNA, 25 bp, Mus musculus
tcatcgaacagttcatgcaacagaa

SEQ ID NO: 357885 - DNA, 25 bp, Mus musculus
tcatcgaagagctggaccgtgctgg

SEQ ID NO: 357886 - DNA, 25 bp, Mus musculus
tcatcgacaaagacaacactgctta

SEQ ID NO: 357887 - DNA, 25 bp, Mus musculus
tcatcgacaaggtgcgcttcctgga

SEQ ID NO: 357888 - DNA, 25 bp, Mus musculus
tcatcgacaatgagcaccgggggct

SEQ ID NO: 357889 - DNA, 25 bp, Mus musculus
tcatcgacaatggttcaggggtgat

SEQ ID NO: 357890 - DNA, 25 bp, Mus musculus
tcatcgacagaggatgagggtgagg

SEQ ID NO: 357891 - DNA, 25 bp, Mus musculus
tcatcgacccccttttgcaatggcc

SEQ ID NO: 357892 - DNA, 25 bp, Mus musculus
tcatcgacctacaggacagctatac

SEQ ID NO: 357893 - DNA, 25 bp, Mus musculus
tcatcgacctacaggaggggcccgg

SEQ ID NO: 357894 - DNA, 25 bp, Mus musculus
tcatcgagaagcccatgggcatcat

SEQ ID NO: 357895 - DNA, 25 bp, Mus musculus
tcatcgagcaatggctaggagacca

SEQ ID NO: 357896 - DNA, 25 bp, Mus musculus
tcatcgagcacctccgggacctgtt

SEQ ID NO: 357897 - DNA, 25 bp, Mus musculus
tcatcgagccgagatgaaaccagac

SEQ ID NO: 357898 - DNA, 25 bp, Mus musculus
tcatcgagtgtcaagactgtgattt

SEQ ID NO: 357899 - DNA, 25 bp, Mus musculus
tcatcgataccgtgatgcaattgct

SEQ ID NO: 357900 - DNA, 25 bp, Mus musculus
tcatcgatataaagactcggtaccc

SEQ ID NO: 357901 - DNA, 25 bp, Mus musculus
tcatcgatataaagattgccctgac

SEQ ID NO: 357902 - DNA, 25 bp, Mus musculus
tcatcgcacagacgattcctcagat

SEQ ID NO: 357903 - DNA, 25 bp, Mus musculus
tcatcgcactgcagacaattgccta

SEQ ID NO: 357904 - DNA, 25 bp, Mus musculus
tcatcgccaatgctgacttggagct

SEQ ID NO: 357905 - DNA, 25 bp, Mus musculus
tcatcgccacctgcggccccgacta

SEQ ID NO: 357906 - DNA, 25 bp, Mus musculus
tcatcgccatcgacctggaactggt

SEQ ID NO: 357907 - DNA, 25 bp, Mus musculus
tcatcgccctggtggggttggtggc

SEQ ID NO: 357908 - DNA, 25 bp, Mus musculus
tcatcgccctggtgggtccaagtac

SEQ ID NO: 357909 - DNA, 25 bp, Mus musculus
tcatcgcctactgcagtcagctggc

SEQ ID NO: 357910 - DNA, 25 bp, Mus musculus
tcatcgcctcagagaacttctgcag

SEQ ID NO: 357911 - DNA, 25 bp, Mus musculus
tcatcgcctcagagatactacggag

SEQ ID NO: 357912 - DNA, 25 bp, Mus musculus
tcatcgcctcttggattctgtgtct

SEQ ID NO: 357913 - DNA, 25 bp, Mus musculus
tcatcggcagccagctggaggagcc

SEQ ID NO: 357914 - DNA, 25 bp, Mus musculus
tcatcgggaagttctgattcaaagg

SEQ ID NO: 357915 - DNA, 25 bp, Mus musculus
tcatcgggacaggacgcgtccagag

SEQ ID NO: 357916 - DNA, 25 bp, Mus musculus
tcatcgggacaggaggcgtccagag

SEQ ID NO: 357917 - DNA, 25 bp, Mus musculus
tcatcgggctgcagatgggcaccaa

SEQ ID NO: 357918 - DNA, 25 bp, Mus musculus
tcatcggttcgatttggggatattc

SEQ ID NO: 357919 - DNA, 25 bp, Mus musculus
tcatcggttcggcgtaatagcttgg

SEQ ID NO: 357920 - DNA, 25 bp, Mus musculus
tcatcgtcagcaagctgtgggccac

SEQ ID NO: 357921 - DNA, 25 bp, Mus musculus
tcatcgtcatacgtccctggaggct

SEQ ID NO: 357922 - DNA, 25 bp, Mus musculus
tcatcgtccgccagactcagtccgc

SEQ ID NO: 357923 - DNA, 25 bp, Mus musculus
tcatcgtccgccagagtacagttga

SEQ ID NO: 357924 - DNA, 25 bp, Mus musculus
tcatcgtcgcagaaagtaagcccca

SEQ ID NO: 357925 - DNA, 25 bp, Mus musculus
tcatcgtcgcagacagctgagtaga

SEQ ID NO: 357926 - DNA, 25 bp, Mus musculus
tcatcgtctctgagccacctgcgca

SEQ ID NO: 357927 - DNA, 25 bp, Mus musculus
tcatcgtgaagagcctccccaggtg

SEQ ID NO: 357928 - DNA, 25 bp, Mus musculus
tcatcgttagaagcaaaatctacat

SEQ ID NO: 357929 - DNA, 25 bp, Mus musculus
tcatcgttagaagctgaaggaagag

SEQ ID NO: 357930 - DNA, 25 bp, Mus musculus
tcatcgtttaacaatggaacatagg

SEQ ID NO: 357931 - DNA, 25 bp, Mus musculus
tcatctaatccaggatgctgggcag

SEQ ID NO: 357932 - DNA, 25 bp, Mus musculus
tcatctacaggtgccaagtcggggc

SEQ ID NO: 357933 - DNA, 25 bp, Mus musculus
tcatctaccctgaggagaatgaagt

SEQ ID NO: 357934 - DNA, 25 bp, Mus musculus
tcatctactcttggttcttcattga

SEQ ID NO: 357935 - DNA, 25 bp, Mus musculus
tcatctaggctaaaggacacagctg

SEQ ID NO: 357936 - DNA, 25 bp, Mus musculus
tcatctataacccgataatccccta

SEQ ID NO: 357937 - DNA, 25 bp, Mus musculus
tcatctataacccgattccaggttg

SEQ ID NO: 357938 - DNA, 25 bp, Mus musculus
tcatctataagcagcctgctgtgga

SEQ ID NO: 357939 - DNA, 25 bp, Mus musculus
tcatctataagcagtgtgctgtgag

SEQ ID NO: 357940 - DNA, 25 bp, Mus musculus
tcatctatctgaaggccctgtccac

SEQ ID NO: 357941 - DNA, 25 bp, Mus musculus
tcatctatgagggctacgagggcct

SEQ ID NO: 357942 - DNA, 25 bp, Mus musculus
tcatctattagggcttatttcaaaa

SEQ ID NO: 357943 - DNA, 25 bp, Mus musculus
tcatctattttcaggatgtcagtgg

SEQ ID NO: 357944 - DNA, 25 bp, Mus musculus
tcatctattttcaggggtttcgtgt

SEQ ID NO: 357945 - DNA, 25 bp, Mus musculus
tcatctcaaagcatacagctgcaag

SEQ ID NO: 357946 - DNA, 25 bp, Mus musculus
tcatctcaaggatccttgacactga

SEQ ID NO: 357947 - DNA, 25 bp, Mus musculus
tcatctcacaggttcaaaagaggaa

SEQ ID NO: 357948 - DNA, 25 bp, Mus musculus
tcatctcacagtctgttgcagggaa

SEQ ID NO: 357949 - DNA, 25 bp, Mus musculus
tcatctcaccaaggattacacagtg

SEQ ID NO: 357950 - DNA, 25 bp, Mus musculus
tcatctcactgcagacactccactc

SEQ ID NO: 357951 - DNA, 25 bp, Mus musculus
tcatctcattgctaagaatgtggct

SEQ ID NO: 357952 - DNA, 25 bp, Mus musculus
tcatctccaagagtgaatgtgggct

SEQ ID NO: 357953 - DNA, 25 bp, Mus musculus
tcatctccaaggttggtgacacatc

SEQ ID NO: 357954 - DNA, 25 bp, Mus musculus
tcatctccaagtccttccagggcag

SEQ ID NO: 357955 - DNA, 25 bp, Mus musculus
tcatctcccagggactgcgcagctg

SEQ ID NO: 357956 - DNA, 25 bp, Mus musculus
tcatctcctgccaggaatgaagaaa

SEQ ID NO: 357957 - DNA, 25 bp, Mus musculus
tcatctctcaggctctctaactgat

SEQ ID NO: 357958 - DNA, 25 bp, Mus musculus
tcatctctcattactcgggtttcat

SEQ ID NO: 357959 - DNA, 25 bp, Mus musculus
tcatctctgaaagttctcctgtcta

SEQ ID NO: 357960 - DNA, 25 bp, Mus musculus
tcatctctgagaacagaggcgtgag

SEQ ID NO: 357961 - DNA, 25 bp, Mus musculus
tcatctctggcgttattgctgtctc

SEQ ID NO: 357962 - DNA, 25 bp, Mus musculus
tcatctctgtatgtgactgtcctag

SEQ ID NO: 357963 - DNA, 25 bp, Mus musculus
tcatctgacaaaagaaagaatatgt

SEQ ID NO: 357964 - DNA, 25 bp, Mus musculus
tcatctgacaacagccaagagaaac

SEQ ID NO: 357965 - DNA, 25 bp, Mus musculus
tcatctgacaacaggtcaccttcgt

SEQ ID NO: 357966 - DNA, 25 bp, Mus musculus
tcatctgacccaggtgtccccatga

SEQ ID NO: 357967 - DNA, 25 bp, Mus musculus
tcatctgcaaacagaagcgatgtcc

SEQ ID NO: 357968 - DNA, 25 bp, Mus musculus
tcatctgcaaagaaatcctacgaac

SEQ ID NO: 357969 - DNA, 25 bp, Mus musculus
tcatctgcagggtccacgccattcc

SEQ ID NO: 357970 - DNA, 25 bp, Mus musculus
tcatctgcatggactcttactcgat

SEQ ID NO: 357971 - DNA, 25 bp, Mus musculus
tcatctgcccctcgcgagagctggc

SEQ ID NO: 357972 - DNA, 25 bp, Mus musculus
tcatctgccgactccctgtcctgtc

SEQ ID NO: 357973 - DNA, 25 bp, Mus musculus
tcatctgccgagaggggtcccacag

SEQ ID NO: 357974 - DNA, 25 bp, Mus musculus
tcatctgccggaagccgactctgtg

SEQ ID NO: 357975 - DNA, 25 bp, Mus musculus
tcatctgcctcaggtcttcggatca

SEQ ID NO: 357976 - DNA, 25 bp, Mus musculus
tcatctgcggaagggaaacaacctg

SEQ ID NO: 357977 - DNA, 25 bp, Mus musculus
tcatctgctaccacagccgctagtc

SEQ ID NO: 357978 - DNA, 25 bp, Mus musculus
tcatctgctaccacaggagccgaaa

SEQ ID NO: 357979 - DNA, 25 bp, Mus musculus
tcatctgctagagaagggcaagtct

SEQ ID NO: 357980 - DNA, 25 bp, Mus musculus
tcatctgctagagactggctctcca

SEQ ID NO: 357981 - DNA, 25 bp, Mus musculus
tcatctgctagagctctggtgttct

SEQ ID NO: 357982 - DNA, 25 bp, Mus musculus
tcatctgctagaggttcacaacaaa

SEQ ID NO: 357983 - DNA, 25 bp, Mus musculus
tcatctgctagagtaggtgcttccc

SEQ ID NO: 357984 - DNA, 25 bp, Mus musculus
tcatctgctcagatggtttagacac

SEQ ID NO: 357985 - DNA, 25 bp, Mus musculus
tcatctgctgggaccagagtgaggg

SEQ ID NO: 357986 - DNA, 25 bp, Mus musculus
tcatctgcttataaggacccataga

SEQ ID NO: 357987 - DNA, 25 bp, Mus musculus
tcatctggccagaaccagacttggg

SEQ ID NO: 357988 - DNA, 25 bp, Mus musculus
tcatctggccaggatactcacaggc

SEQ ID NO: 357989 - DNA, 25 bp, Mus musculus
tcatctgggaccctggtacctcatc

SEQ ID NO: 357990 - DNA, 25 bp, Mus musculus
tcatctggtgtggcagtagaaacag

SEQ ID NO: 357991 - DNA, 25 bp, Mus musculus
tcatctggtgtggcattttttggac

SEQ ID NO: 357992 - DNA, 25 bp, Mus musculus
tcatctgtaccagccgtgactgtcc

SEQ ID NO: 357993 - DNA, 25 bp, Mus musculus
tcatctgtaccaggtgcgcaaggac

SEQ ID NO: 357994 - DNA, 25 bp, Mus musculus
tcatctgtgcctcgatggcactgcc

SEQ ID NO: 357995 - DNA, 25 bp, Mus musculus
tcatctgtgctggctgcaaccaagt

SEQ ID NO: 357996 - DNA, 25 bp, Mus musculus
tcatctgtgtgggaacgtgttccgg

SEQ ID NO: 357997 - DNA, 25 bp, Mus musculus
tcatctgtttcaaatcccagaaacc

SEQ ID NO: 357998 - DNA, 25 bp, Mus musculus
tcatctgtttcaagaagatctgcct

SEQ ID NO: 357999 - DNA, 25 bp, Mus musculus
tcatcttaagaaagaggaagcagaa

SEQ ID NO: 358000 - DNA, 25 bp, Mus musculus
tcatcttaccgatcaagaagctact

SEQ ID NO: 358001 - DNA, 25 bp, Mus musculus
tcatcttatcaggagcacggcatcc

SEQ ID NO: 358002 - DNA, 25 bp, Mus musculus
tcatcttcaaagggattaacatcct

SEQ ID NO: 358003 - DNA, 25 bp, Mus musculus
tcatcttcaaggccacaggaccctc

SEQ ID NO: 358004 - DNA, 25 bp, Mus musculus
tcatcttcaggggtcagcaggaaga

SEQ ID NO: 358005 - DNA, 25 bp, Mus musculus
tcatcttccagagaggaggctcaca

SEQ ID NO: 358006 - DNA, 25 bp, Mus musculus
tcatcttctcccagatgaccaagat

SEQ ID NO: 358007 - DNA, 25 bp, Mus musculus
tcatcttctggggggcagctggcat

SEQ ID NO: 358008 - DNA, 25 bp, Mus musculus
tcatcttcttcctgacagctatcct

SEQ ID NO: 358009 - DNA, 25 bp, Mus musculus
tcatcttgagaacccagcagtgatg

SEQ ID NO: 358010 - DNA, 25 bp, Mus musculus
tcatcttggtccaggatctttctca

SEQ ID NO: 358011 - DNA, 25 bp, Mus musculus
tcatcttggtccaggtcatcccagt

SEQ ID NO: 358012 - DNA, 25 bp, Mus musculus
tcatctttatcagcaatgctggtgg

SEQ ID NO: 358013 - DNA, 25 bp, Mus musculus
tcatctttcagatggtgatatacat

SEQ ID NO: 358014 - DNA, 25 bp, Mus musculus
tcatctttccctcagagccagccca

SEQ ID NO: 358015 - DNA, 25 bp, Mus musculus
tcatctttgtgggcggggcctgccg

SEQ ID NO: 358016 - DNA, 25 bp, Mus musculus
tcatcttttctgcggttgatccaaa

SEQ ID NO: 358017 - DNA, 25 bp, Mus musculus
tcatcttttggatcactggtgttat

SEQ ID NO: 358018 - DNA, 25 bp, Mus musculus
tcatgaaaaaactaaggagttttgg

SEQ ID NO: 358019 - DNA, 25 bp, Mus musculus
tcatgaaaaaacttttgcactcctt

SEQ ID NO: 358020 - DNA, 25 bp, Mus musculus
tcatgaaaaaataggttttcctgca

SEQ ID NO: 358021 - DNA, 25 bp, Mus musculus
tcatgaaactgcagatccaggtgga

SEQ ID NO: 358022 - DNA, 25 bp, Mus musculus
tcatgaaactgcagtgctggcagaa

SEQ ID NO: 358023 - DNA, 25 bp, Mus musculus
tcatgaaagaggctaccttaagggc

SEQ ID NO: 358024 - DNA, 25 bp, Mus musculus
tcatgaacacgctcagaaatgacct

SEQ ID NO: 358025 - DNA, 25 bp, Mus musculus
tcatgaacctgctcctggccgtggt

SEQ ID NO: 358026 - DNA, 25 bp, Mus musculus
tcatgaacgcaaggactttgaatcc

SEQ ID NO: 358027 - DNA, 25 bp, Mus musculus
tcatgaacgcaatgtggaccatctt

SEQ ID NO: 358028 - DNA, 25 bp, Mus musculus
tcatgaacggacccaagtgtgcaga

SEQ ID NO: 358029 - DNA, 25 bp, Mus musculus
tcatgaactaccagtccggcttcag

SEQ ID NO: 358030 - DNA, 25 bp, Mus musculus
tcatgaagaaggctggataccagga

SEQ ID NO: 358031 - DNA, 25 bp, Mus musculus
tcatgaagacacgggtgatgtcccg

SEQ ID NO: 358032 - DNA, 25 bp, Mus musculus
tcatgaagaccccgggtcttgttgc

SEQ ID NO: 358033 - DNA, 25 bp, Mus musculus
tcatgaaggtcaacaccatcaccac

SEQ ID NO: 358034 - DNA, 25 bp, Mus musculus
tcatgaaggtgccggttttggcacg

SEQ ID NO: 358035 - DNA, 25 bp, Mus musculus
tcatgaataagcagttccgggcttg

SEQ ID NO: 358036 - DNA, 25 bp, Mus musculus
tcatgaatcagcacatcctcatatt

SEQ ID NO: 358037 - DNA, 25 bp, Mus musculus
tcatgaatcagcacttcctcatatt

SEQ ID NO: 358038 - DNA, 25 bp, Mus musculus
tcatgaatcccagcccggagggccc

SEQ ID NO: 358039 - DNA, 25 bp, Mus musculus
tcatgacaacgtcaggtatggcatt

SEQ ID NO: 358040 - DNA, 25 bp, Mus musculus
tcatgacaagtgggccaatccgagc

SEQ ID NO: 358041 - DNA, 25 bp, Mus musculus
tcatgacaccaggacttcctccatc

SEQ ID NO: 358042 - DNA, 25 bp, Mus musculus
tcatgacagaggacatttgacacac

SEQ ID NO: 358043 - DNA, 25 bp, Mus musculus
tcatgacagatttctcaggaatatc

SEQ ID NO: 358044 - DNA, 25 bp, Mus musculus
tcatgacagtgtggctcagactcct

SEQ ID NO: 358045 - DNA, 25 bp, Mus musculus
tcatgacattcgcttcaaaatccag

SEQ ID NO: 358046 - DNA, 25 bp, Mus musculus
tcatgaccaatggctggaagctaaa

SEQ ID NO: 358047 - DNA, 25 bp, Mus musculus
tcatgacgccaggatcccattttca

SEQ ID NO: 358048 - DNA, 25 bp, Mus musculus
tcatgacggagcgaaatacttaagg

SEQ ID NO: 358049 - DNA, 25 bp, Mus musculus
tcatgactgaaatctcgagatcttt

SEQ ID NO: 358050 - DNA, 25 bp, Mus musculus
tcatgacttcttgttcagtcaccag

SEQ ID NO: 358051 - DNA, 25 bp, Mus musculus
tcatgagaaggctgctttgattatg

SEQ ID NO: 358052 - DNA, 25 bp, Mus musculus
tcatgagacttagaatccttctgaa

SEQ ID NO: 358053 - DNA, 25 bp, Mus musculus
tcatgagacttagtagctagaagaa

SEQ ID NO: 358054 - DNA, 25 bp, Mus musculus
tcatgagaggccagatcctaaattt

SEQ ID NO: 358055 - DNA, 25 bp, Mus musculus
tcatgagcattgctgagcagatggg

SEQ ID NO: 358056 - DNA, 25 bp, Mus musculus
tcatgagcattgctgcggtgacaga

SEQ ID NO: 358057 - DNA, 25 bp, Mus musculus
tcatgagccaggactgctagacaca

SEQ ID NO: 358058 - DNA, 25 bp, Mus musculus
tcatgagccaggtggctgtgggcac

SEQ ID NO: 358059 - DNA, 25 bp, Mus musculus
tcatgagccttgagatggcgttgac

SEQ ID NO: 358060 - DNA, 25 bp, Mus musculus
tcatgagctacttcccacccctgcc

SEQ ID NO: 358061 - DNA, 25 bp, Mus musculus
tcatgaggaaacggctgctcttccc

SEQ ID NO: 358062 - DNA, 25 bp, Mus musculus
tcatgaggcaagtcagaggccaaaa

SEQ ID NO: 358063 - DNA, 25 bp, Mus musculus
tcatgaggtcggcagattcagagca

SEQ ID NO: 358064 - DNA, 25 bp, Mus musculus
tcatgagtccagacttcttgtgaag

SEQ ID NO: 358065 - DNA, 25 bp, Mus musculus
tcatgagtccaggctagatatggat

SEQ ID NO: 358066 - DNA, 25 bp, Mus musculus
tcatgagtctggcgaacactctgca

SEQ ID NO: 358067 - DNA, 25 bp, Mus musculus
tcatgagtgagattgataacaacaa

SEQ ID NO: 358068 - DNA, 25 bp, Mus musculus
tcatgagtgagggtacaagaaggta

SEQ ID NO: 358069 - DNA, 25 bp, Mus musculus
tcatgagtgcagaggggaacctgca

SEQ ID NO: 358070 - DNA, 25 bp, Mus musculus
tcatgagttaaggcgtcgaggtgga

SEQ ID NO: 358071 - DNA, 25 bp, Mus musculus
tcatgataaatgaggacatagcatt

SEQ ID NO: 358072 - DNA, 25 bp, Mus musculus
tcatgataagaaccaacttcttgtt

SEQ ID NO: 358073 - DNA, 25 bp, Mus musculus
tcatgataagggaagaagacatgag

SEQ ID NO: 358074 - DNA, 25 bp, Mus musculus
tcatgataagtgcacaaagaagacg

SEQ ID NO: 358075 - DNA, 25 bp, Mus musculus
tcatgataggagacgattgcaggga

SEQ ID NO: 358076 - DNA, 25 bp, Mus musculus
tcatgatatgaggagtcagtacagg

SEQ ID NO: 358077 - DNA, 25 bp, Mus musculus
tcatgatcaacaacaccaaggagtt

SEQ ID NO: 358078 - DNA, 25 bp, Mus musculus
tcatgatcacaggacacctatatca

SEQ ID NO: 358079 - DNA, 25 bp, Mus musculus
tcatgatcacaggtgacaatcttca

SEQ ID NO: 358080 - DNA, 25 bp, Mus musculus
tcatgatccccaatgtggaaaccat

SEQ ID NO: 358081 - DNA, 25 bp, Mus musculus
tcatgatgaaaacggaacaccagat

SEQ ID NO: 358082 - DNA, 25 bp, Mus musculus
tcatgatgacaggtttctactgcac

SEQ ID NO: 358083 - DNA, 25 bp, Mus musculus
tcatgatgaccaggattacttacac

SEQ ID NO: 358084 - DNA, 25 bp, Mus musculus
tcatgatgcaagttactgtaacaac

SEQ ID NO: 358085 - DNA, 25 bp, Mus musculus
tcatgatgtgaccctggacaaactg

SEQ ID NO: 358086 - DNA, 25 bp, Mus musculus
tcatgatgtggaagattttaattcc

SEQ ID NO: 358087 - DNA, 25 bp, Mus musculus
tcatgattatagtgcagcagctgcc

SEQ ID NO: 358088 - DNA, 25 bp, Mus musculus
tcatgattcagaagatgatttttgg

SEQ ID NO: 358089 - DNA, 25 bp, Mus musculus
tcatgattccacaggcaatccagat

SEQ ID NO: 358090 - DNA, 25 bp, Mus musculus
tcatgattccgaagcacctttgggg

SEQ ID NO: 358091 - DNA, 25 bp, Mus musculus
tcatgatttccagagagaagacctg

SEQ ID NO: 358092 - DNA, 25 bp, Mus musculus
tcatgatttccagcctcatgtcata

SEQ ID NO: 358093 - DNA, 25 bp, Mus musculus
tcatgcaatagaaatgatcaaaaca

SEQ ID NO: 358094 - DNA, 25 bp, Mus musculus
tcatgcaatagttccagttcagaca

SEQ ID NO: 358095 - DNA, 25 bp, Mus musculus
tcatgcagcactatgccttcctcaa

SEQ ID NO: 358096 - DNA, 25 bp, Mus musculus
tcatgcagcagtatgccttcctcaa

SEQ ID NO: 358097 - DNA, 25 bp, Mus musculus
tcatgcataaattgaatctgtataa

SEQ ID NO: 358098 - DNA, 25 bp, Mus musculus
tcatgcatgccaggttcccactatg

SEQ ID NO: 358099 - DNA, 25 bp, Mus musculus
tcatgcatgggcagacacagccctg

SEQ ID NO: 358100 - DNA, 25 bp, Mus musculus
tcatgcattaagtcttgtgaaagac

SEQ ID NO: 358101 - DNA, 25 bp, Mus musculus
tcatgcattaagtcttgtgatatgc

SEQ ID NO: 358102 - DNA, 25 bp, Mus musculus
tcatgcattaattcaaaaaagatca

SEQ ID NO: 358103 - DNA, 25 bp, Mus musculus
tcatgcattatgaagaagtctttga

SEQ ID NO: 358104 - DNA, 25 bp, Mus musculus
tcatgcatttggaggaactgccatc

SEQ ID NO: 358105 - DNA, 25 bp, Mus musculus
tcatgccaaaggcctctggctgtac

SEQ ID NO: 358106 - DNA, 25 bp, Mus musculus
tcatgccaaaggtcagttcaccggg

SEQ ID NO: 358107 - DNA, 25 bp, Mus musculus
tcatgccaagacaactcctgaggat

SEQ ID NO: 358108 - DNA, 25 bp, Mus musculus
tcatgccaagcctgttcattaaaaa

SEQ ID NO: 358109 - DNA, 25 bp, Mus musculus
tcatgccaaggactctggaggaagc

SEQ ID NO: 358110 - DNA, 25 bp, Mus musculus
tcatgccaccctctgcctcccaagt

SEQ ID NO: 358111 - DNA, 25 bp, Mus musculus
tcatgccatgccaggaactccatgg

SEQ ID NO: 358112 - DNA, 25 bp, Mus musculus
tcatgccatgccaggaggaaagggg

SEQ ID NO: 358113 - DNA, 25 bp, Mus musculus
tcatgccatttcagtgcccgatgga

SEQ ID NO: 358114 - DNA, 25 bp, Mus musculus
tcatgcccacctggtaacatcttgg

SEQ ID NO: 358115 - DNA, 25 bp, Mus musculus
tcatgcccagcttcccatcatcatt

SEQ ID NO: 358116 - DNA, 25 bp, Mus musculus
tcatgcccagggagtccccccatcc

SEQ ID NO: 358117 - DNA, 25 bp, Mus musculus
tcatgcccagggtgttccatgagca

SEQ ID NO: 358118 - DNA, 25 bp, Mus musculus
tcatgcccagtgcctatgcttgtgg

SEQ ID NO: 358119 - DNA, 25 bp, Mus musculus
tcatgcccatccggttccagtggtg

SEQ ID NO: 358120 - DNA, 25 bp, Mus musculus
tcatgcccccgcaaggagatggagt

SEQ ID NO: 358121 - DNA, 25 bp, Mus musculus
tcatgccctgtggctatattgctgc

SEQ ID NO: 358122 - DNA, 25 bp, Mus musculus
tcatgccctgtggcttcattttcca

SEQ ID NO: 358123 - DNA, 25 bp, Mus musculus
tcatgcccttagatttctacacgag

SEQ ID NO: 358124 - DNA, 25 bp, Mus musculus
tcatgccgcttgcgtggctcggatg

SEQ ID NO: 358125 - DNA, 25 bp, Mus musculus
tcatgcctctgcagacgtggagaag

SEQ ID NO: 358126 - DNA, 25 bp, Mus musculus
tcatgcctggataagagtaaagaaa

SEQ ID NO: 358127 - DNA, 25 bp, Mus musculus
tcatgcctggatcaggaagcatata

SEQ ID NO: 358128 - DNA, 25 bp, Mus musculus
tcatgcctgtggggctgcgaggcct

SEQ ID NO: 358129 - DNA, 25 bp, Mus musculus
tcatgcctttgggcttggaagtgtt

SEQ ID NO: 358130 - DNA, 25 bp, Mus musculus
tcatgcgagccaagatggacaacgg

SEQ ID NO: 358131 - DNA, 25 bp, Mus musculus
tcatgcgcccgaatgacagtcctta

SEQ ID NO: 358132 - DNA, 25 bp, Mus musculus
tcatgcgctgtggggatggaaatgc

SEQ ID NO: 358133 - DNA, 25 bp, Mus musculus
tcatgcgtgccacagttcttgctgc

SEQ ID NO: 358134 - DNA, 25 bp, Mus musculus
tcatgctaacaggaaaaattctccc

SEQ ID NO: 358135 - DNA, 25 bp, Mus musculus
tcatgctaggcaatggtcactcgga

SEQ ID NO: 358136 - DNA, 25 bp, Mus musculus
tcatgctatagagctgtcatagcct

SEQ ID NO: 358137 - DNA, 25 bp, Mus musculus
tcatgctatagagtcgacaagcagt

SEQ ID NO: 358138 - DNA, 25 bp, Mus musculus
tcatgctatagagtctggattttcc

SEQ ID NO: 358139 - DNA, 25 bp, Mus musculus
tcatgctataggaggatctcccaga

SEQ ID NO: 358140 - DNA, 25 bp, Mus musculus
tcatgctattaaagctggtgagaaa

SEQ ID NO: 358141 - DNA, 25 bp, Mus musculus
tcatgctcaaggacatggcagactc

SEQ ID NO: 358142 - DNA, 25 bp, Mus musculus
tcatgctcggatcaagcaaatcgtg

SEQ ID NO: 358143 - DNA, 25 bp, Mus musculus
tcatgctcggctatctgcacctggc

SEQ ID NO: 358144 - DNA, 25 bp, Mus musculus
tcatgctgaatgctaggtagaagcc

SEQ ID NO: 358145 - DNA, 25 bp, Mus musculus
tcatgctgagcacttttgtgtaatg

SEQ ID NO: 358146 - DNA, 25 bp, Mus musculus
tcatgctgatcaaactggattcaga

SEQ ID NO: 358147 - DNA, 25 bp, Mus musculus
tcatgctggacccgctgcggctgct

SEQ ID NO: 358148 - DNA, 25 bp, Mus musculus
tcatgctggacccgtccattggaga

SEQ ID NO: 358149 - DNA, 25 bp, Mus musculus
tcatgctggatgatactatcgtgga

SEQ ID NO: 358150 - DNA, 25 bp, Mus musculus
tcatgctggcaaaggcgggttccag

SEQ ID NO: 358151 - DNA, 25 bp, Mus musculus
tcatgctgtgtgcaggagagatggg

SEQ ID NO: 358152 - DNA, 25 bp, Mus musculus
tcatgcttaagctgaagtggtgtgc

SEQ ID NO: 358153 - DNA, 25 bp, Mus musculus
tcatgcttaaggctctctatctccg

SEQ ID NO: 358154 - DNA, 25 bp, Mus musculus
tcatgcttgtgaccatactctcctc

SEQ ID NO: 358155 - DNA, 25 bp, Mus musculus
tcatgcttgtgagcatactctcctc

SEQ ID NO: 358156 - DNA, 25 bp, Mus musculus
tcatgctttaccaggaacatttcag

SEQ ID NO: 358157 - DNA, 25 bp, Mus musculus
tcatgctttaccaggatatgactgc

SEQ ID NO: 358158 - DNA, 25 bp, Mus musculus
tcatgctttcgaaatgaataacagt

SEQ ID NO: 358159 - DNA, 25 bp, Mus musculus
tcatggaaacccagcgctaactgtc

SEQ ID NO: 358160 - DNA, 25 bp, Mus musculus
tcatggaaagttacttcaatgagaa

SEQ ID NO: 358161 - DNA, 25 bp, Mus musculus
tcatggaaatatgggcttaggtcat

SEQ ID NO: 358162 - DNA, 25 bp, Mus musculus
tcatggaacaggtgagaggctatga

SEQ ID NO: 358163 - DNA, 25 bp, Mus musculus
tcatggaagagggtagcacattacg

SEQ ID NO: 358164 - DNA, 25 bp, Mus musculus
tcatggaagaggtccagaaagtctg

SEQ ID NO: 358165 - DNA, 25 bp, Mus musculus
tcatggaagaggttcaaaccttgta

SEQ ID NO: 358166 - DNA, 25 bp, Mus musculus
tcatggaagaggtttattaacaaaa

SEQ ID NO: 358167 - DNA, 25 bp, Mus musculus
tcatggaatcagctgctctgccctg

SEQ ID NO: 358168 - DNA, 25 bp, Mus musculus
tcatggaatcaggcggccccctttc

SEQ ID NO: 358169 - DNA, 25 bp, Mus musculus
tcatggaatcagggtgcgactggac

SEQ ID NO: 358170 - DNA, 25 bp, Mus musculus
tcatggaatcaggtgccaacaggct

SEQ ID NO: 358171 - DNA, 25 bp, Mus musculus
tcatggaattcgtactgcgtttggt

SEQ ID NO: 358172 - DNA, 25 bp, Mus musculus
tcatggacaagattaatgccgctgc

SEQ ID NO: 358173 - DNA, 25 bp, Mus musculus
tcatggacatagaagggcttggctg

SEQ ID NO: 358174 - DNA, 25 bp, Mus musculus
tcatggacggggcatttggcacaat

SEQ ID NO: 358175 - DNA, 25 bp, Mus musculus
tcatggactagcgagccataaaaga

SEQ ID NO: 358176 - DNA, 25 bp, Mus musculus
tcatggactagcggcctggtctcag

SEQ ID NO: 358177 - DNA, 25 bp, Mus musculus
tcatggactagcgtttcaggcctgg

SEQ ID NO: 358178 - DNA, 25 bp, Mus musculus
tcatggactatgccctcagctgggg

SEQ ID NO: 358179 - DNA, 25 bp, Mus musculus
tcatggactggtgtccaaagacaag

SEQ ID NO: 358180 - DNA, 25 bp, Mus musculus
tcatggagaatatccggagacaaac

SEQ ID NO: 358181 - DNA, 25 bp, Mus musculus
tcatggagagacgtgacactcactg

SEQ ID NO: 358182 - DNA, 25 bp, Mus musculus
tcatggagagggaggggcggaagaa

SEQ ID NO: 358183 - DNA, 25 bp, Mus musculus
tcatggagcaggtgcaccgtggcat

SEQ ID NO: 358184 - DNA, 25 bp, Mus musculus
tcatggaggccggagaggagccgct

SEQ ID NO: 358185 - DNA, 25 bp, Mus musculus
tcatggagtatacaaaaaagcctga

SEQ ID NO: 358186 - DNA, 25 bp, Mus musculus
tcatggataaaggtgctggagagtc

SEQ ID NO: 358187 - DNA, 25 bp, Mus musculus
tcatggatacaatgagcagcacctc

SEQ ID NO: 358188 - DNA, 25 bp, Mus musculus
tcatggatgaaacagcatcaaaaga

SEQ ID NO: 358189 - DNA, 25 bp, Mus musculus
tcatggatgaattgaagccccacag

SEQ ID NO: 358190 - DNA, 25 bp, Mus musculus
tcatggatgaatttgctggactctt

SEQ ID NO: 358191 - DNA, 25 bp, Mus musculus
tcatggattaccatctagatgttgg

SEQ ID NO: 358192 - DNA, 25 bp, Mus musculus
tcatggattcactagggaaggaaaa

SEQ ID NO: 358193 - DNA, 25 bp, Mus musculus
tcatggattggcttccaggaggcag

SEQ ID NO: 358194 - DNA, 25 bp, Mus musculus
tcatggcaacagactccaagccccc

SEQ ID NO: 358195 - DNA, 25 bp, Mus musculus
tcatggcacagagaagccatcctgg

SEQ ID NO: 358196 - DNA, 25 bp, Mus musculus
tcatggcacaggagcttgaaggatg

SEQ ID NO: 358197 - DNA, 25 bp, Mus musculus
tcatggcagtgaagcggatacgggc

SEQ ID NO: 358198 - DNA, 25 bp, Mus musculus
tcatggccctggggctgggtccttg

SEQ ID NO: 358199 - DNA, 25 bp, Mus musculus
tcatggccggagcagagtctggcca

SEQ ID NO: 358200 - DNA, 25 bp, Mus musculus
tcatggcctttcaggtgatctgtct

SEQ ID NO: 358201 - DNA, 25 bp, Mus musculus
tcatggctatactgatcatttcaat

SEQ ID NO: 358202 - DNA, 25 bp, Mus musculus
tcatggctattgagcatgcaccatt

SEQ ID NO: 358203 - DNA, 25 bp, Mus musculus
tcatggctgcgtttgagcctgagcc

SEQ ID NO: 358204 - DNA, 25 bp, Mus musculus
tcatggctggaggggatgccaacaa

SEQ ID NO: 358205 - DNA, 25 bp, Mus musculus
tcatggctggaggggtgatggtaat

SEQ ID NO: 358206 - DNA, 25 bp, Mus musculus
tcatggctgtgtgattgatcctgtt

SEQ ID NO: 358207 - DNA, 25 bp, Mus musculus
tcatggctttacaggaaatctgacg

SEQ ID NO: 358208 - DNA, 25 bp, Mus musculus
tcatgggaaggatgggtaacaaagg

SEQ ID NO: 358209 - DNA, 25 bp, Mus musculus
tcatgggaaggatgtcctttcaaca

SEQ ID NO: 358210 - DNA, 25 bp, Mus musculus
tcatgggaatctgatccgctgtact

SEQ ID NO: 358211 - DNA, 25 bp, Mus musculus
tcatgggacagaagggtgaccaggg

SEQ ID NO: 358212 - DNA, 25 bp, Mus musculus
tcatgggacaggtgaacacctttat

SEQ ID NO: 358213 - DNA, 25 bp, Mus musculus
tcatgggatagacaagaacggagag

SEQ ID NO: 358214 - DNA, 25 bp, Mus musculus
tcatgggatggctgcactgcccagc

SEQ ID NO: 358215 - DNA, 25 bp, Mus musculus
tcatgggcccgattgacgacagtgt

SEQ ID NO: 358216 - DNA, 25 bp, Mus musculus
tcatgggcgtgcggattgtcgcagc

SEQ ID NO: 358217 - DNA, 25 bp, Mus musculus
tcatggggaaaagtgcgcaaacttc

SEQ ID NO: 358218 - DNA, 25 bp, Mus musculus
tcatgggtattggtccagaacacag

SEQ ID NO: 358219 - DNA, 25 bp, Mus musculus
tcatgggtattggtccagtccctgc

SEQ ID NO: 358220 - DNA, 25 bp, Mus musculus
tcatggtactgctgtattttcatct

SEQ ID NO: 358221 - DNA, 25 bp, Mus musculus
tcatggtagaagtctttatagatac

SEQ ID NO: 358222 - DNA, 25 bp, Mus musculus
tcatggtagccccagaacccatgtg

SEQ ID NO: 358223 - DNA, 25 bp, Mus musculus
tcatggtagccccagataaggaata

SEQ ID NO: 358224 - DNA, 25 bp, Mus musculus
tcatggtcccgggtgaacagagtat

SEQ ID NO: 358225 - DNA, 25 bp, Mus musculus
tcatggtcgttggccagagtggact

SEQ ID NO: 358226 - DNA, 25 bp, Mus musculus
tcatggtgaaggacacatcttacct

SEQ ID NO: 358227 - DNA, 25 bp, Mus musculus
tcatggtgagtcatctccatccacg

SEQ ID NO: 358228 - DNA, 25 bp, Mus musculus
tcatggtgcagtaccatgcactagg

SEQ ID NO: 358229 - DNA, 25 bp, Mus musculus
tcatggtgcagtgctgttgaatttt

SEQ ID NO: 358230 - DNA, 25 bp, Mus musculus
tcatggtggatttaggagaggatga

SEQ ID NO: 358231 - DNA, 25 bp, Mus musculus
tcatggtggccaaggttccctaccg

SEQ ID NO: 358232 - DNA, 25 bp, Mus musculus
tcatggtgtgaggggtcccacagag

SEQ ID NO: 358233 - DNA, 25 bp, Mus musculus
tcatggttaataatgatgctgtggt

SEQ ID NO: 358234 - DNA, 25 bp, Mus musculus
tcatggttctgggggcaaactggaa

SEQ ID NO: 358235 - DNA, 25 bp, Mus musculus
tcatggtttaacttattagtacttg

SEQ ID NO: 358236 - DNA, 25 bp, Mus musculus
tcatgtacactaggaagtcagaggc

SEQ ID NO: 358237 - DNA, 25 bp, Mus musculus
tcatgtaccaaggagacaaaattct

SEQ ID NO: 358238 - DNA, 25 bp, Mus musculus
tcatgtacccaagagttgtcttgga

SEQ ID NO: 358239 - DNA, 25 bp, Mus musculus
tcatgtagaaacgaaacgttgacaa

SEQ ID NO: 358240 - DNA, 25 bp, Mus musculus
tcatgtagccgcctcaaacatgtcc

SEQ ID NO: 358241 - DNA, 25 bp, Mus musculus
tcatgtagggagcaacatcctttgt

SEQ ID NO: 358242 - DNA, 25 bp, Mus musculus
tcatgtagggagtatgaaggtcaaa

SEQ ID NO: 358243 - DNA, 25 bp, Mus musculus
tcatgtagtgaggacagtagaattt

SEQ ID NO: 358244 - DNA, 25 bp, Mus musculus
tcatgtagtgaggcagcagagtgaa

SEQ ID NO: 358245 - DNA, 25 bp, Mus musculus
tcatgtatatccacagtcaagccct

SEQ ID NO: 358246 - DNA, 25 bp, Mus musculus
tcatgtatgagctggatagagagat

SEQ ID NO: 358247 - DNA, 25 bp, Mus musculus
tcatgtattccagcatccagaattc

SEQ ID NO: 358248 - DNA, 25 bp, Mus musculus
tcatgtattccaggcgttacaatat

SEQ ID NO: 358249 - DNA, 25 bp, Mus musculus
tcatgtcaacaaagtccaaggttgt

SEQ ID NO: 358250 - DNA, 25 bp, Mus musculus
tcatgtcaagaccaaacggccccct

SEQ ID NO: 358251 - DNA, 25 bp, Mus musculus
tcatgtcacacagcactcatgaaca

SEQ ID NO: 358252 - DNA, 25 bp, Mus musculus
tcatgtcacagcgtctgttgacatt

SEQ ID NO: 358253 - DNA, 25 bp, Mus musculus
tcatgtcacagggcagcaagttcat

SEQ ID NO: 358254 - DNA, 25 bp, Mus musculus
tcatgtcagcagataggatctgtac

SEQ ID NO: 358255 - DNA, 25 bp, Mus musculus
tcatgtcagcaggaaatgatggatg

SEQ ID NO: 358256 - DNA, 25 bp, Mus musculus
tcatgtcagcaggctggcgcattgg

SEQ ID NO: 358257 - DNA, 25 bp, Mus musculus
tcatgtcatcaggcagcctgatctc

SEQ ID NO: 358258 - DNA, 25 bp, Mus musculus
tcatgtccaaagggctcccagaggc

SEQ ID NO: 358259 - DNA, 25 bp, Mus musculus
tcatgtccggaaggtctgcgctgcc

SEQ ID NO: 358260 - DNA, 25 bp, Mus musculus
tcatgtcttcaagtaaaggatctcc

SEQ ID NO: 358261 - DNA, 25 bp, Mus musculus
tcatgtgaggcacgtggacatcttc

SEQ ID NO: 358262 - DNA, 25 bp, Mus musculus
tcatgtgcacaaagatagttttgag

SEQ ID NO: 358263 - DNA, 25 bp, Mus musculus
tcatgtgcacaaagcactgtgtgaa

SEQ ID NO: 358264 - DNA, 25 bp, Mus musculus
tcatgtgcagaaggtctcgaggagc

SEQ ID NO: 358265 - DNA, 25 bp, Mus musculus
tcatgtgcagagacaggctttgata

SEQ ID NO: 358266 - DNA, 25 bp, Mus musculus
tcatgtgcaggctttgatatgtcaa

SEQ ID NO: 358267 - DNA, 25 bp, Mus musculus
tcatgtgcatgtccatgctgtggag

SEQ ID NO: 358268 - DNA, 25 bp, Mus musculus
tcatgtgcatgttcatgacttgcag

SEQ ID NO: 358269 - DNA, 25 bp, Mus musculus
tcatgtgccaggctggcgacttcac

SEQ ID NO: 358270 - DNA, 25 bp, Mus musculus
tcatgtgccgtgtggtgtggattcg

SEQ ID NO: 358271 - DNA, 25 bp, Mus musculus
tcatgtggaaagaggagaaccatca

SEQ ID NO: 358272 - DNA, 25 bp, Mus musculus
tcatgtggaaagaggtggcagtggg

SEQ ID NO: 358273 - DNA, 25 bp, Mus musculus
tcatgtggaaggtgtgaatctggca

SEQ ID NO: 358274 - DNA, 25 bp, Mus musculus
tcatgtggaggctgggctgtacggg

SEQ ID NO: 358275 - DNA, 25 bp, Mus musculus
tcatgtgggcacctgaatccacctt

SEQ ID NO: 358276 - DNA, 25 bp, Mus musculus
tcatgtgggcacctgctggggttgg

SEQ ID NO: 358277 - DNA, 25 bp, Mus musculus
tcatgtggtaccggagtaaggaacg

SEQ ID NO: 358278 - DNA, 25 bp, Mus musculus
tcatgtgtagcaggtttcaaagctg

SEQ ID NO: 358279 - DNA, 25 bp, Mus musculus
tcatgttacactgacagacagatgg

SEQ ID NO: 358280 - DNA, 25 bp, Mus musculus
tcatgttatgaaagagaatgcagtg

SEQ ID NO: 358281 - DNA, 25 bp, Mus musculus
tcatgttatgaaatagaatgcagcg

SEQ ID NO: 358282 - DNA, 25 bp, Mus musculus
tcatgttatgactcaacaaggacat

SEQ ID NO: 358283 - DNA, 25 bp, Mus musculus
tcatgttatggttcctccatccctc

SEQ ID NO: 358284 - DNA, 25 bp, Mus musculus
tcatgttcaagaaatccttttatct

SEQ ID NO: 358285 - DNA, 25 bp, Mus musculus
tcatgttcaagaaatctgatagacg

SEQ ID NO: 358286 - DNA, 25 bp, Mus musculus
tcatgttcaagaaatttgatgaaaa

SEQ ID NO: 358287 - DNA, 25 bp, Mus musculus
tcatgttcaagaaccatgaacacat

SEQ ID NO: 358288 - DNA, 25 bp, Mus musculus
tcatgttcacagggtacggattgct

SEQ ID NO: 358289 - DNA, 25 bp, Mus musculus
tcatgttcctccttgtagcaatgct

SEQ ID NO: 358290 - DNA, 25 bp, Mus musculus
tcatgttcgtgattgtgctgtcctc

SEQ ID NO: 358291 - DNA, 25 bp, Mus musculus
tcatgttcttcttcagaaacaaaca

SEQ ID NO: 358292 - DNA, 25 bp, Mus musculus
tcatgttgaagatggtaaaagctat

SEQ ID NO: 358293 - DNA, 25 bp, Mus musculus
tcatgttgaagctcatctacggacc

SEQ ID NO: 358294 - DNA, 25 bp, Mus musculus
tcatgttgatccgtggcttcagtgg

SEQ ID NO: 358295 - DNA, 25 bp, Mus musculus
tcatgttgccagagaggcagatgaa

SEQ ID NO: 358296 - DNA, 25 bp, Mus musculus
tcatgttgctgaagcttcaaaagaa

SEQ ID NO: 358297 - DNA, 25 bp, Mus musculus
tcatgttgtcgcaggacagtaatga

SEQ ID NO: 358298 - DNA, 25 bp, Mus musculus
tcatgtttaattgttcctgctgctg

SEQ ID NO: 358299 - DNA, 25 bp, Mus musculus
tcatgtttccagttggcctctatta

SEQ ID NO: 358300 - DNA, 25 bp, Mus musculus
tcatgtttctgggctttcaggaggt

SEQ ID NO: 358301 - DNA, 25 bp, Mus musculus
tcatgtttgagggccatgacaccac

SEQ ID NO: 358302 - DNA, 25 bp, Mus musculus
tcattaaaagctccaggtctggttc

SEQ ID NO: 358303 - DNA, 25 bp, Mus musculus
tcattaaacccaacaaacctgtgat

SEQ ID NO: 358304 - DNA, 25 bp, Mus musculus
tcattaaatgaatctcctgtaaaaa

SEQ ID NO: 358305 - DNA, 25 bp, Mus musculus
tcattaactacgtggaaaaggcagt

SEQ ID NO: 358306 - DNA, 25 bp, Mus musculus
tcattaactccatgtaatcgtgttc

SEQ ID NO: 358307 - DNA, 25 bp, Mus musculus
tcattaagaagaacaatcaccatga

SEQ ID NO: 358308 - DNA, 25 bp, Mus musculus
tcattaagacgtcagataatcaaat

SEQ ID NO: 358309 - DNA, 25 bp, Mus musculus
tcattaagcagaggtgacagctgcc

SEQ ID NO: 358310 - DNA, 25 bp, Mus musculus
tcattaatccaggatccacagggtc

SEQ ID NO: 358311 - DNA, 25 bp, Mus musculus
tcattacaaccagagggcatgaaga

SEQ ID NO: 358312 - DNA, 25 bp, Mus musculus
tcattacaaccagagttttcctccc

SEQ ID NO: 358313 - DNA, 25 bp, Mus musculus
tcattacagaaaagggtgtgtttga

SEQ ID NO: 358314 - DNA, 25 bp, Mus musculus
tcattacagagggagtttattcaaa

SEQ ID NO: 358315 - DNA, 25 bp, Mus musculus
tcattacatcagattacgagctcct

SEQ ID NO: 358316 - DNA, 25 bp, Mus musculus
tcattaccaaattgttcccataaca

SEQ ID NO: 358317 - DNA, 25 bp, Mus musculus
tcattaccaggcataactcctggct

SEQ ID NO: 358318 - DNA, 25 bp, Mus musculus
tcattacctggagaagtgtgtctgg

SEQ ID NO: 358319 - DNA, 25 bp, Mus musculus
tcattacgtaatgaagtacttaagc

SEQ ID NO: 358320 - DNA, 25 bp, Mus musculus
tcattactacactgctctgctcaga

SEQ ID NO: 358321 - DNA, 25 bp, Mus musculus
tcattagaagaatcagcagccgctc

SEQ ID NO: 358322 - DNA, 25 bp, Mus musculus
tcattagcaacgctgttcctgggcg

SEQ ID NO: 358323 - DNA, 25 bp, Mus musculus
tcattaggaaccaaggtagcttctc

SEQ ID NO: 358324 - DNA, 25 bp, Mus musculus
tcattataaatgctacaataaaagt

SEQ ID NO: 358325 - DNA, 25 bp, Mus musculus
tcattataacaggtgagacgacaag

SEQ ID NO: 358326 - DNA, 25 bp, Mus musculus
tcattataagaacaacaaaaccatc

SEQ ID NO: 358327 - DNA, 25 bp, Mus musculus
tcattataagcatgatcgggagggt

SEQ ID NO: 358328 - DNA, 25 bp, Mus musculus
tcattatccagatacacagacagtt

SEQ ID NO: 358329 - DNA, 25 bp, Mus musculus
tcattatgaccctgcctccacagga

SEQ ID NO: 358330 - DNA, 25 bp, Mus musculus
tcattatgaccctgctttttaaatt

SEQ ID NO: 358331 - DNA, 25 bp, Mus musculus
tcattattcagggattgcttacatt

SEQ ID NO: 358332 - DNA, 25 bp, Mus musculus
tcattattcagttgtttgttgctgg

SEQ ID NO: 358333 - DNA, 25 bp, Mus musculus
tcattattcgagcccccaagctctt

SEQ ID NO: 358334 - DNA, 25 bp, Mus musculus
tcattattcgagctatcttcagaca

SEQ ID NO: 358335 - DNA, 25 bp, Mus musculus
tcattattctatggctagaaaatgc

SEQ ID NO: 358336 - DNA, 25 bp, Mus musculus
tcattattgtgctgctgatgaagag

SEQ ID NO: 358337 - DNA, 25 bp, Mus musculus
tcattattttagacacagaatgttc

SEQ ID NO: 358338 - DNA, 25 bp, Mus musculus
tcattcaaaaggaggtttccccaga

SEQ ID NO: 358339 - DNA, 25 bp, Mus musculus
tcattcaaacctgaacgctggaaag

SEQ ID NO: 358340 - DNA, 25 bp, Mus musculus
tcattcaaacctgtggtttgctctc

SEQ ID NO: 358341 - DNA, 25 bp, Mus musculus
tcattcaagaggtaatcagccagtc

SEQ ID NO: 358342 - DNA, 25 bp, Mus musculus
tcattcaataaatggatggaaaccc

SEQ ID NO: 358343 - DNA, 25 bp, Mus musculus
tcattcactggaaagacatgcagct

SEQ ID NO: 358344 - DNA, 25 bp, Mus musculus
tcattcactgtataagcatgatcct

SEQ ID NO: 358345 - DNA, 25 bp, Mus musculus
tcattcactgtccagcttgccagtg

SEQ ID NO: 358346 - DNA, 25 bp, Mus musculus
tcattcagaaacaggtggtgatgaa

SEQ ID NO: 358347 - DNA, 25 bp, Mus musculus
tcattcagaacccattccaagcttg

SEQ ID NO: 358348 - DNA, 25 bp, Mus musculus
tcattcagaaggcctctctcttgtg

SEQ ID NO: 358349 - DNA, 25 bp, Mus musculus
tcattcagcactcggtaattcagag

SEQ ID NO: 358350 - DNA, 25 bp, Mus musculus
tcattcaggataggggaatggtcta

SEQ ID NO: 358351 - DNA, 25 bp, Mus musculus
tcattcataaagattgaggaagaca

SEQ ID NO: 358352 - DNA, 25 bp, Mus musculus
tcattcattcccactatgggcctcc

SEQ ID NO: 358353 - DNA, 25 bp, Mus musculus
tcattcattcgatattacacaagga

SEQ ID NO: 358354 - DNA, 25 bp, Mus musculus
tcattccaagaagaagcccgggacg

SEQ ID NO: 358355 - DNA, 25 bp, Mus musculus
tcattccaatgtggaaaagaagacc

SEQ ID NO: 358356 - DNA, 25 bp, Mus musculus
tcattccaccaccaggtattccaat

SEQ ID NO: 358357 - DNA, 25 bp, Mus musculus
tcattccaccccagactctgcagag

SEQ ID NO: 358358 - DNA, 25 bp, Mus musculus
tcattccattagtaaccgtgtggaa

SEQ ID NO: 358359 - DNA, 25 bp, Mus musculus
tcattcccaagaatctgggtgtgaa

SEQ ID NO: 358360 - DNA, 25 bp, Mus musculus
tcattcccaagacaagcagtaacat

SEQ ID NO: 358361 - DNA, 25 bp, Mus musculus
tcattcccaagcatccagcgtcaat

SEQ ID NO: 358362 - DNA, 25 bp, Mus musculus
tcattcccataagtctgcgagtaaa

SEQ ID NO: 358363 - DNA, 25 bp, Mus musculus
tcattccccagactaggctgtcctg

SEQ ID NO: 358364 - DNA, 25 bp, Mus musculus
tcattcccccccagctacccgtaca

SEQ ID NO: 358365 - DNA, 25 bp, Mus musculus
tcattcctaggtggtctcctagccc

SEQ ID NO: 358366 - DNA, 25 bp, Mus musculus
tcattcctatcagcttgcgtgtgaa

SEQ ID NO: 358367 - DNA, 25 bp, Mus musculus
tcattcctccacaaaggtcagaaga

SEQ ID NO: 358368 - DNA, 25 bp, Mus musculus
tcattcctccacaagagcctgagtt

SEQ ID NO: 358369 - DNA, 25 bp, Mus musculus
tcattcctccagctacactcctctc

SEQ ID NO: 358370 - DNA, 25 bp, Mus musculus
tcattcctctcagccaaaaagactt

SEQ ID NO: 358371 - DNA, 25 bp, Mus musculus
tcattcctctggaagggagagacga

SEQ ID NO: 358372 - DNA, 25 bp, Mus musculus
tcattcctgaacacagtaaggtaga

SEQ ID NO: 358373 - DNA, 25 bp, Mus musculus
tcattcgaagatgttttcggtgcag

SEQ ID NO: 358374 - DNA, 25 bp, Mus musculus
tcattcgaattgggcggcggccagc

SEQ ID NO: 358375 - DNA, 25 bp, Mus musculus
tcattcgttcacggctgctcagact

SEQ ID NO: 358376 - DNA, 25 bp, Mus musculus
tcattctaaagcagatactaaaatg

SEQ ID NO: 358377 - DNA, 25 bp, Mus musculus
tcattctaataaggagtggagtcaa

SEQ ID NO: 358378 - DNA, 25 bp, Mus musculus
tcattctacagccatgggcttctgc

SEQ ID NO: 358379 - DNA, 25 bp, Mus musculus
tcattctcatcgccgagctgaatgt

SEQ ID NO: 358380 - DNA, 25 bp, Mus musculus
tcattctctcatagggaactttcaa

SEQ ID NO: 358381 - DNA, 25 bp, Mus musculus
tcattctctgcatcgggttcacacc

SEQ ID NO: 358382 - DNA, 25 bp, Mus musculus
tcattctgacagctgtgaactgtgt

SEQ ID NO: 358383 - DNA, 25 bp, Mus musculus
tcattctgatcctagtgtcaaaggt

SEQ ID NO: 358384 - DNA, 25 bp, Mus musculus
tcattctgctggctgctgctgctgc

SEQ ID NO: 358385 - DNA, 25 bp, Mus musculus
tcattcttaccaagaagtttgttcg

SEQ ID NO: 358386 - DNA, 25 bp, Mus musculus
tcattcttggtactgcatagtggga

SEQ ID NO: 358387 - DNA, 25 bp, Mus musculus
tcattcttggtactggtgaacacca

SEQ ID NO: 358388 - DNA, 25 bp, Mus musculus
tcattgaaaagaaaatcaaagatga

SEQ ID NO: 358389 - DNA, 25 bp, Mus musculus
tcattgaaaagaaattcaaagatga

SEQ ID NO: 358390 - DNA, 25 bp, Mus musculus
tcattgaagacccaactccgaagtc

SEQ ID NO: 358391 - DNA, 25 bp, Mus musculus
tcattgaagagaagagccttgttga

SEQ ID NO: 358392 - DNA, 25 bp, Mus musculus
tcattgaaggacagccaaatagaat

SEQ ID NO: 358393 - DNA, 25 bp, Mus musculus
tcattgaaggttcaaccattttgct

SEQ ID NO: 358394 - DNA, 25 bp, Mus musculus
tcattgaattttagaatgattgaag

SEQ ID NO: 358395 - DNA, 25 bp, Mus musculus
tcattgaattttagctggattcatc

SEQ ID NO: 358396 - DNA, 25 bp, Mus musculus
tcattgacagattctttctaaagtt

SEQ ID NO: 358397 - DNA, 25 bp, Mus musculus
tcattgacagtcctgatgcttccct

SEQ ID NO: 358398 - DNA, 25 bp, Mus musculus
tcattgaccagaccaccgctcttga

SEQ ID NO: 358399 - DNA, 25 bp, Mus musculus
tcattgaccagcaccacctgcccct

SEQ ID NO: 358400 - DNA, 25 bp, Mus musculus
tcattgaccaggagctgtccaggtt

SEQ ID NO: 358401 - DNA, 25 bp, Mus musculus
tcattgaccatcagacaagctgcaa

SEQ ID NO: 358402 - DNA, 25 bp, Mus musculus
tcattgacccaggtgctctcaccac

SEQ ID NO: 358403 - DNA, 25 bp, Mus musculus
tcattgactgcaggtccctggaaac

SEQ ID NO: 358404 - DNA, 25 bp, Mus musculus
tcattgacttaaaggaactagaggc

SEQ ID NO: 358405 - DNA, 25 bp, Mus musculus
tcattgagaacctgtctccttaaag

SEQ ID NO: 358406 - DNA, 25 bp, Mus musculus
tcattgagaagtgccccaagccagt

SEQ ID NO: 358407 - DNA, 25 bp, Mus musculus
tcattgagaagtgcctgtgacattc

SEQ ID NO: 358408 - DNA, 25 bp, Mus musculus
tcattgagagaagtgatattgtggt

SEQ ID NO: 358409 - DNA, 25 bp, Mus musculus
tcattgaggatctggaagctcaagt

SEQ ID NO: 358410 - DNA, 25 bp, Mus musculus
tcattgagggcagcctggacactgc

SEQ ID NO: 358411 - DNA, 25 bp, Mus musculus
tcattgagtaggtggacccatgctt

SEQ ID NO: 358412 - DNA, 25 bp, Mus musculus
tcattgagtctgccaaaattatgga

SEQ ID NO: 358413 - DNA, 25 bp, Mus musculus
tcattgagtgcaggaatttgacggg

SEQ ID NO: 358414 - DNA, 25 bp, Mus musculus
tcattgagtgcaggcttggctgttg

SEQ ID NO: 358415 - DNA, 25 bp, Mus musculus
tcattgatatgtcaactcagatgac

SEQ ID NO: 358416 - DNA, 25 bp, Mus musculus
tcattgatcaaggtctgaagaagat

SEQ ID NO: 358417 - DNA, 25 bp, Mus musculus
tcattgatctggttatccaggccgt

SEQ ID NO: 358418 - DNA, 25 bp, Mus musculus
tcattgatgaaagagaaaaaaatct

SEQ ID NO: 358419 - DNA, 25 bp, Mus musculus
tcattgatggcaagatcttctgtgt

SEQ ID NO: 358420 - DNA, 25 bp, Mus musculus
tcattgatgggaatccggaaacctt

SEQ ID NO: 358421 - DNA, 25 bp, Mus musculus
tcattgatgggcagacacgcacccc

SEQ ID NO: 358422 - DNA, 25 bp, Mus musculus
tcattgatggtcctgcttggcgagg

SEQ ID NO: 358423 - DNA, 25 bp, Mus musculus
tcattgcaaaggatgaagtcgccca

SEQ ID NO: 358424 - DNA, 25 bp, Mus musculus
tcattgcaatctccacatggtctat

SEQ ID NO: 358425 - DNA, 25 bp, Mus musculus
tcattgcacaaacaggagagcaacc

SEQ ID NO: 358426 - DNA, 25 bp, Mus musculus
tcattgcacaaacgggagagcaacc

SEQ ID NO: 358427 - DNA, 25 bp, Mus musculus
tcattgcacacagaggaaagaaaat

SEQ ID NO: 358428 - DNA, 25 bp, Mus musculus
tcattgcacacagttttggtttctc

SEQ ID NO: 358429 - DNA, 25 bp, Mus musculus
tcattgccaacccagtgaactccac

SEQ ID NO: 358430 - DNA, 25 bp, Mus musculus
tcattgccagcaaccgtgtcttcac

SEQ ID NO: 358431 - DNA, 25 bp, Mus musculus
tcattgcccatctcaaagaaaaaat

SEQ ID NO: 358432 - DNA, 25 bp, Mus musculus
tcattgcccatctcagagaggaaac

SEQ ID NO: 358433 - DNA, 25 bp, Mus musculus
tcattgcctacagattgtctgtgat

SEQ ID NO: 358434 - DNA, 25 bp, Mus musculus
tcattgctaacaggatgcccatccc

SEQ ID NO: 358435 - DNA, 25 bp, Mus musculus
tcattgctaacaggggatcatgagg

SEQ ID NO: 358436 - DNA, 25 bp, Mus musculus
tcattgctacagagtacctgaacta

SEQ ID NO: 358437 - DNA, 25 bp, Mus musculus
tcattgctcaagaccccggcagccc

SEQ ID NO: 358438 - DNA, 25 bp, Mus musculus
tcattgctcagaagaaacctgctcg

SEQ ID NO: 358439 - DNA, 25 bp, Mus musculus
tcattgctcagacggccagagcaga

SEQ ID NO: 358440 - DNA, 25 bp, Mus musculus
tcattgctcagcatgagaatgatat

SEQ ID NO: 358441 - DNA, 25 bp, Mus musculus
tcattgctcgagtttgtgacaaggg

SEQ ID NO: 358442 - DNA, 25 bp, Mus musculus
tcattgctgtgggagctgtgatgga

SEQ ID NO: 358443 - DNA, 25 bp, Mus musculus
tcattggaaacaagaatgcctacga

SEQ ID NO: 358444 - DNA, 25 bp, Mus musculus
tcattggagccaggcaggtgcagtc

SEQ ID NO: 358445 - DNA, 25 bp, Mus musculus
tcattggagccaggtacgtacagac

SEQ ID NO: 358446 - DNA, 25 bp, Mus musculus
tcattggattccgccattgatctta

SEQ ID NO: 358447 - DNA, 25 bp, Mus musculus
tcattggcacagcagttccgcagag

SEQ ID NO: 358448 - DNA, 25 bp, Mus musculus
tcattggctatcaggatgactttct

SEQ ID NO: 358449 - DNA, 25 bp, Mus musculus
tcattggcttgaaggatgctcagat

SEQ ID NO: 358450 - DNA, 25 bp, Mus musculus
tcattggctttatctcggacctaat

SEQ ID NO: 358451 - DNA, 25 bp, Mus musculus
tcattgggagagtccttatcggaca

SEQ ID NO: 358452 - DNA, 25 bp, Mus musculus
tcattggtctaatctctgaccgcct

SEQ ID NO: 358453 - DNA, 25 bp, Mus musculus
tcattgtaatcgattggtatcattg

SEQ ID NO: 358454 - DNA, 25 bp, Mus musculus
tcattgtcagctggattgtcattgc

SEQ ID NO: 358455 - DNA, 25 bp, Mus musculus
tcattgtcaggttcctggaaagcaa

SEQ ID NO: 358456 - DNA, 25 bp, Mus musculus
tcattgtccgtgcaaaactggtgaa

SEQ ID NO: 358457 - DNA, 25 bp, Mus musculus
tcattgtccttgattggctctttgt

SEQ ID NO: 358458 - DNA, 25 bp, Mus musculus
tcattgtccttggcaggacctcaga

SEQ ID NO: 358459 - DNA, 25 bp, Mus musculus
tcattgtccttgtttatgctgctgg

SEQ ID NO: 358460 - DNA, 25 bp, Mus musculus
tcattgtcgatgaggtccatgagag

SEQ ID NO: 358461 - DNA, 25 bp, Mus musculus
tcattgtctttccagcttctcctgg

SEQ ID NO: 358462 - DNA, 25 bp, Mus musculus
tcattgtctttccagggagctcccg

SEQ ID NO: 358463 - DNA, 25 bp, Mus musculus
tcattgtgcaggcggctctcctagc

SEQ ID NO: 358464 - DNA, 25 bp, Mus musculus
tcattgtgcagttctgtgccaatga

SEQ ID NO: 358465 - DNA, 25 bp, Mus musculus
tcattgtgcttgatgttcaaataga

SEQ ID NO: 358466 - DNA, 25 bp, Mus musculus
tcattgtgcttgctgcctttattgt

SEQ ID NO: 358467 - DNA, 25 bp, Mus musculus
tcattgtgcttggtgcctttattgt

SEQ ID NO: 358468 - DNA, 25 bp, Mus musculus
tcattgtgcttgttgttcaaataga

SEQ ID NO: 358469 - DNA, 25 bp, Mus musculus
tcattgtggaggtcaacgtcctgca

SEQ ID NO: 358470 - DNA, 25 bp, Mus musculus
tcattgtggctgatcagactccaac

SEQ ID NO: 358471 - DNA, 25 bp, Mus musculus
tcattgtggtcaaggacggacccgg

SEQ ID NO: 358472 - DNA, 25 bp, Mus musculus
tcattgtgtaaagcctcctgtaccc

SEQ ID NO: 358473 - DNA, 25 bp, Mus musculus
tcattgtgtcagggacaggagttca

SEQ ID NO: 358474 - DNA, 25 bp, Mus musculus
tcattgtgtcagggctggacagtgc

SEQ ID NO: 358475 - DNA, 25 bp, Mus musculus
tcattgtgtggaatcacaggcctct

SEQ ID NO: 358476 - DNA, 25 bp, Mus musculus
tcattgtgttttcagatgtccctgg

SEQ ID NO: 358477 - DNA, 25 bp, Mus musculus
tcattgttggaggacggaacctagc

SEQ ID NO: 358478 - DNA, 25 bp, Mus musculus
tcattgttggaggagggaacctagc

SEQ ID NO: 358479 - DNA, 25 bp, Mus musculus
tcattgttgtagaggatctgagaaa

SEQ ID NO: 358480 - DNA, 25 bp, Mus musculus
tcatttaaaatggatgtgaaatgat

SEQ ID NO: 358481 - DNA, 25 bp, Mus musculus
tcatttaacaatagacatgaagcgc

SEQ ID NO: 358482 - DNA, 25 bp, Mus musculus
tcatttaacctgagaaatgccaacc

SEQ ID NO: 358483 - DNA, 25 bp, Mus musculus
tcatttaagccagggtcagactcag

SEQ ID NO: 358484 - DNA, 25 bp, Mus musculus
tcatttaagccagggtttgcagagc

SEQ ID NO: 358485 - DNA, 25 bp, Mus musculus
tcatttaatggtcaggggagtacag

SEQ ID NO: 358486 - DNA, 25 bp, Mus musculus
tcatttacacaatgtactttcctta

SEQ ID NO: 358487 - DNA, 25 bp, Mus musculus
tcatttacacgggttatgcaacaag

SEQ ID NO: 358488 - DNA, 25 bp, Mus musculus
tcatttacagaattgcatactggga

SEQ ID NO: 358489 - DNA, 25 bp, Mus musculus
tcatttacagaattggagttcatag

SEQ ID NO: 358490 - DNA, 25 bp, Mus musculus
tcatttactaagactctccttccca

SEQ ID NO: 358491 - DNA, 25 bp, Mus musculus
tcatttactaagggctacagagccc

SEQ ID NO: 358492 - DNA, 25 bp, Mus musculus
tcatttactatttccatgatggcca

SEQ ID NO: 358493 - DNA, 25 bp, Mus musculus
tcatttactgcccagacaagtgctg

SEQ ID NO: 358494 - DNA, 25 bp, Mus musculus
tcatttactgcccagaccgtgccag

SEQ ID NO: 358495 - DNA, 25 bp, Mus musculus
tcatttagaggacattcactgaaca

SEQ ID NO: 358496 - DNA, 25 bp, Mus musculus
tcatttagcaaaggtgtggtggctt

SEQ ID NO: 358497 - DNA, 25 bp, Mus musculus
tcatttagtcaattggatccagtgt

SEQ ID NO: 358498 - DNA, 25 bp, Mus musculus
tcatttatagggttatacaggggac

SEQ ID NO: 358499 - DNA, 25 bp, Mus musculus
tcatttatatgacagagtccgctcc

SEQ ID NO: 358500 - DNA, 25 bp, Mus musculus
tcatttatatgacaggtcatggagg

SEQ ID NO: 358501 - DNA, 25 bp, Mus musculus
tcatttatggagggttcctggtaca

SEQ ID NO: 358502 - DNA, 25 bp, Mus musculus
tcatttcaaaggtattttaaccaca

SEQ ID NO: 358503 - DNA, 25 bp, Mus musculus
tcatttcaaccgaattggcaaggtt

SEQ ID NO: 358504 - DNA, 25 bp, Mus musculus
tcatttcaagagtgagaagcgccac

SEQ ID NO: 358505 - DNA, 25 bp, Mus musculus
tcatttcaagatgtgcccttcccat

SEQ ID NO: 358506 - DNA, 25 bp, Mus musculus
tcatttcaggttgctcaccacaatg

SEQ ID NO: 358507 - DNA, 25 bp, Mus musculus
tcatttccaaggctggtcttgaact

SEQ ID NO: 358508 - DNA, 25 bp, Mus musculus
tcatttccaagtccttccagggaag

SEQ ID NO: 358509 - DNA, 25 bp, Mus musculus
tcatttcccacagacctggatttgg

SEQ ID NO: 358510 - DNA, 25 bp, Mus musculus
tcatttccccaagtgcgccgcagag

SEQ ID NO: 358511 - DNA, 25 bp, Mus musculus
tcatttccccttggtgcaccatgga

SEQ ID NO: 358512 - DNA, 25 bp, Mus musculus
tcatttccgctgcccgtatggtggc

SEQ ID NO: 358513 - DNA, 25 bp, Mus musculus
tcatttccgtcctacaaacctcatc

SEQ ID NO: 358514 - DNA, 25 bp, Mus musculus
tcatttcctataatgttgtgatgac

SEQ ID NO: 358515 - DNA, 25 bp, Mus musculus
tcatttcctgcttcaacagactccc

SEQ ID NO: 358516 - DNA, 25 bp, Mus musculus
tcatttcctgtcctaataaaaggtc

SEQ ID NO: 358517 - DNA, 25 bp, Mus musculus
tcatttcctttgaggaaatggatcc

SEQ ID NO: 358518 - DNA, 25 bp, Mus musculus
tcatttcggctcagactcgcatgtg

SEQ ID NO: 358519 - DNA, 25 bp, Mus musculus
tcatttcggctcagggaagtgactt

SEQ ID NO: 358520 - DNA, 25 bp, Mus musculus
tcatttctcacggaaacctaggcag

SEQ ID NO: 358521 - DNA, 25 bp, Mus musculus
tcatttctcacgggcacatctcatc

SEQ ID NO: 358522 - DNA, 25 bp, Mus musculus
tcatttgagggggtcaggacaaaga

SEQ ID NO: 358523 - DNA, 25 bp, Mus musculus
tcatttgcaggtttaaggagagtat

SEQ ID NO: 358524 - DNA, 25 bp, Mus musculus
tcatttggatggcaccacccctgtg

SEQ ID NO: 358525 - DNA, 25 bp, Mus musculus
tcatttgtaccattgggcagcaaga

SEQ ID NO: 358526 - DNA, 25 bp, Mus musculus
tcatttgtatgtataggctgttatg

SEQ ID NO: 358527 - DNA, 25 bp, Mus musculus
tcatttgtgaagcctccaggcatct

SEQ ID NO: 358528 - DNA, 25 bp, Mus musculus
tcatttgtgaagctggaagccgaag

SEQ ID NO: 358529 - DNA, 25 bp, Mus musculus
tcatttgtgtaattttgtgccatcg

SEQ ID NO: 358530 - DNA, 25 bp, Mus musculus
tcatttgttcgggaacctttgctca

SEQ ID NO: 358531 - DNA, 25 bp, Mus musculus
tcatttgttcgggcttacggtgaag

SEQ ID NO: 358532 - DNA, 25 bp, Mus musculus
tcattttaaggccctgtggttctca

SEQ ID NO: 358533 - DNA, 25 bp, Mus musculus
tcattttcagaatggtcgatgtagg

SEQ ID NO: 358534 - DNA, 25 bp, Mus musculus
tcattttcagtcagatatactttat

SEQ ID NO: 358535 - DNA, 25 bp, Mus musculus
tcattttcatgatcacaaaatttgt

SEQ ID NO: 358536 - DNA, 25 bp, Mus musculus
tcattttccaatatggctttatcct

SEQ ID NO: 358537 - DNA, 25 bp, Mus musculus
tcattttccacacagttgaaaaggg

SEQ ID NO: 358538 - DNA, 25 bp, Mus musculus
tcattttgaaacacgagaagccctg

SEQ ID NO: 358539 - DNA, 25 bp, Mus musculus
tcattttgaaagatgtccttcaaga

SEQ ID NO: 358540 - DNA, 25 bp, Mus musculus
tcattttgtgcagcttacctgtggt

SEQ ID NO: 358541 - DNA, 25 bp, Mus musculus
tcattttgtgcaggatctgctgatg

SEQ ID NO: 358542 - DNA, 25 bp, Mus musculus
tcattttgttaaaggctgatgaacc

SEQ ID NO: 358543 - DNA, 25 bp, Mus musculus
tcatttttaagaggcaagaaacaaa

SEQ ID NO: 358544 - DNA, 25 bp, Mus musculus
tcatttttaatcagtctgttatctc

SEQ ID NO: 358545 - DNA, 25 bp, Mus musculus
tcatttttagctccgcctgctcccc

SEQ ID NO: 358546 - DNA, 25 bp, Mus musculus
tcatttttaggatttggtgtcattt

SEQ ID NO: 358547 - DNA, 25 bp, Mus musculus
tcatttttcgctcccagacctacaa

SEQ ID NO: 358548 - DNA, 25 bp, Mus musculus
tcatttttctgacaagcaggtggtc

SEQ ID NO: 358549 - DNA, 25 bp, Mus musculus
tcatttttctggtgtgatcctgctg

SEQ ID NO: 358550 - DNA, 25 bp, Mus musculus
tcattttttcgtcacagatcacacc

SEQ ID NO: 358551 - DNA, 25 bp, Mus musculus
tccaaaaaacagatcaaaaggtccc

SEQ ID NO: 358552 - DNA, 25 bp, Mus musculus
tccaaaaaaggcaaattgaagaatg

SEQ ID NO: 358553 - DNA, 25 bp, Mus musculus
tccaaaaagagagggagccccgcgc

SEQ ID NO: 358554 - DNA, 25 bp, Mus musculus
tccaaaaccaaaggcagaccgaagg

SEQ ID NO: 358555 - DNA, 25 bp, Mus musculus
tccaaaaccagcaccgtcttctaat

SEQ ID NO: 358556 - DNA, 25 bp, Mus musculus
tccaaaaccagtgtcgtcaccagca

SEQ ID NO: 358557 - DNA, 25 bp, Mus musculus
tccaaaagccggaaggagaaggggt

SEQ ID NO: 358558 - DNA, 25 bp, Mus musculus
tccaaaagccggtgaagatcgtatc

SEQ ID NO: 358559 - DNA, 25 bp, Mus musculus
tccaaaaggagactttctgcactgg

SEQ ID NO: 358560 - DNA, 25 bp, Mus musculus
tccaaaataaaggtgagttcctcag

SEQ ID NO: 358561 - DNA, 25 bp, Mus musculus
tccaaaataccaccaagctcctccc

SEQ ID NO: 358562 - DNA, 25 bp, Mus musculus
tccaaaatcaggaacccactggttg

SEQ ID NO: 358563 - DNA, 25 bp, Mus musculus
tccaaaatcaggcaccccgtggcat

SEQ ID NO: 358564 - DNA, 25 bp, Mus musculus
tccaaaatcaggtcacagacgaacc

SEQ ID NO: 358565 - DNA, 25 bp, Mus musculus
tccaaaatcaggttgctggctcttg

SEQ ID NO: 358566 - DNA, 25 bp, Mus musculus
tccaaaatgaagccaatgctgaggc

SEQ ID NO: 358567 - DNA, 25 bp, Mus musculus
tccaaaatgaaggcaaagggatgtt

SEQ ID NO: 358568 - DNA, 25 bp, Mus musculus
tccaaaatgccattctagttcgcta

SEQ ID NO: 358569 - DNA, 25 bp, Mus musculus
tccaaaatggccatgtcagggatga

SEQ ID NO: 358570 - DNA, 25 bp, Mus musculus
tccaaaatgtattgaggaaaaggag

SEQ ID NO: 358571 - DNA, 25 bp, Mus musculus
tccaaaatgtcaggaattagctctg

SEQ ID NO: 358572 - DNA, 25 bp, Mus musculus
tccaaaattcaggtgattgacattt

SEQ ID NO: 358573 - DNA, 25 bp, Mus musculus
tccaaacaaccaagagaagcaattg

SEQ ID NO: 358574 - DNA, 25 bp, Mus musculus
tccaaacaaccaagcacttgtttca

SEQ ID NO: 358575 - DNA, 25 bp, Mus musculus
tccaaacaatttcagcatctctgag

SEQ ID NO: 358576 - DNA, 25 bp, Mus musculus
tccaaacaatttcagtcatctcctg

SEQ ID NO: 358577 - DNA, 25 bp, Mus musculus
tccaaacacagatccgagtggtgaa

SEQ ID NO: 358578 - DNA, 25 bp, Mus musculus
tccaaacacagatggatgtagtgaa

SEQ ID NO: 358579 - DNA, 25 bp, Mus musculus
tccaaacacagccagccaatgccaa

SEQ ID NO: 358580 - DNA, 25 bp, Mus musculus
tccaaacacagcccacctgcatctg

SEQ ID NO: 358581 - DNA, 25 bp, Mus musculus
tccaaacacagccccagccagccaa

SEQ ID NO: 358582 - DNA, 25 bp, Mus musculus
tccaaacaccatgaggcaaaagcaa

SEQ ID NO: 358583 - DNA, 25 bp, Mus musculus
tccaaacactgacagggatcaagtt

SEQ ID NO: 358584 - DNA, 25 bp, Mus musculus
tccaaacagactgaaagtgtcccag

SEQ ID NO: 358585 - DNA, 25 bp, Mus musculus
tccaaacagagagaggtgaaacctt

SEQ ID NO: 358586 - DNA, 25 bp, Mus musculus
tccaaacagttcagatttcaactat

SEQ ID NO: 358587 - DNA, 25 bp, Mus musculus
tccaaacagttcagtcattgttcta

SEQ ID NO: 358588 - DNA, 25 bp, Mus musculus
tccaaacagttcagtcttcctgtaa

SEQ ID NO: 358589 - DNA, 25 bp, Mus musculus
tccaaacattgtgcgtctccatgac

SEQ ID NO: 358590 - DNA, 25 bp, Mus musculus
tccaaacattgtgttaccggagggg

SEQ ID NO: 358591 - DNA, 25 bp, Mus musculus
tccaaaccaagcagtcctatgcacc

SEQ ID NO: 358592 - DNA, 25 bp, Mus musculus
tccaaacccaaggtgctacagtggg

SEQ ID NO: 358593 - DNA, 25 bp, Mus musculus
tccaaaccccattcaacctctacag

SEQ ID NO: 358594 - DNA, 25 bp, Mus musculus
tccaaacccctgagggagagcagtt

SEQ ID NO: 358595 - DNA, 25 bp, Mus musculus
tccaaaccggagtcctgttgaagag

SEQ ID NO: 358596 - DNA, 25 bp, Mus musculus
tccaaacctagagagagaaatacaa

SEQ ID NO: 358597 - DNA, 25 bp, Mus musculus
tccaaacgctataggtatgtgtatc

SEQ ID NO: 358598 - DNA, 25 bp, Mus musculus
tccaaactacattgccaaccgaggt

SEQ ID NO: 358599 - DNA, 25 bp, Mus musculus
tccaaactacattgttttcatcttc

SEQ ID NO: 358600 - DNA, 25 bp, Mus musculus
tccaaactgtgtgcggagactgcgg

SEQ ID NO: 358601 - DNA, 25 bp, Mus musculus
tccaaacttgaaaagcaagaacggg

SEQ ID NO: 358602 - DNA, 25 bp, Mus musculus
tccaaagaagaggaatgagttcctg

SEQ ID NO: 358603 - DNA, 25 bp, Mus musculus
tccaaagaagaggtgagtcctgagt

SEQ ID NO: 358604 - DNA, 25 bp, Mus musculus
tccaaagacacgagcaccgggggtg

SEQ ID NO: 358605 - DNA, 25 bp, Mus musculus
tccaaagacacttcctctctctggc

SEQ ID NO: 358606 - DNA, 25 bp, Mus musculus
tccaaagagaaggaaaagtgatagt

SEQ ID NO: 358607 - DNA, 25 bp, Mus musculus
tccaaagagaaggcaggtacaccga

SEQ ID NO: 358608 - DNA, 25 bp, Mus musculus
tccaaagagatggtcagccgcctga

SEQ ID NO: 358609 - DNA, 25 bp, Mus musculus
tccaaagagcagcacctgacgttca

SEQ ID NO: 358610 - DNA, 25 bp, Mus musculus
tccaaagattgccatggtggtgcaa

SEQ ID NO: 358611 - DNA, 25 bp, Mus musculus
tccaaagcaagagtgaagtgtgtca

SEQ ID NO: 358612 - DNA, 25 bp, Mus musculus
tccaaagcagatcctggagtaagca

SEQ ID NO: 358613 - DNA, 25 bp, Mus musculus
tccaaagcatggaaataaatgcctt

SEQ ID NO: 358614 - DNA, 25 bp, Mus musculus
tccaaagcatggcaatgcttggcaa

SEQ ID NO: 358615 - DNA, 25 bp, Mus musculus
tccaaagccagggcggttaaactca

SEQ ID NO: 358616 - DNA, 25 bp, Mus musculus
tccaaaggacagaacaactgagatt

SEQ ID NO: 358617 - DNA, 25 bp, Mus musculus
tccaaaggacagaagaagaagaaag

SEQ ID NO: 358618 - DNA, 25 bp, Mus musculus
tccaaaggctccgagcaaggccgtg

SEQ ID NO: 358619 - DNA, 25 bp, Mus musculus
tccaaagtaccaatacacgagacca

SEQ ID NO: 358620 - DNA, 25 bp, Mus musculus
tccaaagtcggtttctgtatgcaaa

SEQ ID NO: 358621 - DNA, 25 bp, Mus musculus
tccaaagtgaggaacttctgcaggt

SEQ ID NO: 358622 - DNA, 25 bp, Mus musculus
tccaaataaaacaggtggcttcggt

SEQ ID NO: 358623 - DNA, 25 bp, Mus musculus
tccaaataaaacaggttcgggagca

SEQ ID NO: 358624 - DNA, 25 bp, Mus musculus
tccaaatatacaaggctcaaactca

SEQ ID NO: 358625 - DNA, 25 bp, Mus musculus
tccaaatcacaggcatatgctatga

SEQ ID NO: 358626 - DNA, 25 bp, Mus musculus
tccaaatcagacccggcactgatac

SEQ ID NO: 358627 - DNA, 25 bp, Mus musculus
tccaaatcttacaggaggccacatg

SEQ ID NO: 358628 - DNA, 25 bp, Mus musculus
tccaaatgtgacgagaagaacgggc

SEQ ID NO: 358629 - DNA, 25 bp, Mus musculus
tccaaattatgtgccaccaaaagcc

SEQ ID NO: 358630 - DNA, 25 bp, Mus musculus
tccaaattccttcaggtgcacgcct

SEQ ID NO: 358631 - DNA, 25 bp, Mus musculus
tccaacaaagcaaagtaacaatccg

SEQ ID NO: 358632 - DNA, 25 bp, Mus musculus
tccaacaaaggagctgacaaaccaa

SEQ ID NO: 358633 - DNA, 25 bp, Mus musculus
tccaacaaaggtcgtcctccttgat

SEQ ID NO: 358634 - DNA, 25 bp, Mus musculus
tccaacaacaatgagagtgctgcaa

SEQ ID NO: 358635 - DNA, 25 bp, Mus musculus
tccaacaacatcaaagaaaaattca

SEQ ID NO: 358636 - DNA, 25 bp, Mus musculus
tccaacaacatcatgaacaacgtgg

SEQ ID NO: 358637 - DNA, 25 bp, Mus musculus
tccaacaacctagctcccgatggtc

SEQ ID NO: 358638 - DNA, 25 bp, Mus musculus
tccaacaatatcaaggaagtgcttc

SEQ ID NO: 358639 - DNA, 25 bp, Mus musculus
tccaacaccaaaagtgcccatggag

SEQ ID NO: 358640 - DNA, 25 bp, Mus musculus
tccaacaccaaaatctgtagattgt

SEQ ID NO: 358641 - DNA, 25 bp, Mus musculus
tccaacaccaaagtggacatgactt

SEQ ID NO: 358642 - DNA, 25 bp, Mus musculus
tccaacaccaacagatgttctgatg

SEQ ID NO: 358643 - DNA, 25 bp, Mus musculus
tccaacaccaacaggggtggtggat

SEQ ID NO: 358644 - DNA, 25 bp, Mus musculus
tccaacaccccgctgctgccttcct

SEQ ID NO: 358645 - DNA, 25 bp, Mus musculus
tccaacaccccgcttctcttgcctc

SEQ ID NO: 358646 - DNA, 25 bp, Mus musculus
tccaacagagcccagcagcagctgg

SEQ ID NO: 358647 - DNA, 25 bp, Mus musculus
tccaacagccgcgcacactggagcg

SEQ ID NO: 358648 - DNA, 25 bp, Mus musculus
tccaacagtccaaaccatagacaga

SEQ ID NO: 358649 - DNA, 25 bp, Mus musculus
tccaacatacaaagacgacgctcac

SEQ ID NO: 358650 - DNA, 25 bp, Mus musculus
tccaacatacaaagctggcttaatg

SEQ ID NO: 358651 - DNA, 25 bp, Mus musculus
tccaacatcaaagccattggtgtca

SEQ ID NO: 358652 - DNA, 25 bp, Mus musculus
tccaacatcaatagtggagattttg

SEQ ID NO: 358653 - DNA, 25 bp, Mus musculus
tccaacatcaatagtgtaattattg

SEQ ID NO: 358654 - DNA, 25 bp, Mus musculus
tccaacatcacagatgtctcccaat

SEQ ID NO: 358655 - DNA, 25 bp, Mus musculus
tccaacatcagaaagggtctgccgt

SEQ ID NO: 358656 - DNA, 25 bp, Mus musculus
tccaacatctgagcagctcaaagat

SEQ ID NO: 358657 - DNA, 25 bp, Mus musculus
tccaacatctgcagctctccctttt

SEQ ID NO: 358658 - DNA, 25 bp, Mus musculus
tccaacatctgcagtgggccggatg

SEQ ID NO: 358659 - DNA, 25 bp, Mus musculus
tccaacatggcaatgggctacaggg

SEQ ID NO: 358660 - DNA, 25 bp, Mus musculus
tccaacatggcaggtaagaaagtgc

SEQ ID NO: 358661 - DNA, 25 bp, Mus musculus
tccaaccaaggcatcctcggagatg

SEQ ID NO: 358662 - DNA, 25 bp, Mus musculus
tccaaccaaggtatcatgtttgtac

SEQ ID NO: 358663 - DNA, 25 bp, Mus musculus
tccaaccacaagcgactcgtcctcc

SEQ ID NO: 358664 - DNA, 25 bp, Mus musculus
tccaaccacaagcgagcctagaaga

SEQ ID NO: 358665 - DNA, 25 bp, Mus musculus
tccaaccacaagcgagttcacatga

SEQ ID NO: 358666 - DNA, 25 bp, Mus musculus
tccaaccacaggggccagctagaga

SEQ ID NO: 358667 - DNA, 25 bp, Mus musculus
tccaaccaccagttttggttcatct

SEQ ID NO: 358668 - DNA, 25 bp, Mus musculus
tccaaccagaaagagtccaaagctg

SEQ ID NO: 358669 - DNA, 25 bp, Mus musculus
tccaaccagaaagatacctcagaat

SEQ ID NO: 358670 - DNA, 25 bp, Mus musculus
tccaaccagaaagatatactgcagg

SEQ ID NO: 358671 - DNA, 25 bp, Mus musculus
tccaaccagacctgccccaggatcc

SEQ ID NO: 358672 - DNA, 25 bp, Mus musculus
tccaaccagctggctgaagccatca

SEQ ID NO: 358673 - DNA, 25 bp, Mus musculus
tccaaccaggtcaaggctctggata

SEQ ID NO: 358674 - DNA, 25 bp, Mus musculus
tccaaccaggtcaagggcaagcctg

SEQ ID NO: 358675 - DNA, 25 bp, Mus musculus
tccaacccaagctcttttgtgactg

SEQ ID NO: 358676 - DNA, 25 bp, Mus musculus
tccaacccaatccagagctaagcta

SEQ ID NO: 358677 - DNA, 25 bp, Mus musculus
tccaacccaatccagcatacagagc

SEQ ID NO: 358678 - DNA, 25 bp, Mus musculus
tccaaccccccggccctgcctgcct

SEQ ID NO: 358679 - DNA, 25 bp, Mus musculus
tccaaccccgatgctctgaacccat

SEQ ID NO: 358680 - DNA, 25 bp, Mus musculus
tccaaccctaaagatcctgttgtct

SEQ ID NO: 358681 - DNA, 25 bp, Mus musculus
tccaaccctcgaatcaacctaccga

SEQ ID NO: 358682 - DNA, 25 bp, Mus musculus
tccaaccgcagagaggaactggccc

SEQ ID NO: 358683 - DNA, 25 bp, Mus musculus
tccaacctacaagggcaagatgaag

SEQ ID NO: 358684 - DNA, 25 bp, Mus musculus
tccaacctccaaagctcatttttcc

SEQ ID NO: 358685 - DNA, 25 bp, Mus musculus
tccaacctccaaaggacacaccagc

SEQ ID NO: 358686 - DNA, 25 bp, Mus musculus
tccaacctccagtctcaccagcgcc

SEQ ID NO: 358687 - DNA, 25 bp, Mus musculus
tccaacctcctaggaaagctgtaga

SEQ ID NO: 358688 - DNA, 25 bp, Mus musculus
tccaacctcctaggaataggtgaag

SEQ ID NO: 358689 - DNA, 25 bp, Mus musculus
tccaacctcgggctcaaaaaattgc

SEQ ID NO: 358690 - DNA, 25 bp, Mus musculus
tccaacctggggtttaagaggcgag

SEQ ID NO: 358691 - DNA, 25 bp, Mus musculus
tccaaccttctgttgccttgaagtt

SEQ ID NO: 358692 - DNA, 25 bp, Mus musculus
tccaacctttgccatgggccttgcc

SEQ ID NO: 358693 - DNA, 25 bp, Mus musculus
tccaacgaaaggtaacatttcactt

SEQ ID NO: 358694 - DNA, 25 bp, Mus musculus
tccaacgacaatcagcgccttgctc

SEQ ID NO: 358695 - DNA, 25 bp, Mus musculus
tccaacgacattgatacactaaaga

SEQ ID NO: 358696 - DNA, 25 bp, Mus musculus
tccaacgacccgtgcccagggatgt

SEQ ID NO: 358697 - DNA, 25 bp, Mus musculus
tccaacgatgtgaaagagttcctag

SEQ ID NO: 358698 - DNA, 25 bp, Mus musculus
tccaacgtggaagcagcctgtgatt

SEQ ID NO: 358699 - DNA, 25 bp, Mus musculus
tccaacgtggaagccctctgctcat

SEQ ID NO: 358700 - DNA, 25 bp, Mus musculus
tccaactcagatctctcgtctgctc

SEQ ID NO: 358701 - DNA, 25 bp, Mus musculus
tccaactcagccctccaggacctca

SEQ ID NO: 358702 - DNA, 25 bp, Mus musculus
tccaactccagcccccggcctccac

SEQ ID NO: 358703 - DNA, 25 bp, Mus musculus
tccaactcttggcattgaccttggc

SEQ ID NO: 358704 - DNA, 25 bp, Mus musculus
tccaactgctgaagacgtgactgcg

SEQ ID NO: 358705 - DNA, 25 bp, Mus musculus
tccaactggggcacttccccactcc

SEQ ID NO: 358706 - DNA, 25 bp, Mus musculus
tccaactgtctaaattgatcaggga

SEQ ID NO: 358707 - DNA, 25 bp, Mus musculus
tccaacttatggagcggcactggag

SEQ ID NO: 358708 - DNA, 25 bp, Mus musculus
tccaacttatggagcggtcgtgtat

SEQ ID NO: 358709 - DNA, 25 bp, Mus musculus
tccaagaaaatatttcagatacacc

SEQ ID NO: 358710 - DNA, 25 bp, Mus musculus
tccaagaaagatcgctcctttgatg

SEQ ID NO: 358711 - DNA, 25 bp, Mus musculus
tccaagaaaggtgcttacagacaca

SEQ ID NO: 358712 - DNA, 25 bp, Mus musculus
tccaagaacactgatgaaatcatgc

SEQ ID NO: 358713 - DNA, 25 bp, Mus musculus
tccaagaactgcagaattgagctcc

SEQ ID NO: 358714 - DNA, 25 bp, Mus musculus
tccaagaactgctgtctattgcatc

SEQ ID NO: 358715 - DNA, 25 bp, Mus musculus
tccaagaagaggttctcccagatgg

SEQ ID NO: 358716 - DNA, 25 bp, Mus musculus
tccaagaagccacggctttctcagg

SEQ ID NO: 358717 - DNA, 25 bp, Mus musculus
tccaagaatatagtcaagttacaag

SEQ ID NO: 358718 - DNA, 25 bp, Mus musculus
tccaagaatggcgggcatatcgaga

SEQ ID NO: 358719 - DNA, 25 bp, Mus musculus
tccaagaatggtcctggcactgtag

SEQ ID NO: 358720 - DNA, 25 bp, Mus musculus
tccaagaattcgaagagccacctaa

SEQ ID NO: 358721 - DNA, 25 bp, Mus musculus
tccaagacaaaagatttgcaacagc

SEQ ID NO: 358722 - DNA, 25 bp, Mus musculus
tccaagacactgcagcggaccttac

SEQ ID NO: 358723 - DNA, 25 bp, Mus musculus
tccaagacagcgcatagaagctcca

SEQ ID NO: 358724 - DNA, 25 bp, Mus musculus
tccaagacagcgcccatgcaggtgc

SEQ ID NO: 358725 - DNA, 25 bp, Mus musculus
tccaagactctcagaccaaatacac

SEQ ID NO: 358726 - DNA, 25 bp, Mus musculus
tccaagagaagagcgcctccctgca

SEQ ID NO: 358727 - DNA, 25 bp, Mus musculus
tccaagagaagagtgcttccctgca

SEQ ID NO: 358728 - DNA, 25 bp, Mus musculus
tccaagagaagagtgcttcgctgca

SEQ ID NO: 358729 - DNA, 25 bp, Mus musculus
tccaagagaaggtggacctggcagt

SEQ ID NO: 358730 - DNA, 25 bp, Mus musculus
tccaagagacaggaggctgtccttt

SEQ ID NO: 358731 - DNA, 25 bp, Mus musculus
tccaagagaggaggctgtgaaagaa

SEQ ID NO: 358732 - DNA, 25 bp, Mus musculus
tccaagagcaggtcaccgacaatga

SEQ ID NO: 358733 - DNA, 25 bp, Mus musculus
tccaagagcgatatgagatcgtggg

SEQ ID NO: 358734 - DNA, 25 bp, Mus musculus
tccaagagctggggtctgatcttgc

SEQ ID NO: 358735 - DNA, 25 bp, Mus musculus
tccaagaggaaagacaaagtcagca

SEQ ID NO: 358736 - DNA, 25 bp, Mus musculus
tccaagaggaaagacagctacaacc

SEQ ID NO: 358737 - DNA, 25 bp, Mus musculus
tccaagaggaaaggtaccagcagtg

SEQ ID NO: 358738 - DNA, 25 bp, Mus musculus
tccaagaggcagagggtgctctggc

SEQ ID NO: 358739 - DNA, 25 bp, Mus musculus
tccaagagtcggccacaggttgtgt

SEQ ID NO: 358740 - DNA, 25 bp, Mus musculus
tccaagatctgaaagttgggatggc

SEQ ID NO: 358741 - DNA, 25 bp, Mus musculus
tccaagatgagacaggagacaatca

SEQ ID NO: 358742 - DNA, 25 bp, Mus musculus
tccaagatgctaatggcccagatgg

SEQ ID NO: 358743 - DNA, 25 bp, Mus musculus
tccaagatgctaatggcctctttat

SEQ ID NO: 358744 - DNA, 25 bp, Mus musculus
tccaagatgctaatggcctggtcca

SEQ ID NO: 358745 - DNA, 25 bp, Mus musculus
tccaagatggcagagctcgtcagtg

SEQ ID NO: 358746 - DNA, 25 bp, Mus musculus
tccaagatgtaccttgaaaccatgt

SEQ ID NO: 358747 - DNA, 25 bp, Mus musculus
tccaagcaatgtggtacacggatga

SEQ ID NO: 358748 - DNA, 25 bp, Mus musculus
tccaagcacaatggcatctgtaagc

SEQ ID NO: 358749 - DNA, 25 bp, Mus musculus
tccaagcaccctcagcagtcccgtc

SEQ ID NO: 358750 - DNA, 25 bp, Mus musculus
tccaagcaccctcagggaacagaag

SEQ ID NO: 358751 - DNA, 25 bp, Mus musculus
tccaagcacgccgcagcagcctgca

SEQ ID NO: 358752 - DNA, 25 bp, Mus musculus
tccaagcacggggacagcttcgtgg

SEQ ID NO: 358753 - DNA, 25 bp, Mus musculus
tccaagcagaggacaaaatcacaaa

SEQ ID NO: 358754 - DNA, 25 bp, Mus musculus
tccaagcagaggtatgtgcaggcag

SEQ ID NO: 358755 - DNA, 25 bp, Mus musculus
tccaagcatgagttatttgctggcg

SEQ ID NO: 358756 - DNA, 25 bp, Mus musculus
tccaagccaagtgccctccaagaaa

SEQ ID NO: 358757 - DNA, 25 bp, Mus musculus
tccaagccagatcgacagcaaagag

SEQ ID NO: 358758 - DNA, 25 bp, Mus musculus
tccaagccagatcgccctacatgaa

SEQ ID NO: 358759 - DNA, 25 bp, Mus musculus
tccaagccagcctggagccatcgtg

SEQ ID NO: 358760 - DNA, 25 bp, Mus musculus
tccaagcccagcatgtgagggagca

SEQ ID NO: 358761 - DNA, 25 bp, Mus musculus
tccaagcccaggtaactgttcagtc

SEQ ID NO: 358762 - DNA, 25 bp, Mus musculus
tccaagcccatccaaggttactttg

SEQ ID NO: 358763 - DNA, 25 bp, Mus musculus
tccaagcctaatatggcggtgtggc

SEQ ID NO: 358764 - DNA, 25 bp, Mus musculus
tccaagcctcagctgctgttgcacc

SEQ ID NO: 358765 - DNA, 25 bp, Mus musculus
tccaagcctcaggattcctctattg

SEQ ID NO: 358766 - DNA, 25 bp, Mus musculus
tccaagcctgaggactgggacaagc

SEQ ID NO: 358767 - DNA, 25 bp, Mus musculus
tccaagcctgaggactgggatgaag

SEQ ID NO: 358768 - DNA, 25 bp, Mus musculus
tccaagcgaggacgggctgtccttg

SEQ ID NO: 358769 - DNA, 25 bp, Mus musculus
tccaagctgaaggaccaagtctcca

SEQ ID NO: 358770 - DNA, 25 bp, Mus musculus
tccaagctgtacaggttgggcttag

SEQ ID NO: 358771 - DNA, 25 bp, Mus musculus
tccaagctgttgagcaagcaccaga

SEQ ID NO: 358772 - DNA, 25 bp, Mus musculus
tccaaggaaactcagactaaggctg

SEQ ID NO: 358773 - DNA, 25 bp, Mus musculus
tccaaggaccctcaggtactaggcg

SEQ ID NO: 358774 - DNA, 25 bp, Mus musculus
tccaaggagaggtcaatactatcaa

SEQ ID NO: 358775 - DNA, 25 bp, Mus musculus
tccaaggagaggttttccttactgc

SEQ ID NO: 358776 - DNA, 25 bp, Mus musculus
tccaaggatgagtgggtggaagagc

SEQ ID NO: 358777 - DNA, 25 bp, Mus musculus
tccaaggatgtacaggggagcagcg

SEQ ID NO: 358778 - DNA, 25 bp, Mus musculus
tccaaggatttttgtcctacttgga

SEQ ID NO: 358779 - DNA, 25 bp, Mus musculus
tccaaggcaaaggtgttgaacgagg

SEQ ID NO: 358780 - DNA, 25 bp, Mus musculus
tccaaggcactagagccccagatcc

SEQ ID NO: 358781 - DNA, 25 bp, Mus musculus
tccaaggcactagggtgccacctac

SEQ ID NO: 358782 - DNA, 25 bp, Mus musculus
tccaaggccatgaacacggctctag

SEQ ID NO: 358783 - DNA, 25 bp, Mus musculus
tccaaggcccaggtggtgaccatag

SEQ ID NO: 358784 - DNA, 25 bp, Mus musculus
tccaaggcccaggttgaccaaagaa

SEQ ID NO: 358785 - DNA, 25 bp, Mus musculus
tccaaggctgggcgcgggctgggag

SEQ ID NO: 358786 - DNA, 25 bp, Mus musculus
tccaagggcaagggactccgaggga

SEQ ID NO: 358787 - DNA, 25 bp, Mus musculus
tccaagggcaagggggagaagatta

SEQ ID NO: 358788 - DNA, 25 bp, Mus musculus
tccaagggccaggagactgttctgg

SEQ ID NO: 358789 - DNA, 25 bp, Mus musculus
tccaagggcttattctcagctcttt

SEQ ID NO: 358790 - DNA, 25 bp, Mus musculus
tccaagggggtgcctgtgggccgaa

SEQ ID NO: 358791 - DNA, 25 bp, Mus musculus
tccaaggtgtcatagacatgaaaaa

SEQ ID NO: 358792 - DNA, 25 bp, Mus musculus
tccaaggttaccagagctgaaatta

SEQ ID NO: 358793 - DNA, 25 bp, Mus musculus
tccaaggttaccagtatgcaaccga

SEQ ID NO: 358794 - DNA, 25 bp, Mus musculus
tccaaggttaccagtgtttgaaaga

SEQ ID NO: 358795 - DNA, 25 bp, Mus musculus
tccaagtaagagtcaaagcagtcct

SEQ ID NO: 358796 - DNA, 25 bp, Mus musculus
tccaagtaatgagaggaagacgact

SEQ ID NO: 358797 - DNA, 25 bp, Mus musculus
tccaagtacattcacttcttccctg

SEQ ID NO: 358798 - DNA, 25 bp, Mus musculus
tccaagtacgtgctccaggcactac

SEQ ID NO: 358799 - DNA, 25 bp, Mus musculus
tccaagtacgtgctctacaccctcg

SEQ ID NO: 358800 - DNA, 25 bp, Mus musculus
tccaagtagccccagctgagaaaaa

SEQ ID NO: 358801 - DNA, 25 bp, Mus musculus
tccaagtataaggtggctctcgagg

SEQ ID NO: 358802 - DNA, 25 bp, Mus musculus
tccaagtatgaaggaggagtagaaa

SEQ ID NO: 358803 - DNA, 25 bp, Mus musculus
tccaagtatgagaaagagctaaagc

SEQ ID NO: 358804 - DNA, 25 bp, Mus musculus
tccaagtatgtaggaggagtaaaaa

SEQ ID NO: 358805 - DNA, 25 bp, Mus musculus
tccaagtcactggaatttcttgatg

SEQ ID NO: 358806 - DNA, 25 bp, Mus musculus
tccaagtcactgggaatctgtcctt

SEQ ID NO: 358807 - DNA, 25 bp, Mus musculus
tccaagtcagtttctgatgacctgg

SEQ ID NO: 358808 - DNA, 25 bp, Mus musculus
tccaagtccagagtcccggccaccc

SEQ ID NO: 358809 - DNA, 25 bp, Mus musculus
tccaagtccccaggagaggagacaa

SEQ ID NO: 358810 - DNA, 25 bp, Mus musculus
tccaagtccccaggccggggagcgt

SEQ ID NO: 358811 - DNA, 25 bp, Mus musculus
tccaagtccgagctctgaactcact

SEQ ID NO: 358812 - DNA, 25 bp, Mus musculus
tccaagtccggtcagagcagcaggg

SEQ ID NO: 358813 - DNA, 25 bp, Mus musculus
tccaagtcgcttcagcctttaccct

SEQ ID NO: 358814 - DNA, 25 bp, Mus musculus
tccaagtctgagtgtggataagtcc

SEQ ID NO: 358815 - DNA, 25 bp, Mus musculus
tccaagtgagttacaagacttaaat

SEQ ID NO: 358816 - DNA, 25 bp, Mus musculus
tccaagtgcaggcggaacaagacaa

SEQ ID NO: 358817 - DNA, 25 bp, Mus musculus
tccaagtgccaggtacaaccagcat

SEQ ID NO: 358818 - DNA, 25 bp, Mus musculus
tccaagtgcgatatgatgaatggat

SEQ ID NO: 358819 - DNA, 25 bp, Mus musculus
tccaagtgggagaaggtgcagcagc

SEQ ID NO: 358820 - DNA, 25 bp, Mus musculus
tccaagttcatgaacacccagtatt

SEQ ID NO: 358821 - DNA, 25 bp, Mus musculus
tccaagttcatgatggattgggtcg

SEQ ID NO: 358822 - DNA, 25 bp, Mus musculus
tccaagttcggggaatgcagcaata

SEQ ID NO: 358823 - DNA, 25 bp, Mus musculus
tccaagttcggtcccctgtgtaggc

SEQ ID NO: 358824 - DNA, 25 bp, Mus musculus
tccaagttgaaactgttatctggga

SEQ ID NO: 358825 - DNA, 25 bp, Mus musculus
tccaagttggcaggaacatcattca

SEQ ID NO: 358826 - DNA, 25 bp, Mus musculus
tccaagtttggaagataccaacatt

SEQ ID NO: 358827 - DNA, 25 bp, Mus musculus
tccaataattctatactttctggca

SEQ ID NO: 358828 - DNA, 25 bp, Mus musculus
tccaataattcttatttgtagagta

SEQ ID NO: 358829 - DNA, 25 bp, Mus musculus
tccaatacaagcacaggggagtata

SEQ ID NO: 358830 - DNA, 25 bp, Mus musculus
tccaatagagaggttgatgttttgg

SEQ ID NO: 358831 - DNA, 25 bp, Mus musculus
tccaatataagtgaggtgttacatc

SEQ ID NO: 358832 - DNA, 25 bp, Mus musculus
tccaatatcatggggggatatccct

SEQ ID NO: 358833 - DNA, 25 bp, Mus musculus
tccaatattcacaggtattcctttt

SEQ ID NO: 358834 - DNA, 25 bp, Mus musculus
tccaatcaaaactagttggacaccc

SEQ ID NO: 358835 - DNA, 25 bp, Mus musculus
tccaatcagcaggcccgtcaagtcc

SEQ ID NO: 358836 - DNA, 25 bp, Mus musculus
tccaatcagcaggggctgctggggc

SEQ ID NO: 358837 - DNA, 25 bp, Mus musculus
tccaatcagcaggggtccttggact

SEQ ID NO: 358838 - DNA, 25 bp, Mus musculus
tccaatcattagcaatcgtggaaca

SEQ ID NO: 358839 - DNA, 25 bp, Mus musculus
tccaatcattagggagctgtccagg

SEQ ID NO: 358840 - DNA, 25 bp, Mus musculus
tccaatccagagacctcttttctgc

SEQ ID NO: 358841 - DNA, 25 bp, Mus musculus
tccaatccagcctgaggtctccaag

SEQ ID NO: 358842 - DNA, 25 bp, Mus musculus
tccaatcccttaccgcgtcgagcag

SEQ ID NO: 358843 - DNA, 25 bp, Mus musculus
tccaatcccttgctgatctgaataa

SEQ ID NO: 358844 - DNA, 25 bp, Mus musculus
tccaatcctgtcaggtgaaaatgct

SEQ ID NO: 358845 - DNA, 25 bp, Mus musculus
tccaatcggaagggtcctaaacaag

SEQ ID NO: 358846 - DNA, 25 bp, Mus musculus
tccaatctatcagggcgtctaagaa

SEQ ID NO: 358847 - DNA, 25 bp, Mus musculus
tccaatctatcagggtgaaggcggg

SEQ ID NO: 358848 - DNA, 25 bp, Mus musculus
tccaatgaaagtgctaatgctgact

SEQ ID NO: 358849 - DNA, 25 bp, Mus musculus
tccaatgaagccctcttattacagg

SEQ ID NO: 358850 - DNA, 25 bp, Mus musculus
tccaatgaaggaaaaggtgcggctt

SEQ ID NO: 358851 - DNA, 25 bp, Mus musculus
tccaatgaaggagatgacaaatcta

SEQ ID NO: 358852 - DNA, 25 bp, Mus musculus
tccaatgaaggagctgaaaggccta

SEQ ID NO: 358853 - DNA, 25 bp, Mus musculus
tccaatgaaggaggaatgtcaagtg

SEQ ID NO: 358854 - DNA, 25 bp, Mus musculus
tccaatgaaggaggtgactccaatg

SEQ ID NO: 358855 - DNA, 25 bp, Mus musculus
tccaatgcagcctgtggcatctcta

SEQ ID NO: 358856 - DNA, 25 bp, Mus musculus
tccaatgcaggaggcccacctgctc

SEQ ID NO: 358857 - DNA, 25 bp, Mus musculus
tccaatgccaatcgctgcctccagg

SEQ ID NO: 358858 - DNA, 25 bp, Mus musculus
tccaatgcgatgcaaatcctctggg

SEQ ID NO: 358859 - DNA, 25 bp, Mus musculus
tccaatgcgatgctttggctcagct

SEQ ID NO: 358860 - DNA, 25 bp, Mus musculus
tccaatgctaatgccagtgactcag

SEQ ID NO: 358861 - DNA, 25 bp, Mus musculus
tccaatggaggaggtgactccaatg

SEQ ID NO: 358862 - DNA, 25 bp, Mus musculus
tccaatgggacaaatgcctggaatg

SEQ ID NO: 358863 - DNA, 25 bp, Mus musculus
tccaatggttggctcaacttgattt

SEQ ID NO: 358864 - DNA, 25 bp, Mus musculus
tccaatgtcaaatgtgactatgaca

SEQ ID NO: 358865 - DNA, 25 bp, Mus musculus
tccaatgtcccatcaccatctcagt

SEQ ID NO: 358866 - DNA, 25 bp, Mus musculus
tccaatgtgaaggctccagcctggc

SEQ ID NO: 358867 - DNA, 25 bp, Mus musculus
tccaatgtggctagctataaaacca

SEQ ID NO: 358868 - DNA, 25 bp, Mus musculus
tccaattaatccccccttctagaag

SEQ ID NO: 358869 - DNA, 25 bp, Mus musculus
tccaattcagccaccagcacagctg

SEQ ID NO: 358870 - DNA, 25 bp, Mus musculus
tccaattcaggcatggtccaggtac

SEQ ID NO: 358871 - DNA, 25 bp, Mus musculus
tccaattcctccaggtcatcgtcac

SEQ ID NO: 358872 - DNA, 25 bp, Mus musculus
tccaattctaggatgtggttagaac

SEQ ID NO: 358873 - DNA, 25 bp, Mus musculus
tccaattctataggtcctgagggag

SEQ ID NO: 358874 - DNA, 25 bp, Mus musculus
tccacaaaaagaaagactgccctcc

SEQ ID NO: 358875 - DNA, 25 bp, Mus musculus
tccacaaacgtgcagttcagtccca

SEQ ID NO: 358876 - DNA, 25 bp, Mus musculus
tccacaaacgtggtgaatacatcaa

SEQ ID NO: 358877 - DNA, 25 bp, Mus musculus
tccacaaagagcgcctggccatcgc

SEQ ID NO: 358878 - DNA, 25 bp, Mus musculus
tccacaaagaggcggttacagggat

SEQ ID NO: 358879 - DNA, 25 bp, Mus musculus
tccacaaagccctcaagaaactccg

SEQ ID NO: 358880 - DNA, 25 bp, Mus musculus
tccacaaagtcaaggctctacccct

SEQ ID NO: 358881 - DNA, 25 bp, Mus musculus
tccacaacaggtgtgagcaggtggg

SEQ ID NO: 358882 - DNA, 25 bp, Mus musculus
tccacaacaggttccacccgactcc

SEQ ID NO: 358883 - DNA, 25 bp, Mus musculus
tccacaacatctgggacaagctgga

SEQ ID NO: 358884 - DNA, 25 bp, Mus musculus
tccacaaccagaaaagccagctcat

SEQ ID NO: 358885 - DNA, 25 bp, Mus musculus
tccacaaccagccctcagcggcatc

SEQ ID NO: 358886 - DNA, 25 bp, Mus musculus
tccacaaccaggctcccaccacctc

SEQ ID NO: 358887 - DNA, 25 bp, Mus musculus
tccacaacccagccaccaatgaagt

SEQ ID NO: 358888 - DNA, 25 bp, Mus musculus
tccacaacctcaacgtcatcctggc

SEQ ID NO: 358889 - DNA, 25 bp, Mus musculus
tccacaacctccgcaagaatggaat

SEQ ID NO: 358890 - DNA, 25 bp, Mus musculus
tccacaactgcaggctgtttggtct

SEQ ID NO: 358891 - DNA, 25 bp, Mus musculus
tccacaagatatgtgagatagatgg

SEQ ID NO: 358892 - DNA, 25 bp, Mus musculus
tccacaagatattggttctgaagac

SEQ ID NO: 358893 - DNA, 25 bp, Mus musculus
tccacaaggataggtcatgctgtga

SEQ ID NO: 358894 - DNA, 25 bp, Mus musculus
tccacaagggggggctgttcaagac

SEQ ID NO: 358895 - DNA, 25 bp, Mus musculus
tccacaagtacaacatcttgattgc

SEQ ID NO: 358896 - DNA, 25 bp, Mus musculus
tccacaagtgcgaggactgcgggaa

SEQ ID NO: 358897 - DNA, 25 bp, Mus musculus
tccacaatacgcgccccctgtaatg

SEQ ID NO: 358898 - DNA, 25 bp, Mus musculus
tccacaatcaataggtttccaggca

SEQ ID NO: 358899 - DNA, 25 bp, Mus musculus
tccacaatcggtattaccagagcat

SEQ ID NO: 358900 - DNA, 25 bp, Mus musculus
tccacaatggtatcgggctagccaa

SEQ ID NO: 358901 - DNA, 25 bp, Mus musculus
tccacacaagctttgaaccactggg

SEQ ID NO: 358902 - DNA, 25 bp, Mus musculus
tccacacaaggtttcacgacttcat

SEQ ID NO: 358903 - DNA, 25 bp, Mus musculus
tccacacacacactgcaagaacaga

SEQ ID NO: 358904 - DNA, 25 bp, Mus musculus
tccacacacgccaccccaccttcat

SEQ ID NO: 358905 - DNA, 25 bp, Mus musculus
tccacacacggaggaggttggcccg

SEQ ID NO: 358906 - DNA, 25 bp, Mus musculus
tccacacagtcaagggatgaactgt

SEQ ID NO: 358907 - DNA, 25 bp, Mus musculus
tccacacagtggaggattaccaggc

SEQ ID NO: 358908 - DNA, 25 bp, Mus musculus
tccacacatatgacgttcagaaact

SEQ ID NO: 358909 - DNA, 25 bp, Mus musculus
tccacacatgatcggaacaccatgg

SEQ ID NO: 358910 - DNA, 25 bp, Mus musculus
tccacacccaccaccccagtctacc

SEQ ID NO: 358911 - DNA, 25 bp, Mus musculus
tccacacccagatgaagttgctgcc

SEQ ID NO: 358912 - DNA, 25 bp, Mus musculus
tccacacccagcacaggtccctgtg

SEQ ID NO: 358913 - DNA, 25 bp, Mus musculus
tccacacccaggttctgattggaac

SEQ ID NO: 358914 - DNA, 25 bp, Mus musculus
tccacaccgggacaaccatcatggc

SEQ ID NO: 358915 - DNA, 25 bp, Mus musculus
tccacacctctctctcaggagtgaa

SEQ ID NO: 358916 - DNA, 25 bp, Mus musculus
tccacacctggatggatgctgcaag

SEQ ID NO: 358917 - DNA, 25 bp, Mus musculus
tccacacctggatggggttcatgtt

SEQ ID NO: 358918 - DNA, 25 bp, Mus musculus
tccacacgagaggctcacaatattg

SEQ ID NO: 358919 - DNA, 25 bp, Mus musculus
tccacacgaggagccagatgttaaa

SEQ ID NO: 358920 - DNA, 25 bp, Mus musculus
tccacacgtttgccgctcctgagaa

SEQ ID NO: 358921 - DNA, 25 bp, Mus musculus
tccacactacaggctccttcctgac

SEQ ID NO: 358922 - DNA, 25 bp, Mus musculus
tccacactacaggtctgtaactggt

SEQ ID NO: 358923 - DNA, 25 bp, Mus musculus
tccacactctggtacatccaaacga

SEQ ID NO: 358924 - DNA, 25 bp, Mus musculus
tccacactgaggtgcactggcacga

SEQ ID NO: 358925 - DNA, 25 bp, Mus musculus
tccacactgcccaagtgggctcacc

SEQ ID NO: 358926 - DNA, 25 bp, Mus musculus
tccacactggaaagggcagcctctt

SEQ ID NO: 358927 - DNA, 25 bp, Mus musculus
tccacacttgtttgatttatgagga

SEQ ID NO: 358928 - DNA, 25 bp, Mus musculus
tccacacttgtttgcgtttcccaac

SEQ ID NO: 358929 - DNA, 25 bp, Mus musculus
tccacagagatccactgaggctttt

SEQ ID NO: 358930 - DNA, 25 bp, Mus musculus
tccacagataacccaaggtggctgg

SEQ ID NO: 358931 - DNA, 25 bp, Mus musculus
tccacagataacccagaggatcacc

SEQ ID NO: 358932 - DNA, 25 bp, Mus musculus
tccacagataacccagtatcagtac

SEQ ID NO: 358933 - DNA, 25 bp, Mus musculus
tccacagcaacagccttctacttct

SEQ ID NO: 358934 - DNA, 25 bp, Mus musculus
tccacagcacatttggtcagaaaac

SEQ ID NO: 358935 - DNA, 25 bp, Mus musculus
tccacagcacggagctcgaagacga

SEQ ID NO: 358936 - DNA, 25 bp, Mus musculus
tccacagcaggattccccctctgtg

SEQ ID NO: 358937 - DNA, 25 bp, Mus musculus
tccacagcaggtggctggattcatc

SEQ ID NO: 358938 - DNA, 25 bp, Mus musculus
tccacagcagttgagtggtgatttt

SEQ ID NO: 358939 - DNA, 25 bp, Mus musculus
tccacagcatcaaagcctgctccca

SEQ ID NO: 358940 - DNA, 25 bp, Mus musculus
tccacagccagatttgaccaagctg

SEQ ID NO: 358941 - DNA, 25 bp, Mus musculus
tccacagcccagaaaagaaaaagta

SEQ ID NO: 358942 - DNA, 25 bp, Mus musculus
tccacagcccctttgacactcctca

SEQ ID NO: 358943 - DNA, 25 bp, Mus musculus
tccacagccggagagtcaaacacaa

SEQ ID NO: 358944 - DNA, 25 bp, Mus musculus
tccacagcctgtgctcattgcccac

SEQ ID NO: 358945 - DNA, 25 bp, Mus musculus
tccacaggaacaagatcctgcacag

SEQ ID NO: 358946 - DNA, 25 bp, Mus musculus
tccacaggaacaaggtgtggccaaa

SEQ ID NO: 358947 - DNA, 25 bp, Mus musculus
tccacaggagatggctttcacggtg

SEQ ID NO: 358948 - DNA, 25 bp, Mus musculus
tccacaggagtggtcccgtaggcct

SEQ ID NO: 358949 - DNA, 25 bp, Mus musculus
tccacaggatgaaggttaggcacgg

SEQ ID NO: 358950 - DNA, 25 bp, Mus musculus
tccacaggatgggtcccagcctgca

SEQ ID NO: 358951 - DNA, 25 bp, Mus musculus
tccacaggcagatgaacacaatgat

SEQ ID NO: 358952 - DNA, 25 bp, Mus musculus
tccacaggcagtgaggaatggtgag

SEQ ID NO: 358953 - DNA, 25 bp, Mus musculus
tccacaggcctgagtttcctgagct

SEQ ID NO: 358954 - DNA, 25 bp, Mus musculus
tccacagtaaaagctgaaaataatg

SEQ ID NO: 358955 - DNA, 25 bp, Mus musculus
tccacagtaaaggacagtctcatcg

SEQ ID NO: 358956 - DNA, 25 bp, Mus musculus
tccacagtaaaggttacagatatac

SEQ ID NO: 358957 - DNA, 25 bp, Mus musculus
tccacagtcaccgagagtggggagt

SEQ ID NO: 358958 - DNA, 25 bp, Mus musculus
tccacagtcactggagagtcaggct

SEQ ID NO: 358959 - DNA, 25 bp, Mus musculus
tccacagtcaggtgacactgctgag

SEQ ID NO: 358960 - DNA, 25 bp, Mus musculus
tccacagtcgagagctaagatgcga
